United States Patent 10,706,955 (BIOINFORMATIC PROCESSES FOR DETERMINATION OF PEPTIDE BINDING) - sequence listing, part 59

SEQ ID NO: 2248609 - protein, 24 aa, Cryptosporidium parvum
VLYNFINYFNQWSSFLKASQYIYN

SEQ ID NO: 2248610 - protein, 24 aa, Cryptosporidium parvum
VMALKLFYIIIVICITSIIYFILP

SEQ ID NO: 2248611 - protein, 23 aa, Cryptosporidium parvum
VMIGNSLFLENAFGIFTCPRIFS

SEQ ID NO: 2248612 - protein, 17 aa, Cryptosporidium parvum
VMIGYILNILLNLVIPY

SEQ ID NO: 2248613 - protein, 43 aa, Cryptosporidium parvum
VMNICLLIALAPWTLPIFLIMMGLILFKIFLPMISASRNLQRI

SEQ ID NO: 2248614 - protein, 18 aa, Cryptosporidium parvum
VMRLGVLEMILYGSIFFN

SEQ ID NO: 2248615 - protein, 25 aa, Cryptosporidium parvum
VMSILQVMISLFGMGFNLYTHIRSL

SEQ ID NO: 2248616 - protein, 26 aa, Cryptosporidium parvum
VMSTKTFFCWVWKSLYQGTVIMLGAF

SEQ ID NO: 2248617 - protein, 24 aa, Cryptosporidium parvum
VMYAIPVAFFFSFNISFNNICLTH

SEQ ID NO: 2248618 - protein, 27 aa, Cryptosporidium parvum
VNFNKYFLLVVTIIVYFNNLMFNNEEK

SEQ ID NO: 2248619 - protein, 25 aa, Cryptosporidium parvum
VNFNSHLLWIIADSSQYWLAKISRY

SEQ ID NO: 2248620 - protein, 27 aa, Cryptosporidium parvum
VNGGIGCTLGFLWKLIEHAFPQQISPD

SEQ ID NO: 2248621 - protein, 24 aa, Cryptosporidium parvum
VNGLEFLFTLLFNIYDSKIDDESI

SEQ ID NO: 2248622 - protein, 20 aa, Cryptosporidium parvum
VNHVFILVSGTNKYFPGTNY

SEQ ID NO: 2248623 - protein, 23 aa, Cryptosporidium parvum
VNIQTPIPKLLPLSSRELKEYNE

SEQ ID NO: 2248624 - protein, 25 aa, Cryptosporidium parvum
VNIWITWKLLSKQVGLIAALPGIIT

SEQ ID NO: 2248625 - protein, 21 aa, Cryptosporidium parvum
VNKFIFKILSLILGCFETYIA

SEQ ID NO: 2248626 - protein, 25 aa, Cryptosporidium parvum
VNKGWFRYFYLVGVFTTLICVYLGY

SEQ ID NO: 2248627 - protein, 18 aa, Cryptosporidium parvum
VNKKKLPKYFYSSALYIS

SEQ ID NO: 2248628 - protein, 18 aa, Cryptosporidium parvum
VNKRIVIYSIIQLTLVSV

SEQ ID NO: 2248629 - protein, 25 aa, Cryptosporidium parvum
VNLLVIFGFLWLVSPILITLTASFS

SEQ ID NO: 2248630 - protein, 27 aa, Cryptosporidium parvum
VNNDAKFFIRFYSFQKNTFSLSFKRED

SEQ ID NO: 2248631 - protein, 42 aa, Cryptosporidium parvum
VNNLLIQINIKTWFFWIVYSFLVFIIYFSADYLYIFKNSILG

SEQ ID NO: 2248632 - protein, 27 aa, Cryptosporidium parvum
VNQYLLIPNIFLLSVPFILNLLKAKRN

SEQ ID NO: 2248633 - protein, 23 aa, Cryptosporidium parvum
VNRITLFIDFDSDKYQFMFADLE

SEQ ID NO: 2248634 - protein, 27 aa, Cryptosporidium parvum
VNSIYSMSALILLAPTPLGIYYKDFMK

SEQ ID NO: 2248635 - protein, 21 aa, Cryptosporidium parvum
VNSLICWNKLIPNFLLCYSEV

SEQ ID NO: 2248636 - protein, 28 aa, Cryptosporidium parvum
VNTLSKILFLLLIITSFVLVFCKGFDTL

SEQ ID NO: 2248637 - protein, 25 aa, Cryptosporidium parvum
VNVINIVGIFLYFELVIFNEMTFSK

SEQ ID NO: 2248638 - protein, 30 aa, Cryptosporidium parvum; identical to SEQ ID NO: 2134105

SEQ ID NO: 2248639 - protein, 30 aa, Cryptosporidium parvum
VNYYDYNLCFIIKILIYLISNVKDGLDLSL

SEQ ID NO: 2248640 - protein, 25 aa, Cryptosporidium parvum
VPARLKSLLPYMGQLISPMLNALES

SEQ ID NO: 2248641 - protein, 29 aa, Cryptosporidium parvum
VPDYIKRDFLLFINHLKIFSTPSGIRKSN

SEQ ID NO: 2248642 - protein, 19 aa, Cryptosporidium parvum
VPEIPFSSYISPLTKTHIS

SEQ ID NO: 2248643 - protein, 26 aa, Cryptosporidium parvum
VPFNHPDLLLNSKPKIFPVFGKRPIE

SEQ ID NO: 2248644 - protein, 19 aa, Cryptosporidium parvum
VPIFSKKFNRKLLKEQLNI

SEQ ID NO: 2248645 - protein, 25 aa, Cryptosporidium parvum
VPILEKLRFIKWFVKVILENMDDYM

SEQ ID NO: 2248646 - protein, 20 aa, Cryptosporidium parvum
VPILYFSIIGLEKKTYEWIV

SEQ ID NO: 2248647 - protein, 18 aa, Cryptosporidium parvum
VPIMPSMKTLPSFATYDL

SEQ ID NO: 2248648 - protein, 25 aa, Cryptosporidium parvum
VPIVEDIIILKLWDNSTKPPAIITQ

SEQ ID NO: 2248649 - protein, 20 aa, Cryptosporidium parvum
VPKELLIYDISAYPSKWVEK

SEQ ID NO: 2248650 - protein, 29 aa, Cryptosporidium parvum
VPKMAYNGMPFQPGFPPAIPGPFNGQFQY

SEQ ID NO: 2248651 - protein, 25 aa, Cryptosporidium parvum
VPLAFVYPPLFYFSLNRERISKAGQ

SEQ ID NO: 2248652 - protein, 24 aa, Cryptosporidium parvum
VPQLIQHRFIGRRAALRFQDSIQE

SEQ ID NO: 2248653 - protein, 18 aa, Cryptosporidium parvum
VPQPLILSIKRFMNKNIR

SEQ ID NO: 2248654 - protein, 32 aa, Cryptosporidium parvum
VPSMVLQNLLLLFSLYQFIGISAFIGYIIIVL

SEQ ID NO: 2248655 - protein, 21 aa, Cryptosporidium parvum
VPVHELLRTYFPHCTVFVVAH

SEQ ID NO: 2248656 - protein, 24 aa, Cryptosporidium parvum
VPYNKVKMILYPSIPSHPPSFQLN

SEQ ID NO: 2248657 - protein, 43 aa, Cryptosporidium parvum
VQCIFGKIILLIVSIILLLGLLVWIFQEKLLFFPNINGKRDLA

SEQ ID NO: 2248658 - protein, 25 aa, Cryptosporidium parvum
VQDNSLILLSIHKLALHYLSIHGQR

SEQ ID NO: 2248659 - protein, 29 aa, Cryptosporidium parvum
VQDYMIACSKIILWFVHFFRGFNGDEHIS

SEQ ID NO: 2248660 - protein, 22 aa, Cryptosporidium parvum
VQELSCIILLVLSVAWGETSKV

SEQ ID NO: 2248661 - protein, 17 aa, Cryptosporidium parvum
VQFSFFYILCQLGEMAK

SEQ ID NO: 2248662 - protein, 19 aa, Cryptosporidium parvum
VQIKLIKLLSIIVLKNSEV

SEQ ID NO: 2248663 - protein, 25 aa, Cryptosporidium parvum
VQISWRLVFFIEYLGPIIIFPIFYF

SEQ ID NO: 2248664 - protein, 26 aa, Cryptosporidium parvum
VQLGIQHTDYWVLKLINRGCYMRQIV

SEQ ID NO: 2248665 - protein, 22 aa, Cryptosporidium parvum
VQNLECYLWLIDELQTICIHPR

SEQ ID NO: 2248666 - protein, 21 aa, Cryptosporidium parvum
VQSLIPCSILFLKALESCIDD

SEQ ID NO: 2248667 - protein, 19 aa, Cryptosporidium parvum
VQVLPAYRLSRAIDTLFPK

SEQ ID NO: 2248668 - protein, 21 aa, Cryptosporidium parvum
VQYSYFIWKFAVKNRINFSLE

SEQ ID NO: 2248669 - protein, 24 aa, Cryptosporidium parvum
VRDLVTLNLLWERVIPIRDYLKSN

SEQ ID NO: 2248670 - protein, 20 aa, Cryptosporidium parvum
VRENSIAFALLYPLMKLFSK

SEQ ID NO: 2248671 - protein, 24 aa, Cryptosporidium parvum
VRHQSLCRYINYSNPTLECPPGSF

SEQ ID NO: 2248672 - protein, 26 aa, Cryptosporidium parvum
VRKIALKYIYLITKFQIQGIGVGIID

SEQ ID NO: 2248673 - protein, 27 aa, Cryptosporidium parvum
VRLISIMSICIWLSLLVFEGSYLFTEV

SEQ ID NO: 2248674 - protein, 28 aa, Cryptosporidium parvum
VRLNTTALLAILFPLIDPSLSAGNYNSE

SEQ ID NO: 2248675 - protein, 19 aa, Cryptosporidium parvum
VRPFPYTLEMSLLKRKENY

SEQ ID NO: 2248676 - protein, 31 aa, Cryptosporidium parvum
VRSRQPLFISFWFIMAKYFSSILIFSTIPLS

SEQ ID NO: 2248677 - protein, 21 aa, Cryptosporidium parvum
VRSVYWRIYNNLYIGSQDSLV

SEQ ID NO: 2248678 - protein, 26 aa, Cryptosporidium parvum
VRVYERLFRQLLCTLITLLGVSSVWF

SEQ ID NO: 2248679 - protein, 27 aa, Cryptosporidium parvum
VSADSCDMFWYPGIIRQVSSESLPDKC

SEQ ID NO: 2248680 - protein, 24 aa, Cryptosporidium parvum
VSAIIAAFFKRFNKPRNQITIAID

SEQ ID NO: 2248681 - protein, 25 aa, Cryptosporidium parvum
VSAILQIRFIQKCLPKWEPISEISK

SEQ ID NO: 2248682 - protein, 28 aa, Cryptosporidium parvum
VSAPLSALWLWVLMAGSAILAICLNQCT

SEQ ID NO: 2248683 - protein, 26 aa, Cryptosporidium parvum
VSCIHFFGLLLFFTLYFINFPNEAGL

SEQ ID NO: 2248684 - protein, 30 aa, Cryptosporidium parvum
VSEVKRNYFLKLFWKITRKITIALRNEISN

SEQ ID NO: 2248685 - protein, 25 aa, Cryptosporidium parvum
VSFYNKYEFVSQLPFPIVIHRFTNS

SEQ ID NO: 2248686 - protein, 17 aa, Cryptosporidium parvum
VSFYSQYNFINYSQVLI

SEQ ID NO: 2248687 - protein, 18 aa, Cryptosporidium parvum
VSFYWYCIELQSTNIRNL

SEQ ID NO: 2248688 - protein, 28 aa, Cryptosporidium parvum
VSGLSILKQIFFQLAKFSSNIDLEELKA

SEQ ID NO: 2248689 - protein, 26 aa, Cryptosporidium parvum
VSGQFFRGFPLCHIYPAPSIGMNRSG

SEQ ID NO: 2248690 - protein, 18 aa, Cryptosporidium parvum
VSIFGVAFLMLYSRSFKV

SEQ ID NO: 2248691 - protein, 21 aa, Cryptosporidium parvum
VSILLIIREKLLPDSITNISK

SEQ ID NO: 2248692 - protein, 28 aa, Cryptosporidium parvum
VSILPQTLYNMGCALIAVLLASLILMPS

SEQ ID NO: 2248693 - protein, 30 aa, Cryptosporidium parvum
VSIMKNHDAWIPLLRSMTYQDPEFRPSAEN

SEQ ID NO: 2248694 - protein, 18 aa, Cryptosporidium parvum
VSISRYFSRKRSTITIQN

SEQ ID NO: 2248695 - protein, 17 aa, Cryptosporidium parvum
VSKDFWPFEALLAGNAM

SEQ ID NO: 2248696 - protein, 23 aa, Cryptosporidium parvum
VSLAISLLLIYWGNTKLKYQYKF

SEQ ID NO: 2248697 - protein, 18 aa, Cryptosporidium parvum
VSLISAPIQPSELFNEVY

SEQ ID NO: 2248698 - protein, 26 aa, Cryptosporidium parvum
VSLKHQRYLIAYPIALLYASFTIVTI

SEQ ID NO: 2248699 - protein, 22 aa, Cryptosporidium parvum
VSLLNLSLIWRNPSLLEVIPSI

SEQ ID NO: 2248700 - protein, 18 aa, Cryptosporidium parvum
VSMINLLLSMGFAVDYST

SEQ ID NO: 2248701 - protein, 39 aa, Cryptosporidium parvum
VSNEKFVIPSLPSDLDPTTFLLIDSTGKKFSPYTGKHAD

SEQ ID NO: 2248702 - protein, 20 aa, Cryptosporidium parvum
VSNIMIFWKNDKLSNHSNGN

SEQ ID NO: 2248703 - protein, 31 aa, Cryptosporidium parvum
VSNKNIFNNLRRFPWININSHPLVKLETDRK

SEQ ID NO: 2248704 - protein, 24 aa, Cryptosporidium parvum
VSNLYFFSQLLYRRFKSNMLVNIL

SEQ ID NO: 2248705 - protein, 24 aa, Cryptosporidium parvum
VSNWINFLQYKLHSSYPLYTFPII

SEQ ID NO: 2248706 - protein, 23 aa, Cryptosporidium parvum
VSQLLIIDIIFIISNIYINRYML

SEQ ID NO: 2248707 - protein, 23 aa, Cryptosporidium parvum
VSQVYLYSYFSIFLNYSGSNDNE

SEQ ID NO: 2248708 - protein, 34 aa, Cryptosporidium parvum
VSSAILLTSIIYILLWAIISYLKVFYIKNMINDW

SEQ ID NO: 2248709 - protein, 20 aa, Cryptosporidium parvum
VSSFLAVLKPKRTWTQGQNQ

SEQ ID NO: 2248710 - protein, 32 aa, Cryptosporidium parvum
VSSIFSLIRISFWYEWIMIKIHLQLGIDHQDE

SEQ ID NO: 2248711 - protein, 28 aa, Cryptosporidium parvum
VSSRRDHFILYYKLLNISLVDTLDIGIL

SEQ ID NO: 2248712 - protein, 28 aa, Cryptosporidium parvum
VSSTIIVYLIWGLFSFIFTVVISGSIEK

SEQ ID NO: 2248713 - protein, 23 aa, Cryptosporidium parvum
VSTLEYLHPFTLKFRSEILEKKF

SEQ ID NO: 2248714 - protein, 24 aa, Cryptosporidium parvum
VSTTILFFFVKYFSPQDSCFSFVR

SEQ ID NO: 2248715 - protein, 36 aa, Cryptosporidium parvum; identical to SEQ ID NO: 2134152

SEQ ID NO: 2248716 - protein, 28 aa, Cryptosporidium parvum
VSVIPLFFEWCYILYRQKLNFSKNQIRE

SEQ ID NO: 2248717 - protein, 25 aa, Cryptosporidium parvum
VSWQLLFRYMEYIDRILDIGLGPMV

SEQ ID NO: 2248718 - protein, 23 aa, Cryptosporidium parvum
VSYFFFLFVKMLIDCIKYIKNKD

SEQ ID NO: 2248719 - protein, 37 aa, Cryptosporidium parvum; identical to SEQ ID NO: 2134154

SEQ ID NO: 2248720 - protein, 27 aa, Cryptosporidium parvum
VTAIVVCHYSFLRIPLSNRILSTIPNA

SEQ ID NO: 2248721 - protein, 33 aa, Cryptosporidium parvum
VTCQQLIDWSELLSLLLDMFVIKASDLDSSTAL

SEQ ID NO: 2248722 - protein, 24 aa, Cryptosporidium parvum
VTDKLLLGILLTSLGALWYSLDKQ

SEQ ID NO: 2248723 - protein, 29 aa, Cryptosporidium parvum
VTFDQIPVWIRWLGWISTVRYTYTGMILS

SEQ ID NO: 2248724 - protein, 18 aa, Cryptosporidium parvum
VTFIVNVEWFATIPKIIK

SEQ ID NO: 2248725 - protein, 28 aa, Cryptosporidium parvum
VTIHYLTLIHFLNLLLFFGISNNLHYTV

SEQ ID NO: 2248726 - protein, 27 aa, Cryptosporidium parvum
VTIVGVWGLLFFGSFLVPPITGISVGV

SEQ ID NO: 2248727 - protein, 26 aa, Cryptosporidium parvum
VTKKGYNLTFFVIISGIFGQLDQLKF

SEQ ID NO: 2248728 - protein, 24 aa, Cryptosporidium parvum
VTKVIFRIFKYQLYSQIYSHPSYF

SEQ ID NO: 2248729 - protein, 25 aa, Cryptosporidium parvum
VTSVLNLLVYYLMNIFVEIGDPVLE

SEQ ID NO: 2248730 - protein, 18 aa, Cryptosporidium parvum
VTVIAFLIVAGLTVFCCL

SEQ ID NO: 2248731 - protein, 26 aa, Cryptosporidium parvum
VTVNKLPLWVSWIKYISFQRYSYSAL

SEQ ID NO: 2248732 - protein, 18 aa, Cryptosporidium parvum
VVAIIIIAGIIHCLCICK

SEQ ID NO: 2248733 - protein, 25 aa, Cryptosporidium parvum
VVCLRWLQNRICYVFKFGCVVGWDL

SEQ ID NO: 2248734 - protein, 21 aa, Cryptosporidium parvum
VVGMLPLLRRGIGIHHGGLLP

SEQ ID NO: 2248735 - protein, 26 aa, Cryptosporidium parvum
VVGSVLYIPISLMRAIEYYHLDGDRR

SEQ ID NO: 2248736 - protein, 25 aa, Cryptosporidium parvum
VVHELWLFIIVSQHNNLKVGDQSTE

SEQ ID NO: 2248737 - protein, 18 aa, Cryptosporidium parvum
VVIFFMLNLILIHFIFEI

SEQ ID NO: 2248738 - protein, 18 aa, Cryptosporidium parvum
VVIIKHITQWHPKKRICV

SEQ ID NO: 2248739 - protein, 24 aa, Cryptosporidium parvum
VVISGRKYILKSILERLGGSGKFL

SEQ ID NO: 2248740 - protein, 24 aa, Cryptosporidium parvum
VVIVFIALFPFNTDALYFILNPGY

SEQ ID NO: 2248741 - protein, 17 aa, Cryptosporidium parvum
VVKLDPFLICHCPNKSN

SEQ ID NO: 2248742 - protein, 19 aa, Cryptosporidium parvum
VVPGHYLILILNGTKNFVN

SEQ ID NO: 2248743 - protein, 26 aa, Cryptosporidium parvum
VVQDLFKLFIYLPLLLDLSKHITRTW

SEQ ID NO: 2248744 - protein, 18 aa, Cryptosporidium parvum
VVRFEYFPNLTVAISYLG

SEQ ID NO: 2248745 - protein, 23 aa, Cryptosporidium parvum
VVSMLDMLLELFTVVFGNSPQAE

SEQ ID NO: 2248746 - protein, 23 aa, Cryptosporidium parvum
VVTPWFRHIFMDTLSLPVVLIIW

SEQ ID NO: 2248747 - protein, 17 aa, Cryptosporidium parvum
VVVSLFFIIPLHIYPML

SEQ ID NO: 2248748 - protein, 23 aa, Cryptosporidium parvum
VVWEESIILLPDTVRLVFLSATI

SEQ ID NO: 2248749 - protein, 29 aa, Cryptosporidium parvum
VVYCLYSLLGIAFILFKLGTMGLIPVNRG

SEQ ID NO: 2248750 - protein, 18 aa, Cryptosporidium parvum
VVYIPFPLSYSFKGMLQR

SEQ ID NO: 2248751 - protein, 17 aa, Cryptosporidium parvum
VWDILFVFLFSVARLSI

SEQ ID NO: 2248752 - protein, 29 aa, Cryptosporidium parvum
VWDLSNLIRIWWHFIPIPHCEIPCPVPKP

SEQ ID NO: 2248753 - protein, 42 aa, Cryptosporidium parvum
VWDSSNLYFTWLLATRIILSLTTYFPRILREIWLRNSNNKTQ

SEQ ID NO: 2248754 - protein, 17 aa, Cryptosporidium parvum
VWGFVTILLAFSSSYWE

SEQ ID NO: 2248755 - protein, 18 aa, Cryptosporidium parvum
VWIGIGVGAIVLIGLIIF

SEQ ID NO: 2248756 - protein, 21 aa, Cryptosporidium parvum
VWKSSPIWLHLKPSDTKNPKE

SEQ ID NO: 2248757 - protein, 27 aa, Cryptosporidium parvum
VWSAGVVMYFLLAGTLPFTGRSIKEVR

SEQ ID NO: 2248758 - protein, 54 aa, Cryptosporidium parvum; identical to SEQ ID NO: 2134187

SEQ ID NO: 2248759 - protein, 25 aa, Cryptosporidium parvum
VWVLIYFYIHYLLLNTIDCTFNFKD

SEQ ID NO: 2248760 - protein, 17 aa, Cryptosporidium parvum
VYAPIKDQTDPAPRYIS

SEQ ID NO: 2248761 - protein, 18 aa, Cryptosporidium parvum
VYLEILLPSLLIEDQMFN

SEQ ID NO: 2248762 - protein, 17 aa, Cryptosporidium parvum
VYMKLLKVALKPSIFML

SEQ ID NO: 2248763 - protein, 26 aa, Cryptosporidium parvum
VYPNPVRVRLYILSALALVVPIDYSE

SEQ ID NO: 2248764 - protein, 20 aa, Cryptosporidium parvum
VYSHMRLLFSYFSNYSKDGV

SEQ ID NO: 2248765 - protein, 18 aa, Cryptosporidium parvum
VYSISWIMVLIWDAYEYG

SEQ ID NO: 2248766 - protein, 27 aa, Cryptosporidium parvum
VYTDYRPVPLQHFIFPAGGNGVYLVMD

SEQ ID NO: 2248767 - protein, 17 aa, Cryptosporidium parvum
VYTLFPFLDSLECITNS

SEQ ID NO: 2248768 - protein, 34 aa, Cryptosporidium parvum
VYVDTIHVYLSVLKNLWVCLVSGIFKILKHKQRI

SEQ ID NO: 2248769 - protein, 18 aa, Cryptosporidium parvum
VYYDNFGNFPLLFKNNEY

SEQ ID NO: 2248770 - protein, 19 aa, Cryptosporidium parvum
WAHIGGFVAGLLWSFASME

SEQ ID NO: 2248771 - protein, 18 aa, Cryptosporidium parvum
WCIVWLSRFLLTSVIRSM

SEQ ID NO: 2248772 - protein, 19 aa, Cryptosporidium parvum
WCLFHSFFQVVSKDWLLGW

SEQ ID NO: 2248773 - protein, 26 aa, Cryptosporidium parvum
WCNTRIQFFILPISIINSIFPYITPF

SEQ ID NO: 2248774 - protein, 17 aa, Cryptosporidium parvum
WCTSRTYPIRIFTGHFG

SEQ ID NO: 2248775 - protein, 23 aa, Cryptosporidium parvum
WDHKKYFSLNLENFGPYYYANYG

SEQ ID NO: 2248776 - protein, 24 aa, Cryptosporidium parvum
WDSKKWCKRLLKSKRKKILRWYKY

SEQ ID NO: 2248777 - protein, 28 aa, Cryptosporidium parvum
WDSMILWNDLFVWRNFVFSIIMNLISRS

SEQ ID NO: 2248778 - protein, 18 aa, Cryptosporidium parvum
WELLIDPTIYLRNLANGE

SEQ ID NO: 2248779 - protein, 19 aa, Cryptosporidium parvum
WEPAQYLYKKYRNTYCLGF

SEQ ID NO: 2248780 - protein, 25 aa, Cryptosporidium parvum
WEVAKVNQFVFMELLFSKNSARGLG

SEQ ID NO: 2248781 - protein, 29 aa, Cryptosporidium parvum
WFLETVDTYWFFHSIWHIMAFLASTFIIH

SEQ ID NO: 2248782 - protein, 17 aa, Cryptosporidium parvum
WFLMAPTMCFQFWYPRT

SEQ ID NO: 2248783 - protein, 19 aa, Cryptosporidium parvum
WFNGLFFDHSMKKTTLFYT

SEQ ID NO: 2248784 - protein, 37 aa, Cryptosporidium parvum
WFSVYLVILKTFRRFYGIYFLLFSINLAISYFVKFQA

SEQ ID NO: 2248785 - protein, 20 aa, Cryptosporidium parvum
WFTHCLQKYFPLWFSDEDLD

SEQ ID NO: 2248786 - protein, 20 aa, Cryptosporidium parvum
WFYFPYIGICLWGISTQLLT

SEQ ID NO: 2248787 - protein, 26 aa, Cryptosporidium parvum
WGIQEKVYPYLACKVLGLLNQEKKED

SEQ ID NO: 2248788 - protein, 28 aa, Cryptosporidium parvum
WGVSTYFSFLLPLFHHYFKNEKNKEIPL

SEQ ID NO: 2248789 - protein, 25 aa, Cryptosporidium parvum
WHHLQSILYLIYGAGALVFVRLIAN

SEQ ID NO: 2248790 - protein, 17 aa, Cryptosporidium parvum
WHIFKETFAKDIGLIIF

SEQ ID NO: 2248791 - protein, 20 aa, Cryptosporidium parvum
WIAKYLLSLSWLFLGIGRVC

SEQ ID NO: 2248792 - protein, 23 aa, Cryptosporidium parvum
WICTKYEMLVLKLLQEYYKGNGE

SEQ ID NO: 2248793 - protein, 20 aa, Cryptosporidium parvum
WIILVTHYSIYSSGLHGPHT

SEQ ID NO: 2248794 - protein, 19 aa, Cryptosporidium parvum
WIPTYQIPYNFANLEIFKM

SEQ ID NO: 2248795 - protein, 30 aa, Cryptosporidium parvum; identical to SEQ ID NO: 2134218

SEQ ID NO: 2248796 - protein, 18 aa, Cryptosporidium parvum
WIQSFYKNYTNMANIKYE

SEQ ID NO: 2248797 - protein, 26 aa, Cryptosporidium parvum
WISSSQFKFVDLWKRIFISERCIIVK

SEQ ID NO: 2248798 - protein, 17 aa, Cryptosporidium parvum
WITGPCCWLDDKFKHLP

SEQ ID NO: 2248799 - protein, 18 aa, Cryptosporidium parvum
WIVPFLMDHLIHYSILVK

SEQ ID NO: 2248800 - protein, 17 aa, Cryptosporidium parvum
WIVVCYLFSKYKKKDNC

SEQ ID NO: 2248801 - protein, 31 aa, Cryptosporidium parvum
WKASISIRLYYFILRIVIIIGTISVLIPLNI

SEQ ID NO: 2248802 - protein, 17 aa, Cryptosporidium parvum
WKIIMGMNILYFMLLTF

SEQ ID NO: 2248803 - protein, 36 aa, Cryptosporidium parvum
WKIPHGYSLLSYIYTYLWQFQINPYYIISNNYFINI

SEQ ID NO: 2248804 - protein, 28 aa, Cryptosporidium parvum
WKLNKEFFELFLRWIFQISLTENFEIPL

SEQ ID NO: 2248805 - protein, 19 aa, Cryptosporidium parvum
WKRLENPIFIFKNGVIVAW

SEQ ID NO: 2248806 - protein, 21 aa, Cryptosporidium parvum
WKSFLWEFQFSRLYFKLARGD

SEQ ID NO: 2248807 - protein, 21 aa, Cryptosporidium parvum
WKVAWMIFSAFKSSYTILFIL

SEQ ID NO: 2248808 - protein, 18 aa, Cryptosporidium parvum
WKVKLSIYILSTLLCGLC

SEQ ID NO: 2248809 - protein, 19 aa, Cryptosporidium parvum
WKVLIYDKMGQTILSPLMK

SEQ ID NO: 2248810 - protein, 20 aa, Cryptosporidium parvum
WLFSQFYLTFASNAKTTRLF

SEQ ID NO: 2248811 - protein, 26 aa, Cryptosporidium parvum
WLLNSHKMILPIIFPENILMNNSQES

SEQ ID NO: 2248812 - protein, 17 aa, Cryptosporidium parvum
WLLPLLRVHINRTELSF

SEQ ID NO: 2248813 - protein, 17 aa, Cryptosporidium parvum
WLNLDWIHPMEPSCSNT

SEQ ID NO: 2248814 - protein, 26 aa, Cryptosporidium parvum
WLTLDIKYRYTKLAKLKLIPKLFGKD

SEQ ID NO: 2248815 - protein, 18 aa, Cryptosporidium parvum
WMLLLLYCGVLIDIESSR

SEQ ID NO: 2248816 - protein, 35 aa, Cryptosporidium parvum
WNGYYCNAYNTCKIRLNVYAPFWINNRQHIPIYVL

SEQ ID NO: 2248817 - protein, 30 aa, Cryptosporidium parvum
WNMPSSYWIRYLPILLGINTFCGFLGYRSE

SEQ ID NO: 2248818 - protein, 17 aa, Cryptosporidium parvum
WNRIFNKNFYLNGLLDN

SEQ ID NO: 2248819 - protein, 17 aa, Cryptosporidium parvum
WNTIWKEIKYNLISEQK

SEQ ID NO: 2248820 - protein, 25 aa, Cryptosporidium parvum
WNVVNTKLIPLWNISIDNIEIQSLI

SEQ ID NO: 2248821 - protein, 20 aa, Cryptosporidium parvum
WPILLIYFIFLFILTMRQQI

SEQ ID NO: 2248822 - protein, 21 aa, Cryptosporidium parvum
WPLLVVGDYLRLPFQAIMFLI

SEQ ID NO: 2248823 - protein, 19 aa, Cryptosporidium parvum
WQHPWSFFHSNECFMLYKM

SEQ ID NO: 2248824 - protein, 28 aa, Cryptosporidium parvum
WRIVVSKTIFHIYFKFPCIINSKLIVQS

SEQ ID NO: 2248825 - protein, 21 aa, Cryptosporidium parvum
WSIICIIFNILIYQITFKNPN

SEQ ID NO: 2248826 - protein, 24 aa, Cryptosporidium parvum
WSNHIVCPVLFYDAINHALNKFDC

SEQ ID NO: 2248827 - protein, 21 aa, Cryptosporidium parvum
WSNLKFLIKRLVDIGMDDLGI

SEQ ID NO: 2248828 - protein, 17 aa, Cryptosporidium parvum
WSSTKFPMNDDSVAPLL

SEQ ID NO: 2248829 - protein, 23 aa, Cryptosporidium parvum
WTKMFCFGVFAMEMFIDRFISFP

SEQ ID NO: 2248830 - protein, 25 aa, Cryptosporidium parvum
WTLGILIYEMVVGFPPFYDDEPMGI

SEQ ID NO: 2248831 - protein, 20 aa, Cryptosporidium parvum
WTLTLVLLIIQVVLGQNEKF

SEQ ID NO: 2248832 - protein, 40 aa, Cryptosporidium parvum; identical to SEQ ID NO: 2134252

SEQ ID NO: 2248833 - protein, 26 aa, Cryptosporidium parvum
WVDYFNLWLIYFFLKNYILGSSIKYI

SEQ ID NO: 2248834 - protein, 18 aa, Cryptosporidium parvum
WVELFKNMKYFSNFYDII

SEQ ID NO: 2248835 - protein, 18 aa, Cryptosporidium parvum
WVSILKRPNLIFLQQIPS

SEQ ID NO: 2248836 - protein, 23 aa, Cryptosporidium parvum
WVTRTIWTIILLSSFLVILAAGH

SEQ ID NO: 2248837 - protein, 17 aa, Cryptosporidium parvum
WVYVVAITFVFMLATSF

SEQ ID NO: 2248838 - protein, 17 aa, Cryptosporidium parvum
WWFSFLNGLSPCVYFFL

SEQ ID NO: 2248839 - protein, 20 aa, Cryptosporidium parvum
WWGSNKMLFSAALYAIANIC

SEQ ID NO: 2248840 - protein, 30 aa, Cryptosporidium parvum
WYCSINNTLLFFGISFLITMFPLKELIRED

SEQ ID NO: 2248841 - protein, 35 aa, Cryptosporidium parvum
WYKKLFPNNILVSSFFFVKACFLFVSAIGRVHSRS

SEQ ID NO: 2248842 - protein, 19 aa, Cryptosporidium parvum
WYYGILLLIISISPGILII

SEQ ID NO: 2248843 - protein, 31 aa, Cryptosporidium parvum
YAALSIFSEFYYYWSKFKYNIRRFSYENPIK

SEQ ID NO: 2248844 - protein, 22 aa, Cryptosporidium parvum
YAILLILIINSAFFTINEVHPS

SEQ ID NO: 2248845 - protein, 21 aa, Cryptosporidium parvum
YAIYSLKYYKYKGWYSFIIST

SEQ ID NO: 2248846 - protein, 22 aa, Cryptosporidium parvum
YALFPIFCVVASIILIFSLTGY

SEQ ID NO: 2248847 - protein, 18 aa, Cryptosporidium parvum
YALLFFSFSIISMSLLFY

SEQ ID NO: 2248848 - protein, 24 aa, Cryptosporidium parvum
YALRALIISIFTKCKQLGYNQLLR

SEQ ID NO: 2248849 - protein, 31 aa, Cryptosporidium parvum; identical to SEQ ID NO: 2134260

SEQ ID NO: 2248850 - protein, 17 aa, Cryptosporidium parvum
YANRTYLMYGNSLLSML

SEQ ID NO: 2248851 - protein, 22 aa, Cryptosporidium parvum
YANTILIISPILKEILFSKSVG

SEQ ID NO: 2248852 - protein, 21 aa, Cryptosporidium parvum
YCFHFLIYEPGVIYMAMTDRS

SEQ ID NO: 2248853 - protein, 25 aa, Cryptosporidium parvum
YCFNLLVLLIMIPFGYYLVEHKLKL

SEQ ID NO: 2248854 - protein, 31 aa, Cryptosporidium parvum
YCKVGLNYKYPLYPIWIIVNKNHYKCSFSFN

SEQ ID NO: 2248855 - protein, 17 aa, Cryptosporidium parvum
YCRYILKKTMEDEINED

SEQ ID NO: 2248856 - protein, 29 aa, Cryptosporidium parvum
YCSLYCSKWEYLKILPVAPKSLFGINSKG

SEQ ID NO: 2248857 - protein, 29 aa, Cryptosporidium parvum
YDDIMEVYKFYWRRLKSGIFSNIGSLFSI

SEQ ID NO: 2248858 - protein, 18 aa, Cryptosporidium parvum
YDELISNPILYYKKLNQS

SEQ ID NO: 2248859 - protein, 30 aa, Cryptosporidium parvum
YDGFNYVYRSFILKLVIKLNNYFLSFIDGN

SEQ ID NO: 2248860 - protein, 17 aa, Cryptosporidium parvum
YDIIKECELLIRATLQL

SEQ ID NO: 2248861 - protein, 20 aa, Cryptosporidium parvum
YDIKKGIHYYKGLKLKINKI

SEQ ID NO: 2248862 - protein, 30 aa, Cryptosporidium parvum
YDINVLLGEYLFYSFLPYHDMAEFCQLIRT

SEQ ID NO: 2248863 - protein, 23 aa, Cryptosporidium parvum
YDNFGIILRKLGFIDQAILCYER

SEQ ID NO: 2248864 - protein, 25 aa, Cryptosporidium parvum
YDNISGFEFFLSKISIRFQSWKLKF

SEQ ID NO: 2248865 - protein, 22 aa, Cryptosporidium parvum
YDNSVLFMFAIQSPISEEKSVL

SEQ ID NO: 2248866 - protein, 27 aa, Cryptosporidium parvum
YDSNSQLFIQIWRNLRLLYIEDNIYQG

SEQ ID NO: 2248867 - protein, 27 aa, Cryptosporidium parvum
YDWNCNKLLLFKFLDNLISIIIQYYQQ

SEQ ID NO: 2248868 - protein, 27 aa, Cryptosporidium parvum
YDYHEPLYLLGITKPFFSLKIFGIWSM

SEQ ID NO: 2248869 - protein, 23 aa, Cryptosporidium parvum
YEDYLIICNSLFLNDNYGLTQKL

SEQ ID NO: 2248870 - protein, 31 aa, Cryptosporidium parvum
YEKEIKPLLIRWIIFVIRLHKFSGLSDELCE

SEQ ID NO: 2248871 - protein, 28 aa, Cryptosporidium parvum
YEKISKMFKYAFQWLSGFLTNNDIIQNG

SEQ ID NO: 2248872 - protein, 31 aa, Cryptosporidium parvum; identical to SEQ ID NO: 2134271

SEQ ID NO: 2248873 - protein, 18 aa, Cryptosporidium parvum
YELYIIPTINYDYDNQLQ

SEQ ID NO: 2248874 - protein, 24 aa, Cryptosporidium parvum
YENGRLSFIFPIHSLKETDLTIEF

SEQ ID NO: 2248875 - protein, 24 aa, Cryptosporidium parvum
YEVIMMIQMELCIGVTLRSWLGDA

SEQ ID NO: 2248876 - protein, 19 aa, Cryptosporidium parvum
YEYGMVFYGLILSIYILKY

SEQ ID NO: 2248877 - protein, 35 aa, Cryptosporidium parvum
YFARLSEYFLCSPSLFVLMFIYIKRIIDNNPSYIF

SEQ ID NO: 2248878 - protein, 25 aa, Cryptosporidium parvum
YFDGGLFNDLLLDFSRQFSEYYILR

SEQ ID NO: 2248879 - protein, 17 aa, Cryptosporidium parvum
YFDGSMYKGFEYFNTSK

SEQ ID NO: 2248880 - protein, 22 aa, Cryptosporidium parvum
YFDPYFFSLLLLLDVICTKYVY

SEQ ID NO: 2248881 - protein, 17 aa, Cryptosporidium parvum
YFFLSEVIFFELITRIQ

SEQ ID NO: 2248882 - protein, 24 aa, Cryptosporidium parvum
YFFQAVFIFVIFFGLALSENIDEY

SEQ ID NO: 2248883 - protein, 24 aa, Cryptosporidium parvum
YFGIGFIVFVFLFNKNNIGHNFHL

SEQ ID NO: 2248884 - protein, 17 aa, Cryptosporidium parvum
YFGIKLDWRPVAASELF

SEQ ID NO: 2248885 - protein, 27 aa, Cryptosporidium parvum
YFGLIYSFPMIFFIPAITSLFIVSKYQ

SEQ ID NO: 2248886 - protein, 39 aa, Cryptosporidium parvum
YFGPNIMTIFWLLLVFFIISILIFCINIIALFGHFISIY

SEQ ID NO: 2248887 - protein, 20 aa, Cryptosporidium parvum
YFHLGEYLGFPFFRQKRNKK

SEQ ID NO: 2248888 - protein, 30 aa, Cryptosporidium parvum
YFHNELMYCFFCRIFIYLKKIKINNSIIHT

SEQ ID NO: 2248889 - protein, 25 aa, Cryptosporidium parvum
YFITNLLLIIPRLCNSFHIFIKMDS

SEQ ID NO: 2248890 - protein, 30 aa, Cryptosporidium parvum
YFKFKVEFLNYYLWFIKVKFIIQNENVESK

SEQ ID NO: 2248891 - protein, 20 aa, Cryptosporidium parvum
YFKICKILFSIYMNLAKNTH

SEQ ID NO: 2248892 - protein, 48 aa, Cryptosporidium parvum; identical to SEQ ID NO: 2134280

SEQ ID NO: 2248893 - protein, 22 aa, Cryptosporidium parvum
YFKPLKVPFLSWSEAAYHSLLS

SEQ ID NO: 2248894 - protein, 24 aa, Cryptosporidium parvum
YFLIIDIVLFLLHSGNFFASCESP

SEQ ID NO: 2248895 - protein, 17 aa, Cryptosporidium parvum
YFLLYFSSSREIASKQD

SEQ ID NO: 2248896 - protein, 19 aa, Cryptosporidium parvum
YFLYLFGYSILYAIGNGLL

SEQ ID NO: 2248897 - protein, 19 aa, Cryptosporidium parvum
YFNDGPFPSLSIPTSRFGN

SEQ ID NO: 2248898 - protein, 29 aa, Cryptosporidium parvum
YFNIEYYPLWVYPALLMAIEFSLLFIPSK

SEQ ID NO: 2248899 - protein, 44 aa, Cryptosporidium parvum
YFNSFILKYMSMIEYIFAILRTQPLYIINLMLECSFGEEFISIL

SEQ ID NO: 2248900 - protein, 18 aa, Cryptosporidium parvum
YFPHFHPLRMPKSKLEWK

SEQ ID NO: 2248901 - protein, 20 aa, Cryptosporidium parvum
YFPMHRRLFSGHQKISILKE

SEQ ID NO: 2248902 - protein, 19 aa, Cryptosporidium parvum
YFPTQAFGFAFKDMIRDMM

SEQ ID NO: 2248903 - protein, 17 aa, Cryptosporidium parvum
YFQIFKNMLLFLSIQPI

SEQ ID NO: 2248904 - protein, 18 aa, Cryptosporidium parvum
YFRRSFSLSVMLKGVMNY

SEQ ID NO: 2248905 - protein, 27 aa, Cryptosporidium parvum
YFSEISIHLYFSLTKLGTSKFKVINEI

SEQ ID NO: 2248906 - protein, 19 aa, Cryptosporidium parvum
YFSFFYYLTNWGCTSTLIF

SEQ ID NO: 2248907 - protein, 25 aa, Cryptosporidium parvum
YFSNTFLYLYISFIQNLLTSNYSDP

SEQ ID NO: 2248908 - protein, 18 aa, Cryptosporidium parvum
YFSVLKNFSFYKLIYCLL

SEQ ID NO: 2248909 - protein, 24 aa, Cryptosporidium parvum
YFTGNLWLEMLIALFSLDIICNKR

SEQ ID NO: 2248910 - protein, 22 aa, Cryptosporidium parvum
YFTHEMLRRFLALAKITIPNSG

SEQ ID NO: 2248911 - protein, 26 aa, Cryptosporidium parvum
YFVRLNYLPRVLANNFTWLIPMRDHY

SEQ ID NO: 2248912 - protein, 17 aa, Cryptosporidium parvum
YGACVFLLLFGFGSSVF

SEQ ID NO: 2248913 - protein, 19 aa, Cryptosporidium parvum
YGDFEVLRDLLIQSLRNSG

SEQ ID NO: 2248914 - protein, 26 aa, Cryptosporidium parvum
YGIAPLIIIFFVIVSGFYVTVNKLPL

SEQ ID NO: 2248915 - protein, 18 aa, Cryptosporidium parvum
YGIPMFPMAPNPGQLQNG

SEQ ID NO: 2248916 - protein, 28 aa, Cryptosporidium parvum
YGKANLFQKIFRFPKLLLSKDEVHNIES

SEQ ID NO: 2248917 - protein, 50 aa, Cryptosporidium parvum
YGKRSQFMLSKSFLFKILLLVLNLIPVTLLTLGVYLIIAEIWTIISSKVL

SEQ ID NO: 2248918 - protein, 39 aa, Cryptosporidium parvum; identical to SEQ ID NO: 2134305

SEQ ID NO: 2248919 - protein, 31 aa, Cryptosporidium parvum
YGPIVHSVWPRILFIQSIIIGRFKFLDDYKH

SEQ ID NO: 2248920 - protein, 20 aa, Cryptosporidium parvum
YGRRPFGVGLLLAGFDESGP

SEQ ID NO: 2248921 - protein, 30 aa, Cryptosporidium parvum; identical to SEQ ID NO: 2134306

SEQ ID NO: 2248922 - protein, 25 aa, Cryptosporidium parvum
YGSNLTLLYDYIYNLASRVIGSGQE

SEQ ID NO: 2248923 - protein, 32 aa, Cryptosporidium parvum
YGTIYLIYSLFAWLVYILIAIKRYLSTKVSEE

SEQ ID NO: 2248924 - protein, 26 aa, Cryptosporidium parvum
YGWALLWVVIIVFQFLSLKFQWISLS

SEQ ID NO: 2248925 - protein, 27 aa, Cryptosporidium parvum
YGYLNIPLRYISLLLLALKAVCVVLCT

SEQ ID NO: 2248926 - protein, 26 aa, Cryptosporidium parvum
YGYRRKLIYLITLFSLGNYNVIRKSA

SEQ ID NO: 2248927 - protein, 29 aa, Cryptosporidium parvum
YHAGTAYRWLFVRLEIMGCIAVFTAGTLG

SEQ ID NO: 2248928 - protein, 20 aa, Cryptosporidium parvum
YHAPLFPEPREYIYPGIFFE

SEQ ID NO: 2248929 - protein, 18 aa, Cryptosporidium parvum
YHDILALIRFGMVNNGLN

SEQ ID NO: 2248930 - protein, 18 aa, Cryptosporidium parvum
YHEESPWIHGGRLIWYKT

SEQ ID NO: 2248931 - protein, 26 aa, Cryptosporidium parvum
YHIKLLVIFLVIIIKIGVVNTEHDLV

SEQ ID NO: 2248932 - protein, 25 aa, Cryptosporidium parvum
YHKYLLGYLFGIHRWYKYLTGDLSI

SEQ ID NO: 2248933 - protein, 20 aa, Cryptosporidium parvum
YHLDLPKIYLNNLESNTGIG

SEQ ID NO: 2248934 - protein, 18 aa, Cryptosporidium parvum
YHLSIALNAIFISRSYRK

SEQ ID NO: 2248935 - protein, 24 aa, Cryptosporidium parvum
YHPYTCIISCILQLPFLSTNNING

SEQ ID NO: 2248936 - protein, 17 aa, Cryptosporidium parvum
YHTNMSRRGIFNIGPRI

SEQ ID NO: 2248937 - protein, 20 aa, Cryptosporidium parvum
YIAHQLGLLVSILHICVFTG

SEQ ID NO: 2248938 - protein, 25 aa, Cryptosporidium parvum
YIAPFGLFGHLKIYDFALSTIEVGL

SEQ ID NO: 2248939 - protein, 25 aa, Cryptosporidium parvum
YIDIEDRFFHPIYQKLILNSESLQP

SEQ ID NO: 2248940 - protein, 29 aa, Cryptosporidium parvum
YIEIPVKAYKYVFPRNINALKTALAKYGP

SEQ ID NO: 2248941 - protein, 18 aa, Cryptosporidium parvum
YIELAIITCRLAALDISS

SEQ ID NO: 2248942 - protein, 25 aa, Cryptosporidium parvum
YIENYYLYFDILLVNIAMDFIFKLN

SEQ ID NO: 2248943 - protein, 31 aa, Cryptosporidium parvum
YIFSRLDISFFYHYIRGQGLLKLYFIFNMLE

SEQ ID NO: 2248944 - protein, 25 aa, Cryptosporidium parvum
YIGENLMWLLEFYSKSFLIGESTGI

SEQ ID NO: 2248945 - protein, 28 aa, Cryptosporidium parvum
YIHSFGNSLLPFIDIYQNIPLISIGLIS

SEQ ID NO: 2248946 - protein, 17 aa, Cryptosporidium parvum
YIHTPKDFAIIGSLVVI

SEQ ID NO: 2248947 - protein, 31 aa, Cryptosporidium parvum
YIINKCELLILIFRNKVNHILFELLLEPGNE

SEQ ID NO: 2248948 - protein, 37 aa, Cryptosporidium parvum
YIIWSSPICILIYPILIWYYFKYIFKPTRIQTRESYR

SEQ ID NO: 2248949 - protein, 25 aa, Cryptosporidium parvum
YIKYLHINYFFFLNNNNLFEWINQY

SEQ ID NO: 2248950 - protein, 20 aa, Cryptosporidium parvum
YILKRLHRGILYYKQKNNYI

SEQ ID NO: 2248951 - protein, 24 aa, Cryptosporidium parvum
YILLIQVFVWLIASVCIFLYLVQY

SEQ ID NO: 2248952 - protein, 26 aa, Cryptosporidium parvum
YILSALIMFYYWVLNVLSTFLLMQCA

SEQ ID NO: 2248953 - protein, 17 aa, Cryptosporidium parvum
YILSSFKLCGLEADISY

SEQ ID NO: 2248954 - protein, 21 aa, Cryptosporidium parvum
YILWIFQAFLEITEGVVKKVP

SEQ ID NO: 2248955 - protein, 24 aa, Cryptosporidium parvum
YINFLFNEIKLSEPIFPILNDLKP

SEQ ID NO: 2248956 - protein, 20 aa, Cryptosporidium parvum
YIPESFSVQATLHVIPKYST

SEQ ID NO: 2248957 - protein, 24 aa, Cryptosporidium parvum
YIPLPIFTLIIHTFSLKSDNVIKS

SEQ ID NO: 2248958 - protein, 24 aa, Cryptosporidium parvum
YIPQMFIYDRIISTVISLLPVVDN

SEQ ID NO: 2248959 - protein, 21 aa, Cryptosporidium parvum
YIPSKLFFHYYDTTNTQYSYL

SEQ ID NO: 2248960 - protein, 18 aa, Cryptosporidium parvum
YIQDIKLDLIPFLTSEDN

SEQ ID NO: 2248961 - protein, 31 aa, Cryptosporidium parvum; identical to SEQ ID NO: 2199310

SEQ ID NO: 2248962 - protein, 19 aa, Cryptosporidium parvum
YIRLFKIWINRMEKVNNNN

SEQ ID NO: 2248963 - protein, 25 aa, Cryptosporidium parvum
YIRNLKALWIIMLSSAFAAILYQNH

SEQ ID NO: 2248964 - protein, 18 aa, Cryptosporidium parvum
YISFFSSLYSGEAGTFSS

SEQ ID NO: 2248965 - protein, 24 aa, Cryptosporidium parvum
YISKLALCTLFRALNNSRCINYIR

SEQ ID NO: 2248966 - protein, 25 aa, Cryptosporidium parvum
YISLKNILKMISFTPISWKKRPDPI

SEQ ID NO: 2248967 - protein, 25 aa, Cryptosporidium parvum
YISLKRRLHNTLQFFKSYSQSSNAS

SEQ ID NO: 2248968 - protein, 28 aa, Cryptosporidium parvum
YISMESMILTTLILGELFIHGASMLIID

SEQ ID NO: 2248969 - protein, 28 aa, Cryptosporidium parvum
YISQIELILKFWFKRFRLTSNNFFDEYS

SEQ ID NO: 2248970 - protein, 46 aa, Cryptosporidium parvum
YIVSLSLNILCGILVAAAAMWVLYYYVFPWFLTGIREMQLVSTASH

SEQ ID NO: 2248971 - protein, 25 aa, Cryptosporidium parvum
YIYKIYLFIYSWSIFQFLSISILGI

SEQ ID NO: 2248972 - protein, 19 aa, Cryptosporidium parvum
YIYWNSRLYFWSPITFYTI

SEQ ID NO: 2248973 - protein, 18 aa, Cryptosporidium parvum
YKAYLLLDSFYAIEKQLF

SEQ ID NO: 2248974 - protein, 45 aa, Cryptosporidium parvum
YKEGSAAYFIDKIQKILRLISLIFSLFILGFIITSRINKGRKDIS

SEQ ID NO: 2248975 - protein, 23 aa, Cryptosporidium parvum
YKELYIYFVNTLRQLYIDSLSHN

SEQ ID NO: 2248976 - protein, 28 aa, Cryptosporidium parvum
YKEQGQVIFLLLFLSLKLITNHKHFLML

SEQ ID NO: 2248977 - protein, 40 aa, Cryptosporidium parvum; identical to SEQ ID NO: 2134327

SEQ ID NO: 2248978 - protein, 31 aa, Cryptosporidium parvum
YKGTGLVIFGLLFIILFGIKDVPVYNVHELG

SEQ ID NO: 2248979 - protein, 18 aa, Cryptosporidium parvum
YKIKDFPALPKFLTNFRD

SEQ ID NO: 2248980 - protein, 17 aa, Cryptosporidium parvum
YKIPPEVTFLILEGLDS

SEQ ID NO: 2248981 - protein, 21 aa, Cryptosporidium parvum
YKKIIIAESFNILISGRYLSN

SEQ ID NO: 2248982 - protein, 20 aa, Cryptosporidium parvum
YKLCIIYINFILKCDHPGSS

SEQ ID NO: 2248983 - protein, 23 aa, Cryptosporidium parvum
YKLFFLIFVSRLSKIYIILTLTI

SEQ ID NO: 2248984 - protein, 18 aa, Cryptosporidium parvum
YKMMTLVVCIGICYGAII

SEQ ID NO: 2248985 - protein, 17 aa, Cryptosporidium parvum
YKNEYSTVWFIRKDEKD

SEQ ID NO: 2248986 - protein, 24 aa, Cryptosporidium parvum
YKPSSILELFGGLPSYCLYYGTQS

SEQ ID NO: 2248987 - protein, 19 aa, Cryptosporidium parvum
YKTGNLIGKIFALIAALDY

SEQ ID NO: 2248988 - protein, 35 aa, Cryptosporidium parvum; identical to SEQ ID NO: 2134330

SEQ ID NO: 2248989 - protein, 27 aa, Cryptosporidium parvum
YKTIGFWMFTYCFFLSYNTIYFNSLVE

SEQ ID NO: 2248990 - protein, 26 aa, Cryptosporidium parvum
YLAIKNFCILTFVGLLFGYITCLTIL

SEQ ID NO: 2248991 - protein, 19 aa, Cryptosporidium parvum
YLCGYTFHKKGIKSMLYLN

SEQ ID NO: 2248992 - protein, 26 aa, Cryptosporidium parvum
YLCSTYPMLIFMRHLLQNRKRFKGPK

SEQ ID NO: 2248993 - protein, 29 aa, Cryptosporidium parvum
YLDNSRIIIASIFGIMEILLNRMVNPYEI

SEQ ID NO: 2248994 - protein, 25 aa, Cryptosporidium parvum
YLDPDKIQLLPNGRVYYFPRDHVCD

SEQ ID NO: 2248995 - protein, 20 aa, Cryptosporidium parvum
YLERFLGKYYSGEAITYLTQ

SEQ ID NO: 2248996 - protein, 25 aa, Cryptosporidium parvum
YLGFTLILSIWILKSQDWYNLDDLS

SEQ ID NO: 2248997 - protein, 27 aa, Cryptosporidium parvum
YLGPIIIFPIFYFFPTLIYGEPAPPKS

SEQ ID NO: 2248998 - protein, 18 aa, Cryptosporidium parvum
YLIELPIYKLVETRSSFC

SEQ ID NO: 2248999 - protein, 23 aa, Cryptosporidium parvum
YLIYTSALVISFLITSILGIFPH

SEQ ID NO: 2249000 - protein, 25 aa, Cryptosporidium parvum
YLKCNIFRFKLSLSSFKIVLSRKFT

SEQ ID NO: 2249001 - protein, 34 aa, Cryptosporidium parvum; identical to SEQ ID NO: 2134342

SEQ ID NO: 2249002 - protein, 28 aa, Cryptosporidium parvum
YLLCIISICFFLYPSWSLYVHIKINGIP

SEQ ID NO: 2249003 - protein, 29 aa, Cryptosporidium parvum
YLLDQDCLMSIWYGTPLFMSRYIADNPNN

SEQ ID NO: 2249004 - protein, 18 aa, Cryptosporidium parvum
YLLQAFPAILTFTMILIG

SEQ ID NO: 2249005 - protein, 25 aa, Cryptosporidium parvum
YLLWEELIEFTNFIYLYCFTNNNSN

SEQ ID NO: 2249006 - protein, 23 aa, Cryptosporidium parvum
YLNINWGYIYKLIPGISNFNCSN

SEQ ID NO: 2249007 - protein, 17 aa, Cryptosporidium parvum
YLNMVKFAEVALLVGIS

SEQ ID NO: 2249008 - protein, 22 aa, Cryptosporidium parvum
YLNQFLYIFSLVTSIGIISAEA

SEQ ID NO: 2249009 - protein, 17 aa, Cryptosporidium parvum
YLNVLKFLNEYNSNVIL

SEQ ID NO: 2249010 - protein, 32 aa, Cryptosporidium parvum
YLNYHFFTSINIIIIIIIQMSSSFLSASSSIS

SEQ ID NO: 2249011 - protein, 17 aa, Cryptosporidium parvum
YLPFHSKLLSKIVEQKR

SEQ ID NO: 2249012 - protein, 19 aa, Cryptosporidium parvum
YLPIIYPSDFWCIERNFKM

SEQ ID NO: 2249013 - protein, 22 aa, Cryptosporidium parvum
YLPMFFVVLFVVMPFSSYLMPD

SEQ ID NO: 2249014 - protein, 17 aa, Cryptosporidium parvum
YLPNCFLCYTLPKIQHP

SEQ ID NO: 2249015 - protein, 19 aa, Cryptosporidium parvum
YLPYKSIYDNVVYPSLFTL

SEQ ID NO: 2249016 - protein, 17 aa, Cryptosporidium parvum
YLSYFEVLSWIKITQEQ

SEQ ID NO: 2249017 - protein, 19 aa, Cryptosporidium parvum
YLTILLSTFSTCISLYCKI

SEQ ID NO: 2249018 - protein, 20 aa, Cryptosporidium parvum
YLTVLLLGTVLFFIGFNGEK

SEQ ID NO: 2249019 - protein, 19 aa, Cryptosporidium parvum
YLVNVFIFYWRQALTEYYL

SEQ ID NO: 2249020 - protein, 17 aa, Cryptosporidium parvum
YLVTMSKVPIYIVTGFL

SEQ ID NO: 2249021 - protein, 20 aa, Cryptosporidium parvum
YLVVIFFTILCENIDEKLLS

SEQ ID NO: 2249022 - protein, 17 aa, Cryptosporidium parvum
YLYDYNIEKLLLNINLK

SEQ ID NO: 2249023 - protein, 22 aa, Cryptosporidium parvum
YLYILVIFKVNYVISIRNNKSS

SEQ ID NO: 2249024 - protein, 25 aa, Cryptosporidium parvum
YMGSVFIVLTLLKILVETQYSYWCG

SEQ ID NO: 2249025 - protein, 31 aa, Cryptosporidium parvum
YMIDYSILLFIMFLFRPFKSLKLFSNVLAKH

SEQ ID NO: 2249026 - protein, 17 aa, Cryptosporidium parvum
YMILSEELNPMFLNTLR

SEQ ID NO: 2249027 - protein, 32 aa, Cryptosporidium parvum
YMKINLYFFGVILHAFLAIYWIYKCIRNSKQL

SEQ ID NO: 2249028 - protein, 23 aa, Cryptosporidium parvum
YMKLLEFFHLNPSLCKLFFEMKQ

SEQ ID NO: 2249029 - protein, 18 aa, Cryptosporidium parvum
YMQNLIPVRVYVDNIILN

SEQ ID NO: 2249030 - protein, 19 aa, Cryptosporidium parvum
YMQYSIILSIYINSAYISN

SEQ ID NO: 2249031 - protein, 17 aa, Cryptosporidium parvum
YMRDRISYINFSTINYL

SEQ ID NO: 2249032 - protein, 21 aa, Cryptosporidium parvum
YMVVILPCEVLYMIHRKLKQI

SEQ ID NO: 2249033 - protein, 25 aa, Cryptosporidium parvum
YMVVPGIIYFFLSILLNFIGIPKHV

SEQ ID NO: 2249034 - protein, 21 aa, Cryptosporidium parvum
YNEVTWWIGVISYAFGAIIHI

SEQ ID NO: 2249035 - protein, 24 aa, Cryptosporidium parvum
YNFKKLKLLLPDPPTINYFELKFE

SEQ ID NO: 2249036 - protein, 24 aa, Cryptosporidium parvum
YNIDHLIWDLIVSDYILSLRKKGI

SEQ ID NO: 2249037 - protein, 36 aa, Cryptosporidium parvum
YNIHLSSFLVLRDCIYIVFSLIYYSKSRDLDDFIID

SEQ ID NO: 2249038 - protein, 18 aa, Cryptosporidium parvum
YNIIFPLCKLINYFIILQ

SEQ ID NO: 2249039 - protein, 18 aa, Cryptosporidium parvum
YNIILIISLTISIYGIML

SEQ ID NO: 2249040 - protein, 23 aa, Cryptosporidium parvum
YNKILTYTMNLMLEKLRTCDSRV

SEQ ID NO: 2249041 - protein, 18 aa, Cryptosporidium parvum
YNKPILNSFKLLINTIYD

SEQ ID NO: 2249042 - protein, 18 aa, Cryptosporidium parvum
YNLPILMICPQPNMPRHF

SEQ ID NO: 2249043 - protein, 22 aa, Cryptosporidium parvum
YNLPLFAFIWWSYFNLSENQKS

SEQ ID NO: 2249044 - protein, 17 aa, Cryptosporidium parvum
YNMNFPCEQVHYWFLAY

SEQ ID NO: 2249045 - protein, 17 aa, Cryptosporidium parvum
YNMSSLMNLTLSKCIKP

SEQ ID NO: 2249046 - protein, 27 aa, Cryptosporidium parvum
YNNLNNRFLILSIPKLKSLKKVKAVLY

SEQ ID NO: 2249047 - protein, 24 aa, Cryptosporidium parvum
YNNNIFPKFWKIELTFWCVFFLML

SEQ ID NO: 2249048 - protein, 32 aa, Cryptosporidium parvum
YNPILKEIYTTTPFWSLTILNSPFLLPSCNMA

SEQ ID NO: 2249049 - protein, 24 aa, Cryptosporidium parvum
YNPINIFVSLFGISFNLYNQLNLY

SEQ ID NO: 2249050 - protein, 28 aa, Cryptosporidium parvum
YNRCKFWWLSLVQFPECIWILYCISICL

SEQ ID NO: 2249051 - protein, 17 aa, Cryptosporidium parvum
YNRLMELGIQYGKKFKT

SEQ ID NO: 2249052 - protein, 20 aa, Cryptosporidium parvum
YNSFLLDYALFLADNRVGLV

SEQ ID NO: 2249053 - protein, 25 aa, Cryptosporidium parvum
YNSLTNLKFIHPINRLFACIKNKKI

SEQ ID NO: 2249054 - protein, 26 aa, Cryptosporidium parvum
YNSVSALYFILTIKSIFHYNIVQVEN

SEQ ID NO: 2249055 - protein, 27 aa, Cryptosporidium parvum
YNTIKQYLIKILTFIFQKELQTEDTSI

SEQ ID NO: 2249056 - protein, 26 aa, Cryptosporidium parvum
YPGANKLLLGGILYDLSRLDQNQRKA

SEQ ID NO: 2249057 - protein, 41 aa, Cryptosporidium parvum
YPLTLSLINTEFYRIFRFNLYNLFTILYKCGGENISDLLKR

SEQ ID NO: 2249058 - protein, 33 aa, Cryptosporidium parvum
YPLTVSFLHFTAFIYYWQLLSMISSPIISVILA

SEQ ID NO: 2249059 - protein, 24 aa, Cryptosporidium parvum
YPSNSFIILILLISTIIIINHGWY

SEQ ID NO: 2249060 - protein, 18 aa, Cryptosporidium parvum
YPVELLKPLSNIWPGDGR

SEQ ID NO: 2249061 - protein, 17 aa, Cryptosporidium parvum
YPVIYGFPFIFFINPNY

SEQ ID NO: 2249062 - protein, 38 aa, Cryptosporidium parvum; identical to SEQ ID NO: 2134370

SEQ ID NO: 2249063 - protein, 17 aa, Cryptosporidium parvum
YQIFTFIFGSIWFPNFL

SEQ ID NO: 2249064 - protein, 18 aa, Cryptosporidium parvum
YQKAITSYLFLTIGVINS

SEQ ID NO: 2249065 - protein, 22 aa, Cryptosporidium parvum
YQPFFLLHGLYLYAYIIGILLA

SEQ ID NO: 2249066 - protein, 26 aa, Cryptosporidium parvum
YQQFYTKIYSRTLTWSYFLGTCIMDY

SEQ ID NO: 2249067 - protein, 21 aa, Cryptosporidium parvum
YQRHYPISTLLPVVTLLLFSW

SEQ ID NO: 2249068 - protein, 23 aa, Cryptosporidium parvum
YQTNFLLQILGITISFFGNIFNS

SEQ ID NO: 2249069 - protein, 17 aa, Cryptosporidium parvum
YQYILPSKYSKISKTII

SEQ ID NO: 2249070 - protein, 29 aa, Cryptosporidium parvum
YQYLLEKYLIKFGFLSDFLFNSKLNKLFS

SEQ ID NO: 2249071 - protein, 21 aa, Cryptosporidium parvum
YRDLFELLSKIFISKLKNKKI

SEQ ID NO: 2249072 - protein, 24 aa, Cryptosporidium parvum
YRDVLFIFVTRGILLTLCFTWASL

SEQ ID NO: 2249073 - protein, 18 aa, Cryptosporidium parvum
YRENCILSIFGVINYVIS

SEQ ID NO: 2249074 - protein, 20 aa, Cryptosporidium parvum
YRIEAIIMKFLKHKQKSSLL

SEQ ID NO: 2249075 - protein, 27 aa, Cryptosporidium parvum
YRIHIFKIQNMLLLISSYYLNINWGYI

SEQ ID NO: 2249076 - protein, 25 aa, Cryptosporidium parvum
YRILKSIWYGSRLYKYNLSIIYNYA

SEQ ID NO: 2249077 - protein, 22 aa, Cryptosporidium parvum
YRKLWLIICLAILALTGITEKT

SEQ ID NO: 2249078 - protein, 25 aa, Cryptosporidium parvum
YRKMLEFCLSIFSFELREFDWSDEI

SEQ ID NO: 2249079 - protein, 17 aa, Cryptosporidium parvum
YRLGKIFKVWRLIKKNN

SEQ ID NO: 2249080 - protein, 19 aa, Cryptosporidium parvum
YRMRIAGIYLALGSPISSA

SEQ ID NO: 2249081 - protein, 19 aa, Cryptosporidium parvum
YRTNYSIVLSPIDDIKQLN

SEQ ID NO: 2249082 - protein, 20 aa, Cryptosporidium parvum
YRVLILFNKSDLITSRSISY

SEQ ID NO: 2249083 - protein, 18 aa, Cryptosporidium parvum
YSAPKKLPSRNFLEQLFA

SEQ ID NO: 2249084 - protein, 26 aa, Cryptosporidium parvum
YSASTWFYCFLLIILNVQYSKLHLKV

SEQ ID NO: 2249085 - protein, 28 aa, Cryptosporidium parvum
YSDHLPCAVWLPWIPQLIAGIDRIEGSA

SEQ ID NO: 2249086 - protein, 26 aa, Cryptosporidium parvum
YSDLIDLWTILWRNYLNENIHLFYNK

SEQ ID NO: 2249087 - protein, 32 aa, Cryptosporidium parvum; identical to SEQ ID NO: 2134382

SEQ ID NO: 2249088 - protein, 28 aa, Cryptosporidium parvum
YSFIHPEHLFLFNNYIKLKILISSQSQS

SEQ ID NO: 2249089 - protein, 26 aa, Cryptosporidium parvum
YSFLYCLIYLIFTIVYFILKLPNPQS

SEQ ID NO: 2249090 - protein, 30 aa, Cryptosporidium parvum
YSGIYLSIPLLNYVFFNIKSLFINKNGSSL

SEQ ID NO: 2249091 - protein, 22 aa, Cryptosporidium parvum
YSILIHFVSLFFDDSFEKRNEY

SEQ ID NO: 2249092 - protein, 29 aa, Cryptosporidium parvum
YSIQQINLLYKQKLIWLRIHLTVGIIDSE

SEQ ID NO: 2249093 - protein, 22 aa, Cryptosporidium parvum
YSITLIVIVWLACTSNQISEFQ

SEQ ID NO: 2249094 - protein, 30 aa, Cryptosporidium parvum
YSIVISTMPFLLIIFAIIAAPILRYFREKE

SEQ ID NO: 2249095 - protein, 22 aa, Cryptosporidium parvum
YSKELCIHLLGASLSIIYKNVN

SEQ ID NO: 2249096 - protein, 29 aa, Cryptosporidium parvum
YSKKITPYLILMIPIITSIGLIFLKSILD

SEQ ID NO: 2249097 - protein, 33 aa, Cryptosporidium parvum
YSKKSGFIFFQWYFWYCLESRRYPSKDFLLKFV

SEQ ID NO: 2249098 - protein, 39 aa, Cryptosporidium parvum
YSKLITFYKKWTIPYKKFITLYFYQLPTLLNHLFSRSDS

SEQ ID NO: 2249099 - protein, 19 aa, Cryptosporidium parvum
YSLFIQVFGSKFSWRWFLP

SEQ ID NO: 2249100 - protein, 26 aa, Cryptosporidium parvum
YSLILLTLFSYFEFNSPLIVGVCISL

SEQ ID NO: 2249101 - protein, 25 aa, Cryptosporidium parvum
YSLKPIHSFYFLRSYVRQYLEYIFK

SEQ ID NO: 2249102 - protein, 26 aa, Cryptosporidium parvum
YSLLHYIRIIINIYIILNYSLKMIAQ

SEQ ID NO: 2249103 - protein, 26 aa, Cryptosporidium parvum
YSNFKWVFAIFILKPSILFLCRVFTL

SEQ ID NO: 2249104 - protein, 33 aa, Cryptosporidium parvum
YSNSQPTIIHWLIILLSALFSCYLFNGVDQKDV

SEQ ID NO: 2249105 - protein, 21 aa, Cryptosporidium parvum
YSPELIVHPLFPSYGELSKEE

SEQ ID NO: 2249106 - protein, 24 aa, Cryptosporidium parvum
YSPFGIPFYFRDIEIIIFDVLGGK

SEQ ID NO: 2249107 - protein, 17 aa, Cryptosporidium parvum
YSRDVLMSMNALIGLIL

SEQ ID NO: 2249108 - protein, 29 aa, Cryptosporidium parvum
YSRKYNDWLVFFLFLNKFFRIKEKNTKCL

SEQ ID NO: 2249109 - protein, 23 aa, Cryptosporidium parvum
YSSDRPRWYPLLSAAHYGIMVGQ

SEQ ID NO: 2249110 - protein, 19 aa, Cryptosporidium parvum
YSSFIFGTICKFIGLPLLL

SEQ ID NO: 2249111 - protein, 21 aa, Cryptosporidium parvum
YSSFIVIILSYFNNYFRDKDG

SEQ ID NO: 2249112 - protein, 32 aa, Cryptosporidium parvum
YSSKFPTKYDLNGLLFWNVSSDTYIYWGYQNK

SEQ ID NO: 2249113 - protein, 23 aa, Cryptosporidium parvum
YSSKWNRRLLARKHNLPLGNSDS

SEQ ID NO: 2249114 - protein, 18 aa, Cryptosporidium parvum
YSSLFREFGITNFNFIQG

SEQ ID NO: 2249115 - protein, 28 aa, Cryptosporidium parvum
YSSTSLLLSWFFNGLFHAGVYPMLVKYL

SEQ ID NO: 2249116 - protein, 22 aa, Cryptosporidium parvum
YSTIFIFLYSCFTVFNYATCEL

SEQ ID NO: 2249117 - protein, 17 aa, Cryptosporidium parvum
YSVIIKLSEKFESEIDP

SEQ ID NO: 2249118 - protein, 19 aa, Cryptosporidium parvum
YSVLASLSLLLLNFTIQAE

SEQ ID NO: 2249119 - protein, 17 aa, Cryptosporidium parvum
YSVLSCIISHLITFLLI

SEQ ID NO: 2249120 - protein, 24 aa, Cryptosporidium parvum
YSYLNCMVSPWKNLEFICVMDTVT

SEQ ID NO: 2249121 - protein, 24 aa, Cryptosporidium parvum
YTCDLLHYNLLLIIKALSFLESYE

SEQ ID NO: 2249122 - protein, 20 aa, Cryptosporidium parvum
YTCMPMWTSIPVLHAGSKND

SEQ ID NO: 2249123 - protein, 19 aa, Cryptosporidium parvum
YTGMILSVFIPGERFSKVT

SEQ ID NO: 2249124 - protein, 20 aa, Cryptosporidium parvum
YTLNVFFLGLILPIGGYINK

SEQ ID NO: 2249125 - protein, 20 aa, Cryptosporidium parvum
YTLRLRGKIPDSINLFASKF

SEQ ID NO: 2249126 - protein, 17 aa, Cryptosporidium parvum
YTLVISPVVGWLTSTKR

SEQ ID NO: 2249127 - protein, 22 aa, Cryptosporidium parvum
YTMAKFYFFERINQMFYDKVFT

SEQ ID NO: 2249128 - protein, 21 aa, Cryptosporidium parvum
YTNFNVLMCVSLSLIFHSRLH

SEQ ID NO: 2249129 - protein, 25 aa, Cryptosporidium parvum
YTNIQAEYRSMLIRDLINIARNDSD

SEQ ID NO: 2249130 - protein, 32 aa, Cryptosporidium parvum
YTNYSATLKPIPLIVILFSCLKYLIVNCNSLP

SEQ ID NO: 2249131 - protein, 19 aa, Cryptosporidium parvum
YTPVPCIVNFPFNAKISRI

SEQ ID NO: 2249132 - protein, 19 aa, Cryptosporidium parvum
YTRELYYTSLLSKQNFPLI

SEQ ID NO: 2249133 - protein, 22 aa, Cryptosporidium parvum
YTRRIPLEGLEMYCKTVWKCIV

SEQ ID NO: 2249134 - protein, 22 aa, Cryptosporidium parvum
YTSFFALISYKLAVVFLKSVSS

SEQ ID NO: 2249135 - protein, 21 aa, Cryptosporidium parvum
YTSIDIIWLNIILQLEDLCKD

SEQ ID NO: 2249136 - protein, 24 aa, Cryptosporidium parvum
YVAHIMRQIMAALAYFHSRNIVHK

SEQ ID NO: 2249137 - protein, 22 aa, Cryptosporidium parvum
YVAKALTMGLYNKGLEVIVEPL

SEQ ID NO: 2249138 - protein, 31 aa, Cryptosporidium parvum
YVEDPFKIIPYIRRAPFGSLYPIHLVKEGTT

SEQ ID NO: 2249139 - protein, 26 aa, Cryptosporidium parvum
YVELHYLFISFWNYTPFYFYNNQHHN

SEQ ID NO: 2249140 - protein, 27 aa, Cryptosporidium parvum
YVIAAVYYYFIRWQGIPQVYGQFVIEK

SEQ ID NO: 2249141 - protein, 25 aa, Cryptosporidium parvum
YVIKKILLIICPYITFFTQNKRKSF

SEQ ID NO: 2249142 - protein, 17 aa, Cryptosporidium parvum
YVKLPYSDLSNIILFCM

SEQ ID NO: 2249143 - protein, 19 aa, Cryptosporidium parvum
YVLLFSLNEFPILILITIS

SEQ ID NO: 2249144 - protein, 27 aa, Cryptosporidium parvum
YVLSIVIILVYWLLNVICTILMFKCAD

SEQ ID NO: 2249145 - protein, 31 aa, Cryptosporidium parvum; identical to SEQ ID NO: 2134412

SEQ ID NO: 2249146 - protein, 27 aa, Cryptosporidium parvum
YVQGYFSIFFIYLFSRIIEADKLDRKL

SEQ ID NO: 2249147 - protein, 17 aa, Cryptosporidium parvum
YVQSIDTVLSRLATPWS

SEQ ID NO: 2249148 - protein, 28 aa, Cryptosporidium parvum
YVSTTIYLFVFCFVCILAKRVNVSSSRR

SEQ ID NO: 2249149 - protein, 26 aa, Cryptosporidium parvum
YVTIYRVEDLLFKKGLRDPFITVEFS

SEQ ID NO: 2249150 - protein, 28 aa, Cryptosporidium parvum
YVYVCTYWGLFYFKIPKKYGIYLNKHTD

SEQ ID NO: 2249151 - protein, 20 aa, Cryptosporidium parvum
YWDFNTVFEFVFFNKNNQFD

SEQ ID NO: 2249152 - protein, 35 aa, Cryptosporidium parvum; identical to SEQ ID NO: 2134419

SEQ ID NO: 2249153 - protein, 27 aa, Cryptosporidium parvum
YYCLRYPCLINYLFKLYSRIVDEINKN

SEQ ID NO: 2249154 - protein, 41 aa, Cryptosporidium parvum; identical to SEQ ID NO: 2134420

SEQ ID NO: 2249155 - protein, 19 aa, Cryptosporidium parvum
YYEKLPLIFDRFFEEILRL

SEQ ID NO: 2249156 - protein, 18 aa, Cryptosporidium parvum
YYFGIYSLIIELLSDSRR

SEQ ID NO: 2249157 - protein, 21 aa, Cryptosporidium parvum
YYGILLFNQIQPYLIGLVLQL

SEQ ID NO: 2249158 - protein, 24 aa, Cryptosporidium parvum
YYIGLFVFFIALFSELDAYSGSFT

SEQ ID NO: 2249159 - protein, 25 aa, Cryptosporidium parvum
YYIIMPVHTVIILRSLWLSKKESTD

SEQ ID NO: 2249160 - protein, 20 aa, Cryptosporidium parvum
YYKQILSEYKLDKSFLHIGS

SEQ ID NO: 2249161 - protein, 24 aa, Cryptosporidium parvum
YYLFFIVIINILILSNGATVPDNR

SEQ ID NO: 2249162 - protein, 17 aa, Cryptosporidium parvum
YYLLFQVNKQIQKEILL

SEQ ID NO: 2249163 - protein, 17 aa, Cryptosporidium parvum
YYLLNIEQYKFTYLQDT

SEQ ID NO: 2249164 - protein, 17 aa, Cryptosporidium parvum
YYLVIALRKSFDLLTRY

SEQ ID NO: 2249165 - protein, 26 aa, Cryptosporidium parvum
YYQSILILLVLFDIFGTLLINQLFNQ

SEQ ID NO: 2249166 - protein, 19 aa, Cryptosporidium parvum
YYREFLAFVYYRCIYGAEG

SEQ ID NO: 2249167 - protein, 27 aa, Cryptosporidium parvum
YYSAMIYLLISILPNRPQLITSIKPFI

SEQ ID NO: 2249168 - protein, 24 aa, Cryptosporidium parvum
AALDYFIWFFLEFFYPKESIEHCI

SEQ ID NO: 2249169 - protein, 23 aa, Cryptosporidium parvum
ACFILIRYFWLAKLIKINKRKYR

SEQ ID NO: 2249170 - protein, 25 aa, Cryptosporidium parvum
AEEMYILLFAFYYSIYQTLKYCKIV

SEQ ID NO: 2249171 - protein, 18 aa, Cryptosporidium parvum
AEIIWILVHSFFSTLTSL

SEQ ID NO: 2249172 - protein, 23 aa, Cryptosporidium parvum
AFEILFYKYRLLIRLILNKERII

SEQ ID NO: 2249173 - protein, 21 aa, Cryptosporidium parvum
AFFALYLICWIFAYVKDLSDW

SEQ ID NO: 2249174 - protein, 27 aa, Cryptosporidium parvum
AGFGILYLFIFHWLIFLPSFVLDEKRI

SEQ ID NO: 2249175 - protein, 29 aa, Cryptosporidium parvum
AGFSLFFQFWFWFPLVHCISLSYVPTCIV

SEQ ID NO: 2249176 - protein, 22 aa, Cryptosporidium parvum
AHIGSLLAWLFQNMAQHVEQDR

SEQ ID NO: 2249177 - protein, 29 aa, Cryptosporidium parvum
AIALVAVIMNPLFSLAFKSSNRLEMRIES

SEQ ID NO: 2249178 - protein, 24 aa, Cryptosporidium parvum
AIGIWRLIRTLFCGILLMFVLFIC

SEQ ID NO: 2249179 - protein, 24 aa, Cryptosporidium parvum
ALELIQICFFLLNGLNVLSVFEEQ

SEQ ID NO: 2249180 - protein, 17 aa, Cryptosporidium parvum
ALIHLLNFLWPNVFENS

SEQ ID NO: 2249181 - protein, 23 aa, Cryptosporidium parvum
ALLILFLMIFLIIEIGIGIYIKL

SEQ ID NO: 2249182 - protein, 25 aa, Cryptosporidium parvum
ALLISVPWMFFPKPLYLIYKSRKQK

SEQ ID NO: 2249183 - protein, 18 aa, Cryptosporidium parvum
ALLKPFIPLFPSYTLIGL

SEQ ID NO: 2249184 - protein, 26 aa, Cryptosporidium parvum
ALLQILHYFLIPMFPLDLVSFNSIFV

SEQ ID NO: 2249185 - protein, 22 aa, Cryptosporidium parvum
ALLSILLIWFMTIMLVYEAIQR

SEQ ID NO: 2249186 - protein, 23 aa, Cryptosporidium parvum
ALTLLIIYLLNKILFWFIVISIF

SEQ ID NO: 2249187 - protein, 25 aa, Cryptosporidium parvum
AMWVLYYYVFPWFLTGIREMQLVST

SEQ ID NO: 2249188 - protein, 25 aa, Cryptosporidium parvum
ANFLLKHPFILLKAKRPNSLGIFIQ

SEQ ID NO: 2249189 - protein, 26 aa, Cryptosporidium parvum
AQFDDLLVRILLGAALMSFFFALIGD

SEQ ID NO: 2249190 - protein, 23 aa, Cryptosporidium parvum
ARNELYFVTIFYGLQFALNRIFQ

SEQ ID NO: 2249191 - protein, 24 aa, Cryptosporidium parvum
ASLIFTLWEFFWFLSVKISRKHAT

SEQ ID NO: 2249192 - protein, 21 aa, Cryptosporidium parvum
ASLLLFCIFVGIAIKTFEGMR

SEQ ID NO: 2249193 - protein, 23 aa, Cryptosporidium parvum
ATFARILLLWWYSIPDIREIQHR

SEQ ID NO: 2249194 - protein, 17 aa, Cryptosporidium parvum
ATFMFFSFALFGLIPML

SEQ ID NO: 2249195 - protein, 18 aa, Cryptosporidium parvum
AVVGALLYYLFRSDSSEN

SEQ ID NO: 2249196 - protein, 28 aa, Cryptosporidium parvum
AYMVMAFLAIYWQSALFSLGLKSSHFWK

SEQ ID NO: 2249197 - protein, 19 aa, Cryptosporidium parvum
CCRITLVTLVFISVSLIIV

SEQ ID NO: 2249198 - protein, 18 aa, Cryptosporidium parvum
CFFLIVCGWVINVFWPFV

SEQ ID NO: 2249199 - protein, 19 aa, Cryptosporidium parvum
CFFVTIFFSISSLFFLLCL

SEQ ID NO: 2249200 - protein, 18 aa, Cryptosporidium parvum
CFGSLFIILFAFICTSCC

SEQ ID NO: 2249201 - protein, 20 aa, Cryptosporidium parvum
CIFECFFEPLLYYKNKHNLP

SEQ ID NO: 2249202 - protein, 23 aa, Cryptosporidium parvum
CIMLQLHYLLFFYKNNKMDFLIN

SEQ ID NO: 2249203 - protein, 17 aa, Cryptosporidium parvum
CLIFSFLITMKLPFNCY

SEQ ID NO: 2249204 - protein, 29 aa, Cryptosporidium parvum
CLIKKLYMELWYNGWLALLKLVQCMNPHK

SEQ ID NO: 2249205 - protein, 19 aa, Cryptosporidium parvum
CNKPMWFVIGFQEDIFLEY

SEQ ID NO: 2249206 - protein, 28 aa, Cryptosporidium parvum
CRNKLLYLVLVIILLWALSFTIVHQLVI

SEQ ID NO: 2249207 - protein, 25 aa, Cryptosporidium parvum
CSFLSFLLVNYYITKWIWGSNLTSS

SEQ ID NO: 2249208 - protein, 18 aa, Cryptosporidium parvum
CSIGIFFLLFLTSNIIWF

SEQ ID NO: 2249209 - protein, 23 aa, Cryptosporidium parvum
CSQIPSYLWYLPSDKIFPFPITS

SEQ ID NO: 2249210 - protein, 19 aa, Cryptosporidium parvum
CTRFDGILLPLRKGYQIDF

SEQ ID NO: 2249211 - protein, 29 aa, Cryptosporidium parvum
CVNRAVFFLHWWLITWPKIPFYANDFVLA

SEQ ID NO: 2249212 - protein, 36 aa, Cryptosporidium parvum
DALRPIWLKIRIVYVIFAILLFFIIGAVYPALFYQS

SEQ ID NO: 2249213 - protein, 25 aa, Cryptosporidium parvum
DAWEIYYLITFIQLSFREIFIIFSQ

SEQ ID NO: 2249214 - protein, 18 aa, Cryptosporidium parvum
DCIYIVFSLIYYSKSRDL

SEQ ID NO: 2249215 - protein, 22 aa, Cryptosporidium parvum
DDFYKNIIFLLRLIALYSEKNE

SEQ ID NO: 2249216 - protein, 24 aa, Cryptosporidium parvum
DDSVAPLLIFKWFDQTTLDITLLS

SEQ ID NO: 2249217 - protein, 25 aa, Cryptosporidium parvum
DEIDLYLQFFIFKRPYLSAFSLVFS

SEQ ID NO: 2249218 - protein, 22 aa, Cryptosporidium parvum
DEKPFFWCEYLRYLNLSRNKFE

SEQ ID NO: 2249219 - protein, 17 aa, Cryptosporidium parvum
DFFFIILISTFLKEVSR

SEQ ID NO: 2249220 - protein, 21 aa, Cryptosporidium parvum
DFLLNILLVLFDLGIERFLGS

SEQ ID NO: 2249221 - protein, 24 aa, Cryptosporidium parvum
DFQDLLWHLIIYSIAPFIVYIYNR

SEQ ID NO: 2249222 - protein, 17 aa, Cryptosporidium parvum
DFYTYLFPKVLLDFSIL

SEQ ID NO: 2249223 - protein, 19 aa, Cryptosporidium parvum
DHQYLFFGIIRMISGPRDK

SEQ ID NO: 2249224 - protein, 18 aa, Cryptosporidium parvum
DIILFWMPFYYLFKLCFL

SEQ ID NO: 2249225 - protein, 30 aa, Cryptosporidium parvum
DILNNYYWKLLLFIIIRRHSLIFFKLNSKS

SEQ ID NO: 2249226 - protein, 26 aa, Cryptosporidium parvum
DIMNSRLILILFSIILIIGWVESSSN

SEQ ID NO: 2249227 - protein, 18 aa, Cryptosporidium parvum
DISLIRIIHFLSVLTFFG

SEQ ID NO: 2249228 - protein, 17 aa, Cryptosporidium parvum
DIVFWLDIILDISNLFK

SEQ ID NO: 2249229 - protein, 26 aa, Cryptosporidium parvum
DIYMLGIIMFWIWSDGGIWKYSDTRQ

SEQ ID NO: 2249230 - protein, 19 aa, Cryptosporidium parvum
DLALFYYRLLQFDYKIARN

SEQ ID NO: 2249231 - protein, 23 aa, Cryptosporidium parvum
DLFIGILLITIFILFVRLFSTFI

SEQ ID NO: 2249232 - protein, 24 aa, Cryptosporidium parvum
DLIRGNNFCFLTLWKKIEELTQQK

SEQ ID NO: 2249233 - protein, 20 aa, Cryptosporidium parvum
DLLIRWFQLGIWFPFYRIHN

SEQ ID NO: 2249234 - protein, 24 aa, Cryptosporidium parvum
DLYGIILNWIITFYFKSIAVHLER

SEQ ID NO: 2249235 - protein, 19 aa, Cryptosporidium parvum
DPIIFPWINDWIFPEISQD

SEQ ID NO: 2249236 - protein, 21 aa, Cryptosporidium parvum
DPLMRFHCFIFGAIYLESAHA

SEQ ID NO: 2249237 - protein, 24 aa, Cryptosporidium parvum
DPNYLLTCFKYLLEKDWIYSIDSI

SEQ ID NO: 2249238 - protein, 18 aa, Cryptosporidium parvum
DQGWWLLALILNVVDLIS

SEQ ID NO: 2249239 - protein, 25 aa, Cryptosporidium parvum
DRIFPYLLTIIVFSASIELPPAPLN

SEQ ID NO: 2249240 - protein, 20 aa, Cryptosporidium parvum
DRLHFYYHYIAELRFNHYQP

SEQ ID NO: 2249241 - protein, 23 aa, Cryptosporidium parvum
DSEDFLLVLVIYSKLWLNGSIAI

SEQ ID NO: 2249242 - protein, 24 aa, Cryptosporidium parvum
DSIWHSLLPLKFSIGWLTCPSILI

SEQ ID NO: 2249243 - protein, 23 aa, Cryptosporidium parvum
DVWSIGVILFILLAGYPPFGGQT

SEQ ID NO: 2249244 - protein, 20 aa, Cryptosporidium parvum
DWVLAFFYRYMQWGFHVAGI

SEQ ID NO: 2249245 - protein, 22 aa, Cryptosporidium parvum
DYNLCFIIKILIYLISNVKDGL

SEQ ID NO: 2249246 - protein, 25 aa, Cryptosporidium parvum
DYSIIRLIHFIFKRALRKFPSDEKL

SEQ ID NO: 2249247 - protein, 23 aa, Cryptosporidium parvum
DYSILLFIMFLFRPFKSLKLFSN

SEQ ID NO: 2249248 - protein, 23 aa, Cryptosporidium parvum
DYYHWWFLCIDIVFSGISISQNS

SEQ ID NO: 2249249 - protein, 19 aa, Cryptosporidium parvum
EAFYKWIQVLYYKVLNNNI

SEQ ID NO: 2249250 - protein, 17 aa, Cryptosporidium parvum
ECENPEYLFPWGNDYLN

SEQ ID NO: 2249251 - protein, 23 aa, Cryptosporidium parvum
ECNSFVDLLLLKRIYRFSQITLD

SEQ ID NO: 2249252 - protein, 23 aa, Cryptosporidium parvum
EDLLLQLDPLVFVKTAIPPTASS

SEQ ID NO: 2249253 - protein, 24 aa, Cryptosporidium parvum
EDNSLLQVPPWANPLLLIAILISV

SEQ ID NO: 2249254 - protein, 30 aa, Cryptosporidium parvum
EEEMNISKFWLLIAIILIYITSLEKDVEEK

SEQ ID NO: 2249255 - protein, 18 aa, Cryptosporidium parvum
EEEVILMMLLFVLLYFTL

SEQ ID NO: 2249256 - protein, 28 aa, Cryptosporidium parvum
EEVGPALFWFITWGLILLCAAGAIVVLT

SEQ ID NO: 2249257 - protein, 19 aa, Cryptosporidium parvum
EGKKFALIYIILALIQLAV

SEQ ID NO: 2249258 - protein, 20 aa, Cryptosporidium parvum
EGLFNFLFLFQKLNGRPTEN

SEQ ID NO: 2249259 - protein, 25 aa, Cryptosporidium parvum
EGMSIIYLYIYWHIQFRAKNERKTP

SEQ ID NO: 2249260 - protein, 20 aa, Cryptosporidium parvum
EIFKKFISYILLFLNVSRTA

SEQ ID NO: 2249261 - protein, 25 aa, Cryptosporidium parvum
EIKPLLIRWIIFVIRLHKFSGLSDE

SEQ ID NO: 2249262 - protein, 21 aa, Cryptosporidium parvum
EILDRNVLFSRLFWLDIAYSE

SEQ ID NO: 2249263 - protein, 21 aa, Cryptosporidium parvum
EITPIPIEKMLDKYTRMIYDY

SEQ ID NO: 2249264 - protein, 19 aa, Cryptosporidium parvum
EIVFLKRPLHYLQNAYLAC

SEQ ID NO: 2249265 - protein, 23 aa, Cryptosporidium parvum
EKLLAFFLLIMAVLILILCLSAI

SEQ ID NO: 2249266 - protein, 18 aa, Cryptosporidium parvum
EKYYLPCQLLITSLGFKP

SEQ ID NO: 2249267 - protein, 19 aa, Cryptosporidium parvum
ELNKKLFPTFLRLSLSPVN

SEQ ID NO: 2249268 - protein, 20 aa, Cryptosporidium parvum
ELQPVLRLLKYWLHIRRLPV

SEQ ID NO: 2249269 - protein, 20 aa, Cryptosporidium parvum
ELRYSLIPYWYTLLAKYSFY

SEQ ID NO: 2249270 - protein, 21 aa, Cryptosporidium parvum
EMIRMFWAMWMHTGFIHIGFN

SEQ ID NO: 2249271 - protein, 20 aa, Cryptosporidium parvum
ENPEYLFPWGNDYLNSCLSF

SEQ ID NO: 2249272 - protein, 22 aa, Cryptosporidium parvum
ENQLILEWFIVLVTKFLISYLN

SEQ ID NO: 2249273 - protein, 20 aa, Cryptosporidium parvum
EPIWRIFLSQFTSLVVSLLL

SEQ ID NO: 2249274 - protein, 19 aa, Cryptosporidium parvum
EQFAKFFWHLLNSIREKYY

SEQ ID NO: 2249275 - protein, 20 aa, Cryptosporidium parvum
EQILKYYVTFSSDSFLYILM

SEQ ID NO: 2249276 - protein, 30 aa, Cryptosporidium parvum
ERDLNILYIVWKLLLYITLGVSIMLCIIQN

SEQ ID NO: 2249277 - protein, 18 aa, Cryptosporidium parvum
ESAKKFLKLLYIQKLWGS

SEQ ID NO: 2249278 - protein, 17 aa, Cryptosporidium parvum
ESKYLWFLPLRNIIRPN

SEQ ID NO: 2249279 - protein, 21 aa, Cryptosporidium parvum
ESTRFLFWIIRHFDLNYLSPT

SEQ ID NO: 2249280 - protein, 21 aa, Cryptosporidium parvum
ETFFFPLKTLLGISLSPIIGL

SEQ ID NO: 2249281 - protein, 22 aa, Cryptosporidium parvum
ETLFIMYMLLISLGWRVLRDSL

SEQ ID NO: 2249282 - protein, 18 aa, Cryptosporidium parvum
ETLYYKFYYYISSAIRPL

SEQ ID NO: 2249283 - protein, 23 aa, Cryptosporidium parvum
EVDKLMIRMIYGSLPSLGCEQLQ

SEQ ID NO: 2249284 - protein, 23 aa, Cryptosporidium parvum
EWKEIIIPLLPLILTYYYDSIDE

SEQ ID NO: 2249285 - protein, 19 aa, Cryptosporidium parvum
FAIFLVVFLNFLGLQTFFN

SEQ ID NO: 2249286 - protein, 21 aa, Cryptosporidium parvum
FCIYRPLIKTLWRPTLEALLL

SEQ ID NO: 2249287 - protein, 19 aa, Cryptosporidium parvum
FDSNFWLFLKRVCTRILEC

SEQ ID NO: 2249288 - protein, 24 aa, Cryptosporidium parvum
FEKLQPFIFILYNDVSWRIRSNVS

SEQ ID NO: 2249289 - protein, 17 aa, Cryptosporidium parvum
FFFFFFFLTEKKGIGYL

SEQ ID NO: 2249290 - protein, 24 aa, Cryptosporidium parvum
FFKNRYFWIISCLFTILFKTNNII

SEQ ID NO: 2249291 - protein, 20 aa, Cryptosporidium parvum
FFLWALFLFIINFDNSNETK

SEQ ID NO: 2249292 - protein, 17 aa, Cryptosporidium parvum
FFQYRYIFRIYSSLATN

SEQ ID NO: 2249293 - protein, 17 aa, Cryptosporidium parvum
FFVIIVHFISFSIGEQQ

SEQ ID NO: 2249294 - protein, 19 aa, Cryptosporidium parvum
FFWGMIIILFFLTSTLPMS

SEQ ID NO: 2249295 - protein, 22 aa, Cryptosporidium parvum
FFYFILFYLFHFIFEEKKTIET

SEQ ID NO: 2249296 - protein, 26 aa, Cryptosporidium parvum
FGFEILKVLFPWKWISWLPTISQLLL

SEQ ID NO: 2249297 - protein, 25 aa, Cryptosporidium parvum
FHIMGWIFCFFLDKTWFYFPYIGIC

SEQ ID NO: 2249298 - protein, 18 aa, Cryptosporidium parvum
FHSSLFPGLYLTGSRTSD

SEQ ID NO: 2249299 - protein, 22 aa, Cryptosporidium parvum
FIEPIVILFILVLNAFVGVWQE

SEQ ID NO: 2249300 - protein, 20 aa, Cryptosporidium parvum
FIFIIYFFALFFNNISQIKA

SEQ ID NO: 2249301 - protein, 19 aa, Cryptosporidium parvum
FIFLLFCILFALLAKNAAQ

SEQ ID NO: 2249302 - protein, 24 aa, Cryptosporidium parvum
FIFVYLFVILQIYIKFEFAGANSV

SEQ ID NO: 2249303 - protein, 20 aa, Cryptosporidium parvum
FIIKFRLPIDPHILSYYLKE

SEQ ID NO: 2249304 - protein, 19 aa, Cryptosporidium parvum
FIIKKYINWFLIPAADIFG

SEQ ID NO: 2249305 - protein, 18 aa, Cryptosporidium parvum
FIIRNYLNGTLALILTWL

SEQ ID NO: 2249306 - protein, 26 aa, Cryptosporidium parvum
FIIWILQWYFFVLLVILMAGRIYGES

SEQ ID NO: 2249307 - protein, 18 aa, Cryptosporidium parvum
FILLSYQLTHFLLFFIFI

SEQ ID NO: 2249308 - protein, 17 aa, Cryptosporidium parvum
FIMALIQFILLPCRIFV

SEQ ID NO: 2249309 - protein, 17 aa, Cryptosporidium parvum
FINSVVSGLYLMLWRFL

SEQ ID NO: 2249310 - protein, 17 aa, Cryptosporidium parvum
FIQIWRNLRLLYIEDNI

SEQ ID NO: 2249311 - protein, 26 aa, Cryptosporidium parvum
FISLWLECFFLCFFYRSTKSSFEQFF

SEQ ID NO: 2249312 - protein, 19 aa, Cryptosporidium parvum
FISRIIFAIWITTTLSLNF

SEQ ID NO: 2249313 - protein, 17 aa, Cryptosporidium parvum
FIVYWDLYGIILNWIIT

SEQ ID NO: 2249314 - protein, 26 aa, Cryptosporidium parvum
FKEPIGEPLLWNYIIQIVLALVHIHS

SEQ ID NO: 2249315 - protein, 19 aa, Cryptosporidium parvum
FKFPQLLYRRIISILPIMF

SEQ ID NO: 2249316 - protein, 19 aa, Cryptosporidium parvum
FKICLLLNFLIISGVLSIL

SEQ ID NO: 2249317 - protein, 23 aa, Cryptosporidium parvum
FKIFIWLCMYAHDPHIYNGVLAY

SEQ ID NO: 2249318 - protein, 32 aa, Cryptosporidium parvum
FKKISVIFLFIIVILLFLNFELLYASDAKESE

SEQ ID NO: 2249319 - protein, 22 aa, Cryptosporidium parvum
FLATFFLFGILNALQIHESVTS

SEQ ID NO: 2249320 - protein, 18 aa, Cryptosporidium parvum
FLCIVLLKLAQNGMLATD

SEQ ID NO: 2249321 - protein, 17 aa, Cryptosporidium parvum
FLCLSILLALVVLIDFI

SEQ ID NO: 2249322 - protein, 31 aa, Cryptosporidium parvum
FLGAYTIFGSLLTALLLLSIATFHGRQYAEK

SEQ ID NO: 2249323 - protein, 29 aa, Cryptosporidium parvum
FLILKLGHLLLFLLILKLLVYIYTKWTKT

SEQ ID NO: 2249324 - protein, 18 aa, Cryptosporidium parvum
FLINIIWAFLWALDSNYL

SEQ ID NO: 2249325 - protein, 24 aa, Cryptosporidium parvum
FLISFLVFIPFLIVILIKRLNNHS

SEQ ID NO: 2249326 - protein, 18 aa, Cryptosporidium parvum
FLKFFIQEIFLSLGILIG

SEQ ID NO: 2249327 - protein, 20 aa, Cryptosporidium parvum
FLLVGSGLYIHYFFRRNKRL

SEQ ID NO: 2249328 - protein, 17 aa, Cryptosporidium parvum
FLLVVTIIVYFNNLMFN

SEQ ID NO: 2249329 - protein, 24 aa, Cryptosporidium parvum
FLSQLNPLCLLLFALEITKLSGSH

SEQ ID NO: 2249330 - protein, 19 aa, Cryptosporidium parvum
FLVIFGFIQFLKFKGPKAA

SEQ ID NO: 2249331 - protein, 31 aa, Cryptosporidium parvum
FMLSKSFLFKILLLVLNLIPVTLLTLGVYLI

SEQ ID NO: 2249332 - protein, 19 aa, Cryptosporidium parvum
FPFIFYYLEFIESFNLPHI

SEQ ID NO: 2249333 - protein, 21 aa, Cryptosporidium parvum
FPIDPISYLPFAKNGELIDPI

SEQ ID NO: 2249334 - protein, 22 aa, Cryptosporidium parvum
FPSLLIWVRFFHQTILKNQETK

SEQ ID NO: 2249335 - protein, 25 aa, Cryptosporidium parvum
FPVLYPILTFFIFSLTVFYLVETGP

SEQ ID NO: 2249336 - protein, 27 aa, Cryptosporidium parvum
FPYFTPFFLIWIMLIIKPICLKFISSY

SEQ ID NO: 2249337 - protein, 21 aa, Cryptosporidium parvum
FQFFVLYIFIQFTSVLYLYSK

SEQ ID NO: 2249338 - protein, 20 aa, Cryptosporidium parvum
FRPQIMPIILKWSKGESFAS

SEQ ID NO: 2249339 - protein, 18 aa, Cryptosporidium parvum
FSFFFFHLWLVFNSMTTI

SEQ ID NO: 2249340 - protein, 23 aa, Cryptosporidium parvum
FSGIPLFMIFVQSNNLILSSRSY

SEQ ID NO: 2249341 - protein, 27 aa, Cryptosporidium parvum
FSIFTYSVFILFILLTILSLNTLFENK

SEQ ID NO: 2249342 - protein, 18 aa, Cryptosporidium parvum
FSILCLVFWYNLMKVTNV

SEQ ID NO: 2249343 - protein, 25 aa, Cryptosporidium parvum
FSIYIIFYIIFFYIQVVYSLYSNLS

SEQ ID NO: 2249344 - protein, 18 aa, Cryptosporidium parvum
FSLIYLYSYLFFDQNTGY

SEQ ID NO: 2249345 - protein, 20 aa, Cryptosporidium parvum
FSSPLFLCLSILLALVVLID

SEQ ID NO: 2249346 - protein, 18 aa, Cryptosporidium parvum
FTIWYLNGFLRACLFRKL

SEQ ID NO: 2249347 - protein, 22 aa, Cryptosporidium parvum
FTMNWIMFIVPFALAIIIGIPI

SEQ ID NO: 2249348 - protein, 36 aa, Cryptosporidium parvum; identical to SEQ ID NO: 2134564

SEQ ID NO: 2249349 - protein, 18 aa, Cryptosporidium parvum
FVLLAYFLNVFGVKDAMD

SEQ ID NO: 2249350 - protein, 17 aa, Cryptosporidium parvum
FVRFLIIGLYVGIATVG

SEQ ID NO: 2249351 - protein, 24 aa, Cryptosporidium parvum
FVSIYLMFLMRNFWDQVLLNTDKS

SEQ ID NO: 2249352 - protein, 23 aa, Cryptosporidium parvum
FVYFLDLNYIWVLRLGFDPFRSK

SEQ ID NO: 2249353 - protein, 17 aa, Cryptosporidium parvum
FWHLLNSIREKYYPEKS

SEQ ID NO: 2249354 - protein, 18 aa, Cryptosporidium parvum
FWYIFLLIPIYIIYKIGK

SEQ ID NO: 2249355 - protein, 17 aa, Cryptosporidium parvum
FYAFPKLYQAFVLIDLY

SEQ ID NO: 2249356 - protein, 27 aa, Cryptosporidium parvum
FYGHLYFIFALLLIGVSFYFALDRLNK

SEQ ID NO: 2249357 - protein, 18 aa, Cryptosporidium parvum
FYGIPIIKPLFWLNQKDF

SEQ ID NO: 2249358 - protein, 17 aa, Cryptosporidium parvum
FYGYSLLSLSAIVLFSG

SEQ ID NO: 2249359 - protein, 22 aa, Cryptosporidium parvum
FYLLLLFIFGFIVKIQAAEGGE

SEQ ID NO: 2249360 - protein, 17 aa, Cryptosporidium parvum
FYYRLLQFDYKIARNII

SEQ ID NO: 2249361 - protein, 22 aa, Cryptosporidium parvum
GDIVHLGYFFTDGHLLICIGDT

SEQ ID NO: 2249362 - protein, 25 aa, Cryptosporidium parvum
GFFPVKFFPILFFSITINNGLFSRN

SEQ ID NO: 2249363 - protein, 20 aa, Cryptosporidium parvum
GFWILSSMFFICFSLVYGTK

SEQ ID NO: 2249364 - protein, 22 aa, Cryptosporidium parvum
GGDYLLFFLYLSLNLEDLKEFY

SEQ ID NO: 2249365 - protein, 22 aa, Cryptosporidium parvum
GGLPCIVWLLLAIVHCSVNGNK

SEQ ID NO: 2249366 - protein, 24 aa, Cryptosporidium parvum
GGQKTLVALAFLFALHRADPAPMY

SEQ ID NO: 2249367 - protein, 22 aa, Cryptosporidium parvum
GGYYYYYNFYPPPPPMQPEPFP

SEQ ID NO: 2249368 - protein, 21 aa, Cryptosporidium parvum
GHLFFEIFPFLSGIENMILKQ

SEQ ID NO: 2249369 - protein, 20 aa, Cryptosporidium parvum
GIAFRIPFKWLPSASEKLSF

SEQ ID NO: 2249370 - protein, 25 aa, Cryptosporidium parvum
GIIFTILILSLLISAPILGLLAVAI

SEQ ID NO: 2249371 - protein, 22 aa, Cryptosporidium parvum
GIKSFYIGSFLRALWLTIGGII

SEQ ID NO: 2249372 - protein, 24 aa, Cryptosporidium parvum
GISIPLFLLYFGLALQKIPLTPNY

SEQ ID NO: 2249373 - protein, 24 aa, Cryptosporidium parvum
GIYFDPLWFIDLPFMYNNAWWDSY

SEQ ID NO: 2249374 - protein, 24 aa, Cryptosporidium parvum
GIYKEFLVILPWFLDTTIKMQKET

SEQ ID NO: 2249375 - protein, 23 aa, Cryptosporidium parvum
  misc_feature (21)..(21): Xaa can be any naturally occurring amino acid
GKFYLFYLFIYYYYFFFFTIXLG

SEQ ID NO: 2249376 - protein, 19 aa, Cryptosporidium parvum
GKLWLLWYVSFKQKDCQMR

SEQ ID NO: 2249377 - protein, 20 aa, Cryptosporidium parvum
GLGKLYWYLTILGLLSYSVI

SEQ ID NO: 2249378 - protein, 23 aa, Cryptosporidium parvum
GLIKLILVLNYKVAVPIPNLRKV

SEQ ID NO: 2249379 - protein, 21 aa, Cryptosporidium parvum
GLLFKYIVLFDLLIMFLILTI

SEQ ID NO: 2249380 - protein, 17 aa, Cryptosporidium parvum
GLYIYNGLILDFKILYK

SEQ ID NO: 2249381 - protein, 24 aa, Cryptosporidium parvum
GSKLFFELLFQLYNFLYTSVPPII

SEQ ID NO: 2249382 - protein, 25 aa, Cryptosporidium parvum
GSLILFIFLVYILLAIILAIIHFII

SEQ ID NO: 2249383 - protein, 25 aa, Cryptosporidium parvum
GSVRSQWDFLLQEMTWMSKDYYEER

SEQ ID NO: 2249384 - protein, 22 aa, Cryptosporidium parvum
GTAYRWLFVRLEIMGCIAVFTA

SEQ ID NO: 2249385 - protein, 22 aa, Cryptosporidium parvum
GTEFLLNILQWLSSMPFSNVPI

SEQ ID NO: 2249386 - protein, 26 aa, Cryptosporidium parvum
GVIEIPYLYFWIYPLSIHLDIDTIKE

SEQ ID NO: 2249387 - protein, 18 aa, Cryptosporidium parvum
GVYPLLPYFGLKADFSKK

SEQ ID NO: 2249388 - protein, 21 aa, Cryptosporidium parvum
HAIKIFPITFLPSIKILEIGL

SEQ ID NO: 2249389 - protein, 29 aa, Cryptosporidium parvum
HARIVLVIALFIIIFMLKQGMFGDWTRFG

SEQ ID NO: 2249390 - protein, 17 aa, Cryptosporidium parvum
HFDLYFPTKIDLLNISS

SEQ ID NO: 2249391 - protein, 18 aa, Cryptosporidium parvum
HFFLQVVILLSINGISLG

SEQ ID NO: 2249392 - protein, 26 aa, Cryptosporidium parvum
HFLVSSYTLPIIWLLKSMNLSDSISI

SEQ ID NO: 2249393 - protein, 24 aa, Cryptosporidium parvum
HIKNIFMFLPYKFLTKMKKSIDLI

SEQ ID NO: 2249394 - protein, 17 aa, Cryptosporidium parvum
HKSWYRFWEKKPKYVHK

SEQ ID NO: 2249395 - protein, 20 aa, Cryptosporidium parvum
HLFKIPMNYLPYIPKDTGES

SEQ ID NO: 2249396 - protein, 28 aa, Cryptosporidium parvum
HLKREWHRLWLVRSFLAFAWESYLEDLM

SEQ ID NO: 2249397 - protein, 20 aa, Cryptosporidium parvum
HLTLIIIYLISTLNLIKKKK

SEQ ID NO: 2249398 - protein, 21 aa, Cryptosporidium parvum
HLVFLMWIVLSLIFTLYSKWL

SEQ ID NO: 2249399 - protein, 22 aa, Cryptosporidium parvum
HNWRPIFITSLILSDKLWDDSC

SEQ ID NO: 2249400 - protein, 28 aa, Cryptosporidium parvum
HSCLIFGLVRLLWNIVFILYGATSLVNI

SEQ ID NO: 2249401 - protein, 23 aa, Cryptosporidium parvum
HSIIQMIIILPYIFEKLLLIIEL

SEQ ID NO: 2249402 - protein, 17 aa, Cryptosporidium parvum
HSRKLFYQVYRPSILIF

SEQ ID NO: 2249403 - protein, 24 aa, Cryptosporidium parvum
ICFDIFFYIFNWKSIPKMGMAIEM

SEQ ID NO: 2249404 - protein, 22 aa, Cryptosporidium parvum
ICFLWLTILVELFWFNKESRKN

SEQ ID NO: 2249405 - protein, 21 aa, Cryptosporidium parvum
IDKFLLLFEMLGIILSIPDSS

SEQ ID NO: 2249406 - protein, 21 aa, Cryptosporidium parvum
IDLIFQLLFGFSKHSFGASSV

SEQ ID NO: 2249407 - protein, 23 aa, Cryptosporidium parvum
IDPYSLWMLVDYRWGWPLVNSYF

SEQ ID NO: 2249408 - protein, 24 aa, Cryptosporidium parvum
IEEETLFLFLFFLSYLPSTNNSNS

SEQ ID NO: 2249409 - protein, 18 aa, Cryptosporidium parvum
IERFWLLNPFHFSINISN

SEQ ID NO: 2249410 - protein, 17 aa, Cryptosporidium parvum
IESLIICYLILSGNTDE

SEQ ID NO: 2249411 - protein, 17 aa, Cryptosporidium parvum
IESYLMIFLLILPPIMV

SEQ ID NO: 2249412 - protein, 20 aa, Cryptosporidium parvum
IEYYGIPKLFPIYIFTSKYT

SEQ ID NO: 2249413 - protein, 20 aa, Cryptosporidium parvum
IFESNLIAIPLFMPCNGRVA

SEQ ID NO: 2249414 - protein, 20 aa, Cryptosporidium parvum
IFFLFINFLFLFENVTDNFL

SEQ ID NO: 2249415 - protein, 20 aa, Cryptosporidium parvum
IFFLVFAISALNVNSQELIL

SEQ ID NO: 2249416 - protein, 18 aa, Cryptosporidium parvum
IFGLTFILILVFILSYYS

SEQ ID NO: 2249417 - protein, 20 aa, Cryptosporidium parvum
IFIGIFIWILIKSKFHRDKV

SEQ ID NO: 2249418 - protein, 21 aa, Cryptosporidium parvum
IFISFLVLYISYFYSFEESNE

SEQ ID NO: 2249419 - protein, 24 aa, Cryptosporidium parvum
IFLFLFALRFYFWVRGRFSFNVGS

SEQ ID NO: 2249420 - protein, 17 aa, Cryptosporidium parvum
IFLICIYTLNLDVAEGF

SEQ ID NO: 2249421 - protein, 18 aa, Cryptosporidium parvum
IFLIFLILVIYNFYRKRL

SEQ ID NO: 2249422 - protein, 21 aa, Cryptosporidium parvum
IFLMMLIFCSLIASSYVLYYG

SEQ ID NO: 2249423 - protein, 18 aa, Cryptosporidium parvum
IFNFCKWYNIISTSNISI

SEQ ID NO: 2249424 - protein, 17 aa, Cryptosporidium parvum
IFQDLIPLPLPWTHPQK

SEQ ID NO: 2249425 - protein, 20 aa, Cryptosporidium parvum
IFSWWYRFILSTPSRVFNTG

SEQ ID NO: 2249426 - protein, 18 aa, Cryptosporidium parvum
IGGWLPPPVAIPCPSHAP

SEQ ID NO: 2249427 - protein, 23 aa, Cryptosporidium parvum
IGNPWLVFVPLFKKYDVWTSYIL

SEQ ID NO: 2249428 - protein, 22 aa, Cryptosporidium parvum
IGRIYFLIFLLVCILKIGVTKS

SEQ ID NO: 2249429 - protein, 23 aa, Cryptosporidium parvum
IGYLNFLIFFKWLTPIEGYNKPS

SEQ ID NO: 2249430 - protein, 27 aa, Cryptosporidium parvum
IIAVIFGCVSKYYFFDKIVLTEENLPN

SEQ ID NO: 2249431 - protein, 20 aa, Cryptosporidium parvum
IIAVYYFKHPWFLKSWKFVN

SEQ ID NO: 2249432 - protein, 24 aa, Cryptosporidium parvum
IIFTYLYVFLFMFPILCLDAKREA

SEQ ID NO: 2249433 - protein, 22 aa, Cryptosporidium parvum
IIIIDFIFRRFGALTLFDNITN

SEQ ID NO: 2249434 - protein, 18 aa, Cryptosporidium parvum
IIIVFITLYIIFGIIFVI

SEQ ID NO: 2249435 - protein, 24 aa, Cryptosporidium parvum
IILDPYLLLRFIKLSFEELKAGIL

SEQ ID NO: 2249436 - protein, 18 aa, Cryptosporidium parvum
IILFVIPLAFIIYYRRQK

SEQ ID NO: 2249437 - protein, 19 aa, Cryptosporidium parvum
IILKRWIYYLFYSTLSWFS

SEQ ID NO: 2249438 - protein, 18 aa, Cryptosporidium parvum
IILLDYLVTWILINVSVF

SEQ ID NO: 2249439 - protein, 19 aa, Cryptosporidium parvum
IILLLLFINFLFLFENITD

SEQ ID NO: 2249440 - protein, 24 aa, Cryptosporidium parvum
IIMIWGFLLFILATILYCTFSVVY

SEQ ID NO: 2249441 - protein, 18 aa, Cryptosporidium parvum
IIPYIRRAPFGSLYPIHL

SEQ ID NO: 2249442 - protein, 19 aa, Cryptosporidium parvum
IISMIYLIKLFIFRVNNEI

SEQ ID NO: 2249443 - protein, 31 aa, Cryptosporidium parvum; identical to SEQ ID NO: 2134625

SEQ ID NO: 2249444 - protein, 24 aa, Cryptosporidium parvum
IISTLPFWPYLPKKFLFSIIDQVL

SEQ ID NO: 2249445 - protein, 24 aa, Cryptosporidium parvum
IITFIWKPLYYLLTFFTFNFILKA

SEQ ID NO: 2249446 - protein, 19 aa, Cryptosporidium parvum
IIYFISSLIFIYYGIDFEL

SEQ ID NO: 2249447 - protein, 18 aa, Cryptosporidium parvum
IIYFLRKLSKFTGVVWSC

SEQ ID NO: 2249448 - protein, 19 aa, Cryptosporidium parvum
IIYQLPLALIFYSFAIYLL

SEQ ID NO: 2249449 - protein, 24 aa, Cryptosporidium parvum
IKEKLKIMYLIRLYTLFLDFQGKF

SEQ ID NO: 2249450 - protein, 21 aa, Cryptosporidium parvum
IKLIRIIFSIFTYSVFILFIL

SEQ ID NO: 2249451 - protein, 27 aa, Cryptosporidium parvum
IKTYLFWALFIYFSISSSLLVYMMLKV

SEQ ID NO: 2249452 - protein, 17 aa, Cryptosporidium parvum
ILCTQNIYFWIISLERI

SEQ ID NO: 2249453 - protein, 24 aa, Cryptosporidium parvum
ILEYYLLVIILAKLFFIFSRKMLS

SEQ ID NO: 2249454 - protein, 20 aa, Cryptosporidium parvum
ILFLFVCCIIFRILGDHSEI

SEQ ID NO: 2249455 - protein, 19 aa, Cryptosporidium parvum
ILFTILLIKSLTILSPSSI

SEQ ID NO: 2249456 - protein, 18 aa, Cryptosporidium parvum
ILLGYYMIALGNRGLFRT

SEQ ID NO: 2249457 - protein, 28 aa, Cryptosporidium parvum
ILLLLLILLVFLLILFSGGITIGQMAPP

SEQ ID NO: 2249458 - protein, 19 aa, Cryptosporidium parvum
ILLQIYIVQKYVICSKLTH

SEQ ID NO: 2249459 - protein, 25 aa, Cryptosporidium parvum
ILLTSIIYILLWAIISYLKVFYIKN

SEQ ID NO: 2249460 - protein, 17 aa, Cryptosporidium parvum
ILLWLRFGEIPLEGKIS

SEQ ID NO: 2249461 - protein, 18 aa, Cryptosporidium parvum
ILNIFYKLIVVFSIIIHS

SEQ ID NO: 2249462 - protein, 18 aa, Cryptosporidium parvum
ILPPFIMDIYIYAKIRFQ

SEQ ID NO: 2249463 - protein, 17 aa, Cryptosporidium parvum
ILPPIRIYELWKGTPMD

SEQ ID NO: 2249464 - protein, 18 aa, Cryptosporidium parvum
ILPPLMALVPRAFRYRQG

SEQ ID NO: 2249465 - protein, 18 aa, Cryptosporidium parvum
ILPRFYRYLGLYYSLICI

SEQ ID NO: 2249466 - protein, 17 aa, Cryptosporidium parvum
ILRPIWILGVLFSCILN

SEQ ID NO: 2249467 - protein, 17 aa, Cryptosporidium parvum
ILTFFIWIVISQIYEEI

SEQ ID NO: 2249468 - protein, 18 aa, Cryptosporidium parvum
ILTIPIYFLLLRDQERAT

SEQ ID NO: 2249469 - protein, 19 aa, Cryptosporidium parvum
ILYFTYFVCIFLAILSVIA

SEQ ID NO: 2249470 - protein, 21 aa, Cryptosporidium parvum
INFHIIPWKGILRWIDSWEGV

SEQ ID NO: 2249471 - protein, 24 aa, Cryptosporidium parvum
INFNYIMLPSYYLWGNIYSILGQW

SEQ ID NO: 2249472 - protein, 24 aa, Cryptosporidium parvum
INKCPFLALLLLYISSHRRHLKER

SEQ ID NO: 2249473 - protein, 24 aa, Cryptosporidium parvum
INMIFNFLMIDLFFIRYFELKILN

SEQ ID NO: 2249474 - protein, 27 aa, Cryptosporidium parvum
INTIWAIFRVQFLVLLLFLNNLACENE

SEQ ID NO: 2249475 - protein, 18 aa, Cryptosporidium parvum
IPICIFLSLYKCKIKIIY

SEQ ID NO: 2249476 - protein, 25 aa, Cryptosporidium parvum
IPIGFLFLLFIYWNYLSYFINTCRT

SEQ ID NO: 2249477 - protein, 18 aa, Cryptosporidium parvum
IPVTLLTLGVYLIIAEIW

SEQ ID NO: 2249478 - protein, 18 aa, Cryptosporidium parvum
IPVWLYPYRILPMMFKDI

SEQ ID NO: 2249479 - protein, 24 aa, Cryptosporidium parvum
IQILPVLLMLFLAIMGNFMPTLFP

SEQ ID NO: 2249480 - protein, 24 aa, Cryptosporidium parvum
IQKYFYFLIIFLSSIFHLKVDQMY

SEQ ID NO: 2249481 - protein, 26 aa, Cryptosporidium parvum
IQLSNLMFNYWYLKILLIIIERIGMD

SEQ ID NO: 2249482 - protein, 17 aa, Cryptosporidium parvum
IRILFIVPIIFSLILSL

SEQ ID NO: 2249483 - protein, 25 aa, Cryptosporidium parvum
IRILNLFFILLLVIPFIYITTSGAC

SEQ ID NO: 2249484 - protein, 27 aa, Cryptosporidium parvum
IRISMRILLLFLFALIFSISSINGSNL

SEQ ID NO: 2249485 - protein, 18 aa, Cryptosporidium parvum
IRKLNILPPIRIYELWKG

SEQ ID NO: 2249486 - protein, 21 aa, Cryptosporidium parvum
IRLIFNIIIVFITLYIIFGII

SEQ ID NO: 2249487 - protein, 18 aa, Cryptosporidium parvum
ISIILFYIDIFQSFPYVN

SEQ ID NO: 2249488 - protein, 23 aa, Cryptosporidium parvum
ISLLILYFLIFLGNVKSSPTVTK

SEQ ID NO: 2249489 - protein, 18 aa, Cryptosporidium parvum
ISLLPYYLKISWYIYYLS

SEQ ID NO: 2249490 - protein, 20 aa, Cryptosporidium parvum
ISLWKTIFPWIWNNLEHQQR

SEQ ID NO: 2249491 - protein, 23 aa, Cryptosporidium parvum
ISTCIFIFFILYIVLNALSRNKE

SEQ ID NO: 2249492 - protein, 23 aa, Cryptosporidium parvum
ISYQFLFLIYRKILISKTKYLVI

SEQ ID NO: 2249493 - protein, 17 aa, Cryptosporidium parvum
ITINFHIIPWKGILRWI

SEQ ID NO: 2249494 - protein, 23 aa, Cryptosporidium parvum
ITLLPIIFFLIQSIHFHITQRSK

SEQ ID NO: 2249495 - protein, 22 aa, Cryptosporidium parvum
ITPQFLFFIPPIFYAFYCVAKK

SEQ ID NO: 2249496 - protein, 23 aa, Cryptosporidium parvum
ITSPPWWMVWQSQFYPRLSIEKN

SEQ ID NO: 2249497 - protein, 17 aa, Cryptosporidium parvum
IVFLYFILRIITSFTRL

SEQ ID NO: 2249498 - protein, 20 aa, Cryptosporidium parvum
IVHWIIIFLCILHMAIFLAI

SEQ ID NO: 2249499 - protein, 22 aa, Cryptosporidium parvum
IVLFLIIFFYISSFLCVSSDSK

SEQ ID NO: 2249500 - protein, 20 aa, Cryptosporidium parvum
IVLIGLIIFFITKSRSNNSQ

SEQ ID NO: 2249501 - protein, 21 aa, Cryptosporidium parvum
IVSLYIIFWTVLLPVFYGIYG

SEQ ID NO: 2249502 - protein, 21 aa, Cryptosporidium parvum
IVWTIFLGIIVLFFHLIYKYL

SEQ ID NO: 2249503 - protein, 21 aa, Cryptosporidium parvum
IVYAPFWFFYINSVGKILSRF

SEQ ID NO: 2249504 - protein, 22 aa, Cryptosporidium parvum
IWFEYFCLILWRLLPIFEQSIP

SEQ ID NO: 2249505 - protein, 30 aa, Cryptosporidium parvum
IYIPSAVRYIILLLLWTIFTKNVYSKSSEE

SEQ ID NO: 2249506 - protein, 19 aa, Cryptosporidium parvum
IYITYYQLFHPPLIIRTGK

SEQ ID NO: 2249507 - protein, 18 aa, Cryptosporidium parvum
IYIYRIYTDKYKRKIIKR

SEQ ID NO: 2249508 - protein, 28 aa, Cryptosporidium parvum
IYKFKWVLIYLILLIFSAYIQLNCVGCY

SEQ ID NO: 2249509 - protein, 17 aa, Cryptosporidium parvum
IYSLMWFVRLYFTVNMK

SEQ ID NO: 2249510 - protein, 21 aa, Cryptosporidium parvum
IYYTWFMFGFYWILSVRPNVE

SEQ ID NO: 2249511 - protein, 23 aa, Cryptosporidium parvum
KAGHWYFLIFTTLIASIVTIAIL

SEQ ID NO: 2249512 - protein, 28 aa, Cryptosporidium parvum
KANSFFFFSWIFMVILPLLISLTYRFGS

SEQ ID NO: 2249513 - protein, 22 aa, Cryptosporidium parvum
KASCILPKLPEAFLFLSKKEDQ

SEQ ID NO: 2249514 - protein, 25 aa, Cryptosporidium parvum
KATKYIFIYMIFALLLKKLEDNSHK

SEQ ID NO: 2249515 - protein, 23 aa, Cryptosporidium parvum
KCFIVFAMNIFLKPYKHLLTNSS

SEQ ID NO: 2249516 - protein, 32 aa, Cryptosporidium parvum
KCITTKLLLLFYKYIILLLRFISIFDLSDAKD

SEQ ID NO: 2249517 - protein, 23 aa, Cryptosporidium parvum
KDDSVYEIFKWIDSLALDKNNLI

SEQ ID NO: 2249518 - protein, 22 aa, Cryptosporidium parvum
KDKLIPFHIFLQTSIFMSTELE

SEQ ID NO: 2249519 - protein, 23 aa, Cryptosporidium parvum
KEGLHLYIFLGLAALGLVRSNLH

SEQ ID NO: 2249520 - protein, 20 aa, Cryptosporidium parvum
KELLLLLRKYIRTNGSCLQS

SEQ ID NO: 2249521 - protein, 24 aa, Cryptosporidium parvum
KEQGQVIFLLLFLSLKLITNHKHF

SEQ ID NO: 2249522 - protein, 27 aa, Cryptosporidium parvum
KERNILRYFYLKLFLFVYKLSIGLANK

SEQ ID NO: 2249523 - protein, 28 aa, Cryptosporidium parvum
KEYYLLFDFVIFLFYIINAYKSAVEKLD

SEQ ID NO: 2249524 - protein, 26 aa, Cryptosporidium parvum
KFCFLYILYFFTFYFSMVVTISLRSP

SEQ ID NO: 2249525 - protein, 20 aa, Cryptosporidium parvum
KFHLNICNLPRPAFSRPVLR

SEQ ID NO: 2249526 - protein, 18 aa, Cryptosporidium parvum
KFIVFINFISFLSIITKI

SEQ ID NO: 2249527 - protein, 23 aa, Cryptosporidium parvum
KFKHIYLCLIFIATFIGYIFCSE

SEQ ID NO: 2249528 - protein, 25 aa, Cryptosporidium parvum
KFLICIPVLAYLFFQVSKKYAPMLR

SEQ ID NO: 2249529 - protein, 18 aa, Cryptosporidium parvum
KFLKLLYIQKLWGSNVSK

SEQ ID NO: 2249530 - protein, 17 aa, Cryptosporidium parvum
KFWLKLRKEAIGWFIYT

SEQ ID NO: 2249531 - protein, 24 aa, Cryptosporidium parvum
KHEKMLFLMVLWIKHYLSNKVENK

SEQ ID NO: 2249532 - protein, 21 aa, Cryptosporidium parvum
KHFLLFLAYVFLFCAYSLILI

SEQ ID NO: 2249533 - protein, 22 aa, Cryptosporidium parvum
KHIFYFLSFFFFILSIFLFERS

SEQ ID NO: 2249534 - protein, 18 aa, Cryptosporidium parvum
KHRMLFVSFLVLGLALVT

SEQ ID NO: 2249535 - protein, 26 aa, Cryptosporidium parvum
KIFSLIFFFFNILNLLNGEEIDNKSL

SEQ ID NO: 2249536 - protein, 18 aa, Cryptosporidium parvum
KIGQFFYGKRLYSLLSGN

SEQ ID NO: 2249537 - protein, 20 aa, Cryptosporidium parvum
KIIVIIIWLGFLGVSIYGFT

SEQ ID NO: 2249538 - protein, 21 aa, Cryptosporidium parvum
KILRLISLIFSLFILGFIITS

SEQ ID NO: 2249539 - protein, 19 aa, Cryptosporidium parvum
KISFIIIIWCPLIIINYSN

SEQ ID NO: 2249540 - protein, 17 aa, Cryptosporidium parvum
KITFLKKLFSRISNDDV

SEQ ID NO: 2249541 - protein, 26 aa, Cryptosporidium parvum
KKFSSILRFLVILAAFISLLVLIKLP

SEQ ID NO: 2249542 - protein, 25 aa, Cryptosporidium parvum
KKFTLFYFFFRWITYYVEMEIAANY

SEQ ID NO: 2249543 - protein, 21 aa, Cryptosporidium parvum
KKILKFNIYIYRIYTDKYKRK

SEQ ID NO: 2249544 - protein, 27 aa, Cryptosporidium parvum
KKLTILIHLFIIYFLVIYNNEWNSLDS

SEQ ID NO: 2249545 - protein, 31 aa, Cryptosporidium parvum
KKSHWGVFWYILPIILILFSSGAGFAYYYYL

SEQ ID NO: 2249546 - protein, 25 aa, Cryptosporidium parvum
KKSSLFIILLMLIMAIFQVCNYSGF

SEQ ID NO: 2249547 - protein, 27 aa, Cryptosporidium parvum
KLGLNIQLFWFLRLNSLKFDFVSDNNS

SEQ ID NO: 2249548 - protein, 33 aa, Cryptosporidium parvum; identical to SEQ ID NO: 2134689

SEQ ID NO: 2249549 - protein, 23 aa, Cryptosporidium parvum
KLKNMFYIFILSASIYFFKKEIK

SEQ ID NO: 2249550 - protein, 22 aa, Cryptosporidium parvum
KLLFFLFFQVSINLIIMSLICS

SEQ ID NO: 2249551 - protein, 17 aa, Cryptosporidium parvum
KLNFCTFEFMLSPTLIG

SEQ ID NO: 2249552 - protein, 28 aa, Cryptosporidium parvum
KLNVRPILFLWIFFLISMVYTFSIFLDE

SEQ ID NO: 2249553 - protein, 25 aa, Cryptosporidium parvum
KLQSYILWLLLCLNLNMGTVRPFVN

SEQ ID NO: 2249554 - protein, 22 aa, Cryptosporidium parvum
KLTLFKLLIFVSLLVAIYVLIT

SEQ ID NO: 2249555 - protein, 25 aa, Cryptosporidium parvum
KLTSKIFFFFFLNIYFQIYNLEHIL

SEQ ID NO: 2249556 - protein, 25 aa, Cryptosporidium parvum
KLTYQLLIMILITGSIQWAFWNTAL

SEQ ID NO: 2249557 - protein, 33 aa, Cryptosporidium parvum
KMGFGPWFSFFYYWKFIPLTFYYNIIKSYSDLS

SEQ ID NO: 2249558 - protein, 22 aa, Cryptosporidium parvum
KMKFVDFPLLFLRRFLPKKRSS

SEQ ID NO: 2249559 - protein, 23 aa, Cryptosporidium parvum
KNEKEWFLYWSSIFGKLCGKEPI

SEQ ID NO: 2249560 - protein, 20 aa, Cryptosporidium parvum
KNMTIINYLLLLLKERKWLK

SEQ ID NO: 2249561 - protein, 18 aa, Cryptosporidium parvum
KNRLFYWLRILLPETRTN

SEQ ID NO: 2249562 - protein, 24 aa, Cryptosporidium parvum
KNVDIFWFMAYTMITLCVFAGIVV

SEQ ID NO: 2249563 - protein, 20 aa, Cryptosporidium parvum
KPFIPLFPSYTLIGLFGDSI

SEQ ID NO: 2249564 - protein, 33 aa, Cryptosporidium parvum
KPKSFLEKVLFWSIIIFCIVFTVVLLLIWFATK

SEQ ID NO: 2249565 - protein, 17 aa, Cryptosporidium parvum
KPNKKFISFLTLLIFII

SEQ ID NO: 2249566 - protein, 25 aa, Cryptosporidium parvum
KQFWLIFWLLFLFSQYVHFIASWWK

SEQ ID NO: 2249567 - protein, 27 aa, Cryptosporidium parvum
KQGFYMKIFSGLKLLFWNLDKIGDIFG

SEQ ID NO: 2249568 - protein, 24 aa, Cryptosporidium parvum
KRKYMYWIWRRWRYLLSAKERMPI

SEQ ID NO: 2249569 - protein, 26 aa, Cryptosporidium parvum
KRLCWNLLKILYLFTLLLFILSDSEF

SEQ ID NO: 2249570 - protein, 25 aa, Cryptosporidium parvum
KRMFRFLFIIKIFPILILKVNCQIQ

SEQ ID NO: 2249571 - protein, 19 aa, Cryptosporidium parvum
KRWKMFLDILPFSDILPLL

SEQ ID NO: 2249572 - protein, 23 aa, Cryptosporidium parvum
KSELLCRLFFLYRGLRLTEERNE

SEQ ID NO: 2249573 - protein, 19 aa, Cryptosporidium parvum
KSFTYLLLLALVGIIIIDF

SEQ ID NO: 2249574 - protein, 25 aa, Cryptosporidium parvum
KSGFIFFQWYFWYCLESRRYPSKDF

SEQ ID NO: 2249575 - protein, 27 aa, Cryptosporidium parvum
KSNLLQFLWIRFYGFRVIFRKFNDLLL

SEQ ID NO: 2249576 - protein, 20 aa, Cryptosporidium parvum
KTFFCWVWKSLYQGTVIMLG

SEQ ID NO: 2249577 - protein, 30 aa, Cryptosporidium parvum
KTQKKMLWIILCIFILILVVLLPIIIGFTI

SEQ ID NO: 2249578 - protein, 24 aa, Cryptosporidium parvum
KVEFLNYYLWFIKVKFIIQNENVE

SEQ ID NO: 2249579 - protein, 27 aa, Cryptosporidium parvum
KVFTFFNFVWKIILFFIIWKSRNDFIK

SEQ ID NO: 2249580 - protein, 17 aa, Cryptosporidium parvum
KVLPLWAFLFMKVVEQS

SEQ ID NO: 2249581 - protein, 22 aa, Cryptosporidium parvum
KVNPWFAVILCISLLNGISIWD

SEQ ID NO: 2249582 - protein, 22 aa, Cryptosporidium parvum
KYEFGWPLLFNKSWFYGDLFCN

SEQ ID NO: 2249583 - protein, 20 aa, Cryptosporidium parvum
KYICIFSFKVIMFRFFLLIS

SEQ ID NO: 2249584 - protein, 21 aa, Cryptosporidium parvum
KYKFIINLSLLWFLAFSQEPE

SEQ ID NO: 2249585 - protein, 19 aa, Cryptosporidium parvum
KYMGIFLQSHFRFLYSAIK

SEQ ID NO: 2249586 - protein, 26 aa, Cryptosporidium parvum
KYMQYFFLIIILLPSTYFLPQIKGII

SEQ ID NO: 2249587 - protein, 24 aa, Cryptosporidium parvum
KYNDWLVFFLFLNKFFRIKEKNTK

SEQ ID NO: 2249588 - protein, 17 aa, Cryptosporidium parvum
KYSILLSRVLWLLPHDS

SEQ ID NO: 2249589 - protein, 22 aa, Cryptosporidium parvum
LAKLIYRIFEPNSGKIRIFGKE

SEQ ID NO: 2249590 - protein, 18 aa, Cryptosporidium parvum
LALILFFLTKISQIYCDI

SEQ ID NO: 2249591 - protein, 18 aa, Cryptosporidium parvum
LAPWTLPIFLIMMGLILF

SEQ ID NO: 2249592 - protein, 18 aa, Cryptosporidium parvum
LAVFLLNIIFFDANIGLF

SEQ ID NO: 2249593 - protein, 20 aa, Cryptosporidium parvum
LCFLSLIILFVIPLAFIIYY

SEQ ID NO: 2249594 - protein, 24 aa, Cryptosporidium parvum
LCIISICFFLYPSWSLYVHIKING

SEQ ID NO: 2249595 - protein, 22 aa, Cryptosporidium parvum
LCKKYLYFRKYGPIKLLNTSAM

SEQ ID NO: 2249596 - protein, 17 aa, Cryptosporidium parvum
LCKVWLLSPFNALDVLL

SEQ ID NO: 2249597 - protein, 17 aa, Cryptosporidium parvum
LCLLLFSTFSFLILIPA

SEQ ID NO: 2249598 - protein, 17 aa, Cryptosporidium parvum
LCWVVFPILLEYELSGD

SEQ ID NO: 2249599 - protein, 21 aa, Cryptosporidium parvum
LDCFYFIFIVFIFETISDTGF

SEQ ID NO: 2249600 - protein, 25 aa, Cryptosporidium parvum
LDILSYFFLFWFTGFHPIFIFINAI

SEQ ID NO: 2249601 - protein, 17 aa, Cryptosporidium parvum
LEEEGLRIFWKGPIHTV

SEQ ID NO: 2249602 - protein, 19 aa, Cryptosporidium parvum
LEGIIFPGWLIPGWSKLSK

SEQ ID NO: 2249603 - protein, 23 aa, Cryptosporidium parvum
LEKFCKLFFPALWLSCNDLKPDV

SEQ ID NO: 2249604 - protein, 17 aa, Cryptosporidium parvum
LEKNWIIDFLLLKRLLY

SEQ ID NO: 2249605 - protein, 24 aa, Cryptosporidium parvum
LEMILYLVLLLLHQFILLFGEKVL

SEQ ID NO: 2249606 - protein, 21 aa, Cryptosporidium parvum
LERTFVKFFIKFLIFLQQKKD

SEQ ID NO: 2249607 - protein, 31 aa, Cryptosporidium parvum
LFAPLILGMLILAILFWFRRYKWKKNLEDDQ

SEQ ID NO: 2249608 - protein, 21 aa, Cryptosporidium parvum
LFCGIWLLFHSWSISLLKGVQ

SEQ ID NO: 2249609 - protein, 17 aa, Cryptosporidium parvum
LFDLYEEYFFLSNLKLL

SEQ ID NO: 2249610 - protein, 31 aa, Cryptosporidium parvum
LFIQKWVIILIGIIFIFLPLYFRIRTRRRKA

SEQ ID NO: 2249611 - protein, 23 aa, Cryptosporidium parvum
LFMLGFLRYFRVLNPVPILTIIL

SEQ ID NO: 2249612 - protein, 19 aa, Cryptosporidium parvum
LFPTFLRLSLSPVNFDISE

SEQ ID NO: 2249613 - protein, 18 aa, Cryptosporidium parvum
LFQYIYVTILLGISLIFV

SEQ ID NO: 2249614 - protein, 17 aa, Cryptosporidium parvum
LFVHIFLNSINATYGQI

SEQ ID NO: 2249615 - protein, 19 aa, Cryptosporidium parvum
LFYQVYRPSILIFGIFLYL

SEQ ID NO: 2249616 - protein, 18 aa, Cryptosporidium parvum
LGIFFKMNFLLGQSLILV

SEQ ID NO: 2249617 - protein, 25 aa, Cryptosporidium parvum
LGKHDFVFKLFYKKGYYYLDSSFTS

SEQ ID NO: 2249618 - protein, 23 aa, Cryptosporidium parvum
LGWYWYHLGIYNLILIKIIYLNL

SEQ ID NO: 2249619 - protein, 18 aa, Cryptosporidium parvum
LHFTAFIYYWQLLSMISS

SEQ ID NO: 2249620 - protein, 23 aa, Cryptosporidium parvum
LHIFIFVGIAIIILLISSIILIN

SEQ ID NO: 2249621 - protein, 19 aa, Cryptosporidium parvum
LHSAFWISLYRLSFIPSKN

SEQ ID NO: 2249622 - protein, 17 aa, Cryptosporidium parvum
LHTCYIPIYLYILGCFS

SEQ ID NO: 2249623 - protein, 17 aa, Cryptosporidium parvum
LICFLILSFLEALKSIQ

SEQ ID NO: 2249624 - protein, 20 aa, Cryptosporidium parvum
LIDFLVPYFLLESAKICIEY

SEQ ID NO: 2249625 - protein, 19 aa, Cryptosporidium parvum
LIIALLFTTLFISQIILFK

SEQ ID NO: 2249626 - protein, 23 aa, Cryptosporidium parvum
LIIFNYLFIIKLLKKIIQIESTS

SEQ ID NO: 2249627 - protein, 19 aa, Cryptosporidium parvum
LIIIIDFMLEYLLLLLENG

SEQ ID NO: 2249628 - protein, 24 aa, Cryptosporidium parvum
LIIITFLLLLPIVQLLFTYSQTLT

SEQ ID NO: 2249629 - protein, 19 aa, Cryptosporidium parvum
LIIKNIIFFIYWKIIKQIS

SEQ ID NO: 2249630 - protein, 18 aa, Cryptosporidium parvum
LIINCLFALGYKKIALVK

SEQ ID NO: 2249631 - protein, 17 aa, Cryptosporidium parvum
LIKTLWRPTLEALLLRL

SEQ ID NO: 2249632 - protein, 19 aa, Cryptosporidium parvum
LILIFALILYLIISIIDIG

SEQ ID NO: 2249633 - protein, 18 aa, Cryptosporidium parvum
LILVPILTFLIFFNFVDS

SEQ ID NO: 2249634 - protein, 28 aa, Cryptosporidium parvum
LIMNIKIFFFFILKLYQFIRFPLNVLNL

SEQ ID NO: 2249635 - protein, 30 aa, Cryptosporidium parvum
LIPSFKLFLFIFFLFRFRKSIIKSLRDEVK

SEQ ID NO: 2249636 - protein, 20 aa, Cryptosporidium parvum
LIQFFYRLLSKIFTKNFFFL

SEQ ID NO: 2249637 - protein, 20 aa, Cryptosporidium parvum
LIQFILLPCRIFVASLLMYR

SEQ ID NO: 2249638 - protein, 19 aa, Cryptosporidium parvum
LIRIIHFLSVLTFFGLPNT

SEQ ID NO: 2249639 - protein, 18 aa, Cryptosporidium parvum
LIVELILIDILFSKFLKK

SEQ ID NO: 2249640 - protein, 17 aa, Cryptosporidium parvum
LIVYFRRAMNLLTVSEA

SEQ ID NO: 2249641 - protein, 21 aa, Cryptosporidium parvum
LIWNVLFQFILLRIKLPVSTI

SEQ ID NO: 2249642 - protein, 26 aa, Cryptosporidium parvum
LIWRWRRNLRYYWIKLLVLFEEIGMF

SEQ ID NO: 2249643 - protein, 18 aa, Cryptosporidium parvum
LIYIYIIVFFGVFHSFTK

SEQ ID NO: 2249644 - protein, 22 aa, Cryptosporidium parvum
LKCIRIFLLRLKADLMWNYTPN

SEQ ID NO: 2249645 - protein, 28 aa, Cryptosporidium parvum
LKEWFIYLFNALYDFIIYQLPLALIFYS

SEQ ID NO: 2249646 - protein, 24 aa, Cryptosporidium parvum
LKNNLTQQFPFNGSLLLNGKVANI

SEQ ID NO: 2249647 - protein, 25 aa, Cryptosporidium parvum
LKYKILCHLWIFRFIMSIAAISFPG

SEQ ID NO: 2249648 - protein, 19 aa, Cryptosporidium parvum
LKYVIGMLLGVFFGIWILS

SEQ ID NO: 2249649 - protein, 24 aa, Cryptosporidium parvum
LLESKAWWICGIPLSVYSLLAEIS

SEQ ID NO: 2249650 - protein, 17 aa, Cryptosporidium parvum
LLFIRPLRNLTSKEVML

SEQ ID NO: 2249651 - protein, 17 aa, Cryptosporidium parvum
LLFPIPPSKVYKFREKG

SEQ ID NO: 2249652 - protein, 18 aa, Cryptosporidium parvum
LLHQLFSQFFWALHDDPE

SEQ ID NO: 2249653 - protein, 22 aa, Cryptosporidium parvum
LLIFPIRFLLTWILLKEHVGSV

SEQ ID NO: 2249654 - protein, 17 aa, Cryptosporidium parvum
LLIVIMLSTFFISYKIN

SEQ ID NO: 2249655 - protein, 17 aa, Cryptosporidium parvum
LLLALVGIIIIDFIFRR

SEQ ID NO: 2249656 - protein, 24 aa, Cryptosporidium parvum
LLLKERKWLKFINNLIIIIDKLLG

SEQ ID NO: 2249657 - protein, 24 aa, Cryptosporidium parvum
LLLSPLYYIVFSKANMLSPRGECR

SEQ ID NO: 2249658 - protein, 17 aa, Cryptosporidium parvum
LLMLFKSWIPFLENEFN

SEQ ID NO: 2249659 - protein, 18 aa, Cryptosporidium parvum
LLNLVYISSIFIVCLSLI

SEQ ID NO: 2249660 - protein, 30 aa, Cryptosporidium parvum; identical to SEQ ID NO: 2134749

SEQ ID NO: 2249661 - protein, 18 aa, Cryptosporidium parvum
LLPRVIFIFVIQCLSLII

SEQ ID NO: 2249662 - protein, 24 aa, Cryptosporidium parvum
LLSKALYILFLLKLVMLIGFGSYY

SEQ ID NO: 2249663 - protein, 17 aa, Cryptosporidium parvum
LLVLFDLGIERFLGSSA

SEQ ID NO: 2249664 - protein, 17 aa, Cryptosporidium parvum
LMLWRFLEQQFESVLSV

SEQ ID NO: 2249665 - protein, 19 aa, Cryptosporidium parvum
LMVLNFFLTAFKGLAMLFR

SEQ ID NO: 2249666 - protein, 22 aa, Cryptosporidium parvum
LNCLYLLLRLLILLISDVVKLS

SEQ ID NO: 2249667 - protein, 23 aa, Cryptosporidium parvum
LNDPQLLFLLLKLLLNSNGINDN

SEQ ID NO: 2249668 - protein, 31 aa, Cryptosporidium parvum
LNFINRLHILLWPHLIHFIYELLPVAITIRL

SEQ ID NO: 2249669 - protein, 25 aa, Cryptosporidium parvum
LNHIMLWFGLIIFWAITQIYGKSPV

SEQ ID NO: 2249670 - protein, 22 aa, Cryptosporidium parvum
LNICYWIQFIGWLCSSKGIYLS

SEQ ID NO: 2249671 - protein, 17 aa, Cryptosporidium parvum
LNTPVKLPLLFGSILMF

SEQ ID NO: 2249672 - protein, 18 aa, Cryptosporidium parvum
LPFLCFPLSIFIMNNVIK

SEQ ID NO: 2249673 - protein, 19 aa, Cryptosporidium parvum
LPIFLIMMGLILFKIFLPM

SEQ ID NO: 2249674 - protein, 18 aa, Cryptosporidium parvum
LPIVWLFLSIIVALIIFK

SEQ ID NO: 2249675 - protein, 19 aa, Cryptosporidium parvum
LPKYKLLLTFLLILGSSIV

SEQ ID NO: 2249676 - protein, 29 aa, Cryptosporidium parvum
LPVVLIIWDNFLLLGLPLLFQAGLSLLKL

SEQ ID NO: 2249677 - protein, 17 aa, Cryptosporidium parvum
LQKISLIFYLFNKTREL

SEQ ID NO: 2249678 - protein, 36 aa, Cryptosporidium parvum
LQSIIKYLFFFIQIISLIYLFTILFLISEYDYIWFL

SEQ ID NO: 2249679 - protein, 27 aa, Cryptosporidium parvum
LREKKLLWTFRILSGILLLFYFVIGWL

SEQ ID NO: 2249680 - protein, 20 aa, Cryptosporidium parvum
LRIYKPLIKVFWFQCLMVLL

SEQ ID NO: 2249681 - protein, 17 aa, Cryptosporidium parvum
LRLYLMHIPSILPSIYT

SEQ ID NO: 2249682 - protein, 22 aa, Cryptosporidium parvum
LRSIYILVLYQLILFNILNSSS

SEQ ID NO: 2249683 - protein, 18 aa, Cryptosporidium parvum
LRYFLLNYIVIILGMTML

SEQ ID NO: 2249684 - protein, 27 aa, Cryptosporidium parvum
LSGILLLFYFVIGWLGTFYPPLYWPNP

SEQ ID NO: 2249685 - protein, 22 aa, Cryptosporidium parvum
LSIFFFDLVAYIFLILSAVLFD

SEQ ID NO: 2249686 - protein, 20 aa, Cryptosporidium parvum
LSILYGLCLGLLFLGKREAC

SEQ ID NO: 2249687 - protein, 20 aa, Cryptosporidium parvum
LSIPLLNYVFFNIKSLFINK

SEQ ID NO: 2249688 - protein, 24 aa, Cryptosporidium parvum
LSKKDYVWIACSFLSFLLVNYYIT

SEQ ID NO: 2249689 - protein, 17 aa, Cryptosporidium parvum
LSYWLIPSEYLLYLIFR

SEQ ID NO: 2249690 - protein, 18 aa, Cryptosporidium parvum
LTIIFLIFIYKVFGYVER

SEQ ID NO: 2249691 - protein, 26 aa, Cryptosporidium parvum
LTKRLLLIPIPLLIQLLQAIFMFLTA

SEQ ID NO: 2249692 - protein, 26 aa, Cryptosporidium parvum
LTLLAISMFLLWFLLGSLINSDNILP

SEQ ID NO: 2249693 - protein, 19 aa, Cryptosporidium parvum
LTMPIIILLDRLASLWFGS

SEQ ID NO: 2249694 - protein, 17 aa, Cryptosporidium parvum
LVALLICFLLCNTVLTS

SEQ ID NO: 2249695 - protein, 18 aa, Cryptosporidium parvum
LVCQLVFLLLLFSRVMSI

SEQ ID NO: 2249696 - protein, 19 aa, Cryptosporidium parvum
LVLFILCWVVFPILLEYEL

SEQ ID NO: 2249697 - protein, 23 aa, Cryptosporidium parvum
LVMKRIFFCPTFILQYLMLSTTF

SEQ ID NO: 2249698 - protein, 19 aa, Cryptosporidium parvum
LVSSFFFVKACFLFVSAIG

SEQ ID NO: 2249699 - protein, 21 aa, Cryptosporidium parvum
LWFISYLFGRQFLNPSLFKLK

SEQ ID NO: 2249700 - protein, 19 aa, Cryptosporidium parvum
LYEAEGLVFWLFRVHNLVT

SEQ ID NO: 2249701 - protein, 27 aa, Cryptosporidium parvum
LYIILKFFILFIFFVYLKTRHDLIKYD

SEQ ID NO: 2249702 - protein, 18 aa, Cryptosporidium parvum
LYLLGITKPFFSLKIFGI

SEQ ID NO: 2249703 - protein, 18 aa, Cryptosporidium parvum
LYRCYMKFFRGILRYFLI

SEQ ID NO: 2249704 - protein, 18 aa, Cryptosporidium parvum
LYRRAYRLGILGFLLVLE

SEQ ID NO: 2249705 - protein, 18 aa, Cryptosporidium parvum
LYYYIIFNSWNTLSLLVE

SEQ ID NO: 2249706 - protein, 17 aa, Cryptosporidium parvum
MCNFTFRLFACLFFIVV

SEQ ID NO: 2249707 - protein, 19 aa, Cryptosporidium parvum
MDTFITPWILLYREPIDNF

SEQ ID NO: 2249708 - protein, 24 aa, Cryptosporidium parvum
MEDISLILSLFVLAVDHLPAFLNR

SEQ ID NO: 2249709 - protein, 26 aa, Cryptosporidium parvum
MELTPLFLLKISIFCWYFFEKLERWL

SEQ ID NO: 2249710 - protein, 18 aa, Cryptosporidium parvum
MERVLFLWAIRNPASGYV

SEQ ID NO: 2249711 - protein, 18 aa, Cryptosporidium parvum
MFAWLRLRLDFLLPVVLT

SEQ ID NO: 2249712 - protein, 18 aa, Cryptosporidium parvum
MIHRFLISQSTWSSIGKL

SEQ ID NO: 2249713 - protein, 17 aa, Cryptosporidium parvum
MIIILFFLTSTLPMSII

SEQ ID NO: 2249714 - protein, 19 aa, Cryptosporidium parvum
MIVRYLLYSLIFTIITFIT

SEQ ID NO: 2249715 - protein, 26 aa, Cryptosporidium parvum
MLCGILSICLLIIIVLLVVLGIRKNK

SEQ ID NO: 2249716 - protein, 19 aa, Cryptosporidium parvum
MLESLYWFFNFYSFTETYQ

SEQ ID NO: 2249717 - protein, 18 aa, Cryptosporidium parvum
MLFFRKIIGIFFLINLII

SEQ ID NO: 2249718 - protein, 24 aa, Cryptosporidium parvum
MLPYKLRFFIGFSSISSLFGSFGQ

SEQ ID NO: 2249719 - protein, 28 aa, Cryptosporidium parvum
MLVKWGLVVLIFQLFFSLLVKAGDLDLP

SEQ ID NO: 2249720 - protein, 18 aa, Cryptosporidium parvum
MNIPWMIFVLYLFIRHVK

SEQ ID NO: 2249721 - protein, 22 aa, Cryptosporidium parvum
MNKLLSFLLFLFDKGLKNHEIC

SEQ ID NO: 2249722 - protein, 17 aa, Cryptosporidium parvum
MPIILKWSKGESFASIL

SEQ ID NO: 2249723 - protein, 23 aa, Cryptosporidium parvum
MPLYKRVFPKWFPITWFEDNNIR

SEQ ID NO: 2249724 - protein, 20 aa, Cryptosporidium parvum
MRLDFFDMLFKELMPSLAYH

SEQ ID NO: 2249725 - protein, 20 aa, Cryptosporidium parvum
MSHIAMILLLFNINLMEAFK

SEQ ID NO: 2249726 - protein, 18 aa, Cryptosporidium parvum
MSTKTFFCWVWKSLYQGT

SEQ ID NO: 2249727 - protein, 30 aa, Cryptosporidium parvum
MVFVTHFCLFLWKIIKPFIILSIFILISFI

SEQ ID NO: 2249728 - protein, 24 aa, Cryptosporidium parvum
MWLRRPRWFVYEIIPLVILFTKIF

SEQ ID NO: 2249729 - protein, 18 aa, Cryptosporidium parvum
MYFLSILVLFSWISIVIG

SEQ ID NO: 2249730 - protein, 23 aa, Cryptosporidium parvum
MYQDTFLFLMFLIGDIPLLMNFL

SEQ ID NO: 2249731 - protein, 25 aa, Cryptosporidium parvum
NAVINFLIFYLINGTLIYIFTRKMN

SEQ ID NO: 2249732 - protein, 17 aa, Cryptosporidium parvum
NDYLFYVNVLIKTLLKS

SEQ ID NO: 2249733 - protein, 19 aa, Cryptosporidium parvum
NEILLFPLIIPCPKLHLVC

SEQ ID NO: 2249734 - protein, 24 aa, Cryptosporidium parvum
NEKYIVYLIFWVVVKFFESIKIVE

SEQ ID NO: 2249735 - protein, 20 aa, Cryptosporidium parvum
NFFNFFYLIVALFQLIPELR

SEQ ID NO: 2249736 - protein, 24 aa, Cryptosporidium parvum
NFGKIWLWLVKLLNKNSPHRLFVF

SEQ ID NO: 2249737 - protein, 23 aa, Cryptosporidium parvum
NFIFFNFLLYLASIGPQLFISFI

SEQ ID NO: 2249738 - protein, 17 aa, Cryptosporidium parvum
NFLFIWSCVYIALVLLF

SEQ ID NO: 2249739 - protein, 20 aa, Cryptosporidium parvum
NFTPFILSNLFIFGLIIYSV

SEQ ID NO: 2249740 - protein, 20 aa, Cryptosporidium parvum
NFYLVLLYFHFVLESKFSLL

SEQ ID NO: 2249741 - protein, 22 aa, Cryptosporidium parvum
NGMQIYFHLINQIKLNYFQHKH

SEQ ID NO: 2249742 - protein, 26 aa, Cryptosporidium parvum
NGTLALILTWLIVLIVMKFSKKLQHY

SEQ ID NO: 2249743 - protein, 36 aa, Cryptosporidium parvum
NGTQVLTLMFFISVIIFGLFILAIALIPRYAKRFGF

SEQ ID NO: 2249744 - protein, 21 aa, Cryptosporidium parvum
NHWVFLWTQILKKVLVIVLSY

SEQ ID NO: 2249745 - protein, 23 aa, Cryptosporidium parvum
NIAIIWIFILRLFGQFSSISSNF

SEQ ID NO: 2249746 - protein, 22 aa, Cryptosporidium parvum
NIHYLYTVLLPFLNERNLYDNW

SEQ ID NO: 2249747 - protein, 23 aa, Cryptosporidium parvum
NIILLIILFILLSLLICSIDTIV

SEQ ID NO: 2249748 - protein, 31 aa, Cryptosporidium parvum
NIKTWFFWIVYSFLVFIIYFSADYLYIFKNS

SEQ ID NO: 2249749 - protein, 25 aa, Cryptosporidium parvum
NIMTIFWLLLVFFIISILIFCINII

SEQ ID NO: 2249750 - protein, 23 aa, Cryptosporidium parvum
NINELWPFFYLHYNYIQKKLIIS

SEQ ID NO: 2249751 - protein, 18 aa, Cryptosporidium parvum
NIYFWIISLERITNYQLK

SEQ ID NO: 2249752 - protein, 22 aa, Cryptosporidium parvum
NKEFFELFLRWIFQISLTENFE

SEQ ID NO: 2249753 - protein, 21 aa, Cryptosporidium parvum
NKIKLLDFILLLPLKLETIII

SEQ ID NO: 2249754 - protein, 25 aa, Cryptosporidium parvum
NKKFISFLTLLIFIIYILEFNSTLA

SEQ ID NO: 2249755 - protein, 17 aa, Cryptosporidium parvum
NKLLFAIILVSYIYKFA

SEQ ID NO: 2249756 - protein, 23 aa, Cryptosporidium parvum
NKSAFYFVRFNLLLHLAAIVIQC

SEQ ID NO: 2249757 - protein, 23 aa, Cryptosporidium parvum
NKSLIFVYLLLSTVPLLSFKIIE

SEQ ID NO: 2249758 - protein, 18 aa, Cryptosporidium parvum
NLFHSVFPYYRGEVPKLT

SEQ ID NO: 2249759 - protein, 21 aa, Cryptosporidium parvum
NLFQKIFRFPKLLLSKDEVHN

SEQ ID NO: 2249760 - protein, 25 aa, Cryptosporidium parvum
NLFVIYIDWLHYLFTLYSTIESDIN

SEQ ID NO: 2249761 - protein, 21 aa, Cryptosporidium parvum
NLLELLYLSDASEFFFCLECI

SEQ ID NO: 2249762 - protein, 23 aa, Cryptosporidium parvum
NLPAPMFMFIFSLFSLIIGMILS

SEQ ID NO: 2249763 - protein, 28 aa, Cryptosporidium parvum
NLVLKTLLLLLLEYLIINFPGVSSIDEK

SEQ ID NO: 2249764 - protein, 18 aa, Cryptosporidium parvum
NLYCMFVQLITLITKLRD

SEQ ID NO: 2249765 - protein, 20 aa, Cryptosporidium parvum
NLYFTWLLATRIILSLTTYF

SEQ ID NO: 2249766 - protein, 18 aa, Cryptosporidium parvum
NMYWIYYRIFHGIPFELF

SEQ ID NO: 2249767 - protein, 24 aa, Cryptosporidium parvum
NNDDLCIILKPPFWYCPIEGTGMD

SEQ ID NO: 2249768 - protein, 27 aa, Cryptosporidium parvum
NNIFKLFLLIIPNLLFQFYCEWSWTLL

SEQ ID NO: 2249769 - protein, 23 aa, Cryptosporidium parvum
NNIIPLFNFPLITQLKILLTKNY

SEQ ID NO: 2249770 - protein, 20 aa, Cryptosporidium parvum
NNYFFKYKLWLFVNQFLIEC

SEQ ID NO: 2249771 - protein, 20 aa, Cryptosporidium parvum
NPLGFLWVLIIQRFRIFLYI

SEQ ID NO: 2249772 - protein, 32 aa, Cryptosporidium parvum
NPTWDFFMSLPFPIPYLLILSVLHLIIIHTTF

SEQ ID NO: 2249773 - protein, 30 aa, Cryptosporidium parvum
NQILHFYCIKFLWKFLPLTSTKDFLEQYSR

SEQ ID NO: 2249774 - protein, 24 aa, Cryptosporidium parvum
NREEFLYWVINLHYDRFLFNGLNT

SEQ ID NO: 2249775 - protein, 24 aa, Cryptosporidium parvum
NRIISLFKFKFFNEPLWNAISWYS

SEQ ID NO: 2249776 - protein, 18 aa, Cryptosporidium parvum
NRLTWIVIILLAIDCFFS

SEQ ID NO: 2249777 - protein, 21 aa, Cryptosporidium parvum
NSIFLFYLKLLSQPITIAWGI

SEQ ID NO: 2249778 - protein, 23 aa, Cryptosporidium parvum
NSIFMWVILGFIVLLLTLICICG

SEQ ID NO: 2249779 - protein, 25 aa, Cryptosporidium parvum
NSKQCYIIVFLLQKITTCLLFRGRR

SEQ ID NO: 2249780 - protein, 22 aa, Cryptosporidium parvum
NSLLNLMFMELLIKLKLATNDN

SEQ ID NO: 2249781 - protein, 26 aa, Cryptosporidium parvum
NSPEFFRLWTLLILCGLLSMLLNYFT

SEQ ID NO: 2249782 - protein, 27 aa, Cryptosporidium parvum
NSQPTIIHWLIILLSALFSCYLFNGVD

SEQ ID NO: 2249783 - protein, 17 aa, Cryptosporidium parvum
NTIRGGYLLILQKILFA

SEQ ID NO: 2249784 - protein, 19 aa, Cryptosporidium parvum
NVLFLKLIFLFSCSLCSIV

SEQ ID NO: 2249785 - protein, 27 aa, Cryptosporidium parvum
NVMIFPLLLLLLLLISIDFIQCEDFEN

SEQ ID NO: 2249786 - protein, 23 aa, Cryptosporidium parvum
NVSIMICLYLNFIPSIYKIPGVP

SEQ ID NO: 2249787 - protein, 20 aa, Cryptosporidium parvum
NWNLIALSHNYFFGALYGRM

SEQ ID NO: 2249788 - protein, 19 aa, Cryptosporidium parvum
NWSSYFYFIRRMSSFSIIT

SEQ ID NO: 2249789 - protein, 32 aa, Cryptosporidium parvum
NYFRNNPIMRLFFFIFVLAMFSPANISNGFQK

SEQ ID NO: 2249790 - protein, 25 aa, Cryptosporidium parvum
NYNYNIFFYISYMNWIPKIFINSND

SEQ ID NO: 2249791 - protein, 19 aa, Cryptosporidium parvum
PALYAILFAPLILGMLILA

SEQ ID NO: 2249792 - protein, 20 aa, Cryptosporidium parvum
PCAVWLPWIPQLIAGIDRIE

SEQ ID NO: 2249793 - protein, 24 aa, Cryptosporidium parvum
PCEQVHYWFLAYWAFRIGSGQILW

SEQ ID NO: 2249794 - protein, 24 aa, Cryptosporidium parvum
PDNDFLFKIFPFLSIFNEGSKRIM

SEQ ID NO: 2249795 - protein, 23 aa, Cryptosporidium parvum
PDVFIYILLIIFYILSHITSTLL

SEQ ID NO: 2249796 - protein, 18 aa, Cryptosporidium parvum
PDWMRPLLFTKSPNEALV

SEQ ID NO: 2249797 - protein, 25 aa, Cryptosporidium parvum
PENQISVWLFLTASLLTSLLLYRNV

SEQ ID NO: 2249798 - protein, 22 aa, Cryptosporidium parvum
PFEKFPIPSWLYKLFSRLVEVD

SEQ ID NO: 2249799 - protein, 19 aa, Cryptosporidium parvum
PFIFLGLFQSIFLFCSGEE

SEQ ID NO: 2249800 - protein, 24 aa, Cryptosporidium parvum
PFIRLIQIILFPLLKPISVILDKA

SEQ ID NO: 2249801 - protein, 23 aa, Cryptosporidium parvum
PFKSLYLMNAIIILKFGLVCIFN

SEQ ID NO: 2249802 - protein, 22 aa, Cryptosporidium parvum
PFTYPFFILLLDVFTYIIIMCL

SEQ ID NO: 2249803 - protein, 28 aa, Cryptosporidium parvum
PICILIYPILIWYYFKYIFKPTRIQTRE

SEQ ID NO: 2249804 - protein, 20 aa, Cryptosporidium parvum
PILLIACLGFFLLLAGKIHF

SEQ ID NO: 2249805 - protein, 18 aa, Cryptosporidium parvum
PINFLWVIPLGTLPSPHI

SEQ ID NO: 2249806 - protein, 19 aa, Cryptosporidium parvum
PIQLPGIRYFALFIFSKQV

SEQ ID NO: 2249807 - protein, 22 aa, Cryptosporidium parvum
PISLYFLSLLPWYTIDQNVNDA

SEQ ID NO: 2249808 - protein, 20 aa, Cryptosporidium parvum
PIYMLFLPFMTIITYNCISI

SEQ ID NO: 2249809 - protein, 18 aa, Cryptosporidium parvum
PKFWSLLFDIMLGPDLDS

SEQ ID NO: 2249810 - protein, 18 aa, Cryptosporidium parvum
PNIFAFEYIYLLSPVLST

SEQ ID NO: 2249811 - protein, 21 aa, Cryptosporidium parvum
PNLLNKYRFLSLLKLPKSHFE

SEQ ID NO: 2249812 - protein, 18 aa, Cryptosporidium parvum
PPEIAIIRPIYPLNPPTV

SEQ ID NO: 2249813 - protein, 25 aa, Cryptosporidium parvum
PRIYVIFIIFIIFFSNVECLLKKAN

SEQ ID NO: 2249814 - protein, 22 aa, Cryptosporidium parvum
PRWIPKFFFLLNFRIPRSRFDR

SEQ ID NO: 2249815 - protein, 19 aa, Cryptosporidium parvum
PSLILFIRALNELNPQKNA

SEQ ID NO: 2249816 - protein, 20 aa, Cryptosporidium parvum
PSRCILLIYIGLSSPVYFGS

SEQ ID NO: 2249817 - protein, 17 aa, Cryptosporidium parvum
PTWFHCLVWKSLTERDN

SEQ ID NO: 2249818 - protein, 21 aa, Cryptosporidium parvum
PWVILRFLFIDIWIGLLLFQI

SEQ ID NO: 2249819 - protein, 17 aa, Cryptosporidium parvum
PWWIYLCLVLLSLVILG

SEQ ID NO: 2249820 - protein, 18 aa, Cryptosporidium parvum
PWYAPLKKIGINIISGKN

SEQ ID NO: 2249821 - protein, 19 aa, Cryptosporidium parvum
PYAVYYWFISILNLLVVFI

SEQ ID NO: 2249822 - protein, 18 aa, Cryptosporidium parvum
PYGFSILILLSLFKIIPI

SEQ ID NO: 2249823 - protein, 22 aa, Cryptosporidium parvum
PYKKFITLYFYQLPTLLNHLFS

SEQ ID NO: 2249824 - protein, 26 aa, Cryptosporidium parvum
PYQALLLQIFIFISPFLRSVQLSSNI

SEQ ID NO: 2249825 - protein, 17 aa, Cryptosporidium parvum
PYYLKISWYIYYLSTIS

SEQ ID NO: 2249826 - protein, 25 aa, Cryptosporidium parvum
QAIQQPLIRLLLYGIILPILEQCNA

SEQ ID NO: 2249827 - protein, 20 aa, Cryptosporidium parvum
QAMFFLNIIKIIFIIHFFTL

SEQ ID NO: 2249828 - protein, 22 aa, Cryptosporidium parvum
QDEKMWFTFYYLNKKSSICNVQ

SEQ ID NO: 2249829 - protein, 23 aa, Cryptosporidium parvum
QDFLFHIFSFLIKFLFGYRYRDL

SEQ ID NO: 2249830 - protein, 24 aa, Cryptosporidium parvum
QDNWYFIYVLYVWLSTLVLIPFSF

SEQ ID NO: 2249831 - protein, 26 aa, Cryptosporidium parvum
QERIPTNLFIISFLALITGAFFLQYI

SEQ ID NO: 2249832 - protein, 20 aa, Cryptosporidium parvum
QFNSILEFAPWLAPKVLACI

SEQ ID NO: 2249833 - protein, 27 aa, Cryptosporidium parvum
QGKYQFYKYILKFKPFLTLISTLPLDL

SEQ ID NO: 2249834 - protein, 28 aa, Cryptosporidium parvum
QIFGTHTIYWWLYILAIGAGFLNMAFDE

SEQ ID NO: 2249835 - protein, 20 aa, Cryptosporidium parvum
QIFRPLLWKVQTAYVSYLYY

SEQ ID NO: 2249836 - protein, 24 aa, Cryptosporidium parvum
QILLWIFLFPYLLYNEKFKIIIMG

SEQ ID NO: 2249837 - protein, 29 aa, Cryptosporidium parvum
QKIIDIVYLLPLWFDLMRLPDKILRSKLL

SEQ ID NO: 2249838 - protein, 20 aa, Cryptosporidium parvum
QKILFYYFLMLIINGAINCA

SEQ ID NO: 2249839 - protein, 23 aa, Cryptosporidium parvum
QKKLLIRFIPFHLFSITGMTLDV

SEQ ID NO: 2249840 - protein, 19 aa, Cryptosporidium parvum
QKMYLLLDILILIKQNWEK

SEQ ID NO: 2249841 - protein, 18 aa, Cryptosporidium parvum
QLFHPPLIIRTGKLLSFS

SEQ ID NO: 2249842 - protein, 17 aa, Cryptosporidium parvum
QLFILCFLSLIILFVIP

SEQ ID NO: 2249843 - protein, 23 aa, Cryptosporidium parvum
QLIVFIIFYLFIGTSLNLPAALA

SEQ ID NO: 2249844 - protein, 18 aa, Cryptosporidium parvum
QLLYWLLQIAFELDGNQE

SEQ ID NO: 2249845 - protein, 26 aa, Cryptosporidium parvum
QMFTRKMIVLFLFAGFLGLFPGSFFH

SEQ ID NO: 2249846 - protein, 18 aa, Cryptosporidium parvum
QNYIFFPQSFLNLSLKNN

SEQ ID NO: 2249847 - protein, 25 aa, Cryptosporidium parvum
QQIPSWWVVFWPCWFWCGVIFSFST

SEQ ID NO: 2249848 - protein, 22 aa, Cryptosporidium parvum
QRGMYLVFLMTFLTILFPMLKQ

SEQ ID NO: 2249849 - protein, 21 aa, Cryptosporidium parvum
QSLIIQVLFWLTIPPDESWRS

SEQ ID NO: 2249850 - protein, 25 aa, Cryptosporidium parvum
QTFSLILLIIIFTPLIFFSIHIIIS

SEQ ID NO: 2249851 - protein, 26 aa, Cryptosporidium parvum
QTILFSILFYIIYKYIFRYFIHSCRL

SEQ ID NO: 2249852 - protein, 23 aa, Cryptosporidium parvum
QVFLSWFKHFLTPWLKFGTVFDH

SEQ ID NO: 2249853 - protein, 20 aa, Cryptosporidium parvum
QVYSFLLFLAMLLSSINIIG

SEQ ID NO: 2249854 - protein, 24 aa, Cryptosporidium parvum
QWFALEWFLCFFVTSLPLKSIMEI

SEQ ID NO: 2249855 - protein, 23 aa, Cryptosporidium parvum
QYFKWIILGFVLIFAILPPFIMD

SEQ ID NO: 2249856 - protein, 18 aa, Cryptosporidium parvum
QYFLNWFKKIYKNSNLFM

SEQ ID NO: 2249857 - protein, 17 aa, Cryptosporidium parvum
QYPILKLQLWSYGLIQS

SEQ ID NO: 2249858 - protein, 18 aa, Cryptosporidium parvum
RASMYWYRVFRSLSLLLY

SEQ ID NO: 2249859 - protein, 18 aa, Cryptosporidium parvum
RFLPNLMMTIIFSTCTDL

SEQ ID NO: 2249860 - protein, 18 aa, Cryptosporidium parvum
RFPETLFIYFTPPKNAKK

SEQ ID NO: 2249861 - protein, 22 aa, Cryptosporidium parvum
RGFLLIKFIRWVIMKDPFNNVQ

SEQ ID NO: 2249862 - protein, 38 aa, Cryptosporidium parvum; identical to SEQ ID NO: 2134871

SEQ ID NO: 2249863 - protein, 23 aa, Cryptosporidium parvum
RGIIKYILPFYSFQMFLKDTYLH

SEQ ID NO: 2249864 - protein, 28 aa, Cryptosporidium parvum
RHLLFTLFFLFLGLFLKLNQFLLLKEND

SEQ ID NO: 2249865 - protein, 18 aa, Cryptosporidium parvum
RIILFIYISFLSMLHDIT

SEQ ID NO: 2249866 - protein, 26 aa, Cryptosporidium parvum
RIIVTLILITTVIWSIIGLLGIILIF

SEQ ID NO: 2249867 - protein, 18 aa, Cryptosporidium parvum
RIPYLFEVLYINLGIPIL

SEQ ID NO: 2249868 - protein, 26 aa, Cryptosporidium parvum
RIRGKFFLILMVQLFCFFFLCMWFSY

SEQ ID NO: 2249869 - protein, 24 aa, Cryptosporidium parvum
RISINIILFIWSSLLLRLSLWIRS

SEQ ID NO: 2249870 - protein, 20 aa, Cryptosporidium parvum
RIWLDFPTILLPIPLQWAKL

SEQ ID NO: 2249871 - protein, 23 aa, Cryptosporidium parvum
RKMLLFLIIVIACSIAILHSPIY

SEQ ID NO: 2249872 - protein, 21 aa, Cryptosporidium parvum
RKWIILLIIIEFVIKINLLYG

SEQ ID NO: 2249873 - protein, 20 aa, Cryptosporidium parvum
RLDIPRLCYTVHLLALISHI

SEQ ID NO: 2249874 - protein, 19 aa, Cryptosporidium parvum
RLKIWLTPLLLFHDLISSK

SEQ ID NO: 2249875 - protein, 17 aa, Cryptosporidium parvum
RLLKYWLHIRRLPVAKD

SEQ ID NO: 2249876 - protein, 18 aa, Cryptosporidium parvum
RMLLFVNFFLKREKLRIL

SEQ ID NO: 2249877 - protein, 27 aa, Cryptosporidium parvum
RQPQNIPWWIYLLIIILGFDEITYVLT

SEQ ID NO: 2249878 - protein, 23 aa, Cryptosporidium parvum
RRILYFILIHILIFNILEINSLP

SEQ ID NO: 2249879 - protein, 20 aa, Cryptosporidium parvum
RRRLNILWSQRYKNIKLRLF

SEQ ID NO: 2249880 - protein, 18 aa, Cryptosporidium parvum
RSAILFTILLIKSLTILS

SEQ ID NO: 2249881 - protein, 25 aa, Cryptosporidium parvum
RSFLPLFLVFVFLALQFIGLSIMIF

SEQ ID NO: 2249882 - protein, 24 aa, Cryptosporidium parvum
RSFNIFDMFFFYKVLNFYYNDLNG

SEQ ID NO: 2249883 - protein, 21 aa, Cryptosporidium parvum
RSTLIFTFLTEKTNKFFDCFL

SEQ ID NO: 2249884 - protein, 32 aa, Cryptosporidium parvum
RSTTSFILIYITSLLFLLLLFETKHVVSDNTS

SEQ ID NO: 2249885 - protein, 26 aa, Cryptosporidium parvum
RTEIGIFWIGLLTLFLIILDILLEVY

SEQ ID NO: 2249886 - protein, 18 aa, Cryptosporidium parvum
RTHLMMLIFFGGNILRGL

SEQ ID NO: 2249887 - protein, 29 aa, Cryptosporidium parvum
RTNALQWYIAWTWFVDLILSISTCSLENS

SEQ ID NO: 2249888 - protein, 17 aa, Cryptosporidium parvum
RVGLIHFFRYFLGGAFQ

SEQ ID NO: 2249889 - protein, 23 aa, Cryptosporidium parvum
RVIPILMIFLIYYRKVRVRRQSI

SEQ ID NO: 2249890 - protein, 20 aa, Cryptosporidium parvum
RYFSPLIIYVLDKALAYYSS

SEQ ID NO: 2249891 - protein, 20 aa, Cryptosporidium parvum
SAFYWIRRGFYLPRSYNLLK

SEQ ID NO: 2249892 - protein, 18 aa, Cryptosporidium parvum
SALWLWVLMAGSAILAIC

SEQ ID NO: 2249893 - protein, 25 aa, Cryptosporidium parvum
SCETYFYFHFFFTTNSKPLTFFFNE

SEQ ID NO: 2249894 - protein, 19 aa, Cryptosporidium parvum
SCEYILFITLVFLISISIM

SEQ ID NO: 2249895 - protein, 20 aa, Cryptosporidium parvum
SCLFILQILVALATITWVIV

SEQ ID NO: 2249896 - protein, 25 aa, Cryptosporidium parvum
SDPSTGLPFIPGFNVLVDPQTGEQI

SEQ ID NO: 2249897 - protein, 17 aa, Cryptosporidium parvum
SDPWIWLDLIETSFLPL

SEQ ID NO: 2249898 - protein, 19 aa, Cryptosporidium parvum
SEILLFPSILILKLLSIQN

SEQ ID NO: 2249899 - protein, 23 aa, Cryptosporidium parvum
SEKRRWIIDFFVYLIGGGLYGAV

SEQ ID NO: 2249900 - protein, 22 aa, Cryptosporidium parvum
SFEFHLFIKPWSYLDDIIENNT

SEQ ID NO: 2249901 - protein, 17 aa, Cryptosporidium parvum
SFIFLLFICLSFGIIVA

SEQ ID NO: 2249902 - protein, 22 aa, Cryptosporidium parvum
SFIGFIILIALIRIIYFAAKKR

SEQ ID NO: 2249903 - protein, 17 aa, Cryptosporidium parvum
SFILFTLIAYALPLIRE

SEQ ID NO: 2249904 - protein, 18 aa, Cryptosporidium parvum
SFLYILMEYAEGGSLYGL

SEQ ID NO: 2249905 - protein, 24 aa, Cryptosporidium parvum
SFSSYFWYFKLIGPKWMIVFTLGC

SEQ ID NO: 2249906 - protein, 23 aa, Cryptosporidium parvum
SFVLLFCLFFYQLDKLHAEVIYA

SEQ ID NO: 2249907 - protein, 26 aa, Cryptosporidium parvum
SGFSIHPFLLQLLFDFIKLYNIEEII

SEQ ID NO: 2249908 - protein, 17 aa, Cryptosporidium parvum
SGGLLIIGLCPWGWEYI

SEQ ID NO: 2249909 - protein, 27 aa, Cryptosporidium parvum
SHGFFLTLVFLLFSILSRIFSVIINIK

SEQ ID NO: 2249910 - protein, 25 aa, Cryptosporidium parvum
SHIYLLLVIILLVNLGIGLFFCGRN

SEQ ID NO: 2249911 - protein, 21 aa, Cryptosporidium parvum
SHPLVIIFIFILVVCMFAGGS

SEQ ID NO: 2249912 - protein, 22 aa, Cryptosporidium parvum
SHSKLPWFPTLSSALYLTEDAS

SEQ ID NO: 2249913 - protein, 19 aa, Cryptosporidium parvum
SICPTLCSLFLLLKSKVIR

SEQ ID NO: 2249914 - protein, 23 aa, Cryptosporidium parvum
SIFTRVIFIWLFQSFGKSQLNDL

SEQ ID NO: 2249915 - protein, 22 aa, Cryptosporidium parvum
SIFVFMLISLIFWALTRFFSFA

SEQ ID NO: 2249916 - protein, 25 aa, Cryptosporidium parvum
SIGMRWLIPWYLIEALLTKPNQINL

SEQ ID NO: 2249917 - protein, 18 aa, Cryptosporidium parvum
SIIIYLRPLILQELLCLF

SEQ ID NO: 2249918 - protein, 20 aa, Cryptosporidium parvum
SILSLLFKIIYLIRILNSLR

SEQ ID NO: 2249919 - protein, 25 aa, Cryptosporidium parvum
SILSVLRLIVYLIKSVFNIFSNISS

SEQ ID NO: 2249920 - protein, 25 aa, Cryptosporidium parvum
SISIRLYYFILRIVIIIGTISVLIP

SEQ ID NO: 2249921 - protein, 23 aa, Cryptosporidium parvum
SIVKFFWKLAYLVLFILCWVVFP

SEQ ID NO: 2249922 - protein, 20 aa, Cryptosporidium parvum
SIWFTVLLCFILILLITSSI

SEQ ID NO: 2249923 - protein, 18 aa, Cryptosporidium parvum
SIYLCIIILIITGLISII

SEQ ID NO: 2249924 - protein, 19 aa, Cryptosporidium parvum
SIYNFVFIFSIIISTIYLL

SEQ ID NO: 2249925 - protein, 19 aa, Cryptosporidium parvum
SKCSALIQSFWLGIADNVD

SEQ ID NO: 2249926 - protein, 24 aa, Cryptosporidium parvum
SKFAVFVFYAFFILQNSIVNAIDQ

SEQ ID NO: 2249927 - protein, 22 aa, Cryptosporidium parvum
SKLFNRFLLFSFLFFSTGLGYY

SEQ ID NO: 2249928 - protein, 17 aa, Cryptosporidium parvum
SKLKLWIKNWYIIDLIL

SEQ ID NO: 2249929 - protein, 26 aa, Cryptosporidium parvum
SKQLIDWVWIISSLPELIFGLLIQND

SEQ ID NO: 2249930 - protein, 17 aa, Cryptosporidium parvum
SKYIYYFEYIGRIYFLI

SEQ ID NO: 2249931 - protein, 22 aa, Cryptosporidium parvum
SKYLIYVFFIALFSFTVKLTIF

SEQ ID NO: 2249932 - protein, 18 aa, Cryptosporidium parvum
SLFAWLVYILIAIKRYLS

SEQ ID NO: 2249933 - protein, 21 aa, Cryptosporidium parvum
SLGILIWMKYLIKLAPIESIE

SEQ ID NO: 2249934 - protein, 24 aa, Cryptosporidium parvum
SLIGLVFWHILIPIVYLLCIYFDT

SEQ ID NO: 2249935 - protein, 21 aa, Cryptosporidium parvum
SLILLLFRWVILLMYIVAQLF

SEQ ID NO: 2249936 - protein, 33 aa, Cryptosporidium parvum
SLIPERILFGKLIFFLLGLLNIMYIKELKICGF

SEQ ID NO: 2249937 - protein, 18 aa, Cryptosporidium parvum
SLKHSFLWPHNNATLISA

SEQ ID NO: 2249938 - protein, 25 aa, Cryptosporidium parvum
SLLILVLSLYFLILSLDLSFINGDN

SEQ ID NO: 2249939 - protein, 26 aa, Cryptosporidium parvum
SLPFNFLLLFTLLVFSIGVVSVKSND

SEQ ID NO: 2249940 - protein, 35 aa, Cryptosporidium parvum
SLRIWIYRKLGKILNYIFKIIKTLSLFLIIGTFLF

SEQ ID NO: 2249941 - protein, 18 aa, Cryptosporidium parvum
SLSLLLYFSRKYIKEYAT

SEQ ID NO: 2249942 - protein, 25 aa, Cryptosporidium parvum
SLWQGIFLRFYIWAVLWAIMIIFTT

SEQ ID NO: 2249943 - protein, 17 aa, Cryptosporidium parvum
SLYILFDVGFFLSSSRG

SEQ ID NO: 2249944 - protein, 20 aa, Cryptosporidium parvum
SMILPYFQLLPIPSSEFKPI

SEQ ID NO: 2249945 - protein, 21 aa, Cryptosporidium parvum
SNFDYLKIFKIPLILFILSFI

SEQ ID NO: 2249946 - protein, 23 aa, Cryptosporidium parvum
SNLIRIWWHFIPIPHCEIPCPVP

SEQ ID NO: 2249947 - protein, 22 aa, Cryptosporidium parvum
SPINWLFWILDSDRISLLTMHE

SEQ ID NO: 2249948 - protein, 21 aa, Cryptosporidium parvum
SPTFLSVIPLIFRQFIDISYM

SEQ ID NO: 2249949 - protein, 23 aa, Cryptosporidium parvum
SQTIKFIFIIFKPNNLSINTPLS

SEQ ID NO: 2249950 - protein, 23 aa, Cryptosporidium parvum
SRPAMFCIIFISLLITILEICLA

SEQ ID NO: 2249951 - protein, 20 aa, Cryptosporidium parvum
SSAFGLRYIVPSVFAIFAAL

SEQ ID NO: 2249952 - protein, 22 aa, Cryptosporidium parvum
SSCKIIYKIILWLLKYSKNIDE

SEQ ID NO: 2249953 - protein, 24 aa, Cryptosporidium parvum
SSHPWFLIFWLVLCYIWIVAYTAF

SEQ ID NO: 2249954 - protein, 24 aa, Cryptosporidium parvum
SSIILLWIINFLKLQKQLPCLKQI

SEQ ID NO: 2249955 - protein, 17 aa, Cryptosporidium parvum
SSRKFILLSYQLTHFLL

SEQ ID NO: 2249956 - protein, 23 aa, Cryptosporidium parvum
SSRRTLMWFSISIIIVLLNIFIG

SEQ ID NO: 2249957 - protein, 22 aa, Cryptosporidium parvum
STFWKVLLGNIFLIILCLSNVY

SEQ ID NO: 2249958 - protein, 27 aa, Cryptosporidium parvum
STIFIIIIGIWLAWIFRYKRQTEIYDM

SEQ ID NO: 2249959 - protein, 22 aa, Cryptosporidium parvum
STRNIWIIPIANPWGFYHNKRT

SEQ ID NO: 2249960 - protein, 22 aa, Cryptosporidium parvum
SVALFLIIGWISCPILPLIWTL

SEQ ID NO: 2249961 - protein, 18 aa, Cryptosporidium parvum
SVFLLITLCLLIITRNSE

SEQ ID NO: 2249962 - protein, 24 aa, Cryptosporidium parvum
SVLFSYLVFILKTTPWWLNISDLI

SEQ ID NO: 2249963 - protein, 23 aa, Cryptosporidium parvum
SVVALFMFPAWPLAIKISVWYIS

SEQ ID NO: 2249964 - protein, 22 aa, Cryptosporidium parvum
SWAFFIYLIFFTSIFLICKIIF

SEQ ID NO: 2249965 - protein, 19 aa, Cryptosporidium parvum
SWIQWLFKFHRISSVPLNS

SEQ ID NO: 2249966 - protein, 17 aa, Cryptosporidium parvum
SWVFSLFIVSFFCYFSM

SEQ ID NO: 2249967 - protein, 17 aa, Cryptosporidium parvum
SWYRFWEKKPKYVHKNI

SEQ ID NO: 2249968 - protein, 23 aa, Cryptosporidium parvum
SYFFLIWSVWLFTISFLFIFMLS

SEQ ID NO: 2249969 - protein, 19 aa, Cryptosporidium parvum
SYILHMMFILIGSLDYYNL

SEQ ID NO: 2249970 - protein, 19 aa, Cryptosporidium parvum
SYIRLRYLIENLYLRMIVD

SEQ ID NO: 2249971 - protein, 20 aa, Cryptosporidium parvum
SYIYTYLWQFQINPYYIISN

SEQ ID NO: 2249972 - protein, 22 aa, Cryptosporidium parvum
SYTYYFSSLILWLFSKSNDSIV

SEQ ID NO: 2249973 - protein, 24 aa, Cryptosporidium parvum
TATYQLLYFLPISALVVVLSKGRV

SEQ ID NO: 2249974 - protein, 28 aa, Cryptosporidium parvum
TCDQFEFPWWFYNIIIVLAVLAVGIFYK

SEQ ID NO: 2249975 - protein, 23 aa, Cryptosporidium parvum
TCTRKYFVLGYLKSSLFLSNIVK

SEQ ID NO: 2249976 - protein, 22 aa, Cryptosporidium parvum
TDWIFFSIILFLTIVRGIEILV

SEQ ID NO: 2249977 - protein, 19 aa, Cryptosporidium parvum
TFCFGFMMVILFFNSSGSV

SEQ ID NO: 2249978 - protein, 24 aa, Cryptosporidium parvum
TFINYLLIFFFILFDSVTLFESKS

SEQ ID NO: 2249979 - protein, 27 aa, Cryptosporidium parvum
TFLITILIFLIFFFKRRLVIDLLLIVE

SEQ ID NO: 2249980 - protein, 23 aa, Cryptosporidium parvum
TFVRCLIICLFVFSWPISKFLDY

SEQ ID NO: 2249981 - protein, 20 aa, Cryptosporidium parvum
TFYLRIINILLFKLIYDIIQ

SEQ ID NO: 2249982 - protein, 27 aa, Cryptosporidium parvum
TGKYSLYFLFLAILIFLTTFAQNSFLQ

SEQ ID NO: 2249983 - protein, 26 aa, Cryptosporidium parvum
TGSIEFYLCILFSIALIFFGGILSGL

SEQ ID NO: 2249984 - protein, 22 aa, Cryptosporidium parvum
THIFKLFDIIWIKLSYLWCGER

SEQ ID NO: 2249985 - protein, 25 aa, Cryptosporidium parvum
TIENSFPWFIPVKTSVQFFDLNSTR

SEQ ID NO: 2249986 - protein, 32 aa, Cryptosporidium parvum; identical to SEQ ID NO: 2134959

SEQ ID NO: 2249987 - protein, 20 aa, Cryptosporidium parvum
TIGMYIFTLMPWWNPDPTYL

SEQ ID NO: 2249988 - protein, 24 aa, Cryptosporidium parvum
TIIFNIIIFLYLLSSFNIIRCNGE

SEQ ID NO: 2249989 - protein, 23 aa, Cryptosporidium parvum
TILMIELILFSFPFNIPNLPLPK

SEQ ID NO: 2249990 - protein, 25 aa, Cryptosporidium parvum
TIRDYFNYKLFWKYYINIEYLEITR

SEQ ID NO: 2249991 - protein, 19 aa, Cryptosporidium parvum
TIVFPPCPILLFSLRDINS

SEQ ID NO: 2249992 - protein, 18 aa, Cryptosporidium parvum
TIWIPLYNNVLLWITLIS

SEQ ID NO: 2249993 - protein, 17 aa, Cryptosporidium parvum
TIYIGYFIYLDYRFIIV

SEQ ID NO: 2249994 - protein, 23 aa, Cryptosporidium parvum
TKFNLFMFITYDKYIDLLLESGQ

SEQ ID NO: 2249995 - protein, 23 aa, Cryptosporidium parvum
TKLFWILIPIIICIISLSTNIFD

SEQ ID NO: 2249996 - protein, 17 aa, Cryptosporidium parvum
TLFIFVLKFVAIAANQD

SEQ ID NO: 2249997 - protein, 21 aa, Cryptosporidium parvum
TLFINLMIKYEFLWQSWKNNN

SEQ ID NO: 2249998 - protein, 26 aa, Cryptosporidium parvum
TLFLLSLLFFIVFLSGIYFLWKKYPA

SEQ ID NO: 2249999 - protein, 22 aa, Cryptosporidium parvum
TLKPIPLIVILFSCLKYLIVNC

SEQ ID NO: 2250000 - protein, 23 aa, Cryptosporidium parvum
TLSKILFLLLIITSFVLVFCKGF

SEQ ID NO: 2250001 - protein, 29 aa, Cryptosporidium parvum
TLSLFLIIGTFLFIIWNSINHFGQYGESK

SEQ ID NO: 2250002 - protein, 24 aa, Cryptosporidium parvum
TLWSKLFFTWLSPWMSKFLGPGVN

SEQ ID NO: 2250003 - protein, 17 aa, Cryptosporidium parvum
TMPLFYILSCWKLLWCL

SEQ ID NO: 2250004 - protein, 22 aa, Cryptosporidium parvum
TNRILIFHFIVVIFVVIITLIV

SEQ ID NO: 2250005 - protein, 26 aa, Cryptosporidium parvum
TPDLYLFPRFLSFYKLAPIKLRQQMW

SEQ ID NO: 2250006 - protein, 22 aa, Cryptosporidium parvum
TPHYLILIYIFVGITFITVGIF

SEQ ID NO: 2250007 - protein, 19 aa, Cryptosporidium parvum
TPYIFIPLLKDINSKKDKS

SEQ ID NO: 2250008 - protein, 23 aa, Cryptosporidium parvum
TRILQKIRILNIPDIYIQATAKK

SEQ ID NO: 2250009 - protein, 23 aa, Cryptosporidium parvum
TRWYLPGYWWYEKVTFTSEVSLP

SEQ ID NO: 2250010 - protein, 22 aa, Cryptosporidium parvum
TRYNPYFLGWILSELIALLTNQ

SEQ ID NO: 2250011 - protein, 20 aa, Cryptosporidium parvum
TSEFPWFTSAWLRRACLALE

SEQ ID NO: 2250012 - protein, 24 aa, Cryptosporidium parvum
TSKKYFHRALFDPTFLQYIYMILG

SEQ ID NO: 2250013 - protein, 25 aa, Cryptosporidium parvum
TSQYFLWWFILFPLALRVYLTNNIA

SEQ ID NO: 2250014 - protein, 18 aa, Cryptosporidium parvum
TVFLFRILRYWNNDITSS

SEQ ID NO: 2250015 - protein, 18 aa, Cryptosporidium parvum
TVFPWCISLLLYSLLHFT

SEQ ID NO: 2250016 - protein, 22 aa, Cryptosporidium parvum
TVTFNLLFMLFLHIFGLVLTRN

SEQ ID NO: 2250017 - protein, 20 aa, Cryptosporidium parvum
TVVKQPWYAPLKKIGINIIS

SEQ ID NO: 2250018 - protein, 22 aa, Cryptosporidium parvum
VDLYLPIFLLFLETFSFEDLNG

SEQ ID NO: 2250019 - protein, 18 aa, Cryptosporidium parvum
VEIQLIYYLVYSLSIHNI

SEQ ID NO: 2250020 - protein, 22 aa, Cryptosporidium parvum
VETIIRLLFFFNYFVRMSTEMN

SEQ ID NO: 2250021 - protein, 23 aa, Cryptosporidium parvum
VETKLFLIFIIKTSLLGIQNTFF

SEQ ID NO: 2250022 - protein, 19 aa, Cryptosporidium parvum
VFITYFLIIYTVSATELDS

SEQ ID NO: 2250023 - protein, 19 aa, Cryptosporidium parvum
VFLIATFIIMLLSPILCFI

SEQ ID NO: 2250024 - protein, 24 aa, Cryptosporidium parvum
VFNWFTFIIFVIYILLIGCRHIDL

SEQ ID NO: 2250025 - protein, 22 aa, Cryptosporidium parvum
VFVIICRFLFFPVSTLRRIKMQ

SEQ ID NO: 2250026 - protein, 19 aa, Cryptosporidium parvum
VIDLLLIVELILIDILFSK

SEQ ID NO: 2250027 - protein, 29 aa, Cryptosporidium parvum
VIERLMLYFIIFVLLLANIYVFFRRILGR

SEQ ID NO: 2250028 - protein, 18 aa, Cryptosporidium parvum
VIGLFFLSQLNPLCLLLF

SEQ ID NO: 2250029 - protein, 25 aa, Cryptosporidium parvum
VILMMLLFVLLYFTLNNSLSIIKDY

SEQ ID NO: 2250030 - protein, 24 aa, Cryptosporidium parvum
VIVNYFFIFIILFSVLGIKIYKRV

SEQ ID NO: 2250031 - protein, 23 aa, Cryptosporidium parvum
VKRNYFLKLFWKITRKITIALRN

SEQ ID NO: 2250032 - protein, 19 aa, Cryptosporidium parvum
VLERYIFGILTFLSEKILN

SEQ ID NO: 2250033 - protein, 27 aa, Cryptosporidium parvum
VLGFAILICFLIGFYLILFSAKHPTSK

SEQ ID NO: 2250034 - protein, 19 aa, Cryptosporidium parvum
VLVFCIVLNILNLSFVTSK

SEQ ID NO: 2250035 - protein, 17 aa, Cryptosporidium parvum
VMYFLLAGTLPFTGRSI

SEQ ID NO: 2250036 - protein, 17 aa, Cryptosporidium parvum
VPIHQLLRQYFPHCTVF

SEQ ID NO: 2250037 - protein, 26 aa, Cryptosporidium parvum
VPSIILLSLLAFVVWFLLAYYDKVDP

SEQ ID NO: 2250038 - protein, 26 aa, Cryptosporidium parvum
VQLFNLFFMFFAFTSFIMILMDSLEC

SEQ ID NO: 2250039 - protein, 24 aa, Cryptosporidium parvum
VSIQELFGFVLSVLHLGGFNVSSF

SEQ ID NO: 2250040 - protein, 30 aa, Cryptosporidium parvum; identical to SEQ ID NO: 2135003

SEQ ID NO: 2250041 - protein, 18 aa, Cryptosporidium parvum
VSSSIYNFVFIFSIIIST

SEQ ID NO: 2250042 - protein, 21 aa, Cryptosporidium parvum
VSWFIFRYFFDFIRYFIEENK

SEQ ID NO: 2250043 - protein, 20 aa, Cryptosporidium parvum
VSYFFFLFVKMLIDCIKYIK

SEQ ID NO: 2250044 - protein, 17 aa, Cryptosporidium parvum
VTLLLLLASFIYSYLTG

SEQ ID NO: 2250045 - protein, 17 aa, Cryptosporidium parvum
VTLVFISVSLIIVLIFK

SEQ ID NO: 2250046 - protein, 24 aa, Cryptosporidium parvum
VTYPYYYRPFFGYGFPLLGTEPYF

SEQ ID NO: 2250047 - protein, 24 aa, Cryptosporidium parvum
VVGRYFYMILVEKLSFNTGGICSF

SEQ ID NO: 2250048 - protein, 20 aa, Cryptosporidium parvum
VVNFLRLYLIKVLPKNILGT

SEQ ID NO: 2250049 - protein, 22 aa, Cryptosporidium parvum
VVYPSLFTLFPLFRQILIREKI

SEQ ID NO: 2250050 - protein, 20 aa, Cryptosporidium parvum
VWVLIYFYIHYLLLNTIDCT

SEQ ID NO: 2250051 - protein, 18 aa, Cryptosporidium parvum
VYFFLFSLYYFLSYSNHI

SEQ ID NO: 2250052 - protein, 19 aa, Cryptosporidium parvum
VYGCILLTSLIFITIYLFI

SEQ ID NO: 2250053 - protein, 18 aa, Cryptosporidium parvum
WFLVIPYWIIYFIQSGNN

SEQ ID NO: 2250054 - protein, 17 aa, Cryptosporidium parvum
WFVIGFQEDIFLEYIAL

SEQ ID NO: 2250055 - protein, 22 aa, Cryptosporidium parvum
WGIFLGMFLAIVRIIPAGFASF

SEQ ID NO: 2250056 - protein, 20 aa, Cryptosporidium parvum
WGILRFFLLFFLSGVGGNLA

SEQ ID NO: 2250057 - protein, 20 aa, Cryptosporidium parvum
WGLLLFWLFSALESSFFYIY

SEQ ID NO: 2250058 - protein, 17 aa, Cryptosporidium parvum
WIAQGHELLFFYLTYYS

SEQ ID NO: 2250059 - protein, 24 aa, Cryptosporidium parvum
WIIPQWFLIYLRLSVFLYLLIMLG

SEQ ID NO: 2250060 - protein, 17 aa, Cryptosporidium parvum
WILCFIYGTFIALTDSY

SEQ ID NO: 2250061 - protein, 25 aa, Cryptosporidium parvum
WLIPSEYLLYLIFRISSESYSDSLI

SEQ ID NO: 2250062 - protein, 27 aa, Cryptosporidium parvum
WMELIAFWVLLIMVIVLLRGIRSNYEV

SEQ ID NO: 2250063 - protein, 21 aa, Cryptosporidium parvum
WRNIFGLIWVIFYTKPFKPKD

SEQ ID NO: 2250064 - protein, 17 aa, Cryptosporidium parvum
WSFLNPLGFLWVLIIQR

SEQ ID NO: 2250065 - protein, 17 aa, Cryptosporidium parvum
WSWTLLQLLDIVSLYII

SEQ ID NO: 2250066 - protein, 17 aa, Cryptosporidium parvum
WTLTLVLLIIQVVLGQN

SEQ ID NO: 2250067 - protein, 18 aa, Cryptosporidium parvum
WVNLYWTQPPYGGAAELF

SEQ ID NO: 2250068 - protein, 24 aa, Cryptosporidium parvum
WYIIQWLICMLITLSFYTLSYIDK

SEQ ID NO: 2250069 - protein, 17 aa, Cryptosporidium parvum
WYVSFARFMLLLSSIIP

SEQ ID NO: 2250070 - protein, 17 aa, Cryptosporidium parvum
YAILLILIINSAFFTIN

SEQ ID NO: 2250071 - protein, 17 aa, Cryptosporidium parvum
YAIYFWSDAINAKVYSP

SEQ ID NO: 2250072 - protein, 25 aa, Cryptosporidium parvum
YALIWMTWCLWLLGSFLFSFGRVML

SEQ ID NO: 2250073 - protein, 17 aa, Cryptosporidium parvum
YCFFCRIFIYLKKIKIN

SEQ ID NO: 2250074 - protein, 24 aa, Cryptosporidium parvum
YDDAYIWQYLFDTPWFKIDCVPDV

SEQ ID NO: 2250075 - protein, 17 aa, Cryptosporidium parvum
YEEYFFLSNLKLLELVD

SEQ ID NO: 2250076 - protein, 20 aa, Cryptosporidium parvum
YERLFRQLLCTLITLLGVSS

SEQ ID NO: 2250077 - protein, 17 aa, Cryptosporidium parvum
YERPWYFIFGSVLLTLI

SEQ ID NO: 2250078 - protein, 19 aa, Cryptosporidium parvum
YFEFPIQILFWFGYENTRL

SEQ ID NO: 2250079 - protein, 22 aa, Cryptosporidium parvum
YFFQAVFIFVIFFGLALSENID

SEQ ID NO: 2250080 - protein, 19 aa, Cryptosporidium parvum
YFHHLYLFIYFFFTLNISI

SEQ ID NO: 2250081 - protein, 26 aa, Cryptosporidium parvum
YFINIAKLIFHYILNPRLNTLKELYP

SEQ ID NO: 2250082 - protein, 17 aa, Cryptosporidium parvum
YFKKKIIPKMTILDLIE

SEQ ID NO: 2250083 - protein, 17 aa, Cryptosporidium parvum
YFKLFLYYIVISNLVHS

SEQ ID NO: 2250084 - protein, 26 aa, Cryptosporidium parvum
YFKSAYFFFLVFFALHFFIVKGQIQL

SEQ ID NO: 2250085 - protein, 19 aa, Cryptosporidium parvum
YFKYAYVLFSWLTRVLYKQ

SEQ ID NO: 2250086 - protein, 19 aa, Cryptosporidium parvum
YFLIVYLVFPILRRHFYAT

SEQ ID NO: 2250087 - protein, 19 aa, Cryptosporidium parvum
YFQYDFVLRYIFLNSLKIS

SEQ ID NO: 2250088 - protein, 18 aa, Cryptosporidium parvum
YFYQYIYITYYQLFHPPL

SEQ ID NO: 2250089 - protein, 17 aa, Cryptosporidium parvum
YGDFFFIILISTFLKEV

SEQ ID NO: 2250090 - protein, 25 aa, Cryptosporidium parvum
YGYLKFIILYFLSLVLWGLYRHHLH

SEQ ID NO: 2250091 - protein, 25 aa, Cryptosporidium parvum
YICSHGTFFWILKRYILPWDTYSDY

SEQ ID NO: 2250092 - protein, 28 aa, Cryptosporidium parvum
YIFCCLLFFIWYICTWFVGAHLLRIETK

SEQ ID NO: 2250093 - protein, 19 aa, Cryptosporidium parvum
YIFNYWFAIYLLYSTRYIN

SEQ ID NO: 2250094 - protein, 22 aa, Cryptosporidium parvum
YIGLLLYYFINIAKLIFHYILN

SEQ ID NO: 2250095 - protein, 30 aa, Cryptosporidium parvum
YIGYFIYLDYRFIIVFLPISYFFNKFRIRA

SEQ ID NO: 2250096 - protein, 25 aa, Cryptosporidium parvum
YILNNRLFSLWLFVQKRLTTIQIAI

SEQ ID NO: 2250097 - protein, 19 aa, Cryptosporidium parvum
YILWIFQAFLEITEGVVKK

SEQ ID NO: 2250098 - protein, 19 aa, Cryptosporidium parvum
YIPLPIFTLIIHTFSLKSD

SEQ ID NO: 2250099 - protein, 24 aa, Cryptosporidium parvum
YIPYHLFFLIVLFSIVSILWIINI

SEQ ID NO: 2250100 - protein, 19 aa, Cryptosporidium parvum
YIRSLLRLFFLFSSFKEDN

SEQ ID NO: 2250101 - protein, 17 aa, Cryptosporidium parvum
YIYNGLILDFKILYKVY

SEQ ID NO: 2250102 - protein, 37 aa, Cryptosporidium parvum
YIYPYYWKYILEPIRYIISIIFYFIWGIELTPKKEFD

SEQ ID NO: 2250103 - protein, 19 aa, Cryptosporidium parvum
YIYYFEYIGRIYFLIFLLV

SEQ ID NO: 2250104 - protein, 22 aa, Cryptosporidium parvum
YKKSMWLFFGIGIVQMTLSLFL

SEQ ID NO: 2250105 - protein, 17 aa, Cryptosporidium parvum
YKLYWKLMLTCGVATIC

SEQ ID NO: 2250106 - protein, 17 aa, Cryptosporidium parvum
YLKILLIIIERIGMDLT

SEQ ID NO: 2250107 - protein, 17 aa, Cryptosporidium parvum
YLPCQLLITSLGFKPKY

SEQ ID NO: 2250108 - protein, 19 aa, Cryptosporidium parvum
YLRIPLLLQFFSDENRINS

SEQ ID NO: 2250109 - protein, 20 aa, Cryptosporidium parvum
YLRYLYACRIILYSKNYNLI

SEQ ID NO: 2250110 - protein, 24 aa, Cryptosporidium parvum
YLSDWIFIYELLTGYFPLEVIPGE

SEQ ID NO: 2250111 - protein, 18 aa, Cryptosporidium parvum
YLVVIFFTILCENIDEKL

SEQ ID NO: 2250112 - protein, 20 aa, Cryptosporidium parvum
YLYILVIFKVNYVISIRNNK

SEQ ID NO: 2250113 - protein, 21 aa, Cryptosporidium parvum
YMESFFKYFYQYIYITYYQLF

SEQ ID NO: 2250114 - protein, 20 aa, Cryptosporidium parvum
YNDFLFEFIIKFILKQESCQ

SEQ ID NO: 2250115 - protein, 18 aa, Cryptosporidium parvum
YNELLFYSHFRWLKGEYI

SEQ ID NO: 2250116 - protein, 19 aa, Cryptosporidium parvum
YNYHYFWDPALLLNAFYSQ

SEQ ID NO: 2250117 - protein, 17 aa, Cryptosporidium parvum
YPKFLNFSLLKSSLFDY

SEQ ID NO: 2250118 - protein, 18 aa, Cryptosporidium parvum
YQDGFLSSLWKFIKNIYF

SEQ ID NO: 2250119 - protein, 21 aa, Cryptosporidium parvum
YQLLRFQPLVIKAFLGRLVFP

SEQ ID NO: 2250120 - protein, 18 aa, Cryptosporidium parvum
YQLYILLVFLIESSDWFI

SEQ ID NO: 2250121 - protein, 17 aa, Cryptosporidium parvum
YRFWEKKPKYVHKNING

SEQ ID NO: 2250122 - protein, 18 aa, Cryptosporidium parvum
YTLILTFKWELFIIFSLV

SEQ ID NO: 2250123 - protein, 22 aa, Cryptosporidium parvum
YTLLTIFIIMFITTFINYSIEI

SEQ ID NO: 2250124 - protein, 17 aa, Cryptosporidium parvum
YTTTPFWSLTILNSPFL

SEQ ID NO: 2250125 - protein, 20 aa, Cryptosporidium parvum
YVGLLVIISGIWLVSRLAKI

SEQ ID NO: 2250126 - protein, 17 aa, Cryptosporidium parvum
YVKFKTLLTYLFTYFKE

SEQ ID NO: 2250127 - protein, 21 aa, Cryptosporidium parvum
YVSLFNPFLIPIILDCFSVII

SEQ ID NO: 2250128 - protein, 25 aa, Cryptosporidium parvum
YVSRYLYLVVSLLDLPYFVDSFSLF

SEQ ID NO: 2250129 - protein, 20 aa, Cryptosporidium parvum
YWYFSKLKWSWTIALFILCY

SEQ ID NO: 2250130 - protein, 22 aa, Cryptosporidium parvum
YWYRVFRSLSLLLYFSRKYIKE

SEQ ID NO: 2250131 - protein, 21 aa, Cryptosporidium parvum
YYLFFIVIINILILSNGATVP

SEQ ID NO: 2250132 - protein, 17 aa, Cryptosporidium parvum
YYLFYSTLSWFSSSFSG

SEQ ID NO: 2250133 - protein, 21 aa, Cryptosporidium parvum
YYLLTFFTFNFILKALIPASI

SEQ ID NO: 2250134 - protein, 17 aa, Cryptosporidium parvum
YYMMIYDLEWTWKYILS

SEQ ID NO: 2250135 - protein, 25 aa, Cryptosporidium parvum
YYYYYYYYIILMPILMDKLNNPLYC

SEQ ID NO: 2250136 - protein, 8 aa, Cryptosporidium parvum
GPPGTGKT

SEQ ID NO: 2250137 - protein, 4 aa, Cryptosporidium parvum
AGGL

SEQ ID NO: 2250138 - protein, 8 aa, Cryptosporidium parvum
EPSDTIEN

SEQ ID NO: 2250139 - protein, 12 aa, Cryptosporidium parvum
KIQDKEGIPPDQ

SEQ ID NO: 2250140 - protein, 8 aa, Cryptosporidium parvum
QLEDGRTL

SEQ ID NO: 2250141 - protein, 4 aa, Cryptosporidium parvum
SSSI

SEQ ID NO: 2250142 - protein, 4 aa, Cryptosporidium parvum
TPEE

SEQ ID NO: 2250143 - protein, 4 aa, Cryptosporidium parvum
DEID

SEQ ID NO: 2250144 - protein, 4 aa, Cryptosporidium parvum
GNPL

SEQ ID NO: 2250145 - protein, 5 aa, Cryptosporidium parvum
IQKES

SEQ ID NO: 2250146 - protein, 4 aa, Cryptosporidium parvum
ISDE

SEQ ID NO: 2250147 - protein, 4 aa, Cryptosporidium parvum
KDLE

SEQ ID NO: 2250148 - protein, 8 aa, Cryptosporidium parvum
MKEKRPDI

SEQ ID NO: 2250149 - protein, 4 aa, Cryptosporidium parvum
NKIT

SEQ ID NO: 2250150 - protein, 4 aa, Cryptosporidium parvum
NSEI

SEQ ID NO: 2250151 - protein, 4 aa, Cryptosporidium parvum
NSLE

SEQ ID NO: 2250152 - protein, 13 aa, Cryptosporidium parvum
PGDPGPPGGDCSG

SEQ ID NO: 2250153 - protein, 5 aa, Cryptosporidium parvum
PPGCG

SEQ ID NO: 2250154 - protein, 5 aa, Cryptosporidium parvum
TPLQN

SEQ ID NO: 2250155 - protein, 17 aa, Cryptosporidium parvum
VERVSSSRNADKFKEDM

SEQ ID NO: 2250156 - protein, 11 aa, Cryptosporidium parvum
YGTAGSESKVE

SEQ ID NO: 2250157 - protein, 6 aa, Cryptosporidium parvum
AAGKTT

SEQ ID NO: 2250158 - protein, 13 aa, Cryptosporidium parvum
ADVGYNSKPEINL

SEQ ID NO: 2250159 - protein, 4 aa, Cryptosporidium parvum
AGET

SEQ ID NO: 2250160 - protein, 6 aa, Cryptosporidium parvum
AGQERF

SEQ ID NO: 2250161 - protein, 7 aa, Cryptosporidium parvum
AGQERYR

SEQ ID NO: 2250162 - protein, 4 aa, Cryptosporidium parvum
ANER

SEQ ID NO: 2250163 - protein, 7 aa, Cryptosporidium parvum
ASDDRGI

SEQ ID NO: 2250164 - protein, 4 aa, Cryptosporidium parvum
ATEL

SEQ ID NO: 2250165 - protein, 4 aa, Cryptosporidium parvum
ATQI

SEQ ID NO: 2250166 - protein, 4 aa, Cryptosporidium parvum
DDQY

SEQ ID NO: 2250167 - protein, 5 aa, Cryptosporidium parvum
DEKEY

SEQ ID NO: 2250168 - protein, 4 aa, Cryptosporidium parvum
DGVT

SEQ ID NO: 2250169 - protein, 4 aa, Cryptosporidium parvum
DKSN

SEQ ID NO: 2250170 - protein, 10 aa, Cryptosporidium parvum
DLKGQEKSVF

SEQ ID NO: 2250171 - protein, 8 aa, Cryptosporidium parvum
DPSTAKSQ

SEQ ID NO: 2250172 - protein, 4 aa, Cryptosporidium parvum
DPTV

SEQ ID NO: 2250173 - protein, 4 aa, Cryptosporidium parvum
DQRN

SEQ ID NO: 2250174 - protein, 4 aa, Cryptosporidium parvum
DSED

SEQ ID NO: 2250175 - protein, 4 aa, Cryptosporidium parvum
DSEK

SEQ ID NO: 2250176 - protein, 5 aa, Cryptosporidium parvum
DSSWE

SEQ ID NO: 2250177 - protein, 4 aa, Cryptosporidium parvum
DVNE

SEQ ID NO: 2250178 - protein, 4 aa, Cryptosporidium parvum
DYYS

SEQ ID NO: 2250179 - protein, 4 aa, Cryptosporidium parvum
EDES

SEQ ID NO: 2250180 - protein, 5 aa, Cryptosporidium parvum
EDPKE

SEQ ID NO: 2250181 - protein, 5 aa, Cryptosporidium parvum
EDSNL

SEQ ID NO: 2250182 - protein, 4 aa, Cryptosporidium parvum
EEAI

SEQ ID NO: 2250183 - protein, 4 aa, Cryptosporidium parvum
EEDD

SEQ ID NO: 2250184 - protein, 4 aa, Cryptosporidium parvum
EEDI

SEQ ID NO: 2250185 - protein, 4 aa, Cryptosporidium parvum
EESS

SEQ ID NO: 2250186 - protein, 4 aa, Cryptosporidium parvum
EETN

SEQ ID NO: 2250187 - protein, 5 aa, Cryptosporidium parvum
EITSN

SEQ ID NO: 2250188 - protein, 4 aa, Cryptosporidium parvum
EKDS

SEQ ID NO: 2250189 - protein, 5 aa, Cryptosporidium parvum
ELEEE

SEQ ID NO: 2250190 - protein, 4 aa, Cryptosporidium parvum
ELKE

SEQ ID NO: 2250191 - protein, 4 aa, Cryptosporidium parvum
ENEE

SEQ ID NO: 2250192 - protein, 4 aa, Cryptosporidium parvum
ENNE

SEQ ID NO: 2250193 - protein, 4 aa, Cryptosporidium parvum
ENRK

SEQ ID NO: 2250194 - protein, 8 aa, Cryptosporidium parvum
EQSRRDDL

SEQ ID NO: 2250195 - protein, 4 aa, Cryptosporidium parvum
ERIN

SEQ ID NO: 2250196 - protein, 4 aa, Cryptosporidium parvum
ERTI

SEQ ID NO: 2250197 - protein, 4 aa, Cryptosporidium parvum
ESED

SEQ ID NO: 2250198 - protein, 4 aa, Cryptosporidium parvum
ESIT

SEQ ID NO: 2250199 - protein, 4 aa, Cryptosporidium parvum
ETGK

SEQ ID NO: 2250200 - protein, 7 aa, Cryptosporidium parvum
ETGSGKT

SEQ ID NO: 2250201 - protein, 10 aa, Cryptosporidium parvum
ETGSGKTTQI

SEQ ID NO: 2250202 - protein, 4 aa, Cryptosporidium parvum
ETSV

SEQ ID NO: 2250203 - protein, 4 aa, Cryptosporidium parvum
FESD

SEQ ID NO: 2250204 - protein, 4 aa, Cryptosporidium parvum
FGSN

SEQ ID NO: 2250205 - protein, 5 aa, Cryptosporidium parvum
FSESG

SEQ ID NO: 2250206 - protein, 6 aa, Cryptosporidium parvum
FSPSGK

SEQ ID NO: 2250207 - protein, 4 aa, Cryptosporidium parvum
GAGN

SEQ ID NO: 2250208 - protein, 4 aa, Cryptosporidium parvum
GDPS

SEQ ID NO: 2250209 - protein, 4 aa, Cryptosporidium parvum
GENS

SEQ ID NO: 2250210 - protein, 4 aa, Cryptosporidium parvum
GERS

SEQ ID NO: 2250211 - protein, 4 aa, Cryptosporidium parvum
GGDG

SEQ ID NO: 2250212 - protein, 4 aa, Cryptosporidium parvum
GKST

SEQ ID NO: 2250213 - protein, 5 aa, Cryptosporidium parvum
GQDKI

SEQ ID NO: 2250214 - protein, 10 aa, Cryptosporidium parvum
GQTNYSAANS

SEQ ID NO: 2250215 - protein, 7 aa, Cryptosporidium parvum
GSDENGI

SEQ ID NO: 2250216 - protein, 5 aa, Cryptosporidium parvum
GTFRP

SEQ ID NO: 2250217 - protein, 4 aa, Cryptosporidium parvum
IDPS

SEQ ID NO: 2250218 - protein, 4 aa, Cryptosporidium parvum
IEAS

SEQ ID NO: 2250219 - protein, 4 aa, Cryptosporidium parvum
IEDS

SEQ ID NO: 2250220 - protein, 4 aa, Cryptosporidium parvum
IEGS

SEQ ID NO: 2250221 - protein, 4 aa, Cryptosporidium parvum
IEKS

SEQ ID NO: 2250222 - protein, 4 aa, Cryptosporidium parvum
IQLE

SEQ ID NO: 2250223 - protein, 4 aa, Cryptosporidium parvum
IQQN

SEQ ID NO: 2250224 - protein, 26 aa, Cryptosporidium parvum
IRIPPKKDFSTPPIKKEADTSIQTKS

SEQ ID NO: 2250225 - protein, 4 aa, Cryptosporidium parvum
ISNS

SEQ ID NO: 2250226 - protein, 6 aa, Cryptosporidium parvum
ISSNGQ

SEQ ID NO: 2250227 - protein, 4 aa, Cryptosporidium parvum
ISTL

SEQ ID NO: 2250228 - protein, 5 aa, Cryptosporidium parvum
ITKKE

SEQ ID NO: 2250229 - protein, 4 aa, Cryptosporidium parvum
ITSY

SEQ ID NO: 2250230 - protein, 4 aa, Cryptosporidium parvum
KEEE

SEQ ID NO: 2250231 - protein, 4 aa, Cryptosporidium parvum
KEKI

SEQ ID NO: 2250232 - protein, 4 aa, Cryptosporidium parvum
KELD

SEQ ID NO: 2250233 - protein, 4 aa, Cryptosporidium parvum
KESF

SEQ ID NO: 2250234 - protein, 4 aa, Cryptosporidium parvum
KEVE

SEQ ID NO: 2250235 - protein, 4 aa, Cryptosporidium parvum
KGYS

SEQ ID NO: 2250236 - protein, 4 aa, Cryptosporidium parvum
KISS

SEQ ID NO: 2250237 - protein, 5 aa, Cryptosporidium parvum
KLPSS

SEQ ID NO: 2250238 - protein, 5 aa, Cryptosporidium parvum
KNKER

SEQ ID NO: 2250239 - protein, 4 aa, Cryptosporidium parvum
KNNS

SEQ ID NO: 2250240 - protein, 5 aa, Cryptosporidium parvum
KRTNS

SEQ ID NO: 2250241 - protein, 4 aa, Cryptosporidium parvum
KSAL

SEQ ID NO: 2250242 - protein, 4 aa, Cryptosporidium parvum
KSDE

SEQ ID NO: 2250243 - protein, 4 aa, Cryptosporidium parvum
KSKD

SEQ ID NO: 2250244 - protein, 4 aa, Cryptosporidium parvum
KTGI

SEQ ID NO: 2250245 - protein, 4 aa, Cryptosporidium parvum
KTQR

SEQ ID NO: 2250246 - protein, 4 aa, Cryptosporidium parvum
KTSN

SEQ ID NO: 2250247 - protein, 4 aa, Cryptosporidium parvum
LDPS

SEQ ID NO: 2250248 - protein, 4 aa, Cryptosporidium parvum
LEEQ

SEQ ID NO: 2250249 - protein, 6 aa, Cryptosporidium parvum
LENQDD

SEQ ID NO: 2250250 - protein, 4 aa, Cryptosporidium parvum
LESN

SEQ ID NO: 2250251 - protein, 4 aa, Cryptosporidium parvum
LESS

SEQ ID NO: 2250252 - protein, 27 aa, Cryptosporidium parvum
LKIPPKKDFSTPPIKKEADTSIQTKSN

SEQ ID NO: 2250253 - protein, 27 aa, Cryptosporidium parvum
LKIPPKKDFSTPPVKKEADTSIQTKSN

SEQ ID NO: 2250254 - protein, 27 aa, Cryptosporidium parvum
LKIPPKKDLSTPPVKKEADTSIQTKSN

SEQ ID NO: 2250255 - protein, 5 aa, Cryptosporidium parvum
LNEDE

SEQ ID NO: 2250256 - protein, 4 aa, Cryptosporidium parvum
LNEG

SEQ ID NO: 2250257 - protein, 4 aa, Cryptosporidium parvum
LNNE

SEQ ID NO: 2250258 - protein, 15 aa, Cryptosporidium parvum
LNNVGSEKEDRHNNE

SEQ ID NO: 2250259 - protein, 4 aa, Cryptosporidium parvum
LPPG

SEQ ID NO: 2250260 - protein, 5 aa, Cryptosporidium parvum
LSENE

SEQ ID NO: 2250261 - protein, 4 aa, Cryptosporidium parvum
LSSE

SEQ ID NO: 2250262 - protein, 5 aa, Cryptosporidium parvum
LSSSS

SEQ ID NO: 2250263 - protein, 4 aa, Cryptosporidium parvum
MGGA

SEQ ID NO: 2250264 - protein, 9 aa, Cryptosporidium parvum
NAGPNTNGS

SEQ ID NO: 2250265 - protein, 4 aa, Cryptosporidium parvum
NEEN

SEQ ID NO: 2250266 - protein, 5 aa, Cryptosporidium parvum
NIKSE

SEQ ID NO: 2250267 - protein, 4 aa, Cryptosporidium parvum
NINS

SEQ ID NO: 2250268 - protein, 4 aa, Cryptosporidium parvum
NKPL

SEQ ID NO: 2250269 - protein, 5 aa, Cryptosporidium parvum
NNRDS

SEQ ID NO: 2250270 - protein, 4 aa, Cryptosporidium parvum
NNYN

SEQ ID NO: 2250271 - protein, 4 aa, Cryptosporidium parvum
NPER

SEQ ID NO: 2250272 - protein, 4 aa, Cryptosporidium parvum
NQNE

SEQ ID NO: 2250273 - protein, 4 aa, Cryptosporidium parvum
NRSR

SEQ ID NO: 2250274 - protein, 5 aa, Cryptosporidium parvum
NSKLN

SEQ ID NO: 2250275 - protein, 5 aa, Cryptosporidium parvum
NSPIT

SEQ ID NO: 2250276 - protein, 4 aa, Cryptosporidium parvum
NSSQ

SEQ ID NO: 2250277 - protein, 4 aa, Cryptosporidium parvum
NTNE

SEQ ID NO: 2250278 - protein, 4 aa, Cryptosporidium parvum
NTPK

SEQ ID NO: 2250279 - protein, 4 aa, Cryptosporidium parvum
PASN

SEQ ID NO: 2250280 - protein, 5 aa, Cryptosporidium parvum
PDLEP

SEQ ID NO: 2250281 - protein, 4 aa, Cryptosporidium parvum
PEKL

SEQ ID NO: 2250282 - protein, 4 aa, Cryptosporidium parvum
PESE

SEQ ID NO: 2250283 - protein, 4 aa, Cryptosporidium parvum
PGRL

SEQ ID NO: 2250284 - protein, 4 aa, Cryptosporidium parvum
PNEN

SEQ ID NO: 2250285 - protein, 4 aa, Cryptosporidium parvum
PNNV

SEQ ID NO: 2250286 - protein, 4 aa, Cryptosporidium parvum
PNVP

SEQ ID NO: 2250287 - protein, 5 aa, Cryptosporidium parvum
PPLPD

SEQ ID NO: 2250288 - protein, 4 aa, Cryptosporidium parvum
PPSL

SEQ ID NO: 2250289 - protein, 4 aa, Cryptosporidium parvum
QKNI

SEQ ID NO: 2250290 - protein, 4 aa, Cryptosporidium parvum
QKNL

SEQ ID NO: 2250291 - protein, 4 aa, Cryptosporidium parvum
QSSS

SEQ ID NO: 2250292 - protein, 4 aa, Cryptosporidium parvum
QTLS

SEQ ID NO: 2250293 - protein, 4 aa, Cryptosporidium parvum
QTNF

SEQ ID NO: 2250294 - protein, 4 aa, Cryptosporidium parvum
RDPR

SEQ ID NO: 2250295 - protein, 4 aa, Cryptosporidium parvum
REEA

SEQ ID NO: 2250296 - protein, 4 aa, Cryptosporidium parvum
RFSD

SEQ ID NO: 2250297 - protein, 4 aa, Cryptosporidium parvum
RFTE

SEQ ID NO: 2250298 - protein, 4 aa, Cryptosporidium parvum
RIGQ

SEQ ID NO: 2250299 - protein, 4 aa, Cryptosporidium parvum
RLSG

SEQ ID NO: 2250300 - protein, 4 aa, Cryptosporidium parvum
RNGT

SEQ ID NO: 2250301 - protein, 11 aa, Cryptosporidium parvum
RSANNDSLRDI

SEQ ID NO: 2250302 - protein, 4 aa, Cryptosporidium parvum
SAPN

SEQ ID NO: 2250303 - protein, 4 aa, Cryptosporidium parvum
SDDG

SEQ ID NO: 2250304 - protein, 4 aa, Cryptosporidium parvum
SDQK

SEQ ID NO: 2250305 - protein, 4 aa, Cryptosporidium parvum
SDSG

SEQ ID NO: 2250306 - protein, 4 aa, Cryptosporidium parvum
SEEI

SEQ ID NO: 2250307 - protein, 4 aa, Cryptosporidium parvum
SEIE

SEQ ID NO: 2250308 - protein, 4 aa, Cryptosporidium parvum
SESL

SEQ ID NO: 2250309 - protein, 44 aa, Cryptosporidium parvum
SETTPAPPPTPTATINPEPTKTPTDIPKESSTPPQPQPPAEESS

SEQ ID NO: 2250310 - protein, 4 aa, Cryptosporidium parvum
SGIE

SEQ ID NO: 2250311 - protein, 4 aa, Cryptosporidium parvum
SGQN

SEQ ID NO: 2250312 - protein, 5 aa, Cryptosporidium parvum
SGVAG

SEQ ID NO: 2250313 - protein, 4 aa, Cryptosporidium parvum
SKES

SEQ ID NO: 2250314 - protein, 4 aa, Cryptosporidium parvum
SKNI

SEQ ID NO: 2250315 - protein, 7 aa, Cryptosporidium parvum
SLGPKGM

SEQ ID NO: 2250316 - protein, 4 aa, Cryptosporidium parvum
SNEK

SEQ ID NO: 2250317 - protein, 4 aa, Cryptosporidium parvum
SNGL

SEQ ID NO: 2250318 - protein, 4 aa, Cryptosporidium parvum
SNKF

SEQ ID NO: 2250319 - protein, 4 aa, Cryptosporidium parvum
SNNN

SEQ ID NO: 2250320 - protein, 4 aa, Cryptosporidium parvum
SNPQ

SEQ ID NO: 2250321 - protein, 4 aa, Cryptosporidium parvum
SNSV

SEQ ID NO: 2250322 - protein, 4 aa, Cryptosporidium parvum
SQGE

SEQ ID NO: 2250323 - protein, 5 aa, Cryptosporidium parvum
SRNNI

SEQ ID NO: 2250324 - protein, 4 aa, Cryptosporidium parvum
SSDG

SEQ ID NO: 2250325 - protein, 4 aa, Cryptosporidium parvum
SSER

SEQ ID NO: 2250326 - protein, 5 aa, Cryptosporidium parvum
SSIEG

SEQ ID NO: 2250327 - protein, 6 aa, Cryptosporidium parvum
SSNFES

SEQ ID NO: 2250328 - protein, 4 aa, Cryptosporidium parvum
SSNT

SEQ ID NO: 2250329 - protein, 4 aa, Cryptosporidium parvum
SSPI

SEQ ID NO: 2250330 - protein, 4 aa, Cryptosporidium parvum
SSQI

SEQ ID NO: 2250331 - protein, 4 aa, Cryptosporidium parvum
SSSL

SEQ ID NO: 2250332 - protein, 6 aa, Cryptosporidium parvum
SSSTIE

SEQ ID NO: 2250333 - protein, 17 aa, Cryptosporidium parvum
STASGKSVSIDEESLNR

SEQ ID NO: 2250334 - protein, 4 aa, Cryptosporidium parvum
STPI

SEQ ID NO: 2250335 - protein, 5 aa, Cryptosporidium parvum
TENEE

SEQ ID NO: 2250336 - protein, 5 aa, Cryptosporidium parvum
TENHK

SEQ ID NO: 2250337 - protein, 4 aa, Cryptosporidium parvum
TESK

SEQ ID NO: 2250338 - protein, 13 aa, Cryptosporidium parvum
TIPETGSGSDHAP

SEQ ID NO: 2250339 - protein, 4 aa, Cryptosporidium parvum
TNLT

SEQ ID NO: 2250340 - protein, 4 aa, Cryptosporidium parvum
TPLQ

SEQ ID NO: 2250341 - protein, 4 aa, Cryptosporidium parvum
TQNS

SEQ ID NO: 2250342 - protein, 5 aa, Cryptosporidium parvum
TVSGG

SEQ ID NO: 2250343 - protein, 13 aa, Cryptosporidium parvum
VGGSPSGGSPIGR

SEQ ID NO: 2250344 - protein, 4 aa, Cryptosporidium parvum
YRGA

SEQ ID NO: 2250345 - protein, 8 aa, Cryptosporidium parvum
AAAAAAAA

SEQ ID NO: 2250346 - protein, 18 aa, Cryptosporidium parvum
AAAAAAAANNAASSTIQN

SEQ ID NO: 2250347 - protein, 12 aa, Cryptosporidium parvum
AAAAAAAANPYN

SEQ ID NO: 2250348 - protein, 23 aa, Cryptosporidium parvum
AAAAAAAAVGSNNTHIGSGSSNS

SEQ ID NO: 2250349 - protein, 35 aa, Cryptosporidium parvum
AAAAAIASTPTKSQAPTKDHASSQSTATPQPQVRG

SEQ ID NO: 2250350 - protein, 24 aa, Cryptosporidium parvum
AAAAGGRAKRKKWSKGKQKDKANH

SEQ ID NO: 2250351 - protein, 32 aa, Cryptosporidium parvum
AAAASATNATANFSASNPPSPSLGSKKRTIDA

SEQ ID NO: 2250352 - protein, 26 aa, Cryptosporidium parvum
AAAATAATSTGSGGQAQIPAQPQNMP

SEQ ID NO: 2250353 - protein, 5 aa, Cryptosporidium parvum
AAAEE

SEQ ID NO: 2250354 - protein, 10 aa, Cryptosporidium parvum
AAANGYVRGE

SEQ ID NO: 2250355 - protein, 15 aa, Cryptosporidium parvum
AAANQRSGRAGRVRP

SEQ ID NO: 2250356 - protein, 8 aa, Cryptosporidium parvum
AAASPSMQ

SEQ ID NO: 2250357 - protein, 8 aa, Cryptosporidium parvum
AACGTDKG

SEQ ID NO: 2250358 - protein, 11 aa, Cryptosporidium parvum
AADGVTGTSDP

SEQ ID NO: 2250359 - protein, 24 aa, Cryptosporidium parvum
AADTESKHLSQTDKDKLNKAKKGF

SEQ ID NO: 2250360 - protein, 6 aa, Cryptosporidium parvum
AADTYR

SEQ ID NO: 2250361 - protein, 47 aa, Cryptosporidium parvum
AAEAANPEVENAPELKTIEKEKSGSGRSSKSSSVESKKSGKKTSKVA

SEQ ID NO: 2250362 - protein, 6 aa, Cryptosporidium parvum
AAEKSI

SEQ ID NO: 2250363 - protein, 7 aa, Cryptosporidium parvum
AAESLAG

SEQ ID NO: 2250364 - protein, 7 aa, Cryptosporidium parvum
AAESNQR

SEQ ID NO: 2250365 - protein, 10 aa, Cryptosporidium parvum
AAGETSGNAI

SEQ ID NO: 2250366 - protein, 13 aa, Cryptosporidium parvum
AAGGNSNDKKDVD

SEQ ID NO: 2250367 - protein, 6 aa, Cryptosporidium parvum
AAGGRY

SEQ ID NO: 2250368 - protein, 8 aa, Cryptosporidium parvum
AAGGSVEP

SEQ ID NO: 2250369 - protein, 7 aa, Cryptosporidium parvum
AAGNGKH

SEQ ID NO: 2250370 - protein, 5 aa, Cryptosporidium parvum
AAGVS

SEQ ID NO: 2250371 - protein, 19 aa, Cryptosporidium parvum
AAHHNGSQYNEFSTEDARH

SEQ ID NO: 2250372 - protein, 10 aa, Cryptosporidium parvum
AAHSDDGKPV

SEQ ID NO: 2250373 - protein, 6 aa, Cryptosporidium parvum
AAIKAA

SEQ ID NO: 2250374 - protein, 6 aa, Cryptosporidium parvum
AAITNS

SEQ ID NO: 2250375 - protein, 6 aa, Cryptosporidium parvum
AAKEAN

SEQ ID NO: 2250376 - protein, 6 aa, Cryptosporidium parvum
AAKEYS

SEQ ID NO: 2250377 - protein, 4 aa, Cryptosporidium parvum
AAKK

SEQ ID NO: 2250378 - protein, 14 aa, Cryptosporidium parvum
AAKNQVARNPENTV

SEQ ID NO: 2250379 - protein, 10 aa, Cryptosporidium parvum
AAKPNRKIKT

SEQ ID NO: 2250380 - protein, 11 aa, Cryptosporidium parvum
AAKPPNGGNLD

SEQ ID NO: 2250381 - protein, 5 aa, Cryptosporidium parvum
AAKRM

SEQ ID NO: 2250382 - protein, 17 aa, Cryptosporidium parvum
AAKSDINTNNAQDSVAD

SEQ ID NO: 2250383 - protein, 10 aa, Cryptosporidium parvum
AAKSGETTVR

SEQ ID NO: 2250384 - protein, 4 aa, Cryptosporidium parvum
AAKT

SEQ ID NO: 2250385 - protein, 5 aa, Cryptosporidium parvum
AAKTG

SEQ ID NO: 2250386 - protein, 14 aa, Cryptosporidium parvum
AALEQRKKRENKNS

SEQ ID NO: 2250387 - protein, 15 aa, Cryptosporidium parvum
AALGSSIKNIGWSWR

SEQ ID NO: 2250388 - protein, 68 aa, Cryptosporidium parvum
AALNNEEKINKLDNKDDNNTNKSNNSNEKDNFNDSSNKAQNNLENDDNSHLNESNNTNENDNKIDGLS

SEQ ID NO: 2250389 - protein, 11 aa, Cryptosporidium parvum
AANDKKTDPKI

SEQ ID NO: 2250390 - protein, 35 aa, Cryptosporidium parvum; identical to SEQ ID NO: 2135295

SEQ ID NO: 2250391 - protein, 11 aa, Cryptosporidium parvum
AANKDEIAYSD

SEQ ID NO: 2250392 - protein, 4 aa, Cryptosporidium parvum
AANN

SEQ ID NO: 2250393 - protein, 9 aa, Cryptosporidium parvum
AANNDNTSN

SEQ ID NO: 2250394 - protein, 17 aa, Cryptosporidium parvum
AANQQLKSSKQLGSQKL

SEQ ID NO: 2250395 - protein, 12 aa, Cryptosporidium parvum
AANSKSNQKNLG

SEQ ID NO: 2250396 - protein, 31 aa, Cryptosporidium parvum
AAPAEPEPEPNKEEPKEEQKTEEPAATSWWG

SEQ ID NO: 2250397 - protein, 19 aa, Cryptosporidium parvum
AAPAEQRGIPAKRPAPDYF

SEQ ID NO: 2250398 - protein, 9 aa, Cryptosporidium parvum
AAPGGKTTY

SEQ ID NO: 2250399 - protein, 16 aa, Cryptosporidium parvum
AAPHPGSSTQFHQGQY

SEQ ID NO: 2250400 - protein, 8 aa, Cryptosporidium parvum
AAPPDNSD

SEQ ID NO: 2250401 - protein, 22 aa, Cryptosporidium parvum
AAPSPSLDKKSSSKKQSSKVGA

SEQ ID NO: 2250402 - protein, 9 aa, Cryptosporidium parvum
AAQKSLKDP

SEQ ID NO: 2250403 - protein, 6 aa, Cryptosporidium parvum
AAQRQF

SEQ ID NO: 2250404 - protein, 9 aa, Cryptosporidium parvum
AAQSKTRDE

SEQ ID NO: 2250405 - protein, 10 aa, Cryptosporidium parvum
AARAKDLRRN

SEQ ID NO: 2250406 - protein, 9 aa, Cryptosporidium parvum
AARDSNNVP

SEQ ID NO: 2250407 - protein, 13 aa, Cryptosporidium parvum
AARGALSTRARVP

SEQ ID NO: 2250408 - protein, 8 aa, Cryptosporidium parvum
AARGNGTS

SEQ ID NO: 2250409 - protein, 5 aa, Cryptosporidium parvum
AARGQ

SEQ ID NO: 2250410 - protein, 6 aa, Cryptosporidium parvum
AARRAQ

SEQ ID NO: 2250411 - protein, 7 aa, Cryptosporidium parvum
AASAQTA

SEQ ID NO: 2250412 - protein, 25 aa, Cryptosporidium parvum
AASEYSCSSGSFRDLNSSAEQTTFE

SEQ ID NO: 2250413 - protein, 6 aa, Cryptosporidium parvum
AASIRD

SEQ ID NO: 2250414 - protein, 5 aa, Cryptosporidium parvum
AASNT

SEQ ID NO: 2250415 - protein, 24 aa, Cryptosporidium parvum
AASPPKPASGAAAGGAAPAQPKED

SEQ ID NO: 2250416 - protein, 12 aa, Cryptosporidium parvum
AASQQTNKSDVK

SEQ ID NO: 2250417 - protein, 4 aa, Cryptosporidium parvum
AASS

SEQ ID NO: 2250418 - protein, 5 aa, Cryptosporidium parvum
AASSD

SEQ ID NO: 2250419 - protein, 13 aa, Cryptosporidium parvum
AASSNTISIWDLL

SEQ ID NO: 2250420 - protein, 8 aa, Cryptosporidium parvum
AASSPHSS

SEQ ID NO: 2250421 - protein, 14 aa, Cryptosporidium parvum
AATAQDDISGDGTT

SEQ ID NO: 2250422 - protein, 6 aa, Cryptosporidium parvum
AATEGV

SEQ ID NO: 2250423 - protein, 9 aa, Cryptosporidium parvum
AATGRGRGR

SEQ ID NO: 2250424 - protein, 7 aa, Cryptosporidium parvum
AATKSVA

SEQ ID NO: 2250425 - protein, 4 aa, Cryptosporidium parvum
AATS

SEQ ID NO: 2250426 - protein, 8 aa, Cryptosporidium parvum
AATSGKAF

SEQ ID NO: 2250427 - protein, 7 aa, Cryptosporidium parvum
AATSSIS

SEQ ID NO: 2250428 - protein, 30 aa, Cryptosporidium parvum
AAVDSAAAANEWGGVSGNWGGSAADEWRNA

SEQ ID NO: 2250429 - protein, 18 aa, Cryptosporidium parvum
AAVNGQKSVTISGKKESV

SEQ ID NO: 2250430 - protein, 8 aa, Cryptosporidium parvum
AAVNKPRN

SEQ ID NO: 2250431 - protein, 6 aa, Cryptosporidium parvum
AAVNPE

SEQ ID NO: 2250432 - protein, 4 aa, Cryptosporidium parvum
AAVS

SEQ ID NO: 2250433 - protein, 6 aa, Cryptosporidium parvum
AAYRAT

SEQ ID NO: 2250434 - protein, 6 aa, Cryptosporidium parvum
AAYSPA

SEQ ID NO: 2250435 - protein, 5 aa, Cryptosporidium parvum
ACDAL

SEQ ID NO: 2250436 - protein, 31 aa, Cryptosporidium parvum
ACGPSTEAEKRLARSKRFGSTSEDDKRKLRQ

SEQ ID NO: 2250437 - protein, 7 aa, Cryptosporidium parvum
ACKNGDN

SEQ ID NO: 2250438 - protein, 14 aa, Cryptosporidium parvum
ACQESNKYVTSEEK

SEQ ID NO: 2250439 - protein, 5 aa, Cryptosporidium parvum
ACSNS

SEQ ID NO: 2250440 - protein, 8 aa, Cryptosporidium parvum
ACTGSGKT

SEQ ID NO: 2250441 - protein, 4 aa, Cryptosporidium parvum
ACTH

SEQ ID NO: 2250442 - protein, 14 aa, Cryptosporidium parvum
ACTSTGKKGAQVGD

SEQ ID NO: 2250443 - protein, 4 aa, Cryptosporidium parvum
ADAL

SEQ ID NO: 2250444 - protein, 30 aa, Cryptosporidium parvum
ADASKKMESDQDQNKDLEIKPKDEKKTKLS

SEQ ID NO: 2250445 - protein, 7 aa, Cryptosporidium parvum
ADASKSS

SEQ ID NO: 2250446 - protein, 12 aa, Cryptosporidium parvum
ADCRAKTSSGCT

SEQ ID NO: 2250447 - protein, 41 aa, Cryptosporidium parvum
ADDGTSKLAELEDTSPKKKSKTRLKNSKSSKFTTKTNQEIK

SEQ ID NO: 2250448 - protein, 20 aa, Cryptosporidium parvum
ADDHFDDSQIDGTTNQLEIS

SEQ ID NO: 2250449 - protein, 9 aa, Cryptosporidium parvum
ADDNNVEMN

SEQ ID NO: 2250450 - protein, 6 aa, Cryptosporidium parvum
ADDNQY

SEQ ID NO: 2250451 - protein, 8 aa, Cryptosporidium parvum
ADDSGDIT

SEQ ID NO: 2250452 - protein, 6 aa, Cryptosporidium parvum
ADDSNF

SEQ ID NO: 2250453 - protein, 8 aa, Cryptosporidium parvum
ADDSRFDP

SEQ ID NO: 2250454 - protein, 14 aa, Cryptosporidium parvum
ADDTLNPGLNDSET

SEQ ID NO: 2250455 - protein, 12 aa, Cryptosporidium parvum
ADEEDISGGNKK

SEQ ID NO: 2250456 - protein, 6 aa, Cryptosporidium parvum
ADEEEL

SEQ ID NO: 2250457 - protein, 7 aa, Cryptosporidium parvum
ADEEFSE

SEQ ID NO: 2250458 - protein, 6 aa, Cryptosporidium parvum
ADEEVD

SEQ ID NO: 2250459 - protein, 5 aa, Cryptosporidium parvum
ADENG

SEQ ID NO: 2250460 - protein, 14 aa, Cryptosporidium parvum
ADENQDNYGDEQIS

SEQ ID NO: 2250461 - protein, 9 aa, Cryptosporidium parvum
ADESTGTIK

SEQ ID NO: 2250462 - protein, 6 aa, Cryptosporidium parvum
ADETVA

SEQ ID NO: 2250463 - protein, 10 aa, Cryptosporidium parvum
ADFSSSENYQ

SEQ ID NO: 2250464 - protein, 9 aa, Cryptosporidium parvum
ADGASYEGE

SEQ ID NO: 2250465 - protein, 13 aa, Cryptosporidium parvum
ADGEDEEVHYEGD

SEQ ID NO: 2250466 - protein, 7 aa, Cryptosporidium parvum
ADGGSGI

SEQ ID NO: 2250467 - protein, 5 aa, Cryptosporidium parvum
ADGLK

SEQ ID NO: 2250468 - protein, 8 aa, Cryptosporidium parvum
ADGLPNIG

SEQ ID NO: 2250469 - protein, 31 aa, Cryptosporidium parvum
ADGNATTCETTPCKSKNLKSDKFGVETTGRR

SEQ ID NO: 2250470 - protein, 7 aa, Cryptosporidium parvum
ADGQGWH

SEQ ID NO: 2250471 - protein, 7 aa, Cryptosporidium parvum
ADGQSNS

SEQ ID NO: 2250472 - protein, 4 aa, Cryptosporidium parvum
ADGS

SEQ ID NO: 2250473 - protein, 6 aa, Cryptosporidium parvum
ADGSEI

SEQ ID NO: 2250474 - protein, 7 aa, Cryptosporidium parvum
ADGSYLE

SEQ ID NO: 2250475 - protein, 7 aa, Cryptosporidium parvum
ADGTLHS

SEQ ID NO: 2250476 - protein, 16 aa, Cryptosporidium parvum
ADHNQNLERGSSNHNL

SEQ ID NO: 2250477 - protein, 5 aa, Cryptosporidium parvum
ADHYE

SEQ ID NO: 2250478 - protein, 8 aa, Cryptosporidium parvum
ADIDNDEG

SEQ ID NO: 2250479 - protein, 6 aa, Cryptosporidium parvum
ADITSR

SEQ ID NO: 2250480 - protein, 6 aa, Cryptosporidium parvum
ADKISE

SEQ ID NO: 2250481 - protein, 20 aa, Cryptosporidium parvum
ADKNENGKTLNQNQEEKNHV

SEQ ID NO: 2250482 - protein, 6 aa, Cryptosporidium parvum
ADKNYQ

SEQ ID NO: 2250483 - protein, 17 aa, Cryptosporidium parvum
ADKPQPGSLSSGGYGPS

SEQ ID NO: 2250484 - protein, 10 aa, Cryptosporidium parvum
ADKSSPANLE

SEQ ID NO: 2250485 - protein, 35 aa, Cryptosporidium parvum; identical to SEQ ID NO: 2135369

SEQ ID NO: 2250486 - protein, 9 aa, Cryptosporidium parvum
ADLGGPPLS

SEQ ID NO: 2250487 - protein, 18 aa, Cryptosporidium parvum
ADLKEQSNPGNHQQISTN

SEQ ID NO: 2250488 - protein, 21 aa, Cryptosporidium parvum
ADLNAKASSFNNANEGLSKSQ

SEQ ID NO: 2250489 - protein, 27 aa, Cryptosporidium parvum
ADLSGSDKELDTNSQIPPHSEVGQNMG

SEQ ID NO: 2250490 - protein, 13 aa, Cryptosporidium parvum
ADLTSKWQGESEK

SEQ ID NO: 2250491 - protein, 5 aa, Cryptosporidium parvum
ADMEE

SEQ ID NO: 2250492 - protein, 4 aa, Cryptosporidium parvum
ADNA

SEQ ID NO: 2250493 - protein, 5 aa, Cryptosporidium parvum
ADNDR

SEQ ID NO: 2250494 - protein, 9 aa, Cryptosporidium parvum
ADNESDKGH

SEQ ID NO: 2250495 - protein, 6 aa, Cryptosporidium parvum
ADNGDA

SEQ ID NO: 2250496 - protein, 12 aa, Cryptosporidium parvum
ADNISKKEDQNF

SEQ ID NO: 2250497 - protein, 17 aa, Cryptosporidium parvum
ADNKNYPQNGNGFNGRN

SEQ ID NO: 2250498 - protein, 8 aa, Cryptosporidium parvum
ADNPNKKN

SEQ ID NO: 2250499 - protein, 8 aa, Cryptosporidium parvum
ADNQITSQ

SEQ ID NO: 2250500 - protein, 6 aa, Cryptosporidium parvum
ADNQSG

SEQ ID NO: 2250501 - protein, 32 aa, Cryptosporidium parvum
ADNSGVTEANSSYSSVKNKIDSIDEKSRMESS

SEQ ID NO: 2250502 - protein, 6 aa, Cryptosporidium parvum
ADNSPW

SEQ ID NO: 2250503 - protein, 9 aa, Cryptosporidium parvum
ADPDKTGKC

SEQ ID NO: 2250504 - protein, 21 aa, Cryptosporidium parvum
ADPDSGSNLIPNGKDLPFTNA

SEQ ID NO: 2250505 - protein, 8 aa, Cryptosporidium parvum
ADPDTQNV

SEQ ID NO: 2250506 - protein, 8 aa, Cryptosporidium parvum
ADPKTVGA

SEQ ID NO: 2250507 - protein, 11 aa, Cryptosporidium parvum
ADPSKAEKELG

SEQ ID NO: 2250508 - protein, 7 aa, Cryptosporidium parvum
ADPSQNE

SEQ ID NO: 2250509 - protein, 9 aa, Cryptosporidium parvum
ADPTNAEEN

SEQ ID NO: 2250510 - protein, 4 aa, Cryptosporidium parvum
ADQA

SEQ ID NO: 2250511 - protein, 7 aa, Cryptosporidium parvum
ADQDTSK

SEQ ID NO: 2250512 - protein, 23 aa, Cryptosporidium parvum
ADQENDENDSFDNYEDEDEDDID

SEQ ID NO: 2250513 - protein, 9 aa, Cryptosporidium parvum
ADQGSRGKK

SEQ ID NO: 2250514 - protein, 4 aa, Cryptosporidium parvum
ADQI

SEQ ID NO: 2250515 - protein, 10 aa, Cryptosporidium parvum
ADQKEKKKFN

SEQ ID NO: 2250516 - protein, 16 aa, Cryptosporidium parvum
ADQKRQRQSDQRRPVQ

SEQ ID NO: 2250517 - protein, 11 aa, Cryptosporidium parvum
ADQNNTNEEKQ

SEQ ID NO: 2250518 - protein, 38 aa, Cryptosporidium parvum
ADQSPTNGNNSTELGNFEEEEGGYEKEQEKEDEGIQDD

SEQ ID NO: 2250519 - protein, 16 aa, Cryptosporidium parvum
ADQSTLSQSDKREIPS

SEQ ID NO: 2250520 - protein, 6 aa, Cryptosporidium parvum
ADRDKI

SEQ ID NO: 2250521 - protein, 6 aa, Cryptosporidium parvum
ADRIAE

SEQ ID NO: 2250522 - protein, 9 aa, Cryptosporidium parvum
ADRISNTEE

SEQ ID NO: 2250523 - protein, 6 aa, Cryptosporidium parvum
ADRPTV

SEQ ID NO: 2250524 - protein, 8 aa, Cryptosporidium parvum
ADSDGSSS

SEQ ID NO: 2250525 - protein, 13 aa, Cryptosporidium parvum
ADSDSESAKNAHK

SEQ ID NO: 2250526 - protein, 6 aa, Cryptosporidium parvum
ADSGES

SEQ ID NO: 2250527 - protein, 26 aa, Cryptosporidium parvum
ADSHGLPDDDDDDDFDDDDDEDAGQV

SEQ ID NO: 2250528 - protein, 5 aa, Cryptosporidium parvum
ADSIR

SEQ ID NO: 2250529 - protein, 9 aa, Cryptosporidium parvum
ADSNGDGEI

SEQ ID NO: 2250530 - protein, 8 aa, Cryptosporidium parvum
ADSNGRQV

SEQ ID NO: 2250531 - protein, 5 aa, Cryptosporidium parvum
ADSQD

SEQ ID NO: 2250532 - protein, 8 aa, Cryptosporidium parvum
ADSSESSV

SEQ ID NO: 2250533 - protein, 6 aa, Cryptosporidium parvum
ADSSIQ

SEQ ID NO: 2250534 - protein, 25 aa, Cryptosporidium parvum
ADSVNTNSSQTNKVSYNTISQSSLS

SEQ ID NO: 2250535 - protein, 9 aa, Cryptosporidium parvum
ADTFEENSI

SEQ ID NO: 2250536 - protein, 29 aa, Cryptosporidium parvum
ADTSIQDQCRQNSNKSGNSQNGNPNTNKN

SEQ ID NO: 2250537 - protein, 15 aa, Cryptosporidium parvum
ADTTPQSLRPQLRNT

SEQ ID NO: 2250538 - protein, 13 aa, Cryptosporidium parvum
ADVNAKDKYGRTP

SEQ ID NO: 2250539 - protein, 9 aa, Cryptosporidium parvum
ADVPGEGEH

SEQ ID NO: 2250540 - protein, 43 aa, Cryptosporidium parvum
ADYNSSSGNSQTTNNNNAQNFNSIPSASNDTNNGTNHNSNDPF

SEQ ID NO: 2250541 - protein, 5 aa, Cryptosporidium parvum
ADYSN

SEQ ID NO: 2250542 - protein, 11 aa, Cryptosporidium parvum
AEAAPKTSPFG

SEQ ID NO: 2250543 - protein, 4 aa, Cryptosporidium parvum
AEAG

SEQ ID NO: 2250544 - protein, 8 aa, Cryptosporidium parvum
AEAGDFGN

SEQ ID NO: 2250545 - protein, 13 aa, Cryptosporidium parvum
AEANKNINGTGGI

SEQ ID NO: 2250546 - protein, 13 aa, Cryptosporidium parvum
AECGEKSGKKCDV

SEQ ID NO: 2250547 - protein, 10 aa, Cryptosporidium parvum
AECQKQGKEL

SEQ ID NO: 2250548 - protein, 4 aa, Cryptosporidium parvum
AEDC

SEQ ID NO: 2250549 - protein, 21 aa, Cryptosporidium parvum
AEDDDDDDVIDGKKPKKPKRM

SEQ ID NO: 2250550 - protein, 26 aa, Cryptosporidium parvum
AEDDEHNKQNSKANSPPGSDHGSCSE

SEQ ID NO: 2250551 - protein, 10 aa, Cryptosporidium parvum
AEDEGIPSTA

SEQ ID NO: 2250552 - protein, 10 aa, Cryptosporidium parvum
AEDENSSKFY

SEQ ID NO: 2250553 - protein, 10 aa, Cryptosporidium parvum
AEDEYRQKGD

SEQ ID NO: 2250554 - protein, 5 aa, Cryptosporidium parvum
AEDGD

SEQ ID NO: 2250555 - protein, 6 aa, Cryptosporidium parvum
AEDPFQ

SEQ ID NO: 2250556 - protein, 5 aa, Cryptosporidium parvum
AEEAA

SEQ ID NO: 2250557 - protein, 11 aa, Cryptosporidium parvum
AEEAQTGQCGK

SEQ ID NO: 2250558 - protein, 5 aa, Cryptosporidium parvum
AEEAV

SEQ ID NO: 2250559 - protein, 11 aa, Cryptosporidium parvum
AEEEASEDNSK

SEQ ID NO: 2250560 - protein, 14 aa, Cryptosporidium parvum
AEEFGSGNKRRLSG

SEQ ID NO: 2250561 - protein, 8 aa, Cryptosporidium parvum
AEEGAYSG

SEQ ID NO: 2250562 - protein, 7 aa, Cryptosporidium parvum
AEEKEEQ

SEQ ID NO: 2250563 - protein, 6 aa, Cryptosporidium parvum
AEEKEI

SEQ ID NO: 2250564 - protein, 9 aa, Cryptosporidium parvum
AEEKHYSSC

SEQ ID NO: 2250565 - protein, 8 aa, Cryptosporidium parvum
AEERQGEA

SEQ ID NO: 2250566 - protein, 9 aa, Cryptosporidium parvum
AEESAKETN

SEQ ID NO: 2250567 - protein, 18 aa, Cryptosporidium parvum
AEESKETKTEIQKDEEMA

SEQ ID NO: 2250568 - protein, 5 aa, Cryptosporidium parvum
AEESS

SEQ ID NO: 2250569 - protein, 5 aa, Cryptosporidium parvum
AEEYE

SEQ ID NO: 2250570 - protein, 12 aa, Cryptosporidium parvum
AEEYNNQKKTRA

SEQ ID NO: 2250571 - protein, 5 aa, Cryptosporidium parvum
AEEYT

SEQ ID NO: 2250572 - protein, 9 aa, Cryptosporidium parvum
AEGARNTLK

SEQ ID NO: 2250573 - protein, 20 aa, Cryptosporidium parvum
AEGERSEIQYDSGDYKRDPV

SEQ ID NO: 2250574 - protein, 6 aa, Cryptosporidium parvum
AEGFDA

SEQ ID NO: 2250575 - protein, 56 aa, Cryptosporidium parvum
AEGGMPGGMPGGMPGGMPGGMPGGMPGGMPGGMPGGMPGGMPGGMPGSNGPTVEEV

SEQ ID NO: 2250576 - protein, 13 aa, Cryptosporidium parvum
AEGGSSDAQLSAE

SEQ ID NO: 2250577 - protein, 10 aa, Cryptosporidium parvum
AEGLEGNSRE

SEQ ID NO: 2250578 - protein, 6 aa, Cryptosporidium parvum
AEGSGI

SEQ ID NO: 2250579 - protein, 5 aa, Cryptosporidium parvum
AEGVS

SEQ ID NO: 2250580 - protein, 18 aa, Cryptosporidium parvum
AEHKNKGPSQGSFHGEKK

SEQ ID NO: 2250581 - protein, 8 aa, Cryptosporidium parvum
AEHQSGVP

SEQ ID NO: 2250582 - protein, 4 aa, Cryptosporidium parvum
AEHS

SEQ ID NO: 2250583 - protein, 10 aa, Cryptosporidium parvum
AEIDDDDEKI

SEQ ID NO: 2250584 - protein, 14 aa, Cryptosporidium parvum
AEIDENNPSGFDET

SEQ ID NO: 2250585 - protein, 6 aa, Cryptosporidium parvum
AEINEG

SEQ ID NO: 2250586 - protein, 6 aa, Cryptosporidium parvum
AEISRP

SEQ ID NO: 2250587 - protein, 8 aa, Cryptosporidium parvum
AEITELTP

SEQ ID NO: 2250588 - protein, 23 aa, Cryptosporidium parvum
AEIYSEEDEEPKDRGAYESSVTP

SEQ ID NO: 2250589 - protein, 11 aa, Cryptosporidium parvum
AEKAGKGSTGF

SEQ ID NO: 2250590 - protein, 10 aa, Cryptosporidium parvum
AEKCKPKEQL

SEQ ID NO: 2250591 - protein, 6 aa, Cryptosporidium parvum
AEKDGL

SEQ ID NO: 2250592 - protein, 7 aa, Cryptosporidium parvum
AEKDSFS

SEQ ID NO: 2250593 - protein, 8 aa, Cryptosporidium parvum
AEKEAYIN

SEQ ID NO: 2250594 - protein, 29 aa, Cryptosporidium parvum
AEKEQQKKSEEKPKVNKKSAGSKQASSKR

SEQ ID NO: 2250595 - protein, 8 aa, Cryptosporidium parvum
AEKKRNSI

SEQ ID NO: 2250596 - protein, 5 aa, Cryptosporidium parvum
AEKNR

SEQ ID NO: 2250597 - protein, 9 aa, Cryptosporidium parvum
AEKNSESYR

SEQ ID NO: 2250598 - protein, 10 aa, Cryptosporidium parvum
AEKNTNDNPV

SEQ ID NO: 2250599 - protein, 8 aa, Cryptosporidium parvum
AEKQMDDI

SEQ ID NO: 2250600 - protein, 24 aa, Cryptosporidium parvum
AEKREREKQRRSGNKKLSETKDKG

SEQ ID NO: 2250601 - protein, 4 aa, Cryptosporidium parvum
AEKY

SEQ ID NO: 2250602 - protein, 13 aa, Cryptosporidium parvum
AEKYKGEDEQNRL

SEQ ID NO: 2250603 - protein, 4 aa, Cryptosporidium parvum
AELD

SEQ ID NO: 2250604 - protein, 6 aa, Cryptosporidium parvum
AELKES

SEQ ID NO: 2250605 - protein, 11 aa, Cryptosporidium parvum
AELNDSNEKTA

SEQ ID NO: 2250606 - protein, 10 aa, Cryptosporidium parvum
AELNEKSHSE

SEQ ID NO: 2250607 - protein, 17 aa, Cryptosporidium parvum
AELNSQKDELDKQGIEL

SEQ ID NO: 2250608 - protein, 50 aa, Cryptosporidium parvum
AELRTRDGKLRHPTLSNGNSEVANQNQGQSQSQSQAQSQSQYQSAAQLPT

SEQ ID NO: 2250609 - protein, 13 aa, Cryptosporidium parvum
AELSGSSKLEDEN

SEQ ID NO: 2250610 - protein, 9 aa, Cryptosporidium parvum
AEMKSSSTL

SEQ ID NO: 2250611 - protein, 8 aa, Cryptosporidium parvum
AEMYPEGD

SEQ ID NO: 2250612 - protein, 12 aa, Cryptosporidium parvum
AENAGLDQQETT

SEQ ID NO: 2250613 - protein, 16 aa, Cryptosporidium parvum
AENAKNNSQEELPNSQ

SEQ ID NO: 2250614 - protein, 8 aa, Cryptosporidium parvum
AENDHDKI

SEQ ID NO: 2250615 - protein, 7 aa, Cryptosporidium parvum
AENDSGE

SEQ ID NO: 2250616 - protein, 12 aa, Cryptosporidium parvum
AENEKNYSGRFG

SEQ ID NO: 2250617 - protein, 7 aa, Cryptosporidium parvum
AENGPEY

SEQ ID NO: 2250618 - protein, 6 aa, Cryptosporidium parvum
AENITK

SEQ ID NO: 2250619 - protein, 26 aa, Cryptosporidium parvum
AENKKLKDGRRSNTADFGKRGSESLI

SEQ ID NO: 2250620 - protein, 14 aa, Cryptosporidium parvum
AENKKMEGNLDYEK

SEQ ID NO: 2250621 - protein, 7 aa, Cryptosporidium parvum
AENKNKD

SEQ ID NO: 2250622 - protein, 5 aa, Cryptosporidium parvum
AENNG

SEQ ID NO: 2250623 - protein, 7 aa, Cryptosporidium parvum
AENNNFQ

SEQ ID NO: 2250624 - protein, 8 aa, Cryptosporidium parvum
AENNSSLS

SEQ ID NO: 2250625 - protein, 8 aa, Cryptosporidium parvum
AENNTLRG

SEQ ID NO: 2250626 - protein, 4 aa, Cryptosporidium parvum
AENQ

SEQ ID NO: 2250627 - protein, 17 aa, Cryptosporidium parvum
AENQSLKDYEKTNLNEQ

SEQ ID NO: 2250628 - protein, 26 aa, Cryptosporidium parvum
AENQTQTDDDKGHWSEESAESNSRTM

SEQ ID NO: 2250629 - protein, 8 aa, Cryptosporidium parvum
AENSETEI

SEQ ID NO: 2250630 - protein, 8 aa, Cryptosporidium parvum
AENSHTTR

SEQ ID NO: 2250631 - protein, 10 aa, Cryptosporidium parvum
AENSSPQHDI

SEQ ID NO: 2250632 - protein, 13 aa, Cryptosporidium parvum
AENSSTKGKKKNE

SEQ ID NO: 2250633 - protein, 14 aa, Cryptosporidium parvum
AENSTQKSDSDSLD

SEQ ID NO: 2250634 - protein, 6 aa, Cryptosporidium parvum
AENTKD

SEQ ID NO: 2250635 - protein, 5 aa, Cryptosporidium parvum
AENYE

SEQ ID NO: 2250636 - protein, 16 aa, Cryptosporidium parvum
AENYNEDKKDGKIAAK

SEQ ID NO: 2250637 - protein, 7 aa, Cryptosporidium parvum
AEPIRKT

SEQ ID NO: 2250638 - protein, 6 aa, Cryptosporidium parvum
AEPNFY

SEQ ID NO: 2250639 - protein, 5 aa, Cryptosporidium parvum
AEPSN

SEQ ID NO: 2250640 - protein, 8 aa, Cryptosporidium parvum
AEQDESIK

SEQ ID NO: 2250641 - protein, 6 aa, Cryptosporidium parvum
AEQIKY

SEQ ID NO: 2250642 - protein, 15 aa, Cryptosporidium parvum
AEQKISKAESDCEQD

SEQ ID NO: 2250643 - protein, 7 aa, Cryptosporidium parvum
AEQKKSF

SEQ ID NO: 2250644 - protein, 6 aa, Cryptosporidium parvum
AEQQIT

SEQ ID NO: 2250645 - protein, 26 aa, Cryptosporidium parvum
AEQQQKPSVALKNSSSQTSSTQETIT

SEQ ID NO: 2250646 - protein, 7 aa, Cryptosporidium parvum
AEQSEWS

SEQ ID NO: 2250647 - protein, 7 aa, Cryptosporidium parvum
AEQSVHD

SEQ ID NO: 2250648 - protein, 12 aa, Cryptosporidium parvum
AERESGKDAKKG

SEQ ID NO: 2250649 - protein, 15 aa, Cryptosporidium parvum
AERETGTNDPRLNTP

SEQ ID NO: 2250650 - protein, 7 aa, Cryptosporidium parvum
AERGTRM

SEQ ID NO: 2250651 - protein, 6 aa, Cryptosporidium parvum
AERING

SEQ ID NO: 2250652 - protein, 6 aa, Cryptosporidium parvum
AERREL

SEQ ID NO: 2250653 - protein, 5 aa, Cryptosporidium parvum
AERSL

SEQ ID NO: 2250654 - protein, 7 aa, Cryptosporidium parvum
AERSSEV

SEQ ID NO: 2250655 - protein, 24 aa, Cryptosporidium parvum
AERSSTNDFPNNVNNTELAGPPIL

SEQ ID NO: 2250656 - protein, 23 aa, Cryptosporidium parvum
AESDLDENMEGNNNSSDDEFNMT

SEQ ID NO: 2250657 - protein, 43 aa, Cryptosporidium parvum
AESDLNINSNDKVKENSKVKPKSKAINDSDLSNEYDNNKSTQL

SEQ ID NO: 2250658 - protein, 8 aa, Cryptosporidium parvum
AESDSEKK

SEQ ID NO: 2250659 - protein, 7 aa, Cryptosporidium parvum
AESESPI

SEQ ID NO: 2250660 - protein, 23 aa, Cryptosporidium parvum
AESFEKRKSAESEKKNANGSYKS

SEQ ID NO: 2250661 - protein, 10 aa, Cryptosporidium parvum
AESFPTPGTE

SEQ ID NO: 2250662 - protein, 5 aa, Cryptosporidium parvum
AESII

SEQ ID NO: 2250663 - protein, 6 aa, Cryptosporidium parvum
AESIKD

SEQ ID NO: 2250664 - protein, 6 aa, Cryptosporidium parvum
AESKNL

SEQ ID NO: 2250665 - protein, 7 aa, Cryptosporidium parvum
AESKRQF

SEQ ID NO: 2250666 - protein, 8 aa, Cryptosporidium parvum
AESMETVG

SEQ ID NO: 2250667 - protein, 6 aa, Cryptosporidium parvum
AESNCD

SEQ ID NO: 2250668 - protein, 5 aa, Cryptosporidium parvum
AESNR

SEQ ID NO: 2250669 - protein, 7 aa, Cryptosporidium parvum
AESNSKQ

SEQ ID NO: 2250670 - protein, 7 aa, Cryptosporidium parvum
AESQHRI

SEQ ID NO: 2250671 - protein, 60 aa, Cryptosporidium parvum
AESSEGSSPNRNRGRTNSNAQSSRTSRSSRSRRTRTDRRTRSGVSRRDNSRSERSATGTS

SEQ ID NO: 2250672 - protein, 6 aa, Cryptosporidium parvum
AESSIN

SEQ ID NO: 2250673 - protein, 41 aa, Cryptosporidium parvum
AESSPPPPPPPTPTLRPKDKPKWSPPPPLEPIDNSANTQTI

SEQ ID NO: 2250674 - protein, 5 aa, Cryptosporidium parvum
AESSS

SEQ ID NO: 2250675 - protein, 15 aa, Cryptosporidium parvum
AESTAREWNRLYAKG

SEQ ID NO: 2250676 - protein, 7 aa, Cryptosporidium parvum
AESTMSR

SEQ ID NO: 2250677 - protein, 6 aa, Cryptosporidium parvum
AETHSE

SEQ ID NO: 2250678 - protein, 7 aa, Cryptosporidium parvum
AETIPGL

SEQ ID NO: 2250679 - protein, 33 aa, Cryptosporidium parvum
AETNHGTAKHRIDGDQNSGSGVVGQNENIGGFS

SEQ ID NO: 2250680 - protein, 7 aa, Cryptosporidium parvum
AETNIEP

SEQ ID NO: 2250681 - protein, 7 aa, Cryptosporidium parvum
AETNKSN

SEQ ID NO: 2250682 - protein, 8 aa, Cryptosporidium parvum
AETPGSLG

SEQ ID NO: 2250683 - protein, 6 aa, Cryptosporidium parvum
AETPQE

SEQ ID NO: 2250684 - protein, 8 aa, Cryptosporidium parvum
AETSTSGL

SEQ ID NO: 2250685 - protein, 4 aa, Cryptosporidium parvum
AETV

SEQ ID NO: 2250686 - protein, 5 aa, Cryptosporidium parvum
AEVER

SEQ ID NO: 2250687 - protein, 10 aa, Cryptosporidium parvum
AEVNEEDQSN

SEQ ID NO: 2250688 - protein, 4 aa, Cryptosporidium parvum
AEVT

SEQ ID NO: 2250689 - protein, 10 aa, Cryptosporidium parvum
AEVTNGNSTE

SEQ ID NO: 2250690 - protein, 6 aa, Cryptosporidium parvum
AEYEKQ

SEQ ID NO: 2250691 - protein, 4 aa, Cryptosporidium parvum
AEYK

SEQ ID NO: 2250692 - protein, 4 aa, Cryptosporidium parvum
AEYN

SEQ ID NO: 2250693 - protein, 6 aa, Cryptosporidium parvum
AEYNST

SEQ ID NO: 2250694 - protein, 6 aa, Cryptosporidium parvum
AEYPTD

SEQ ID NO: 2250695 - protein, 14 aa, Cryptosporidium parvum
AEYSPSSPLDETKN

SEQ ID NO: 2250696 - protein, 4 aa, Cryptosporidium parvum
AFDN

SEQ ID NO: 2250697 - protein, 10 aa, Cryptosporidium parvum
AFDNSEDSFG

SEQ ID NO: 2250698 - protein, 10 aa, Cryptosporidium parvum
AFESNKNSYS

SEQ ID NO: 2250699 - protein, 5 aa, Cryptosporidium parvum
AFGGG

SEQ ID NO: 2250700 - protein, 8 aa, Cryptosporidium parvum
AFGQNSKK

SEQ ID NO: 2250701 - protein, 6 aa, Cryptosporidium parvum
AFGRSD

SEQ ID NO: 2250702 - protein, 9 aa, Cryptosporidium parvum
AFKPGEKVS

SEQ ID NO: 2250703 - protein, 14 aa, Cryptosporidium parvum
AFNKPTKTITDSFN

SEQ ID NO: 2250704 - protein, 6 aa, Cryptosporidium parvum
AFNSEG

SEQ ID NO: 2250705 - protein, 6 aa, Cryptosporidium parvum
AFPANK

SEQ ID NO: 2250706 - protein, 5 aa, Cryptosporidium parvum
AFPNS

SEQ ID NO: 2250707 - protein, 6 aa, Cryptosporidium parvum
AFPPLT

SEQ ID NO: 2250708 - protein, 12 aa, Cryptosporidium parvum
AFQGNKKSTINF

SEQ ID NO: 2250709 - protein, 15 aa, Cryptosporidium parvum
AFSNSSSVSISDDGN

SEQ ID NO: 2250710 - protein, 7 aa, Cryptosporidium parvum
AFSSSNN

SEQ ID NO: 2250711 - protein, 5 aa, Cryptosporidium parvum
AFTDE

SEQ ID NO: 2250712 - protein, 8 aa, Cryptosporidium parvum
AGAAARGV

SEQ ID NO: 2250713 - protein, 6 aa, Cryptosporidium parvum
AGADSS

SEQ ID NO: 2250714 - protein, 6 aa, Cryptosporidium parvum
AGAGKS

SEQ ID NO: 2250715 - protein, 8 aa, Cryptosporidium parvum
AGAGKTSM

SEQ ID NO: 2250716 - protein, 9 aa, Cryptosporidium parvum
AGAGTAADL

SEQ ID NO: 2250717 - protein, 10 aa, Cryptosporidium parvum
AGAKNAERIS

SEQ ID NO: 2250718 - protein, 10 aa, Cryptosporidium parvum
AGANPNAVSA

SEQ ID NO: 2250719 - protein, 20 aa, Cryptosporidium parvum
AGASKGPKQLVGQDQRPYPL

SEQ ID NO: 2250720 - protein, 12 aa, Cryptosporidium parvum
AGATGLDPSQTS

SEQ ID NO: 2250721 - protein, 10 aa, Cryptosporidium parvum
AGATQKEDFD

SEQ ID NO: 2250722 - protein, 6 aa, Cryptosporidium parvum
AGDANG

SEQ ID NO: 2250723 - protein, 8 aa, Cryptosporidium parvum
AGDGGVST

SEQ ID NO: 2250724 - protein, 8 aa, Cryptosporidium parvum
AGDLETET

SEQ ID NO: 2250725 - protein, 6 aa, Cryptosporidium parvum
AGDSAN

SEQ ID NO: 2250726 - protein, 14 aa, Cryptosporidium parvum
AGDSRAVLSRSGQA

SEQ ID NO: 2250727 - protein, 7 aa, Cryptosporidium parvum
AGDTIDD

SEQ ID NO: 2250728 - protein, 8 aa, Cryptosporidium parvum
AGEAEGNL

SEQ ID NO: 2250729 - protein, 4 aa, Cryptosporidium parvum
AGED

SEQ ID NO: 2250730 - protein, 7 aa, Cryptosporidium parvum
AGEDTIS

SEQ ID NO: 2250731 - protein, 6 aa, Cryptosporidium parvum
AGEEAP

SEQ ID NO: 2250732 - protein, 6 aa, Cryptosporidium parvum
AGEITD

SEQ ID NO: 2250733 - protein, 4 aa, Cryptosporidium parvum
AGEN

SEQ ID NO: 2250734 - protein, 13 aa, Cryptosporidium parvum
AGESAEASPSSTK

SEQ ID NO: 2250735 - protein, 10 aa, Cryptosporidium parvum
AGESSKSKVS

SEQ ID NO: 2250736 - protein, 5 aa, Cryptosporidium parvum
AGETV

SEQ ID NO: 2250737 - protein, 4 aa, Cryptosporidium parvum
AGEY

SEQ ID NO: 2250738 - protein, 25 aa, Cryptosporidium parvum
AGFSNDSIKAEDAVENPSRKNHISS

SEQ ID NO: 2250739 - protein, 8 aa, Cryptosporidium parvum
AGFTRPEA

SEQ ID NO: 2250740 - protein, 4 aa, Cryptosporidium parvum
AGGD

SEQ ID NO: 2250741 - protein, 6 aa, Cryptosporidium parvum
AGGEGL

SEQ ID NO: 2250742 - protein, 4 aa, Cryptosporidium parvum
AGGF

SEQ ID NO: 2250743 - protein, 4 aa, Cryptosporidium parvum
AGGI

SEQ ID NO: 2250744 - protein, 5 aa, Cryptosporidium parvum
AGGIE

SEQ ID NO: 2250745 - protein, 42 aa, Cryptosporidium parvum
AGGLADDTSFTPVKKTSSRASASKGAVFTPKRRDSQGADGSV

SEQ ID NO: 2250746 - protein, 6 aa, Cryptosporidium parvum
AGGSDQ

SEQ ID NO: 2250747 - protein, 13 aa, Cryptosporidium parvum
AGGSLGGAQSVNE

SEQ ID NO: 2250748 - protein, 6 aa, Cryptosporidium parvum
AGGSNL

SEQ ID NO: 2250749 - protein, 7 aa, Cryptosporidium parvum
AGGTGDV

SEQ ID NO: 2250750 - protein, 9 aa, Cryptosporidium parvum
AGGTGSGMG

SEQ ID NO: 2250751 - protein, 73 aa, Cryptosporidium parvum
AGGTNKIKKDQGANSIVNTNSNQPTKGSSLISDDDDTFEIDNSSSKNGVITNGTSSVALSSHSSTTTTSSGVT

SEQ ID NO: 2250752 - protein, 18 aa, Cryptosporidium parvum
AGGTSKNSLNSSSNERSR

SEQ ID NO: 2250753 - protein, 6 aa, Cryptosporidium parvum
AGIGGA

SEQ ID NO: 2250754 - protein, 6 aa, Cryptosporidium parvum
AGIGPG

SEQ ID NO: 2250755 - protein, 13 aa, Cryptosporidium parvum
AGIGTGAGIEAGV

SEQ ID NO: 2250756 - protein, 8 aa, Cryptosporidium parvum
AGIGTGIG

SEQ ID NO: 2250757 - protein, 5 aa, Cryptosporidium parvum
AGISD

SEQ ID NO: 2250758 - protein, 6 aa, Cryptosporidium parvum
AGISEE

SEQ ID NO: 2250759 - protein, 8 aa, Cryptosporidium parvum
AGITTTLN

SEQ ID NO: 2250760 - protein, 6 aa, Cryptosporidium parvum
AGKEEM

SEQ ID NO: 2250761 - protein, 14 aa, Cryptosporidium parvum
AGKQAYNNKVDASE

SEQ ID NO: 2250762 - protein, 19 aa, Cryptosporidium parvum
AGKQDHTEAIKNGENTDQS

SEQ ID NO: 2250763 - protein, 6 aa, Cryptosporidium parvum
AGKRGL

SEQ ID NO: 2250764 - protein, 23 aa, Cryptosporidium parvum
AGKSAKTKIDPRRVSEKSSKKVP

SEQ ID NO: 2250765 - protein, 11 aa, Cryptosporidium parvum
AGKSFRKSAPA

SEQ ID NO: 2250766 - protein, 8 aa, Cryptosporidium parvum
AGKSTSAV

SEQ ID NO: 2250767 - protein, 8 aa, Cryptosporidium parvum
AGKSTTCG

SEQ ID NO: 2250768 - protein, 31 aa, Cryptosporidium parvum
AGKVKNQTPRVEKQEKKKALTGRAKKRQQYN

SEQ ID NO: 2250769 - protein, 12 aa, Cryptosporidium parvum
AGLGERKLKKLL

SEQ ID NO: 2250770 - protein, 16 aa, Cryptosporidium parvum
AGLLDPSQRPSISSNG

SEQ ID NO: 2250771 - protein, 14 aa, Cryptosporidium parvum
AGLTPGVSTDSGRI

SEQ ID NO: 2250772 - protein, 12 aa, Cryptosporidium parvum
AGNDEESGNSEL

SEQ ID NO: 2250773 - protein, 6 aa, Cryptosporidium parvum
AGNDTN

SEQ ID NO: 2250774 - protein, 10 aa, Cryptosporidium parvum
AGNENDAQGL

SEQ ID NO: 2250775 - protein, 7 aa, Cryptosporidium parvum
AGNGYTN

SEQ ID NO: 2250776 - protein, 18 aa, Cryptosporidium parvum
AGNKSSVAGRDTKENVSS

SEQ ID NO: 2250777 - protein, 11 aa, Cryptosporidium parvum
AGNNPGNTSSL

SEQ ID NO: 2250778 - protein, 6 aa, Cryptosporidium parvum
AGNNYH

SEQ ID NO: 2250779 - protein, 8 aa, Cryptosporidium parvum
AGNSESSS

SEQ ID NO: 2250780 - protein, 8 aa, Cryptosporidium parvum
AGNTGITT

SEQ ID NO: 2250781 - protein, 27 aa, Cryptosporidium parvum
AGNVPNSTVLDGPSSNRRTALGNVSPN

SEQ ID NO: 2250782 - protein, 6 aa, Cryptosporidium parvum
AGPGIS

SEQ ID NO: 2250783 - protein, 9 aa, Cryptosporidium parvum
AGPNITSYT

SEQ ID NO: 2250784 - protein, 10 aa, Cryptosporidium parvum
AGPPGTGKTA

SEQ ID NO: 2250785 - protein, 4 aa, Cryptosporidium parvum
AGPY

SEQ ID NO: 2250786 - protein, 17 aa, Cryptosporidium parvum
AGQDDGIEGETRLEKKK

SEQ ID NO: 2250787 - protein, 8 aa, Cryptosporidium parvum
AGQEKFGG

SEQ ID NO: 2250788 - protein, 5 aa, Cryptosporidium parvum
AGQER

SEQ ID NO: 2250789 - protein, 8 aa, Cryptosporidium parvum
AGQERYRS

SEQ ID NO: 2250790 - protein, 7 aa, Cryptosporidium parvum
AGQESFR

SEQ ID NO: 2250791 - protein, 9 aa, Cryptosporidium parvum
AGQGDDNIE

SEQ ID NO: 2250792 - protein, 10 aa, Cryptosporidium parvum
AGQIDNADEH

SEQ ID NO: 2250793 - protein, 7 aa, Cryptosporidium parvum
AGRFGTK

SEQ ID NO: 2250794 - protein, 11 aa, Cryptosporidium parvum
AGRGRGKSAAL

SEQ ID NO: 2250795 - protein, 4 aa, Cryptosporidium parvum
AGRI

SEQ ID NO: 2250796 - protein, 7 aa, Cryptosporidium parvum
AGRKDKR

SEQ ID NO: 2250797 - protein, 7 aa, Cryptosporidium parvum
AGRKNLE

SEQ ID NO: 2250798 - protein, 7 aa, Cryptosporidium parvum
AGRPQFE

SEQ ID NO: 2250799 - protein, 9 aa, Cryptosporidium parvum
AGRTQIAAG

SEQ ID NO: 2250800 - protein, 6 aa, Cryptosporidium parvum
AGRTTG

SEQ ID NO: 2250801 - protein, 4 aa, Cryptosporidium parvum
AGSI

SEQ ID NO: 2250802 - protein, 12 aa, Cryptosporidium parvum
AGSIESEEAPLS

SEQ ID NO: 2250803 - protein, 33 aa, Cryptosporidium parvum
AGSNVGSSISYHSESQCQGSELDNSVNCSRKQR

SEQ ID NO: 2250804 - protein, 9 aa, Cryptosporidium parvum
AGSPLDPNS

SEQ ID NO: 2250805 - protein, 5 aa, Cryptosporidium parvum
AGSSD

SEQ ID NO: 2250806 - protein, 7 aa, Cryptosporidium parvum
AGSSEPQ

SEQ ID NO: 2250807 - protein, 5 aa, Cryptosporidium parvum
AGSSG

SEQ ID NO: 2250808 - protein, 7 aa, Cryptosporidium parvum
AGSSGEI

SEQ ID NO: 2250809 - protein, 7 aa, Cryptosporidium parvum
AGSSNEF

SEQ ID NO: 2250810 - protein, 6 aa, Cryptosporidium parvum
AGSTAE

SEQ ID NO: 2250811 - protein, 8 aa, Cryptosporidium parvum
AGSTEPNA

SEQ ID NO: 2250812 - protein, 7 aa, Cryptosporidium parvum
AGSVDEN

SEQ ID NO: 2250813 - protein, 7 aa, Cryptosporidium parvum
AGTDGHY

SEQ ID NO: 2250814 - protein, 6 aa, Cryptosporidium parvum
AGTEEA

SEQ ID NO: 2250815 - protein, 6 aa, Cryptosporidium parvum
AGTGFS

SEQ ID NO: 2250816 - protein, 9 aa, Cryptosporidium parvum
AGTGTYPPE

SEQ ID NO: 2250817 - protein, 18 aa, Cryptosporidium parvum
AGTHGFEENGEKNKKQKF

SEQ ID NO: 2250818 - protein, 4 aa, Cryptosporidium parvum
AGTL

SEQ ID NO: 2250819 - protein, 6 aa, Cryptosporidium parvum
AGTRMY

SEQ ID NO: 2250820 - protein, 27 aa, Cryptosporidium parvum
AGTSLQPYSGAYKRTKGKRWSTEQTNK

SEQ ID NO: 2250821 - protein, 35 aa, Cryptosporidium parvum
AGTVASSSITINSNTNTNSASVSSPNYLEQPSTTV

SEQ ID NO: 2250822 - protein, 4 aa, Cryptosporidium parvum
AGTY

SEQ ID NO: 2250823 - protein, 25 aa, Cryptosporidium parvum
AGVGSGVGVGAGTGIDAGAGSGGVG

SEQ ID NO: 2250824 - protein, 11 aa, Cryptosporidium parvum
AGVGTQTEIER

SEQ ID NO: 2250825 - protein, 42 aa, Cryptosporidium parvum
AGVNQGEGSYFSDSKERKSRGMSRKSLTSNSNLSYTNSGLFS

SEQ ID NO: 2250826 - protein, 6 aa, Cryptosporidium parvum
AGVTLN

SEQ ID NO: 2250827 - protein, 63 aa, Cryptosporidium parvum
AGVTNNSLTKTPSKTRTRKVRESSDDFGNSSSGPSVHSKSGYSSNSSGESCSFGSSSNVSEDL

SEQ ID NO: 2250828 - protein, 6 aa, Cryptosporidium parvum
AGVTTE

SEQ ID NO: 2250829 - protein, 7 aa, Cryptosporidium parvum
AGYAADA

SEQ ID NO: 2250830 - protein, 5 aa, Cryptosporidium parvum
AGYGI

SEQ ID NO: 2250831 - protein, 4 aa, Cryptosporidium parvum
AGYI

SEQ ID NO: 2250832 - protein, 4 aa, Cryptosporidium parvum
AGYV

SEQ ID NO: 2250833 - protein, 59 aa, Cryptosporidium parvum
AHANTDSNAESQKKVSSSTAANTSNNSSNNASTSAPNTTSNNAAANTSSASSPSPLDPV

SEQ ID NO: 2250834 - protein, 8 aa, Cryptosporidium parvum
AHDETDLN

SEQ ID NO: 2250835 - protein, 16 aa, Cryptosporidium parvum
AHDGSKAQAKVSKLRE

SEQ ID NO: 2250836 - protein, 8 aa, Cryptosporidium parvum
AHEARRNL

SEQ ID NO: 2250837 - protein, 4 aa, Cryptosporidium parvum
AHEK

SEQ ID NO: 2250838 - protein, 4 aa, Cryptosporidium parvum
AHEL

SEQ ID NO: 2250839 - protein, 9 aa, Cryptosporidium parvum
AHENDKNSI

SEQ ID NO: 2250840 - protein, 7 aa, Cryptosporidium parvum
AHEQTKS

SEQ ID NO: 2250841 - protein, 5 aa, Cryptosporidium parvum
AHESE

SEQ ID NO: 2250842 - protein, 11 aa, Cryptosporidium parvum
AHFDSKDGQYL

SEQ ID NO: 2250843 - protein, 6 aa, Cryptosporidium parvum
AHGGTF

SEQ ID NO: 2250844 - protein, 12 aa, Cryptosporidium parvum
AHKSNIKREHMN

SEQ ID NO: 2250845 - protein, 13 aa, Cryptosporidium parvum
AHLGDEAAGSCNA

SEQ ID NO: 2250846 - protein, 7 aa, Cryptosporidium parvum
AHNGPAA

SEQ ID NO: 2250847 - protein, 4 aa, Cryptosporidium parvum
AHNL

SEQ ID NO: 2250848 - protein, 21 aa, Cryptosporidium parvum
AHNNNAISSYYSSTSEANDLE

SEQ ID NO: 2250849 - protein, 5 aa, Cryptosporidium parvum
AHNSN

SEQ ID NO: 2250850 - protein, 6 aa, Cryptosporidium parvum
AHNTQL

SEQ ID NO: 2250851 - protein, 5 aa, Cryptosporidium parvum
AHPEM

SEQ ID NO: 2250852 - protein, 6 aa, Cryptosporidium parvum
AHPGAK

SEQ ID NO: 2250853 - protein, 6 aa, Cryptosporidium parvum
AHPNDV

SEQ ID NO: 2250854 - protein, 4 aa, Cryptosporidium parvum
AHQK

SEQ ID NO: 2250855 - protein, 15 aa, Cryptosporidium parvum
AHRADAQCSSCGGTL

SEQ ID NO: 2250856 - protein, 23 aa, Cryptosporidium parvum
AHREEQIEEEEHATPSSNDSFST

SEQ ID NO: 2250857 - protein, 7 aa, Cryptosporidium parvum
AHRIGQK

SEQ ID NO: 2250858 - protein, 4 aa, Cryptosporidium parvum
AHRK

SEQ ID NO: 2250859 - protein, 8 aa, Cryptosporidium parvum
AHRPPKHQ

SEQ ID NO: 2250860 - protein, 7 aa, Cryptosporidium parvum
AHSKGQL

SEQ ID NO: 2250861 - protein, 4 aa, Cryptosporidium parvum
AHSL

SEQ ID NO: 2250862 - protein, 6 aa, Cryptosporidium parvum
AHTFTP

SEQ ID NO: 2250863 - protein, 6 aa, Cryptosporidium parvum
AHTKEE

SEQ ID NO: 2250864 - protein, 12 aa, Cryptosporidium parvum
AHTTEDTPNNYS

SEQ ID NO: 2250865 - protein, 5 aa, Cryptosporidium parvum
AIAAT

SEQ ID NO: 2250866 - protein, 7 aa, Cryptosporidium parvum
AIDSGAG

SEQ ID NO: 2250867 - protein, 19 aa, Cryptosporidium parvum
AIEASQKAIEASKKAIEAS

SEQ ID NO: 2250868 - protein, 50 aa, Cryptosporidium parvum
AIEDKDQQTKLDMTTKSSEEEQVDKEDQYPASVSSITETQSVHSNSNSFV

SEQ ID NO: 2250869 - protein, 12 aa, Cryptosporidium parvum
AIEEEYKKNQEN

SEQ ID NO: 2250870 - protein, 7 aa, Cryptosporidium parvum
AIEETEQ

SEQ ID NO: 2250871 - protein, 14 aa, Cryptosporidium parvum
AIEPSIAPPIPPIP

SEQ ID NO: 2250872 - protein, 5 aa, Cryptosporidium parvum
AIERE

SEQ ID NO: 2250873 - protein, 16 aa, Cryptosporidium parvum
AIESQNYETKKVNSSL

SEQ ID NO: 2250874 - protein, 10 aa, Cryptosporidium parvum
AIGGGGSYSL

SEQ ID NO: 2250875 - protein, 84 aa, Cryptosporidium parvum
AIGGPDRGSSSRGGMSTRGRGTGRFPSRGGSSSATAGSSSRGGASSGTVGTIGGSVRGGGSSRGGLNSRTRGTEIIPGRGRLSS

SEQ ID NO: 2250876 - protein, 9 aa, Cryptosporidium parvum
AIGKDMQNA

SEQ ID NO: 2250877 - protein, 13 aa, Cryptosporidium parvum
AIGNEENMETELK

SEQ ID NO: 2250878 - protein, 11 aa, Cryptosporidium parvum
AIGPVNKNISQ

SEQ ID NO: 2250879 - protein, 11 aa, Cryptosporidium parvum
AIGQNNQTATS

SEQ ID NO: 2250880 - protein, 10 aa, Cryptosporidium parvum
AIGTAQEGAE

SEQ ID NO: 2250881 - protein, 20 aa, Cryptosporidium parvum
AIGTGPLNTGSSNNYFGGQS

SEQ ID NO: 2250882 - protein, 16 aa, Cryptosporidium parvum
AIKDNEKFKEKHKNLK

SEQ ID NO: 2250883 - protein, 4 aa, Cryptosporidium parvum
AIKG

SEQ ID NO: 2250884 - protein, 5 aa, Cryptosporidium parvum
AIKQG

SEQ ID NO: 2250885 - protein, 6 aa, Cryptosporidium parvum
AINGNN

SEQ ID NO: 2250886 - protein, 16 aa, Cryptosporidium parvum
AINGPKSVTISGSRSS

SEQ ID NO: 2250887 - protein, 10 aa, Cryptosporidium parvum
AINKERKEQK

SEQ ID NO: 2250888 - protein, 14 aa, Cryptosporidium parvum
AINNQKRQVVHSPF

SEQ ID NO: 2250889 - protein, 6 aa, Cryptosporidium parvum
AINNQS

SEQ ID NO: 2250890 - protein, 5 aa, Cryptosporidium parvum
AINSA

SEQ ID NO: 2250891 - protein, 10 aa, Cryptosporidium parvum
AINSKEESEI

SEQ ID NO: 2250892 - protein, 5 aa, Cryptosporidium parvum
AIPEE

SEQ ID NO: 2250893 - protein, 15 aa, Cryptosporidium parvum
AIPGQVDTSTPQANP

SEQ ID NO: 2250894 - protein, 12 aa, Cryptosporidium parvum
AIPNGSSSNTNC

SEQ ID NO: 2250895 - protein, 4 aa, Cryptosporidium parvum
AIPS

SEQ ID NO: 2250896 - protein, 6 aa, Cryptosporidium parvum
AIQDSP

SEQ ID NO: 2250897 - protein, 10 aa, Cryptosporidium parvum
AIQYDTRSNE

SEQ ID NO: 2250898 - protein, 31 aa, Cryptosporidium parvum
AIRKYDGNIDEDNDFDDNDYTGSRKGDSILD

SEQ ID NO: 2250899 - protein, 9 aa, Cryptosporidium parvum
AISGSASST

SEQ ID NO: 2250900 - protein, 8 aa, Cryptosporidium parvum
AISGSGSG

SEQ ID NO: 2250901 - protein, 5 aa, Cryptosporidium parvum
AISKE

SEQ ID NO: 2250902 - protein, 8 aa, Cryptosporidium parvum
AISNGEDK

SEQ ID NO: 2250903 - protein, 5 aa, Cryptosporidium parvum
AISRK

SEQ ID NO: 2250904 - protein, 22 aa, Cryptosporidium parvum
AISRKSANYGKDRNQLHENNNS

SEQ ID NO: 2250905 - protein, 11 aa, Cryptosporidium parvum
AISSGTSNGKY

SEQ ID NO: 2250906 - protein, 6 aa, Cryptosporidium parvum
AISSMP

SEQ ID NO: 2250907 - protein, 6 aa, Cryptosporidium parvum
AISSNS

SEQ ID NO: 2250908 - protein, 8 aa, Cryptosporidium parvum
AISTDEEN

SEQ ID NO: 2250909 - protein, 11 aa, Cryptosporidium parvum
AISTPRDPVEQ

SEQ ID NO: 2250910 - protein, 6 aa, Cryptosporidium parvum
AISTSN

SEQ ID NO: 2250911 - protein, 4 aa, Cryptosporidium parvum
AITD

SEQ ID NO: 2250912 - protein, 13 aa, Cryptosporidium parvum
AKAAAPSYSGLPA

SEQ ID NO: 2250913 - protein, 17 aa, Cryptosporidium parvum
AKAERLIPKSGTTDQIG

SEQ ID NO: 2250914 - protein, 7 aa, Cryptosporidium parvum
AKAFSGT

SEQ ID NO: 2250915 - protein, 4 aa, Cryptosporidium parvum
AKAK

SEQ ID NO: 2250916 - protein, 13 aa, Cryptosporidium parvum
AKAKAKSKSNSVL

SEQ ID NO: 2250917 - protein, 10 aa, Cryptosporidium parvum
AKAKESRTTH

SEQ ID NO: 2250918 - protein, 6 aa, Cryptosporidium parvum
AKAMEE

SEQ ID NO: 2250919 - protein, 7 aa, Cryptosporidium parvum
AKANENI

SEQ ID NO: 2250920 - protein, 9 aa, Cryptosporidium parvum
AKANSEAQL

SEQ ID NO: 2250921 - protein, 7 aa, Cryptosporidium parvum
AKAPEVN

SEQ ID NO: 2250922 - protein, 6 aa, Cryptosporidium parvum
AKAPLL

SEQ ID NO: 2250923 - protein, 20 aa, Cryptosporidium parvum
AKAQGNKDDKKSGTSDKATV

SEQ ID NO: 2250924 - protein, 9 aa, Cryptosporidium parvum
AKASTSVPI

SEQ ID NO: 2250925 - protein, 7 aa, Cryptosporidium parvum
AKCPHGS

SEQ ID NO: 2250926 - protein, 6 aa, Cryptosporidium parvum
AKDASQ

SEQ ID NO: 2250927 - protein, 6 aa, Cryptosporidium parvum
AKDASR

SEQ ID NO: 2250928 - protein, 15 aa, Cryptosporidium parvum
AKDEDEDEDEADEDE

SEQ ID NO: 2250929 - protein, 9 aa, Cryptosporidium parvum
AKDEKSIAE

SEQ ID NO: 2250930 - protein, 11 aa, Cryptosporidium parvum
AKDEQGKQEYK

SEQ ID NO: 2250931 - protein, 26 aa, Cryptosporidium parvum
AKDGDSIAEYSTSKGSNSMIDGGTST

SEQ ID NO: 2250932 - protein, 7 aa, Cryptosporidium parvum
AKDHPNL

SEQ ID NO: 2250933 - protein, 8 aa, Cryptosporidium parvum
AKDIGSLP

SEQ ID NO: 2250934 - protein, 10 aa, Cryptosporidium parvum
AKDKANEIEA

SEQ ID NO: 2250935 - protein, 13 aa, Cryptosporidium parvum
AKDLTEESENDTL

SEQ ID NO: 2250936 - protein, 7 aa, Cryptosporidium parvum
AKDQDTL

SEQ ID NO: 2250937 - protein, 7 aa, Cryptosporidium parvum
AKDSQGR

SEQ ID NO: 2250938 - protein, 5 aa, Cryptosporidium parvum
AKDTI

SEQ ID NO: 2250939 - protein, 6 aa, Cryptosporidium parvum
AKDVPA

SEQ ID NO: 2250940 - protein, 6 aa, Cryptosporidium parvum
AKEDKV

SEQ ID NO: 2250941 - protein, 6 aa, Cryptosporidium parvum
AKEEKI

SEQ ID NO: 2250942 - protein, 5 aa, Cryptosporidium parvum
AKEKG

SEQ ID NO: 2250943 - protein, 7 aa, Cryptosporidium parvum
AKELEEK

SEQ ID NO: 2250944 - protein, 4 aa, Cryptosporidium parvum
AKEM

SEQ ID NO: 2250945 - protein, 48 aa, Cryptosporidium parvum
AKENNGNSTSETSNNNNATSINNNSSSSTNKHDESNKSINQNGQDEYN

SEQ ID NO: 2250946 - protein, 32 aa, Cryptosporidium parvum; identical to SEQ ID NO: 2135774

SEQ ID NO: 2250947 - protein, 13 aa, Cryptosporidium parvum
AKESENLKKSQQT

SEQ ID NO: 2250948 - protein, 9 aa, Cryptosporidium parvum
AKESERRNI

SEQ ID NO: 2250949 - protein, 6 aa, Cryptosporidium parvum
AKESGL

SEQ ID NO: 2250950 - protein, 7 aa, Cryptosporidium parvum
AKESNSL

SEQ ID NO: 2250951 - protein, 8 aa, Cryptosporidium parvum
AKESSLRR

SEQ ID NO: 2250952 - protein, 17 aa, Cryptosporidium parvum
AKETETWSKDSSMGKSC

SEQ ID NO: 2250953 - protein, 7 aa, Cryptosporidium parvum
AKETLND

SEQ ID NO: 2250954 - protein, 15 aa, Cryptosporidium parvum
AKETYSDYKQGNGFS

SEQ ID NO: 2250955 - protein, 13 aa, Cryptosporidium parvum
AKEYEDEAQAKRK

SEQ ID NO: 2250956 - protein, 12 aa, Cryptosporidium parvum
AKFAPISQESDD

SEQ ID NO: 2250957 - protein, 12 aa, Cryptosporidium parvum
AKFSKENRLEYL

SEQ ID NO: 2250958 - protein, 8 aa, Cryptosporidium parvum
AKFSKNPS

SEQ ID NO: 2250959 - protein, 15 aa, Cryptosporidium parvum
AKGGGGSQGHSSTPQ

SEQ ID NO: 2250960 - protein, 10 aa, Cryptosporidium parvum
AKGGGKVQPN

SEQ ID NO: 2250961 - protein, 13 aa, Cryptosporidium parvum
AKGIPTATTNDAR

SEQ ID NO: 2250962 - protein, 9 aa, Cryptosporidium parvum
AKGKSSIKL

SEQ ID NO: 2250963 - protein, 4 aa, Cryptosporidium parvum
AKGL

SEQ ID NO: 2250964 - protein, 11 aa, Cryptosporidium parvum
AKGLSNSTLRQ

SEQ ID NO: 2250965 - protein, 7 aa, Cryptosporidium parvum
AKGPEER

SEQ ID NO: 2250966 - protein, 12 aa, Cryptosporidium parvum
AKGQPQYDRAED

SEQ ID NO: 2250967 - protein, 8 aa, Cryptosporidium parvum
AKGTSKRV

SEQ ID NO: 2250968 - protein, 11 aa, Cryptosporidium parvum
AKHGLTKTIEN

SEQ ID NO: 2250969 - protein, 9 aa, Cryptosporidium parvum
AKIDPSSLK

SEQ ID NO: 2250970 - protein, 5 aa, Cryptosporidium parvum
AKIPK

SEQ ID NO: 2250971 - protein, 16 aa, Cryptosporidium parvum
AKIPSNSTSRSSQNVK

SEQ ID NO: 2250972 - protein, 14 aa, Cryptosporidium parvum
AKIQAKRNSSKKNY

SEQ ID NO: 2250973 - protein, 4 aa, Cryptosporidium parvum
AKIS

SEQ ID NO: 2250974 - protein, 14 aa, Cryptosporidium parvum
AKITKKNTGSSTIR

SEQ ID NO: 2250975 - protein, 8 aa, Cryptosporidium parvum
AKKAGGAT

SEQ ID NO: 2250976 - protein, 9 aa, Cryptosporidium parvum
AKKDGNEKA

SEQ ID NO: 2250977 - protein, 25 aa, Cryptosporidium parvum
AKKDKSKFNLDNNNNNNNKNNKIGQ

SEQ ID NO: 2250978 - protein, 4 aa, Cryptosporidium parvum
AKKE

SEQ ID NO: 2250979 - protein, 9 aa, Cryptosporidium parvum
AKKEKSLEL

SEQ ID NO: 2250980 - protein, 75 aa, Cryptosporidium parvum
AKKERQKKANLTQSRVRNGRGGKGQNLKKRGERRPNSVNSNGRRNFKGSPGKISRSRGGNRGRGFDQGKRMSRDQ

SEQ ID NO: 2250981 - protein, 6 aa, Cryptosporidium parvum
AKKGFK

SEQ ID NO: 2250982 - protein, 8 aa, Cryptosporidium parvum
AKKGSNEI

SEQ ID NO: 2250983 - protein, 8 aa, Cryptosporidium parvum
AKKGTNGI

SEQ ID NO: 2250984 - protein, 7 aa, Cryptosporidium parvum
AKKIKKP

SEQ ID NO: 2250985 - protein, 6 aa, Cryptosporidium parvum
AKKIQN

SEQ ID NO: 2250986 - protein, 18 aa, Cryptosporidium parvum
AKKKKSRQKWAEISKNQK

SEQ ID NO: 2250987 - protein, 10 aa, Cryptosporidium parvum
AKKKQKNVMD

SEQ ID NO: 2250988 - protein, 9 aa, Cryptosporidium parvum
AKKLTDSSS

SEQ ID NO: 2250989 - protein, 8 aa, Cryptosporidium parvum
AKKMANDD

SEQ ID NO: 2250990 - protein, 7 aa, Cryptosporidium parvum
AKKPEMP

SEQ ID NO: 2250991 - protein, 47 aa, Cryptosporidium parvum; identical to SEQ ID NO: 2135809

SEQ ID NO: 2250992 - protein, 7 aa, Cryptosporidium parvum
AKKRDHR

SEQ ID NO: 2250993 - protein, 15 aa, Cryptosporidium parvum
AKKRKEEEQREQQKT

SEQ ID NO: 2250994 - protein, 6 aa, Cryptosporidium parvum
AKKTVN

SEQ ID NO: 2250995 - protein, 7 aa, Cryptosporidium parvum
AKLDESK

SEQ ID NO: 2250996 - protein, 8 aa, Cryptosporidium parvum
AKLPRKKM

SEQ ID NO: 2250997 - protein, 7 aa, Cryptosporidium parvum
AKLQEEK

SEQ ID NO: 2250998 - protein, 6 aa, Cryptosporidium parvum
AKLQSR

SEQ ID NO: 2250999 - protein, 7 aa, Cryptosporidium parvum
AKMAKNL

SEQ ID NO: 2251000 - protein, 14 aa, Cryptosporidium parvum
AKMKREKSKHSSNM

SEQ ID NO: 2251001 - protein, 32 aa, Cryptosporidium parvum
AKNATNIESGQNLYSSSSANGAGFNSSSDLTS

SEQ ID NO: 2251002 - protein, 6 aa, Cryptosporidium parvum
AKNDYK

SEQ ID NO: 2251003 - protein, 7 aa, Cryptosporidium parvum
AKNEFEA

SEQ ID NO: 2251004 - protein, 10 aa, Cryptosporidium parvum
AKNEKKYKNL

SEQ ID NO: 2251005 - protein, 6 aa, Cryptosporidium parvum
AKNGYN

SEQ ID NO: 2251006 - protein, 73 aa, Cryptosporidium parvum
AKNKGDNGNGDDDDDDDDDDDDDDDDDNNNNNNNNNNNSNNDVNNNDRANDESREDGEGKEGEYGREGGESEL

SEQ ID NO: 2251007 - protein, 19 aa, Cryptosporidium parvum
AKNRGDEPSSLLKGSADSS

SEQ ID NO: 2251008 - protein, 14 aa, Cryptosporidium parvum
AKNSFRGGGKRGKR

SEQ ID NO: 2251009 - protein, 5 aa, Cryptosporidium parvum
AKNSL

SEQ ID NO: 2251010 - protein, 10 aa, Cryptosporidium parvum
AKNSSKNSHE

SEQ ID NO: 2251011 - protein, 18 aa, Cryptosporidium parvum
AKNVSSRSGGNVSGTVGG

SEQ ID NO: 2251012 - protein, 7 aa, Cryptosporidium parvum
AKPEEPC

SEQ ID NO: 2251013 - protein, 9 aa, Cryptosporidium parvum
AKPESIETN

SEQ ID NO: 2251014 - protein, 10 aa, Cryptosporidium parvum
AKPESSEWGN

SEQ ID NO: 2251015 - protein, 4 aa, Cryptosporidium parvum
AKPI

SEQ ID NO: 2251016 - protein, 8 aa, Cryptosporidium parvum
AKPNEGHR

SEQ ID NO: 2251017 - protein, 8 aa, Cryptosporidium parvum
AKPQGASF

SEQ ID NO: 2251018 - protein, 7 aa, Cryptosporidium parvum
AKPSPNL

SEQ ID NO: 2251019 - protein, 9 aa, Cryptosporidium parvum
AKPTSKEER

SEQ ID NO: 2251020 - protein, 12 aa, Cryptosporidium parvum
AKQFSRNKHEIK

SEQ ID NO: 2251021 - protein, 6 aa, Cryptosporidium parvum
AKQGDA

SEQ ID NO: 2251022 - protein, 9 aa, Cryptosporidium parvum
AKQKSQDVS

SEQ ID NO: 2251023 - protein, 8 aa, Cryptosporidium parvum
AKQPNSAV

SEQ ID NO: 2251024 - protein, 10 aa, Cryptosporidium parvum
AKQQSLEREK

SEQ ID NO: 2251025 - protein, 7 aa, Cryptosporidium parvum
AKQRVPP

SEQ ID NO: 2251026 - protein, 6 aa, Cryptosporidium parvum
AKQSLN

SEQ ID NO: 2251027 - protein, 8 aa, Cryptosporidium parvum
AKQSPKYE

SEQ ID NO: 2251028 - protein, 5 aa, Cryptosporidium parvum
AKREL

SEQ ID NO: 2251029 - protein, 6 aa, Cryptosporidium parvum
AKRGNY

SEQ ID NO: 2251030 - protein, 7 aa, Cryptosporidium parvum
AKRKNSS

SEQ ID NO: 2251031 - protein, 22 aa, Cryptosporidium parvum
AKRPRAETSFSDKLDSDTLEPT

SEQ ID NO: 2251032 - protein, 4 aa, Cryptosporidium parvum
AKRQ

SEQ ID NO: 2251033 - protein, 49 aa, Cryptosporidium parvum
AKRRKLAEKNKETAQFSQNNINSEGSNVDKKGVESNEGIKPKEELQDSE

SEQ ID NO: 2251034 - protein, 7 aa, Cryptosporidium parvum
AKRRTVQ

SEQ ID NO: 2251035 - protein, 8 aa, Cryptosporidium parvum
AKRSEASG

SEQ ID NO: 2251036 - protein, 12 aa, Cryptosporidium parvum
AKRSKEKYKDSM

SEQ ID NO: 2251037 - protein, 11 aa, Cryptosporidium parvum
AKRTESTNLED

SEQ ID NO: 2251038 - protein, 4 aa, Cryptosporidium parvum
AKSD

SEQ ID NO: 2251039 - protein, 5 aa, Cryptosporidium parvum
AKSEF

SEQ ID NO: 2251040 - protein, 6 aa, Cryptosporidium parvum
AKSEHN

SEQ ID NO: 2251041 - protein, 6 aa, Cryptosporidium parvum
AKSGKK

SEQ ID NO: 2251042 - protein, 7 aa, Cryptosporidium parvum
AKSGTDF

SEQ ID NO: 2251043 - protein, 8 aa, Cryptosporidium parvum
AKSGTGKT

SEQ ID NO: 2251044 - protein, 24 aa, Cryptosporidium parvum
AKSHKDSNKASEISFNENNENKRI

SEQ ID NO: 2251045 - protein, 6 aa, Cryptosporidium parvum
AKSIGT

SEQ ID NO: 2251046 - protein, 25 aa, Cryptosporidium parvum
AKSIRNKRRKIEDSNSSYTNSENLN

SEQ ID NO: 2251047 - protein, 17 aa, Cryptosporidium parvum
AKSISKSFSKSSMKSFQ

SEQ ID NO: 2251048 - protein, 11 aa, Cryptosporidium parvum
AKSKANHNSLN

SEQ ID NO: 2251049 - protein, 8 aa, Cryptosporidium parvum
AKSKGRRH

SEQ ID NO: 2251050 - protein, 9 aa, Cryptosporidium parvum
AKSKSERDG

SEQ ID NO: 2251051 - protein, 5 aa, Cryptosporidium parvum
AKSKV

SEQ ID NO: 2251052 - protein, 25 aa, Cryptosporidium parvum
AKSMNNNLESNSDADTVLNQALTKQ

SEQ ID NO: 2251053 - protein, 14 aa, Cryptosporidium parvum
AKSNISNKEPAKHR

SEQ ID NO: 2251054 - protein, 7 aa, Cryptosporidium parvum
AKSPIWD

SEQ ID NO: 2251055 - protein, 11 aa, Cryptosporidium parvum
AKSPPANDPFK

SEQ ID NO: 2251056 - protein, 7 aa, Cryptosporidium parvum
AKSRSKS

SEQ ID NO: 2251057 - protein, 5 aa, Cryptosporidium parvum
AKSRY

SEQ ID NO: 2251058 - protein, 12 aa, Cryptosporidium parvum
AKSSSRTSTETD

SEQ ID NO: 2251059 - protein, 19 aa, Cryptosporidium parvum
AKSSSSLFQNNPNKKNTKL

SEQ ID NO: 2251060 - protein, 6 aa, Cryptosporidium parvum
AKSTDS

SEQ ID NO: 2251061 - protein, 16 aa, Cryptosporidium parvum
AKTGDVESKSQVSTKL

SEQ ID NO: 2251062 - protein, 8 aa, Cryptosporidium parvum
AKTHNTNL

SEQ ID NO: 2251063 - protein, 6 aa, Cryptosporidium parvum
AKTINK

SEQ ID NO: 2251064 - protein, 4 aa, Cryptosporidium parvum
AKTL

SEQ ID NO: 2251065 - protein, 7 aa, Cryptosporidium parvum
AKTLNKT

SEQ ID NO: 2251066 - protein, 12 aa, Cryptosporidium parvum
AKTLRNNNSSRF

SEQ ID NO: 2251067 - protein, 9 aa, Cryptosporidium parvum
AKTMNSLGT

SEQ ID NO: 2251068 - protein, 4 aa, Cryptosporidium parvum
AKTN

SEQ ID NO: 2251069 - protein, 8 aa, Cryptosporidium parvum
AKTNDETK

SEQ ID NO: 2251070 - protein, 9 aa, Cryptosporidium parvum
AKTNNAFSK

SEQ ID NO: 2251071 - protein, 6 aa, Cryptosporidium parvum
AKTSEF

SEQ ID NO: 2251072 - protein, 8 aa, Cryptosporidium parvum
AKTSEHSS

SEQ ID NO: 2251073 - protein, 6 aa, Cryptosporidium parvum
AKTSLK

SEQ ID NO: 2251074 - protein, 34 aa, Cryptosporidium parvum
AKTSSKIKVKGSRANVSSIKSKHSHSEKETPTIS

SEQ ID NO: 2251075 - protein, 12 aa, Cryptosporidium parvum
AKTVSNPLLYSN

SEQ ID NO: 2251076 - protein, 11 aa, Cryptosporidium parvum
AKVSSEWESTE

SEQ ID NO: 2251077 - protein, 18 aa, Cryptosporidium parvum
AKWRPGRGNSSKSQATKR

SEQ ID NO: 2251078 - protein, 4 aa, Cryptosporidium parvum
AKYE

SEQ ID NO: 2251079 - protein, 4 aa, Cryptosporidium parvum
AKYG

SEQ ID NO: 2251080 - protein, 4 aa, Cryptosporidium parvum
AKYI

SEQ ID NO: 2251081 - protein, 9 aa, Cryptosporidium parvum
AKYKQETQP

SEQ ID NO: 2251082 - protein, 4 aa, Cryptosporidium parvum
AKYQ

SEQ ID NO: 2251083 - protein, 11 aa, Cryptosporidium parvum
ALDASKKCEDV

SEQ ID NO: 2251084 - protein, 7 aa, Cryptosporidium parvum
ALDDSDT

SEQ ID NO: 2251085 - protein, 6 aa, Cryptosporidium parvum
ALDKDY

SEQ ID NO: 2251086 - protein, 7 aa, Cryptosporidium parvum
ALDPRNV

SEQ ID NO: 2251087 - protein, 5 aa, Cryptosporidium parvum
ALEDE

SEQ ID NO: 2251088 - protein, 14 aa, Cryptosporidium parvum
ALEENKNSDSSPSF

SEQ ID NO: 2251089 - protein, 6 aa, Cryptosporidium parvum
ALEEQK

SEQ ID NO: 2251090 - protein, 14 aa, Cryptosporidium parvum
ALEESNDKLEPDEV

SEQ ID NO: 2251091 - protein, 8 aa, Cryptosporidium parvum
ALEKENES

SEQ ID NO: 2251092 - protein, 9 aa, Cryptosporidium parvum
ALENEERNV

SEQ ID NO: 2251093 - protein, 13 aa, Cryptosporidium parvum
ALERNKDKLDNED

SEQ ID NO: 2251094 - protein, 27 aa, Cryptosporidium parvum
ALGRDDCSADSNTPEHREGPQSNQNNV

SEQ ID NO: 2251095 - protein, 9 aa, Cryptosporidium parvum
ALKSGGGGK

SEQ ID NO: 2251096 - protein, 8 aa, Cryptosporidium parvum
ALKTEKNE

SEQ ID NO: 2251097 - protein, 5 aa, Cryptosporidium parvum
ALKTM

SEQ ID NO: 2251098 - protein, 8 aa, Cryptosporidium parvum
ALLPTDSS

SEQ ID NO: 2251099 - protein, 9 aa, Cryptosporidium parvum
ALNDAKKNA

SEQ ID NO: 2251100 - protein, 5 aa, Cryptosporidium parvum
ALNDS

SEQ ID NO: 2251101 - protein, 11 aa, Cryptosporidium parvum
ALNNEQEKQKA

SEQ ID NO: 2251102 - protein, 9 aa, Cryptosporidium parvum
ALNQVNSDS

SEQ ID NO: 2251103 - protein, 9 aa, Cryptosporidium parvum
ALNSSTEFG

SEQ ID NO: 2251104 - protein, 5 aa, Cryptosporidium parvum
ALPNE

SEQ ID NO: 2251105 - protein, 14 aa, Cryptosporidium parvum
ALPNNKKIESKNCS

SEQ ID NO: 2251106 - protein, 12 aa, Cryptosporidium parvum
ALPNTNSYLGNS

SEQ ID NO: 2251107 - protein, 12 aa, Cryptosporidium parvum
ALPPPKGFESNP

SEQ ID NO: 2251108 - protein, 8 aa, Cryptosporidium parvum
ALPPSSFG

SEQ ID NO: 2251109 - protein, 20 aa, Cryptosporidium parvum
ALPSSTTESQELDPKSNSTE

SEQ ID NO: 2251110 - protein, 20 aa, Cryptosporidium parvum
ALPTEPEKEKNLETPPSEEY

SEQ ID NO: 2251111 - protein, 23 aa, Cryptosporidium parvum
ALQDQLDARKARAANLKQKRKVL

SEQ ID NO: 2251112 - protein, 10 aa, Cryptosporidium parvum
ALQEKEGGGK

SEQ ID NO: 2251113 - protein, 8 aa, Cryptosporidium parvum
ALQGDKNS

SEQ ID NO: 2251114 - protein, 6 aa, Cryptosporidium parvum
ALQKNT

SEQ ID NO: 2251115 - protein, 12 aa, Cryptosporidium parvum
ALQNSPKESIKE

SEQ ID NO: 2251116 - protein, 8 aa, Cryptosporidium parvum
ALQSKTDS

SEQ ID NO: 2251117 - protein, 13 aa, Cryptosporidium parvum
ALRKQNSSHRISP

SEQ ID NO: 2251118 - protein, 8 aa, Cryptosporidium parvum
ALRNPDEF

SEQ ID NO: 2251119 - protein, 20 aa, Cryptosporidium parvum
ALSANNSKQNTINSGKPGVV

SEQ ID NO: 2251120 - protein, 7 aa, Cryptosporidium parvum
ALSDSEG

SEQ ID NO: 2251121 - protein, 9 aa, Cryptosporidium parvum
ALSNADQKL

SEQ ID NO: 2251122 - protein, 4 aa, Cryptosporidium parvum
ALSR

SEQ ID NO: 2251123 - protein, 8 aa, Cryptosporidium parvum
ALSSEEYQ

SEQ ID NO: 2251124 - protein, 7 aa, Cryptosporidium parvum
ALSSQKY

SEQ ID NO: 2251125 - protein, 11 aa, Cryptosporidium parvum
ALSTGENSEGV

SEQ ID NO: 2251126 - protein, 7 aa, Cryptosporidium parvum
ALTGEGV

SEQ ID NO: 2251127 - protein, 14 aa, Cryptosporidium parvum
ALTGKNIRHVSDKI

SEQ ID NO: 2251128 - protein, 8 aa, Cryptosporidium parvum
ALTPSSNS

SEQ ID NO: 2251129 - protein, 6 aa, Cryptosporidium parvum
ALTTRS

SEQ ID NO: 2251130 - protein, 10 aa, Cryptosporidium parvum
AMASAKSKAF

SEQ ID NO: 2251131 - protein, 8 aa, Cryptosporidium parvum
AMDNDENK

SEQ ID NO: 2251132 - protein, 17 aa, Cryptosporidium parvum
AMGRNDKTKARSIRENK

SEQ ID NO: 2251133 - protein, 14 aa, Cryptosporidium parvum
AMGSVSGQSVIDPS

SEQ ID NO: 2251134 - protein, 10 aa, Cryptosporidium parvum
AMKSGSGDRY

SEQ ID NO: 2251135 - protein, 12 aa, Cryptosporidium parvum
AMNKDHSNEYEQ

SEQ ID NO: 2251136 - protein, 11 aa, Cryptosporidium parvum
AMNNPNSNLGA

SEQ ID NO: 2251137 - protein, 4 aa, Cryptosporidium parvum
AMNS

SEQ ID NO: 2251138 - protein, 10 aa, Cryptosporidium parvum
AMPQNQNRPL

SEQ ID NO: 2251139 - protein, 4 aa, Cryptosporidium parvum
AMQG

SEQ ID NO: 2251140 - protein, 10 aa, Cryptosporidium parvum
AMSEKTSSTL

SEQ ID NO: 2251141 - protein, 6 aa, Cryptosporidium parvum
AMYPNS

SEQ ID NO: 2251142 - protein, 7 aa, Cryptosporidium parvum
ANACNPE

SEQ ID NO: 2251143 - protein, 17 aa, Cryptosporidium parvum
ANAENNQVDEEKSINNM

SEQ ID NO: 2251144 - protein, 17 aa, Cryptosporidium parvum
ANAESTFSSENKPHTEI

SEQ ID NO: 2251145 - protein, 13 aa, Cryptosporidium parvum
ANAGANGPIPTNG

SEQ ID NO: 2251146 - protein, 32 aa, Cryptosporidium parvum
ANASASENTEKTLSETGSTPPPEESSDEESDV

SEQ ID NO: 2251147 - protein, 6 aa, Cryptosporidium parvum
ANASEE

SEQ ID NO: 2251148 - protein, 8 aa, Cryptosporidium parvum
ANDAARHE

SEQ ID NO: 2251149 - protein, 28 aa, Cryptosporidium parvum
ANDFGLADDKDESTDKKKSSSHKNLADR

SEQ ID NO: 2251150 - protein, 8 aa, Cryptosporidium parvum
ANDGSVTH

SEQ ID NO: 2251151 - protein, 5 aa, Cryptosporidium parvum
ANDLA

SEQ ID NO: 2251152 - protein, 9 aa, Cryptosporidium parvum
ANDLKNSIQ

SEQ ID NO: 2251153 - protein, 16 aa, Cryptosporidium parvum
ANDPDHITAESSEIPS

SEQ ID NO: 2251154 - protein, 18 aa, Cryptosporidium parvum
ANDPIYQKNRESSEKSIR

SEQ ID NO: 2251155 - protein, 17 aa, Cryptosporidium parvum
ANDPSPGINAEPDEDNY

SEQ ID NO: 2251156 - protein, 21 aa, Cryptosporidium parvum
ANDSNQQREEKGDKPDARRKV

SEQ ID NO: 2251157 - protein, 7 aa, Cryptosporidium parvum
ANDVSKL

SEQ ID NO: 2251158 - protein, 60 aa, Cryptosporidium parvum
ANEADESADSNNQASNNSGNTNANNANISGNSGSNTANSNSNVTGRSHIGGAGGSSGGFS

SEQ ID NO: 2251159 - protein, 21 aa, Cryptosporidium parvum
ANEEKDAVEKDPENVQKGAVP

SEQ ID NO: 2251160 - protein, 5 aa, Cryptosporidium parvum
ANEGS

SEQ ID NO: 2251161 - protein, 4 aa, Cryptosporidium parvum
ANEI

SEQ ID NO: 2251162 - protein, 5 aa, Cryptosporidium parvum
ANEKI

SEQ ID NO: 2251163 - protein, 10 aa, Cryptosporidium parvum
ANEKTNKQRE

SEQ ID NO: 2251164 - protein, 8 aa, Cryptosporidium parvum
ANENGSGD

SEQ ID NO: 2251165 - protein, 32 aa, Cryptosporidium parvum
ANENSKSHSINSQFQNNEHKRTSKNNKAVRDS

SEQ ID NO: 2251166 - protein, 13 aa, Cryptosporidium parvum
ANEQESNVKNKSF

SEQ ID NO: 2251167 - protein, 7 aa, Cryptosporidium parvum
ANEQNSN

SEQ ID NO: 2251168 - protein, 45 aa, Cryptosporidium parvum
ANERRGQPSSTSQIYSQNKKKPKPYFSDATKDKRTFGTKAGSGWD

SEQ ID NO: 2251169 - protein, 34 aa, Cryptosporidium parvum
ANERRLSRTNSPENRRFGTNSNTEGNDPNGSNGL

SEQ ID NO: 2251170 - protein, 8 aa, Cryptosporidium parvum
ANESNWPG

SEQ ID NO: 2251171 - protein, 6 aa, Cryptosporidium parvum
ANEYET

SEQ ID NO: 2251172 - protein, 4 aa, Cryptosporidium parvum
ANFR

SEQ ID NO: 2251173 - protein, 19 aa, Cryptosporidium parvum
ANGANRSVNSNVPNPAPQM

SEQ ID NO: 2251174 - protein, 9 aa, Cryptosporidium parvum
ANGDFNKST

SEQ ID NO: 2251175 - protein, 40 aa, Cryptosporidium parvum; identical to SEQ ID NO: 2135974

SEQ ID NO: 2251176 - protein, 8 aa, Cryptosporidium parvum
ANGGKSEL

SEQ ID NO: 2251177 - protein, 8 aa, Cryptosporidium parvum
ANGNPISE

SEQ ID NO: 2251178 - protein, 11 aa, Cryptosporidium parvum
ANGPAAGSKAR

SEQ ID NO: 2251179 - protein, 32 aa, Cryptosporidium parvum; identical to SEQ ID NO: 2135977

SEQ ID NO: 2251180 - protein, 4 aa, Cryptosporidium parvum
ANGR

SEQ ID NO: 2251181 - protein, 5 aa, Cryptosporidium parvum
ANGTG

SEQ ID NO: 2251182 - protein, 7 aa, Cryptosporidium parvum
ANGTTVS

SEQ ID NO: 2251183 - protein, 6 aa, Cryptosporidium parvum
ANGTVI

SEQ ID NO: 2251184 - protein, 13 aa, Cryptosporidium parvum
ANGVDGSSPRWAP

SEQ ID NO: 2251185 - protein, 4 aa, Cryptosporidium parvum
ANHD

SEQ ID NO: 2251186 - protein, 21 aa, Cryptosporidium parvum
ANHDDNNNNNKRITGRDRKYN

SEQ ID NO: 2251187 - protein, 23 aa, Cryptosporidium parvum
ANHENENLENTDNRLDNSDITYD

SEQ ID NO: 2251188 - protein, 25 aa, Cryptosporidium parvum
ANHSDDEESEISSLEGDESEKQVED

SEQ ID NO: 2251189 - protein, 5 aa, Cryptosporidium parvum
ANHTT

SEQ ID NO: 2251190 - protein, 6 aa, Cryptosporidium parvum
ANIASP

SEQ ID NO: 2251191 - protein, 7 aa, Cryptosporidium parvum
ANIDESS

SEQ ID NO: 2251192 - protein, 6 aa, Cryptosporidium parvum
ANIDPN

SEQ ID NO: 2251193 - protein, 9 aa, Cryptosporidium parvum
ANIGPNTSN

SEQ ID NO: 2251194 - protein, 16 aa, Cryptosporidium parvum
ANIGSNSGSNTTTTVK

SEQ ID NO: 2251195 - protein, 9 aa, Cryptosporidium parvum
ANIKTDSQS

SEQ ID NO: 2251196 - protein, 7 aa, Cryptosporidium parvum
ANIPKGN

SEQ ID NO: 2251197 - protein, 8 aa, Cryptosporidium parvum
ANIQSPSG

SEQ ID NO: 2251198 - protein, 24 aa, Cryptosporidium parvum
ANISSYPQDISKTQNVGRVQSTCS

SEQ ID NO: 2251199 - protein, 9 aa, Cryptosporidium parvum
ANITNGGNP

SEQ ID NO: 2251200 - protein, 16 aa, Cryptosporidium parvum
ANKADRYGNKSNSKNW

SEQ ID NO: 2251201 - protein, 36 aa, Cryptosporidium parvum
ANKANEKTFTEDKDELVGNTDKNELEDTQDDSTKIL

SEQ ID NO: 2251202 - protein, 8 aa, Cryptosporidium parvum
ANKDNTHI

SEQ ID NO: 2251203 - protein, 9 aa, Cryptosporidium parvum
ANKEGMKIE

SEQ ID NO: 2251204 - protein, 11 aa, Cryptosporidium parvum
ANKELERSTSN

SEQ ID NO: 2251205 - protein, 16 aa, Cryptosporidium parvum
ANKETTIKSEKGNQDE

SEQ ID NO: 2251206 - protein, 7 aa, Cryptosporidium parvum
ANKETYY

SEQ ID NO: 2251207 - protein, 6 aa, Cryptosporidium parvum
ANKGKN

SEQ ID NO: 2251208 - protein, 6 aa, Cryptosporidium parvum
ANKIES

SEQ ID NO: 2251209 - protein, 8 aa, Cryptosporidium parvum
ANKKKEDF

SEQ ID NO: 2251210 - protein, 10 aa, Cryptosporidium parvum
ANKKKNTRQR

SEQ ID NO: 2251211 - protein, 10 aa, Cryptosporidium parvum
ANKKSGVHGR

SEQ ID NO: 2251212 - protein, 28 aa, Cryptosporidium parvum
ANKLTENSRAQRPKKKKRRQQGSIIGGG

SEQ ID NO: 2251213 - protein, 5 aa, Cryptosporidium parvum
ANKND

SEQ ID NO: 2251214 - protein, 11 aa, Cryptosporidium parvum
ANKNSEHPESI

SEQ ID NO: 2251215 - protein, 10 aa, Cryptosporidium parvum
ANKPEDSALQ

SEQ ID NO: 2251216 - protein, 10 aa, Cryptosporidium parvum
ANKPTKMNNI

SEQ ID NO: 2251217 - protein, 6 aa, Cryptosporidium parvum
ANKQTP

SEQ ID NO: 2251218 - protein, 16 aa, Cryptosporidium parvum
ANKQVEEEDGLDSDNE

SEQ ID NO: 2251219 - protein, 31 aa, Cryptosporidium parvum
ANKRAKPKIKEKKHVKKKSNRSIVNENDSGN

SEQ ID NO: 2251220 - protein, 16 aa, Cryptosporidium parvum
ANKRSIPRANSITFRR

SEQ ID NO: 2251221 - protein, 14 aa, Cryptosporidium parvum
ANKSQGGSNQKGGN

SEQ ID NO: 2251222 - protein, 8 aa, Cryptosporidium parvum
ANKTSEGF

SEQ ID NO: 2251223 - protein, 4 aa, Cryptosporidium parvum
ANLE

SEQ ID NO: 2251224 - protein, 5 aa, Cryptosporidium parvum
ANLET

SEQ ID NO: 2251225 - protein, 18 aa, Cryptosporidium parvum
ANLQNSETIDSNSKKISL

SEQ ID NO: 2251226 - protein, 10 aa, Cryptosporidium parvum
ANLQSPPCNI

SEQ ID NO: 2251227 - protein, 4 aa, Cryptosporidium parvum
ANLS

SEQ ID NO: 2251228 - protein, 9 aa, Cryptosporidium parvum
ANLSHRSDT

SEQ ID NO: 2251229 - protein, 6 aa, Cryptosporidium parvum
ANLSSH

SEQ ID NO: 2251230 - protein, 10 aa, Cryptosporidium parvum
ANNDQSNTNF

SEQ ID NO: 2251231 - protein, 6 aa, Cryptosporidium parvum
ANNDSL

SEQ ID NO: 2251232 - protein, 11 aa, Cryptosporidium parvum
ANNDSSSGRAS

SEQ ID NO: 2251233 - protein, 9 aa, Cryptosporidium parvum
ANNGIPKRS

SEQ ID NO: 2251234 - protein, 5 aa, Cryptosporidium parvum
ANNGS

SEQ ID NO: 2251235 - protein, 8 aa, Cryptosporidium parvum
ANNGSSKE

SEQ ID NO: 2251236 - protein, 4 aa, Cryptosporidium parvum
ANNK

SEQ ID NO: 2251237 - protein, 9 aa, Cryptosporidium parvum
ANNKEEKYK

SEQ ID NO: 2251238 - protein, 7 aa, Cryptosporidium parvum
ANNNPHK

SEQ ID NO: 2251239 - protein, 15 aa, Cryptosporidium parvum
ANNPENSSNAINQNS

SEQ ID NO: 2251240 - protein, 6 aa, Cryptosporidium parvum
ANNPLK

SEQ ID NO: 2251241 - protein, 7 aa, Cryptosporidium parvum
ANNPNPA

SEQ ID NO: 2251242 - protein, 5 aa, Cryptosporidium parvum
ANNQS

SEQ ID NO: 2251243 - protein, 21 aa, Cryptosporidium parvum
ANNSNNNNNTNNNNVNNNSNN

SEQ ID NO: 2251244 - protein, 5 aa, Cryptosporidium parvum
ANNTE

SEQ ID NO: 2251245 - protein, 9 aa, Cryptosporidium parvum
ANNTSSGTF

SEQ ID NO: 2251246 - protein, 15 aa, Cryptosporidium parvum
ANNVPSGSRARVTPF

SEQ ID NO: 2251247 - protein, 6 aa, Cryptosporidium parvum
ANNVSP

SEQ ID NO: 2251248 - protein, 8 aa, Cryptosporidium parvum
ANNVSSRS

SEQ ID NO: 2251249 - protein, 14 aa, Cryptosporidium parvum
ANPISSRYDPKKSV

SEQ ID NO: 2251250 - protein, 4 aa, Cryptosporidium parvum
ANPL

SEQ ID NO: 2251251 - protein, 6 aa, Cryptosporidium parvum
ANPPGL

SEQ ID NO: 2251252 - protein, 5 aa, Cryptosporidium parvum
ANPRV

SEQ ID NO: 2251253 - protein, 14 aa, Cryptosporidium parvum
ANPSISSHDNSSLE

SEQ ID NO: 2251254 - protein, 22 aa, Cryptosporidium parvum
ANPTNSNNVSPVSVGNNTNQNM

SEQ ID NO: 2251255 - protein, 16 aa, Cryptosporidium parvum
ANPVSGRYDPRKSPVA

SEQ ID NO: 2251256 - protein, 9 aa, Cryptosporidium parvum
ANQDPEKLG

SEQ ID NO: 2251257 - protein, 7 aa, Cryptosporidium parvum
ANQENSS

SEQ ID NO: 2251258 - protein, 4 aa, Cryptosporidium parvum
ANQG

SEQ ID NO: 2251259 - protein, 9 aa, Cryptosporidium parvum
ANQGIQRDD

SEQ ID NO: 2251260 - protein, 12 aa, Cryptosporidium parvum
ANQHPPPHPSQL

SEQ ID NO: 2251261 - protein, 9 aa, Cryptosporidium parvum
ANQSTNFED

SEQ ID NO: 2251262 - protein, 6 aa, Cryptosporidium parvum
ANRAKN

SEQ ID NO: 2251263 - protein, 10 aa, Cryptosporidium parvum
ANREKRKEEI

SEQ ID NO: 2251264 - protein, 37 aa, Cryptosporidium parvum; identical to SEQ ID NO: 2136051

SEQ ID NO: 2251265 - protein, 13 aa, Cryptosporidium parvum
ANRMKEKGGQCYK

SEQ ID NO: 2251266 - protein, 38 aa, Cryptosporidium parvum
ANRNNNSDNINGEVKAESGIDNNNNNNNNNNGTQQVPT

SEQ ID NO: 2251267 - protein, 25 aa, Cryptosporidium parvum
ANRPQSHTGGASNSRTTTASQHSGL

SEQ ID NO: 2251268 - protein, 9 aa, Cryptosporidium parvum
ANRRNGKSE

SEQ ID NO: 2251269 - protein, 13 aa, Cryptosporidium parvum
ANRRTEAEKLSKG

SEQ ID NO: 2251270 - protein, 7 aa, Cryptosporidium parvum
ANRSVQN

SEQ ID NO: 2251271 - protein, 4 aa, Cryptosporidium parvum
ANSD

SEQ ID NO: 2251272 - protein, 8 aa, Cryptosporidium parvum
ANSEEEEA

SEQ ID NO: 2251273 - protein, 14 aa, Cryptosporidium parvum
ANSEKDALESAEEM

SEQ ID NO: 2251274 - protein, 5 aa, Cryptosporidium parvum
ANSGC

SEQ ID NO: 2251275 - protein, 60 aa, Cryptosporidium parvum
ANSIGKKDSLTSKEKNVTNDNNDDSDSIEDLEDDDEDLEEDDENENENEYENESHQEEID

SEQ ID NO: 2251276 - protein, 29 aa, Cryptosporidium parvum
ANSKIKSKPSTVSQATNSASSSTAPSNIS

SEQ ID NO: 2251277 - protein, 7 aa, Cryptosporidium parvum
ANSKNGE

SEQ ID NO: 2251278 - protein, 20 aa, Cryptosporidium parvum
ANSKSQGEIMEKRDELFEIS

SEQ ID NO: 2251279 - protein, 29 aa, Cryptosporidium parvum
ANSKSSGGSSNINNSSNNNSGGFNDRGDA

SEQ ID NO: 2251280 - protein, 8 aa, Cryptosporidium parvum
ANSKTGGY

SEQ ID NO: 2251281 - protein, 5 aa, Cryptosporidium parvum
ANSNN

SEQ ID NO: 2251282 - protein, 13 aa, Cryptosporidium parvum
ANSNQNPRNDPID

SEQ ID NO: 2251283 - protein, 8 aa, Cryptosporidium parvum
ANSNSQTK

SEQ ID NO: 2251284 - protein, 4 aa, Cryptosporidium parvum
ANSQ

SEQ ID NO: 2251285 - protein, 30 aa, Cryptosporidium parvum
ANSQGYKPNETLQSTNYSDNTTVSESQLSS

SEQ ID NO: 2251286 - protein, 5 aa, Cryptosporidium parvum
ANSQI

SEQ ID NO: 2251287 - protein, 13 aa, Cryptosporidium parvum
ANSQSINKQFEEK

SEQ ID NO: 2251288 - protein, 11 aa, Cryptosporidium parvum
ANSRNNKANID

SEQ ID NO: 2251289 - protein, 7 aa, Cryptosporidium parvum
ANSSEFK

SEQ ID NO: 2251290 - protein, 10 aa, Cryptosporidium parvum
ANSSNNVSSV

SEQ ID NO: 2251291 - protein, 14 aa, Cryptosporidium parvum
ANSSNTFDEPKDKT

SEQ ID NO: 2251292 - protein, 10 aa, Cryptosporidium parvum
ANSVGSEMDS

SEQ ID NO: 2251293 - protein, 7 aa, Cryptosporidium parvum
ANTAPKE

SEQ ID NO: 2251294 - protein, 6 aa, Cryptosporidium parvum
ANTENS

SEQ ID NO: 2251295 - protein, 12 aa, Cryptosporidium parvum
ANTGSAQRSEEC

SEQ ID NO: 2251296 - protein, 22 aa, Cryptosporidium parvum
ANTNLNTNHSISQNVNQTTYGQ

SEQ ID NO: 2251297 - protein, 9 aa, Cryptosporidium parvum
ANTNTHSSI

SEQ ID NO: 2251298 - protein, 6 aa, Cryptosporidium parvum
ANTPID

SEQ ID NO: 2251299 - protein, 7 aa, Cryptosporidium parvum
ANTSEKT

SEQ ID NO: 2251300 - protein, 6 aa, Cryptosporidium parvum
ANTSKE

SEQ ID NO: 2251301 - protein, 8 aa, Cryptosporidium parvum
ANTSSTGQ

SEQ ID NO: 2251302 - protein, 8 aa, Cryptosporidium parvum
ANVEESIR

SEQ ID NO: 2251303 - protein, 6 aa, Cryptosporidium parvum
ANVKDN

SEQ ID NO: 2251304 - protein, 7 aa, Cryptosporidium parvum
ANVNTFD

SEQ ID NO: 2251305 - protein, 4 aa, Cryptosporidium parvum
ANVQ

SEQ ID NO: 2251306 - protein, 7 aa, Cryptosporidium parvum
ANYDGTI

SEQ ID NO: 2251307 - protein, 4 aa, Cryptosporidium parvum
ANYK

SEQ ID NO: 2251308 - protein, 9 aa, Cryptosporidium parvum
ANYKNQPHM

SEQ ID NO: 2251309 - protein, 6 aa, Cryptosporidium parvum
ANYSQT

SEQ ID NO: 2251310 - protein, 5 aa, Cryptosporidium parvum
APAKD

SEQ ID NO: 2251311 - protein, 4 aa, Cryptosporidium parvum
APAT

SEQ ID NO: 2251312 - protein, 11 aa, Cryptosporidium parvum
APDGKKMSKSL

SEQ ID NO: 2251313 - protein, 10 aa, Cryptosporidium parvum
APDPNEVDSR

SEQ ID NO: 2251314 - protein, 6 aa, Cryptosporidium parvum
APDYDD

SEQ ID NO: 2251315 - protein, 13 aa, Cryptosporidium parvum
APDYEGKESGVGD

SEQ ID NO: 2251316 - protein, 6 aa, Cryptosporidium parvum
APEGLE

SEQ ID NO: 2251317 - protein, 4 aa, Cryptosporidium parvum
APEL

SEQ ID NO: 2251318 - protein, 4 aa, Cryptosporidium parvum
APEN

SEQ ID NO: 2251319 - protein, 9 aa, Cryptosporidium parvum
APENLNNGR

SEQ ID NO: 2251320 - protein, 16 aa, Cryptosporidium parvum
APEPKHDEKSEIPKAT

SEQ ID NO: 2251321 - protein, 10 aa, Cryptosporidium parvum
APERQVTEPL

SEQ ID NO: 2251322 - protein, 7 aa, Cryptosporidium parvum
APESDDE

SEQ ID NO: 2251323 - protein, 6 aa, Cryptosporidium parvum
APESVT

SEQ ID NO: 2251324 - protein, 6 aa, Cryptosporidium parvum
APFSQS

SEQ ID NO: 2251325 - protein, 9 aa, Cryptosporidium parvum
APGAPNTWP

SEQ ID NO: 2251326 - protein, 8 aa, Cryptosporidium parvum
APGDDPDI

SEQ ID NO: 2251327 - protein, 7 aa, Cryptosporidium parvum
APGFGDH

SEQ ID NO: 2251328 - protein, 19 aa, Cryptosporidium parvum
APGIPGPSGVQAPTVPNPL

SEQ ID NO: 2251329 - protein, 5 aa, Cryptosporidium parvum
APGKI

SEQ ID NO: 2251330 - protein, 8 aa, Cryptosporidium parvum
APGNYDSN

SEQ ID NO: 2251331 - protein, 5 aa, Cryptosporidium parvum
APGPL

SEQ ID NO: 2251332 - protein, 4 aa, Cryptosporidium parvum
APGQ

SEQ ID NO: 2251333 - protein, 10 aa, Cryptosporidium parvum
APGSGKGTQC

SEQ ID NO: 2251334 - protein, 8 aa, Cryptosporidium parvum
APGSKTSQ

SEQ ID NO: 2251335 - protein, 5 aa, Cryptosporidium parvum
APGSP

SEQ ID NO: 2251336 - protein, 5 aa, Cryptosporidium parvum
APGSW

SEQ ID NO: 2251337 - protein, 6 aa, Cryptosporidium parvum
APHPQW

SEQ ID NO: 2251338 - protein, 12 aa, Cryptosporidium parvum
APIEKKNPHDND

SEQ ID NO: 2251339 - protein, 11 aa, Cryptosporidium parvum
APIQPNEGFSG

SEQ ID NO: 2251340 - protein, 7 aa, Cryptosporidium parvum
APITPRM

SEQ ID NO: 2251341 - protein, 6 aa, Cryptosporidium parvum
APKKID

SEQ ID NO: 2251342 - protein, 6 aa, Cryptosporidium parvum
APKKSI

SEQ ID NO: 2251343 - protein, 23 aa, Cryptosporidium parvum
APKNQEKNRSENVAKEEKPKEFT

SEQ ID NO: 2251344 - protein, 17 aa, Cryptosporidium parvum
APKSNQFNSGAGVQSNP

SEQ ID NO: 2251345 - protein, 26 aa, Cryptosporidium parvum
APKSSLKLDPTKSKAKSKAAQTGPKL

SEQ ID NO: 2251346 - protein, 6 aa, Cryptosporidium parvum
APKTIG

SEQ ID NO: 2251347 - protein, 9 aa, Cryptosporidium parvum
APKVSGFGS

SEQ ID NO: 2251348 - protein, 9 aa, Cryptosporidium parvum
APLEPTPTH

SEQ ID NO: 2251349 - protein, 4 aa, Cryptosporidium parvum
APLP

SEQ ID NO: 2251350 - protein, 15 aa, Cryptosporidium parvum
APMGAGKLPSSYDNN

SEQ ID NO: 2251351 - protein, 5 aa, Cryptosporidium parvum
APNCC

SEQ ID NO: 2251352 - protein, 5 aa, Cryptosporidium parvum
APNDE

SEQ ID NO: 2251353 - protein, 16 aa, Cryptosporidium parvum
APNEEIHEKKDEDQVG

SEQ ID NO: 2251354 - protein, 4 aa, Cryptosporidium parvum
APNF

SEQ ID NO: 2251355 - protein, 8 aa, Cryptosporidium parvum
APNHSQYP

SEQ ID NO: 2251356 - protein, 15 aa, Cryptosporidium parvum
APNKRDPNNSEIDQS

SEQ ID NO: 2251357 - protein, 4 aa, Cryptosporidium parvum
APNL

SEQ ID NO: 2251358 - protein, 5 aa, Cryptosporidium parvum
APNLP

SEQ ID NO: 2251359 - protein, 22 aa, Cryptosporidium parvum
APNQNIYSNTNQTSLNADDTFS

SEQ ID NO: 2251360 - protein, 14 aa, Cryptosporidium parvum
APNQSNLSGNLPSS

SEQ ID NO: 2251361 - protein, 11 aa, Cryptosporidium parvum
APNQYSNSKQI

SEQ ID NO: 2251362 - protein, 5 aa, Cryptosporidium parvum
APNRC

SEQ ID NO: 2251363 - protein, 8 aa, Cryptosporidium parvum
APNSEEIT

SEQ ID NO: 2251364 - protein, 8 aa, Cryptosporidium parvum
APNSHTNN

SEQ ID NO: 2251365 - protein, 12 aa, Cryptosporidium parvum
APNSNVGSLESD

SEQ ID NO: 2251366 - protein, 10 aa, Cryptosporidium parvum
APPAGETSEF

SEQ ID NO: 2251367 - protein, 7 aa, Cryptosporidium parvum
APPAPIK

SEQ ID NO: 2251368 - protein, 20 aa, Cryptosporidium parvum
APPEMKKDELTKRDERREKA

SEQ ID NO: 2251369 - protein, 6 aa, Cryptosporidium parvum
APPERK

SEQ ID NO: 2251370 - protein, 5 aa, Cryptosporidium parvum
APPGC

SEQ ID NO: 2251371 - protein, 6 aa, Cryptosporidium parvum
APPKMM

SEQ ID NO: 2251372 - protein, 15 aa, Cryptosporidium parvum
APPKNQSTKPVEPTF

SEQ ID NO: 2251373 - protein, 5 aa, Cryptosporidium parvum
APPKS

SEQ ID NO: 2251374 - protein, 7 aa, Cryptosporidium parvum
APPPDYV

SEQ ID NO: 2251375 - protein, 6 aa, Cryptosporidium parvum
APPPLP

SEQ ID NO: 2251376 - protein, 25 aa, Cryptosporidium parvum
APPPSSIVTPSREKINRKESAARGH

SEQ ID NO: 2251377 - protein, 5 aa, Cryptosporidium parvum
APPPV

SEQ ID NO: 2251378 - protein, 15 aa, Cryptosporidium parvum
APPRISRKRRKERKK

SEQ ID NO: 2251379 - protein, 15 aa, Cryptosporidium parvum
APPRLDSSSGQGSVA

SEQ ID NO: 2251380 - protein, 10 aa, Cryptosporidium parvum
APPSPKKNVK

SEQ ID NO: 2251381 - protein, 7 aa, Cryptosporidium parvum
APQCPPD

SEQ ID NO: 2251382 - protein, 8 aa, Cryptosporidium parvum
APQDDRED

SEQ ID NO: 2251383 - protein, 6 aa, Cryptosporidium parvum
APQDPS

SEQ ID NO: 2251384 - protein, 6 aa, Cryptosporidium parvum
APQNGI

SEQ ID NO: 2251385 - protein, 22 aa, Cryptosporidium parvum
APQSTDNGADPALSVNSTPQIG

SEQ ID NO: 2251386 - protein, 11 aa, Cryptosporidium parvum
APRAATVKARG

SEQ ID NO: 2251387 - protein, 15 aa, Cryptosporidium parvum
APRAKMNQQRSRRYK

SEQ ID NO: 2251388 - protein, 7 aa, Cryptosporidium parvum
APRDQER

SEQ ID NO: 2251389 - protein, 6 aa, Cryptosporidium parvum
APRGTA

SEQ ID NO: 2251390 - protein, 20 aa, Cryptosporidium parvum
APRKPNKTIPGGKKRGRKRS

SEQ ID NO: 2251391 - protein, 5 aa, Cryptosporidium parvum
APRRP

SEQ ID NO: 2251392 - protein, 4 aa, Cryptosporidium parvum
APSD

SEQ ID NO: 2251393 - protein, 8 aa, Cryptosporidium parvum
APSEAEAQ

SEQ ID NO: 2251394 - protein, 42 aa, Cryptosporidium parvum
APSESESTKDNLTDNFQEQNKSKSNNQNSTTNGQISGNNDHF

SEQ ID NO: 2251395 - protein, 4 aa, Cryptosporidium parvum
APSH

SEQ ID NO: 2251396 - protein, 9 aa, Cryptosporidium parvum
APSISENSD

SEQ ID NO: 2251397 - protein, 20 aa, Cryptosporidium parvum
APSKSDLEQLNEETGGKVTY

SEQ ID NO: 2251398 - protein, 6 aa, Cryptosporidium parvum
APSLKR

SEQ ID NO: 2251399 - protein, 5 aa, Cryptosporidium parvum
APSLS

SEQ ID NO: 2251400 - protein, 65 aa, Cryptosporidium parvum
APSMPAAPSIPAAPMPAAPPMPAAPSMPAAPPMPAAPSMPTAPPMPAAPPMPAAPPMPTVPPMPK

SEQ ID NO: 2251401 - protein, 12 aa, Cryptosporidium parvum
APSTLTDTVSRQ

SEQ ID NO: 2251402 - protein, 5 aa, Cryptosporidium parvum
APTGH

SEQ ID NO: 2251403 - protein, 6 aa, Cryptosporidium parvum
APTGQI

SEQ ID NO: 2251404 - protein, 8 aa, Cryptosporidium parvum
APTGSGKT

SEQ ID NO: 2251405 - protein, 9 aa, Cryptosporidium parvum
APTGSGKTN

SEQ ID NO: 2251406 - protein, 8 aa, Cryptosporidium parvum
APTGTGKT

SEQ ID NO: 2251407 - protein, 7 aa, Cryptosporidium parvum
APTKQFP

SEQ ID NO: 2251408 - protein, 5 aa, Cryptosporidium parvum
APTNL

SEQ ID NO: 2251409 - protein, 14 aa, Cryptosporidium parvum
APTPTKFDNSDDSN

SEQ ID NO: 2251410 - protein, 11 aa, Cryptosporidium parvum
APTSGVKIDQG

SEQ ID NO: 2251411 - protein, 11 aa, Cryptosporidium parvum
APTTERDHNNV

SEQ ID NO: 2251412 - protein, 4 aa, Cryptosporidium parvum
APWK

SEQ ID NO: 2251413 - protein, 4 aa, Cryptosporidium parvum
APYE

SEQ ID NO: 2251414 - protein, 14 aa, Cryptosporidium parvum
APYYSTPCDKSRYG

SEQ ID NO: 2251415 - protein, 8 aa, Cryptosporidium parvum
AQAGPNDL

SEQ ID NO: 2251416 - protein, 6 aa, Cryptosporidium parvum
AQALQQ

SEQ ID NO: 2251417 - protein, 17 aa, Cryptosporidium parvum
AQANDADLQQGQDETLI

SEQ ID NO: 2251418 - protein, 7 aa, Cryptosporidium parvum
AQANNLG

SEQ ID NO: 2251419 - protein, 8 aa, Cryptosporidium parvum
AQAQEQYK

SEQ ID NO: 2251420 - protein, 11 aa, Cryptosporidium parvum
AQDDEVGDGTT

SEQ ID NO: 2251421 - protein, 10 aa, Cryptosporidium parvum
AQDDSDDLEC

SEQ ID NO: 2251422 - protein, 9 aa, Cryptosporidium parvum
AQDKDVENL

SEQ ID NO: 2251423 - protein, 8 aa, Cryptosporidium parvum
AQDLSGEG

SEQ ID NO: 2251424 - protein, 6 aa, Cryptosporidium parvum
AQDLTG

SEQ ID NO: 2251425 - protein, 8 aa, Cryptosporidium parvum
AQDSKDIE

SEQ ID NO: 2251426 - protein, 6 aa, Cryptosporidium parvum
AQDTGK

SEQ ID NO: 2251427 - protein, 12 aa, Cryptosporidium parvum
AQDVEVGDGTSS

SEQ ID NO: 2251428 - protein, 6 aa, Cryptosporidium parvum
AQEDYD

SEQ ID NO: 2251429 - protein, 7 aa, Cryptosporidium parvum
AQEIHES

SEQ ID NO: 2251430 - protein, 7 aa, Cryptosporidium parvum
AQENFEE

SEQ ID NO: 2251431 - protein, 8 aa, Cryptosporidium parvum
AQESESNF

SEQ ID NO: 2251432 - protein, 4 aa, Cryptosporidium parvum
AQEY

SEQ ID NO: 2251433 - protein, 9 aa, Cryptosporidium parvum
AQFENSETN

SEQ ID NO: 2251434 - protein, 10 aa, Cryptosporidium parvum
AQGAAGGGQG

SEQ ID NO: 2251435 - protein, 7 aa, Cryptosporidium parvum
AQGEHGL

SEQ ID NO: 2251436 - protein, 10 aa, Cryptosporidium parvum
AQGHGPGAGL

SEQ ID NO: 2251437 - protein, 10 aa, Cryptosporidium parvum
AQGSHAQKNF

SEQ ID NO: 2251438 - protein, 5 aa, Cryptosporidium parvum
AQIGS

SEQ ID NO: 2251439 - protein, 9 aa, Cryptosporidium parvum
AQINEQKKK

SEQ ID NO: 2251440 - protein, 12 aa, Cryptosporidium parvum
AQIQHQKHQSGI

SEQ ID NO: 2251441 - protein, 15 aa, Cryptosporidium parvum
AQIYSSSQNFNNPGK

SEQ ID NO: 2251442 - protein, 9 aa, Cryptosporidium parvum
AQKCTNNKY

SEQ ID NO: 2251443 - protein, 8 aa, Cryptosporidium parvum
AQKDSPEA

SEQ ID NO: 2251444 - protein, 9 aa, Cryptosporidium parvum
AQKELSSEN

SEQ ID NO: 2251445 - protein, 12 aa, Cryptosporidium parvum
AQKGKLDCQPGK

SEQ ID NO: 2251446 - protein, 9 aa, Cryptosporidium parvum
AQKISSKKR

SEQ ID NO: 2251447 - protein, 8 aa, Cryptosporidium parvum
AQKKNERQ

SEQ ID NO: 2251448 - protein, 24 aa, Cryptosporidium parvum
AQKKSNNKKENQSKRQNGNLKDER

SEQ ID NO: 2251449 - protein, 5 aa, Cryptosporidium parvum
AQKQL

SEQ ID NO: 2251450 - protein, 6 aa, Cryptosporidium parvum
AQKRNL

SEQ ID NO: 2251451 - protein, 8 aa, Cryptosporidium parvum
AQKSQAIR

SEQ ID NO: 2251452 - protein, 7 aa, Cryptosporidium parvum
AQLGDGH

SEQ ID NO: 2251453 - protein, 5 aa, Cryptosporidium parvum
AQLKQ

SEQ ID NO: 2251454 - protein, 6 aa, Cryptosporidium parvum
AQLSQE

SEQ ID NO: 2251455 - protein, 10 aa, Cryptosporidium parvum
AQNENTYKTV

SEQ ID NO: 2251456 - protein, 4 aa, Cryptosporidium parvum
AQNG

SEQ ID NO: 2251457 - protein, 17 aa, Cryptosporidium parvum
AQNPPNTQKSKSNPYSE

SEQ ID NO: 2251458 - protein, 9 aa, Cryptosporidium parvum
AQNQAMEGE

SEQ ID NO: 2251459 - protein, 13 aa, Cryptosporidium parvum
AQNQNSPPKSPNR

SEQ ID NO: 2251460 - protein, 19 aa, Cryptosporidium parvum
AQNQSINGVPYPASSIPQN

SEQ ID NO: 2251461 - protein, 6 aa, Cryptosporidium parvum
AQNRQI

SEQ ID NO: 2251462 - protein, 6 aa, Cryptosporidium parvum
AQPDQA

SEQ ID NO: 2251463 - protein, 5 aa, Cryptosporidium parvum
AQPEL

SEQ ID NO: 2251464 - protein, 6 aa, Cryptosporidium parvum
AQPGDM

SEQ ID NO: 2251465 - protein, 8 aa, Cryptosporidium parvum
AQPMSTHN

SEQ ID NO: 2251466 - protein, 19 aa, Cryptosporidium parvum
AQPSVGQNTGLKSPNSGGI

SEQ ID NO: 2251467 - protein, 4 aa, Cryptosporidium parvum
AQQQ

SEQ ID NO: 2251468 - protein, 9 aa, Cryptosporidium parvum
AQQQNSLSN

SEQ ID NO: 2251469 - protein, 13 aa, Cryptosporidium parvum
AQQQQKYTHRGGV

SEQ ID NO: 2251470 - protein, 5 aa, Cryptosporidium parvum
AQQRK

SEQ ID NO: 2251471 - protein, 8 aa, Cryptosporidium parvum
AQQSSDVR

SEQ ID NO: 2251472 - protein, 5 aa, Cryptosporidium parvum
AQQSV

SEQ ID NO: 2251473 - protein, 4 aa, Cryptosporidium parvum
AQRK

SEQ ID NO: 2251474 - protein, 16 aa, Cryptosporidium parvum
AQRLKSGYANNDQVEI

SEQ ID NO: 2251475 - protein, 25 aa, Cryptosporidium parvum
AQRTSLNSKVNSSNDSINSQTSNLG

SEQ ID NO: 2251476 - protein, 11 aa, Cryptosporidium parvum
AQSEGKEPTPV

SEQ ID NO: 2251477 - protein, 13 aa, Cryptosporidium parvum
AQSGNLRQKKDIG

SEQ ID NO: 2251478 - protein, 4 aa, Cryptosporidium parvum
AQSQ

SEQ ID NO: 2251479 - protein, 19 aa, Cryptosporidium parvum
AQSRSSPNPLSIINISSST

SEQ ID NO: 2251480 - protein, 7 aa, Cryptosporidium parvum
AQSSNPH

SEQ ID NO: 2251481 - protein, 6 aa, Cryptosporidium parvum
AQSSPH

SEQ ID NO: 2251482 - protein, 31 aa, Cryptosporidium parvum
AQSSSSRDSKDGKNNKKNSKINSSGLTNEDL

SEQ ID NO: 2251483 - protein, 7 aa, Cryptosporidium parvum
AQTETNY

SEQ ID NO: 2251484 - protein, 5 aa, Cryptosporidium parvum
AQTHT

SEQ ID NO: 2251485 - protein, 5 aa, Cryptosporidium parvum
AQTIP

SEQ ID NO: 2251486 - protein, 14 aa, Cryptosporidium parvum
AQTNTDKDEKTMEN

SEQ ID NO: 2251487 - protein, 24 aa, Cryptosporidium parvum
AQTPQQANTHNSNSEEEGANRAQQ

SEQ ID NO: 2251488 - protein, 7 aa, Cryptosporidium parvum
AQTSGLP

SEQ ID NO: 2251489 - protein, 11 aa, Cryptosporidium parvum
AQTTTTSNVNV

SEQ ID NO: 2251490 - protein, 15 aa, Cryptosporidium parvum
AQTVGTDEGIPSGSQ

SEQ ID NO: 2251491 - protein, 7 aa, Cryptosporidium parvum
AQVNEKN

SEQ ID NO: 2251492 - protein, 4 aa, Cryptosporidium parvum
AQVT

SEQ ID NO: 2251493 - protein, 6 aa, Cryptosporidium parvum
AQYEPY

SEQ ID NO: 2251494 - protein, 55 aa, Cryptosporidium parvum
ARAKRANKLTTKQVASSPKSKAVKQSPQKKTVKTKSSVETSGKTVETTKKQQAKK

SEQ ID NO: 2251495 - protein, 7 aa, Cryptosporidium parvum
ARANKSW

SEQ ID NO: 2251496 - protein, 4 aa, Cryptosporidium parvum
ARAR

SEQ ID NO: 2251497 - protein, 5 aa, Cryptosporidium parvum
ARDGL

SEQ ID NO: 2251498 - protein, 4 aa, Cryptosporidium parvum
ARDL

SEQ ID NO: 2251499 - protein, 8 aa, Cryptosporidium parvum
ARDMGRER

SEQ ID NO: 2251500 - protein, 4 aa, Cryptosporidium parvum
ARDR

SEQ ID NO: 2251501 - protein, 50 aa, Cryptosporidium parvum; identical to SEQ ID NO: 2136261

SEQ ID NO: 2251502 - protein, 11 aa, Cryptosporidium parvum
AREETEKEGSI

SEQ ID NO: 2251503 - protein, 10 aa, Cryptosporidium parvum
AREPKIVNGP

SEQ ID NO: 2251504 - protein, 5 aa, Cryptosporidium parvum
ARESA

SEQ ID NO: 2251505 - protein, 8 aa, Cryptosporidium parvum
ARESDKMD

SEQ ID NO: 2251506 - protein, 12 aa, Cryptosporidium parvum
ARESLESRAERS

SEQ ID NO: 2251507 - protein, 9 aa, Cryptosporidium parvum
ARESSSIDS

SEQ ID NO: 2251508 - protein, 10 aa, Cryptosporidium parvum
ARETSKKDIS

SEQ ID NO: 2251509 - protein, 6 aa, Cryptosporidium parvum
ARFEKE

SEQ ID NO: 2251510 - protein, 9 aa, Cryptosporidium parvum
ARFSPDDIY

SEQ ID NO: 2251511 - protein, 13 aa, Cryptosporidium parvum
ARGGNMGTSSNGI

SEQ ID NO: 2251512 - protein, 8 aa, Cryptosporidium parvum
ARGRGPRQ

SEQ ID NO: 2251513 - protein, 5 aa, Cryptosporidium parvum
ARGRI

SEQ ID NO: 2251514 - protein, 19 aa, Cryptosporidium parvum
ARGSDVEDPLESEVARTEQ

SEQ ID NO: 2251515 - protein, 7 aa, Cryptosporidium parvum
ARHEGED

SEQ ID NO: 2251516 - protein, 8 aa, Cryptosporidium parvum
ARHPDMPK

SEQ ID NO: 2251517 - protein, 7 aa, Cryptosporidium parvum
ARIDPDS

SEQ ID NO: 2251518 - protein, 7 aa, Cryptosporidium parvum
ARIKGGT

SEQ ID NO: 2251519 - protein, 31 aa, Cryptosporidium parvum
ARIQESSNKMRTKLENDAEDDQTPESDTNKN

SEQ ID NO: 2251520 - protein, 9 aa, Cryptosporidium parvum
ARKADSDIY

SEQ ID NO: 2251521 - protein, 13 aa, Cryptosporidium parvum
ARKKASGIKKTGI

SEQ ID NO: 2251522 - protein, 5 aa, Cryptosporidium parvum
ARKNE

SEQ ID NO: 2251523 - protein, 62 aa, Cryptosporidium parvum
ARKNNNKDIGSTLEKSQTTNSNNKDHKNSSNDTITKEKLSQDHSASTRQHQEQENTQETSSL

SEQ ID NO: 2251524 - protein, 12 aa, Cryptosporidium parvum
ARKNRSNGNSYS

SEQ ID NO: 2251525 - protein, 6 aa, Cryptosporidium parvum
ARKPRH

SEQ ID NO: 2251526 - protein, 6 aa, Cryptosporidium parvum
ARKSKT

SEQ ID NO: 2251527 - protein, 7 aa, Cryptosporidium parvum
ARKSPCL

SEQ ID NO: 2251528 - protein, 17 aa, Cryptosporidium parvum
ARKSSSSSQFGEEGGLN

SEQ ID NO: 2251529 - protein, 10 aa, Cryptosporidium parvum
ARLGDSAKNE

SEQ ID NO: 2251530 - protein, 18 aa, Cryptosporidium parvum
ARLSPSNYRSSRDKPLNR

SEQ ID NO: 2251531 - protein, 7 aa, Cryptosporidium parvum
ARLTPND

SEQ ID NO: 2251532 - protein, 6 aa, Cryptosporidium parvum
ARNDSG

SEQ ID NO: 2251533 - protein, 8 aa, Cryptosporidium parvum
ARNGRHSF

SEQ ID NO: 2251534 - protein, 4 aa, Cryptosporidium parvum
ARNN

SEQ ID NO: 2251535 - protein, 14 aa, Cryptosporidium parvum
ARNNKHANKELDED

SEQ ID NO: 2251536 - protein, 5 aa, Cryptosporidium parvum
ARNPD

SEQ ID NO: 2251537 - protein, 18 aa, Cryptosporidium parvum
ARPGPYAQGRYAPSGALP

SEQ ID NO: 2251538 - protein, 9 aa, Cryptosporidium parvum
ARPGSIEPD

SEQ ID NO: 2251539 - protein, 4 aa, Cryptosporidium parvum
ARPK

SEQ ID NO: 2251540 - protein, 7 aa, Cryptosporidium parvum
ARPKSQQ

SEQ ID NO: 2251541 - protein, 23 aa, Cryptosporidium parvum
ARPKTPPVKNSSYVNTSSPDEIF

SEQ ID NO: 2251542 - protein, 10 aa, Cryptosporidium parvum
ARPRNLEPSE

SEQ ID NO: 2251543 - protein, 8 aa, Cryptosporidium parvum
ARPSTVNN

SEQ ID NO: 2251544 - protein, 5 aa, Cryptosporidium parvum
ARPTL

SEQ ID NO: 2251545 - protein, 32 aa, Cryptosporidium parvum; identical to SEQ ID NO: 2136298

SEQ ID NO: 2251546 - protein, 6 aa, Cryptosporidium parvum
ARQNQD

SEQ ID NO: 2251547 - protein, 5 aa, Cryptosporidium parvum
ARQNS

SEQ ID NO: 2251548 - protein, 6 aa, Cryptosporidium parvum
ARQPNS

SEQ ID NO: 2251549 - protein, 5 aa, Cryptosporidium parvum
ARQRK

SEQ ID NO: 2251550 - protein, 5 aa, Cryptosporidium parvum
ARQRR

SEQ ID NO: 2251551 - protein, 41 aa, Cryptosporidium parvum
ARQTLNGEITPPQSIKKRRVNNNTLQEDHSSSYNSTNIENE

SEQ ID NO: 2251552 - protein, 8 aa, Cryptosporidium parvum
ARRRPYSS

SEQ ID NO: 2251553 - protein, 19 aa, Cryptosporidium parvum
ARRSRESGIQLSSSTVEER

SEQ ID NO: 2251554 - protein, 9 aa, Cryptosporidium parvum
ARRTSNSGV

SEQ ID NO: 2251555 - protein, 12 aa, Cryptosporidium parvum
ARSIETSSKSQD

SEQ ID NO: 2251556 - protein, 13 aa, Cryptosporidium parvum
ARSLEHSSKTAKR

SEQ ID NO: 2251557 - protein, 4 aa, Cryptosporidium parvum
ARSN

SEQ ID NO: 2251558 - protein, 9 aa, Cryptosporidium parvum
ARSNPNKYT

SEQ ID NO: 2251559 - protein, 8 aa, Cryptosporidium parvum
ARSQKLEK

SEQ ID NO: 2251560 - protein, 12 aa, Cryptosporidium parvum
ARSSEGNGATER

SEQ ID NO: 2251561 - protein, 13 aa, Cryptosporidium parvum
ARTGRSKQYGNSS

SEQ ID NO: 2251562 - protein, 6 aa, Cryptosporidium parvum
ARTPQK

SEQ ID NO: 2251563 - protein, 10 aa, Cryptosporidium parvum
ARTQKNKATN

SEQ ID NO: 2251564 - protein, 12 aa, Cryptosporidium parvum
ARTQKNKKTEYH

SEQ ID NO: 2251565 - protein, 21 aa, Cryptosporidium parvum
ARTSVSRRKQNVSKSKRRKTS

SEQ ID NO: 2251566 - protein, 8 aa, Cryptosporidium parvum
ARYRPEPG

SEQ ID NO: 2251567 - protein, 28 aa, Cryptosporidium parvum
ARYTEYDKVQDSNSSENKSNKQKRRRTM

SEQ ID NO: 2251568 - protein, 4 aa, Cryptosporidium parvum
ASAA

SEQ ID NO: 2251569 - protein, 7 aa, Cryptosporidium parvum
ASADDGR

SEQ ID NO: 2251570 - protein, 8 aa, Cryptosporidium parvum
ASADQGDA

SEQ ID NO: 2251571 - protein, 9 aa, Cryptosporidium parvum
ASAEGQSLS

SEQ ID NO: 2251572 - protein, 4 aa, Cryptosporidium parvum
ASAF

SEQ ID NO: 2251573 - protein, 12 aa, Cryptosporidium parvum
ASAGVPYSSGMG

SEQ ID NO: 2251574 - protein, 18 aa, Cryptosporidium parvum
ASAINISSSRSSSSNNNI

SEQ ID NO: 2251575 - protein, 8 aa, Cryptosporidium parvum
ASAKINQD

SEQ ID NO: 2251576 - protein, 16 aa, Cryptosporidium parvum
ASAKRTLSGTPVNSDD

SEQ ID NO: 2251577 - protein, 16 aa, Cryptosporidium parvum
ASANELNTESSQNKNY

SEQ ID NO: 2251578 - protein, 10 aa, Cryptosporidium parvum
ASANGYVRGE

SEQ ID NO: 2251579 - protein, 29 aa, Cryptosporidium parvum
ASAQQGQLNNYATKPTSSDLTVKSQDQDK

SEQ ID NO: 2251580 - protein, 14 aa, Cryptosporidium parvum
ASARRLAEDSNSFI

SEQ ID NO: 2251581 - protein, 15 aa, Cryptosporidium parvum
ASASQRSGRAGRVGP

SEQ ID NO: 2251582 - protein, 9 aa, Cryptosporidium parvum
ASASSDSTV

SEQ ID NO: 2251583 - protein, 4 aa, Cryptosporidium parvum
ASAT

SEQ ID NO: 2251584 - protein, 14 aa, Cryptosporidium parvum
ASATIPSSSNSNNI

SEQ ID NO: 2251585 - protein, 4 aa, Cryptosporidium parvum
ASCG

SEQ ID NO: 2251586 - protein, 8 aa, Cryptosporidium parvum
ASCGSAER

SEQ ID NO: 2251587 - protein, 21 aa, Cryptosporidium parvum
ASCPYSKPRKIKPIDSSHDSL

SEQ ID NO: 2251588 - protein, 4 aa, Cryptosporidium parvum
ASDA

SEQ ID NO: 2251589 - protein, 4 aa, Cryptosporidium parvum
ASDD

SEQ ID NO: 2251590 - protein, 8 aa, Cryptosporidium parvum
ASDDRTKE

SEQ ID NO: 2251591 - protein, 8 aa, Cryptosporidium parvum
ASDEKARF

SEQ ID NO: 2251592 - protein, 7 aa, Cryptosporidium parvum
ASDERGI

SEQ ID NO: 2251593 - protein, 4 aa, Cryptosporidium parvum
ASDF

SEQ ID NO: 2251594 - protein, 8 aa, Cryptosporidium parvum
ASDGIGKA

SEQ ID NO: 2251595 - protein, 6 aa, Cryptosporidium parvum
ASDKPM

SEQ ID NO: 2251596 - protein, 6 aa, Cryptosporidium parvum
ASDLAQ

SEQ ID NO: 2251597 - protein, 8 aa, Cryptosporidium parvum
ASDQDIKR

SEQ ID NO: 2251598 - protein, 18 aa, Cryptosporidium parvum
ASDQGIAKVSSPQSSTSY

SEQ ID NO: 2251599 - protein, 15 aa, Cryptosporidium parvum
ASDQSEDSNSTNEAI

SEQ ID NO: 2251600 - protein, 8 aa, Cryptosporidium parvum
ASDSHSFQ

SEQ ID NO: 2251601 - protein, 11 aa, Cryptosporidium parvum
ASDTSSLEFGP

SEQ ID NO: 2251602 - protein, 5 aa, Cryptosporidium parvum
ASDVS

SEQ ID NO: 2251603 - protein, 24 aa, Cryptosporidium parvum
ASEAKDNIEKEIKSEKLDSEEVQD

SEQ ID NO: 2251604 - protein, 4 aa, Cryptosporidium parvum
ASEC

SEQ ID NO: 2251605 - protein, 11 aa, Cryptosporidium parvum
ASEDEATEKIE

SEQ ID NO: 2251606 - protein, 10 aa, Cryptosporidium parvum
ASEDELEDDT

SEQ ID NO: 2251607 - protein, 5 aa, Cryptosporidium parvum
ASEDG

SEQ ID NO: 2251608 - protein, 7 aa, Cryptosporidium parvum
ASEDKTN

SEQ ID NO: 2251609 - protein, 6 aa, Cryptosporidium parvum
ASEELY

SEQ ID NO: 2251610 - protein, 10 aa, Cryptosporidium parvum
ASEGKNNKSF

SEQ ID NO: 2251611 - protein, 11 aa, Cryptosporidium parvum
ASEGNKRRAEY

SEQ ID NO: 2251612 - protein, 4 aa, Cryptosporidium parvum
ASEI

SEQ ID NO: 2251613 - protein, 10 aa, Cryptosporidium parvum
ASEKQKLNRP

SEQ ID NO: 2251614 - protein, 11 aa, Cryptosporidium parvum
ASEKRNGNEAV

SEQ ID NO: 2251615 - protein, 8 aa, Cryptosporidium parvum
ASENPELP

SEQ ID NO: 2251616 - protein, 15 aa, Cryptosporidium parvum
ASENPKEEVNSESLE

SEQ ID NO: 2251617 - protein, 26 aa, Cryptosporidium parvum
ASEQETQESACPESKASNGSKSESTI

SEQ ID NO: 2251618 - protein, 16 aa, Cryptosporidium parvum
ASERSDLDYKLVADQY

SEQ ID NO: 2251619 - protein, 8 aa, Cryptosporidium parvum
ASESNSSD

SEQ ID NO: 2251620 - protein, 13 aa, Cryptosporidium parvum
ASESSKSEREPKF

SEQ ID NO: 2251621 - protein, 4 aa, Cryptosporidium parvum
ASET

SEQ ID NO: 2251622 - protein, 15 aa, Cryptosporidium parvum
ASETSRPDPDLSDDD

SEQ ID NO: 2251623 - protein, 7 aa, Cryptosporidium parvum
ASETTTE

SEQ ID NO: 2251624 - protein, 5 aa, Cryptosporidium parvum
ASEYT

SEQ ID NO: 2251625 - protein, 8 aa, Cryptosporidium parvum
ASFESKSD

SEQ ID NO: 2251626 - protein, 4 aa, Cryptosporidium parvum
ASFG

SEQ ID NO: 2251627 - protein, 4 aa, Cryptosporidium parvum
ASGD

SEQ ID NO: 2251628 - protein, 7 aa, Cryptosporidium parvum
ASGDRKG

SEQ ID NO: 2251629 - protein, 9 aa, Cryptosporidium parvum
ASGEAQAAE

SEQ ID NO: 2251630 - protein, 30 aa, Cryptosporidium parvum
ASGGDGTGTTGGEEDEENNEEANEEPEIES

SEQ ID NO: 2251631 - protein, 9 aa, Cryptosporidium parvum
ASGGGTADR

SEQ ID NO: 2251632 - protein, 7 aa, Cryptosporidium parvum
ASGGRYV

SEQ ID NO: 2251633 - protein, 9 aa, Cryptosporidium parvum
ASGISPNTI

SEQ ID NO: 2251634 - protein, 7 aa, Cryptosporidium parvum
ASGNNPK

SEQ ID NO: 2251635 - protein, 11 aa, Cryptosporidium parvum
ASGNSKKNSSK

SEQ ID NO: 2251636 - protein, 12 aa, Cryptosporidium parvum
ASGRAGRRGYDV

SEQ ID NO: 2251637 - protein, 7 aa, Cryptosporidium parvum
ASGTGGK

SEQ ID NO: 2251638 - protein, 6 aa, Cryptosporidium parvum
ASGYDK

SEQ ID NO: 2251639 - protein, 8 aa, Cryptosporidium parvum
ASGYPANS

SEQ ID NO: 2251640 - protein, 7 aa, Cryptosporidium parvum
ASGYSSN

SEQ ID NO: 2251641 - protein, 7 aa, Cryptosporidium parvum
ASHEEEL

SEQ ID NO: 2251642 - protein, 8 aa, Cryptosporidium parvum
ASHKGNVS

SEQ ID NO: 2251643 - protein, 26 aa, Cryptosporidium parvum
ASHKTEKSDFQYNNTPQNKLPSDRSN

SEQ ID NO: 2251644 - protein, 4 aa, Cryptosporidium parvum
ASHN

SEQ ID NO: 2251645 - protein, 10 aa, Cryptosporidium parvum
ASIEDSSLTT

SEQ ID NO: 2251646 - protein, 4 aa, Cryptosporidium parvum
ASIN

SEQ ID NO: 2251647 - protein, 20 aa, Cryptosporidium parvum
ASINDENDSSSIETQSNSRD

SEQ ID NO: 2251648 - protein, 13 aa, Cryptosporidium parvum
ASINKQNNNGNSP

SEQ ID NO: 2251649 - protein, 4 aa, Cryptosporidium parvum
ASIP

SEQ ID NO: 2251650 - protein, 10 aa, Cryptosporidium parvum
ASIPDERGDI

SEQ ID NO: 2251651 - protein, 6 aa, Cryptosporidium parvum
ASIREK

SEQ ID NO: 2251652 - protein, 13 aa, Cryptosporidium parvum
ASIRGDRVSHESQ

SEQ ID NO: 2251653 - protein, 16 aa, Cryptosporidium parvum
ASISTNNTLSSPRSSE

SEQ ID NO: 2251654 - protein, 5 aa, Cryptosporidium parvum
ASITP

SEQ ID NO: 2251655 - protein, 5 aa, Cryptosporidium parvum
ASIVP

SEQ ID NO: 2251656 - protein, 26 aa, Cryptosporidium parvum
ASKEEVEIKDEDDVQNNKSNNEATSI

SEQ ID NO: 2251657 - protein, 19 aa, Cryptosporidium parvum
ASKEKGRYKQSGNESSQFR

SEQ ID NO: 2251658 - protein, 8 aa, Cryptosporidium parvum
ASKEKKDK

SEQ ID NO: 2251659 - protein, 4 aa, Cryptosporidium parvum
ASKF

SEQ ID NO: 2251660 - protein, 4 aa, Cryptosporidium parvum
ASKG

SEQ ID NO: 2251661 - protein, 7 aa, Cryptosporidium parvum
ASKGAIN

SEQ ID NO: 2251662 - protein, 13 aa, Cryptosporidium parvum
ASKGKSDSKVTKN

SEQ ID NO: 2251663 - protein, 8 aa, Cryptosporidium parvum
ASKGSFGA

SEQ ID NO: 2251664 - protein, 11 aa, Cryptosporidium parvum
ASKGTFVREST

SEQ ID NO: 2251665 - protein, 5 aa, Cryptosporidium parvum
ASKGV

SEQ ID NO: 2251666 - protein, 4 aa, Cryptosporidium parvum
ASKK

SEQ ID NO: 2251667 - protein, 8 aa, Cryptosporidium parvum
ASKKNGSF

SEQ ID NO: 2251668 - protein, 14 aa, Cryptosporidium parvum
ASKLRDSLKGNGMD

SEQ ID NO: 2251669 - protein, 9 aa, Cryptosporidium parvum
ASKNIDPES

SEQ ID NO: 2251670 - protein, 6 aa, Cryptosporidium parvum
ASKNPE

SEQ ID NO: 2251671 - protein, 6 aa, Cryptosporidium parvum
ASKNWD

SEQ ID NO: 2251672 - protein, 16 aa, Cryptosporidium parvum
ASKPSDQVCNESSKSC

SEQ ID NO: 2251673 - protein, 5 aa, Cryptosporidium parvum
ASKQI

SEQ ID NO: 2251674 - protein, 11 aa, Cryptosporidium parvum
ASKQNQSGESM

SEQ ID NO: 2251675 - protein, 7 aa, Cryptosporidium parvum
ASLETGV

SEQ ID NO: 2251676 - protein, 7 aa, Cryptosporidium parvum
ASLGPTI

SEQ ID NO: 2251677 - protein, 11 aa, Cryptosporidium parvum
ASLIDKQEDKI

SEQ ID NO: 2251678 - protein, 14 aa, Cryptosporidium parvum
ASLKENPKNVKAAY

SEQ ID NO: 2251679 - protein, 14 aa, Cryptosporidium parvum
ASLNEDKMNDSNDL

SEQ ID NO: 2251680 - protein, 11 aa, Cryptosporidium parvum
ASLNSGSPESR

SEQ ID NO: 2251681 - protein, 5 aa, Cryptosporidium parvum
ASLSR

SEQ ID NO: 2251682 - protein, 4 aa, Cryptosporidium parvum
ASMD

SEQ ID NO: 2251683 - protein, 4 aa, Cryptosporidium parvum
ASMG

SEQ ID NO: 2251684 - protein, 16 aa, Cryptosporidium parvum
ASMISGSETSDSEEIQ

SEQ ID NO: 2251685 - protein, 8 aa, Cryptosporidium parvum
ASNDENDV

SEQ ID NO: 2251686 - protein, 9 aa, Cryptosporidium parvum
ASNDRKPLD

SEQ ID NO: 2251687 - protein, 6 aa, Cryptosporidium parvum
ASNEPN

SEQ ID NO: 2251688 - protein, 36 aa, Cryptosporidium parvum
ASNERKNTHETPSRPPLSEKQKSETRKEVDSSLSCD

SEQ ID NO: 2251689 - protein, 8 aa, Cryptosporidium parvum
ASNFKNDS

SEQ ID NO: 2251690 - protein, 7 aa, Cryptosporidium parvum
ASNGTLS

SEQ ID NO: 2251691 - protein, 6 aa, Cryptosporidium parvum
ASNINE

SEQ ID NO: 2251692 - protein, 9 aa, Cryptosporidium parvum
ASNKHQEEV

SEQ ID NO: 2251693 - protein, 6 aa, Cryptosporidium parvum
ASNKNY

SEQ ID NO: 2251694 - protein, 9 aa, Cryptosporidium parvum
ASNKSLPLP

SEQ ID NO: 2251695 - protein, 4 aa, Cryptosporidium parvum
ASNL

SEQ ID NO: 2251696 - protein, 10 aa, Cryptosporidium parvum
ASNLKDKEIN

SEQ ID NO: 2251697 - protein, 53 aa, Cryptosporidium parvum
ASNLQKQEDEEREEELSSWQGGGRAAGSTESQGNHNEKPKSSRKLQKEHASEF

SEQ ID NO: 2251698 - protein, 29 aa, Cryptosporidium parvum
ASNMNDSNGLKSKMNEKNLDSMTKNVEKK

SEQ ID NO: 2251699 - protein, 8 aa, Cryptosporidium parvum
ASNNINNS

SEQ ID NO: 2251700 - protein, 5 aa, Cryptosporidium parvum
ASNNS

SEQ ID NO: 2251701 - protein, 9 aa, Cryptosporidium parvum
ASNNTKTNH

SEQ ID NO: 2251702 - protein, 5 aa, Cryptosporidium parvum
ASNNV

SEQ ID NO: 2251703 - protein, 7 aa, Cryptosporidium parvum
ASNPEKA

SEQ ID NO: 2251704 - protein, 40 aa, Cryptosporidium parvum
ASNPPKSQAPRKSLSSRGNSKYKRQTRRKQAQDQQDSSTT

SEQ ID NO: 2251705 - protein, 15 aa, Cryptosporidium parvum
ASNPSKTSSSSDEII

SEQ ID NO: 2251706 - protein, 7 aa, Cryptosporidium parvum
ASNPSNV

SEQ ID NO: 2251707 - protein, 9 aa, Cryptosporidium parvum
ASNRPTKQS

SEQ ID NO: 2251708 - protein, 16 aa, Cryptosporidium parvum
ASNSERNSPENKKDIN

SEQ ID NO: 2251709 - protein, 5 aa, Cryptosporidium parvum
ASNSI

SEQ ID NO: 2251710 - protein, 18 aa, Cryptosporidium parvum
ASNSNRRLAQPPEGTFYD

SEQ ID NO: 2251711 - protein, 8 aa, Cryptosporidium parvum
ASNTREFQ

SEQ ID NO: 2251712 - protein, 8 aa, Cryptosporidium parvum
ASNTRNSY

SEQ ID NO: 2251713 - protein, 40 aa, Cryptosporidium parvum
ASNTRSNNSNKNTRKNKTDFATKSPECNTKNKNKSYVDGI

SEQ ID NO: 2251714 - protein, 13 aa, Cryptosporidium parvum
ASNTSSFQSSDAP

SEQ ID NO: 2251715 - protein, 7 aa, Cryptosporidium parvum
ASNWPTI

SEQ ID NO: 2251716 - protein, 6 aa, Cryptosporidium parvum
ASPAIE

SEQ ID NO: 2251717 - protein, 8 aa, Cryptosporidium parvum
ASPDETAY

SEQ ID NO: 2251718 - protein, 7 aa, Cryptosporidium parvum
ASPDRIK

SEQ ID NO: 2251719 - protein, 7 aa, Cryptosporidium parvum
ASPGAAP

SEQ ID NO: 2251720 - protein, 7 aa, Cryptosporidium parvum
ASPGKNI

SEQ ID NO: 2251721 - protein, 14 aa, Cryptosporidium parvum
ASPISGSNRDSIGG

SEQ ID NO: 2251722 - protein, 6 aa, Cryptosporidium parvum
ASPKEF

SEQ ID NO: 2251723 - protein, 17 aa, Cryptosporidium parvum
ASPLQQNSANSVASATS

SEQ ID NO: 2251724 - protein, 29 aa, Cryptosporidium parvum
ASPLSTSQHQNLQQKKQQIHQNNHQQSSA

SEQ ID NO: 2251725 - protein, 7 aa, Cryptosporidium parvum
ASPLSTT

SEQ ID NO: 2251726 - protein, 7 aa, Cryptosporidium parvum
ASPNTKI

SEQ ID NO: 2251727 - protein, 34 aa, Cryptosporidium parvum
ASPNVSNAQTRQQNYVSSNSSSFNNKSQSNYKSN

SEQ ID NO: 2251728 - protein, 7 aa, Cryptosporidium parvum
ASPPEEI

SEQ ID NO: 2251729 - protein, 13 aa, Cryptosporidium parvum
ASPPNERKHPKGI

SEQ ID NO: 2251730 - protein, 10 aa, Cryptosporidium parvum
ASPPPGYPEV

SEQ ID NO: 2251731 - protein, 4 aa, Cryptosporidium parvum
ASPR

SEQ ID NO: 2251732 - protein, 16 aa, Cryptosporidium parvum
ASPVKSDTSTATPSSM

SEQ ID NO: 2251733 - protein, 5 aa, Cryptosporidium parvum
ASPYN

SEQ ID NO: 2251734 - protein, 8 aa, Cryptosporidium parvum
ASQAQSRM

SEQ ID NO: 2251735 - protein, 14 aa, Cryptosporidium parvum
ASQDDRKKRPNNPL

SEQ ID NO: 2251736 - protein, 7 aa, Cryptosporidium parvum
ASQDEAR

SEQ ID NO: 2251737 - protein, 10 aa, Cryptosporidium parvum
ASQDSKVTKD

SEQ ID NO: 2251738 - protein, 6 aa, Cryptosporidium parvum
ASQGVE

SEQ ID NO: 2251739 - protein, 4 aa, Cryptosporidium parvum
ASQI

SEQ ID NO: 2251740 - protein, 14 aa, Cryptosporidium parvum
ASQLKKKEKIPEKQ

SEQ ID NO: 2251741 - protein, 8 aa, Cryptosporidium parvum
ASQNLTKY

SEQ ID NO: 2251742 - protein, 23 aa, Cryptosporidium parvum
ASQQPPSSSYSLPPQFSNEPDVR

SEQ ID NO: 2251743 - protein, 28 aa, Cryptosporidium parvum
ASQQTPPENISGKKPCGSNCMPESPSEH

SEQ ID NO: 2251744 - protein, 5 aa, Cryptosporidium parvum
ASQRG

SEQ ID NO: 2251745 - protein, 8 aa, Cryptosporidium parvum
ASQRSNCV

SEQ ID NO: 2251746 - protein, 5 aa, Cryptosporidium parvum
ASQSF

SEQ ID NO: 2251747 - protein, 7 aa, Cryptosporidium parvum
ASQSPDV

SEQ ID NO: 2251748 - protein, 9 aa, Cryptosporidium parvum
ASQSSDQTV

SEQ ID NO: 2251749 - protein, 10 aa, Cryptosporidium parvum
ASQSSEMGNL

SEQ ID NO: 2251750 - protein, 7 aa, Cryptosporidium parvum
ASQTISE

SEQ ID NO: 2251751 - protein, 6 aa, Cryptosporidium parvum
ASQTNC

SEQ ID NO: 2251752 - protein, 15 aa, Cryptosporidium parvum
ASQTQNQPQTQINPQ

SEQ ID NO: 2251753 - protein, 10 aa, Cryptosporidium parvum
ASQYKETQLK

SEQ ID NO: 2251754 - protein, 7 aa, Cryptosporidium parvum
ASRAQIE

SEQ ID NO: 2251755 - protein, 5 aa, Cryptosporidium parvum
ASRDE

SEQ ID NO: 2251756 - protein, 6 aa, Cryptosporidium parvum
ASRDIQ

SEQ ID NO: 2251757 - protein, 6 aa, Cryptosporidium parvum
ASRDNT

SEQ ID NO: 2251758 - protein, 9 aa, Cryptosporidium parvum
ASREKISQL

SEQ ID NO: 2251759 - protein, 5 aa, Cryptosporidium parvum
ASRGL

SEQ ID NO: 2251760 - protein, 5 aa, Cryptosporidium parvum
ASRGM

SEQ ID NO: 2251761 - protein, 12 aa, Cryptosporidium parvum
ASRGVRSRKYRN

SEQ ID NO: 2251762 - protein, 7 aa, Cryptosporidium parvum
ASRHGQK

SEQ ID NO: 2251763 - protein, 10 aa, Cryptosporidium parvum
ASRHGQKGTI

SEQ ID NO: 2251764 - protein, 5 aa, Cryptosporidium parvum
ASRIN

SEQ ID NO: 2251765 - protein, 6 aa, Cryptosporidium parvum
ASRPGK

SEQ ID NO: 2251766 - protein, 6 aa, Cryptosporidium parvum
ASRSFN

SEQ ID NO: 2251767 - protein, 6 aa, Cryptosporidium parvum
ASRTCR

SEQ ID NO: 2251768 - protein, 11 aa, Cryptosporidium parvum
ASRTKNRKRNI

SEQ ID NO: 2251769 - protein, 5 aa, Cryptosporidium parvum
ASRYD

SEQ ID NO: 2251770 - protein, 9 aa, Cryptosporidium parvum
ASSCGNDPI

SEQ ID NO: 2251771 - protein, 6 aa, Cryptosporidium parvum
ASSDET

SEQ ID NO: 2251772 - protein, 14 aa, Cryptosporidium parvum
ASSEHTSTAEKRSR

SEQ ID NO: 2251773 - protein, 9 aa, Cryptosporidium parvum
ASSEMNSDS

SEQ ID NO: 2251774 - protein, 4 aa, Cryptosporidium parvum
ASSG

SEQ ID NO: 2251775 - protein, 6 aa, Cryptosporidium parvum
ASSGED

SEQ ID NO: 2251776 - protein, 5 aa, Cryptosporidium parvum
ASSGF

SEQ ID NO: 2251777 - protein, 9 aa, Cryptosporidium parvum
ASSGGGGKG

SEQ ID NO: 2251778 - protein, 10 aa, Cryptosporidium parvum
ASSGNHIGAG

SEQ ID NO: 2251779 - protein, 10 aa, Cryptosporidium parvum
ASSGNTPINN

SEQ ID NO: 2251780 - protein, 7 aa, Cryptosporidium parvum
ASSGNYY

SEQ ID NO: 2251781 - protein, 4 aa, Cryptosporidium parvum
ASSI

SEQ ID NO: 2251782 - protein, 10 aa, Cryptosporidium parvum
ASSKGKENVI

SEQ ID NO: 2251783 - protein, 14 aa, Cryptosporidium parvum
ASSKKISSQNNSQE

SEQ ID NO: 2251784 - protein, 20 aa, Cryptosporidium parvum
ASSKTDSTFDTSYSTYSDEN

SEQ ID NO: 2251785 - protein, 6 aa, Cryptosporidium parvum
ASSKTM

SEQ ID NO: 2251786 - protein, 14 aa, Cryptosporidium parvum
ASSLISDPKSQGRY

SEQ ID NO: 2251787 - protein, 12 aa, Cryptosporidium parvum
ASSLNNNRTNTI

SEQ ID NO: 2251788 - protein, 15 aa, Cryptosporidium parvum
ASSMGKFSTDRTIEE

SEQ ID NO: 2251789 - protein, 9 aa, Cryptosporidium parvum
ASSNEAEVR

SEQ ID NO: 2251790 - protein, 15 aa, Cryptosporidium parvum
ASSPTSNNATREDLG

SEQ ID NO: 2251791 - protein, 232 aa, Cryptosporidium parvum; identical to SEQ ID NO: 2136510

SEQ ID NO: 2251792 - protein, 10 aa, Cryptosporidium parvum
ASSQDNLECK

SEQ ID NO: 2251793 - protein, 9 aa, Cryptosporidium parvum
ASSQRDIRD

SEQ ID NO: 2251794 - protein, 13 aa, Cryptosporidium parvum
ASSRDHSKLDRSK

SEQ ID NO: 2251795 - protein, 16 aa, Cryptosporidium parvum
ASSSRNENSNISNSYY

SEQ ID NO: 2251796 - protein, 46 aa, Cryptosporidium parvum
ASSSSKVLGATPSAQISSSLSSSSSSSSSSLASSSSSSSSSPSLTL

SEQ ID NO: 2251797 - protein, 5 aa, Cryptosporidium parvum
ASSST

SEQ ID NO: 2251798 - protein, 5 aa, Cryptosporidium parvum
ASSTI

SEQ ID NO: 2251799 - protein, 6 aa, Cryptosporidium parvum
ASSTIK

SEQ ID NO: 2251800 - protein, 30 aa, Cryptosporidium parvum
ASSTSATKANAKKTAQAVKNSKRSSTTKIR

SEQ ID NO: 2251801 - protein, 16 aa, Cryptosporidium parvum
ASSTSNMNSNGGHSEY

SEQ ID NO: 2251802 - protein, 10 aa, Cryptosporidium parvum
ASSVEETASM

SEQ ID NO: 2251803 - protein, 30 aa, Cryptosporidium parvum
ASSVSGLKKDNIASDNATIKNSSEYKINTN

SEQ ID NO: 2251804 - protein, 16 aa, Cryptosporidium parvum
ASTGFKNDARKTVNRD

SEQ ID NO: 2251805 - protein, 7 aa, Cryptosporidium parvum
ASTGPRY

SEQ ID NO: 2251806 - protein, 69 aa, Cryptosporidium parvum
ASTGSSSSSSPLTVSGSTPGSSIVTSTSNSNSVSNIGPSTGTGTGTSSISTSNSNSNSNSSSNSNSSTI

SEQ ID NO: 2251807 - protein, 7 aa, Cryptosporidium parvum
ASTGTTI

SEQ ID NO: 2251808 - protein, 12 aa, Cryptosporidium parvum
ASTISTTPTRSI

SEQ ID NO: 2251809 - protein, 15 aa, Cryptosporidium parvum
ASTKRMEEKGIRKRR

SEQ ID NO: 2251810 - protein, 33 aa, Cryptosporidium parvum
ASTNPDNNNDSNNKNNNNNNDDNNNNMAENNHY

SEQ ID NO: 2251811 - protein, 13 aa, Cryptosporidium parvum
ASTNSSQEISPSS

SEQ ID NO: 2251812 - protein, 7 aa, Cryptosporidium parvum
ASTNSTE

SEQ ID NO: 2251813 - protein, 5 aa, Cryptosporidium parvum
ASTPS

SEQ ID NO: 2251814 - protein, 9 aa, Cryptosporidium parvum
ASTPTEKDK

SEQ ID NO: 2251815 - protein, 4 aa, Cryptosporidium parvum
ASTQ

SEQ ID NO: 2251816 - protein, 4 aa, Cryptosporidium parvum
ASTR

SEQ ID NO: 2251817 - protein, 18 aa, Cryptosporidium parvum
ASTSPVSPTSSNLTDSEY

SEQ ID NO: 2251818 - protein, 8 aa, Cryptosporidium parvum
ASTSTSHA

SEQ ID NO: 2251819 - protein, 15 aa, Cryptosporidium parvum
ASTTAREVESSEPEE

SEQ ID NO: 2251820 - protein, 10 aa, Cryptosporidium parvum
ASTTVSPNTN

SEQ ID NO: 2251821 - protein, 8 aa, Cryptosporidium parvum
ASTVPKDY

SEQ ID NO: 2251822 - protein, 5 aa, Cryptosporidium parvum
ASVGK

SEQ ID NO: 2251823 - protein, 6 aa, Cryptosporidium parvum
ASVLDG

SEQ ID NO: 2251824 - protein, 23 aa, Cryptosporidium parvum
ASVPSPALNTSRSFSSKTRGKSI

SEQ ID NO: 2251825 - protein, 15 aa, Cryptosporidium parvum
ASVSTPGSPDINSDT

SEQ ID NO: 2251826 - protein, 9 aa, Cryptosporidium parvum
ASWSSDGHT

SEQ ID NO: 2251827 - protein, 7 aa, Cryptosporidium parvum
ASYEKTM

SEQ ID NO: 2251828 - protein, 13 aa, Cryptosporidium parvum
ASYNSNNQNAVGR

SEQ ID NO: 2251829 - protein, 4 aa, Cryptosporidium parvum
ASYQ

SEQ ID NO: 2251830 - protein, 20 aa, Cryptosporidium parvum
ASYYSSSINNSNPIKKGGGF

SEQ ID NO: 2251831 - protein, 5 aa, Cryptosporidium parvum
ATADS

SEQ ID NO: 2251832 - protein, 18 aa, Cryptosporidium parvum
ATAETSINRSTETKPEKL

SEQ ID NO: 2251833 - protein, 7 aa, Cryptosporidium parvum
ATAGDGL

SEQ ID NO: 2251834 - protein, 13 aa, Cryptosporidium parvum
ATAGDTHLGGEDF

SEQ ID NO: 2251835 - protein, 7 aa, Cryptosporidium parvum
ATAPGTA

SEQ ID NO: 2251836 - protein, 12 aa, Cryptosporidium parvum
ATARKRTRDADY

SEQ ID NO: 2251837 - protein, 10 aa, Cryptosporidium parvum
ATASPKVQRD

SEQ ID NO: 2251838 - protein, 7 aa, Cryptosporidium parvum
ATASSDH

SEQ ID NO: 2251839 - protein, 4 aa, Cryptosporidium parvum
ATAT

SEQ ID NO: 2251840 - protein, 6 aa, Cryptosporidium parvum
ATCSDR

SEQ ID NO: 2251841 - protein, 8 aa, Cryptosporidium parvum
ATDAHDQF

SEQ ID NO: 2251842 - protein, 5 aa, Cryptosporidium parvum
ATDIT

SEQ ID NO: 2251843 - protein, 6 aa, Cryptosporidium parvum
ATDKDG

SEQ ID NO: 2251844 - protein, 9 aa, Cryptosporidium parvum
ATDNESKNL

SEQ ID NO: 2251845 - protein, 5 aa, Cryptosporidium parvum
ATDQE

SEQ ID NO: 2251846 - protein, 7 aa, Cryptosporidium parvum
ATDSNTI

SEQ ID NO: 2251847 - protein, 5 aa, Cryptosporidium parvum
ATEEE

SEQ ID NO: 2251848 - protein, 8 aa, Cryptosporidium parvum
ATEGDANT

SEQ ID NO: 2251849 - protein, 4 aa, Cryptosporidium parvum
ATEK

SEQ ID NO: 2251850 - protein, 8 aa, Cryptosporidium parvum
ATESARHN

SEQ ID NO: 2251851 - protein, 7 aa, Cryptosporidium parvum
ATESGSI

SEQ ID NO: 2251852 - protein, 5 aa, Cryptosporidium parvum
ATESN

SEQ ID NO: 2251853 - protein, 6 aa, Cryptosporidium parvum
ATESNE

SEQ ID NO: 2251854 - protein, 9 aa, Cryptosporidium parvum
ATESSNDER

SEQ ID NO: 2251855 - protein, 6 aa, Cryptosporidium parvum
ATGADD

SEQ ID NO: 2251856 - protein, 4 aa, Cryptosporidium parvum
ATGC

SEQ ID NO: 2251857 - protein, 10 aa, Cryptosporidium parvum
ATGDSKKRDY

SEQ ID NO: 2251858 - protein, 8 aa, Cryptosporidium parvum
ATGGCTDG

SEQ ID NO: 2251859 - protein, 7 aa, Cryptosporidium parvum
ATGGNDN

SEQ ID NO: 2251860 - protein, 7 aa, Cryptosporidium parvum
ATGGSDA

SEQ ID NO: 2251861 - protein, 10 aa, Cryptosporidium parvum
ATGKELPRGV

SEQ ID NO: 2251862 - protein, 17 aa, Cryptosporidium parvum
ATGNDKGDVLLYRINDY

SEQ ID NO: 2251863 - protein, 39 aa, Cryptosporidium parvum
ATGNKRQRLEGQEGGSSIQNTQQNSFKEENNMGNNTSNV

SEQ ID NO: 2251864 - protein, 6 aa, Cryptosporidium parvum
ATGRSK

SEQ ID NO: 2251865 - protein, 8 aa, Cryptosporidium parvum
ATGSADKT

SEQ ID NO: 2251866 - protein, 8 aa, Cryptosporidium parvum
ATGSKDET

SEQ ID NO: 2251867 - protein, 8 aa, Cryptosporidium parvum
ATGTGKTY

SEQ ID NO: 2251868 - protein, 8 aa, Cryptosporidium parvum
ATGVSKSS

SEQ ID NO: 2251869 - protein, 6 aa, Cryptosporidium parvum
ATHSRA

SEQ ID NO: 2251870 - protein, 4 aa, Cryptosporidium parvum
ATIE

SEQ ID NO: 2251871 - protein, 4 aa, Cryptosporidium parvum
ATIN

SEQ ID NO: 2251872 - protein, 11 aa, Cryptosporidium parvum
ATIQTPNPFPY

SEQ ID NO: 2251873 - protein, 13 aa, Cryptosporidium parvum
ATKENYAQNSQPQ

SEQ ID NO: 2251874 - protein, 12 aa, Cryptosporidium parvum
ATKETNFNVSDQ

SEQ ID NO: 2251875 - protein, 17 aa, Cryptosporidium parvum
ATKEVPGLSSGSGNGNR

SEQ ID NO: 2251876 - protein, 10 aa, Cryptosporidium parvum
ATKSSSGTEW

SEQ ID NO: 2251877 - protein, 5 aa, Cryptosporidium parvum
ATLED

SEQ ID NO: 2251878 - protein, 8 aa, Cryptosporidium parvum
ATLGEKDQ

SEQ ID NO: 2251879 - protein, 35 aa, Cryptosporidium parvum
ATLKANSRAQKEKNKLAKRTKKDSVIRDNTNKSLD

SEQ ID NO: 2251880 - protein, 4 aa, Cryptosporidium parvum
ATLS

SEQ ID NO: 2251881 - protein, 11 aa, Cryptosporidium parvum
ATLSKKAEELV

SEQ ID NO: 2251882 - protein, 4 aa, Cryptosporidium parvum
ATMH

SEQ ID NO: 2251883 - protein, 13 aa, Cryptosporidium parvum
ATNCTESDMGQTL

SEQ ID NO: 2251884 - protein, 11 aa, Cryptosporidium parvum
ATNDESEQRRV

SEQ ID NO: 2251885 - protein, 13 aa, Cryptosporidium parvum
ATNGNTSLGGEDF

SEQ ID NO: 2251886 - protein, 28 aa, Cryptosporidium parvum
ATNGSENYKRMSSKSKNSPRSHNKYTGN

SEQ ID NO: 2251887 - protein, 22 aa, Cryptosporidium parvum
ATNHNGRSASLTAPNGPSQTEV

SEQ ID NO: 2251888 - protein, 6 aa, Cryptosporidium parvum
ATNISK

SEQ ID NO: 2251889 - protein, 9 aa, Cryptosporidium parvum
ATPGQAQEA

SEQ ID NO: 2251890 - protein, 15 aa, Cryptosporidium parvum
ATPKPNSLNYTEPPI

SEQ ID NO: 2251891 - protein, 7 aa, Cryptosporidium parvum
ATPLSAE

SEQ ID NO: 2251892 - protein, 4 aa, Cryptosporidium parvum
ATPN

SEQ ID NO: 2251893 - protein, 7 aa, Cryptosporidium parvum
ATPNKGF

SEQ ID NO: 2251894 - protein, 15 aa, Cryptosporidium parvum
ATPNNNKLSSSNSNI

SEQ ID NO: 2251895 - protein, 12 aa, Cryptosporidium parvum
ATPQPPAQQYGT

SEQ ID NO: 2251896 - protein, 7 aa, Cryptosporidium parvum
ATPSLST

SEQ ID NO: 2251897 - protein, 6 aa, Cryptosporidium parvum
ATPSNL

SEQ ID NO: 2251898 - protein, 13 aa, Cryptosporidium parvum
ATPSSTISYNNNN

SEQ ID NO: 2251899 - protein, 5 aa, Cryptosporidium parvum
ATQSY

SEQ ID NO: 2251900 - protein, 7 aa, Cryptosporidium parvum
ATQTTKV

SEQ ID NO: 2251901 - protein, 13 aa, Cryptosporidium parvum
ATQVNNGQFFSID

SEQ ID NO: 2251902 - protein, 5 aa, Cryptosporidium parvum
ATREY

SEQ ID NO: 2251903 - protein, 4 aa, Cryptosporidium parvum
ATRQ

SEQ ID NO: 2251904 - protein, 8 aa, Cryptosporidium parvum
ATSDKTPL

SEQ ID NO: 2251905 - protein, 5 aa, Cryptosporidium parvum
ATSEF

SEQ ID NO: 2251906 - protein, 20 aa, Cryptosporidium parvum
ATSGNNGDADPDLEKQIGGL

SEQ ID NO: 2251907 - protein, 8 aa, Cryptosporidium parvum
ATSKESKN

SEQ ID NO: 2251908 - protein, 11 aa, Cryptosporidium parvum
ATSNSSNSSCN

SEQ ID NO: 2251909 - protein, 5 aa, Cryptosporidium parvum
ATSPA

SEQ ID NO: 2251910 - protein, 10 aa, Cryptosporidium parvum
ATSPKLNNLN

SEQ ID NO: 2251911 - protein, 6 aa, Cryptosporidium parvum
ATSPKR

SEQ ID NO: 2251912 - protein, 19 aa, Cryptosporidium parvum
ATSRTTNSNSNQPTSVYSG

SEQ ID NO: 2251913 - protein, 9 aa, Cryptosporidium parvum
ATSSSEPME

SEQ ID NO: 2251914 - protein, 12 aa, Cryptosporidium parvum
ATSTAGTHVTGG

SEQ ID NO: 2251915 - protein, 13 aa, Cryptosporidium parvum
ATSTSSKPANTTV

SEQ ID NO: 2251916 - protein, 5 aa, Cryptosporidium parvum
ATSYS

SEQ ID NO: 2251917 - protein, 18 aa, Cryptosporidium parvum
ATTASGGHPSVSNSQNIS

SEQ ID NO: 2251918 - protein, 9 aa, Cryptosporidium parvum
ATTASSGII

SEQ ID NO: 2251919 - protein, 8 aa, Cryptosporidium parvum
ATTGRGYV

SEQ ID NO: 2251920 - protein, 77 aa, Cryptosporidium parvum
ATTNKPRGSNLTPLNPVGTSGNDSDALGVATSTNTFTEKQATSTASATIVEQKDNSCESTDMKNEEKHSENDEKSDL

SEQ ID NO: 2251921 - protein, 7 aa, Cryptosporidium parvum
ATTPVDP

SEQ ID NO: 2251922 - protein, 4 aa, Cryptosporidium parvum
ATTS

SEQ ID NO: 2251923 - protein, 8 aa, Cryptosporidium parvum
ATTSNGPI

SEQ ID NO: 2251924 - protein, 4 aa, Cryptosporidium parvum
ATTT

SEQ ID NO: 2251925 - protein, 7 aa, Cryptosporidium parvum
ATTTSTA

SEQ ID NO: 2251926 - protein, 11 aa, Cryptosporidium parvum
ATVDPQTSEMD

SEQ ID NO: 2251927 - protein, 4 aa, Cryptosporidium parvum
ATYE

SEQ ID NO: 2251928 - protein, 5 aa, Cryptosporidium parvum
ATYGR

SEQ ID NO: 2251929 - protein, 31 aa, Cryptosporidium parvum; identical to SEQ ID NO: 2136637

SEQ ID NO: 2251930 - protein, 15 aa, Cryptosporidium parvum
AVDEDDELEEDDEGD

SEQ ID NO: 2251931 - protein, 8 aa, Cryptosporidium parvum
AVDGAAAL

SEQ ID NO: 2251932 - protein, 15 aa, Cryptosporidium parvum
AVDKTENKDIHQSIS

SEQ ID NO: 2251933 - protein, 11 aa, Cryptosporidium parvum
AVENYNDSSEL

SEQ ID NO: 2251934 - protein, 26 aa, Cryptosporidium parvum
AVETEEKRMGTEEKGIESKKKESIDS

SEQ ID NO: 2251935 - protein, 21 aa, Cryptosporidium parvum
AVGGTTSEDLKKKKNKKRFNK

SEQ ID NO: 2251936 - protein, 10 aa, Cryptosporidium parvum
AVGQNSKTVQ

SEQ ID NO: 2251937 - protein, 4 aa, Cryptosporidium parvum
AVKS

SEQ ID NO: 2251938 - protein, 9 aa, Cryptosporidium parvum
AVKVDEQDI

SEQ ID NO: 2251939 - protein, 6 aa, Cryptosporidium parvum
AVNGNT

SEQ ID NO: 2251940 - protein, 12 aa, Cryptosporidium parvum
AVNGSEVSVSAA

SEQ ID NO: 2251941 - protein, 11 aa, Cryptosporidium parvum
AVNPESETIET

SEQ ID NO: 2251942 - protein, 9 aa, Cryptosporidium parvum
AVNSEHNKN

SEQ ID NO: 2251943 - protein, 7 aa, Cryptosporidium parvum
AVQSSGT

SEQ ID NO: 2251944 - protein, 19 aa, Cryptosporidium parvum
AVQSTKNKTPISAFDPEGR

SEQ ID NO: 2251945 - protein, 10 aa, Cryptosporidium parvum
AVRKNERKRE

SEQ ID NO: 2251946 - protein, 16 aa, Cryptosporidium parvum
AVSEGTKAVTKFTGGQ

SEQ ID NO: 2251947 - protein, 5 aa, Cryptosporidium parvum
AVSGT

SEQ ID NO: 2251948 - protein, 9 aa, Cryptosporidium parvum
AVSNDTGLK

SEQ ID NO: 2251949 - protein, 25 aa, Cryptosporidium parvum
AVSNERQARSSIGLTTPRPITRRPD

SEQ ID NO: 2251950 - protein, 15 aa, Cryptosporidium parvum
AVSPTSSRSLENPDF

SEQ ID NO: 2251951 - protein, 8 aa, Cryptosporidium parvum
AVSSDGSY

SEQ ID NO: 2251952 - protein, 19 aa, Cryptosporidium parvum
AVSSPASISPEKNYIPASS

SEQ ID NO: 2251953 - protein, 6 aa, Cryptosporidium parvum
AVTARS

SEQ ID NO: 2251954 - protein, 15 aa, Cryptosporidium parvum
AVTGGGEGTNEDDEE

SEQ ID NO: 2251955 - protein, 8 aa, Cryptosporidium parvum
AVTGGNND

SEQ ID NO: 2251956 - protein, 6 aa, Cryptosporidium parvum
AVTPSG

SEQ ID NO: 2251957 - protein, 7 aa, Cryptosporidium parvum
AVTSSDS

SEQ ID NO: 2251958 - protein, 18 aa, Cryptosporidium parvum
AVTSSGNRVASGYPYKLP

SEQ ID NO: 2251959 - protein, 5 aa, Cryptosporidium parvum
AWSGG

SEQ ID NO: 2251960 - protein, 5 aa, Cryptosporidium parvum
AWSRK

SEQ ID NO: 2251961 - protein, 6 aa, Cryptosporidium parvum
AYDPNG

SEQ ID NO: 2251962 - protein, 4 aa, Cryptosporidium parvum
AYEP

SEQ ID NO: 2251963 - protein, 7 aa, Cryptosporidium parvum
AYKEGGE

SEQ ID NO: 2251964 - protein, 29 aa, Cryptosporidium parvum
AYKPGNSDNQSSENYANHEDNSCESQDSD

SEQ ID NO: 2251965 - protein, 7 aa, Cryptosporidium parvum
AYKTAQA

SEQ ID NO: 2251966 - protein, 7 aa, Cryptosporidium parvum
AYKTIGG

SEQ ID NO: 2251967 - protein, 10 aa, Cryptosporidium parvum
AYNGNKPSLS

SEQ ID NO: 2251968 - protein, 19 aa, Cryptosporidium parvum
AYNGPEGSNHRVRESSVGE

SEQ ID NO: 2251969 - protein, 17 aa, Cryptosporidium parvum
AYNKSKSQISNSSYNTS

SEQ ID NO: 2251970 - protein, 13 aa, Cryptosporidium parvum
AYNKTSTDKYTPE

SEQ ID NO: 2251971 - protein, 4 aa, Cryptosporidium parvum
AYNS

SEQ ID NO: 2251972 - protein, 11 aa, Cryptosporidium parvum
AYNSSKEGFLG

SEQ ID NO: 2251973 - protein, 11 aa, Cryptosporidium parvum
AYNSSKSGKKY

SEQ ID NO: 2251974 - protein, 20 aa, Cryptosporidium parvum
AYNSYKRKISNREKLDEANS

SEQ ID NO: 2251975 - protein, 6 aa, Cryptosporidium parvum
AYPAPN

SEQ ID NO: 2251976 - protein, 21 aa, Cryptosporidium parvum
AYPNTDANPSLASIPNSSIYN

SEQ ID NO: 2251977 - protein, 5 aa, Cryptosporidium parvum
AYQFS

SEQ ID NO: 2251978 - protein, 6 aa, Cryptosporidium parvum
AYQSAS

SEQ ID NO: 2251979 - protein, 6 aa, Cryptosporidium parvum
AYRDQT

SEQ ID NO: 2251980 - protein, 25 aa, Cryptosporidium parvum
AYRKKASKLHPDKQRSENDEQKEKS

SEQ ID NO: 2251981 - protein, 4 aa, Cryptosporidium parvum
AYRQ

SEQ ID NO: 2251982 - protein, 5 aa, Cryptosporidium parvum
AYSES

SEQ ID NO: 2251983 - protein, 4 aa, Cryptosporidium parvum
AYSK

SEQ ID NO: 2251984 - protein, 12 aa, Cryptosporidium parvum
AYSQSSSNNIEF

SEQ ID NO: 2251985 - protein, 47 aa, Cryptosporidium parvum
AYSSSRGGNSQRGANAVGTSSMTGNMSSAAASSSKGRSISDSRREGL

SEQ ID NO: 2251986 - protein, 13 aa, Cryptosporidium parvum
AYSTDQSQKLTST

SEQ ID NO: 2251987 - protein, 10 aa, Cryptosporidium parvum
AYTGEPLANA

SEQ ID NO: 2251988 - protein, 11 aa, Cryptosporidium parvum
AYWNSGNNATF

SEQ ID NO: 2251989 - protein, 13 aa, Cryptosporidium parvum
AYYREEKDPEQII

SEQ ID NO: 2251990 - protein, 5 aa, Cryptosporidium parvum
AYYSN

SEQ ID NO: 2251991 - protein, 4 aa, Cryptosporidium parvum
CADE

SEQ ID NO: 2251992 - protein, 7 aa, Cryptosporidium parvum
CAESPDN

SEQ ID NO: 2251993 - protein, 8 aa, Cryptosporidium parvum
CAGRPRLD

SEQ ID NO: 2251994 - protein, 8 aa, Cryptosporidium parvum
CAKEESKK

SEQ ID NO: 2251995 - protein, 7 aa, Cryptosporidium parvum
CAPPPQV

SEQ ID NO: 2251996 - protein, 5 aa, Cryptosporidium parvum
CAPPS

SEQ ID NO: 2251997 - protein, 4 aa, Cryptosporidium parvum
CAQE

SEQ ID NO: 2251998 - protein, 11 aa, Cryptosporidium parvum
CARNSPEIGEV

SEQ ID NO: 2251999 - protein, 8 aa, Cryptosporidium parvum
CASGGKDG

SEQ ID NO: 2252000 - protein, 11 aa, Cryptosporidium parvum
CASSPTLPSPD

SEQ ID NO: 2252001 - protein, 7 aa, Cryptosporidium parvum
CASYGST

SEQ ID NO: 2252002 - protein, 9 aa, Cryptosporidium parvum
CATSGDGLY

SEQ ID NO: 2252003 - protein, 52 aa, Cryptosporidium parvum
CCGSPPNYGDISNSGSNNSSTTNTGKEANSKELATNSSSQTGSNNKPTGSIA

SEQ ID NO: 2252004 - protein, 6 aa, Cryptosporidium parvum
CDASSH

SEQ ID NO: 2252005 - protein, 6 aa, Cryptosporidium parvum
CDDPNN

SEQ ID NO: 2252006 - protein, 9 aa, Cryptosporidium parvum
CDEKFGDKN

SEQ ID NO: 2252007 - protein, 5 aa, Cryptosporidium parvum
CDEKN

SEQ ID NO: 2252008 - protein, 13 aa, Cryptosporidium parvum
CDEKNLKSKIKSE

SEQ ID NO: 2252009 - protein, 114 aa, Cryptosporidium parvum
CDEPSRIEDREEEIDREAENGKAESGEAEDREAENRKAESGEAEDREAENGEAENGEAENGEAENGEAENGEAENGEAENDNISESDKKQVNNTSKVNTDPKEKSERRLTSQIS

SEQ ID NO: 2252010 - protein, 19 aa, Cryptosporidium parvum
CDGKSRKESVSAGNGGPSR

SEQ ID NO: 2252011 - protein, 13 aa, Cryptosporidium parvum
CDGNNIKNRNNIS

SEQ ID NO: 2252012 - protein, 8 aa, Cryptosporidium parvum
CDGRKPEV

SEQ ID NO: 2252013 - protein, 26 aa, Cryptosporidium parvum
CDKNDQGRRLSPRIRNKNKNKNIETL

SEQ ID NO: 2252014 - protein, 4 aa, Cryptosporidium parvum
CDKP

SEQ ID NO: 2252015 - protein, 4 aa, Cryptosporidium parvum
CDNH

SEQ ID NO: 2252016 - protein, 10 aa, Cryptosporidium parvum
CDNINSNPID

SEQ ID NO: 2252017 - protein, 6 aa, Cryptosporidium parvum
CDNSSI

SEQ ID NO: 2252018 - protein, 11 aa, Cryptosporidium parvum
CDNTENESYQG

SEQ ID NO: 2252019 - protein, 13 aa, Cryptosporidium parvum
CDNTENVNLESSN

SEQ ID NO: 2252020 - protein, 6 aa, Cryptosporidium parvum
CDPRHG

SEQ ID NO: 2252021 - protein, 9 aa, Cryptosporidium parvum
CDQNNSNTI

SEQ ID NO: 2252022 - protein, 7 aa, Cryptosporidium parvum
CDQRGGD

SEQ ID NO: 2252023 - protein, 12 aa, Cryptosporidium parvum
CDSNKNSNIAQG

SEQ ID NO: 2252024 - protein, 8 aa, Cryptosporidium parvum
CDSSESQV

SEQ ID NO: 2252025 - protein, 13 aa, Cryptosporidium parvum
CDSSTLKKENPGN

SEQ ID NO: 2252026 - protein, 38 aa, Cryptosporidium parvum
CDTKTLGSKLGYSPNVNSVSASSNSSLGLSSSVTGDYK

SEQ ID NO: 2252027 - protein, 8 aa, Cryptosporidium parvum
CEAASKNH

SEQ ID NO: 2252028 - protein, 5 aa, Cryptosporidium parvum
CEDSS

SEQ ID NO: 2252029 - protein, 10 aa, Cryptosporidium parvum
CEEEQMESVN

SEQ ID NO: 2252030 - protein, 7 aa, Cryptosporidium parvum
CEEPTRI

SEQ ID NO: 2252031 - protein, 7 aa, Cryptosporidium parvum
CEEVSSD

SEQ ID NO: 2252032 - protein, 5 aa, Cryptosporidium parvum
CEGAG

SEQ ID NO: 2252033 - protein, 5 aa, Cryptosporidium parvum
CEGLN

SEQ ID NO: 2252034 - protein, 32 aa, Cryptosporidium parvum
CEIESQQKHKKGRKHFSKKNSQNSKDDSELSE

SEQ ID NO: 2252035 - protein, 11 aa, Cryptosporidium parvum
CEKKNEKEIED

SEQ ID NO: 2252036 - protein, 12 aa, Cryptosporidium parvum
CENENVDYESSE

SEQ ID NO: 2252037 - protein, 5 aa, Cryptosporidium parvum
CENGE

SEQ ID NO: 2252038 - protein, 19 aa, Cryptosporidium parvum
CENNERKENENQDKTAGFN

SEQ ID NO: 2252039 - protein, 6 aa, Cryptosporidium parvum
CENNVE

SEQ ID NO: 2252040 - protein, 7 aa, Cryptosporidium parvum
CEPADSG

SEQ ID NO: 2252041 - protein, 7 aa, Cryptosporidium parvum
CEQNPNS

SEQ ID NO: 2252042 - protein, 4 aa, Cryptosporidium parvum
CEQR

SEQ ID NO: 2252043 - protein, 16 aa, Cryptosporidium parvum
CERAKRTLSSSTQATI

SEQ ID NO: 2252044 - protein, 12 aa, Cryptosporidium parvum
CERGGSKQPLQV

SEQ ID NO: 2252045 - protein, 6 aa, Cryptosporidium parvum
CESGKT

SEQ ID NO: 2252046 - protein, 9 aa, Cryptosporidium parvum
CESGTGNGN

SEQ ID NO: 2252047 - protein, 10 aa, Cryptosporidium parvum
CESKGNDLEL

SEQ ID NO: 2252048 - protein, 7 aa, Cryptosporidium parvum
CESKTEV

SEQ ID NO: 2252049 - protein, 13 aa, Cryptosporidium parvum
CESSKNSSSDSEI

SEQ ID NO: 2252050 - protein, 26 aa, Cryptosporidium parvum
CESTSEGSFLTEDEDDDGTSDSEVDM

SEQ ID NO: 2252051 - protein, 6 aa, Cryptosporidium parvum
CETKDS

SEQ ID NO: 2252052 - protein, 5 aa, Cryptosporidium parvum
CETNK

SEQ ID NO: 2252053 - protein, 7 aa, Cryptosporidium parvum
CETQQDK

SEQ ID NO: 2252054 - protein, 4 aa, Cryptosporidium parvum
CETR

SEQ ID NO: 2252055 - protein, 5 aa, Cryptosporidium parvum
CETSK

SEQ ID NO: 2252056 - protein, 9 aa, Cryptosporidium parvum
CFQNQENKP

SEQ ID NO: 2252057 - protein, 6 aa, Cryptosporidium parvum
CGAGFT

SEQ ID NO: 2252058 - protein, 10 aa, Cryptosporidium parvum
CGAKSGIGEK

SEQ ID NO: 2252059 - protein, 7 aa, Cryptosporidium parvum
CGDENKN

SEQ ID NO: 2252060 - protein, 8 aa, Cryptosporidium parvum
CGDNNTGR

SEQ ID NO: 2252061 - protein, 5 aa, Cryptosporidium parvum
CGDRS

SEQ ID NO: 2252062 - protein, 6 aa, Cryptosporidium parvum
CGEDEN

SEQ ID NO: 2252063 - protein, 22 aa, Cryptosporidium parvum
CGINGKRSSLKIGNNNNNNNKT

SEQ ID NO: 2252064 - protein, 15 aa, Cryptosporidium parvum
CGKPALGGGAGNSPV

SEQ ID NO: 2252065 - protein, 13 aa, Cryptosporidium parvum
CGKRQKNTDSNWE

SEQ ID NO: 2252066 - protein, 5 aa, Cryptosporidium parvum
CGKSN

SEQ ID NO: 2252067 - protein, 5 aa, Cryptosporidium parvum
CGNKR

SEQ ID NO: 2252068 - protein, 9 aa, Cryptosporidium parvum
CGNNGESDV

SEQ ID NO: 2252069 - protein, 5 aa, Cryptosporidium parvum
CGNNQ

SEQ ID NO: 2252070 - protein, 9 aa, Cryptosporidium parvum
CGNPSAQSW

SEQ ID NO: 2252071 - protein, 4 aa, Cryptosporidium parvum
CGNV

SEQ ID NO: 2252072 - protein, 7 aa, Cryptosporidium parvum
CGPNGTV

SEQ ID NO: 2252073 - protein, 7 aa, Cryptosporidium parvum
CGPQTFE

SEQ ID NO: 2252074 - protein, 15 aa, Cryptosporidium parvum
CGRVSSDNSSVSHTS

SEQ ID NO: 2252075 - protein, 17 aa, Cryptosporidium parvum
CGSANKVSHVSTGGGAS

SEQ ID NO: 2252076 - protein, 12 aa, Cryptosporidium parvum
CGSDLNRDSAVK

SEQ ID NO: 2252077 - protein, 15 aa, Cryptosporidium parvum
CGSEGELGKNGLTSA

SEQ ID NO: 2252078 - protein, 11 aa, Cryptosporidium parvum
CGSGPTAITET

SEQ ID NO: 2252079 - protein, 10 aa, Cryptosporidium parvum
CGSGSEVTST

SEQ ID NO: 2252080 - protein, 12 aa, Cryptosporidium parvum
CGSNTKSKLSCP

SEQ ID NO: 2252081 - protein, 4 aa, Cryptosporidium parvum
CGSR

SEQ ID NO: 2252082 - protein, 6 aa, Cryptosporidium parvum
CGSSDQ

SEQ ID NO: 2252083 - protein, 5 aa, Cryptosporidium parvum
CGTDE

SEQ ID NO: 2252084 - protein, 8 aa, Cryptosporidium parvum
CGTKGGEN

SEQ ID NO: 2252085 - protein, 16 aa, Cryptosporidium parvum
CGTSSSSSSASSFAAS

SEQ ID NO: 2252086 - protein, 6 aa, Cryptosporidium parvum
CGTSTA

SEQ ID NO: 2252087 - protein, 4 aa, Cryptosporidium parvum
CHGQ

SEQ ID NO: 2252088 - protein, 4 aa, Cryptosporidium parvum
CHPS

SEQ ID NO: 2252089 - protein, 23 aa, Cryptosporidium parvum
CHRSKSKKMELKNERNEANNTFS

SEQ ID NO: 2252090 - protein, 10 aa, Cryptosporidium parvum
CIDDEPKKGF

SEQ ID NO: 2252091 - protein, 19 aa, Cryptosporidium parvum
CITKPNSNLHHKDKTSEFV

SEQ ID NO: 2252092 - protein, 10 aa, Cryptosporidium parvum
CKARSSATWY

SEQ ID NO: 2252093 - protein, 12 aa, Cryptosporidium parvum
CKEDDSPTSESK

SEQ ID NO: 2252094 - protein, 11 aa, Cryptosporidium parvum
CKEDGNIPRHS

SEQ ID NO: 2252095 - protein, 9 aa, Cryptosporidium parvum
CKEDTRNIS

SEQ ID NO: 2252096 - protein, 12 aa, Cryptosporidium parvum
CKEESQTSSIRS

SEQ ID NO: 2252097 - protein, 10 aa, Cryptosporidium parvum
CKEGNDCGEY

SEQ ID NO: 2252098 - protein, 4 aa, Cryptosporidium parvum
CKEN

SEQ ID NO: 2252099 - protein, 10 aa, Cryptosporidium parvum
CKETDEDENL

SEQ ID NO: 2252100 - protein, 4 aa, Cryptosporidium parvum
CKEY

SEQ ID NO: 2252101 - protein, 17 aa, Cryptosporidium parvum
CKFPNKKSDNTNSSCSN

SEQ ID NO: 2252102 - protein, 9 aa, Cryptosporidium parvum
CKGGNSENL

SEQ ID NO: 2252103 - protein, 9 aa, Cryptosporidium parvum
CKGGVGKST

SEQ ID NO: 2252104 - protein, 6 aa, Cryptosporidium parvum
CKGSMS

SEQ ID NO: 2252105 - protein, 10 aa, Cryptosporidium parvum
CKKDSQEGYR

SEQ ID NO: 2252106 - protein, 20 aa, Cryptosporidium parvum
CKKNNNSLKSNDFNNNGLNT

SEQ ID NO: 2252107 - protein, 9 aa, Cryptosporidium parvum
CKKPRNDNS

SEQ ID NO: 2252108 - protein, 9 aa, Cryptosporidium parvum
CKKSMSSNN

SEQ ID NO: 2252109 - protein, 7 aa, Cryptosporidium parvum
CKNDNKL

SEQ ID NO: 2252110 - protein, 8 aa, Cryptosporidium parvum
CKNETREN

SEQ ID NO: 2252111 - protein, 7 aa, Cryptosporidium parvum
CKNPAEG

SEQ ID NO: 2252112 - protein, 8 aa, Cryptosporidium parvum
CKNSYNNN

SEQ ID NO: 2252113 - protein, 7 aa, Cryptosporidium parvum
CKPTTQY

SEQ ID NO: 2252114 - protein, 20 aa, Cryptosporidium parvum
CKQGGSKCDNNTGIEQNKSC

SEQ ID NO: 2252115 - protein, 8 aa, Cryptosporidium parvum
CKQTGSVK

SEQ ID NO: 2252116 - protein, 10 aa, Cryptosporidium parvum
CKRERAEKKI

SEQ ID NO: 2252117 - protein, 7 aa, Cryptosporidium parvum
CKRQETR

SEQ ID NO: 2252118 - protein, 17 aa, Cryptosporidium parvum
CKRRPKVANPNYGTPLA

SEQ ID NO: 2252119 - protein, 8 aa, Cryptosporidium parvum
CKRSRASP

SEQ ID NO: 2252120 - protein, 4 aa, Cryptosporidium parvum
CKSE

SEQ ID NO: 2252121 - protein, 5 aa, Cryptosporidium parvum
CKSGS

SEQ ID NO: 2252122 - protein, 14 aa, Cryptosporidium parvum
CKSITDSNGQTRTA

SEQ ID NO: 2252123 - protein, 9 aa, Cryptosporidium parvum
CKSNNNETN

SEQ ID NO: 2252124 - protein, 9 aa, Cryptosporidium parvum
CKTKKAPNM

SEQ ID NO: 2252125 - protein, 6 aa, Cryptosporidium parvum
CKTRNQ

SEQ ID NO: 2252126 - protein, 8 aa, Cryptosporidium parvum
CKTSETGY

SEQ ID NO: 2252127 - protein, 11 aa, Cryptosporidium parvum
CLKENKSRLEN

SEQ ID NO: 2252128 - protein, 4 aa, Cryptosporidium parvum
CLNP

SEQ ID NO: 2252129 - protein, 9 aa, Cryptosporidium parvum
CLNSGGSKT

SEQ ID NO: 2252130 - protein, 9 aa, Cryptosporidium parvum
CLPSPTTTQ

SEQ ID NO: 2252131 - protein, 8 aa, Cryptosporidium parvum
CNAQSTMS

SEQ ID NO: 2252132 - protein, 20 aa, Cryptosporidium parvum
CNDDGNGNLYTKKQGKGREN

SEQ ID NO: 2252133 - protein, 11 aa, Cryptosporidium parvum
CNDEPTSQDIT

SEQ ID NO: 2252134 - protein, 4 aa, Cryptosporidium parvum
CNDK

SEQ ID NO: 2252135 - protein, 8 aa, Cryptosporidium parvum
CNDNTNLS

SEQ ID NO: 2252136 - protein, 5 aa, Cryptosporidium parvum
CNDSS

SEQ ID NO: 2252137 - protein, 5 aa, Cryptosporidium parvum
CNEEN

SEQ ID NO: 2252138 - protein, 15 aa, Cryptosporidium parvum
CNEESQFNDLDEDKL

SEQ ID NO: 2252139 - protein, 5 aa, Cryptosporidium parvum
CNEGY

SEQ ID NO: 2252140 - protein, 4 aa, Cryptosporidium parvum
CNEI

SEQ ID NO: 2252141 - protein, 10 aa, Cryptosporidium parvum
CNEKNKNTQI

SEQ ID NO: 2252142 - protein, 17 aa, Cryptosporidium parvum
CNEQRKAKRRSFSRSLS

SEQ ID NO: 2252143 - protein, 11 aa, Cryptosporidium parvum
CNESERNKDYM

SEQ ID NO: 2252144 - protein, 21 aa, Cryptosporidium parvum
CNESKDQKTQERDEIKDEKHD

SEQ ID NO: 2252145 - protein, 8 aa, Cryptosporidium parvum
CNGSFDSR

SEQ ID NO: 2252146 - protein, 8 aa, Cryptosporidium parvum
CNGSNNNA

SEQ ID NO: 2252147 - protein, 8 aa, Cryptosporidium parvum
CNGTKESL

SEQ ID NO: 2252148 - protein, 7 aa, Cryptosporidium parvum
CNKEQQN

SEQ ID NO: 2252149 - protein, 8 aa, Cryptosporidium parvum
CNNGANGI

SEQ ID NO: 2252150 - protein, 8 aa, Cryptosporidium parvum
CNNKGKES

SEQ ID NO: 2252151 - protein, 9 aa, Cryptosporidium parvum
CNNPTDLSR

SEQ ID NO: 2252152 - protein, 33 aa, Cryptosporidium parvum
CNNRDNQIKPSRDSRASLEKENLDDNTGKSECD

SEQ ID NO: 2252153 - protein, 4 aa, Cryptosporidium parvum
CNNS

SEQ ID NO: 2252154 - protein, 5 aa, Cryptosporidium parvum
CNNSE

SEQ ID NO: 2252155 - protein, 8 aa, Cryptosporidium parvum
CNPDDTIG

SEQ ID NO: 2252156 - protein, 9 aa, Cryptosporidium parvum
CNPKLSTDA

SEQ ID NO: 2252157 - protein, 7 aa, Cryptosporidium parvum
CNPNPGF

SEQ ID NO: 2252158 - protein, 7 aa, Cryptosporidium parvum
CNPNSQA

SEQ ID NO: 2252159 - protein, 6 aa, Cryptosporidium parvum
CNQDSS

SEQ ID NO: 2252160 - protein, 4 aa, Cryptosporidium parvum
CNQQ

SEQ ID NO: 2252161 - protein, 7 aa, Cryptosporidium parvum
CNRGGGC

SEQ ID NO: 2252162 - protein, 8 aa, Cryptosporidium parvum
CNRTQTLS

SEQ ID NO: 2252163 - protein, 8 aa, Cryptosporidium parvum
CNSDGSLK

SEQ ID NO: 2252164 - protein, 5 aa, Cryptosporidium parvum
CNSDK

SEQ ID NO: 2252165 - protein, 4 aa, Cryptosporidium parvum
CNSE

SEQ ID NO: 2252166 - protein, 19 aa, Cryptosporidium parvum
CNSGIQSNNNNDSKKKRSR

SEQ ID NO: 2252167 - protein, 8 aa, Cryptosporidium parvum
CNSNTEDP

SEQ ID NO: 2252168 - protein, 10 aa, Cryptosporidium parvum
CNSNTSHPPI

SEQ ID NO: 2252169 - protein, 8 aa, Cryptosporidium parvum
CNSQNKSK

SEQ ID NO: 2252170 - protein, 15 aa, Cryptosporidium parvum
CNTAQNDSKESDQNV

SEQ ID NO: 2252171 - protein, 14 aa, Cryptosporidium parvum
CNTDNTNSSLETGQ

SEQ ID NO: 2252172 - protein, 15 aa, Cryptosporidium parvum
CNTEFSEETAIIQYF

SEQ ID NO: 2252173 - protein, 10 aa, Cryptosporidium parvum
CNTGTSGSII

SEQ ID NO: 2252174 - protein, 6 aa, Cryptosporidium parvum
CPADKD

SEQ ID NO: 2252175 - protein, 5 aa, Cryptosporidium parvum
CPAET

SEQ ID NO: 2252176 - protein, 4 aa, Cryptosporidium parvum
CPDE

SEQ ID NO: 2252177 - protein, 5 aa, Cryptosporidium parvum
CPEPY

SEQ ID NO: 2252178 - protein, 6 aa, Cryptosporidium parvum
CPHDPG

SEQ ID NO: 2252179 - protein, 7 aa, Cryptosporidium parvum
CPHEENE

SEQ ID NO: 2252180 - protein, 20 aa, Cryptosporidium parvum
CPIESNDDFASQTDKTTTFQ

SEQ ID NO: 2252181 - protein, 4 aa, Cryptosporidium parvum
CPLE

SEQ ID NO: 2252182 - protein, 6 aa, Cryptosporidium parvum
CPNQDK

SEQ ID NO: 2252183 - protein, 4 aa, Cryptosporidium parvum
CPPN

SEQ ID NO: 2252184 - protein, 5 aa, Cryptosporidium parvum
CPPNG

SEQ ID NO: 2252185 - protein, 5 aa, Cryptosporidium parvum
CPPQN

SEQ ID NO: 2252186 - protein, 9 aa, Cryptosporidium parvum
CPTGTQPGM

SEQ ID NO: 2252187 - protein, 13 aa, Cryptosporidium parvum
CQDGQKSAESNNL

SEQ ID NO: 2252188 - protein, 7 aa, Cryptosporidium parvum
CQDQNQA

SEQ ID NO: 2252189 - protein, 4 aa, Cryptosporidium parvum
CQDS

SEQ ID NO: 2252190 - protein, 11 aa, Cryptosporidium parvum
CQDYGQNTGVV

SEQ ID NO: 2252191 - protein, 13 aa, Cryptosporidium parvum
CQGFSKGDIGGGR

SEQ ID NO: 2252192 - protein, 5 aa, Cryptosporidium parvum
CQKNL

SEQ ID NO: 2252193 - protein, 12 aa, Cryptosporidium parvum
CQNASTNTTIES

SEQ ID NO: 2252194 - protein, 6 aa, Cryptosporidium parvum
CQNENT

SEQ ID NO: 2252195 - protein, 8 aa, Cryptosporidium parvum
CQNETGIS

SEQ ID NO: 2252196 - protein, 10 aa, Cryptosporidium parvum
CQNGGRSSRH

SEQ ID NO: 2252197 - protein, 13 aa, Cryptosporidium parvum
CQNNKTKKSVELE

SEQ ID NO: 2252198 - protein, 16 aa, Cryptosporidium parvum
CQPPNLDNSTIRGSEI

SEQ ID NO: 2252199 - protein, 8 aa, Cryptosporidium parvum
CQPSPNNG

SEQ ID NO: 2252200 - protein, 8 aa, Cryptosporidium parvum
CQPTGGRC

SEQ ID NO: 2252201 - protein, 7 aa, Cryptosporidium parvum
CQQKPRN

SEQ ID NO: 2252202 - protein, 12 aa, Cryptosporidium parvum
CQQNNNGNNTNM

SEQ ID NO: 2252203 - protein, 31 aa, Cryptosporidium parvum
CQSKEPSLQKISESKANLTPSKEQNQKPNLA

SEQ ID NO: 2252204 - protein, 8 aa, Cryptosporidium parvum
CQSSNNLS

SEQ ID NO: 2252205 - protein, 4 aa, Cryptosporidium parvum
CQTK

SEQ ID NO: 2252206 - protein, 14 aa, Cryptosporidium parvum
CQTTKKDTIASREI

SEQ ID NO: 2252207 - protein, 10 aa, Cryptosporidium parvum
CRESNQNQQL

SEQ ID NO: 2252208 - protein, 19 aa, Cryptosporidium parvum
CRETSKQFGANIPNKDLGQ

SEQ ID NO: 2252209 - protein, 7 aa, Cryptosporidium parvum
CRKESEK

SEQ ID NO: 2252210 - protein, 10 aa, Cryptosporidium parvum
CRKTKNKTEI

SEQ ID NO: 2252211 - protein, 6 aa, Cryptosporidium parvum
CRNNSQ

SEQ ID NO: 2252212 - protein, 9 aa, Cryptosporidium parvum
CRNQSGLTQ

SEQ ID NO: 2252213 - protein, 27 aa, Cryptosporidium parvum
CRPKSSFSLTSTNSTDEDKDDININNN

SEQ ID NO: 2252214 - protein, 14 aa, Cryptosporidium parvum
CRSKSPSGQPGKSV

SEQ ID NO: 2252215 - protein, 7 aa, Cryptosporidium parvum
CRTGTID

SEQ ID NO: 2252216 - protein, 4 aa, Cryptosporidium parvum
CRTR

SEQ ID NO: 2252217 - protein, 5 aa, Cryptosporidium parvum
CRTSG

SEQ ID NO: 2252218 - protein, 6 aa, Cryptosporidium parvum
CSADKT

SEQ ID NO: 2252219 - protein, 9 aa, Cryptosporidium parvum
CSANSDLRT

SEQ ID NO: 2252220 - protein, 38 aa, Cryptosporidium parvum
CSASKDSQAKPQSGSADASEEKPKKKDNPLDSLPPTSM

SEQ ID NO: 2252221 - protein, 12 aa, Cryptosporidium parvum
CSDASSKEVSKS

SEQ ID NO: 2252222 - protein, 8 aa, Cryptosporidium parvum
CSDKPEEP

SEQ ID NO: 2252223 - protein, 6 aa, Cryptosporidium parvum
CSDNKG

SEQ ID NO: 2252224 - protein, 7 aa, Cryptosporidium parvum
CSDNPRI

SEQ ID NO: 2252225 - protein, 12 aa, Cryptosporidium parvum
CSDSQDKLQIEN

SEQ ID NO: 2252226 - protein, 8 aa, Cryptosporidium parvum
CSDYNKNK

SEQ ID NO: 2252227 - protein, 7 aa, Cryptosporidium parvum
CSEGKSG

SEQ ID NO: 2252228 - protein, 19 aa, Cryptosporidium parvum
CSETESETNNLDLDDNGTF

SEQ ID NO: 2252229 - protein, 20 aa, Cryptosporidium parvum
CSGASGTYPGNSRRHSTERQ

SEQ ID NO: 2252230 - protein, 20 aa, Cryptosporidium parvum
CSGEHKSKTESANNDPQDEQ

SEQ ID NO: 2252231 - protein, 8 aa, Cryptosporidium parvum
CSGGGSVG

SEQ ID NO: 2252232 - protein, 6 aa, Cryptosporidium parvum
CSGGNY

SEQ ID NO: 2252233 - protein, 30 aa, Cryptosporidium parvum
CSGKPPDENHREATKLGSAQGDSEKTIESN

SEQ ID NO: 2252234 - protein, 8 aa, Cryptosporidium parvum
CSGSDGPH

SEQ ID NO: 2252235 - protein, 6 aa, Cryptosporidium parvum
CSGTPR

SEQ ID NO: 2252236 - protein, 14 aa, Cryptosporidium parvum
CSKGPFTGTSGIGS

SEQ ID NO: 2252237 - protein, 8 aa, Cryptosporidium parvum
CSKPDTSS

SEQ ID NO: 2252238 - protein, 5 aa, Cryptosporidium parvum
CSKPR

SEQ ID NO: 2252239 - protein, 7 aa, Cryptosporidium parvum
CSKQENM

SEQ ID NO: 2252240 - protein, 10 aa, Cryptosporidium parvum
CSKQKQSNLD

SEQ ID NO: 2252241 - protein, 11 aa, Cryptosporidium parvum
CSMGASSSTNY

SEQ ID NO: 2252242 - protein, 13 aa, Cryptosporidium parvum
CSNEESSFSTEMD

SEQ ID NO: 2252243 - protein, 7 aa, Cryptosporidium parvum
CSNETNK

SEQ ID NO: 2252244 - protein, 4 aa, Cryptosporidium parvum
CSNG

SEQ ID NO: 2252245 - protein, 5 aa, Cryptosporidium parvum
CSNGG

SEQ ID NO: 2252246 - protein, 6 aa, Cryptosporidium parvum
CSNGSM

SEQ ID NO: 2252247 - protein, 10 aa, Cryptosporidium parvum
CSNKSLANSV

SEQ ID NO: 2252248 - protein, 17 aa, Cryptosporidium parvum
CSNLENVSSSNNQSINS

SEQ ID NO: 2252249 - protein, 12 aa, Cryptosporidium parvum
CSNNNGNTFHDE

SEQ ID NO: 2252250 - protein, 14 aa, Cryptosporidium parvum
CSNNNSDSSSSAFN

SEQ ID NO: 2252251 - protein, 22 aa, Cryptosporidium parvum
CSNPYSSSCSSCSSSSSSSCSS

SEQ ID NO: 2252252 - protein, 4 aa, Cryptosporidium parvum
CSNR

SEQ ID NO: 2252253 - protein, 8 aa, Cryptosporidium parvum
CSNRHEEK

SEQ ID NO: 2252254 - protein, 14 aa, Cryptosporidium parvum
CSNTNGSSSTAYNK

SEQ ID NO: 2252255 - protein, 18 aa, Cryptosporidium parvum
CSNTNKIEKNEKNQNGDM

SEQ ID NO: 2252256 - protein, 13 aa, Cryptosporidium parvum
CSPNENYIPEKEN

SEQ ID NO: 2252257 - protein, 5 aa, Cryptosporidium parvum
CSPPC

SEQ ID NO: 2252258 - protein, 5 aa, Cryptosporidium parvum
CSPSD

SEQ ID NO: 2252259 - protein, 11 aa, Cryptosporidium parvum
CSPTPEQPKKR

SEQ ID NO: 2252260 - protein, 27 aa, Cryptosporidium parvum
CSQSSKSTVSTNNVSNSNNNLGNGNNS

SEQ ID NO: 2252261 - protein, 11 aa, Cryptosporidium parvum
CSRAARRQQKL

SEQ ID NO: 2252262 - protein, 49 aa, Cryptosporidium parvum
CSRSHSNSSPHSYSNSRSYSNSPSSSQSKSNSYSRSRSNSYSKSRNSYF

SEQ ID NO: 2252263 - protein, 6 aa, Cryptosporidium parvum
CSSDFS

SEQ ID NO: 2252264 - protein, 7 aa, Cryptosporidium parvum
CSSDYTE

SEQ ID NO: 2252265 - protein, 22 aa, Cryptosporidium parvum
CSSFSSTSYIDSSASSNSSSRF

SEQ ID NO: 2252266 - protein, 13 aa, Cryptosporidium parvum
CSSIGSGNSSVQN

SEQ ID NO: 2252267 - protein, 10 aa, Cryptosporidium parvum
CSSNGQENID

SEQ ID NO: 2252268 - protein, 11 aa, Cryptosporidium parvum
CSSNPNVSTNT

SEQ ID NO: 2252269 - protein, 11 aa, Cryptosporidium parvum
CSSNPSTEFEK

SEQ ID NO: 2252270 - protein, 4 aa, Cryptosporidium parvum
CSSP

SEQ ID NO: 2252271 - protein, 8 aa, Cryptosporidium parvum
CSSPPSNT

SEQ ID NO: 2252272 - protein, 7 aa, Cryptosporidium parvum
CSSRREA

SEQ ID NO: 2252273 - protein, 15 aa, Cryptosporidium parvum
CSSSISSYGTSIPRS

SEQ ID NO: 2252274 - protein, 9 aa, Cryptosporidium parvum
CSSYGKELE

SEQ ID NO: 2252275 - protein, 4 aa, Cryptosporidium parvum
CSTD

SEQ ID NO: 2252276 - protein, 10 aa, Cryptosporidium parvum
CSTDSNGAKK

SEQ ID NO: 2252277 - protein, 8 aa, Cryptosporidium parvum
CSTDTEKI

SEQ ID NO: 2252278 - protein, 53 aa, Cryptosporidium parvum
CSTNSSKQYPSNEKEIECSPSEEAHIGDNSSITENTANTCTSCANDDNQNRIS

SEQ ID NO: 2252279 - protein, 14 aa, Cryptosporidium parvum
CSTNTGSNERISDS

SEQ ID NO: 2252280 - protein, 8 aa, Cryptosporidium parvum
CSTPAGSA

SEQ ID NO: 2252281 - protein, 10 aa, Cryptosporidium parvum
CSTPPRSSVS

SEQ ID NO: 2252282 - protein, 23 aa, Cryptosporidium parvum
CSTSSENNDDENLDKNINKAERQ

SEQ ID NO: 2252283 - protein, 11 aa, Cryptosporidium parvum
CTAPSSWSSIK

SEQ ID NO: 2252284 - protein, 4 aa, Cryptosporidium parvum
CTAS

SEQ ID NO: 2252285 - protein, 4 aa, Cryptosporidium parvum
CTDG

SEQ ID NO: 2252286 - protein, 5 aa, Cryptosporidium parvum
CTDKG

SEQ ID NO: 2252287 - protein, 5 aa, Cryptosporidium parvum
CTDSQ

SEQ ID NO: 2252288 - protein, 6 aa, Cryptosporidium parvum
CTDYQS

SEQ ID NO: 2252289 - protein, 4 aa, Cryptosporidium parvum
CTEE

SEQ ID NO: 2252290 - protein, 5 aa, Cryptosporidium parvum
CTENR

SEQ ID NO: 2252291 - protein, 20 aa, Cryptosporidium parvum
CTGGTDSDTTGDFDSRSSGT

SEQ ID NO: 2252292 - protein, 11 aa, Cryptosporidium parvum
CTGKSNNIYKE

SEQ ID NO: 2252293 - protein, 8 aa, Cryptosporidium parvum
CTHEDKDR

SEQ ID NO: 2252294 - protein, 7 aa, Cryptosporidium parvum
CTHPASG

SEQ ID NO: 2252295 - protein, 6 aa, Cryptosporidium parvum
CTKKEY

SEQ ID NO: 2252296 - protein, 5 aa, Cryptosporidium parvum
CTKNS

SEQ ID NO: 2252297 - protein, 8 aa, Cryptosporidium parvum
CTKRTKID

SEQ ID NO: 2252298 - protein, 6 aa, Cryptosporidium parvum
CTQSNE

SEQ ID NO: 2252299 - protein, 4 aa, Cryptosporidium parvum
CTQT

SEQ ID NO: 2252300 - protein, 22 aa, Cryptosporidium parvum
CTRDSYPSTTHKTGKLGECKSN

SEQ ID NO: 2252301 - protein, 6 aa, Cryptosporidium parvum
CTRESG

SEQ ID NO: 2252302 - protein, 4 aa, Cryptosporidium parvum
CTRG

SEQ ID NO: 2252303 - protein, 11 aa, Cryptosporidium parvum
CTSDPNVQEEA

SEQ ID NO: 2252304 - protein, 6 aa, Cryptosporidium parvum
CTSEET

SEQ ID NO: 2252305 - protein, 8 aa, Cryptosporidium parvum
CTSNGDIT

SEQ ID NO: 2252306 - protein, 6 aa, Cryptosporidium parvum
CTSPQG

SEQ ID NO: 2252307 - protein, 4 aa, Cryptosporidium parvum
CTSS

SEQ ID NO: 2252308 - protein, 10 aa, Cryptosporidium parvum
CTTESRKKQM

SEQ ID NO: 2252309 - protein, 5 aa, Cryptosporidium parvum
CTTNT

SEQ ID NO: 2252310 - protein, 5 aa, Cryptosporidium parvum
CVNGS

SEQ ID NO: 2252311 - protein, 11 aa, Cryptosporidium parvum
CVQNNENADID

SEQ ID NO: 2252312 - protein, 4 aa, Cryptosporidium parvum
CYAQ

SEQ ID NO: 2252313 - protein, 5 aa, Cryptosporidium parvum
DAACR

SEQ ID NO: 2252314 - protein, 10 aa, Cryptosporidium parvum
DAASNSSVKP

SEQ ID NO: 2252315 - protein, 7 aa, Cryptosporidium parvum
DADCSKQ

SEQ ID NO: 2252316 - protein, 12 aa, Cryptosporidium parvum
DADGFTDTNEPL

SEQ ID NO: 2252317 - protein, 8 aa, Cryptosporidium parvum
DADGNGTI

SEQ ID NO: 2252318 - protein, 10 aa, Cryptosporidium parvum
DADKTTELKR

SEQ ID NO: 2252319 - protein, 8 aa, Cryptosporidium parvum
DADMKPPE

SEQ ID NO: 2252320 - protein, 5 aa, Cryptosporidium parvum
DADSL

SEQ ID NO: 2252321 - protein, 5 aa, Cryptosporidium parvum
DAEAG

SEQ ID NO: 2252322 - protein, 4 aa, Cryptosporidium parvum
DAED

SEQ ID NO: 2252323 - protein, 11 aa, Cryptosporidium parvum
DAEEEKTNFDS

SEQ ID NO: 2252324 - protein, 11 aa, Cryptosporidium parvum
DAEIENGTQEF

SEQ ID NO: 2252325 - protein, 12 aa, Cryptosporidium parvum
DAELQASKMEEV

SEQ ID NO: 2252326 - protein, 4 aa, Cryptosporidium parvum
DAEN

SEQ ID NO: 2252327 - protein, 5 aa, Cryptosporidium parvum
DAEND

SEQ ID NO: 2252328 - protein, 5 aa, Cryptosporidium parvum
DAEQL

SEQ ID NO: 2252329 - protein, 7 aa, Cryptosporidium parvum
DAERRAR

SEQ ID NO: 2252330 - protein, 29 aa, Cryptosporidium parvum
DAERRREKVRKNKEKLKPRRKLTKEEAAN

SEQ ID NO: 2252331 - protein, 4 aa, Cryptosporidium parvum
DAEY

SEQ ID NO: 2252332 - protein, 7 aa, Cryptosporidium parvum
DAEYKQE

SEQ ID NO: 2252333 - protein, 9 aa, Cryptosporidium parvum
DAFKKSQRL

SEQ ID NO: 2252334 - protein, 8 aa, Cryptosporidium parvum
DAFPGESF

SEQ ID NO: 2252335 - protein, 6 aa, Cryptosporidium parvum
DAFSSS

SEQ ID NO: 2252336 - protein, 9 aa, Cryptosporidium parvum
DAFTQHDAQ

SEQ ID NO: 2252337 - protein, 8 aa, Cryptosporidium parvum
DAGEKGFG

SEQ ID NO: 2252338 - protein, 13 aa, Cryptosporidium parvum
DAGGDLTQLDKPE

SEQ ID NO: 2252339 - protein, 8 aa, Cryptosporidium parvum
DAGMDKRS

SEQ ID NO: 2252340 - protein, 20 aa, Cryptosporidium parvum
DAGNETDEKTMNESNDENNK

SEQ ID NO: 2252341 - protein, 6 aa, Cryptosporidium parvum
DAGNQG

SEQ ID NO: 2252342 - protein, 17 aa, Cryptosporidium parvum
DAGQGERLVHAKKNIIS

SEQ ID NO: 2252343 - protein, 5 aa, Cryptosporidium parvum
DAGQY

SEQ ID NO: 2252344 - protein, 12 aa, Cryptosporidium parvum
DAGSNMFDNGSP

SEQ ID NO: 2252345 - protein, 4 aa, Cryptosporidium parvum
DAHE

SEQ ID NO: 2252346 - protein, 30 aa, Cryptosporidium parvum
DAIDDSSSATFSPRASKIENKSSSDSSKPL

SEQ ID NO: 2252347 - protein, 13 aa, Cryptosporidium parvum
DAIENGKATARKL

SEQ ID NO: 2252348 - protein, 4 aa, Cryptosporidium parvum
DAIG

SEQ ID NO: 2252349 - protein, 7 aa, Cryptosporidium parvum
DAKAREY

SEQ ID NO: 2252350 - protein, 13 aa, Cryptosporidium parvum
DAKDEQLKTNEYK

SEQ ID NO: 2252351 - protein, 4 aa, Cryptosporidium parvum
DAKE

SEQ ID NO: 2252352 - protein, 15 aa, Cryptosporidium parvum
DAKERIKQEREEKKK

SEQ ID NO: 2252353 - protein, 10 aa, Cryptosporidium parvum
DAKKKQKERL

SEQ ID NO: 2252354 - protein, 11 aa, Cryptosporidium parvum
DAKKLNPNPSK

SEQ ID NO: 2252355 - protein, 15 aa, Cryptosporidium parvum
DAKKQKKSIKHESEF

SEQ ID NO: 2252356 - protein, 6 aa, Cryptosporidium parvum
DAKKVE

SEQ ID NO: 2252357 - protein, 40 aa, Cryptosporidium parvum; identical to SEQ ID NO: 2136986

SEQ ID NO: 2252358 - protein, 10 aa, Cryptosporidium parvum
DAKSESSNSY

SEQ ID NO: 2252359 - protein, 9 aa, Cryptosporidium parvum
DAKTHTSIN

SEQ ID NO: 2252360 - protein, 6 aa, Cryptosporidium parvum
DALENE

SEQ ID NO: 2252361 - protein, 27 aa, Cryptosporidium parvum
DALKSHYPSLSSGANSISANSSAPGDI

SEQ ID NO: 2252362 - protein, 11 aa, Cryptosporidium parvum
DALPKTPQPTI

SEQ ID NO: 2252363 - protein, 6 aa, Cryptosporidium parvum
DANEVD

SEQ ID NO: 2252364 - protein, 22 aa, Cryptosporidium parvum
DANKDQHSIGSAKTRLTGHNQA

SEQ ID NO: 2252365 - protein, 5 aa, Cryptosporidium parvum
DANLS

SEQ ID NO: 2252366 - protein, 39 aa, Cryptosporidium parvum
DANQDTGNKYVTADTGVKQSHIQTDGNSTHIQEHETATT

SEQ ID NO: 2252367 - protein, 12 aa, Cryptosporidium parvum
DANTNKALDAIS

SEQ ID NO: 2252368 - protein, 6 aa, Cryptosporidium parvum
DAPGVN

SEQ ID NO: 2252369 - protein, 13 aa, Cryptosporidium parvum
DAPIPPPNPVSKN

SEQ ID NO: 2252370 - protein, 5 aa, Cryptosporidium parvum
DAPPV

SEQ ID NO: 2252371 - protein, 13 aa, Cryptosporidium parvum
DAPVPKVPNSMKG

SEQ ID NO: 2252372 - protein, 9 aa, Cryptosporidium parvum
DAQKNNEEV

SEQ ID NO: 2252373 - protein, 5 aa, Cryptosporidium parvum
DAQSA

SEQ ID NO: 2252374 - protein, 12 aa, Cryptosporidium parvum
DARAASKSKELY

SEQ ID NO: 2252375 - protein, 9 aa, Cryptosporidium parvum
DARDSNIPT

SEQ ID NO: 2252376 - protein, 7 aa, Cryptosporidium parvum
DARGPKH

SEQ ID NO: 2252377 - protein, 12 aa, Cryptosporidium parvum
DARKGEVQKEIE

SEQ ID NO: 2252378 - protein, 10 aa, Cryptosporidium parvum
DARNNDVINE

SEQ ID NO: 2252379 - protein, 12 aa, Cryptosporidium parvum
DARSRDLRPRGQ

SEQ ID NO: 2252380 - protein, 9 aa, Cryptosporidium parvum
DARSSDTSE

SEQ ID NO: 2252381 - protein, 9 aa, Cryptosporidium parvum
DARTDCSRR

SEQ ID NO: 2252382 - protein, 10 aa, Cryptosporidium parvum
DARYSSDGMV

SEQ ID NO: 2252383 - protein, 4 aa, Cryptosporidium parvum
DASD

SEQ ID NO: 2252384 - protein, 9 aa, Cryptosporidium parvum
DASEDNSLL

SEQ ID NO: 2252385 - protein, 5 aa, Cryptosporidium parvum
DASKY

SEQ ID NO: 2252386 - protein, 18 aa, Cryptosporidium parvum
DASNGSISDPRSKYLGNR

SEQ ID NO: 2252387 - protein, 4 aa, Cryptosporidium parvum
DASP

SEQ ID NO: 2252388 - protein, 15 aa, Cryptosporidium parvum
DASQDTLSPRPLTSR

SEQ ID NO: 2252389 - protein, 6 aa, Cryptosporidium parvum
DASSGE

SEQ ID NO: 2252390 - protein, 10 aa, Cryptosporidium parvum
DASSSSDEST

SEQ ID NO: 2252391 - protein, 11 aa, Cryptosporidium parvum
DASTSEIKKSY

SEQ ID NO: 2252392 - protein, 10 aa, Cryptosporidium parvum
DASVIDGSNE

SEQ ID NO: 2252393 - protein, 7 aa, Cryptosporidium parvum
DASVTDT

SEQ ID NO: 2252394 - protein, 11 aa, Cryptosporidium parvum
DATCYKEKASD

SEQ ID NO: 2252395 - protein, 7 aa, Cryptosporidium parvum
DATEDEL

SEQ ID NO: 2252396 - protein, 5 aa, Cryptosporidium parvum
DATPH

SEQ ID NO: 2252397 - protein, 6 aa, Cryptosporidium parvum
DATQIL

SEQ ID NO: 2252398 - protein, 15 aa, Cryptosporidium parvum
DATSGKQSCLSGNTT

SEQ ID NO: 2252399 - protein, 6 aa, Cryptosporidium parvum
DATVKK

SEQ ID NO: 2252400 - protein, 20 aa, Cryptosporidium parvum
DAVANAEKQKNGFGSNSGLN

SEQ ID NO: 2252401 - protein, 7 aa, Cryptosporidium parvum
DAVDEET

SEQ ID NO: 2252402 - protein, 7 aa, Cryptosporidium parvum
DAVEARK

SEQ ID NO: 2252403 - protein, 8 aa, Cryptosporidium parvum
DAVQKQAK

SEQ ID NO: 2252404 - protein, 11 aa, Cryptosporidium parvum
DAYKTKKCNTF

SEQ ID NO: 2252405 - protein, 6 aa, Cryptosporidium parvum
DAYQPR

SEQ ID NO: 2252406 - protein, 9 aa, Cryptosporidium parvum
DCDKSDNEC

SEQ ID NO: 2252407 - protein, 17 aa, Cryptosporidium parvum
DCDQDNGNKTLESSSDE

SEQ ID NO: 2252408 - protein, 9 aa, Cryptosporidium parvum
DCDTDSSNR

SEQ ID NO: 2252409 - protein, 6 aa, Cryptosporidium parvum
DCEPNG

SEQ ID NO: 2252410 - protein, 6 aa, Cryptosporidium parvum
DCERAQ

SEQ ID NO: 2252411 - protein, 12 aa, Cryptosporidium parvum
DCKELNKDEMEA

SEQ ID NO: 2252412 - protein, 8 aa, Cryptosporidium parvum
DCNESSSS

SEQ ID NO: 2252413 - protein, 5 aa, Cryptosporidium parvum
DCNGE

SEQ ID NO: 2252414 - protein, 10 aa, Cryptosporidium parvum
DCNGGYTSAN

SEQ ID NO: 2252415 - protein, 10 aa, Cryptosporidium parvum
DCNNRIGEGI

SEQ ID NO: 2252416 - protein, 51 aa, Cryptosporidium parvum
DCRKHTPHKVSQYKRGKESPRAQGRRRYDQKQKGYGGQTKPKLRKTAKTTK

SEQ ID NO: 2252417 - protein, 54 aa, Cryptosporidium parvum
DCSSKSKNYISESESESESESESESKYEFKPEPEPEPKPKPEYEPEFEPENSKV

SEQ ID NO: 2252418 - protein, 5 aa, Cryptosporidium parvum
DCTAS

SEQ ID NO: 2252419 - protein, 7 aa, Cryptosporidium parvum
DCTEESF

SEQ ID NO: 2252420 - protein, 42 aa, Cryptosporidium parvum
DDAASDLNSDSEADYSESNRLDSSSETENPAHSHHANDGADF

SEQ ID NO: 2252421 - protein, 9 aa, Cryptosporidium parvum
DDAGEVKRQ

SEQ ID NO: 2252422 - protein, 7 aa, Cryptosporidium parvum
DDAGTGQ

SEQ ID NO: 2252423 - protein, 6 aa, Cryptosporidium parvum
DDAKIE

SEQ ID NO: 2252424 - protein, 7 aa, Cryptosporidium parvum
DDANQLT

SEQ ID NO: 2252425 - protein, 8 aa, Cryptosporidium parvum
DDASGLNK

SEQ ID NO: 2252426 - protein, 4 aa, Cryptosporidium parvum
DDAY

SEQ ID NO: 2252427 - protein, 6 aa, Cryptosporidium parvum
DDCGSD

SEQ ID NO: 2252428 - protein, 92 aa, Cryptosporidium parvum
DDCKNNPLAYQDDNLSDDDSDSNSYSDSDSDSDSDSDSSSSSSGSDSRSVSGSDSDGNGSGSDESSSDSDSSSSSSSSEWSSYEDEYEDRHA

SEQ ID NO: 2252429 - protein, 23 aa, Cryptosporidium parvum
DDCSGKAKTKEKAISHKDDDQYS

SEQ ID NO: 2252430 - protein, 7 aa, Cryptosporidium parvum
DDDAELE

SEQ ID NO: 2252431 - protein, 31 aa, Cryptosporidium parvum
DDDDDDDDDDKGDKKEKLNYNNMNNNKNNSQ

SEQ ID NO: 2252432 - protein, 11 aa, Cryptosporidium parvum
DDDDENPENPV

SEQ ID NO: 2252433 - protein, 18 aa, Cryptosporidium parvum
DDDDRRESIGKSTYSRKL

SEQ ID NO: 2252434 - protein, 9 aa, Cryptosporidium parvum
DDDEDMEAA

SEQ ID NO: 2252435 - protein, 5 aa, Cryptosporidium parvum
DDDEE

SEQ ID NO: 2252436 - protein, 13 aa, Cryptosporidium parvum
DDDEEEDQENEYK

SEQ ID NO: 2252437 - protein, 9 aa, Cryptosporidium parvum
DDDKNSFSF

SEQ ID NO: 2252438 - protein, 14 aa, Cryptosporidium parvum
DDDKPKGKRGRPRL

SEQ ID NO: 2252439 - protein, 4 aa, Cryptosporidium parvum
DDDL

SEQ ID NO: 2252440 - protein, 7 aa, Cryptosporidium parvum
DDDNNDA

SEQ ID NO: 2252441 - protein, 9 aa, Cryptosporidium parvum
DDDNQNQER

SEQ ID NO: 2252442 - protein, 15 aa, Cryptosporidium parvum
DDDNTSSNENSSSSS

SEQ ID NO: 2252443 - protein, 5 aa, Cryptosporidium parvum
DDDSE

SEQ ID NO: 2252444 - protein, 10 aa, Cryptosporidium parvum
DDDSESTGDA

SEQ ID NO: 2252445 - protein, 11 aa, Cryptosporidium parvum
DDDTEKKDGVS

SEQ ID NO: 2252446 - protein, 10 aa, Cryptosporidium parvum
DDDTQLTPGS

SEQ ID NO: 2252447 - protein, 20 aa, Cryptosporidium parvum
DDDYHQNNKQSSESKNPETS

SEQ ID NO: 2252448 - protein, 36 aa, Cryptosporidium parvum
DDDYSGYSDADINENYGEFDGENEDNGEIANESSVE

SEQ ID NO: 2252449 - protein, 39 aa, Cryptosporidium parvum
DDEDGNNDDTNDDNSNNDNFNDNNANYEYEYNDSDLVNS

SEQ ID NO: 2252450 - protein, 9 aa, Cryptosporidium parvum
DDEEAEDFD

SEQ ID NO: 2252451 - protein, 23 aa, Cryptosporidium parvum
DDEEEAKDNDNSKQQPKSSNDEI

SEQ ID NO: 2252452 - protein, 69 aa, Cryptosporidium parvum
DDEEPEEQKPVVKKEKTSQVKKEKPTKKELDESEEEFDDDETEEDSEDDRHSKSKKDSKEIKKEKKSKE

SEQ ID NO: 2252453 - protein, 26 aa, Cryptosporidium parvum
DDEEPLNSEENNKQSKYNKDSKNDKL

SEQ ID NO: 2252454 - protein, 7 aa, Cryptosporidium parvum
DDEEPPI

SEQ ID NO: 2252455 - protein, 9 aa, Cryptosporidium parvum
DDEGEYYEE

SEQ ID NO: 2252456 - protein, 4 aa, Cryptosporidium parvum
DDEH

SEQ ID NO: 2252457 - protein, 24 aa, Cryptosporidium parvum
DDEHNSAINSSHETDTDSIKGSYD

SEQ ID NO: 2252458 - protein, 6 aa, Cryptosporidium parvum
DDEIEE

SEQ ID NO: 2252459 - protein, 5 aa, Cryptosporidium parvum
DDEIQ

SEQ ID NO: 2252460 - protein, 7 aa, Cryptosporidium parvum
DDEKSLF

SEQ ID NO: 2252461 - protein, 4 aa, Cryptosporidium parvum
DDEL

SEQ ID NO: 2252462 - protein, 11 aa, Cryptosporidium parvum
DDELSPSESNN

SEQ ID NO: 2252463 - protein, 9 aa, Cryptosporidium parvum
DDELSSDPC

SEQ ID NO: 2252464 - protein, 8 aa, Cryptosporidium parvum
DDENINQN

SEQ ID NO: 2252465 - protein, 5 aa, Cryptosporidium parvum
DDENL

SEQ ID NO: 2252466 - protein, 7 aa, Cryptosporidium parvum
DDENLDE

SEQ ID NO: 2252467 - protein, 21 aa, Cryptosporidium parvum
DDENSGNYNSRNITTGSTPVV

SEQ ID NO: 2252468 - protein, 7 aa, Cryptosporidium parvum
DDERERG

SEQ ID NO: 2252469 - protein, 6 aa, Cryptosporidium parvum
DDESLS

SEQ ID NO: 2252470 - protein, 20 aa, Cryptosporidium parvum
DDESSDDSDQSSSNEEDLGM

SEQ ID NO: 2252471 - protein, 7 aa, Cryptosporidium parvum
DDETGKI

SEQ ID NO: 2252472 - protein, 7 aa, Cryptosporidium parvum
DDETLQS

SEQ ID NO: 2252473 - protein, 39 aa, Cryptosporidium parvum
DDEYISNESMNNPNKRPNIPPQKKTYNQTPSTAAQTGLL

SEQ ID NO: 2252474 - protein, 21 aa, Cryptosporidium parvum
DDFDSTKVNLSKKSKLENTHS

SEQ ID NO: 2252475 - protein, 4 aa, Cryptosporidium parvum
DDFE

SEQ ID NO: 2252476 - protein, 8 aa, Cryptosporidium parvum
DDFEGHKK

SEQ ID NO: 2252477 - protein, 8 aa, Cryptosporidium parvum
DDFEQGEK

SEQ ID NO: 2252478 - protein, 17 aa, Cryptosporidium parvum
DDFSDESPKNVEEHSDS

SEQ ID NO: 2252479 - protein, 7 aa, Cryptosporidium parvum
DDFSEDE

SEQ ID NO: 2252480 - protein, 8 aa, Cryptosporidium parvum
DDGALGRL

SEQ ID NO: 2252481 - protein, 6 aa, Cryptosporidium parvum
DDGEAV

SEQ ID NO: 2252482 - protein, 9 aa, Cryptosporidium parvum
DDGLGSLSS

SEQ ID NO: 2252483 - protein, 8 aa, Cryptosporidium parvum
DDGNGEGY

SEQ ID NO: 2252484 - protein, 7 aa, Cryptosporidium parvum
DDGPGKY

SEQ ID NO: 2252485 - protein, 24 aa, Cryptosporidium parvum
DDGVNKENKEDSDSISNRKSIPKP

SEQ ID NO: 2252486 - protein, 4 aa, Cryptosporidium parvum
DDHE

SEQ ID NO: 2252487 - protein, 8 aa, Cryptosporidium parvum
DDHHAKGQ

SEQ ID NO: 2252488 - protein, 5 aa, Cryptosporidium parvum
DDHSE

SEQ ID NO: 2252489 - protein, 14 aa, Cryptosporidium parvum
DDHSTSSKYNLTSN

SEQ ID NO: 2252490 - protein, 4 aa, Cryptosporidium parvum
DDIA

SEQ ID NO: 2252491 - protein, 11 aa, Cryptosporidium parvum
DDIDNDPDPKV

SEQ ID NO: 2252492 - protein, 6 aa, Cryptosporidium parvum
DDIEDV

SEQ ID NO: 2252493 - protein, 6 aa, Cryptosporidium parvum
DDIGNR

SEQ ID NO: 2252494 - protein, 6 aa, Cryptosporidium parvum
DDIPEM

SEQ ID NO: 2252495 - protein, 14 aa, Cryptosporidium parvum
DDIQKRGGKSLNDG

SEQ ID NO: 2252496 - protein, 4 aa, Cryptosporidium parvum
DDIS

SEQ ID NO: 2252497 - protein, 7 aa, Cryptosporidium parvum
DDKATLQ

SEQ ID NO: 2252498 - protein, 9 aa, Cryptosporidium parvum
DDKDENSQV

SEQ ID NO: 2252499 - protein, 10 aa, Cryptosporidium parvum
DDKETNNGLK

SEQ ID NO: 2252500 - protein, 8 aa, Cryptosporidium parvum
DDKIDNPL

SEQ ID NO: 2252501 - protein, 8 aa, Cryptosporidium parvum
DDKIPTIE

SEQ ID NO: 2252502 - protein, 6 aa, Cryptosporidium parvum
DDKIST

SEQ ID NO: 2252503 - protein, 11 aa, Cryptosporidium parvum
DDKKTIKPLDN

SEQ ID NO: 2252504 - protein, 5 aa, Cryptosporidium parvum
DDKNI

SEQ ID NO: 2252505 - protein, 8 aa, Cryptosporidium parvum
DDKNKRNW

SEQ ID NO: 2252506 - protein, 8 aa, Cryptosporidium parvum
DDKQNSQC

SEQ ID NO: 2252507 - protein, 15 aa, Cryptosporidium parvum
DDKQSADMHPEKRQK

SEQ ID NO: 2252508 - protein, 4 aa, Cryptosporidium parvum
DDKS

SEQ ID NO: 2252509 - protein, 10 aa, Cryptosporidium parvum
DDKSNSSPLY

SEQ ID NO: 2252510 - protein, 8 aa, Cryptosporidium parvum
DDKTELSS

SEQ ID NO: 2252511 - protein, 6 aa, Cryptosporidium parvum
DDKTGN

SEQ ID NO: 2252512 - protein, 14 aa, Cryptosporidium parvum
DDKTSEDDDTPESS

SEQ ID NO: 2252513 - protein, 19 aa, Cryptosporidium parvum
DDKTTAPSTPDDKSTPLPH

SEQ ID NO: 2252514 - protein, 8 aa, Cryptosporidium parvum
DDKVITSQ

SEQ ID NO: 2252515 - protein, 8 aa, Cryptosporidium parvum
DDKYSNLP

SEQ ID NO: 2252516 - protein, 13 aa, Cryptosporidium parvum
DDLDTDEDNDYPS

SEQ ID NO: 2252517 - protein, 8 aa, Cryptosporidium parvum
DDLETSNI

SEQ ID NO: 2252518 - protein, 21 aa, Cryptosporidium parvum
DDLGDSGSLLTPDTATNSEPI

SEQ ID NO: 2252519 - protein, 7 aa, Cryptosporidium parvum
DDLGESS

SEQ ID NO: 2252520 - protein, 8 aa, Cryptosporidium parvum
DDLGTNQT

SEQ ID NO: 2252521 - protein, 6 aa, Cryptosporidium parvum
DDLKEK

SEQ ID NO: 2252522 - protein, 9 aa, Cryptosporidium parvum
DDLKSKTKV

SEQ ID NO: 2252523 - protein, 7 aa, Cryptosporidium parvum
DDLPSYS

SEQ ID NO: 2252524 - protein, 18 aa, Cryptosporidium parvum
DDLSDEKQKDFYNESGKD

SEQ ID NO: 2252525 - protein, 5 aa, Cryptosporidium parvum
DDLTM

SEQ ID NO: 2252526 - protein, 11 aa, Cryptosporidium parvum
DDMNRKYDEGM

SEQ ID NO: 2252527 - protein, 7 aa, Cryptosporidium parvum
DDNAEAV

SEQ ID NO: 2252528 - protein, 10 aa, Cryptosporidium parvum
DDNASVQGRN

SEQ ID NO: 2252529 - protein, 23 aa, Cryptosporidium parvum
DDNCSSTTGASGYRDASVSPQRF

SEQ ID NO: 2252530 - protein, 31 aa, Cryptosporidium parvum
DDNDSEGSADWVGSEETSDPEDSHNNKDGEI

SEQ ID NO: 2252531 - protein, 169 aa, Cryptosporidium parvum
DDNEHFNTGGGQGSGSGGGGQSSRRFAGQRRDYRERGGDRAERGELERDRERGDRGERGERGERGERGDRGDRDRDRDRDRDRDRDRDRDRDRDRGERGERGERGERGERDRNRDRNREKNDRDRVDKGDIKAERSEKERHRDKDWERDRSGDQEKGSTNKGSGGSSMV

SEQ ID NO: 2252532 - protein, 10 aa, Cryptosporidium parvum
DDNGNILNPK

SEQ ID NO: 2252533 - protein, 5 aa, Cryptosporidium parvum
DDNHS

SEQ ID NO: 2252534 - protein, 14 aa, Cryptosporidium parvum
DDNKNENESNDDND

SEQ ID NO: 2252535 - protein, 10 aa, Cryptosporidium parvum
DDNKSSIKSV

SEQ ID NO: 2252536 - protein, 12 aa, Cryptosporidium parvum
DDNKYRKKRGVR

SEQ ID NO: 2252537 - protein, 7 aa, Cryptosporidium parvum
DDNNETE

SEQ ID NO: 2252538 - protein, 10 aa, Cryptosporidium parvum
DDNNSSVDTT

SEQ ID NO: 2252539 - protein, 34 aa, Cryptosporidium parvum
DDNPNGAAGGSGGINESNSAKTMSNVNTSPSDEV

SEQ ID NO: 2252540 - protein, 9 aa, Cryptosporidium parvum
DDNSDNDER

SEQ ID NO: 2252541 - protein, 26 aa, Cryptosporidium parvum
DDNSDSDSDVENNSHSEGEENLDDDI

SEQ ID NO: 2252542 - protein, 10 aa, Cryptosporidium parvum
DDNSKESEYE

SEQ ID NO: 2252543 - protein, 6 aa, Cryptosporidium parvum
DDNSLN

SEQ ID NO: 2252544 - protein, 8 aa, Cryptosporidium parvum
DDNTGKIS

SEQ ID NO: 2252545 - protein, 6 aa, Cryptosporidium parvum
DDNTGQ

SEQ ID NO: 2252546 - protein, 8 aa, Cryptosporidium parvum
DDNTLDPG

SEQ ID NO: 2252547 - protein, 10 aa, Cryptosporidium parvum
DDNVKNTRSN

SEQ ID NO: 2252548 - protein, 6 aa, Cryptosporidium parvum
DDPEHG

SEQ ID NO: 2252549 - protein, 7 aa, Cryptosporidium parvum
DDPEKNQ

SEQ ID NO: 2252550 - protein, 7 aa, Cryptosporidium parvum
DDPGSLE

SEQ ID NO: 2252551 - protein, 6 aa, Cryptosporidium parvum
DDPITE

SEQ ID NO: 2252552 - protein, 6 aa, Cryptosporidium parvum
DDPIYS

SEQ ID NO: 2252553 - protein, 19 aa, Cryptosporidium parvum
DDPKDLSSTKIENKTDNRI

SEQ ID NO: 2252554 - protein, 10 aa, Cryptosporidium parvum
DDPNKKSNSL

SEQ ID NO: 2252555 - protein, 19 aa, Cryptosporidium parvum
DDPNPTSMENSKKRNAEEV

SEQ ID NO: 2252556 - protein, 8 aa, Cryptosporidium parvum
DDPNQANI

SEQ ID NO: 2252557 - protein, 23 aa, Cryptosporidium parvum
DDPNWSEISPEQEENDLESDIDD

SEQ ID NO: 2252558 - protein, 9 aa, Cryptosporidium parvum
DDPPEDSFE

SEQ ID NO: 2252559 - protein, 5 aa, Cryptosporidium parvum
DDPPN

SEQ ID NO: 2252560 - protein, 8 aa, Cryptosporidium parvum
DDPSGNSF

SEQ ID NO: 2252561 - protein, 6 aa, Cryptosporidium parvum
DDPSLE

SEQ ID NO: 2252562 - protein, 8 aa, Cryptosporidium parvum
DDPVPLPN

SEQ ID NO: 2252563 - protein, 4 aa, Cryptosporidium parvum
DDPY

SEQ ID NO: 2252564 - protein, 14 aa, Cryptosporidium parvum
DDQDYELGKNSQDL

SEQ ID NO: 2252565 - protein, 4 aa, Cryptosporidium parvum
DDQE

SEQ ID NO: 2252566 - protein, 6 aa, Cryptosporidium parvum
DDQECE

SEQ ID NO: 2252567 - protein, 7 aa, Cryptosporidium parvum
DDQESDI

SEQ ID NO: 2252568 - protein, 4 aa, Cryptosporidium parvum
DDQI

SEQ ID NO: 2252569 - protein, 9 aa, Cryptosporidium parvum
DDQKPINNE

SEQ ID NO: 2252570 - protein, 9 aa, Cryptosporidium parvum
DDQLPPSIR

SEQ ID NO: 2252571 - protein, 7 aa, Cryptosporidium parvum
DDQNSSV

SEQ ID NO: 2252572 - protein, 34 aa, Cryptosporidium parvum
DDQPMDDESGSENTEDNDNKLINRKTKKSMKSSL

SEQ ID NO: 2252573 - protein, 20 aa, Cryptosporidium parvum
DDQQLKTEKYQRTDYQNETL

SEQ ID NO: 2252574 - protein, 4 aa, Cryptosporidium parvum
DDQT

SEQ ID NO: 2252575 - protein, 28 aa, Cryptosporidium parvum
DDRDPPGSRPSGGYVSSGVPSGGRPNVA

SEQ ID NO: 2252576 - protein, 22 aa, Cryptosporidium parvum
DDRENEKNEPKISEVKEDNTRL

SEQ ID NO: 2252577 - protein, 8 aa, Cryptosporidium parvum
DDRNSASE

SEQ ID NO: 2252578 - protein, 6 aa, Cryptosporidium parvum
DDRPDY

SEQ ID NO: 2252579 - protein, 5 aa, Cryptosporidium parvum
DDRQT

SEQ ID NO: 2252580 - protein, 7 aa, Cryptosporidium parvum
DDRSDED

SEQ ID NO: 2252581 - protein, 7 aa, Cryptosporidium parvum
DDRSSEI

SEQ ID NO: 2252582 - protein, 8 aa, Cryptosporidium parvum
DDRYPGRA

SEQ ID NO: 2252583 - protein, 5 aa, Cryptosporidium parvum
DDSEN

SEQ ID NO: 2252584 - protein, 6 aa, Cryptosporidium parvum
DDSETL

SEQ ID NO: 2252585 - protein, 9 aa, Cryptosporidium parvum
DDSFEEVDE

SEQ ID NO: 2252586 - protein, 12 aa, Cryptosporidium parvum
DDSFQNEDEEIN

SEQ ID NO: 2252587 - protein, 6 aa, Cryptosporidium parvum
DDSFTD

SEQ ID NO: 2252588 - protein, 13 aa, Cryptosporidium parvum
DDSGDEEASKNLG

SEQ ID NO: 2252589 - protein, 6 aa, Cryptosporidium parvum
DDSHDN

SEQ ID NO: 2252590 - protein, 23 aa, Cryptosporidium parvum
DDSIEDSDQDELNKDLNTTPKNV

SEQ ID NO: 2252591 - protein, 4 aa, Cryptosporidium parvum
DDSK

SEQ ID NO: 2252592 - protein, 10 aa, Cryptosporidium parvum
DDSKTARVEI

SEQ ID NO: 2252593 - protein, 6 aa, Cryptosporidium parvum
DDSKYI

SEQ ID NO: 2252594 - protein, 8 aa, Cryptosporidium parvum
DDSNIGGQ

SEQ ID NO: 2252595 - protein, 11 aa, Cryptosporidium parvum
DDSNNNNQNSD

SEQ ID NO: 2252596 - protein, 14 aa, Cryptosporidium parvum
DDSNNPQDDDRLGD

SEQ ID NO: 2252597 - protein, 15 aa, Cryptosporidium parvum
DDSNSNNNNNNNNHN

SEQ ID NO: 2252598 - protein, 9 aa, Cryptosporidium parvum
DDSPMSDTS

SEQ ID NO: 2252599 - protein, 5 aa, Cryptosporidium parvum
DDSQI

SEQ ID NO: 2252600 - protein, 5 aa, Cryptosporidium parvum
DDSSD

SEQ ID NO: 2252601 - protein, 9 aa, Cryptosporidium parvum
DDSSKKVDD

SEQ ID NO: 2252602 - protein, 6 aa, Cryptosporidium parvum
DDSTGK

SEQ ID NO: 2252603 - protein, 8 aa, Cryptosporidium parvum
DDSTPYRK

SEQ ID NO: 2252604 - protein, 6 aa, Cryptosporidium parvum
DDSTRN

SEQ ID NO: 2252605 - protein, 5 aa, Cryptosporidium parvum
DDSVN

SEQ ID NO: 2252606 - protein, 10 aa, Cryptosporidium parvum
DDSYKDETDR

SEQ ID NO: 2252607 - protein, 4 aa, Cryptosporidium parvum
DDTC

SEQ ID NO: 2252608 - protein, 14 aa, Cryptosporidium parvum
DDTEGGDEEETSVH

SEQ ID NO: 2252609 - protein, 8 aa, Cryptosporidium parvum
DDTENDDI

SEQ ID NO: 2252610 - protein, 6 aa, Cryptosporidium parvum
DDTFAD

SEQ ID NO: 2252611 - protein, 9 aa, Cryptosporidium parvum
DDTGSSYSN

SEQ ID NO: 2252612 - protein, 34 aa, Cryptosporidium parvum; identical to SEQ ID NO: 2137199

SEQ ID NO: 2252613 - protein, 6 aa, Cryptosporidium parvum
DDTINT

SEQ ID NO: 2252614 - protein, 6 aa, Cryptosporidium parvum
DDTKKA

SEQ ID NO: 2252615 - protein, 12 aa, Cryptosporidium parvum
DDTLKQSNKNKF

SEQ ID NO: 2252616 - protein, 7 aa, Cryptosporidium parvum
DDTNKQS

SEQ ID NO: 2252617 - protein, 5 aa, Cryptosporidium parvum
DDTNN

SEQ ID NO: 2252618 - protein, 9 aa, Cryptosporidium parvum
DDTVSSGGA

SEQ ID NO: 2252619 - protein, 8 aa, Cryptosporidium parvum
DDVDSNSD

SEQ ID NO: 2252620 - protein, 8 aa, Cryptosporidium parvum
DDYDENSA

SEQ ID NO: 2252621 - protein, 59 aa, Cryptosporidium parvum
DDYDSSDDSEGEDQYEEEGEEDDSDEDEDESNTKDWGNKKQDFYDGGSSSTDSEGENWS

SEQ ID NO: 2252622 - protein, 9 aa, Cryptosporidium parvum
DDYLETDSV

SEQ ID NO: 2252623 - protein, 7 aa, Cryptosporidium parvum
DDYNSNE

SEQ ID NO: 2252624 - protein, 8 aa, Cryptosporidium parvum
DEAARGGA

SEQ ID NO: 2252625 - protein, 44 aa, Cryptosporidium parvum
DEADLNNQDEPNVGLSGSSRANSDVGGGSGNGGSGSGGSLFSGT

SEQ ID NO: 2252626 - protein, 10 aa, Cryptosporidium parvum
DEAEQEYEKR

SEQ ID NO: 2252627 - protein, 20 aa, Cryptosporidium parvum
DEAESQVKENLAKASEIDDE

SEQ ID NO: 2252628 - protein, 4 aa, Cryptosporidium parvum
DEAN

SEQ ID NO: 2252629 - protein, 4 aa, Cryptosporidium parvum
DEAQ

SEQ ID NO: 2252630 - protein, 22 aa, Cryptosporidium parvum
DEAQKTPSNKDVRNSPSEDATE

SEQ ID NO: 2252631 - protein, 4 aa, Cryptosporidium parvum
DEAR

SEQ ID NO: 2252632 - protein, 6 aa, Cryptosporidium parvum
DEASQF

SEQ ID NO: 2252633 - protein, 9 aa, Cryptosporidium parvum
DEATEEFET

SEQ ID NO: 2252634 - protein, 8 aa, Cryptosporidium parvum
DEATKQEI

SEQ ID NO: 2252635 - protein, 6 aa, Cryptosporidium parvum
DEAWND

SEQ ID NO: 2252636 - protein, 16 aa, Cryptosporidium parvum
DEDDEKKDNEEKPTIS

SEQ ID NO: 2252637 - protein, 14 aa, Cryptosporidium parvum
DEDEELERIKDIQV

SEQ ID NO: 2252638 - protein, 39 aa, Cryptosporidium parvum
DEDESDSESESSSESNSDTDSDSEDDRSNKISNRSNKKN

SEQ ID NO: 2252639 - protein, 7 aa, Cryptosporidium parvum
DEDFNKK

SEQ ID NO: 2252640 - protein, 5 aa, Cryptosporidium parvum
DEDGK

SEQ ID NO: 2252641 - protein, 7 aa, Cryptosporidium parvum
DEDGKLS

SEQ ID NO: 2252642 - protein, 7 aa, Cryptosporidium parvum
DEDGPSL

SEQ ID NO: 2252643 - protein, 21 aa, Cryptosporidium parvum
DEDHSSSTQRVEQENSSHPAF

SEQ ID NO: 2252644 - protein, 14 aa, Cryptosporidium parvum
DEDISGELLLTSCS

SEQ ID NO: 2252645 - protein, 14 aa, Cryptosporidium parvum
DEDISRSNIDTMGS

SEQ ID NO: 2252646 - protein, 32 aa, Cryptosporidium parvum
DEDNDNSDIEENEISKHDLGDEFDESTNIDSD

SEQ ID NO: 2252647 - protein, 9 aa, Cryptosporidium parvum
DEDQMEDSE

SEQ ID NO: 2252648 - protein, 6 aa, Cryptosporidium parvum
DEDSGQ

SEQ ID NO: 2252649 - protein, 7 aa, Cryptosporidium parvum
DEDTERS

SEQ ID NO: 2252650 - protein, 9 aa, Cryptosporidium parvum
DEDTSSKRE

SEQ ID NO: 2252651 - protein, 7 aa, Cryptosporidium parvum
DEDWKPS

SEQ ID NO: 2252652 - protein, 9 aa, Cryptosporidium parvum
DEEAAKECD

SEQ ID NO: 2252653 - protein, 12 aa, Cryptosporidium parvum
DEEDEPELKLLH

SEQ ID NO: 2252654 - protein, 37 aa, Cryptosporidium parvum
DEEEEEEEGVEEEGVEEEEVEGEEDKDEEKNDQKNDL

SEQ ID NO: 2252655 - protein, 6 aa, Cryptosporidium parvum
DEEEEY

SEQ ID NO: 2252656 - protein, 26 aa, Cryptosporidium parvum
DEEENDEDDNQDKYKKRNKIKDNYLE

SEQ ID NO: 2252657 - protein, 6 aa, Cryptosporidium parvum
DEEEYQ

SEQ ID NO: 2252658 - protein, 9 aa, Cryptosporidium parvum
DEEFTDGDL

SEQ ID NO: 2252659 - protein, 5 aa, Cryptosporidium parvum
DEEGA

SEQ ID NO: 2252660 - protein, 14 aa, Cryptosporidium parvum
DEEGGIATDEHNID

SEQ ID NO: 2252661 - protein, 5 aa, Cryptosporidium parvum
DEEGI

SEQ ID NO: 2252662 - protein, 6 aa, Cryptosporidium parvum
DEEGNN

SEQ ID NO: 2252663 - protein, 8 aa, Cryptosporidium parvum
DEEGRPSI

SEQ ID NO: 2252664 - protein, 10 aa, Cryptosporidium parvum
DEEHKSNEVY

SEQ ID NO: 2252665 - protein, 5 aa, Cryptosporidium parvum
DEEIK

SEQ ID NO: 2252666 - protein, 6 aa, Cryptosporidium parvum
DEEKEF

SEQ ID NO: 2252667 - protein, 8 aa, Cryptosporidium parvum
DEEKNRED

SEQ ID NO: 2252668 - protein, 6 aa, Cryptosporidium parvum
DEELEE

SEQ ID NO: 2252669 - protein, 8 aa, Cryptosporidium parvum
DEELNKAR

SEQ ID NO: 2252670 - protein, 10 aa, Cryptosporidium parvum
DEENCDQSKL

SEQ ID NO: 2252671 - protein, 10 aa, Cryptosporidium parvum
DEENENTNSI

SEQ ID NO: 2252672 - protein, 35 aa, Cryptosporidium parvum
DEEREEIGEGAMTGVEEKRKLKKNMRDGSGLGVEG

SEQ ID NO: 2252673 - protein, 16 aa, Cryptosporidium parvum
DEESKEESKLELSSTS

SEQ ID NO: 2252674 - protein, 6 aa, Cryptosporidium parvum
DEESSI

SEQ ID NO: 2252675 - protein, 6 aa, Cryptosporidium parvum
DEESTS

SEQ ID NO: 2252676 - protein, 5 aa, Cryptosporidium parvum
DEFGT

SEQ ID NO: 2252677 - protein, 8 aa, Cryptosporidium parvum
DEFKDNDN

SEQ ID NO: 2252678 - protein, 9 aa, Cryptosporidium parvum
DEFNDSNTN

SEQ ID NO: 2252679 - protein, 5 aa, Cryptosporidium parvum
DEFRN

SEQ ID NO: 2252680 - protein, 5 aa, Cryptosporidium parvum
DEFSP

SEQ ID NO: 2252681 - protein, 10 aa, Cryptosporidium parvum
DEFSTRRPES

SEQ ID NO: 2252682 - protein, 36 aa, Cryptosporidium parvum
DEFYESRRRSSAQNISSTLESTNQAGTQVEARNGIQ

SEQ ID NO: 2252683 - protein, 9 aa, Cryptosporidium parvum
DEGARQKAI

SEQ ID NO: 2252684 - protein, 8 aa, Cryptosporidium parvum
DEGDSREK

SEQ ID NO: 2252685 - protein, 4 aa, Cryptosporidium parvum
DEGE

SEQ ID NO: 2252686 - protein, 6 aa, Cryptosporidium parvum
DEGELT

SEQ ID NO: 2252687 - protein, 4 aa, Cryptosporidium parvum
DEGF

SEQ ID NO: 2252688 - protein, 9 aa, Cryptosporidium parvum
DEGGRNGRD

SEQ ID NO: 2252689 - protein, 14 aa, Cryptosporidium parvum
DEGINKNKNADRVE

SEQ ID NO: 2252690 - protein, 15 aa, Cryptosporidium parvum
DEGKNKDISAKEKDY

SEQ ID NO: 2252691 - protein, 6 aa, Cryptosporidium parvum
DEGKSK

SEQ ID NO: 2252692 - protein, 6 aa, Cryptosporidium parvum
DEGKTI

SEQ ID NO: 2252693 - protein, 4 aa, Cryptosporidium parvum
DEGL

SEQ ID NO: 2252694 - protein, 6 aa, Cryptosporidium parvum
DEGNSK

SEQ ID NO: 2252695 - protein, 14 aa, Cryptosporidium parvum
DEGPGTINEDNKCE

SEQ ID NO: 2252696 - protein, 7 aa, Cryptosporidium parvum
DEGPPQP

SEQ ID NO: 2252697 - protein, 4 aa, Cryptosporidium parvum
DEGR

SEQ ID NO: 2252698 - protein, 5 aa, Cryptosporidium parvum
DEGRN

SEQ ID NO: 2252699 - protein, 13 aa, Cryptosporidium parvum
DEGRQIPTEYKNV

SEQ ID NO: 2252700 - protein, 5 aa, Cryptosporidium parvum
DEGRR

SEQ ID NO: 2252701 - protein, 5 aa, Cryptosporidium parvum
DEGSI

SEQ ID NO: 2252702 - protein, 9 aa, Cryptosporidium parvum
DEGSISESQ

SEQ ID NO: 2252703 - protein, 14 aa, Cryptosporidium parvum
DEGSLKSKVDSSNS

SEQ ID NO: 2252704 - protein, 7 aa, Cryptosporidium parvum
DEGVATG

SEQ ID NO: 2252705 - protein, 8 aa, Cryptosporidium parvum
DEGYNTRN

SEQ ID NO: 2252706 - protein, 13 aa, Cryptosporidium parvum
DEHENQKSKEKPC

SEQ ID NO: 2252707 - protein, 20 aa, Cryptosporidium parvum
DEHEQTKSELKKAKEQSSEF

SEQ ID NO: 2252708 - protein, 11 aa, Cryptosporidium parvum
DEHNNTSPSTS

SEQ ID NO: 2252709 - protein, 13 aa, Cryptosporidium parvum
DEHNQEDKPPKQD

SEQ ID NO: 2252710 - protein, 13 aa, Cryptosporidium parvum
DEHSIQSTGTDYC

SEQ ID NO: 2252711 - protein, 9 aa, Cryptosporidium parvum
DEHSNENQN

SEQ ID NO: 2252712 - protein, 6 aa, Cryptosporidium parvum
DEHSRQ

SEQ ID NO: 2252713 - protein, 5 aa, Cryptosporidium parvum
DEIDL

SEQ ID NO: 2252714 - protein, 5 aa, Cryptosporidium parvum
DEIDT

SEQ ID NO: 2252715 - protein, 6 aa, Cryptosporidium parvum
DEIEQE

SEQ ID NO: 2252716 - protein, 8 aa, Cryptosporidium parvum
DEIESEEE

SEQ ID NO: 2252717 - protein, 26 aa, Cryptosporidium parvum
DEIKSDIEENSNSNSNNNNNNNNNGI

SEQ ID NO: 2252718 - protein, 4 aa, Cryptosporidium parvum
DEIP

SEQ ID NO: 2252719 - protein, 4 aa, Cryptosporidium parvum
DEIQ

SEQ ID NO: 2252720 - protein, 8 aa, Cryptosporidium parvum
DEIRSEND

SEQ ID NO: 2252721 - protein, 13 aa, Cryptosporidium parvum
DEISKLNSKPREI

SEQ ID NO: 2252722 - protein, 12 aa, Cryptosporidium parvum
DEISPNVKHDEP

SEQ ID NO: 2252723 - protein, 4 aa, Cryptosporidium parvum
DEIT

SEQ ID NO: 2252724 - protein, 9 aa, Cryptosporidium parvum
DEITNNNAE

SEQ ID NO: 2252725 - protein, 4 aa, Cryptosporidium parvum
DEKA

SEQ ID NO: 2252726 - protein, 11 aa, Cryptosporidium parvum
DEKAPEKQQEV

SEQ ID NO: 2252727 - protein, 4 aa, Cryptosporidium parvum
DEKD

SEQ ID NO: 2252728 - protein, 8 aa, Cryptosporidium parvum
DEKELRRQ

SEQ ID NO: 2252729 - protein, 14 aa, Cryptosporidium parvum
DEKEPVSDKPRSVQ

SEQ ID NO: 2252730 - protein, 7 aa, Cryptosporidium parvum
DEKERNI

SEQ ID NO: 2252731 - protein, 5 aa, Cryptosporidium parvum
DEKGF

SEQ ID NO: 2252732 - protein, 6 aa, Cryptosporidium parvum
DEKLKH

SEQ ID NO: 2252733 - protein, 9 aa, Cryptosporidium parvum
DEKLSYESP

SEQ ID NO: 2252734 - protein, 17 aa, Cryptosporidium parvum
DEKNEFKSKTNLKGINS

SEQ ID NO: 2252735 - protein, 55 aa, Cryptosporidium parvum
DEKNEQEEKDNKDHFQETNKKEETEENIQTKKEKVQDIKSEVGSPKNSRESLEEL

SEQ ID NO: 2252736 - protein, 5 aa, Cryptosporidium parvum
DEKNK

SEQ ID NO: 2252737 - protein, 7 aa, Cryptosporidium parvum
DEKNKEN

SEQ ID NO: 2252738 - protein, 6 aa, Cryptosporidium parvum
DEKNNK

SEQ ID NO: 2252739 - protein, 6 aa, Cryptosporidium parvum
DEKPIV

SEQ ID NO: 2252740 - protein, 5 aa, Cryptosporidium parvum
DEKRA

SEQ ID NO: 2252741 - protein, 8 aa, Cryptosporidium parvum
DEKRQAIQ

SEQ ID NO: 2252742 - protein, 10 aa, Cryptosporidium parvum
DEKSEDITKE

SEQ ID NO: 2252743 - protein, 18 aa, Cryptosporidium parvum
DEKSGTKVERDEKKSVEV

SEQ ID NO: 2252744 - protein, 6 aa, Cryptosporidium parvum
DEKSQK

SEQ ID NO: 2252745 - protein, 26 aa, Cryptosporidium parvum
DEKTESDKEGNIKEREANENSEEETN

SEQ ID NO: 2252746 - protein, 14 aa, Cryptosporidium parvum
DEKTLRNVSSDLKA

SEQ ID NO: 2252747 - protein, 8 aa, Cryptosporidium parvum
DEKTNSFD

SEQ ID NO: 2252748 - protein, 4 aa, Cryptosporidium parvum
DELA

SEQ ID NO: 2252749 - protein, 4 aa, Cryptosporidium parvum
DELE

SEQ ID NO: 2252750 - protein, 12 aa, Cryptosporidium parvum
DELEAKKTEFEV

SEQ ID NO: 2252751 - protein, 8 aa, Cryptosporidium parvum
DELEEGEA

SEQ ID NO: 2252752 - protein, 14 aa, Cryptosporidium parvum
DELENLQNKSNFRP

SEQ ID NO: 2252753 - protein, 25 aa, Cryptosporidium parvum
DELETYNTDNSLTRDSSGSSTESTG

SEQ ID NO: 2252754 - protein, 18 aa, Cryptosporidium parvum
DELGNKSNDLISKETKNA

SEQ ID NO: 2252755 - protein, 5 aa, Cryptosporidium parvum
DELKD

SEQ ID NO: 2252756 - protein, 7 aa, Cryptosporidium parvum
DELKETV

SEQ ID NO: 2252757 - protein, 4 aa, Cryptosporidium parvum
DELN

SEQ ID NO: 2252758 - protein, 8 aa, Cryptosporidium parvum
DELNNDAS

SEQ ID NO: 2252759 - protein, 8 aa, Cryptosporidium parvum
DELPNTGL

SEQ ID NO: 2252760 - protein, 5 aa, Cryptosporidium parvum
DELQR

SEQ ID NO: 2252761 - protein, 11 aa, Cryptosporidium parvum
DELRNNEKIET

SEQ ID NO: 2252762 - protein, 19 aa, Cryptosporidium parvum
DELSSKSEEIQKMTESSKR

SEQ ID NO: 2252763 - protein, 5 aa, Cryptosporidium parvum
DEMEE

SEQ ID NO: 2252764 - protein, 9 aa, Cryptosporidium parvum
DENAGLNRE

SEQ ID NO: 2252765 - protein, 17 aa, Cryptosporidium parvum
DENDFKSNDLKKEMNDQ

SEQ ID NO: 2252766 - protein, 11 aa, Cryptosporidium parvum
DENGQFGTGGL

SEQ ID NO: 2252767 - protein, 10 aa, Cryptosporidium parvum
DENGVTRSSR

SEQ ID NO: 2252768 - protein, 7 aa, Cryptosporidium parvum
DENIENE

SEQ ID NO: 2252769 - protein, 10 aa, Cryptosporidium parvum
DENKAKKFAK

SEQ ID NO: 2252770 - protein, 5 aa, Cryptosporidium parvum
DENKQ

SEQ ID NO: 2252771 - protein, 18 aa, Cryptosporidium parvum
DENKYKEKLSDERLNDNS

SEQ ID NO: 2252772 - protein, 8 aa, Cryptosporidium parvum
DENLGNSN

SEQ ID NO: 2252773 - protein, 4 aa, Cryptosporidium parvum
DENM

SEQ ID NO: 2252774 - protein, 4 aa, Cryptosporidium parvum
DENN

SEQ ID NO: 2252775 - protein, 7 aa, Cryptosporidium parvum
DENNEFD

SEQ ID NO: 2252776 - protein, 14 aa, Cryptosporidium parvum
DENNINTERENKAD

SEQ ID NO: 2252777 - protein, 9 aa, Cryptosporidium parvum
DENNNIGNS

SEQ ID NO: 2252778 - protein, 6 aa, Cryptosporidium parvum
DENNPR

SEQ ID NO: 2252779 - protein, 21 aa, Cryptosporidium parvum
DENNSIESFQNKDGQDPEQYR

SEQ ID NO: 2252780 - protein, 6 aa, Cryptosporidium parvum
DENNSN

SEQ ID NO: 2252781 - protein, 4 aa, Cryptosporidium parvum
DENP

SEQ ID NO: 2252782 - protein, 9 aa, Cryptosporidium parvum
DENQKKRKE

SEQ ID NO: 2252783 - protein, 8 aa, Cryptosporidium parvum
DENQPQNI

SEQ ID NO: 2252784 - protein, 6 aa, Cryptosporidium parvum
DENSSI

SEQ ID NO: 2252785 - protein, 33 aa, Cryptosporidium parvum; identical to SEQ ID NO: 2137358

SEQ ID NO: 2252786 - protein, 15 aa, Cryptosporidium parvum
DENTKDSNGGLNKQI

SEQ ID NO: 2252787 - protein, 5 aa, Cryptosporidium parvum
DENTW

SEQ ID NO: 2252788 - protein, 4 aa, Cryptosporidium parvum
DENY

SEQ ID NO: 2252789 - protein, 8 aa, Cryptosporidium parvum
DENYENNY

SEQ ID NO: 2252790 - protein, 9 aa, Cryptosporidium parvum
DEPDGHNDQ

SEQ ID NO: 2252791 - protein, 7 aa, Cryptosporidium parvum
DEPEKWS

SEQ ID NO: 2252792 - protein, 6 aa, Cryptosporidium parvum
DEPEKY

SEQ ID NO: 2252793 - protein, 8 aa, Cryptosporidium parvum
DEPKRQST

SEQ ID NO: 2252794 - protein, 22 aa, Cryptosporidium parvum
DEPLGNNNIGDKVNNYKGNNLS

SEQ ID NO: 2252795 - protein, 6 aa, Cryptosporidium parvum
DEPSED

SEQ ID NO: 2252796 - protein, 17 aa, Cryptosporidium parvum
DEPSSSDETQESNTNSI

SEQ ID NO: 2252797 - protein, 8 aa, Cryptosporidium parvum
DEQAGELP

SEQ ID NO: 2252798 - protein, 18 aa, Cryptosporidium parvum
DEQDKITKLSSSNDLYNN

SEQ ID NO: 2252799 - protein, 18 aa, Cryptosporidium parvum
DEQDNSEMFQDDDEIQEI

SEQ ID NO: 2252800 - protein, 12 aa, Cryptosporidium parvum
DEQDSSVNDQTN

SEQ ID NO: 2252801 - protein, 6 aa, Cryptosporidium parvum
DEQGKG

SEQ ID NO: 2252802 - protein, 5 aa, Cryptosporidium parvum
DEQIQ

SEQ ID NO: 2252803 - protein, 27 aa, Cryptosporidium parvum
DEQRHQEQFNSEAPKVQSSGNEYSVPT

SEQ ID NO: 2252804 - protein, 5 aa, Cryptosporidium parvum
DERAL

SEQ ID NO: 2252805 - protein, 13 aa, Cryptosporidium parvum
DEREASRKQVNTT

SEQ ID NO: 2252806 - protein, 7 aa, Cryptosporidium parvum
DERFGGD

SEQ ID NO: 2252807 - protein, 8 aa, Cryptosporidium parvum
DERGPSVE

SEQ ID NO: 2252808 - protein, 7 aa, Cryptosporidium parvum
DERKGNL

SEQ ID NO: 2252809 - protein, 4 aa, Cryptosporidium parvum
DERL

SEQ ID NO: 2252810 - protein, 10 aa, Cryptosporidium parvum
DERNSESGSC

SEQ ID NO: 2252811 - protein, 51 aa, Cryptosporidium parvum
DERQNTSNESSSSSNYVQNKGNTLGSSITTVSGSISVSGSGSGSGSGSSSR

SEQ ID NO: 2252812 - protein, 7 aa, Cryptosporidium parvum
DERSNPV

SEQ ID NO: 2252813 - protein, 6 aa, Cryptosporidium parvum
DERSQN

SEQ ID NO: 2252814 - protein, 12 aa, Cryptosporidium parvum
DERSVGENGEIQ

SEQ ID NO: 2252815 - protein, 6 aa, Cryptosporidium parvum
DERTHR

SEQ ID NO: 2252816 - protein, 15 aa, Cryptosporidium parvum
DERTSNVISKGKKTA

SEQ ID NO: 2252817 - protein, 7 aa, Cryptosporidium parvum
DESAGSF

SEQ ID NO: 2252818 - protein, 11 aa, Cryptosporidium parvum
DESDPTSSKPW

SEQ ID NO: 2252819 - protein, 8 aa, Cryptosporidium parvum
DESEPNLP

SEQ ID NO: 2252820 - protein, 8 aa, Cryptosporidium parvum
DESGGFGG

SEQ ID NO: 2252821 - protein, 12 aa, Cryptosporidium parvum
DESGRERTNPNN

SEQ ID NO: 2252822 - protein, 4 aa, Cryptosporidium parvum
DESI

SEQ ID NO: 2252823 - protein, 6 aa, Cryptosporidium parvum
DESINN

SEQ ID NO: 2252824 - protein, 11 aa, Cryptosporidium parvum
DESIRLGSNGD

SEQ ID NO: 2252825 - protein, 5 aa, Cryptosporidium parvum
DESKN

SEQ ID NO: 2252826 - protein, 7 aa, Cryptosporidium parvum
DESNFKT

SEQ ID NO: 2252827 - protein, 14 aa, Cryptosporidium parvum
DESPNNTRYGVQGS

SEQ ID NO: 2252828 - protein, 4 aa, Cryptosporidium parvum
DESR

SEQ ID NO: 2252829 - protein, 7 aa, Cryptosporidium parvum
DESRPIY

SEQ ID NO: 2252830 - protein, 23 aa, Cryptosporidium parvum
DESSFNGIDETREVQKYERPVGN

SEQ ID NO: 2252831 - protein, 10 aa, Cryptosporidium parvum
DESSHTRSSS

SEQ ID NO: 2252832 - protein, 4 aa, Cryptosporidium parvum
DEST

SEQ ID NO: 2252833 - protein, 5 aa, Cryptosporidium parvum
DESVD

SEQ ID NO: 2252834 - protein, 8 aa, Cryptosporidium parvum
DESVDESI

SEQ ID NO: 2252835 - protein, 7 aa, Cryptosporidium parvum
DESVDSK

SEQ ID NO: 2252836 - protein, 9 aa, Cryptosporidium parvum
DESVENEDT

SEQ ID NO: 2252837 - protein, 13 aa, Cryptosporidium parvum
DESWKSRKPEVRK

SEQ ID NO: 2252838 - protein, 6 aa, Cryptosporidium parvum
DETDKK

SEQ ID NO: 2252839 - protein, 5 aa, Cryptosporidium parvum
DETDN

SEQ ID NO: 2252840 - protein, 15 aa, Cryptosporidium parvum
DETDRGERGLGSTGL

SEQ ID NO: 2252841 - protein, 9 aa, Cryptosporidium parvum
DETESNKSK

SEQ ID NO: 2252842 - protein, 7 aa, Cryptosporidium parvum
DETGDTP

SEQ ID NO: 2252843 - protein, 23 aa, Cryptosporidium parvum
DETKISGKAINDKSYVDSSPISY

SEQ ID NO: 2252844 - protein, 10 aa, Cryptosporidium parvum
DETKPLDSKI

SEQ ID NO: 2252845 - protein, 11 aa, Cryptosporidium parvum
DETKSKSNPRY

SEQ ID NO: 2252846 - protein, 7 aa, Cryptosporidium parvum
DETKSSK

SEQ ID NO: 2252847 - protein, 7 aa, Cryptosporidium parvum
DETNKKI

SEQ ID NO: 2252848 - protein, 14 aa, Cryptosporidium parvum
DETNKNVSSHSKSA

SEQ ID NO: 2252849 - protein, 6 aa, Cryptosporidium parvum
DETNQI

SEQ ID NO: 2252850 - protein, 7 aa, Cryptosporidium parvum
DETPESL

SEQ ID NO: 2252851 - protein, 4 aa, Cryptosporidium parvum
DETQ

SEQ ID NO: 2252852 - protein, 11 aa, Cryptosporidium parvum
DETQAEAAHRE

SEQ ID NO: 2252853 - protein, 21 aa, Cryptosporidium parvum
DETSKENSTINSIENTIVMQH

SEQ ID NO: 2252854 - protein, 6 aa, Cryptosporidium parvum
DETSNQ

SEQ ID NO: 2252855 - protein, 14 aa, Cryptosporidium parvum
DETSPYEDDYDPFS

SEQ ID NO: 2252856 - protein, 8 aa, Cryptosporidium parvum
DETSYPDE

SEQ ID NO: 2252857 - protein, 4 aa, Cryptosporidium parvum
DETT

SEQ ID NO: 2252858 - protein, 16 aa, Cryptosporidium parvum
DETTFGASSDKTRTNV

SEQ ID NO: 2252859 - protein, 5 aa, Cryptosporidium parvum
DETTR

SEQ ID NO: 2252860 - protein, 13 aa, Cryptosporidium parvum
DETTSKGPPHIPA

SEQ ID NO: 2252861 - protein, 11 aa, Cryptosporidium parvum
DEVAGKNKGIV

SEQ ID NO: 2252862 - protein, 39 aa, Cryptosporidium parvum
DEVDENGNYNENLESKDEVHNYNQKGMQGHARAGTGGNG

SEQ ID NO: 2252863 - protein, 7 aa, Cryptosporidium parvum
DEVDTVR

SEQ ID NO: 2252864 - protein, 11 aa, Cryptosporidium parvum
DEVENNQINDD

SEQ ID NO: 2252865 - protein, 19 aa, Cryptosporidium parvum
DEVERKSNVDNEDLDNSYN

SEQ ID NO: 2252866 - protein, 4 aa, Cryptosporidium parvum
DEVN

SEQ ID NO: 2252867 - protein, 12 aa, Cryptosporidium parvum
DEVNKNKRAVSK

SEQ ID NO: 2252868 - protein, 10 aa, Cryptosporidium parvum
DEVNQKTKLN

SEQ ID NO: 2252869 - protein, 11 aa, Cryptosporidium parvum
DEVQDSEKTKI

SEQ ID NO: 2252870 - protein, 6 aa, Cryptosporidium parvum
DEVQEQ

SEQ ID NO: 2252871 - protein, 14 aa, Cryptosporidium parvum
DEVRKKQKQLPKIS

SEQ ID NO: 2252872 - protein, 9 aa, Cryptosporidium parvum
DEVSKTSKD

SEQ ID NO: 2252873 - protein, 5 aa, Cryptosporidium parvum
DEVYK

SEQ ID NO: 2252874 - protein, 34 aa, Cryptosporidium parvum
DEWDDEPKSSKKKNSNSNSKKKKLGQNGNGSSSS

SEQ ID NO: 2252875 - protein, 5 aa, Cryptosporidium parvum
DEWPE

SEQ ID NO: 2252876 - protein, 4 aa, Cryptosporidium parvum
DEYA

SEQ ID NO: 2252877 - protein, 18 aa, Cryptosporidium parvum
DEYDEDGDEEEEEEEENV

SEQ ID NO: 2252878 - protein, 21 aa, Cryptosporidium parvum
DEYEGRSNSIREENEDSQIEE

SEQ ID NO: 2252879 - protein, 8 aa, Cryptosporidium parvum
DEYETESE

SEQ ID NO: 2252880 - protein, 18 aa, Cryptosporidium parvum
DEYGEEGLEGGGGGADPV

SEQ ID NO: 2252881 - protein, 4 aa, Cryptosporidium parvum
DEYK

SEQ ID NO: 2252882 - protein, 6 aa, Cryptosporidium parvum
DEYNSS

SEQ ID NO: 2252883 - protein, 12 aa, Cryptosporidium parvum
DEYSETQQESNH

SEQ ID NO: 2252884 - protein, 19 aa, Cryptosporidium parvum
DEYSNHSISNTEKTALGNN

SEQ ID NO: 2252885 - protein, 5 aa, Cryptosporidium parvum
DEYTR

SEQ ID NO: 2252886 - protein, 7 aa, Cryptosporidium parvum
DEYTSLQ

SEQ ID NO: 2252887 - protein, 9 aa, Cryptosporidium parvum
DEYYDSNDN

SEQ ID NO: 2252888 - protein, 12 aa, Cryptosporidium parvum
DFDDEDDELDDF

SEQ ID NO: 2252889 - protein, 5 aa, Cryptosporidium parvum
DFDES

SEQ ID NO: 2252890 - protein, 5 aa, Cryptosporidium parvum
DFDGD

SEQ ID NO: 2252891 - protein, 5 aa, Cryptosporidium parvum
DFDGE

SEQ ID NO: 2252892 - protein, 5 aa, Cryptosporidium parvum
DFEEG

SEQ ID NO: 2252893 - protein, 11 aa, Cryptosporidium parvum
DFEKSNIKKKY

SEQ ID NO: 2252894 - protein, 10 aa, Cryptosporidium parvum
DFERAVSESR

SEQ ID NO: 2252895 - protein, 4 aa, Cryptosporidium parvum
DFES

SEQ ID NO: 2252896 - protein, 5 aa, Cryptosporidium parvum
DFESS

SEQ ID NO: 2252897 - protein, 7 aa, Cryptosporidium parvum
DFGDKSK

SEQ ID NO: 2252898 - protein, 5 aa, Cryptosporidium parvum
DFGND

SEQ ID NO: 2252899 - protein, 5 aa, Cryptosporidium parvum
DFGSP

SEQ ID NO: 2252900 - protein, 11 aa, Cryptosporidium parvum
DFHCSESETEE

SEQ ID NO: 2252901 - protein, 4 aa, Cryptosporidium parvum
DFKG

SEQ ID NO: 2252902 - protein, 6 aa, Cryptosporidium parvum
DFKNEL

SEQ ID NO: 2252903 - protein, 10 aa, Cryptosporidium parvum
DFKNKSKNNL

SEQ ID NO: 2252904 - protein, 5 aa, Cryptosporidium parvum
DFKQN

SEQ ID NO: 2252905 - protein, 5 aa, Cryptosporidium parvum
DFKSG

SEQ ID NO: 2252906 - protein, 23 aa, Cryptosporidium parvum
DFLQESNDDLKKATTSQSKVENV

SEQ ID NO: 2252907 - protein, 15 aa, Cryptosporidium parvum
DFNKGSNSNHKSNEN

SEQ ID NO: 2252908 - protein, 8 aa, Cryptosporidium parvum
DFNPANGR

SEQ ID NO: 2252909 - protein, 12 aa, Cryptosporidium parvum
DFNSESSIGNHH

SEQ ID NO: 2252910 - protein, 28 aa, Cryptosporidium parvum
DFNSPRSSPVRSQTKSATVTGTKPARQI

SEQ ID NO: 2252911 - protein, 17 aa, Cryptosporidium parvum
DFNTQKVETREFEPEQR

SEQ ID NO: 2252912 - protein, 10 aa, Cryptosporidium parvum
DFPDSNEFSN

SEQ ID NO: 2252913 - protein, 7 aa, Cryptosporidium parvum
DFPEPSK

SEQ ID NO: 2252914 - protein, 4 aa, Cryptosporidium parvum
DFPK

SEQ ID NO: 2252915 - protein, 8 aa, Cryptosporidium parvum
DFPNSPPK

SEQ ID NO: 2252916 - protein, 7 aa, Cryptosporidium parvum
DFPPGMS

SEQ ID NO: 2252917 - protein, 17 aa, Cryptosporidium parvum
DFQESKPNLKEEKKEKM

SEQ ID NO: 2252918 - protein, 7 aa, Cryptosporidium parvum
DFRGGGS

SEQ ID NO: 2252919 - protein, 16 aa, Cryptosporidium parvum
DFSEENDTEKQEEKLP

SEQ ID NO: 2252920 - protein, 9 aa, Cryptosporidium parvum
DFSEGGGLK

SEQ ID NO: 2252921 - protein, 7 aa, Cryptosporidium parvum
DFSEGKA

SEQ ID NO: 2252922 - protein, 14 aa, Cryptosporidium parvum
DFSESKDKHSGQSN

SEQ ID NO: 2252923 - protein, 35 aa, Cryptosporidium parvum
DFSKNNKDSIDVTDPCSSENSEIKNERNEINNDQS

SEQ ID NO: 2252924 - protein, 11 aa, Cryptosporidium parvum
DFSNDKYELGY

SEQ ID NO: 2252925 - protein, 6 aa, Cryptosporidium parvum
DFSNEG

SEQ ID NO: 2252926 - protein, 5 aa, Cryptosporidium parvum
DFSSN

SEQ ID NO: 2252927 - protein, 21 aa, Cryptosporidium parvum
DFSSNEEEDNDLKNQNDIKDQ

SEQ ID NO: 2252928 - protein, 6 aa, Cryptosporidium parvum
DFTGAK

SEQ ID NO: 2252929 - protein, 14 aa, Cryptosporidium parvum
DFTRGDGTGGESIY

SEQ ID NO: 2252930 - protein, 16 aa, Cryptosporidium parvum
DFYNNETLDKLEWIDY

SEQ ID NO: 2252931 - protein, 7 aa, Cryptosporidium parvum
DGAFGGV

SEQ ID NO: 2252932 - protein, 9 aa, Cryptosporidium parvum
DGAKSQVRK

SEQ ID NO: 2252933 - protein, 11 aa, Cryptosporidium parvum
DGANELETPPV

SEQ ID NO: 2252934 - protein, 6 aa, Cryptosporidium parvum
DGAPIT

SEQ ID NO: 2252935 - protein, 10 aa, Cryptosporidium parvum
DGAQESKGEL

SEQ ID NO: 2252936 - protein, 24 aa, Cryptosporidium parvum
DGCENTNIEQNYKRDLGESLNSDF

SEQ ID NO: 2252937 - protein, 5 aa, Cryptosporidium parvum
DGCTR

SEQ ID NO: 2252938 - protein, 4 aa, Cryptosporidium parvum
DGDA

SEQ ID NO: 2252939 - protein, 26 aa, Cryptosporidium parvum
DGDEDDNDDDSEPINDNKVNNETKSV

SEQ ID NO: 2252940 - protein, 5 aa, Cryptosporidium parvum
DGDEF

SEQ ID NO: 2252941 - protein, 10 aa, Cryptosporidium parvum
DGDEKDANIN

SEQ ID NO: 2252942 - protein, 30 aa, Cryptosporidium parvum; identical to SEQ ID NO: 2137476

SEQ ID NO: 2252943 - protein, 4 aa, Cryptosporidium parvum
DGDL

SEQ ID NO: 2252944 - protein, 7 aa, Cryptosporidium parvum
DGDNKTM

SEQ ID NO: 2252945 - protein, 9 aa, Cryptosporidium parvum
DGDSLTRAT

SEQ ID NO: 2252946 - protein, 6 aa, Cryptosporidium parvum
DGDSQI

SEQ ID NO: 2252947 - protein, 6 aa, Cryptosporidium parvum
DGDTDL

SEQ ID NO: 2252948 - protein, 9 aa, Cryptosporidium parvum
DGEDGGVSY

SEQ ID NO: 2252949 - protein, 16 aa, Cryptosporidium parvum
DGEDNISSGDRKQKEI

SEQ ID NO: 2252950 - protein, 23 aa, Cryptosporidium parvum
DGEEDEEDEEVEVNGGFNSNNRH

SEQ ID NO: 2252951 - protein, 7 aa, Cryptosporidium parvum
DGEEPDN

SEQ ID NO: 2252952 - protein, 4 aa, Cryptosporidium parvum
DGEI

SEQ ID NO: 2252953 - protein, 21 aa, Cryptosporidium parvum
DGEKNNSSSSTDNQQTKNVAP

SEQ ID NO: 2252954 - protein, 11 aa, Cryptosporidium parvum
DGELNSPKKKL

SEQ ID NO: 2252955 - protein, 5 aa, Cryptosporidium parvum
DGEND

SEQ ID NO: 2252956 - protein, 12 aa, Cryptosporidium parvum
DGEQLSQIPSNS

SEQ ID NO: 2252957 - protein, 7 aa, Cryptosporidium parvum
DGERDID

SEQ ID NO: 2252958 - protein, 6 aa, Cryptosporidium parvum
DGESEV

SEQ ID NO: 2252959 - protein, 5 aa, Cryptosporidium parvum
DGESL

SEQ ID NO: 2252960 - protein, 6 aa, Cryptosporidium parvum
DGETTK

SEQ ID NO: 2252961 - protein, 15 aa, Cryptosporidium parvum
DGEVRNKAKDSDERL

SEQ ID NO: 2252962 - protein, 5 aa, Cryptosporidium parvum
DGFDS

SEQ ID NO: 2252963 - protein, 4 aa, Cryptosporidium parvum
DGFE

SEQ ID NO: 2252964 - protein, 12 aa, Cryptosporidium parvum
DGFGYKDNSQLR

SEQ ID NO: 2252965 - protein, 7 aa, Cryptosporidium parvum
DGFQGQE

SEQ ID NO: 2252966 - protein, 5 aa, Cryptosporidium parvum
DGGDA

SEQ ID NO: 2252967 - protein, 8 aa, Cryptosporidium parvum
DGGDTPSL

SEQ ID NO: 2252968 - protein, 14 aa, Cryptosporidium parvum
DGGKEEEDQSRPLD

SEQ ID NO: 2252969 - protein, 5 aa, Cryptosporidium parvum
DGGNM

SEQ ID NO: 2252970 - protein, 6 aa, Cryptosporidium parvum
DGGNVE

SEQ ID NO: 2252971 - protein, 8 aa, Cryptosporidium parvum
DGGVGKTT

SEQ ID NO: 2252972 - protein, 13 aa, Cryptosporidium parvum
DGGVTEGTIGEEI

SEQ ID NO: 2252973 - protein, 9 aa, Cryptosporidium parvum
DGHEGTSLS

SEQ ID NO: 2252974 - protein, 10 aa, Cryptosporidium parvum
DGHGSSGSHA

SEQ ID NO: 2252975 - protein, 8 aa, Cryptosporidium parvum
DGHLPGTN

SEQ ID NO: 2252976 - protein, 8 aa, Cryptosporidium parvum
DGIDDDMN

SEQ ID NO: 2252977 - protein, 10 aa, Cryptosporidium parvum
DGIDKSGLKE

SEQ ID NO: 2252978 - protein, 13 aa, Cryptosporidium parvum
DGISSSENKKKEI

SEQ ID NO: 2252979 - protein, 7 aa, Cryptosporidium parvum
DGKAQGE

SEQ ID NO: 2252980 - protein, 8 aa, Cryptosporidium parvum
DGKCDEGE

SEQ ID NO: 2252981 - protein, 6 aa, Cryptosporidium parvum
DGKEDA

SEQ ID NO: 2252982 - protein, 13 aa, Cryptosporidium parvum
DGKEETRLKSPEE

SEQ ID NO: 2252983 - protein, 8 aa, Cryptosporidium parvum
DGKEGNNL

SEQ ID NO: 2252984 - protein, 10 aa, Cryptosporidium parvum
DGKKQTEDEY

SEQ ID NO: 2252985 - protein, 8 aa, Cryptosporidium parvum
DGKNGLNF

SEQ ID NO: 2252986 - protein, 6 aa, Cryptosporidium parvum
DGKNRC

SEQ ID NO: 2252987 - protein, 44 aa, Cryptosporidium parvum
DGKPIKLNSSSSLYSNKSGQTNNSNPEPWKTDRIPGGVRTYNEK

SEQ ID NO: 2252988 - protein, 7 aa, Cryptosporidium parvum
DGKPLIE

SEQ ID NO: 2252989 - protein, 9 aa, Cryptosporidium parvum
DGKSNYAKD

SEQ ID NO: 2252990 - protein, 5 aa, Cryptosporidium parvum
DGKTE

SEQ ID NO: 2252991 - protein, 12 aa, Cryptosporidium parvum
DGKTNVAMSEFS

SEQ ID NO: 2252992 - protein, 14 aa, Cryptosporidium parvum
DGKYEEGNKGFKQR

SEQ ID NO: 2252993 - protein, 9 aa, Cryptosporidium parvum
DGLAEDDGY

SEQ ID NO: 2252994 - protein, 16 aa, Cryptosporidium parvum
DGLKPGKSEYSENQNC

SEQ ID NO: 2252995 - protein, 31 aa, Cryptosporidium parvum
DGLNGGDIAGEIGDEINGGNSSSDVNGGNLN

SEQ ID NO: 2252996 - protein, 6 aa, Cryptosporidium parvum
DGLSNN

SEQ ID NO: 2252997 - protein, 6 aa, Cryptosporidium parvum
DGLTES

SEQ ID NO: 2252998 - protein, 5 aa, Cryptosporidium parvum
DGMPK

SEQ ID NO: 2252999 - protein, 10 aa, Cryptosporidium parvum
DGMQNTSTFG

SEQ ID NO: 2253000 - protein, 11 aa, Cryptosporidium parvum
DGNARDGRSIK

SEQ ID NO: 2253001 - protein, 6 aa, Cryptosporidium parvum
DGNEGI

SEQ ID NO: 2253002 - protein, 9 aa, Cryptosporidium parvum
DGNEQVEET

SEQ ID NO: 2253003 - protein, 7 aa, Cryptosporidium parvum
DGNESYS

SEQ ID NO: 2253004 - protein, 5 aa, Cryptosporidium parvum
DGNGF

SEQ ID NO: 2253005 - protein, 7 aa, Cryptosporidium parvum
DGNGSQF

SEQ ID NO: 2253006 - protein, 7 aa, Cryptosporidium parvum
DGNIGPG

SEQ ID NO: 2253007 - protein, 4 aa, Cryptosporidium parvum
DGNL

SEQ ID NO: 2253008 - protein, 8 aa, Cryptosporidium parvum
DGNNGKKI

SEQ ID NO: 2253009 - protein, 10 aa, Cryptosporidium parvum
DGNNRSSSNQ

SEQ ID NO: 2253010 - protein, 4 aa, Cryptosporidium parvum
DGNP

SEQ ID NO: 2253011 - protein, 6 aa, Cryptosporidium parvum
DGNRIA

SEQ ID NO: 2253012 - protein, 10 aa, Cryptosporidium parvum
DGNRKETPVV

SEQ ID NO: 2253013 - protein, 8 aa, Cryptosporidium parvum
DGNRRERE

SEQ ID NO: 2253014 - protein, 5 aa, Cryptosporidium parvum
DGNTH

SEQ ID NO: 2253015 - protein, 6 aa, Cryptosporidium parvum
DGNYMN

SEQ ID NO: 2253016 - protein, 8 aa, Cryptosporidium parvum
DGPLKEYQ

SEQ ID NO: 2253017 - protein, 11 aa, Cryptosporidium parvum
DGPPPTPQQSS

SEQ ID NO: 2253018 - protein, 7 aa, Cryptosporidium parvum
DGPSMGL

SEQ ID NO: 2253019 - protein, 10 aa, Cryptosporidium parvum
DGQCDGRGGT

SEQ ID NO: 2253020 - protein, 10 aa, Cryptosporidium parvum
DGQENDSDNF

SEQ ID NO: 2253021 - protein, 5 aa, Cryptosporidium parvum
DGQKK

SEQ ID NO: 2253022 - protein, 7 aa, Cryptosporidium parvum
DGQKPVD

SEQ ID NO: 2253023 - protein, 24 aa, Cryptosporidium parvum
DGQNCSSSNSLEYKQPNNSSLNRS

SEQ ID NO: 2253024 - protein, 5 aa, Cryptosporidium parvum
DGQSV

SEQ ID NO: 2253025 - protein, 4 aa, Cryptosporidium parvum
DGRF

SEQ ID NO: 2253026 - protein, 6 aa, Cryptosporidium parvum
DGRGDQ

SEQ ID NO: 2253027 - protein, 12 aa, Cryptosporidium parvum
DGRNSGSNSREN

SEQ ID NO: 2253028 - protein, 5 aa, Cryptosporidium parvum
DGRSF

SEQ ID NO: 2253029 - protein, 9 aa, Cryptosporidium parvum
DGRSNRNKI

SEQ ID NO: 2253030 - protein, 8 aa, Cryptosporidium parvum
DGRTSTGP

SEQ ID NO: 2253031 - protein, 6 aa, Cryptosporidium parvum
DGSAFS

SEQ ID NO: 2253032 - protein, 7 aa, Cryptosporidium parvum
DGSDGVS

SEQ ID NO: 2253033 - protein, 12 aa, Cryptosporidium parvum
DGSDRDDEDLNR

SEQ ID NO: 2253034 - protein, 4 aa, Cryptosporidium parvum
DGSE

SEQ ID NO: 2253035 - protein, 5 aa, Cryptosporidium parvum
DGSED

SEQ ID NO: 2253036 - protein, 7 aa, Cryptosporidium parvum
DGSFHSK

SEQ ID NO: 2253037 - protein, 7 aa, Cryptosporidium parvum
DGSFKSQ

SEQ ID NO: 2253038 - protein, 12 aa, Cryptosporidium parvum
DGSGILSSSDDR

SEQ ID NO: 2253039 - protein, 4 aa, Cryptosporidium parvum
DGSI

SEQ ID NO: 2253040 - protein, 7 aa, Cryptosporidium parvum
DGSIREG

SEQ ID NO: 2253041 - protein, 5 aa, Cryptosporidium parvum
DGSKE

SEQ ID NO: 2253042 - protein, 15 aa, Cryptosporidium parvum
DGSKIKINDTGTTLN

SEQ ID NO: 2253043 - protein, 5 aa, Cryptosporidium parvum
DGSLG

SEQ ID NO: 2253044 - protein, 34 aa, Cryptosporidium parvum
DGSNLENISKDVEKYDGEIKQDINNNTENAAPRL

SEQ ID NO: 2253045 - protein, 39 aa, Cryptosporidium parvum
DGSNVNSSSNQDNLNSRNSEYNSTASSKTIKSSNTSNAN

SEQ ID NO: 2253046 - protein, 6 aa, Cryptosporidium parvum
DGSQYN

SEQ ID NO: 2253047 - protein, 8 aa, Cryptosporidium parvum
DGSRAFSG

SEQ ID NO: 2253048 - protein, 9 aa, Cryptosporidium parvum
DGSSDFDED

SEQ ID NO: 2253049 - protein, 8 aa, Cryptosporidium parvum
DGSSEAVL

SEQ ID NO: 2253050 - protein, 5 aa, Cryptosporidium parvum
DGSSV

SEQ ID NO: 2253051 - protein, 6 aa, Cryptosporidium parvum
DGSTPF

SEQ ID NO: 2253052 - protein, 8 aa, Cryptosporidium parvum
DGSTPLST

SEQ ID NO: 2253053 - protein, 7 aa, Cryptosporidium parvum
DGSTSSN

SEQ ID NO: 2253054 - protein, 7 aa, Cryptosporidium parvum
DGSTTDC

SEQ ID NO: 2253055 - protein, 9 aa, Cryptosporidium parvum
DGTATACSS

SEQ ID NO: 2253056 - protein, 9 aa, Cryptosporidium parvum
DGTDPYNEP

SEQ ID NO: 2253057 - protein, 7 aa, Cryptosporidium parvum
DGTDSQL

SEQ ID NO: 2253058 - protein, 16 aa, Cryptosporidium parvum
DGTGGCNNNASSNTQD

SEQ ID NO: 2253059 - protein, 7 aa, Cryptosporidium parvum
DGTGGID

SEQ ID NO: 2253060 - protein, 7 aa, Cryptosporidium parvum
DGTITRS

SEQ ID NO: 2253061 - protein, 4 aa, Cryptosporidium parvum
DGTK

SEQ ID NO: 2253062 - protein, 7 aa, Cryptosporidium parvum
DGTKITS

SEQ ID NO: 2253063 - protein, 6 aa, Cryptosporidium parvum
DGTLPN

SEQ ID NO: 2253064 - protein, 6 aa, Cryptosporidium parvum
DGTLTP

SEQ ID NO: 2253065 - protein, 7 aa, Cryptosporidium parvum
DGTNRRY

SEQ ID NO: 2253066 - protein, 7 aa, Cryptosporidium parvum
DGTPDIA

SEQ ID NO: 2253067 - protein, 20 aa, Cryptosporidium parvum
DGTQGVENKLKEDENSADLL

SEQ ID NO: 2253068 - protein, 8 aa, Cryptosporidium parvum
DGTRNEQL

SEQ ID NO: 2253069 - protein, 6 aa, Cryptosporidium parvum
DGTSNI

SEQ ID NO: 2253070 - protein, 7 aa, Cryptosporidium parvum
DGTTVDG

SEQ ID NO: 2253071 - protein, 22 aa, Cryptosporidium parvum
DGTVNIDRKPSGTSAQVYTNEE

SEQ ID NO: 2253072 - protein, 8 aa, Cryptosporidium parvum
DGVNPDIE

SEQ ID NO: 2253073 - protein, 5 aa, Cryptosporidium parvum
DGVQS

SEQ ID NO: 2253074 - protein, 21 aa, Cryptosporidium parvum
DGVSKDWKPEKKEADYNNNEL

SEQ ID NO: 2253075 - protein, 49 aa, Cryptosporidium parvum
DGVTSSIENTPVRQTSSRKVDQNSSCNRKCQSTESYRTRTKLESSERDK

SEQ ID NO: 2253076 - protein, 4 aa, Cryptosporidium parvum
DGWI

SEQ ID NO: 2253077 - protein, 4 aa, Cryptosporidium parvum
DGYI

SEQ ID NO: 2253078 - protein, 11 aa, Cryptosporidium parvum
DGYKRNNSVLS

SEQ ID NO: 2253079 - protein, 5 aa, Cryptosporidium parvum
DGYPN

SEQ ID NO: 2253080 - protein, 4 aa, Cryptosporidium parvum
DGYT

SEQ ID NO: 2253081 - protein, 5 aa, Cryptosporidium parvum
DHADP

SEQ ID NO: 2253082 - protein, 6 aa, Cryptosporidium parvum
DHAKEK

SEQ ID NO: 2253083 - protein, 6 aa, Cryptosporidium parvum
DHAQGL

SEQ ID NO: 2253084 - protein, 19 aa, Cryptosporidium parvum
DHATNYQENSFKKQCSNKH

SEQ ID NO: 2253085 - protein, 6 aa, Cryptosporidium parvum
DHDEEI

SEQ ID NO: 2253086 - protein, 7 aa, Cryptosporidium parvum
DHDEKEV

SEQ ID NO: 2253087 - protein, 25 aa, Cryptosporidium parvum
DHDHNQDQNQNKNQVSQNIDSSNSI

SEQ ID NO: 2253088 - protein, 5 aa, Cryptosporidium parvum
DHDNS

SEQ ID NO: 2253089 - protein, 9 aa, Cryptosporidium parvum
DHDSTEKIT

SEQ ID NO: 2253090 - protein, 10 aa, Cryptosporidium parvum
DHDTRRLSSG

SEQ ID NO: 2253091 - protein, 13 aa, Cryptosporidium parvum
DHEDNKDKNYKPK

SEQ ID NO: 2253092 - protein, 7 aa, Cryptosporidium parvum
DHEENVI

SEQ ID NO: 2253093 - protein, 4 aa, Cryptosporidium parvum
DHEF

SEQ ID NO: 2253094 - protein, 6 aa, Cryptosporidium parvum
DHENGL

SEQ ID NO: 2253095 - protein, 24 aa, Cryptosporidium parvum
DHESDANSKSRAESISFSPNKPHK

SEQ ID NO: 2253096 - protein, 7 aa, Cryptosporidium parvum
DHETEVK

SEQ ID NO: 2253097 - protein, 5 aa, Cryptosporidium parvum
DHFEP

SEQ ID NO: 2253098 - protein, 16 aa, Cryptosporidium parvum
DHGPASTVVSSPTPCN

SEQ ID NO: 2253099 - protein, 5 aa, Cryptosporidium parvum
DHGRI

SEQ ID NO: 2253100 - protein, 18 aa, Cryptosporidium parvum
DHHSTGQSGGCESNNGDM

SEQ ID NO: 2253101 - protein, 14 aa, Cryptosporidium parvum
DHIQSRCKSSENNL

SEQ ID NO: 2253102 - protein, 23 aa, Cryptosporidium parvum
DHKHEQWGGSNIRDNNSNNNSVI

SEQ ID NO: 2253103 - protein, 7 aa, Cryptosporidium parvum
DHKIKQD

SEQ ID NO: 2253104 - protein, 15 aa, Cryptosporidium parvum
DHKQTDQHVEERKQY

SEQ ID NO: 2253105 - protein, 7 aa, Cryptosporidium parvum
DHKSSEC

SEQ ID NO: 2253106 - protein, 19 aa, Cryptosporidium parvum
DHLDQESVNNIKSDSLSNL

SEQ ID NO: 2253107 - protein, 8 aa, Cryptosporidium parvum
DHLNENDK

SEQ ID NO: 2253108 - protein, 11 aa, Cryptosporidium parvum
DHLSKQDADNL

SEQ ID NO: 2253109 - protein, 9 aa, Cryptosporidium parvum
DHNQSPRNV

SEQ ID NO: 2253110 - protein, 21 aa, Cryptosporidium parvum
DHNYNENNDCDDNNNDNNNYD

SEQ ID NO: 2253111 - protein, 12 aa, Cryptosporidium parvum
DHPESEEELGEL

SEQ ID NO: 2253112 - protein, 10 aa, Cryptosporidium parvum
DHPHGGGNHQ

SEQ ID NO: 2253113 - protein, 7 aa, Cryptosporidium parvum
DHPKKKI

SEQ ID NO: 2253114 - protein, 71 aa, Cryptosporidium parvum
DHPTKSETIRSEGKTDSRAESRMEDKNVDKNLANQNQDQDESIHNNANEHDQTGVNKPSSCTDSKPEEQDE

SEQ ID NO: 2253115 - protein, 6 aa, Cryptosporidium parvum
DHRRGP

SEQ ID NO: 2253116 - protein, 6 aa, Cryptosporidium parvum
DHRSAP

SEQ ID NO: 2253117 - protein, 24 aa, Cryptosporidium parvum
DHSEEEEEKEEEEEEEEKKTERMS

SEQ ID NO: 2253118 - protein, 6 aa, Cryptosporidium parvum
DHSNTL

SEQ ID NO: 2253119 - protein, 9 aa, Cryptosporidium parvum
DHSQNNSQN

SEQ ID NO: 2253120 - protein, 5 aa, Cryptosporidium parvum
DHSSD

SEQ ID NO: 2253121 - protein, 11 aa, Cryptosporidium parvum
DHSYSENPTIH

SEQ ID NO: 2253122 - protein, 9 aa, Cryptosporidium parvum
DHTEENNPI

SEQ ID NO: 2253123 - protein, 13 aa, Cryptosporidium parvum
DHTEGAGSSKTSF

SEQ ID NO: 2253124 - protein, 9 aa, Cryptosporidium parvum
DHTERIQNS

SEQ ID NO: 2253125 - protein, 6 aa, Cryptosporidium parvum
DHTSGI

SEQ ID NO: 2253126 - protein, 7 aa, Cryptosporidium parvum
DHVGSKQ

SEQ ID NO: 2253127 - protein, 11 aa, Cryptosporidium parvum
DHYEESGAEDI

SEQ ID NO: 2253128 - protein, 15 aa, Cryptosporidium parvum
DHYHNDDHNSLAGGT

SEQ ID NO: 2253129 - protein, 14 aa, Cryptosporidium parvum
DHYKQQNPSSETRY

SEQ ID NO: 2253130 - protein, 11 aa, Cryptosporidium parvum
DHYNKESSSTG

SEQ ID NO: 2253131 - protein, 10 aa, Cryptosporidium parvum
DIAERQQDGS

SEQ ID NO: 2253132 - protein, 10 aa, Cryptosporidium parvum
DIAKSSYGSI

SEQ ID NO: 2253133 - protein, 4 aa, Cryptosporidium parvum
DIAN

SEQ ID NO: 2253134 - protein, 6 aa, Cryptosporidium parvum
DIASYK

SEQ ID NO: 2253135 - protein, 26 aa, Cryptosporidium parvum
DIDCNSSSSHGFQSDPTSIYNSNAGK

SEQ ID NO: 2253136 - protein, 4 aa, Cryptosporidium parvum
DIDE

SEQ ID NO: 2253137 - protein, 5 aa, Cryptosporidium parvum
DIDNA

SEQ ID NO: 2253138 - protein, 10 aa, Cryptosporidium parvum
DIDQKKSVEE

SEQ ID NO: 2253139 - protein, 27 aa, Cryptosporidium parvum
DIDSSDQKNETEKDLCENGKSMDEEDI

SEQ ID NO: 2253140 - protein, 17 aa, Cryptosporidium parvum
DIEGRDMKEKYKTLSAT

SEQ ID NO: 2253141 - protein, 6 aa, Cryptosporidium parvum
DIEKEE

SEQ ID NO: 2253142 - protein, 11 aa, Cryptosporidium parvum
DIENNEEMDSK

SEQ ID NO: 2253143 - protein, 12 aa, Cryptosporidium parvum
DIEPTRSSRKLS

SEQ ID NO: 2253144 - protein, 9 aa, Cryptosporidium parvum
DIERETQKT

SEQ ID NO: 2253145 - protein, 13 aa, Cryptosporidium parvum
DIESINGKSSENI

SEQ ID NO: 2253146 - protein, 12 aa, Cryptosporidium parvum
DIESNGSSSNEL

SEQ ID NO: 2253147 - protein, 8 aa, Cryptosporidium parvum
DIESRPRK

SEQ ID NO: 2253148 - protein, 17 aa, Cryptosporidium parvum
DIGPESLEDNLRGPGSA

SEQ ID NO: 2253149 - protein, 6 aa, Cryptosporidium parvum
DIGTNV

SEQ ID NO: 2253150 - protein, 11 aa, Cryptosporidium parvum
DIKGSRPEHTD

SEQ ID NO: 2253151 - protein, 23 aa, Cryptosporidium parvum
DIKSEQSSQSTQGNSFYDILSML

SEQ ID NO: 2253152 - protein, 11 aa, Cryptosporidium parvum
DIKSNNSKEEL

SEQ ID NO: 2253153 - protein, 6 aa, Cryptosporidium parvum
DIKSNS

SEQ ID NO: 2253154 - protein, 14 aa, Cryptosporidium parvum
DIKSNTTTYTIPSS

SEQ ID NO: 2253155 - protein, 10 aa, Cryptosporidium parvum
DIKSQEGDPN

SEQ ID NO: 2253156 - protein, 9 aa, Cryptosporidium parvum
DILNQNKSE

SEQ ID NO: 2253157 - protein, 9 aa, Cryptosporidium parvum
DINANSSLI

SEQ ID NO: 2253158 - protein, 6 aa, Cryptosporidium parvum
DINDEL

SEQ ID NO: 2253159 - protein, 4 aa, Cryptosporidium parvum
DINE

SEQ ID NO: 2253160 - protein, 5 aa, Cryptosporidium parvum
DINED

SEQ ID NO: 2253161 - protein, 10 aa, Cryptosporidium parvum
DINNEEEDEK

SEQ ID NO: 2253162 - protein, 6 aa, Cryptosporidium parvum
DINNSV

SEQ ID NO: 2253163 - protein, 5 aa, Cryptosporidium parvum
DINSD

SEQ ID NO: 2253164 - protein, 5 aa, Cryptosporidium parvum
DIPAE

SEQ ID NO: 2253165 - protein, 23 aa, Cryptosporidium parvum
DIPDSNSLEKLDNDALDKREIQP

SEQ ID NO: 2253166 - protein, 10 aa, Cryptosporidium parvum
DIPKNNNTKK

SEQ ID NO: 2253167 - protein, 7 aa, Cryptosporidium parvum
DIPNDKK

SEQ ID NO: 2253168 - protein, 9 aa, Cryptosporidium parvum
DIPNKEREY

SEQ ID NO: 2253169 - protein, 22 aa, Cryptosporidium parvum
DIPNQTNNSSSIQSATQQPNIP

SEQ ID NO: 2253170 - protein, 5 aa, Cryptosporidium parvum
DIPPK

SEQ ID NO: 2253171 - protein, 10 aa, Cryptosporidium parvum
DIPPSTQKGV

SEQ ID NO: 2253172 - protein, 9 aa, Cryptosporidium parvum
DIPRKKNAD

SEQ ID NO: 2253173 - protein, 8 aa, Cryptosporidium parvum
DIPSPEKI

SEQ ID NO: 2253174 - protein, 7 aa, Cryptosporidium parvum
DIPSSIN

SEQ ID NO: 2253175 - protein, 19 aa, Cryptosporidium parvum
DIPTKDQGVKSFDWISSLL

SEQ ID NO: 2253176 - protein, 7 aa, Cryptosporidium parvum
DIQDQAR

SEQ ID NO: 2253177 - protein, 9 aa, Cryptosporidium parvum
DIQGNEIPE

SEQ ID NO: 2253178 - protein, 8 aa, Cryptosporidium parvum
DIQGSNGV

SEQ ID NO: 2253179 - protein, 8 aa, Cryptosporidium parvum
DIQKGGSA

SEQ ID NO: 2253180 - protein, 6 aa, Cryptosporidium parvum
DIQNDK

SEQ ID NO: 2253181 - protein, 20 aa, Cryptosporidium parvum
DIQPDSSNYINERPSLNKEE

SEQ ID NO: 2253182 - protein, 4 aa, Cryptosporidium parvum
DIQS

SEQ ID NO: 2253183 - protein, 9 aa, Cryptosporidium parvum
DIQSSNGSL

SEQ ID NO: 2253184 - protein, 20 aa, Cryptosporidium parvum
DIQSTDSTEESINESIGKNE

SEQ ID NO: 2253185 - protein, 7 aa, Cryptosporidium parvum
DIRPKTD

SEQ ID NO: 2253186 - protein, 96 aa, Cryptosporidium parvum
DISDEDDDDLNDESFEPVKPTKSRERKGTGRGGRANSSKTSSNNATGGNNSSGEQDGNQNFAETSVDGTNTLSNGARQSKKRKSTNSNNLNTGDDI

SEQ ID NO: 2253187 - protein, 5 aa, Cryptosporidium parvum
DISDK

SEQ ID NO: 2253188 - protein, 5 aa, Cryptosporidium parvum
DISDP

SEQ ID NO: 2253189 - protein, 9 aa, Cryptosporidium parvum
DISDSQHDS

SEQ ID NO: 2253190 - protein, 6 aa, Cryptosporidium parvum
DISEGI

SEQ ID NO: 2253191 - protein, 22 aa, Cryptosporidium parvum
DISEKKKSKAIEKPDQEEQKME

SEQ ID NO: 2253192 - protein, 6 aa, Cryptosporidium parvum
DISGAD

SEQ ID NO: 2253193 - protein, 10 aa, Cryptosporidium parvum
DISKENESIY

SEQ ID NO: 2253194 - protein, 8 aa, Cryptosporidium parvum
DISKSDQA

SEQ ID NO: 2253195 - protein, 9 aa, Cryptosporidium parvum
DISKTGAVS

SEQ ID NO: 2253196 - protein, 5 aa, Cryptosporidium parvum
DISND

SEQ ID NO: 2253197 - protein, 5 aa, Cryptosporidium parvum
DISQE

SEQ ID NO: 2253198 - protein, 5 aa, Cryptosporidium parvum
DISRS

SEQ ID NO: 2253199 - protein, 9 aa, Cryptosporidium parvum
DISSEEPNV

SEQ ID NO: 2253200 - protein, 5 aa, Cryptosporidium parvum
DISSN

SEQ ID NO: 2253201 - protein, 24 aa, Cryptosporidium parvum
DISSPDTHIPSTNSLTADSPISED

SEQ ID NO: 2253202 - protein, 7 aa, Cryptosporidium parvum
DISSVQA

SEQ ID NO: 2253203 - protein, 4 aa, Cryptosporidium parvum
DIST

SEQ ID NO: 2253204 - protein, 9 aa, Cryptosporidium parvum
DITDKSEEI

SEQ ID NO: 2253205 - protein, 5 aa, Cryptosporidium parvum
DITDN

SEQ ID NO: 2253206 - protein, 8 aa, Cryptosporidium parvum
DITEELNN

SEQ ID NO: 2253207 - protein, 6 aa, Cryptosporidium parvum
DITKEE

SEQ ID NO: 2253208 - protein, 5 aa, Cryptosporidium parvum
DITSI

SEQ ID NO: 2253209 - protein, 20 aa, Cryptosporidium parvum
DIYSSSSSSSIAKESKQTIT

SEQ ID NO: 2253210 - protein, 8 aa, Cryptosporidium parvum
DKAGKISE

SEQ ID NO: 2253211 - protein, 9 aa, Cryptosporidium parvum
DKANDSDGY

SEQ ID NO: 2253212 - protein, 23 aa, Cryptosporidium parvum
DKANEYTNTSKKVQNSKINQSLG

SEQ ID NO: 2253213 - protein, 24 aa, Cryptosporidium parvum
DKAPGKSNLKKKEGRNARISQRED

SEQ ID NO: 2253214 - protein, 6 aa, Cryptosporidium parvum
DKATEL

SEQ ID NO: 2253215 - protein, 5 aa, Cryptosporidium parvum
DKAYN

SEQ ID NO: 2253216 - protein, 6 aa, Cryptosporidium parvum
DKCEVA

SEQ ID NO: 2253217 - protein, 12 aa, Cryptosporidium parvum
DKCSSPNSGPMG

SEQ ID NO: 2253218 - protein, 24 aa, Cryptosporidium parvum
DKCVNNKDDCHKNESNISKNVSEL

SEQ ID NO: 2253219 - protein, 15 aa, Cryptosporidium parvum
DKDDNNSKKEETYSG

SEQ ID NO: 2253220 - protein, 9 aa, Cryptosporidium parvum
DKDDTKPKI

SEQ ID NO: 2253221 - protein, 7 aa, Cryptosporidium parvum
DKDESFE

SEQ ID NO: 2253222 - protein, 7 aa, Cryptosporidium parvum
DKDETIR

SEQ ID NO: 2253223 - protein, 7 aa, Cryptosporidium parvum
DKDGDGL

SEQ ID NO: 2253224 - protein, 10 aa, Cryptosporidium parvum
DKDGGLTSTT

SEQ ID NO: 2253225 - protein, 8 aa, Cryptosporidium parvum
DKDGKFDY

SEQ ID NO: 2253226 - protein, 12 aa, Cryptosporidium parvum
DKDGNGLGKAGR

SEQ ID NO: 2253227 - protein, 9 aa, Cryptosporidium parvum
DKDGSISGS

SEQ ID NO: 2253228 - protein, 18 aa, Cryptosporidium parvum
DKDHNDKKQLEGKDQSFG

SEQ ID NO: 2253229 - protein, 6 aa, Cryptosporidium parvum
DKDIER

SEQ ID NO: 2253230 - protein, 5 aa, Cryptosporidium parvum
DKDLG

SEQ ID NO: 2253231 - protein, 8 aa, Cryptosporidium parvum
DKDNPDHK

SEQ ID NO: 2253232 - protein, 8 aa, Cryptosporidium parvum
DKDNQGRC

SEQ ID NO: 2253233 - protein, 20 aa, Cryptosporidium parvum
DKDNYNKNTKESSKINENGY

SEQ ID NO: 2253234 - protein, 4 aa, Cryptosporidium parvum
DKDP

SEQ ID NO: 2253235 - protein, 31 aa, Cryptosporidium parvum
DKDQSQNLTNKDTKSIQNDTETKKTYTPEEK

SEQ ID NO: 2253236 - protein, 10 aa, Cryptosporidium parvum
DKDSDGKVSV

SEQ ID NO: 2253237 - protein, 7 aa, Cryptosporidium parvum
DKDSISQ

SEQ ID NO: 2253238 - protein, 8 aa, Cryptosporidium parvum
DKDSNTVE

SEQ ID NO: 2253239 - protein, 19 aa, Cryptosporidium parvum
DKDSQINNDNQKSNPVSTL

SEQ ID NO: 2253240 - protein, 7 aa, Cryptosporidium parvum
DKDTKRK

SEQ ID NO: 2253241 - protein, 7 aa, Cryptosporidium parvum
DKDTRIE

SEQ ID NO: 2253242 - protein, 16 aa, Cryptosporidium parvum
DKEDEISESSSTREED

SEQ ID NO: 2253243 - protein, 8 aa, Cryptosporidium parvum
DKEDNKGF

SEQ ID NO: 2253244 - protein, 121 aa, Cryptosporidium parvum
DKEEDLKENKEEETEKEENLDKKDGMENGEELEGEKEELEKRNDLENEKGELKNKEEDLENKEEPEKNNDMEDKKEDQESKVEEQENKEELEDEKEYQENKEKELEEKETENQNSKEDEQN

SEQ ID NO: 2253245 - protein, 7 aa, Cryptosporidium parvum
DKEEDVR

SEQ ID NO: 2253246 - protein, 5 aa, Cryptosporidium parvum
DKEEI

SEQ ID NO: 2253247 - protein, 17 aa, Cryptosporidium parvum
DKEENDENLENKGQDHA

SEQ ID NO: 2253248 - protein, 4 aa, Cryptosporidium parvum
DKEF

SEQ ID NO: 2253249 - protein, 5 aa, Cryptosporidium parvum
DKEFS

SEQ ID NO: 2253250 - protein, 9 aa, Cryptosporidium parvum
DKEGKIPQG

SEQ ID NO: 2253251 - protein, 5 aa, Cryptosporidium parvum
DKEGN

SEQ ID NO: 2253252 - protein, 5 aa, Cryptosporidium parvum
DKEGR

SEQ ID NO: 2253253 - protein, 13 aa, Cryptosporidium parvum
DKEINSLKSENQE

SEQ ID NO: 2253254 - protein, 6 aa, Cryptosporidium parvum
DKEKDL

SEQ ID NO: 2253255 - protein, 15 aa, Cryptosporidium parvum
DKEKRERDPQNRITT

SEQ ID NO: 2253256 - protein, 8 aa, Cryptosporidium parvum
DKEKRNIY

SEQ ID NO: 2253257 - protein, 5 aa, Cryptosporidium parvum
DKENK

SEQ ID NO: 2253258 - protein, 16 aa, Cryptosporidium parvum
DKENLYPKKKIKRNEQ

SEQ ID NO: 2253259 - protein, 7 aa, Cryptosporidium parvum
DKEPWES

SEQ ID NO: 2253260 - protein, 6 aa, Cryptosporidium parvum
DKERKK

SEQ ID NO: 2253261 - protein, 6 aa, Cryptosporidium parvum
DKERYR

SEQ ID NO: 2253262 - protein, 7 aa, Cryptosporidium parvum
DKESEEI

SEQ ID NO: 2253263 - protein, 7 aa, Cryptosporidium parvum
DKESRKN

SEQ ID NO: 2253264 - protein, 15 aa, Cryptosporidium parvum
DKESSKYLSSNSKNN

SEQ ID NO: 2253265 - protein, 9 aa, Cryptosporidium parvum
DKETERNAT

SEQ ID NO: 2253266 - protein, 14 aa, Cryptosporidium parvum
DKETGNLEKNSDFT

SEQ ID NO: 2253267 - protein, 12 aa, Cryptosporidium parvum
DKETGTSKGEEM

SEQ ID NO: 2253268 - protein, 8 aa, Cryptosporidium parvum
DKETKTSG

SEQ ID NO: 2253269 - protein, 6 aa, Cryptosporidium parvum
DKFEGY

SEQ ID NO: 2253270 - protein, 18 aa, Cryptosporidium parvum
DKFNEEVSTKNKEFSEDR

SEQ ID NO: 2253271 - protein, 7 aa, Cryptosporidium parvum
DKFSNNL

SEQ ID NO: 2253272 - protein, 5 aa, Cryptosporidium parvum
DKGDG

SEQ ID NO: 2253273 - protein, 8 aa, Cryptosporidium parvum
DKGDNYTF

SEQ ID NO: 2253274 - protein, 8 aa, Cryptosporidium parvum
DKGGRELE

SEQ ID NO: 2253275 - protein, 7 aa, Cryptosporidium parvum
DKGNRIR

SEQ ID NO: 2253276 - protein, 6 aa, Cryptosporidium parvum
DKGPLQ

SEQ ID NO: 2253277 - protein, 10 aa, Cryptosporidium parvum
DKGPTKSGNY

SEQ ID NO: 2253278 - protein, 8 aa, Cryptosporidium parvum
DKGQLGMS

SEQ ID NO: 2253279 - protein, 18 aa, Cryptosporidium parvum
DKGQQGEVSSYDEDNYSD

SEQ ID NO: 2253280 - protein, 5 aa, Cryptosporidium parvum
DKGRF

SEQ ID NO: 2253281 - protein, 9 aa, Cryptosporidium parvum
DKGRPSPDH

SEQ ID NO: 2253282 - protein, 8 aa, Cryptosporidium parvum
DKGSGNDK

SEQ ID NO: 2253283 - protein, 8 aa, Cryptosporidium parvum
DKGSLKKG

SEQ ID NO: 2253284 - protein, 7 aa, Cryptosporidium parvum
DKGTELA

SEQ ID NO: 2253285 - protein, 9 aa, Cryptosporidium parvum
DKGTGKSAL

SEQ ID NO: 2253286 - protein, 13 aa, Cryptosporidium parvum
DKHGKPNEQTPES

SEQ ID NO: 2253287 - protein, 31 aa, Cryptosporidium parvum
DKHHSSKGNSGSKKSREYRKTKAMIDNIKND

SEQ ID NO: 2253288 - protein, 5 aa, Cryptosporidium parvum
DKHIK

SEQ ID NO: 2253289 - protein, 8 aa, Cryptosporidium parvum
DKHSSKTE

SEQ ID NO: 2253290 - protein, 5 aa, Cryptosporidium parvum
DKIED

SEQ ID NO: 2253291 - protein, 4 aa, Cryptosporidium parvum
DKIK

SEQ ID NO: 2253292 - protein, 22 aa, Cryptosporidium parvum
DKIKERTDEELTAGSSTESKQI

SEQ ID NO: 2253293 - protein, 10 aa, Cryptosporidium parvum
DKIKNRRERF

SEQ ID NO: 2253294 - protein, 6 aa, Cryptosporidium parvum
DKINKE

SEQ ID NO: 2253295 - protein, 6 aa, Cryptosporidium parvum
DKINKK

SEQ ID NO: 2253296 - protein, 6 aa, Cryptosporidium parvum
DKIPRE

SEQ ID NO: 2253297 - protein, 14 aa, Cryptosporidium parvum
DKIQDSRNNSNLSF

SEQ ID NO: 2253298 - protein, 7 aa, Cryptosporidium parvum
DKIRDYK

SEQ ID NO: 2253299 - protein, 7 aa, Cryptosporidium parvum
DKISDGL

SEQ ID NO: 2253300 - protein, 7 aa, Cryptosporidium parvum
DKISDQS

SEQ ID NO: 2253301 - protein, 6 aa, Cryptosporidium parvum
DKISDT

SEQ ID NO: 2253302 - protein, 14 aa, Cryptosporidium parvum
DKISEPSNIPSSQQ

SEQ ID NO: 2253303 - protein, 6 aa, Cryptosporidium parvum
DKISQS

SEQ ID NO: 2253304 - protein, 21 aa, Cryptosporidium parvum
DKISSTGGDNEVDNSINPASD

SEQ ID NO: 2253305 - protein, 6 aa, Cryptosporidium parvum
DKITDQ

SEQ ID NO: 2253306 - protein, 4 aa, Cryptosporidium parvum
DKKA

SEQ ID NO: 2253307 - protein, 9 aa, Cryptosporidium parvum
DKKAENTLS

SEQ ID NO: 2253308 - protein, 9 aa, Cryptosporidium parvum
DKKAKSGLS

SEQ ID NO: 2253309 - protein, 15 aa, Cryptosporidium parvum
DKKAMEPFRRTGDSL

SEQ ID NO: 2253310 - protein, 7 aa, Cryptosporidium parvum
DKKDLEV

SEQ ID NO: 2253311 - protein, 13 aa, Cryptosporidium parvum
DKKEGSDEDNDEF

SEQ ID NO: 2253312 - protein, 6 aa, Cryptosporidium parvum
DKKGKK

SEQ ID NO: 2253313 - protein, 6 aa, Cryptosporidium parvum
DKKGMT

SEQ ID NO: 2253314 - protein, 5 aa, Cryptosporidium parvum
DKKGS

SEQ ID NO: 2253315 - protein, 8 aa, Cryptosporidium parvum
DKKGTGER

SEQ ID NO: 2253316 - protein, 7 aa, Cryptosporidium parvum
DKKINQY

SEQ ID NO: 2253317 - protein, 8 aa, Cryptosporidium parvum
DKKKEDSI

SEQ ID NO: 2253318 - protein, 8 aa, Cryptosporidium parvum
DKKKLETS

SEQ ID NO: 2253319 - protein, 14 aa, Cryptosporidium parvum
DKKKTNSDTNPPKT

SEQ ID NO: 2253320 - protein, 4 aa, Cryptosporidium parvum
DKKN

SEQ ID NO: 2253321 - protein, 10 aa, Cryptosporidium parvum
DKKNKKSKLD

SEQ ID NO: 2253322 - protein, 17 aa, Cryptosporidium parvum
DKKPSNIQDSSSAEAVS

SEQ ID NO: 2253323 - protein, 8 aa, Cryptosporidium parvum
DKKQEERT

SEQ ID NO: 2253324 - protein, 8 aa, Cryptosporidium parvum
DKKQHDSD

SEQ ID NO: 2253325 - protein, 27 aa, Cryptosporidium parvum
DKKRELEEAKAREKLKQEEFEKEEKLK

SEQ ID NO: 2253326 - protein, 7 aa, Cryptosporidium parvum
DKKSNDL

SEQ ID NO: 2253327 - protein, 6 aa, Cryptosporidium parvum
DKKSQS

SEQ ID NO: 2253328 - protein, 42 aa, Cryptosporidium parvum
DKKTARSLNEGDKKSQTNQENRAHSNSSITSNSKTNIRRPSS

SEQ ID NO: 2253329 - protein, 6 aa, Cryptosporidium parvum
DKLARE

SEQ ID NO: 2253330 - protein, 13 aa, Cryptosporidium parvum
DKLDSNQLSRLKE

SEQ ID NO: 2253331 - protein, 18 aa, Cryptosporidium parvum
DKLGAANRVSDEDLDGNG

SEQ ID NO: 2253332 - protein, 38 aa, Cryptosporidium parvum
DKLGGTNKVSNPNKKKKTKTQDKKSDSTDGQHNSGENY

SEQ ID NO: 2253333 - protein, 5 aa, Cryptosporidium parvum
DKLGQ

SEQ ID NO: 2253334 - protein, 19 aa, Cryptosporidium parvum
DKLQGRLKAPSSSEAGGAL

SEQ ID NO: 2253335 - protein, 7 aa, Cryptosporidium parvum
DKLQNND

SEQ ID NO: 2253336 - protein, 7 aa, Cryptosporidium parvum
DKLRDTA

SEQ ID NO: 2253337 - protein, 14 aa, Cryptosporidium parvum
DKLRSDGNKSSEII

SEQ ID NO: 2253338 - protein, 7 aa, Cryptosporidium parvum
DKLSDRN

SEQ ID NO: 2253339 - protein, 7 aa, Cryptosporidium parvum
DKMPETR

SEQ ID NO: 2253340 - protein, 9 aa, Cryptosporidium parvum
DKMPQDPPS

SEQ ID NO: 2253341 - protein, 8 aa, Cryptosporidium parvum
DKMRNSNK

SEQ ID NO: 2253342 - protein, 16 aa, Cryptosporidium parvum
DKNAVQKDKSGVKFTF

SEQ ID NO: 2253343 - protein, 5 aa, Cryptosporidium parvum
DKNEI

SEQ ID NO: 2253344 - protein, 15 aa, Cryptosporidium parvum
DKNFNNKTETKEVEI

SEQ ID NO: 2253345 - protein, 11 aa, Cryptosporidium parvum
DKNGDRITPNR

SEQ ID NO: 2253346 - protein, 12 aa, Cryptosporidium parvum
DKNKKASKSERS

SEQ ID NO: 2253347 - protein, 8 aa, Cryptosporidium parvum
DKNKKFTD

SEQ ID NO: 2253348 - protein, 12 aa, Cryptosporidium parvum
DKNKSQREQNNS

SEQ ID NO: 2253349 - protein, 13 aa, Cryptosporidium parvum
DKNKTLPKKYSKE

SEQ ID NO: 2253350 - protein, 9 aa, Cryptosporidium parvum
DKNMGNDRQ

SEQ ID NO: 2253351 - protein, 4 aa, Cryptosporidium parvum
DKNN

SEQ ID NO: 2253352 - protein, 9 aa, Cryptosporidium parvum
DKNNGRPRG

SEQ ID NO: 2253353 - protein, 6 aa, Cryptosporidium parvum
DKNNNI

SEQ ID NO: 2253354 - protein, 16 aa, Cryptosporidium parvum
DKNPISSEASTSVPHY

SEQ ID NO: 2253355 - protein, 6 aa, Cryptosporidium parvum
DKNQFE

SEQ ID NO: 2253356 - protein, 7 aa, Cryptosporidium parvum
DKNQSSQ

SEQ ID NO: 2253357 - protein, 5 aa, Cryptosporidium parvum
DKNRL

SEQ ID NO: 2253358 - protein, 5 aa, Cryptosporidium parvum
DKNST

SEQ ID NO: 2253359 - protein, 4 aa, Cryptosporidium parvum
DKNT

SEQ ID NO: 2253360 - protein, 8 aa, Cryptosporidium parvum
DKNTNKSN

SEQ ID NO: 2253361 - protein, 5 aa, Cryptosporidium parvum
DKNTP

SEQ ID NO: 2253362 - protein, 4 aa, Cryptosporidium parvum
DKNV

SEQ ID NO: 2253363 - protein, 18 aa, Cryptosporidium parvum
DKPDVTYNDIGGAKEQLE

SEQ ID NO: 2253364 - protein, 5 aa, Cryptosporidium parvum
DKPIQ

SEQ ID NO: 2253365 - protein, 5 aa, Cryptosporidium parvum
DKPKI

SEQ ID NO: 2253366 - protein, 6 aa, Cryptosporidium parvum
DKPQKI

SEQ ID NO: 2253367 - protein, 7 aa, Cryptosporidium parvum
DKPSLKH

SEQ ID NO: 2253368 - protein, 21 aa, Cryptosporidium parvum
DKPTRGRYKQRYNNKRSRNEI

SEQ ID NO: 2253369 - protein, 7 aa, Cryptosporidium parvum
DKPVDTS

SEQ ID NO: 2253370 - protein, 6 aa, Cryptosporidium parvum
DKPYDE

SEQ ID NO: 2253371 - protein, 17 aa, Cryptosporidium parvum
DKPYQTPNSTLSNFGKE

SEQ ID NO: 2253372 - protein, 9 aa, Cryptosporidium parvum
DKQAEKQDI

SEQ ID NO: 2253373 - protein, 8 aa, Cryptosporidium parvum
DKQAEPGA

SEQ ID NO: 2253374 - protein, 18 aa, Cryptosporidium parvum
DKQKKHSSSGDDENNYNN

SEQ ID NO: 2253375 - protein, 7 aa, Cryptosporidium parvum
DKQNQES

SEQ ID NO: 2253376 - protein, 7 aa, Cryptosporidium parvum
DKQNSAL

SEQ ID NO: 2253377 - protein, 8 aa, Cryptosporidium parvum
DKQSGAQR

SEQ ID NO: 2253378 - protein, 7 aa, Cryptosporidium parvum
DKRDREE

SEQ ID NO: 2253379 - protein, 30 aa, Cryptosporidium parvum; identical to SEQ ID NO: 2137865

SEQ ID NO: 2253380 - protein, 8 aa, Cryptosporidium parvum
DKRGNSTV

SEQ ID NO: 2253381 - protein, 30 aa, Cryptosporidium parvum
DKRKRVQETEVDSEGNEEETSLKKNSVEVD

SEQ ID NO: 2253382 - protein, 4 aa, Cryptosporidium parvum
DKRN

SEQ ID NO: 2253383 - protein, 4 aa, Cryptosporidium parvum
DKRS

SEQ ID NO: 2253384 - protein, 9 aa, Cryptosporidium parvum
DKRYPDGIR

SEQ ID NO: 2253385 - protein, 4 aa, Cryptosporidium parvum
DKSA

SEQ ID NO: 2253386 - protein, 7 aa, Cryptosporidium parvum
DKSAFEK

SEQ ID NO: 2253387 - protein, 8 aa, Cryptosporidium parvum
DKSAGKVG

SEQ ID NO: 2253388 - protein, 10 aa, Cryptosporidium parvum
DKSDNSYHAK

SEQ ID NO: 2253389 - protein, 5 aa, Cryptosporidium parvum
DKSEQ

SEQ ID NO: 2253390 - protein, 8 aa, Cryptosporidium parvum
DKSGIYTS

SEQ ID NO: 2253391 - protein, 9 aa, Cryptosporidium parvum
DKSGSGQVE

SEQ ID NO: 2253392 - protein, 5 aa, Cryptosporidium parvum
DKSHL

SEQ ID NO: 2253393 - protein, 8 aa, Cryptosporidium parvum
DKSHNFGD

SEQ ID NO: 2253394 - protein, 15 aa, Cryptosporidium parvum
DKSISPEKSDGDKEL

SEQ ID NO: 2253395 - protein, 8 aa, Cryptosporidium parvum
DKSKDELT

SEQ ID NO: 2253396 - protein, 7 aa, Cryptosporidium parvum
DKSKRGY

SEQ ID NO: 2253397 - protein, 6 aa, Cryptosporidium parvum
DKSLDM

SEQ ID NO: 2253398 - protein, 9 aa, Cryptosporidium parvum
DKSLKQTLE

SEQ ID NO: 2253399 - protein, 19 aa, Cryptosporidium parvum
DKSLNNPDSLSNNISRNAS

SEQ ID NO: 2253400 - protein, 9 aa, Cryptosporidium parvum
DKSLSSSTS

SEQ ID NO: 2253401 - protein, 6 aa, Cryptosporidium parvum
DKSNKR

SEQ ID NO: 2253402 - protein, 9 aa, Cryptosporidium parvum
DKSNKSKKK

SEQ ID NO: 2253403 - protein, 6 aa, Cryptosporidium parvum
DKSNKV

SEQ ID NO: 2253404 - protein, 9 aa, Cryptosporidium parvum
DKSNPKLSN

SEQ ID NO: 2253405 - protein, 18 aa, Cryptosporidium parvum
DKSNSKVSGEELNENSTK

SEQ ID NO: 2253406 - protein, 6 aa, Cryptosporidium parvum
DKSNTI

SEQ ID NO: 2253407 - protein, 8 aa, Cryptosporidium parvum
DKSNYSDM

SEQ ID NO: 2253408 - protein, 4 aa, Cryptosporidium parvum
DKSP

SEQ ID NO: 2253409 - protein, 10 aa, Cryptosporidium parvum
DKSPEQATSS

SEQ ID NO: 2253410 - protein, 5 aa, Cryptosporidium parvum
DKSPK

SEQ ID NO: 2253411 - protein, 7 aa, Cryptosporidium parvum
DKSRDAF

SEQ ID NO: 2253412 - protein, 5 aa, Cryptosporidium parvum
DKSRI

SEQ ID NO: 2253413 - protein, 21 aa, Cryptosporidium parvum
DKSRQDKDLVAENKDALEEER

SEQ ID NO: 2253414 - protein, 8 aa, Cryptosporidium parvum
DKSRQSKS

SEQ ID NO: 2253415 - protein, 14 aa, Cryptosporidium parvum
DKSSGPNSEALPNP

SEQ ID NO: 2253416 - protein, 7 aa, Cryptosporidium parvum
DKSSKDF

SEQ ID NO: 2253417 - protein, 7 aa, Cryptosporidium parvum
DKSSKQL

SEQ ID NO: 2253418 - protein, 9 aa, Cryptosporidium parvum
DKSSPDGRK

SEQ ID NO: 2253419 - protein, 5 aa, Cryptosporidium parvum
DKSTI

SEQ ID NO: 2253420 - protein, 5 aa, Cryptosporidium parvum
DKSTN

SEQ ID NO: 2253421 - protein, 19 aa, Cryptosporidium parvum
DKSTSDSLDDSDDNKCDLT

SEQ ID NO: 2253422 - protein, 7 aa, Cryptosporidium parvum
DKTAETC

SEQ ID NO: 2253423 - protein, 5 aa, Cryptosporidium parvum
DKTEK

SEQ ID NO: 2253424 - protein, 10 aa, Cryptosporidium parvum
DKTEVERSDY

SEQ ID NO: 2253425 - protein, 7 aa, Cryptosporidium parvum
DKTGSIT

SEQ ID NO: 2253426 - protein, 8 aa, Cryptosporidium parvum
DKTKIKKK

SEQ ID NO: 2253427 - protein, 10 aa, Cryptosporidium parvum
DKTLEGGRKL

SEQ ID NO: 2253428 - protein, 8 aa, Cryptosporidium parvum
DKTNENTR

SEQ ID NO: 2253429 - protein, 15 aa, Cryptosporidium parvum
DKTPGPKYPGGPTGR

SEQ ID NO: 2253430 - protein, 5 aa, Cryptosporidium parvum
DKTQF

SEQ ID NO: 2253431 - protein, 9 aa, Cryptosporidium parvum
DKTSHEKAR

SEQ ID NO: 2253432 - protein, 25 aa, Cryptosporidium parvum
DKTSNSSESTSKRRQNKTSSSNNME

SEQ ID NO: 2253433 - protein, 6 aa, Cryptosporidium parvum
DKTSNV

SEQ ID NO: 2253434 - protein, 33 aa, Cryptosporidium parvum
DKTSQSTKDKATLSDESKNLSASAIKGRDKDES

SEQ ID NO: 2253435 - protein, 20 aa, Cryptosporidium parvum
DKTTGYTKAELSHKEAQRKR

SEQ ID NO: 2253436 - protein, 5 aa, Cryptosporidium parvum
DKTTL

SEQ ID NO: 2253437 - protein, 25 aa, Cryptosporidium parvum
DKTTRGEGGFGSTDKLDSVKGLPQK

SEQ ID NO: 2253438 - protein, 7 aa, Cryptosporidium parvum
DKTVKKS

SEQ ID NO: 2253439 - protein, 7 aa, Cryptosporidium parvum
DKTYEYN

SEQ ID NO: 2253440 - protein, 5 aa, Cryptosporidium parvum
DKVES

SEQ ID NO: 2253441 - protein, 9 aa, Cryptosporidium parvum
DKVKQENSQ

SEQ ID NO: 2253442 - protein, 4 aa, Cryptosporidium parvum
DKVN

SEQ ID NO: 2253443 - protein, 18 aa, Cryptosporidium parvum
DKVNSNIDNLGDDRFRDQ

SEQ ID NO: 2253444 - protein, 4 aa, Cryptosporidium parvum
DKVP

SEQ ID NO: 2253445 - protein, 5 aa, Cryptosporidium parvum
DKVQS

SEQ ID NO: 2253446 - protein, 19 aa, Cryptosporidium parvum
DKVSRIKAKDADLSGGRSD

SEQ ID NO: 2253447 - protein, 24 aa, Cryptosporidium parvum
DKWSSNDEININDNDNNNDNNNHQ

SEQ ID NO: 2253448 - protein, 7 aa, Cryptosporidium parvum
DKYEKND

SEQ ID NO: 2253449 - protein, 11 aa, Cryptosporidium parvum
DKYKSALNKSI

SEQ ID NO: 2253450 - protein, 5 aa, Cryptosporidium parvum
DKYLK

SEQ ID NO: 2253451 - protein, 8 aa, Cryptosporidium parvum
DKYNENDD

SEQ ID NO: 2253452 - protein, 6 aa, Cryptosporidium parvum
DKYNSQ

SEQ ID NO: 2253453 - protein, 11 aa, Cryptosporidium parvum
DKYPSSSEPIN

SEQ ID NO: 2253454 - protein, 12 aa, Cryptosporidium parvum
DLDAEKRRNNLV

SEQ ID NO: 2253455 - protein, 8 aa, Cryptosporidium parvum
DLDAPETV

SEQ ID NO: 2253456 - protein, 9 aa, Cryptosporidium parvum
DLDDGEGEE

SEQ ID NO: 2253457 - protein, 59 aa, Cryptosporidium parvum
DLDDISDDGGVGNKGKRTQKTLANKSKTDNQGKTKLNNLKKAKNTSSVKSSSKDKKQGL

SEQ ID NO: 2253458 - protein, 9 aa, Cryptosporidium parvum
DLDKNSLGK

SEQ ID NO: 2253459 - protein, 4 aa, Cryptosporidium parvum
DLDL

SEQ ID NO: 2253460 - protein, 25 aa, Cryptosporidium parvum
DLDNDNNNNNNNNNNNNSTNNINND

SEQ ID NO: 2253461 - protein, 8 aa, Cryptosporidium parvum
DLDNEDSR

SEQ ID NO: 2253462 - protein, 6 aa, Cryptosporidium parvum
DLDNTN

SEQ ID NO: 2253463 - protein, 9 aa, Cryptosporidium parvum
DLDQAEDNR

SEQ ID NO: 2253464 - protein, 5 aa, Cryptosporidium parvum
DLDSK

SEQ ID NO: 2253465 - protein, 11 aa, Cryptosporidium parvum
DLDTESEKRMR

SEQ ID NO: 2253466 - protein, 5 aa, Cryptosporidium parvum
DLDTL

SEQ ID NO: 2253467 - protein, 15 aa, Cryptosporidium parvum
DLEDDDDEDEFEPGD

SEQ ID NO: 2253468 - protein, 26 aa, Cryptosporidium parvum
DLEDEVEEEEGEEGEEGEVDEDESFD

SEQ ID NO: 2253469 - protein, 11 aa, Cryptosporidium parvum
DLEDGKEHGNV

SEQ ID NO: 2253470 - protein, 17 aa, Cryptosporidium parvum
DLEDSQDELSSDTDDIG

SEQ ID NO: 2253471 - protein, 19 aa, Cryptosporidium parvum
DLEEELEKNENEKDELNEQ

SEQ ID NO: 2253472 - protein, 6 aa, Cryptosporidium parvum
DLEEGK

SEQ ID NO: 2253473 - protein, 5 aa, Cryptosporidium parvum
DLEEH

SEQ ID NO: 2253474 - protein, 16 aa, Cryptosporidium parvum
DLEENTKDLKGYGGDL

SEQ ID NO: 2253475 - protein, 25 aa, Cryptosporidium parvum
DLEENTQGENKTKKKKNKKRGRSKI

SEQ ID NO: 2253476 - protein, 7 aa, Cryptosporidium parvum
DLEEREN

SEQ ID NO: 2253477 - protein, 8 aa, Cryptosporidium parvum
DLEESECE

SEQ ID NO: 2253478 - protein, 13 aa, Cryptosporidium parvum
DLENAQTDNYSGF

SEQ ID NO: 2253479 - protein, 70 aa, Cryptosporidium parvum
DLEPEKEQEQEHQSEQEPEQEPEQELEHEPDQDQDQEQKPEQEPERQPELEQEPEPDQKQEHQPEPDLEP

SEQ ID NO: 2253480 - protein, 8 aa, Cryptosporidium parvum
DLEPSGSL

SEQ ID NO: 2253481 - protein, 12 aa, Cryptosporidium parvum
DLEQRRGRNVYD

SEQ ID NO: 2253482 - protein, 9 aa, Cryptosporidium parvum
DLESKQAEL

SEQ ID NO: 2253483 - protein, 10 aa, Cryptosporidium parvum
DLGKEKNIEE

SEQ ID NO: 2253484 - protein, 6 aa, Cryptosporidium parvum
DLGRLN

SEQ ID NO: 2253485 - protein, 10 aa, Cryptosporidium parvum
DLGRTSPSLG

SEQ ID NO: 2253486 - protein, 9 aa, Cryptosporidium parvum
DLGSETTPV

SEQ ID NO: 2253487 - protein, 13 aa, Cryptosporidium parvum
DLHPGDLKKGLSD

SEQ ID NO: 2253488 - protein, 8 aa, Cryptosporidium parvum
DLIPKENQ

SEQ ID NO: 2253489 - protein, 5 aa, Cryptosporidium parvum
DLKDK

SEQ ID NO: 2253490 - protein, 13 aa, Cryptosporidium parvum
DLKDKNSKQNESA

SEQ ID NO: 2253491 - protein, 28 aa, Cryptosporidium parvum
DLKERPAMKNVGAKKKSSVKSKVNQQNI

SEQ ID NO: 2253492 - protein, 5 aa, Cryptosporidium parvum
DLKHG

SEQ ID NO: 2253493 - protein, 13 aa, Cryptosporidium parvum
DLKKPNVNKENNT

SEQ ID NO: 2253494 - protein, 8 aa, Cryptosporidium parvum
DLKNGKHN

SEQ ID NO: 2253495 - protein, 5 aa, Cryptosporidium parvum
DLKPE

SEQ ID NO: 2253496 - protein, 13 aa, Cryptosporidium parvum
DLKPVQSANDNEQ

SEQ ID NO: 2253497 - protein, 28 aa, Cryptosporidium parvum
DLKQKQKQNQKKKHKQQKLRGEEYESEN

SEQ ID NO: 2253498 - protein, 9 aa, Cryptosporidium parvum
DLKRSKSQE

SEQ ID NO: 2253499 - protein, 20 aa, Cryptosporidium parvum
DLKSDRDNSVVESQKSENNC

SEQ ID NO: 2253500 - protein, 6 aa, Cryptosporidium parvum
DLKSEN

SEQ ID NO: 2253501 - protein, 6 aa, Cryptosporidium parvum
DLKSKT

SEQ ID NO: 2253502 - protein, 19 aa, Cryptosporidium parvum
DLKTNDPNSNFSGKPSNIK

SEQ ID NO: 2253503 - protein, 5 aa, Cryptosporidium parvum
DLKYG

SEQ ID NO: 2253504 - protein, 42 aa, Cryptosporidium parvum
DLNDDKDVEMSDQNRANSSSEIKPHSETQNRESNIVNDGSKS

SEQ ID NO: 2253505 - protein, 4 aa, Cryptosporidium parvum
DLNE

SEQ ID NO: 2253506 - protein, 6 aa, Cryptosporidium parvum
DLNEET

SEQ ID NO: 2253507 - protein, 4 aa, Cryptosporidium parvum
DLNK

SEQ ID NO: 2253508 - protein, 6 aa, Cryptosporidium parvum
DLNKSP

SEQ ID NO: 2253509 - protein, 7 aa, Cryptosporidium parvum
DLNNDEP

SEQ ID NO: 2253510 - protein, 33 aa, Cryptosporidium parvum
DLNNINTNANSNIDANSSTGTNTLNVGDFNKDG

SEQ ID NO: 2253511 - protein, 22 aa, Cryptosporidium parvum
DLNNSKGGRVGGGHSNCNTNSL

SEQ ID NO: 2253512 - protein, 15 aa, Cryptosporidium parvum
DLNNTSEGKAPISTS

SEQ ID NO: 2253513 - protein, 12 aa, Cryptosporidium parvum
DLNQLGDNDNRK

SEQ ID NO: 2253514 - protein, 7 aa, Cryptosporidium parvum
DLNSLNE

SEQ ID NO: 2253515 - protein, 7 aa, Cryptosporidium parvum
DLNSNKK

SEQ ID NO: 2253516 - protein, 8 aa, Cryptosporidium parvum
DLNSRNQL

SEQ ID NO: 2253517 - protein, 5 aa, Cryptosporidium parvum
DLPAS

SEQ ID NO: 2253518 - protein, 16 aa, Cryptosporidium parvum
DLPDSNNDSDKDLPQG

SEQ ID NO: 2253519 - protein, 4 aa, Cryptosporidium parvum
DLPE

SEQ ID NO: 2253520 - protein, 6 aa, Cryptosporidium parvum
DLPEAD

SEQ ID NO: 2253521 - protein, 5 aa, Cryptosporidium parvum
DLPED

SEQ ID NO: 2253522 - protein, 5 aa, Cryptosporidium parvum
DLPEG

SEQ ID NO: 2253523 - protein, 6 aa, Cryptosporidium parvum
DLPEKK

SEQ ID NO: 2253524 - protein, 8 aa, Cryptosporidium parvum
DLPGLNQD

SEQ ID NO: 2253525 - protein, 12 aa, Cryptosporidium parvum
DLPGSADDEEMK

SEQ ID NO: 2253526 - protein, 7 aa, Cryptosporidium parvum
DLPKNEE

SEQ ID NO: 2253527 - protein, 6 aa, Cryptosporidium parvum
DLPKST

SEQ ID NO: 2253528 - protein, 8 aa, Cryptosporidium parvum
DLPPGQRI

SEQ ID NO: 2253529 - protein, 5 aa, Cryptosporidium parvum
DLPPH

SEQ ID NO: 2253530 - protein, 11 aa, Cryptosporidium parvum
DLPRPNNNMDN

SEQ ID NO: 2253531 - protein, 46 aa, Cryptosporidium parvum
DLPSDDEDDEDFENDEESYSSSSGSSDGDEEGGSEDEDEADDDDDD

SEQ ID NO: 2253532 - protein, 9 aa, Cryptosporidium parvum
DLPSDSYEE

SEQ ID NO: 2253533 - protein, 4 aa, Cryptosporidium parvum
DLPY

SEQ ID NO: 2253534 - protein, 13 aa, Cryptosporidium parvum
DLQEGLNEEERRK

SEQ ID NO: 2253535 - protein, 7 aa, Cryptosporidium parvum
DLQEKNN

SEQ ID NO: 2253536 - protein, 11 aa, Cryptosporidium parvum
DLQETEQPGLY

SEQ ID NO: 2253537 - protein, 4 aa, Cryptosporidium parvum
DLQI

SEQ ID NO: 2253538 - protein, 15 aa, Cryptosporidium parvum
DLQNEVNERREENAR

SEQ ID NO: 2253539 - protein, 45 aa, Cryptosporidium parvum
DLQSSGSTSPKNSLSHSRSSSPKTPQTNTNINSTFSSNSKSIPIK

SEQ ID NO: 2253540 - protein, 5 aa, Cryptosporidium parvum
DLRNC

SEQ ID NO: 2253541 - protein, 12 aa, Cryptosporidium parvum
DLRNESKKYQAK

SEQ ID NO: 2253542 - protein, 4 aa, Cryptosporidium parvum
DLRQ

SEQ ID NO: 2253543 - protein, 8 aa, Cryptosporidium parvum
DLSARKGK

SEQ ID NO: 2253544 - protein, 29 aa, Cryptosporidium parvum
DLSEEELDETLESESEENTENIESENEDD

SEQ ID NO: 2253545 - protein, 6 aa, Cryptosporidium parvum
DLSENT

SEQ ID NO: 2253546 - protein, 6 aa, Cryptosporidium parvum
DLSESS

SEQ ID NO: 2253547 - protein, 6 aa, Cryptosporidium parvum
DLSETH

SEQ ID NO: 2253548 - protein, 13 aa, Cryptosporidium parvum
DLSKNTGDLTEEI

SEQ ID NO: 2253549 - protein, 7 aa, Cryptosporidium parvum
DLSKYDG

SEQ ID NO: 2253550 - protein, 6 aa, Cryptosporidium parvum
DLSNIQ

SEQ ID NO: 2253551 - protein, 14 aa, Cryptosporidium parvum
DLSNPNIKSIESKR

SEQ ID NO: 2253552 - protein, 30 aa, Cryptosporidium parvum
DLSPQKADQGFSSPASNKLSSSDLSNQSTH

SEQ ID NO: 2253553 - protein, 20 aa, Cryptosporidium parvum
DLSRSEENCEDDKAGEKTTV

SEQ ID NO: 2253554 - protein, 7 aa, Cryptosporidium parvum
DLSSDRI

SEQ ID NO: 2253555 - protein, 8 aa, Cryptosporidium parvum
DLSSGLNT

SEQ ID NO: 2253556 - protein, 9 aa, Cryptosporidium parvum
DLSTLNTPH

SEQ ID NO: 2253557 - protein, 10 aa, Cryptosporidium parvum
DLTESRQKVG

SEQ ID NO: 2253558 - protein, 17 aa, Cryptosporidium parvum
DLTLNSSAEYNNFKDST

SEQ ID NO: 2253559 - protein, 11 aa, Cryptosporidium parvum
DLTSGTESEEC

SEQ ID NO: 2253560 - protein, 15 aa, Cryptosporidium parvum
DLTTPTAKTSEAVSG

SEQ ID NO: 2253561 - protein, 10 aa, Cryptosporidium parvum
DLYDGDDEEF

SEQ ID NO: 2253562 - protein, 9 aa, Cryptosporidium parvum
DLYSGNENG

SEQ ID NO: 2253563 - protein, 13 aa, Cryptosporidium parvum
DMDNSNKNNISEP

SEQ ID NO: 2253564 - protein, 11 aa, Cryptosporidium parvum
DMEEKDQGQRE

SEQ ID NO: 2253565 - protein, 5 aa, Cryptosporidium parvum
DMESK

SEQ ID NO: 2253566 - protein, 18 aa, Cryptosporidium parvum
DMESPEDFDEDDNSHFEQ

SEQ ID NO: 2253567 - protein, 5 aa, Cryptosporidium parvum
DMFQS

SEQ ID NO: 2253568 - protein, 16 aa, Cryptosporidium parvum
DMGDDRREGLGNNDDE

SEQ ID NO: 2253569 - protein, 11 aa, Cryptosporidium parvum
DMGGAGMKDPM

SEQ ID NO: 2253570 - protein, 6 aa, Cryptosporidium parvum
DMGKNQ

SEQ ID NO: 2253571 - protein, 8 aa, Cryptosporidium parvum
DMHNSSTN

SEQ ID NO: 2253572 - protein, 17 aa, Cryptosporidium parvum
DMKAEEANSDISNDSEI

SEQ ID NO: 2253573 - protein, 9 aa, Cryptosporidium parvum
DMNDDKNKE

SEQ ID NO: 2253574 - protein, 11 aa, Cryptosporidium parvum
DMNDSQNIKRG

SEQ ID NO: 2253575 - protein, 4 aa, Cryptosporidium parvum
DMNG

SEQ ID NO: 2253576 - protein, 8 aa, Cryptosporidium parvum
DMNGDGTL

SEQ ID NO: 2253577 - protein, 12 aa, Cryptosporidium parvum
DMNSSSNNNPLY

SEQ ID NO: 2253578 - protein, 5 aa, Cryptosporidium parvum
DMRQR

SEQ ID NO: 2253579 - protein, 8 aa, Cryptosporidium parvum
DMSDEMQQ

SEQ ID NO: 2253580 - protein, 5 aa, Cryptosporidium parvum
DMTNP

SEQ ID NO: 2253581 - protein, 5 aa, Cryptosporidium parvum
DMVDE

SEQ ID NO: 2253582 - protein, 13 aa, Cryptosporidium parvum
DMVTDSKKNSLSK

SEQ ID NO: 2253583 - protein, 4 aa, Cryptosporidium parvum
DNAE

SEQ ID NO: 2253584 - protein, 234 aa, Cryptosporidium parvum
DNANIKNNEQLDGQKDWEKDPKKDQKKSDEKQKDKKEAEKEVEKNAEKNAKKNTEKNQKKESENKVQEKGNKKREKEEADKAKTKEDVKKEVKKKDQKEGQKKETKINDQEKDPKKDQKKDPKKETKIKDQEKDPKKDQKKDLKKETKKDHKEDPKKDQKKDLKNKSDQAKTKDEKDTKKDSGKEVQKKDSSSQNKAKYKETMKEDNITDSESDHKEKKNAKIKKNSSSSSKSI

SEQ ID NO: 2253585 - protein, 12 aa, Cryptosporidium parvum
DNANSKSSFNQD

SEQ ID NO: 2253586 - protein, 11 aa, Cryptosporidium parvum
DNAPKSIQQQG

SEQ ID NO: 2253587 - protein, 23 aa, Cryptosporidium parvum
DNCLPGEKKSNDTSNNNIDDEGN

SEQ ID NO: 2253588 - protein, 4 aa, Cryptosporidium parvum
DNCN

SEQ ID NO: 2253589 - protein, 8 aa, Cryptosporidium parvum
DNDEDVRR

SEQ ID NO: 2253590 - protein, 9 aa, Cryptosporidium parvum
DNDEGGKYR

SEQ ID NO: 2253591 - protein, 11 aa, Cryptosporidium parvum
DNDKEFDHQSY

SEQ ID NO: 2253592 - protein, 23 aa, Cryptosporidium parvum
DNDKLNNSSDNTNNNSKIEDKEE

SEQ ID NO: 2253593 - protein, 7 aa, Cryptosporidium parvum
DNDKSEI

SEQ ID NO: 2253594 - protein, 16 aa, Cryptosporidium parvum
DNDSGSGKHKNKQIGD

SEQ ID NO: 2253595 - protein, 31 aa, Cryptosporidium parvum
DNDSNNDVKLKKEEKEKEHKQDNQKEQEDID

SEQ ID NO: 2253596 - protein, 4 aa, Cryptosporidium parvum
DNDT

SEQ ID NO: 2253597 - protein, 6 aa, Cryptosporidium parvum
DNDYAS

SEQ ID NO: 2253598 - protein, 6 aa, Cryptosporidium parvum
DNDYDE

SEQ ID NO: 2253599 - protein, 5 aa, Cryptosporidium parvum
DNEAK

SEQ ID NO: 2253600 - protein, 7 aa, Cryptosporidium parvum
DNEDLSN

SEQ ID NO: 2253601 - protein, 10 aa, Cryptosporidium parvum
DNEEIKKGGK

SEQ ID NO: 2253602 - protein, 7 aa, Cryptosporidium parvum
DNEETFD

SEQ ID NO: 2253603 - protein, 5 aa, Cryptosporidium parvum
DNEGN

SEQ ID NO: 2253604 - protein, 8 aa, Cryptosporidium parvum
DNEGNLNE

SEQ ID NO: 2253605 - protein, 7 aa, Cryptosporidium parvum
DNEITDE

SEQ ID NO: 2253606 - protein, 9 aa, Cryptosporidium parvum
DNEKLKNEI

SEQ ID NO: 2253607 - protein, 4 aa, Cryptosporidium parvum
DNEL

SEQ ID NO: 2253608 - protein, 29 aa, Cryptosporidium parvum
DNENNNNNNNNDNNNEYNKLQEKDEKNNI

SEQ ID NO: 2253609 - protein, 9 aa, Cryptosporidium parvum
DNEQKEANI

SEQ ID NO: 2253610 - protein, 7 aa, Cryptosporidium parvum
DNERDLP

SEQ ID NO: 2253611 - protein, 8 aa, Cryptosporidium parvum
DNERQSES

SEQ ID NO: 2253612 - protein, 5 aa, Cryptosporidium parvum
DNERS

SEQ ID NO: 2253613 - protein, 27 aa, Cryptosporidium parvum
DNESDHTCSADEVENECYSTPRRVTKN

SEQ ID NO: 2253614 - protein, 8 aa, Cryptosporidium parvum
DNESEKAL

SEQ ID NO: 2253615 - protein, 20 aa, Cryptosporidium parvum
DNESSTQCKNNPKRRSSEYE

SEQ ID NO: 2253616 - protein, 6 aa, Cryptosporidium parvum
DNESTY

SEQ ID NO: 2253617 - protein, 6 aa, Cryptosporidium parvum
DNETFS

SEQ ID NO: 2253618 - protein, 17 aa, Cryptosporidium parvum
DNETKSEMESDNENQSC

SEQ ID NO: 2253619 - protein, 6 aa, Cryptosporidium parvum
DNETPC

SEQ ID NO: 2253620 - protein, 4 aa, Cryptosporidium parvum
DNFD

SEQ ID NO: 2253621 - protein, 5 aa, Cryptosporidium parvum
DNFED

SEQ ID NO: 2253622 - protein, 20 aa, Cryptosporidium parvum
DNFEENQPKTLEERTFQGSL

SEQ ID NO: 2253623 - protein, 5 aa, Cryptosporidium parvum
DNFET

SEQ ID NO: 2253624 - protein, 6 aa, Cryptosporidium parvum
DNFKEN

SEQ ID NO: 2253625 - protein, 10 aa, Cryptosporidium parvum
DNGENSKQIS

SEQ ID NO: 2253626 - protein, 7 aa, Cryptosporidium parvum
DNGEPTC

SEQ ID NO: 2253627 - protein, 8 aa, Cryptosporidium parvum
DNGHTGNV

SEQ ID NO: 2253628 - protein, 28 aa, Cryptosporidium parvum
DNGLGKNNSSPNDTHKSSTQSNQNKDSL

SEQ ID NO: 2253629 - protein, 23 aa, Cryptosporidium parvum
DNGNNEELEKKYSDDEKDRIRKD

SEQ ID NO: 2253630 - protein, 26 aa, Cryptosporidium parvum
DNGNPKKNCGGDYEEFTDSAAEDKVS

SEQ ID NO: 2253631 - protein, 5 aa, Cryptosporidium parvum
DNGQR

SEQ ID NO: 2253632 - protein, 7 aa, Cryptosporidium parvum
DNGSGTI

SEQ ID NO: 2253633 - protein, 11 aa, Cryptosporidium parvum
DNGSKQDEKLK

SEQ ID NO: 2253634 - protein, 17 aa, Cryptosporidium parvum
DNGTGFKRSTRSRTMDD

SEQ ID NO: 2253635 - protein, 12 aa, Cryptosporidium parvum
DNHCNNDNNNTD

SEQ ID NO: 2253636 - protein, 6 aa, Cryptosporidium parvum
DNHKPE

SEQ ID NO: 2253637 - protein, 4 aa, Cryptosporidium parvum
DNHN

SEQ ID NO: 2253638 - protein, 11 aa, Cryptosporidium parvum
DNHSNYSSSKI

SEQ ID NO: 2253639 - protein, 4 aa, Cryptosporidium parvum
DNIE

SEQ ID NO: 2253640 - protein, 17 aa, Cryptosporidium parvum
DNIEDTINKKNDLDQDV

SEQ ID NO: 2253641 - protein, 9 aa, Cryptosporidium parvum
DNIENPNNK

SEQ ID NO: 2253642 - protein, 6 aa, Cryptosporidium parvum
DNIESN

SEQ ID NO: 2253643 - protein, 7 aa, Cryptosporidium parvum
DNIGRNK

SEQ ID NO: 2253644 - protein, 8 aa, Cryptosporidium parvum
DNIGSRLR

SEQ ID NO: 2253645 - protein, 13 aa, Cryptosporidium parvum
DNIKGKGRTSGSI

SEQ ID NO: 2253646 - protein, 6 aa, Cryptosporidium parvum
DNINNS

SEQ ID NO: 2253647 - protein, 7 aa, Cryptosporidium parvum
DNINPEN

SEQ ID NO: 2253648 - protein, 8 aa, Cryptosporidium parvum
DNIPGGGR

SEQ ID NO: 2253649 - protein, 6 aa, Cryptosporidium parvum
DNIPKI

SEQ ID NO: 2253650 - protein, 36 aa, Cryptosporidium parvum
DNIQDPNNFEQDLGENQEDERNEFQVPDENKVLENS

SEQ ID NO: 2253651 - protein, 13 aa, Cryptosporidium parvum
DNIRRVGNNDTIN

SEQ ID NO: 2253652 - protein, 13 aa, Cryptosporidium parvum
DNISSYKSGDAGL

SEQ ID NO: 2253653 - protein, 8 aa, Cryptosporidium parvum
DNISTEYR

SEQ ID NO: 2253654 - protein, 30 aa, Cryptosporidium parvum
DNISTNTCENNINNKRHKSESSKKFASNNN

SEQ ID NO: 2253655 - protein, 32 aa, Cryptosporidium parvum
DNISTSDQVDNQIPLPAKTKRRIAPTVLISYD

SEQ ID NO: 2253656 - protein, 6 aa, Cryptosporidium parvum
DNITHR

SEQ ID NO: 2253657 - protein, 5 aa, Cryptosporidium parvum
DNITT

SEQ ID NO: 2253658 - protein, 10 aa, Cryptosporidium parvum
DNKAYPNKGN

SEQ ID NO: 2253659 - protein, 4 aa, Cryptosporidium parvum
DNKD

SEQ ID NO: 2253660 - protein, 7 aa, Cryptosporidium parvum
DNKENEL

SEQ ID NO: 2253661 - protein, 11 aa, Cryptosporidium parvum
DNKESKTPRKI

SEQ ID NO: 2253662 - protein, 6 aa, Cryptosporidium parvum
DNKFQR

SEQ ID NO: 2253663 - protein, 8 aa, Cryptosporidium parvum
DNKGSYDG

SEQ ID NO: 2253664 - protein, 10 aa, Cryptosporidium parvum
DNKIDENNKH

SEQ ID NO: 2253665 - protein, 6 aa, Cryptosporidium parvum
DNKIEQ

SEQ ID NO: 2253666 - protein, 6 aa, Cryptosporidium parvum
DNKIPK

SEQ ID NO: 2253667 - protein, 13 aa, Cryptosporidium parvum
DNKISNKDLEDLD

SEQ ID NO: 2253668 - protein, 8 aa, Cryptosporidium parvum
DNKKIERM

SEQ ID NO: 2253669 - protein, 83 aa, Cryptosporidium parvum
DNKNEKDGDGDGDGDGDGDGDGDGDGDGDGDGDGEEERTTSTTTTTTTTTTTTTTTTTTTTTTTTTTTTTTTTTTSSTTTTEM

SEQ ID NO: 2253670 - protein, 12 aa, Cryptosporidium parvum
DNKNGNTEANSI

SEQ ID NO: 2253671 - protein, 7 aa, Cryptosporidium parvum
DNKQDLE

SEQ ID NO: 2253672 - protein, 23 aa, Cryptosporidium parvum
DNKRGEFISAGDDGEIALWRFDF

SEQ ID NO: 2253673 - protein, 20 aa, Cryptosporidium parvum
DNKRTHNSSLDSQASTMDSD

SEQ ID NO: 2253674 - protein, 16 aa, Cryptosporidium parvum
DNKSLNDESNKNVGES

SEQ ID NO: 2253675 - protein, 30 aa, Cryptosporidium parvum
DNKSNNTKYYNSSKSDARATKATSNDDESI

SEQ ID NO: 2253676 - protein, 7 aa, Cryptosporidium parvum
DNKSNSK

SEQ ID NO: 2253677 - protein, 6 aa, Cryptosporidium parvum
DNKSRL

SEQ ID NO: 2253678 - protein, 14 aa, Cryptosporidium parvum
DNKTNKNSTDKVST

SEQ ID NO: 2253679 - protein, 15 aa, Cryptosporidium parvum
DNKTNPYGPFSRNDE

SEQ ID NO: 2253680 - protein, 8 aa, Cryptosporidium parvum
DNLHSSDE

SEQ ID NO: 2253681 - protein, 8 aa, Cryptosporidium parvum
DNLKTGTA

SEQ ID NO: 2253682 - protein, 11 aa, Cryptosporidium parvum
DNLNNSSNSNH

SEQ ID NO: 2253683 - protein, 8 aa, Cryptosporidium parvum
DNLNQVPE

SEQ ID NO: 2253684 - protein, 7 aa, Cryptosporidium parvum
DNLSDDN

SEQ ID NO: 2253685 - protein, 7 aa, Cryptosporidium parvum
DNLSGEA

SEQ ID NO: 2253686 - protein, 11 aa, Cryptosporidium parvum
DNLSNSGKAPE

SEQ ID NO: 2253687 - protein, 32 aa, Cryptosporidium parvum
DNLSREKKLNADKELRQSCNQKRKHQVSITFI

SEQ ID NO: 2253688 - protein, 7 aa, Cryptosporidium parvum
DNLSTTR

SEQ ID NO: 2253689 - protein, 13 aa, Cryptosporidium parvum
DNMTLSNKTNVEE

SEQ ID NO: 2253690 - protein, 8 aa, Cryptosporidium parvum
DNNDDNLV

SEQ ID NO: 2253691 - protein, 6 aa, Cryptosporidium parvum
DNNDRE

SEQ ID NO: 2253692 - protein, 8 aa, Cryptosporidium parvum
DNNENEEL

SEQ ID NO: 2253693 - protein, 34 aa, Cryptosporidium parvum
DNNEPSDAEYKEPQAQQLNANSLSNYEPDHSETL

SEQ ID NO: 2253694 - protein, 17 aa, Cryptosporidium parvum
DNNFNNTNKSYVSSPNV

SEQ ID NO: 2253695 - protein, 8 aa, Cryptosporidium parvum
DNNHSDNF

SEQ ID NO: 2253696 - protein, 4 aa, Cryptosporidium parvum
DNNI

SEQ ID NO: 2253697 - protein, 30 aa, Cryptosporidium parvum
DNNIKGNNNNNNNNNNSNSNQNISNEADYD

SEQ ID NO: 2253698 - protein, 16 aa, Cryptosporidium parvum
DNNINNDGTSKNESGI

SEQ ID NO: 2253699 - protein, 13 aa, Cryptosporidium parvum
DNNINSNNLNPNM

SEQ ID NO: 2253700 - protein, 9 aa, Cryptosporidium parvum
DNNKDGEVD

SEQ ID NO: 2253701 - protein, 7 aa, Cryptosporidium parvum
DNNKEMN

SEQ ID NO: 2253702 - protein, 14 aa, Cryptosporidium parvum
DNNKSRSSRRPYTT

SEQ ID NO: 2253703 - protein, 6 aa, Cryptosporidium parvum
DNNLPS

SEQ ID NO: 2253704 - protein, 5 aa, Cryptosporidium parvum
DNNLS

SEQ ID NO: 2253705 - protein, 58 aa, Cryptosporidium parvum
DNNLTSNSDFNKSKMGVEKPSKVKKSKKRANKDINKGEVELSDSITKKQKKAKKSLIE

SEQ ID NO: 2253706 - protein, 17 aa, Cryptosporidium parvum
DNNMKGFSDSSSQEKIE

SEQ ID NO: 2253707 - protein, 8 aa, Cryptosporidium parvum
DNNNEKVE

SEQ ID NO: 2253708 - protein, 7 aa, Cryptosporidium parvum
DNNNKDL

SEQ ID NO: 2253709 - protein, 8 aa, Cryptosporidium parvum
DNNNNNNI

SEQ ID NO: 2253710 - protein, 15 aa, Cryptosporidium parvum
DNNNNNNNNKFTNSQ

SEQ ID NO: 2253711 - protein, 32 aa, Cryptosporidium parvum
DNNNNNSNNDNSNSHGHNQNSGPISNNINTSE

SEQ ID NO: 2253712 - protein, 4 aa, Cryptosporidium parvum
DNNP

SEQ ID NO: 2253713 - protein, 15 aa, Cryptosporidium parvum
DNNPISTLHNPWLVN

SEQ ID NO: 2253714 - protein, 30 aa, Cryptosporidium parvum; identical to SEQ ID NO: 2138127

SEQ ID NO: 2253715 - protein, 7 aa, Cryptosporidium parvum
DNNSEFE

SEQ ID NO: 2253716 - protein, 9 aa, Cryptosporidium parvum
DNNSELNEI

SEQ ID NO: 2253717 - protein, 6 aa, Cryptosporidium parvum
DNNSQQ

SEQ ID NO: 2253718 - protein, 8 aa, Cryptosporidium parvum
DNNSSIDA

SEQ ID NO: 2253719 - protein, 8 aa, Cryptosporidium parvum
DNNSSTET

SEQ ID NO: 2253720 - protein, 4 aa, Cryptosporidium parvum
DNNT

SEQ ID NO: 2253721 - protein, 9 aa, Cryptosporidium parvum
DNNTGKPRP

SEQ ID NO: 2253722 - protein, 9 aa, Cryptosporidium parvum
DNNTKNYSE

SEQ ID NO: 2253723 - protein, 13 aa, Cryptosporidium parvum
DNNTPEKHEKRDS

SEQ ID NO: 2253724 - protein, 16 aa, Cryptosporidium parvum
DNNTPRCPYWCNLICR

SEQ ID NO: 2253725 - protein, 9 aa, Cryptosporidium parvum
DNNTPSTKV

SEQ ID NO: 2253726 - protein, 8 aa, Cryptosporidium parvum
DNNTSSSL

SEQ ID NO: 2253727 - protein, 14 aa, Cryptosporidium parvum
DNNTTDLPENNGSH

SEQ ID NO: 2253728 - protein, 4 aa, Cryptosporidium parvum
DNNV

SEQ ID NO: 2253729 - protein, 78 aa, Cryptosporidium parvum
DNPDNNSNEGNHLNQNTKKTSKSTHNSNKKANTKSNNSKNSRKKKKYEDEFEDDYNAEEESIDEYSEYDESDDSQDLN

SEQ ID NO: 2253730 - protein, 4 aa, Cryptosporidium parvum
DNPE

SEQ ID NO: 2253731 - protein, 13 aa, Cryptosporidium parvum
DNPEKLNDGCGAE

SEQ ID NO: 2253732 - protein, 7 aa, Cryptosporidium parvum
DNPESNK

SEQ ID NO: 2253733 - protein, 8 aa, Cryptosporidium parvum
DNPETIQD

SEQ ID NO: 2253734 - protein, 8 aa, Cryptosporidium parvum
DNPKIDTF

SEQ ID NO: 2253735 - protein, 6 aa, Cryptosporidium parvum
DNPLSE

SEQ ID NO: 2253736 - protein, 8 aa, Cryptosporidium parvum
DNPNNDNY

SEQ ID NO: 2253737 - protein, 6 aa, Cryptosporidium parvum
DNPQNY

SEQ ID NO: 2253738 - protein, 15 aa, Cryptosporidium parvum
DNPSKEIPKPLRSNS

SEQ ID NO: 2253739 - protein, 21 aa, Cryptosporidium parvum
DNPWNTKTSNNISNNLRREDH

SEQ ID NO: 2253740 - protein, 4 aa, Cryptosporidium parvum
DNQA

SEQ ID NO: 2253741 - protein, 8 aa, Cryptosporidium parvum
DNQDNDQI

SEQ ID NO: 2253742 - protein, 7 aa, Cryptosporidium parvum
DNQEHTQ

SEQ ID NO: 2253743 - protein, 6 aa, Cryptosporidium parvum
DNQELN

SEQ ID NO: 2253744 - protein, 8 aa, Cryptosporidium parvum
DNQENSMS

SEQ ID NO: 2253745 - protein, 6 aa, Cryptosporidium parvum
DNQESA

SEQ ID NO: 2253746 - protein, 8 aa, Cryptosporidium parvum
DNQGCPAP

SEQ ID NO: 2253747 - protein, 10 aa, Cryptosporidium parvum
DNQGERISID

SEQ ID NO: 2253748 - protein, 10 aa, Cryptosporidium parvum
DNQNELRDEQ

SEQ ID NO: 2253749 - protein, 8 aa, Cryptosporidium parvum
DNQNSDIT

SEQ ID NO: 2253750 - protein, 10 aa, Cryptosporidium parvum
DNQPNANSNF

SEQ ID NO: 2253751 - protein, 5 aa, Cryptosporidium parvum
DNQQI

SEQ ID NO: 2253752 - protein, 15 aa, Cryptosporidium parvum
DNQRKKFGKTPPKVV

SEQ ID NO: 2253753 - protein, 10 aa, Cryptosporidium parvum
DNQRRSKTFS

SEQ ID NO: 2253754 - protein, 15 aa, Cryptosporidium parvum
DNQSASENEFPKPQN

SEQ ID NO: 2253755 - protein, 7 aa, Cryptosporidium parvum
DNQSEIA

SEQ ID NO: 2253756 - protein, 6 aa, Cryptosporidium parvum
DNQTHS

SEQ ID NO: 2253757 - protein, 5 aa, Cryptosporidium parvum
DNRDY

SEQ ID NO: 2253758 - protein, 4 aa, Cryptosporidium parvum
DNRG

SEQ ID NO: 2253759 - protein, 8 aa, Cryptosporidium parvum
DNRKIASE

SEQ ID NO: 2253760 - protein, 6 aa, Cryptosporidium parvum
DNRSQS

SEQ ID NO: 2253761 - protein, 7 aa, Cryptosporidium parvum
DNRSSYL

SEQ ID NO: 2253762 - protein, 7 aa, Cryptosporidium parvum
DNSATNF

SEQ ID NO: 2253763 - protein, 5 aa, Cryptosporidium parvum
DNSDE

SEQ ID NO: 2253764 - protein, 9 aa, Cryptosporidium parvum
DNSDEIQSS

SEQ ID NO: 2253765 - protein, 6 aa, Cryptosporidium parvum
DNSDTL

SEQ ID NO: 2253766 - protein, 7 aa, Cryptosporidium parvum
DNSECNS

SEQ ID NO: 2253767 - protein, 6 aa, Cryptosporidium parvum
DNSESI

SEQ ID NO: 2253768 - protein, 32 aa, Cryptosporidium parvum
DNSFNKSDKFENKSTEVKNIEEKNKKQKTSIN

SEQ ID NO: 2253769 - protein, 7 aa, Cryptosporidium parvum
DNSGGKN

SEQ ID NO: 2253770 - protein, 9 aa, Cryptosporidium parvum
DNSGMNGKE

SEQ ID NO: 2253771 - protein, 22 aa, Cryptosporidium parvum
DNSGYSDEIEEANDDLNNTLSK

SEQ ID NO: 2253772 - protein, 7 aa, Cryptosporidium parvum
DNSHENA

SEQ ID NO: 2253773 - protein, 11 aa, Cryptosporidium parvum
DNSHEYKRQES

SEQ ID NO: 2253774 - protein, 4 aa, Cryptosporidium parvum
DNSI

SEQ ID NO: 2253775 - protein, 12 aa, Cryptosporidium parvum
DNSIESSKIQEK

SEQ ID NO: 2253776 - protein, 6 aa, Cryptosporidium parvum
DNSISS

SEQ ID NO: 2253777 - protein, 10 aa, Cryptosporidium parvum
DNSKEKNPSW

SEQ ID NO: 2253778 - protein, 5 aa, Cryptosporidium parvum
DNSKS

SEQ ID NO: 2253779 - protein, 9 aa, Cryptosporidium parvum
DNSKSNTID

SEQ ID NO: 2253780 - protein, 8 aa, Cryptosporidium parvum
DNSLEEHE

SEQ ID NO: 2253781 - protein, 7 aa, Cryptosporidium parvum
DNSLSHS

SEQ ID NO: 2253782 - protein, 21 aa, Cryptosporidium parvum
DNSNNGNESNQVNIENSTDNN

SEQ ID NO: 2253783 - protein, 13 aa, Cryptosporidium parvum
DNSNNNDDSNNNK

SEQ ID NO: 2253784 - protein, 9 aa, Cryptosporidium parvum
DNSNNTEIN

SEQ ID NO: 2253785 - protein, 13 aa, Cryptosporidium parvum
DNSNSLGGSNTTD

SEQ ID NO: 2253786 - protein, 6 aa, Cryptosporidium parvum
DNSPYI

SEQ ID NO: 2253787 - protein, 20 aa, Cryptosporidium parvum
DNSQSHGQNYSQNQNQDDIQ

SEQ ID NO: 2253788 - protein, 7 aa, Cryptosporidium parvum
DNSSHES

SEQ ID NO: 2253789 - protein, 12 aa, Cryptosporidium parvum
DNSSLRSAIGGE

SEQ ID NO: 2253790 - protein, 22 aa, Cryptosporidium parvum
DNSSTNDQINDSISNNAITKTE

SEQ ID NO: 2253791 - protein, 8 aa, Cryptosporidium parvum
DNSTENRE

SEQ ID NO: 2253792 - protein, 7 aa, Cryptosporidium parvum
DNSTGIK

SEQ ID NO: 2253793 - protein, 5 aa, Cryptosporidium parvum
DNSYK

SEQ ID NO: 2253794 - protein, 8 aa, Cryptosporidium parvum
DNTEASKM

SEQ ID NO: 2253795 - protein, 9 aa, Cryptosporidium parvum
DNTENGEPL

SEQ ID NO: 2253796 - protein, 23 aa, Cryptosporidium parvum
DNTFDSMNSGELPNNNALTDDQI

SEQ ID NO: 2253797 - protein, 6 aa, Cryptosporidium parvum
DNTGHR

SEQ ID NO: 2253798 - protein, 22 aa, Cryptosporidium parvum
DNTIKETADPDSKNNANIDEIP

SEQ ID NO: 2253799 - protein, 11 aa, Cryptosporidium parvum
DNTKDERNDQE

SEQ ID NO: 2253800 - protein, 13 aa, Cryptosporidium parvum
DNTKENSKIKSLE

SEQ ID NO: 2253801 - protein, 6 aa, Cryptosporidium parvum
DNTNNL

SEQ ID NO: 2253802 - protein, 7 aa, Cryptosporidium parvum
DNTPNTC

SEQ ID NO: 2253803 - protein, 13 aa, Cryptosporidium parvum
DNTPSTHCTESQV

SEQ ID NO: 2253804 - protein, 7 aa, Cryptosporidium parvum
DNTQTYS

SEQ ID NO: 2253805 - protein, 15 aa, Cryptosporidium parvum
DNTRFSSASDFNREE

SEQ ID NO: 2253806 - protein, 14 aa, Cryptosporidium parvum
DNTSASIRKQLQSG

SEQ ID NO: 2253807 - protein, 16 aa, Cryptosporidium parvum
DNTSKQKSKSKSNRDL

SEQ ID NO: 2253808 - protein, 15 aa, Cryptosporidium parvum
DNTTSTQTSSSNSAY

SEQ ID NO: 2253809 - protein, 5 aa, Cryptosporidium parvum
DNTVT

SEQ ID NO: 2253810 - protein, 7 aa, Cryptosporidium parvum
DNVRRDE

SEQ ID NO: 2253811 - protein, 4 aa, Cryptosporidium parvum
DNVS

SEQ ID NO: 2253812 - protein, 18 aa, Cryptosporidium parvum
DNYDDNEDRVTGGRNGFG

SEQ ID NO: 2253813 - protein, 14 aa, Cryptosporidium parvum
DNYDGWNTEHSKGV

SEQ ID NO: 2253814 - protein, 4 aa, Cryptosporidium parvum
DNYG

SEQ ID NO: 2253815 - protein, 51 aa, Cryptosporidium parvum
DNYGNHSSRRENNQTRYEELGNNYKSTVQSDYNSFGPRNKHINTRSNPYST

SEQ ID NO: 2253816 - protein, 8 aa, Cryptosporidium parvum
DNYNPSKD

SEQ ID NO: 2253817 - protein, 6 aa, Cryptosporidium parvum
DNYPEG

SEQ ID NO: 2253818 - protein, 14 aa, Cryptosporidium parvum
DNYSKVSKPSWDGG

SEQ ID NO: 2253819 - protein, 14 aa, Cryptosporidium parvum
DNYTGIQQAKKKSQ

SEQ ID NO: 2253820 - protein, 5 aa, Cryptosporidium parvum
DNYYN

SEQ ID NO: 2253821 - protein, 13 aa, Cryptosporidium parvum
DPAAENERPEEEI

SEQ ID NO: 2253822 - protein, 5 aa, Cryptosporidium parvum
DPAGG

SEQ ID NO: 2253823 - protein, 5 aa, Cryptosporidium parvum
DPAGN

SEQ ID NO: 2253824 - protein, 6 aa, Cryptosporidium parvum
DPAHNL

SEQ ID NO: 2253825 - protein, 12 aa, Cryptosporidium parvum
DPARPNSNANEK

SEQ ID NO: 2253826 - protein, 11 aa, Cryptosporidium parvum
DPATGNKNPLK

SEQ ID NO: 2253827 - protein, 7 aa, Cryptosporidium parvum
DPAYDKC

SEQ ID NO: 2253828 - protein, 7 aa, Cryptosporidium parvum
DPDEDLE

SEQ ID NO: 2253829 - protein, 6 aa, Cryptosporidium parvum
DPDENV

SEQ ID NO: 2253830 - protein, 4 aa, Cryptosporidium parvum
DPDL

SEQ ID NO: 2253831 - protein, 13 aa, Cryptosporidium parvum
DPDLVSRKKRRQV

SEQ ID NO: 2253832 - protein, 8 aa, Cryptosporidium parvum
DPDNNISI

SEQ ID NO: 2253833 - protein, 10 aa, Cryptosporidium parvum
DPDNNYKSGL

SEQ ID NO: 2253834 - protein, 12 aa, Cryptosporidium parvum
DPDNSLRDRDDA

SEQ ID NO: 2253835 - protein, 13 aa, Cryptosporidium parvum
DPDPDNRSKSYVN

SEQ ID NO: 2253836 - protein, 5 aa, Cryptosporidium parvum
DPDSD

SEQ ID NO: 2253837 - protein, 14 aa, Cryptosporidium parvum
DPDTGKEIDGPGSG

SEQ ID NO: 2253838 - protein, 7 aa, Cryptosporidium parvum
DPDYDTS

SEQ ID NO: 2253839 - protein, 8 aa, Cryptosporidium parvum
DPEASNDY

SEQ ID NO: 2253840 - protein, 7 aa, Cryptosporidium parvum
DPEDRGY

SEQ ID NO: 2253841 - protein, 5 aa, Cryptosporidium parvum
DPEDS

SEQ ID NO: 2253842 - protein, 5 aa, Cryptosporidium parvum
DPEFG

SEQ ID NO: 2253843 - protein, 16 aa, Cryptosporidium parvum
DPEFNEDSDEDLESSH

SEQ ID NO: 2253844 - protein, 14 aa, Cryptosporidium parvum
DPEGKTGPSKPLPD

SEQ ID NO: 2253845 - protein, 11 aa, Cryptosporidium parvum
DPEHPNKETNN

SEQ ID NO: 2253846 - protein, 11 aa, Cryptosporidium parvum
DPEIKKKTNDW

SEQ ID NO: 2253847 - protein, 11 aa, Cryptosporidium parvum
DPEIPQKTSRT

SEQ ID NO: 2253848 - protein, 4 aa, Cryptosporidium parvum
DPEK

SEQ ID NO: 2253849 - protein, 15 aa, Cryptosporidium parvum
DPEKDVRGWGENDRG

SEQ ID NO: 2253850 - protein, 9 aa, Cryptosporidium parvum
DPEKRKEYD

SEQ ID NO: 2253851 - protein, 4 aa, Cryptosporidium parvum
DPEL

SEQ ID NO: 2253852 - protein, 35 aa, Cryptosporidium parvum; identical to SEQ ID NO: 2138243

SEQ ID NO: 2253853 - protein, 9 aa, Cryptosporidium parvum
DPENSTNLS

SEQ ID NO: 2253854 - protein, 5 aa, Cryptosporidium parvum
DPERG

SEQ ID NO: 2253855 - protein, 11 aa, Cryptosporidium parvum
DPERRKRYDEY

SEQ ID NO: 2253856 - protein, 8 aa, Cryptosporidium parvum
DPESRCTA

SEQ ID NO: 2253857 - protein, 7 aa, Cryptosporidium parvum
DPESSEV

SEQ ID NO: 2253858 - protein, 4 aa, Cryptosporidium parvum
DPET

SEQ ID NO: 2253859 - protein, 6 aa, Cryptosporidium parvum
DPETQI

SEQ ID NO: 2253860 - protein, 6 aa, Cryptosporidium parvum
DPETRK

SEQ ID NO: 2253861 - protein, 5 aa, Cryptosporidium parvum
DPEWA

SEQ ID NO: 2253862 - protein, 4 aa, Cryptosporidium parvum
DPFG

SEQ ID NO: 2253863 - protein, 12 aa, Cryptosporidium parvum
DPFGKKSIKKDE

SEQ ID NO: 2253864 - protein, 14 aa, Cryptosporidium parvum
DPFNGKKSKVKSKL

SEQ ID NO: 2253865 - protein, 7 aa, Cryptosporidium parvum
DPFPESS

SEQ ID NO: 2253866 - protein, 11 aa, Cryptosporidium parvum
DPFSKTPFANQ

SEQ ID NO: 2253867 - protein, 16 aa, Cryptosporidium parvum
DPFSQNKDNNKRKTRY

SEQ ID NO: 2253868 - protein, 6 aa, Cryptosporidium parvum
DPGIDS

SEQ ID NO: 2253869 - protein, 4 aa, Cryptosporidium parvum
DPGN

SEQ ID NO: 2253870 - protein, 11 aa, Cryptosporidium parvum
DPGSTNSRSKT

SEQ ID NO: 2253871 - protein, 13 aa, Cryptosporidium parvum
DPGSVSYSQVGGL

SEQ ID NO: 2253872 - protein, 10 aa, Cryptosporidium parvum
DPGTKTISIN

SEQ ID NO: 2253873 - protein, 6 aa, Cryptosporidium parvum
DPGVNP

SEQ ID NO: 2253874 - protein, 5 aa, Cryptosporidium parvum
DPGYS

SEQ ID NO: 2253875 - protein, 6 aa, Cryptosporidium parvum
DPHGNV

SEQ ID NO: 2253876 - protein, 4 aa, Cryptosporidium parvum
DPID

SEQ ID NO: 2253877 - protein, 13 aa, Cryptosporidium parvum
DPIKREDEEKMDD

SEQ ID NO: 2253878 - protein, 42 aa, Cryptosporidium parvum
DPISEKKDASGKSGRRTAHSSKKINSNSAKSTQTDSSNIGSS

SEQ ID NO: 2253879 - protein, 13 aa, Cryptosporidium parvum
DPISKDEVKREQM

SEQ ID NO: 2253880 - protein, 6 aa, Cryptosporidium parvum
DPISKV

SEQ ID NO: 2253881 - protein, 6 aa, Cryptosporidium parvum
DPISNH

SEQ ID NO: 2253882 - protein, 4 aa, Cryptosporidium parvum
DPKD

SEQ ID NO: 2253883 - protein, 8 aa, Cryptosporidium parvum
DPKEGGKF

SEQ ID NO: 2253884 - protein, 5 aa, Cryptosporidium parvum
DPKEL

SEQ ID NO: 2253885 - protein, 29 aa, Cryptosporidium parvum
DPKEVEYNNPAEEDEEDIGNRKSDKIKFQ

SEQ ID NO: 2253886 - protein, 11 aa, Cryptosporidium parvum
DPKGKEENSMR

SEQ ID NO: 2253887 - protein, 9 aa, Cryptosporidium parvum
DPKGKPKGF

SEQ ID NO: 2253888 - protein, 6 aa, Cryptosporidium parvum
DPKGNT

SEQ ID NO: 2253889 - protein, 7 aa, Cryptosporidium parvum
DPKKEEL

SEQ ID NO: 2253890 - protein, 42 aa, Cryptosporidium parvum
DPKMKKGISNSGTKNISEENQGKKLSSKTNVNSGSTKGEEIE

SEQ ID NO: 2253891 - protein, 7 aa, Cryptosporidium parvum
DPKMRPD

SEQ ID NO: 2253892 - protein, 8 aa, Cryptosporidium parvum
DPKPFPPP

SEQ ID NO: 2253893 - protein, 8 aa, Cryptosporidium parvum
DPKPNPEN

SEQ ID NO: 2253894 - protein, 11 aa, Cryptosporidium parvum
DPKRRERENDY

SEQ ID NO: 2253895 - protein, 8 aa, Cryptosporidium parvum
DPKTPIPI

SEQ ID NO: 2253896 - protein, 11 aa, Cryptosporidium parvum
DPLEKGSKTEE

SEQ ID NO: 2253897 - protein, 13 aa, Cryptosporidium parvum
DPLNPGQEPDPER

SEQ ID NO: 2253898 - protein, 5 aa, Cryptosporidium parvum
DPMRD

SEQ ID NO: 2253899 - protein, 7 aa, Cryptosporidium parvum
DPNADPE

SEQ ID NO: 2253900 - protein, 7 aa, Cryptosporidium parvum
DPNDKGY

SEQ ID NO: 2253901 - protein, 5 aa, Cryptosporidium parvum
DPNDS

SEQ ID NO: 2253902 - protein, 8 aa, Cryptosporidium parvum
DPNDSHNE

SEQ ID NO: 2253903 - protein, 9 aa, Cryptosporidium parvum
DPNEPLPNP

SEQ ID NO: 2253904 - protein, 4 aa, Cryptosporidium parvum
DPNG

SEQ ID NO: 2253905 - protein, 5 aa, Cryptosporidium parvum
DPNGE

SEQ ID NO: 2253906 - protein, 20 aa, Cryptosporidium parvum
DPNGVYEGDVNEKGLKHGNG

SEQ ID NO: 2253907 - protein, 9 aa, Cryptosporidium parvum
DPNLRPTPE

SEQ ID NO: 2253908 - protein, 4 aa, Cryptosporidium parvum
DPNN

SEQ ID NO: 2253909 - protein, 6 aa, Cryptosporidium parvum
DPNNPH

SEQ ID NO: 2253910 - protein, 5 aa, Cryptosporidium parvum
DPNNS

SEQ ID NO: 2253911 - protein, 8 aa, Cryptosporidium parvum
DPNPNTRW

SEQ ID NO: 2253912 - protein, 12 aa, Cryptosporidium parvum
DPNSISSPCEGR

SEQ ID NO: 2253913 - protein, 20 aa, Cryptosporidium parvum
DPNSKSAVKVPTDVDPTEVP

SEQ ID NO: 2253914 - protein, 7 aa, Cryptosporidium parvum
DPNSQNF

SEQ ID NO: 2253915 - protein, 8 aa, Cryptosporidium parvum
DPNSRLDQ

SEQ ID NO: 2253916 - protein, 6 aa, Cryptosporidium parvum
DPNTTL

SEQ ID NO: 2253917 - protein, 5 aa, Cryptosporidium parvum
DPNWT

SEQ ID NO: 2253918 - protein, 8 aa, Cryptosporidium parvum
DPPDDPRE

SEQ ID NO: 2253919 - protein, 7 aa, Cryptosporidium parvum
DPPGCKD

SEQ ID NO: 2253920 - protein, 4 aa, Cryptosporidium parvum
DPPK

SEQ ID NO: 2253921 - protein, 5 aa, Cryptosporidium parvum
DPPLP

SEQ ID NO: 2253922 - protein, 6 aa, Cryptosporidium parvum
DPPPTT

SEQ ID NO: 2253923 - protein, 6 aa, Cryptosporidium parvum
DPPQSI

SEQ ID NO: 2253924 - protein, 6 aa, Cryptosporidium parvum
DPPRPS

SEQ ID NO: 2253925 - protein, 5 aa, Cryptosporidium parvum
DPPSL

SEQ ID NO: 2253926 - protein, 6 aa, Cryptosporidium parvum
DPPSSQ

SEQ ID NO: 2253927 - protein, 8 aa, Cryptosporidium parvum
DPPTAKDL

SEQ ID NO: 2253928 - protein, 5 aa, Cryptosporidium parvum
DPPTL

SEQ ID NO: 2253929 - protein, 6 aa, Cryptosporidium parvum
DPPTLH

SEQ ID NO: 2253930 - protein, 5 aa, Cryptosporidium parvum
DPQCS

SEQ ID NO: 2253931 - protein, 10 aa, Cryptosporidium parvum
DPQFKSGYKG

SEQ ID NO: 2253932 - protein, 8 aa, Cryptosporidium parvum
DPQKALDD

SEQ ID NO: 2253933 - protein, 5 aa, Cryptosporidium parvum
DPQND

SEQ ID NO: 2253934 - protein, 6 aa, Cryptosporidium parvum
DPQPSN

SEQ ID NO: 2253935 - protein, 7 aa, Cryptosporidium parvum
DPQQGEA

SEQ ID NO: 2253936 - protein, 15 aa, Cryptosporidium parvum
DPQQKEGRSPSPRGV

SEQ ID NO: 2253937 - protein, 5 aa, Cryptosporidium parvum
DPQRS

SEQ ID NO: 2253938 - protein, 8 aa, Cryptosporidium parvum
DPQTSNNK

SEQ ID NO: 2253939 - protein, 21 aa, Cryptosporidium parvum
DPQVETEDKQTAKGSIQEETS

SEQ ID NO: 2253940 - protein, 6 aa, Cryptosporidium parvum
DPRERD

SEQ ID NO: 2253941 - protein, 10 aa, Cryptosporidium parvum
DPRKDPESRI

SEQ ID NO: 2253942 - protein, 20 aa, Cryptosporidium parvum
DPRKLNDPDSVKYGFILDMS

SEQ ID NO: 2253943 - protein, 9 aa, Cryptosporidium parvum
DPRLQAPEG

SEQ ID NO: 2253944 - protein, 7 aa, Cryptosporidium parvum
DPRLRPS

SEQ ID NO: 2253945 - protein, 5 aa, Cryptosporidium parvum
DPRMP

SEQ ID NO: 2253946 - protein, 5 aa, Cryptosporidium parvum
DPRNA

SEQ ID NO: 2253947 - protein, 6 aa, Cryptosporidium parvum
DPRTFR

SEQ ID NO: 2253948 - protein, 6 aa, Cryptosporidium parvum
DPRTGR

SEQ ID NO: 2253949 - protein, 9 aa, Cryptosporidium parvum
DPSGTYTQY

SEQ ID NO: 2253950 - protein, 7 aa, Cryptosporidium parvum
DPSIELS

SEQ ID NO: 2253951 - protein, 6 aa, Cryptosporidium parvum
DPSKAI

SEQ ID NO: 2253952 - protein, 8 aa, Cryptosporidium parvum
DPSKINSA

SEQ ID NO: 2253953 - protein, 8 aa, Cryptosporidium parvum
DPSKQIYG

SEQ ID NO: 2253954 - protein, 6 aa, Cryptosporidium parvum
DPSKSI

SEQ ID NO: 2253955 - protein, 5 aa, Cryptosporidium parvum
DPSLG

SEQ ID NO: 2253956 - protein, 11 aa, Cryptosporidium parvum
DPSLQSDSGQV

SEQ ID NO: 2253957 - protein, 9 aa, Cryptosporidium parvum
DPSNADAHR

SEQ ID NO: 2253958 - protein, 10 aa, Cryptosporidium parvum
DPSNERQSEI

SEQ ID NO: 2253959 - protein, 7 aa, Cryptosporidium parvum
DPSNFND

SEQ ID NO: 2253960 - protein, 8 aa, Cryptosporidium parvum
DPSNRPNV

SEQ ID NO: 2253961 - protein, 7 aa, Cryptosporidium parvum
DPSNSCE

SEQ ID NO: 2253962 - protein, 4 aa, Cryptosporidium parvum
DPSP

SEQ ID NO: 2253963 - protein, 5 aa, Cryptosporidium parvum
DPSSC

SEQ ID NO: 2253964 - protein, 8 aa, Cryptosporidium parvum
DPSSENLE

SEQ ID NO: 2253965 - protein, 7 aa, Cryptosporidium parvum
DPSSGTI

SEQ ID NO: 2253966 - protein, 10 aa, Cryptosporidium parvum
DPSSNDGEPL

SEQ ID NO: 2253967 - protein, 4 aa, Cryptosporidium parvum
DPST

SEQ ID NO: 2253968 - protein, 7 aa, Cryptosporidium parvum
DPSTAKS

SEQ ID NO: 2253969 - protein, 6 aa, Cryptosporidium parvum
DPSTQH

SEQ ID NO: 2253970 - protein, 9 aa, Cryptosporidium parvum
DPSTSNYDK

SEQ ID NO: 2253971 - protein, 6 aa, Cryptosporidium parvum
DPSVKV

SEQ ID NO: 2253972 - protein, 4 aa, Cryptosporidium parvum
DPSY

SEQ ID NO: 2253973 - protein, 8 aa, Cryptosporidium parvum
DPTADKRR

SEQ ID NO: 2253974 - protein, 8 aa, Cryptosporidium parvum
DPTARGSV

SEQ ID NO: 2253975 - protein, 8 aa, Cryptosporidium parvum
DPTDNDSL

SEQ ID NO: 2253976 - protein, 4 aa, Cryptosporidium parvum
DPTI

SEQ ID NO: 2253977 - protein, 4 aa, Cryptosporidium parvum
DPTN

SEQ ID NO: 2253978 - protein, 6 aa, Cryptosporidium parvum
DPTNEN

SEQ ID NO: 2253979 - protein, 11 aa, Cryptosporidium parvum
DPTNPIYKPTE

SEQ ID NO: 2253980 - protein, 8 aa, Cryptosporidium parvum
DPTRDEHA

SEQ ID NO: 2253981 - protein, 5 aa, Cryptosporidium parvum
DPTSN

SEQ ID NO: 2253982 - protein, 4 aa, Cryptosporidium parvum
DPTT

SEQ ID NO: 2253983 - protein, 7 aa, Cryptosporidium parvum
DPTTINS

SEQ ID NO: 2253984 - protein, 14 aa, Cryptosporidium parvum
DPVFNSESEDENVS

SEQ ID NO: 2253985 - protein, 4 aa, Cryptosporidium parvum
DPVR

SEQ ID NO: 2253986 - protein, 5 aa, Cryptosporidium parvum
DPVSS

SEQ ID NO: 2253987 - protein, 6 aa, Cryptosporidium parvum
DPVSTN

SEQ ID NO: 2253988 - protein, 6 aa, Cryptosporidium parvum
DPWSPV

SEQ ID NO: 2253989 - protein, 6 aa, Cryptosporidium parvum
DPYAAD

SEQ ID NO: 2253990 - protein, 7 aa, Cryptosporidium parvum
DPYASFT

SEQ ID NO: 2253991 - protein, 4 aa, Cryptosporidium parvum
DPYG

SEQ ID NO: 2253992 - protein, 8 aa, Cryptosporidium parvum
DPYHQPGQ

SEQ ID NO: 2253993 - protein, 13 aa, Cryptosporidium parvum
DPYSQSIASNNDN

SEQ ID NO: 2253994 - protein, 8 aa, Cryptosporidium parvum
DQADSAKI

SEQ ID NO: 2253995 - protein, 18 aa, Cryptosporidium parvum
DQAEYKRMKTTGGTMDTS

SEQ ID NO: 2253996 - protein, 5 aa, Cryptosporidium parvum
DQAQD

SEQ ID NO: 2253997 - protein, 6 aa, Cryptosporidium parvum
DQAVQS

SEQ ID NO: 2253998 - protein, 13 aa, Cryptosporidium parvum
DQAYSRNQSEFER

SEQ ID NO: 2253999 - protein, 5 aa, Cryptosporidium parvum
DQDEK

SEQ ID NO: 2254000 - protein, 7 aa, Cryptosporidium parvum
DQDETKM

SEQ ID NO: 2254001 - protein, 5 aa, Cryptosporidium parvum
DQDGE

SEQ ID NO: 2254002 - protein, 5 aa, Cryptosporidium parvum
DQDGL

SEQ ID NO: 2254003 - protein, 10 aa, Cryptosporidium parvum
DQDGNGKITA

SEQ ID NO: 2254004 - protein, 8 aa, Cryptosporidium parvum
DQDMDEEK

SEQ ID NO: 2254005 - protein, 10 aa, Cryptosporidium parvum
DQDNEGSATT

SEQ ID NO: 2254006 - protein, 11 aa, Cryptosporidium parvum
DQDNNINSNSQ

SEQ ID NO: 2254007 - protein, 12 aa, Cryptosporidium parvum
DQDPKKTEKKIS

SEQ ID NO: 2254008 - protein, 5 aa, Cryptosporidium parvum
DQDRG

SEQ ID NO: 2254009 - protein, 7 aa, Cryptosporidium parvum
DQDSTNV

SEQ ID NO: 2254010 - protein, 9 aa, Cryptosporidium parvum
DQDTATPYN

SEQ ID NO: 2254011 - protein, 6 aa, Cryptosporidium parvum
DQDTLE

SEQ ID NO: 2254012 - protein, 6 aa, Cryptosporidium parvum
DQDTVT

SEQ ID NO: 2254013 - protein, 7 aa, Cryptosporidium parvum
DQDYGSK

SEQ ID NO: 2254014 - protein, 5 aa, Cryptosporidium parvum
DQEAR

SEQ ID NO: 2254015 - protein, 71 aa, Cryptosporidium parvum
DQEEEGEEEEEEGEEEEEEEEEEEEEEEEDDDDDDDDDDDDEDEQGYHNSRKKRSINTRKNNRKCSKRKRF

SEQ ID NO: 2254016 - protein, 9 aa, Cryptosporidium parvum
DQEETVNYK

SEQ ID NO: 2254017 - protein, 19 aa, Cryptosporidium parvum
DQEGNVKKKKLEKIRGTAR

SEQ ID NO: 2254018 - protein, 14 aa, Cryptosporidium parvum
DQEGSAPKQCRPIT

SEQ ID NO: 2254019 - protein, 6 aa, Cryptosporidium parvum
DQEIDT

SEQ ID NO: 2254020 - protein, 6 aa, Cryptosporidium parvum
DQEIGN

SEQ ID NO: 2254021 - protein, 8 aa, Cryptosporidium parvum
DQEKNSKS

SEQ ID NO: 2254022 - protein, 9 aa, Cryptosporidium parvum
DQENGSNVK

SEQ ID NO: 2254023 - protein, 6 aa, Cryptosporidium parvum
DQENNL

SEQ ID NO: 2254024 - protein, 6 aa, Cryptosporidium parvum
DQENSM

SEQ ID NO: 2254025 - protein, 6 aa, Cryptosporidium parvum
DQENVQ

SEQ ID NO: 2254026 - protein, 13 aa, Cryptosporidium parvum
DQEPASEDSKHNQ

SEQ ID NO: 2254027 - protein, 10 aa, Cryptosporidium parvum
DQEQKNDEVT

SEQ ID NO: 2254028 - protein, 18 aa, Cryptosporidium parvum
DQEQSEEGINNDGGSYNK

SEQ ID NO: 2254029 - protein, 4 aa, Cryptosporidium parvum
DQER

SEQ ID NO: 2254030 - protein, 9 aa, Cryptosporidium parvum
DQERDDEDE

SEQ ID NO: 2254031 - protein, 6 aa, Cryptosporidium parvum
DQFKKE

SEQ ID NO: 2254032 - protein, 15 aa, Cryptosporidium parvum
DQFSENENINRNSEL

SEQ ID NO: 2254033 - protein, 28 aa, Cryptosporidium parvum
DQGEDEVTDSSSSLFSNSESNIKTTISN

SEQ ID NO: 2254034 - protein, 7 aa, Cryptosporidium parvum
DQGENNR

SEQ ID NO: 2254035 - protein, 4 aa, Cryptosporidium parvum
DQGG

SEQ ID NO: 2254036 - protein, 7 aa, Cryptosporidium parvum
DQGGEQL

SEQ ID NO: 2254037 - protein, 7 aa, Cryptosporidium parvum
DQGGEYN

SEQ ID NO: 2254038 - protein, 4 aa, Cryptosporidium parvum
DQGL

SEQ ID NO: 2254039 - protein, 5 aa, Cryptosporidium parvum
DQGQL

SEQ ID NO: 2254040 - protein, 12 aa, Cryptosporidium parvum
DQGRRTDRFERP

SEQ ID NO: 2254041 - protein, 7 aa, Cryptosporidium parvum
DQGSEKY

SEQ ID NO: 2254042 - protein, 4 aa, Cryptosporidium parvum
DQGY

SEQ ID NO: 2254043 - protein, 24 aa, Cryptosporidium parvum
DQHESRKSQYVSTEYNETENISTY

SEQ ID NO: 2254044 - protein, 4 aa, Cryptosporidium parvum
DQHG

SEQ ID NO: 2254045 - protein, 36 aa, Cryptosporidium parvum
DQIELDGDANDNNRTNSLIGQNKEGRGVTEDSVEAR

SEQ ID NO: 2254046 - protein, 10 aa, Cryptosporidium parvum
DQIETSKGGQ

SEQ ID NO: 2254047 - protein, 15 aa, Cryptosporidium parvum
DQINTQEKDSLESKI

SEQ ID NO: 2254048 - protein, 10 aa, Cryptosporidium parvum
DQIPSSVKSY

SEQ ID NO: 2254049 - protein, 31 aa, Cryptosporidium parvum
DQISKKPNAFVGTSTSQKSDQNNLSNDNQNQ

SEQ ID NO: 2254050 - protein, 21 aa, Cryptosporidium parvum
DQISNENSTPRSELKRKKKGL

SEQ ID NO: 2254051 - protein, 16 aa, Cryptosporidium parvum
DQISQKKEKRRGGTGV

SEQ ID NO: 2254052 - protein, 11 aa, Cryptosporidium parvum
DQISSTSSASF

SEQ ID NO: 2254053 - protein, 15 aa, Cryptosporidium parvum
DQKDDEKEGFGEDEM

SEQ ID NO: 2254054 - protein, 7 aa, Cryptosporidium parvum
DQKENTN

SEQ ID NO: 2254055 - protein, 10 aa, Cryptosporidium parvum
DQKINGKNDY

SEQ ID NO: 2254056 - protein, 21 aa, Cryptosporidium parvum
DQKKDSNTNLHAKKEDGNYPP

SEQ ID NO: 2254057 - protein, 31 aa, Cryptosporidium parvum
DQKKQSKSNKRYIHSSSSRKANNSGAPANSN

SEQ ID NO: 2254058 - protein, 10 aa, Cryptosporidium parvum
DQKKRQALEN

SEQ ID NO: 2254059 - protein, 14 aa, Cryptosporidium parvum
DQKNDKIIKQESEI

SEQ ID NO: 2254060 - protein, 15 aa, Cryptosporidium parvum
DQKNGVSCSCNSPNC

SEQ ID NO: 2254061 - protein, 9 aa, Cryptosporidium parvum
DQKNLDSEY

SEQ ID NO: 2254062 - protein, 28 aa, Cryptosporidium parvum
DQKNNSLKSSIPNSKKCSKKISSAPKNE

SEQ ID NO: 2254063 - protein, 5 aa, Cryptosporidium parvum
DQKPK

SEQ ID NO: 2254064 - protein, 4 aa, Cryptosporidium parvum
DQKR

SEQ ID NO: 2254065 - protein, 27 aa, Cryptosporidium parvum
DQKSNDGSQSNSSSSDQFSNKNNGTLN

SEQ ID NO: 2254066 - protein, 30 aa, Cryptosporidium parvum
DQKSTHTTKSDQSQKELESYSIENENEFEY

SEQ ID NO: 2254067 - protein, 17 aa, Cryptosporidium parvum
DQKSTNQSEDFGSRSNL

SEQ ID NO: 2254068 - protein, 7 aa, Cryptosporidium parvum
DQKTWKE

SEQ ID NO: 2254069 - protein, 9 aa, Cryptosporidium parvum
DQLQDDGED

SEQ ID NO: 2254070 - protein, 14 aa, Cryptosporidium parvum
DQLSKRKKKEKIQP

SEQ ID NO: 2254071 - protein, 10 aa, Cryptosporidium parvum
DQLTSKSEIG

SEQ ID NO: 2254072 - protein, 4 aa, Cryptosporidium parvum
DQLV

SEQ ID NO: 2254073 - protein, 6 aa, Cryptosporidium parvum
DQMNSN

SEQ ID NO: 2254074 - protein, 6 aa, Cryptosporidium parvum
DQMREE

SEQ ID NO: 2254075 - protein, 6 aa, Cryptosporidium parvum
DQNDHS

SEQ ID NO: 2254076 - protein, 10 aa, Cryptosporidium parvum
DQNENSKIGR

SEQ ID NO: 2254077 - protein, 17 aa, Cryptosporidium parvum
DQNGYGSDEYNTENQGV

SEQ ID NO: 2254078 - protein, 8 aa, Cryptosporidium parvum
DQNIQEAQ

SEQ ID NO: 2254079 - protein, 21 aa, Cryptosporidium parvum
DQNIQGKKNNGNRNNQKDEQI

SEQ ID NO: 2254080 - protein, 24 aa, Cryptosporidium parvum
DQNISVPSSSYTNFTNQSSANTIS

SEQ ID NO: 2254081 - protein, 8 aa, Cryptosporidium parvum
DQNKQNSL

SEQ ID NO: 2254082 - protein, 12 aa, Cryptosporidium parvum
DQNKRRNNSLTK

SEQ ID NO: 2254083 - protein, 10 aa, Cryptosporidium parvum
DQNKSNEEEL

SEQ ID NO: 2254084 - protein, 7 aa, Cryptosporidium parvum
DQNLQNK

SEQ ID NO: 2254085 - protein, 10 aa, Cryptosporidium parvum
DQNPQNDTTG

SEQ ID NO: 2254086 - protein, 24 aa, Cryptosporidium parvum
DQNSGNSTKSDSKKHSQTSNEQAK

SEQ ID NO: 2254087 - protein, 10 aa, Cryptosporidium parvum
DQNSPNFQSP

SEQ ID NO: 2254088 - protein, 15 aa, Cryptosporidium parvum
DQNSQLATNNLNNQN

SEQ ID NO: 2254089 - protein, 13 aa, Cryptosporidium parvum
DQNTCSSQSMSQN

SEQ ID NO: 2254090 - protein, 13 aa, Cryptosporidium parvum
DQNTTKDHNKNVS

SEQ ID NO: 2254091 - protein, 9 aa, Cryptosporidium parvum
DQNVSSSIQ

SEQ ID NO: 2254092 - protein, 4 aa, Cryptosporidium parvum
DQPL

SEQ ID NO: 2254093 - protein, 6 aa, Cryptosporidium parvum
DQPQNI

SEQ ID NO: 2254094 - protein, 8 aa, Cryptosporidium parvum
DQPSEPNK

SEQ ID NO: 2254095 - protein, 12 aa, Cryptosporidium parvum
DQPSEVREEPCG

SEQ ID NO: 2254096 - protein, 5 aa, Cryptosporidium parvum
DQQEI

SEQ ID NO: 2254097 - protein, 10 aa, Cryptosporidium parvum
DQQGSNPSTE

SEQ ID NO: 2254098 - protein, 7 aa, Cryptosporidium parvum
DQQSSHV

SEQ ID NO: 2254099 - protein, 5 aa, Cryptosporidium parvum
DQQYG

SEQ ID NO: 2254100 - protein, 4 aa, Cryptosporidium parvum
DQRI

SEQ ID NO: 2254101 - protein, 8 aa, Cryptosporidium parvum
DQRNGTIG

SEQ ID NO: 2254102 - protein, 5 aa, Cryptosporidium parvum
DQRRR

SEQ ID NO: 2254103 - protein, 10 aa, Cryptosporidium parvum
DQRSLSTPTE

SEQ ID NO: 2254104 - protein, 4 aa, Cryptosporidium parvum
DQSD

SEQ ID NO: 2254105 - protein, 12 aa, Cryptosporidium parvum
DQSEIKSKTEPY

SEQ ID NO: 2254106 - protein, 28 aa, Cryptosporidium parvum
DQSGKKGGSRTEVRKRKLNSNASINSSI

SEQ ID NO: 2254107 - protein, 38 aa, Cryptosporidium parvum
DQSGMSSSSATSSSSPPLPSSINSTSNTSSLGGEISGI

SEQ ID NO: 2254108 - protein, 11 aa, Cryptosporidium parvum
DQSKSIEYSDA

SEQ ID NO: 2254109 - protein, 9 aa, Cryptosporidium parvum
DQSNDETGY

SEQ ID NO: 2254110 - protein, 6 aa, Cryptosporidium parvum
DQSNVN

SEQ ID NO: 2254111 - protein, 11 aa, Cryptosporidium parvum
DQSPISESKSS

SEQ ID NO: 2254112 - protein, 8 aa, Cryptosporidium parvum
DQSPVNNP

SEQ ID NO: 2254113 - protein, 12 aa, Cryptosporidium parvum
DQSSSAASTNPF

SEQ ID NO: 2254114 - protein, 53 aa, Cryptosporidium parvum
DQSSSSSSSSSDNNNDNNSPSISDNNSSLSSNNNYSSPNNLQSKLSNSPQINN

SEQ ID NO: 2254115 - protein, 11 aa, Cryptosporidium parvum
DQSTEYNASEV

SEQ ID NO: 2254116 - protein, 7 aa, Cryptosporidium parvum
DQSVEPV

SEQ ID NO: 2254117 - protein, 7 aa, Cryptosporidium parvum
DQTANDC

SEQ ID NO: 2254118 - protein, 4 aa, Cryptosporidium parvum
DQTI

SEQ ID NO: 2254119 - protein, 10 aa, Cryptosporidium parvum
DQTKNPIPGN

SEQ ID NO: 2254120 - protein, 50 aa, Cryptosporidium parvum
DQTKSQNSKYSLRNKSQTSASSTNNSPKKGGRGSSFNHNKANSNNQNRQF

SEQ ID NO: 2254121 - protein, 22 aa, Cryptosporidium parvum
DQTNKRASGLKRGRFNKESNEL

SEQ ID NO: 2254122 - protein, 8 aa, Cryptosporidium parvum
DQTNLAKN

SEQ ID NO: 2254123 - protein, 6 aa, Cryptosporidium parvum
DQTNSK

SEQ ID NO: 2254124 - protein, 7 aa, Cryptosporidium parvum
DQTQDEM

SEQ ID NO: 2254125 - protein, 5 aa, Cryptosporidium parvum
DQTRG

SEQ ID NO: 2254126 - protein, 10 aa, Cryptosporidium parvum
DQTSSDDSHN

SEQ ID NO: 2254127 - protein, 4 aa, Cryptosporidium parvum
DQVA

SEQ ID NO: 2254128 - protein, 18 aa, Cryptosporidium parvum
DQVKNRNGISTNKNISNV

SEQ ID NO: 2254129 - protein, 4 aa, Cryptosporidium parvum
DQVS

SEQ ID NO: 2254130 - protein, 21 aa, Cryptosporidium parvum
DQVSEESVSGIRQKSKEKDET

SEQ ID NO: 2254131 - protein, 6 aa, Cryptosporidium parvum
DQWNQA

SEQ ID NO: 2254132 - protein, 7 aa, Cryptosporidium parvum
DQWTQGG

SEQ ID NO: 2254133 - protein, 13 aa, Cryptosporidium parvum
DQYEDDTSSNYSF

SEQ ID NO: 2254134 - protein, 9 aa, Cryptosporidium parvum
DQYRKSPLP

SEQ ID NO: 2254135 - protein, 7 aa, Cryptosporidium parvum
DRAPQNL

SEQ ID NO: 2254136 - protein, 8 aa, Cryptosporidium parvum
DRDGSEIE

SEQ ID NO: 2254137 - protein, 4 aa, Cryptosporidium parvum
DRDN

SEQ ID NO: 2254138 - protein, 31 aa, Cryptosporidium parvum
DRDPGSESQIRSSSRRKGNIKNTPVSKSRRV

SEQ ID NO: 2254139 - protein, 18 aa, Cryptosporidium parvum
DRDSESGLTDRQSNKVES

SEQ ID NO: 2254140 - protein, 6 aa, Cryptosporidium parvum
DRDSFD

SEQ ID NO: 2254141 - protein, 22 aa, Cryptosporidium parvum
DREDESSRYGRRSNKWNNRGYG

SEQ ID NO: 2254142 - protein, 9 aa, Cryptosporidium parvum
DREGNPRKV

SEQ ID NO: 2254143 - protein, 7 aa, Cryptosporidium parvum
DREGSSA

SEQ ID NO: 2254144 - protein, 16 aa, Cryptosporidium parvum
DREISTRDENSKFEEA

SEQ ID NO: 2254145 - protein, 7 aa, Cryptosporidium parvum
DREKNPD

SEQ ID NO: 2254146 - protein, 7 aa, Cryptosporidium parvum
DREKRQL

SEQ ID NO: 2254147 - protein, 10 aa, Cryptosporidium parvum
DREKTEEDIK

SEQ ID NO: 2254148 - protein, 17 aa, Cryptosporidium parvum
DRENKNEGTEIQTEKSK

SEQ ID NO: 2254149 - protein, 5 aa, Cryptosporidium parvum
DREQL

SEQ ID NO: 2254150 - protein, 12 aa, Cryptosporidium parvum
DRERKNQQTKEI

SEQ ID NO: 2254151 - protein, 12 aa, Cryptosporidium parvum
DRESRGDNKYRG

SEQ ID NO: 2254152 - protein, 8 aa, Cryptosporidium parvum
DRETEVDN

SEQ ID NO: 2254153 - protein, 4 aa, Cryptosporidium parvum
DRFK

SEQ ID NO: 2254154 - protein, 11 aa, Cryptosporidium parvum
DRGEEARKKLD

SEQ ID NO: 2254155 - protein, 4 aa, Cryptosporidium parvum
DRGG

SEQ ID NO: 2254156 - protein, 7 aa, Cryptosporidium parvum
DRGKQSL

SEQ ID NO: 2254157 - protein, 5 aa, Cryptosporidium parvum
DRGPY

SEQ ID NO: 2254158 - protein, 6 aa, Cryptosporidium parvum
DRGSHS

SEQ ID NO: 2254159 - protein, 8 aa, Cryptosporidium parvum
DRGTDASK

SEQ ID NO: 2254160 - protein, 5 aa, Cryptosporidium parvum
DRHEN

SEQ ID NO: 2254161 - protein, 11 aa, Cryptosporidium parvum
DRHSSQSKEEL

SEQ ID NO: 2254162 - protein, 13 aa, Cryptosporidium parvum
DRIPPPREDYYRR

SEQ ID NO: 2254163 - protein, 7 aa, Cryptosporidium parvum
DRIQDKQ

SEQ ID NO: 2254164 - protein, 11 aa, Cryptosporidium parvum
DRIQQNQETRI

SEQ ID NO: 2254165 - protein, 9 aa, Cryptosporidium parvum
DRISTKESE

SEQ ID NO: 2254166 - protein, 16 aa, Cryptosporidium parvum
DRKIRANPNSQRFKAQ

SEQ ID NO: 2254167 - protein, 8 aa, Cryptosporidium parvum
DRKLKKNI

SEQ ID NO: 2254168 - protein, 8 aa, Cryptosporidium parvum
DRKSHDPY

SEQ ID NO: 2254169 - protein, 10 aa, Cryptosporidium parvum
DRKSLSSEEL

SEQ ID NO: 2254170 - protein, 6 aa, Cryptosporidium parvum
DRKTSF

SEQ ID NO: 2254171 - protein, 5 aa, Cryptosporidium parvum
DRKYN

SEQ ID NO: 2254172 - protein, 4 aa, Cryptosporidium parvum
DRLA

SEQ ID NO: 2254173 - protein, 18 aa, Cryptosporidium parvum
DRLEEADASREKFSIPES

SEQ ID NO: 2254174 - protein, 26 aa, Cryptosporidium parvum
DRLGDASISTSNANRNSASSSNRNSI

SEQ ID NO: 2254175 - protein, 6 aa, Cryptosporidium parvum
DRLGNT

SEQ ID NO: 2254176 - protein, 20 aa, Cryptosporidium parvum
DRLQTGMRGAYGKPTGTAAR

SEQ ID NO: 2254177 - protein, 16 aa, Cryptosporidium parvum
DRLSEDKVCKSQDDDP

SEQ ID NO: 2254178 - protein, 22 aa, Cryptosporidium parvum
DRNAPLKHNQEDKCKKKENKWK

SEQ ID NO: 2254179 - protein, 8 aa, Cryptosporidium parvum
DRNDGISI

SEQ ID NO: 2254180 - protein, 6 aa, Cryptosporidium parvum
DRNETR

SEQ ID NO: 2254181 - protein, 6 aa, Cryptosporidium parvum
DRNGDG

SEQ ID NO: 2254182 - protein, 5 aa, Cryptosporidium parvum
DRNID

SEQ ID NO: 2254183 - protein, 6 aa, Cryptosporidium parvum
DRNKST

SEQ ID NO: 2254184 - protein, 5 aa, Cryptosporidium parvum
DRNNT

SEQ ID NO: 2254185 - protein, 8 aa, Cryptosporidium parvum
DRNPVEGN

SEQ ID NO: 2254186 - protein, 17 aa, Cryptosporidium parvum
DRNSENKNAKNDSSHIS

SEQ ID NO: 2254187 - protein, 6 aa, Cryptosporidium parvum
DRNTKN

SEQ ID NO: 2254188 - protein, 4 aa, Cryptosporidium parvum
DRPD

SEQ ID NO: 2254189 - protein, 10 aa, Cryptosporidium parvum
DRPLANDHSS

SEQ ID NO: 2254190 - protein, 41 aa, Cryptosporidium parvum; identical to SEQ ID NO: 2138522

SEQ ID NO: 2254191 - protein, 26 aa, Cryptosporidium parvum
DRQAGQRRQSGAGLTSTASGRNLGSN

SEQ ID NO: 2254192 - protein, 5 aa, Cryptosporidium parvum
DRQNM

SEQ ID NO: 2254193 - protein, 5 aa, Cryptosporidium parvum
DRRAG

SEQ ID NO: 2254194 - protein, 32 aa, Cryptosporidium parvum
DRRAIKSKGRRPYSNTNNQNYNSTDKNEDEIR

SEQ ID NO: 2254195 - protein, 7 aa, Cryptosporidium parvum
DRRGEEC

SEQ ID NO: 2254196 - protein, 15 aa, Cryptosporidium parvum
DRRGGGNCFSNGCSS

SEQ ID NO: 2254197 - protein, 6 aa, Cryptosporidium parvum
DRRGIT

SEQ ID NO: 2254198 - protein, 6 aa, Cryptosporidium parvum
DRRHGK

SEQ ID NO: 2254199 - protein, 8 aa, Cryptosporidium parvum
DRRRDSKM

SEQ ID NO: 2254200 - protein, 8 aa, Cryptosporidium parvum
DRRSPSEA

SEQ ID NO: 2254201 - protein, 11 aa, Cryptosporidium parvum
DRRSPSRSGIG

SEQ ID NO: 2254202 - protein, 6 aa, Cryptosporidium parvum
DRRTGE

SEQ ID NO: 2254203 - protein, 26 aa, Cryptosporidium parvum
DRSDDQSIVPSNIDSNAKNKVDSEDF

SEQ ID NO: 2254204 - protein, 8 aa, Cryptosporidium parvum
DRSDSTNL

SEQ ID NO: 2254205 - protein, 10 aa, Cryptosporidium parvum
DRSEINEQQI

SEQ ID NO: 2254206 - protein, 12 aa, Cryptosporidium parvum
DRSFESSSERLA

SEQ ID NO: 2254207 - protein, 8 aa, Cryptosporidium parvum
DRSFSRSE

SEQ ID NO: 2254208 - protein, 5 aa, Cryptosporidium parvum
DRSGH

SEQ ID NO: 2254209 - protein, 5 aa, Cryptosporidium parvum
DRSLE

SEQ ID NO: 2254210 - protein, 30 aa, Cryptosporidium parvum
DRSNKVKRIEAEDEEEKKDEPKKASLGKSK

SEQ ID NO: 2254211 - protein, 9 aa, Cryptosporidium parvum
DRSNTTGVK

SEQ ID NO: 2254212 - protein, 15 aa, Cryptosporidium parvum
DRSNYENQLRSRKED

SEQ ID NO: 2254213 - protein, 8 aa, Cryptosporidium parvum
DRSNYTPG

SEQ ID NO: 2254214 - protein, 11 aa, Cryptosporidium parvum
DRSRFGETREE

SEQ ID NO: 2254215 - protein, 6 aa, Cryptosporidium parvum
DRSRRK

SEQ ID NO: 2254216 - protein, 19 aa, Cryptosporidium parvum
DRSRSQSRRRSSLEENGVK

SEQ ID NO: 2254217 - protein, 7 aa, Cryptosporidium parvum
DRSTKHY

SEQ ID NO: 2254218 - protein, 8 aa, Cryptosporidium parvum
DRTESTKT

SEQ ID NO: 2254219 - protein, 6 aa, Cryptosporidium parvum
DRTRNE

SEQ ID NO: 2254220 - protein, 14 aa, Cryptosporidium parvum
DRTSTSNNTLPSSS

SEQ ID NO: 2254221 - protein, 4 aa, Cryptosporidium parvum
DRTT

SEQ ID NO: 2254222 - protein, 7 aa, Cryptosporidium parvum
DRVEGKI

SEQ ID NO: 2254223 - protein, 5 aa, Cryptosporidium parvum
DRVPM

SEQ ID NO: 2254224 - protein, 9 aa, Cryptosporidium parvum
DRYKEENDI

SEQ ID NO: 2254225 - protein, 6 aa, Cryptosporidium parvum
DRYPDL

SEQ ID NO: 2254226 - protein, 9 aa, Cryptosporidium parvum
DRYREDQSA

SEQ ID NO: 2254227 - protein, 16 aa, Cryptosporidium parvum
DRYSQSNGFNSGGGNM

SEQ ID NO: 2254228 - protein, 9 aa, Cryptosporidium parvum
DSADLDDNS

SEQ ID NO: 2254229 - protein, 11 aa, Cryptosporidium parvum
DSAGGNLATSS

SEQ ID NO: 2254230 - protein, 7 aa, Cryptosporidium parvum
DSAINNK

SEQ ID NO: 2254231 - protein, 4 aa, Cryptosporidium parvum
DSAK

SEQ ID NO: 2254232 - protein, 8 aa, Cryptosporidium parvum
DSAKEAIS

SEQ ID NO: 2254233 - protein, 10 aa, Cryptosporidium parvum
DSAKEIAGTI

SEQ ID NO: 2254234 - protein, 8 aa, Cryptosporidium parvum
DSAKNNNE

SEQ ID NO: 2254235 - protein, 43 aa, Cryptosporidium parvum
DSANLESEGGSAMTSKKSKGKKKGDKTVKGNTNSNNNNNNSKE

SEQ ID NO: 2254236 - protein, 8 aa, Cryptosporidium parvum
DSAPLSEQ

SEQ ID NO: 2254237 - protein, 5 aa, Cryptosporidium parvum
DSAQS

SEQ ID NO: 2254238 - protein, 18 aa, Cryptosporidium parvum
DSARSTSRNSSENRKKYE

SEQ ID NO: 2254239 - protein, 6 aa, Cryptosporidium parvum
DSASAT

SEQ ID NO: 2254240 - protein, 12 aa, Cryptosporidium parvum
DSASDGSSLTNP

SEQ ID NO: 2254241 - protein, 8 aa, Cryptosporidium parvum
DSASGGGL

SEQ ID NO: 2254242 - protein, 8 aa, Cryptosporidium parvum
DSASNDTI

SEQ ID NO: 2254243 - protein, 7 aa, Cryptosporidium parvum
DSATKTT

SEQ ID NO: 2254244 - protein, 4 aa, Cryptosporidium parvum
DSAV

SEQ ID NO: 2254245 - protein, 6 aa, Cryptosporidium parvum
DSCEKE

SEQ ID NO: 2254246 - protein, 13 aa, Cryptosporidium parvum
DSCENTMSERSDL

SEQ ID NO: 2254247 - protein, 5 aa, Cryptosporidium parvum
DSCGS

SEQ ID NO: 2254248 - protein, 5 aa, Cryptosporidium parvum
DSCSG

SEQ ID NO: 2254249 - protein, 6 aa, Cryptosporidium parvum
DSDASI

SEQ ID NO: 2254250 - protein, 10 aa, Cryptosporidium parvum
DSDDELDPSE

SEQ ID NO: 2254251 - protein, 16 aa, Cryptosporidium parvum
DSDDPINISPSEVGKK

SEQ ID NO: 2254252 - protein, 9 aa, Cryptosporidium parvum
DSDDSVIGK

SEQ ID NO: 2254253 - protein, 7 aa, Cryptosporidium parvum
DSDEDRY

SEQ ID NO: 2254254 - protein, 14 aa, Cryptosporidium parvum
DSDEERAKIRGKQL

SEQ ID NO: 2254255 - protein, 5 aa, Cryptosporidium parvum
DSDEK

SEQ ID NO: 2254256 - protein, 10 aa, Cryptosporidium parvum
DSDESTGNRK

SEQ ID NO: 2254257 - protein, 13 aa, Cryptosporidium parvum
DSDGESGNLHDTN

SEQ ID NO: 2254258 - protein, 8 aa, Cryptosporidium parvum
DSDGNGEI

SEQ ID NO: 2254259 - protein, 7 aa, Cryptosporidium parvum
DSDGRIE

SEQ ID NO: 2254260 - protein, 9 aa, Cryptosporidium parvum
DSDGSGSID

SEQ ID NO: 2254261 - protein, 8 aa, Cryptosporidium parvum
DSDIQEDD

SEQ ID NO: 2254262 - protein, 7 aa, Cryptosporidium parvum
DSDIRRS

SEQ ID NO: 2254263 - protein, 7 aa, Cryptosporidium parvum
DSDKPCT

SEQ ID NO: 2254264 - protein, 11 aa, Cryptosporidium parvum
DSDKPNEERVD

SEQ ID NO: 2254265 - protein, 10 aa, Cryptosporidium parvum
DSDNSSPIEF

SEQ ID NO: 2254266 - protein, 33 aa, Cryptosporidium parvum
DSDSCTDNHLDSDNKTTTTRVSDEKKRNVISPT

SEQ ID NO: 2254267 - protein, 15 aa, Cryptosporidium parvum
DSDSDSSEDDRRVVR

SEQ ID NO: 2254268 - protein, 22 aa, Cryptosporidium parvum
DSDSEFESRIDKKRSDNNNFHK

SEQ ID NO: 2254269 - protein, 8 aa, Cryptosporidium parvum
DSDSFDPS

SEQ ID NO: 2254270 - protein, 8 aa, Cryptosporidium parvum
DSDSLDGM

SEQ ID NO: 2254271 - protein, 30 aa, Cryptosporidium parvum
DSDSNSDKDIEDNNNNNNNNNNKECSPTKN

SEQ ID NO: 2254272 - protein, 9 aa, Cryptosporidium parvum
DSDSSIELN

SEQ ID NO: 2254273 - protein, 7 aa, Cryptosporidium parvum
DSDSSIK

SEQ ID NO: 2254274 - protein, 11 aa, Cryptosporidium parvum
DSDSSTSSLND

SEQ ID NO: 2254275 - protein, 12 aa, Cryptosporidium parvum
DSDSTGNPTGLT

SEQ ID NO: 2254276 - protein, 7 aa, Cryptosporidium parvum
DSDTDSV

SEQ ID NO: 2254277 - protein, 10 aa, Cryptosporidium parvum
DSDTQCGAGA

SEQ ID NO: 2254278 - protein, 34 aa, Cryptosporidium parvum
DSEASTDIEQEETSDSDEIIKNSKNKEKDPIKDY

SEQ ID NO: 2254279 - protein, 20 aa, Cryptosporidium parvum
DSEDEQQNCGVGGNGGGELK

SEQ ID NO: 2254280 - protein, 7 aa, Cryptosporidium parvum
DSEDSIS

SEQ ID NO: 2254281 - protein, 10 aa, Cryptosporidium parvum
DSEEKFQCSQ

SEQ ID NO: 2254282 - protein, 7 aa, Cryptosporidium parvum
DSEEPEF

SEQ ID NO: 2254283 - protein, 9 aa, Cryptosporidium parvum
DSEGGFSDN

SEQ ID NO: 2254284 - protein, 7 aa, Cryptosporidium parvum
DSEGIPD

SEQ ID NO: 2254285 - protein, 11 aa, Cryptosporidium parvum
DSEGKEGALKD

SEQ ID NO: 2254286 - protein, 6 aa, Cryptosporidium parvum
DSEGYT

SEQ ID NO: 2254287 - protein, 18 aa, Cryptosporidium parvum
DSEKSLESNKQAASDTLV

SEQ ID NO: 2254288 - protein, 15 aa, Cryptosporidium parvum
DSENDNAKSKMAKNQ

SEQ ID NO: 2254289 - protein, 6 aa, Cryptosporidium parvum
DSENTK

SEQ ID NO: 2254290 - protein, 8 aa, Cryptosporidium parvum
DSEQEKYI

SEQ ID NO: 2254291 - protein, 9 aa, Cryptosporidium parvum
DSEQNARDG

SEQ ID NO: 2254292 - protein, 8 aa, Cryptosporidium parvum
DSEQNWSK

SEQ ID NO: 2254293 - protein, 24 aa, Cryptosporidium parvum
DSERSLTSEEENFSEGSWEDEEDA

SEQ ID NO: 2254294 - protein, 18 aa, Cryptosporidium parvum
DSESNTKLKRQQTLGSSF

SEQ ID NO: 2254295 - protein, 7 aa, Cryptosporidium parvum
DSESPPI

SEQ ID NO: 2254296 - protein, 14 aa, Cryptosporidium parvum
DSESSKESNSFTDE

SEQ ID NO: 2254297 - protein, 10 aa, Cryptosporidium parvum
DSETEKNPFE

SEQ ID NO: 2254298 - protein, 14 aa, Cryptosporidium parvum
DSEYTKSKNKGNDN

SEQ ID NO: 2254299 - protein, 6 aa, Cryptosporidium parvum
DSEYVQ

SEQ ID NO: 2254300 - protein, 15 aa, Cryptosporidium parvum
DSEYVTKQDRPEKKR

SEQ ID NO: 2254301 - protein, 16 aa, Cryptosporidium parvum
DSFEEGLGSQKGEVSE

SEQ ID NO: 2254302 - protein, 12 aa, Cryptosporidium parvum
DSFGPKKSGVTT

SEQ ID NO: 2254303 - protein, 8 aa, Cryptosporidium parvum
DSFKRAEA

SEQ ID NO: 2254304 - protein, 7 aa, Cryptosporidium parvum
DSFKSKQ

SEQ ID NO: 2254305 - protein, 6 aa, Cryptosporidium parvum
DSFQTE

SEQ ID NO: 2254306 - protein, 12 aa, Cryptosporidium parvum
DSFSGINDQNKK

SEQ ID NO: 2254307 - protein, 13 aa, Cryptosporidium parvum
DSFSPEKLNENDI

SEQ ID NO: 2254308 - protein, 6 aa, Cryptosporidium parvum
DSFSSS

SEQ ID NO: 2254309 - protein, 8 aa, Cryptosporidium parvum
DSGAQTTI

SEQ ID NO: 2254310 - protein, 5 aa, Cryptosporidium parvum
DSGDL

SEQ ID NO: 2254311 - protein, 12 aa, Cryptosporidium parvum
DSGEDSINNGTY

SEQ ID NO: 2254312 - protein, 5 aa, Cryptosporidium parvum
DSGEE

SEQ ID NO: 2254313 - protein, 4 aa, Cryptosporidium parvum
DSGG

SEQ ID NO: 2254314 - protein, 7 aa, Cryptosporidium parvum
DSGGIQI

SEQ ID NO: 2254315 - protein, 12 aa, Cryptosporidium parvum
DSGHSISRSKEP

SEQ ID NO: 2254316 - protein, 5 aa, Cryptosporidium parvum
DSGIL

SEQ ID NO: 2254317 - protein, 8 aa, Cryptosporidium parvum
DSGKDNYN

SEQ ID NO: 2254318 - protein, 10 aa, Cryptosporidium parvum
DSGKDPNYHT

SEQ ID NO: 2254319 - protein, 6 aa, Cryptosporidium parvum
DSGKFD

SEQ ID NO: 2254320 - protein, 6 aa, Cryptosporidium parvum
DSGKST

SEQ ID NO: 2254321 - protein, 9 aa, Cryptosporidium parvum
DSGKSTTTG

SEQ ID NO: 2254322 - protein, 11 aa, Cryptosporidium parvum
DSGLKNGQSSN

SEQ ID NO: 2254323 - protein, 6 aa, Cryptosporidium parvum
DSGNDA

SEQ ID NO: 2254324 - protein, 9 aa, Cryptosporidium parvum
DSGNEIESE

SEQ ID NO: 2254325 - protein, 15 aa, Cryptosporidium parvum
DSGNHSSQKNKVQPK

SEQ ID NO: 2254326 - protein, 5 aa, Cryptosporidium parvum
DSGNS

SEQ ID NO: 2254327 - protein, 6 aa, Cryptosporidium parvum
DSGNTL

SEQ ID NO: 2254328 - protein, 6 aa, Cryptosporidium parvum
DSGRSM

SEQ ID NO: 2254329 - protein, 9 aa, Cryptosporidium parvum
DSGSAKEEA

SEQ ID NO: 2254330 - protein, 12 aa, Cryptosporidium parvum
DSGSRRASTKEM

SEQ ID NO: 2254331 - protein, 15 aa, Cryptosporidium parvum
DSGTIKQNNKSPSDF

SEQ ID NO: 2254332 - protein, 6 aa, Cryptosporidium parvum
DSGVGK

SEQ ID NO: 2254333 - protein, 10 aa, Cryptosporidium parvum
DSHLNTNKRY

SEQ ID NO: 2254334 - protein, 6 aa, Cryptosporidium parvum
DSHSDY

SEQ ID NO: 2254335 - protein, 12 aa, Cryptosporidium parvum
DSIADENSSLEW

SEQ ID NO: 2254336 - protein, 9 aa, Cryptosporidium parvum
DSIDGNGTI

SEQ ID NO: 2254337 - protein, 10 aa, Cryptosporidium parvum
DSIDSDKISS

SEQ ID NO: 2254338 - protein, 5 aa, Cryptosporidium parvum
DSIEE

SEQ ID NO: 2254339 - protein, 7 aa, Cryptosporidium parvum
DSIEQDK

SEQ ID NO: 2254340 - protein, 7 aa, Cryptosporidium parvum
DSIGDNY

SEQ ID NO: 2254341 - protein, 5 aa, Cryptosporidium parvum
DSIGS

SEQ ID NO: 2254342 - protein, 9 aa, Cryptosporidium parvum
DSIINNKDS

SEQ ID NO: 2254343 - protein, 20 aa, Cryptosporidium parvum
DSIKEKQEINEKPNNGNNYI

SEQ ID NO: 2254344 - protein, 6 aa, Cryptosporidium parvum
DSIKSK

SEQ ID NO: 2254345 - protein, 7 aa, Cryptosporidium parvum
DSINEED

SEQ ID NO: 2254346 - protein, 14 aa, Cryptosporidium parvum
DSIRNQNGNLVSDG

SEQ ID NO: 2254347 - protein, 31 aa, Cryptosporidium parvum; identical to SEQ ID NO: 2138658

SEQ ID NO: 2254348 - protein, 6 aa, Cryptosporidium parvum
DSISPI

SEQ ID NO: 2254349 - protein, 28 aa, Cryptosporidium parvum
DSISPVSSRSDSESYSIGSLSESSIPTF

SEQ ID NO: 2254350 - protein, 7 aa, Cryptosporidium parvum
DSISRKV

SEQ ID NO: 2254351 - protein, 4 aa, Cryptosporidium parvum
DSIT

SEQ ID NO: 2254352 - protein, 6 aa, Cryptosporidium parvum
DSITNI

SEQ ID NO: 2254353 - protein, 14 aa, Cryptosporidium parvum
DSKAPNKLSEVPTE

SEQ ID NO: 2254354 - protein, 15 aa, Cryptosporidium parvum
DSKDDDSSGPSRTEK

SEQ ID NO: 2254355 - protein, 13 aa, Cryptosporidium parvum
DSKDYREKHSNQY

SEQ ID NO: 2254356 - protein, 8 aa, Cryptosporidium parvum
DSKEEALA

SEQ ID NO: 2254357 - protein, 9 aa, Cryptosporidium parvum
DSKEIDKSN

SEQ ID NO: 2254358 - protein, 8 aa, Cryptosporidium parvum
DSKENNEM

SEQ ID NO: 2254359 - protein, 13 aa, Cryptosporidium parvum
DSKEQSIKSKYSK

SEQ ID NO: 2254360 - protein, 6 aa, Cryptosporidium parvum
DSKFAD

SEQ ID NO: 2254361 - protein, 13 aa, Cryptosporidium parvum
DSKGLKRKPVDEG

SEQ ID NO: 2254362 - protein, 18 aa, Cryptosporidium parvum
DSKGNAHDLRPKENKPCY

SEQ ID NO: 2254363 - protein, 10 aa, Cryptosporidium parvum
DSKGPGKATI

SEQ ID NO: 2254364 - protein, 9 aa, Cryptosporidium parvum
DSKGQFNSG

SEQ ID NO: 2254365 - protein, 8 aa, Cryptosporidium parvum
DSKGSTIK

SEQ ID NO: 2254366 - protein, 10 aa, Cryptosporidium parvum
DSKGYSSIEE

SEQ ID NO: 2254367 - protein, 9 aa, Cryptosporidium parvum
DSKIQDESL

SEQ ID NO: 2254368 - protein, 10 aa, Cryptosporidium parvum
DSKITTEDAE

SEQ ID NO: 2254369 - protein, 4 aa, Cryptosporidium parvum
DSKK

SEQ ID NO: 2254370 - protein, 7 aa, Cryptosporidium parvum
DSKKEIQ

SEQ ID NO: 2254371 - protein, 8 aa, Cryptosporidium parvum
DSKKSFKS

SEQ ID NO: 2254372 - protein, 12 aa, Cryptosporidium parvum
DSKKSSENKPVP

SEQ ID NO: 2254373 - protein, 35 aa, Cryptosporidium parvum
DSKKSTGNGKSGPNNGESNVETTGFSPNNSNRIDG

SEQ ID NO: 2254374 - protein, 4 aa, Cryptosporidium parvum
DSKL

SEQ ID NO: 2254375 - protein, 10 aa, Cryptosporidium parvum
DSKLTSNSKK

SEQ ID NO: 2254376 - protein, 7 aa, Cryptosporidium parvum
DSKNEDL

SEQ ID NO: 2254377 - protein, 9 aa, Cryptosporidium parvum
DSKNNSNNS

SEQ ID NO: 2254378 - protein, 7 aa, Cryptosporidium parvum
DSKQAYR

SEQ ID NO: 2254379 - protein, 15 aa, Cryptosporidium parvum
DSKQKASNTKNRLEI

SEQ ID NO: 2254380 - protein, 8 aa, Cryptosporidium parvum
DSKQYSKE

SEQ ID NO: 2254381 - protein, 6 aa, Cryptosporidium parvum
DSKRAY

SEQ ID NO: 2254382 - protein, 8 aa, Cryptosporidium parvum
DSKRENDK

SEQ ID NO: 2254383 - protein, 4 aa, Cryptosporidium parvum
DSKS

SEQ ID NO: 2254384 - protein, 19 aa, Cryptosporidium parvum
DSKSFRQSIGKNSLKSENL

SEQ ID NO: 2254385 - protein, 5 aa, Cryptosporidium parvum
DSKSK

SEQ ID NO: 2254386 - protein, 5 aa, Cryptosporidium parvum
DSKST

SEQ ID NO: 2254387 - protein, 15 aa, Cryptosporidium parvum
DSKTGTTSPMSDSVS

SEQ ID NO: 2254388 - protein, 12 aa, Cryptosporidium parvum
DSKTNKSTTKEN

SEQ ID NO: 2254389 - protein, 4 aa, Cryptosporidium parvum
DSKV

SEQ ID NO: 2254390 - protein, 5 aa, Cryptosporidium parvum
DSKYM

SEQ ID NO: 2254391 - protein, 12 aa, Cryptosporidium parvum
DSLDSQNTSESV

SEQ ID NO: 2254392 - protein, 6 aa, Cryptosporidium parvum
DSLEEN

SEQ ID NO: 2254393 - protein, 6 aa, Cryptosporidium parvum
DSLGKK

SEQ ID NO: 2254394 - protein, 23 aa, Cryptosporidium parvum
DSLGNRDTSSLNSESQKLDDPNA

SEQ ID NO: 2254395 - protein, 13 aa, Cryptosporidium parvum
DSLGSSSSNRSSV

SEQ ID NO: 2254396 - protein, 5 aa, Cryptosporidium parvum
DSLGY

SEQ ID NO: 2254397 - protein, 21 aa, Cryptosporidium parvum
DSLIDGTKCSESIENKDSDCS

SEQ ID NO: 2254398 - protein, 4 aa, Cryptosporidium parvum
DSLN

SEQ ID NO: 2254399 - protein, 19 aa, Cryptosporidium parvum
DSLNAKNNANINRSNPHKY

SEQ ID NO: 2254400 - protein, 9 aa, Cryptosporidium parvum
DSLNENGNI

SEQ ID NO: 2254401 - protein, 6 aa, Cryptosporidium parvum
DSLNNK

SEQ ID NO: 2254402 - protein, 7 aa, Cryptosporidium parvum
DSLSEDQ

SEQ ID NO: 2254403 - protein, 7 aa, Cryptosporidium parvum
DSLSGDR

SEQ ID NO: 2254404 - protein, 16 aa, Cryptosporidium parvum
DSLSGENKSTESLEKH

SEQ ID NO: 2254405 - protein, 20 aa, Cryptosporidium parvum
DSLSGGGGDGASSSSGYGEK

SEQ ID NO: 2254406 - protein, 6 aa, Cryptosporidium parvum
DSLSNN

SEQ ID NO: 2254407 - protein, 10 aa, Cryptosporidium parvum
DSLSNTAYQN

SEQ ID NO: 2254408 - protein, 8 aa, Cryptosporidium parvum
DSLSRNGQ

SEQ ID NO: 2254409 - protein, 10 aa, Cryptosporidium parvum
DSLSSLTSDQ

SEQ ID NO: 2254410 - protein, 6 aa, Cryptosporidium parvum
DSMAPV

SEQ ID NO: 2254411 - protein, 6 aa, Cryptosporidium parvum
DSMGNK

SEQ ID NO: 2254412 - protein, 8 aa, Cryptosporidium parvum
DSMPGFPS

SEQ ID NO: 2254413 - protein, 12 aa, Cryptosporidium parvum
DSMQNGNQGANI

SEQ ID NO: 2254414 - protein, 6 aa, Cryptosporidium parvum
DSNADD

SEQ ID NO: 2254415 - protein, 9 aa, Cryptosporidium parvum
DSNAEDIEG

SEQ ID NO: 2254416 - protein, 6 aa, Cryptosporidium parvum
DSNAPL

SEQ ID NO: 2254417 - protein, 7 aa, Cryptosporidium parvum
DSNATFE

SEQ ID NO: 2254418 - protein, 15 aa, Cryptosporidium parvum
DSNCEVDPHTGAQKS

SEQ ID NO: 2254419 - protein, 4 aa, Cryptosporidium parvum
DSND

SEQ ID NO: 2254420 - protein, 9 aa, Cryptosporidium parvum
DSNDKPSAL

SEQ ID NO: 2254421 - protein, 7 aa, Cryptosporidium parvum
DSNEARI

SEQ ID NO: 2254422 - protein, 7 aa, Cryptosporidium parvum
DSNEKSQ

SEQ ID NO: 2254423 - protein, 8 aa, Cryptosporidium parvum
DSNENNQY

SEQ ID NO: 2254424 - protein, 4 aa, Cryptosporidium parvum
DSNF

SEQ ID NO: 2254425 - protein, 12 aa, Cryptosporidium parvum
DSNFEGINGKGV

SEQ ID NO: 2254426 - protein, 18 aa, Cryptosporidium parvum
DSNFKDENFDENSSETLS

SEQ ID NO: 2254427 - protein, 8 aa, Cryptosporidium parvum
DSNFPKNC

SEQ ID NO: 2254428 - protein, 20 aa, Cryptosporidium parvum
DSNFSNSESEESEEATKLGS

SEQ ID NO: 2254429 - protein, 6 aa, Cryptosporidium parvum
DSNGKD

SEQ ID NO: 2254430 - protein, 6 aa, Cryptosporidium parvum
DSNGLN

SEQ ID NO: 2254431 - protein, 8 aa, Cryptosporidium parvum
DSNGNQNI

SEQ ID NO: 2254432 - protein, 7 aa, Cryptosporidium parvum
DSNGPKG

SEQ ID NO: 2254433 - protein, 6 aa, Cryptosporidium parvum
DSNGRI

SEQ ID NO: 2254434 - protein, 8 aa, Cryptosporidium parvum
DSNGYRME

SEQ ID NO: 2254435 - protein, 4 aa, Cryptosporidium parvum
DSNI

SEQ ID NO: 2254436 - protein, 12 aa, Cryptosporidium parvum
DSNIETQTRESI

SEQ ID NO: 2254437 - protein, 13 aa, Cryptosporidium parvum
DSNIKDESSNNIR

SEQ ID NO: 2254438 - protein, 7 aa, Cryptosporidium parvum
DSNIKQK

SEQ ID NO: 2254439 - protein, 25 aa, Cryptosporidium parvum
DSNKEESEISYSKKRKQAEKNNSGV

SEQ ID NO: 2254440 - protein, 16 aa, Cryptosporidium parvum
DSNKKYPNNSSTPFDN

SEQ ID NO: 2254441 - protein, 9 aa, Cryptosporidium parvum
DSNKRNQVR

SEQ ID NO: 2254442 - protein, 6 aa, Cryptosporidium parvum
DSNLQT

SEQ ID NO: 2254443 - protein, 5 aa, Cryptosporidium parvum
DSNMS

SEQ ID NO: 2254444 - protein, 7 aa, Cryptosporidium parvum
DSNNESD

SEQ ID NO: 2254445 - protein, 8 aa, Cryptosporidium parvum
DSNNEVEL

SEQ ID NO: 2254446 - protein, 6 aa, Cryptosporidium parvum
DSNNFS

SEQ ID NO: 2254447 - protein, 7 aa, Cryptosporidium parvum
DSNNGIG

SEQ ID NO: 2254448 - protein, 7 aa, Cryptosporidium parvum
DSNNGKF

SEQ ID NO: 2254449 - protein, 8 aa, Cryptosporidium parvum
DSNNIENL

SEQ ID NO: 2254450 - protein, 16 aa, Cryptosporidium parvum
DSNNIYSASSPSMGNN

SEQ ID NO: 2254451 - protein, 9 aa, Cryptosporidium parvum
DSNNNDQSA

SEQ ID NO: 2254452 - protein, 8 aa, Cryptosporidium parvum
DSNNRGLQ

SEQ ID NO: 2254453 - protein, 9 aa, Cryptosporidium parvum
DSNNSPQTL

SEQ ID NO: 2254454 - protein, 12 aa, Cryptosporidium parvum
DSNNYDSKQNHS

SEQ ID NO: 2254455 - protein, 8 aa, Cryptosporidium parvum
DSNNYLSS

SEQ ID NO: 2254456 - protein, 10 aa, Cryptosporidium parvum
DSNRKEEVNP

SEQ ID NO: 2254457 - protein, 6 aa, Cryptosporidium parvum
DSNRKM

SEQ ID NO: 2254458 - protein, 4 aa, Cryptosporidium parvum
DSNS

SEQ ID NO: 2254459 - protein, 15 aa, Cryptosporidium parvum
DSNSDSNSDSNSNSL

SEQ ID NO: 2254460 - protein, 10 aa, Cryptosporidium parvum
DSNSELNKEL

SEQ ID NO: 2254461 - protein, 7 aa, Cryptosporidium parvum
DSNSIAQ

SEQ ID NO: 2254462 - protein, 9 aa, Cryptosporidium parvum
DSNSIGGGI

SEQ ID NO: 2254463 - protein, 6 aa, Cryptosporidium parvum
DSNSKH

SEQ ID NO: 2254464 - protein, 16 aa, Cryptosporidium parvum
DSNSLIQNEGSTIEDQ

SEQ ID NO: 2254465 - protein, 7 aa, Cryptosporidium parvum
DSNSNSI

SEQ ID NO: 2254466 - protein, 13 aa, Cryptosporidium parvum
DSNSQKSSSDSIS

SEQ ID NO: 2254467 - protein, 7 aa, Cryptosporidium parvum
DSNSYQS

SEQ ID NO: 2254468 - protein, 4 aa, Cryptosporidium parvum
DSNT

SEQ ID NO: 2254469 - protein, 30 aa, Cryptosporidium parvum
DSNTLQQKGRQDSYSNRSLTVNTSKTDGLL

SEQ ID NO: 2254470 - protein, 8 aa, Cryptosporidium parvum
DSNTTDSI

SEQ ID NO: 2254471 - protein, 10 aa, Cryptosporidium parvum
DSNYYSNNGN

SEQ ID NO: 2254472 - protein, 5 aa, Cryptosporidium parvum
DSPDI

SEQ ID NO: 2254473 - protein, 20 aa, Cryptosporidium parvum
DSPDSNKNCTHESSSPIKSR

SEQ ID NO: 2254474 - protein, 7 aa, Cryptosporidium parvum
DSPDSPL

SEQ ID NO: 2254475 - protein, 7 aa, Cryptosporidium parvum
DSPEINE

SEQ ID NO: 2254476 - protein, 19 aa, Cryptosporidium parvum
DSPENHKNHRSPDRSTSRF

SEQ ID NO: 2254477 - protein, 8 aa, Cryptosporidium parvum
DSPKREPW

SEQ ID NO: 2254478 - protein, 4 aa, Cryptosporidium parvum
DSPL

SEQ ID NO: 2254479 - protein, 6 aa, Cryptosporidium parvum
DSPNSQ

SEQ ID NO: 2254480 - protein, 20 aa, Cryptosporidium parvum
DSPQSNENSNEKLKDNKDQL

SEQ ID NO: 2254481 - protein, 6 aa, Cryptosporidium parvum
DSPSFK

SEQ ID NO: 2254482 - protein, 4 aa, Cryptosporidium parvum
DSPW

SEQ ID NO: 2254483 - protein, 4 aa, Cryptosporidium parvum
DSPY

SEQ ID NO: 2254484 - protein, 10 aa, Cryptosporidium parvum
DSQDDDNIQI

SEQ ID NO: 2254485 - protein, 10 aa, Cryptosporidium parvum
DSQDNFDEDV

SEQ ID NO: 2254486 - protein, 8 aa, Cryptosporidium parvum
DSQEDENK

SEQ ID NO: 2254487 - protein, 6 aa, Cryptosporidium parvum
DSQELK

SEQ ID NO: 2254488 - protein, 6 aa, Cryptosporidium parvum
DSQEPI

SEQ ID NO: 2254489 - protein, 4 aa, Cryptosporidium parvum
DSQF

SEQ ID NO: 2254490 - protein, 7 aa, Cryptosporidium parvum
DSQGKLD

SEQ ID NO: 2254491 - protein, 5 aa, Cryptosporidium parvum
DSQGN

SEQ ID NO: 2254492 - protein, 10 aa, Cryptosporidium parvum
DSQGRKMSKS

SEQ ID NO: 2254493 - protein, 19 aa, Cryptosporidium parvum
DSQKGYDYENDSLAGKSTY

SEQ ID NO: 2254494 - protein, 6 aa, Cryptosporidium parvum
DSQKPE

SEQ ID NO: 2254495 - protein, 6 aa, Cryptosporidium parvum
DSQPPI

SEQ ID NO: 2254496 - protein, 40 aa, Cryptosporidium parvum
DSQQHNNGLGGGAAVQGGISEKFESHSSIGNTNGGVIPRG

SEQ ID NO: 2254497 - protein, 4 aa, Cryptosporidium parvum
DSQR

SEQ ID NO: 2254498 - protein, 13 aa, Cryptosporidium parvum
DSQRQATKDAGAI

SEQ ID NO: 2254499 - protein, 14 aa, Cryptosporidium parvum
DSQRQATKDAGSIA

SEQ ID NO: 2254500 - protein, 13 aa, Cryptosporidium parvum
DSQTSAEDASKIY

SEQ ID NO: 2254501 - protein, 7 aa, Cryptosporidium parvum
DSQTVQD

SEQ ID NO: 2254502 - protein, 6 aa, Cryptosporidium parvum
DSQWDR

SEQ ID NO: 2254503 - protein, 13 aa, Cryptosporidium parvum
DSRDPSIRILPER

SEQ ID NO: 2254504 - protein, 10 aa, Cryptosporidium parvum
DSRGNPTVEA

SEQ ID NO: 2254505 - protein, 4 aa, Cryptosporidium parvum
DSRI

SEQ ID NO: 2254506 - protein, 5 aa, Cryptosporidium parvum
DSRIE

SEQ ID NO: 2254507 - protein, 4 aa, Cryptosporidium parvum
DSRK

SEQ ID NO: 2254508 - protein, 11 aa, Cryptosporidium parvum
DSRKDEQDRGI

SEQ ID NO: 2254509 - protein, 11 aa, Cryptosporidium parvum
DSRLKSQGQDI

SEQ ID NO: 2254510 - protein, 11 aa, Cryptosporidium parvum
DSRSKNNLNDE

SEQ ID NO: 2254511 - protein, 14 aa, Cryptosporidium parvum
DSRSVDDLSPEEKK

SEQ ID NO: 2254512 - protein, 13 aa, Cryptosporidium parvum
DSRYRPDQRAYEN

SEQ ID NO: 2254513 - protein, 29 aa, Cryptosporidium parvum
DSSDESDDSNESDIKSSNSNTQKNSKPMT

SEQ ID NO: 2254514 - protein, 11 aa, Cryptosporidium parvum
DSSDKFKDPEE

SEQ ID NO: 2254515 - protein, 10 aa, Cryptosporidium parvum
DSSEDSYTED

SEQ ID NO: 2254516 - protein, 7 aa, Cryptosporidium parvum
DSSEEAN

SEQ ID NO: 2254517 - protein, 13 aa, Cryptosporidium parvum
DSSELSKKCSVTN

SEQ ID NO: 2254518 - protein, 7 aa, Cryptosporidium parvum
DSSEMRD

SEQ ID NO: 2254519 - protein, 8 aa, Cryptosporidium parvum
DSSENQLG

SEQ ID NO: 2254520 - protein, 8 aa, Cryptosporidium parvum
DSSENSKY

SEQ ID NO: 2254521 - protein, 29 aa, Cryptosporidium parvum
DSSEQQAQGQGQGQGQGQTQNENKIPSGP

SEQ ID NO: 2254522 - protein, 6 aa, Cryptosporidium parvum
DSSEYG

SEQ ID NO: 2254523 - protein, 9 aa, Cryptosporidium parvum
DSSGQLSSL

SEQ ID NO: 2254524 - protein, 14 aa, Cryptosporidium parvum
DSSGTMTGGGPNVS

SEQ ID NO: 2254525 - protein, 4 aa, Cryptosporidium parvum
DSSI

SEQ ID NO: 2254526 - protein, 12 aa, Cryptosporidium parvum
DSSINTGNNTNN

SEQ ID NO: 2254527 - protein, 17 aa, Cryptosporidium parvum
DSSIQNDKVEKIKSEDI

SEQ ID NO: 2254528 - protein, 8 aa, Cryptosporidium parvum
DSSISCKN

SEQ ID NO: 2254529 - protein, 9 aa, Cryptosporidium parvum
DSSKESNSD

SEQ ID NO: 2254530 - protein, 18 aa, Cryptosporidium parvum
DSSKGRRWSNNSTTSTIS

SEQ ID NO: 2254531 - protein, 14 aa, Cryptosporidium parvum
DSSKLENKSMNELN

SEQ ID NO: 2254532 - protein, 5 aa, Cryptosporidium parvum
DSSKN

SEQ ID NO: 2254533 - protein, 10 aa, Cryptosporidium parvum
DSSKTGNHQY

SEQ ID NO: 2254534 - protein, 9 aa, Cryptosporidium parvum
DSSKVESKN

SEQ ID NO: 2254535 - protein, 4 aa, Cryptosporidium parvum
DSSL

SEQ ID NO: 2254536 - protein, 5 aa, Cryptosporidium parvum
DSSMS

SEQ ID NO: 2254537 - protein, 4 aa, Cryptosporidium parvum
DSSN

SEQ ID NO: 2254538 - protein, 10 aa, Cryptosporidium parvum
DSSNKRTPSY

SEQ ID NO: 2254539 - protein, 8 aa, Cryptosporidium parvum
DSSNNSFS

SEQ ID NO: 2254540 - protein, 27 aa, Cryptosporidium parvum
DSSNSAQSGTGSSSGFGSRFGRENSAK

SEQ ID NO: 2254541 - protein, 4 aa, Cryptosporidium parvum
DSSP

SEQ ID NO: 2254542 - protein, 10 aa, Cryptosporidium parvum
DSSPAQAAGL

SEQ ID NO: 2254543 - protein, 10 aa, Cryptosporidium parvum
DSSPDGTAEV

SEQ ID NO: 2254544 - protein, 19 aa, Cryptosporidium parvum
DSSPNKENDKSIGTDSSSN

SEQ ID NO: 2254545 - protein, 7 aa, Cryptosporidium parvum
DSSPNSL

SEQ ID NO: 2254546 - protein, 10 aa, Cryptosporidium parvum
DSSPQQSFNR

SEQ ID NO: 2254547 - protein, 14 aa, Cryptosporidium parvum
DSSPVTTQSYENRN

SEQ ID NO: 2254548 - protein, 16 aa, Cryptosporidium parvum
DSSQINDQKPDLEEPE

SEQ ID NO: 2254549 - protein, 5 aa, Cryptosporidium parvum
DSSQN

SEQ ID NO: 2254550 - protein, 19 aa, Cryptosporidium parvum
DSSQQANISHSNVEESTQS

SEQ ID NO: 2254551 - protein, 16 aa, Cryptosporidium parvum
DSSRGRKIQNEKTSDN

SEQ ID NO: 2254552 - protein, 19 aa, Cryptosporidium parvum
DSSRKAHAEDGANSEKGIK

SEQ ID NO: 2254553 - protein, 10 aa, Cryptosporidium parvum
DSSSARKNIS

SEQ ID NO: 2254554 - protein, 24 aa, Cryptosporidium parvum
DSSSEAKHYSTRVSASPNKQQYDM

SEQ ID NO: 2254555 - protein, 6 aa, Cryptosporidium parvum
DSSSGG

SEQ ID NO: 2254556 - protein, 19 aa, Cryptosporidium parvum
DSSSKGNNSEKNKKNYPEL

SEQ ID NO: 2254557 - protein, 9 aa, Cryptosporidium parvum
DSSSKIASI

SEQ ID NO: 2254558 - protein, 13 aa, Cryptosporidium parvum
DSSSLRRADIGGQ

SEQ ID NO: 2254559 - protein, 5 aa, Cryptosporidium parvum
DSSSN

SEQ ID NO: 2254560 - protein, 6 aa, Cryptosporidium parvum
DSSSPE

SEQ ID NO: 2254561 - protein, 11 aa, Cryptosporidium parvum
DSSSSKSSYSV

SEQ ID NO: 2254562 - protein, 8 aa, Cryptosporidium parvum
DSSSTSDW

SEQ ID NO: 2254563 - protein, 5 aa, Cryptosporidium parvum
DSSSV

SEQ ID NO: 2254564 - protein, 25 aa, Cryptosporidium parvum
DSSSYEGDFQNGAPNGQGKYTYSNG

SEQ ID NO: 2254565 - protein, 5 aa, Cryptosporidium parvum
DSSVE

SEQ ID NO: 2254566 - protein, 6 aa, Cryptosporidium parvum
DSSYRM

SEQ ID NO: 2254567 - protein, 69 aa, Cryptosporidium parvum
DSTAETPVDNEAGADSETSSKQESGEASNKKQTASGEASKDSSGTSNEESAQNEDGSADKNVSADVQPN

SEQ ID NO: 2254568 - protein, 5 aa, Cryptosporidium parvum
DSTEF

SEQ ID NO: 2254569 - protein, 7 aa, Cryptosporidium parvum
DSTEKTR

SEQ ID NO: 2254570 - protein, 7 aa, Cryptosporidium parvum
DSTELPR

SEQ ID NO: 2254571 - protein, 6 aa, Cryptosporidium parvum
DSTEQI

SEQ ID NO: 2254572 - protein, 16 aa, Cryptosporidium parvum
DSTESNNRESKKEDEK

SEQ ID NO: 2254573 - protein, 6 aa, Cryptosporidium parvum
DSTEVR

SEQ ID NO: 2254574 - protein, 7 aa, Cryptosporidium parvum
DSTFNSP

SEQ ID NO: 2254575 - protein, 5 aa, Cryptosporidium parvum
DSTFT

SEQ ID NO: 2254576 - protein, 7 aa, Cryptosporidium parvum
DSTFTSE

SEQ ID NO: 2254577 - protein, 19 aa, Cryptosporidium parvum
DSTHAQYSAPIDDDADDLY

SEQ ID NO: 2254578 - protein, 9 aa, Cryptosporidium parvum
DSTINTDSH

SEQ ID NO: 2254579 - protein, 7 aa, Cryptosporidium parvum
DSTISSI

SEQ ID NO: 2254580 - protein, 11 aa, Cryptosporidium parvum
DSTKAYGGSYF

SEQ ID NO: 2254581 - protein, 9 aa, Cryptosporidium parvum
DSTKEPRRG

SEQ ID NO: 2254582 - protein, 12 aa, Cryptosporidium parvum
DSTKVGDYDNSK

SEQ ID NO: 2254583 - protein, 6 aa, Cryptosporidium parvum
DSTLGE

SEQ ID NO: 2254584 - protein, 6 aa, Cryptosporidium parvum
DSTLQG

SEQ ID NO: 2254585 - protein, 9 aa, Cryptosporidium parvum
DSTNEDKKI

SEQ ID NO: 2254586 - protein, 6 aa, Cryptosporidium parvum
DSTNGL

SEQ ID NO: 2254587 - protein, 7 aa, Cryptosporidium parvum
DSTNKKE

SEQ ID NO: 2254588 - protein, 6 aa, Cryptosporidium parvum
DSTNQV

SEQ ID NO: 2254589 - protein, 10 aa, Cryptosporidium parvum
DSTNTSLQEI

SEQ ID NO: 2254590 - protein, 9 aa, Cryptosporidium parvum
DSTQGYIPT

SEQ ID NO: 2254591 - protein, 5 aa, Cryptosporidium parvum
DSTRD

SEQ ID NO: 2254592 - protein, 7 aa, Cryptosporidium parvum
DSTRGPQ

SEQ ID NO: 2254593 - protein, 7 aa, Cryptosporidium parvum
DSTTAAS

SEQ ID NO: 2254594 - protein, 11 aa, Cryptosporidium parvum
DSTTAEGKEVP

SEQ ID NO: 2254595 - protein, 18 aa, Cryptosporidium parvum
DSTTCTTIQNDTNSNTPF

SEQ ID NO: 2254596 - protein, 7 aa, Cryptosporidium parvum
DSTVDRG

SEQ ID NO: 2254597 - protein, 12 aa, Cryptosporidium parvum
DSTYDGEETEEY

SEQ ID NO: 2254598 - protein, 5 aa, Cryptosporidium parvum
DSTYP

SEQ ID NO: 2254599 - protein, 13 aa, Cryptosporidium parvum
DSTYRTKNHPTQD

SEQ ID NO: 2254600 - protein, 6 aa, Cryptosporidium parvum
DSVDNR

SEQ ID NO: 2254601 - protein, 5 aa, Cryptosporidium parvum
DSVDP

SEQ ID NO: 2254602 - protein, 14 aa, Cryptosporidium parvum
DSVDQTLEKSTEEA

SEQ ID NO: 2254603 - protein, 6 aa, Cryptosporidium parvum
DSVEDD

SEQ ID NO: 2254604 - protein, 9 aa, Cryptosporidium parvum
DSVESNPSI

SEQ ID NO: 2254605 - protein, 18 aa, Cryptosporidium parvum
DSVKDKEQKMSGNYFLLE

SEQ ID NO: 2254606 - protein, 10 aa, Cryptosporidium parvum
DSVKDPEDLS

SEQ ID NO: 2254607 - protein, 4 aa, Cryptosporidium parvum
DSVM

SEQ ID NO: 2254608 - protein, 24 aa, Cryptosporidium parvum
DSVNDSKDSNMLDKDSNQESSDEK

SEQ ID NO: 2254609 - protein, 7 aa, Cryptosporidium parvum
DSVNNEN

SEQ ID NO: 2254610 - protein, 12 aa, Cryptosporidium parvum
DSVQDSTSEWKK

SEQ ID NO: 2254611 - protein, 7 aa, Cryptosporidium parvum
DSVRGDR

SEQ ID NO: 2254612 - protein, 10 aa, Cryptosporidium parvum
DSVRNDPKKA

SEQ ID NO: 2254613 - protein, 7 aa, Cryptosporidium parvum
DSVRRQA

SEQ ID NO: 2254614 - protein, 9 aa, Cryptosporidium parvum
DSVRSEAEV

SEQ ID NO: 2254615 - protein, 17 aa, Cryptosporidium parvum
DSVSSDSLSQDSDEVEV

SEQ ID NO: 2254616 - protein, 6 aa, Cryptosporidium parvum
DSYEKS

SEQ ID NO: 2254617 - protein, 6 aa, Cryptosporidium parvum
DSYKEI

SEQ ID NO: 2254618 - protein, 11 aa, Cryptosporidium parvum
DSYNTNNSTAI

SEQ ID NO: 2254619 - protein, 43 aa, Cryptosporidium parvum
DSYSNNNNNNNDNNNQNNINNNNNQDDIDYHSDDSYSDEENFK

SEQ ID NO: 2254620 - protein, 13 aa, Cryptosporidium parvum
DSYSRSRDREPTY

SEQ ID NO: 2254621 - protein, 16 aa, Cryptosporidium parvum
DSYSYKGNSKQSLSRI

SEQ ID NO: 2254622 - protein, 4 aa, Cryptosporidium parvum
DTAI

SEQ ID NO: 2254623 - protein, 7 aa, Cryptosporidium parvum
DTASTAG

SEQ ID NO: 2254624 - protein, 7 aa, Cryptosporidium parvum
DTASTKI

SEQ ID NO: 2254625 - protein, 7 aa, Cryptosporidium parvum
DTATPCT

SEQ ID NO: 2254626 - protein, 13 aa, Cryptosporidium parvum
DTCNDLTNKFDIK

SEQ ID NO: 2254627 - protein, 10 aa, Cryptosporidium parvum
DTDEAQNSHT

SEQ ID NO: 2254628 - protein, 19 aa, Cryptosporidium parvum
DTDEEWEEQFGGEDVENVD

SEQ ID NO: 2254629 - protein, 7 aa, Cryptosporidium parvum
DTDIENK

SEQ ID NO: 2254630 - protein, 8 aa, Cryptosporidium parvum
DTDQSFSD

SEQ ID NO: 2254631 - protein, 8 aa, Cryptosporidium parvum
DTDQTEIE

SEQ ID NO: 2254632 - protein, 7 aa, Cryptosporidium parvum
DTDTKEV

SEQ ID NO: 2254633 - protein, 8 aa, Cryptosporidium parvum
DTDVENDS

SEQ ID NO: 2254634 - protein, 5 aa, Cryptosporidium parvum
DTEAN

SEQ ID NO: 2254635 - protein, 7 aa, Cryptosporidium parvum
DTEDQEL

SEQ ID NO: 2254636 - protein, 4 aa, Cryptosporidium parvum
DTEE

SEQ ID NO: 2254637 - protein, 11 aa, Cryptosporidium parvum
DTEENEEEYKN

SEQ ID NO: 2254638 - protein, 6 aa, Cryptosporidium parvum
DTEENI

SEQ ID NO: 2254639 - protein, 5 aa, Cryptosporidium parvum
DTEEY

SEQ ID NO: 2254640 - protein, 8 aa, Cryptosporidium parvum
DTEGEQTM

SEQ ID NO: 2254641 - protein, 4 aa, Cryptosporidium parvum
DTEI

SEQ ID NO: 2254642 - protein, 13 aa, Cryptosporidium parvum
DTEKETTDSSLKP

SEQ ID NO: 2254643 - protein, 10 aa, Cryptosporidium parvum
DTEKSSSQGL

SEQ ID NO: 2254644 - protein, 7 aa, Cryptosporidium parvum
DTEMTSS

SEQ ID NO: 2254645 - protein, 6 aa, Cryptosporidium parvum
DTENNQ

SEQ ID NO: 2254646 - protein, 17 aa, Cryptosporidium parvum
DTENNSLKENENNTEKN

SEQ ID NO: 2254647 - protein, 10 aa, Cryptosporidium parvum
DTENPDSDAM

SEQ ID NO: 2254648 - protein, 10 aa, Cryptosporidium parvum
DTENSSQHHH

SEQ ID NO: 2254649 - protein, 6 aa, Cryptosporidium parvum
DTEPRI

SEQ ID NO: 2254650 - protein, 25 aa, Cryptosporidium parvum
DTESKLNKVNSDSLKLQKSDSNNDN

SEQ ID NO: 2254651 - protein, 11 aa, Cryptosporidium parvum
DTETNNFNKDS

SEQ ID NO: 2254652 - protein, 7 aa, Cryptosporidium parvum
DTETPKF

SEQ ID NO: 2254653 - protein, 14 aa, Cryptosporidium parvum
DTFDDRSNHNLRNT

SEQ ID NO: 2254654 - protein, 5 aa, Cryptosporidium parvum
DTGDF

SEQ ID NO: 2254655 - protein, 8 aa, Cryptosporidium parvum
DTGEIKPE

SEQ ID NO: 2254656 - protein, 4 aa, Cryptosporidium parvum
DTGL

SEQ ID NO: 2254657 - protein, 4 aa, Cryptosporidium parvum
DTGN

SEQ ID NO: 2254658 - protein, 9 aa, Cryptosporidium parvum
DTGNNNKGF

SEQ ID NO: 2254659 - protein, 11 aa, Cryptosporidium parvum
DTGSDLTDEKA

SEQ ID NO: 2254660 - protein, 10 aa, Cryptosporidium parvum
DTGSGKTTQC

SEQ ID NO: 2254661 - protein, 29 aa, Cryptosporidium parvum
DTGSNGSGNSSRRANQGGAAGGTESGGIG

SEQ ID NO: 2254662 - protein, 19 aa, Cryptosporidium parvum
DTGYKNGTKQSESNANKEY

SEQ ID NO: 2254663 - protein, 5 aa, Cryptosporidium parvum
DTHPT

SEQ ID NO: 2254664 - protein, 7 aa, Cryptosporidium parvum
DTHRGQH

SEQ ID NO: 2254665 - protein, 6 aa, Cryptosporidium parvum
DTHTEY

SEQ ID NO: 2254666 - protein, 21 aa, Cryptosporidium parvum
DTIEEDEQQHVGYNSNGDSME

SEQ ID NO: 2254667 - protein, 9 aa, Cryptosporidium parvum
DTIEQARQK

SEQ ID NO: 2254668 - protein, 6 aa, Cryptosporidium parvum
DTIKDC

SEQ ID NO: 2254669 - protein, 14 aa, Cryptosporidium parvum
DTINDSKDQNSTNE

SEQ ID NO: 2254670 - protein, 9 aa, Cryptosporidium parvum
DTINEKDES

SEQ ID NO: 2254671 - protein, 12 aa, Cryptosporidium parvum
DTINERSQGYEQ

SEQ ID NO: 2254672 - protein, 12 aa, Cryptosporidium parvum
DTINRKNSKLDE

SEQ ID NO: 2254673 - protein, 7 aa, Cryptosporidium parvum
DTIPEAD

SEQ ID NO: 2254674 - protein, 22 aa, Cryptosporidium parvum
DTIQTNENKTQALTKSLKGDQK

SEQ ID NO: 2254675 - protein, 6 aa, Cryptosporidium parvum
DTISDT

SEQ ID NO: 2254676 - protein, 10 aa, Cryptosporidium parvum
DTISGENRLD

SEQ ID NO: 2254677 - protein, 13 aa, Cryptosporidium parvum
DTISKNNSSYKKK

SEQ ID NO: 2254678 - protein, 13 aa, Cryptosporidium parvum
DTISPRKSIKEYA

SEQ ID NO: 2254679 - protein, 5 aa, Cryptosporidium parvum
DTISQ

SEQ ID NO: 2254680 - protein, 11 aa, Cryptosporidium parvum
DTITKKKRDSI

SEQ ID NO: 2254681 - protein, 31 aa, Cryptosporidium parvum
DTKDEIDNNSYSRQQNNGIRKKKSEINKEIR

SEQ ID NO: 2254682 - protein, 6 aa, Cryptosporidium parvum
DTKECK

SEQ ID NO: 2254683 - protein, 8 aa, Cryptosporidium parvum
DTKEEQKE

SEQ ID NO: 2254684 - protein, 12 aa, Cryptosporidium parvum
DTKEKSMETNTR

SEQ ID NO: 2254685 - protein, 9 aa, Cryptosporidium parvum
DTKESREKH

SEQ ID NO: 2254686 - protein, 16 aa, Cryptosporidium parvum
DTKKEQEEYNIMLQLI

SEQ ID NO: 2254687 - protein, 8 aa, Cryptosporidium parvum
DTKKKSKV

SEQ ID NO: 2254688 - protein, 10 aa, Cryptosporidium parvum
DTKNENEKYK

SEQ ID NO: 2254689 - protein, 8 aa, Cryptosporidium parvum
DTKPGSAT

SEQ ID NO: 2254690 - protein, 7 aa, Cryptosporidium parvum
DTKRPST

SEQ ID NO: 2254691 - protein, 10 aa, Cryptosporidium parvum
DTKRSNLDNS

SEQ ID NO: 2254692 - protein, 9 aa, Cryptosporidium parvum
DTKTAKHRE

SEQ ID NO: 2254693 - protein, 11 aa, Cryptosporidium parvum
DTKTSANKTRP

SEQ ID NO: 2254694 - protein, 12 aa, Cryptosporidium parvum
DTKVKDEESLKW

SEQ ID NO: 2254695 - protein, 14 aa, Cryptosporidium parvum
DTLNNSGCTTSDAT

SEQ ID NO: 2254696 - protein, 13 aa, Cryptosporidium parvum
DTLNSTSTSDNSI

SEQ ID NO: 2254697 - protein, 14 aa, Cryptosporidium parvum
DTLNYSSSSVKPEI

SEQ ID NO: 2254698 - protein, 6 aa, Cryptosporidium parvum
DTLPPS

SEQ ID NO: 2254699 - protein, 12 aa, Cryptosporidium parvum
DTLSKDSSLSQN

SEQ ID NO: 2254700 - protein, 13 aa, Cryptosporidium parvum
DTMHSGSEKEVAQ

SEQ ID NO: 2254701 - protein, 12 aa, Cryptosporidium parvum
DTMPSQELNKED

SEQ ID NO: 2254702 - protein, 15 aa, Cryptosporidium parvum
DTNAISDLDGEKNIK

SEQ ID NO: 2254703 - protein, 6 aa, Cryptosporidium parvum
DTNEKS

SEQ ID NO: 2254704 - protein, 5 aa, Cryptosporidium parvum
DTNEP

SEQ ID NO: 2254705 - protein, 6 aa, Cryptosporidium parvum
DTNETN

SEQ ID NO: 2254706 - protein, 6 aa, Cryptosporidium parvum
DTNEYF

SEQ ID NO: 2254707 - protein, 6 aa, Cryptosporidium parvum
DTNGNH

SEQ ID NO: 2254708 - protein, 8 aa, Cryptosporidium parvum
DTNKYTQE

SEQ ID NO: 2254709 - protein, 7 aa, Cryptosporidium parvum
DTNLKKG

SEQ ID NO: 2254710 - protein, 12 aa, Cryptosporidium parvum
DTNNANKKSLDP

SEQ ID NO: 2254711 - protein, 7 aa, Cryptosporidium parvum
DTNNDGM

SEQ ID NO: 2254712 - protein, 10 aa, Cryptosporidium parvum
DTNNDGTPQI

SEQ ID NO: 2254713 - protein, 10 aa, Cryptosporidium parvum
DTNNNSHDLK

SEQ ID NO: 2254714 - protein, 10 aa, Cryptosporidium parvum
DTNPYSEEQQ

SEQ ID NO: 2254715 - protein, 9 aa, Cryptosporidium parvum
DTNQNGELD

SEQ ID NO: 2254716 - protein, 8 aa, Cryptosporidium parvum
DTNQQNNL

SEQ ID NO: 2254717 - protein, 15 aa, Cryptosporidium parvum
DTNQSIKKNSEEKIF

SEQ ID NO: 2254718 - protein, 6 aa, Cryptosporidium parvum
DTNRHR

SEQ ID NO: 2254719 - protein, 4 aa, Cryptosporidium parvum
DTNS

SEQ ID NO: 2254720 - protein, 7 aa, Cryptosporidium parvum
DTNSHKI

SEQ ID NO: 2254721 - protein, 18 aa, Cryptosporidium parvum
DTNSINNKSTNNNGANAN

SEQ ID NO: 2254722 - protein, 8 aa, Cryptosporidium parvum
DTNSSTVN

SEQ ID NO: 2254723 - protein, 8 aa, Cryptosporidium parvum
DTNTTNNL

SEQ ID NO: 2254724 - protein, 12 aa, Cryptosporidium parvum
DTNYSKEPERIK

SEQ ID NO: 2254725 - protein, 4 aa, Cryptosporidium parvum
DTPC

SEQ ID NO: 2254726 - protein, 8 aa, Cryptosporidium parvum
DTPEGESC

SEQ ID NO: 2254727 - protein, 7 aa, Cryptosporidium parvum
DTPEYEP

SEQ ID NO: 2254728 - protein, 5 aa, Cryptosporidium parvum
DTPFG

SEQ ID NO: 2254729 - protein, 16 aa, Cryptosporidium parvum
DTPKIKKKNQEDSEIT

SEQ ID NO: 2254730 - protein, 43 aa, Cryptosporidium parvum
DTPKQNPPRVNPISGPKFGNKSTTNLSGGGNFDNKSRGSFGNR

SEQ ID NO: 2254731 - protein, 23 aa, Cryptosporidium parvum
DTPKQQTTINSSNDMRTSIKYDD

SEQ ID NO: 2254732 - protein, 7 aa, Cryptosporidium parvum
DTPSGSI

SEQ ID NO: 2254733 - protein, 4 aa, Cryptosporidium parvum
DTPT

SEQ ID NO: 2254734 - protein, 9 aa, Cryptosporidium parvum
DTPTSKSNY

SEQ ID NO: 2254735 - protein, 8 aa, Cryptosporidium parvum
DTPVGTST

SEQ ID NO: 2254736 - protein, 4 aa, Cryptosporidium parvum
DTQD

SEQ ID NO: 2254737 - protein, 5 aa, Cryptosporidium parvum
DTQKM

SEQ ID NO: 2254738 - protein, 7 aa, Cryptosporidium parvum
DTQTNKF

SEQ ID NO: 2254739 - protein, 10 aa, Cryptosporidium parvum
DTRATNGPIV

SEQ ID NO: 2254740 - protein, 7 aa, Cryptosporidium parvum
DTRDNKR

SEQ ID NO: 2254741 - protein, 7 aa, Cryptosporidium parvum
DTRKEVD

SEQ ID NO: 2254742 - protein, 8 aa, Cryptosporidium parvum
DTRSEEDN

SEQ ID NO: 2254743 - protein, 11 aa, Cryptosporidium parvum
DTRTDNSISPV

SEQ ID NO: 2254744 - protein, 4 aa, Cryptosporidium parvum
DTSA

SEQ ID NO: 2254745 - protein, 7 aa, Cryptosporidium parvum
DTSDGPF

SEQ ID NO: 2254746 - protein, 8 aa, Cryptosporidium parvum
DTSEKRKN

SEQ ID NO: 2254747 - protein, 10 aa, Cryptosporidium parvum
DTSESENPFN

SEQ ID NO: 2254748 - protein, 5 aa, Cryptosporidium parvum
DTSGE

SEQ ID NO: 2254749 - protein, 6 aa, Cryptosporidium parvum
DTSGQT

SEQ ID NO: 2254750 - protein, 9 aa, Cryptosporidium parvum
DTSGTKSNL

SEQ ID NO: 2254751 - protein, 10 aa, Cryptosporidium parvum
DTSHTNENDS

SEQ ID NO: 2254752 - protein, 4 aa, Cryptosporidium parvum
DTSK

SEQ ID NO: 2254753 - protein, 8 aa, Cryptosporidium parvum
DTSKPQIQ

SEQ ID NO: 2254754 - protein, 8 aa, Cryptosporidium parvum
DTSKYIKG

SEQ ID NO: 2254755 - protein, 5 aa, Cryptosporidium parvum
DTSMT

SEQ ID NO: 2254756 - protein, 10 aa, Cryptosporidium parvum
DTSNDSEAVQ

SEQ ID NO: 2254757 - protein, 8 aa, Cryptosporidium parvum
DTSNRMKA

SEQ ID NO: 2254758 - protein, 16 aa, Cryptosporidium parvum
DTSNSQQEQISNRPLD

SEQ ID NO: 2254759 - protein, 16 aa, Cryptosporidium parvum
DTSSKNYLKSKDSLAP

SEQ ID NO: 2254760 - protein, 5 aa, Cryptosporidium parvum
DTSSN

SEQ ID NO: 2254761 - protein, 10 aa, Cryptosporidium parvum
DTSSRGQDTI

SEQ ID NO: 2254762 - protein, 8 aa, Cryptosporidium parvum
DTSTNGTF

SEQ ID NO: 2254763 - protein, 14 aa, Cryptosporidium parvum
DTSTPVPKNKSSRL

SEQ ID NO: 2254764 - protein, 17 aa, Cryptosporidium parvum
DTTDGTTPVPSSPAAVG

SEQ ID NO: 2254765 - protein, 12 aa, Cryptosporidium parvum
DTTEQAKEMPSK

SEQ ID NO: 2254766 - protein, 7 aa, Cryptosporidium parvum
DTTERTL

SEQ ID NO: 2254767 - protein, 7 aa, Cryptosporidium parvum
DTTKISL

SEQ ID NO: 2254768 - protein, 8 aa, Cryptosporidium parvum
DTTMQSTD

SEQ ID NO: 2254769 - protein, 27 aa, Cryptosporidium parvum
DTTNHISKKSASKKGKKMISGEEWSEE

SEQ ID NO: 2254770 - protein, 22 aa, Cryptosporidium parvum
DTTNNSNNNNNNNNNNNNNNMA

SEQ ID NO: 2254771 - protein, 5 aa, Cryptosporidium parvum
DTTPE

SEQ ID NO: 2254772 - protein, 6 aa, Cryptosporidium parvum
DTTRDF

SEQ ID NO: 2254773 - protein, 6 aa, Cryptosporidium parvum
DTTRSI

SEQ ID NO: 2254774 - protein, 7 aa, Cryptosporidium parvum
DTTSIRN

SEQ ID NO: 2254775 - protein, 18 aa, Cryptosporidium parvum
DTTSNKPGKNNKGRSVTG

SEQ ID NO: 2254776 - protein, 6 aa, Cryptosporidium parvum
DTTSSS

SEQ ID NO: 2254777 - protein, 12 aa, Cryptosporidium parvum
DTVEQPKNIEGQ

SEQ ID NO: 2254778 - protein, 12 aa, Cryptosporidium parvum
DTVSHPKPLTTP

SEQ ID NO: 2254779 - protein, 7 aa, Cryptosporidium parvum
DTVSSNA

SEQ ID NO: 2254780 - protein, 53 aa, Cryptosporidium parvum
DTVTKGRKLRSQKWEDEDEDEDEDEDENENEEDKEDEEGGEDDSGVQNDDYED

SEQ ID NO: 2254781 - protein, 16 aa, Cryptosporidium parvum
DTWTPTIESKAGENCL

SEQ ID NO: 2254782 - protein, 6 aa, Cryptosporidium parvum
DTYEIK

SEQ ID NO: 2254783 - protein, 6 aa, Cryptosporidium parvum
DTYTDS

SEQ ID NO: 2254784 - protein, 10 aa, Cryptosporidium parvum
DVAQRAPKEL

SEQ ID NO: 2254785 - protein, 24 aa, Cryptosporidium parvum
DVASTTNVATNDNEIRDSRRNRSD

SEQ ID NO: 2254786 - protein, 20 aa, Cryptosporidium parvum
DVDDDDDKRCIEEEKEQEQE

SEQ ID NO: 2254787 - protein, 4 aa, Cryptosporidium parvum
DVDE

SEQ ID NO: 2254788 - protein, 7 aa, Cryptosporidium parvum
DVDGDGQ

SEQ ID NO: 2254789 - protein, 23 aa, Cryptosporidium parvum
DVDPATSATSEIETQKTTKTEPS

SEQ ID NO: 2254790 - protein, 4 aa, Cryptosporidium parvum
DVED

SEQ ID NO: 2254791 - protein, 19 aa, Cryptosporidium parvum
DVEDEAEDVGVDNNERNYN

SEQ ID NO: 2254792 - protein, 11 aa, Cryptosporidium parvum
DVEEEEEKTDF

SEQ ID NO: 2254793 - protein, 9 aa, Cryptosporidium parvum
DVEEIGTTE

SEQ ID NO: 2254794 - protein, 8 aa, Cryptosporidium parvum
DVEKEMPS

SEQ ID NO: 2254795 - protein, 9 aa, Cryptosporidium parvum
DVEKSLPNK

SEQ ID NO: 2254796 - protein, 6 aa, Cryptosporidium parvum
DVEKTQ

SEQ ID NO: 2254797 - protein, 15 aa, Cryptosporidium parvum
DVESYGEKDKMVDGE

SEQ ID NO: 2254798 - protein, 6 aa, Cryptosporidium parvum
DVHSEK

SEQ ID NO: 2254799 - protein, 10 aa, Cryptosporidium parvum
DVISPKPPNA

SEQ ID NO: 2254800 - protein, 9 aa, Cryptosporidium parvum
DVKDRQVKA

SEQ ID NO: 2254801 - protein, 11 aa, Cryptosporidium parvum
DVKKGAKRSDA

SEQ ID NO: 2254802 - protein, 18 aa, Cryptosporidium parvum
DVKTQDKKELSPQVESKA

SEQ ID NO: 2254803 - protein, 32 aa, Cryptosporidium parvum
DVMTTEPERGSNHRRRNYQNKFQNDVSGATQL

SEQ ID NO: 2254804 - protein, 5 aa, Cryptosporidium parvum
DVNDP

SEQ ID NO: 2254805 - protein, 17 aa, Cryptosporidium parvum
DVNEDRYSNENSSRGLR

SEQ ID NO: 2254806 - protein, 8 aa, Cryptosporidium parvum
DVNGTGGV

SEQ ID NO: 2254807 - protein, 4 aa, Cryptosporidium parvum
DVNL

SEQ ID NO: 2254808 - protein, 8 aa, Cryptosporidium parvum
DVNLNNPD

SEQ ID NO: 2254809 - protein, 8 aa, Cryptosporidium parvum
DVNNPLQQ

SEQ ID NO: 2254810 - protein, 8 aa, Cryptosporidium parvum
DVNPTQNT

SEQ ID NO: 2254811 - protein, 5 aa, Cryptosporidium parvum
DVNSE

SEQ ID NO: 2254812 - protein, 10 aa, Cryptosporidium parvum
DVNSNENADN

SEQ ID NO: 2254813 - protein, 6 aa, Cryptosporidium parvum
DVNSPN

SEQ ID NO: 2254814 - protein, 11 aa, Cryptosporidium parvum
DVNSSDNEDED

SEQ ID NO: 2254815 - protein, 6 aa, Cryptosporidium parvum
DVPAYS

SEQ ID NO: 2254816 - protein, 8 aa, Cryptosporidium parvum
DVPSSSIS

SEQ ID NO: 2254817 - protein, 10 aa, Cryptosporidium parvum
DVQAQDNRRN

SEQ ID NO: 2254818 - protein, 7 aa, Cryptosporidium parvum
DVQNSQV

SEQ ID NO: 2254819 - protein, 5 aa, Cryptosporidium parvum
DVQQE

SEQ ID NO: 2254820 - protein, 5 aa, Cryptosporidium parvum
DVRRI

SEQ ID NO: 2254821 - protein, 8 aa, Cryptosporidium parvum
DVRTPIPS

SEQ ID NO: 2254822 - protein, 4 aa, Cryptosporidium parvum
DVSG

SEQ ID NO: 2254823 - protein, 4 aa, Cryptosporidium parvum
DVSK

SEQ ID NO: 2254824 - protein, 9 aa, Cryptosporidium parvum
DVSKAKSRN

SEQ ID NO: 2254825 - protein, 8 aa, Cryptosporidium parvum
DVSNNVNE

SEQ ID NO: 2254826 - protein, 7 aa, Cryptosporidium parvum
DVSPDNS

SEQ ID NO: 2254827 - protein, 6 aa, Cryptosporidium parvum
DVSPNK

SEQ ID NO: 2254828 - protein, 7 aa, Cryptosporidium parvum
DVSTGQV

SEQ ID NO: 2254829 - protein, 8 aa, Cryptosporidium parvum
DVSTQQSF

SEQ ID NO: 2254830 - protein, 4 aa, Cryptosporidium parvum
DVSY

SEQ ID NO: 2254831 - protein, 6 aa, Cryptosporidium parvum
DVSYED

SEQ ID NO: 2254832 - protein, 5 aa, Cryptosporidium parvum
DVTEA

SEQ ID NO: 2254833 - protein, 6 aa, Cryptosporidium parvum
DVTPRL

SEQ ID NO: 2254834 - protein, 7 aa, Cryptosporidium parvum
DVTTNAS

SEQ ID NO: 2254835 - protein, 20 aa, Cryptosporidium parvum
DVTTPQNLSQIGETERQNDK

SEQ ID NO: 2254836 - protein, 5 aa, Cryptosporidium parvum
DVYYS

SEQ ID NO: 2254837 - protein, 13 aa, Cryptosporidium parvum
DWAPRQPTCNTGI

SEQ ID NO: 2254838 - protein, 7 aa, Cryptosporidium parvum
DWESDDN

SEQ ID NO: 2254839 - protein, 5 aa, Cryptosporidium parvum
DWKDT

SEQ ID NO: 2254840 - protein, 11 aa, Cryptosporidium parvum
DWKEGNGKYCG

SEQ ID NO: 2254841 - protein, 5 aa, Cryptosporidium parvum
DWPNN

SEQ ID NO: 2254842 - protein, 9 aa, Cryptosporidium parvum
DWPPPDTDY

SEQ ID NO: 2254843 - protein, 7 aa, Cryptosporidium parvum
DYAAERN

SEQ ID NO: 2254844 - protein, 13 aa, Cryptosporidium parvum
DYADDKEGRPFSE

SEQ ID NO: 2254845 - protein, 7 aa, Cryptosporidium parvum
DYASNNN

SEQ ID NO: 2254846 - protein, 4 aa, Cryptosporidium parvum
DYDE

SEQ ID NO: 2254847 - protein, 17 aa, Cryptosporidium parvum
DYDEHAKVKPEDSNDLA

SEQ ID NO: 2254848 - protein, 7 aa, Cryptosporidium parvum
DYDGSPP

SEQ ID NO: 2254849 - protein, 12 aa, Cryptosporidium parvum
DYDPNSSSLRSG

SEQ ID NO: 2254850 - protein, 7 aa, Cryptosporidium parvum
DYDSDKV

SEQ ID NO: 2254851 - protein, 5 aa, Cryptosporidium parvum
DYDTG

SEQ ID NO: 2254852 - protein, 10 aa, Cryptosporidium parvum
DYDTQRDKRF

SEQ ID NO: 2254853 - protein, 12 aa, Cryptosporidium parvum
DYENEENEDSSE

SEQ ID NO: 2254854 - protein, 9 aa, Cryptosporidium parvum
DYENNENGV

SEQ ID NO: 2254855 - protein, 6 aa, Cryptosporidium parvum
DYESNK

SEQ ID NO: 2254856 - protein, 7 aa, Cryptosporidium parvum
DYESPQT

SEQ ID NO: 2254857 - protein, 7 aa, Cryptosporidium parvum
DYEYRPE

SEQ ID NO: 2254858 - protein, 26 aa, Cryptosporidium parvum
DYGGKSSVSDSQEPKQVTIGSDTRLS

SEQ ID NO: 2254859 - protein, 6 aa, Cryptosporidium parvum
DYGKKS

SEQ ID NO: 2254860 - protein, 17 aa, Cryptosporidium parvum
DYGKRKYTASTQSSTED

SEQ ID NO: 2254861 - protein, 5 aa, Cryptosporidium parvum
DYGKS

SEQ ID NO: 2254862 - protein, 9 aa, Cryptosporidium parvum
DYGNGASVE

SEQ ID NO: 2254863 - protein, 5 aa, Cryptosporidium parvum
DYGNQ

SEQ ID NO: 2254864 - protein, 10 aa, Cryptosporidium parvum
DYGQKSGIQP

SEQ ID NO: 2254865 - protein, 6 aa, Cryptosporidium parvum
DYHPNG

SEQ ID NO: 2254866 - protein, 4 aa, Cryptosporidium parvum
DYIK

SEQ ID NO: 2254867 - protein, 10 aa, Cryptosporidium parvum
DYIQKSSKEA

SEQ ID NO: 2254868 - protein, 11 aa, Cryptosporidium parvum
DYKPDPTPAYN

SEQ ID NO: 2254869 - protein, 9 aa, Cryptosporidium parvum
DYKTSSDSE

SEQ ID NO: 2254870 - protein, 8 aa, Cryptosporidium parvum
DYNEKKED

SEQ ID NO: 2254871 - protein, 14 aa, Cryptosporidium parvum
DYNKSESRTMTDTN

SEQ ID NO: 2254872 - protein, 24 aa, Cryptosporidium parvum
DYNNNNNNNNSNSNSKFPNNGETD

SEQ ID NO: 2254873 - protein, 18 aa, Cryptosporidium parvum
DYNNSNSNSFYRTNSKTN

SEQ ID NO: 2254874 - protein, 8 aa, Cryptosporidium parvum
DYNPDQYN

SEQ ID NO: 2254875 - protein, 13 aa, Cryptosporidium parvum
DYNSPEKDDNDIT

SEQ ID NO: 2254876 - protein, 9 aa, Cryptosporidium parvum
DYNSSDELK

SEQ ID NO: 2254877 - protein, 10 aa, Cryptosporidium parvum
DYPESNSEES

SEQ ID NO: 2254878 - protein, 11 aa, Cryptosporidium parvum
DYPSDKEKQEC

SEQ ID NO: 2254879 - protein, 14 aa, Cryptosporidium parvum
DYQENQTHSTRNEI

SEQ ID NO: 2254880 - protein, 31 aa, Cryptosporidium parvum
DYQESSHNYDDETTETKESINTSSITATSPI

SEQ ID NO: 2254881 - protein, 12 aa, Cryptosporidium parvum
DYQKSRNVEKNN

SEQ ID NO: 2254882 - protein, 10 aa, Cryptosporidium parvum
DYRKGQKDAI

SEQ ID NO: 2254883 - protein, 7 aa, Cryptosporidium parvum
DYRTNQG

SEQ ID NO: 2254884 - protein, 6 aa, Cryptosporidium parvum
DYSGAL

SEQ ID NO: 2254885 - protein, 8 aa, Cryptosporidium parvum
DYSGPHYK

SEQ ID NO: 2254886 - protein, 8 aa, Cryptosporidium parvum
DYSHSDYN

SEQ ID NO: 2254887 - protein, 30 aa, Cryptosporidium parvum
DYSKSTSASSSASSTINSPSSNTPTSGRPA

SEQ ID NO: 2254888 - protein, 8 aa, Cryptosporidium parvum
DYSKWGKE

SEQ ID NO: 2254889 - protein, 8 aa, Cryptosporidium parvum
DYSLKSSR

SEQ ID NO: 2254890 - protein, 13 aa, Cryptosporidium parvum
DYSNSKESKNEEI

SEQ ID NO: 2254891 - protein, 5 aa, Cryptosporidium parvum
DYSPC

SEQ ID NO: 2254892 - protein, 12 aa, Cryptosporidium parvum
DYSPQGGGGGGL

SEQ ID NO: 2254893 - protein, 10 aa, Cryptosporidium parvum
DYSPYESQVE

SEQ ID NO: 2254894 - protein, 6 aa, Cryptosporidium parvum
DYSQEE

SEQ ID NO: 2254895 - protein, 16 aa, Cryptosporidium parvum
DYSQVSDNDKTVPRGA

SEQ ID NO: 2254896 - protein, 11 aa, Cryptosporidium parvum
DYSREDDRHVP

SEQ ID NO: 2254897 - protein, 27 aa, Cryptosporidium parvum
DYSSSGETKSNYMDSTKNVTRVRTDSK

SEQ ID NO: 2254898 - protein, 11 aa, Cryptosporidium parvum
DYSTPKSEINK

SEQ ID NO: 2254899 - protein, 9 aa, Cryptosporidium parvum
DYSVNEQKL

SEQ ID NO: 2254900 - protein, 12 aa, Cryptosporidium parvum
DYTISGTKQGSI

SEQ ID NO: 2254901 - protein, 6 aa, Cryptosporidium parvum
DYTPAT

SEQ ID NO: 2254902 - protein, 5 aa, Cryptosporidium parvum
DYYDA

SEQ ID NO: 2254903 - protein, 5 aa, Cryptosporidium parvum
DYYDS

SEQ ID NO: 2254904 - protein, 8 aa, Cryptosporidium parvum
DYYETDDL

SEQ ID NO: 2254905 - protein, 6 aa, Cryptosporidium parvum
DYYPST

SEQ ID NO: 2254906 - protein, 14 aa, Cryptosporidium parvum
EAAAKAAAAKKALF

SEQ ID NO: 2254907 - protein, 7 aa, Cryptosporidium parvum
EAAKAGR

SEQ ID NO: 2254908 - protein, 6 aa, Cryptosporidium parvum
EAANAK

SEQ ID NO: 2254909 - protein, 7 aa, Cryptosporidium parvum
EACEQNR

SEQ ID NO: 2254910 - protein, 8 aa, Cryptosporidium parvum
EADKEPEI

SEQ ID NO: 2254911 - protein, 15 aa, Cryptosporidium parvum
EADPDSEKKPNIHKG

SEQ ID NO: 2254912 - protein, 8 aa, Cryptosporidium parvum
EADPTSSL

SEQ ID NO: 2254913 - protein, 12 aa, Cryptosporidium parvum
EADRDGDGEINQ

SEQ ID NO: 2254914 - protein, 10 aa, Cryptosporidium parvum
EADSPGDSKL

SEQ ID NO: 2254915 - protein, 5 aa, Cryptosporidium parvum
EADTI

SEQ ID NO: 2254916 - protein, 8 aa, Cryptosporidium parvum
EADTPIPI

SEQ ID NO: 2254917 - protein, 10 aa, Cryptosporidium parvum
EADTSIQTKS

SEQ ID NO: 2254918 - protein, 11 aa, Cryptosporidium parvum
EADTSIQTKSN

SEQ ID NO: 2254919 - protein, 7 aa, Cryptosporidium parvum
EAEDGAP

SEQ ID NO: 2254920 - protein, 45 aa, Cryptosporidium parvum; identical to SEQ ID NO: 2139112

SEQ ID NO: 2254921 - protein, 7 aa, Cryptosporidium parvum
EAEEDDL

SEQ ID NO: 2254922 - protein, 6 aa, Cryptosporidium parvum
EAEEDS

SEQ ID NO: 2254923 - protein, 7 aa, Cryptosporidium parvum
EAEGISS

SEQ ID NO: 2254924 - protein, 7 aa, Cryptosporidium parvum
EAEGTTL

SEQ ID NO: 2254925 - protein, 12 aa, Cryptosporidium parvum
EAELSQDKDTLL

SEQ ID NO: 2254926 - protein, 16 aa, Cryptosporidium parvum
EAENNLDNERIQKERT

SEQ ID NO: 2254927 - protein, 13 aa, Cryptosporidium parvum
EAENTQNGPDRKT

SEQ ID NO: 2254928 - protein, 56 aa, Cryptosporidium parvum
EAEQSSVSRPEPGEKALQDPIDSQGEDIEQRTQKLSEIEASSSAASSSTSSSSNLY

SEQ ID NO: 2254929 - protein, 31 aa, Cryptosporidium parvum
EAEREVEAEREVETEREVETEKTMKTEKEMD

SEQ ID NO: 2254930 - protein, 4 aa, Cryptosporidium parvum
EAES

SEQ ID NO: 2254931 - protein, 9 aa, Cryptosporidium parvum
EAESDGQRR

SEQ ID NO: 2254932 - protein, 6 aa, Cryptosporidium parvum
EAESGG

SEQ ID NO: 2254933 - protein, 29 aa, Cryptosporidium parvum
EAESGTQISIRGKGTTKEGKKCDHQTEEE

SEQ ID NO: 2254934 - protein, 7 aa, Cryptosporidium parvum
EAESNMN

SEQ ID NO: 2254935 - protein, 10 aa, Cryptosporidium parvum
EAETGSGKTA

SEQ ID NO: 2254936 - protein, 18 aa, Cryptosporidium parvum
EAETRNEDTIDNRRKRGS

SEQ ID NO: 2254937 - protein, 9 aa, Cryptosporidium parvum
EAFPENKKI

SEQ ID NO: 2254938 - protein, 21 aa, Cryptosporidium parvum
EAFSPNNPRGYQGKLGQQGFR

SEQ ID NO: 2254939 - protein, 9 aa, Cryptosporidium parvum
EAGAHGKDT

SEQ ID NO: 2254940 - protein, 7 aa, Cryptosporidium parvum
EAGAPED

SEQ ID NO: 2254941 - protein, 21 aa, Cryptosporidium parvum
EAGDKNSNSCKANGNRGKHSL

SEQ ID NO: 2254942 - protein, 17 aa, Cryptosporidium parvum
EAGDRRQSFNYGNNESA

SEQ ID NO: 2254943 - protein, 8 aa, Cryptosporidium parvum
EAGENSIS

SEQ ID NO: 2254944 - protein, 29 aa, Cryptosporidium parvum
EAGGGFSTGNHKGKREKSVKSQKYPVNSK

SEQ ID NO: 2254945 - protein, 4 aa, Cryptosporidium parvum
EAGK

SEQ ID NO: 2254946 - protein, 5 aa, Cryptosporidium parvum
EAGKD

SEQ ID NO: 2254947 - protein, 5 aa, Cryptosporidium parvum
EAGNK

SEQ ID NO: 2254948 - protein, 4 aa, Cryptosporidium parvum
EAGS

SEQ ID NO: 2254949 - protein, 14 aa, Cryptosporidium parvum
EAGSGGKGKGEGFD

SEQ ID NO: 2254950 - protein, 9 aa, Cryptosporidium parvum
EAGTGSGSL

SEQ ID NO: 2254951 - protein, 5 aa, Cryptosporidium parvum
EAHEE

SEQ ID NO: 2254952 - protein, 7 aa, Cryptosporidium parvum
EAHGYDT

SEQ ID NO: 2254953 - protein, 30 aa, Cryptosporidium parvum
EAIENNKLSKKKVNYESNSNVENKNQTIKN

SEQ ID NO: 2254954 - protein, 16 aa, Cryptosporidium parvum
EAIGRTKEEKLKTEEF

SEQ ID NO: 2254955 - protein, 23 aa, Cryptosporidium parvum
EAIHTNPATVTKEDLSTILKETW

SEQ ID NO: 2254956 - protein, 10 aa, Cryptosporidium parvum
EAIKYSKSSR

SEQ ID NO: 2254957 - protein, 23 aa, Cryptosporidium parvum
EAINDEDSKSDEEKNSEEGVTTV

SEQ ID NO: 2254958 - protein, 4 aa, Cryptosporidium parvum
EAIS

SEQ ID NO: 2254959 - protein, 19 aa, Cryptosporidium parvum
EAISSSYGNDELTIGTSEE

SEQ ID NO: 2254960 - protein, 5 aa, Cryptosporidium parvum
EAKDK

SEQ ID NO: 2254961 - protein, 14 aa, Cryptosporidium parvum
EAKEILSRNSDNTF

SEQ ID NO: 2254962 - protein, 13 aa, Cryptosporidium parvum
EAKEKSSTETTSF

SEQ ID NO: 2254963 - protein, 38 aa, Cryptosporidium parvum
EAKENSKGRWNNKGENLQTKRNFKSTKNDINAGTYQPY

SEQ ID NO: 2254964 - protein, 10 aa, Cryptosporidium parvum
EAKKEGLTTP

SEQ ID NO: 2254965 - protein, 12 aa, Cryptosporidium parvum
EAKKQKINETDK

SEQ ID NO: 2254966 - protein, 12 aa, Cryptosporidium parvum
EAKNEERKKRRY

SEQ ID NO: 2254967 - protein, 9 aa, Cryptosporidium parvum
EAKNTTIEK

SEQ ID NO: 2254968 - protein, 15 aa, Cryptosporidium parvum
EAKQKQVSQDDPNYG

SEQ ID NO: 2254969 - protein, 11 aa, Cryptosporidium parvum
EAKQTNIESEV

SEQ ID NO: 2254970 - protein, 4 aa, Cryptosporidium parvum
EAKR

SEQ ID NO: 2254971 - protein, 11 aa, Cryptosporidium parvum
EAKRKGRSMGL

SEQ ID NO: 2254972 - protein, 14 aa, Cryptosporidium parvum
EAKSKSAAQQSSSL

SEQ ID NO: 2254973 - protein, 6 aa, Cryptosporidium parvum
EAKTKH

SEQ ID NO: 2254974 - protein, 11 aa, Cryptosporidium parvum
EALAESRRNYE

SEQ ID NO: 2254975 - protein, 6 aa, Cryptosporidium parvum
EALDDE

SEQ ID NO: 2254976 - protein, 4 aa, Cryptosporidium parvum
EALK

SEQ ID NO: 2254977 - protein, 5 aa, Cryptosporidium parvum
EALKE

SEQ ID NO: 2254978 - protein, 11 aa, Cryptosporidium parvum
EALNSNENENM

SEQ ID NO: 2254979 - protein, 8 aa, Cryptosporidium parvum
EALNSNSI

SEQ ID NO: 2254980 - protein, 4 aa, Cryptosporidium parvum
EALS

SEQ ID NO: 2254981 - protein, 9 aa, Cryptosporidium parvum
EAMTQPYKN

SEQ ID NO: 2254982 - protein, 10 aa, Cryptosporidium parvum
EANEAYIPDG

SEQ ID NO: 2254983 - protein, 11 aa, Cryptosporidium parvum
EANGKETLKLP

SEQ ID NO: 2254984 - protein, 15 aa, Cryptosporidium parvum
EANNNNGRINPIPAE

SEQ ID NO: 2254985 - protein, 23 aa, Cryptosporidium parvum
EANPEKDIQTKKYSLRENSRSIT

SEQ ID NO: 2254986 - protein, 13 aa, Cryptosporidium parvum
EANQRAPNTYRSG

SEQ ID NO: 2254987 - protein, 4 aa, Cryptosporidium parvum
EANR

SEQ ID NO: 2254988 - protein, 11 aa, Cryptosporidium parvum
EANRQKEEKRL

SEQ ID NO: 2254989 - protein, 7 aa, Cryptosporidium parvum
EANSRQS

SEQ ID NO: 2254990 - protein, 4 aa, Cryptosporidium parvum
EANV

SEQ ID NO: 2254991 - protein, 12 aa, Cryptosporidium parvum
EANVGHNENDPL

SEQ ID NO: 2254992 - protein, 5 aa, Cryptosporidium parvum
EANWP

SEQ ID NO: 2254993 - protein, 6 aa, Cryptosporidium parvum
EAPEEF

SEQ ID NO: 2254994 - protein, 13 aa, Cryptosporidium parvum
EAPKYLKLYEILK

SEQ ID NO: 2254995 - protein, 5 aa, Cryptosporidium parvum
EAPSE

SEQ ID NO: 2254996 - protein, 19 aa, Cryptosporidium parvum
EAPTRASEKDSHDSKSMSH

SEQ ID NO: 2254997 - protein, 5 aa, Cryptosporidium parvum
EAQNE

SEQ ID NO: 2254998 - protein, 14 aa, Cryptosporidium parvum
EAQSENLGGSFPEN

SEQ ID NO: 2254999 - protein, 57 aa, Cryptosporidium parvum
EARERKQAAALEKKRKEEERAENEKWRDDDKHANRKIERRKEALNKQEEKQQKKQEL

SEQ ID NO: 2255000 - protein, 4 aa, Cryptosporidium parvum
EARI

SEQ ID NO: 2255001 - protein, 13 aa, Cryptosporidium parvum
EARIAQDQEVGGK

SEQ ID NO: 2255002 - protein, 9 aa, Cryptosporidium parvum
EARLTQKKS

SEQ ID NO: 2255003 - protein, 9 aa, Cryptosporidium parvum
EARNNPSYF

SEQ ID NO: 2255004 - protein, 11 aa, Cryptosporidium parvum
EARQESEELTV

SEQ ID NO: 2255005 - protein, 8 aa, Cryptosporidium parvum
EARSMDPQ

SEQ ID NO: 2255006 - protein, 21 aa, Cryptosporidium parvum
EARTTKKKKHINSNQIKNNEQ

SEQ ID NO: 2255007 - protein, 24 aa, Cryptosporidium parvum
EASAAAVASSRQSNHRQKQKQKPK

SEQ ID NO: 2255008 - protein, 7 aa, Cryptosporidium parvum
EASDDTI

SEQ ID NO: 2255009 - protein, 10 aa, Cryptosporidium parvum
EASDGKVDKE

SEQ ID NO: 2255010 - protein, 7 aa, Cryptosporidium parvum
EASEDAV

SEQ ID NO: 2255011 - protein, 16 aa, Cryptosporidium parvum
EASETAKKELSSKTQV

SEQ ID NO: 2255012 - protein, 11 aa, Cryptosporidium parvum
EASIRNSSSRI

SEQ ID NO: 2255013 - protein, 12 aa, Cryptosporidium parvum
EASNQTSSVNSL

SEQ ID NO: 2255014 - protein, 9 aa, Cryptosporidium parvum
EASNRDAPL

SEQ ID NO: 2255015 - protein, 6 aa, Cryptosporidium parvum
EASNSH

SEQ ID NO: 2255016 - protein, 9 aa, Cryptosporidium parvum
EASPKGWIP

SEQ ID NO: 2255017 - protein, 9 aa, Cryptosporidium parvum
EASSKEQGK

SEQ ID NO: 2255018 - protein, 4 aa, Cryptosporidium parvum
EASW

SEQ ID NO: 2255019 - protein, 8 aa, Cryptosporidium parvum
EATDEELA

SEQ ID NO: 2255020 - protein, 13 aa, Cryptosporidium parvum
EATDSGDISPFDE

SEQ ID NO: 2255021 - protein, 6 aa, Cryptosporidium parvum
EATGQI

SEQ ID NO: 2255022 - protein, 13 aa, Cryptosporidium parvum
EATIETDHRDYTE

SEQ ID NO: 2255023 - protein, 5 aa, Cryptosporidium parvum
EATLS

SEQ ID NO: 2255024 - protein, 8 aa, Cryptosporidium parvum
EATSKGPV

SEQ ID NO: 2255025 - protein, 9 aa, Cryptosporidium parvum
EATSNTNWG

SEQ ID NO: 2255026 - protein, 38 aa, Cryptosporidium parvum
EATSSISLSPKSDPWVPKSDSNFSKHDNQLDDTSQSHI

SEQ ID NO: 2255027 - protein, 15 aa, Cryptosporidium parvum
EATTDFHRDDPSRNP

SEQ ID NO: 2255028 - protein, 7 aa, Cryptosporidium parvum
EATTTIG

SEQ ID NO: 2255029 - protein, 9 aa, Cryptosporidium parvum
EAVENARTN

SEQ ID NO: 2255030 - protein, 8 aa, Cryptosporidium parvum
EAVPGDNV

SEQ ID NO: 2255031 - protein, 6 aa, Cryptosporidium parvum
EAYDPR

SEQ ID NO: 2255032 - protein, 19 aa, Cryptosporidium parvum
ECAESAAKSRFSKYIFVIR

SEQ ID NO: 2255033 - protein, 7 aa, Cryptosporidium parvum
ECDDDDG

SEQ ID NO: 2255034 - protein, 15 aa, Cryptosporidium parvum
ECEEVSKDLNKEGIS

SEQ ID NO: 2255035 - protein, 6 aa, Cryptosporidium parvum
ECESEN

SEQ ID NO: 2255036 - protein, 8 aa, Cryptosporidium parvum
ECGENNGI

SEQ ID NO: 2255037 - protein, 5 aa, Cryptosporidium parvum
ECGSN

SEQ ID NO: 2255038 - protein, 5 aa, Cryptosporidium parvum
ECNSS

SEQ ID NO: 2255039 - protein, 14 aa, Cryptosporidium parvum
ECRNSSSSKSSEFY

SEQ ID NO: 2255040 - protein, 9 aa, Cryptosporidium parvum
ECRSKHEED

SEQ ID NO: 2255041 - protein, 9 aa, Cryptosporidium parvum
ECSDKENYE

SEQ ID NO: 2255042 - protein, 8 aa, Cryptosporidium parvum
ECSNDREF

SEQ ID NO: 2255043 - protein, 31 aa, Cryptosporidium parvum
ECSNSGNKDKTNANSNGNNGSSGSSSTVGAA

SEQ ID NO: 2255044 - protein, 10 aa, Cryptosporidium parvum
ECTEDDLNEN

SEQ ID NO: 2255045 - protein, 11 aa, Cryptosporidium parvum
EDAAGGDTYEI

SEQ ID NO: 2255046 - protein, 5 aa, Cryptosporidium parvum
EDAEY

SEQ ID NO: 2255047 - protein, 9 aa, Cryptosporidium parvum
EDAKSALKQ

SEQ ID NO: 2255048 - protein, 12 aa, Cryptosporidium parvum
EDANEAGGPHSK

SEQ ID NO: 2255049 - protein, 10 aa, Cryptosporidium parvum
EDANNTTFSK

SEQ ID NO: 2255050 - protein, 9 aa, Cryptosporidium parvum
EDAPLPGDS

SEQ ID NO: 2255051 - protein, 8 aa, Cryptosporidium parvum
EDCDNQRS

SEQ ID NO: 2255052 - protein, 4 aa, Cryptosporidium parvum
EDCP

SEQ ID NO: 2255053 - protein, 6 aa, Cryptosporidium parvum
EDCRNN

SEQ ID NO: 2255054 - protein, 5 aa, Cryptosporidium parvum
EDCYK

SEQ ID NO: 2255055 - protein, 10 aa, Cryptosporidium parvum
EDDEIPDNIE

SEQ ID NO: 2255056 - protein, 18 aa, Cryptosporidium parvum
EDDFPHKEKGYIYLYRRT

SEQ ID NO: 2255057 - protein, 5 aa, Cryptosporidium parvum
EDDIK

SEQ ID NO: 2255058 - protein, 8 aa, Cryptosporidium parvum
EDDLVNSE

SEQ ID NO: 2255059 - protein, 8 aa, Cryptosporidium parvum
EDDNERYN

SEQ ID NO: 2255060 - protein, 8 aa, Cryptosporidium parvum
EDDSNPLH

SEQ ID NO: 2255061 - protein, 9 aa, Cryptosporidium parvum
EDDSNRKQI

SEQ ID NO: 2255062 - protein, 8 aa, Cryptosporidium parvum
EDDSSLES

SEQ ID NO: 2255063 - protein, 9 aa, Cryptosporidium parvum
EDDTKEKDQ

SEQ ID NO: 2255064 - protein, 14 aa, Cryptosporidium parvum
EDDTQIQNNNDDEC

SEQ ID NO: 2255065 - protein, 29 aa, Cryptosporidium parvum
EDDVPDDEDDEEPKGEPDCSNKCCDSEHK

SEQ ID NO: 2255066 - protein, 12 aa, Cryptosporidium parvum
EDEANNSGHKIG

SEQ ID NO: 2255067 - protein, 17 aa, Cryptosporidium parvum
EDECENPFENESKRKKI

SEQ ID NO: 2255068 - protein, 6 aa, Cryptosporidium parvum
EDEDEN

SEQ ID NO: 2255069 - protein, 6 aa, Cryptosporidium parvum
EDEDQH

SEQ ID NO: 2255070 - protein, 4 aa, Cryptosporidium parvum
EDEE

SEQ ID NO: 2255071 - protein, 5 aa, Cryptosporidium parvum
EDEED

SEQ ID NO: 2255072 - protein, 13 aa, Cryptosporidium parvum
EDEEDDEEDEEDD

SEQ ID NO: 2255073 - protein, 10 aa, Cryptosporidium parvum
EDEEDEDDEY

SEQ ID NO: 2255074 - protein, 8 aa, Cryptosporidium parvum
EDEEIEEE

SEQ ID NO: 2255075 - protein, 5 aa, Cryptosporidium parvum
EDEEQ

SEQ ID NO: 2255076 - protein, 8 aa, Cryptosporidium parvum
EDEEREKS

SEQ ID NO: 2255077 - protein, 14 aa, Cryptosporidium parvum
EDEFKNNNCESYGP

SEQ ID NO: 2255078 - protein, 5 aa, Cryptosporidium parvum
EDEID

SEQ ID NO: 2255079 - protein, 5 aa, Cryptosporidium parvum
EDEIP

SEQ ID NO: 2255080 - protein, 28 aa, Cryptosporidium parvum
EDEKEAKKNLSKEEKELQKKCRGDQESP

SEQ ID NO: 2255081 - protein, 12 aa, Cryptosporidium parvum
EDEKGNKEYAHQ

SEQ ID NO: 2255082 - protein, 13 aa, Cryptosporidium parvum
EDEKKNVSNTFST

SEQ ID NO: 2255083 - protein, 4 aa, Cryptosporidium parvum
EDEL

SEQ ID NO: 2255084 - protein, 6 aa, Cryptosporidium parvum
EDELPN

SEQ ID NO: 2255085 - protein, 36 aa, Cryptosporidium parvum
EDENANLKREKDSIRESISNDDLQYRKSKDDHDFTP

SEQ ID NO: 2255086 - protein, 6 aa, Cryptosporidium parvum
EDENIK

SEQ ID NO: 2255087 - protein, 23 aa, Cryptosporidium parvum
EDENNKPTEERKNDEVDDSFRKT

SEQ ID NO: 2255088 - protein, 9 aa, Cryptosporidium parvum
EDENQYRQR

SEQ ID NO: 2255089 - protein, 20 aa, Cryptosporidium parvum
EDENSDHEPLEEKKKAIKYR

SEQ ID NO: 2255090 - protein, 10 aa, Cryptosporidium parvum
EDEQDNEDFK

SEQ ID NO: 2255091 - protein, 6 aa, Cryptosporidium parvum
EDEQED

SEQ ID NO: 2255092 - protein, 9 aa, Cryptosporidium parvum
EDEQNQALN

SEQ ID NO: 2255093 - protein, 18 aa, Cryptosporidium parvum
EDEQTSKRKHGLEDSPLE

SEQ ID NO: 2255094 - protein, 7 aa, Cryptosporidium parvum
EDEREAK

SEQ ID NO: 2255095 - protein, 8 aa, Cryptosporidium parvum
EDESSISH

SEQ ID NO: 2255096 - protein, 17 aa, Cryptosporidium parvum
EDETEKIKDNLDKTEHA

SEQ ID NO: 2255097 - protein, 5 aa, Cryptosporidium parvum
EDETG

SEQ ID NO: 2255098 - protein, 24 aa, Cryptosporidium parvum
EDEVTDDEGDESSEEGSEEDEELE

SEQ ID NO: 2255099 - protein, 4 aa, Cryptosporidium parvum
EDEY

SEQ ID NO: 2255100 - protein, 6 aa, Cryptosporidium parvum
EDFAAP

SEQ ID NO: 2255101 - protein, 6 aa, Cryptosporidium parvum
EDFDDD

SEQ ID NO: 2255102 - protein, 8 aa, Cryptosporidium parvum
EDFDEKED

SEQ ID NO: 2255103 - protein, 4 aa, Cryptosporidium parvum
EDFK

SEQ ID NO: 2255104 - protein, 4 aa, Cryptosporidium parvum
EDFT

SEQ ID NO: 2255105 - protein, 7 aa, Cryptosporidium parvum
EDGDKPL

SEQ ID NO: 2255106 - protein, 12 aa, Cryptosporidium parvum
EDGDSDNDSEDE

SEQ ID NO: 2255107 - protein, 6 aa, Cryptosporidium parvum
EDGEKR

SEQ ID NO: 2255108 - protein, 27 aa, Cryptosporidium parvum
EDGGYAKVENKQEPGRFDDEGNTSRRI

SEQ ID NO: 2255109 - protein, 4 aa, Cryptosporidium parvum
EDGI

SEQ ID NO: 2255110 - protein, 8 aa, Cryptosporidium parvum
EDGKGRQP

SEQ ID NO: 2255111 - protein, 7 aa, Cryptosporidium parvum
EDGKINR

SEQ ID NO: 2255112 - protein, 5 aa, Cryptosporidium parvum
EDGND

SEQ ID NO: 2255113 - protein, 6 aa, Cryptosporidium parvum
EDGNTV

SEQ ID NO: 2255114 - protein, 5 aa, Cryptosporidium parvum
EDGQR

SEQ ID NO: 2255115 - protein, 13 aa, Cryptosporidium parvum
EDGSQSSQEDEAN

SEQ ID NO: 2255116 - protein, 9 aa, Cryptosporidium parvum
EDGSSKNHH

SEQ ID NO: 2255117 - protein, 8 aa, Cryptosporidium parvum
EDGSTYTV

SEQ ID NO: 2255118 - protein, 4 aa, Cryptosporidium parvum
EDGT

SEQ ID NO: 2255119 - protein, 8 aa, Cryptosporidium parvum
EDGTADNN

SEQ ID NO: 2255120 - protein, 38 aa, Cryptosporidium parvum
EDGTIDPSTMTSSGVQAPSRAQLTSSSKDDETRSSGRC

SEQ ID NO: 2255121 - protein, 6 aa, Cryptosporidium parvum
EDGYAG

SEQ ID NO: 2255122 - protein, 6 aa, Cryptosporidium parvum
EDGYKI

SEQ ID NO: 2255123 - protein, 8 aa, Cryptosporidium parvum
EDHAEQEI

SEQ ID NO: 2255124 - protein, 18 aa, Cryptosporidium parvum
EDHPLKSSLTPGPPSRSC

SEQ ID NO: 2255125 - protein, 12 aa, Cryptosporidium parvum
EDHQEENEYDYD

SEQ ID NO: 2255126 - protein, 35 aa, Cryptosporidium parvum; identical to SEQ ID NO: 2139300

SEQ ID NO: 2255127 - protein, 29 aa, Cryptosporidium parvum
EDIEDQKSDLEEIKENVSSKDLNSNQVTN

SEQ ID NO: 2255128 - protein, 5 aa, Cryptosporidium parvum
EDIES

SEQ ID NO: 2255129 - protein, 8 aa, Cryptosporidium parvum
EDIGAGDQ

SEQ ID NO: 2255130 - protein, 6 aa, Cryptosporidium parvum
EDIGED

SEQ ID NO: 2255131 - protein, 5 aa, Cryptosporidium parvum
EDIRP

SEQ ID NO: 2255132 - protein, 7 aa, Cryptosporidium parvum
EDISKES

SEQ ID NO: 2255133 - protein, 14 aa, Cryptosporidium parvum
EDISPEEKEEKRNL

SEQ ID NO: 2255134 - protein, 12 aa, Cryptosporidium parvum
EDITSNGTLTES

SEQ ID NO: 2255135 - protein, 10 aa, Cryptosporidium parvum
EDKALPDSKL

SEQ ID NO: 2255136 - protein, 8 aa, Cryptosporidium parvum
EDKCNVSS

SEQ ID NO: 2255137 - protein, 7 aa, Cryptosporidium parvum
EDKEKDE

SEQ ID NO: 2255138 - protein, 6 aa, Cryptosporidium parvum
EDKGEI

SEQ ID NO: 2255139 - protein, 5 aa, Cryptosporidium parvum
EDKHG

SEQ ID NO: 2255140 - protein, 9 aa, Cryptosporidium parvum
EDKIPGPTR

SEQ ID NO: 2255141 - protein, 29 aa, Cryptosporidium parvum
EDKKKLESKYYNTKNMKNTKSRKRKNSKF

SEQ ID NO: 2255142 - protein, 8 aa, Cryptosporidium parvum
EDKLSEET

SEQ ID NO: 2255143 - protein, 7 aa, Cryptosporidium parvum
EDKNATI

SEQ ID NO: 2255144 - protein, 25 aa, Cryptosporidium parvum
EDKQSSISSSNISSSATQGINTQTP

SEQ ID NO: 2255145 - protein, 9 aa, Cryptosporidium parvum
EDKRITSRL

SEQ ID NO: 2255146 - protein, 9 aa, Cryptosporidium parvum
EDKRSRKQK

SEQ ID NO: 2255147 - protein, 5 aa, Cryptosporidium parvum
EDKSE

SEQ ID NO: 2255148 - protein, 10 aa, Cryptosporidium parvum
EDKSKHEQRV

SEQ ID NO: 2255149 - protein, 27 aa, Cryptosporidium parvum
EDKSSKNDKDSSPEKDSKNNKEDIISS

SEQ ID NO: 2255150 - protein, 8 aa, Cryptosporidium parvum
EDKSTNIY

SEQ ID NO: 2255151 - protein, 8 aa, Cryptosporidium parvum
EDKSVDPF

SEQ ID NO: 2255152 - protein, 4 aa, Cryptosporidium parvum
EDKT

SEQ ID NO: 2255153 - protein, 8 aa, Cryptosporidium parvum
EDKTMKPK

SEQ ID NO: 2255154 - protein, 8 aa, Cryptosporidium parvum
EDKTTERS

SEQ ID NO: 2255155 - protein, 17 aa, Cryptosporidium parvum
EDLENGEINVETNPKVD

SEQ ID NO: 2255156 - protein, 5 aa, Cryptosporidium parvum
EDLET

SEQ ID NO: 2255157 - protein, 4 aa, Cryptosporidium parvum
EDLG

SEQ ID NO: 2255158 - protein, 8 aa, Cryptosporidium parvum
EDLNDNSE

SEQ ID NO: 2255159 - protein, 11 aa, Cryptosporidium parvum
EDLNEKNSKEI

SEQ ID NO: 2255160 - protein, 4 aa, Cryptosporidium parvum
EDLQ

SEQ ID NO: 2255161 - protein, 8 aa, Cryptosporidium parvum
EDLQQTQE

SEQ ID NO: 2255162 - protein, 12 aa, Cryptosporidium parvum
EDLQTMGKNGLP

SEQ ID NO: 2255163 - protein, 23 aa, Cryptosporidium parvum
EDLRKAKEKALYRKKGGIPEGLY

SEQ ID NO: 2255164 - protein, 14 aa, Cryptosporidium parvum
EDLRPNNSTENTYI

SEQ ID NO: 2255165 - protein, 17 aa, Cryptosporidium parvum
EDLSDKPDNKNGIENNK

SEQ ID NO: 2255166 - protein, 9 aa, Cryptosporidium parvum
EDLSGKSAR

SEQ ID NO: 2255167 - protein, 4 aa, Cryptosporidium parvum
EDLT

SEQ ID NO: 2255168 - protein, 4 aa, Cryptosporidium parvum
EDLV

SEQ ID NO: 2255169 - protein, 5 aa, Cryptosporidium parvum
EDMNN

SEQ ID NO: 2255170 - protein, 16 aa, Cryptosporidium parvum
EDNDDIEDEGQPPKVL

SEQ ID NO: 2255171 - protein, 24 aa, Cryptosporidium parvum
EDNEKLNYKDTCDSAYDNSKVEEL

SEQ ID NO: 2255172 - protein, 8 aa, Cryptosporidium parvum
EDNEQLSE

SEQ ID NO: 2255173 - protein, 7 aa, Cryptosporidium parvum
EDNEYQK

SEQ ID NO: 2255174 - protein, 8 aa, Cryptosporidium parvum
EDNGPLGA

SEQ ID NO: 2255175 - protein, 13 aa, Cryptosporidium parvum
EDNKEESQNGSIL

SEQ ID NO: 2255176 - protein, 17 aa, Cryptosporidium parvum
EDNKKNTNSTEDQAPKL

SEQ ID NO: 2255177 - protein, 14 aa, Cryptosporidium parvum
EDNKTVRKTKKKLK

SEQ ID NO: 2255178 - protein, 6 aa, Cryptosporidium parvum
EDNNNI

SEQ ID NO: 2255179 - protein, 11 aa, Cryptosporidium parvum
EDNNRHTRTSL

SEQ ID NO: 2255180 - protein, 8 aa, Cryptosporidium parvum
EDNPGVDR

SEQ ID NO: 2255181 - protein, 8 aa, Cryptosporidium parvum
EDNPPDIP

SEQ ID NO: 2255182 - protein, 4 aa, Cryptosporidium parvum
EDNQ

SEQ ID NO: 2255183 - protein, 7 aa, Cryptosporidium parvum
EDNQEQL

SEQ ID NO: 2255184 - protein, 8 aa, Cryptosporidium parvum
EDNQIENR

SEQ ID NO: 2255185 - protein, 15 aa, Cryptosporidium parvum
EDNREDTNKASKDRI

SEQ ID NO: 2255186 - protein, 5 aa, Cryptosporidium parvum
EDNSA

SEQ ID NO: 2255187 - protein, 8 aa, Cryptosporidium parvum
EDNSEECK

SEQ ID NO: 2255188 - protein, 7 aa, Cryptosporidium parvum
EDNSSMR

SEQ ID NO: 2255189 - protein, 23 aa, Cryptosporidium parvum
EDNYNENSLSKINNGSYDDNYSR

SEQ ID NO: 2255190 - protein, 7 aa, Cryptosporidium parvum
EDNYSDI

SEQ ID NO: 2255191 - protein, 6 aa, Cryptosporidium parvum
EDPDGF

SEQ ID NO: 2255192 - protein, 4 aa, Cryptosporidium parvum
EDPF

SEQ ID NO: 2255193 - protein, 12 aa, Cryptosporidium parvum
EDPFDQDDYEAY

SEQ ID NO: 2255194 - protein, 14 aa, Cryptosporidium parvum
EDPGKVKSRQTKDR

SEQ ID NO: 2255195 - protein, 10 aa, Cryptosporidium parvum
EDPKKAALPL

SEQ ID NO: 2255196 - protein, 4 aa, Cryptosporidium parvum
EDPN

SEQ ID NO: 2255197 - protein, 6 aa, Cryptosporidium parvum
EDPNFE

SEQ ID NO: 2255198 - protein, 19 aa, Cryptosporidium parvum
EDPNIQSSSNTKQNLNMSQ

SEQ ID NO: 2255199 - protein, 4 aa, Cryptosporidium parvum
EDPR

SEQ ID NO: 2255200 - protein, 5 aa, Cryptosporidium parvum
EDPRN

SEQ ID NO: 2255201 - protein, 8 aa, Cryptosporidium parvum
EDPTGAQY

SEQ ID NO: 2255202 - protein, 7 aa, Cryptosporidium parvum
EDPTQFS

SEQ ID NO: 2255203 - protein, 12 aa, Cryptosporidium parvum
EDPTTISLDSSG

SEQ ID NO: 2255204 - protein, 5 aa, Cryptosporidium parvum
EDPVT

SEQ ID NO: 2255205 - protein, 11 aa, Cryptosporidium parvum
EDQCDRQQEEL

SEQ ID NO: 2255206 - protein, 11 aa, Cryptosporidium parvum
EDQEDENGLNT

SEQ ID NO: 2255207 - protein, 9 aa, Cryptosporidium parvum
EDQETNKVS

SEQ ID NO: 2255208 - protein, 7 aa, Cryptosporidium parvum
EDQGETI

SEQ ID NO: 2255209 - protein, 69 aa, Cryptosporidium parvum
EDQINSQKSSNNDSQDSINSQISSNSSPKPSQISNLNSQKLSSSQGPTSQSSNPNNNENLDANMSTISS

SEQ ID NO: 2255210 - protein, 8 aa, Cryptosporidium parvum
EDQKDNIQ

SEQ ID NO: 2255211 - protein, 19 aa, Cryptosporidium parvum
EDQKLESSTLRDRATRSST

SEQ ID NO: 2255212 - protein, 7 aa, Cryptosporidium parvum
EDQKRGA

SEQ ID NO: 2255213 - protein, 16 aa, Cryptosporidium parvum
EDQNQSTSSQVPETTN

SEQ ID NO: 2255214 - protein, 6 aa, Cryptosporidium parvum
EDQNSK

SEQ ID NO: 2255215 - protein, 6 aa, Cryptosporidium parvum
EDQQNQ

SEQ ID NO: 2255216 - protein, 40 aa, Cryptosporidium parvum
EDRGNCASSEVSFEGKTTRQNSGNRATINHDASSKDYAGV

SEQ ID NO: 2255217 - protein, 10 aa, Cryptosporidium parvum
EDRGNQEKMR

SEQ ID NO: 2255218 - protein, 31 aa, Cryptosporidium parvum
EDRHQDDEALRSSVEGGLREKTQTTTGIGTK

SEQ ID NO: 2255219 - protein, 7 aa, Cryptosporidium parvum
EDRNSRQ

SEQ ID NO: 2255220 - protein, 5 aa, Cryptosporidium parvum
EDSAF

SEQ ID NO: 2255221 - protein, 55 aa, Cryptosporidium parvum
EDSASNSIFGTSRSRSSSEIIRSSSNNNNNQRRGRNSNLHENTRINNTGRQSIQT

SEQ ID NO: 2255222 - protein, 7 aa, Cryptosporidium parvum
EDSATKC

SEQ ID NO: 2255223 - protein, 11 aa, Cryptosporidium parvum
EDSDLNSSPKE

SEQ ID NO: 2255224 - protein, 66 aa, Cryptosporidium parvum
EDSDRFTDTSIQNQKLESETKNHNYKDSHLENSKVKKTNGTHATHSDIQEHTSMSDQEKKSTREVN

SEQ ID NO: 2255225 - protein, 9 aa, Cryptosporidium parvum
EDSEESFDP

SEQ ID NO: 2255226 - protein, 13 aa, Cryptosporidium parvum
EDSEIKRISTSEF

SEQ ID NO: 2255227 - protein, 29 aa, Cryptosporidium parvum
EDSEYEKSQESESKLESKNLNRKQKVQRQ

SEQ ID NO: 2255228 - protein, 7 aa, Cryptosporidium parvum
EDSEYHG

SEQ ID NO: 2255229 - protein, 4 aa, Cryptosporidium parvum
EDSG

SEQ ID NO: 2255230 - protein, 7 aa, Cryptosporidium parvum
EDSGAGE

SEQ ID NO: 2255231 - protein, 7 aa, Cryptosporidium parvum
EDSGSEL

SEQ ID NO: 2255232 - protein, 21 aa, Cryptosporidium parvum
EDSGSNNINSSINDTNTNTQL

SEQ ID NO: 2255233 - protein, 13 aa, Cryptosporidium parvum
EDSHAKKHKSLSN

SEQ ID NO: 2255234 - protein, 7 aa, Cryptosporidium parvum
EDSIEDQ

SEQ ID NO: 2255235 - protein, 8 aa, Cryptosporidium parvum
EDSKDKDK

SEQ ID NO: 2255236 - protein, 8 aa, Cryptosporidium parvum
EDSKQPLG

SEQ ID NO: 2255237 - protein, 15 aa, Cryptosporidium parvum
EDSLNNADNRKTNAG

SEQ ID NO: 2255238 - protein, 5 aa, Cryptosporidium parvum
EDSLS

SEQ ID NO: 2255239 - protein, 19 aa, Cryptosporidium parvum
EDSLSKDAQEKNHSTISGA

SEQ ID NO: 2255240 - protein, 9 aa, Cryptosporidium parvum
EDSLTSDEL

SEQ ID NO: 2255241 - protein, 37 aa, Cryptosporidium parvum; identical to SEQ ID NO: 2139396

SEQ ID NO: 2255242 - protein, 42 aa, Cryptosporidium parvum
EDSNSIDNCKKDNLDSSQKSKYTTTNINRGLNKENINTENHP

SEQ ID NO: 2255243 - protein, 10 aa, Cryptosporidium parvum
EDSNSKKHDS

SEQ ID NO: 2255244 - protein, 10 aa, Cryptosporidium parvum
EDSQEDVDEN

SEQ ID NO: 2255245 - protein, 8 aa, Cryptosporidium parvum
EDSQGRTH

SEQ ID NO: 2255246 - protein, 27 aa, Cryptosporidium parvum
EDSQGYESKNKRGSKVFQTESKPIEIE

SEQ ID NO: 2255247 - protein, 10 aa, Cryptosporidium parvum
EDSQKKKNKA

SEQ ID NO: 2255248 - protein, 14 aa, Cryptosporidium parvum
EDSQPETVGENVGK

SEQ ID NO: 2255249 - protein, 5 aa, Cryptosporidium parvum
EDSRK

SEQ ID NO: 2255250 - protein, 14 aa, Cryptosporidium parvum
EDSSFDQKKQKELK

SEQ ID NO: 2255251 - protein, 9 aa, Cryptosporidium parvum
EDSSKIQEK

SEQ ID NO: 2255252 - protein, 11 aa, Cryptosporidium parvum
EDSSNKRNIGR

SEQ ID NO: 2255253 - protein, 28 aa, Cryptosporidium parvum
EDSSPNQNDEINSNNSNNNNNNNNQTSL

SEQ ID NO: 2255254 - protein, 8 aa, Cryptosporidium parvum
EDSSSRIP

SEQ ID NO: 2255255 - protein, 9 aa, Cryptosporidium parvum
EDSTENHSN

SEQ ID NO: 2255256 - protein, 5 aa, Cryptosporidium parvum
EDSTY

SEQ ID NO: 2255257 - protein, 5 aa, Cryptosporidium parvum
EDSVK

SEQ ID NO: 2255258 - protein, 4 aa, Cryptosporidium parvum
EDTA

SEQ ID NO: 2255259 - protein, 9 aa, Cryptosporidium parvum
EDTAGRELT

SEQ ID NO: 2255260 - protein, 5 aa, Cryptosporidium parvum
EDTAK

SEQ ID NO: 2255261 - protein, 6 aa, Cryptosporidium parvum
EDTEEQ

SEQ ID NO: 2255262 - protein, 28 aa, Cryptosporidium parvum
EDTEKSCSIEDDGQTLKNQNSKSNTSND

SEQ ID NO: 2255263 - protein, 13 aa, Cryptosporidium parvum
EDTGESQSNAQSN

SEQ ID NO: 2255264 - protein, 14 aa, Cryptosporidium parvum
EDTGNVTKVDDTNA

SEQ ID NO: 2255265 - protein, 7 aa, Cryptosporidium parvum
EDTKDAE

SEQ ID NO: 2255266 - protein, 16 aa, Cryptosporidium parvum
EDTKKTSGAAVSDDNY

SEQ ID NO: 2255267 - protein, 5 aa, Cryptosporidium parvum
EDTMD

SEQ ID NO: 2255268 - protein, 7 aa, Cryptosporidium parvum
EDTNESS

SEQ ID NO: 2255269 - protein, 7 aa, Cryptosporidium parvum
EDTNNGK

SEQ ID NO: 2255270 - protein, 8 aa, Cryptosporidium parvum
EDTPISPK

SEQ ID NO: 2255271 - protein, 14 aa, Cryptosporidium parvum
EDTQKSLTRAITSE

SEQ ID NO: 2255272 - protein, 9 aa, Cryptosporidium parvum
EDTTNRNKI

SEQ ID NO: 2255273 - protein, 8 aa, Cryptosporidium parvum
EDVAPYYG

SEQ ID NO: 2255274 - protein, 4 aa, Cryptosporidium parvum
EDVC

SEQ ID NO: 2255275 - protein, 13 aa, Cryptosporidium parvum
EDVEKSDLSQNDT

SEQ ID NO: 2255276 - protein, 12 aa, Cryptosporidium parvum
EDVNKEQTNTIR

SEQ ID NO: 2255277 - protein, 4 aa, Cryptosporidium parvum
EDVS

SEQ ID NO: 2255278 - protein, 8 aa, Cryptosporidium parvum
EDYANENM

SEQ ID NO: 2255279 - protein, 8 aa, Cryptosporidium parvum
EDYDDYSD

SEQ ID NO: 2255280 - protein, 8 aa, Cryptosporidium parvum
EDYKPINR

SEQ ID NO: 2255281 - protein, 5 aa, Cryptosporidium parvum
EDYNE

SEQ ID NO: 2255282 - protein, 9 aa, Cryptosporidium parvum
EDYPAKPPK

SEQ ID NO: 2255283 - protein, 7 aa, Cryptosporidium parvum
EDYTEQS

SEQ ID NO: 2255284 - protein, 33 aa, Cryptosporidium parvum
EEAEAELEAETESNEFKKDFKGESRLLIQKKNS

SEQ ID NO: 2255285 - protein, 20 aa, Cryptosporidium parvum
EEAEEEEEEEEEEEKREKID

SEQ ID NO: 2255286 - protein, 8 aa, Cryptosporidium parvum
EEAEKNSP

SEQ ID NO: 2255287 - protein, 5 aa, Cryptosporidium parvum
EEAES

SEQ ID NO: 2255288 - protein, 11 aa, Cryptosporidium parvum
EEAKSESNNCL

SEQ ID NO: 2255289 - protein, 17 aa, Cryptosporidium parvum
EEANEEEKNTEQNTEFS

SEQ ID NO: 2255290 - protein, 5 aa, Cryptosporidium parvum
EEANK

SEQ ID NO: 2255291 - protein, 21 aa, Cryptosporidium parvum
EEANNNKYNKTKIDPLESKQI

SEQ ID NO: 2255292 - protein, 11 aa, Cryptosporidium parvum
EEAPDVDEDGF

SEQ ID NO: 2255293 - protein, 8 aa, Cryptosporidium parvum
EEAPEEGA

SEQ ID NO: 2255294 - protein, 4 aa, Cryptosporidium parvum
EEAQ

SEQ ID NO: 2255295 - protein, 13 aa, Cryptosporidium parvum
EEARENWSQNGDL

SEQ ID NO: 2255296 - protein, 5 aa, Cryptosporidium parvum
EEARN

SEQ ID NO: 2255297 - protein, 4 aa, Cryptosporidium parvum
EEAS

SEQ ID NO: 2255298 - protein, 4 aa, Cryptosporidium parvum
EEAT

SEQ ID NO: 2255299 - protein, 18 aa, Cryptosporidium parvum
EEATKNSQLSNYTSNDDK

SEQ ID NO: 2255300 - protein, 12 aa, Cryptosporidium parvum
EEAYSRKAHNRA

SEQ ID NO: 2255301 - protein, 4 aa, Cryptosporidium parvum
EECG

SEQ ID NO: 2255302 - protein, 5 aa, Cryptosporidium parvum
EECGE

SEQ ID NO: 2255303 - protein, 5 aa, Cryptosporidium parvum
EECTQ

SEQ ID NO: 2255304 - protein, 5 aa, Cryptosporidium parvum
EEDAK

SEQ ID NO: 2255305 - protein, 7 aa, Cryptosporidium parvum
EEDARAA

SEQ ID NO: 2255306 - protein, 5 aa, Cryptosporidium parvum
EEDAY

SEQ ID NO: 2255307 - protein, 4 aa, Cryptosporidium parvum
EEDC

SEQ ID NO: 2255308 - protein, 17 aa, Cryptosporidium parvum
EEDDDDHEKSRRNNYPG

SEQ ID NO: 2255309 - protein, 29 aa, Cryptosporidium parvum
EEDDPDKDLGEAKSEEEIVPKENTPECKD

SEQ ID NO: 2255310 - protein, 6 aa, Cryptosporidium parvum
EEDEGF

SEQ ID NO: 2255311 - protein, 9 aa, Cryptosporidium parvum
EEDESRQQI

SEQ ID NO: 2255312 - protein, 9 aa, Cryptosporidium parvum
EEDFDSPHA

SEQ ID NO: 2255313 - protein, 5 aa, Cryptosporidium parvum
EEDHH

SEQ ID NO: 2255314 - protein, 6 aa, Cryptosporidium parvum
EEDHKP

SEQ ID NO: 2255315 - protein, 12 aa, Cryptosporidium parvum
EEDKRNEDENGV

SEQ ID NO: 2255316 - protein, 7 aa, Cryptosporidium parvum
EEDLPDD

SEQ ID NO: 2255317 - protein, 5 aa, Cryptosporidium parvum
EEDLQ

SEQ ID NO: 2255318 - protein, 5 aa, Cryptosporidium parvum
EEDLS

SEQ ID NO: 2255319 - protein, 4 aa, Cryptosporidium parvum
EEDN

SEQ ID NO: 2255320 - protein, 6 aa, Cryptosporidium parvum
EEDNFG

SEQ ID NO: 2255321 - protein, 23 aa, Cryptosporidium parvum
EEDNIKRKENVSSSKQTAQASKQ

SEQ ID NO: 2255322 - protein, 55 aa, Cryptosporidium parvum
EEDNSEPQTCQAEEGNSQTQHELEQAEPIQEATNAESDEKNQVAPQIERSNDPSC

SEQ ID NO: 2255323 - protein, 10 aa, Cryptosporidium parvum
EEDQDTEDQA

SEQ ID NO: 2255324 - protein, 11 aa, Cryptosporidium parvum
EEDSNGDEGQV

SEQ ID NO: 2255325 - protein, 6 aa, Cryptosporidium parvum
EEDSRD

SEQ ID NO: 2255326 - protein, 6 aa, Cryptosporidium parvum
EEDSYF

SEQ ID NO: 2255327 - protein, 10 aa, Cryptosporidium parvum
EEEAIKKEQG

SEQ ID NO: 2255328 - protein, 7 aa, Cryptosporidium parvum
EEEANLN

SEQ ID NO: 2255329 - protein, 22 aa, Cryptosporidium parvum
EEEASSSSDDEYSQKDKNGVQR

SEQ ID NO: 2255330 - protein, 12 aa, Cryptosporidium parvum
EEECHSNQSKYS

SEQ ID NO: 2255331 - protein, 25 aa, Cryptosporidium parvum
EEECPTDSTPPSNGVPMNNGNSQSQ

SEQ ID NO: 2255332 - protein, 14 aa, Cryptosporidium parvum
EEEDGGSNIYRNSS

SEQ ID NO: 2255333 - protein, 4 aa, Cryptosporidium parvum
EEEE

SEQ ID NO: 2255334 - protein, 20 aa, Cryptosporidium parvum
EEEEEDDDDDDFSGNTNEIR

SEQ ID NO: 2255335 - protein, 9 aa, Cryptosporidium parvum
EEEEEEEDI

SEQ ID NO: 2255336 - protein, 25 aa, Cryptosporidium parvum
EEEEEEEEEEEEEEEEEGEEERLRK

SEQ ID NO: 2255337 - protein, 16 aa, Cryptosporidium parvum
EEEEEEEEKEETERSL

SEQ ID NO: 2255338 - protein, 15 aa, Cryptosporidium parvum
EEEEEREEIEKRRKR

SEQ ID NO: 2255339 - protein, 5 aa, Cryptosporidium parvum
EEEEK

SEQ ID NO: 2255340 - protein, 11 aa, Cryptosporidium parvum
EEEENKLSTEW

SEQ ID NO: 2255341 - protein, 25 aa, Cryptosporidium parvum
EEEENQVESIENDHKDRDKNSPEVK

SEQ ID NO: 2255342 - protein, 31 aa, Cryptosporidium parvum
EEEERLRKEEEEERIRKEEEERIRKEEEERL

SEQ ID NO: 2255343 - protein, 5 aa, Cryptosporidium parvum
EEEET

SEQ ID NO: 2255344 - protein, 25 aa, Cryptosporidium parvum
EEEETTTRIEEESRADEGSKVGRGN

SEQ ID NO: 2255345 - protein, 86 aa, Cryptosporidium parvum
EEEFEKGKKGKKSTTKKKGGESINSKPAKPKKQSSKESSVEDELESDDEDKSTKPAKKKKLSAPKNLTKRNVANSGGGSAAGDAGE

SEQ ID NO: 2255346 - protein, 5 aa, Cryptosporidium parvum
EEEHE

SEQ ID NO: 2255347 - protein, 4 aa, Cryptosporidium parvum
EEEI

SEQ ID NO: 2255348 - protein, 11 aa, Cryptosporidium parvum
EEEIKKETARL

SEQ ID NO: 2255349 - protein, 7 aa, Cryptosporidium parvum
EEEKKTK

SEQ ID NO: 2255350 - protein, 7 aa, Cryptosporidium parvum
EEEKPET

SEQ ID NO: 2255351 - protein, 6 aa, Cryptosporidium parvum
EEEKSL

SEQ ID NO: 2255352 - protein, 4 aa, Cryptosporidium parvum
EEEL

SEQ ID NO: 2255353 - protein, 14 aa, Cryptosporidium parvum
EEELDDYEEEIDER

SEQ ID NO: 2255354 - protein, 8 aa, Cryptosporidium parvum
EEELDEEL

SEQ ID NO: 2255355 - protein, 20 aa, Cryptosporidium parvum
EEELGTEKEMNDTDKKNDFS

SEQ ID NO: 2255356 - protein, 6 aa, Cryptosporidium parvum
EEENLP

SEQ ID NO: 2255357 - protein, 5 aa, Cryptosporidium parvum
EEENS

SEQ ID NO: 2255358 - protein, 8 aa, Cryptosporidium parvum
EEEPDSPT

SEQ ID NO: 2255359 - protein, 19 aa, Cryptosporidium parvum
EEEPKSAKTISHNDLEDKS

SEQ ID NO: 2255360 - protein, 6 aa, Cryptosporidium parvum
EEEQNV

SEQ ID NO: 2255361 - protein, 22 aa, Cryptosporidium parvum
EEEQSNRKNRVQGRETPQGSAI

SEQ ID NO: 2255362 - protein, 70 aa, Cryptosporidium parvum
EEERIRKEEEEERLRREEEEERIRKEEEERLRKEEEERLRKEEEERIRKEEERIRKEEEERLRKEEEERL

SEQ ID NO: 2255363 - protein, 55 aa, Cryptosporidium parvum
EEERIRKEEEEERLRREEEEERIRKEEEERLRREEEERLRKEEEERLRKEEEERL

SEQ ID NO: 2255364 - protein, 173 aa, Cryptosporidium parvum
EEERIRKEEERIRKEEEERLRKEEERIRKEEEERLRREEEERLRKEEEERLRKEEERLRKEEEEERIRKEEEERIRKEEEERLRKEEERLRKEEEEERIRKEEEERLRKEEEERLRKEEEERLRKEEEEERIRKEEEERLRREEEERLRKEEEERIRKEEEERLRKEEEEERI

SEQ ID NO: 2255365 - protein, 36 aa, Cryptosporidium parvum
EEERIRKEEERIRKEEERIRKEEEEERLRKEEEERL

SEQ ID NO: 2255366 - protein, 5 aa, Cryptosporidium parvum
EEERK

SEQ ID NO: 2255367 - protein, 7 aa, Cryptosporidium parvum
EEERNRQ

SEQ ID NO: 2255368 - protein, 7 aa, Cryptosporidium parvum
EEESGIQ

SEQ ID NO: 2255369 - protein, 5 aa, Cryptosporidium parvum
EEESN

SEQ ID NO: 2255370 - protein, 10 aa, Cryptosporidium parvum
EEESPPSLNY

SEQ ID NO: 2255371 - protein, 7 aa, Cryptosporidium parvum
EEETQDE

SEQ ID NO: 2255372 - protein, 4 aa, Cryptosporidium parvum
EEEV

SEQ ID NO: 2255373 - protein, 19 aa, Cryptosporidium parvum
EEEVEREEDDEDDEKGERM

SEQ ID NO: 2255374 - protein, 52 aa, Cryptosporidium parvum
EEEVGYNKEVEEEEEGRSLSTFSDKEVESKDLASLEKSGPTEAGEEGYASAN

SEQ ID NO: 2255375 - protein, 5 aa, Cryptosporidium parvum
EEEYI

SEQ ID NO: 2255376 - protein, 6 aa, Cryptosporidium parvum
EEEYPE

SEQ ID NO: 2255377 - protein, 8 aa, Cryptosporidium parvum
EEEYSSGF

SEQ ID NO: 2255378 - protein, 19 aa, Cryptosporidium parvum
EEFEDEDEFESENDNNYST

SEQ ID NO: 2255379 - protein, 4 aa, Cryptosporidium parvum
EEFG

SEQ ID NO: 2255380 - protein, 7 aa, Cryptosporidium parvum
EEFKNSK

SEQ ID NO: 2255381 - protein, 4 aa, Cryptosporidium parvum
EEFS

SEQ ID NO: 2255382 - protein, 6 aa, Cryptosporidium parvum
EEFSGP

SEQ ID NO: 2255383 - protein, 10 aa, Cryptosporidium parvum
EEFSSKNDNI

SEQ ID NO: 2255384 - protein, 9 aa, Cryptosporidium parvum
EEGDDEMKR

SEQ ID NO: 2255385 - protein, 11 aa, Cryptosporidium parvum
EEGENDSGMSN

SEQ ID NO: 2255386 - protein, 10 aa, Cryptosporidium parvum
EEGENNSSII

SEQ ID NO: 2255387 - protein, 4 aa, Cryptosporidium parvum
EEGF

SEQ ID NO: 2255388 - protein, 10 aa, Cryptosporidium parvum
EEGGSGVPLK

SEQ ID NO: 2255389 - protein, 4 aa, Cryptosporidium parvum
EEGI

SEQ ID NO: 2255390 - protein, 6 aa, Cryptosporidium parvum
EEGIKN

SEQ ID NO: 2255391 - protein, 8 aa, Cryptosporidium parvum
EEGISGEN

SEQ ID NO: 2255392 - protein, 12 aa, Cryptosporidium parvum
EEGKSDSSNDYN

SEQ ID NO: 2255393 - protein, 5 aa, Cryptosporidium parvum
EEGNP

SEQ ID NO: 2255394 - protein, 62 aa, Cryptosporidium parvum; identical to SEQ ID NO: 2139528

SEQ ID NO: 2255395 - protein, 9 aa, Cryptosporidium parvum
EEGNTTQSE

SEQ ID NO: 2255396 - protein, 18 aa, Cryptosporidium parvum
EEGPGGPPQQSVPSSQVG

SEQ ID NO: 2255397 - protein, 6 aa, Cryptosporidium parvum
EEGQTM

SEQ ID NO: 2255398 - protein, 4 aa, Cryptosporidium parvum
EEGR

SEQ ID NO: 2255399 - protein, 7 aa, Cryptosporidium parvum
EEGRIQT

SEQ ID NO: 2255400 - protein, 23 aa, Cryptosporidium parvum
EEGSSYENNTKTQHSVGKNFNGS

SEQ ID NO: 2255401 - protein, 5 aa, Cryptosporidium parvum
EEGTE

SEQ ID NO: 2255402 - protein, 6 aa, Cryptosporidium parvum
EEGTES

SEQ ID NO: 2255403 - protein, 4 aa, Cryptosporidium parvum
EEGV

SEQ ID NO: 2255404 - protein, 10 aa, Cryptosporidium parvum
EEGVDEGGVQ

SEQ ID NO: 2255405 - protein, 12 aa, Cryptosporidium parvum
EEGVDKAKQLED

SEQ ID NO: 2255406 - protein, 10 aa, Cryptosporidium parvum
EEGVNTSTSV

SEQ ID NO: 2255407 - protein, 12 aa, Cryptosporidium parvum
EEHAKSNSNKKY

SEQ ID NO: 2255408 - protein, 4 aa, Cryptosporidium parvum
EEHG

SEQ ID NO: 2255409 - protein, 4 aa, Cryptosporidium parvum
EEHS

SEQ ID NO: 2255410 - protein, 30 aa, Cryptosporidium parvum
EEHSDKTLDECKEDEAVPTIEKGPTADFPS

SEQ ID NO: 2255411 - protein, 4 aa, Cryptosporidium parvum
EEIA

SEQ ID NO: 2255412 - protein, 5 aa, Cryptosporidium parvum
EEIDN

SEQ ID NO: 2255413 - protein, 7 aa, Cryptosporidium parvum
EEIEQAK

SEQ ID NO: 2255414 - protein, 5 aa, Cryptosporidium parvum
EEIGK

SEQ ID NO: 2255415 - protein, 20 aa, Cryptosporidium parvum
EEIGRDDVRGANTTSDDALN

SEQ ID NO: 2255416 - protein, 5 aa, Cryptosporidium parvum
EEIKK

SEQ ID NO: 2255417 - protein, 6 aa, Cryptosporidium parvum
EEIKSI

SEQ ID NO: 2255418 - protein, 8 aa, Cryptosporidium parvum
EEIPEDET

SEQ ID NO: 2255419 - protein, 5 aa, Cryptosporidium parvum
EEIPS

SEQ ID NO: 2255420 - protein, 14 aa, Cryptosporidium parvum
EEIPSSSENDMRSS

SEQ ID NO: 2255421 - protein, 4 aa, Cryptosporidium parvum
EEIQ

SEQ ID NO: 2255422 - protein, 6 aa, Cryptosporidium parvum
EEISEA

SEQ ID NO: 2255423 - protein, 6 aa, Cryptosporidium parvum
EEISKK

SEQ ID NO: 2255424 - protein, 56 aa, Cryptosporidium parvum
EEISNNDNNYDNTNNSDSSNDDISDTSDFDSDHSTRKKNNDCSNLKTANGSNKQKI

SEQ ID NO: 2255425 - protein, 4 aa, Cryptosporidium parvum
EEIT

SEQ ID NO: 2255426 - protein, 7 aa, Cryptosporidium parvum
EEITSKE

SEQ ID NO: 2255427 - protein, 7 aa, Cryptosporidium parvum
EEKAAED

SEQ ID NO: 2255428 - protein, 16 aa, Cryptosporidium parvum
EEKAGDRGKLARTSGT

SEQ ID NO: 2255429 - protein, 33 aa, Cryptosporidium parvum
EEKAMQQRCSETISGKVTSEIEDDSVSQSTSLN

SEQ ID NO: 2255430 - protein, 9 aa, Cryptosporidium parvum
EEKASYPCS

SEQ ID NO: 2255431 - protein, 5 aa, Cryptosporidium parvum
EEKDD

SEQ ID NO: 2255432 - protein, 12 aa, Cryptosporidium parvum
EEKDDQNTQDST

SEQ ID NO: 2255433 - protein, 10 aa, Cryptosporidium parvum
EEKDTDSNEV

SEQ ID NO: 2255434 - protein, 4 aa, Cryptosporidium parvum
EEKE

SEQ ID NO: 2255435 - protein, 14 aa, Cryptosporidium parvum
EEKEKKKENGNNDY

SEQ ID NO: 2255436 - protein, 11 aa, Cryptosporidium parvum
EEKEKKLENEA

SEQ ID NO: 2255437 - protein, 8 aa, Cryptosporidium parvum
EEKEKSDV

SEQ ID NO: 2255438 - protein, 5 aa, Cryptosporidium parvum
EEKEN

SEQ ID NO: 2255439 - protein, 6 aa, Cryptosporidium parvum
EEKENL

SEQ ID NO: 2255440 - protein, 26 aa, Cryptosporidium parvum
EEKEQTSNNSPANNTVAKRRNRRDSA

SEQ ID NO: 2255441 - protein, 8 aa, Cryptosporidium parvum
EEKERINA

SEQ ID NO: 2255442 - protein, 6 aa, Cryptosporidium parvum
EEKESE

SEQ ID NO: 2255443 - protein, 46 aa, Cryptosporidium parvum
EEKGDSEDANSIETGKKESDSMNVQGSAEDGEEKIRQRSREKELNQ

SEQ ID NO: 2255444 - protein, 8 aa, Cryptosporidium parvum
EEKIPSDF

SEQ ID NO: 2255445 - protein, 8 aa, Cryptosporidium parvum
EEKKDFEG

SEQ ID NO: 2255446 - protein, 18 aa, Cryptosporidium parvum
EEKKEEDEDEDEEEEDIS

SEQ ID NO: 2255447 - protein, 9 aa, Cryptosporidium parvum
EEKKEINDK

SEQ ID NO: 2255448 - protein, 20 aa, Cryptosporidium parvum
EEKKMQKQKRKQEIDSRNMP

SEQ ID NO: 2255449 - protein, 5 aa, Cryptosporidium parvum
EEKKP

SEQ ID NO: 2255450 - protein, 28 aa, Cryptosporidium parvum
EEKLNEKEFNNKIETNNNNNKNSNQGIP

SEQ ID NO: 2255451 - protein, 8 aa, Cryptosporidium parvum
EEKNEGEF

SEQ ID NO: 2255452 - protein, 7 aa, Cryptosporidium parvum
EEKNNDL

SEQ ID NO: 2255453 - protein, 12 aa, Cryptosporidium parvum
EEKNNENDSSKL

SEQ ID NO: 2255454 - protein, 4 aa, Cryptosporidium parvum
EEKQ

SEQ ID NO: 2255455 - protein, 9 aa, Cryptosporidium parvum
EEKQSDRRS

SEQ ID NO: 2255456 - protein, 7 aa, Cryptosporidium parvum
EEKQVGS

SEQ ID NO: 2255457 - protein, 8 aa, Cryptosporidium parvum
EEKRKERS

SEQ ID NO: 2255458 - protein, 6 aa, Cryptosporidium parvum
EEKRQH

SEQ ID NO: 2255459 - protein, 13 aa, Cryptosporidium parvum
EEKSALSKSWEEQ

SEQ ID NO: 2255460 - protein, 8 aa, Cryptosporidium parvum
EEKSLSKS

SEQ ID NO: 2255461 - protein, 36 aa, Cryptosporidium parvum; identical to SEQ ID NO: 2139587

SEQ ID NO: 2255462 - protein, 5 aa, Cryptosporidium parvum
EEKTG

SEQ ID NO: 2255463 - protein, 9 aa, Cryptosporidium parvum
EEKTKYEEN

SEQ ID NO: 2255464 - protein, 5 aa, Cryptosporidium parvum
EEKTS

SEQ ID NO: 2255465 - protein, 9 aa, Cryptosporidium parvum
EEKTSYPTQ

SEQ ID NO: 2255466 - protein, 5 aa, Cryptosporidium parvum
EEKVK

SEQ ID NO: 2255467 - protein, 19 aa, Cryptosporidium parvum
EEKVNDDYDPISNAMMIWE

SEQ ID NO: 2255468 - protein, 64 aa, Cryptosporidium parvum
EEKYDADSSNIKESDDHHIRDGSNSDNNIKDVTTATEITNSTTTDSIHNSNINDSSNGNSTQYH

SEQ ID NO: 2255469 - protein, 7 aa, Cryptosporidium parvum
EELASNH

SEQ ID NO: 2255470 - protein, 9 aa, Cryptosporidium parvum
EELDDPEYT

SEQ ID NO: 2255471 - protein, 12 aa, Cryptosporidium parvum
EELDRSSGSRGV

SEQ ID NO: 2255472 - protein, 6 aa, Cryptosporidium parvum
EELEEE

SEQ ID NO: 2255473 - protein, 44 aa, Cryptosporidium parvum
EELESSSIRSQNKEMEDSSSARDKSKRNIDKYKQRRKDKSVHQE

SEQ ID NO: 2255474 - protein, 5 aa, Cryptosporidium parvum
EELGS

SEQ ID NO: 2255475 - protein, 5 aa, Cryptosporidium parvum
EELKE

SEQ ID NO: 2255476 - protein, 19 aa, Cryptosporidium parvum
EELKEKSGALDQMDDETRV

SEQ ID NO: 2255477 - protein, 14 aa, Cryptosporidium parvum
EELKQSGKSGKSEK

SEQ ID NO: 2255478 - protein, 7 aa, Cryptosporidium parvum
EELKSKA

SEQ ID NO: 2255479 - protein, 20 aa, Cryptosporidium parvum
EELNQQDLKKSEKKNLQKKK

SEQ ID NO: 2255480 - protein, 6 aa, Cryptosporidium parvum
EELPTN

SEQ ID NO: 2255481 - protein, 7 aa, Cryptosporidium parvum
EELPTQG

SEQ ID NO: 2255482 - protein, 10 aa, Cryptosporidium parvum
EELQKAENRV

SEQ ID NO: 2255483 - protein, 7 aa, Cryptosporidium parvum
EELQNNP

SEQ ID NO: 2255484 - protein, 5 aa, Cryptosporidium parvum
EELSG

SEQ ID NO: 2255485 - protein, 5 aa, Cryptosporidium parvum
EELSK

SEQ ID NO: 2255486 - protein, 5 aa, Cryptosporidium parvum
EELSS

SEQ ID NO: 2255487 - protein, 9 aa, Cryptosporidium parvum
EELTNATAE

SEQ ID NO: 2255488 - protein, 9 aa, Cryptosporidium parvum
EEMDQNDMG

SEQ ID NO: 2255489 - protein, 19 aa, Cryptosporidium parvum
EEMKKSQESSELEKTYELP

SEQ ID NO: 2255490 - protein, 15 aa, Cryptosporidium parvum
EEMNTQSSESTNSTI

SEQ ID NO: 2255491 - protein, 4 aa, Cryptosporidium parvum
EEMQ

SEQ ID NO: 2255492 - protein, 35 aa, Cryptosporidium parvum
EEMQPSKNEVESDSESESGFEKKQEETNTKEPGCL

SEQ ID NO: 2255493 - protein, 7 aa, Cryptosporidium parvum
EENAGVQ

SEQ ID NO: 2255494 - protein, 5 aa, Cryptosporidium parvum
EENAP

SEQ ID NO: 2255495 - protein, 8 aa, Cryptosporidium parvum
EENDENNL

SEQ ID NO: 2255496 - protein, 16 aa, Cryptosporidium parvum
EENDIENNNQVSKTAL

SEQ ID NO: 2255497 - protein, 10 aa, Cryptosporidium parvum
EENDNKSNLE

SEQ ID NO: 2255498 - protein, 25 aa, Cryptosporidium parvum
EENDTLNKTEKEIHSGTANETKKIN

SEQ ID NO: 2255499 - protein, 17 aa, Cryptosporidium parvum
EENEEQRKGSFDGSNSL

SEQ ID NO: 2255500 - protein, 16 aa, Cryptosporidium parvum
EENEINQTESLNQGVE

SEQ ID NO: 2255501 - protein, 69 aa, Cryptosporidium parvum
EENEKKKNQLVNKNKSNESNSGSGNRSRDMDGNRNGNGNGNGNRNGSGSSSGNGNGSGSRSSSGNNIAT

SEQ ID NO: 2255502 - protein, 10 aa, Cryptosporidium parvum
EENENNKSSF

SEQ ID NO: 2255503 - protein, 21 aa, Cryptosporidium parvum
EENEQNHKKDLNNKKSKNQRK

SEQ ID NO: 2255504 - protein, 10 aa, Cryptosporidium parvum
EENEQNTTSR

SEQ ID NO: 2255505 - protein, 8 aa, Cryptosporidium parvum
EENFEGSN

SEQ ID NO: 2255506 - protein, 4 aa, Cryptosporidium parvum
EENG

SEQ ID NO: 2255507 - protein, 7 aa, Cryptosporidium parvum
EENGPEN

SEQ ID NO: 2255508 - protein, 6 aa, Cryptosporidium parvum
EENGSM

SEQ ID NO: 2255509 - protein, 13 aa, Cryptosporidium parvum
EENHKTLSEGDQN

SEQ ID NO: 2255510 - protein, 40 aa, Cryptosporidium parvum
EENHSSKKWQPASSSSVEKEGSGYTSKNNVDTSRNNTNVE

SEQ ID NO: 2255511 - protein, 4 aa, Cryptosporidium parvum
EENI

SEQ ID NO: 2255512 - protein, 17 aa, Cryptosporidium parvum
EENKDFSNMESEYASSH

SEQ ID NO: 2255513 - protein, 8 aa, Cryptosporidium parvum
EENKQLEN

SEQ ID NO: 2255514 - protein, 9 aa, Cryptosporidium parvum
EENKSLERK

SEQ ID NO: 2255515 - protein, 68 aa, Cryptosporidium parvum
EENNAFDENNENKVSKMSQNDQIEEPYNGVTQPGNLDTLGEKNQVHEKNQIQSPRKNMENMSPEDERA

SEQ ID NO: 2255516 - protein, 10 aa, Cryptosporidium parvum
EENNPEQTKH

SEQ ID NO: 2255517 - protein, 6 aa, Cryptosporidium parvum
EENNRT

SEQ ID NO: 2255518 - protein, 8 aa, Cryptosporidium parvum
EENNSNRL

SEQ ID NO: 2255519 - protein, 12 aa, Cryptosporidium parvum
EENQRTIKFEDC

SEQ ID NO: 2255520 - protein, 7 aa, Cryptosporidium parvum
EENQSNI

SEQ ID NO: 2255521 - protein, 7 aa, Cryptosporidium parvum
EENRDAT

SEQ ID NO: 2255522 - protein, 7 aa, Cryptosporidium parvum
EENRKSA

SEQ ID NO: 2255523 - protein, 4 aa, Cryptosporidium parvum
EENS

SEQ ID NO: 2255524 - protein, 9 aa, Cryptosporidium parvum
EENSINTTD

SEQ ID NO: 2255525 - protein, 5 aa, Cryptosporidium parvum
EENSR

SEQ ID NO: 2255526 - protein, 9 aa, Cryptosporidium parvum
EENSSDCNS

SEQ ID NO: 2255527 - protein, 13 aa, Cryptosporidium parvum
EENSSSNSRFDSN

SEQ ID NO: 2255528 - protein, 8 aa, Cryptosporidium parvum
EENTKWDE

SEQ ID NO: 2255529 - protein, 16 aa, Cryptosporidium parvum
EENTRLRSGNNSTNLQ

SEQ ID NO: 2255530 - protein, 20 aa, Cryptosporidium parvum
EENTTDNSGEKQEASKPNLQ

SEQ ID NO: 2255531 - protein, 10 aa, Cryptosporidium parvum
EENVKDPREI

SEQ ID NO: 2255532 - protein, 7 aa, Cryptosporidium parvum
EEPCSPS

SEQ ID NO: 2255533 - protein, 13 aa, Cryptosporidium parvum
EEPEDTGLSKEEL

SEQ ID NO: 2255534 - protein, 8 aa, Cryptosporidium parvum
EEPGANQQ

SEQ ID NO: 2255535 - protein, 6 aa, Cryptosporidium parvum
EEPGKT

SEQ ID NO: 2255536 - protein, 14 aa, Cryptosporidium parvum
EEPINNSSKDLKSR

SEQ ID NO: 2255537 - protein, 7 aa, Cryptosporidium parvum
EEPIQEY

SEQ ID NO: 2255538 - protein, 18 aa, Cryptosporidium parvum
EEPKKYKDDLDNNKVTEF

SEQ ID NO: 2255539 - protein, 17 aa, Cryptosporidium parvum
EEPNSKEFSKLKNNPTQ

SEQ ID NO: 2255540 - protein, 24 aa, Cryptosporidium parvum
EEPVQEQKKEPVQEYNKEPIQEQK

SEQ ID NO: 2255541 - protein, 11 aa, Cryptosporidium parvum
EEQDLKRTSLA

SEQ ID NO: 2255542 - protein, 15 aa, Cryptosporidium parvum
EEQDPTMNFDINGDE

SEQ ID NO: 2255543 - protein, 32 aa, Cryptosporidium parvum
EEQEEGETEENEENSDKKQKENKKKKKSSRLV

SEQ ID NO: 2255544 - protein, 13 aa, Cryptosporidium parvum
EEQEEQMKSEGQQ

SEQ ID NO: 2255545 - protein, 20 aa, Cryptosporidium parvum
EEQEQVNKLENEQKQEQEQE

SEQ ID NO: 2255546 - protein, 22 aa, Cryptosporidium parvum
EEQESKGLKGADLEEAVDRKRE

SEQ ID NO: 2255547 - protein, 6 aa, Cryptosporidium parvum
EEQGKY

SEQ ID NO: 2255548 - protein, 18 aa, Cryptosporidium parvum
EEQKPAGKPEESKENESL

SEQ ID NO: 2255549 - protein, 6 aa, Cryptosporidium parvum
EEQRRI

SEQ ID NO: 2255550 - protein, 25 aa, Cryptosporidium parvum
EEQSLPNNELSSNINNNNSQNVNYK

SEQ ID NO: 2255551 - protein, 5 aa, Cryptosporidium parvum
EERAS

SEQ ID NO: 2255552 - protein, 4 aa, Cryptosporidium parvum
EERD

SEQ ID NO: 2255553 - protein, 32 aa, Cryptosporidium parvum
EERDNINQNKINNGKSIDYSNNNNNNNNNNNS

SEQ ID NO: 2255554 - protein, 10 aa, Cryptosporidium parvum
EEREESGTSD

SEQ ID NO: 2255555 - protein, 32 aa, Cryptosporidium parvum
EERERIEREERERIEREERERIEREEKERIER

SEQ ID NO: 2255556 - protein, 4 aa, Cryptosporidium parvum
EERK

SEQ ID NO: 2255557 - protein, 15 aa, Cryptosporidium parvum
EERLRKEEEDSSVRR

SEQ ID NO: 2255558 - protein, 12 aa, Cryptosporidium parvum
EERLRKEEEERL

SEQ ID NO: 2255559 - protein, 27 aa, Cryptosporidium parvum
EERLRREEEERIRKEEERIRKEEKKPI

SEQ ID NO: 2255560 - protein, 11 aa, Cryptosporidium parvum
EERNSLARKNS

SEQ ID NO: 2255561 - protein, 6 aa, Cryptosporidium parvum
EERPTI

SEQ ID NO: 2255562 - protein, 22 aa, Cryptosporidium parvum
EERRTEGPFKPLTGTEVNRSNE

SEQ ID NO: 2255563 - protein, 8 aa, Cryptosporidium parvum
EERSNKSL

SEQ ID NO: 2255564 - protein, 4 aa, Cryptosporidium parvum
EERT

SEQ ID NO: 2255565 - protein, 18 aa, Cryptosporidium parvum
EERTEPQNELDKDDKEEM

SEQ ID NO: 2255566 - protein, 5 aa, Cryptosporidium parvum
EERVG

SEQ ID NO: 2255567 - protein, 4 aa, Cryptosporidium parvum
EERY

SEQ ID NO: 2255568 - protein, 8 aa, Cryptosporidium parvum
EESEEKFG

SEQ ID NO: 2255569 - protein, 7 aa, Cryptosporidium parvum
EESEKKA

SEQ ID NO: 2255570 - protein, 5 aa, Cryptosporidium parvum
EESEN

SEQ ID NO: 2255571 - protein, 15 aa, Cryptosporidium parvum
EESEPTRSSESNELS

SEQ ID NO: 2255572 - protein, 12 aa, Cryptosporidium parvum
EESETDTWENRQ

SEQ ID NO: 2255573 - protein, 13 aa, Cryptosporidium parvum
EESFSSGTSTKQL

SEQ ID NO: 2255574 - protein, 8 aa, Cryptosporidium parvum
EESGIDPR

SEQ ID NO: 2255575 - protein, 33 aa, Cryptosporidium parvum
EESGKNIINSNTSSNINTNNTNINGGNCTNVNN

SEQ ID NO: 2255576 - protein, 9 aa, Cryptosporidium parvum
EESGQDAPE

SEQ ID NO: 2255577 - protein, 4 aa, Cryptosporidium parvum
EESK

SEQ ID NO: 2255578 - protein, 8 aa, Cryptosporidium parvum
EESKDDHT

SEQ ID NO: 2255579 - protein, 6 aa, Cryptosporidium parvum
EESKDV

SEQ ID NO: 2255580 - protein, 6 aa, Cryptosporidium parvum
EESKEK

SEQ ID NO: 2255581 - protein, 7 aa, Cryptosporidium parvum
EESKIEG

SEQ ID NO: 2255582 - protein, 7 aa, Cryptosporidium parvum
EESKKLQ

SEQ ID NO: 2255583 - protein, 8 aa, Cryptosporidium parvum
EESKREIK

SEQ ID NO: 2255584 - protein, 13 aa, Cryptosporidium parvum
EESKSSETSGSKA

SEQ ID NO: 2255585 - protein, 21 aa, Cryptosporidium parvum
EESLSQLEEENLTKTSVVSTN

SEQ ID NO: 2255586 - protein, 4 aa, Cryptosporidium parvum
EESN

SEQ ID NO: 2255587 - protein, 11 aa, Cryptosporidium parvum
EESNESEDLSE

SEQ ID NO: 2255588 - protein, 17 aa, Cryptosporidium parvum
EESNKRKRDNSRRSELE

SEQ ID NO: 2255589 - protein, 10 aa, Cryptosporidium parvum
EESNNEELKY

SEQ ID NO: 2255590 - protein, 6 aa, Cryptosporidium parvum
EESNRE

SEQ ID NO: 2255591 - protein, 7 aa, Cryptosporidium parvum
EESNSNL

SEQ ID NO: 2255592 - protein, 8 aa, Cryptosporidium parvum
EESPIPSY

SEQ ID NO: 2255593 - protein, 7 aa, Cryptosporidium parvum
EESQANK

SEQ ID NO: 2255594 - protein, 8 aa, Cryptosporidium parvum
EESQPDKD

SEQ ID NO: 2255595 - protein, 6 aa, Cryptosporidium parvum
EESQRL

SEQ ID NO: 2255596 - protein, 12 aa, Cryptosporidium parvum
EESQSNKNIDPF

SEQ ID NO: 2255597 - protein, 4 aa, Cryptosporidium parvum
EESR

SEQ ID NO: 2255598 - protein, 9 aa, Cryptosporidium parvum
EESRGDGEI

SEQ ID NO: 2255599 - protein, 9 aa, Cryptosporidium parvum
EESRKSLEE

SEQ ID NO: 2255600 - protein, 13 aa, Cryptosporidium parvum
EESSDKEEKPISA

SEQ ID NO: 2255601 - protein, 17 aa, Cryptosporidium parvum
EESSEESESSEEYEPEI

SEQ ID NO: 2255602 - protein, 14 aa, Cryptosporidium parvum
EESSGDNTSPVDNE

SEQ ID NO: 2255603 - protein, 13 aa, Cryptosporidium parvum
EESSNEHILTLNC

SEQ ID NO: 2255604 - protein, 10 aa, Cryptosporidium parvum
EESSSEKGFP

SEQ ID NO: 2255605 - protein, 6 aa, Cryptosporidium parvum
EESSTM

SEQ ID NO: 2255606 - protein, 7 aa, Cryptosporidium parvum
EESSVPK

SEQ ID NO: 2255607 - protein, 7 aa, Cryptosporidium parvum
EESTQIK

SEQ ID NO: 2255608 - protein, 29 aa, Cryptosporidium parvum
EESTTPNKCNCNPEVNNNNNNDNDDTEEF

SEQ ID NO: 2255609 - protein, 4 aa, Cryptosporidium parvum
EESV

SEQ ID NO: 2255610 - protein, 11 aa, Cryptosporidium parvum
EESYGGKCPNL

SEQ ID NO: 2255611 - protein, 8 aa, Cryptosporidium parvum
EESYTKKD

SEQ ID NO: 2255612 - protein, 15 aa, Cryptosporidium parvum
EETDELYKDKNKTKF

SEQ ID NO: 2255613 - protein, 10 aa, Cryptosporidium parvum
EETDKNDVED

SEQ ID NO: 2255614 - protein, 10 aa, Cryptosporidium parvum
EETEKTASFK

SEQ ID NO: 2255615 - protein, 11 aa, Cryptosporidium parvum
EETENPHGNFG

SEQ ID NO: 2255616 - protein, 11 aa, Cryptosporidium parvum
EETGASISNYE

SEQ ID NO: 2255617 - protein, 5 aa, Cryptosporidium parvum
EETGD

SEQ ID NO: 2255618 - protein, 4 aa, Cryptosporidium parvum
EETI

SEQ ID NO: 2255619 - protein, 10 aa, Cryptosporidium parvum
EETKFKSPEY

SEQ ID NO: 2255620 - protein, 7 aa, Cryptosporidium parvum
EETKNEL

SEQ ID NO: 2255621 - protein, 31 aa, Cryptosporidium parvum
EETNHSYGDDDMNNDSEKVISSYKSKQMEEK

SEQ ID NO: 2255622 - protein, 7 aa, Cryptosporidium parvum
EETNQYS

SEQ ID NO: 2255623 - protein, 5 aa, Cryptosporidium parvum
EETRD

SEQ ID NO: 2255624 - protein, 13 aa, Cryptosporidium parvum
EETSENKTNEYSL

SEQ ID NO: 2255625 - protein, 6 aa, Cryptosporidium parvum
EETTRL

SEQ ID NO: 2255626 - protein, 11 aa, Cryptosporidium parvum
EEVDDSTSNDE

SEQ ID NO: 2255627 - protein, 8 aa, Cryptosporidium parvum
EEVDSSNI

SEQ ID NO: 2255628 - protein, 6 aa, Cryptosporidium parvum
EEVEND

SEQ ID NO: 2255629 - protein, 5 aa, Cryptosporidium parvum
EEVET

SEQ ID NO: 2255630 - protein, 8 aa, Cryptosporidium parvum
EEVGTKDS

SEQ ID NO: 2255631 - protein, 5 aa, Cryptosporidium parvum
EEVPF

SEQ ID NO: 2255632 - protein, 13 aa, Cryptosporidium parvum
EEVPNSQDSNINS

SEQ ID NO: 2255633 - protein, 4 aa, Cryptosporidium parvum
EEVR

SEQ ID NO: 2255634 - protein, 10 aa, Cryptosporidium parvum
EEYAGNPNAC

SEQ ID NO: 2255635 - protein, 5 aa, Cryptosporidium parvum
EEYAK

SEQ ID NO: 2255636 - protein, 4 aa, Cryptosporidium parvum
EEYD

SEQ ID NO: 2255637 - protein, 15 aa, Cryptosporidium parvum
EEYDESGPSIVHRKC

SEQ ID NO: 2255638 - protein, 6 aa, Cryptosporidium parvum
EEYEEE

SEQ ID NO: 2255639 - protein, 8 aa, Cryptosporidium parvum
EEYENSAI

SEQ ID NO: 2255640 - protein, 9 aa, Cryptosporidium parvum
EEYKHSLGS

SEQ ID NO: 2255641 - protein, 26 aa, Cryptosporidium parvum
EEYKSEESQRRNEEKENESNKAFQSL

SEQ ID NO: 2255642 - protein, 6 aa, Cryptosporidium parvum
EEYNTN

SEQ ID NO: 2255643 - protein, 9 aa, Cryptosporidium parvum
EEYPNKAPK

SEQ ID NO: 2255644 - protein, 12 aa, Cryptosporidium parvum
EEYRANDQAKKE

SEQ ID NO: 2255645 - protein, 9 aa, Cryptosporidium parvum
EEYSKQREE

SEQ ID NO: 2255646 - protein, 10 aa, Cryptosporidium parvum
EEYTKKESKL

SEQ ID NO: 2255647 - protein, 13 aa, Cryptosporidium parvum
EFDESEGKSNNLK

SEQ ID NO: 2255648 - protein, 6 aa, Cryptosporidium parvum
EFEAPK

SEQ ID NO: 2255649 - protein, 9 aa, Cryptosporidium parvum
EFENDNSKT

SEQ ID NO: 2255650 - protein, 10 aa, Cryptosporidium parvum
EFENSDSSLT

SEQ ID NO: 2255651 - protein, 7 aa, Cryptosporidium parvum
EFEQNRN

SEQ ID NO: 2255652 - protein, 4 aa, Cryptosporidium parvum
EFER

SEQ ID NO: 2255653 - protein, 9 aa, Cryptosporidium parvum
EFESRDSDV

SEQ ID NO: 2255654 - protein, 7 aa, Cryptosporidium parvum
EFESRQE

SEQ ID NO: 2255655 - protein, 9 aa, Cryptosporidium parvum
EFGREGSLS

SEQ ID NO: 2255656 - protein, 19 aa, Cryptosporidium parvum
EFGSENSSFTNHANNLDDD

SEQ ID NO: 2255657 - protein, 6 aa, Cryptosporidium parvum
EFGTLS

SEQ ID NO: 2255658 - protein, 4 aa, Cryptosporidium parvum
EFKN

SEQ ID NO: 2255659 - protein, 6 aa, Cryptosporidium parvum
EFKNND

SEQ ID NO: 2255660 - protein, 6 aa, Cryptosporidium parvum
EFKNPS

SEQ ID NO: 2255661 - protein, 8 aa, Cryptosporidium parvum
EFKRSNKD

SEQ ID NO: 2255662 - protein, 17 aa, Cryptosporidium parvum
EFNDNEEAEIDEMTSSN

SEQ ID NO: 2255663 - protein, 6 aa, Cryptosporidium parvum
EFNDNG

SEQ ID NO: 2255664 - protein, 12 aa, Cryptosporidium parvum
EFNENLDSNPVS

SEQ ID NO: 2255665 - protein, 9 aa, Cryptosporidium parvum
EFNNENEYN

SEQ ID NO: 2255666 - protein, 4 aa, Cryptosporidium parvum
EFNQ

SEQ ID NO: 2255667 - protein, 6 aa, Cryptosporidium parvum
EFPGQD

SEQ ID NO: 2255668 - protein, 5 aa, Cryptosporidium parvum
EFPNG

SEQ ID NO: 2255669 - protein, 18 aa, Cryptosporidium parvum
EFPNIESKKNTSKSNSGY

SEQ ID NO: 2255670 - protein, 9 aa, Cryptosporidium parvum
EFPNNSSTC

SEQ ID NO: 2255671 - protein, 10 aa, Cryptosporidium parvum
EFPPVNTNGF

SEQ ID NO: 2255672 - protein, 6 aa, Cryptosporidium parvum
EFPTGS

SEQ ID NO: 2255673 - protein, 14 aa, Cryptosporidium parvum
EFQAEEKESLDSSI

SEQ ID NO: 2255674 - protein, 5 aa, Cryptosporidium parvum
EFSDS

SEQ ID NO: 2255675 - protein, 11 aa, Cryptosporidium parvum
EFSDSRSQKVS

SEQ ID NO: 2255676 - protein, 9 aa, Cryptosporidium parvum
EFSEGEKKV

SEQ ID NO: 2255677 - protein, 19 aa, Cryptosporidium parvum
EFSEQDEESIKFFRNLLDI

SEQ ID NO: 2255678 - protein, 11 aa, Cryptosporidium parvum
EFSESAKSSIT

SEQ ID NO: 2255679 - protein, 6 aa, Cryptosporidium parvum
EFSKGG

SEQ ID NO: 2255680 - protein, 7 aa, Cryptosporidium parvum
EFSQNKN

SEQ ID NO: 2255681 - protein, 10 aa, Cryptosporidium parvum
EFSSPISTFG

SEQ ID NO: 2255682 - protein, 9 aa, Cryptosporidium parvum
EFSSSDTQR

SEQ ID NO: 2255683 - protein, 11 aa, Cryptosporidium parvum
EFSSSSQRTNE

SEQ ID NO: 2255684 - protein, 5 aa, Cryptosporidium parvum
EFTSQ

SEQ ID NO: 2255685 - protein, 8 aa, Cryptosporidium parvum
EGAIPASV

SEQ ID NO: 2255686 - protein, 11 aa, Cryptosporidium parvum
EGANKKNSKKI

SEQ ID NO: 2255687 - protein, 8 aa, Cryptosporidium parvum
EGAPKSYY

SEQ ID NO: 2255688 - protein, 9 aa, Cryptosporidium parvum
EGASYNSSL

SEQ ID NO: 2255689 - protein, 4 aa, Cryptosporidium parvum
EGCE

SEQ ID NO: 2255690 - protein, 6 aa, Cryptosporidium parvum
EGDAFG

SEQ ID NO: 2255691 - protein, 7 aa, Cryptosporidium parvum
EGDATPF

SEQ ID NO: 2255692 - protein, 16 aa, Cryptosporidium parvum
EGDEDSDDEDDENDLD

SEQ ID NO: 2255693 - protein, 11 aa, Cryptosporidium parvum
EGDENREYQTE

SEQ ID NO: 2255694 - protein, 5 aa, Cryptosporidium parvum
EGDKD

SEQ ID NO: 2255695 - protein, 9 aa, Cryptosporidium parvum
EGDKTKSPV

SEQ ID NO: 2255696 - protein, 11 aa, Cryptosporidium parvum
EGDSLEKREDA

SEQ ID NO: 2255697 - protein, 17 aa, Cryptosporidium parvum
EGEDGVKPVKANLGEEN

SEQ ID NO: 2255698 - protein, 10 aa, Cryptosporidium parvum
EGEDTNEDVG

SEQ ID NO: 2255699 - protein, 27 aa, Cryptosporidium parvum
EGEEDDDDEDDDDEMVDEEVDDGASSR

SEQ ID NO: 2255700 - protein, 12 aa, Cryptosporidium parvum
EGEEDEFEDNSY

SEQ ID NO: 2255701 - protein, 7 aa, Cryptosporidium parvum
EGEEDVR

SEQ ID NO: 2255702 - protein, 5 aa, Cryptosporidium parvum
EGEEF

SEQ ID NO: 2255703 - protein, 6 aa, Cryptosporidium parvum
EGEGEI

SEQ ID NO: 2255704 - protein, 9 aa, Cryptosporidium parvum
EGEGELGEH

SEQ ID NO: 2255705 - protein, 96 aa, Cryptosporidium parvum
EGEGRRAGGGMERGEHSSRGGGHSGRGGHSGRGGHSGRGGHSGRGGHSGGGGVNSGRGGSSGRGHSSRGGGGHSTRGGGKKGRGGNGKSKHENSSK

SEQ ID NO: 2255706 - protein, 5 aa, Cryptosporidium parvum
EGEIL

SEQ ID NO: 2255707 - protein, 4 aa, Cryptosporidium parvum
EGEK

SEQ ID NO: 2255708 - protein, 9 aa, Cryptosporidium parvum
EGEKNNTGI

SEQ ID NO: 2255709 - protein, 9 aa, Cryptosporidium parvum
EGEKPHPLE

SEQ ID NO: 2255710 - protein, 9 aa, Cryptosporidium parvum
EGEKYKLGS

SEQ ID NO: 2255711 - protein, 9 aa, Cryptosporidium parvum
EGELEEEPI

SEQ ID NO: 2255712 - protein, 14 aa, Cryptosporidium parvum
EGELKNNDSFTPFE

SEQ ID NO: 2255713 - protein, 4 aa, Cryptosporidium parvum
EGEN

SEQ ID NO: 2255714 - protein, 12 aa, Cryptosporidium parvum
EGENKSSYGFDS

SEQ ID NO: 2255715 - protein, 8 aa, Cryptosporidium parvum
EGEQEDDP

SEQ ID NO: 2255716 - protein, 23 aa, Cryptosporidium parvum
EGERLSSEETNGNIKSKEKKTVK

SEQ ID NO: 2255717 - protein, 19 aa, Cryptosporidium parvum
EGESGELVTPPASLSTQDH

SEQ ID NO: 2255718 - protein, 12 aa, Cryptosporidium parvum
EGESLSDKFNQS

SEQ ID NO: 2255719 - protein, 6 aa, Cryptosporidium parvum
EGESNQ

SEQ ID NO: 2255720 - protein, 7 aa, Cryptosporidium parvum
EGESVGK

SEQ ID NO: 2255721 - protein, 7 aa, Cryptosporidium parvum
EGEVNPV

SEQ ID NO: 2255722 - protein, 7 aa, Cryptosporidium parvum
EGEVQTP

SEQ ID NO: 2255723 - protein, 12 aa, Cryptosporidium parvum
EGFGKQRAKKGV

SEQ ID NO: 2255724 - protein, 12 aa, Cryptosporidium parvum
EGFRPSVDSDAE

SEQ ID NO: 2255725 - protein, 6 aa, Cryptosporidium parvum
EGFSGR

SEQ ID NO: 2255726 - protein, 19 aa, Cryptosporidium parvum
EGFSSREKQYDYSNIPGRL

SEQ ID NO: 2255727 - protein, 18 aa, Cryptosporidium parvum
EGGAPNNFEDEISPQEKE

SEQ ID NO: 2255728 - protein, 8 aa, Cryptosporidium parvum
EGGATRNV

SEQ ID NO: 2255729 - protein, 9 aa, Cryptosporidium parvum
EGGDNENNN

SEQ ID NO: 2255730 - protein, 8 aa, Cryptosporidium parvum
EGGEDSSK

SEQ ID NO: 2255731 - protein, 5 aa, Cryptosporidium parvum
EGGEE

SEQ ID NO: 2255732 - protein, 8 aa, Cryptosporidium parvum
EGGEYESL

SEQ ID NO: 2255733 - protein, 4 aa, Cryptosporidium parvum
EGGF

SEQ ID NO: 2255734 - protein, 9 aa, Cryptosporidium parvum
EGGGAGNNW

SEQ ID NO: 2255735 - protein, 6 aa, Cryptosporidium parvum
EGGIEQ

SEQ ID NO: 2255736 - protein, 8 aa, Cryptosporidium parvum
EGGLAGHS

SEQ ID NO: 2255737 - protein, 4 aa, Cryptosporidium parvum
EGGR

SEQ ID NO: 2255738 - protein, 5 aa, Cryptosporidium parvum
EGGSM

SEQ ID NO: 2255739 - protein, 11 aa, Cryptosporidium parvum
EGGSSGGPTVP

SEQ ID NO: 2255740 - protein, 10 aa, Cryptosporidium parvum
EGGYPPDYGH

SEQ ID NO: 2255741 - protein, 5 aa, Cryptosporidium parvum
EGHKQ

SEQ ID NO: 2255742 - protein, 6 aa, Cryptosporidium parvum
EGHRVK

SEQ ID NO: 2255743 - protein, 7 aa, Cryptosporidium parvum
EGIAANE

SEQ ID NO: 2255744 - protein, 6 aa, Cryptosporidium parvum
EGIEKT

SEQ ID NO: 2255745 - protein, 10 aa, Cryptosporidium parvum
EGIGGSSTLS

SEQ ID NO: 2255746 - protein, 6 aa, Cryptosporidium parvum
EGIKHK

SEQ ID NO: 2255747 - protein, 9 aa, Cryptosporidium parvum
EGIKSPRDI

SEQ ID NO: 2255748 - protein, 11 aa, Cryptosporidium parvum
EGINGGGSLPV

SEQ ID NO: 2255749 - protein, 14 aa, Cryptosporidium parvum
EGINNSISTTPSAN

SEQ ID NO: 2255750 - protein, 7 aa, Cryptosporidium parvum
EGIPEES

SEQ ID NO: 2255751 - protein, 8 aa, Cryptosporidium parvum
EGISPPKN

SEQ ID NO: 2255752 - protein, 6 aa, Cryptosporidium parvum
EGISVE

SEQ ID NO: 2255753 - protein, 9 aa, Cryptosporidium parvum
EGKATNDYF

SEQ ID NO: 2255754 - protein, 19 aa, Cryptosporidium parvum
EGKGVNENGEKVKATPEEI

SEQ ID NO: 2255755 - protein, 8 aa, Cryptosporidium parvum
EGKHQNSA

SEQ ID NO: 2255756 - protein, 12 aa, Cryptosporidium parvum
EGKIKASDAYTL

SEQ ID NO: 2255757 - protein, 9 aa, Cryptosporidium parvum
EGKKPSNRL

SEQ ID NO: 2255758 - protein, 18 aa, Cryptosporidium parvum
EGKNEANSSSSLENNNAN

SEQ ID NO: 2255759 - protein, 10 aa, Cryptosporidium parvum
EGKSDSNLVK

SEQ ID NO: 2255760 - protein, 10 aa, Cryptosporidium parvum
EGKTRVTKNK

SEQ ID NO: 2255761 - protein, 9 aa, Cryptosporidium parvum
EGKTSIKGK

SEQ ID NO: 2255762 - protein, 4 aa, Cryptosporidium parvum
EGKV

SEQ ID NO: 2255763 - protein, 9 aa, Cryptosporidium parvum
EGKVGEWRD

SEQ ID NO: 2255764 - protein, 4 aa, Cryptosporidium parvum
EGKW

SEQ ID NO: 2255765 - protein, 13 aa, Cryptosporidium parvum
EGKWGHPERPLSD

SEQ ID NO: 2255766 - protein, 10 aa, Cryptosporidium parvum
EGLDESEDEL

SEQ ID NO: 2255767 - protein, 18 aa, Cryptosporidium parvum
EGLEYRESDHMNDGEEDF

SEQ ID NO: 2255768 - protein, 10 aa, Cryptosporidium parvum
EGLGKHEGYS

SEQ ID NO: 2255769 - protein, 6 aa, Cryptosporidium parvum
EGLGND

SEQ ID NO: 2255770 - protein, 4 aa, Cryptosporidium parvum
EGLK

SEQ ID NO: 2255771 - protein, 8 aa, Cryptosporidium parvum
EGLSSEKE

SEQ ID NO: 2255772 - protein, 7 aa, Cryptosporidium parvum
EGMPTYK

SEQ ID NO: 2255773 - protein, 4 aa, Cryptosporidium parvum
EGMT

SEQ ID NO: 2255774 - protein, 5 aa, Cryptosporidium parvum
EGNDE

SEQ ID NO: 2255775 - protein, 4 aa, Cryptosporidium parvum
EGNE

SEQ ID NO: 2255776 - protein, 4 aa, Cryptosporidium parvum
EGNG

SEQ ID NO: 2255777 - protein, 10 aa, Cryptosporidium parvum
EGNGSKNWRN

SEQ ID NO: 2255778 - protein, 4 aa, Cryptosporidium parvum
EGNI

SEQ ID NO: 2255779 - protein, 10 aa, Cryptosporidium parvum
EGNKDNLYQP

SEQ ID NO: 2255780 - protein, 5 aa, Cryptosporidium parvum
EGNLP

SEQ ID NO: 2255781 - protein, 25 aa, Cryptosporidium parvum
EGNNFSPEKENAQQGADYTNSVPPP

SEQ ID NO: 2255782 - protein, 7 aa, Cryptosporidium parvum
EGNNKEM

SEQ ID NO: 2255783 - protein, 8 aa, Cryptosporidium parvum
EGNNPNAI

SEQ ID NO: 2255784 - protein, 13 aa, Cryptosporidium parvum
EGNNTISERDTDH

SEQ ID NO: 2255785 - protein, 5 aa, Cryptosporidium parvum
EGNPL

SEQ ID NO: 2255786 - protein, 20 aa, Cryptosporidium parvum
EGNQYSVNNQYNNGNGGLNN

SEQ ID NO: 2255787 - protein, 9 aa, Cryptosporidium parvum
EGNSEEEKV

SEQ ID NO: 2255788 - protein, 12 aa, Cryptosporidium parvum
EGNSFQSINSQD

SEQ ID NO: 2255789 - protein, 5 aa, Cryptosporidium parvum
EGNTE

SEQ ID NO: 2255790 - protein, 26 aa, Cryptosporidium parvum
EGNTEGNPSSAEPANSAQGQSTTNNF

SEQ ID NO: 2255791 - protein, 10 aa, Cryptosporidium parvum
EGNTNGTGEK

SEQ ID NO: 2255792 - protein, 13 aa, Cryptosporidium parvum
EGNTPGPKPSKSI

SEQ ID NO: 2255793 - protein, 7 aa, Cryptosporidium parvum
EGNYDVK

SEQ ID NO: 2255794 - protein, 4 aa, Cryptosporidium parvum
EGPS

SEQ ID NO: 2255795 - protein, 9 aa, Cryptosporidium parvum
EGPTGNDIS

SEQ ID NO: 2255796 - protein, 11 aa, Cryptosporidium parvum
EGQDKTTTQRE

SEQ ID NO: 2255797 - protein, 7 aa, Cryptosporidium parvum
EGQESLI

SEQ ID NO: 2255798 - protein, 16 aa, Cryptosporidium parvum
EGQEVSDKLADEESDK

SEQ ID NO: 2255799 - protein, 7 aa, Cryptosporidium parvum
EGQEYGQ

SEQ ID NO: 2255800 - protein, 12 aa, Cryptosporidium parvum
EGQSDIVSSDKS

SEQ ID NO: 2255801 - protein, 10 aa, Cryptosporidium parvum
EGQSTTDSTI

SEQ ID NO: 2255802 - protein, 12 aa, Cryptosporidium parvum
EGRDNNNLNSQY

SEQ ID NO: 2255803 - protein, 14 aa, Cryptosporidium parvum
EGREPDASEYQQEL

SEQ ID NO: 2255804 - protein, 12 aa, Cryptosporidium parvum
EGRFSPDESTSR

SEQ ID NO: 2255805 - protein, 5 aa, Cryptosporidium parvum
EGRRV

SEQ ID NO: 2255806 - protein, 5 aa, Cryptosporidium parvum
EGRSK

SEQ ID NO: 2255807 - protein, 6 aa, Cryptosporidium parvum
EGSAGK

SEQ ID NO: 2255808 - protein, 4 aa, Cryptosporidium parvum
EGSE

SEQ ID NO: 2255809 - protein, 7 aa, Cryptosporidium parvum
EGSESTI

SEQ ID NO: 2255810 - protein, 10 aa, Cryptosporidium parvum
EGSFGTSGTS

SEQ ID NO: 2255811 - protein, 9 aa, Cryptosporidium parvum
EGSGGCNVS

SEQ ID NO: 2255812 - protein, 21 aa, Cryptosporidium parvum
EGSGPYPGVGSISQPQGFGSN

SEQ ID NO: 2255813 - protein, 5 aa, Cryptosporidium parvum
EGSIG

SEQ ID NO: 2255814 - protein, 4 aa, Cryptosporidium parvum
EGSK

SEQ ID NO: 2255815 - protein, 10 aa, Cryptosporidium parvum
EGSKAKPRKF

SEQ ID NO: 2255816 - protein, 6 aa, Cryptosporidium parvum
EGSLED

SEQ ID NO: 2255817 - protein, 4 aa, Cryptosporidium parvum
EGSM

SEQ ID NO: 2255818 - protein, 6 aa, Cryptosporidium parvum
EGSNRE

SEQ ID NO: 2255819 - protein, 11 aa, Cryptosporidium parvum
EGSPAFQSGIR

SEQ ID NO: 2255820 - protein, 7 aa, Cryptosporidium parvum
EGSPGDL

SEQ ID NO: 2255821 - protein, 18 aa, Cryptosporidium parvum
EGSQWGNLTNSSGESTSH

SEQ ID NO: 2255822 - protein, 6 aa, Cryptosporidium parvum
EGSREI

SEQ ID NO: 2255823 - protein, 18 aa, Cryptosporidium parvum
EGSSIKTLSPSSYSSNQS

SEQ ID NO: 2255824 - protein, 9 aa, Cryptosporidium parvum
EGSTDFGGP

SEQ ID NO: 2255825 - protein, 9 aa, Cryptosporidium parvum
EGSTRNRNF

SEQ ID NO: 2255826 - protein, 6 aa, Cryptosporidium parvum
EGSVPD

SEQ ID NO: 2255827 - protein, 9 aa, Cryptosporidium parvum
EGTDNPDLK

SEQ ID NO: 2255828 - protein, 10 aa, Cryptosporidium parvum
EGTEETKKEV

SEQ ID NO: 2255829 - protein, 12 aa, Cryptosporidium parvum
EGTEGDNSNSIK

SEQ ID NO: 2255830 - protein, 6 aa, Cryptosporidium parvum
EGTEQI

SEQ ID NO: 2255831 - protein, 9 aa, Cryptosporidium parvum
EGTETDANE

SEQ ID NO: 2255832 - protein, 12 aa, Cryptosporidium parvum
EGTGDSNSTEIR

SEQ ID NO: 2255833 - protein, 7 aa, Cryptosporidium parvum
EGTGLSQ

SEQ ID NO: 2255834 - protein, 8 aa, Cryptosporidium parvum
EGTKEREI

SEQ ID NO: 2255835 - protein, 11 aa, Cryptosporidium parvum
EGTKGLESDYG

SEQ ID NO: 2255836 - protein, 4 aa, Cryptosporidium parvum
EGTN

SEQ ID NO: 2255837 - protein, 9 aa, Cryptosporidium parvum
EGTPYEGGS

SEQ ID NO: 2255838 - protein, 4 aa, Cryptosporidium parvum
EGTQ

SEQ ID NO: 2255839 - protein, 8 aa, Cryptosporidium parvum
EGTSSGVY

SEQ ID NO: 2255840 - protein, 31 aa, Cryptosporidium parvum
EGVEMETDAETDVDNNTDHAELDDEDSFNNE

SEQ ID NO: 2255841 - protein, 5 aa, Cryptosporidium parvum
EGVNR

SEQ ID NO: 2255842 - protein, 7 aa, Cryptosporidium parvum
EGVPNSH

SEQ ID NO: 2255843 - protein, 4 aa, Cryptosporidium parvum
EGVS

SEQ ID NO: 2255844 - protein, 5 aa, Cryptosporidium parvum
EGVSD

SEQ ID NO: 2255845 - protein, 14 aa, Cryptosporidium parvum
EGVSETSIEKKRKA

SEQ ID NO: 2255846 - protein, 6 aa, Cryptosporidium parvum
EGVSRT

SEQ ID NO: 2255847 - protein, 14 aa, Cryptosporidium parvum
EGYLDGKEASLSNL

SEQ ID NO: 2255848 - protein, 5 aa, Cryptosporidium parvum
EGYNN

SEQ ID NO: 2255849 - protein, 5 aa, Cryptosporidium parvum
EGYNS

SEQ ID NO: 2255850 - protein, 7 aa, Cryptosporidium parvum
EGYPLST

SEQ ID NO: 2255851 - protein, 13 aa, Cryptosporidium parvum
EGYQQDHDDEFSQ

SEQ ID NO: 2255852 - protein, 7 aa, Cryptosporidium parvum
EGYTGDG

SEQ ID NO: 2255853 - protein, 5 aa, Cryptosporidium parvum
EHAES

SEQ ID NO: 2255854 - protein, 7 aa, Cryptosporidium parvum
EHAPKYN

SEQ ID NO: 2255855 - protein, 60 aa, Cryptosporidium parvum
EHDASKSYTSSNNRDPEYSNDEYSYKDELESDESNDYSDNTSEQEDFSSRYSTSRVNTER

SEQ ID NO: 2255856 - protein, 25 aa, Cryptosporidium parvum
EHEEKQQKEEEEEEEEQQQQQQQNY

SEQ ID NO: 2255857 - protein, 6 aa, Cryptosporidium parvum
EHEGPV

SEQ ID NO: 2255858 - protein, 5 aa, Cryptosporidium parvum
EHEKK

SEQ ID NO: 2255859 - protein, 7 aa, Cryptosporidium parvum
EHEPKAE

SEQ ID NO: 2255860 - protein, 7 aa, Cryptosporidium parvum
EHESEKE

SEQ ID NO: 2255861 - protein, 8 aa, Cryptosporidium parvum
EHESRGIE

SEQ ID NO: 2255862 - protein, 20 aa, Cryptosporidium parvum
EHESRKKHEEQLQKRKKLSS

SEQ ID NO: 2255863 - protein, 4 aa, Cryptosporidium parvum
EHGF

SEQ ID NO: 2255864 - protein, 12 aa, Cryptosporidium parvum
EHGREEREESYD

SEQ ID NO: 2255865 - protein, 14 aa, Cryptosporidium parvum
EHHSESKNKVQNSY

SEQ ID NO: 2255866 - protein, 6 aa, Cryptosporidium parvum
EHKEQI

SEQ ID NO: 2255867 - protein, 7 aa, Cryptosporidium parvum
EHKGKPF

SEQ ID NO: 2255868 - protein, 8 aa, Cryptosporidium parvum
EHKKRNDG

SEQ ID NO: 2255869 - protein, 10 aa, Cryptosporidium parvum
EHKNSNSTDV

SEQ ID NO: 2255870 - protein, 11 aa, Cryptosporidium parvum
EHKRTRTRSLE

SEQ ID NO: 2255871 - protein, 6 aa, Cryptosporidium parvum
EHKSGR

SEQ ID NO: 2255872 - protein, 26 aa, Cryptosporidium parvum
EHLGTEEQWKEAENALKSALDKTGRD

SEQ ID NO: 2255873 - protein, 12 aa, Cryptosporidium parvum
EHNEEKKCSSLS

SEQ ID NO: 2255874 - protein, 10 aa, Cryptosporidium parvum
EHNLENGTHI

SEQ ID NO: 2255875 - protein, 31 aa, Cryptosporidium parvum; identical to SEQ ID NO: 2139935

SEQ ID NO: 2255876 - protein, 6 aa, Cryptosporidium parvum
EHNPPI

SEQ ID NO: 2255877 - protein, 15 aa, Cryptosporidium parvum
EHNVNNGNGNNNDGI

SEQ ID NO: 2255878 - protein, 4 aa, Cryptosporidium parvum
EHSE

SEQ ID NO: 2255879 - protein, 10 aa, Cryptosporidium parvum
EHSSSANSVY

SEQ ID NO: 2255880 - protein, 8 aa, Cryptosporidium parvum
EIAAPSPY

SEQ ID NO: 2255881 - protein, 9 aa, Cryptosporidium parvum
EIAKTTNNI

SEQ ID NO: 2255882 - protein, 8 aa, Cryptosporidium parvum
EIARENQA

SEQ ID NO: 2255883 - protein, 13 aa, Cryptosporidium parvum
EIDDEEDDNEEDE

SEQ ID NO: 2255884 - protein, 4 aa, Cryptosporidium parvum
EIDE

SEQ ID NO: 2255885 - protein, 7 aa, Cryptosporidium parvum
EIDENSV

SEQ ID NO: 2255886 - protein, 8 aa, Cryptosporidium parvum
EIDENTDQ

SEQ ID NO: 2255887 - protein, 11 aa, Cryptosporidium parvum
EIDEYSKKDNF

SEQ ID NO: 2255888 - protein, 18 aa, Cryptosporidium parvum
EIDGKDCKNNEDNNMEEY

SEQ ID NO: 2255889 - protein, 41 aa, Cryptosporidium parvum; identical to SEQ ID NO: 2139953

SEQ ID NO: 2255890 - protein, 21 aa, Cryptosporidium parvum
EIDPKTSESSPLKTNSGAELD

SEQ ID NO: 2255891 - protein, 5 aa, Cryptosporidium parvum
EIDQD

SEQ ID NO: 2255892 - protein, 5 aa, Cryptosporidium parvum
EIDQR

SEQ ID NO: 2255893 - protein, 18 aa, Cryptosporidium parvum
EIDSDTNKASSNKESKIH

SEQ ID NO: 2255894 - protein, 8 aa, Cryptosporidium parvum
EIDSEYNG

SEQ ID NO: 2255895 - protein, 8 aa, Cryptosporidium parvum
EIEDEDEL

SEQ ID NO: 2255896 - protein, 29 aa, Cryptosporidium parvum
EIEDTELNKTIRNNGFKDKYNTSDINSSF

SEQ ID NO: 2255897 - protein, 11 aa, Cryptosporidium parvum
EIEEDGRGNRV

SEQ ID NO: 2255898 - protein, 5 aa, Cryptosporidium parvum
EIEEE

SEQ ID NO: 2255899 - protein, 6 aa, Cryptosporidium parvum
EIEGDE

SEQ ID NO: 2255900 - protein, 21 aa, Cryptosporidium parvum
EIEGTGEAEADMEQNIETETE

SEQ ID NO: 2255901 - protein, 11 aa, Cryptosporidium parvum
EIEKNSASIID

SEQ ID NO: 2255902 - protein, 5 aa, Cryptosporidium parvum
EIEND

SEQ ID NO: 2255903 - protein, 17 aa, Cryptosporidium parvum
EIENEGKQKIIQEKKAS

SEQ ID NO: 2255904 - protein, 10 aa, Cryptosporidium parvum
EIENPKNHCP

SEQ ID NO: 2255905 - protein, 10 aa, Cryptosporidium parvum
EIENRQKELR

SEQ ID NO: 2255906 - protein, 20 aa, Cryptosporidium parvum
EIEPEKSEQPAPEKNSELES

SEQ ID NO: 2255907 - protein, 11 aa, Cryptosporidium parvum
EIEQAEKKKMY

SEQ ID NO: 2255908 - protein, 11 aa, Cryptosporidium parvum
EIEREKKRVEN

SEQ ID NO: 2255909 - protein, 7 aa, Cryptosporidium parvum
EIERSNY

SEQ ID NO: 2255910 - protein, 11 aa, Cryptosporidium parvum
EIESGKNNQMG

SEQ ID NO: 2255911 - protein, 7 aa, Cryptosporidium parvum
EIESPEQ

SEQ ID NO: 2255912 - protein, 9 aa, Cryptosporidium parvum
EIETANKQN

SEQ ID NO: 2255913 - protein, 5 aa, Cryptosporidium parvum
EIGAV

SEQ ID NO: 2255914 - protein, 6 aa, Cryptosporidium parvum
EIGDGS

SEQ ID NO: 2255915 - protein, 7 aa, Cryptosporidium parvum
EIGEEDY

SEQ ID NO: 2255916 - protein, 6 aa, Cryptosporidium parvum
EIGESI

SEQ ID NO: 2255917 - protein, 11 aa, Cryptosporidium parvum
EIGGGSSQRMD

SEQ ID NO: 2255918 - protein, 6 aa, Cryptosporidium parvum
EIGGHD

SEQ ID NO: 2255919 - protein, 13 aa, Cryptosporidium parvum
EIGGPEMKKQSEL

SEQ ID NO: 2255920 - protein, 16 aa, Cryptosporidium parvum
EIGNKVNNRSRRSISE

SEQ ID NO: 2255921 - protein, 4 aa, Cryptosporidium parvum
EIGR

SEQ ID NO: 2255922 - protein, 9 aa, Cryptosporidium parvum
EIGRGEKLS

SEQ ID NO: 2255923 - protein, 5 aa, Cryptosporidium parvum
EIGSD

SEQ ID NO: 2255924 - protein, 8 aa, Cryptosporidium parvum
EIGTQKNE

SEQ ID NO: 2255925 - protein, 13 aa, Cryptosporidium parvum
EIKDQAKQKLIDD

SEQ ID NO: 2255926 - protein, 21 aa, Cryptosporidium parvum
EIKEDNKDDVDDDDDDSLGPM

SEQ ID NO: 2255927 - protein, 6 aa, Cryptosporidium parvum
EIKEKT

SEQ ID NO: 2255928 - protein, 7 aa, Cryptosporidium parvum
EIKEQKN

SEQ ID NO: 2255929 - protein, 14 aa, Cryptosporidium parvum
EIKGSENKSTSYKL

SEQ ID NO: 2255930 - protein, 16 aa, Cryptosporidium parvum
EIKKDDNSENWTPTSI

SEQ ID NO: 2255931 - protein, 18 aa, Cryptosporidium parvum
EIKKREKEFDSLKAEQEK

SEQ ID NO: 2255932 - protein, 25 aa, Cryptosporidium parvum
EIKNDDQLKENQHQLKNENSNNKKL

SEQ ID NO: 2255933 - protein, 5 aa, Cryptosporidium parvum
EIKPP

SEQ ID NO: 2255934 - protein, 8 aa, Cryptosporidium parvum
EIKQSDDI

SEQ ID NO: 2255935 - protein, 8 aa, Cryptosporidium parvum
EIKTQEQN

SEQ ID NO: 2255936 - protein, 25 aa, Cryptosporidium parvum
EIKYSQKNDNYEASDYDKKESINLD

SEQ ID NO: 2255937 - protein, 8 aa, Cryptosporidium parvum
EINDPKEV

SEQ ID NO: 2255938 - protein, 4 aa, Cryptosporidium parvum
EINE

SEQ ID NO: 2255939 - protein, 19 aa, Cryptosporidium parvum
EINNNDNDNDSNDISAKPC

SEQ ID NO: 2255940 - protein, 4 aa, Cryptosporidium parvum
EINP

SEQ ID NO: 2255941 - protein, 8 aa, Cryptosporidium parvum
EINPSNNG

SEQ ID NO: 2255942 - protein, 11 aa, Cryptosporidium parvum
EINPTSEKNES

SEQ ID NO: 2255943 - protein, 15 aa, Cryptosporidium parvum
EINQKHSKSSESLGK

SEQ ID NO: 2255944 - protein, 10 aa, Cryptosporidium parvum
EINQNNRDFS

SEQ ID NO: 2255945 - protein, 15 aa, Cryptosporidium parvum
EINSEISQINSNNEY

SEQ ID NO: 2255946 - protein, 11 aa, Cryptosporidium parvum
EINSKRKSSNW

SEQ ID NO: 2255947 - protein, 12 aa, Cryptosporidium parvum
EINSKTKKKNGY

SEQ ID NO: 2255948 - protein, 12 aa, Cryptosporidium parvum
EINSREKKLKDK

SEQ ID NO: 2255949 - protein, 16 aa, Cryptosporidium parvum
EINSYEKGKLTPHPGL

SEQ ID NO: 2255950 - protein, 5 aa, Cryptosporidium parvum
EINTI

SEQ ID NO: 2255951 - protein, 11 aa, Cryptosporidium parvum
EINTKEEYTPL

SEQ ID NO: 2255952 - protein, 6 aa, Cryptosporidium parvum
EINTQT

SEQ ID NO: 2255953 - protein, 14 aa, Cryptosporidium parvum
EIPDSADKNELNQD

SEQ ID NO: 2255954 - protein, 16 aa, Cryptosporidium parvum
EIPETESKKENESNDI

SEQ ID NO: 2255955 - protein, 32 aa, Cryptosporidium parvum; identical to SEQ ID NO: 2140003

SEQ ID NO: 2255956 - protein, 16 aa, Cryptosporidium parvum
EIPISNKEKDKEKDIG

SEQ ID NO: 2255957 - protein, 18 aa, Cryptosporidium parvum
EIPKESEEINQPDRNYAN

SEQ ID NO: 2255958 - protein, 16 aa, Cryptosporidium parvum
EIPKGSVPGSSSQKNI

SEQ ID NO: 2255959 - protein, 12 aa, Cryptosporidium parvum
EIPNGDEIDEAE

SEQ ID NO: 2255960 - protein, 6 aa, Cryptosporidium parvum
EIPNKN

SEQ ID NO: 2255961 - protein, 7 aa, Cryptosporidium parvum
EIPPEGI

SEQ ID NO: 2255962 - protein, 5 aa, Cryptosporidium parvum
EIPPK

SEQ ID NO: 2255963 - protein, 4 aa, Cryptosporidium parvum
EIPQ

SEQ ID NO: 2255964 - protein, 19 aa, Cryptosporidium parvum
EIQDNNNNDLTRNKKKDDF

SEQ ID NO: 2255965 - protein, 6 aa, Cryptosporidium parvum
EIQENE

SEQ ID NO: 2255966 - protein, 4 aa, Cryptosporidium parvum
EIQK

SEQ ID NO: 2255967 - protein, 7 aa, Cryptosporidium parvum
EIQNEER

SEQ ID NO: 2255968 - protein, 5 aa, Cryptosporidium parvum
EIQSD

SEQ ID NO: 2255969 - protein, 13 aa, Cryptosporidium parvum
EIQSDDDISNLFS

SEQ ID NO: 2255970 - protein, 10 aa, Cryptosporidium parvum
EIRANSEKTF

SEQ ID NO: 2255971 - protein, 9 aa, Cryptosporidium parvum
EIRKKNERE

SEQ ID NO: 2255972 - protein, 9 aa, Cryptosporidium parvum
EIRQSNKRD

SEQ ID NO: 2255973 - protein, 4 aa, Cryptosporidium parvum
EISD

SEQ ID NO: 2255974 - protein, 11 aa, Cryptosporidium parvum
EISEEEKRKAE

SEQ ID NO: 2255975 - protein, 11 aa, Cryptosporidium parvum
EISEEPEKNIS

SEQ ID NO: 2255976 - protein, 6 aa, Cryptosporidium parvum
EISGGE

SEQ ID NO: 2255977 - protein, 9 aa, Cryptosporidium parvum
EISGSNQSW

SEQ ID NO: 2255978 - protein, 6 aa, Cryptosporidium parvum
EISKGE

SEQ ID NO: 2255979 - protein, 9 aa, Cryptosporidium parvum
EISKSSINE

SEQ ID NO: 2255980 - protein, 10 aa, Cryptosporidium parvum
EISNNKNENE

SEQ ID NO: 2255981 - protein, 28 aa, Cryptosporidium parvum
EISNYTESLNNSYDEIKREAEYKEIPQN

SEQ ID NO: 2255982 - protein, 4 aa, Cryptosporidium parvum
EISP

SEQ ID NO: 2255983 - protein, 13 aa, Cryptosporidium parvum
EISPELATKFNCL

SEQ ID NO: 2255984 - protein, 11 aa, Cryptosporidium parvum
EISRSKRLERA

SEQ ID NO: 2255985 - protein, 10 aa, Cryptosporidium parvum
EISSEKPKIY

SEQ ID NO: 2255986 - protein, 11 aa, Cryptosporidium parvum
EISSSNKATHI

SEQ ID NO: 2255987 - protein, 7 aa, Cryptosporidium parvum
EISTEEN

SEQ ID NO: 2255988 - protein, 9 aa, Cryptosporidium parvum
EISTSSDSI

SEQ ID NO: 2255989 - protein, 6 aa, Cryptosporidium parvum
EITEED

SEQ ID NO: 2255990 - protein, 6 aa, Cryptosporidium parvum
EITGDD

SEQ ID NO: 2255991 - protein, 6 aa, Cryptosporidium parvum
EITGDK

SEQ ID NO: 2255992 - protein, 21 aa, Cryptosporidium parvum
EITGNNGIMSSSNGSNSPRNM

SEQ ID NO: 2255993 - protein, 5 aa, Cryptosporidium parvum
EITHH

SEQ ID NO: 2255994 - protein, 4 aa, Cryptosporidium parvum
EITM

SEQ ID NO: 2255995 - protein, 12 aa, Cryptosporidium parvum
EITNEDNLNGDS

SEQ ID NO: 2255996 - protein, 12 aa, Cryptosporidium parvum
EITNSNNGTMNG

SEQ ID NO: 2255997 - protein, 16 aa, Cryptosporidium parvum
EITQKTEYNKSDLNEN

SEQ ID NO: 2255998 - protein, 10 aa, Cryptosporidium parvum
EITRKNSSGC

SEQ ID NO: 2255999 - protein, 6 aa, Cryptosporidium parvum
EITTEQ

SEQ ID NO: 2256000 - protein, 5 aa, Cryptosporidium parvum
EIVTE

SEQ ID NO: 2256001 - protein, 10 aa, Cryptosporidium parvum
EIYDSQSEIN

SEQ ID NO: 2256002 - protein, 6 aa, Cryptosporidium parvum
EIYPPD

SEQ ID NO: 2256003 - protein, 6 aa, Cryptosporidium parvum
EKAANE

SEQ ID NO: 2256004 - protein, 22 aa, Cryptosporidium parvum
EKACKERDPFSNSGADLESSWG

SEQ ID NO: 2256005 - protein, 7 aa, Cryptosporidium parvum
EKADGKT

SEQ ID NO: 2256006 - protein, 9 aa, Cryptosporidium parvum
EKADPTLSG

SEQ ID NO: 2256007 - protein, 12 aa, Cryptosporidium parvum
EKAELNDKIGQL

SEQ ID NO: 2256008 - protein, 19 aa, Cryptosporidium parvum
EKAGPGSWNRGQLPNEYPI

SEQ ID NO: 2256009 - protein, 5 aa, Cryptosporidium parvum
EKAIK

SEQ ID NO: 2256010 - protein, 4 aa, Cryptosporidium parvum
EKAK

SEQ ID NO: 2256011 - protein, 20 aa, Cryptosporidium parvum
EKAKKKGKKEVSIASHESKN

SEQ ID NO: 2256012 - protein, 8 aa, Cryptosporidium parvum
EKAKKSKK

SEQ ID NO: 2256013 - protein, 14 aa, Cryptosporidium parvum
EKAKMSSLQGSRDY

SEQ ID NO: 2256014 - protein, 14 aa, Cryptosporidium parvum
EKANINPSETSSNC

SEQ ID NO: 2256015 - protein, 21 aa, Cryptosporidium parvum
EKANYANSNRSYLENRSEKSI

SEQ ID NO: 2256016 - protein, 5 aa, Cryptosporidium parvum
EKARL

SEQ ID NO: 2256017 - protein, 36 aa, Cryptosporidium parvum; identical to SEQ ID NO: 2140057

SEQ ID NO: 2256018 - protein, 8 aa, Cryptosporidium parvum
EKASFPDI

SEQ ID NO: 2256019 - protein, 11 aa, Cryptosporidium parvum
EKASSKEKIST

SEQ ID NO: 2256020 - protein, 8 aa, Cryptosporidium parvum
EKCENSNI

SEQ ID NO: 2256021 - protein, 5 aa, Cryptosporidium parvum
EKCGS

SEQ ID NO: 2256022 - protein, 25 aa, Cryptosporidium parvum
EKCQNSNGNENNNNDEFEDDEFGDA

SEQ ID NO: 2256023 - protein, 6 aa, Cryptosporidium parvum
EKCSCE

SEQ ID NO: 2256024 - protein, 7 aa, Cryptosporidium parvum
EKDDDSN

SEQ ID NO: 2256025 - protein, 14 aa, Cryptosporidium parvum
EKDDDSQNKLPPWK

SEQ ID NO: 2256026 - protein, 8 aa, Cryptosporidium parvum
EKDDIQLP

SEQ ID NO: 2256027 - protein, 7 aa, Cryptosporidium parvum
EKDEDFS

SEQ ID NO: 2256028 - protein, 7 aa, Cryptosporidium parvum
EKDEIKK

SEQ ID NO: 2256029 - protein, 9 aa, Cryptosporidium parvum
EKDERLRGE

SEQ ID NO: 2256030 - protein, 8 aa, Cryptosporidium parvum
EKDESTGL

SEQ ID NO: 2256031 - protein, 10 aa, Cryptosporidium parvum
EKDFQTYEKN

SEQ ID NO: 2256032 - protein, 11 aa, Cryptosporidium parvum
EKDGDSLSNQI

SEQ ID NO: 2256033 - protein, 12 aa, Cryptosporidium parvum
EKDGLDKTPVEE

SEQ ID NO: 2256034 - protein, 6 aa, Cryptosporidium parvum
EKDGQW

SEQ ID NO: 2256035 - protein, 14 aa, Cryptosporidium parvum
EKDHEKEKEENQDH

SEQ ID NO: 2256036 - protein, 9 aa, Cryptosporidium parvum
EKDHSSDTY

SEQ ID NO: 2256037 - protein, 8 aa, Cryptosporidium parvum
EKDINNEG

SEQ ID NO: 2256038 - protein, 16 aa, Cryptosporidium parvum
EKDKELKELRDTQNSV

SEQ ID NO: 2256039 - protein, 8 aa, Cryptosporidium parvum
EKDKGIRN

SEQ ID NO: 2256040 - protein, 8 aa, Cryptosporidium parvum
EKDNENRL

SEQ ID NO: 2256041 - protein, 9 aa, Cryptosporidium parvum
EKDNINKKQ

SEQ ID NO: 2256042 - protein, 30 aa, Cryptosporidium parvum
EKDNKANNNINNSSRCDLTDRESKRGDIEG

SEQ ID NO: 2256043 - protein, 11 aa, Cryptosporidium parvum
EKDNSLKKSAY

SEQ ID NO: 2256044 - protein, 7 aa, Cryptosporidium parvum
EKDPLNN

SEQ ID NO: 2256045 - protein, 9 aa, Cryptosporidium parvum
EKDPSKREV

SEQ ID NO: 2256046 - protein, 7 aa, Cryptosporidium parvum
EKDPTHE

SEQ ID NO: 2256047 - protein, 13 aa, Cryptosporidium parvum
EKDQNIKVNQTPT

SEQ ID NO: 2256048 - protein, 6 aa, Cryptosporidium parvum
EKDREE

SEQ ID NO: 2256049 - protein, 7 aa, Cryptosporidium parvum
EKDRSTL

SEQ ID NO: 2256050 - protein, 5 aa, Cryptosporidium parvum
EKDSI

SEQ ID NO: 2256051 - protein, 7 aa, Cryptosporidium parvum
EKDSSNC

SEQ ID NO: 2256052 - protein, 11 aa, Cryptosporidium parvum
EKDSTSLSNKT

SEQ ID NO: 2256053 - protein, 8 aa, Cryptosporidium parvum
EKDTASSS

SEQ ID NO: 2256054 - protein, 9 aa, Cryptosporidium parvum
EKDTELKDY

SEQ ID NO: 2256055 - protein, 7 aa, Cryptosporidium parvum
EKDYEEL

SEQ ID NO: 2256056 - protein, 6 aa, Cryptosporidium parvum
EKECEP

SEQ ID NO: 2256057 - protein, 4 aa, Cryptosporidium parvum
EKED

SEQ ID NO: 2256058 - protein, 9 aa, Cryptosporidium parvum
EKEDSSGKV

SEQ ID NO: 2256059 - protein, 6 aa, Cryptosporidium parvum
EKEDTR

SEQ ID NO: 2256060 - protein, 5 aa, Cryptosporidium parvum
EKEDV

SEQ ID NO: 2256061 - protein, 6 aa, Cryptosporidium parvum
EKEEDD

SEQ ID NO: 2256062 - protein, 6 aa, Cryptosporidium parvum
EKEEIN

SEQ ID NO: 2256063 - protein, 9 aa, Cryptosporidium parvum
EKEEKNYTH

SEQ ID NO: 2256064 - protein, 6 aa, Cryptosporidium parvum
EKEENE

SEQ ID NO: 2256065 - protein, 9 aa, Cryptosporidium parvum
EKEENSNDH

SEQ ID NO: 2256066 - protein, 24 aa, Cryptosporidium parvum
EKEERAKARKEAKERKRLKQQAKM

SEQ ID NO: 2256067 - protein, 19 aa, Cryptosporidium parvum
EKEEREKSQQKKKPNDFST

SEQ ID NO: 2256068 - protein, 4 aa, Cryptosporidium parvum
EKEG

SEQ ID NO: 2256069 - protein, 7 aa, Cryptosporidium parvum
EKEGIPS

SEQ ID NO: 2256070 - protein, 7 aa, Cryptosporidium parvum
EKEGNEI

SEQ ID NO: 2256071 - protein, 11 aa, Cryptosporidium parvum
EKEGNENKLSE

SEQ ID NO: 2256072 - protein, 7 aa, Cryptosporidium parvum
EKEGNQY

SEQ ID NO: 2256073 - protein, 5 aa, Cryptosporidium parvum
EKEHE

SEQ ID NO: 2256074 - protein, 30 aa, Cryptosporidium parvum; identical to SEQ ID NO: 2140106

SEQ ID NO: 2256075 - protein, 7 aa, Cryptosporidium parvum
EKEIVTD

SEQ ID NO: 2256076 - protein, 11 aa, Cryptosporidium parvum
EKEKKDKISGL

SEQ ID NO: 2256077 - protein, 8 aa, Cryptosporidium parvum
EKEKLKDI

SEQ ID NO: 2256078 - protein, 23 aa, Cryptosporidium parvum
EKEKNQDNVEKTQEATTKQNVEN

SEQ ID NO: 2256079 - protein, 10 aa, Cryptosporidium parvum
EKEKQISELT

SEQ ID NO: 2256080 - protein, 7 aa, Cryptosporidium parvum
EKEKQRI

SEQ ID NO: 2256081 - protein, 6 aa, Cryptosporidium parvum
EKENCS

SEQ ID NO: 2256082 - protein, 5 aa, Cryptosporidium parvum
EKENI

SEQ ID NO: 2256083 - protein, 7 aa, Cryptosporidium parvum
EKENNDL

SEQ ID NO: 2256084 - protein, 7 aa, Cryptosporidium parvum
EKENSKQ

SEQ ID NO: 2256085 - protein, 9 aa, Cryptosporidium parvum
EKENSSNSL

SEQ ID NO: 2256086 - protein, 12 aa, Cryptosporidium parvum
EKEQNRVKRGRS

SEQ ID NO: 2256087 - protein, 15 aa, Cryptosporidium parvum
EKEREEEKEKIRQEI

SEQ ID NO: 2256088 - protein, 12 aa, Cryptosporidium parvum
EKERENIKEAEN

SEQ ID NO: 2256089 - protein, 15 aa, Cryptosporidium parvum
EKERIENADSKGFSS

SEQ ID NO: 2256090 - protein, 7 aa, Cryptosporidium parvum
EKERNSQ

SEQ ID NO: 2256091 - protein, 8 aa, Cryptosporidium parvum
EKERSIRR

SEQ ID NO: 2256092 - protein, 11 aa, Cryptosporidium parvum
EKESDEQDSEV

SEQ ID NO: 2256093 - protein, 6 aa, Cryptosporidium parvum
EKESET

SEQ ID NO: 2256094 - protein, 9 aa, Cryptosporidium parvum
EKESIDSEK

SEQ ID NO: 2256095 - protein, 10 aa, Cryptosporidium parvum
EKESINEKNH

SEQ ID NO: 2256096 - protein, 7 aa, Cryptosporidium parvum
EKESKGC

SEQ ID NO: 2256097 - protein, 8 aa, Cryptosporidium parvum
EKESREIE

SEQ ID NO: 2256098 - protein, 11 aa, Cryptosporidium parvum
EKESSEMGKGS

SEQ ID NO: 2256099 - protein, 11 aa, Cryptosporidium parvum
EKESSNELSKM

SEQ ID NO: 2256100 - protein, 9 aa, Cryptosporidium parvum
EKESSVENF

SEQ ID NO: 2256101 - protein, 5 aa, Cryptosporidium parvum
EKEVS

SEQ ID NO: 2256102 - protein, 5 aa, Cryptosporidium parvum
EKEYN

SEQ ID NO: 2256103 - protein, 8 aa, Cryptosporidium parvum
EKEYNNSV

SEQ ID NO: 2256104 - protein, 10 aa, Cryptosporidium parvum
EKFEERAQGW

SEQ ID NO: 2256105 - protein, 7 aa, Cryptosporidium parvum
EKFESRD

SEQ ID NO: 2256106 - protein, 7 aa, Cryptosporidium parvum
EKFKEED

SEQ ID NO: 2256107 - protein, 12 aa, Cryptosporidium parvum
EKFKQTAAQRSE

SEQ ID NO: 2256108 - protein, 17 aa, Cryptosporidium parvum
EKFNSSLGSNSSRKRVQ

SEQ ID NO: 2256109 - protein, 12 aa, Cryptosporidium parvum
EKFNTSSNFYGD

SEQ ID NO: 2256110 - protein, 6 aa, Cryptosporidium parvum
EKFPDI

SEQ ID NO: 2256111 - protein, 6 aa, Cryptosporidium parvum
EKGARE

SEQ ID NO: 2256112 - protein, 8 aa, Cryptosporidium parvum
EKGASKSM

SEQ ID NO: 2256113 - protein, 8 aa, Cryptosporidium parvum
EKGCSGKG

SEQ ID NO: 2256114 - protein, 5 aa, Cryptosporidium parvum
EKGDQ

SEQ ID NO: 2256115 - protein, 7 aa, Cryptosporidium parvum
EKGDRET

SEQ ID NO: 2256116 - protein, 5 aa, Cryptosporidium parvum
EKGDY

SEQ ID NO: 2256117 - protein, 9 aa, Cryptosporidium parvum
EKGEADKDE

SEQ ID NO: 2256118 - protein, 7 aa, Cryptosporidium parvum
EKGEENF

SEQ ID NO: 2256119 - protein, 8 aa, Cryptosporidium parvum
EKGEKEEV

SEQ ID NO: 2256120 - protein, 7 aa, Cryptosporidium parvum
EKGGQLK

SEQ ID NO: 2256121 - protein, 4 aa, Cryptosporidium parvum
EKGI

SEQ ID NO: 2256122 - protein, 5 aa, Cryptosporidium parvum
EKGIG

SEQ ID NO: 2256123 - protein, 9 aa, Cryptosporidium parvum
EKGINTNTN

SEQ ID NO: 2256124 - protein, 8 aa, Cryptosporidium parvum
EKGKDDCK

SEQ ID NO: 2256125 - protein, 10 aa, Cryptosporidium parvum
EKGKNDEINT

SEQ ID NO: 2256126 - protein, 10 aa, Cryptosporidium parvum
EKGLDESQDN

SEQ ID NO: 2256127 - protein, 7 aa, Cryptosporidium parvum
EKGLKDD

SEQ ID NO: 2256128 - protein, 7 aa, Cryptosporidium parvum
EKGLRGD

SEQ ID NO: 2256129 - protein, 10 aa, Cryptosporidium parvum
EKGMGQSGKP

SEQ ID NO: 2256130 - protein, 5 aa, Cryptosporidium parvum
EKGNG

SEQ ID NO: 2256131 - protein, 7 aa, Cryptosporidium parvum
EKGNPHV

SEQ ID NO: 2256132 - protein, 8 aa, Cryptosporidium parvum
EKGSEGVS

SEQ ID NO: 2256133 - protein, 5 aa, Cryptosporidium parvum
EKGST

SEQ ID NO: 2256134 - protein, 6 aa, Cryptosporidium parvum
EKGTIE

SEQ ID NO: 2256135 - protein, 7 aa, Cryptosporidium parvum
EKGTNIN

SEQ ID NO: 2256136 - protein, 7 aa, Cryptosporidium parvum
EKGTVSF

SEQ ID NO: 2256137 - protein, 12 aa, Cryptosporidium parvum
EKGTYKLTGERN

SEQ ID NO: 2256138 - protein, 9 aa, Cryptosporidium parvum
EKHEEGRTL

SEQ ID NO: 2256139 - protein, 6 aa, Cryptosporidium parvum
EKHSEI

SEQ ID NO: 2256140 - protein, 11 aa, Cryptosporidium parvum
EKHVEKKAYDN

SEQ ID NO: 2256141 - protein, 9 aa, Cryptosporidium parvum
EKIDSNVND

SEQ ID NO: 2256142 - protein, 9 aa, Cryptosporidium parvum
EKIEQTRED

SEQ ID NO: 2256143 - protein, 8 aa, Cryptosporidium parvum
EKIKENQE

SEQ ID NO: 2256144 - protein, 16 aa, Cryptosporidium parvum
EKIKGLSDSLRETKKE

SEQ ID NO: 2256145 - protein, 5 aa, Cryptosporidium parvum
EKIKS

SEQ ID NO: 2256146 - protein, 5 aa, Cryptosporidium parvum
EKIKT

SEQ ID NO: 2256147 - protein, 5 aa, Cryptosporidium parvum
EKISS

SEQ ID NO: 2256148 - protein, 15 aa, Cryptosporidium parvum
EKISSTTLKSKKKSM

SEQ ID NO: 2256149 - protein, 8 aa, Cryptosporidium parvum
EKKATKLK

SEQ ID NO: 2256150 - protein, 12 aa, Cryptosporidium parvum
EKKDDESQESVI

SEQ ID NO: 2256151 - protein, 9 aa, Cryptosporidium parvum
EKKDMGELA

SEQ ID NO: 2256152 - protein, 9 aa, Cryptosporidium parvum
EKKDSSMST

SEQ ID NO: 2256153 - protein, 7 aa, Cryptosporidium parvum
EKKEGIP

SEQ ID NO: 2256154 - protein, 22 aa, Cryptosporidium parvum
EKKEGNSNWSKSDTTSSISKSN

SEQ ID NO: 2256155 - protein, 5 aa, Cryptosporidium parvum
EKKEI

SEQ ID NO: 2256156 - protein, 4 aa, Cryptosporidium parvum
EKKF

SEQ ID NO: 2256157 - protein, 18 aa, Cryptosporidium parvum
EKKGGKIKKNVVSNKSGM

SEQ ID NO: 2256158 - protein, 8 aa, Cryptosporidium parvum
EKKGKVQD

SEQ ID NO: 2256159 - protein, 9 aa, Cryptosporidium parvum
EKKGNDKSC

SEQ ID NO: 2256160 - protein, 7 aa, Cryptosporidium parvum
EKKHLKE

SEQ ID NO: 2256161 - protein, 4 aa, Cryptosporidium parvum
EKKK

SEQ ID NO: 2256162 - protein, 9 aa, Cryptosporidium parvum
EKKKEELET

SEQ ID NO: 2256163 - protein, 8 aa, Cryptosporidium parvum
EKKKPIFD

SEQ ID NO: 2256164 - protein, 9 aa, Cryptosporidium parvum
EKKKQERIP

SEQ ID NO: 2256165 - protein, 10 aa, Cryptosporidium parvum
EKKKQSEQDY

SEQ ID NO: 2256166 - protein, 23 aa, Cryptosporidium parvum
EKKKSLNDNSKNLEKTMNKSGYC

SEQ ID NO: 2256167 - protein, 7 aa, Cryptosporidium parvum
EKKLTSK

SEQ ID NO: 2256168 - protein, 7 aa, Cryptosporidium parvum
EKKNDRW

SEQ ID NO: 2256169 - protein, 11 aa, Cryptosporidium parvum
EKKNKEDSNIM

SEQ ID NO: 2256170 - protein, 8 aa, Cryptosporidium parvum
EKKNNKKI

SEQ ID NO: 2256171 - protein, 5 aa, Cryptosporidium parvum
EKKNQ

SEQ ID NO: 2256172 - protein, 7 aa, Cryptosporidium parvum
EKKNSYV

SEQ ID NO: 2256173 - protein, 9 aa, Cryptosporidium parvum
EKKPNELDA

SEQ ID NO: 2256174 - protein, 6 aa, Cryptosporidium parvum
EKKPNG

SEQ ID NO: 2256175 - protein, 21 aa, Cryptosporidium parvum
EKKPSVKKEKPTVQEKDPRIV

SEQ ID NO: 2256176 - protein, 8 aa, Cryptosporidium parvum
EKKQKNSN

SEQ ID NO: 2256177 - protein, 7 aa, Cryptosporidium parvum
EKKQSEF

SEQ ID NO: 2256178 - protein, 4 aa, Cryptosporidium parvum
EKKR

SEQ ID NO: 2256179 - protein, 23 aa, Cryptosporidium parvum
EKKRMQAEKKNKIDISDQKQKLE

SEQ ID NO: 2256180 - protein, 5 aa, Cryptosporidium parvum
EKKSI

SEQ ID NO: 2256181 - protein, 9 aa, Cryptosporidium parvum
EKKSRHAKT

SEQ ID NO: 2256182 - protein, 22 aa, Cryptosporidium parvum
EKKSRKSLAEQYDDSSSEYNFS

SEQ ID NO: 2256183 - protein, 15 aa, Cryptosporidium parvum
EKKSRSDLQVNNETE

SEQ ID NO: 2256184 - protein, 6 aa, Cryptosporidium parvum
EKKSRV

SEQ ID NO: 2256185 - protein, 14 aa, Cryptosporidium parvum
EKKSSRTPSGTKSF

SEQ ID NO: 2256186 - protein, 37 aa, Cryptosporidium parvum
EKKTKELEEEEEVEEEEEEEEKEDSISVSTGDQENTN

SEQ ID NO: 2256187 - protein, 9 aa, Cryptosporidium parvum
EKKTNPISI

SEQ ID NO: 2256188 - protein, 43 aa, Cryptosporidium parvum
EKKTQDKKDTEFGVPNGTKSSSFSSSSSSSSNAARSSIGTNQN

SEQ ID NO: 2256189 - protein, 6 aa, Cryptosporidium parvum
EKKYYN

SEQ ID NO: 2256190 - protein, 11 aa, Cryptosporidium parvum
EKLEDDPKVEE

SEQ ID NO: 2256191 - protein, 5 aa, Cryptosporidium parvum
EKLET

SEQ ID NO: 2256192 - protein, 10 aa, Cryptosporidium parvum
EKLGKKSDQF

SEQ ID NO: 2256193 - protein, 5 aa, Cryptosporidium parvum
EKLGR

SEQ ID NO: 2256194 - protein, 9 aa, Cryptosporidium parvum
EKLKDTKAF

SEQ ID NO: 2256195 - protein, 9 aa, Cryptosporidium parvum
EKLKETNEA

SEQ ID NO: 2256196 - protein, 37 aa, Cryptosporidium parvum
EKLKKDKSNSKENDSSSYDTIKNSGDSILEQKNEGIL

SEQ ID NO: 2256197 - protein, 8 aa, Cryptosporidium parvum
EKLKQEEN

SEQ ID NO: 2256198 - protein, 28 aa, Cryptosporidium parvum
EKLKRQQEENTKKSGEVRSSKDSDSAAI

SEQ ID NO: 2256199 - protein, 19 aa, Cryptosporidium parvum
EKLKSGISLTSSNSIAKGE

SEQ ID NO: 2256200 - protein, 6 aa, Cryptosporidium parvum
EKLNKD

SEQ ID NO: 2256201 - protein, 47 aa, Cryptosporidium parvum
EKLNKKSDNDKNRNKDEEDEEEDEEDDDEVENEDEEEPEDSEKYPNK

SEQ ID NO: 2256202 - protein, 16 aa, Cryptosporidium parvum
EKLQTEKQQEHVSNEE

SEQ ID NO: 2256203 - protein, 8 aa, Cryptosporidium parvum
EKLSDEEV

SEQ ID NO: 2256204 - protein, 12 aa, Cryptosporidium parvum
EKLSTQRNTSVS

SEQ ID NO: 2256205 - protein, 13 aa, Cryptosporidium parvum
EKMEANKKSLQGI

SEQ ID NO: 2256206 - protein, 6 aa, Cryptosporidium parvum
EKMTQA

SEQ ID NO: 2256207 - protein, 12 aa, Cryptosporidium parvum
EKMTRGPASNNL

SEQ ID NO: 2256208 - protein, 12 aa, Cryptosporidium parvum
EKMTSDTRIEQK

SEQ ID NO: 2256209 - protein, 8 aa, Cryptosporidium parvum
EKNAGNNE

SEQ ID NO: 2256210 - protein, 7 aa, Cryptosporidium parvum
EKNAREQ

SEQ ID NO: 2256211 - protein, 10 aa, Cryptosporidium parvum
EKNCQNEDLN

SEQ ID NO: 2256212 - protein, 75 aa, Cryptosporidium parvum
EKNDLKTNRDIEGREKLESSIPASDNKEGSSNNTGGSGNGNNITPTSSSSSSNSNSNSNSTSSSSSSSSGTSGVV

SEQ ID NO: 2256213 - protein, 6 aa, Cryptosporidium parvum
EKNEEI

SEQ ID NO: 2256214 - protein, 10 aa, Cryptosporidium parvum
EKNEKNIQKE

SEQ ID NO: 2256215 - protein, 13 aa, Cryptosporidium parvum
EKNEKYSKSGNLE

SEQ ID NO: 2256216 - protein, 9 aa, Cryptosporidium parvum
EKNESNNGL

SEQ ID NO: 2256217 - protein, 41 aa, Cryptosporidium parvum
EKNESTPDQNLDKESTDGKDTKSNNNIDAYSNENLDNKGRL

SEQ ID NO: 2256218 - protein, 6 aa, Cryptosporidium parvum
EKNETL

SEQ ID NO: 2256219 - protein, 7 aa, Cryptosporidium parvum
EKNFQTV

SEQ ID NO: 2256220 - protein, 5 aa, Cryptosporidium parvum
EKNGD

SEQ ID NO: 2256221 - protein, 8 aa, Cryptosporidium parvum
EKNGGKEE

SEQ ID NO: 2256222 - protein, 11 aa, Cryptosporidium parvum
EKNISEKSKIK

SEQ ID NO: 2256223 - protein, 6 aa, Cryptosporidium parvum
EKNKEI

SEQ ID NO: 2256224 - protein, 9 aa, Cryptosporidium parvum
EKNKKFEKK

SEQ ID NO: 2256225 - protein, 16 aa, Cryptosporidium parvum
EKNKQKDEQNKIEGSM

SEQ ID NO: 2256226 - protein, 22 aa, Cryptosporidium parvum
EKNLSENPDPSQINDQSPFTTR

SEQ ID NO: 2256227 - protein, 19 aa, Cryptosporidium parvum
EKNNNSKRSRSEKRATKRK

SEQ ID NO: 2256228 - protein, 13 aa, Cryptosporidium parvum
EKNNSIDTTQNNV

SEQ ID NO: 2256229 - protein, 7 aa, Cryptosporidium parvum
EKNNSIQ

SEQ ID NO: 2256230 - protein, 9 aa, Cryptosporidium parvum
EKNNSNLVE

SEQ ID NO: 2256231 - protein, 9 aa, Cryptosporidium parvum
EKNNTNLDE

SEQ ID NO: 2256232 - protein, 8 aa, Cryptosporidium parvum
EKNPEIGK

SEQ ID NO: 2256233 - protein, 6 aa, Cryptosporidium parvum
EKNPKL

SEQ ID NO: 2256234 - protein, 12 aa, Cryptosporidium parvum
EKNSLSNTSVSS

SEQ ID NO: 2256235 - protein, 19 aa, Cryptosporidium parvum
EKNSNSINQKIPPNAYHIN

SEQ ID NO: 2256236 - protein, 12 aa, Cryptosporidium parvum
EKNSTDSPIEQI

SEQ ID NO: 2256237 - protein, 14 aa, Cryptosporidium parvum
EKNTEKNFKNEEKE

SEQ ID NO: 2256238 - protein, 7 aa, Cryptosporidium parvum
EKNTNNI

SEQ ID NO: 2256239 - protein, 43 aa, Cryptosporidium parvum
EKNTSFGRNANSNPSSVSSKRKARNGSQAGRNSCPVRGSRENL

SEQ ID NO: 2256240 - protein, 8 aa, Cryptosporidium parvum
EKNTTNSK

SEQ ID NO: 2256241 - protein, 7 aa, Cryptosporidium parvum
EKNVERD

SEQ ID NO: 2256242 - protein, 4 aa, Cryptosporidium parvum
EKPD

SEQ ID NO: 2256243 - protein, 6 aa, Cryptosporidium parvum
EKPDEN

SEQ ID NO: 2256244 - protein, 7 aa, Cryptosporidium parvum
EKPDSNQ

SEQ ID NO: 2256245 - protein, 8 aa, Cryptosporidium parvum
EKPDVTYS

SEQ ID NO: 2256246 - protein, 5 aa, Cryptosporidium parvum
EKPET

SEQ ID NO: 2256247 - protein, 6 aa, Cryptosporidium parvum
EKPIAA

SEQ ID NO: 2256248 - protein, 10 aa, Cryptosporidium parvum
EKPISISGKE

SEQ ID NO: 2256249 - protein, 7 aa, Cryptosporidium parvum
EKPKKAT

SEQ ID NO: 2256250 - protein, 5 aa, Cryptosporidium parvum
EKPKP

SEQ ID NO: 2256251 - protein, 4 aa, Cryptosporidium parvum
EKPL

SEQ ID NO: 2256252 - protein, 9 aa, Cryptosporidium parvum
EKPLGTAGP

SEQ ID NO: 2256253 - protein, 8 aa, Cryptosporidium parvum
EKPLHENQ

SEQ ID NO: 2256254 - protein, 5 aa, Cryptosporidium parvum
EKPNK

SEQ ID NO: 2256255 - protein, 8 aa, Cryptosporidium parvum
EKPPDQEH

SEQ ID NO: 2256256 - protein, 9 aa, Cryptosporidium parvum
EKPQERGYN

SEQ ID NO: 2256257 - protein, 11 aa, Cryptosporidium parvum
EKPRKRSKSNV

SEQ ID NO: 2256258 - protein, 5 aa, Cryptosporidium parvum
EKPRN

SEQ ID NO: 2256259 - protein, 9 aa, Cryptosporidium parvum
EKPSDPGGN

SEQ ID NO: 2256260 - protein, 11 aa, Cryptosporidium parvum
EKPSWKPEEGK

SEQ ID NO: 2256261 - protein, 24 aa, Cryptosporidium parvum
EKPSYNDSESNSDTIDCSQESISV

SEQ ID NO: 2256262 - protein, 10 aa, Cryptosporidium parvum
EKPTENTEEV

SEQ ID NO: 2256263 - protein, 5 aa, Cryptosporidium parvum
EKPTP

SEQ ID NO: 2256264 - protein, 8 aa, Cryptosporidium parvum
EKQAEDQL

SEQ ID NO: 2256265 - protein, 4 aa, Cryptosporidium parvum
EKQD

SEQ ID NO: 2256266 - protein, 17 aa, Cryptosporidium parvum
EKQDYKAEMSGNGNSNF

SEQ ID NO: 2256267 - protein, 6 aa, Cryptosporidium parvum
EKQEKY

SEQ ID NO: 2256268 - protein, 4 aa, Cryptosporidium parvum
EKQF

SEQ ID NO: 2256269 - protein, 15 aa, Cryptosporidium parvum
EKQGTEEEKRNSNDY

SEQ ID NO: 2256270 - protein, 10 aa, Cryptosporidium parvum
EKQHEDLSQE

SEQ ID NO: 2256271 - protein, 8 aa, Cryptosporidium parvum
EKQINKGN

SEQ ID NO: 2256272 - protein, 11 aa, Cryptosporidium parvum
EKQKEEQFQNK

SEQ ID NO: 2256273 - protein, 10 aa, Cryptosporidium parvum
EKQKTSASLR

SEQ ID NO: 2256274 - protein, 4 aa, Cryptosporidium parvum
EKQL

SEQ ID NO: 2256275 - protein, 7 aa, Cryptosporidium parvum
EKQNKCN

SEQ ID NO: 2256276 - protein, 9 aa, Cryptosporidium parvum
EKQNTTCEQ

SEQ ID NO: 2256277 - protein, 4 aa, Cryptosporidium parvum
EKQP

SEQ ID NO: 2256278 - protein, 10 aa, Cryptosporidium parvum
EKQPNSISSV

SEQ ID NO: 2256279 - protein, 23 aa, Cryptosporidium parvum
EKQPRSFSNSSRASRTNVTTPKG

SEQ ID NO: 2256280 - protein, 9 aa, Cryptosporidium parvum
EKQPSTNEG

SEQ ID NO: 2256281 - protein, 4 aa, Cryptosporidium parvum
EKQR

SEQ ID NO: 2256282 - protein, 5 aa, Cryptosporidium parvum
EKQRI

SEQ ID NO: 2256283 - protein, 14 aa, Cryptosporidium parvum
EKQRKREKTGNSAV

SEQ ID NO: 2256284 - protein, 8 aa, Cryptosporidium parvum
EKQSELEK

SEQ ID NO: 2256285 - protein, 8 aa, Cryptosporidium parvum
EKQSIGDQ

SEQ ID NO: 2256286 - protein, 26 aa, Cryptosporidium parvum
EKQSMSNPQSKNTNTSNTNHKDSGLN

SEQ ID NO: 2256287 - protein, 5 aa, Cryptosporidium parvum
EKQSN

SEQ ID NO: 2256288 - protein, 10 aa, Cryptosporidium parvum
EKQSQIISQQ

SEQ ID NO: 2256289 - protein, 10 aa, Cryptosporidium parvum
EKQVAQQDAE

SEQ ID NO: 2256290 - protein, 13 aa, Cryptosporidium parvum
EKQYSGREESNKL

SEQ ID NO: 2256291 - protein, 12 aa, Cryptosporidium parvum
EKRAQKESNVIE

SEQ ID NO: 2256292 - protein, 6 aa, Cryptosporidium parvum
EKRASG

SEQ ID NO: 2256293 - protein, 7 aa, Cryptosporidium parvum
EKRDLEH

SEQ ID NO: 2256294 - protein, 7 aa, Cryptosporidium parvum
EKRDRKH

SEQ ID NO: 2256295 - protein, 11 aa, Cryptosporidium parvum
EKRDSYYKAGG

SEQ ID NO: 2256296 - protein, 10 aa, Cryptosporidium parvum
EKREDNEKPV

SEQ ID NO: 2256297 - protein, 6 aa, Cryptosporidium parvum
EKRGKY

SEQ ID NO: 2256298 - protein, 5 aa, Cryptosporidium parvum
EKRIP

SEQ ID NO: 2256299 - protein, 9 aa, Cryptosporidium parvum
EKRKNEISD

SEQ ID NO: 2256300 - protein, 17 aa, Cryptosporidium parvum
EKRKSDGVAKNIAKEDA

SEQ ID NO: 2256301 - protein, 5 aa, Cryptosporidium parvum
EKRLN

SEQ ID NO: 2256302 - protein, 4 aa, Cryptosporidium parvum
EKRN

SEQ ID NO: 2256303 - protein, 10 aa, Cryptosporidium parvum
EKRNPSESWE

SEQ ID NO: 2256304 - protein, 17 aa, Cryptosporidium parvum
EKRPDKKNKQNSKNNNN

SEQ ID NO: 2256305 - protein, 21 aa, Cryptosporidium parvum
EKRPKPQTTKTKSENNSEKTK

SEQ ID NO: 2256306 - protein, 16 aa, Cryptosporidium parvum
EKRRSISKKRSEEDLS

SEQ ID NO: 2256307 - protein, 12 aa, Cryptosporidium parvum
EKRSDRNSIKRK

SEQ ID NO: 2256308 - protein, 7 aa, Cryptosporidium parvum
EKRSQKI

SEQ ID NO: 2256309 - protein, 18 aa, Cryptosporidium parvum
EKRSSEDPRTPKCDTRLT

SEQ ID NO: 2256310 - protein, 9 aa, Cryptosporidium parvum
EKRTKDNIK

SEQ ID NO: 2256311 - protein, 12 aa, Cryptosporidium parvum
EKRVKSSKNNIT

SEQ ID NO: 2256312 - protein, 8 aa, Cryptosporidium parvum
EKSDEKFP

SEQ ID NO: 2256313 - protein, 5 aa, Cryptosporidium parvum
EKSDL

SEQ ID NO: 2256314 - protein, 7 aa, Cryptosporidium parvum
EKSEEQN

SEQ ID NO: 2256315 - protein, 14 aa, Cryptosporidium parvum
EKSELEEVERTNSL

SEQ ID NO: 2256316 - protein, 8 aa, Cryptosporidium parvum
EKSENNSL

SEQ ID NO: 2256317 - protein, 8 aa, Cryptosporidium parvum
EKSENSNF

SEQ ID NO: 2256318 - protein, 10 aa, Cryptosporidium parvum
EKSEVTAKSV

SEQ ID NO: 2256319 - protein, 6 aa, Cryptosporidium parvum
EKSEYD

SEQ ID NO: 2256320 - protein, 11 aa, Cryptosporidium parvum
EKSEYNESKPV

SEQ ID NO: 2256321 - protein, 6 aa, Cryptosporidium parvum
EKSEYY

SEQ ID NO: 2256322 - protein, 5 aa, Cryptosporidium parvum
EKSGE

SEQ ID NO: 2256323 - protein, 6 aa, Cryptosporidium parvum
EKSGYQ

SEQ ID NO: 2256324 - protein, 6 aa, Cryptosporidium parvum
EKSIPH

SEQ ID NO: 2256325 - protein, 17 aa, Cryptosporidium parvum
EKSIREAQSNKMPNKEL

SEQ ID NO: 2256326 - protein, 11 aa, Cryptosporidium parvum
EKSKANSKTLN

SEQ ID NO: 2256327 - protein, 9 aa, Cryptosporidium parvum
EKSKGRLSV

SEQ ID NO: 2256328 - protein, 7 aa, Cryptosporidium parvum
EKSKIEE

SEQ ID NO: 2256329 - protein, 12 aa, Cryptosporidium parvum
EKSKQSPIHFSY

SEQ ID NO: 2256330 - protein, 11 aa, Cryptosporidium parvum
EKSKSGKSSFV

SEQ ID NO: 2256331 - protein, 8 aa, Cryptosporidium parvum
EKSKSQVV

SEQ ID NO: 2256332 - protein, 5 aa, Cryptosporidium parvum
EKSKW

SEQ ID NO: 2256333 - protein, 4 aa, Cryptosporidium parvum
EKSL

SEQ ID NO: 2256334 - protein, 5 aa, Cryptosporidium parvum
EKSLQ

SEQ ID NO: 2256335 - protein, 8 aa, Cryptosporidium parvum
EKSNSELE

SEQ ID NO: 2256336 - protein, 8 aa, Cryptosporidium parvum
EKSNTINS

SEQ ID NO: 2256337 - protein, 7 aa, Cryptosporidium parvum
EKSPKLL

SEQ ID NO: 2256338 - protein, 7 aa, Cryptosporidium parvum
EKSQSGI

SEQ ID NO: 2256339 - protein, 8 aa, Cryptosporidium parvum
EKSQSNVS

SEQ ID NO: 2256340 - protein, 6 aa, Cryptosporidium parvum
EKSQST

SEQ ID NO: 2256341 - protein, 14 aa, Cryptosporidium parvum
EKSRHSNQNITTKT

SEQ ID NO: 2256342 - protein, 12 aa, Cryptosporidium parvum
EKSRLKKDEQIS

SEQ ID NO: 2256343 - protein, 13 aa, Cryptosporidium parvum
EKSRSKNNGFSGN

SEQ ID NO: 2256344 - protein, 8 aa, Cryptosporidium parvum
EKSSEQLS

SEQ ID NO: 2256345 - protein, 23 aa, Cryptosporidium parvum
EKSSKNENNPENVNEKKNNKSIT

SEQ ID NO: 2256346 - protein, 19 aa, Cryptosporidium parvum
EKSSKTYKKENSEDNGEHL

SEQ ID NO: 2256347 - protein, 13 aa, Cryptosporidium parvum
EKSSLGKNNVETP

SEQ ID NO: 2256348 - protein, 6 aa, Cryptosporidium parvum
EKSSNV

SEQ ID NO: 2256349 - protein, 13 aa, Cryptosporidium parvum
EKSSQNSDLSLSN

SEQ ID NO: 2256350 - protein, 7 aa, Cryptosporidium parvum
EKSSQVD

SEQ ID NO: 2256351 - protein, 8 aa, Cryptosporidium parvum
EKSSTQQL

SEQ ID NO: 2256352 - protein, 8 aa, Cryptosporidium parvum
EKSTARGG

SEQ ID NO: 2256353 - protein, 9 aa, Cryptosporidium parvum
EKSTGNSVQ

SEQ ID NO: 2256354 - protein, 19 aa, Cryptosporidium parvum
EKSTYGECEDRTKSLSFSS

SEQ ID NO: 2256355 - protein, 8 aa, Cryptosporidium parvum
EKSVPIET

SEQ ID NO: 2256356 - protein, 8 aa, Cryptosporidium parvum
EKSVREPS

SEQ ID NO: 2256357 - protein, 4 aa, Cryptosporidium parvum
EKSY

SEQ ID NO: 2256358 - protein, 16 aa, Cryptosporidium parvum
EKSYWNDKSENKISGN

SEQ ID NO: 2256359 - protein, 16 aa, Cryptosporidium parvum
EKTDDSSKKGPQLSLK

SEQ ID NO: 2256360 - protein, 6 aa, Cryptosporidium parvum
EKTEDL

SEQ ID NO: 2256361 - protein, 15 aa, Cryptosporidium parvum
EKTEWDNPPSSYGRK

SEQ ID NO: 2256362 - protein, 8 aa, Cryptosporidium parvum
EKTGKETE

SEQ ID NO: 2256363 - protein, 7 aa, Cryptosporidium parvum
EKTGRID

SEQ ID NO: 2256364 - protein, 5 aa, Cryptosporidium parvum
EKTGS

SEQ ID NO: 2256365 - protein, 4 aa, Cryptosporidium parvum
EKTH

SEQ ID NO: 2256366 - protein, 6 aa, Cryptosporidium parvum
EKTHID

SEQ ID NO: 2256367 - protein, 7 aa, Cryptosporidium parvum
EKTIGKL

SEQ ID NO: 2256368 - protein, 9 aa, Cryptosporidium parvum
EKTKEMSEK

SEQ ID NO: 2256369 - protein, 10 aa, Cryptosporidium parvum
EKTKGRPNYS

SEQ ID NO: 2256370 - protein, 6 aa, Cryptosporidium parvum
EKTKNA

SEQ ID NO: 2256371 - protein, 28 aa, Cryptosporidium parvum
EKTKQKELERDIEQSSAYRSKANLERTR

SEQ ID NO: 2256372 - protein, 7 aa, Cryptosporidium parvum
EKTNIEQ

SEQ ID NO: 2256373 - protein, 6 aa, Cryptosporidium parvum
EKTNNQ

SEQ ID NO: 2256374 - protein, 8 aa, Cryptosporidium parvum
EKTNPTIS

SEQ ID NO: 2256375 - protein, 6 aa, Cryptosporidium parvum
EKTNTV

SEQ ID NO: 2256376 - protein, 5 aa, Cryptosporidium parvum
EKTQL

SEQ ID NO: 2256377 - protein, 11 aa, Cryptosporidium parvum
EKTSKDESTLD

SEQ ID NO: 2256378 - protein, 23 aa, Cryptosporidium parvum
EKTSQYNGIEDEGKSSESEDSSF

SEQ ID NO: 2256379 - protein, 48 aa, Cryptosporidium parvum; identical to SEQ ID NO: 2140373

SEQ ID NO: 2256380 - protein, 14 aa, Cryptosporidium parvum
EKTTEKSSKYVKTP

SEQ ID NO: 2256381 - protein, 9 aa, Cryptosporidium parvum
EKTTGRSRG

SEQ ID NO: 2256382 - protein, 8 aa, Cryptosporidium parvum
EKTTMNDI

SEQ ID NO: 2256383 - protein, 25 aa, Cryptosporidium parvum
EKTTSESENTAKSSMFSGNKNDEIT

SEQ ID NO: 2256384 - protein, 7 aa, Cryptosporidium parvum
EKTTYSP

SEQ ID NO: 2256385 - protein, 22 aa, Cryptosporidium parvum
EKTVKGHSSYSSYSTSIGASHT

SEQ ID NO: 2256386 - protein, 5 aa, Cryptosporidium parvum
EKTYV

SEQ ID NO: 2256387 - protein, 7 aa, Cryptosporidium parvum
EKVDAGL

SEQ ID NO: 2256388 - protein, 16 aa, Cryptosporidium parvum
EKVEKIASQGNPEDRS

SEQ ID NO: 2256389 - protein, 13 aa, Cryptosporidium parvum
EKVEKKSSETGID

SEQ ID NO: 2256390 - protein, 12 aa, Cryptosporidium parvum
EKVETGTARSSC

SEQ ID NO: 2256391 - protein, 8 aa, Cryptosporidium parvum
EKVGEGSW

SEQ ID NO: 2256392 - protein, 7 aa, Cryptosporidium parvum
EKVGQQG

SEQ ID NO: 2256393 - protein, 22 aa, Cryptosporidium parvum
EKVKESEEQTSKNEESPNPNYS

SEQ ID NO: 2256394 - protein, 7 aa, Cryptosporidium parvum
EKVKGNE

SEQ ID NO: 2256395 - protein, 9 aa, Cryptosporidium parvum
EKVNEQNEA

SEQ ID NO: 2256396 - protein, 12 aa, Cryptosporidium parvum
EKVNGEGNSRGE

SEQ ID NO: 2256397 - protein, 16 aa, Cryptosporidium parvum
EKVRDDELEQREIEEH

SEQ ID NO: 2256398 - protein, 4 aa, Cryptosporidium parvum
EKVS

SEQ ID NO: 2256399 - protein, 20 aa, Cryptosporidium parvum
EKVSKKDKEIYKPKKIKPDD

SEQ ID NO: 2256400 - protein, 7 aa, Cryptosporidium parvum
EKVSTLT

SEQ ID NO: 2256401 - protein, 4 aa, Cryptosporidium parvum
EKWR

SEQ ID NO: 2256402 - protein, 9 aa, Cryptosporidium parvum
EKYDGSQSS

SEQ ID NO: 2256403 - protein, 5 aa, Cryptosporidium parvum
EKYED

SEQ ID NO: 2256404 - protein, 6 aa, Cryptosporidium parvum
EKYGNF

SEQ ID NO: 2256405 - protein, 8 aa, Cryptosporidium parvum
EKYGQQNN

SEQ ID NO: 2256406 - protein, 15 aa, Cryptosporidium parvum
EKYKTKSSIKEQRIE

SEQ ID NO: 2256407 - protein, 4 aa, Cryptosporidium parvum
EKYM

SEQ ID NO: 2256408 - protein, 4 aa, Cryptosporidium parvum
EKYN

SEQ ID NO: 2256409 - protein, 21 aa, Cryptosporidium parvum
EKYNNNSQSNPHSQREDNENI

SEQ ID NO: 2256410 - protein, 7 aa, Cryptosporidium parvum
EKYNQQS

SEQ ID NO: 2256411 - protein, 4 aa, Cryptosporidium parvum
EKYP

SEQ ID NO: 2256412 - protein, 5 aa, Cryptosporidium parvum
EKYPE

SEQ ID NO: 2256413 - protein, 6 aa, Cryptosporidium parvum
EKYPGT

SEQ ID NO: 2256414 - protein, 26 aa, Cryptosporidium parvum
EKYPPKSTSNSNNTAAAFKDSSPKVL

SEQ ID NO: 2256415 - protein, 18 aa, Cryptosporidium parvum
EKYRENTKCEKNCESDEN

SEQ ID NO: 2256416 - protein, 11 aa, Cryptosporidium parvum
EKYYQYSSPCN

SEQ ID NO: 2256417 - protein, 11 aa, Cryptosporidium parvum
ELAQSEAHYDQ

SEQ ID NO: 2256418 - protein, 7 aa, Cryptosporidium parvum
ELARSES

SEQ ID NO: 2256419 - protein, 12 aa, Cryptosporidium parvum
ELDDPSNEEHQN

SEQ ID NO: 2256420 - protein, 4 aa, Cryptosporidium parvum
ELDE

SEQ ID NO: 2256421 - protein, 9 aa, Cryptosporidium parvum
ELDEDQKSI

SEQ ID NO: 2256422 - protein, 9 aa, Cryptosporidium parvum
ELDENGKQL

SEQ ID NO: 2256423 - protein, 29 aa, Cryptosporidium parvum
ELDESRKALKEERESQDARRSQVAHQESR

SEQ ID NO: 2256424 - protein, 8 aa, Cryptosporidium parvum
ELDNEEAC

SEQ ID NO: 2256425 - protein, 8 aa, Cryptosporidium parvum
ELDPSQGI

SEQ ID NO: 2256426 - protein, 12 aa, Cryptosporidium parvum
ELDQNNSIQDVS

SEQ ID NO: 2256427 - protein, 41 aa, Cryptosporidium parvum; identical to SEQ ID NO: 2140410

SEQ ID NO: 2256428 - protein, 7 aa, Cryptosporidium parvum
ELDYEEE

SEQ ID NO: 2256429 - protein, 19 aa, Cryptosporidium parvum
ELEASIKTKNSLKVSSKID

SEQ ID NO: 2256430 - protein, 38 aa, Cryptosporidium parvum
ELEEEEEEEEEEEEEEDEEEEEEEEDEDDDDELEEEEL

SEQ ID NO: 2256431 - protein, 17 aa, Cryptosporidium parvum
ELEEEKEEEGEEGSPNE

SEQ ID NO: 2256432 - protein, 7 aa, Cryptosporidium parvum
ELEETKS

SEQ ID NO: 2256433 - protein, 5 aa, Cryptosporidium parvum
ELEHS

SEQ ID NO: 2256434 - protein, 4 aa, Cryptosporidium parvum
ELEK

SEQ ID NO: 2256435 - protein, 5 aa, Cryptosporidium parvum
ELEKE

SEQ ID NO: 2256436 - protein, 12 aa, Cryptosporidium parvum
ELENGKAEYDRL

SEQ ID NO: 2256437 - protein, 12 aa, Cryptosporidium parvum
ELENMSSSTISN

SEQ ID NO: 2256438 - protein, 4 aa, Cryptosporidium parvum
ELEP

SEQ ID NO: 2256439 - protein, 11 aa, Cryptosporidium parvum
ELEPPSEREED

SEQ ID NO: 2256440 - protein, 25 aa, Cryptosporidium parvum
ELEQEELEEEEKEQQKEQENEGSKN

SEQ ID NO: 2256441 - protein, 6 aa, Cryptosporidium parvum
ELESGK

SEQ ID NO: 2256442 - protein, 17 aa, Cryptosporidium parvum
ELESIKEKNDERTGNRS

SEQ ID NO: 2256443 - protein, 12 aa, Cryptosporidium parvum
ELESRDLDANSF

SEQ ID NO: 2256444 - protein, 13 aa, Cryptosporidium parvum
ELETGEDTKVKSV

SEQ ID NO: 2256445 - protein, 5 aa, Cryptosporidium parvum
ELGDK

SEQ ID NO: 2256446 - protein, 8 aa, Cryptosporidium parvum
ELGDQESM

SEQ ID NO: 2256447 - protein, 10 aa, Cryptosporidium parvum
ELGENISDEE

SEQ ID NO: 2256448 - protein, 5 aa, Cryptosporidium parvum
ELGKS

SEQ ID NO: 2256449 - protein, 10 aa, Cryptosporidium parvum
ELGKSNPEIY

SEQ ID NO: 2256450 - protein, 5 aa, Cryptosporidium parvum
ELGPV

SEQ ID NO: 2256451 - protein, 5 aa, Cryptosporidium parvum
ELGRK

SEQ ID NO: 2256452 - protein, 9 aa, Cryptosporidium parvum
ELGSNRSSI

SEQ ID NO: 2256453 - protein, 7 aa, Cryptosporidium parvum
ELGTAKG

SEQ ID NO: 2256454 - protein, 5 aa, Cryptosporidium parvum
ELKCD

SEQ ID NO: 2256455 - protein, 7 aa, Cryptosporidium parvum
ELKDSPD

SEQ ID NO: 2256456 - protein, 6 aa, Cryptosporidium parvum
ELKEEK

SEQ ID NO: 2256457 - protein, 13 aa, Cryptosporidium parvum
ELKGSSSSRIDAD

SEQ ID NO: 2256458 - protein, 4 aa, Cryptosporidium parvum
ELKK

SEQ ID NO: 2256459 - protein, 19 aa, Cryptosporidium parvum
ELKKTQDQRVQQLKDDREK

SEQ ID NO: 2256460 - protein, 4 aa, Cryptosporidium parvum
ELKN

SEQ ID NO: 2256461 - protein, 16 aa, Cryptosporidium parvum
ELKNASKKRKRETINT

SEQ ID NO: 2256462 - protein, 6 aa, Cryptosporidium parvum
ELKNGT

SEQ ID NO: 2256463 - protein, 8 aa, Cryptosporidium parvum
ELKNQKRA

SEQ ID NO: 2256464 - protein, 9 aa, Cryptosporidium parvum
ELKQNNFSD

SEQ ID NO: 2256465 - protein, 11 aa, Cryptosporidium parvum
ELKSKDSQQCP

SEQ ID NO: 2256466 - protein, 14 aa, Cryptosporidium parvum
ELKSPSAYKSASGH

SEQ ID NO: 2256467 - protein, 9 aa, Cryptosporidium parvum
ELKSSNEKQ

SEQ ID NO: 2256468 - protein, 11 aa, Cryptosporidium parvum
ELKTEQDSFPI

SEQ ID NO: 2256469 - protein, 9 aa, Cryptosporidium parvum
ELNATQEAV

SEQ ID NO: 2256470 - protein, 14 aa, Cryptosporidium parvum
ELNDPSNAITDSES

SEQ ID NO: 2256471 - protein, 9 aa, Cryptosporidium parvum
ELNDSVSSA

SEQ ID NO: 2256472 - protein, 4 aa, Cryptosporidium parvum
ELNE

SEQ ID NO: 2256473 - protein, 12 aa, Cryptosporidium parvum
ELNEKKKSLDSL

SEQ ID NO: 2256474 - protein, 6 aa, Cryptosporidium parvum
ELNGKE

SEQ ID NO: 2256475 - protein, 9 aa, Cryptosporidium parvum
ELNGTGPHK

SEQ ID NO: 2256476 - protein, 33 aa, Cryptosporidium parvum; identical to SEQ ID NO: 2140447

SEQ ID NO: 2256477 - protein, 11 aa, Cryptosporidium parvum
ELNKTDKGVSV

SEQ ID NO: 2256478 - protein, 7 aa, Cryptosporidium parvum
ELNNRSE

SEQ ID NO: 2256479 - protein, 20 aa, Cryptosporidium parvum
ELNNSEDDGYESSENEDNEI

SEQ ID NO: 2256480 - protein, 7 aa, Cryptosporidium parvum
ELNPDEE

SEQ ID NO: 2256481 - protein, 43 aa, Cryptosporidium parvum
ELNQESKPEVEKEGIDKVEEENSKTVNENHDDDQNSKSASSGL

SEQ ID NO: 2256482 - protein, 18 aa, Cryptosporidium parvum
ELNSDTAEMKNSGNLPPI

SEQ ID NO: 2256483 - protein, 14 aa, Cryptosporidium parvum
ELNSGGASKGGGST

SEQ ID NO: 2256484 - protein, 9 aa, Cryptosporidium parvum
ELNSNQKGE

SEQ ID NO: 2256485 - protein, 11 aa, Cryptosporidium parvum
ELNSPNKSINP

SEQ ID NO: 2256486 - protein, 17 aa, Cryptosporidium parvum
ELNTQEESNKEDENRYP

SEQ ID NO: 2256487 - protein, 4 aa, Cryptosporidium parvum
ELPE

SEQ ID NO: 2256488 - protein, 6 aa, Cryptosporidium parvum
ELPGGE

SEQ ID NO: 2256489 - protein, 39 aa, Cryptosporidium parvum
ELPPPPPSEELPPPPPPSEELPPPPPPSSGELPPPLPPS

SEQ ID NO: 2256490 - protein, 5 aa, Cryptosporidium parvum
ELPPT

SEQ ID NO: 2256491 - protein, 10 aa, Cryptosporidium parvum
ELPRDKSEDY

SEQ ID NO: 2256492 - protein, 10 aa, Cryptosporidium parvum
ELPRSENLEQ

SEQ ID NO: 2256493 - protein, 5 aa, Cryptosporidium parvum
ELPSS

SEQ ID NO: 2256494 - protein, 20 aa, Cryptosporidium parvum
ELPYASKTKNDSKKIKDKNQ

SEQ ID NO: 2256495 - protein, 12 aa, Cryptosporidium parvum
ELQDRENDTIKE

SEQ ID NO: 2256496 - protein, 19 aa, Cryptosporidium parvum
ELQKNISDQAQKQHEEKKR

SEQ ID NO: 2256497 - protein, 16 aa, Cryptosporidium parvum
ELQKQKKIREEMEREE

SEQ ID NO: 2256498 - protein, 18 aa, Cryptosporidium parvum
ELQNGTDNSFGAPGPNNI

SEQ ID NO: 2256499 - protein, 14 aa, Cryptosporidium parvum
ELQRQEDELASNIF

SEQ ID NO: 2256500 - protein, 6 aa, Cryptosporidium parvum
ELQSQS

SEQ ID NO: 2256501 - protein, 5 aa, Cryptosporidium parvum
ELQTE

SEQ ID NO: 2256502 - protein, 10 aa, Cryptosporidium parvum
ELRDEEKYKK

SEQ ID NO: 2256503 - protein, 13 aa, Cryptosporidium parvum
ELRDGDEKRYLGK

SEQ ID NO: 2256504 - protein, 5 aa, Cryptosporidium parvum
ELRDI

SEQ ID NO: 2256505 - protein, 5 aa, Cryptosporidium parvum
ELRGM

SEQ ID NO: 2256506 - protein, 4 aa, Cryptosporidium parvum
ELRN

SEQ ID NO: 2256507 - protein, 10 aa, Cryptosporidium parvum
ELRRKYDSSI

SEQ ID NO: 2256508 - protein, 9 aa, Cryptosporidium parvum
ELRSKNDNC

SEQ ID NO: 2256509 - protein, 8 aa, Cryptosporidium parvum
ELSAPEKD

SEQ ID NO: 2256510 - protein, 15 aa, Cryptosporidium parvum
ELSDEKRRSKTREMS

SEQ ID NO: 2256511 - protein, 14 aa, Cryptosporidium parvum
ELSDRQQHITNNQN

SEQ ID NO: 2256512 - protein, 12 aa, Cryptosporidium parvum
ELSDSDNSKPDF

SEQ ID NO: 2256513 - protein, 6 aa, Cryptosporidium parvum
ELSEEN

SEQ ID NO: 2256514 - protein, 18 aa, Cryptosporidium parvum
ELSEKQSRIRSKKLDKDQ

SEQ ID NO: 2256515 - protein, 5 aa, Cryptosporidium parvum
ELSEN

SEQ ID NO: 2256516 - protein, 27 aa, Cryptosporidium parvum
ELSESLTSKSSLFDSGNLDKEKNSVGH

SEQ ID NO: 2256517 - protein, 9 aa, Cryptosporidium parvum
ELSKKDDSY

SEQ ID NO: 2256518 - protein, 11 aa, Cryptosporidium parvum
ELSKSKSSLER

SEQ ID NO: 2256519 - protein, 13 aa, Cryptosporidium parvum
ELSKSTGGTKTSL

SEQ ID NO: 2256520 - protein, 8 aa, Cryptosporidium parvum
ELSKTNNE

SEQ ID NO: 2256521 - protein, 12 aa, Cryptosporidium parvum
ELSNKAASNLHT

SEQ ID NO: 2256522 - protein, 16 aa, Cryptosporidium parvum
ELSPENSDTEGSEYGE

SEQ ID NO: 2256523 - protein, 4 aa, Cryptosporidium parvum
ELSR

SEQ ID NO: 2256524 - protein, 15 aa, Cryptosporidium parvum
ELSRVESSAGISDSD

SEQ ID NO: 2256525 - protein, 23 aa, Cryptosporidium parvum
ELSSEEKVQDQTKKVENSKNEFN

SEQ ID NO: 2256526 - protein, 6 aa, Cryptosporidium parvum
ELSSNQ

SEQ ID NO: 2256527 - protein, 28 aa, Cryptosporidium parvum
ELSSSGSSTVSSSSMTDAFPTSQSSSSL

SEQ ID NO: 2256528 - protein, 5 aa, Cryptosporidium parvum
ELSTE

SEQ ID NO: 2256529 - protein, 5 aa, Cryptosporidium parvum
ELTED

SEQ ID NO: 2256530 - protein, 21 aa, Cryptosporidium parvum
ELTEEDSDGGKGVYKAPKNLP

SEQ ID NO: 2256531 - protein, 6 aa, Cryptosporidium parvum
ELTERK

SEQ ID NO: 2256532 - protein, 5 aa, Cryptosporidium parvum
ELTEV

SEQ ID NO: 2256533 - protein, 10 aa, Cryptosporidium parvum
ELTPSSQCAQ

SEQ ID NO: 2256534 - protein, 7 aa, Cryptosporidium parvum
ELTQQDS

SEQ ID NO: 2256535 - protein, 4 aa, Cryptosporidium parvum
ELVK

SEQ ID NO: 2256536 - protein, 10 aa, Cryptosporidium parvum
EMDEEEDEKH

SEQ ID NO: 2256537 - protein, 5 aa, Cryptosporidium parvum
EMDYE

SEQ ID NO: 2256538 - protein, 6 aa, Cryptosporidium parvum
EMEDDG

SEQ ID NO: 2256539 - protein, 5 aa, Cryptosporidium parvum
EMEES

SEQ ID NO: 2256540 - protein, 6 aa, Cryptosporidium parvum
EMENAR

SEQ ID NO: 2256541 - protein, 7 aa, Cryptosporidium parvum
EMENEDM

SEQ ID NO: 2256542 - protein, 9 aa, Cryptosporidium parvum
EMGDIKNKD

SEQ ID NO: 2256543 - protein, 14 aa, Cryptosporidium parvum
EMGENTENASYDGN

SEQ ID NO: 2256544 - protein, 7 aa, Cryptosporidium parvum
EMGRKDQ

SEQ ID NO: 2256545 - protein, 5 aa, Cryptosporidium parvum
EMGSR

SEQ ID NO: 2256546 - protein, 4 aa, Cryptosporidium parvum
EMIE

SEQ ID NO: 2256547 - protein, 20 aa, Cryptosporidium parvum
EMKDSTKSTSTLKNNSKSRI

SEQ ID NO: 2256548 - protein, 5 aa, Cryptosporidium parvum
EMKEL

SEQ ID NO: 2256549 - protein, 8 aa, Cryptosporidium parvum
EMKGNKSM

SEQ ID NO: 2256550 - protein, 21 aa, Cryptosporidium parvum
EMKKANDDRSSNKTKDSNEFL

SEQ ID NO: 2256551 - protein, 6 aa, Cryptosporidium parvum
EMKKQN

SEQ ID NO: 2256552 - protein, 9 aa, Cryptosporidium parvum
EMKNTAVDG

SEQ ID NO: 2256553 - protein, 11 aa, Cryptosporidium parvum
EMNGSEKRMTT

SEQ ID NO: 2256554 - protein, 6 aa, Cryptosporidium parvum
EMQTST

SEQ ID NO: 2256555 - protein, 11 aa, Cryptosporidium parvum
EMSGSLSREAD

SEQ ID NO: 2256556 - protein, 10 aa, Cryptosporidium parvum
EMTPYEKTTT

SEQ ID NO: 2256557 - protein, 4 aa, Cryptosporidium parvum
EMTS

SEQ ID NO: 2256558 - protein, 7 aa, Cryptosporidium parvum
ENAASLT

SEQ ID NO: 2256559 - protein, 6 aa, Cryptosporidium parvum
ENADFT

SEQ ID NO: 2256560 - protein, 7 aa, Cryptosporidium parvum
ENADGSA

SEQ ID NO: 2256561 - protein, 13 aa, Cryptosporidium parvum
ENADVSSRESTPQ

SEQ ID NO: 2256562 - protein, 23 aa, Cryptosporidium parvum
ENAEHEKKLEKKEEISEEDAKKM

SEQ ID NO: 2256563 - protein, 11 aa, Cryptosporidium parvum
ENAESLNNQNL

SEQ ID NO: 2256564 - protein, 5 aa, Cryptosporidium parvum
ENAEV

SEQ ID NO: 2256565 - protein, 6 aa, Cryptosporidium parvum
ENAKHE

SEQ ID NO: 2256566 - protein, 5 aa, Cryptosporidium parvum
ENAKV

SEQ ID NO: 2256567 - protein, 8 aa, Cryptosporidium parvum
ENANNGEK

SEQ ID NO: 2256568 - protein, 6 aa, Cryptosporidium parvum
ENANRE

SEQ ID NO: 2256569 - protein, 6 aa, Cryptosporidium parvum
ENAQDT

SEQ ID NO: 2256570 - protein, 9 aa, Cryptosporidium parvum
ENASASDKK

SEQ ID NO: 2256571 - protein, 8 aa, Cryptosporidium parvum
ENASGKQI

SEQ ID NO: 2256572 - protein, 9 aa, Cryptosporidium parvum
ENASITSVK

SEQ ID NO: 2256573 - protein, 4 aa, Cryptosporidium parvum
ENAT

SEQ ID NO: 2256574 - protein, 6 aa, Cryptosporidium parvum
ENATKP

SEQ ID NO: 2256575 - protein, 33 aa, Cryptosporidium parvum
ENAVEGKKKTKLQPYKRNNSGENNNCRESKPYL

SEQ ID NO: 2256576 - protein, 7 aa, Cryptosporidium parvum
ENAVNTS

SEQ ID NO: 2256577 - protein, 4 aa, Cryptosporidium parvum
ENCN

SEQ ID NO: 2256578 - protein, 8 aa, Cryptosporidium parvum
ENCNYSAP

SEQ ID NO: 2256579 - protein, 11 aa, Cryptosporidium parvum
ENCSGDDKRAL

SEQ ID NO: 2256580 - protein, 10 aa, Cryptosporidium parvum
ENDAKLGGKK

SEQ ID NO: 2256581 - protein, 5 aa, Cryptosporidium parvum
ENDDA

SEQ ID NO: 2256582 - protein, 11 aa, Cryptosporidium parvum
ENDDDSIGKAP

SEQ ID NO: 2256583 - protein, 15 aa, Cryptosporidium parvum
ENDDDSSPGKKKAKS

SEQ ID NO: 2256584 - protein, 6 aa, Cryptosporidium parvum
ENDDQH

SEQ ID NO: 2256585 - protein, 16 aa, Cryptosporidium parvum
ENDDSEDQQSPDVSDE

SEQ ID NO: 2256586 - protein, 4 aa, Cryptosporidium parvum
ENDE

SEQ ID NO: 2256587 - protein, 11 aa, Cryptosporidium parvum
ENDENEQEEGL

SEQ ID NO: 2256588 - protein, 8 aa, Cryptosporidium parvum
ENDEPNYN

SEQ ID NO: 2256589 - protein, 7 aa, Cryptosporidium parvum
ENDHNSD

SEQ ID NO: 2256590 - protein, 4 aa, Cryptosporidium parvum
ENDK

SEQ ID NO: 2256591 - protein, 7 aa, Cryptosporidium parvum
ENDKDFT

SEQ ID NO: 2256592 - protein, 9 aa, Cryptosporidium parvum
ENDKESQKR

SEQ ID NO: 2256593 - protein, 10 aa, Cryptosporidium parvum
ENDKNHQSDV

SEQ ID NO: 2256594 - protein, 36 aa, Cryptosporidium parvum
ENDKNNNQIRPSKMKRKETHKNDLKNGSIEEITKPK

SEQ ID NO: 2256595 - protein, 11 aa, Cryptosporidium parvum
ENDKSVQEKMR

SEQ ID NO: 2256596 - protein, 14 aa, Cryptosporidium parvum
ENDLEQSQNVNSTA

SEQ ID NO: 2256597 - protein, 14 aa, Cryptosporidium parvum
ENDLNNYDNNRFGP

SEQ ID NO: 2256598 - protein, 8 aa, Cryptosporidium parvum
ENDNDDNY

SEQ ID NO: 2256599 - protein, 5 aa, Cryptosporidium parvum
ENDNS

SEQ ID NO: 2256600 - protein, 16 aa, Cryptosporidium parvum
ENDNSGVDQNNAEDRT

SEQ ID NO: 2256601 - protein, 12 aa, Cryptosporidium parvum
ENDNVEDDDEEG

SEQ ID NO: 2256602 - protein, 13 aa, Cryptosporidium parvum
ENDQDDPEKLLYL

SEQ ID NO: 2256603 - protein, 6 aa, Cryptosporidium parvum
ENDQKN

SEQ ID NO: 2256604 - protein, 9 aa, Cryptosporidium parvum
ENDQQHETC

SEQ ID NO: 2256605 - protein, 7 aa, Cryptosporidium parvum
ENDQSIN

SEQ ID NO: 2256606 - protein, 4 aa, Cryptosporidium parvum
ENDS

SEQ ID NO: 2256607 - protein, 6 aa, Cryptosporidium parvum
ENDSDF

SEQ ID NO: 2256608 - protein, 16 aa, Cryptosporidium parvum
ENDSFNSNNKDGNSKG

SEQ ID NO: 2256609 - protein, 8 aa, Cryptosporidium parvum
ENDSKPKV

SEQ ID NO: 2256610 - protein, 6 aa, Cryptosporidium parvum
ENDSLR

SEQ ID NO: 2256611 - protein, 9 aa, Cryptosporidium parvum
ENDSNDSGY

SEQ ID NO: 2256612 - protein, 25 aa, Cryptosporidium parvum
ENDSSTGTSAGVDNKGAYKKDSIPC

SEQ ID NO: 2256613 - protein, 12 aa, Cryptosporidium parvum
ENDSYSEEDNIG

SEQ ID NO: 2256614 - protein, 6 aa, Cryptosporidium parvum
ENDTFE

SEQ ID NO: 2256615 - protein, 6 aa, Cryptosporidium parvum
ENDTVR

SEQ ID NO: 2256616 - protein, 7 aa, Cryptosporidium parvum
ENDVSTE

SEQ ID NO: 2256617 - protein, 6 aa, Cryptosporidium parvum
ENDYRD

SEQ ID NO: 2256618 - protein, 7 aa, Cryptosporidium parvum
ENEADED

SEQ ID NO: 2256619 - protein, 6 aa, Cryptosporidium parvum
ENEAPG

SEQ ID NO: 2256620 - protein, 8 aa, Cryptosporidium parvum
ENEARDKK

SEQ ID NO: 2256621 - protein, 14 aa, Cryptosporidium parvum
ENECKKENKDSTID

SEQ ID NO: 2256622 - protein, 4 aa, Cryptosporidium parvum
ENED

SEQ ID NO: 2256623 - protein, 23 aa, Cryptosporidium parvum
ENEDPSSKITDIGGEGNVTTMGG

SEQ ID NO: 2256624 - protein, 8 aa, Cryptosporidium parvum
ENEDSSSL

SEQ ID NO: 2256625 - protein, 14 aa, Cryptosporidium parvum
ENEEIQIQSTTSRS

SEQ ID NO: 2256626 - protein, 7 aa, Cryptosporidium parvum
ENEELGN

SEQ ID NO: 2256627 - protein, 15 aa, Cryptosporidium parvum
ENEELRSKLELTRTT

SEQ ID NO: 2256628 - protein, 7 aa, Cryptosporidium parvum
ENEENKV

SEQ ID NO: 2256629 - protein, 6 aa, Cryptosporidium parvum
ENEETC

SEQ ID NO: 2256630 - protein, 5 aa, Cryptosporidium parvum
ENEEY

SEQ ID NO: 2256631 - protein, 5 aa, Cryptosporidium parvum
ENEGI

SEQ ID NO: 2256632 - protein, 4 aa, Cryptosporidium parvum
ENEI

SEQ ID NO: 2256633 - protein, 10 aa, Cryptosporidium parvum
ENEIGAKESM

SEQ ID NO: 2256634 - protein, 4 aa, Cryptosporidium parvum
ENEK

SEQ ID NO: 2256635 - protein, 8 aa, Cryptosporidium parvum
ENEKDRIN

SEQ ID NO: 2256636 - protein, 9 aa, Cryptosporidium parvum
ENEKIKDNS

SEQ ID NO: 2256637 - protein, 8 aa, Cryptosporidium parvum
ENEKKTSE

SEQ ID NO: 2256638 - protein, 8 aa, Cryptosporidium parvum
ENEKSIEV

SEQ ID NO: 2256639 - protein, 16 aa, Cryptosporidium parvum
ENEKSKELSSDDNQSI

SEQ ID NO: 2256640 - protein, 6 aa, Cryptosporidium parvum
ENEKSY

SEQ ID NO: 2256641 - protein, 4 aa, Cryptosporidium parvum
ENEL

SEQ ID NO: 2256642 - protein, 6 aa, Cryptosporidium parvum
ENELNK

SEQ ID NO: 2256643 - protein, 31 aa, Cryptosporidium parvum
ENELQQEDNSRNKRREEKKYQRSNHPSKTPE

SEQ ID NO: 2256644 - protein, 11 aa, Cryptosporidium parvum
ENELSKKNIRT

SEQ ID NO: 2256645 - protein, 12 aa, Cryptosporidium parvum
ENEMAESEEEVI

SEQ ID NO: 2256646 - protein, 10 aa, Cryptosporidium parvum
ENENEDGDEA

SEQ ID NO: 2256647 - protein, 10 aa, Cryptosporidium parvum
ENENENPNIK

SEQ ID NO: 2256648 - protein, 5 aa, Cryptosporidium parvum
ENENF

SEQ ID NO: 2256649 - protein, 10 aa, Cryptosporidium parvum
ENENLRQRHR

SEQ ID NO: 2256650 - protein, 9 aa, Cryptosporidium parvum
ENENSNNQI

SEQ ID NO: 2256651 - protein, 9 aa, Cryptosporidium parvum
ENEPKTPSI

SEQ ID NO: 2256652 - protein, 6 aa, Cryptosporidium parvum
ENEPNM

SEQ ID NO: 2256653 - protein, 4 aa, Cryptosporidium parvum
ENEQ

SEQ ID NO: 2256654 - protein, 23 aa, Cryptosporidium parvum
ENEQEQEQEQEQEQEQKQELSQK

SEQ ID NO: 2256655 - protein, 21 aa, Cryptosporidium parvum
ENEQSDNVKVQNSSNSSQKEV

SEQ ID NO: 2256656 - protein, 6 aa, Cryptosporidium parvum
ENERNY

SEQ ID NO: 2256657 - protein, 11 aa, Cryptosporidium parvum
ENERSGSDEEI

SEQ ID NO: 2256658 - protein, 7 aa, Cryptosporidium parvum
ENESEEF

SEQ ID NO: 2256659 - protein, 10 aa, Cryptosporidium parvum
ENESKEIPKS

SEQ ID NO: 2256660 - protein, 7 aa, Cryptosporidium parvum
ENESLNN

SEQ ID NO: 2256661 - protein, 10 aa, Cryptosporidium parvum
ENESTSIYND

SEQ ID NO: 2256662 - protein, 4 aa, Cryptosporidium parvum
ENET

SEQ ID NO: 2256663 - protein, 9 aa, Cryptosporidium parvum
ENETPGNKE

SEQ ID NO: 2256664 - protein, 9 aa, Cryptosporidium parvum
ENEYGREQS

SEQ ID NO: 2256665 - protein, 6 aa, Cryptosporidium parvum
ENEYSN

SEQ ID NO: 2256666 - protein, 7 aa, Cryptosporidium parvum
ENFDENQ

SEQ ID NO: 2256667 - protein, 11 aa, Cryptosporidium parvum
ENFDSRDNIKN

SEQ ID NO: 2256668 - protein, 9 aa, Cryptosporidium parvum
ENFGSNQRY

SEQ ID NO: 2256669 - protein, 6 aa, Cryptosporidium parvum
ENFGSR

SEQ ID NO: 2256670 - protein, 10 aa, Cryptosporidium parvum
ENFNESSEEF

SEQ ID NO: 2256671 - protein, 13 aa, Cryptosporidium parvum
ENFSQNNGSFERN

SEQ ID NO: 2256672 - protein, 6 aa, Cryptosporidium parvum
ENGADG

SEQ ID NO: 2256673 - protein, 4 aa, Cryptosporidium parvum
ENGE

SEQ ID NO: 2256674 - protein, 9 aa, Cryptosporidium parvum
ENGEFSPEK

SEQ ID NO: 2256675 - protein, 9 aa, Cryptosporidium parvum
ENGEKEKSI

SEQ ID NO: 2256676 - protein, 8 aa, Cryptosporidium parvum
ENGGSPRY

SEQ ID NO: 2256677 - protein, 8 aa, Cryptosporidium parvum
ENGINQAS

SEQ ID NO: 2256678 - protein, 16 aa, Cryptosporidium parvum
ENGNNTKLEDLGPGEV

SEQ ID NO: 2256679 - protein, 6 aa, Cryptosporidium parvum
ENGPGD

SEQ ID NO: 2256680 - protein, 14 aa, Cryptosporidium parvum
ENGPNGAPGPASST

SEQ ID NO: 2256681 - protein, 6 aa, Cryptosporidium parvum
ENGQAI

SEQ ID NO: 2256682 - protein, 4 aa, Cryptosporidium parvum
ENGR

SEQ ID NO: 2256683 - protein, 20 aa, Cryptosporidium parvum
ENGRYTSNTVSNSNKSHTNG

SEQ ID NO: 2256684 - protein, 9 aa, Cryptosporidium parvum
ENGSNIEGR

SEQ ID NO: 2256685 - protein, 6 aa, Cryptosporidium parvum
ENGYKN

SEQ ID NO: 2256686 - protein, 5 aa, Cryptosporidium parvum
ENHDE

SEQ ID NO: 2256687 - protein, 4 aa, Cryptosporidium parvum
ENHE

SEQ ID NO: 2256688 - protein, 12 aa, Cryptosporidium parvum
ENHSSSCPSAEN

SEQ ID NO: 2256689 - protein, 9 aa, Cryptosporidium parvum
ENIDNKNAG

SEQ ID NO: 2256690 - protein, 23 aa, Cryptosporidium parvum
ENIDNSKNEYNYHNNNKTLNEQN

SEQ ID NO: 2256691 - protein, 4 aa, Cryptosporidium parvum
ENIE

SEQ ID NO: 2256692 - protein, 11 aa, Cryptosporidium parvum
ENIEPDEVEPY

SEQ ID NO: 2256693 - protein, 23 aa, Cryptosporidium parvum
ENIKQSSSTIYSTGASCSRSTTF

SEQ ID NO: 2256694 - protein, 4 aa, Cryptosporidium parvum
ENIN

SEQ ID NO: 2256695 - protein, 17 aa, Cryptosporidium parvum
ENINNEQKQKLEASKSN

SEQ ID NO: 2256696 - protein, 38 aa, Cryptosporidium parvum; identical to SEQ ID NO: 2140624

SEQ ID NO: 2256697 - protein, 11 aa, Cryptosporidium parvum
ENIPNRPKYYN

SEQ ID NO: 2256698 - protein, 7 aa, Cryptosporidium parvum
ENIPSKM

SEQ ID NO: 2256699 - protein, 13 aa, Cryptosporidium parvum
ENIPSRSQQEDPL

SEQ ID NO: 2256700 - protein, 8 aa, Cryptosporidium parvum
ENIPTKGS

SEQ ID NO: 2256701 - protein, 4 aa, Cryptosporidium parvum
ENIQ

SEQ ID NO: 2256702 - protein, 16 aa, Cryptosporidium parvum
ENIQKSSGSVNNIKDN

SEQ ID NO: 2256703 - protein, 5 aa, Cryptosporidium parvum
ENIRS

SEQ ID NO: 2256704 - protein, 8 aa, Cryptosporidium parvum
ENISEQDN

SEQ ID NO: 2256705 - protein, 11 aa, Cryptosporidium parvum
ENISGKTHSSL

SEQ ID NO: 2256706 - protein, 12 aa, Cryptosporidium parvum
ENISPNEKNQLQ

SEQ ID NO: 2256707 - protein, 7 aa, Cryptosporidium parvum
ENISQRN

SEQ ID NO: 2256708 - protein, 6 aa, Cryptosporidium parvum
ENISRD

SEQ ID NO: 2256709 - protein, 4 aa, Cryptosporidium parvum
ENIT

SEQ ID NO: 2256710 - protein, 6 aa, Cryptosporidium parvum
ENITKE

SEQ ID NO: 2256711 - protein, 31 aa, Cryptosporidium parvum
ENITKKNSKKFIDQTKSSEQALTNNKSSIQG

SEQ ID NO: 2256712 - protein, 21 aa, Cryptosporidium parvum
ENITSSEKCEVESNSPLSESE

SEQ ID NO: 2256713 - protein, 17 aa, Cryptosporidium parvum
ENKAESNPNHNKSNDNL

SEQ ID NO: 2256714 - protein, 14 aa, Cryptosporidium parvum
ENKARTEVAPGSNI

SEQ ID NO: 2256715 - protein, 5 aa, Cryptosporidium parvum
ENKDV

SEQ ID NO: 2256716 - protein, 5 aa, Cryptosporidium parvum
ENKEF

SEQ ID NO: 2256717 - protein, 15 aa, Cryptosporidium parvum
ENKELERLNSHENNH

SEQ ID NO: 2256718 - protein, 6 aa, Cryptosporidium parvum
ENKFHP

SEQ ID NO: 2256719 - protein, 4 aa, Cryptosporidium parvum
ENKG

SEQ ID NO: 2256720 - protein, 5 aa, Cryptosporidium parvum
ENKGH

SEQ ID NO: 2256721 - protein, 7 aa, Cryptosporidium parvum
ENKGIPN

SEQ ID NO: 2256722 - protein, 8 aa, Cryptosporidium parvum
ENKGYKIE

SEQ ID NO: 2256723 - protein, 11 aa, Cryptosporidium parvum
ENKHGKDLSEN

SEQ ID NO: 2256724 - protein, 6 aa, Cryptosporidium parvum
ENKHNK

SEQ ID NO: 2256725 - protein, 10 aa, Cryptosporidium parvum
ENKHNKPELP

SEQ ID NO: 2256726 - protein, 5 aa, Cryptosporidium parvum
ENKIE

SEQ ID NO: 2256727 - protein, 30 aa, Cryptosporidium parvum
ENKIEDSNQLEAKPEELQDSEASLKKKERR

SEQ ID NO: 2256728 - protein, 6 aa, Cryptosporidium parvum
ENKIRQ

SEQ ID NO: 2256729 - protein, 8 aa, Cryptosporidium parvum
ENKKGTQN

SEQ ID NO: 2256730 - protein, 10 aa, Cryptosporidium parvum
ENKKIKSEEA

SEQ ID NO: 2256731 - protein, 9 aa, Cryptosporidium parvum
ENKKKADVS

SEQ ID NO: 2256732 - protein, 12 aa, Cryptosporidium parvum
ENKKKEIQKLNY

SEQ ID NO: 2256733 - protein, 9 aa, Cryptosporidium parvum
ENKKKSTLI

SEQ ID NO: 2256734 - protein, 5 aa, Cryptosporidium parvum
ENKKM

SEQ ID NO: 2256735 - protein, 25 aa, Cryptosporidium parvum
ENKKNEEKEKQQEKEKHLEKVENED

SEQ ID NO: 2256736 - protein, 7 aa, Cryptosporidium parvum
ENKKTSP

SEQ ID NO: 2256737 - protein, 68 aa, Cryptosporidium parvum
ENKLEEKMGEEVEEKEEKKKAKEEEEEEEEEEEEEEEEEEEEDDDDEKEEEEEEEEVKTVSNSSDDED

SEQ ID NO: 2256738 - protein, 7 aa, Cryptosporidium parvum
ENKLGSA

SEQ ID NO: 2256739 - protein, 6 aa, Cryptosporidium parvum
ENKNNR

SEQ ID NO: 2256740 - protein, 5 aa, Cryptosporidium parvum
ENKNR

SEQ ID NO: 2256741 - protein, 7 aa, Cryptosporidium parvum
ENKNSKK

SEQ ID NO: 2256742 - protein, 19 aa, Cryptosporidium parvum
ENKNTTKEESKGEENNTNN

SEQ ID NO: 2256743 - protein, 5 aa, Cryptosporidium parvum
ENKPV

SEQ ID NO: 2256744 - protein, 9 aa, Cryptosporidium parvum
ENKQDENSL

SEQ ID NO: 2256745 - protein, 31 aa, Cryptosporidium parvum
ENKQKESSKRNTPTMDSNSNSKGETSQNTKQ

SEQ ID NO: 2256746 - protein, 16 aa, Cryptosporidium parvum
ENKSDLKNSESSQLNS

SEQ ID NO: 2256747 - protein, 7 aa, Cryptosporidium parvum
ENKSDNI

SEQ ID NO: 2256748 - protein, 5 aa, Cryptosporidium parvum
ENKSK

SEQ ID NO: 2256749 - protein, 10 aa, Cryptosporidium parvum
ENKSSEIEQH

SEQ ID NO: 2256750 - protein, 20 aa, Cryptosporidium parvum
ENKSSEMDEDISEKYDLEET

SEQ ID NO: 2256751 - protein, 6 aa, Cryptosporidium parvum
ENKSSK

SEQ ID NO: 2256752 - protein, 9 aa, Cryptosporidium parvum
ENKSSSLES

SEQ ID NO: 2256753 - protein, 5 aa, Cryptosporidium parvum
ENKTQ

SEQ ID NO: 2256754 - protein, 9 aa, Cryptosporidium parvum
ENKTSSLSI

SEQ ID NO: 2256755 - protein, 7 aa, Cryptosporidium parvum
ENKVEEI

SEQ ID NO: 2256756 - protein, 8 aa, Cryptosporidium parvum
ENKVSRQK

SEQ ID NO: 2256757 - protein, 6 aa, Cryptosporidium parvum
ENKYKA

SEQ ID NO: 2256758 - protein, 11 aa, Cryptosporidium parvum
ENKYKEKRQKS

SEQ ID NO: 2256759 - protein, 7 aa, Cryptosporidium parvum
ENKYSRS

SEQ ID NO: 2256760 - protein, 10 aa, Cryptosporidium parvum
ENLDESYDEN

SEQ ID NO: 2256761 - protein, 7 aa, Cryptosporidium parvum
ENLEKAR

SEQ ID NO: 2256762 - protein, 6 aa, Cryptosporidium parvum
ENLEQR

SEQ ID NO: 2256763 - protein, 13 aa, Cryptosporidium parvum
ENLGGQESAAQLE

SEQ ID NO: 2256764 - protein, 6 aa, Cryptosporidium parvum
ENLKNS

SEQ ID NO: 2256765 - protein, 23 aa, Cryptosporidium parvum
ENLKRREKKSSEICDKKPRKSYN

SEQ ID NO: 2256766 - protein, 19 aa, Cryptosporidium parvum
ENLKSKGIVSKSKDIKSLK

SEQ ID NO: 2256767 - protein, 11 aa, Cryptosporidium parvum
ENLKTDDSPKV

SEQ ID NO: 2256768 - protein, 7 aa, Cryptosporidium parvum
ENLQKEN

SEQ ID NO: 2256769 - protein, 5 aa, Cryptosporidium parvum
ENLQV

SEQ ID NO: 2256770 - protein, 52 aa, Cryptosporidium parvum
ENLRKKQLEEAEEEEEAEEVEGEEEEEEEEEEEGQPELLGTEDKDEVESEEN

SEQ ID NO: 2256771 - protein, 7 aa, Cryptosporidium parvum
ENLSDKS

SEQ ID NO: 2256772 - protein, 26 aa, Cryptosporidium parvum
ENLSETDSDCTNTTACTSPAKSPLRK

SEQ ID NO: 2256773 - protein, 9 aa, Cryptosporidium parvum
ENLSGIPKP

SEQ ID NO: 2256774 - protein, 11 aa, Cryptosporidium parvum
ENLTKKSQSFS

SEQ ID NO: 2256775 - protein, 6 aa, Cryptosporidium parvum
ENLTRS

SEQ ID NO: 2256776 - protein, 6 aa, Cryptosporidium parvum
ENLTSI

SEQ ID NO: 2256777 - protein, 7 aa, Cryptosporidium parvum
ENLTSSK

SEQ ID NO: 2256778 - protein, 16 aa, Cryptosporidium parvum
ENMGSNNSGNSGLGGA

SEQ ID NO: 2256779 - protein, 5 aa, Cryptosporidium parvum
ENMPN

SEQ ID NO: 2256780 - protein, 6 aa, Cryptosporidium parvum
ENMQGK

SEQ ID NO: 2256781 - protein, 17 aa, Cryptosporidium parvum
ENNAANKNSEESEKLKQ

SEQ ID NO: 2256782 - protein, 14 aa, Cryptosporidium parvum
ENNASTKAMNNGQK

SEQ ID NO: 2256783 - protein, 10 aa, Cryptosporidium parvum
ENNDNNNELR

SEQ ID NO: 2256784 - protein, 9 aa, Cryptosporidium parvum
ENNDPNLAA

SEQ ID NO: 2256785 - protein, 7 aa, Cryptosporidium parvum
ENNDSTI

SEQ ID NO: 2256786 - protein, 7 aa, Cryptosporidium parvum
ENNEETD

SEQ ID NO: 2256787 - protein, 14 aa, Cryptosporidium parvum
ENNEGSSECSNPNF

SEQ ID NO: 2256788 - protein, 11 aa, Cryptosporidium parvum
ENNEKDSIKEN

SEQ ID NO: 2256789 - protein, 18 aa, Cryptosporidium parvum
ENNEKIQRAQDKMSDENV

SEQ ID NO: 2256790 - protein, 11 aa, Cryptosporidium parvum
ENNEKNESIIK

SEQ ID NO: 2256791 - protein, 16 aa, Cryptosporidium parvum
ENNENGNEKKKSLNFG

SEQ ID NO: 2256792 - protein, 11 aa, Cryptosporidium parvum
ENNENNEKNSK

SEQ ID NO: 2256793 - protein, 12 aa, Cryptosporidium parvum
ENNENQNNLNET

SEQ ID NO: 2256794 - protein, 4 aa, Cryptosporidium parvum
ENNI

SEQ ID NO: 2256795 - protein, 15 aa, Cryptosporidium parvum
ENNIKENSNYTKKGN

SEQ ID NO: 2256796 - protein, 11 aa, Cryptosporidium parvum
ENNIKTKSKIS

SEQ ID NO: 2256797 - protein, 4 aa, Cryptosporidium parvum
ENNK

SEQ ID NO: 2256798 - protein, 7 aa, Cryptosporidium parvum
ENNKETK

SEQ ID NO: 2256799 - protein, 15 aa, Cryptosporidium parvum
ENNKITNNTGKRMAE

SEQ ID NO: 2256800 - protein, 7 aa, Cryptosporidium parvum
ENNKNLE

SEQ ID NO: 2256801 - protein, 4 aa, Cryptosporidium parvum
ENNL

SEQ ID NO: 2256802 - protein, 4 aa, Cryptosporidium parvum
ENNN

SEQ ID NO: 2256803 - protein, 11 aa, Cryptosporidium parvum
ENNNHNSSDLR

SEQ ID NO: 2256804 - protein, 42 aa, Cryptosporidium parvum
ENNNNNDNGNNNNNNSTNNSNNNSKIGKKSNNIGYSGPSENK

SEQ ID NO: 2256805 - protein, 6 aa, Cryptosporidium parvum
ENNNPC

SEQ ID NO: 2256806 - protein, 8 aa, Cryptosporidium parvum
ENNQRITY

SEQ ID NO: 2256807 - protein, 18 aa, Cryptosporidium parvum
ENNSASLINSSRTEQKLN

SEQ ID NO: 2256808 - protein, 15 aa, Cryptosporidium parvum
ENNSFETDSNVSQDR

SEQ ID NO: 2256809 - protein, 9 aa, Cryptosporidium parvum
ENNSGAELT

SEQ ID NO: 2256810 - protein, 8 aa, Cryptosporidium parvum
ENNSIDEQ

SEQ ID NO: 2256811 - protein, 10 aa, Cryptosporidium parvum
ENNSKSDYEI

SEQ ID NO: 2256812 - protein, 6 aa, Cryptosporidium parvum
ENNSLD

SEQ ID NO: 2256813 - protein, 5 aa, Cryptosporidium parvum
ENNSV

SEQ ID NO: 2256814 - protein, 5 aa, Cryptosporidium parvum
ENNTR

SEQ ID NO: 2256815 - protein, 19 aa, Cryptosporidium parvum
ENNTTQSEASYDPKSPEIS

SEQ ID NO: 2256816 - protein, 4 aa, Cryptosporidium parvum
ENPD

SEQ ID NO: 2256817 - protein, 9 aa, Cryptosporidium parvum
ENPDDSPVE

SEQ ID NO: 2256818 - protein, 8 aa, Cryptosporidium parvum
ENPDFSNN

SEQ ID NO: 2256819 - protein, 8 aa, Cryptosporidium parvum
ENPDLGYK

SEQ ID NO: 2256820 - protein, 10 aa, Cryptosporidium parvum
ENPDSAKAAV

SEQ ID NO: 2256821 - protein, 13 aa, Cryptosporidium parvum
ENPDYSNPEDYLN

SEQ ID NO: 2256822 - protein, 4 aa, Cryptosporidium parvum
ENPE

SEQ ID NO: 2256823 - protein, 15 aa, Cryptosporidium parvum
ENPENDASERFSNTN

SEQ ID NO: 2256824 - protein, 5 aa, Cryptosporidium parvum
ENPHR

SEQ ID NO: 2256825 - protein, 18 aa, Cryptosporidium parvum
ENPIENVDSNANKNKSLG

SEQ ID NO: 2256826 - protein, 7 aa, Cryptosporidium parvum
ENPISPE

SEQ ID NO: 2256827 - protein, 7 aa, Cryptosporidium parvum
ENPLPGR

SEQ ID NO: 2256828 - protein, 4 aa, Cryptosporidium parvum
ENPN

SEQ ID NO: 2256829 - protein, 7 aa, Cryptosporidium parvum
ENPNALN

SEQ ID NO: 2256830 - protein, 15 aa, Cryptosporidium parvum
ENPNPNRIPKTPPKL

SEQ ID NO: 2256831 - protein, 13 aa, Cryptosporidium parvum
ENPNRSYQDSSFG

SEQ ID NO: 2256832 - protein, 8 aa, Cryptosporidium parvum
ENPPIVAE

SEQ ID NO: 2256833 - protein, 6 aa, Cryptosporidium parvum
ENPPKH

SEQ ID NO: 2256834 - protein, 6 aa, Cryptosporidium parvum
ENPPKL

SEQ ID NO: 2256835 - protein, 17 aa, Cryptosporidium parvum
ENPPLNNYENANPYIQN

SEQ ID NO: 2256836 - protein, 5 aa, Cryptosporidium parvum
ENPQN

SEQ ID NO: 2256837 - protein, 7 aa, Cryptosporidium parvum
ENPQQLG

SEQ ID NO: 2256838 - protein, 4 aa, Cryptosporidium parvum
ENPR

SEQ ID NO: 2256839 - protein, 16 aa, Cryptosporidium parvum
ENPSFDEKMEDEKHDY

SEQ ID NO: 2256840 - protein, 6 aa, Cryptosporidium parvum
ENPSNL

SEQ ID NO: 2256841 - protein, 4 aa, Cryptosporidium parvum
ENPY

SEQ ID NO: 2256842 - protein, 9 aa, Cryptosporidium parvum
ENQAEEKDT

SEQ ID NO: 2256843 - protein, 17 aa, Cryptosporidium parvum
ENQDNDQNLSSNSVPTN

SEQ ID NO: 2256844 - protein, 16 aa, Cryptosporidium parvum
ENQDSSKDPENSNNYS

SEQ ID NO: 2256845 - protein, 4 aa, Cryptosporidium parvum
ENQF

SEQ ID NO: 2256846 - protein, 35 aa, Cryptosporidium parvum
ENQIPKSEEVQMTNGDSSANNTSPGQIEKKRAPNR

SEQ ID NO: 2256847 - protein, 17 aa, Cryptosporidium parvum
ENQITRRSSKRVSFGAN

SEQ ID NO: 2256848 - protein, 34 aa, Cryptosporidium parvum
ENQKEGEEEEEDEEVETGENNQNQEGKDLGYKGD

SEQ ID NO: 2256849 - protein, 6 aa, Cryptosporidium parvum
ENQLSQ

SEQ ID NO: 2256850 - protein, 9 aa, Cryptosporidium parvum
ENQNDVIAS

SEQ ID NO: 2256851 - protein, 10 aa, Cryptosporidium parvum
ENQNHKNIST

SEQ ID NO: 2256852 - protein, 7 aa, Cryptosporidium parvum
ENQNSNL

SEQ ID NO: 2256853 - protein, 9 aa, Cryptosporidium parvum
ENQPKKFTL

SEQ ID NO: 2256854 - protein, 8 aa, Cryptosporidium parvum
ENQRASGE

SEQ ID NO: 2256855 - protein, 5 aa, Cryptosporidium parvum
ENQRL

SEQ ID NO: 2256856 - protein, 4 aa, Cryptosporidium parvum
ENQS

SEQ ID NO: 2256857 - protein, 6 aa, Cryptosporidium parvum
ENQSDD

SEQ ID NO: 2256858 - protein, 10 aa, Cryptosporidium parvum
ENQSDNTDLT

SEQ ID NO: 2256859 - protein, 6 aa, Cryptosporidium parvum
ENRAHR

SEQ ID NO: 2256860 - protein, 8 aa, Cryptosporidium parvum
ENRDTADA

SEQ ID NO: 2256861 - protein, 9 aa, Cryptosporidium parvum
ENREQGPIY

SEQ ID NO: 2256862 - protein, 7 aa, Cryptosporidium parvum
ENRESSC

SEQ ID NO: 2256863 - protein, 11 aa, Cryptosporidium parvum
ENRKNKEREND

SEQ ID NO: 2256864 - protein, 14 aa, Cryptosporidium parvum
ENRNNYDDDYYNSD

SEQ ID NO: 2256865 - protein, 4 aa, Cryptosporidium parvum
ENRQ

SEQ ID NO: 2256866 - protein, 6 aa, Cryptosporidium parvum
ENRRIQ

SEQ ID NO: 2256867 - protein, 5 aa, Cryptosporidium parvum
ENRRK

SEQ ID NO: 2256868 - protein, 7 aa, Cryptosporidium parvum
ENRSKEN

SEQ ID NO: 2256869 - protein, 11 aa, Cryptosporidium parvum
ENRSKTVGNSS

SEQ ID NO: 2256870 - protein, 7 aa, Cryptosporidium parvum
ENRSYPH

SEQ ID NO: 2256871 - protein, 14 aa, Cryptosporidium parvum
ENRTEKSNKQNAKY

SEQ ID NO: 2256872 - protein, 4 aa, Cryptosporidium parvum
ENSA

SEQ ID NO: 2256873 - protein, 9 aa, Cryptosporidium parvum
ENSATALTG

SEQ ID NO: 2256874 - protein, 11 aa, Cryptosporidium parvum
ENSDENANGQR

SEQ ID NO: 2256875 - protein, 7 aa, Cryptosporidium parvum
ENSDEYL

SEQ ID NO: 2256876 - protein, 4 aa, Cryptosporidium parvum
ENSE

SEQ ID NO: 2256877 - protein, 5 aa, Cryptosporidium parvum
ENSED

SEQ ID NO: 2256878 - protein, 7 aa, Cryptosporidium parvum
ENSEEMD

SEQ ID NO: 2256879 - protein, 6 aa, Cryptosporidium parvum
ENSEGK

SEQ ID NO: 2256880 - protein, 11 aa, Cryptosporidium parvum
ENSEGNVQYGH

SEQ ID NO: 2256881 - protein, 16 aa, Cryptosporidium parvum
ENSENSMNKSDQNNSI

SEQ ID NO: 2256882 - protein, 13 aa, Cryptosporidium parvum
ENSERKELNNEKL

SEQ ID NO: 2256883 - protein, 10 aa, Cryptosporidium parvum
ENSESENIRP

SEQ ID NO: 2256884 - protein, 6 aa, Cryptosporidium parvum
ENSFKN

SEQ ID NO: 2256885 - protein, 7 aa, Cryptosporidium parvum
ENSGGGC

SEQ ID NO: 2256886 - protein, 10 aa, Cryptosporidium parvum
ENSGITNGSK

SEQ ID NO: 2256887 - protein, 7 aa, Cryptosporidium parvum
ENSGNSC

SEQ ID NO: 2256888 - protein, 7 aa, Cryptosporidium parvum
ENSHNGD

SEQ ID NO: 2256889 - protein, 14 aa, Cryptosporidium parvum
ENSIEAEKAQEDRI

SEQ ID NO: 2256890 - protein, 8 aa, Cryptosporidium parvum
ENSIGNNN

SEQ ID NO: 2256891 - protein, 5 aa, Cryptosporidium parvum
ENSIP

SEQ ID NO: 2256892 - protein, 10 aa, Cryptosporidium parvum
ENSKDDSIKE

SEQ ID NO: 2256893 - protein, 26 aa, Cryptosporidium parvum
ENSKEEVNEKSAQVTSNNIVDDSNGI

SEQ ID NO: 2256894 - protein, 6 aa, Cryptosporidium parvum
ENSKEY

SEQ ID NO: 2256895 - protein, 7 aa, Cryptosporidium parvum
ENSKQRI

SEQ ID NO: 2256896 - protein, 5 aa, Cryptosporidium parvum
ENSKR

SEQ ID NO: 2256897 - protein, 8 aa, Cryptosporidium parvum
ENSKVRDA

SEQ ID NO: 2256898 - protein, 19 aa, Cryptosporidium parvum
ENSKVSNSHDTKKLIDSNK

SEQ ID NO: 2256899 - protein, 14 aa, Cryptosporidium parvum
ENSLGNNQSTSFDQ

SEQ ID NO: 2256900 - protein, 8 aa, Cryptosporidium parvum
ENSNDNLS

SEQ ID NO: 2256901 - protein, 7 aa, Cryptosporidium parvum
ENSNESV

SEQ ID NO: 2256902 - protein, 5 aa, Cryptosporidium parvum
ENSNI

SEQ ID NO: 2256903 - protein, 28 aa, Cryptosporidium parvum
ENSNMKPSQKRLERKDGGRTKKLANESG

SEQ ID NO: 2256904 - protein, 61 aa, Cryptosporidium parvum
ENSNSESSDDEENEKEKQSSSEGSHSEGESSVENSESGSSESDSDSEDIDEEELAKRNKRR

SEQ ID NO: 2256905 - protein, 9 aa, Cryptosporidium parvum
ENSNSSNSH

SEQ ID NO: 2256906 - protein, 6 aa, Cryptosporidium parvum
ENSNTH

SEQ ID NO: 2256907 - protein, 14 aa, Cryptosporidium parvum
ENSNTLDSKHHRSR

SEQ ID NO: 2256908 - protein, 24 aa, Cryptosporidium parvum
ENSNVQNQANIKSNTNSNRITTNS

SEQ ID NO: 2256909 - protein, 5 aa, Cryptosporidium parvum
ENSPL

SEQ ID NO: 2256910 - protein, 8 aa, Cryptosporidium parvum
ENSPNGHI

SEQ ID NO: 2256911 - protein, 5 aa, Cryptosporidium parvum
ENSPQ

SEQ ID NO: 2256912 - protein, 5 aa, Cryptosporidium parvum
ENSPR

SEQ ID NO: 2256913 - protein, 7 aa, Cryptosporidium parvum
ENSQDAN

SEQ ID NO: 2256914 - protein, 7 aa, Cryptosporidium parvum
ENSQISD

SEQ ID NO: 2256915 - protein, 7 aa, Cryptosporidium parvum
ENSQSCD

SEQ ID NO: 2256916 - protein, 8 aa, Cryptosporidium parvum
ENSRFEKK

SEQ ID NO: 2256917 - protein, 5 aa, Cryptosporidium parvum
ENSRQ

SEQ ID NO: 2256918 - protein, 16 aa, Cryptosporidium parvum
ENSSDSVHKSTESASM

SEQ ID NO: 2256919 - protein, 7 aa, Cryptosporidium parvum
ENSSLSR

SEQ ID NO: 2256920 - protein, 10 aa, Cryptosporidium parvum
ENSSNFPNDK

SEQ ID NO: 2256921 - protein, 8 aa, Cryptosporidium parvum
ENSSQDER

SEQ ID NO: 2256922 - protein, 15 aa, Cryptosporidium parvum
ENSSQEELSNNLSDP

SEQ ID NO: 2256923 - protein, 18 aa, Cryptosporidium parvum
ENSSQENSFEGVTPYNSK

SEQ ID NO: 2256924 - protein, 28 aa, Cryptosporidium parvum
ENSSTFEQENKEDQDKEFNSEDSDHDNQ

SEQ ID NO: 2256925 - protein, 9 aa, Cryptosporidium parvum
ENSTGEEKL

SEQ ID NO: 2256926 - protein, 9 aa, Cryptosporidium parvum
ENSTNKDDL

SEQ ID NO: 2256927 - protein, 13 aa, Cryptosporidium parvum
ENSTNQTENGSGS

SEQ ID NO: 2256928 - protein, 16 aa, Cryptosporidium parvum
ENSTNTPTSTGGSSRM

SEQ ID NO: 2256929 - protein, 16 aa, Cryptosporidium parvum
ENTAYSNSLQRKTERE

SEQ ID NO: 2256930 - protein, 5 aa, Cryptosporidium parvum
ENTDH

SEQ ID NO: 2256931 - protein, 8 aa, Cryptosporidium parvum
ENTDISGA

SEQ ID NO: 2256932 - protein, 9 aa, Cryptosporidium parvum
ENTEANRAA

SEQ ID NO: 2256933 - protein, 8 aa, Cryptosporidium parvum
ENTEKESK

SEQ ID NO: 2256934 - protein, 11 aa, Cryptosporidium parvum
ENTENFDDDQP

SEQ ID NO: 2256935 - protein, 4 aa, Cryptosporidium parvum
ENTI

SEQ ID NO: 2256936 - protein, 10 aa, Cryptosporidium parvum
ENTKLNDSEL

SEQ ID NO: 2256937 - protein, 5 aa, Cryptosporidium parvum
ENTKR

SEQ ID NO: 2256938 - protein, 4 aa, Cryptosporidium parvum
ENTN

SEQ ID NO: 2256939 - protein, 6 aa, Cryptosporidium parvum
ENTNFS

SEQ ID NO: 2256940 - protein, 8 aa, Cryptosporidium parvum
ENTNGDSE

SEQ ID NO: 2256941 - protein, 5 aa, Cryptosporidium parvum
ENTNI

SEQ ID NO: 2256942 - protein, 6 aa, Cryptosporidium parvum
ENTNNS

SEQ ID NO: 2256943 - protein, 6 aa, Cryptosporidium parvum
ENTNTQ

SEQ ID NO: 2256944 - protein, 14 aa, Cryptosporidium parvum
ENTPLEPKKRKEIS

SEQ ID NO: 2256945 - protein, 21 aa, Cryptosporidium parvum
ENTPLPPKYERQREQKEQEKL

SEQ ID NO: 2256946 - protein, 22 aa, Cryptosporidium parvum
ENTPNKSETEGSRGELKPSQDV

SEQ ID NO: 2256947 - protein, 10 aa, Cryptosporidium parvum
ENTPSTNLSI

SEQ ID NO: 2256948 - protein, 16 aa, Cryptosporidium parvum
ENTPTTTSSSNSVNSA

SEQ ID NO: 2256949 - protein, 5 aa, Cryptosporidium parvum
ENTRD

SEQ ID NO: 2256950 - protein, 8 aa, Cryptosporidium parvum
ENTREEIK

SEQ ID NO: 2256951 - protein, 10 aa, Cryptosporidium parvum
ENTRTRKTIP

SEQ ID NO: 2256952 - protein, 7 aa, Cryptosporidium parvum
ENTSKAR

SEQ ID NO: 2256953 - protein, 5 aa, Cryptosporidium parvum
ENTSS

SEQ ID NO: 2256954 - protein, 9 aa, Cryptosporidium parvum
ENTTGQDSG

SEQ ID NO: 2256955 - protein, 19 aa, Cryptosporidium parvum
ENTTNDYSALPEKNIPDES

SEQ ID NO: 2256956 - protein, 13 aa, Cryptosporidium parvum
ENTTNKPYNLQTK

SEQ ID NO: 2256957 - protein, 4 aa, Cryptosporidium parvum
ENVD

SEQ ID NO: 2256958 - protein, 15 aa, Cryptosporidium parvum
ENVDDKNKKNELNSA

SEQ ID NO: 2256959 - protein, 5 aa, Cryptosporidium parvum
ENVEK

SEQ ID NO: 2256960 - protein, 7 aa, Cryptosporidium parvum
ENVENQI

SEQ ID NO: 2256961 - protein, 5 aa, Cryptosporidium parvum
ENVES

SEQ ID NO: 2256962 - protein, 8 aa, Cryptosporidium parvum
ENVGDQEQ

SEQ ID NO: 2256963 - protein, 4 aa, Cryptosporidium parvum
ENVP

SEQ ID NO: 2256964 - protein, 5 aa, Cryptosporidium parvum
ENVPG

SEQ ID NO: 2256965 - protein, 4 aa, Cryptosporidium parvum
ENVQ

SEQ ID NO: 2256966 - protein, 39 aa, Cryptosporidium parvum; identical to SEQ ID NO: 2140856

SEQ ID NO: 2256967 - protein, 11 aa, Cryptosporidium parvum
ENVSTDSQMKM

SEQ ID NO: 2256968 - protein, 17 aa, Cryptosporidium parvum
ENVTQDEVSNGDSLENE

SEQ ID NO: 2256969 - protein, 17 aa, Cryptosporidium parvum
ENYDHDTDDLKSKETKY

SEQ ID NO: 2256970 - protein, 6 aa, Cryptosporidium parvum
ENYDLE

SEQ ID NO: 2256971 - protein, 6 aa, Cryptosporidium parvum
ENYDSD

SEQ ID NO: 2256972 - protein, 6 aa, Cryptosporidium parvum
ENYESN

SEQ ID NO: 2256973 - protein, 21 aa, Cryptosporidium parvum
ENYKNASLTQEQNIAPKQEIK

SEQ ID NO: 2256974 - protein, 16 aa, Cryptosporidium parvum
ENYKRRVSSSSFIQGG

SEQ ID NO: 2256975 - protein, 8 aa, Cryptosporidium parvum
ENYNKNSS

SEQ ID NO: 2256976 - protein, 8 aa, Cryptosporidium parvum
ENYNSGSS

SEQ ID NO: 2256977 - protein, 5 aa, Cryptosporidium parvum
ENYPI

SEQ ID NO: 2256978 - protein, 13 aa, Cryptosporidium parvum
ENYSDDTTLIISI

SEQ ID NO: 2256979 - protein, 9 aa, Cryptosporidium parvum
ENYSQMNAT

SEQ ID NO: 2256980 - protein, 7 aa, Cryptosporidium parvum
ENYSSKY

SEQ ID NO: 2256981 - protein, 7 aa, Cryptosporidium parvum
ENYSSNE

SEQ ID NO: 2256982 - protein, 13 aa, Cryptosporidium parvum
EPADQVPTGNVPR

SEQ ID NO: 2256983 - protein, 17 aa, Cryptosporidium parvum
EPAKSENKKRSAESSSY

SEQ ID NO: 2256984 - protein, 4 aa, Cryptosporidium parvum
EPAL

SEQ ID NO: 2256985 - protein, 9 aa, Cryptosporidium parvum
EPCEGNPDF

SEQ ID NO: 2256986 - protein, 7 aa, Cryptosporidium parvum
EPDASGY

SEQ ID NO: 2256987 - protein, 7 aa, Cryptosporidium parvum
EPDDFEE

SEQ ID NO: 2256988 - protein, 6 aa, Cryptosporidium parvum
EPDDST

SEQ ID NO: 2256989 - protein, 7 aa, Cryptosporidium parvum
EPDNDSM

SEQ ID NO: 2256990 - protein, 6 aa, Cryptosporidium parvum
EPDPRP

SEQ ID NO: 2256991 - protein, 4 aa, Cryptosporidium parvum
EPED

SEQ ID NO: 2256992 - protein, 11 aa, Cryptosporidium parvum
EPEEPRKDQYT

SEQ ID NO: 2256993 - protein, 5 aa, Cryptosporidium parvum
EPEIK

SEQ ID NO: 2256994 - protein, 7 aa, Cryptosporidium parvum
EPENENE

SEQ ID NO: 2256995 - protein, 5 aa, Cryptosporidium parvum
EPENM

SEQ ID NO: 2256996 - protein, 4 aa, Cryptosporidium parvum
EPEP

SEQ ID NO: 2256997 - protein, 17 aa, Cryptosporidium parvum
EPEPEPEPEPDPEPEPE

SEQ ID NO: 2256998 - protein, 6 aa, Cryptosporidium parvum
EPERDE

SEQ ID NO: 2256999 - protein, 7 aa, Cryptosporidium parvum
EPERNPG

SEQ ID NO: 2257000 - protein, 22 aa, Cryptosporidium parvum
EPESSGEDFPSNNQRPTQEEVT

SEQ ID NO: 2257001 - protein, 11 aa, Cryptosporidium parvum
EPETSFSEGLT

SEQ ID NO: 2257002 - protein, 5 aa, Cryptosporidium parvum
EPGEK

SEQ ID NO: 2257003 - protein, 14 aa, Cryptosporidium parvum
EPGKNHSVQISSDT

SEQ ID NO: 2257004 - protein, 6 aa, Cryptosporidium parvum
EPGPPY

SEQ ID NO: 2257005 - protein, 8 aa, Cryptosporidium parvum
EPGTNAQH

SEQ ID NO: 2257006 - protein, 5 aa, Cryptosporidium parvum
EPIAS

SEQ ID NO: 2257007 - protein, 11 aa, Cryptosporidium parvum
EPIDSGKDDNV

SEQ ID NO: 2257008 - protein, 6 aa, Cryptosporidium parvum
EPIDTH

SEQ ID NO: 2257009 - protein, 4 aa, Cryptosporidium parvum
EPIG

SEQ ID NO: 2257010 - protein, 7 aa, Cryptosporidium parvum
EPIRDRK

SEQ ID NO: 2257011 - protein, 4 aa, Cryptosporidium parvum
EPIT

SEQ ID NO: 2257012 - protein, 8 aa, Cryptosporidium parvum
EPKAINSE

SEQ ID NO: 2257013 - protein, 9 aa, Cryptosporidium parvum
EPKPEPELE

SEQ ID NO: 2257014 - protein, 6 aa, Cryptosporidium parvum
EPKQCS

SEQ ID NO: 2257015 - protein, 9 aa, Cryptosporidium parvum
EPKSGTPQV

SEQ ID NO: 2257016 - protein, 16 aa, Cryptosporidium parvum
EPKSKNVSRGKSRPFK

SEQ ID NO: 2257017 - protein, 7 aa, Cryptosporidium parvum
EPKSRRL

SEQ ID NO: 2257018 - protein, 12 aa, Cryptosporidium parvum
EPKVFKDSKGNI

SEQ ID NO: 2257019 - protein, 5 aa, Cryptosporidium parvum
EPLDE

SEQ ID NO: 2257020 - protein, 4 aa, Cryptosporidium parvum
EPLL

SEQ ID NO: 2257021 - protein, 7 aa, Cryptosporidium parvum
EPLSEKM

SEQ ID NO: 2257022 - protein, 4 aa, Cryptosporidium parvum
EPLT

SEQ ID NO: 2257023 - protein, 6 aa, Cryptosporidium parvum
EPLTTK

SEQ ID NO: 2257024 - protein, 9 aa, Cryptosporidium parvum
EPNDNKEIR

SEQ ID NO: 2257025 - protein, 10 aa, Cryptosporidium parvum
EPNLDSPANI

SEQ ID NO: 2257026 - protein, 18 aa, Cryptosporidium parvum
EPNNPIRKSVNVALGLQP

SEQ ID NO: 2257027 - protein, 9 aa, Cryptosporidium parvum
EPNQTRKGT

SEQ ID NO: 2257028 - protein, 6 aa, Cryptosporidium parvum
EPNSEL

SEQ ID NO: 2257029 - protein, 9 aa, Cryptosporidium parvum
EPNSGGVIS

SEQ ID NO: 2257030 - protein, 5 aa, Cryptosporidium parvum
EPNSV

SEQ ID NO: 2257031 - protein, 4 aa, Cryptosporidium parvum
EPNY

SEQ ID NO: 2257032 - protein, 4 aa, Cryptosporidium parvum
EPPG

SEQ ID NO: 2257033 - protein, 10 aa, Cryptosporidium parvum
EPPKPKTKHK

SEQ ID NO: 2257034 - protein, 12 aa, Cryptosporidium parvum
EPPQDEKAEPGK

SEQ ID NO: 2257035 - protein, 6 aa, Cryptosporidium parvum
EPPTNL

SEQ ID NO: 2257036 - protein, 4 aa, Cryptosporidium parvum
EPQK

SEQ ID NO: 2257037 - protein, 4 aa, Cryptosporidium parvum
EPQN

SEQ ID NO: 2257038 - protein, 5 aa, Cryptosporidium parvum
EPQND

SEQ ID NO: 2257039 - protein, 11 aa, Cryptosporidium parvum
EPQNNGKFTLD

SEQ ID NO: 2257040 - protein, 5 aa, Cryptosporidium parvum
EPQNT

SEQ ID NO: 2257041 - protein, 29 aa, Cryptosporidium parvum
EPQRDNSVSTPEQSEKDDSNREASASGFE

SEQ ID NO: 2257042 - protein, 4 aa, Cryptosporidium parvum
EPQY

SEQ ID NO: 2257043 - protein, 7 aa, Cryptosporidium parvum
EPRFTEA

SEQ ID NO: 2257044 - protein, 7 aa, Cryptosporidium parvum
EPRKDSD

SEQ ID NO: 2257045 - protein, 33 aa, Cryptosporidium parvum; identical to SEQ ID NO: 2140921

SEQ ID NO: 2257046 - protein, 5 aa, Cryptosporidium parvum
EPRYS

SEQ ID NO: 2257047 - protein, 9 aa, Cryptosporidium parvum
EPSEGSSTY

SEQ ID NO: 2257048 - protein, 6 aa, Cryptosporidium parvum
EPSEQD

SEQ ID NO: 2257049 - protein, 5 aa, Cryptosporidium parvum
EPSFD

SEQ ID NO: 2257050 - protein, 4 aa, Cryptosporidium parvum
EPSG

SEQ ID NO: 2257051 - protein, 11 aa, Cryptosporidium parvum
EPSKELSGGTF

SEQ ID NO: 2257052 - protein, 30 aa, Cryptosporidium parvum; identical to SEQ ID NO: 2140927

SEQ ID NO: 2257053 - protein, 6 aa, Cryptosporidium parvum
EPSQSI

SEQ ID NO: 2257054 - protein, 6 aa, Cryptosporidium parvum
EPSSDW

SEQ ID NO: 2257055 - protein, 5 aa, Cryptosporidium parvum
EPSVE

SEQ ID NO: 2257056 - protein, 4 aa, Cryptosporidium parvum
EPTA

SEQ ID NO: 2257057 - protein, 6 aa, Cryptosporidium parvum
EPTDRR

SEQ ID NO: 2257058 - protein, 8 aa, Cryptosporidium parvum
EPTEPYLN

SEQ ID NO: 2257059 - protein, 8 aa, Cryptosporidium parvum
EPTHASGA

SEQ ID NO: 2257060 - protein, 5 aa, Cryptosporidium parvum
EPTIP

SEQ ID NO: 2257061 - protein, 4 aa, Cryptosporidium parvum
EPTK

SEQ ID NO: 2257062 - protein, 14 aa, Cryptosporidium parvum
EPTKPDTQLKRRPS

SEQ ID NO: 2257063 - protein, 6 aa, Cryptosporidium parvum
EPTTNL

SEQ ID NO: 2257064 - protein, 5 aa, Cryptosporidium parvum
EPVDD

SEQ ID NO: 2257065 - protein, 12 aa, Cryptosporidium parvum
EPVPQQNNGSDC

SEQ ID NO: 2257066 - protein, 5 aa, Cryptosporidium parvum
EPYNG

SEQ ID NO: 2257067 - protein, 5 aa, Cryptosporidium parvum
EPYSK

SEQ ID NO: 2257068 - protein, 12 aa, Cryptosporidium parvum
EPYTPNDEQPTG

SEQ ID NO: 2257069 - protein, 7 aa, Cryptosporidium parvum
EQAERYD

SEQ ID NO: 2257070 - protein, 5 aa, Cryptosporidium parvum
EQANQ

SEQ ID NO: 2257071 - protein, 9 aa, Cryptosporidium parvum
EQANRLKPL

SEQ ID NO: 2257072 - protein, 8 aa, Cryptosporidium parvum
EQAPQEDE

SEQ ID NO: 2257073 - protein, 8 aa, Cryptosporidium parvum
EQARATKT

SEQ ID NO: 2257074 - protein, 12 aa, Cryptosporidium parvum
EQATKLPEEIKQ

SEQ ID NO: 2257075 - protein, 5 aa, Cryptosporidium parvum
EQCED

SEQ ID NO: 2257076 - protein, 7 aa, Cryptosporidium parvum
EQCEKES

SEQ ID NO: 2257077 - protein, 9 aa, Cryptosporidium parvum
EQDESAPGH

SEQ ID NO: 2257078 - protein, 14 aa, Cryptosporidium parvum
EQDKIDETNRIQQG

SEQ ID NO: 2257079 - protein, 24 aa, Cryptosporidium parvum
EQDLSSKIDSLRTQDTIHGNYESN

SEQ ID NO: 2257080 - protein, 5 aa, Cryptosporidium parvum
EQDNR

SEQ ID NO: 2257081 - protein, 12 aa, Cryptosporidium parvum
EQDPRQVRAPVS

SEQ ID NO: 2257082 - protein, 6 aa, Cryptosporidium parvum
EQDRNR

SEQ ID NO: 2257083 - protein, 14 aa, Cryptosporidium parvum
EQEENSGSEGRNGF

SEQ ID NO: 2257084 - protein, 19 aa, Cryptosporidium parvum
EQEFNKTSYSCSQTNNQSK

SEQ ID NO: 2257085 - protein, 12 aa, Cryptosporidium parvum
EQEIDEQNTYQI

SEQ ID NO: 2257086 - protein, 11 aa, Cryptosporidium parvum
EQEKKGSSFKQ

SEQ ID NO: 2257087 - protein, 10 aa, Cryptosporidium parvum
EQEKNTLQES

SEQ ID NO: 2257088 - protein, 11 aa, Cryptosporidium parvum
EQEKSWKQREA

SEQ ID NO: 2257089 - protein, 14 aa, Cryptosporidium parvum
EQENDNNNNEEEIS

SEQ ID NO: 2257090 - protein, 10 aa, Cryptosporidium parvum
EQENEDTNNI

SEQ ID NO: 2257091 - protein, 8 aa, Cryptosporidium parvum
EQENMDRK

SEQ ID NO: 2257092 - protein, 15 aa, Cryptosporidium parvum
EQEQEQEQEQEQELN

SEQ ID NO: 2257093 - protein, 14 aa, Cryptosporidium parvum
EQEREDSKEGNQVT

SEQ ID NO: 2257094 - protein, 6 aa, Cryptosporidium parvum
EQERQI

SEQ ID NO: 2257095 - protein, 5 aa, Cryptosporidium parvum
EQERS

SEQ ID NO: 2257096 - protein, 16 aa, Cryptosporidium parvum
EQERSDDGFIPSFIFH

SEQ ID NO: 2257097 - protein, 20 aa, Cryptosporidium parvum
EQESDDGGDIEGEEETLEER

SEQ ID NO: 2257098 - protein, 7 aa, Cryptosporidium parvum
EQESGAQ

SEQ ID NO: 2257099 - protein, 11 aa, Cryptosporidium parvum
EQESQENWTEA

SEQ ID NO: 2257100 - protein, 14 aa, Cryptosporidium parvum
EQETSTPGQFGGTN

SEQ ID NO: 2257101 - protein, 4 aa, Cryptosporidium parvum
EQEV

SEQ ID NO: 2257102 - protein, 18 aa, Cryptosporidium parvum
EQFNSNTFPEKEQETKNL

SEQ ID NO: 2257103 - protein, 6 aa, Cryptosporidium parvum
EQFQGA

SEQ ID NO: 2257104 - protein, 13 aa, Cryptosporidium parvum
EQFSNKGKERSNA

SEQ ID NO: 2257105 - protein, 16 aa, Cryptosporidium parvum
EQGEAEEKKKTTETLA

SEQ ID NO: 2257106 - protein, 6 aa, Cryptosporidium parvum
EQGFSE

SEQ ID NO: 2257107 - protein, 20 aa, Cryptosporidium parvum
EQGKNNEKEESNKENNKNNE

SEQ ID NO: 2257108 - protein, 5 aa, Cryptosporidium parvum
EQGLI

SEQ ID NO: 2257109 - protein, 7 aa, Cryptosporidium parvum
EQGPFGS

SEQ ID NO: 2257110 - protein, 10 aa, Cryptosporidium parvum
EQGPSKNSNL

SEQ ID NO: 2257111 - protein, 4 aa, Cryptosporidium parvum
EQGR

SEQ ID NO: 2257112 - protein, 7 aa, Cryptosporidium parvum
EQGYRAR

SEQ ID NO: 2257113 - protein, 6 aa, Cryptosporidium parvum
EQHNQL

SEQ ID NO: 2257114 - protein, 8 aa, Cryptosporidium parvum
EQHSLNSN

SEQ ID NO: 2257115 - protein, 22 aa, Cryptosporidium parvum
EQHSSVKEHQPNGNHSTGALGG

SEQ ID NO: 2257116 - protein, 6 aa, Cryptosporidium parvum
EQHYPT

SEQ ID NO: 2257117 - protein, 4 aa, Cryptosporidium parvum
EQID

SEQ ID NO: 2257118 - protein, 6 aa, Cryptosporidium parvum
EQIETN

SEQ ID NO: 2257119 - protein, 20 aa, Cryptosporidium parvum
EQIKDNSTIKKEISSNTSQI

SEQ ID NO: 2257120 - protein, 10 aa, Cryptosporidium parvum
EQIKGNDKKM

SEQ ID NO: 2257121 - protein, 26 aa, Cryptosporidium parvum
EQIKHNSAESAKPKMEASSPPQNVTK

SEQ ID NO: 2257122 - protein, 10 aa, Cryptosporidium parvum
EQIKSNSTVP

SEQ ID NO: 2257123 - protein, 10 aa, Cryptosporidium parvum
EQIKTDENLS

SEQ ID NO: 2257124 - protein, 4 aa, Cryptosporidium parvum
EQIN

SEQ ID NO: 2257125 - protein, 28 aa, Cryptosporidium parvum
EQIPSDSDFAESGSESDDAGLDVAQEEQ

SEQ ID NO: 2257126 - protein, 5 aa, Cryptosporidium parvum
EQIRD

SEQ ID NO: 2257127 - protein, 6 aa, Cryptosporidium parvum
EQIRQD

SEQ ID NO: 2257128 - protein, 5 aa, Cryptosporidium parvum
EQKED

SEQ ID NO: 2257129 - protein, 15 aa, Cryptosporidium parvum
EQKEHSRNAEDASKM

SEQ ID NO: 2257130 - protein, 9 aa, Cryptosporidium parvum
EQKESFREG

SEQ ID NO: 2257131 - protein, 5 aa, Cryptosporidium parvum
EQKEV

SEQ ID NO: 2257132 - protein, 11 aa, Cryptosporidium parvum
EQKKRGDNATH

SEQ ID NO: 2257133 - protein, 6 aa, Cryptosporidium parvum
EQKKRI

SEQ ID NO: 2257134 - protein, 8 aa, Cryptosporidium parvum
EQKKRTFR

SEQ ID NO: 2257135 - protein, 18 aa, Cryptosporidium parvum
EQKLQREKGVTSKPIKNV

SEQ ID NO: 2257136 - protein, 15 aa, Cryptosporidium parvum
EQKNASVNNFENDEE

SEQ ID NO: 2257137 - protein, 13 aa, Cryptosporidium parvum
EQKPGSPERPLSD

SEQ ID NO: 2257138 - protein, 8 aa, Cryptosporidium parvum
EQKQKQKS

SEQ ID NO: 2257139 - protein, 9 aa, Cryptosporidium parvum
EQKSGNNSE

SEQ ID NO: 2257140 - protein, 21 aa, Cryptosporidium parvum
EQKSTPSFQPEINENSRQIAE

SEQ ID NO: 2257141 - protein, 7 aa, Cryptosporidium parvum
EQLEEKT

SEQ ID NO: 2257142 - protein, 22 aa, Cryptosporidium parvum
EQLESGSQKNKSNSKKLKDLDS

SEQ ID NO: 2257143 - protein, 12 aa, Cryptosporidium parvum
EQLGSKGEMRRQ

SEQ ID NO: 2257144 - protein, 8 aa, Cryptosporidium parvum
EQLPSQDQ

SEQ ID NO: 2257145 - protein, 15 aa, Cryptosporidium parvum
EQMRNSGKESKDIDR

SEQ ID NO: 2257146 - protein, 7 aa, Cryptosporidium parvum
EQMRNSQ

SEQ ID NO: 2257147 - protein, 9 aa, Cryptosporidium parvum
EQNDDQGGL

SEQ ID NO: 2257148 - protein, 5 aa, Cryptosporidium parvum
EQNEI

SEQ ID NO: 2257149 - protein, 14 aa, Cryptosporidium parvum
EQNHSESINRNTHD

SEQ ID NO: 2257150 - protein, 23 aa, Cryptosporidium parvum
EQNKKFEKTLNEGLASAQTEQGV

SEQ ID NO: 2257151 - protein, 9 aa, Cryptosporidium parvum
EQNRRTDEK

SEQ ID NO: 2257152 - protein, 8 aa, Cryptosporidium parvum
EQNRTNNQ

SEQ ID NO: 2257153 - protein, 7 aa, Cryptosporidium parvum
EQNSGID

SEQ ID NO: 2257154 - protein, 8 aa, Cryptosporidium parvum
EQNSPKSL

SEQ ID NO: 2257155 - protein, 6 aa, Cryptosporidium parvum
EQPANK

SEQ ID NO: 2257156 - protein, 6 aa, Cryptosporidium parvum
EQPAYT

SEQ ID NO: 2257157 - protein, 20 aa, Cryptosporidium parvum
EQPESDETLTSKAGPPSSTL

SEQ ID NO: 2257158 - protein, 4 aa, Cryptosporidium parvum
EQPI

SEQ ID NO: 2257159 - protein, 5 aa, Cryptosporidium parvum
EQPLE

SEQ ID NO: 2257160 - protein, 13 aa, Cryptosporidium parvum
EQPLGQNSHGNQT

SEQ ID NO: 2257161 - protein, 8 aa, Cryptosporidium parvum
EQQESSDH

SEQ ID NO: 2257162 - protein, 7 aa, Cryptosporidium parvum
EQQGDES

SEQ ID NO: 2257163 - protein, 12 aa, Cryptosporidium parvum
EQQRRRKMNEQL

SEQ ID NO: 2257164 - protein, 7 aa, Cryptosporidium parvum
EQQTQAK

SEQ ID NO: 2257165 - protein, 12 aa, Cryptosporidium parvum
EQRERETKKRYN

SEQ ID NO: 2257166 - protein, 6 aa, Cryptosporidium parvum
EQRERF

SEQ ID NO: 2257167 - protein, 6 aa, Cryptosporidium parvum
EQRKPP

SEQ ID NO: 2257168 - protein, 5 aa, Cryptosporidium parvum
EQRNV

SEQ ID NO: 2257169 - protein, 5 aa, Cryptosporidium parvum
EQRQE

SEQ ID NO: 2257170 - protein, 7 aa, Cryptosporidium parvum
EQRRRNK

SEQ ID NO: 2257171 - protein, 6 aa, Cryptosporidium parvum
EQRSRK

SEQ ID NO: 2257172 - protein, 47 aa, Cryptosporidium parvum
EQSADTEESNEHTSNKATNTTTNNERVQTESNGVRAATPKKTQDIES

SEQ ID NO: 2257173 - protein, 9 aa, Cryptosporidium parvum
EQSEKNWSQ

SEQ ID NO: 2257174 - protein, 5 aa, Cryptosporidium parvum
EQSIE

SEQ ID NO: 2257175 - protein, 5 aa, Cryptosporidium parvum
EQSIN

SEQ ID NO: 2257176 - protein, 6 aa, Cryptosporidium parvum
EQSNTQ

SEQ ID NO: 2257177 - protein, 8 aa, Cryptosporidium parvum
EQSPESNI

SEQ ID NO: 2257178 - protein, 4 aa, Cryptosporidium parvum
EQSR

SEQ ID NO: 2257179 - protein, 7 aa, Cryptosporidium parvum
EQSRINA

SEQ ID NO: 2257180 - protein, 11 aa, Cryptosporidium parvum
EQSSPKKLTSL

SEQ ID NO: 2257181 - protein, 16 aa, Cryptosporidium parvum
EQTDINNTVNSEEADN

SEQ ID NO: 2257182 - protein, 12 aa, Cryptosporidium parvum
EQTGGSNSSHSA

SEQ ID NO: 2257183 - protein, 4 aa, Cryptosporidium parvum
EQTI

SEQ ID NO: 2257184 - protein, 6 aa, Cryptosporidium parvum
EQTKDI

SEQ ID NO: 2257185 - protein, 5 aa, Cryptosporidium parvum
EQTKF

SEQ ID NO: 2257186 - protein, 19 aa, Cryptosporidium parvum
EQTKMSGEDEHKNTLATYA

SEQ ID NO: 2257187 - protein, 10 aa, Cryptosporidium parvum
EQTKNNISKE

SEQ ID NO: 2257188 - protein, 6 aa, Cryptosporidium parvum
EQTNEE

SEQ ID NO: 2257189 - protein, 9 aa, Cryptosporidium parvum
EQTNNHQNY

SEQ ID NO: 2257190 - protein, 5 aa, Cryptosporidium parvum
EQTQD

SEQ ID NO: 2257191 - protein, 21 aa, Cryptosporidium parvum
EQTQNRNRNQNQNQSQKQQLT

SEQ ID NO: 2257192 - protein, 9 aa, Cryptosporidium parvum
EQVEDQQAD

SEQ ID NO: 2257193 - protein, 9 aa, Cryptosporidium parvum
EQVEEAKNE

SEQ ID NO: 2257194 - protein, 4 aa, Cryptosporidium parvum
EQVQ

SEQ ID NO: 2257195 - protein, 7 aa, Cryptosporidium parvum
EQYDGET

SEQ ID NO: 2257196 - protein, 5 aa, Cryptosporidium parvum
EQYEA

SEQ ID NO: 2257197 - protein, 12 aa, Cryptosporidium parvum
EQYEKLKNNELE

SEQ ID NO: 2257198 - protein, 7 aa, Cryptosporidium parvum
EQYQDEL

SEQ ID NO: 2257199 - protein, 4 aa, Cryptosporidium parvum
ERAC

SEQ ID NO: 2257200 - protein, 6 aa, Cryptosporidium parvum
ERAHTP

SEQ ID NO: 2257201 - protein, 10 aa, Cryptosporidium parvum
ERAITDDDPN

SEQ ID NO: 2257202 - protein, 6 aa, Cryptosporidium parvum
ERAMTK

SEQ ID NO: 2257203 - protein, 4 aa, Cryptosporidium parvum
ERAR

SEQ ID NO: 2257204 - protein, 6 aa, Cryptosporidium parvum
ERARLS

SEQ ID NO: 2257205 - protein, 9 aa, Cryptosporidium parvum
ERASEEDLK

SEQ ID NO: 2257206 - protein, 10 aa, Cryptosporidium parvum
ERASKNKEKI

SEQ ID NO: 2257207 - protein, 6 aa, Cryptosporidium parvum
ERDERW

SEQ ID NO: 2257208 - protein, 12 aa, Cryptosporidium parvum
ERDNSDDQYSGF

SEQ ID NO: 2257209 - protein, 7 aa, Cryptosporidium parvum
ERDPREE

SEQ ID NO: 2257210 - protein, 9 aa, Cryptosporidium parvum
ERDPTEQEQ

SEQ ID NO: 2257211 - protein, 10 aa, Cryptosporidium parvum
ERDQNEQLSI

SEQ ID NO: 2257212 - protein, 20 aa, Cryptosporidium parvum
ERDRSQGGVGQSENGTDLGV

SEQ ID NO: 2257213 - protein, 8 aa, Cryptosporidium parvum
ERDSNIRT

SEQ ID NO: 2257214 - protein, 8 aa, Cryptosporidium parvum
ERDTEDNY

SEQ ID NO: 2257215 - protein, 7 aa, Cryptosporidium parvum
ERDTSRK

SEQ ID NO: 2257216 - protein, 11 aa, Cryptosporidium parvum
ERDYDSKSDLK

SEQ ID NO: 2257217 - protein, 10 aa, Cryptosporidium parvum
EREAKTQERL

SEQ ID NO: 2257218 - protein, 6 aa, Cryptosporidium parvum
ERECSP

SEQ ID NO: 2257219 - protein, 6 aa, Cryptosporidium parvum
EREEGI

SEQ ID NO: 2257220 - protein, 6 aa, Cryptosporidium parvum
EREGRS

SEQ ID NO: 2257221 - protein, 10 aa, Cryptosporidium parvum
EREKEQEEQL

SEQ ID NO: 2257222 - protein, 7 aa, Cryptosporidium parvum
ERELQSA

SEQ ID NO: 2257223 - protein, 18 aa, Cryptosporidium parvum
ERELSEAANAPIEDDDED

SEQ ID NO: 2257224 - protein, 9 aa, Cryptosporidium parvum
ERENERVEK

SEQ ID NO: 2257225 - protein, 5 aa, Cryptosporidium parvum
ERENK

SEQ ID NO: 2257226 - protein, 12 aa, Cryptosporidium parvum
ERFKDDNSAQRI

SEQ ID NO: 2257227 - protein, 5 aa, Cryptosporidium parvum
ERFKG

SEQ ID NO: 2257228 - protein, 5 aa, Cryptosporidium parvum
ERGFL

SEQ ID NO: 2257229 - protein, 36 aa, Cryptosporidium parvum
ERGGFGKGFGSRGGDRGGRGKGPRGRSRASPAEDEL

SEQ ID NO: 2257230 - protein, 4 aa, Cryptosporidium parvum
ERGK

SEQ ID NO: 2257231 - protein, 17 aa, Cryptosporidium parvum
ERGKGIESKNRNNSVDE

SEQ ID NO: 2257232 - protein, 6 aa, Cryptosporidium parvum
ERGNEM

SEQ ID NO: 2257233 - protein, 5 aa, Cryptosporidium parvum
ERGNR

SEQ ID NO: 2257234 - protein, 9 aa, Cryptosporidium parvum
ERGNSTNNT

SEQ ID NO: 2257235 - protein, 12 aa, Cryptosporidium parvum
ERGQKGQATDGV

SEQ ID NO: 2257236 - protein, 21 aa, Cryptosporidium parvum
ERGRSLARKEENKRERGRSLT

SEQ ID NO: 2257237 - protein, 5 aa, Cryptosporidium parvum
ERHEV

SEQ ID NO: 2257238 - protein, 13 aa, Cryptosporidium parvum
ERHKGKSKTNQEI

SEQ ID NO: 2257239 - protein, 4 aa, Cryptosporidium parvum
ERIE

SEQ ID NO: 2257240 - protein, 6 aa, Cryptosporidium parvum
ERIESQ

SEQ ID NO: 2257241 - protein, 4 aa, Cryptosporidium parvum
ERII

SEQ ID NO: 2257242 - protein, 10 aa, Cryptosporidium parvum
ERINPTQEVS

SEQ ID NO: 2257243 - protein, 9 aa, Cryptosporidium parvum
ERISGKQAD

SEQ ID NO: 2257244 - protein, 14 aa, Cryptosporidium parvum
ERISRGSGTSNQDV

SEQ ID NO: 2257245 - protein, 4 aa, Cryptosporidium parvum
ERKD

SEQ ID NO: 2257246 - protein, 8 aa, Cryptosporidium parvum
ERKEREKL

SEQ ID NO: 2257247 - protein, 12 aa, Cryptosporidium parvum
ERKEYEGPRDTW

SEQ ID NO: 2257248 - protein, 4 aa, Cryptosporidium parvum
ERKK

SEQ ID NO: 2257249 - protein, 11 aa, Cryptosporidium parvum
ERKKARDNRGK

SEQ ID NO: 2257250 - protein, 22 aa, Cryptosporidium parvum
ERKKKGIRKEDSNGKNDEFLDE

SEQ ID NO: 2257251 - protein, 7 aa, Cryptosporidium parvum
ERKKQTI

SEQ ID NO: 2257252 - protein, 8 aa, Cryptosporidium parvum
ERKNDHDK

SEQ ID NO: 2257253 - protein, 25 aa, Cryptosporidium parvum
ERKNNKDGINSKSGPRIPRTTRHDP

SEQ ID NO: 2257254 - protein, 18 aa, Cryptosporidium parvum
ERKNQAQQALEKKKHELE

SEQ ID NO: 2257255 - protein, 12 aa, Cryptosporidium parvum
ERKQEKKVQQQK

SEQ ID NO: 2257256 - protein, 10 aa, Cryptosporidium parvum
ERKQRREEFE

SEQ ID NO: 2257257 - protein, 4 aa, Cryptosporidium parvum
ERKR

SEQ ID NO: 2257258 - protein, 31 aa, Cryptosporidium parvum
ERKREEKQKEKERDEAKEENKEEKDKGENMD

SEQ ID NO: 2257259 - protein, 29 aa, Cryptosporidium parvum
ERKRGKRYKSSANCSSTSNSCNNSGAGTG

SEQ ID NO: 2257260 - protein, 9 aa, Cryptosporidium parvum
ERKRNSSHS

SEQ ID NO: 2257261 - protein, 5 aa, Cryptosporidium parvum
ERKSI

SEQ ID NO: 2257262 - protein, 19 aa, Cryptosporidium parvum
ERKSSENVYSRQSQKPNTH

SEQ ID NO: 2257263 - protein, 4 aa, Cryptosporidium parvum
ERLA

SEQ ID NO: 2257264 - protein, 6 aa, Cryptosporidium parvum
ERLDSD

SEQ ID NO: 2257265 - protein, 10 aa, Cryptosporidium parvum
ERLEKQEDTL

SEQ ID NO: 2257266 - protein, 8 aa, Cryptosporidium parvum
ERLKAEAN

SEQ ID NO: 2257267 - protein, 4 aa, Cryptosporidium parvum
ERLP

SEQ ID NO: 2257268 - protein, 28 aa, Cryptosporidium parvum
ERLQRKKKYRRTLKERSEASANAKKEYQ

SEQ ID NO: 2257269 - protein, 11 aa, Cryptosporidium parvum
ERLREKNEELR

SEQ ID NO: 2257270 - protein, 7 aa, Cryptosporidium parvum
ERLSASQ

SEQ ID NO: 2257271 - protein, 20 aa, Cryptosporidium parvum
ERLSRKVDKTSFSSGSNVRN

SEQ ID NO: 2257272 - protein, 6 aa, Cryptosporidium parvum
ERLSSQ

SEQ ID NO: 2257273 - protein, 5 aa, Cryptosporidium parvum
ERLTK

SEQ ID NO: 2257274 - protein, 4 aa, Cryptosporidium parvum
ERNE

SEQ ID NO: 2257275 - protein, 8 aa, Cryptosporidium parvum
ERNENERL

SEQ ID NO: 2257276 - protein, 21 aa, Cryptosporidium parvum
ERNETYKISKSSPNNNSTEYQ

SEQ ID NO: 2257277 - protein, 12 aa, Cryptosporidium parvum
ERNEYKYKNDTY

SEQ ID NO: 2257278 - protein, 4 aa, Cryptosporidium parvum
ERNG

SEQ ID NO: 2257279 - protein, 9 aa, Cryptosporidium parvum
ERNKESLHN

SEQ ID NO: 2257280 - protein, 16 aa, Cryptosporidium parvum
ERNKPIEPPKKPESAP

SEQ ID NO: 2257281 - protein, 14 aa, Cryptosporidium parvum
ERNLSQSSPNMPDE

SEQ ID NO: 2257282 - protein, 5 aa, Cryptosporidium parvum
ERNQM

SEQ ID NO: 2257283 - protein, 10 aa, Cryptosporidium parvum
ERNQNGKLEG

SEQ ID NO: 2257284 - protein, 6 aa, Cryptosporidium parvum
ERNQQK

SEQ ID NO: 2257285 - protein, 6 aa, Cryptosporidium parvum
ERNREF

SEQ ID NO: 2257286 - protein, 7 aa, Cryptosporidium parvum
ERPAPEA

SEQ ID NO: 2257287 - protein, 4 aa, Cryptosporidium parvum
ERPL

SEQ ID NO: 2257288 - protein, 9 aa, Cryptosporidium parvum
ERPRKVGAK

SEQ ID NO: 2257289 - protein, 9 aa, Cryptosporidium parvum
ERPTDVPDT

SEQ ID NO: 2257290 - protein, 43 aa, Cryptosporidium parvum
ERQDQMKEKNNGGSKSNSKSTRNKPSRNKANNHRNEDSYQRHI

SEQ ID NO: 2257291 - protein, 12 aa, Cryptosporidium parvum
ERQETKNVKEER

SEQ ID NO: 2257292 - protein, 4 aa, Cryptosporidium parvum
ERQF

SEQ ID NO: 2257293 - protein, 30 aa, Cryptosporidium parvum; identical to SEQ ID NO: 2141139

SEQ ID NO: 2257294 - protein, 6 aa, Cryptosporidium parvum
ERQGEY

SEQ ID NO: 2257295 - protein, 4 aa, Cryptosporidium parvum
ERQI

SEQ ID NO: 2257296 - protein, 22 aa, Cryptosporidium parvum
ERQKESNDRKPSSFSQSNQKKN

SEQ ID NO: 2257297 - protein, 11 aa, Cryptosporidium parvum
ERQLTANQHDL

SEQ ID NO: 2257298 - protein, 8 aa, Cryptosporidium parvum
ERQSNRPR

SEQ ID NO: 2257299 - protein, 35 aa, Cryptosporidium parvum
ERQTTGAYMNPSTSTTTVSSKRFKPNSKTETLDSS

SEQ ID NO: 2257300 - protein, 22 aa, Cryptosporidium parvum
ERRDSLRDLENKGNAKNPNARS

SEQ ID NO: 2257301 - protein, 5 aa, Cryptosporidium parvum
ERREL

SEQ ID NO: 2257302 - protein, 5 aa, Cryptosporidium parvum
ERRES

SEQ ID NO: 2257303 - protein, 11 aa, Cryptosporidium parvum
ERRGAKEKKLH

SEQ ID NO: 2257304 - protein, 4 aa, Cryptosporidium parvum
ERRI

SEQ ID NO: 2257305 - protein, 6 aa, Cryptosporidium parvum
ERRKEL

SEQ ID NO: 2257306 - protein, 19 aa, Cryptosporidium parvum
ERRKLGSKKLYGDENEYSR

SEQ ID NO: 2257307 - protein, 16 aa, Cryptosporidium parvum
ERRKQANNNTLDKNPA

SEQ ID NO: 2257308 - protein, 14 aa, Cryptosporidium parvum
ERRLARKSQLTENI

SEQ ID NO: 2257309 - protein, 12 aa, Cryptosporidium parvum
ERRLDQEKINEY

SEQ ID NO: 2257310 - protein, 5 aa, Cryptosporidium parvum
ERRQE

SEQ ID NO: 2257311 - protein, 11 aa, Cryptosporidium parvum
ERRSEIKERRE

SEQ ID NO: 2257312 - protein, 6 aa, Cryptosporidium parvum
ERRSGN

SEQ ID NO: 2257313 - protein, 14 aa, Cryptosporidium parvum
ERSAMQSKVEEQHT

SEQ ID NO: 2257314 - protein, 17 aa, Cryptosporidium parvum
ERSASSASRGSRKKYSQ

SEQ ID NO: 2257315 - protein, 5 aa, Cryptosporidium parvum
ERSCK

SEQ ID NO: 2257316 - protein, 4 aa, Cryptosporidium parvum
ERSF

SEQ ID NO: 2257317 - protein, 6 aa, Cryptosporidium parvum
ERSGQA

SEQ ID NO: 2257318 - protein, 6 aa, Cryptosporidium parvum
ERSKND

SEQ ID NO: 2257319 - protein, 4 aa, Cryptosporidium parvum
ERSL

SEQ ID NO: 2257320 - protein, 5 aa, Cryptosporidium parvum
ERSLN

SEQ ID NO: 2257321 - protein, 15 aa, Cryptosporidium parvum
ERSNHTSELAKKAEK

SEQ ID NO: 2257322 - protein, 14 aa, Cryptosporidium parvum
ERSNKFSSKSYSNF

SEQ ID NO: 2257323 - protein, 10 aa, Cryptosporidium parvum
ERSNNGGDGI

SEQ ID NO: 2257324 - protein, 8 aa, Cryptosporidium parvum
ERSPEDLP

SEQ ID NO: 2257325 - protein, 9 aa, Cryptosporidium parvum
ERSSGIKPS

SEQ ID NO: 2257326 - protein, 8 aa, Cryptosporidium parvum
ERSSSSGG

SEQ ID NO: 2257327 - protein, 16 aa, Cryptosporidium parvum
ERSTENNMGESKASIG

SEQ ID NO: 2257328 - protein, 8 aa, Cryptosporidium parvum
ERSTEPEF

SEQ ID NO: 2257329 - protein, 13 aa, Cryptosporidium parvum
ERSTGSVADPRVP

SEQ ID NO: 2257330 - protein, 24 aa, Cryptosporidium parvum
ERTDSYNSNRGGSRMSSRYDNDEK

SEQ ID NO: 2257331 - protein, 9 aa, Cryptosporidium parvum
ERTFSDEEN

SEQ ID NO: 2257332 - protein, 7 aa, Cryptosporidium parvum
ERTNSPS

SEQ ID NO: 2257333 - protein, 8 aa, Cryptosporidium parvum
ERTPSISS

SEQ ID NO: 2257334 - protein, 9 aa, Cryptosporidium parvum
ERTSNTRER

SEQ ID NO: 2257335 - protein, 18 aa, Cryptosporidium parvum
ERTTFESQKTIKRRLSQA

SEQ ID NO: 2257336 - protein, 7 aa, Cryptosporidium parvum
ERTTSNI

SEQ ID NO: 2257337 - protein, 17 aa, Cryptosporidium parvum
ERVETKEGDEEKVTKDV

SEQ ID NO: 2257338 - protein, 6 aa, Cryptosporidium parvum
ERVSTC

SEQ ID NO: 2257339 - protein, 6 aa, Cryptosporidium parvum
ERWDPN

SEQ ID NO: 2257340 - protein, 7 aa, Cryptosporidium parvum
ERYEEKR

SEQ ID NO: 2257341 - protein, 4 aa, Cryptosporidium parvum
ERYG

SEQ ID NO: 2257342 - protein, 6 aa, Cryptosporidium parvum
ERYRET

SEQ ID NO: 2257343 - protein, 7 aa, Cryptosporidium parvum
ERYRNSN

SEQ ID NO: 2257344 - protein, 10 aa, Cryptosporidium parvum
ERYSNANEEI

SEQ ID NO: 2257345 - protein, 15 aa, Cryptosporidium parvum
ESAEESSQQLTPPNN

SEQ ID NO: 2257346 - protein, 8 aa, Cryptosporidium parvum
ESAEGEKK

SEQ ID NO: 2257347 - protein, 7 aa, Cryptosporidium parvum
ESAEGSR

SEQ ID NO: 2257348 - protein, 10 aa, Cryptosporidium parvum
ESAEGTGIEQ

SEQ ID NO: 2257349 - protein, 12 aa, Cryptosporidium parvum
ESAESTKPFGGR

SEQ ID NO: 2257350 - protein, 7 aa, Cryptosporidium parvum
ESAINQE

SEQ ID NO: 2257351 - protein, 16 aa, Cryptosporidium parvum
ESALRKAGVPPGKPSY

SEQ ID NO: 2257352 - protein, 6 aa, Cryptosporidium parvum
ESANHS

SEQ ID NO: 2257353 - protein, 8 aa, Cryptosporidium parvum
ESANSKTQ

SEQ ID NO: 2257354 - protein, 5 aa, Cryptosporidium parvum
ESAQR

SEQ ID NO: 2257355 - protein, 6 aa, Cryptosporidium parvum
ESARRK

SEQ ID NO: 2257356 - protein, 9 aa, Cryptosporidium parvum
ESARSQELR

SEQ ID NO: 2257357 - protein, 17 aa, Cryptosporidium parvum
ESASDAPKVRDDQMDSF

SEQ ID NO: 2257358 - protein, 7 aa, Cryptosporidium parvum
ESASDNY

SEQ ID NO: 2257359 - protein, 8 aa, Cryptosporidium parvum
ESATDRYP

SEQ ID NO: 2257360 - protein, 5 aa, Cryptosporidium parvum
ESAVG

SEQ ID NO: 2257361 - protein, 18 aa, Cryptosporidium parvum
ESAVSQRFRTDQVEILWR

SEQ ID NO: 2257362 - protein, 4 aa, Cryptosporidium parvum
ESCE

SEQ ID NO: 2257363 - protein, 6 aa, Cryptosporidium parvum
ESCEMT

SEQ ID NO: 2257364 - protein, 16 aa, Cryptosporidium parvum
ESCNEIGKNELNYGSP

SEQ ID NO: 2257365 - protein, 9 aa, Cryptosporidium parvum
ESCNEREYN

SEQ ID NO: 2257366 - protein, 12 aa, Cryptosporidium parvum
ESCQNSNIPEKV

SEQ ID NO: 2257367 - protein, 6 aa, Cryptosporidium parvum
ESCRNA

SEQ ID NO: 2257368 - protein, 11 aa, Cryptosporidium parvum
ESCSGGITEGN

SEQ ID NO: 2257369 - protein, 4 aa, Cryptosporidium parvum
ESCT

SEQ ID NO: 2257370 - protein, 4 aa, Cryptosporidium parvum
ESDD

SEQ ID NO: 2257371 - protein, 5 aa, Cryptosporidium parvum
ESDDC

SEQ ID NO: 2257372 - protein, 8 aa, Cryptosporidium parvum
ESDDDDYD

SEQ ID NO: 2257373 - protein, 13 aa, Cryptosporidium parvum
ESDEEGEEPYVGS

SEQ ID NO: 2257374 - protein, 15 aa, Cryptosporidium parvum
ESDESKSVGGEQEKP

SEQ ID NO: 2257375 - protein, 22 aa, Cryptosporidium parvum
ESDFSEQEYELSENEQNELSRK

SEQ ID NO: 2257376 - protein, 9 aa, Cryptosporidium parvum
ESDGEAIEE

SEQ ID NO: 2257377 - protein, 7 aa, Cryptosporidium parvum
ESDGGQF

SEQ ID NO: 2257378 - protein, 13 aa, Cryptosporidium parvum
ESDGSRNGTNNPY

SEQ ID NO: 2257379 - protein, 8 aa, Cryptosporidium parvum
ESDKEQGN

SEQ ID NO: 2257380 - protein, 36 aa, Cryptosporidium parvum
ESDKKSVDEDKDEKKKEDKEEKKKKDNNSEKERRRA

SEQ ID NO: 2257381 - protein, 4 aa, Cryptosporidium parvum
ESDL

SEQ ID NO: 2257382 - protein, 5 aa, Cryptosporidium parvum
ESDPQ

SEQ ID NO: 2257383 - protein, 8 aa, Cryptosporidium parvum
ESDQSENY

SEQ ID NO: 2257384 - protein, 45 aa, Cryptosporidium parvum
ESDSEKRKGELSDGDDDSENDSDTSESDDEEDNDYDDDNEYYEEY

SEQ ID NO: 2257385 - protein, 6 aa, Cryptosporidium parvum
ESDSSF

SEQ ID NO: 2257386 - protein, 20 aa, Cryptosporidium parvum
ESDSYHSSESDSNHSENSQS

SEQ ID NO: 2257387 - protein, 9 aa, Cryptosporidium parvum
ESDTENNTK

SEQ ID NO: 2257388 - protein, 18 aa, Cryptosporidium parvum
ESDTKSGQENDNTNIRKG

SEQ ID NO: 2257389 - protein, 6 aa, Cryptosporidium parvum
ESDTTT

SEQ ID NO: 2257390 - protein, 8 aa, Cryptosporidium parvum
ESDVDNGD

SEQ ID NO: 2257391 - protein, 5 aa, Cryptosporidium parvum
ESDYR

SEQ ID NO: 2257392 - protein, 9 aa, Cryptosporidium parvum
ESEDEKERF

SEQ ID NO: 2257393 - protein, 7 aa, Cryptosporidium parvum
ESEDELS

SEQ ID NO: 2257394 - protein, 9 aa, Cryptosporidium parvum
ESEDIQSSG

SEQ ID NO: 2257395 - protein, 8 aa, Cryptosporidium parvum
ESEDQLND

SEQ ID NO: 2257396 - protein, 10 aa, Cryptosporidium parvum
ESEEDAKSAF

SEQ ID NO: 2257397 - protein, 17 aa, Cryptosporidium parvum
ESEEPTEDSINNETEEK

SEQ ID NO: 2257398 - protein, 15 aa, Cryptosporidium parvum
ESEEQDVENNGHSND

SEQ ID NO: 2257399 - protein, 5 aa, Cryptosporidium parvum
ESEET

SEQ ID NO: 2257400 - protein, 10 aa, Cryptosporidium parvum
ESEFGKETSC

SEQ ID NO: 2257401 - protein, 24 aa, Cryptosporidium parvum
ESEFGNREEQVSSDSTGESKAGSV

SEQ ID NO: 2257402 - protein, 9 aa, Cryptosporidium parvum
ESEGAKKLN

SEQ ID NO: 2257403 - protein, 27 aa, Cryptosporidium parvum
ESEHENDDKEKQEVNKSNRESGKIENG

SEQ ID NO: 2257404 - protein, 8 aa, Cryptosporidium parvum
ESEIGTST

SEQ ID NO: 2257405 - protein, 8 aa, Cryptosporidium parvum
ESEISKSQ

SEQ ID NO: 2257406 - protein, 23 aa, Cryptosporidium parvum
ESEKDENNSAEDLGSKNSDNFQS

SEQ ID NO: 2257407 - protein, 6 aa, Cryptosporidium parvum
ESEKKE

SEQ ID NO: 2257408 - protein, 19 aa, Cryptosporidium parvum
ESEKQKIRDSESKLAKDNL

SEQ ID NO: 2257409 - protein, 25 aa, Cryptosporidium parvum
ESEKSINDRNTAPSNESCQKQNGRA

SEQ ID NO: 2257410 - protein, 4 aa, Cryptosporidium parvum
ESEL

SEQ ID NO: 2257411 - protein, 6 aa, Cryptosporidium parvum
ESELAG

SEQ ID NO: 2257412 - protein, 13 aa, Cryptosporidium parvum
ESELDNEKTINAS

SEQ ID NO: 2257413 - protein, 9 aa, Cryptosporidium parvum
ESELEPEPE

SEQ ID NO: 2257414 - protein, 13 aa, Cryptosporidium parvum
ESELGSQSETESR

SEQ ID NO: 2257415 - protein, 8 aa, Cryptosporidium parvum
ESENLPGK

SEQ ID NO: 2257416 - protein, 7 aa, Cryptosporidium parvum
ESENQMV

SEQ ID NO: 2257417 - protein, 27 aa, Cryptosporidium parvum
ESEPEPEPEPEPEPEPELEPEFKPEPE

SEQ ID NO: 2257418 - protein, 5 aa, Cryptosporidium parvum
ESERI

SEQ ID NO: 2257419 - protein, 8 aa, Cryptosporidium parvum
ESESELEE

SEQ ID NO: 2257420 - protein, 8 aa, Cryptosporidium parvum
ESESENDI

SEQ ID NO: 2257421 - protein, 10 aa, Cryptosporidium parvum
ESESKDKSHQ

SEQ ID NO: 2257422 - protein, 5 aa, Cryptosporidium parvum
ESESL

SEQ ID NO: 2257423 - protein, 10 aa, Cryptosporidium parvum
ESESSVNCDP

SEQ ID NO: 2257424 - protein, 7 aa, Cryptosporidium parvum
ESESTYD

SEQ ID NO: 2257425 - protein, 5 aa, Cryptosporidium parvum
ESESY

SEQ ID NO: 2257426 - protein, 15 aa, Cryptosporidium parvum
ESETSKHKSQLETPE

SEQ ID NO: 2257427 - protein, 8 aa, Cryptosporidium parvum
ESETVPPE

SEQ ID NO: 2257428 - protein, 4 aa, Cryptosporidium parvum
ESEV

SEQ ID NO: 2257429 - protein, 11 aa, Cryptosporidium parvum
ESEWNKENRFT

SEQ ID NO: 2257430 - protein, 27 aa, Cryptosporidium parvum
ESEYASNAAEIGARRRADLERDENMGR

SEQ ID NO: 2257431 - protein, 6 aa, Cryptosporidium parvum
ESFDGT

SEQ ID NO: 2257432 - protein, 4 aa, Cryptosporidium parvum
ESFE

SEQ ID NO: 2257433 - protein, 13 aa, Cryptosporidium parvum
ESFEEEEEDDDNY

SEQ ID NO: 2257434 - protein, 6 aa, Cryptosporidium parvum
ESFEPF

SEQ ID NO: 2257435 - protein, 6 aa, Cryptosporidium parvum
ESFGTE

SEQ ID NO: 2257436 - protein, 13 aa, Cryptosporidium parvum
ESFGTGSDHIREK

SEQ ID NO: 2257437 - protein, 6 aa, Cryptosporidium parvum
ESFIPG

SEQ ID NO: 2257438 - protein, 6 aa, Cryptosporidium parvum
ESFKEK

SEQ ID NO: 2257439 - protein, 25 aa, Cryptosporidium parvum
ESFKGDPETENDEVNTIKDKTSDIA

SEQ ID NO: 2257440 - protein, 7 aa, Cryptosporidium parvum
ESFKNSD

SEQ ID NO: 2257441 - protein, 8 aa, Cryptosporidium parvum
ESFRSNQR

SEQ ID NO: 2257442 - protein, 11 aa, Cryptosporidium parvum
ESGAGKTEATK

SEQ ID NO: 2257443 - protein, 8 aa, Cryptosporidium parvum
ESGAIDRD

SEQ ID NO: 2257444 - protein, 6 aa, Cryptosporidium parvum
ESGAKF

SEQ ID NO: 2257445 - protein, 44 aa, Cryptosporidium parvum
ESGARENTKDIERRNAYHTNREKIAAERAARKLAKEAKKVQKNN

SEQ ID NO: 2257446 - protein, 4 aa, Cryptosporidium parvum
ESGF

SEQ ID NO: 2257447 - protein, 4 aa, Cryptosporidium parvum
ESGG

SEQ ID NO: 2257448 - protein, 14 aa, Cryptosporidium parvum
ESGGTKNSNTIKTH

SEQ ID NO: 2257449 - protein, 8 aa, Cryptosporidium parvum
ESGHQQNI

SEQ ID NO: 2257450 - protein, 6 aa, Cryptosporidium parvum
ESGIEN

SEQ ID NO: 2257451 - protein, 95 aa, Cryptosporidium parvum
ESGKNAELDKKDGEKVSKKADKDEAIEVNKEEKVEEEDDEEKGEEEEEEEEEEEEEEEEEEEEEEEEEEEEEDDDDDDDEEEEEDDEEEKEEPTI

SEQ ID NO: 2257452 - protein, 9 aa, Cryptosporidium parvum
ESGKNSLSD

SEQ ID NO: 2257453 - protein, 5 aa, Cryptosporidium parvum
ESGKT

SEQ ID NO: 2257454 - protein, 4 aa, Cryptosporidium parvum
ESGL

SEQ ID NO: 2257455 - protein, 13 aa, Cryptosporidium parvum
ESGLNDDLSGYEE

SEQ ID NO: 2257456 - protein, 4 aa, Cryptosporidium parvum
ESGN

SEQ ID NO: 2257457 - protein, 10 aa, Cryptosporidium parvum
ESGNPERKEN

SEQ ID NO: 2257458 - protein, 7 aa, Cryptosporidium parvum
ESGRKEL

SEQ ID NO: 2257459 - protein, 12 aa, Cryptosporidium parvum
ESGSCPKSIKSP

SEQ ID NO: 2257460 - protein, 14 aa, Cryptosporidium parvum
ESGSEKEELDDDEE

SEQ ID NO: 2257461 - protein, 10 aa, Cryptosporidium parvum
ESGSGNPQSF

SEQ ID NO: 2257462 - protein, 9 aa, Cryptosporidium parvum
ESGSNGNFK

SEQ ID NO: 2257463 - protein, 6 aa, Cryptosporidium parvum
ESGSRN

SEQ ID NO: 2257464 - protein, 10 aa, Cryptosporidium parvum
ESGSVSAKLG

SEQ ID NO: 2257465 - protein, 8 aa, Cryptosporidium parvum
ESGTKDRP

SEQ ID NO: 2257466 - protein, 15 aa, Cryptosporidium parvum
ESGTKVSAASHESLA

SEQ ID NO: 2257467 - protein, 15 aa, Cryptosporidium parvum
ESGTLGTKANSETYL

SEQ ID NO: 2257468 - protein, 13 aa, Cryptosporidium parvum
ESGTVEESGTPGL

SEQ ID NO: 2257469 - protein, 4 aa, Cryptosporidium parvum
ESGY

SEQ ID NO: 2257470 - protein, 8 aa, Cryptosporidium parvum
ESGYGNNN

SEQ ID NO: 2257471 - protein, 5 aa, Cryptosporidium parvum
ESGYV

SEQ ID NO: 2257472 - protein, 15 aa, Cryptosporidium parvum
ESHDANTSNISYKPR

SEQ ID NO: 2257473 - protein, 5 aa, Cryptosporidium parvum
ESHGI

SEQ ID NO: 2257474 - protein, 12 aa, Cryptosporidium parvum
ESHGIGGRSRRV

SEQ ID NO: 2257475 - protein, 11 aa, Cryptosporidium parvum
ESHNKQTGSDY

SEQ ID NO: 2257476 - protein, 10 aa, Cryptosporidium parvum
ESHPEYLDGS

SEQ ID NO: 2257477 - protein, 7 aa, Cryptosporidium parvum
ESHRDKN

SEQ ID NO: 2257478 - protein, 4 aa, Cryptosporidium parvum
ESHS

SEQ ID NO: 2257479 - protein, 56 aa, Cryptosporidium parvum
ESHTIEGKERVSKSTTNANEDSPLPPRPIRRQTSEKMQEKGENRVEEVEGGEQTPI

SEQ ID NO: 2257480 - protein, 6 aa, Cryptosporidium parvum
ESIDQF

SEQ ID NO: 2257481 - protein, 4 aa, Cryptosporidium parvum
ESIG

SEQ ID NO: 2257482 - protein, 14 aa, Cryptosporidium parvum
ESIGRSDQIDSDER

SEQ ID NO: 2257483 - protein, 5 aa, Cryptosporidium parvum
ESIKK

SEQ ID NO: 2257484 - protein, 22 aa, Cryptosporidium parvum
ESINNTNPTPITTQQEAPQPNI

SEQ ID NO: 2257485 - protein, 11 aa, Cryptosporidium parvum
ESINRDSSTRL

SEQ ID NO: 2257486 - protein, 6 aa, Cryptosporidium parvum
ESINSK

SEQ ID NO: 2257487 - protein, 6 aa, Cryptosporidium parvum
ESINSP

SEQ ID NO: 2257488 - protein, 24 aa, Cryptosporidium parvum
ESINTKKDEPKLPTSDKKIPSQED

SEQ ID NO: 2257489 - protein, 20 aa, Cryptosporidium parvum
ESIPKSRFPDSAEITSSKKG

SEQ ID NO: 2257490 - protein, 7 aa, Cryptosporidium parvum
ESIRGPE

SEQ ID NO: 2257491 - protein, 19 aa, Cryptosporidium parvum
ESIRKNAEQQLQAAQEQNI

SEQ ID NO: 2257492 - protein, 4 aa, Cryptosporidium parvum
ESIS

SEQ ID NO: 2257493 - protein, 15 aa, Cryptosporidium parvum
ESISEVKPYSEGKCS

SEQ ID NO: 2257494 - protein, 5 aa, Cryptosporidium parvum
ESISN

SEQ ID NO: 2257495 - protein, 41 aa, Cryptosporidium parvum
ESISNDKLNGKDLEEEEEEEEEKGKKREEIQHNQRGQSDRQ

SEQ ID NO: 2257496 - protein, 13 aa, Cryptosporidium parvum
ESISNSNSYISGE

SEQ ID NO: 2257497 - protein, 7 aa, Cryptosporidium parvum
ESISPET

SEQ ID NO: 2257498 - protein, 8 aa, Cryptosporidium parvum
ESITDSEN

SEQ ID NO: 2257499 - protein, 6 aa, Cryptosporidium parvum
ESITKD

SEQ ID NO: 2257500 - protein, 6 aa, Cryptosporidium parvum
ESITPE

SEQ ID NO: 2257501 - protein, 10 aa, Cryptosporidium parvum
ESITTGAYDD

SEQ ID NO: 2257502 - protein, 5 aa, Cryptosporidium parvum
ESKCG

SEQ ID NO: 2257503 - protein, 7 aa, Cryptosporidium parvum
ESKDIPP

SEQ ID NO: 2257504 - protein, 7 aa, Cryptosporidium parvum
ESKDMDQ

SEQ ID NO: 2257505 - protein, 6 aa, Cryptosporidium parvum
ESKDQL

SEQ ID NO: 2257506 - protein, 11 aa, Cryptosporidium parvum
ESKDQSSGNCK

SEQ ID NO: 2257507 - protein, 6 aa, Cryptosporidium parvum
ESKDSR

SEQ ID NO: 2257508 - protein, 6 aa, Cryptosporidium parvum
ESKEDF

SEQ ID NO: 2257509 - protein, 21 aa, Cryptosporidium parvum
ESKEETNNNSLDKNNSETCVE

SEQ ID NO: 2257510 - protein, 10 aa, Cryptosporidium parvum
ESKESSSKVE

SEQ ID NO: 2257511 - protein, 22 aa, Cryptosporidium parvum
ESKFSNGSDKWDRSNGERRNIG

SEQ ID NO: 2257512 - protein, 8 aa, Cryptosporidium parvum
ESKGTKQL

SEQ ID NO: 2257513 - protein, 10 aa, Cryptosporidium parvum
ESKHKENPQA

SEQ ID NO: 2257514 - protein, 5 aa, Cryptosporidium parvum
ESKID

SEQ ID NO: 2257515 - protein, 11 aa, Cryptosporidium parvum
ESKKDSLISSN

SEQ ID NO: 2257516 - protein, 9 aa, Cryptosporidium parvum
ESKKEAKTE

SEQ ID NO: 2257517 - protein, 7 aa, Cryptosporidium parvum
ESKKNHS

SEQ ID NO: 2257518 - protein, 9 aa, Cryptosporidium parvum
ESKKTGVKP

SEQ ID NO: 2257519 - protein, 5 aa, Cryptosporidium parvum
ESKMA

SEQ ID NO: 2257520 - protein, 10 aa, Cryptosporidium parvum
ESKNAEESDL

SEQ ID NO: 2257521 - protein, 6 aa, Cryptosporidium parvum
ESKNEN

SEQ ID NO: 2257522 - protein, 9 aa, Cryptosporidium parvum
ESKNKGNIG

SEQ ID NO: 2257523 - protein, 17 aa, Cryptosporidium parvum
ESKNKQDPTAKKESKLS

SEQ ID NO: 2257524 - protein, 8 aa, Cryptosporidium parvum
ESKNNIYR

SEQ ID NO: 2257525 - protein, 5 aa, Cryptosporidium parvum
ESKNP

SEQ ID NO: 2257526 - protein, 7 aa, Cryptosporidium parvum
ESKNPKL

SEQ ID NO: 2257527 - protein, 7 aa, Cryptosporidium parvum
ESKNSEE

SEQ ID NO: 2257528 - protein, 8 aa, Cryptosporidium parvum
ESKPELSR

SEQ ID NO: 2257529 - protein, 10 aa, Cryptosporidium parvum
ESKPKDGEKN

SEQ ID NO: 2257530 - protein, 21 aa, Cryptosporidium parvum
ESKPNVSDHKSNIESLNHFSL

SEQ ID NO: 2257531 - protein, 6 aa, Cryptosporidium parvum
ESKQIR

SEQ ID NO: 2257532 - protein, 8 aa, Cryptosporidium parvum
ESKRIQNR

SEQ ID NO: 2257533 - protein, 18 aa, Cryptosporidium parvum
ESKRKKKKYKRRKKFSQR

SEQ ID NO: 2257534 - protein, 5 aa, Cryptosporidium parvum
ESKRN

SEQ ID NO: 2257535 - protein, 11 aa, Cryptosporidium parvum
ESKRNENVERK

SEQ ID NO: 2257536 - protein, 13 aa, Cryptosporidium parvum
ESKRPSREQQKKS

SEQ ID NO: 2257537 - protein, 7 aa, Cryptosporidium parvum
ESKSEHV

SEQ ID NO: 2257538 - protein, 15 aa, Cryptosporidium parvum
ESKSITKVKNESDSF

SEQ ID NO: 2257539 - protein, 7 aa, Cryptosporidium parvum
ESKSLEN

SEQ ID NO: 2257540 - protein, 9 aa, Cryptosporidium parvum
ESKSLKEFN

SEQ ID NO: 2257541 - protein, 6 aa, Cryptosporidium parvum
ESKSNN

SEQ ID NO: 2257542 - protein, 11 aa, Cryptosporidium parvum
ESKSNSEKTVI

SEQ ID NO: 2257543 - protein, 6 aa, Cryptosporidium parvum
ESKSTI

SEQ ID NO: 2257544 - protein, 6 aa, Cryptosporidium parvum
ESKSVG

SEQ ID NO: 2257545 - protein, 15 aa, Cryptosporidium parvum
ESKTSVQKNKINNDF

SEQ ID NO: 2257546 - protein, 34 aa, Cryptosporidium parvum
ESKYGNSEEKTKKGAKPASSSFSLGGEEKCNSEK

SEQ ID NO: 2257547 - protein, 29 aa, Cryptosporidium parvum
ESLDSSSRRTTSRSKDQDSSKKESSTKSI

SEQ ID NO: 2257548 - protein, 4 aa, Cryptosporidium parvum
ESLE

SEQ ID NO: 2257549 - protein, 16 aa, Cryptosporidium parvum
ESLEFDSKKDPYPSPC

SEQ ID NO: 2257550 - protein, 20 aa, Cryptosporidium parvum
ESLEGSNTNSDSTYHTNCER

SEQ ID NO: 2257551 - protein, 6 aa, Cryptosporidium parvum
ESLERT

SEQ ID NO: 2257552 - protein, 10 aa, Cryptosporidium parvum
ESLETKESEY

SEQ ID NO: 2257553 - protein, 7 aa, Cryptosporidium parvum
ESLHESK

SEQ ID NO: 2257554 - protein, 12 aa, Cryptosporidium parvum
ESLKRGKSHDAS

SEQ ID NO: 2257555 - protein, 9 aa, Cryptosporidium parvum
ESLLESSGT

SEQ ID NO: 2257556 - protein, 6 aa, Cryptosporidium parvum
ESLNVG

SEQ ID NO: 2257557 - protein, 10 aa, Cryptosporidium parvum
ESLQNSHTTL

SEQ ID NO: 2257558 - protein, 5 aa, Cryptosporidium parvum
ESLQQ

SEQ ID NO: 2257559 - protein, 9 aa, Cryptosporidium parvum
ESLQSSPQY

SEQ ID NO: 2257560 - protein, 10 aa, Cryptosporidium parvum
ESLSSNIEDI

SEQ ID NO: 2257561 - protein, 6 aa, Cryptosporidium parvum
ESLSSS

SEQ ID NO: 2257562 - protein, 18 aa, Cryptosporidium parvum
ESLTGNNDNSNNETAHAG

SEQ ID NO: 2257563 - protein, 5 aa, Cryptosporidium parvum
ESLVN

SEQ ID NO: 2257564 - protein, 5 aa, Cryptosporidium parvum
ESLYE

SEQ ID NO: 2257565 - protein, 5 aa, Cryptosporidium parvum
ESMEE

SEQ ID NO: 2257566 - protein, 14 aa, Cryptosporidium parvum
ESMTQNPSPNQDEQ

SEQ ID NO: 2257567 - protein, 6 aa, Cryptosporidium parvum
ESNAKW

SEQ ID NO: 2257568 - protein, 9 aa, Cryptosporidium parvum
ESNANKNSH

SEQ ID NO: 2257569 - protein, 7 aa, Cryptosporidium parvum
ESNDGLD

SEQ ID NO: 2257570 - protein, 9 aa, Cryptosporidium parvum
ESNDKKNWS

SEQ ID NO: 2257571 - protein, 34 aa, Cryptosporidium parvum
ESNDPEDSEDEHEQNHGQEYDQYHEDEEMHNDGN

SEQ ID NO: 2257572 - protein, 6 aa, Cryptosporidium parvum
ESNDRL

SEQ ID NO: 2257573 - protein, 8 aa, Cryptosporidium parvum
ESNDRSDE

SEQ ID NO: 2257574 - protein, 5 aa, Cryptosporidium parvum
ESNDS

SEQ ID NO: 2257575 - protein, 25 aa, Cryptosporidium parvum
ESNDTSLSLSSSCNSNIDSNIPSAP

SEQ ID NO: 2257576 - protein, 6 aa, Cryptosporidium parvum
ESNEDC

SEQ ID NO: 2257577 - protein, 6 aa, Cryptosporidium parvum
ESNEKI

SEQ ID NO: 2257578 - protein, 14 aa, Cryptosporidium parvum
ESNEKNLSNTKITE

SEQ ID NO: 2257579 - protein, 9 aa, Cryptosporidium parvum
ESNENSGPN

SEQ ID NO: 2257580 - protein, 25 aa, Cryptosporidium parvum
ESNEPAEDEEKDVELRQNSEERPTF

SEQ ID NO: 2257581 - protein, 15 aa, Cryptosporidium parvum
ESNESKISQKSLISL

SEQ ID NO: 2257582 - protein, 4 aa, Cryptosporidium parvum
ESNG

SEQ ID NO: 2257583 - protein, 5 aa, Cryptosporidium parvum
ESNGE

SEQ ID NO: 2257584 - protein, 8 aa, Cryptosporidium parvum
ESNGISKE

SEQ ID NO: 2257585 - protein, 8 aa, Cryptosporidium parvum
ESNGNPDL

SEQ ID NO: 2257586 - protein, 6 aa, Cryptosporidium parvum
ESNIED

SEQ ID NO: 2257587 - protein, 7 aa, Cryptosporidium parvum
ESNIKQE

SEQ ID NO: 2257588 - protein, 21 aa, Cryptosporidium parvum
ESNINGSNTINNSNNYSIDSK

SEQ ID NO: 2257589 - protein, 8 aa, Cryptosporidium parvum
ESNIPRSE

SEQ ID NO: 2257590 - protein, 6 aa, Cryptosporidium parvum
ESNKKF

SEQ ID NO: 2257591 - protein, 6 aa, Cryptosporidium parvum
ESNKPI

SEQ ID NO: 2257592 - protein, 18 aa, Cryptosporidium parvum
ESNLHNATESFPNKESSI

SEQ ID NO: 2257593 - protein, 7 aa, Cryptosporidium parvum
ESNNELQ

SEQ ID NO: 2257594 - protein, 5 aa, Cryptosporidium parvum
ESNNF

SEQ ID NO: 2257595 - protein, 11 aa, Cryptosporidium parvum
ESNNNSCESED

SEQ ID NO: 2257596 - protein, 9 aa, Cryptosporidium parvum
ESNNPDKCD

SEQ ID NO: 2257597 - protein, 12 aa, Cryptosporidium parvum
ESNNQPNYGTNA

SEQ ID NO: 2257598 - protein, 5 aa, Cryptosporidium parvum
ESNNR

SEQ ID NO: 2257599 - protein, 8 aa, Cryptosporidium parvum
ESNNSKAT

SEQ ID NO: 2257600 - protein, 13 aa, Cryptosporidium parvum
ESNNSNNNHKEHH

SEQ ID NO: 2257601 - protein, 12 aa, Cryptosporidium parvum
ESNNTDPTRFDE

SEQ ID NO: 2257602 - protein, 13 aa, Cryptosporidium parvum
ESNPSSNSNSGLE

SEQ ID NO: 2257603 - protein, 5 aa, Cryptosporidium parvum
ESNQL

SEQ ID NO: 2257604 - protein, 6 aa, Cryptosporidium parvum
ESNQLN

SEQ ID NO: 2257605 - protein, 6 aa, Cryptosporidium parvum
ESNQRL

SEQ ID NO: 2257606 - protein, 6 aa, Cryptosporidium parvum
ESNRKL

SEQ ID NO: 2257607 - protein, 7 aa, Cryptosporidium parvum
ESNRQYH

SEQ ID NO: 2257608 - protein, 7 aa, Cryptosporidium parvum
ESNRRNK

SEQ ID NO: 2257609 - protein, 10 aa, Cryptosporidium parvum
ESNSENEQLK

SEQ ID NO: 2257610 - protein, 12 aa, Cryptosporidium parvum
ESNSENKSENEI

SEQ ID NO: 2257611 - protein, 7 aa, Cryptosporidium parvum
ESNSGNY

SEQ ID NO: 2257612 - protein, 5 aa, Cryptosporidium parvum
ESNSN

SEQ ID NO: 2257613 - protein, 10 aa, Cryptosporidium parvum
ESNSNENSNS

SEQ ID NO: 2257614 - protein, 7 aa, Cryptosporidium parvum
ESNSSSN

SEQ ID NO: 2257615 - protein, 5 aa, Cryptosporidium parvum
ESNSV

SEQ ID NO: 2257616 - protein, 12 aa, Cryptosporidium parvum
ESNTLSSETKDN

SEQ ID NO: 2257617 - protein, 8 aa, Cryptosporidium parvum
ESNTRNYQ

SEQ ID NO: 2257618 - protein, 5 aa, Cryptosporidium parvum
ESNVD

SEQ ID NO: 2257619 - protein, 42 aa, Cryptosporidium parvum
ESNYDKENEPLGNDEDRRKDDPEDAQEEEQGDEEEEESETID

SEQ ID NO: 2257620 - protein, 8 aa, Cryptosporidium parvum
ESNYENDQ

SEQ ID NO: 2257621 - protein, 33 aa, Cryptosporidium parvum
ESNYGSNCNPKLDSDYKNNNRKENFEKQESPHA

SEQ ID NO: 2257622 - protein, 5 aa, Cryptosporidium parvum
ESNYS

SEQ ID NO: 2257623 - protein, 6 aa, Cryptosporidium parvum
ESPDAV

SEQ ID NO: 2257624 - protein, 21 aa, Cryptosporidium parvum
ESPEWDTEKINRASHAAGPLS

SEQ ID NO: 2257625 - protein, 8 aa, Cryptosporidium parvum
ESPFEGQE

SEQ ID NO: 2257626 - protein, 7 aa, Cryptosporidium parvum
ESPFSPK

SEQ ID NO: 2257627 - protein, 8 aa, Cryptosporidium parvum
ESPHKKLS

SEQ ID NO: 2257628 - protein, 5 aa, Cryptosporidium parvum
ESPIS

SEQ ID NO: 2257629 - protein, 7 aa, Cryptosporidium parvum
ESPISQE

SEQ ID NO: 2257630 - protein, 4 aa, Cryptosporidium parvum
ESPM

SEQ ID NO: 2257631 - protein, 22 aa, Cryptosporidium parvum
ESPNKSNIENYNGKSSSLSSQI

SEQ ID NO: 2257632 - protein, 4 aa, Cryptosporidium parvum
ESPQ

SEQ ID NO: 2257633 - protein, 16 aa, Cryptosporidium parvum
ESPSKMPDKNSKCTET

SEQ ID NO: 2257634 - protein, 24 aa, Cryptosporidium parvum
ESPSNASSLTKASNPPGSFKPSFA

SEQ ID NO: 2257635 - protein, 8 aa, Cryptosporidium parvum
ESPTEKKK

SEQ ID NO: 2257636 - protein, 8 aa, Cryptosporidium parvum
ESPTGTGK

SEQ ID NO: 2257637 - protein, 9 aa, Cryptosporidium parvum
ESPTHQEKT

SEQ ID NO: 2257638 - protein, 6 aa, Cryptosporidium parvum
ESPTKP

SEQ ID NO: 2257639 - protein, 8 aa, Cryptosporidium parvum
ESPTNRTL

SEQ ID NO: 2257640 - protein, 14 aa, Cryptosporidium parvum
ESQAKDNSNITNKN

SEQ ID NO: 2257641 - protein, 7 aa, Cryptosporidium parvum
ESQDAEL

SEQ ID NO: 2257642 - protein, 6 aa, Cryptosporidium parvum
ESQDLS

SEQ ID NO: 2257643 - protein, 5 aa, Cryptosporidium parvum
ESQDV

SEQ ID NO: 2257644 - protein, 6 aa, Cryptosporidium parvum
ESQEEK

SEQ ID NO: 2257645 - protein, 13 aa, Cryptosporidium parvum
ESQEKNTKTTSKG

SEQ ID NO: 2257646 - protein, 8 aa, Cryptosporidium parvum
ESQGAEPY

SEQ ID NO: 2257647 - protein, 6 aa, Cryptosporidium parvum
ESQKNE

SEQ ID NO: 2257648 - protein, 10 aa, Cryptosporidium parvum
ESQKPTDAEL

SEQ ID NO: 2257649 - protein, 29 aa, Cryptosporidium parvum
ESQNDENSHHSHNNCQKSCKGSDALQPAI

SEQ ID NO: 2257650 - protein, 10 aa, Cryptosporidium parvum
ESQNDHLNQE

SEQ ID NO: 2257651 - protein, 6 aa, Cryptosporidium parvum
ESQNPT

SEQ ID NO: 2257652 - protein, 7 aa, Cryptosporidium parvum
ESQNSME

SEQ ID NO: 2257653 - protein, 4 aa, Cryptosporidium parvum
ESQQ

SEQ ID NO: 2257654 - protein, 11 aa, Cryptosporidium parvum
ESQQDISDSKC

SEQ ID NO: 2257655 - protein, 4 aa, Cryptosporidium parvum
ESQR

SEQ ID NO: 2257656 - protein, 6 aa, Cryptosporidium parvum
ESQRNS

SEQ ID NO: 2257657 - protein, 15 aa, Cryptosporidium parvum
ESQSSSSSMNSSHNL

SEQ ID NO: 2257658 - protein, 4 aa, Cryptosporidium parvum
ESQT

SEQ ID NO: 2257659 - protein, 9 aa, Cryptosporidium parvum
ESQVNEETK

SEQ ID NO: 2257660 - protein, 36 aa, Cryptosporidium parvum
ESQYYRKGNMGNSNSFNNEFTSSNFNESSESSGKVW

SEQ ID NO: 2257661 - protein, 4 aa, Cryptosporidium parvum
ESRD

SEQ ID NO: 2257662 - protein, 14 aa, Cryptosporidium parvum
ESRGKTSGQLESSS

SEQ ID NO: 2257663 - protein, 23 aa, Cryptosporidium parvum
ESRGTDSSSSEDGNEENKESQIK

SEQ ID NO: 2257664 - protein, 15 aa, Cryptosporidium parvum
ESRKERNFKESKKNV

SEQ ID NO: 2257665 - protein, 4 aa, Cryptosporidium parvum
ESRL

SEQ ID NO: 2257666 - protein, 6 aa, Cryptosporidium parvum
ESRQKE

SEQ ID NO: 2257667 - protein, 8 aa, Cryptosporidium parvum
ESRRKQME

SEQ ID NO: 2257668 - protein, 5 aa, Cryptosporidium parvum
ESRSE

SEQ ID NO: 2257669 - protein, 9 aa, Cryptosporidium parvum
ESRSVREKV

SEQ ID NO: 2257670 - protein, 4 aa, Cryptosporidium parvum
ESRY

SEQ ID NO: 2257671 - protein, 8 aa, Cryptosporidium parvum
ESSAESAF

SEQ ID NO: 2257672 - protein, 7 aa, Cryptosporidium parvum
ESSANKV

SEQ ID NO: 2257673 - protein, 16 aa, Cryptosporidium parvum
ESSDDENNPDNNLEME

SEQ ID NO: 2257674 - protein, 7 aa, Cryptosporidium parvum
ESSDFRD

SEQ ID NO: 2257675 - protein, 18 aa, Cryptosporidium parvum
ESSDKSEKRIKEDQISGK

SEQ ID NO: 2257676 - protein, 7 aa, Cryptosporidium parvum
ESSDNIE

SEQ ID NO: 2257677 - protein, 9 aa, Cryptosporidium parvum
ESSDPDQNM

SEQ ID NO: 2257678 - protein, 8 aa, Cryptosporidium parvum
ESSDPSLE

SEQ ID NO: 2257679 - protein, 9 aa, Cryptosporidium parvum
ESSDQSKLE

SEQ ID NO: 2257680 - protein, 4 aa, Cryptosporidium parvum
ESSE

SEQ ID NO: 2257681 - protein, 16 aa, Cryptosporidium parvum
ESSEAGKNKGFSNDDD

SEQ ID NO: 2257682 - protein, 6 aa, Cryptosporidium parvum
ESSEVY

SEQ ID NO: 2257683 - protein, 7 aa, Cryptosporidium parvum
ESSGDIE

SEQ ID NO: 2257684 - protein, 9 aa, Cryptosporidium parvum
ESSGISEQE

SEQ ID NO: 2257685 - protein, 11 aa, Cryptosporidium parvum
ESSGKKNCEQT

SEQ ID NO: 2257686 - protein, 8 aa, Cryptosporidium parvum
ESSGYQRK

SEQ ID NO: 2257687 - protein, 9 aa, Cryptosporidium parvum
ESSHNNNKA

SEQ ID NO: 2257688 - protein, 8 aa, Cryptosporidium parvum
ESSIGTKT

SEQ ID NO: 2257689 - protein, 7 aa, Cryptosporidium parvum
ESSIPKK

SEQ ID NO: 2257690 - protein, 5 aa, Cryptosporidium parvum
ESSIT

SEQ ID NO: 2257691 - protein, 8 aa, Cryptosporidium parvum
ESSKCRSK

SEQ ID NO: 2257692 - protein, 13 aa, Cryptosporidium parvum
ESSKEDLGNIDAS

SEQ ID NO: 2257693 - protein, 7 aa, Cryptosporidium parvum
ESSKHGI

SEQ ID NO: 2257694 - protein, 10 aa, Cryptosporidium parvum
ESSKNGVESN

SEQ ID NO: 2257695 - protein, 8 aa, Cryptosporidium parvum
ESSKQYRR

SEQ ID NO: 2257696 - protein, 5 aa, Cryptosporidium parvum
ESSLE

SEQ ID NO: 2257697 - protein, 8 aa, Cryptosporidium parvum
ESSLGMEP

SEQ ID NO: 2257698 - protein, 5 aa, Cryptosporidium parvum
ESSLN

SEQ ID NO: 2257699 - protein, 12 aa, Cryptosporidium parvum
ESSNDEKSDNFG

SEQ ID NO: 2257700 - protein, 9 aa, Cryptosporidium parvum
ESSNLNNQF

SEQ ID NO: 2257701 - protein, 6 aa, Cryptosporidium parvum
ESSNNF

SEQ ID NO: 2257702 - protein, 7 aa, Cryptosporidium parvum
ESSNPDL

SEQ ID NO: 2257703 - protein, 8 aa, Cryptosporidium parvum
ESSNSLPT

SEQ ID NO: 2257704 - protein, 32 aa, Cryptosporidium parvum
ESSPDTPKSSFPPNQCGKRKRIEQEESKIENV

SEQ ID NO: 2257705 - protein, 15 aa, Cryptosporidium parvum
ESSPNKSGNNSFSDH

SEQ ID NO: 2257706 - protein, 9 aa, Cryptosporidium parvum
ESSPRNRTT

SEQ ID NO: 2257707 - protein, 14 aa, Cryptosporidium parvum
ESSQCKNNKRTGNL

SEQ ID NO: 2257708 - protein, 20 aa, Cryptosporidium parvum
ESSQKISSDELSSESNENKS

SEQ ID NO: 2257709 - protein, 17 aa, Cryptosporidium parvum
ESSQNSHDGNNSSSNGI

SEQ ID NO: 2257710 - protein, 9 aa, Cryptosporidium parvum
ESSQQDGIL

SEQ ID NO: 2257711 - protein, 8 aa, Cryptosporidium parvum
ESSQSSNS

SEQ ID NO: 2257712 - protein, 7 aa, Cryptosporidium parvum
ESSRDGV

SEQ ID NO: 2257713 - protein, 36 aa, Cryptosporidium parvum
ESSRLGEKKINEDEKNNNESENKDEISNTSFSESKM

SEQ ID NO: 2257714 - protein, 12 aa, Cryptosporidium parvum
ESSSDEFSVREF

SEQ ID NO: 2257715 - protein, 7 aa, Cryptosporidium parvum
ESSSEKI

SEQ ID NO: 2257716 - protein, 8 aa, Cryptosporidium parvum
ESSSKNTL

SEQ ID NO: 2257717 - protein, 9 aa, Cryptosporidium parvum
ESSSNDEEL

SEQ ID NO: 2257718 - protein, 7 aa, Cryptosporidium parvum
ESSSNEM

SEQ ID NO: 2257719 - protein, 11 aa, Cryptosporidium parvum
ESSSQSKHPIP

SEQ ID NO: 2257720 - protein, 19 aa, Cryptosporidium parvum
ESSSSSDNNILTTTDSKDG

SEQ ID NO: 2257721 - protein, 12 aa, Cryptosporidium parvum
ESSSVNLENETE

SEQ ID NO: 2257722 - protein, 22 aa, Cryptosporidium parvum
ESSTADSNASANFNDNQKKEFE

SEQ ID NO: 2257723 - protein, 56 aa, Cryptosporidium parvum
ESSTEDRPSSSSSSSSAISSSSSLSASSSSSSSSSSSSSSFSSSSLSFSSSYSSPS

SEQ ID NO: 2257724 - protein, 9 aa, Cryptosporidium parvum
ESSTEEPSL

SEQ ID NO: 2257725 - protein, 6 aa, Cryptosporidium parvum
ESSTEQ

SEQ ID NO: 2257726 - protein, 6 aa, Cryptosporidium parvum
ESSTSS

SEQ ID NO: 2257727 - protein, 9 aa, Cryptosporidium parvum
ESSYITESG

SEQ ID NO: 2257728 - protein, 33 aa, Cryptosporidium parvum
ESTAPTVSSTPASSSSSKIKAITSPKKKNMGGI

SEQ ID NO: 2257729 - protein, 6 aa, Cryptosporidium parvum
ESTAWQ

SEQ ID NO: 2257730 - protein, 5 aa, Cryptosporidium parvum
ESTDL

SEQ ID NO: 2257731 - protein, 8 aa, Cryptosporidium parvum
ESTESNIE

SEQ ID NO: 2257732 - protein, 7 aa, Cryptosporidium parvum
ESTETTN

SEQ ID NO: 2257733 - protein, 5 aa, Cryptosporidium parvum
ESTFD

SEQ ID NO: 2257734 - protein, 5 aa, Cryptosporidium parvum
ESTGE

SEQ ID NO: 2257735 - protein, 5 aa, Cryptosporidium parvum
ESTGG

SEQ ID NO: 2257736 - protein, 8 aa, Cryptosporidium parvum
ESTGQDGV

SEQ ID NO: 2257737 - protein, 12 aa, Cryptosporidium parvum
ESTINKKNNFGT

SEQ ID NO: 2257738 - protein, 6 aa, Cryptosporidium parvum
ESTINS

SEQ ID NO: 2257739 - protein, 5 aa, Cryptosporidium parvum
ESTKE

SEQ ID NO: 2257740 - protein, 37 aa, Cryptosporidium parvum
ESTKKNNSSSSNLYPVTPSSKNQDEKINNNSSRSEFK

SEQ ID NO: 2257741 - protein, 19 aa, Cryptosporidium parvum
ESTKNMSKKLSSEEMEELK

SEQ ID NO: 2257742 - protein, 6 aa, Cryptosporidium parvum
ESTKNT

SEQ ID NO: 2257743 - protein, 41 aa, Cryptosporidium parvum; identical to SEQ ID NO: 2141531

SEQ ID NO: 2257744 - protein, 4 aa, Cryptosporidium parvum
ESTL

SEQ ID NO: 2257745 - protein, 6 aa, Cryptosporidium parvum
ESTNRS

SEQ ID NO: 2257746 - protein, 17 aa, Cryptosporidium parvum
ESTNSSSQANASECNPQ

SEQ ID NO: 2257747 - protein, 6 aa, Cryptosporidium parvum
ESTPNS

SEQ ID NO: 2257748 - protein, 4 aa, Cryptosporidium parvum
ESTS

SEQ ID NO: 2257749 - protein, 10 aa, Cryptosporidium parvum
ESTSGAKAEQ

SEQ ID NO: 2257750 - protein, 8 aa, Cryptosporidium parvum
ESTSIEQI

SEQ ID NO: 2257751 - protein, 10 aa, Cryptosporidium parvum
ESTSSSYSST

SEQ ID NO: 2257752 - protein, 14 aa, Cryptosporidium parvum
ESTSYSRETNKGNE

SEQ ID NO: 2257753 - protein, 11 aa, Cryptosporidium parvum
ESVDGRDTQKD

SEQ ID NO: 2257754 - protein, 9 aa, Cryptosporidium parvum
ESVETSSNI

SEQ ID NO: 2257755 - protein, 6 aa, Cryptosporidium parvum
ESVNNL

SEQ ID NO: 2257756 - protein, 28 aa, Cryptosporidium parvum
ESVPINEDDKGSSIKKPKSILHNRNRNY

SEQ ID NO: 2257757 - protein, 4 aa, Cryptosporidium parvum
ESVS

SEQ ID NO: 2257758 - protein, 8 aa, Cryptosporidium parvum
ESVSKEIQ

SEQ ID NO: 2257759 - protein, 10 aa, Cryptosporidium parvum
ESVSPPSETS

SEQ ID NO: 2257760 - protein, 10 aa, Cryptosporidium parvum
ESWENSQETK

SEQ ID NO: 2257761 - protein, 10 aa, Cryptosporidium parvum
ESYCGSRTTN

SEQ ID NO: 2257762 - protein, 5 aa, Cryptosporidium parvum
ESYGG

SEQ ID NO: 2257763 - protein, 7 aa, Cryptosporidium parvum
ESYGKGD

SEQ ID NO: 2257764 - protein, 9 aa, Cryptosporidium parvum
ESYKGDKLQ

SEQ ID NO: 2257765 - protein, 17 aa, Cryptosporidium parvum
ESYNPMEENVDNKTFDP

SEQ ID NO: 2257766 - protein, 6 aa, Cryptosporidium parvum
ESYPNT

SEQ ID NO: 2257767 - protein, 11 aa, Cryptosporidium parvum
ESYRDNGKNIM

SEQ ID NO: 2257768 - protein, 16 aa, Cryptosporidium parvum
ESYSGSANSVGGNNSL

SEQ ID NO: 2257769 - protein, 5 aa, Cryptosporidium parvum
ESYSR

SEQ ID NO: 2257770 - protein, 6 aa, Cryptosporidium parvum
ESYSRE

SEQ ID NO: 2257771 - protein, 5 aa, Cryptosporidium parvum
ESYTP

SEQ ID NO: 2257772 - protein, 22 aa, Cryptosporidium parvum
ETAATKRESREFPSLPSTSIEI

SEQ ID NO: 2257773 - protein, 4 aa, Cryptosporidium parvum
ETAE

SEQ ID NO: 2257774 - protein, 17 aa, Cryptosporidium parvum
ETAESSSKKEADPPNSS

SEQ ID NO: 2257775 - protein, 7 aa, Cryptosporidium parvum
ETAETYL

SEQ ID NO: 2257776 - protein, 6 aa, Cryptosporidium parvum
ETAEYT

SEQ ID NO: 2257777 - protein, 5 aa, Cryptosporidium parvum
ETAIK

SEQ ID NO: 2257778 - protein, 13 aa, Cryptosporidium parvum
ETAIPTLPSARDG

SEQ ID NO: 2257779 - protein, 10 aa, Cryptosporidium parvum
ETANSMGDNS

SEQ ID NO: 2257780 - protein, 8 aa, Cryptosporidium parvum
ETANTECH

SEQ ID NO: 2257781 - protein, 7 aa, Cryptosporidium parvum
ETAPVSK

SEQ ID NO: 2257782 - protein, 5 aa, Cryptosporidium parvum
ETAQR

SEQ ID NO: 2257783 - protein, 4 aa, Cryptosporidium parvum
ETAS

SEQ ID NO: 2257784 - protein, 14 aa, Cryptosporidium parvum
ETASWSSVKDSIKE

SEQ ID NO: 2257785 - protein, 4 aa, Cryptosporidium parvum
ETCD

SEQ ID NO: 2257786 - protein, 11 aa, Cryptosporidium parvum
ETCPQPQTSEH

SEQ ID NO: 2257787 - protein, 49 aa, Cryptosporidium parvum; identical to SEQ ID NO: 2141573

SEQ ID NO: 2257788 - protein, 13 aa, Cryptosporidium parvum
ETDDQYKYQSQTQ

SEQ ID NO: 2257789 - protein, 5 aa, Cryptosporidium parvum
ETDEC

SEQ ID NO: 2257790 - protein, 11 aa, Cryptosporidium parvum
ETDEEDGEDTI

SEQ ID NO: 2257791 - protein, 6 aa, Cryptosporidium parvum
ETDELR

SEQ ID NO: 2257792 - protein, 6 aa, Cryptosporidium parvum
ETDESW

SEQ ID NO: 2257793 - protein, 6 aa, Cryptosporidium parvum
ETDGRI

SEQ ID NO: 2257794 - protein, 7 aa, Cryptosporidium parvum
ETDINRK

SEQ ID NO: 2257795 - protein, 6 aa, Cryptosporidium parvum
ETDKNG

SEQ ID NO: 2257796 - protein, 4 aa, Cryptosporidium parvum
ETDN

SEQ ID NO: 2257797 - protein, 9 aa, Cryptosporidium parvum
ETDNDQRLN

SEQ ID NO: 2257798 - protein, 11 aa, Cryptosporidium parvum
ETDNEEINKQS

SEQ ID NO: 2257799 - protein, 8 aa, Cryptosporidium parvum
ETDPLSQF

SEQ ID NO: 2257800 - protein, 25 aa, Cryptosporidium parvum
ETDRKSLKYDSDLEQSNKSNSTETG

SEQ ID NO: 2257801 - protein, 5 aa, Cryptosporidium parvum
ETDRT

SEQ ID NO: 2257802 - protein, 19 aa, Cryptosporidium parvum
ETDSNSGEERISSPPAADD

SEQ ID NO: 2257803 - protein, 19 aa, Cryptosporidium parvum
ETDSVHSNQYNLDSRNNSL

SEQ ID NO: 2257804 - protein, 7 aa, Cryptosporidium parvum
ETDTKMK

SEQ ID NO: 2257805 - protein, 9 aa, Cryptosporidium parvum
ETDTNGKNL

SEQ ID NO: 2257806 - protein, 9 aa, Cryptosporidium parvum
ETDTSESIN

SEQ ID NO: 2257807 - protein, 25 aa, Cryptosporidium parvum
ETEDHFSNEGFSDSDLQSEEGEEIN

SEQ ID NO: 2257808 - protein, 4 aa, Cryptosporidium parvum
ETEE

SEQ ID NO: 2257809 - protein, 11 aa, Cryptosporidium parvum
ETEENSEAPTS

SEQ ID NO: 2257810 - protein, 14 aa, Cryptosporidium parvum
ETEGKDKLRIGESP

SEQ ID NO: 2257811 - protein, 4 aa, Cryptosporidium parvum
ETEH

SEQ ID NO: 2257812 - protein, 7 aa, Cryptosporidium parvum
ETEKKEV

SEQ ID NO: 2257813 - protein, 6 aa, Cryptosporidium parvum
ETENIE

SEQ ID NO: 2257814 - protein, 6 aa, Cryptosporidium parvum
ETEPYE

SEQ ID NO: 2257815 - protein, 4 aa, Cryptosporidium parvum
ETEQ

SEQ ID NO: 2257816 - protein, 14 aa, Cryptosporidium parvum
ETERDQVESSKITK

SEQ ID NO: 2257817 - protein, 15 aa, Cryptosporidium parvum
ETETQKEKETESKVV

SEQ ID NO: 2257818 - protein, 7 aa, Cryptosporidium parvum
ETETSQI

SEQ ID NO: 2257819 - protein, 20 aa, Cryptosporidium parvum
ETEVENSSPDLKSSSQKSFS

SEQ ID NO: 2257820 - protein, 4 aa, Cryptosporidium parvum
ETEY

SEQ ID NO: 2257821 - protein, 16 aa, Cryptosporidium parvum
ETEYEEGKRDYESNKN

SEQ ID NO: 2257822 - protein, 25 aa, Cryptosporidium parvum
ETFESQEEINCEDKNEEKNQEIEDK

SEQ ID NO: 2257823 - protein, 33 aa, Cryptosporidium parvum
ETFNENDDNSSTNVSESDLSSESNTDSDDNQEL

SEQ ID NO: 2257824 - protein, 16 aa, Cryptosporidium parvum
ETFPAGDDEPSKSAIE

SEQ ID NO: 2257825 - protein, 9 aa, Cryptosporidium parvum
ETFQDPSKT

SEQ ID NO: 2257826 - protein, 8 aa, Cryptosporidium parvum
ETGAGKHV

SEQ ID NO: 2257827 - protein, 9 aa, Cryptosporidium parvum
ETGCGKTTQ

SEQ ID NO: 2257828 - protein, 5 aa, Cryptosporidium parvum
ETGDE

SEQ ID NO: 2257829 - protein, 9 aa, Cryptosporidium parvum
ETGEANMEL

SEQ ID NO: 2257830 - protein, 5 aa, Cryptosporidium parvum
ETGEE

SEQ ID NO: 2257831 - protein, 5 aa, Cryptosporidium parvum
ETGEK

SEQ ID NO: 2257832 - protein, 14 aa, Cryptosporidium parvum
ETGISNIDEKDSTI

SEQ ID NO: 2257833 - protein, 19 aa, Cryptosporidium parvum
ETGKLTEENISNNSGDTYI

SEQ ID NO: 2257834 - protein, 13 aa, Cryptosporidium parvum
ETGKPSLKTSQGF

SEQ ID NO: 2257835 - protein, 6 aa, Cryptosporidium parvum
ETGKVP

SEQ ID NO: 2257836 - protein, 11 aa, Cryptosporidium parvum
ETGNKSKNDIR

SEQ ID NO: 2257837 - protein, 6 aa, Cryptosporidium parvum
ETGRVS

SEQ ID NO: 2257838 - protein, 9 aa, Cryptosporidium parvum
ETGSGKTGS

SEQ ID NO: 2257839 - protein, 10 aa, Cryptosporidium parvum
ETGSGKTTQL

SEQ ID NO: 2257840 - protein, 4 aa, Cryptosporidium parvum
ETHS

SEQ ID NO: 2257841 - protein, 11 aa, Cryptosporidium parvum
ETHSKTRETVS

SEQ ID NO: 2257842 - protein, 5 aa, Cryptosporidium parvum
ETIDE

SEQ ID NO: 2257843 - protein, 11 aa, Cryptosporidium parvum
ETIDSKLETTR

SEQ ID NO: 2257844 - protein, 14 aa, Cryptosporidium parvum
ETINETASKWSTRL

SEQ ID NO: 2257845 - protein, 4 aa, Cryptosporidium parvum
ETIQ

SEQ ID NO: 2257846 - protein, 6 aa, Cryptosporidium parvum
ETITSE

SEQ ID NO: 2257847 - protein, 5 aa, Cryptosporidium parvum
ETKDD

SEQ ID NO: 2257848 - protein, 11 aa, Cryptosporidium parvum
ETKDSNSPQAG

SEQ ID NO: 2257849 - protein, 10 aa, Cryptosporidium parvum
ETKDWNPEET

SEQ ID NO: 2257850 - protein, 5 aa, Cryptosporidium parvum
ETKEI

SEQ ID NO: 2257851 - protein, 8 aa, Cryptosporidium parvum
ETKEPEED

SEQ ID NO: 2257852 - protein, 35 aa, Cryptosporidium parvum
ETKESSGSDSISGIGVGGSSGAGGPSLSSNGSHSS

SEQ ID NO: 2257853 - protein, 8 aa, Cryptosporidium parvum
ETKKKGGI

SEQ ID NO: 2257854 - protein, 8 aa, Cryptosporidium parvum
ETKKQQSL

SEQ ID NO: 2257855 - protein, 11 aa, Cryptosporidium parvum
ETKKQVESEDE

SEQ ID NO: 2257856 - protein, 6 aa, Cryptosporidium parvum
ETKNRR

SEQ ID NO: 2257857 - protein, 13 aa, Cryptosporidium parvum
ETKQSESKITNVE

SEQ ID NO: 2257858 - protein, 12 aa, Cryptosporidium parvum
ETKQSLKDSKYE

SEQ ID NO: 2257859 - protein, 10 aa, Cryptosporidium parvum
ETKQSQNQKS

SEQ ID NO: 2257860 - protein, 6 aa, Cryptosporidium parvum
ETKSGE

SEQ ID NO: 2257861 - protein, 9 aa, Cryptosporidium parvum
ETKSIKINN

SEQ ID NO: 2257862 - protein, 13 aa, Cryptosporidium parvum
ETKSKLEAAPPKI

SEQ ID NO: 2257863 - protein, 5 aa, Cryptosporidium parvum
ETKSN

SEQ ID NO: 2257864 - protein, 18 aa, Cryptosporidium parvum
ETKVNDGEENATESGSNN

SEQ ID NO: 2257865 - protein, 5 aa, Cryptosporidium parvum
ETKVR

SEQ ID NO: 2257866 - protein, 4 aa, Cryptosporidium parvum
ETLN

SEQ ID NO: 2257867 - protein, 15 aa, Cryptosporidium parvum
ETLNEPKTNSELPKV

SEQ ID NO: 2257868 - protein, 12 aa, Cryptosporidium parvum
ETLNSDNNSSFI

SEQ ID NO: 2257869 - protein, 11 aa, Cryptosporidium parvum
ETLSREQAEER

SEQ ID NO: 2257870 - protein, 6 aa, Cryptosporidium parvum
ETMRDS

SEQ ID NO: 2257871 - protein, 6 aa, Cryptosporidium parvum
ETMTDD

SEQ ID NO: 2257872 - protein, 10 aa, Cryptosporidium parvum
ETNANNETEI

SEQ ID NO: 2257873 - protein, 7 aa, Cryptosporidium parvum
ETNCNNE

SEQ ID NO: 2257874 - protein, 8 aa, Cryptosporidium parvum
ETNEDSLS

SEQ ID NO: 2257875 - protein, 5 aa, Cryptosporidium parvum
ETNEE

SEQ ID NO: 2257876 - protein, 14 aa, Cryptosporidium parvum
ETNESEEKSNLPID

SEQ ID NO: 2257877 - protein, 5 aa, Cryptosporidium parvum
ETNFN

SEQ ID NO: 2257878 - protein, 12 aa, Cryptosporidium parvum
ETNHSTSNIPTT

SEQ ID NO: 2257879 - protein, 8 aa, Cryptosporidium parvum
ETNKARNN

SEQ ID NO: 2257880 - protein, 14 aa, Cryptosporidium parvum
ETNKISEKLEDIST

SEQ ID NO: 2257881 - protein, 8 aa, Cryptosporidium parvum
ETNKLNKE

SEQ ID NO: 2257882 - protein, 13 aa, Cryptosporidium parvum
ETNKVENTKGHAE

SEQ ID NO: 2257883 - protein, 20 aa, Cryptosporidium parvum
ETNLSETTNTNINTNNINNS

SEQ ID NO: 2257884 - protein, 4 aa, Cryptosporidium parvum
ETNN

SEQ ID NO: 2257885 - protein, 16 aa, Cryptosporidium parvum
ETNNGQSSSGNHPKQL

SEQ ID NO: 2257886 - protein, 22 aa, Cryptosporidium parvum
ETNNQASRTEIPKRKPAPSSIN

SEQ ID NO: 2257887 - protein, 5 aa, Cryptosporidium parvum
ETNPD

SEQ ID NO: 2257888 - protein, 23 aa, Cryptosporidium parvum
ETNPLSEIESAHEKALKASQAIQ

SEQ ID NO: 2257889 - protein, 6 aa, Cryptosporidium parvum
ETNRIN

SEQ ID NO: 2257890 - protein, 17 aa, Cryptosporidium parvum
ETNSDCKTNHDLKNFVI

SEQ ID NO: 2257891 - protein, 16 aa, Cryptosporidium parvum
ETNTGERRSKSLSSSN

SEQ ID NO: 2257892 - protein, 10 aa, Cryptosporidium parvum
ETNTSKRPVT

SEQ ID NO: 2257893 - protein, 15 aa, Cryptosporidium parvum
ETNVKQSNSKDTNYN

SEQ ID NO: 2257894 - protein, 7 aa, Cryptosporidium parvum
ETPEGHS

SEQ ID NO: 2257895 - protein, 11 aa, Cryptosporidium parvum
ETPEKLKKQNI

SEQ ID NO: 2257896 - protein, 9 aa, Cryptosporidium parvum
ETPESTQVD

SEQ ID NO: 2257897 - protein, 26 aa, Cryptosporidium parvum
ETPKELEERNRSASRGVKKDKAIKRS

SEQ ID NO: 2257898 - protein, 24 aa, Cryptosporidium parvum
ETPNTTIGTPVTSPRKKSSSTRKV

SEQ ID NO: 2257899 - protein, 6 aa, Cryptosporidium parvum
ETPPLS

SEQ ID NO: 2257900 - protein, 5 aa, Cryptosporidium parvum
ETPQQ

SEQ ID NO: 2257901 - protein, 4 aa, Cryptosporidium parvum
ETPS

SEQ ID NO: 2257902 - protein, 9 aa, Cryptosporidium parvum
ETPSESKPV

SEQ ID NO: 2257903 - protein, 16 aa, Cryptosporidium parvum
ETPYSVAPGSSREGIT

SEQ ID NO: 2257904 - protein, 5 aa, Cryptosporidium parvum
ETQAD

SEQ ID NO: 2257905 - protein, 4 aa, Cryptosporidium parvum
ETQD

SEQ ID NO: 2257906 - protein, 16 aa, Cryptosporidium parvum
ETQDFGNSNEKKSKLF

SEQ ID NO: 2257907 - protein, 28 aa, Cryptosporidium parvum
ETQISQGSAQKKHEESNSAKKKKTKQNV

SEQ ID NO: 2257908 - protein, 4 aa, Cryptosporidium parvum
ETQL

SEQ ID NO: 2257909 - protein, 13 aa, Cryptosporidium parvum
ETQNPNVSKLPAN

SEQ ID NO: 2257910 - protein, 11 aa, Cryptosporidium parvum
ETQNRSRDSKL

SEQ ID NO: 2257911 - protein, 4 aa, Cryptosporidium parvum
ETQP

SEQ ID NO: 2257912 - protein, 15 aa, Cryptosporidium parvum
ETQTNPQNKTKTKLN

SEQ ID NO: 2257913 - protein, 6 aa, Cryptosporidium parvum
ETRDAF

SEQ ID NO: 2257914 - protein, 4 aa, Cryptosporidium parvum
ETRK

SEQ ID NO: 2257915 - protein, 17 aa, Cryptosporidium parvum
ETRKDLDYSNATKPVAR

SEQ ID NO: 2257916 - protein, 4 aa, Cryptosporidium parvum
ETRL

SEQ ID NO: 2257917 - protein, 5 aa, Cryptosporidium parvum
ETRNE

SEQ ID NO: 2257918 - protein, 7 aa, Cryptosporidium parvum
ETRNGNC

SEQ ID NO: 2257919 - protein, 10 aa, Cryptosporidium parvum
ETRNRNTNCD

SEQ ID NO: 2257920 - protein, 11 aa, Cryptosporidium parvum
ETRTKEEDDNY

SEQ ID NO: 2257921 - protein, 15 aa, Cryptosporidium parvum
ETRTNDENIDKESTR

SEQ ID NO: 2257922 - protein, 6 aa, Cryptosporidium parvum
ETRTSL

SEQ ID NO: 2257923 - protein, 18 aa, Cryptosporidium parvum
ETSAEPPLPDNVNKNNRP

SEQ ID NO: 2257924 - protein, 8 aa, Cryptosporidium parvum
ETSGDSYN

SEQ ID NO: 2257925 - protein, 7 aa, Cryptosporidium parvum
ETSGLGN

SEQ ID NO: 2257926 - protein, 9 aa, Cryptosporidium parvum
ETSIGESSN

SEQ ID NO: 2257927 - protein, 10 aa, Cryptosporidium parvum
ETSISKSKIP

SEQ ID NO: 2257928 - protein, 7 aa, Cryptosporidium parvum
ETSKAEY

SEQ ID NO: 2257929 - protein, 5 aa, Cryptosporidium parvum
ETSKM

SEQ ID NO: 2257930 - protein, 12 aa, Cryptosporidium parvum
ETSKNKNHSTSS

SEQ ID NO: 2257931 - protein, 14 aa, Cryptosporidium parvum
ETSKRVEKKVPTNS

SEQ ID NO: 2257932 - protein, 9 aa, Cryptosporidium parvum
ETSKTELEN

SEQ ID NO: 2257933 - protein, 4 aa, Cryptosporidium parvum
ETSL

SEQ ID NO: 2257934 - protein, 12 aa, Cryptosporidium parvum
ETSPDSYWWFIS

SEQ ID NO: 2257935 - protein, 17 aa, Cryptosporidium parvum
ETSPENEPYIILSTNTS

SEQ ID NO: 2257936 - protein, 7 aa, Cryptosporidium parvum
ETSPFHE

SEQ ID NO: 2257937 - protein, 6 aa, Cryptosporidium parvum
ETSPGR

SEQ ID NO: 2257938 - protein, 7 aa, Cryptosporidium parvum
ETSPIQE

SEQ ID NO: 2257939 - protein, 7 aa, Cryptosporidium parvum
ETSPTND

SEQ ID NO: 2257940 - protein, 8 aa, Cryptosporidium parvum
ETSQNSRV

SEQ ID NO: 2257941 - protein, 14 aa, Cryptosporidium parvum
ETSRLSSKEEDYKS

SEQ ID NO: 2257942 - protein, 7 aa, Cryptosporidium parvum
ETSRNSA

SEQ ID NO: 2257943 - protein, 6 aa, Cryptosporidium parvum
ETSRQP

SEQ ID NO: 2257944 - protein, 7 aa, Cryptosporidium parvum
ETSRYEE

SEQ ID NO: 2257945 - protein, 16 aa, Cryptosporidium parvum
ETSSDQNNQNAESSFS

SEQ ID NO: 2257946 - protein, 8 aa, Cryptosporidium parvum
ETSSNRPV

SEQ ID NO: 2257947 - protein, 11 aa, Cryptosporidium parvum
ETSSQNSSKHS

SEQ ID NO: 2257948 - protein, 6 aa, Cryptosporidium parvum
ETSSSD

SEQ ID NO: 2257949 - protein, 6 aa, Cryptosporidium parvum
ETSSSH

SEQ ID NO: 2257950 - protein, 7 aa, Cryptosporidium parvum
ETSSTTN

SEQ ID NO: 2257951 - protein, 15 aa, Cryptosporidium parvum
ETSTRNKNIPNSHTE

SEQ ID NO: 2257952 - protein, 7 aa, Cryptosporidium parvum
ETSTSIT

SEQ ID NO: 2257953 - protein, 8 aa, Cryptosporidium parvum
ETSVPDKK

SEQ ID NO: 2257954 - protein, 7 aa, Cryptosporidium parvum
ETTCPTR

SEQ ID NO: 2257955 - protein, 7 aa, Cryptosporidium parvum
ETTDERR

SEQ ID NO: 2257956 - protein, 6 aa, Cryptosporidium parvum
ETTDSM

SEQ ID NO: 2257957 - protein, 8 aa, Cryptosporidium parvum
ETTDSMGN

SEQ ID NO: 2257958 - protein, 10 aa, Cryptosporidium parvum
ETTEKSSSRI

SEQ ID NO: 2257959 - protein, 5 aa, Cryptosporidium parvum
ETTEN

SEQ ID NO: 2257960 - protein, 6 aa, Cryptosporidium parvum
ETTGRY

SEQ ID NO: 2257961 - protein, 8 aa, Cryptosporidium parvum
ETTINGSR

SEQ ID NO: 2257962 - protein, 5 aa, Cryptosporidium parvum
ETTIS

SEQ ID NO: 2257963 - protein, 6 aa, Cryptosporidium parvum
ETTPKL

SEQ ID NO: 2257964 - protein, 5 aa, Cryptosporidium parvum
ETTRY

SEQ ID NO: 2257965 - protein, 4 aa, Cryptosporidium parvum
ETTV

SEQ ID NO: 2257966 - protein, 8 aa, Cryptosporidium parvum
ETTVPNEK

SEQ ID NO: 2257967 - protein, 23 aa, Cryptosporidium parvum
ETVATETNSNMDECSAKKKSINE

SEQ ID NO: 2257968 - protein, 7 aa, Cryptosporidium parvum
ETVDPER

SEQ ID NO: 2257969 - protein, 12 aa, Cryptosporidium parvum
ETVESENEEELK

SEQ ID NO: 2257970 - protein, 5 aa, Cryptosporidium parvum
ETVGN

SEQ ID NO: 2257971 - protein, 10 aa, Cryptosporidium parvum
ETVNLKDPSL

SEQ ID NO: 2257972 - protein, 4 aa, Cryptosporidium parvum
ETVP

SEQ ID NO: 2257973 - protein, 5 aa, Cryptosporidium parvum
ETVRK

SEQ ID NO: 2257974 - protein, 6 aa, Cryptosporidium parvum
ETVRQS

SEQ ID NO: 2257975 - protein, 39 aa, Cryptosporidium parvum
ETVSGSKYSEFQSNLSKKSNGSSPRSLNNTDRKIAPPET

SEQ ID NO: 2257976 - protein, 8 aa, Cryptosporidium parvum
ETVTESKN

SEQ ID NO: 2257977 - protein, 7 aa, Cryptosporidium parvum
ETVTNQD

SEQ ID NO: 2257978 - protein, 9 aa, Cryptosporidium parvum
ETYNSTYSE

SEQ ID NO: 2257979 - protein, 99 aa, Cryptosporidium parvum
ETYQTDGTYTSKKEQTNTDRTKCVTTTSTTPVQTGTTEKSYKGTVTRETYSVDGKQTSKTEETFDQTVSTNTQSGETVTKTTTRFASGNVDGVTTRTET

SEQ ID NO: 2257980 - protein, 6 aa, Cryptosporidium parvum
EVAHAR

SEQ ID NO: 2257981 - protein, 18 aa, Cryptosporidium parvum
EVAKTSSALATSTYELPD

SEQ ID NO: 2257982 - protein, 6 aa, Cryptosporidium parvum
EVANNY

SEQ ID NO: 2257983 - protein, 12 aa, Cryptosporidium parvum
EVDAGKAETEKL

SEQ ID NO: 2257984 - protein, 5 aa, Cryptosporidium parvum
EVDED

SEQ ID NO: 2257985 - protein, 14 aa, Cryptosporidium parvum
EVDRDIKPTNTEPG

SEQ ID NO: 2257986 - protein, 29 aa, Cryptosporidium parvum
EVDSDDSNSEKESGDEQDKLEKVKRKRNE

SEQ ID NO: 2257987 - protein, 21 aa, Cryptosporidium parvum
EVEEDEEKQKNDLKVKEDGDN

SEQ ID NO: 2257988 - protein, 5 aa, Cryptosporidium parvum
EVEEG

SEQ ID NO: 2257989 - protein, 16 aa, Cryptosporidium parvum
EVEESSQGKRERNDNI

SEQ ID NO: 2257990 - protein, 13 aa, Cryptosporidium parvum
EVEFESKEQSDQL

SEQ ID NO: 2257991 - protein, 9 aa, Cryptosporidium parvum
EVEGSKKNI

SEQ ID NO: 2257992 - protein, 7 aa, Cryptosporidium parvum
EVEKTTE

SEQ ID NO: 2257993 - protein, 7 aa, Cryptosporidium parvum
EVENPSK

SEQ ID NO: 2257994 - protein, 7 aa, Cryptosporidium parvum
EVEPGKR

SEQ ID NO: 2257995 - protein, 8 aa, Cryptosporidium parvum
EVERNGDA

SEQ ID NO: 2257996 - protein, 5 aa, Cryptosporidium parvum
EVESQ

SEQ ID NO: 2257997 - protein, 11 aa, Cryptosporidium parvum
EVESSKNVEDE

SEQ ID NO: 2257998 - protein, 8 aa, Cryptosporidium parvum
EVETEAGM

SEQ ID NO: 2257999 - protein, 7 aa, Cryptosporidium parvum
EVETNSG

SEQ ID NO: 2258000 - protein, 24 aa, Cryptosporidium parvum
EVFERPSRKIRSKNNKHALSFSFG

SEQ ID NO: 2258001 - protein, 8 aa, Cryptosporidium parvum
EVFSSSPP

SEQ ID NO: 2258002 - protein, 9 aa, Cryptosporidium parvum
EVGKSSSGY

SEQ ID NO: 2258003 - protein, 8 aa, Cryptosporidium parvum
EVGRSRGC

SEQ ID NO: 2258004 - protein, 6 aa, Cryptosporidium parvum
EVGSDS

SEQ ID NO: 2258005 - protein, 13 aa, Cryptosporidium parvum
EVGSEPAFHRPIV

SEQ ID NO: 2258006 - protein, 10 aa, Cryptosporidium parvum
EVHESKNEIL

SEQ ID NO: 2258007 - protein, 25 aa, Cryptosporidium parvum
EVKEKEEQDEEKPALNSTIADSQYD

SEQ ID NO: 2258008 - protein, 8 aa, Cryptosporidium parvum
EVKESESA

SEQ ID NO: 2258009 - protein, 15 aa, Cryptosporidium parvum
EVKGETNSSKNNSKI

SEQ ID NO: 2258010 - protein, 4 aa, Cryptosporidium parvum
EVMD

SEQ ID NO: 2258011 - protein, 16 aa, Cryptosporidium parvum
EVNESSRDSQNVESEN

SEQ ID NO: 2258012 - protein, 12 aa, Cryptosporidium parvum
EVNKSLKEEVQV

SEQ ID NO: 2258013 - protein, 30 aa, Cryptosporidium parvum
EVNNDFDNQDVKKQDKLYEDDNDDEDDYYE

SEQ ID NO: 2258014 - protein, 18 aa, Cryptosporidium parvum
EVNTARRQASRQLRKDSQ

SEQ ID NO: 2258015 - protein, 6 aa, Cryptosporidium parvum
EVPDIP

SEQ ID NO: 2258016 - protein, 5 aa, Cryptosporidium parvum
EVPGP

SEQ ID NO: 2258017 - protein, 8 aa, Cryptosporidium parvum
EVPSDSGK

SEQ ID NO: 2258018 - protein, 8 aa, Cryptosporidium parvum
EVPTESLK

SEQ ID NO: 2258019 - protein, 5 aa, Cryptosporidium parvum
EVQEW

SEQ ID NO: 2258020 - protein, 10 aa, Cryptosporidium parvum
EVQKQQDRQA

SEQ ID NO: 2258021 - protein, 9 aa, Cryptosporidium parvum
EVQQAREDA

SEQ ID NO: 2258022 - protein, 4 aa, Cryptosporidium parvum
EVQS

SEQ ID NO: 2258023 - protein, 21 aa, Cryptosporidium parvum
EVRGGYPGERYPPPPYEDPRE

SEQ ID NO: 2258024 - protein, 10 aa, Cryptosporidium parvum
EVRNQGEKEF

SEQ ID NO: 2258025 - protein, 11 aa, Cryptosporidium parvum
EVRNTKEKADN

SEQ ID NO: 2258026 - protein, 11 aa, Cryptosporidium parvum
EVRSGSSTTFG

SEQ ID NO: 2258027 - protein, 7 aa, Cryptosporidium parvum
EVSDDYE

SEQ ID NO: 2258028 - protein, 7 aa, Cryptosporidium parvum
EVSDEEV

SEQ ID NO: 2258029 - protein, 11 aa, Cryptosporidium parvum
EVSDSKKLKRA

SEQ ID NO: 2258030 - protein, 7 aa, Cryptosporidium parvum
EVSDSQK

SEQ ID NO: 2258031 - protein, 14 aa, Cryptosporidium parvum
EVSEANKLDSQLNT

SEQ ID NO: 2258032 - protein, 16 aa, Cryptosporidium parvum
EVSESDKNAGTHIQES

SEQ ID NO: 2258033 - protein, 16 aa, Cryptosporidium parvum
EVSKEDGENGNIREKK

SEQ ID NO: 2258034 - protein, 8 aa, Cryptosporidium parvum
EVSKSEEE

SEQ ID NO: 2258035 - protein, 7 aa, Cryptosporidium parvum
EVSPRHK

SEQ ID NO: 2258036 - protein, 6 aa, Cryptosporidium parvum
EVSQDR

SEQ ID NO: 2258037 - protein, 47 aa, Cryptosporidium parvum
EVSQNEEALSPNTHNIKSKQKISFNASKNHSVSTRGNKMDEYDWDIE

SEQ ID NO: 2258038 - protein, 7 aa, Cryptosporidium parvum
EVSQSDT

SEQ ID NO: 2258039 - protein, 12 aa, Cryptosporidium parvum
EVSQTSTNTNKV

SEQ ID NO: 2258040 - protein, 9 aa, Cryptosporidium parvum
EVSSTPISS

SEQ ID NO: 2258041 - protein, 15 aa, Cryptosporidium parvum
EVTDNSQDSDKENDF

SEQ ID NO: 2258042 - protein, 13 aa, Cryptosporidium parvum
EVTLTEDQKEING

SEQ ID NO: 2258043 - protein, 4 aa, Cryptosporidium parvum
EVTT

SEQ ID NO: 2258044 - protein, 4 aa, Cryptosporidium parvum
EVTV

SEQ ID NO: 2258045 - protein, 4 aa, Cryptosporidium parvum
EVVG

SEQ ID NO: 2258046 - protein, 10 aa, Cryptosporidium parvum
EVYKKNSDVI

SEQ ID NO: 2258047 - protein, 7 aa, Cryptosporidium parvum
EWEPPEE

SEQ ID NO: 2258048 - protein, 4 aa, Cryptosporidium parvum
EWGR

SEQ ID NO: 2258049 - protein, 9 aa, Cryptosporidium parvum
EWKEESRAE

SEQ ID NO: 2258050 - protein, 25 aa, Cryptosporidium parvum
EWVDSDSDTESNISSEYFSSSNESC

SEQ ID NO: 2258051 - protein, 5 aa, Cryptosporidium parvum
EYANK

SEQ ID NO: 2258052 - protein, 10 aa, Cryptosporidium parvum
EYASMESNEM

SEQ ID NO: 2258053 - protein, 11 aa, Cryptosporidium parvum
EYDESSDLNYE

SEQ ID NO: 2258054 - protein, 4 aa, Cryptosporidium parvum
EYDN

SEQ ID NO: 2258055 - protein, 6 aa, Cryptosporidium parvum
EYDNYK

SEQ ID NO: 2258056 - protein, 9 aa, Cryptosporidium parvum
EYDPKTVKT

SEQ ID NO: 2258057 - protein, 6 aa, Cryptosporidium parvum
EYDPSV

SEQ ID NO: 2258058 - protein, 10 aa, Cryptosporidium parvum
EYDSKMREGG

SEQ ID NO: 2258059 - protein, 10 aa, Cryptosporidium parvum
EYDSNPNEID

SEQ ID NO: 2258060 - protein, 8 aa, Cryptosporidium parvum
EYDTQKSI

SEQ ID NO: 2258061 - protein, 10 aa, Cryptosporidium parvum
EYEDDDDQSV

SEQ ID NO: 2258062 - protein, 12 aa, Cryptosporidium parvum
EYEESGKERSDI

SEQ ID NO: 2258063 - protein, 9 aa, Cryptosporidium parvum
EYEKESISH

SEQ ID NO: 2258064 - protein, 8 aa, Cryptosporidium parvum
EYEKKGLT

SEQ ID NO: 2258065 - protein, 13 aa, Cryptosporidium parvum
EYEKQGRGRKTMK

SEQ ID NO: 2258066 - protein, 8 aa, Cryptosporidium parvum
EYESVNKS

SEQ ID NO: 2258067 - protein, 7 aa, Cryptosporidium parvum
EYETVEK

SEQ ID NO: 2258068 - protein, 6 aa, Cryptosporidium parvum
EYGNDK

SEQ ID NO: 2258069 - protein, 9 aa, Cryptosporidium parvum
EYGNSLDSK

SEQ ID NO: 2258070 - protein, 17 aa, Cryptosporidium parvum
EYGQHGSKGEEVSPGPH

SEQ ID NO: 2258071 - protein, 28 aa, Cryptosporidium parvum
EYGRCGNQSYGGQSGRISDIEREGSHTA

SEQ ID NO: 2258072 - protein, 11 aa, Cryptosporidium parvum
EYGTASNIKSR

SEQ ID NO: 2258073 - protein, 6 aa, Cryptosporidium parvum
EYGTKK

SEQ ID NO: 2258074 - protein, 6 aa, Cryptosporidium parvum
EYGTNN

SEQ ID NO: 2258075 - protein, 4 aa, Cryptosporidium parvum
EYHE

SEQ ID NO: 2258076 - protein, 23 aa, Cryptosporidium parvum
EYIEKEDEFDKVDEKQDDSELDE

SEQ ID NO: 2258077 - protein, 8 aa, Cryptosporidium parvum
EYKDEKEY

SEQ ID NO: 2258078 - protein, 13 aa, Cryptosporidium parvum
EYKDNDSNEKNEM

SEQ ID NO: 2258079 - protein, 8 aa, Cryptosporidium parvum
EYKDQESL

SEQ ID NO: 2258080 - protein, 8 aa, Cryptosporidium parvum
EYKEIEDS

SEQ ID NO: 2258081 - protein, 4 aa, Cryptosporidium parvum
EYKK

SEQ ID NO: 2258082 - protein, 8 aa, Cryptosporidium parvum
EYKKNKRN

SEQ ID NO: 2258083 - protein, 4 aa, Cryptosporidium parvum
EYKR

SEQ ID NO: 2258084 - protein, 4 aa, Cryptosporidium parvum
EYKS

SEQ ID NO: 2258085 - protein, 9 aa, Cryptosporidium parvum
EYKSENERR

SEQ ID NO: 2258086 - protein, 26 aa, Cryptosporidium parvum
EYKTTNDSGNTDKNNASLNKNPKNQY

SEQ ID NO: 2258087 - protein, 10 aa, Cryptosporidium parvum
EYLPSGSERI

SEQ ID NO: 2258088 - protein, 12 aa, Cryptosporidium parvum
EYMNGESAKSGI

SEQ ID NO: 2258089 - protein, 15 aa, Cryptosporidium parvum
EYNDPHDVNNNLDNE

SEQ ID NO: 2258090 - protein, 5 aa, Cryptosporidium parvum
EYNED

SEQ ID NO: 2258091 - protein, 25 aa, Cryptosporidium parvum
EYNKNNDNNCNRQKDCHNDSQNGGC

SEQ ID NO: 2258092 - protein, 9 aa, Cryptosporidium parvum
EYNKSMKDS

SEQ ID NO: 2258093 - protein, 8 aa, Cryptosporidium parvum
EYNNEQEQ

SEQ ID NO: 2258094 - protein, 22 aa, Cryptosporidium parvum
EYNNNNDNDENNNENKQSQYSP

SEQ ID NO: 2258095 - protein, 6 aa, Cryptosporidium parvum
EYNNYY

SEQ ID NO: 2258096 - protein, 12 aa, Cryptosporidium parvum
EYNQRNPINPRA

SEQ ID NO: 2258097 - protein, 4 aa, Cryptosporidium parvum
EYNR

SEQ ID NO: 2258098 - protein, 20 aa, Cryptosporidium parvum
EYNRSETQKRNKQNVNNSSR

SEQ ID NO: 2258099 - protein, 4 aa, Cryptosporidium parvum
EYNS

SEQ ID NO: 2258100 - protein, 25 aa, Cryptosporidium parvum
EYNSNPNSSSLETARSELGAGTGAV

SEQ ID NO: 2258101 - protein, 5 aa, Cryptosporidium parvum
EYNTS

SEQ ID NO: 2258102 - protein, 11 aa, Cryptosporidium parvum
EYPIESDSEGY

SEQ ID NO: 2258103 - protein, 9 aa, Cryptosporidium parvum
EYPNPVNGI

SEQ ID NO: 2258104 - protein, 20 aa, Cryptosporidium parvum
EYPSNRRSVLPSSSSYGPRR

SEQ ID NO: 2258105 - protein, 7 aa, Cryptosporidium parvum
EYPTGTN

SEQ ID NO: 2258106 - protein, 9 aa, Cryptosporidium parvum
EYPTKPPDV

SEQ ID NO: 2258107 - protein, 7 aa, Cryptosporidium parvum
EYRGGRT

SEQ ID NO: 2258108 - protein, 16 aa, Cryptosporidium parvum
EYRRTAQNSMNDMSSR

SEQ ID NO: 2258109 - protein, 4 aa, Cryptosporidium parvum
EYSG

SEQ ID NO: 2258110 - protein, 8 aa, Cryptosporidium parvum
EYSGKNTR

SEQ ID NO: 2258111 - protein, 10 aa, Cryptosporidium parvum
EYSGNDKEYT

SEQ ID NO: 2258112 - protein, 8 aa, Cryptosporidium parvum
EYSGNTSV

SEQ ID NO: 2258113 - protein, 16 aa, Cryptosporidium parvum
EYSKEEEEDELKARSW

SEQ ID NO: 2258114 - protein, 8 aa, Cryptosporidium parvum
EYSKESSI

SEQ ID NO: 2258115 - protein, 9 aa, Cryptosporidium parvum
EYSKGNYDS

SEQ ID NO: 2258116 - protein, 30 aa, Cryptosporidium parvum
EYSPENPTKHELSQQESQKAETPRQQDVQE

SEQ ID NO: 2258117 - protein, 8 aa, Cryptosporidium parvum
EYSQLEKQ

SEQ ID NO: 2258118 - protein, 5 aa, Cryptosporidium parvum
EYSRK

SEQ ID NO: 2258119 - protein, 5 aa, Cryptosporidium parvum
EYSSN

SEQ ID NO: 2258120 - protein, 7 aa, Cryptosporidium parvum
EYSTDTN

SEQ ID NO: 2258121 - protein, 6 aa, Cryptosporidium parvum
EYSTEN

SEQ ID NO: 2258122 - protein, 12 aa, Cryptosporidium parvum
EYSTQNSKIPSK

SEQ ID NO: 2258123 - protein, 4 aa, Cryptosporidium parvum
EYTE

SEQ ID NO: 2258124 - protein, 15 aa, Cryptosporidium parvum
EYTEHGAKLVERKCS

SEQ ID NO: 2258125 - protein, 33 aa, Cryptosporidium parvum
EYTKPANDGYDYDDDYYDDDDEALTPLASSAAR

SEQ ID NO: 2258126 - protein, 4 aa, Cryptosporidium parvum
EYTM

SEQ ID NO: 2258127 - protein, 6 aa, Cryptosporidium parvum
EYTNTE

SEQ ID NO: 2258128 - protein, 69 aa, Cryptosporidium parvum
EYTPGGGSGGGGAGGGGGAGGGGGAGGGGSGGAGGGGSGGGSGSGGGSGGGGGSGGAGEEENLDEDEEI

SEQ ID NO: 2258129 - protein, 5 aa, Cryptosporidium parvum
EYTPS

SEQ ID NO: 2258130 - protein, 4 aa, Cryptosporidium parvum
EYTT

SEQ ID NO: 2258131 - protein, 5 aa, Cryptosporidium parvum
EYTTN

SEQ ID NO: 2258132 - protein, 5 aa, Cryptosporidium parvum
EYVAP

SEQ ID NO: 2258133 - protein, 14 aa, Cryptosporidium parvum
EYYEEDEDELNASL

SEQ ID NO: 2258134 - protein, 8 aa, Cryptosporidium parvum
EYYGDAKK

SEQ ID NO: 2258135 - protein, 4 aa, Cryptosporidium parvum
EYYP

SEQ ID NO: 2258136 - protein, 11 aa, Cryptosporidium parvum
EYYPDPSDVYG

SEQ ID NO: 2258137 - protein, 13 aa, Cryptosporidium parvum
EYYSNNSREQIET

SEQ ID NO: 2258138 - protein, 24 aa, Cryptosporidium parvum
FAEEEEEEEPEEEVGDRSVLGGGQ

SEQ ID NO: 2258139 - protein, 5 aa, Cryptosporidium parvum
FAENE

SEQ ID NO: 2258140 - protein, 9 aa, Cryptosporidium parvum
FAGNTDTEI

SEQ ID NO: 2258141 - protein, 10 aa, Cryptosporidium parvum
FAGSPSKATL

SEQ ID NO: 2258142 - protein, 15 aa, Cryptosporidium parvum
FAGSTDSNIYVYKVK

SEQ ID NO: 2258143 - protein, 8 aa, Cryptosporidium parvum
FAKETESV

SEQ ID NO: 2258144 - protein, 9 aa, Cryptosporidium parvum
FANSNPNTI

SEQ ID NO: 2258145 - protein, 6 aa, Cryptosporidium parvum
FAPEEK

SEQ ID NO: 2258146 - protein, 12 aa, Cryptosporidium parvum
FAPNIDDGDIKK

SEQ ID NO: 2258147 - protein, 6 aa, Cryptosporidium parvum
FAPPKS

SEQ ID NO: 2258148 - protein, 9 aa, Cryptosporidium parvum
FASDGSMNG

SEQ ID NO: 2258149 - protein, 9 aa, Cryptosporidium parvum
FASKNDNNC

SEQ ID NO: 2258150 - protein, 16 aa, Cryptosporidium parvum
FASKSGEKMPERGSNR

SEQ ID NO: 2258151 - protein, 12 aa, Cryptosporidium parvum
FASSKPKYIPGN

SEQ ID NO: 2258152 - protein, 9 aa, Cryptosporidium parvum
FATGGSDGA

SEQ ID NO: 2258153 - protein, 14 aa, Cryptosporidium parvum
FATKTAKKAKRRVK

SEQ ID NO: 2258154 - protein, 9 aa, Cryptosporidium parvum
FATTSTQRR

SEQ ID NO: 2258155 - protein, 10 aa, Cryptosporidium parvum
FAYPNSSNES

SEQ ID NO: 2258156 - protein, 5 aa, Cryptosporidium parvum
FDADG

SEQ ID NO: 2258157 - protein, 10 aa, Cryptosporidium parvum
FDAGSDSPTE

SEQ ID NO: 2258158 - protein, 11 aa, Cryptosporidium parvum
FDAQTGADREV

SEQ ID NO: 2258159 - protein, 5 aa, Cryptosporidium parvum
FDARG

SEQ ID NO: 2258160 - protein, 21 aa, Cryptosporidium parvum
FDDDGSGVNNVQSKGGVLKLN

SEQ ID NO: 2258161 - protein, 53 aa, Cryptosporidium parvum
FDDEDGEEEDGFEDEEEDEEEEEEEEEEEEEEEEEEEEEEEEEEEEDEGRKVE

SEQ ID NO: 2258162 - protein, 5 aa, Cryptosporidium parvum
FDDEN

SEQ ID NO: 2258163 - protein, 11 aa, Cryptosporidium parvum
FDDGEIENEKY

SEQ ID NO: 2258164 - protein, 4 aa, Cryptosporidium parvum
FDDN

SEQ ID NO: 2258165 - protein, 10 aa, Cryptosporidium parvum
FDDNYNKPDI

SEQ ID NO: 2258166 - protein, 24 aa, Cryptosporidium parvum
FDDQKKKDQFANVATGKKNLEPSL

SEQ ID NO: 2258167 - protein, 10 aa, Cryptosporidium parvum
FDEDDSSSSM

SEQ ID NO: 2258168 - protein, 15 aa, Cryptosporidium parvum
FDEGEASGDDVDEDV

SEQ ID NO: 2258169 - protein, 11 aa, Cryptosporidium parvum
FDEKENDIEDI

SEQ ID NO: 2258170 - protein, 5 aa, Cryptosporidium parvum
FDEND

SEQ ID NO: 2258171 - protein, 13 aa, Cryptosporidium parvum
FDENEQDQEGFED

SEQ ID NO: 2258172 - protein, 5 aa, Cryptosporidium parvum
FDENS

SEQ ID NO: 2258173 - protein, 6 aa, Cryptosporidium parvum
FDENSI

SEQ ID NO: 2258174 - protein, 18 aa, Cryptosporidium parvum
FDEYETQHESKLEKASFS

SEQ ID NO: 2258175 - protein, 5 aa, Cryptosporidium parvum
FDGEQ

SEQ ID NO: 2258176 - protein, 8 aa, Cryptosporidium parvum
FDGGGADN

SEQ ID NO: 2258177 - protein, 16 aa, Cryptosporidium parvum
FDGGYSGDFGGESHGG

SEQ ID NO: 2258178 - protein, 8 aa, Cryptosporidium parvum
FDGKDEGA

SEQ ID NO: 2258179 - protein, 8 aa, Cryptosporidium parvum
FDGKPSVR

SEQ ID NO: 2258180 - protein, 9 aa, Cryptosporidium parvum
FDGPNSGVT

SEQ ID NO: 2258181 - protein, 8 aa, Cryptosporidium parvum
FDGRMGGR

SEQ ID NO: 2258182 - protein, 5 aa, Cryptosporidium parvum
FDGRN

SEQ ID NO: 2258183 - protein, 11 aa, Cryptosporidium parvum
FDHSEKSGKWL

SEQ ID NO: 2258184 - protein, 13 aa, Cryptosporidium parvum
FDINPDEEGEMKR

SEQ ID NO: 2258185 - protein, 4 aa, Cryptosporidium parvum
FDKN

SEQ ID NO: 2258186 - protein, 7 aa, Cryptosporidium parvum
FDNDKAK

SEQ ID NO: 2258187 - protein, 10 aa, Cryptosporidium parvum
FDNNEDESYY

SEQ ID NO: 2258188 - protein, 7 aa, Cryptosporidium parvum
FDNPEKT

SEQ ID NO: 2258189 - protein, 13 aa, Cryptosporidium parvum
FDNSDNVNSNNYQ

SEQ ID NO: 2258190 - protein, 35 aa, Cryptosporidium parvum
FDNSSSTNKNYDKKNGKIGKDEYNNKNEGNKNGGV

SEQ ID NO: 2258191 - protein, 6 aa, Cryptosporidium parvum
FDPESY

SEQ ID NO: 2258192 - protein, 4 aa, Cryptosporidium parvum
FDPF

SEQ ID NO: 2258193 - protein, 16 aa, Cryptosporidium parvum
FDPFGNSSNGNNTQGI

SEQ ID NO: 2258194 - protein, 5 aa, Cryptosporidium parvum
FDPND

SEQ ID NO: 2258195 - protein, 10 aa, Cryptosporidium parvum
FDPNKQDKSI

SEQ ID NO: 2258196 - protein, 9 aa, Cryptosporidium parvum
FDPNTKSIP

SEQ ID NO: 2258197 - protein, 9 aa, Cryptosporidium parvum
FDPSTTLKN

SEQ ID NO: 2258198 - protein, 14 aa, Cryptosporidium parvum
FDQEGNDSKCQTSG

SEQ ID NO: 2258199 - protein, 5 aa, Cryptosporidium parvum
FDQFS

SEQ ID NO: 2258200 - protein, 6 aa, Cryptosporidium parvum
FDQNSF

SEQ ID NO: 2258201 - protein, 5 aa, Cryptosporidium parvum
FDQTT

SEQ ID NO: 2258202 - protein, 9 aa, Cryptosporidium parvum
FDRRKGVKK

SEQ ID NO: 2258203 - protein, 11 aa, Cryptosporidium parvum
FDSAYDPQEAE

SEQ ID NO: 2258204 - protein, 23 aa, Cryptosporidium parvum
FDSDENAPDSNLPKNSQSVPNTG

SEQ ID NO: 2258205 - protein, 84 aa, Cryptosporidium parvum
FDSEESSPGAGAGPGPEAGPGPGPEAGPGPGPEAGAGPGPGPEAGAGPGPGPEAGAGAGAGAPGKPTIPAWPGSSGRPSGIPGG

SEQ ID NO: 2258206 - protein, 24 aa, Cryptosporidium parvum
FDSESESDSLSTASEKEPQKGGKK

SEQ ID NO: 2258207 - protein, 21 aa, Cryptosporidium parvum
FDSFTEKGGYAIPGSNSSTIY

SEQ ID NO: 2258208 - protein, 4 aa, Cryptosporidium parvum
FDSG

SEQ ID NO: 2258209 - protein, 32 aa, Cryptosporidium parvum
FDSNTESKKTSSNSCKRSKDAIPEQKNDSESN

SEQ ID NO: 2258210 - protein, 17 aa, Cryptosporidium parvum
FDSQDYSDEDNSSRSSD

SEQ ID NO: 2258211 - protein, 5 aa, Cryptosporidium parvum
FDSSN

SEQ ID NO: 2258212 - protein, 14 aa, Cryptosporidium parvum
FDSSSSKSEDALST

SEQ ID NO: 2258213 - protein, 4 aa, Cryptosporidium parvum
FDSY

SEQ ID NO: 2258214 - protein, 9 aa, Cryptosporidium parvum
FDTDSPIYT

SEQ ID NO: 2258215 - protein, 9 aa, Cryptosporidium parvum
FDTEKTSFN

SEQ ID NO: 2258216 - protein, 12 aa, Cryptosporidium parvum
FDTENNQFSDTN

SEQ ID NO: 2258217 - protein, 8 aa, Cryptosporidium parvum
FDTKSTRS

SEQ ID NO: 2258218 - protein, 13 aa, Cryptosporidium parvum
FDTRREQFEHDNI

SEQ ID NO: 2258219 - protein, 7 aa, Cryptosporidium parvum
FDTTNKA

SEQ ID NO: 2258220 - protein, 20 aa, Cryptosporidium parvum
FDVSPPKLPPIEREQQGRML

SEQ ID NO: 2258221 - protein, 11 aa, Cryptosporidium parvum
FEANEAEYSQN

SEQ ID NO: 2258222 - protein, 5 aa, Cryptosporidium parvum
FEARG

SEQ ID NO: 2258223 - protein, 12 aa, Cryptosporidium parvum
FEDDKTASDTDA

SEQ ID NO: 2258224 - protein, 8 aa, Cryptosporidium parvum
FEDKNVSG

SEQ ID NO: 2258225 - protein, 10 aa, Cryptosporidium parvum
FEDKTEDDLH

SEQ ID NO: 2258226 - protein, 7 aa, Cryptosporidium parvum
FEEDDNR

SEQ ID NO: 2258227 - protein, 5 aa, Cryptosporidium parvum
FEEDS

SEQ ID NO: 2258228 - protein, 4 aa, Cryptosporidium parvum
FEEE

SEQ ID NO: 2258229 - protein, 28 aa, Cryptosporidium parvum
FEEEEEDGEGEEEDGEDDEERVKPASKG

SEQ ID NO: 2258230 - protein, 9 aa, Cryptosporidium parvum
FEEEEEEDI

SEQ ID NO: 2258231 - protein, 14 aa, Cryptosporidium parvum
FEEEEEEEDEYEYE

SEQ ID NO: 2258232 - protein, 32 aa, Cryptosporidium parvum
FEEEETEKEEGKEEARNEEEERKEEEKVDDNW

SEQ ID NO: 2258233 - protein, 6 aa, Cryptosporidium parvum
FEEENV

SEQ ID NO: 2258234 - protein, 10 aa, Cryptosporidium parvum
FEEKTSVSSI

SEQ ID NO: 2258235 - protein, 14 aa, Cryptosporidium parvum
FEENSKNDNNPQLN

SEQ ID NO: 2258236 - protein, 5 aa, Cryptosporidium parvum
FEESE

SEQ ID NO: 2258237 - protein, 6 aa, Cryptosporidium parvum
FEESSH

SEQ ID NO: 2258238 - protein, 10 aa, Cryptosporidium parvum
FEETKHQTQI

SEQ ID NO: 2258239 - protein, 17 aa, Cryptosporidium parvum
FEEYERENQRLRESNEE

SEQ ID NO: 2258240 - protein, 6 aa, Cryptosporidium parvum
FEGEGM

SEQ ID NO: 2258241 - protein, 4 aa, Cryptosporidium parvum
FEGS

SEQ ID NO: 2258242 - protein, 4 aa, Cryptosporidium parvum
FEKE

SEQ ID NO: 2258243 - protein, 12 aa, Cryptosporidium parvum
FEKGERAEEYSE

SEQ ID NO: 2258244 - protein, 31 aa, Cryptosporidium parvum
FEKGSEYSNNYSSSDDSDSDDDNRDNGKCYS

SEQ ID NO: 2258245 - protein, 4 aa, Cryptosporidium parvum
FEKH

SEQ ID NO: 2258246 - protein, 4 aa, Cryptosporidium parvum
FEKK

SEQ ID NO: 2258247 - protein, 8 aa, Cryptosporidium parvum
FEKNGEVD

SEQ ID NO: 2258248 - protein, 6 aa, Cryptosporidium parvum
FEKPEQ

SEQ ID NO: 2258249 - protein, 9 aa, Cryptosporidium parvum
FEKSKKGGV

SEQ ID NO: 2258250 - protein, 7 aa, Cryptosporidium parvum
FEKTGNP

SEQ ID NO: 2258251 - protein, 5 aa, Cryptosporidium parvum
FENAK

SEQ ID NO: 2258252 - protein, 5 aa, Cryptosporidium parvum
FENAR

SEQ ID NO: 2258253 - protein, 10 aa, Cryptosporidium parvum
FENDTESEKI

SEQ ID NO: 2258254 - protein, 17 aa, Cryptosporidium parvum
FENKATQSHNSQTGSYV

SEQ ID NO: 2258255 - protein, 9 aa, Cryptosporidium parvum
FENKPEAHK

SEQ ID NO: 2258256 - protein, 18 aa, Cryptosporidium parvum
FENKSKALKEAIDKTESE

SEQ ID NO: 2258257 - protein, 10 aa, Cryptosporidium parvum
FENNKRNDYY

SEQ ID NO: 2258258 - protein, 5 aa, Cryptosporidium parvum
FENNS

SEQ ID NO: 2258259 - protein, 6 aa, Cryptosporidium parvum
FENPAN

SEQ ID NO: 2258260 - protein, 8 aa, Cryptosporidium parvum
FENPGNSK

SEQ ID NO: 2258261 - protein, 6 aa, Cryptosporidium parvum
FENSQQ

SEQ ID NO: 2258262 - protein, 9 aa, Cryptosporidium parvum
FENSSKNCI

SEQ ID NO: 2258263 - protein, 12 aa, Cryptosporidium parvum
FEPEKGIEPETK

SEQ ID NO: 2258264 - protein, 18 aa, Cryptosporidium parvum
FEPKKEETEENNYQQIKE

SEQ ID NO: 2258265 - protein, 18 aa, Cryptosporidium parvum
FEPNNNPSSNYSSIGSRR

SEQ ID NO: 2258266 - protein, 14 aa, Cryptosporidium parvum
FEPNTNNSEDNFSS

SEQ ID NO: 2258267 - protein, 19 aa, Cryptosporidium parvum
FEQAKNSKIDKSNKSNKKL

SEQ ID NO: 2258268 - protein, 9 aa, Cryptosporidium parvum
FEQEKKRTI

SEQ ID NO: 2258269 - protein, 8 aa, Cryptosporidium parvum
FEQSDYKK

SEQ ID NO: 2258270 - protein, 20 aa, Cryptosporidium parvum
FEQSQNDEDETEGIEKGTEE

SEQ ID NO: 2258271 - protein, 10 aa, Cryptosporidium parvum
FERDEDDPFG

SEQ ID NO: 2258272 - protein, 6 aa, Cryptosporidium parvum
FEREDQ

SEQ ID NO: 2258273 - protein, 10 aa, Cryptosporidium parvum
FERPSPIQEE

SEQ ID NO: 2258274 - protein, 11 aa, Cryptosporidium parvum
FESELADQTHP

SEQ ID NO: 2258275 - protein, 5 aa, Cryptosporidium parvum
FESEP

SEQ ID NO: 2258276 - protein, 11 aa, Cryptosporidium parvum
FESEPRRNSVA

SEQ ID NO: 2258277 - protein, 26 aa, Cryptosporidium parvum
FESKIDSNKAVVNSDSTSKISKSPED

SEQ ID NO: 2258278 - protein, 7 aa, Cryptosporidium parvum
FESNNQR

SEQ ID NO: 2258279 - protein, 9 aa, Cryptosporidium parvum
FESNPSCES

SEQ ID NO: 2258280 - protein, 20 aa, Cryptosporidium parvum
FESNSASMENLNGKNVDSAL

SEQ ID NO: 2258281 - protein, 6 aa, Cryptosporidium parvum
FESNTS

SEQ ID NO: 2258282 - protein, 28 aa, Cryptosporidium parvum
FESPKKKIQTETTFNQSKLSSSSYSSND

SEQ ID NO: 2258283 - protein, 15 aa, Cryptosporidium parvum
FESPKPKKVKDESGF

SEQ ID NO: 2258284 - protein, 4 aa, Cryptosporidium parvum
FESS

SEQ ID NO: 2258285 - protein, 21 aa, Cryptosporidium parvum
FESSGGGDVGGGSSGGSGVNV

SEQ ID NO: 2258286 - protein, 16 aa, Cryptosporidium parvum
FESSGHDKIKNKTPLK

SEQ ID NO: 2258287 - protein, 12 aa, Cryptosporidium parvum
FESSQSNLMKNG

SEQ ID NO: 2258288 - protein, 15 aa, Cryptosporidium parvum
FETESKNSHKSKPQI

SEQ ID NO: 2258289 - protein, 6 aa, Cryptosporidium parvum
FETKSK

SEQ ID NO: 2258290 - protein, 17 aa, Cryptosporidium parvum
FETLTKNSPHYCDISKK

SEQ ID NO: 2258291 - protein, 21 aa, Cryptosporidium parvum
FEYKSESCDTVETAPNSLYGP

SEQ ID NO: 2258292 - protein, 12 aa, Cryptosporidium parvum
FFSDSNNSYSLN

SEQ ID NO: 2258293 - protein, 61 aa, Cryptosporidium parvum
FGAPTTAASTSTTPSTTPATTTTSSLFGTSSTTAPSTSTSTNNFSTSPTLSSSTPSSTITG

SEQ ID NO: 2258294 - protein, 7 aa, Cryptosporidium parvum
FGDDGQY

SEQ ID NO: 2258295 - protein, 4 aa, Cryptosporidium parvum
FGDF

SEQ ID NO: 2258296 - protein, 8 aa, Cryptosporidium parvum
FGDKAGSQ

SEQ ID NO: 2258297 - protein, 5 aa, Cryptosporidium parvum
FGDNQ

SEQ ID NO: 2258298 - protein, 5 aa, Cryptosporidium parvum
FGDNV

SEQ ID NO: 2258299 - protein, 5 aa, Cryptosporidium parvum
FGDNY

SEQ ID NO: 2258300 - protein, 6 aa, Cryptosporidium parvum
FGDQHN

SEQ ID NO: 2258301 - protein, 15 aa, Cryptosporidium parvum
FGEKETNQNKPSSVK

SEQ ID NO: 2258302 - protein, 14 aa, Cryptosporidium parvum
FGENDELNDTLSRL

SEQ ID NO: 2258303 - protein, 6 aa, Cryptosporidium parvum
FGENRS

SEQ ID NO: 2258304 - protein, 16 aa, Cryptosporidium parvum
FGEPPPDYVPGKGRGA

SEQ ID NO: 2258305 - protein, 8 aa, Cryptosporidium parvum
FGESFSQS

SEQ ID NO: 2258306 - protein, 10 aa, Cryptosporidium parvum
FGETEDGASI

SEQ ID NO: 2258307 - protein, 9 aa, Cryptosporidium parvum
FGGGGGSVS

SEQ ID NO: 2258308 - protein, 15 aa, Cryptosporidium parvum
FGGGGSMSLDSSDGL

SEQ ID NO: 2258309 - protein, 7 aa, Cryptosporidium parvum
FGGGRSS

SEQ ID NO: 2258310 - protein, 9 aa, Cryptosporidium parvum
FGGKDLKPY

SEQ ID NO: 2258311 - protein, 22 aa, Cryptosporidium parvum
FGGKKEEKNDQKGDISDSEEDF

SEQ ID NO: 2258312 - protein, 4 aa, Cryptosporidium parvum
FGGT

SEQ ID NO: 2258313 - protein, 5 aa, Cryptosporidium parvum
FGHKN

SEQ ID NO: 2258314 - protein, 4 aa, Cryptosporidium parvum
FGIR

SEQ ID NO: 2258315 - protein, 4 aa, Cryptosporidium parvum
FGIS

SEQ ID NO: 2258316 - protein, 8 aa, Cryptosporidium parvum
FGKEDDTS

SEQ ID NO: 2258317 - protein, 9 aa, Cryptosporidium parvum
FGKEGAAKR

SEQ ID NO: 2258318 - protein, 15 aa, Cryptosporidium parvum
FGKKNVTASISEQRK

SEQ ID NO: 2258319 - protein, 10 aa, Cryptosporidium parvum
FGKSSNRKTS

SEQ ID NO: 2258320 - protein, 4 aa, Cryptosporidium parvum
FGLD

SEQ ID NO: 2258321 - protein, 4 aa, Cryptosporidium parvum
FGLS

SEQ ID NO: 2258322 - protein, 4 aa, Cryptosporidium parvum
FGNG

SEQ ID NO: 2258323 - protein, 9 aa, Cryptosporidium parvum
FGNKNATLS

SEQ ID NO: 2258324 - protein, 11 aa, Cryptosporidium parvum
FGNKQDSPEKI

SEQ ID NO: 2258325 - protein, 10 aa, Cryptosporidium parvum
FGNKQTEKEI

SEQ ID NO: 2258326 - protein, 7 aa, Cryptosporidium parvum
FGNNDSL

SEQ ID NO: 2258327 - protein, 5 aa, Cryptosporidium parvum
FGNPG

SEQ ID NO: 2258328 - protein, 11 aa, Cryptosporidium parvum
FGNPSSTSTNL

SEQ ID NO: 2258329 - protein, 19 aa, Cryptosporidium parvum
FGNSNKNKYSENNSSNSTI

SEQ ID NO: 2258330 - protein, 18 aa, Cryptosporidium parvum
FGNTSASPFGGTMGTNSN

SEQ ID NO: 2258331 - protein, 14 aa, Cryptosporidium parvum
FGNTSNYSSFRPNT

SEQ ID NO: 2258332 - protein, 15 aa, Cryptosporidium parvum
FGNYNKDNQDNIDEF

SEQ ID NO: 2258333 - protein, 11 aa, Cryptosporidium parvum
FGPESEHENKQ

SEQ ID NO: 2258334 - protein, 14 aa, Cryptosporidium parvum
FGPESTSTDPISGD

SEQ ID NO: 2258335 - protein, 5 aa, Cryptosporidium parvum
FGPKI

SEQ ID NO: 2258336 - protein, 13 aa, Cryptosporidium parvum
FGPKKKKHKPSVS

SEQ ID NO: 2258337 - protein, 8 aa, Cryptosporidium parvum
FGPNDSSV

SEQ ID NO: 2258338 - protein, 9 aa, Cryptosporidium parvum
FGPSPPLGF

SEQ ID NO: 2258339 - protein, 89 aa, Cryptosporidium parvum
FGPSQPKPRPPRSTSKPSQPPAYPQPPAYPQPSKPPPYPQPPRYPQPSQPPAYPQPPRYPQPSQPPAYPQPPAYPQPSQPSQPSQIPTS

SEQ ID NO: 2258340 - protein, 21 aa, Cryptosporidium parvum
FGQENEQPPPPPPTPAPVEES

SEQ ID NO: 2258341 - protein, 11 aa, Cryptosporidium parvum
FGQGHERRKKP

SEQ ID NO: 2258342 - protein, 16 aa, Cryptosporidium parvum
FGQNSEKYKNNLSNFV

SEQ ID NO: 2258343 - protein, 6 aa, Cryptosporidium parvum
FGRQKA

SEQ ID NO: 2258344 - protein, 4 aa, Cryptosporidium parvum
FGRS

SEQ ID NO: 2258345 - protein, 5 aa, Cryptosporidium parvum
FGRSE

SEQ ID NO: 2258346 - protein, 13 aa, Cryptosporidium parvum
FGSDSIDKSFEGM

SEQ ID NO: 2258347 - protein, 6 aa, Cryptosporidium parvum
FGSGGA

SEQ ID NO: 2258348 - protein, 7 aa, Cryptosporidium parvum
FGSGNTS

SEQ ID NO: 2258349 - protein, 5 aa, Cryptosporidium parvum
FGSNE

SEQ ID NO: 2258350 - protein, 11 aa, Cryptosporidium parvum
FGSQNKASEID

SEQ ID NO: 2258351 - protein, 14 aa, Cryptosporidium parvum
FGSRKEGGKDASAA

SEQ ID NO: 2258352 - protein, 11 aa, Cryptosporidium parvum
FGSRKSSATMD

SEQ ID NO: 2258353 - protein, 5 aa, Cryptosporidium parvum
FGSRM

SEQ ID NO: 2258354 - protein, 20 aa, Cryptosporidium parvum
FGSSENGNIHSKRTSLDENN

SEQ ID NO: 2258355 - protein, 13 aa, Cryptosporidium parvum
FGSSTSGTRSGDE

SEQ ID NO: 2258356 - protein, 5 aa, Cryptosporidium parvum
FGSTD

SEQ ID NO: 2258357 - protein, 12 aa, Cryptosporidium parvum
FGSTNHSKKFNF

SEQ ID NO: 2258358 - protein, 4 aa, Cryptosporidium parvum
FGTH

SEQ ID NO: 2258359 - protein, 8 aa, Cryptosporidium parvum
FGTKDNTS

SEQ ID NO: 2258360 - protein, 6 aa, Cryptosporidium parvum
FGTNEI

SEQ ID NO: 2258361 - protein, 5 aa, Cryptosporidium parvum
FGTNG

SEQ ID NO: 2258362 - protein, 8 aa, Cryptosporidium parvum
FGVGGEPA

SEQ ID NO: 2258363 - protein, 5 aa, Cryptosporidium parvum
FHEEG

SEQ ID NO: 2258364 - protein, 9 aa, Cryptosporidium parvum
FHGNGGRHL

SEQ ID NO: 2258365 - protein, 5 aa, Cryptosporidium parvum
FHHEQ

SEQ ID NO: 2258366 - protein, 7 aa, Cryptosporidium parvum
FHKAPKS

SEQ ID NO: 2258367 - protein, 29 aa, Cryptosporidium parvum
FHKNGNSNSRRQSTNMNGVSNSGEQLNSS

SEQ ID NO: 2258368 - protein, 10 aa, Cryptosporidium parvum
FHKPNDKRGL

SEQ ID NO: 2258369 - protein, 18 aa, Cryptosporidium parvum
FHPNSNCNNSNIGGYPLS

SEQ ID NO: 2258370 - protein, 6 aa, Cryptosporidium parvum
FIDSET

SEQ ID NO: 2258371 - protein, 14 aa, Cryptosporidium parvum
FITKGESKFQEEPY

SEQ ID NO: 2258372 - protein, 8 aa, Cryptosporidium parvum
FKAPEGSK

SEQ ID NO: 2258373 - protein, 9 aa, Cryptosporidium parvum
FKASERSQN

SEQ ID NO: 2258374 - protein, 8 aa, Cryptosporidium parvum
FKDNPKNG

SEQ ID NO: 2258375 - protein, 7 aa, Cryptosporidium parvum
FKDSDKS

SEQ ID NO: 2258376 - protein, 7 aa, Cryptosporidium parvum
FKDSPMA

SEQ ID NO: 2258377 - protein, 13 aa, Cryptosporidium parvum
FKEEQQETNGHLE

SEQ ID NO: 2258378 - protein, 13 aa, Cryptosporidium parvum
FKEERKERISKKG

SEQ ID NO: 2258379 - protein, 6 aa, Cryptosporidium parvum
FKEKNE

SEQ ID NO: 2258380 - protein, 5 aa, Cryptosporidium parvum
FKESK

SEQ ID NO: 2258381 - protein, 6 aa, Cryptosporidium parvum
FKESKY

SEQ ID NO: 2258382 - protein, 6 aa, Cryptosporidium parvum
FKETSI

SEQ ID NO: 2258383 - protein, 6 aa, Cryptosporidium parvum
FKFSPQ

SEQ ID NO: 2258384 - protein, 6 aa, Cryptosporidium parvum
FKGHES

SEQ ID NO: 2258385 - protein, 4 aa, Cryptosporidium parvum
FKGM

SEQ ID NO: 2258386 - protein, 4 aa, Cryptosporidium parvum
FKGN

SEQ ID NO: 2258387 - protein, 12 aa, Cryptosporidium parvum
FKGNEKQKTVIS

SEQ ID NO: 2258388 - protein, 8 aa, Cryptosporidium parvum
FKKGSSHT

SEQ ID NO: 2258389 - protein, 7 aa, Cryptosporidium parvum
FKLPESN

SEQ ID NO: 2258390 - protein, 7 aa, Cryptosporidium parvum
FKNAPET

SEQ ID NO: 2258391 - protein, 7 aa, Cryptosporidium parvum
FKNKTSK

SEQ ID NO: 2258392 - protein, 8 aa, Cryptosporidium parvum
FKNNGGAV

SEQ ID NO: 2258393 - protein, 13 aa, Cryptosporidium parvum
FKNSEKESRMAGR

SEQ ID NO: 2258394 - protein, 11 aa, Cryptosporidium parvum
FKNSTSSNIKY

SEQ ID NO: 2258395 - protein, 8 aa, Cryptosporidium parvum
FKNTSSNK

SEQ ID NO: 2258396 - protein, 4 aa, Cryptosporidium parvum
FKPR

SEQ ID NO: 2258397 - protein, 7 aa, Cryptosporidium parvum
FKPRGRD

SEQ ID NO: 2258398 - protein, 9 aa, Cryptosporidium parvum
FKPRSTKAR

SEQ ID NO: 2258399 - protein, 5 aa, Cryptosporidium parvum
FKPSE

SEQ ID NO: 2258400 - protein, 6 aa, Cryptosporidium parvum
FKPTSE

SEQ ID NO: 2258401 - protein, 6 aa, Cryptosporidium parvum
FKQPPL

SEQ ID NO: 2258402 - protein, 8 aa, Cryptosporidium parvum
FKQSSDSL

SEQ ID NO: 2258403 - protein, 9 aa, Cryptosporidium parvum
FKQSTSEDN

SEQ ID NO: 2258404 - protein, 4 aa, Cryptosporidium parvum
FKRP

SEQ ID NO: 2258405 - protein, 15 aa, Cryptosporidium parvum
FKSGNLQNVRKDSYE

SEQ ID NO: 2258406 - protein, 11 aa, Cryptosporidium parvum
FKSKQQYNSHI

SEQ ID NO: 2258407 - protein, 8 aa, Cryptosporidium parvum
FKSKTGSK

SEQ ID NO: 2258408 - protein, 13 aa, Cryptosporidium parvum
FKSNEKDVDDEYT

SEQ ID NO: 2258409 - protein, 22 aa, Cryptosporidium parvum
FKSNNSVDFNSSSESKDEENLE

SEQ ID NO: 2258410 - protein, 5 aa, Cryptosporidium parvum
FKSNS

SEQ ID NO: 2258411 - protein, 10 aa, Cryptosporidium parvum
FKSRPRSRTL

SEQ ID NO: 2258412 - protein, 8 aa, Cryptosporidium parvum
FKSSEKKL

SEQ ID NO: 2258413 - protein, 7 aa, Cryptosporidium parvum
FKSSEND

SEQ ID NO: 2258414 - protein, 6 aa, Cryptosporidium parvum
FKSSNS

SEQ ID NO: 2258415 - protein, 6 aa, Cryptosporidium parvum
FKSTVD

SEQ ID NO: 2258416 - protein, 4 aa, Cryptosporidium parvum
FKTP

SEQ ID NO: 2258417 - protein, 8 aa, Cryptosporidium parvum
FKTSQDNE

SEQ ID NO: 2258418 - protein, 9 aa, Cryptosporidium parvum
FKYSSGEST

SEQ ID NO: 2258419 - protein, 15 aa, Cryptosporidium parvum
FLDSNQKASKSSFQS

SEQ ID NO: 2258420 - protein, 9 aa, Cryptosporidium parvum
FLGGPGNNS

SEQ ID NO: 2258421 - protein, 6 aa, Cryptosporidium parvum
FLPPNS

SEQ ID NO: 2258422 - protein, 16 aa, Cryptosporidium parvum
FMGGGGGSSGSSGNFA

SEQ ID NO: 2258423 - protein, 24 aa, Cryptosporidium parvum
FNDDSPSNIPFSNGTNFAPSIEKE

SEQ ID NO: 2258424 - protein, 8 aa, Cryptosporidium parvum
FNDEKDGF

SEQ ID NO: 2258425 - protein, 12 aa, Cryptosporidium parvum
FNDENKKGDEML

SEQ ID NO: 2258426 - protein, 9 aa, Cryptosporidium parvum
FNDGKDIEA

SEQ ID NO: 2258427 - protein, 8 aa, Cryptosporidium parvum
FNDGVSKA

SEQ ID NO: 2258428 - protein, 8 aa, Cryptosporidium parvum
FNDNGGGE

SEQ ID NO: 2258429 - protein, 8 aa, Cryptosporidium parvum
FNDPNSNS

SEQ ID NO: 2258430 - protein, 5 aa, Cryptosporidium parvum
FNDSN

SEQ ID NO: 2258431 - protein, 5 aa, Cryptosporidium parvum
FNEDK

SEQ ID NO: 2258432 - protein, 27 aa, Cryptosporidium parvum
FNEKNSEIQDDSKFNSNVKQEQQKDEL

SEQ ID NO: 2258433 - protein, 4 aa, Cryptosporidium parvum
FNEN

SEQ ID NO: 2258434 - protein, 21 aa, Cryptosporidium parvum
FNEPSRSSRGFSRSRGSRLSP

SEQ ID NO: 2258435 - protein, 8 aa, Cryptosporidium parvum
FNEQSGES

SEQ ID NO: 2258436 - protein, 5 aa, Cryptosporidium parvum
FNESE

SEQ ID NO: 2258437 - protein, 7 aa, Cryptosporidium parvum
FNESNEL

SEQ ID NO: 2258438 - protein, 14 aa, Cryptosporidium parvum
FNEYPSSPITKGSL

SEQ ID NO: 2258439 - protein, 5 aa, Cryptosporidium parvum
FNGGI

SEQ ID NO: 2258440 - protein, 34 aa, Cryptosporidium parvum
FNGNGNGNGNGNGNGNGNGIGNGIGNGIGNNGYH

SEQ ID NO: 2258441 - protein, 15 aa, Cryptosporidium parvum
FNGNIPDPRNFMGGL

SEQ ID NO: 2258442 - protein, 9 aa, Cryptosporidium parvum
FNGNSRNRR

SEQ ID NO: 2258443 - protein, 13 aa, Cryptosporidium parvum
FNGSGKPIDNGPP

SEQ ID NO: 2258444 - protein, 12 aa, Cryptosporidium parvum
FNHETQDHRNDY

SEQ ID NO: 2258445 - protein, 16 aa, Cryptosporidium parvum
FNKGGVSSSQRGNRGL

SEQ ID NO: 2258446 - protein, 6 aa, Cryptosporidium parvum
FNKKDR

SEQ ID NO: 2258447 - protein, 10 aa, Cryptosporidium parvum
FNKKSNKKSV

SEQ ID NO: 2258448 - protein, 7 aa, Cryptosporidium parvum
FNKPNSE

SEQ ID NO: 2258449 - protein, 9 aa, Cryptosporidium parvum
FNKPQKYNN

SEQ ID NO: 2258450 - protein, 7 aa, Cryptosporidium parvum
FNNDKNH

SEQ ID NO: 2258451 - protein, 10 aa, Cryptosporidium parvum
FNNEDQDYEC

SEQ ID NO: 2258452 - protein, 6 aa, Cryptosporidium parvum
FNNENE

SEQ ID NO: 2258453 - protein, 10 aa, Cryptosporidium parvum
FNNKKNSSMI

SEQ ID NO: 2258454 - protein, 10 aa, Cryptosporidium parvum
FNNKKSPNIL

SEQ ID NO: 2258455 - protein, 17 aa, Cryptosporidium parvum
FNNKKTTKNSEKETKNK

SEQ ID NO: 2258456 - protein, 11 aa, Cryptosporidium parvum
FNNKPEEYQSN

SEQ ID NO: 2258457 - protein, 10 aa, Cryptosporidium parvum
FNNNDNNNLY

SEQ ID NO: 2258458 - protein, 9 aa, Cryptosporidium parvum
FNNNSRQEI

SEQ ID NO: 2258459 - protein, 6 aa, Cryptosporidium parvum
FNNPDR

SEQ ID NO: 2258460 - protein, 12 aa, Cryptosporidium parvum
FNNRSNKSSNPI

SEQ ID NO: 2258461 - protein, 8 aa, Cryptosporidium parvum
FNNSNNNE

SEQ ID NO: 2258462 - protein, 23 aa, Cryptosporidium parvum
FNNSSGPGSGSGSGSSSGTTGSK

SEQ ID NO: 2258463 - protein, 21 aa, Cryptosporidium parvum
FNNSSSEDSSLIRPNKIPKLE

SEQ ID NO: 2258464 - protein, 6 aa, Cryptosporidium parvum
FNPFGD

SEQ ID NO: 2258465 - protein, 6 aa, Cryptosporidium parvum
FNPKDS

SEQ ID NO: 2258466 - protein, 10 aa, Cryptosporidium parvum
FNPQTGTYQT

SEQ ID NO: 2258467 - protein, 4 aa, Cryptosporidium parvum
FNPS

SEQ ID NO: 2258468 - protein, 6 aa, Cryptosporidium parvum
FNQGSE

SEQ ID NO: 2258469 - protein, 5 aa, Cryptosporidium parvum
FNQHE

SEQ ID NO: 2258470 - protein, 13 aa, Cryptosporidium parvum
FNQNNEAVKRDTD

SEQ ID NO: 2258471 - protein, 4 aa, Cryptosporidium parvum
FNQP

SEQ ID NO: 2258472 - protein, 10 aa, Cryptosporidium parvum
FNREKSSSNY

SEQ ID NO: 2258473 - protein, 8 aa, Cryptosporidium parvum
FNSDSQAL

SEQ ID NO: 2258474 - protein, 5 aa, Cryptosporidium parvum
FNSEE

SEQ ID NO: 2258475 - protein, 35 aa, Cryptosporidium parvum
FNSGSNKTPTEESFVEDSDSEFYPQPSSLESTNKD

SEQ ID NO: 2258476 - protein, 4 aa, Cryptosporidium parvum
FNSN

SEQ ID NO: 2258477 - protein, 8 aa, Cryptosporidium parvum
FNSNKNEW

SEQ ID NO: 2258478 - protein, 7 aa, Cryptosporidium parvum
FNSPNSD

SEQ ID NO: 2258479 - protein, 14 aa, Cryptosporidium parvum
FNSQTGGTSQSPKH

SEQ ID NO: 2258480 - protein, 8 aa, Cryptosporidium parvum
FNSSPPEV

SEQ ID NO: 2258481 - protein, 9 aa, Cryptosporidium parvum
FNSSSTSFS

SEQ ID NO: 2258482 - protein, 6 aa, Cryptosporidium parvum
FNTEGG

SEQ ID NO: 2258483 - protein, 6 aa, Cryptosporidium parvum
FNTKNS

SEQ ID NO: 2258484 - protein, 21 aa, Cryptosporidium parvum
FNTNGKDAMQTGNGAKSHTDI

SEQ ID NO: 2258485 - protein, 15 aa, Cryptosporidium parvum
FNTPNPGNGSKFDSS

SEQ ID NO: 2258486 - protein, 14 aa, Cryptosporidium parvum
FNTSDSSSGSLSPL

SEQ ID NO: 2258487 - protein, 19 aa, Cryptosporidium parvum
FNTSNKPSKRKRASKRLGS

SEQ ID NO: 2258488 - protein, 6 aa, Cryptosporidium parvum
FNTTAP

SEQ ID NO: 2258489 - protein, 33 aa, Cryptosporidium parvum
FPAGSSSCAGGLSASSIDTSGNDASQNGLTPSS

SEQ ID NO: 2258490 - protein, 7 aa, Cryptosporidium parvum
FPDDGYD

SEQ ID NO: 2258491 - protein, 4 aa, Cryptosporidium parvum
FPDE

SEQ ID NO: 2258492 - protein, 8 aa, Cryptosporidium parvum
FPDGETRQ

SEQ ID NO: 2258493 - protein, 17 aa, Cryptosporidium parvum
FPDLDGNQFKRNDTAVS

SEQ ID NO: 2258494 - protein, 5 aa, Cryptosporidium parvum
FPECG

SEQ ID NO: 2258495 - protein, 7 aa, Cryptosporidium parvum
FPENKDD

SEQ ID NO: 2258496 - protein, 37 aa, Cryptosporidium parvum; identical to SEQ ID NO: 2142174

SEQ ID NO: 2258497 - protein, 38 aa, Cryptosporidium parvum
FPENSDHHRPEDNKAKQFKKSDEQSEKATNNEDMENLN

SEQ ID NO: 2258498 - protein, 5 aa, Cryptosporidium parvum
FPEPE

SEQ ID NO: 2258499 - protein, 10 aa, Cryptosporidium parvum
FPESGTSISP

SEQ ID NO: 2258500 - protein, 5 aa, Cryptosporidium parvum
FPESN

SEQ ID NO: 2258501 - protein, 8 aa, Cryptosporidium parvum
FPFQTTNS

SEQ ID NO: 2258502 - protein, 9 aa, Cryptosporidium parvum
FPGASSQSI

SEQ ID NO: 2258503 - protein, 9 aa, Cryptosporidium parvum
FPGEENKTV

SEQ ID NO: 2258504 - protein, 10 aa, Cryptosporidium parvum
FPGGSSTPGE

SEQ ID NO: 2258505 - protein, 9 aa, Cryptosporidium parvum
FPGQPLTST

SEQ ID NO: 2258506 - protein, 8 aa, Cryptosporidium parvum
FPGSHDSN

SEQ ID NO: 2258507 - protein, 8 aa, Cryptosporidium parvum
FPGSSTMN

SEQ ID NO: 2258508 - protein, 6 aa, Cryptosporidium parvum
FPGTGA

SEQ ID NO: 2258509 - protein, 11 aa, Cryptosporidium parvum
FPIPPQESAWG

SEQ ID NO: 2258510 - protein, 9 aa, Cryptosporidium parvum
FPKERSMKE

SEQ ID NO: 2258511 - protein, 12 aa, Cryptosporidium parvum
FPKGEDKSQRAV

SEQ ID NO: 2258512 - protein, 14 aa, Cryptosporidium parvum
FPKPSRSSKANSVD

SEQ ID NO: 2258513 - protein, 10 aa, Cryptosporidium parvum
FPKSTGISND

SEQ ID NO: 2258514 - protein, 10 aa, Cryptosporidium parvum
FPNDDSNKGI

SEQ ID NO: 2258515 - protein, 5 aa, Cryptosporidium parvum
FPNDK

SEQ ID NO: 2258516 - protein, 4 aa, Cryptosporidium parvum
FPNE

SEQ ID NO: 2258517 - protein, 13 aa, Cryptosporidium parvum
FPNEDSNSSSGGH

SEQ ID NO: 2258518 - protein, 9 aa, Cryptosporidium parvum
FPNHNNNRV

SEQ ID NO: 2258519 - protein, 11 aa, Cryptosporidium parvum
FPNKNESDAVD

SEQ ID NO: 2258520 - protein, 4 aa, Cryptosporidium parvum
FPNN

SEQ ID NO: 2258521 - protein, 11 aa, Cryptosporidium parvum
FPNNTTTEYPN

SEQ ID NO: 2258522 - protein, 16 aa, Cryptosporidium parvum
FPNPGTPNIQPEQYSK

SEQ ID NO: 2258523 - protein, 9 aa, Cryptosporidium parvum
FPNPNEDAR

SEQ ID NO: 2258524 - protein, 5 aa, Cryptosporidium parvum
FPNRA

SEQ ID NO: 2258525 - protein, 11 aa, Cryptosporidium parvum
FPNRTEDSNSK

SEQ ID NO: 2258526 - protein, 4 aa, Cryptosporidium parvum
FPNT

SEQ ID NO: 2258527 - protein, 5 aa, Cryptosporidium parvum
FPPED

SEQ ID NO: 2258528 - protein, 6 aa, Cryptosporidium parvum
FPPEPN

SEQ ID NO: 2258529 - protein, 7 aa, Cryptosporidium parvum
FPPEPSG

SEQ ID NO: 2258530 - protein, 11 aa, Cryptosporidium parvum
FPPGANSNPFS

SEQ ID NO: 2258531 - protein, 6 aa, Cryptosporidium parvum
FPPGSD

SEQ ID NO: 2258532 - protein, 5 aa, Cryptosporidium parvum
FPPKE

SEQ ID NO: 2258533 - protein, 19 aa, Cryptosporidium parvum
FPPNEISNGSKPTSTSTQP

SEQ ID NO: 2258534 - protein, 5 aa, Cryptosporidium parvum
FPPNK

SEQ ID NO: 2258535 - protein, 16 aa, Cryptosporidium parvum
FPPNQRQQFPYQFPPQ

SEQ ID NO: 2258536 - protein, 6 aa, Cryptosporidium parvum
FPPPPP

SEQ ID NO: 2258537 - protein, 4 aa, Cryptosporidium parvum
FPPQ

SEQ ID NO: 2258538 - protein, 4 aa, Cryptosporidium parvum
FPPT

SEQ ID NO: 2258539 - protein, 23 aa, Cryptosporidium parvum
FPQKRNPTRRVTQNAPSNPPPNV

SEQ ID NO: 2258540 - protein, 15 aa, Cryptosporidium parvum
FPQRVSDTSSSKDWG

SEQ ID NO: 2258541 - protein, 5 aa, Cryptosporidium parvum
FPQSG

SEQ ID NO: 2258542 - protein, 11 aa, Cryptosporidium parvum
FPQSGTEIGPE

SEQ ID NO: 2258543 - protein, 10 aa, Cryptosporidium parvum
FPQYQQPNYQ

SEQ ID NO: 2258544 - protein, 17 aa, Cryptosporidium parvum
FPRDYSRESSKRNYDYR

SEQ ID NO: 2258545 - protein, 9 aa, Cryptosporidium parvum
FPSDDVRNT

SEQ ID NO: 2258546 - protein, 11 aa, Cryptosporidium parvum
FPSDNTPSDCV

SEQ ID NO: 2258547 - protein, 4 aa, Cryptosporidium parvum
FPSE

SEQ ID NO: 2258548 - protein, 8 aa, Cryptosporidium parvum
FPSKGTWN

SEQ ID NO: 2258549 - protein, 8 aa, Cryptosporidium parvum
FPSRSSTR

SEQ ID NO: 2258550 - protein, 28 aa, Cryptosporidium parvum
FPSSNGSPIPSKNSPDNFKSSDTESIKE

SEQ ID NO: 2258551 - protein, 9 aa, Cryptosporidium parvum
FPSSSMSNS

SEQ ID NO: 2258552 - protein, 11 aa, Cryptosporidium parvum
FPSTNKESDTA

SEQ ID NO: 2258553 - protein, 9 aa, Cryptosporidium parvum
FPSTQGRSV

SEQ ID NO: 2258554 - protein, 6 aa, Cryptosporidium parvum
FPSTTI

SEQ ID NO: 2258555 - protein, 5 aa, Cryptosporidium parvum
FPTFD

SEQ ID NO: 2258556 - protein, 5 aa, Cryptosporidium parvum
FPTNI

SEQ ID NO: 2258557 - protein, 36 aa, Cryptosporidium parvum
FPTNSNINSEGISNLGEGLDTSNTGESLNKKPRMDE

SEQ ID NO: 2258558 - protein, 27 aa, Cryptosporidium parvum
FPTNSQDGETNVSQVKGSTPGKGREWD

SEQ ID NO: 2258559 - protein, 6 aa, Cryptosporidium parvum
FPTNTN

SEQ ID NO: 2258560 - protein, 7 aa, Cryptosporidium parvum
FPTPKIE

SEQ ID NO: 2258561 - protein, 12 aa, Cryptosporidium parvum
FPTPPEKSQIDQ

SEQ ID NO: 2258562 - protein, 5 aa, Cryptosporidium parvum
FPTSP

SEQ ID NO: 2258563 - protein, 8 aa, Cryptosporidium parvum
FQADQRRK

SEQ ID NO: 2258564 - protein, 9 aa, Cryptosporidium parvum
FQDDDSEKQ

SEQ ID NO: 2258565 - protein, 15 aa, Cryptosporidium parvum
FQDESSQIGENSNIN

SEQ ID NO: 2258566 - protein, 8 aa, Cryptosporidium parvum
FQDKSNDL

SEQ ID NO: 2258567 - protein, 4 aa, Cryptosporidium parvum
FQDN

SEQ ID NO: 2258568 - protein, 6 aa, Cryptosporidium parvum
FQDSKG

SEQ ID NO: 2258569 - protein, 9 aa, Cryptosporidium parvum
FQEGGDSVI

SEQ ID NO: 2258570 - protein, 11 aa, Cryptosporidium parvum
FQEKQNKLQEI

SEQ ID NO: 2258571 - protein, 11 aa, Cryptosporidium parvum
FQENSDQQIND

SEQ ID NO: 2258572 - protein, 7 aa, Cryptosporidium parvum
FQENSSN

SEQ ID NO: 2258573 - protein, 18 aa, Cryptosporidium parvum
FQESPSEFEAEKHQVTNT

SEQ ID NO: 2258574 - protein, 8 aa, Cryptosporidium parvum
FQESSKRN

SEQ ID NO: 2258575 - protein, 6 aa, Cryptosporidium parvum
FQETLG

SEQ ID NO: 2258576 - protein, 4 aa, Cryptosporidium parvum
FQGD

SEQ ID NO: 2258577 - protein, 9 aa, Cryptosporidium parvum
FQGGSARTR

SEQ ID NO: 2258578 - protein, 15 aa, Cryptosporidium parvum
FQGNDSNNNQLQNDN

SEQ ID NO: 2258579 - protein, 10 aa, Cryptosporidium parvum
FQGSKRGELH

SEQ ID NO: 2258580 - protein, 15 aa, Cryptosporidium parvum
FQGSPDFQKMFGGMG

SEQ ID NO: 2258581 - protein, 10 aa, Cryptosporidium parvum
FQGTQNQVDK

SEQ ID NO: 2258582 - protein, 7 aa, Cryptosporidium parvum
FQKNTEN

SEQ ID NO: 2258583 - protein, 96 aa, Cryptosporidium parvum
FQKPTPSSSGVNANINDSNSKKTTTLSSALSGSCASDPTKLVSKNKSRSNRSSINGTQKNRRNSNVQSNFEDGDSGHSNNNKSQQPTQSAPSNSSM

SEQ ID NO: 2258584 - protein, 6 aa, Cryptosporidium parvum
FQKSKS

SEQ ID NO: 2258585 - protein, 12 aa, Cryptosporidium parvum
FQNNKGGASIGS

SEQ ID NO: 2258586 - protein, 8 aa, Cryptosporidium parvum
FQNTNNSL

SEQ ID NO: 2258587 - protein, 5 aa, Cryptosporidium parvum
FQPRT

SEQ ID NO: 2258588 - protein, 6 aa, Cryptosporidium parvum
FQPSND

SEQ ID NO: 2258589 - protein, 6 aa, Cryptosporidium parvum
FQQNDA

SEQ ID NO: 2258590 - protein, 9 aa, Cryptosporidium parvum
FQRAKEEIK

SEQ ID NO: 2258591 - protein, 5 aa, Cryptosporidium parvum
FQSNN

SEQ ID NO: 2258592 - protein, 7 aa, Cryptosporidium parvum
FQSQRDA

SEQ ID NO: 2258593 - protein, 9 aa, Cryptosporidium parvum
FQSSNKKYQ

SEQ ID NO: 2258594 - protein, 41 aa, Cryptosporidium parvum
FQSSPKSIINTNEQPDTNSIYGSTRKVSDNSNFNMGGETMS

SEQ ID NO: 2258595 - protein, 12 aa, Cryptosporidium parvum
FQSSQGASQSFN

SEQ ID NO: 2258596 - protein, 12 aa, Cryptosporidium parvum
FQSSRKSRSSNL

SEQ ID NO: 2258597 - protein, 15 aa, Cryptosporidium parvum
FQSSSEKEVNSDKKD

SEQ ID NO: 2258598 - protein, 4 aa, Cryptosporidium parvum
FQST

SEQ ID NO: 2258599 - protein, 8 aa, Cryptosporidium parvum
FQSTEQTI

SEQ ID NO: 2258600 - protein, 19 aa, Cryptosporidium parvum
FQTSAEKAKYYGPCKRSID

SEQ ID NO: 2258601 - protein, 7 aa, Cryptosporidium parvum
FQVDSPE

SEQ ID NO: 2258602 - protein, 4 aa, Cryptosporidium parvum
FRDP

SEQ ID NO: 2258603 - protein, 5 aa, Cryptosporidium parvum
FRDPK

SEQ ID NO: 2258604 - protein, 9 aa, Cryptosporidium parvum
FRDSTKKSL

SEQ ID NO: 2258605 - protein, 24 aa, Cryptosporidium parvum
FREENNSNTVNGIGTSGEPTKQEI

SEQ ID NO: 2258606 - protein, 15 aa, Cryptosporidium parvum
FREGTVARPLNMAAH

SEQ ID NO: 2258607 - protein, 35 aa, Cryptosporidium parvum
FREPPKRTRDKFNNETSKNDSLKRGSQESKSAYSF

SEQ ID NO: 2258608 - protein, 9 aa, Cryptosporidium parvum
FRGDDDRQA

SEQ ID NO: 2258609 - protein, 9 aa, Cryptosporidium parvum
FRGDGKSYW

SEQ ID NO: 2258610 - protein, 5 aa, Cryptosporidium parvum
FRGGP

SEQ ID NO: 2258611 - protein, 5 aa, Cryptosporidium parvum
FRGRK

SEQ ID NO: 2258612 - protein, 18 aa, Cryptosporidium parvum
FRGRQRTENQKPSHEKTN

SEQ ID NO: 2258613 - protein, 58 aa, Cryptosporidium parvum
FRKPGAHGSHKPDMPGLSAPGVPGGGEPASVISEPGAENSKGSKSEPKNNRNLGGRKD

SEQ ID NO: 2258614 - protein, 7 aa, Cryptosporidium parvum
FRPARSS

SEQ ID NO: 2258615 - protein, 6 aa, Cryptosporidium parvum
FRPGER

SEQ ID NO: 2258616 - protein, 5 aa, Cryptosporidium parvum
FRPPE

SEQ ID NO: 2258617 - protein, 16 aa, Cryptosporidium parvum
FRPPEAYETGSLYDPT

SEQ ID NO: 2258618 - protein, 6 aa, Cryptosporidium parvum
FRPPKN

SEQ ID NO: 2258619 - protein, 5 aa, Cryptosporidium parvum
FRPSI

SEQ ID NO: 2258620 - protein, 12 aa, Cryptosporidium parvum
FRPTENKTHNKY

SEQ ID NO: 2258621 - protein, 6 aa, Cryptosporidium parvum
FRQKNP

SEQ ID NO: 2258622 - protein, 11 aa, Cryptosporidium parvum
FRQNGGSKSGY

SEQ ID NO: 2258623 - protein, 5 aa, Cryptosporidium parvum
FRRPE

SEQ ID NO: 2258624 - protein, 6 aa, Cryptosporidium parvum
FRSGES

SEQ ID NO: 2258625 - protein, 7 aa, Cryptosporidium parvum
FRSGSSI

SEQ ID NO: 2258626 - protein, 6 aa, Cryptosporidium parvum
FRSKTS

SEQ ID NO: 2258627 - protein, 8 aa, Cryptosporidium parvum
FRSNEDFP

SEQ ID NO: 2258628 - protein, 8 aa, Cryptosporidium parvum
FRSQDNIH

SEQ ID NO: 2258629 - protein, 7 aa, Cryptosporidium parvum
FRSQPYS

SEQ ID NO: 2258630 - protein, 8 aa, Cryptosporidium parvum
FRSSNTGK

SEQ ID NO: 2258631 - protein, 4 aa, Cryptosporidium parvum
FRST

SEQ ID NO: 2258632 - protein, 4 aa, Cryptosporidium parvum
FRTN

SEQ ID NO: 2258633 - protein, 6 aa, Cryptosporidium parvum
FSAGEG

SEQ ID NO: 2258634 - protein, 25 aa, Cryptosporidium parvum
FSASSSNTSNNDVEDTNNESQLFPS

SEQ ID NO: 2258635 - protein, 6 aa, Cryptosporidium parvum
FSDAYK

SEQ ID NO: 2258636 - protein, 5 aa, Cryptosporidium parvum
FSDEE

SEQ ID NO: 2258637 - protein, 7 aa, Cryptosporidium parvum
FSDEEDD

SEQ ID NO: 2258638 - protein, 12 aa, Cryptosporidium parvum
FSDKDISNITSE

SEQ ID NO: 2258639 - protein, 9 aa, Cryptosporidium parvum
FSDKENAKI

SEQ ID NO: 2258640 - protein, 9 aa, Cryptosporidium parvum
FSDKGERQI

SEQ ID NO: 2258641 - protein, 14 aa, Cryptosporidium parvum
FSDKSTKKKLEELS

SEQ ID NO: 2258642 - protein, 7 aa, Cryptosporidium parvum
FSDNSNN

SEQ ID NO: 2258643 - protein, 9 aa, Cryptosporidium parvum
FSDSISASS

SEQ ID NO: 2258644 - protein, 10 aa, Cryptosporidium parvum
FSDSNNLQLT

SEQ ID NO: 2258645 - protein, 5 aa, Cryptosporidium parvum
FSEDK

SEQ ID NO: 2258646 - protein, 6 aa, Cryptosporidium parvum
FSEEDT

SEQ ID NO: 2258647 - protein, 20 aa, Cryptosporidium parvum
FSEERERSRERERRRRRMQA

SEQ ID NO: 2258648 - protein, 5 aa, Cryptosporidium parvum
FSEHD

SEQ ID NO: 2258649 - protein, 4 aa, Cryptosporidium parvum
FSEI

SEQ ID NO: 2258650 - protein, 30 aa, Cryptosporidium parvum
FSEKDSQTLSEGGAFGRPTPTPESVEKTPF

SEQ ID NO: 2258651 - protein, 10 aa, Cryptosporidium parvum
FSEKELTARK

SEQ ID NO: 2258652 - protein, 19 aa, Cryptosporidium parvum
FSEKNSQNNSIWSSKTKPE

SEQ ID NO: 2258653 - protein, 7 aa, Cryptosporidium parvum
FSENPNI

SEQ ID NO: 2258654 - protein, 9 aa, Cryptosporidium parvum
FSENQSKKF

SEQ ID NO: 2258655 - protein, 25 aa, Cryptosporidium parvum
FSENSKKSDLNKNKKVSKHISKTNN

SEQ ID NO: 2258656 - protein, 4 aa, Cryptosporidium parvum
FSES

SEQ ID NO: 2258657 - protein, 6 aa, Cryptosporidium parvum
FSESDL

SEQ ID NO: 2258658 - protein, 9 aa, Cryptosporidium parvum
FSESSEFTE

SEQ ID NO: 2258659 - protein, 20 aa, Cryptosporidium parvum
FSESSNKITDKSPSKQKNGM

SEQ ID NO: 2258660 - protein, 5 aa, Cryptosporidium parvum
FSETS

SEQ ID NO: 2258661 - protein, 30 aa, Cryptosporidium parvum
FSFSNNAKDQFKGGVNPSNNDLEKENKELR

SEQ ID NO: 2258662 - protein, 9 aa, Cryptosporidium parvum
FSFSPTPPF

SEQ ID NO: 2258663 - protein, 6 aa, Cryptosporidium parvum
FSGDTS

SEQ ID NO: 2258664 - protein, 10 aa, Cryptosporidium parvum
FSGEPNALQT

SEQ ID NO: 2258665 - protein, 7 aa, Cryptosporidium parvum
FSGGQKD

SEQ ID NO: 2258666 - protein, 6 aa, Cryptosporidium parvum
FSGGTT

SEQ ID NO: 2258667 - protein, 4 aa, Cryptosporidium parvum
FSGK

SEQ ID NO: 2258668 - protein, 14 aa, Cryptosporidium parvum
FSGKKDTKFIEETK

SEQ ID NO: 2258669 - protein, 50 aa, Cryptosporidium parvum
FSGNDSTNNTNTSNQQQGTSTSENTSNTSTNPNQGNNAQAGSTSDPNSIE

SEQ ID NO: 2258670 - protein, 8 aa, Cryptosporidium parvum
FSGQGSNL

SEQ ID NO: 2258671 - protein, 5 aa, Cryptosporidium parvum
FSGSQ

SEQ ID NO: 2258672 - protein, 10 aa, Cryptosporidium parvum
FSGSTPPYPQ

SEQ ID NO: 2258673 - protein, 4 aa, Cryptosporidium parvum
FSGT

SEQ ID NO: 2258674 - protein, 14 aa, Cryptosporidium parvum
FSGTDNSKTALRTK

SEQ ID NO: 2258675 - protein, 16 aa, Cryptosporidium parvum
FSGTPAPWEVETDRRK

SEQ ID NO: 2258676 - protein, 5 aa, Cryptosporidium parvum
FSIDN

SEQ ID NO: 2258677 - protein, 12 aa, Cryptosporidium parvum
FSISDKETRAYV

SEQ ID NO: 2258678 - protein, 9 aa, Cryptosporidium parvum
FSKDEKSSL

SEQ ID NO: 2258679 - protein, 9 aa, Cryptosporidium parvum
FSKEGQTRE

SEQ ID NO: 2258680 - protein, 8 aa, Cryptosporidium parvum
FSKENDRR

SEQ ID NO: 2258681 - protein, 4 aa, Cryptosporidium parvum
FSKN

SEQ ID NO: 2258682 - protein, 7 aa, Cryptosporidium parvum
FSKPHHG

SEQ ID NO: 2258683 - protein, 5 aa, Cryptosporidium parvum
FSKPN

SEQ ID NO: 2258684 - protein, 9 aa, Cryptosporidium parvum
FSKPRDLNG

SEQ ID NO: 2258685 - protein, 6 aa, Cryptosporidium parvum
FSKSPF

SEQ ID NO: 2258686 - protein, 7 aa, Cryptosporidium parvum
FSKSSNH

SEQ ID NO: 2258687 - protein, 13 aa, Cryptosporidium parvum
FSKSSSDQLPNEE

SEQ ID NO: 2258688 - protein, 9 aa, Cryptosporidium parvum
FSKTKNSRQ

SEQ ID NO: 2258689 - protein, 6 aa, Cryptosporidium parvum
FSKTPQ

SEQ ID NO: 2258690 - protein, 11 aa, Cryptosporidium parvum
FSLGSNNDGVT

SEQ ID NO: 2258691 - protein, 11 aa, Cryptosporidium parvum
FSLSNGNSNQK

SEQ ID NO: 2258692 - protein, 16 aa, Cryptosporidium parvum
FSNDGNDGNSKSRIGS

SEQ ID NO: 2258693 - protein, 7 aa, Cryptosporidium parvum
FSNEANA

SEQ ID NO: 2258694 - protein, 16 aa, Cryptosporidium parvum
FSNEKSKLQVDDRNDR

SEQ ID NO: 2258695 - protein, 18 aa, Cryptosporidium parvum
FSNELKDTKMANNPNLSR

SEQ ID NO: 2258696 - protein, 5 aa, Cryptosporidium parvum
FSNEM

SEQ ID NO: 2258697 - protein, 18 aa, Cryptosporidium parvum
FSNGRNPINTENSKLSIN

SEQ ID NO: 2258698 - protein, 9 aa, Cryptosporidium parvum
FSNGSITSR

SEQ ID NO: 2258699 - protein, 5 aa, Cryptosporidium parvum
FSNKN

SEQ ID NO: 2258700 - protein, 8 aa, Cryptosporidium parvum
FSNKPYKR

SEQ ID NO: 2258701 - protein, 17 aa, Cryptosporidium parvum
FSNKSNSINDATINNST

SEQ ID NO: 2258702 - protein, 6 aa, Cryptosporidium parvum
FSNKSS

SEQ ID NO: 2258703 - protein, 9 aa, Cryptosporidium parvum
FSNNAGKEM

SEQ ID NO: 2258704 - protein, 29 aa, Cryptosporidium parvum
FSNNNNNKSDNLYSRKDSKGGEFDKSKGS

SEQ ID NO: 2258705 - protein, 45 aa, Cryptosporidium parvum
FSNNTGGSWKNQNGGDHTYGRHGRYSGPKNVGKGTNACNGGPNQN

SEQ ID NO: 2258706 - protein, 23 aa, Cryptosporidium parvum
FSNSNNSSSTNNNFNQHANKRAC

SEQ ID NO: 2258707 - protein, 11 aa, Cryptosporidium parvum
FSNSQSHPNLQ

SEQ ID NO: 2258708 - protein, 8 aa, Cryptosporidium parvum
FSPDRREG

SEQ ID NO: 2258709 - protein, 5 aa, Cryptosporidium parvum
FSPKG

SEQ ID NO: 2258710 - protein, 8 aa, Cryptosporidium parvum
FSPKGMPA

SEQ ID NO: 2258711 - protein, 6 aa, Cryptosporidium parvum
FSPPDI

SEQ ID NO: 2258712 - protein, 25 aa, Cryptosporidium parvum
FSPPNSHKETLASENSSSEQFSPLS

SEQ ID NO: 2258713 - protein, 13 aa, Cryptosporidium parvum
FSPRNSPEQLSNV

SEQ ID NO: 2258714 - protein, 18 aa, Cryptosporidium parvum
FSPSEQGLHSQKSPLHPM

SEQ ID NO: 2258715 - protein, 5 aa, Cryptosporidium parvum
FSPSI

SEQ ID NO: 2258716 - protein, 7 aa, Cryptosporidium parvum
FSPSIPN

SEQ ID NO: 2258717 - protein, 12 aa, Cryptosporidium parvum
FSPSNNISENSN

SEQ ID NO: 2258718 - protein, 25 aa, Cryptosporidium parvum
FSPSSSKALRKGNGEITGSATNSEI

SEQ ID NO: 2258719 - protein, 14 aa, Cryptosporidium parvum
FSPSSYSKKITEDP

SEQ ID NO: 2258720 - protein, 19 aa, Cryptosporidium parvum
FSPVTQPNRPSGAESGIEE

SEQ ID NO: 2258721 - protein, 7 aa, Cryptosporidium parvum
FSQEEND

SEQ ID NO: 2258722 - protein, 9 aa, Cryptosporidium parvum
FSQEETPKS

SEQ ID NO: 2258723 - protein, 12 aa, Cryptosporidium parvum
FSQHPKNEEKKN

SEQ ID NO: 2258724 - protein, 11 aa, Cryptosporidium parvum
FSQKSGVGGKR

SEQ ID NO: 2258725 - protein, 7 aa, Cryptosporidium parvum
FSQNGGM

SEQ ID NO: 2258726 - protein, 15 aa, Cryptosporidium parvum
FSQRTSTFANDRGRR

SEQ ID NO: 2258727 - protein, 9 aa, Cryptosporidium parvum
FSQSDNSYN

SEQ ID NO: 2258728 - protein, 8 aa, Cryptosporidium parvum
FSQSENKG

SEQ ID NO: 2258729 - protein, 10 aa, Cryptosporidium parvum
FSQSKNLNNS

SEQ ID NO: 2258730 - protein, 9 aa, Cryptosporidium parvum
FSQSNTYSN

SEQ ID NO: 2258731 - protein, 6 aa, Cryptosporidium parvum
FSQTRN

SEQ ID NO: 2258732 - protein, 4 aa, Cryptosporidium parvum
FSRD

SEQ ID NO: 2258733 - protein, 22 aa, Cryptosporidium parvum
FSRDKGNADLRVDSSSGPEAIS

SEQ ID NO: 2258734 - protein, 15 aa, Cryptosporidium parvum
FSRENHENSTKNNEK

SEQ ID NO: 2258735 - protein, 5 aa, Cryptosporidium parvum
FSRNR

SEQ ID NO: 2258736 - protein, 12 aa, Cryptosporidium parvum
FSRNSGSNRQYS

SEQ ID NO: 2258737 - protein, 9 aa, Cryptosporidium parvum
FSRSKNDEN

SEQ ID NO: 2258738 - protein, 7 aa, Cryptosporidium parvum
FSSANDG

SEQ ID NO: 2258739 - protein, 8 aa, Cryptosporidium parvum
FSSANNSV

SEQ ID NO: 2258740 - protein, 8 aa, Cryptosporidium parvum
FSSAYSSK

SEQ ID NO: 2258741 - protein, 10 aa, Cryptosporidium parvum
FSSCSPESTS

SEQ ID NO: 2258742 - protein, 4 aa, Cryptosporidium parvum
FSSD

SEQ ID NO: 2258743 - protein, 9 aa, Cryptosporidium parvum
FSSGNTAIT

SEQ ID NO: 2258744 - protein, 10 aa, Cryptosporidium parvum
FSSGTSNHHG

SEQ ID NO: 2258745 - protein, 27 aa, Cryptosporidium parvum
FSSGVKAAKETTYEELSKEENDEIEYP

SEQ ID NO: 2258746 - protein, 4 aa, Cryptosporidium parvum
FSSK

SEQ ID NO: 2258747 - protein, 9 aa, Cryptosporidium parvum
FSSKPKQAR

SEQ ID NO: 2258748 - protein, 4 aa, Cryptosporidium parvum
FSSN

SEQ ID NO: 2258749 - protein, 8 aa, Cryptosporidium parvum
FSSNGANP

SEQ ID NO: 2258750 - protein, 10 aa, Cryptosporidium parvum
FSSNNECPES

SEQ ID NO: 2258751 - protein, 29 aa, Cryptosporidium parvum
FSSNSNNGIINNSNNSNNLGTSISSLNGG

SEQ ID NO: 2258752 - protein, 10 aa, Cryptosporidium parvum
FSSNSNQNTE

SEQ ID NO: 2258753 - protein, 8 aa, Cryptosporidium parvum
FSSNSTRR

SEQ ID NO: 2258754 - protein, 14 aa, Cryptosporidium parvum
FSSPRLSDSHETEF

SEQ ID NO: 2258755 - protein, 10 aa, Cryptosporidium parvum
FSSPSIKSIS

SEQ ID NO: 2258756 - protein, 8 aa, Cryptosporidium parvum
FSSPSNME

SEQ ID NO: 2258757 - protein, 9 aa, Cryptosporidium parvum
FSSPSRQSH

SEQ ID NO: 2258758 - protein, 13 aa, Cryptosporidium parvum
FSSQISSKKVNET

SEQ ID NO: 2258759 - protein, 9 aa, Cryptosporidium parvum
FSSRHGQKG

SEQ ID NO: 2258760 - protein, 17 aa, Cryptosporidium parvum
FSSRRSKVQQKEETLPE

SEQ ID NO: 2258761 - protein, 8 aa, Cryptosporidium parvum
FSSSFNPG

SEQ ID NO: 2258762 - protein, 5 aa, Cryptosporidium parvum
FSSSS

SEQ ID NO: 2258763 - protein, 8 aa, Cryptosporidium parvum
FSSSSNDI

SEQ ID NO: 2258764 - protein, 9 aa, Cryptosporidium parvum
FSSSSSSQL

SEQ ID NO: 2258765 - protein, 10 aa, Cryptosporidium parvum
FSSSSSSSSS

SEQ ID NO: 2258766 - protein, 8 aa, Cryptosporidium parvum
FSSTNNFN

SEQ ID NO: 2258767 - protein, 17 aa, Cryptosporidium parvum
FSTEANERSKPVYPNPS

SEQ ID NO: 2258768 - protein, 19 aa, Cryptosporidium parvum
FSTESSNNNLSKNVNSSDL

SEQ ID NO: 2258769 - protein, 19 aa, Cryptosporidium parvum
FSTGSGKKVSIDEESLNKA

SEQ ID NO: 2258770 - protein, 18 aa, Cryptosporidium parvum
FSTGSGKKVSITEESLNR

SEQ ID NO: 2258771 - protein, 19 aa, Cryptosporidium parvum
FSTGSGKKVSITEESLSRA

SEQ ID NO: 2258772 - protein, 10 aa, Cryptosporidium parvum
FSTGTSTYNY

SEQ ID NO: 2258773 - protein, 12 aa, Cryptosporidium parvum
FSTKEDSAPVKK

SEQ ID NO: 2258774 - protein, 9 aa, Cryptosporidium parvum
FSTKKQGEI

SEQ ID NO: 2258775 - protein, 10 aa, Cryptosporidium parvum
FSTNKNSSSI

SEQ ID NO: 2258776 - protein, 12 aa, Cryptosporidium parvum
FSTNQIQRNNQK

SEQ ID NO: 2258777 - protein, 11 aa, Cryptosporidium parvum
FSTPTNNNSMA

SEQ ID NO: 2258778 - protein, 21 aa, Cryptosporidium parvum
FSTSKNSKVEKMPGKKLSTKL

SEQ ID NO: 2258779 - protein, 6 aa, Cryptosporidium parvum
FSTSKP

SEQ ID NO: 2258780 - protein, 17 aa, Cryptosporidium parvum
FTANKNSENYSNNKNGV

SEQ ID NO: 2258781 - protein, 12 aa, Cryptosporidium parvum
FTANRNTSIKEA

SEQ ID NO: 2258782 - protein, 5 aa, Cryptosporidium parvum
FTDTN

SEQ ID NO: 2258783 - protein, 33 aa, Cryptosporidium parvum
FTEKSKSSRIRASSTSPAVKNMGGSDVGEHACD

SEQ ID NO: 2258784 - protein, 4 aa, Cryptosporidium parvum
FTEN

SEQ ID NO: 2258785 - protein, 6 aa, Cryptosporidium parvum
FTEQGK

SEQ ID NO: 2258786 - protein, 5 aa, Cryptosporidium parvum
FTESG

SEQ ID NO: 2258787 - protein, 13 aa, Cryptosporidium parvum
FTGNNNTSPFQTS

SEQ ID NO: 2258788 - protein, 10 aa, Cryptosporidium parvum
FTGNNRNDIL

SEQ ID NO: 2258789 - protein, 19 aa, Cryptosporidium parvum
FTGRQNSNPYRSISKQRVE

SEQ ID NO: 2258790 - protein, 13 aa, Cryptosporidium parvum
FTGSTSSRYSNTE

SEQ ID NO: 2258791 - protein, 6 aa, Cryptosporidium parvum
FTKPGS

SEQ ID NO: 2258792 - protein, 20 aa, Cryptosporidium parvum
FTKTSENGDKRYGDNNINNI

SEQ ID NO: 2258793 - protein, 4 aa, Cryptosporidium parvum
FTND

SEQ ID NO: 2258794 - protein, 6 aa, Cryptosporidium parvum
FTNKEE

SEQ ID NO: 2258795 - protein, 5 aa, Cryptosporidium parvum
FTNQG

SEQ ID NO: 2258796 - protein, 6 aa, Cryptosporidium parvum
FTNSRE

SEQ ID NO: 2258797 - protein, 16 aa, Cryptosporidium parvum
FTNTTTPGQNSSSTIS

SEQ ID NO: 2258798 - protein, 18 aa, Cryptosporidium parvum
FTPEEESAIREENKWCDE

SEQ ID NO: 2258799 - protein, 9 aa, Cryptosporidium parvum
FTPESKQQV

SEQ ID NO: 2258800 - protein, 31 aa, Cryptosporidium parvum; identical to SEQ ID NO: 2142418

SEQ ID NO: 2258801 - protein, 17 aa, Cryptosporidium parvum
FTPPSYPKTKEQEKRIR

SEQ ID NO: 2258802 - protein, 8 aa, Cryptosporidium parvum
FTPQPNLK

SEQ ID NO: 2258803 - protein, 4 aa, Cryptosporidium parvum
FTPS

SEQ ID NO: 2258804 - protein, 7 aa, Cryptosporidium parvum
FTPSPYK

SEQ ID NO: 2258805 - protein, 6 aa, Cryptosporidium parvum
FTPTKF

SEQ ID NO: 2258806 - protein, 5 aa, Cryptosporidium parvum
FTQEN

SEQ ID NO: 2258807 - protein, 10 aa, Cryptosporidium parvum
FTQSDESNII

SEQ ID NO: 2258808 - protein, 14 aa, Cryptosporidium parvum
FTRLSESSNNNHSI

SEQ ID NO: 2258809 - protein, 10 aa, Cryptosporidium parvum
FTSCEKDQGC

SEQ ID NO: 2258810 - protein, 19 aa, Cryptosporidium parvum
FTSNENNKSLSARIDTKKE

SEQ ID NO: 2258811 - protein, 4 aa, Cryptosporidium parvum
FTSQ

SEQ ID NO: 2258812 - protein, 11 aa, Cryptosporidium parvum
FTSSDKGGTMR

SEQ ID NO: 2258813 - protein, 11 aa, Cryptosporidium parvum
FTSSNKEERNK

SEQ ID NO: 2258814 - protein, 6 aa, Cryptosporidium parvum
FTSSTE

SEQ ID NO: 2258815 - protein, 19 aa, Cryptosporidium parvum
FTSSTKKENFESNNSNLSI

SEQ ID NO: 2258816 - protein, 10 aa, Cryptosporidium parvum
FTSTNTSARR

SEQ ID NO: 2258817 - protein, 6 aa, Cryptosporidium parvum
FTSTTK

SEQ ID NO: 2258818 - protein, 9 aa, Cryptosporidium parvum
FTTDKENLN

SEQ ID NO: 2258819 - protein, 4 aa, Cryptosporidium parvum
FTTE

SEQ ID NO: 2258820 - protein, 6 aa, Cryptosporidium parvum
FTTEEK

SEQ ID NO: 2258821 - protein, 5 aa, Cryptosporidium parvum
FTTGE

SEQ ID NO: 2258822 - protein, 8 aa, Cryptosporidium parvum
FTTGGEDG

SEQ ID NO: 2258823 - protein, 6 aa, Cryptosporidium parvum
FTTTAE

SEQ ID NO: 2258824 - protein, 18 aa, Cryptosporidium parvum
FTTTTNNNNSNNNNNSIA

SEQ ID NO: 2258825 - protein, 4 aa, Cryptosporidium parvum
FVSQ

SEQ ID NO: 2258826 - protein, 6 aa, Cryptosporidium parvum
FVTNTN

SEQ ID NO: 2258827 - protein, 7 aa, Cryptosporidium parvum
FVTTSDD

SEQ ID NO: 2258828 - protein, 12 aa, Cryptosporidium parvum
FYDSEDTSNEYM

SEQ ID NO: 2258829 - protein, 21 aa, Cryptosporidium parvum
FYGRESDVTGHSNSYKPYRNE

SEQ ID NO: 2258830 - protein, 12 aa, Cryptosporidium parvum
FYGSDNSNDSND

SEQ ID NO: 2258831 - protein, 13 aa, Cryptosporidium parvum
FYKPQSNKNKKNQ

SEQ ID NO: 2258832 - protein, 10 aa, Cryptosporidium parvum
FYPGTGPDQC

SEQ ID NO: 2258833 - protein, 7 aa, Cryptosporidium parvum
FYPKGKD

SEQ ID NO: 2258834 - protein, 11 aa, Cryptosporidium parvum
FYSESGGQVAD

SEQ ID NO: 2258835 - protein, 10 aa, Cryptosporidium parvum
FYSGGKNSLF

SEQ ID NO: 2258836 - protein, 30 aa, Cryptosporidium parvum
FYTRKQNASFNNGPISNPSLERKTSNISEF

SEQ ID NO: 2258837 - protein, 11 aa, Cryptosporidium parvum
GAAETGSGKTL

SEQ ID NO: 2258838 - protein, 8 aa, Cryptosporidium parvum
GAAIRDNK

SEQ ID NO: 2258839 - protein, 10 aa, Cryptosporidium parvum
GAAKTGSGKT

SEQ ID NO: 2258840 - protein, 11 aa, Cryptosporidium parvum
GAANGKERVPT

SEQ ID NO: 2258841 - protein, 8 aa, Cryptosporidium parvum
GAANISPK

SEQ ID NO: 2258842 - protein, 7 aa, Cryptosporidium parvum
GAAPLDE

SEQ ID NO: 2258843 - protein, 6 aa, Cryptosporidium parvum
GACTNC

SEQ ID NO: 2258844 - protein, 15 aa, Cryptosporidium parvum
GADAGIKDKNRQAAH

SEQ ID NO: 2258845 - protein, 8 aa, Cryptosporidium parvum
GADDNYSI

SEQ ID NO: 2258846 - protein, 6 aa, Cryptosporidium parvum
GADETI

SEQ ID NO: 2258847 - protein, 28 aa, Cryptosporidium parvum
GADGVEEKGTKVVSESNQATNLLTAEMK

SEQ ID NO: 2258848 - protein, 31 aa, Cryptosporidium parvum
GADQEEDSSYKPRDYDPVPGFDSENSEDADD

SEQ ID NO: 2258849 - protein, 13 aa, Cryptosporidium parvum
GADSNLQLEEENE

SEQ ID NO: 2258850 - protein, 12 aa, Cryptosporidium parvum
GAEASQKALNGY

SEQ ID NO: 2258851 - protein, 8 aa, Cryptosporidium parvum
GAEDSNKK

SEQ ID NO: 2258852 - protein, 7 aa, Cryptosporidium parvum
GAEEIIS

SEQ ID NO: 2258853 - protein, 7 aa, Cryptosporidium parvum
GAEIPED

SEQ ID NO: 2258854 - protein, 4 aa, Cryptosporidium parvum
GAEK

SEQ ID NO: 2258855 - protein, 4 aa, Cryptosporidium parvum
GAEL

SEQ ID NO: 2258856 - protein, 6 aa, Cryptosporidium parvum
GAELAG

SEQ ID NO: 2258857 - protein, 12 aa, Cryptosporidium parvum
GAEPNLSDNVGQ

SEQ ID NO: 2258858 - protein, 16 aa, Cryptosporidium parvum
GAFSNGRLNGNNNINH

SEQ ID NO: 2258859 - protein, 13 aa, Cryptosporidium parvum
GAGEGSNDGHQIE

SEQ ID NO: 2258860 - protein, 9 aa, Cryptosporidium parvum
GAGNSENLD

SEQ ID NO: 2258861 - protein, 10 aa, Cryptosporidium parvum
GAGQSKNVQV

SEQ ID NO: 2258862 - protein, 4 aa, Cryptosporidium parvum
GAGS

SEQ ID NO: 2258863 - protein, 5 aa, Cryptosporidium parvum
GAGSA

SEQ ID NO: 2258864 - protein, 19 aa, Cryptosporidium parvum
GAGSDASNDKVSLRKETQK

SEQ ID NO: 2258865 - protein, 17 aa, Cryptosporidium parvum
GAGSNSKKTSEVNDSPI

SEQ ID NO: 2258866 - protein, 27 aa, Cryptosporidium parvum
GAGSPQTTPASNTFGWPSGGSTTPQGF

SEQ ID NO: 2258867 - protein, 7 aa, Cryptosporidium parvum
GAGYTFG

SEQ ID NO: 2258868 - protein, 10 aa, Cryptosporidium parvum
GAHKRKKPGV

SEQ ID NO: 2258869 - protein, 8 aa, Cryptosporidium parvum
GAIDQENQ

SEQ ID NO: 2258870 - protein, 7 aa, Cryptosporidium parvum
GAIGDVN

SEQ ID NO: 2258871 - protein, 15 aa, Cryptosporidium parvum
GAIGNSRRSLEVNSG

SEQ ID NO: 2258872 - protein, 12 aa, Cryptosporidium parvum
GAIPPGPPGVHG

SEQ ID NO: 2258873 - protein, 4 aa, Cryptosporidium parvum
GAIQ

SEQ ID NO: 2258874 - protein, 13 aa, Cryptosporidium parvum
GAISSSSSTGAKD

SEQ ID NO: 2258875 - protein, 4 aa, Cryptosporidium parvum
GAIT

SEQ ID NO: 2258876 - protein, 11 aa, Cryptosporidium parvum
GAKDGKGRGRQ

SEQ ID NO: 2258877 - protein, 10 aa, Cryptosporidium parvum
GAKDKSPKVR

SEQ ID NO: 2258878 - protein, 8 aa, Cryptosporidium parvum
GAKKTENG

SEQ ID NO: 2258879 - protein, 7 aa, Cryptosporidium parvum
GAKQNFN

SEQ ID NO: 2258880 - protein, 11 aa, Cryptosporidium parvum
GAKRPTSERYY

SEQ ID NO: 2258881 - protein, 7 aa, Cryptosporidium parvum
GAKTPRW

SEQ ID NO: 2258882 - protein, 16 aa, Cryptosporidium parvum
GAKYNSDIYEKKEDYE

SEQ ID NO: 2258883 - protein, 4 aa, Cryptosporidium parvum
GALP

SEQ ID NO: 2258884 - protein, 36 aa, Cryptosporidium parvum
GANNTTNTTSTTNNNTNSTNAALGQNSQFKDTKYTS

SEQ ID NO: 2258885 - protein, 14 aa, Cryptosporidium parvum
GANPNVKDNFGDSP

SEQ ID NO: 2258886 - protein, 10 aa, Cryptosporidium parvum
GANSGKSGKV

SEQ ID NO: 2258887 - protein, 9 aa, Cryptosporidium parvum
GANTWAPNK

SEQ ID NO: 2258888 - protein, 9 aa, Cryptosporidium parvum
GAPAKQETI

SEQ ID NO: 2258889 - protein, 32 aa, Cryptosporidium parvum
GAPGAAVQGDSGDMESSPPNTISNSEANKDNI

SEQ ID NO: 2258890 - protein, 21 aa, Cryptosporidium parvum
GAPGIGGGSVNSNGSLGGTGV

SEQ ID NO: 2258891 - protein, 5 aa, Cryptosporidium parvum
GAPHE

SEQ ID NO: 2258892 - protein, 17 aa, Cryptosporidium parvum
GAPLSGAGHPDSYDTRS

SEQ ID NO: 2258893 - protein, 9 aa, Cryptosporidium parvum
GAPNVGTSW

SEQ ID NO: 2258894 - protein, 7 aa, Cryptosporidium parvum
GAPPHGG

SEQ ID NO: 2258895 - protein, 6 aa, Cryptosporidium parvum
GAPQQV

SEQ ID NO: 2258896 - protein, 6 aa, Cryptosporidium parvum
GAPTTK

SEQ ID NO: 2258897 - protein, 8 aa, Cryptosporidium parvum
GAPTVGDQ

SEQ ID NO: 2258898 - protein, 81 aa, Cryptosporidium parvum
GAQGFGGKPTRPGAPAFPGTQPGIPTQPGIPTQPEMPSQSGGSGLPGSSGGAGGGGGGWPERPGGSGIGNDENEEDPQNYP

SEQ ID NO: 2258899 - protein, 7 aa, Cryptosporidium parvum
GAQNIPP

SEQ ID NO: 2258900 - protein, 58 aa, Cryptosporidium parvum; identical to SEQ ID NO: 2142516

SEQ ID NO: 2258901 - protein, 12 aa, Cryptosporidium parvum
GARAGARAGNRA

SEQ ID NO: 2258902 - protein, 9 aa, Cryptosporidium parvum
GARDPQGKT

SEQ ID NO: 2258903 - protein, 9 aa, Cryptosporidium parvum
GARKDSIEE

SEQ ID NO: 2258904 - protein, 6 aa, Cryptosporidium parvum
GARRSV

SEQ ID NO: 2258905 - protein, 5 aa, Cryptosporidium parvum
GASDS

SEQ ID NO: 2258906 - protein, 23 aa, Cryptosporidium parvum
GASDSSETKNGIKEKNSNELSNK

SEQ ID NO: 2258907 - protein, 4 aa, Cryptosporidium parvum
GASG

SEQ ID NO: 2258908 - protein, 12 aa, Cryptosporidium parvum
GASGEAEGAPEA

SEQ ID NO: 2258909 - protein, 8 aa, Cryptosporidium parvum
GASHAGSR

SEQ ID NO: 2258910 - protein, 11 aa, Cryptosporidium parvum
GASIGGGYNRQ

SEQ ID NO: 2258911 - protein, 6 aa, Cryptosporidium parvum
GASISG

SEQ ID NO: 2258912 - protein, 7 aa, Cryptosporidium parvum
GASITPR

SEQ ID NO: 2258913 - protein, 6 aa, Cryptosporidium parvum
GASKRD

SEQ ID NO: 2258914 - protein, 23 aa, Cryptosporidium parvum
GASNNTNSFPLQSSTSGSNSGLF

SEQ ID NO: 2258915 - protein, 20 aa, Cryptosporidium parvum
GASNPGGMAGGNAGGISQNP

SEQ ID NO: 2258916 - protein, 8 aa, Cryptosporidium parvum
GASPNSLT

SEQ ID NO: 2258917 - protein, 6 aa, Cryptosporidium parvum
GASQAD

SEQ ID NO: 2258918 - protein, 9 aa, Cryptosporidium parvum
GASQNSDKG

SEQ ID NO: 2258919 - protein, 11 aa, Cryptosporidium parvum
GASQYTRTGSL

SEQ ID NO: 2258920 - protein, 8 aa, Cryptosporidium parvum
GASSDEIS

SEQ ID NO: 2258921 - protein, 11 aa, Cryptosporidium parvum
GASSENPYKSN

SEQ ID NO: 2258922 - protein, 12 aa, Cryptosporidium parvum
GASTKEIKSSFR

SEQ ID NO: 2258923 - protein, 4 aa, Cryptosporidium parvum
GATE

SEQ ID NO: 2258924 - protein, 7 aa, Cryptosporidium parvum
GATEDEK

SEQ ID NO: 2258925 - protein, 12 aa, Cryptosporidium parvum
GATGSGKSTQVP

SEQ ID NO: 2258926 - protein, 10 aa, Cryptosporidium parvum
GATIKCSGND

SEQ ID NO: 2258927 - protein, 8 aa, Cryptosporidium parvum
GATINENN

SEQ ID NO: 2258928 - protein, 11 aa, Cryptosporidium parvum
GATKRNKPNLV

SEQ ID NO: 2258929 - protein, 12 aa, Cryptosporidium parvum
GATQEDIEATMS

SEQ ID NO: 2258930 - protein, 7 aa, Cryptosporidium parvum
GATSQID

SEQ ID NO: 2258931 - protein, 4 aa, Cryptosporidium parvum
GAVG

SEQ ID NO: 2258932 - protein, 6 aa, Cryptosporidium parvum
GAVPNM

SEQ ID NO: 2258933 - protein, 6 aa, Cryptosporidium parvum
GAVPRG

SEQ ID NO: 2258934 - protein, 12 aa, Cryptosporidium parvum
GAVPTHGRLRGM

SEQ ID NO: 2258935 - protein, 5 aa, Cryptosporidium parvum
GAYGT

SEQ ID NO: 2258936 - protein, 11 aa, Cryptosporidium parvum
GAYRENRTGIS

SEQ ID NO: 2258937 - protein, 9 aa, Cryptosporidium parvum
GAYSEDQAK

SEQ ID NO: 2258938 - protein, 6 aa, Cryptosporidium parvum
GCGETP

SEQ ID NO: 2258939 - protein, 5 aa, Cryptosporidium parvum
GCGKT

SEQ ID NO: 2258940 - protein, 8 aa, Cryptosporidium parvum
GCGPEATE

SEQ ID NO: 2258941 - protein, 9 aa, Cryptosporidium parvum
GCNDYGDIS

SEQ ID NO: 2258942 - protein, 4 aa, Cryptosporidium parvum
GCNG

SEQ ID NO: 2258943 - protein, 4 aa, Cryptosporidium parvum
GCTD

SEQ ID NO: 2258944 - protein, 5 aa, Cryptosporidium parvum
GCTTL

SEQ ID NO: 2258945 - protein, 4 aa, Cryptosporidium parvum
GDAF

SEQ ID NO: 2258946 - protein, 15 aa, Cryptosporidium parvum
GDANQGLRSSNETRE

SEQ ID NO: 2258947 - protein, 14 aa, Cryptosporidium parvum
GDASLGKTLSDQGY

SEQ ID NO: 2258948 - protein, 9 aa, Cryptosporidium parvum
GDATSGAKA

SEQ ID NO: 2258949 - protein, 5 aa, Cryptosporidium parvum
GDAYG

SEQ ID NO: 2258950 - protein, 17 aa, Cryptosporidium parvum
GDDDDFSVDEDDDMKLD

SEQ ID NO: 2258951 - protein, 6 aa, Cryptosporidium parvum
GDDDQA

SEQ ID NO: 2258952 - protein, 6 aa, Cryptosporidium parvum
GDDGKI

SEQ ID NO: 2258953 - protein, 8 aa, Cryptosporidium parvum
GDDIPTNN

SEQ ID NO: 2258954 - protein, 6 aa, Cryptosporidium parvum
GDDISE

SEQ ID NO: 2258955 - protein, 17 aa, Cryptosporidium parvum
GDDKTDPYTSSLPDSND

SEQ ID NO: 2258956 - protein, 12 aa, Cryptosporidium parvum
GDDLEQKRKEKI

SEQ ID NO: 2258957 - protein, 4 aa, Cryptosporidium parvum
GDDN

SEQ ID NO: 2258958 - protein, 7 aa, Cryptosporidium parvum
GDDPSSI

SEQ ID NO: 2258959 - protein, 8 aa, Cryptosporidium parvum
GDDSNTNA

SEQ ID NO: 2258960 - protein, 16 aa, Cryptosporidium parvum
GDDWEPKDFKKGNTKK

SEQ ID NO: 2258961 - protein, 4 aa, Cryptosporidium parvum
GDDY

SEQ ID NO: 2258962 - protein, 9 aa, Cryptosporidium parvum
GDEAQSKRG

SEQ ID NO: 2258963 - protein, 5 aa, Cryptosporidium parvum
GDEDF

SEQ ID NO: 2258964 - protein, 22 aa, Cryptosporidium parvum
GDEDKDKDSCYNKGNDQQQLEP

SEQ ID NO: 2258965 - protein, 44 aa, Cryptosporidium parvum
GDEEEEEEEEENDDEEEEEDEEENDDDDDDDNNKNNRVEKKTGK

SEQ ID NO: 2258966 - protein, 9 aa, Cryptosporidium parvum
GDEEISDES

SEQ ID NO: 2258967 - protein, 6 aa, Cryptosporidium parvum
GDEEKL

SEQ ID NO: 2258968 - protein, 5 aa, Cryptosporidium parvum
GDEEL

SEQ ID NO: 2258969 - protein, 6 aa, Cryptosporidium parvum
GDEERD

SEQ ID NO: 2258970 - protein, 8 aa, Cryptosporidium parvum
GDEESAEM

SEQ ID NO: 2258971 - protein, 9 aa, Cryptosporidium parvum
GDEESNHLP

SEQ ID NO: 2258972 - protein, 6 aa, Cryptosporidium parvum
GDEEVR

SEQ ID NO: 2258973 - protein, 15 aa, Cryptosporidium parvum
GDEFGDSGMISSSGH

SEQ ID NO: 2258974 - protein, 4 aa, Cryptosporidium parvum
GDEH

SEQ ID NO: 2258975 - protein, 6 aa, Cryptosporidium parvum
GDENCG

SEQ ID NO: 2258976 - protein, 7 aa, Cryptosporidium parvum
GDENESR

SEQ ID NO: 2258977 - protein, 16 aa, Cryptosporidium parvum
GDERGDGRLDPGLGGY

SEQ ID NO: 2258978 - protein, 8 aa, Cryptosporidium parvum
GDESDSVR

SEQ ID NO: 2258979 - protein, 6 aa, Cryptosporidium parvum
GDESMV

SEQ ID NO: 2258980 - protein, 5 aa, Cryptosporidium parvum
GDETN

SEQ ID NO: 2258981 - protein, 4 aa, Cryptosporidium parvum
GDFE

SEQ ID NO: 2258982 - protein, 6 aa, Cryptosporidium parvum
GDFNEA

SEQ ID NO: 2258983 - protein, 7 aa, Cryptosporidium parvum
GDFRSTK

SEQ ID NO: 2258984 - protein, 14 aa, Cryptosporidium parvum
GDFSEKKSQRSISK

SEQ ID NO: 2258985 - protein, 13 aa, Cryptosporidium parvum
GDFTSGNSPNNNY

SEQ ID NO: 2258986 - protein, 4 aa, Cryptosporidium parvum
GDGA

SEQ ID NO: 2258987 - protein, 12 aa, Cryptosporidium parvum
GDGDSSIPIGEG

SEQ ID NO: 2258988 - protein, 26 aa, Cryptosporidium parvum
GDGGLSGGGNNKIEQEEALKSDTTGI

SEQ ID NO: 2258989 - protein, 6 aa, Cryptosporidium parvum
GDGLDK

SEQ ID NO: 2258990 - protein, 8 aa, Cryptosporidium parvum
GDGNHHTE

SEQ ID NO: 2258991 - protein, 5 aa, Cryptosporidium parvum
GDGNL

SEQ ID NO: 2258992 - protein, 15 aa, Cryptosporidium parvum
GDGPGRSKNPEAKNI

SEQ ID NO: 2258993 - protein, 5 aa, Cryptosporidium parvum
GDGPK

SEQ ID NO: 2258994 - protein, 6 aa, Cryptosporidium parvum
GDGQIS

SEQ ID NO: 2258995 - protein, 6 aa, Cryptosporidium parvum
GDGSFS

SEQ ID NO: 2258996 - protein, 5 aa, Cryptosporidium parvum
GDGSG

SEQ ID NO: 2258997 - protein, 10 aa, Cryptosporidium parvum
GDGSNKFSLN

SEQ ID NO: 2258998 - protein, 9 aa, Cryptosporidium parvum
GDGSNSNAA

SEQ ID NO: 2258999 - protein, 14 aa, Cryptosporidium parvum
GDGSRLGYNGPKGM

SEQ ID NO: 2259000 - protein, 7 aa, Cryptosporidium parvum
GDGTDTH

SEQ ID NO: 2259001 - protein, 7 aa, Cryptosporidium parvum
GDGTQTR

SEQ ID NO: 2259002 - protein, 4 aa, Cryptosporidium parvum
GDGV

SEQ ID NO: 2259003 - protein, 30 aa, Cryptosporidium parvum
GDHENVNDNGIEIENNREREVEREGERERE

SEQ ID NO: 2259004 - protein, 22 aa, Cryptosporidium parvum
GDHGKSIRASRKSSISKTRSCT

SEQ ID NO: 2259005 - protein, 11 aa, Cryptosporidium parvum
GDHNKNPPHPR

SEQ ID NO: 2259006 - protein, 21 aa, Cryptosporidium parvum
GDHPPITPVRSATQNDLDGDS

SEQ ID NO: 2259007 - protein, 8 aa, Cryptosporidium parvum
GDHQDQNR

SEQ ID NO: 2259008 - protein, 6 aa, Cryptosporidium parvum
GDIDST

SEQ ID NO: 2259009 - protein, 4 aa, Cryptosporidium parvum
GDIN

SEQ ID NO: 2259010 - protein, 14 aa, Cryptosporidium parvum
GDIPSVENEDFQDQ

SEQ ID NO: 2259011 - protein, 8 aa, Cryptosporidium parvum
GDIQNTSI

SEQ ID NO: 2259012 - protein, 19 aa, Cryptosporidium parvum
GDISSGNGTGGESIYGPTF

SEQ ID NO: 2259013 - protein, 7 aa, Cryptosporidium parvum
GDKAEEI

SEQ ID NO: 2259014 - protein, 7 aa, Cryptosporidium parvum
GDKAKYE

SEQ ID NO: 2259015 - protein, 6 aa, Cryptosporidium parvum
GDKDMQ

SEQ ID NO: 2259016 - protein, 10 aa, Cryptosporidium parvum
GDKEDKVASH

SEQ ID NO: 2259017 - protein, 4 aa, Cryptosporidium parvum
GDKI

SEQ ID NO: 2259018 - protein, 8 aa, Cryptosporidium parvum
GDKPSGYF

SEQ ID NO: 2259019 - protein, 8 aa, Cryptosporidium parvum
GDKYDKGT

SEQ ID NO: 2259020 - protein, 9 aa, Cryptosporidium parvum
GDKYDKTIG

SEQ ID NO: 2259021 - protein, 30 aa, Cryptosporidium parvum; identical to SEQ ID NO: 2142622

SEQ ID NO: 2259022 - protein, 13 aa, Cryptosporidium parvum
GDKYSRELKIVII

SEQ ID NO: 2259023 - protein, 9 aa, Cryptosporidium parvum
GDLDKDGTI

SEQ ID NO: 2259024 - protein, 9 aa, Cryptosporidium parvum
GDLKESFEN

SEQ ID NO: 2259025 - protein, 5 aa, Cryptosporidium parvum
GDLNQ

SEQ ID NO: 2259026 - protein, 8 aa, Cryptosporidium parvum
GDLNSSSR

SEQ ID NO: 2259027 - protein, 5 aa, Cryptosporidium parvum
GDLSD

SEQ ID NO: 2259028 - protein, 20 aa, Cryptosporidium parvum
GDLSTDLESLSEEEIESDEL

SEQ ID NO: 2259029 - protein, 4 aa, Cryptosporidium parvum
GDLY

SEQ ID NO: 2259030 - protein, 8 aa, Cryptosporidium parvum
GDMDQKDR

SEQ ID NO: 2259031 - protein, 8 aa, Cryptosporidium parvum
GDNDEREI

SEQ ID NO: 2259032 - protein, 6 aa, Cryptosporidium parvum
GDNEKI

SEQ ID NO: 2259033 - protein, 6 aa, Cryptosporidium parvum
GDNELS

SEQ ID NO: 2259034 - protein, 29 aa, Cryptosporidium parvum
GDNGNNSEKKPSLFGDESSNTNSRRNLFD

SEQ ID NO: 2259035 - protein, 6 aa, Cryptosporidium parvum
GDNGPE

SEQ ID NO: 2259036 - protein, 10 aa, Cryptosporidium parvum
GDNKADYDSF

SEQ ID NO: 2259037 - protein, 11 aa, Cryptosporidium parvum
GDNKDKDESKI

SEQ ID NO: 2259038 - protein, 46 aa, Cryptosporidium parvum
GDNLEKEDNERENVEKESKDRRTTGYLESNPENNVDIKKNEKKYHE

SEQ ID NO: 2259039 - protein, 6 aa, Cryptosporidium parvum
GDNNLN

SEQ ID NO: 2259040 - protein, 7 aa, Cryptosporidium parvum
GDNNYSS

SEQ ID NO: 2259041 - protein, 12 aa, Cryptosporidium parvum
GDNPFSNKETTM

SEQ ID NO: 2259042 - protein, 6 aa, Cryptosporidium parvum
GDNSGL

SEQ ID NO: 2259043 - protein, 6 aa, Cryptosporidium parvum
GDNSIP

SEQ ID NO: 2259044 - protein, 7 aa, Cryptosporidium parvum
GDNSVRD

SEQ ID NO: 2259045 - protein, 5 aa, Cryptosporidium parvum
GDNVQ

SEQ ID NO: 2259046 - protein, 8 aa, Cryptosporidium parvum
GDNYRKQT

SEQ ID NO: 2259047 - protein, 9 aa, Cryptosporidium parvum
GDPAKTGLN

SEQ ID NO: 2259048 - protein, 4 aa, Cryptosporidium parvum
GDPI

SEQ ID NO: 2259049 - protein, 13 aa, Cryptosporidium parvum
GDPILNTTSPSPQ

SEQ ID NO: 2259050 - protein, 15 aa, Cryptosporidium parvum
GDPKLPSCPPDEEAK

SEQ ID NO: 2259051 - protein, 9 aa, Cryptosporidium parvum
GDPNDLPEE

SEQ ID NO: 2259052 - protein, 6 aa, Cryptosporidium parvum
GDPNME

SEQ ID NO: 2259053 - protein, 8 aa, Cryptosporidium parvum
GDQAANGE

SEQ ID NO: 2259054 - protein, 5 aa, Cryptosporidium parvum
GDQAC

SEQ ID NO: 2259055 - protein, 5 aa, Cryptosporidium parvum
GDQEI

SEQ ID NO: 2259056 - protein, 6 aa, Cryptosporidium parvum
GDQISG

SEQ ID NO: 2259057 - protein, 9 aa, Cryptosporidium parvum
GDQPSNNST

SEQ ID NO: 2259058 - protein, 10 aa, Cryptosporidium parvum
GDQSDKETFN

SEQ ID NO: 2259059 - protein, 5 aa, Cryptosporidium parvum
GDQSR

SEQ ID NO: 2259060 - protein, 7 aa, Cryptosporidium parvum
GDREDLE

SEQ ID NO: 2259061 - protein, 15 aa, Cryptosporidium parvum
GDRFEGEYKDGVKEG

SEQ ID NO: 2259062 - protein, 6 aa, Cryptosporidium parvum
GDRQNV

SEQ ID NO: 2259063 - protein, 9 aa, Cryptosporidium parvum
GDRQTGKTS

SEQ ID NO: 2259064 - protein, 4 aa, Cryptosporidium parvum
GDRS

SEQ ID NO: 2259065 - protein, 9 aa, Cryptosporidium parvum
GDRSQQERE

SEQ ID NO: 2259066 - protein, 9 aa, Cryptosporidium parvum
GDRSSEYDP

SEQ ID NO: 2259067 - protein, 8 aa, Cryptosporidium parvum
GDSAKTSC

SEQ ID NO: 2259068 - protein, 12 aa, Cryptosporidium parvum
GDSATSEQKKGF

SEQ ID NO: 2259069 - protein, 10 aa, Cryptosporidium parvum
GDSDEFQRNR

SEQ ID NO: 2259070 - protein, 6 aa, Cryptosporidium parvum
GDSDTV

SEQ ID NO: 2259071 - protein, 5 aa, Cryptosporidium parvum
GDSEG

SEQ ID NO: 2259072 - protein, 8 aa, Cryptosporidium parvum
GDSEIEDS

SEQ ID NO: 2259073 - protein, 8 aa, Cryptosporidium parvum
GDSKLGKN

SEQ ID NO: 2259074 - protein, 5 aa, Cryptosporidium parvum
GDSLD

SEQ ID NO: 2259075 - protein, 8 aa, Cryptosporidium parvum
GDSLDNPR

SEQ ID NO: 2259076 - protein, 5 aa, Cryptosporidium parvum
GDSLG

SEQ ID NO: 2259077 - protein, 10 aa, Cryptosporidium parvum
GDSLNRGKHS

SEQ ID NO: 2259078 - protein, 6 aa, Cryptosporidium parvum
GDSNGT

SEQ ID NO: 2259079 - protein, 12 aa, Cryptosporidium parvum
GDSNNDSALSGY

SEQ ID NO: 2259080 - protein, 6 aa, Cryptosporidium parvum
GDSPNS

SEQ ID NO: 2259081 - protein, 4 aa, Cryptosporidium parvum
GDSR

SEQ ID NO: 2259082 - protein, 7 aa, Cryptosporidium parvum
GDSRGNL

SEQ ID NO: 2259083 - protein, 5 aa, Cryptosporidium parvum
GDSRS

SEQ ID NO: 2259084 - protein, 4 aa, Cryptosporidium parvum
GDSS

SEQ ID NO: 2259085 - protein, 7 aa, Cryptosporidium parvum
GDSSKAL

SEQ ID NO: 2259086 - protein, 6 aa, Cryptosporidium parvum
GDSSSI

SEQ ID NO: 2259087 - protein, 5 aa, Cryptosporidium parvum
GDSSV

SEQ ID NO: 2259088 - protein, 8 aa, Cryptosporidium parvum
GDSVASSL

SEQ ID NO: 2259089 - protein, 8 aa, Cryptosporidium parvum
GDSYHSGS

SEQ ID NO: 2259090 - protein, 6 aa, Cryptosporidium parvum
GDSYRN

SEQ ID NO: 2259091 - protein, 6 aa, Cryptosporidium parvum
GDTASI

SEQ ID NO: 2259092 - protein, 8 aa, Cryptosporidium parvum
GDTGTPEE

SEQ ID NO: 2259093 - protein, 10 aa, Cryptosporidium parvum
GDTLGSPPSD

SEQ ID NO: 2259094 - protein, 7 aa, Cryptosporidium parvum
GDTNGSV

SEQ ID NO: 2259095 - protein, 4 aa, Cryptosporidium parvum
GDTP

SEQ ID NO: 2259096 - protein, 5 aa, Cryptosporidium parvum
GDTPL

SEQ ID NO: 2259097 - protein, 4 aa, Cryptosporidium parvum
GDTR

SEQ ID NO: 2259098 - protein, 7 aa, Cryptosporidium parvum
GDTTNPE

SEQ ID NO: 2259099 - protein, 6 aa, Cryptosporidium parvum
GDVGGP

SEQ ID NO: 2259100 - protein, 13 aa, Cryptosporidium parvum
GDVGKLGKNGVTE

SEQ ID NO: 2259101 - protein, 4 aa, Cryptosporidium parvum
GDVI

SEQ ID NO: 2259102 - protein, 7 aa, Cryptosporidium parvum
GDVPEDA

SEQ ID NO: 2259103 - protein, 11 aa, Cryptosporidium parvum
GDVSPEQTGNL

SEQ ID NO: 2259104 - protein, 7 aa, Cryptosporidium parvum
GDYSDTK

SEQ ID NO: 2259105 - protein, 32 aa, Cryptosporidium parvum
GDYSTGEQGQGLTSPNANAGSAFGANSVPTST

SEQ ID NO: 2259106 - protein, 4 aa, Cryptosporidium parvum
GEAA

SEQ ID NO: 2259107 - protein, 12 aa, Cryptosporidium parvum
GEADEKQGEIPG

SEQ ID NO: 2259108 - protein, 10 aa, Cryptosporidium parvum
GEAELRKKTN

SEQ ID NO: 2259109 - protein, 7 aa, Cryptosporidium parvum
GEAEQKE

SEQ ID NO: 2259110 - protein, 5 aa, Cryptosporidium parvum
GEAGR

SEQ ID NO: 2259111 - protein, 8 aa, Cryptosporidium parvum
GEAGTGKT

SEQ ID NO: 2259112 - protein, 19 aa, Cryptosporidium parvum
GEAKNTEASEKGKRLSTPP

SEQ ID NO: 2259113 - protein, 11 aa, Cryptosporidium parvum
GEAPKITKDGV

SEQ ID NO: 2259114 - protein, 6 aa, Cryptosporidium parvum
GEATSS

SEQ ID NO: 2259115 - protein, 10 aa, Cryptosporidium parvum
GECEKEGYSN

SEQ ID NO: 2259116 - protein, 11 aa, Cryptosporidium parvum
GEDDEEDEGEY

SEQ ID NO: 2259117 - protein, 12 aa, Cryptosporidium parvum
GEDGKRFGSEIP

SEQ ID NO: 2259118 - protein, 5 aa, Cryptosporidium parvum
GEDIS

SEQ ID NO: 2259119 - protein, 9 aa, Cryptosporidium parvum
GEDNRNSDY

SEQ ID NO: 2259120 - protein, 9 aa, Cryptosporidium parvum
GEDPEEPNN

SEQ ID NO: 2259121 - protein, 7 aa, Cryptosporidium parvum
GEDPLKN

SEQ ID NO: 2259122 - protein, 64 aa, Cryptosporidium parvum
GEDSDDEEGGSDDDDDDEDEEYSESDEDDEDDDDDDDDEDLSDLEEESSDDSFKELSSDEEEGL

SEQ ID NO: 2259123 - protein, 7 aa, Cryptosporidium parvum
GEDSDVK

SEQ ID NO: 2259124 - protein, 21 aa, Cryptosporidium parvum
GEDTSTDSENDSQSDDGMEEE

SEQ ID NO: 2259125 - protein, 10 aa, Cryptosporidium parvum
GEEAITNKSA

SEQ ID NO: 2259126 - protein, 7 aa, Cryptosporidium parvum
GEECGKK

SEQ ID NO: 2259127 - protein, 15 aa, Cryptosporidium parvum
GEEDDDGEEEEDDDD

SEQ ID NO: 2259128 - protein, 8 aa, Cryptosporidium parvum
GEEDSRHD

SEQ ID NO: 2259129 - protein, 12 aa, Cryptosporidium parvum
GEEEDEAAARSR

SEQ ID NO: 2259130 - protein, 7 aa, Cryptosporidium parvum
GEEEEKD

SEQ ID NO: 2259131 - protein, 7 aa, Cryptosporidium parvum
GEEEGDW

SEQ ID NO: 2259132 - protein, 6 aa, Cryptosporidium parvum
GEEEIP

SEQ ID NO: 2259133 - protein, 7 aa, Cryptosporidium parvum
GEEEMKE

SEQ ID NO: 2259134 - protein, 5 aa, Cryptosporidium parvum
GEEEY

SEQ ID NO: 2259135 - protein, 9 aa, Cryptosporidium parvum
GEEGRNNYL

SEQ ID NO: 2259136 - protein, 8 aa, Cryptosporidium parvum
GEEIAPPQ

SEQ ID NO: 2259137 - protein, 7 aa, Cryptosporidium parvum
GEEISQS

SEQ ID NO: 2259138 - protein, 9 aa, Cryptosporidium parvum
GEEKLSKNR

SEQ ID NO: 2259139 - protein, 6 aa, Cryptosporidium parvum
GEELPA

SEQ ID NO: 2259140 - protein, 4 aa, Cryptosporidium parvum
GEES

SEQ ID NO: 2259141 - protein, 12 aa, Cryptosporidium parvum
GEESNSFWNYFY

SEQ ID NO: 2259142 - protein, 5 aa, Cryptosporidium parvum
GEESS

SEQ ID NO: 2259143 - protein, 6 aa, Cryptosporidium parvum
GEESVT

SEQ ID NO: 2259144 - protein, 5 aa, Cryptosporidium parvum
GEEVD

SEQ ID NO: 2259145 - protein, 5 aa, Cryptosporidium parvum
GEEVK

SEQ ID NO: 2259146 - protein, 6 aa, Cryptosporidium parvum
GEFEHK

SEQ ID NO: 2259147 - protein, 13 aa, Cryptosporidium parvum
GEFGISSSTYSSE

SEQ ID NO: 2259148 - protein, 6 aa, Cryptosporidium parvum
GEGADT

SEQ ID NO: 2259149 - protein, 10 aa, Cryptosporidium parvum
GEGDLGKTEA

SEQ ID NO: 2259150 - protein, 9 aa, Cryptosporidium parvum
GEGEDDNNL

SEQ ID NO: 2259151 - protein, 9 aa, Cryptosporidium parvum
GEGEEVKEK

SEQ ID NO: 2259152 - protein, 7 aa, Cryptosporidium parvum
GEGEVNK

SEQ ID NO: 2259153 - protein, 10 aa, Cryptosporidium parvum
GEGGIKDSEI

SEQ ID NO: 2259154 - protein, 6 aa, Cryptosporidium parvum
GEGGYG

SEQ ID NO: 2259155 - protein, 4 aa, Cryptosporidium parvum
GEGI

SEQ ID NO: 2259156 - protein, 30 aa, Cryptosporidium parvum
GEGNLENEEDSVEQSSENNRNIDDSNTNKL

SEQ ID NO: 2259157 - protein, 5 aa, Cryptosporidium parvum
GEGPR

SEQ ID NO: 2259158 - protein, 5 aa, Cryptosporidium parvum
GEGSR

SEQ ID NO: 2259159 - protein, 5 aa, Cryptosporidium parvum
GEGTY

SEQ ID NO: 2259160 - protein, 6 aa, Cryptosporidium parvum
GEHGER

SEQ ID NO: 2259161 - protein, 6 aa, Cryptosporidium parvum
GEHNKK

SEQ ID NO: 2259162 - protein, 48 aa, Cryptosporidium parvum
GEIAQTEKFDESVSTETNDAKQENLDEVKEDNTTEGNPMQDETNDSNI

SEQ ID NO: 2259163 - protein, 8 aa, Cryptosporidium parvum
GEIKNGYS

SEQ ID NO: 2259164 - protein, 5 aa, Cryptosporidium parvum
GEIPK

SEQ ID NO: 2259165 - protein, 5 aa, Cryptosporidium parvum
GEIPT

SEQ ID NO: 2259166 - protein, 6 aa, Cryptosporidium parvum
GEIPYE

SEQ ID NO: 2259167 - protein, 7 aa, Cryptosporidium parvum
GEIQKPK

SEQ ID NO: 2259168 - protein, 5 aa, Cryptosporidium parvum
GEIQS

SEQ ID NO: 2259169 - protein, 4 aa, Cryptosporidium parvum
GEIR

SEQ ID NO: 2259170 - protein, 18 aa, Cryptosporidium parvum
GEIRNKNAKDEKNTEKRL

SEQ ID NO: 2259171 - protein, 14 aa, Cryptosporidium parvum
GEKDDDNDNSQRFE

SEQ ID NO: 2259172 - protein, 15 aa, Cryptosporidium parvum
GEKDNQIDMNSNNGI

SEQ ID NO: 2259173 - protein, 11 aa, Cryptosporidium parvum
GEKDPKPYIGG

SEQ ID NO: 2259174 - protein, 9 aa, Cryptosporidium parvum
GEKENSSIQ

SEQ ID NO: 2259175 - protein, 7 aa, Cryptosporidium parvum
GEKESMK

SEQ ID NO: 2259176 - protein, 6 aa, Cryptosporidium parvum
GEKFNR

SEQ ID NO: 2259177 - protein, 8 aa, Cryptosporidium parvum
GEKGESKK

SEQ ID NO: 2259178 - protein, 13 aa, Cryptosporidium parvum
GEKGKDNADTKEM

SEQ ID NO: 2259179 - protein, 10 aa, Cryptosporidium parvum
GEKGRSQNGV

SEQ ID NO: 2259180 - protein, 5 aa, Cryptosporidium parvum
GEKHT

SEQ ID NO: 2259181 - protein, 4 aa, Cryptosporidium parvum
GEKI

SEQ ID NO: 2259182 - protein, 20 aa, Cryptosporidium parvum
GEKITSEGSLENESEDEFRE

SEQ ID NO: 2259183 - protein, 28 aa, Cryptosporidium parvum
GEKKKKKKSKEHKTGVSEVESSYVDGSG

SEQ ID NO: 2259184 - protein, 4 aa, Cryptosporidium parvum
GEKL

SEQ ID NO: 2259185 - protein, 13 aa, Cryptosporidium parvum
GEKLNNENQEELE

SEQ ID NO: 2259186 - protein, 5 aa, Cryptosporidium parvum
GEKNR

SEQ ID NO: 2259187 - protein, 17 aa, Cryptosporidium parvum
GEKRGERFATGETWSEN

SEQ ID NO: 2259188 - protein, 11 aa, Cryptosporidium parvum
GEKRKSEKARL

SEQ ID NO: 2259189 - protein, 5 aa, Cryptosporidium parvum
GEKSI

SEQ ID NO: 2259190 - protein, 7 aa, Cryptosporidium parvum
GEKSLSE

SEQ ID NO: 2259191 - protein, 5 aa, Cryptosporidium parvum
GEKTH

SEQ ID NO: 2259192 - protein, 7 aa, Cryptosporidium parvum
GEKTNIV

SEQ ID NO: 2259193 - protein, 5 aa, Cryptosporidium parvum
GELDQ

SEQ ID NO: 2259194 - protein, 4 aa, Cryptosporidium parvum
GELE

SEQ ID NO: 2259195 - protein, 9 aa, Cryptosporidium parvum
GELEQGEEH

SEQ ID NO: 2259196 - protein, 4 aa, Cryptosporidium parvum
GELG

SEQ ID NO: 2259197 - protein, 16 aa, Cryptosporidium parvum
GELKNQYNQDETNNES

SEQ ID NO: 2259198 - protein, 8 aa, Cryptosporidium parvum
GELKPATT

SEQ ID NO: 2259199 - protein, 6 aa, Cryptosporidium parvum
GELPDT

SEQ ID NO: 2259200 - protein, 7 aa, Cryptosporidium parvum
GELQKKR

SEQ ID NO: 2259201 - protein, 8 aa, Cryptosporidium parvum
GELQQNKA

SEQ ID NO: 2259202 - protein, 7 aa, Cryptosporidium parvum
GELSGGE

SEQ ID NO: 2259203 - protein, 16 aa, Cryptosporidium parvum
GENDQQFENFNSPSAE

SEQ ID NO: 2259204 - protein, 14 aa, Cryptosporidium parvum
GENENDSKKGEKEL

SEQ ID NO: 2259205 - protein, 14 aa, Cryptosporidium parvum
GENEQKENEKLLDS

SEQ ID NO: 2259206 - protein, 16 aa, Cryptosporidium parvum
GENFKDGSGISGSSTL

SEQ ID NO: 2259207 - protein, 5 aa, Cryptosporidium parvum
GENGN

SEQ ID NO: 2259208 - protein, 8 aa, Cryptosporidium parvum
GENGRKPI

SEQ ID NO: 2259209 - protein, 7 aa, Cryptosporidium parvum
GENGSKL

SEQ ID NO: 2259210 - protein, 13 aa, Cryptosporidium parvum
GENIQGEKDSIEI

SEQ ID NO: 2259211 - protein, 8 aa, Cryptosporidium parvum
GENKNVSE

SEQ ID NO: 2259212 - protein, 11 aa, Cryptosporidium parvum
GENKSIPGSQT

SEQ ID NO: 2259213 - protein, 9 aa, Cryptosporidium parvum
GENLTKNEK

SEQ ID NO: 2259214 - protein, 5 aa, Cryptosporidium parvum
GENNL

SEQ ID NO: 2259215 - protein, 9 aa, Cryptosporidium parvum
GENNLKARL

SEQ ID NO: 2259216 - protein, 15 aa, Cryptosporidium parvum
GENNNNIKNYGNGGY

SEQ ID NO: 2259217 - protein, 4 aa, Cryptosporidium parvum
GENP

SEQ ID NO: 2259218 - protein, 7 aa, Cryptosporidium parvum
GENPEIT

SEQ ID NO: 2259219 - protein, 4 aa, Cryptosporidium parvum
GENQ

SEQ ID NO: 2259220 - protein, 4 aa, Cryptosporidium parvum
GENR

SEQ ID NO: 2259221 - protein, 6 aa, Cryptosporidium parvum
GENSAI

SEQ ID NO: 2259222 - protein, 6 aa, Cryptosporidium parvum
GENSEL

SEQ ID NO: 2259223 - protein, 7 aa, Cryptosporidium parvum
GEPGKEK

SEQ ID NO: 2259224 - protein, 4 aa, Cryptosporidium parvum
GEPI

SEQ ID NO: 2259225 - protein, 6 aa, Cryptosporidium parvum
GEPINP

SEQ ID NO: 2259226 - protein, 8 aa, Cryptosporidium parvum
GEPKKIHK

SEQ ID NO: 2259227 - protein, 12 aa, Cryptosporidium parvum
GEPPFPSNQGHN

SEQ ID NO: 2259228 - protein, 7 aa, Cryptosporidium parvum
GEPQSAE

SEQ ID NO: 2259229 - protein, 7 aa, Cryptosporidium parvum
GEPSPGC

SEQ ID NO: 2259230 - protein, 25 aa, Cryptosporidium parvum
GEQDIPGLTDGEKPRRLGPKRASKI

SEQ ID NO: 2259231 - protein, 13 aa, Cryptosporidium parvum
GEQDPSDDEAWGN

SEQ ID NO: 2259232 - protein, 9 aa, Cryptosporidium parvum
GERAKGGKR

SEQ ID NO: 2259233 - protein, 6 aa, Cryptosporidium parvum
GERISV

SEQ ID NO: 2259234 - protein, 8 aa, Cryptosporidium parvum
GERLTDQE

SEQ ID NO: 2259235 - protein, 7 aa, Cryptosporidium parvum
GERNRKR

SEQ ID NO: 2259236 - protein, 14 aa, Cryptosporidium parvum
GERQSNASNSKYQY

SEQ ID NO: 2259237 - protein, 9 aa, Cryptosporidium parvum
GERQTAKVD

SEQ ID NO: 2259238 - protein, 14 aa, Cryptosporidium parvum
GERVNWGNSSTDEY

SEQ ID NO: 2259239 - protein, 5 aa, Cryptosporidium parvum
GESCS

SEQ ID NO: 2259240 - protein, 12 aa, Cryptosporidium parvum
GESDKNSYYNTP

SEQ ID NO: 2259241 - protein, 9 aa, Cryptosporidium parvum
GESDPNALN

SEQ ID NO: 2259242 - protein, 9 aa, Cryptosporidium parvum
GESEKNRKL

SEQ ID NO: 2259243 - protein, 7 aa, Cryptosporidium parvum
GESEKSI

SEQ ID NO: 2259244 - protein, 19 aa, Cryptosporidium parvum
GESENYGTQLERASDNSMG

SEQ ID NO: 2259245 - protein, 6 aa, Cryptosporidium parvum
GESETK

SEQ ID NO: 2259246 - protein, 5 aa, Cryptosporidium parvum
GESFE

SEQ ID NO: 2259247 - protein, 5 aa, Cryptosporidium parvum
GESFT

SEQ ID NO: 2259248 - protein, 11 aa, Cryptosporidium parvum
GESGAGKTEAT

SEQ ID NO: 2259249 - protein, 11 aa, Cryptosporidium parvum
GESGAGKTETA

SEQ ID NO: 2259250 - protein, 12 aa, Cryptosporidium parvum
GESGAGKTETSK

SEQ ID NO: 2259251 - protein, 11 aa, Cryptosporidium parvum
GESGAGKTETT

SEQ ID NO: 2259252 - protein, 8 aa, Cryptosporidium parvum
GESKLTNN

SEQ ID NO: 2259253 - protein, 8 aa, Cryptosporidium parvum
GESKNDSI

SEQ ID NO: 2259254 - protein, 19 aa, Cryptosporidium parvum
GESKNSKHLESKSKSGSNC

SEQ ID NO: 2259255 - protein, 4 aa, Cryptosporidium parvum
GESN

SEQ ID NO: 2259256 - protein, 4 aa, Cryptosporidium parvum
GESP

SEQ ID NO: 2259257 - protein, 7 aa, Cryptosporidium parvum
GESPHDN

SEQ ID NO: 2259258 - protein, 6 aa, Cryptosporidium parvum
GESSCQ

SEQ ID NO: 2259259 - protein, 7 aa, Cryptosporidium parvum
GESSREK

SEQ ID NO: 2259260 - protein, 6 aa, Cryptosporidium parvum
GETASF

SEQ ID NO: 2259261 - protein, 16 aa, Cryptosporidium parvum
GETCQVRDNPTRFATS

SEQ ID NO: 2259262 - protein, 7 aa, Cryptosporidium parvum
GETDPME

SEQ ID NO: 2259263 - protein, 7 aa, Cryptosporidium parvum
GETDTET

SEQ ID NO: 2259264 - protein, 4 aa, Cryptosporidium parvum
GETE

SEQ ID NO: 2259265 - protein, 9 aa, Cryptosporidium parvum
GETGSGKST

SEQ ID NO: 2259266 - protein, 5 aa, Cryptosporidium parvum
GETLG

SEQ ID NO: 2259267 - protein, 8 aa, Cryptosporidium parvum
GETNQARR

SEQ ID NO: 2259268 - protein, 26 aa, Cryptosporidium parvum
GETPKENSSPASPIEPNTYSPPSSDK

SEQ ID NO: 2259269 - protein, 7 aa, Cryptosporidium parvum
GETQLDR

SEQ ID NO: 2259270 - protein, 24 aa, Cryptosporidium parvum
GETQTLGNSNASKQGASITTSSGE

SEQ ID NO: 2259271 - protein, 9 aa, Cryptosporidium parvum
GETSRDPDI

SEQ ID NO: 2259272 - protein, 5 aa, Cryptosporidium parvum
GETTD

SEQ ID NO: 2259273 - protein, 6 aa, Cryptosporidium parvum
GEVGAT

SEQ ID NO: 2259274 - protein, 5 aa, Cryptosporidium parvum
GEVND

SEQ ID NO: 2259275 - protein, 4 aa, Cryptosporidium parvum
GEVP

SEQ ID NO: 2259276 - protein, 8 aa, Cryptosporidium parvum
GEVSTSPE

SEQ ID NO: 2259277 - protein, 15 aa, Cryptosporidium parvum
GEVTLDSNGNSDPIL

SEQ ID NO: 2259278 - protein, 14 aa, Cryptosporidium parvum
GEVTPQSISSESNS

SEQ ID NO: 2259279 - protein, 14 aa, Cryptosporidium parvum
GEWGKPPLDDQGKP

SEQ ID NO: 2259280 - protein, 8 aa, Cryptosporidium parvum
GEYDKSHQ

SEQ ID NO: 2259281 - protein, 13 aa, Cryptosporidium parvum
GEYGQSSKNFINN

SEQ ID NO: 2259282 - protein, 17 aa, Cryptosporidium parvum
GEYHPPHLGGGGGGGGT

SEQ ID NO: 2259283 - protein, 6 aa, Cryptosporidium parvum
GEYISP

SEQ ID NO: 2259284 - protein, 12 aa, Cryptosporidium parvum
GFASNQNNAVYS

SEQ ID NO: 2259285 - protein, 20 aa, Cryptosporidium parvum
GFDENGGQNSFVDPETTDQG

SEQ ID NO: 2259286 - protein, 5 aa, Cryptosporidium parvum
GFDES

SEQ ID NO: 2259287 - protein, 11 aa, Cryptosporidium parvum
GFDNEGSWSER

SEQ ID NO: 2259288 - protein, 7 aa, Cryptosporidium parvum
GFDNPRS

SEQ ID NO: 2259289 - protein, 6 aa, Cryptosporidium parvum
GFDQES

SEQ ID NO: 2259290 - protein, 9 aa, Cryptosporidium parvum
GFEHPNTSQ

SEQ ID NO: 2259291 - protein, 6 aa, Cryptosporidium parvum
GFEHPS

SEQ ID NO: 2259292 - protein, 5 aa, Cryptosporidium parvum
GFENE

SEQ ID NO: 2259293 - protein, 10 aa, Cryptosporidium parvum
GFERGDTMNT

SEQ ID NO: 2259294 - protein, 11 aa, Cryptosporidium parvum
GFESKPDKDGI

SEQ ID NO: 2259295 - protein, 6 aa, Cryptosporidium parvum
GFESTQ

SEQ ID NO: 2259296 - protein, 6 aa, Cryptosporidium parvum
GFGGDY

SEQ ID NO: 2259297 - protein, 16 aa, Cryptosporidium parvum
GFGGGNNDPLKSSDDL

SEQ ID NO: 2259298 - protein, 5 aa, Cryptosporidium parvum
GFGKS

SEQ ID NO: 2259299 - protein, 4 aa, Cryptosporidium parvum
GFGP

SEQ ID NO: 2259300 - protein, 11 aa, Cryptosporidium parvum
GFGQKYGSAIS

SEQ ID NO: 2259301 - protein, 19 aa, Cryptosporidium parvum
GFGQSSTKHGNSNSIKGSE

SEQ ID NO: 2259302 - protein, 13 aa, Cryptosporidium parvum
GFKEGKESKIATE

SEQ ID NO: 2259303 - protein, 6 aa, Cryptosporidium parvum
GFNEGE

SEQ ID NO: 2259304 - protein, 21 aa, Cryptosporidium parvum
GFNKENPNQPKGKNSSPVSPK

SEQ ID NO: 2259305 - protein, 12 aa, Cryptosporidium parvum
GFNNNNSTSTRI

SEQ ID NO: 2259306 - protein, 5 aa, Cryptosporidium parvum
GFNPK

SEQ ID NO: 2259307 - protein, 9 aa, Cryptosporidium parvum
GFNRPSKIQ

SEQ ID NO: 2259308 - protein, 6 aa, Cryptosporidium parvum
GFPDIS

SEQ ID NO: 2259309 - protein, 14 aa, Cryptosporidium parvum
GFPEASEKDDMDAN

SEQ ID NO: 2259310 - protein, 7 aa, Cryptosporidium parvum
GFPEPHK

SEQ ID NO: 2259311 - protein, 8 aa, Cryptosporidium parvum
GFPNQNAM

SEQ ID NO: 2259312 - protein, 6 aa, Cryptosporidium parvum
GFPPDT

SEQ ID NO: 2259313 - protein, 7 aa, Cryptosporidium parvum
GFPTQQP

SEQ ID NO: 2259314 - protein, 28 aa, Cryptosporidium parvum
GFQSSSSSTCATSPYYKSNSTSAGEGFN

SEQ ID NO: 2259315 - protein, 4 aa, Cryptosporidium parvum
GFQV

SEQ ID NO: 2259316 - protein, 4 aa, Cryptosporidium parvum
GFRS

SEQ ID NO: 2259317 - protein, 13 aa, Cryptosporidium parvum
GFSDGDKNKITVD

SEQ ID NO: 2259318 - protein, 10 aa, Cryptosporidium parvum
GFSETNNNTI

SEQ ID NO: 2259319 - protein, 10 aa, Cryptosporidium parvum
GFSGEGSEAL

SEQ ID NO: 2259320 - protein, 33 aa, Cryptosporidium parvum
GFSGGGGNGGNSGMGGLGKNYENIDRGRSPQAP

SEQ ID NO: 2259321 - protein, 6 aa, Cryptosporidium parvum
GFSPKY

SEQ ID NO: 2259322 - protein, 8 aa, Cryptosporidium parvum
GFSPSESE

SEQ ID NO: 2259323 - protein, 24 aa, Cryptosporidium parvum
GFSSKNGNSFKSLSSDSGSNSNFI

SEQ ID NO: 2259324 - protein, 6 aa, Cryptosporidium parvum
GFSSTT

SEQ ID NO: 2259325 - protein, 6 aa, Cryptosporidium parvum
GFTEPT

SEQ ID NO: 2259326 - protein, 4 aa, Cryptosporidium parvum
GFTF

SEQ ID NO: 2259327 - protein, 6 aa, Cryptosporidium parvum
GFTSEE

SEQ ID NO: 2259328 - protein, 5 aa, Cryptosporidium parvum
GGAAD

SEQ ID NO: 2259329 - protein, 7 aa, Cryptosporidium parvum
GGAIDQG

SEQ ID NO: 2259330 - protein, 22 aa, Cryptosporidium parvum
GGAKKKKKNFTKPKKIKHKKKK

SEQ ID NO: 2259331 - protein, 9 aa, Cryptosporidium parvum
GGALSESTQ

SEQ ID NO: 2259332 - protein, 5 aa, Cryptosporidium parvum
GGAMQ

SEQ ID NO: 2259333 - protein, 7 aa, Cryptosporidium parvum
GGAPLGR

SEQ ID NO: 2259334 - protein, 7 aa, Cryptosporidium parvum
GGATTGF

SEQ ID NO: 2259335 - protein, 9 aa, Cryptosporidium parvum
GGCDGKPWK

SEQ ID NO: 2259336 - protein, 8 aa, Cryptosporidium parvum
GGCNTPDT

SEQ ID NO: 2259337 - protein, 13 aa, Cryptosporidium parvum
GGCSTSGGGKDNY

SEQ ID NO: 2259338 - protein, 5 aa, Cryptosporidium parvum
GGDAN

SEQ ID NO: 2259339 - protein, 35 aa, Cryptosporidium parvum; identical to SEQ ID NO: 2142896

SEQ ID NO: 2259340 - protein, 14 aa, Cryptosporidium parvum
GGDDETEKVNEEED

SEQ ID NO: 2259341 - protein, 6 aa, Cryptosporidium parvum
GGDGYS

SEQ ID NO: 2259342 - protein, 9 aa, Cryptosporidium parvum
GGDKNKTIS

SEQ ID NO: 2259343 - protein, 5 aa, Cryptosporidium parvum
GGDKS

SEQ ID NO: 2259344 - protein, 18 aa, Cryptosporidium parvum
GGDKSLEDHSQSQESEMK

SEQ ID NO: 2259345 - protein, 6 aa, Cryptosporidium parvum
GGDKTV

SEQ ID NO: 2259346 - protein, 5 aa, Cryptosporidium parvum
GGDNC

SEQ ID NO: 2259347 - protein, 7 aa, Cryptosporidium parvum
GGDPETT

SEQ ID NO: 2259348 - protein, 14 aa, Cryptosporidium parvum
GGDPTGTGKGGESI

SEQ ID NO: 2259349 - protein, 9 aa, Cryptosporidium parvum
GGDPTLNNS

SEQ ID NO: 2259350 - protein, 8 aa, Cryptosporidium parvum
GGDQDALT

SEQ ID NO: 2259351 - protein, 10 aa, Cryptosporidium parvum
GGDRDGNPYV

SEQ ID NO: 2259352 - protein, 6 aa, Cryptosporidium parvum
GGDSFS

SEQ ID NO: 2259353 - protein, 4 aa, Cryptosporidium parvum
GGDY

SEQ ID NO: 2259354 - protein, 10 aa, Cryptosporidium parvum
GGEDSGKQLA

SEQ ID NO: 2259355 - protein, 7 aa, Cryptosporidium parvum
GGEGEIA

SEQ ID NO: 2259356 - protein, 6 aa, Cryptosporidium parvum
GGEGGD

SEQ ID NO: 2259357 - protein, 10 aa, Cryptosporidium parvum
GGEHGTESPY

SEQ ID NO: 2259358 - protein, 4 aa, Cryptosporidium parvum
GGEK

SEQ ID NO: 2259359 - protein, 12 aa, Cryptosporidium parvum
GGEKDTDEEADT

SEQ ID NO: 2259360 - protein, 6 aa, Cryptosporidium parvum
GGEKPI

SEQ ID NO: 2259361 - protein, 9 aa, Cryptosporidium parvum
GGEKSSKLK

SEQ ID NO: 2259362 - protein, 4 aa, Cryptosporidium parvum
GGEL

SEQ ID NO: 2259363 - protein, 16 aa, Cryptosporidium parvum
GGELPENKPSGDKGGS

SEQ ID NO: 2259364 - protein, 7 aa, Cryptosporidium parvum
GGEMESS

SEQ ID NO: 2259365 - protein, 10 aa, Cryptosporidium parvum
GGENGKSPNR

SEQ ID NO: 2259366 - protein, 13 aa, Cryptosporidium parvum
GGENLDGKSTIAT

SEQ ID NO: 2259367 - protein, 4 aa, Cryptosporidium parvum
GGES

SEQ ID NO: 2259368 - protein, 5 aa, Cryptosporidium parvum
GGESM

SEQ ID NO: 2259369 - protein, 10 aa, Cryptosporidium parvum
GGETEQQRFD

SEQ ID NO: 2259370 - protein, 18 aa, Cryptosporidium parvum
GGEYSENKDSEVGGASET

SEQ ID NO: 2259371 - protein, 11 aa, Cryptosporidium parvum
GGFSNKEKEEY

SEQ ID NO: 2259372 - protein, 6 aa, Cryptosporidium parvum
GGFSQG

SEQ ID NO: 2259373 - protein, 6 aa, Cryptosporidium parvum
GGFSTG

SEQ ID NO: 2259374 - protein, 10 aa, Cryptosporidium parvum
GGGADPPYSP

SEQ ID NO: 2259375 - protein, 20 aa, Cryptosporidium parvum
GGGAGGSGNTAVNNNTSGNV

SEQ ID NO: 2259376 - protein, 6 aa, Cryptosporidium parvum
GGGATN

SEQ ID NO: 2259377 - protein, 7 aa, Cryptosporidium parvum
GGGDTAS

SEQ ID NO: 2259378 - protein, 8 aa, Cryptosporidium parvum
GGGDTGWG

SEQ ID NO: 2259379 - protein, 4 aa, Cryptosporidium parvum
GGGE

SEQ ID NO: 2259380 - protein, 13 aa, Cryptosporidium parvum
GGGESSRADARNS

SEQ ID NO: 2259381 - protein, 7 aa, Cryptosporidium parvum
GGGFESS

SEQ ID NO: 2259382 - protein, 14 aa, Cryptosporidium parvum
GGGGNGNTHDHIII

SEQ ID NO: 2259383 - protein, 9 aa, Cryptosporidium parvum
GGGGSGGIE

SEQ ID NO: 2259384 - protein, 20 aa, Cryptosporidium parvum
GGGINSANAGVGGGNNNAGF

SEQ ID NO: 2259385 - protein, 9 aa, Cryptosporidium parvum
GGGIPNQIS

SEQ ID NO: 2259386 - protein, 64 aa, Cryptosporidium parvum
GGGISRGGGNRDGSDSKRGGRGYQGSGGEGVGNNHSNASRGAGSGSNNGGVSESRVSSGSKGKV

SEQ ID NO: 2259387 - protein, 19 aa, Cryptosporidium parvum
GGGKKTTRKTMSNSAKAGL

SEQ ID NO: 2259388 - protein, 17 aa, Cryptosporidium parvum
GGGKKVSNSSNSSNSGF

SEQ ID NO: 2259389 - protein, 4 aa, Cryptosporidium parvum
GGGL

SEQ ID NO: 2259390 - protein, 14 aa, Cryptosporidium parvum
GGGLGVDGSGISEP

SEQ ID NO: 2259391 - protein, 24 aa, Cryptosporidium parvum
GGGLSSSSINNHGNKNDKNKSNMR

SEQ ID NO: 2259392 - protein, 10 aa, Cryptosporidium parvum
GGGNGGSTHN

SEQ ID NO: 2259393 - protein, 8 aa, Cryptosporidium parvum
GGGPTGVE

SEQ ID NO: 2259394 - protein, 7 aa, Cryptosporidium parvum
GGGQIKV

SEQ ID NO: 2259395 - protein, 14 aa, Cryptosporidium parvum
GGGQSGKPSNQNSS

SEQ ID NO: 2259396 - protein, 8 aa, Cryptosporidium parvum
GGGRKSQC

SEQ ID NO: 2259397 - protein, 7 aa, Cryptosporidium parvum
GGGSHPS

SEQ ID NO: 2259398 - protein, 15 aa, Cryptosporidium parvum
GGGSSFSVGGPGKGI

SEQ ID NO: 2259399 - protein, 8 aa, Cryptosporidium parvum
GGGSSMGI

SEQ ID NO: 2259400 - protein, 8 aa, Cryptosporidium parvum
GGGTGAGL

SEQ ID NO: 2259401 - protein, 10 aa, Cryptosporidium parvum
GGGTNAAAAA

SEQ ID NO: 2259402 - protein, 21 aa, Cryptosporidium parvum
GGGTSIENSTAGTSGQGVAHT

SEQ ID NO: 2259403 - protein, 6 aa, Cryptosporidium parvum
GGGTVT

SEQ ID NO: 2259404 - protein, 32 aa, Cryptosporidium parvum
GGGYAEEDRRREEEDDDSENSGGEDGDDDYWE

SEQ ID NO: 2259405 - protein, 6 aa, Cryptosporidium parvum
GGGYTS

SEQ ID NO: 2259406 - protein, 7 aa, Cryptosporidium parvum
GGHFGPH

SEQ ID NO: 2259407 - protein, 4 aa, Cryptosporidium parvum
GGHG

SEQ ID NO: 2259408 - protein, 5 aa, Cryptosporidium parvum
GGHIS

SEQ ID NO: 2259409 - protein, 5 aa, Cryptosporidium parvum
GGHPF

SEQ ID NO: 2259410 - protein, 5 aa, Cryptosporidium parvum
GGHPK

SEQ ID NO: 2259411 - protein, 14 aa, Cryptosporidium parvum
GGHQGETGVGASIG

SEQ ID NO: 2259412 - protein, 11 aa, Cryptosporidium parvum
GGHTSSAVTGV

SEQ ID NO: 2259413 - protein, 4 aa, Cryptosporidium parvum
GGID

SEQ ID NO: 2259414 - protein, 11 aa, Cryptosporidium parvum
GGIEAASEDSK

SEQ ID NO: 2259415 - protein, 5 aa, Cryptosporidium parvum
GGILK

SEQ ID NO: 2259416 - protein, 30 aa, Cryptosporidium parvum
GGIMAPSSASTAPPSSSSSSSSSSAPSMPL

SEQ ID NO: 2259417 - protein, 6 aa, Cryptosporidium parvum
GGINGG

SEQ ID NO: 2259418 - protein, 6 aa, Cryptosporidium parvum
GGIPGI

SEQ ID NO: 2259419 - protein, 5 aa, Cryptosporidium parvum
GGIPN

SEQ ID NO: 2259420 - protein, 20 aa, Cryptosporidium parvum
GGIPSPMAGGMPTRQNGPVF

SEQ ID NO: 2259421 - protein, 6 aa, Cryptosporidium parvum
GGIQNE

SEQ ID NO: 2259422 - protein, 14 aa, Cryptosporidium parvum
GGIRNPDKVLDENQ

SEQ ID NO: 2259423 - protein, 8 aa, Cryptosporidium parvum
GGIRTKTV

SEQ ID NO: 2259424 - protein, 14 aa, Cryptosporidium parvum
GGISGSVASYNSGI

SEQ ID NO: 2259425 - protein, 6 aa, Cryptosporidium parvum
GGISKE

SEQ ID NO: 2259426 - protein, 63 aa, Cryptosporidium parvum
GGIVGGSNYTAGITTSPNPTSVNNSTTKDSTELKERDLNPETEPNLESEPGPETKLKPESETL

SEQ ID NO: 2259427 - protein, 4 aa, Cryptosporidium parvum
GGKD

SEQ ID NO: 2259428 - protein, 10 aa, Cryptosporidium parvum
GGKHAGNALA

SEQ ID NO: 2259429 - protein, 7 aa, Cryptosporidium parvum
GGKIPQS

SEQ ID NO: 2259430 - protein, 5 aa, Cryptosporidium parvum
GGKNI

SEQ ID NO: 2259431 - protein, 12 aa, Cryptosporidium parvum
GGKNIGQNEKKK

SEQ ID NO: 2259432 - protein, 14 aa, Cryptosporidium parvum
GGKPDDITVSIGVV

SEQ ID NO: 2259433 - protein, 5 aa, Cryptosporidium parvum
GGKSE

SEQ ID NO: 2259434 - protein, 9 aa, Cryptosporidium parvum
GGKSREVSS

SEQ ID NO: 2259435 - protein, 15 aa, Cryptosporidium parvum
GGKTRQRKDGNTHSS

SEQ ID NO: 2259436 - protein, 8 aa, Cryptosporidium parvum
GGLAPSTI

SEQ ID NO: 2259437 - protein, 28 aa, Cryptosporidium parvum
GGLASNGALPGNGQAGLIGNSSSNSIAL

SEQ ID NO: 2259438 - protein, 24 aa, Cryptosporidium parvum
GGLASTGSSTGTGCPLSSQRPCEA

SEQ ID NO: 2259439 - protein, 6 aa, Cryptosporidium parvum
GGLDRD

SEQ ID NO: 2259440 - protein, 14 aa, Cryptosporidium parvum
GGLDSQEANEMRNA

SEQ ID NO: 2259441 - protein, 10 aa, Cryptosporidium parvum
GGLEPPQVSQ

SEQ ID NO: 2259442 - protein, 13 aa, Cryptosporidium parvum
GGLIDKPKKPRDL

SEQ ID NO: 2259443 - protein, 35 aa, Cryptosporidium parvum
GGLTNKENEASGNTEDINDSINDQNNDSYSNQDNS

SEQ ID NO: 2259444 - protein, 8 aa, Cryptosporidium parvum
GGMEQHHP

SEQ ID NO: 2259445 - protein, 6 aa, Cryptosporidium parvum
GGMNVG

SEQ ID NO: 2259446 - protein, 9 aa, Cryptosporidium parvum
GGMSPEEHE

SEQ ID NO: 2259447 - protein, 8 aa, Cryptosporidium parvum
GGNAYDRS

SEQ ID NO: 2259448 - protein, 4 aa, Cryptosporidium parvum
GGNC

SEQ ID NO: 2259449 - protein, 7 aa, Cryptosporidium parvum
GGNDEIP

SEQ ID NO: 2259450 - protein, 12 aa, Cryptosporidium parvum
GGNDFGSRISNS

SEQ ID NO: 2259451 - protein, 8 aa, Cryptosporidium parvum
GGNGRARN

SEQ ID NO: 2259452 - protein, 9 aa, Cryptosporidium parvum
GGNGSGKTT

SEQ ID NO: 2259453 - protein, 5 aa, Cryptosporidium parvum
GGNIN

SEQ ID NO: 2259454 - protein, 8 aa, Cryptosporidium parvum
GGNKSTII

SEQ ID NO: 2259455 - protein, 11 aa, Cryptosporidium parvum
GGNLNKRVNGS

SEQ ID NO: 2259456 - protein, 22 aa, Cryptosporidium parvum
GGNNAGNIDNTGLSSMRSGAMT

SEQ ID NO: 2259457 - protein, 10 aa, Cryptosporidium parvum
GGNNDLGTSC

SEQ ID NO: 2259458 - protein, 6 aa, Cryptosporidium parvum
GGNPED

SEQ ID NO: 2259459 - protein, 8 aa, Cryptosporidium parvum
GGNSGSQI

SEQ ID NO: 2259460 - protein, 10 aa, Cryptosporidium parvum
GGNSKVNPNF

SEQ ID NO: 2259461 - protein, 13 aa, Cryptosporidium parvum
GGNSNNINNTSNA

SEQ ID NO: 2259462 - protein, 8 aa, Cryptosporidium parvum
GGNSNSNE

SEQ ID NO: 2259463 - protein, 10 aa, Cryptosporidium parvum
GGNSSRRSLT

SEQ ID NO: 2259464 - protein, 12 aa, Cryptosporidium parvum
GGNTKTKYEKNT

SEQ ID NO: 2259465 - protein, 4 aa, Cryptosporidium parvum
GGNV

SEQ ID NO: 2259466 - protein, 8 aa, Cryptosporidium parvum
GGPAPGGH

SEQ ID NO: 2259467 - protein, 39 aa, Cryptosporidium parvum
GGPFGGGSSGAIGVGNGSFGGGITSNPFGGGNTSTTGSI

SEQ ID NO: 2259468 - protein, 5 aa, Cryptosporidium parvum
GGPFP

SEQ ID NO: 2259469 - protein, 9 aa, Cryptosporidium parvum
GGPGGTQAL

SEQ ID NO: 2259470 - protein, 6 aa, Cryptosporidium parvum
GGPHLG

SEQ ID NO: 2259471 - protein, 7 aa, Cryptosporidium parvum
GGPNKTG

SEQ ID NO: 2259472 - protein, 7 aa, Cryptosporidium parvum
GGPNVKN

SEQ ID NO: 2259473 - protein, 9 aa, Cryptosporidium parvum
GGPSEEFKS

SEQ ID NO: 2259474 - protein, 24 aa, Cryptosporidium parvum
GGPSSPAGIPVAGGATQVTYTQTN

SEQ ID NO: 2259475 - protein, 8 aa, Cryptosporidium parvum
GGPSSVYD

SEQ ID NO: 2259476 - protein, 9 aa, Cryptosporidium parvum
GGQASGGHN

SEQ ID NO: 2259477 - protein, 9 aa, Cryptosporidium parvum
GGQGEKGQA

SEQ ID NO: 2259478 - protein, 6 aa, Cryptosporidium parvum
GGQKSR

SEQ ID NO: 2259479 - protein, 9 aa, Cryptosporidium parvum
GGQSEEEAS

SEQ ID NO: 2259480 - protein, 5 aa, Cryptosporidium parvum
GGQTI

SEQ ID NO: 2259481 - protein, 5 aa, Cryptosporidium parvum
GGQVI

SEQ ID NO: 2259482 - protein, 11 aa, Cryptosporidium parvum
GGQYHTGTTDV

SEQ ID NO: 2259483 - protein, 9 aa, Cryptosporidium parvum
GGRASDSRC

SEQ ID NO: 2259484 - protein, 10 aa, Cryptosporidium parvum
GGRDGGQGRV

SEQ ID NO: 2259485 - protein, 4 aa, Cryptosporidium parvum
GGRE

SEQ ID NO: 2259486 - protein, 8 aa, Cryptosporidium parvum
GGREREIQ

SEQ ID NO: 2259487 - protein, 8 aa, Cryptosporidium parvum
GGRGDDVS

SEQ ID NO: 2259488 - protein, 29 aa, Cryptosporidium parvum
GGRGSSRGKGGVPSNGRPSFSGPPSSITE

SEQ ID NO: 2259489 - protein, 5 aa, Cryptosporidium parvum
GGRID

SEQ ID NO: 2259490 - protein, 6 aa, Cryptosporidium parvum
GGRLDE

SEQ ID NO: 2259491 - protein, 24 aa, Cryptosporidium parvum
GGRNASTKQNIPQNAAKLDEDTGD

SEQ ID NO: 2259492 - protein, 10 aa, Cryptosporidium parvum
GGRPQYDNNG

SEQ ID NO: 2259493 - protein, 9 aa, Cryptosporidium parvum
GGRSQGRVG

SEQ ID NO: 2259494 - protein, 10 aa, Cryptosporidium parvum
GGSASGKTSV

SEQ ID NO: 2259495 - protein, 18 aa, Cryptosporidium parvum
GGSCIGNNTSMGNANGSL

SEQ ID NO: 2259496 - protein, 5 aa, Cryptosporidium parvum
GGSDS

SEQ ID NO: 2259497 - protein, 19 aa, Cryptosporidium parvum
GGSEFEDTESQEPLSSSEE

SEQ ID NO: 2259498 - protein, 8 aa, Cryptosporidium parvum
GGSESRLN

SEQ ID NO: 2259499 - protein, 5 aa, Cryptosporidium parvum
GGSGF

SEQ ID NO: 2259500 - protein, 13 aa, Cryptosporidium parvum
GGSGGGGKSLTRK

SEQ ID NO: 2259501 - protein, 7 aa, Cryptosporidium parvum
GGSGGGL

SEQ ID NO: 2259502 - protein, 6 aa, Cryptosporidium parvum
GGSGIG

SEQ ID NO: 2259503 - protein, 7 aa, Cryptosporidium parvum
GGSGNFN

SEQ ID NO: 2259504 - protein, 6 aa, Cryptosporidium parvum
GGSGSL

SEQ ID NO: 2259505 - protein, 12 aa, Cryptosporidium parvum
GGSGTETKTKDE

SEQ ID NO: 2259506 - protein, 7 aa, Cryptosporidium parvum
GGSIDGA

SEQ ID NO: 2259507 - protein, 11 aa, Cryptosporidium parvum
GGSIGRGGGPQ

SEQ ID NO: 2259508 - protein, 17 aa, Cryptosporidium parvum
GGSIPNSKIGQFPPSNQ

SEQ ID NO: 2259509 - protein, 5 aa, Cryptosporidium parvum
GGSLQ

SEQ ID NO: 2259510 - protein, 7 aa, Cryptosporidium parvum
GGSNPNI

SEQ ID NO: 2259511 - protein, 14 aa, Cryptosporidium parvum
GGSNSSPLHSNQST

SEQ ID NO: 2259512 - protein, 8 aa, Cryptosporidium parvum
GGSPEYPQ

SEQ ID NO: 2259513 - protein, 13 aa, Cryptosporidium parvum
GGSPLGGSPIGGN

SEQ ID NO: 2259514 - protein, 7 aa, Cryptosporidium parvum
GGSPMDA

SEQ ID NO: 2259515 - protein, 5 aa, Cryptosporidium parvum
GGSQA

SEQ ID NO: 2259516 - protein, 5 aa, Cryptosporidium parvum
GGSQE

SEQ ID NO: 2259517 - protein, 10 aa, Cryptosporidium parvum
GGSQREDDIE

SEQ ID NO: 2259518 - protein, 8 aa, Cryptosporidium parvum
GGSSLDRQ

SEQ ID NO: 2259519 - protein, 8 aa, Cryptosporidium parvum
GGSSPAPC

SEQ ID NO: 2259520 - protein, 9 aa, Cryptosporidium parvum
GGSSPLQSP

SEQ ID NO: 2259521 - protein, 8 aa, Cryptosporidium parvum
GGSSSGIS

SEQ ID NO: 2259522 - protein, 11 aa, Cryptosporidium parvum
GGSTSKTEYAL

SEQ ID NO: 2259523 - protein, 108 aa, Cryptosporidium parvum
GGSVRGGSVRGGSTRGRGSGRGGSGRGAVGTIGGSGRGGSSRIGAGSGAVGAIGGPDRGGSNRGGMSTRGGSGRGGSGIGRLTGRGRLGSGTTNHSNCSLGTTEQSIT

SEQ ID NO: 2259524 - protein, 4 aa, Cryptosporidium parvum
GGSW

SEQ ID NO: 2259525 - protein, 5 aa, Cryptosporidium parvum
GGSYG

SEQ ID NO: 2259526 - protein, 8 aa, Cryptosporidium parvum
GGTDPNVE

SEQ ID NO: 2259527 - protein, 10 aa, Cryptosporidium parvum
GGTEKTISTL

SEQ ID NO: 2259528 - protein, 21 aa, Cryptosporidium parvum
GGTISNLNSTNNTSIATTSLS

SEQ ID NO: 2259529 - protein, 7 aa, Cryptosporidium parvum
GGTKREE

SEQ ID NO: 2259530 - protein, 5 aa, Cryptosporidium parvum
GGTNF

SEQ ID NO: 2259531 - protein, 18 aa, Cryptosporidium parvum
GGTNQDKGNKSLKSTIPT

SEQ ID NO: 2259532 - protein, 4 aa, Cryptosporidium parvum
GGTP

SEQ ID NO: 2259533 - protein, 6 aa, Cryptosporidium parvum
GGTPGR

SEQ ID NO: 2259534 - protein, 8 aa, Cryptosporidium parvum
GGTPLEES

SEQ ID NO: 2259535 - protein, 6 aa, Cryptosporidium parvum
GGTPTG

SEQ ID NO: 2259536 - protein, 4 aa, Cryptosporidium parvum
GGTQ

SEQ ID NO: 2259537 - protein, 14 aa, Cryptosporidium parvum
GGTQGSSGEHSHTK

SEQ ID NO: 2259538 - protein, 17 aa, Cryptosporidium parvum
GGTRATRSFNPKEHGTV

SEQ ID NO: 2259539 - protein, 10 aa, Cryptosporidium parvum
GGTSLTTGIE

SEQ ID NO: 2259540 - protein, 6 aa, Cryptosporidium parvum
GGTSTS

SEQ ID NO: 2259541 - protein, 7 aa, Cryptosporidium parvum
GGTVEDT

SEQ ID NO: 2259542 - protein, 6 aa, Cryptosporidium parvum
GGTVSD

SEQ ID NO: 2259543 - protein, 13 aa, Cryptosporidium parvum
GGVDDSNSSDLTT

SEQ ID NO: 2259544 - protein, 36 aa, Cryptosporidium parvum; identical to SEQ ID NO: 2143088

SEQ ID NO: 2259545 - protein, 6 aa, Cryptosporidium parvum
GGVGGN

SEQ ID NO: 2259546 - protein, 18 aa, Cryptosporidium parvum
GGVGGSAASEGLFVKSYV

SEQ ID NO: 2259547 - protein, 6 aa, Cryptosporidium parvum
GGVGSN

SEQ ID NO: 2259548 - protein, 26 aa, Cryptosporidium parvum
GGVGVGGNNNGIGNISSSGGGIGGVG

SEQ ID NO: 2259549 - protein, 16 aa, Cryptosporidium parvum
GGVKSKTMGPGAQSAL

SEQ ID NO: 2259550 - protein, 80 aa, Cryptosporidium parvum
GGVNSGEMKDSTLSHNNANHHTNSALGDHPNKGLKKSHDSSSGPNLSSNYNNSNNNNNQSMEESYQYSNSGRGSKSVKYE

SEQ ID NO: 2259551 - protein, 5 aa, Cryptosporidium parvum
GGVNT

SEQ ID NO: 2259552 - protein, 15 aa, Cryptosporidium parvum
GGVPPQMTGGPQMTA

SEQ ID NO: 2259553 - protein, 8 aa, Cryptosporidium parvum
GGVPSQQI

SEQ ID NO: 2259554 - protein, 8 aa, Cryptosporidium parvum
GGVPVTSE

SEQ ID NO: 2259555 - protein, 11 aa, Cryptosporidium parvum
GGVSPKAISEG

SEQ ID NO: 2259556 - protein, 5 aa, Cryptosporidium parvum
GGVSS

SEQ ID NO: 2259557 - protein, 12 aa, Cryptosporidium parvum
GGVTNIETNTDF

SEQ ID NO: 2259558 - protein, 8 aa, Cryptosporidium parvum
GGVTSIKE

SEQ ID NO: 2259559 - protein, 40 aa, Cryptosporidium parvum
GGVVTNSNKSSNNSINKAGYNNNNSSINGNNNINNSTNVG

SEQ ID NO: 2259560 - protein, 7 aa, Cryptosporidium parvum
GGYEEVK

SEQ ID NO: 2259561 - protein, 6 aa, Cryptosporidium parvum
GGYNTK

SEQ ID NO: 2259562 - protein, 15 aa, Cryptosporidium parvum
GGYPTEDSTRLKSPG

SEQ ID NO: 2259563 - protein, 5 aa, Cryptosporidium parvum
GGYQD

SEQ ID NO: 2259564 - protein, 4 aa, Cryptosporidium parvum
GGYT

SEQ ID NO: 2259565 - protein, 19 aa, Cryptosporidium parvum
GGYTGTGNLTKYQQQNQFG

SEQ ID NO: 2259566 - protein, 10 aa, Cryptosporidium parvum
GHAKGGGALS

SEQ ID NO: 2259567 - protein, 4 aa, Cryptosporidium parvum
GHEG

SEQ ID NO: 2259568 - protein, 8 aa, Cryptosporidium parvum
GHENQSDG

SEQ ID NO: 2259569 - protein, 5 aa, Cryptosporidium parvum
GHETA

SEQ ID NO: 2259570 - protein, 4 aa, Cryptosporidium parvum
GHFA

SEQ ID NO: 2259571 - protein, 6 aa, Cryptosporidium parvum
GHGDSI

SEQ ID NO: 2259572 - protein, 7 aa, Cryptosporidium parvum
GHHPPTT

SEQ ID NO: 2259573 - protein, 5 aa, Cryptosporidium parvum
GHIST

SEQ ID NO: 2259574 - protein, 4 aa, Cryptosporidium parvum
GHKS

SEQ ID NO: 2259575 - protein, 10 aa, Cryptosporidium parvum
GHLENPGNIS

SEQ ID NO: 2259576 - protein, 4 aa, Cryptosporidium parvum
GHNH

SEQ ID NO: 2259577 - protein, 12 aa, Cryptosporidium parvum
GHNHKQYDETGY

SEQ ID NO: 2259578 - protein, 5 aa, Cryptosporidium parvum
GHNSD

SEQ ID NO: 2259579 - protein, 24 aa, Cryptosporidium parvum
GHNSGNIQNNQNLSHSNSGSNHSA

SEQ ID NO: 2259580 - protein, 9 aa, Cryptosporidium parvum
GHPNGANSV

SEQ ID NO: 2259581 - protein, 15 aa, Cryptosporidium parvum
GHPNYSSKTAENVEH

SEQ ID NO: 2259582 - protein, 15 aa, Cryptosporidium parvum
GHPSTVSRSAPPGQK

SEQ ID NO: 2259583 - protein, 7 aa, Cryptosporidium parvum
GHQKDEI

SEQ ID NO: 2259584 - protein, 4 aa, Cryptosporidium parvum
GHQM

SEQ ID NO: 2259585 - protein, 8 aa, Cryptosporidium parvum
GHRTSSLS

SEQ ID NO: 2259586 - protein, 5 aa, Cryptosporidium parvum
GHSDT

SEQ ID NO: 2259587 - protein, 4 aa, Cryptosporidium parvum
GHSE

SEQ ID NO: 2259588 - protein, 5 aa, Cryptosporidium parvum
GHSKA

SEQ ID NO: 2259589 - protein, 4 aa, Cryptosporidium parvum
GHSS

SEQ ID NO: 2259590 - protein, 9 aa, Cryptosporidium parvum
GHSSHQNIY

SEQ ID NO: 2259591 - protein, 19 aa, Cryptosporidium parvum
GHSSKLGSETPDSNKPNLK

SEQ ID NO: 2259592 - protein, 7 aa, Cryptosporidium parvum
GHTGQIT

SEQ ID NO: 2259593 - protein, 8 aa, Cryptosporidium parvum
GHTSGSIQ

SEQ ID NO: 2259594 - protein, 5 aa, Cryptosporidium parvum
GHTSP

SEQ ID NO: 2259595 - protein, 9 aa, Cryptosporidium parvum
GHTSTAEGI

SEQ ID NO: 2259596 - protein, 7 aa, Cryptosporidium parvum
GHYDRGD

SEQ ID NO: 2259597 - protein, 5 aa, Cryptosporidium parvum
GHYEG

SEQ ID NO: 2259598 - protein, 9 aa, Cryptosporidium parvum
GHYGKTASH

SEQ ID NO: 2259599 - protein, 5 aa, Cryptosporidium parvum
GIAGG

SEQ ID NO: 2259600 - protein, 6 aa, Cryptosporidium parvum
GIAGTT

SEQ ID NO: 2259601 - protein, 7 aa, Cryptosporidium parvum
GIAPSTL

SEQ ID NO: 2259602 - protein, 27 aa, Cryptosporidium parvum
GIASGTKMVGTASSNNNNNNNNNNNGF

SEQ ID NO: 2259603 - protein, 11 aa, Cryptosporidium parvum
GIASKDDMNEP

SEQ ID NO: 2259604 - protein, 10 aa, Cryptosporidium parvum
GIASPSPVDP

SEQ ID NO: 2259605 - protein, 7 aa, Cryptosporidium parvum
GIDGQSS

SEQ ID NO: 2259606 - protein, 11 aa, Cryptosporidium parvum
GIDKDGKSHRL

SEQ ID NO: 2259607 - protein, 9 aa, Cryptosporidium parvum
GIDKKETSF

SEQ ID NO: 2259608 - protein, 5 aa, Cryptosporidium parvum
GIDNI

SEQ ID NO: 2259609 - protein, 12 aa, Cryptosporidium parvum
GIDNSDDEEDHH

SEQ ID NO: 2259610 - protein, 4 aa, Cryptosporidium parvum
GIDP

SEQ ID NO: 2259611 - protein, 8 aa, Cryptosporidium parvum
GIDPNNNT

SEQ ID NO: 2259612 - protein, 6 aa, Cryptosporidium parvum
GIDPPS

SEQ ID NO: 2259613 - protein, 16 aa, Cryptosporidium parvum
GIDQRKNDIQHFHFKQ

SEQ ID NO: 2259614 - protein, 11 aa, Cryptosporidium parvum
GIDSNQEPSLE

SEQ ID NO: 2259615 - protein, 8 aa, Cryptosporidium parvum
GIDSNSNK

SEQ ID NO: 2259616 - protein, 5 aa, Cryptosporidium parvum
GIEDN

SEQ ID NO: 2259617 - protein, 16 aa, Cryptosporidium parvum
GIEEGDDDDDDDDGQI

SEQ ID NO: 2259618 - protein, 20 aa, Cryptosporidium parvum
GIEEGGGSNMSESDRMPDQF

SEQ ID NO: 2259619 - protein, 5 aa, Cryptosporidium parvum
GIELG

SEQ ID NO: 2259620 - protein, 15 aa, Cryptosporidium parvum
GIENGIENGIENGDI

SEQ ID NO: 2259621 - protein, 11 aa, Cryptosporidium parvum
GIEPIGDGKGK

SEQ ID NO: 2259622 - protein, 13 aa, Cryptosporidium parvum
GIEQKSTDKETNS

SEQ ID NO: 2259623 - protein, 4 aa, Cryptosporidium parvum
GIES

SEQ ID NO: 2259624 - protein, 14 aa, Cryptosporidium parvum
GIESNSIQKGSLPA

SEQ ID NO: 2259625 - protein, 7 aa, Cryptosporidium parvum
GIESSQE

SEQ ID NO: 2259626 - protein, 15 aa, Cryptosporidium parvum
GIESSSRDDLYSPDL

SEQ ID NO: 2259627 - protein, 6 aa, Cryptosporidium parvum
GIETGS

SEQ ID NO: 2259628 - protein, 4 aa, Cryptosporidium parvum
GIGD

SEQ ID NO: 2259629 - protein, 7 aa, Cryptosporidium parvum
GIGDQTR

SEQ ID NO: 2259630 - protein, 5 aa, Cryptosporidium parvum
GIGET

SEQ ID NO: 2259631 - protein, 6 aa, Cryptosporidium parvum
GIGGET

SEQ ID NO: 2259632 - protein, 11 aa, Cryptosporidium parvum
GIGGNPSTSMN

SEQ ID NO: 2259633 - protein, 7 aa, Cryptosporidium parvum
GIGGSSI

SEQ ID NO: 2259634 - protein, 5 aa, Cryptosporidium parvum
GIGKS

SEQ ID NO: 2259635 - protein, 5 aa, Cryptosporidium parvum
GIGNK

SEQ ID NO: 2259636 - protein, 19 aa, Cryptosporidium parvum
GIGNNRGYSDNQSYQQGNF

SEQ ID NO: 2259637 - protein, 4 aa, Cryptosporidium parvum
GIGP

SEQ ID NO: 2259638 - protein, 6 aa, Cryptosporidium parvum
GIGPQQ

SEQ ID NO: 2259639 - protein, 8 aa, Cryptosporidium parvum
GIGRSTDY

SEQ ID NO: 2259640 - protein, 5 aa, Cryptosporidium parvum
GIGSK

SEQ ID NO: 2259641 - protein, 10 aa, Cryptosporidium parvum
GIGTDASMPT

SEQ ID NO: 2259642 - protein, 10 aa, Cryptosporidium parvum
GIGYEDDGRD

SEQ ID NO: 2259643 - protein, 5 aa, Cryptosporidium parvum
GIKAG

SEQ ID NO: 2259644 - protein, 9 aa, Cryptosporidium parvum
GIKDESSEG

SEQ ID NO: 2259645 - protein, 12 aa, Cryptosporidium parvum
GIKDKNEDNEER

SEQ ID NO: 2259646 - protein, 15 aa, Cryptosporidium parvum
GIKEESQNTQSPPQI

SEQ ID NO: 2259647 - protein, 5 aa, Cryptosporidium parvum
GIKET

SEQ ID NO: 2259648 - protein, 12 aa, Cryptosporidium parvum
GIKGEGDSYSNS

SEQ ID NO: 2259649 - protein, 24 aa, Cryptosporidium parvum
GIKPENVSKKTKIIPESKPKKMKY

SEQ ID NO: 2259650 - protein, 24 aa, Cryptosporidium parvum
GIKSNNTSFESLNNKNSNINSRKQ

SEQ ID NO: 2259651 - protein, 13 aa, Cryptosporidium parvum
GIKSSDDECDEKI

SEQ ID NO: 2259652 - protein, 12 aa, Cryptosporidium parvum
GIKSVGSSGESE

SEQ ID NO: 2259653 - protein, 15 aa, Cryptosporidium parvum
GINADNNQKGETTFK

SEQ ID NO: 2259654 - protein, 20 aa, Cryptosporidium parvum
GINDGLEQHSNEISLLDVSS

SEQ ID NO: 2259655 - protein, 12 aa, Cryptosporidium parvum
GINDHNEGYNNH

SEQ ID NO: 2259656 - protein, 5 aa, Cryptosporidium parvum
GINED

SEQ ID NO: 2259657 - protein, 10 aa, Cryptosporidium parvum
GINGEYGKRA

SEQ ID NO: 2259658 - protein, 11 aa, Cryptosporidium parvum
GINGGSSFGSS

SEQ ID NO: 2259659 - protein, 10 aa, Cryptosporidium parvum
GINNDQNNHQ

SEQ ID NO: 2259660 - protein, 7 aa, Cryptosporidium parvum
GINNENN

SEQ ID NO: 2259661 - protein, 41 aa, Cryptosporidium parvum
GINNSTCSTSSSTSVSPVGSASTSCQSTNKKQSSSKVMSVN

SEQ ID NO: 2259662 - protein, 50 aa, Cryptosporidium parvum
GINNTTQTKTESTQNISVTGRKEEAKKEKVTEKNDIDECNRSKLTTQPSL

SEQ ID NO: 2259663 - protein, 7 aa, Cryptosporidium parvum
GINPGVA

SEQ ID NO: 2259664 - protein, 10 aa, Cryptosporidium parvum
GINPPTSIPG

SEQ ID NO: 2259665 - protein, 9 aa, Cryptosporidium parvum
GINQESSEK

SEQ ID NO: 2259666 - protein, 5 aa, Cryptosporidium parvum
GINTN

SEQ ID NO: 2259667 - protein, 5 aa, Cryptosporidium parvum
GIPDS

SEQ ID NO: 2259668 - protein, 6 aa, Cryptosporidium parvum
GIPEDV

SEQ ID NO: 2259669 - protein, 6 aa, Cryptosporidium parvum
GIPGES

SEQ ID NO: 2259670 - protein, 5 aa, Cryptosporidium parvum
GIPKG

SEQ ID NO: 2259671 - protein, 35 aa, Cryptosporidium parvum
GIPKGSTKNAKSIIDGSSALEPPKKIQNTGKNTGS

SEQ ID NO: 2259672 - protein, 4 aa, Cryptosporidium parvum
GIPN

SEQ ID NO: 2259673 - protein, 9 aa, Cryptosporidium parvum
GIPNDKQPC

SEQ ID NO: 2259674 - protein, 6 aa, Cryptosporidium parvum
GIPNNE

SEQ ID NO: 2259675 - protein, 6 aa, Cryptosporidium parvum
GIPPRK

SEQ ID NO: 2259676 - protein, 6 aa, Cryptosporidium parvum
GIPQGK

SEQ ID NO: 2259677 - protein, 5 aa, Cryptosporidium parvum
GIPQN

SEQ ID NO: 2259678 - protein, 5 aa, Cryptosporidium parvum
GIPRS

SEQ ID NO: 2259679 - protein, 9 aa, Cryptosporidium parvum
GIPSTVPTQ

SEQ ID NO: 2259680 - protein, 6 aa, Cryptosporidium parvum
GIPSYS

SEQ ID NO: 2259681 - protein, 4 aa, Cryptosporidium parvum
GIQH

SEQ ID NO: 2259682 - protein, 9 aa, Cryptosporidium parvum
GIQSKDKNM

SEQ ID NO: 2259683 - protein, 12 aa, Cryptosporidium parvum
GIRDPFLPQTFK

SEQ ID NO: 2259684 - protein, 9 aa, Cryptosporidium parvum
GIRKTNGIT

SEQ ID NO: 2259685 - protein, 10 aa, Cryptosporidium parvum
GIRRKTGELV

SEQ ID NO: 2259686 - protein, 10 aa, Cryptosporidium parvum
GIRSGDDFPK

SEQ ID NO: 2259687 - protein, 17 aa, Cryptosporidium parvum
GISESSDSSEDFTPKPI

SEQ ID NO: 2259688 - protein, 14 aa, Cryptosporidium parvum
GISGGNSGDMDEIT

SEQ ID NO: 2259689 - protein, 26 aa, Cryptosporidium parvum
GISGNSNASNDTTDDDPSKKLTVGGY

SEQ ID NO: 2259690 - protein, 7 aa, Cryptosporidium parvum
GISGPEI

SEQ ID NO: 2259691 - protein, 6 aa, Cryptosporidium parvum
GISGSN

SEQ ID NO: 2259692 - protein, 9 aa, Cryptosporidium parvum
GISHTSGSD

SEQ ID NO: 2259693 - protein, 4 aa, Cryptosporidium parvum
GISM

SEQ ID NO: 2259694 - protein, 12 aa, Cryptosporidium parvum
GISNANSSAQVT

SEQ ID NO: 2259695 - protein, 9 aa, Cryptosporidium parvum
GISNGSNKY

SEQ ID NO: 2259696 - protein, 13 aa, Cryptosporidium parvum
GISNPPIAPHRAV

SEQ ID NO: 2259697 - protein, 12 aa, Cryptosporidium parvum
GISNSDDPNSNL

SEQ ID NO: 2259698 - protein, 11 aa, Cryptosporidium parvum
GISPFKNSESH

SEQ ID NO: 2259699 - protein, 10 aa, Cryptosporidium parvum
GISPLTSEEA

SEQ ID NO: 2259700 - protein, 7 aa, Cryptosporidium parvum
GISPPHG

SEQ ID NO: 2259701 - protein, 7 aa, Cryptosporidium parvum
GISPPRE

SEQ ID NO: 2259702 - protein, 11 aa, Cryptosporidium parvum
GISQEKKLESG

SEQ ID NO: 2259703 - protein, 6 aa, Cryptosporidium parvum
GISSPQ

SEQ ID NO: 2259704 - protein, 38 aa, Cryptosporidium parvum
GISSSNSIGVNGKVSTGGGFSSGFTSTSSFSSSGRNNF

SEQ ID NO: 2259705 - protein, 26 aa, Cryptosporidium parvum
GISSTEASEYCKSQGSSQNPSPLGGC

SEQ ID NO: 2259706 - protein, 5 aa, Cryptosporidium parvum
GISTE

SEQ ID NO: 2259707 - protein, 5 aa, Cryptosporidium parvum
GISTN

SEQ ID NO: 2259708 - protein, 9 aa, Cryptosporidium parvum
GITKAEERS

SEQ ID NO: 2259709 - protein, 16 aa, Cryptosporidium parvum
GITKIRGTDYKSPHGI

SEQ ID NO: 2259710 - protein, 20 aa, Cryptosporidium parvum
GITKRSLTSIKKTAKTGDDP

SEQ ID NO: 2259711 - protein, 44 aa, Cryptosporidium parvum; identical to SEQ ID NO: 2143210

SEQ ID NO: 2259712 - protein, 10 aa, Cryptosporidium parvum
GITSESSTCF

SEQ ID NO: 2259713 - protein, 5 aa, Cryptosporidium parvum
GITTN

SEQ ID NO: 2259714 - protein, 10 aa, Cryptosporidium parvum
GIYNGDDDEE

SEQ ID NO: 2259715 - protein, 12 aa, Cryptosporidium parvum
GIYSNEDTTSAN

SEQ ID NO: 2259716 - protein, 16 aa, Cryptosporidium parvum
GKAKRIAKNTDFGNRM

SEQ ID NO: 2259717 - protein, 13 aa, Cryptosporidium parvum
GKAPTFKSRTNEY

SEQ ID NO: 2259718 - protein, 5 aa, Cryptosporidium parvum
GKASE

SEQ ID NO: 2259719 - protein, 12 aa, Cryptosporidium parvum
GKASQKNKGRIS

SEQ ID NO: 2259720 - protein, 48 aa, Cryptosporidium parvum
GKATISALSSSSSIVGSGTTAQSSVGRRMSRRAAGRGTGASRSSGRFQ

SEQ ID NO: 2259721 - protein, 9 aa, Cryptosporidium parvum
GKATPHPCM

SEQ ID NO: 2259722 - protein, 8 aa, Cryptosporidium parvum
GKAYTGPE

SEQ ID NO: 2259723 - protein, 4 aa, Cryptosporidium parvum
GKCG

SEQ ID NO: 2259724 - protein, 7 aa, Cryptosporidium parvum
GKCGQLG

SEQ ID NO: 2259725 - protein, 9 aa, Cryptosporidium parvum
GKCKNSDSC

SEQ ID NO: 2259726 - protein, 8 aa, Cryptosporidium parvum
GKCYSENS

SEQ ID NO: 2259727 - protein, 9 aa, Cryptosporidium parvum
GKDEAENYL

SEQ ID NO: 2259728 - protein, 16 aa, Cryptosporidium parvum
GKDEFDNSKEKFTLDE

SEQ ID NO: 2259729 - protein, 7 aa, Cryptosporidium parvum
GKDENEL

SEQ ID NO: 2259730 - protein, 7 aa, Cryptosporidium parvum
GKDIPQS

SEQ ID NO: 2259731 - protein, 10 aa, Cryptosporidium parvum
GKDKRVPASQ

SEQ ID NO: 2259732 - protein, 8 aa, Cryptosporidium parvum
GKDKSEWK

SEQ ID NO: 2259733 - protein, 4 aa, Cryptosporidium parvum
GKDN

SEQ ID NO: 2259734 - protein, 8 aa, Cryptosporidium parvum
GKDQFEKQ

SEQ ID NO: 2259735 - protein, 4 aa, Cryptosporidium parvum
GKDR

SEQ ID NO: 2259736 - protein, 7 aa, Cryptosporidium parvum
GKDTKLI

SEQ ID NO: 2259737 - protein, 8 aa, Cryptosporidium parvum
GKDTSIDT

SEQ ID NO: 2259738 - protein, 9 aa, Cryptosporidium parvum
GKDVPNPIR

SEQ ID NO: 2259739 - protein, 12 aa, Cryptosporidium parvum
GKDVSKNNDNEQ

SEQ ID NO: 2259740 - protein, 8 aa, Cryptosporidium parvum
GKEAINTN

SEQ ID NO: 2259741 - protein, 42 aa, Cryptosporidium parvum
GKEEEKGGREDRKRRREEEEKGEEEEGEEEEGEEEEEEEETS

SEQ ID NO: 2259742 - protein, 8 aa, Cryptosporidium parvum
GKEEERAG

SEQ ID NO: 2259743 - protein, 5 aa, Cryptosporidium parvum
GKEEM

SEQ ID NO: 2259744 - protein, 8 aa, Cryptosporidium parvum
GKEGSSDL

SEQ ID NO: 2259745 - protein, 9 aa, Cryptosporidium parvum
GKELECKPI

SEQ ID NO: 2259746 - protein, 14 aa, Cryptosporidium parvum
GKELSFGGKARKEM

SEQ ID NO: 2259747 - protein, 12 aa, Cryptosporidium parvum
GKENRDLNHGDV

SEQ ID NO: 2259748 - protein, 4 aa, Cryptosporidium parvum
GKET

SEQ ID NO: 2259749 - protein, 6 aa, Cryptosporidium parvum
GKETEE

SEQ ID NO: 2259750 - protein, 4 aa, Cryptosporidium parvum
GKEY

SEQ ID NO: 2259751 - protein, 5 aa, Cryptosporidium parvum
GKEYV

SEQ ID NO: 2259752 - protein, 11 aa, Cryptosporidium parvum
GKFDPNKHGRR

SEQ ID NO: 2259753 - protein, 8 aa, Cryptosporidium parvum
GKFGETDH

SEQ ID NO: 2259754 - protein, 6 aa, Cryptosporidium parvum
GKFRRG

SEQ ID NO: 2259755 - protein, 54 aa, Cryptosporidium parvum
GKFSSNSSKEKPWEGRSSGGGGSSGNNGSRGSKNSYRESRSLAERGGWERRSNR

SEQ ID NO: 2259756 - protein, 6 aa, Cryptosporidium parvum
GKFSYD

SEQ ID NO: 2259757 - protein, 20 aa, Cryptosporidium parvum
GKFTTTSRSSVTPKPSESST

SEQ ID NO: 2259758 - protein, 4 aa, Cryptosporidium parvum
GKGA

SEQ ID NO: 2259759 - protein, 9 aa, Cryptosporidium parvum
GKGATGETL

SEQ ID NO: 2259760 - protein, 10 aa, Cryptosporidium parvum
GKGCAQGLSG

SEQ ID NO: 2259761 - protein, 8 aa, Cryptosporidium parvum
GKGCRNPL

SEQ ID NO: 2259762 - protein, 6 aa, Cryptosporidium parvum
GKGEHP

SEQ ID NO: 2259763 - protein, 16 aa, Cryptosporidium parvum
GKGEYFNRRTTKSDST

SEQ ID NO: 2259764 - protein, 34 aa, Cryptosporidium parvum; identical to SEQ ID NO: 2143263

SEQ ID NO: 2259765 - protein, 7 aa, Cryptosporidium parvum
GKGFSGV

SEQ ID NO: 2259766 - protein, 9 aa, Cryptosporidium parvum
GKGGAKRHR

SEQ ID NO: 2259767 - protein, 6 aa, Cryptosporidium parvum
GKGIED

SEQ ID NO: 2259768 - protein, 6 aa, Cryptosporidium parvum
GKGINP

SEQ ID NO: 2259769 - protein, 5 aa, Cryptosporidium parvum
GKGIS

SEQ ID NO: 2259770 - protein, 7 aa, Cryptosporidium parvum
GKGKAYS

SEQ ID NO: 2259771 - protein, 8 aa, Cryptosporidium parvum
GKGKRNGV

SEQ ID NO: 2259772 - protein, 6 aa, Cryptosporidium parvum
GKGLNE

SEQ ID NO: 2259773 - protein, 9 aa, Cryptosporidium parvum
GKGNENVTG

SEQ ID NO: 2259774 - protein, 35 aa, Cryptosporidium parvum
GKGNGRGGGTYRGNRFSRGNKTKSGSIYRDQNTKL

SEQ ID NO: 2259775 - protein, 10 aa, Cryptosporidium parvum
GKGNPGHGDL

SEQ ID NO: 2259776 - protein, 8 aa, Cryptosporidium parvum
GKGNTAKG

SEQ ID NO: 2259777 - protein, 7 aa, Cryptosporidium parvum
GKGTPIQ

SEQ ID NO: 2259778 - protein, 8 aa, Cryptosporidium parvum
GKGVSNGT

SEQ ID NO: 2259779 - protein, 16 aa, Cryptosporidium parvum
GKGYPVKEREIGERRV

SEQ ID NO: 2259780 - protein, 23 aa, Cryptosporidium parvum
GKHANSKYMKSSENGGEDEDDDI

SEQ ID NO: 2259781 - protein, 5 aa, Cryptosporidium parvum
GKHDE

SEQ ID NO: 2259782 - protein, 8 aa, Cryptosporidium parvum
GKHKEQFE

SEQ ID NO: 2259783 - protein, 5 aa, Cryptosporidium parvum
GKHNS

SEQ ID NO: 2259784 - protein, 6 aa, Cryptosporidium parvum
GKHQNA

SEQ ID NO: 2259785 - protein, 5 aa, Cryptosporidium parvum
GKHTG

SEQ ID NO: 2259786 - protein, 4 aa, Cryptosporidium parvum
GKIA

SEQ ID NO: 2259787 - protein, 10 aa, Cryptosporidium parvum
GKIDAKKTSV

SEQ ID NO: 2259788 - protein, 7 aa, Cryptosporidium parvum
GKIGNED

SEQ ID NO: 2259789 - protein, 12 aa, Cryptosporidium parvum
GKIISDSKTAIQ

SEQ ID NO: 2259790 - protein, 6 aa, Cryptosporidium parvum
GKINGY

SEQ ID NO: 2259791 - protein, 9 aa, Cryptosporidium parvum
GKIPMKGNR

SEQ ID NO: 2259792 - protein, 6 aa, Cryptosporidium parvum
GKIQSK

SEQ ID NO: 2259793 - protein, 9 aa, Cryptosporidium parvum
GKISNNSDI

SEQ ID NO: 2259794 - protein, 12 aa, Cryptosporidium parvum
GKISSKKEDDDD

SEQ ID NO: 2259795 - protein, 4 aa, Cryptosporidium parvum
GKIW

SEQ ID NO: 2259796 - protein, 8 aa, Cryptosporidium parvum
GKIYERDG

SEQ ID NO: 2259797 - protein, 9 aa, Cryptosporidium parvum
GKKEENSEF

SEQ ID NO: 2259798 - protein, 4 aa, Cryptosporidium parvum
GKKG

SEQ ID NO: 2259799 - protein, 8 aa, Cryptosporidium parvum
GKKGQGLR

SEQ ID NO: 2259800 - protein, 8 aa, Cryptosporidium parvum
GKKHEASG

SEQ ID NO: 2259801 - protein, 11 aa, Cryptosporidium parvum
GKKKEAEEKLK

SEQ ID NO: 2259802 - protein, 14 aa, Cryptosporidium parvum
GKKKKDKQSKGSLK

SEQ ID NO: 2259803 - protein, 4 aa, Cryptosporidium parvum
GKKL

SEQ ID NO: 2259804 - protein, 12 aa, Cryptosporidium parvum
GKKLDKKHANNY

SEQ ID NO: 2259805 - protein, 11 aa, Cryptosporidium parvum
GKKLSRPEQVS

SEQ ID NO: 2259806 - protein, 9 aa, Cryptosporidium parvum
GKKMKQNRA

SEQ ID NO: 2259807 - protein, 11 aa, Cryptosporidium parvum
GKKNDKDEYDY

SEQ ID NO: 2259808 - protein, 8 aa, Cryptosporidium parvum
GKKSDLNN

SEQ ID NO: 2259809 - protein, 45 aa, Cryptosporidium parvum
GKKSSSGSQTSTSEMTLSPSSSSSSSSSSSSSSSSMITSTSASTI

SEQ ID NO: 2259810 - protein, 8 aa, Cryptosporidium parvum
GKKVTASQ

SEQ ID NO: 2259811 - protein, 14 aa, Cryptosporidium parvum
GKLASQNVPDSPPT

SEQ ID NO: 2259812 - protein, 13 aa, Cryptosporidium parvum
GKLDTRRGKTPVH

SEQ ID NO: 2259813 - protein, 7 aa, Cryptosporidium parvum
GKLNKKT

SEQ ID NO: 2259814 - protein, 8 aa, Cryptosporidium parvum
GKLPEEVA

SEQ ID NO: 2259815 - protein, 9 aa, Cryptosporidium parvum
GKLPSPRAA

SEQ ID NO: 2259816 - protein, 7 aa, Cryptosporidium parvum
GKLQNSM

SEQ ID NO: 2259817 - protein, 7 aa, Cryptosporidium parvum
GKLRGAS

SEQ ID NO: 2259818 - protein, 4 aa, Cryptosporidium parvum
GKME

SEQ ID NO: 2259819 - protein, 9 aa, Cryptosporidium parvum
GKMQKEELN

SEQ ID NO: 2259820 - protein, 6 aa, Cryptosporidium parvum
GKMRNR

SEQ ID NO: 2259821 - protein, 7 aa, Cryptosporidium parvum
GKMSQDV

SEQ ID NO: 2259822 - protein, 10 aa, Cryptosporidium parvum
GKNEQIDENP

SEQ ID NO: 2259823 - protein, 5 aa, Cryptosporidium parvum
GKNFE

SEQ ID NO: 2259824 - protein, 6 aa, Cryptosporidium parvum
GKNFKP

SEQ ID NO: 2259825 - protein, 7 aa, Cryptosporidium parvum
GKNGALG

SEQ ID NO: 2259826 - protein, 42 aa, Cryptosporidium parvum
GKNGGGGRGAGSGGGRGGANNRPAKNNSSTTFQGTSTTFDDS

SEQ ID NO: 2259827 - protein, 14 aa, Cryptosporidium parvum
GKNGMTAPTDPQQI

SEQ ID NO: 2259828 - protein, 27 aa, Cryptosporidium parvum
GKNGSNNVGPIETNQEFNQKVDDQKRI

SEQ ID NO: 2259829 - protein, 10 aa, Cryptosporidium parvum
GKNHSGKNID

SEQ ID NO: 2259830 - protein, 6 aa, Cryptosporidium parvum
GKNISN

SEQ ID NO: 2259831 - protein, 13 aa, Cryptosporidium parvum
GKNKKDKKNHSQE

SEQ ID NO: 2259832 - protein, 9 aa, Cryptosporidium parvum
GKNLTGTAR

SEQ ID NO: 2259833 - protein, 5 aa, Cryptosporidium parvum
GKNND

SEQ ID NO: 2259834 - protein, 8 aa, Cryptosporidium parvum
GKNNENHV

SEQ ID NO: 2259835 - protein, 31 aa, Cryptosporidium parvum
GKNNHENENQYIDGENSDMEENNEQIREKND

SEQ ID NO: 2259836 - protein, 12 aa, Cryptosporidium parvum
GKNNTKPDVNQE

SEQ ID NO: 2259837 - protein, 47 aa, Cryptosporidium parvum
GKNQVDREVTQNKPLERIGPNNTDFRNSKSTSTTASSHSGSSLSHPH

SEQ ID NO: 2259838 - protein, 4 aa, Cryptosporidium parvum
GKNT

SEQ ID NO: 2259839 - protein, 9 aa, Cryptosporidium parvum
GKNTIEDSN

SEQ ID NO: 2259840 - protein, 12 aa, Cryptosporidium parvum
GKNVNNTNSEHS

SEQ ID NO: 2259841 - protein, 40 aa, Cryptosporidium parvum; identical to SEQ ID NO: 2143338

SEQ ID NO: 2259842 - protein, 6 aa, Cryptosporidium parvum
GKPEQI

SEQ ID NO: 2259843 - protein, 20 aa, Cryptosporidium parvum
GKPETKRKKLDGQKKSEELH

SEQ ID NO: 2259844 - protein, 12 aa, Cryptosporidium parvum
GKPFSKQQKGVS

SEQ ID NO: 2259845 - protein, 5 aa, Cryptosporidium parvum
GKPHL

SEQ ID NO: 2259846 - protein, 10 aa, Cryptosporidium parvum
GKPKGINTAR

SEQ ID NO: 2259847 - protein, 8 aa, Cryptosporidium parvum
GKPKNQGI

SEQ ID NO: 2259848 - protein, 4 aa, Cryptosporidium parvum
GKPL

SEQ ID NO: 2259849 - protein, 13 aa, Cryptosporidium parvum
GKPPGLGTQLTPA

SEQ ID NO: 2259850 - protein, 6 aa, Cryptosporidium parvum
GKPPYY

SEQ ID NO: 2259851 - protein, 16 aa, Cryptosporidium parvum
GKPQETFKEASERAQK

SEQ ID NO: 2259852 - protein, 11 aa, Cryptosporidium parvum
GKPQNKIKPSK

SEQ ID NO: 2259853 - protein, 6 aa, Cryptosporidium parvum
GKPRKW

SEQ ID NO: 2259854 - protein, 4 aa, Cryptosporidium parvum
GKPS

SEQ ID NO: 2259855 - protein, 7 aa, Cryptosporidium parvum
GKPSPFI

SEQ ID NO: 2259856 - protein, 9 aa, Cryptosporidium parvum
GKPSSGKST

SEQ ID NO: 2259857 - protein, 9 aa, Cryptosporidium parvum
GKPTELNPH

SEQ ID NO: 2259858 - protein, 7 aa, Cryptosporidium parvum
GKPYPKS

SEQ ID NO: 2259859 - protein, 6 aa, Cryptosporidium parvum
GKQIEN

SEQ ID NO: 2259860 - protein, 15 aa, Cryptosporidium parvum
GKQKWEDASTSDEIQ

SEQ ID NO: 2259861 - protein, 13 aa, Cryptosporidium parvum
GKQPSNGSQNPPL

SEQ ID NO: 2259862 - protein, 9 aa, Cryptosporidium parvum
GKQREQGTL

SEQ ID NO: 2259863 - protein, 26 aa, Cryptosporidium parvum
GKQRESSSFGLSSDKIKKKQKEEEYG

SEQ ID NO: 2259864 - protein, 12 aa, Cryptosporidium parvum
GKQRNQSEMERV

SEQ ID NO: 2259865 - protein, 24 aa, Cryptosporidium parvum
GKQSLDERNSSIDSFNKNNVSCNV

SEQ ID NO: 2259866 - protein, 14 aa, Cryptosporidium parvum
GKRFSQGTSADREI

SEQ ID NO: 2259867 - protein, 7 aa, Cryptosporidium parvum
GKRGING

SEQ ID NO: 2259868 - protein, 58 aa, Cryptosporidium parvum
GKRGRPPSNPTSNSRGDTGLSSSSIGNTQLSSSSLGNFEDSTETQTNTQAGVGTGSSV

SEQ ID NO: 2259869 - protein, 7 aa, Cryptosporidium parvum
GKRGSYQ

SEQ ID NO: 2259870 - protein, 18 aa, Cryptosporidium parvum
GKRIEKESDNKSGKSNSV

SEQ ID NO: 2259871 - protein, 7 aa, Cryptosporidium parvum
GKRITSE

SEQ ID NO: 2259872 - protein, 13 aa, Cryptosporidium parvum
GKRNRDGYEKGDD

SEQ ID NO: 2259873 - protein, 6 aa, Cryptosporidium parvum
GKRQGC

SEQ ID NO: 2259874 - protein, 9 aa, Cryptosporidium parvum
GKRQKKSWK

SEQ ID NO: 2259875 - protein, 13 aa, Cryptosporidium parvum
GKRRGTKDARRPE

SEQ ID NO: 2259876 - protein, 16 aa, Cryptosporidium parvum
GKRSAKMRQAGTQQYQ

SEQ ID NO: 2259877 - protein, 10 aa, Cryptosporidium parvum
GKRSASSSQI

SEQ ID NO: 2259878 - protein, 7 aa, Cryptosporidium parvum
GKRTFNN

SEQ ID NO: 2259879 - protein, 28 aa, Cryptosporidium parvum
GKRTKSTGNLDDKDEKNEKLKEGKDLTK

SEQ ID NO: 2259880 - protein, 6 aa, Cryptosporidium parvum
GKSDAL

SEQ ID NO: 2259881 - protein, 8 aa, Cryptosporidium parvum
GKSDDISN

SEQ ID NO: 2259882 - protein, 7 aa, Cryptosporidium parvum
GKSDFAN

SEQ ID NO: 2259883 - protein, 16 aa, Cryptosporidium parvum
GKSEFEENPSSMQETV

SEQ ID NO: 2259884 - protein, 9 aa, Cryptosporidium parvum
GKSEFSKSI

SEQ ID NO: 2259885 - protein, 33 aa, Cryptosporidium parvum
GKSGKTQSSPSSSSSSSSSASSSSQGNGISSKG

SEQ ID NO: 2259886 - protein, 5 aa, Cryptosporidium parvum
GKSGL

SEQ ID NO: 2259887 - protein, 13 aa, Cryptosporidium parvum
GKSIGKKEQRKNL

SEQ ID NO: 2259888 - protein, 7 aa, Cryptosporidium parvum
GKSIKSV

SEQ ID NO: 2259889 - protein, 7 aa, Cryptosporidium parvum
GKSIRDV

SEQ ID NO: 2259890 - protein, 8 aa, Cryptosporidium parvum
GKSISKSS

SEQ ID NO: 2259891 - protein, 5 aa, Cryptosporidium parvum
GKSKD

SEQ ID NO: 2259892 - protein, 46 aa, Cryptosporidium parvum
GKSKKSASNNQSSQNSSSSKSAKTPKKHSQASSSSYGAKGITEPER

SEQ ID NO: 2259893 - protein, 9 aa, Cryptosporidium parvum
GKSKNGKSY

SEQ ID NO: 2259894 - protein, 7 aa, Cryptosporidium parvum
GKSLPEY

SEQ ID NO: 2259895 - protein, 4 aa, Cryptosporidium parvum
GKSN

SEQ ID NO: 2259896 - protein, 20 aa, Cryptosporidium parvum
GKSNKSDEYSSNPRNTKYPE

SEQ ID NO: 2259897 - protein, 9 aa, Cryptosporidium parvum
GKSPEERNK

SEQ ID NO: 2259898 - protein, 32 aa, Cryptosporidium parvum
GKSQLNDGKIGHDEHTNSSNQLANKNNIAEKN

SEQ ID NO: 2259899 - protein, 7 aa, Cryptosporidium parvum
GKSRDEF

SEQ ID NO: 2259900 - protein, 6 aa, Cryptosporidium parvum
GKSRNS

SEQ ID NO: 2259901 - protein, 11 aa, Cryptosporidium parvum
GKSRSVTPNQV

SEQ ID NO: 2259902 - protein, 6 aa, Cryptosporidium parvum
GKSSLN

SEQ ID NO: 2259903 - protein, 11 aa, Cryptosporidium parvum
GKSSNDHKPNH

SEQ ID NO: 2259904 - protein, 7 aa, Cryptosporidium parvum
GKSTLTD

SEQ ID NO: 2259905 - protein, 4 aa, Cryptosporidium parvum
GKSV

SEQ ID NO: 2259906 - protein, 7 aa, Cryptosporidium parvum
GKSVKEN

SEQ ID NO: 2259907 - protein, 5 aa, Cryptosporidium parvum
GKSVP

SEQ ID NO: 2259908 - protein, 9 aa, Cryptosporidium parvum
GKSVRKKDT

SEQ ID NO: 2259909 - protein, 79 aa, Cryptosporidium parvum
GKSVSSSLKSPSISASKNSSAILSNKEQNLSSAGHKDNSIDLNSSNSKASETIKSSLESNEPSLISKKDAPAAPPAKKD

SEQ ID NO: 2259910 - protein, 6 aa, Cryptosporidium parvum
GKTGLP

SEQ ID NO: 2259911 - protein, 40 aa, Cryptosporidium parvum
GKTKIAENKENSQFKSQNKIELGDEKSSRLKTKRVNSKKE

SEQ ID NO: 2259912 - protein, 13 aa, Cryptosporidium parvum
GKTKSSENLSKQP

SEQ ID NO: 2259913 - protein, 21 aa, Cryptosporidium parvum
GKTLSYANPTQKNANLAGSEF

SEQ ID NO: 2259914 - protein, 6 aa, Cryptosporidium parvum
GKTLTG

SEQ ID NO: 2259915 - protein, 11 aa, Cryptosporidium parvum
GKTPGNKREEY

SEQ ID NO: 2259916 - protein, 7 aa, Cryptosporidium parvum
GKTPGSS

SEQ ID NO: 2259917 - protein, 5 aa, Cryptosporidium parvum
GKTPH

SEQ ID NO: 2259918 - protein, 7 aa, Cryptosporidium parvum
GKTPKTK

SEQ ID NO: 2259919 - protein, 7 aa, Cryptosporidium parvum
GKTQKYK

SEQ ID NO: 2259920 - protein, 6 aa, Cryptosporidium parvum
GKTQRE

SEQ ID NO: 2259921 - protein, 13 aa, Cryptosporidium parvum
GKTSKSTYMRTGD

SEQ ID NO: 2259922 - protein, 4 aa, Cryptosporidium parvum
GKTT

SEQ ID NO: 2259923 - protein, 8 aa, Cryptosporidium parvum
GKTTNSGH

SEQ ID NO: 2259924 - protein, 5 aa, Cryptosporidium parvum
GKTTP

SEQ ID NO: 2259925 - protein, 4 aa, Cryptosporidium parvum
GKVG

SEQ ID NO: 2259926 - protein, 9 aa, Cryptosporidium parvum
GKVGDIDDP

SEQ ID NO: 2259927 - protein, 31 aa, Cryptosporidium parvum; identical to SEQ ID NO: 2143418

SEQ ID NO: 2259928 - protein, 16 aa, Cryptosporidium parvum
GKVNGKGTLTYSRGDK

SEQ ID NO: 2259929 - protein, 5 aa, Cryptosporidium parvum
GKVPK

SEQ ID NO: 2259930 - protein, 7 aa, Cryptosporidium parvum
GKVQNDI

SEQ ID NO: 2259931 - protein, 5 aa, Cryptosporidium parvum
GKWAT

SEQ ID NO: 2259932 - protein, 8 aa, Cryptosporidium parvum
GKWSEEEN

SEQ ID NO: 2259933 - protein, 4 aa, Cryptosporidium parvum
GKYD

SEQ ID NO: 2259934 - protein, 6 aa, Cryptosporidium parvum
GKYDNT

SEQ ID NO: 2259935 - protein, 9 aa, Cryptosporidium parvum
GKYDTESSL

SEQ ID NO: 2259936 - protein, 21 aa, Cryptosporidium parvum
GKYENKEETTLPEEAKLPEKV

SEQ ID NO: 2259937 - protein, 7 aa, Cryptosporidium parvum
GKYGEDS

SEQ ID NO: 2259938 - protein, 6 aa, Cryptosporidium parvum
GKYGPK

SEQ ID NO: 2259939 - protein, 5 aa, Cryptosporidium parvum
GKYGS

SEQ ID NO: 2259940 - protein, 7 aa, Cryptosporidium parvum
GKYLQKG

SEQ ID NO: 2259941 - protein, 5 aa, Cryptosporidium parvum
GKYNH

SEQ ID NO: 2259942 - protein, 5 aa, Cryptosporidium parvum
GKYQD

SEQ ID NO: 2259943 - protein, 6 aa, Cryptosporidium parvum
GKYTSK

SEQ ID NO: 2259944 - protein, 7 aa, Cryptosporidium parvum
GLAPDIP

SEQ ID NO: 2259945 - protein, 6 aa, Cryptosporidium parvum
GLDATK

SEQ ID NO: 2259946 - protein, 18 aa, Cryptosporidium parvum
GLDDEDKNLITSRKPHGK

SEQ ID NO: 2259947 - protein, 13 aa, Cryptosporidium parvum
GLDDTGKNAVRQT

SEQ ID NO: 2259948 - protein, 10 aa, Cryptosporidium parvum
GLDHSDQETF

SEQ ID NO: 2259949 - protein, 14 aa, Cryptosporidium parvum
GLDNTIPNNSTPGN

SEQ ID NO: 2259950 - protein, 7 aa, Cryptosporidium parvum
GLDPNSE

SEQ ID NO: 2259951 - protein, 5 aa, Cryptosporidium parvum
GLDQT

SEQ ID NO: 2259952 - protein, 10 aa, Cryptosporidium parvum
GLDSGFSNDT

SEQ ID NO: 2259953 - protein, 4 aa, Cryptosporidium parvum
GLEE

SEQ ID NO: 2259954 - protein, 13 aa, Cryptosporidium parvum
GLEGESNENGGKI

SEQ ID NO: 2259955 - protein, 4 aa, Cryptosporidium parvum
GLEN

SEQ ID NO: 2259956 - protein, 4 aa, Cryptosporidium parvum
GLER

SEQ ID NO: 2259957 - protein, 7 aa, Cryptosporidium parvum
GLGDDEK

SEQ ID NO: 2259958 - protein, 12 aa, Cryptosporidium parvum
GLGGSDRGGAAA

SEQ ID NO: 2259959 - protein, 4 aa, Cryptosporidium parvum
GLGN

SEQ ID NO: 2259960 - protein, 15 aa, Cryptosporidium parvum
GLGNFGQTNYSAANS

SEQ ID NO: 2259961 - protein, 6 aa, Cryptosporidium parvum
GLGPNG

SEQ ID NO: 2259962 - protein, 6 aa, Cryptosporidium parvum
GLGRTG

SEQ ID NO: 2259963 - protein, 11 aa, Cryptosporidium parvum
GLKEKKDNQIF

SEQ ID NO: 2259964 - protein, 4 aa, Cryptosporidium parvum
GLKG

SEQ ID NO: 2259965 - protein, 9 aa, Cryptosporidium parvum
GLKGDDPLK

SEQ ID NO: 2259966 - protein, 12 aa, Cryptosporidium parvum
GLKIGRNSDCDF

SEQ ID NO: 2259967 - protein, 9 aa, Cryptosporidium parvum
GLKKNNGLD

SEQ ID NO: 2259968 - protein, 8 aa, Cryptosporidium parvum
GLKNKFDG

SEQ ID NO: 2259969 - protein, 7 aa, Cryptosporidium parvum
GLKNSGY

SEQ ID NO: 2259970 - protein, 36 aa, Cryptosporidium parvum
GLKPNSSSERLSPNIEEGSRGRTKFQGNHHSRAATR

SEQ ID NO: 2259971 - protein, 61 aa, Cryptosporidium parvum
GLKPPKRKKTIEQAIGTSEEKAQVNDKTKKKKGSKSNDDTEGSDKPPQVANDDMRFAAKMV

SEQ ID NO: 2259972 - protein, 6 aa, Cryptosporidium parvum
GLKSSE

SEQ ID NO: 2259973 - protein, 6 aa, Cryptosporidium parvum
GLKSVT

SEQ ID NO: 2259974 - protein, 11 aa, Cryptosporidium parvum
GLNDNTDPSSL

SEQ ID NO: 2259975 - protein, 5 aa, Cryptosporidium parvum
GLNDT

SEQ ID NO: 2259976 - protein, 9 aa, Cryptosporidium parvum
GLNESIGRD

SEQ ID NO: 2259977 - protein, 10 aa, Cryptosporidium parvum
GLNGSGKSNI

SEQ ID NO: 2259978 - protein, 26 aa, Cryptosporidium parvum
GLNNGSKMNSNSIRDSQKEAEKRAEI

SEQ ID NO: 2259979 - protein, 11 aa, Cryptosporidium parvum
GLNNSNIGQTT

SEQ ID NO: 2259980 - protein, 7 aa, Cryptosporidium parvum
GLNPQNL

SEQ ID NO: 2259981 - protein, 25 aa, Cryptosporidium parvum
GLNSSNNDDEPNNNKNSSNNFGNNT

SEQ ID NO: 2259982 - protein, 9 aa, Cryptosporidium parvum
GLPKTKPID

SEQ ID NO: 2259983 - protein, 12 aa, Cryptosporidium parvum
GLPPKPAETSLK

SEQ ID NO: 2259984 - protein, 5 aa, Cryptosporidium parvum
GLPPQ

SEQ ID NO: 2259985 - protein, 6 aa, Cryptosporidium parvum
GLPSKI

SEQ ID NO: 2259986 - protein, 9 aa, Cryptosporidium parvum
GLPSQTPLN

SEQ ID NO: 2259987 - protein, 6 aa, Cryptosporidium parvum
GLQDPR

SEQ ID NO: 2259988 - protein, 5 aa, Cryptosporidium parvum
GLQEI

SEQ ID NO: 2259989 - protein, 12 aa, Cryptosporidium parvum
GLQNSQSNIGNT

SEQ ID NO: 2259990 - protein, 12 aa, Cryptosporidium parvum
GLQQNKDNFSKF

SEQ ID NO: 2259991 - protein, 8 aa, Cryptosporidium parvum
GLRKPSNS

SEQ ID NO: 2259992 - protein, 9 aa, Cryptosporidium parvum
GLRSYSDEE

SEQ ID NO: 2259993 - protein, 8 aa, Cryptosporidium parvum
GLSAQGPN

SEQ ID NO: 2259994 - protein, 11 aa, Cryptosporidium parvum
GLSDKDTGTIS

SEQ ID NO: 2259995 - protein, 8 aa, Cryptosporidium parvum
GLSDTEIR

SEQ ID NO: 2259996 - protein, 12 aa, Cryptosporidium parvum
GLSEDDSKLDPV

SEQ ID NO: 2259997 - protein, 10 aa, Cryptosporidium parvum
GLSGGESKDS

SEQ ID NO: 2259998 - protein, 12 aa, Cryptosporidium parvum
GLSKGKPTERGI

SEQ ID NO: 2259999 - protein, 9 aa, Cryptosporidium parvum
GLSKTSEEF

SEQ ID NO: 2260000 - protein, 6 aa, Cryptosporidium parvum
GLSNDG

SEQ ID NO: 2260001 - protein, 16 aa, Cryptosporidium parvum
GLSNNNNNNSTEGSQP

SEQ ID NO: 2260002 - protein, 6 aa, Cryptosporidium parvum
GLSPGA

SEQ ID NO: 2260003 - protein, 7 aa, Cryptosporidium parvum
GLSPKRS

SEQ ID NO: 2260004 - protein, 7 aa, Cryptosporidium parvum
GLSSDSW

SEQ ID NO: 2260005 - protein, 17 aa, Cryptosporidium parvum
GLSSEEMQQRQIEGKSY

SEQ ID NO: 2260006 - protein, 5 aa, Cryptosporidium parvum
GLSSN

SEQ ID NO: 2260007 - protein, 7 aa, Cryptosporidium parvum
GLSSTPE

SEQ ID NO: 2260008 - protein, 13 aa, Cryptosporidium parvum
GLSSTSSNTVGPI

SEQ ID NO: 2260009 - protein, 10 aa, Cryptosporidium parvum
GLSTGSQIRN

SEQ ID NO: 2260010 - protein, 24 aa, Cryptosporidium parvum
GLSTNSRNSKQALGRGGVDQSGIG

SEQ ID NO: 2260011 - protein, 7 aa, Cryptosporidium parvum
GLSTSGF

SEQ ID NO: 2260012 - protein, 12 aa, Cryptosporidium parvum
GLTEGSNKADIR

SEQ ID NO: 2260013 - protein, 4 aa, Cryptosporidium parvum
GLTK

SEQ ID NO: 2260014 - protein, 16 aa, Cryptosporidium parvum
GLTKSTEIKENISANQ

SEQ ID NO: 2260015 - protein, 31 aa, Cryptosporidium parvum; identical to SEQ ID NO: 2143492

SEQ ID NO: 2260016 - protein, 8 aa, Cryptosporidium parvum
GLTRGSYD

SEQ ID NO: 2260017 - protein, 11 aa, Cryptosporidium parvum
GLTSKSNSNIC

SEQ ID NO: 2260018 - protein, 11 aa, Cryptosporidium parvum
GLTSSSSTNSL

SEQ ID NO: 2260019 - protein, 14 aa, Cryptosporidium parvum
GLVTKSEQKKKGKM

SEQ ID NO: 2260020 - protein, 4 aa, Cryptosporidium parvum
GMAS

SEQ ID NO: 2260021 - protein, 4 aa, Cryptosporidium parvum
GMDN

SEQ ID NO: 2260022 - protein, 5 aa, Cryptosporidium parvum
GMDNK

SEQ ID NO: 2260023 - protein, 10 aa, Cryptosporidium parvum
GMEKNGQNLN

SEQ ID NO: 2260024 - protein, 9 aa, Cryptosporidium parvum
GMGQEQNSQ

SEQ ID NO: 2260025 - protein, 9 aa, Cryptosporidium parvum
GMGTDVKPD

SEQ ID NO: 2260026 - protein, 28 aa, Cryptosporidium parvum
GMKEHKSDIDSGDSSKSDNYSKANQEKF

SEQ ID NO: 2260027 - protein, 27 aa, Cryptosporidium parvum
GMKNNRKSKNNGKDEKKKLESAPPPME

SEQ ID NO: 2260028 - protein, 8 aa, Cryptosporidium parvum
GMKSKSCP

SEQ ID NO: 2260029 - protein, 8 aa, Cryptosporidium parvum
GMSGPAEF

SEQ ID NO: 2260030 - protein, 8 aa, Cryptosporidium parvum
GMSVSTSG

SEQ ID NO: 2260031 - protein, 4 aa, Cryptosporidium parvum
GMTR

SEQ ID NO: 2260032 - protein, 6 aa, Cryptosporidium parvum
GMTREN

SEQ ID NO: 2260033 - protein, 15 aa, Cryptosporidium parvum
GNAARDAKKTRITPR

SEQ ID NO: 2260034 - protein, 26 aa, Cryptosporidium parvum
GNAKTTSGTIGGEIGDSVDSTESGSH

SEQ ID NO: 2260035 - protein, 10 aa, Cryptosporidium parvum
GNALKKSYGH

SEQ ID NO: 2260036 - protein, 14 aa, Cryptosporidium parvum
GNANTEINNGDSGF

SEQ ID NO: 2260037 - protein, 9 aa, Cryptosporidium parvum
GNAPTGSGK

SEQ ID NO: 2260038 - protein, 7 aa, Cryptosporidium parvum
GNASKDL

SEQ ID NO: 2260039 - protein, 6 aa, Cryptosporidium parvum
GNATGK

SEQ ID NO: 2260040 - protein, 11 aa, Cryptosporidium parvum
GNAVPTNPRNC

SEQ ID NO: 2260041 - protein, 8 aa, Cryptosporidium parvum
GNCAPTDE

SEQ ID NO: 2260042 - protein, 7 aa, Cryptosporidium parvum
GNCESES

SEQ ID NO: 2260043 - protein, 5 aa, Cryptosporidium parvum
GNCSR

SEQ ID NO: 2260044 - protein, 7 aa, Cryptosporidium parvum
GNDDDTL

SEQ ID NO: 2260045 - protein, 4 aa, Cryptosporidium parvum
GNDE

SEQ ID NO: 2260046 - protein, 11 aa, Cryptosporidium parvum
GNDGLDGIEGL

SEQ ID NO: 2260047 - protein, 8 aa, Cryptosporidium parvum
GNDGTYKS

SEQ ID NO: 2260048 - protein, 4 aa, Cryptosporidium parvum
GNDI

SEQ ID NO: 2260049 - protein, 6 aa, Cryptosporidium parvum
GNDKLQ

SEQ ID NO: 2260050 - protein, 10 aa, Cryptosporidium parvum
GNDKVSDERR

SEQ ID NO: 2260051 - protein, 14 aa, Cryptosporidium parvum
GNDLKEGTVEKVEG

SEQ ID NO: 2260052 - protein, 26 aa, Cryptosporidium parvum
GNDNYNDDDDYDYNDNNNNSNNDSFI

SEQ ID NO: 2260053 - protein, 13 aa, Cryptosporidium parvum
GNDQSSQSPKNSA

SEQ ID NO: 2260054 - protein, 7 aa, Cryptosporidium parvum
GNDQTTE

SEQ ID NO: 2260055 - protein, 26 aa, Cryptosporidium parvum
GNDSKSARNSENSRRLDGKSDNQVSP

SEQ ID NO: 2260056 - protein, 9 aa, Cryptosporidium parvum
GNDSNNSRN

SEQ ID NO: 2260057 - protein, 17 aa, Cryptosporidium parvum
GNDSNTKQTGSNDKKLI

SEQ ID NO: 2260058 - protein, 4 aa, Cryptosporidium parvum
GNDT

SEQ ID NO: 2260059 - protein, 8 aa, Cryptosporidium parvum
GNDYANDD

SEQ ID NO: 2260060 - protein, 4 aa, Cryptosporidium parvum
GNED

SEQ ID NO: 2260061 - protein, 7 aa, Cryptosporidium parvum
GNEDIGT

SEQ ID NO: 2260062 - protein, 6 aa, Cryptosporidium parvum
GNEDSS

SEQ ID NO: 2260063 - protein, 13 aa, Cryptosporidium parvum
GNEEFASSIGNHE

SEQ ID NO: 2260064 - protein, 8 aa, Cryptosporidium parvum
GNEEGGLK

SEQ ID NO: 2260065 - protein, 5 aa, Cryptosporidium parvum
GNEES

SEQ ID NO: 2260066 - protein, 7 aa, Cryptosporidium parvum
GNEGSGR

SEQ ID NO: 2260067 - protein, 12 aa, Cryptosporidium parvum
GNEKVTQSYNED

SEQ ID NO: 2260068 - protein, 6 aa, Cryptosporidium parvum
GNELYK

SEQ ID NO: 2260069 - protein, 5 aa, Cryptosporidium parvum
GNEMV

SEQ ID NO: 2260070 - protein, 4 aa, Cryptosporidium parvum
GNEN

SEQ ID NO: 2260071 - protein, 21 aa, Cryptosporidium parvum
GNENRKKKVNLKTSNNQNGIK

SEQ ID NO: 2260072 - protein, 8 aa, Cryptosporidium parvum
GNEPVSSC

SEQ ID NO: 2260073 - protein, 4 aa, Cryptosporidium parvum
GNEQ

SEQ ID NO: 2260074 - protein, 5 aa, Cryptosporidium parvum
GNESF

SEQ ID NO: 2260075 - protein, 8 aa, Cryptosporidium parvum
GNESLIGN

SEQ ID NO: 2260076 - protein, 11 aa, Cryptosporidium parvum
GNESQPEEEEA

SEQ ID NO: 2260077 - protein, 24 aa, Cryptosporidium parvum
GNESQVEKSKTLLNNSDNSEFGNV

SEQ ID NO: 2260078 - protein, 32 aa, Cryptosporidium parvum
GNESSAGVYDTEKGVDKKSDYKAAKRKKENDM

SEQ ID NO: 2260079 - protein, 6 aa, Cryptosporidium parvum
GNETEE

SEQ ID NO: 2260080 - protein, 16 aa, Cryptosporidium parvum
GNETTSNINNSNPGNN

SEQ ID NO: 2260081 - protein, 16 aa, Cryptosporidium parvum
GNFDKSEEGASFRSED

SEQ ID NO: 2260082 - protein, 13 aa, Cryptosporidium parvum
GNFNDETSIEKKE

SEQ ID NO: 2260083 - protein, 13 aa, Cryptosporidium parvum
GNFSSASQCSKGE

SEQ ID NO: 2260084 - protein, 11 aa, Cryptosporidium parvum
GNGASTSPQNL

SEQ ID NO: 2260085 - protein, 9 aa, Cryptosporidium parvum
GNGEEPKSA

SEQ ID NO: 2260086 - protein, 11 aa, Cryptosporidium parvum
GNGESQGADSW

SEQ ID NO: 2260087 - protein, 11 aa, Cryptosporidium parvum
GNGFTKSINGN

SEQ ID NO: 2260088 - protein, 4 aa, Cryptosporidium parvum
GNGG

SEQ ID NO: 2260089 - protein, 10 aa, Cryptosporidium parvum
GNGNLSGIQS

SEQ ID NO: 2260090 - protein, 14 aa, Cryptosporidium parvum
GNGNPGRSGSINRV

SEQ ID NO: 2260091 - protein, 5 aa, Cryptosporidium parvum
GNGNR

SEQ ID NO: 2260092 - protein, 9 aa, Cryptosporidium parvum
GNGNTMSEA

SEQ ID NO: 2260093 - protein, 9 aa, Cryptosporidium parvum
GNGQERSDL

SEQ ID NO: 2260094 - protein, 9 aa, Cryptosporidium parvum
GNGSFPASS

SEQ ID NO: 2260095 - protein, 18 aa, Cryptosporidium parvum
GNGSGASETASNHPQEEV

SEQ ID NO: 2260096 - protein, 7 aa, Cryptosporidium parvum
GNGSKEY

SEQ ID NO: 2260097 - protein, 10 aa, Cryptosporidium parvum
GNGSRSKAFR

SEQ ID NO: 2260098 - protein, 36 aa, Cryptosporidium parvum; identical to SEQ ID NO: 2143567

SEQ ID NO: 2260099 - protein, 7 aa, Cryptosporidium parvum
GNHETKN

SEQ ID NO: 2260100 - protein, 9 aa, Cryptosporidium parvum
GNHTHQESL

SEQ ID NO: 2260101 - protein, 6 aa, Cryptosporidium parvum
GNIDYN

SEQ ID NO: 2260102 - protein, 6 aa, Cryptosporidium parvum
GNIEDS

SEQ ID NO: 2260103 - protein, 5 aa, Cryptosporidium parvum
GNIGQ

SEQ ID NO: 2260104 - protein, 7 aa, Cryptosporidium parvum
GNIGTTV

SEQ ID NO: 2260105 - protein, 4 aa, Cryptosporidium parvum
GNIN

SEQ ID NO: 2260106 - protein, 31 aa, Cryptosporidium parvum
GNINTQGSNPVTSSSSGGENAKKETESLANN

SEQ ID NO: 2260107 - protein, 4 aa, Cryptosporidium parvum
GNIP

SEQ ID NO: 2260108 - protein, 5 aa, Cryptosporidium parvum
GNIPT

SEQ ID NO: 2260109 - protein, 14 aa, Cryptosporidium parvum
GNIQESAVEDSITN

SEQ ID NO: 2260110 - protein, 16 aa, Cryptosporidium parvum
GNISRSSKDVSESSHE

SEQ ID NO: 2260111 - protein, 18 aa, Cryptosporidium parvum
GNISSSGSSNYGSISSPK

SEQ ID NO: 2260112 - protein, 4 aa, Cryptosporidium parvum
GNKD

SEQ ID NO: 2260113 - protein, 7 aa, Cryptosporidium parvum
GNKDAEF

SEQ ID NO: 2260114 - protein, 7 aa, Cryptosporidium parvum
GNKDLTD

SEQ ID NO: 2260115 - protein, 5 aa, Cryptosporidium parvum
GNKDN

SEQ ID NO: 2260116 - protein, 8 aa, Cryptosporidium parvum
GNKEIRKQ

SEQ ID NO: 2260117 - protein, 10 aa, Cryptosporidium parvum
GNKGPGDTDI

SEQ ID NO: 2260118 - protein, 5 aa, Cryptosporidium parvum
GNKGY

SEQ ID NO: 2260119 - protein, 4 aa, Cryptosporidium parvum
GNKI

SEQ ID NO: 2260120 - protein, 19 aa, Cryptosporidium parvum
GNKINEGNMNNSNFDGNSS

SEQ ID NO: 2260121 - protein, 10 aa, Cryptosporidium parvum
GNKLKPGSKF

SEQ ID NO: 2260122 - protein, 8 aa, Cryptosporidium parvum
GNKQKPSL

SEQ ID NO: 2260123 - protein, 7 aa, Cryptosporidium parvum
GNKSGTH

SEQ ID NO: 2260124 - protein, 9 aa, Cryptosporidium parvum
GNKSRFTGQ

SEQ ID NO: 2260125 - protein, 21 aa, Cryptosporidium parvum
GNKSSSGTSRYQNAISQSRKK

SEQ ID NO: 2260126 - protein, 12 aa, Cryptosporidium parvum
GNKTSKNNTRNE

SEQ ID NO: 2260127 - protein, 6 aa, Cryptosporidium parvum
GNKVET

SEQ ID NO: 2260128 - protein, 26 aa, Cryptosporidium parvum
GNLDNSSIRKRSFNASENVENTPKKR

SEQ ID NO: 2260129 - protein, 4 aa, Cryptosporidium parvum
GNLE

SEQ ID NO: 2260130 - protein, 4 aa, Cryptosporidium parvum
GNLF

SEQ ID NO: 2260131 - protein, 4 aa, Cryptosporidium parvum
GNLG

SEQ ID NO: 2260132 - protein, 7 aa, Cryptosporidium parvum
GNLKDNR

SEQ ID NO: 2260133 - protein, 14 aa, Cryptosporidium parvum
GNLKNENSSQTQPT

SEQ ID NO: 2260134 - protein, 17 aa, Cryptosporidium parvum
GNLKRSRKLTQIEQEHS

SEQ ID NO: 2260135 - protein, 7 aa, Cryptosporidium parvum
GNLNSKT

SEQ ID NO: 2260136 - protein, 4 aa, Cryptosporidium parvum
GNLP

SEQ ID NO: 2260137 - protein, 14 aa, Cryptosporidium parvum
GNLSSNNNKLNVST

SEQ ID NO: 2260138 - protein, 6 aa, Cryptosporidium parvum
GNLSTT

SEQ ID NO: 2260139 - protein, 10 aa, Cryptosporidium parvum
GNLTRNNGER

SEQ ID NO: 2260140 - protein, 8 aa, Cryptosporidium parvum
GNLTTKPV

SEQ ID NO: 2260141 - protein, 13 aa, Cryptosporidium parvum
GNMNNNNNSNNNG

SEQ ID NO: 2260142 - protein, 6 aa, Cryptosporidium parvum
GNMQPT

SEQ ID NO: 2260143 - protein, 30 aa, Cryptosporidium parvum
GNMSTSSSLPNGGDAQTVSRAEDDQSSIGE

SEQ ID NO: 2260144 - protein, 7 aa, Cryptosporidium parvum
GNMTNSR

SEQ ID NO: 2260145 - protein, 7 aa, Cryptosporidium parvum
GNNATLD

SEQ ID NO: 2260146 - protein, 22 aa, Cryptosporidium parvum
GNNDGKSLNRSKNDEVSSFSRG

SEQ ID NO: 2260147 - protein, 10 aa, Cryptosporidium parvum
GNNEKSPTTP

SEQ ID NO: 2260148 - protein, 13 aa, Cryptosporidium parvum
GNNEKYDQGINED

SEQ ID NO: 2260149 - protein, 8 aa, Cryptosporidium parvum
GNNETNEG

SEQ ID NO: 2260150 - protein, 5 aa, Cryptosporidium parvum
GNNFD

SEQ ID NO: 2260151 - protein, 16 aa, Cryptosporidium parvum
GNNIKSSQDNQNQKKS

SEQ ID NO: 2260152 - protein, 6 aa, Cryptosporidium parvum
GNNKDF

SEQ ID NO: 2260153 - protein, 12 aa, Cryptosporidium parvum
GNNKELNGPIET

SEQ ID NO: 2260154 - protein, 5 aa, Cryptosporidium parvum
GNNKG

SEQ ID NO: 2260155 - protein, 12 aa, Cryptosporidium parvum
GNNMSADNKSEL

SEQ ID NO: 2260156 - protein, 8 aa, Cryptosporidium parvum
GNNNMSST

SEQ ID NO: 2260157 - protein, 26 aa, Cryptosporidium parvum
GNNNNSNNNNTNNSNTGTNNSSYNGL

SEQ ID NO: 2260158 - protein, 7 aa, Cryptosporidium parvum
GNNPAIQ

SEQ ID NO: 2260159 - protein, 7 aa, Cryptosporidium parvum
GNNPGQI

SEQ ID NO: 2260160 - protein, 8 aa, Cryptosporidium parvum
GNNPQKME

SEQ ID NO: 2260161 - protein, 43 aa, Cryptosporidium parvum
GNNPVQSSPMNTGSPFGASLGGAAPPPPPPPPPPPGIRRYPGV

SEQ ID NO: 2260162 - protein, 5 aa, Cryptosporidium parvum
GNNRD

SEQ ID NO: 2260163 - protein, 4 aa, Cryptosporidium parvum
GNNS

SEQ ID NO: 2260164 - protein, 23 aa, Cryptosporidium parvum
GNNSEPSDIKFGSNKQETIPPES

SEQ ID NO: 2260165 - protein, 6 aa, Cryptosporidium parvum
GNNSKC

SEQ ID NO: 2260166 - protein, 5 aa, Cryptosporidium parvum
GNNSL

SEQ ID NO: 2260167 - protein, 7 aa, Cryptosporidium parvum
GNNSNIS

SEQ ID NO: 2260168 - protein, 8 aa, Cryptosporidium parvum
GNNTAAQE

SEQ ID NO: 2260169 - protein, 12 aa, Cryptosporidium parvum
GNNTGQHQQLRP

SEQ ID NO: 2260170 - protein, 5 aa, Cryptosporidium parvum
GNNTI

SEQ ID NO: 2260171 - protein, 12 aa, Cryptosporidium parvum
GNNVGKGEGRVG

SEQ ID NO: 2260172 - protein, 11 aa, Cryptosporidium parvum
GNPDEEKRSKM

SEQ ID NO: 2260173 - protein, 8 aa, Cryptosporidium parvum
GNPDELQE

SEQ ID NO: 2260174 - protein, 6 aa, Cryptosporidium parvum
GNPEGA

SEQ ID NO: 2260175 - protein, 5 aa, Cryptosporidium parvum
GNPFP

SEQ ID NO: 2260176 - protein, 18 aa, Cryptosporidium parvum
GNPGTGMGQIQGSSNALG

SEQ ID NO: 2260177 - protein, 4 aa, Cryptosporidium parvum
GNPI

SEQ ID NO: 2260178 - protein, 9 aa, Cryptosporidium parvum
GNPIDGKPS

SEQ ID NO: 2260179 - protein, 6 aa, Cryptosporidium parvum
GNPKQN

SEQ ID NO: 2260180 - protein, 8 aa, Cryptosporidium parvum
GNPKVDNV

SEQ ID NO: 2260181 - protein, 6 aa, Cryptosporidium parvum
GNPLDR

SEQ ID NO: 2260182 - protein, 10 aa, Cryptosporidium parvum
GNPLGNNNRQ

SEQ ID NO: 2260183 - protein, 6 aa, Cryptosporidium parvum
GNPLNK

SEQ ID NO: 2260184 - protein, 5 aa, Cryptosporidium parvum
GNPNE

SEQ ID NO: 2260185 - protein, 12 aa, Cryptosporidium parvum
GNPNIEADESLT

SEQ ID NO: 2260186 - protein, 6 aa, Cryptosporidium parvum
GNPQEK

SEQ ID NO: 2260187 - protein, 7 aa, Cryptosporidium parvum
GNPTTNN

SEQ ID NO: 2260188 - protein, 126 aa, Cryptosporidium parvum
GNPVPNSDEERSLGIDQESYSEISAPQKPKIEGKEETGYGQGLNKEQDQNLEQDQEQDHVQEQDQEQEQEQEQEQEQEQDQDQDQDREQEQDQEGAASERIEGKTYSQKTDGDASSVVTQTSQNAV

SEQ ID NO: 2260189 - protein, 19 aa, Cryptosporidium parvum
GNPYDKKNNLKRDKSDHAY

SEQ ID NO: 2260190 - protein, 5 aa, Cryptosporidium parvum
GNQEL

SEQ ID NO: 2260191 - protein, 14 aa, Cryptosporidium parvum
GNQGNKQTNIASNS

SEQ ID NO: 2260192 - protein, 29 aa, Cryptosporidium parvum
  misc_feature (13)..(13): Xaa can be any naturally occurring amino acid
GNQINKGGKNMEXSLNLMNKENNSLDTIS

SEQ ID NO: 2260193 - protein, 11 aa, Cryptosporidium parvum
GNQLNEQQLED

SEQ ID NO: 2260194 - protein, 8 aa, Cryptosporidium parvum
GNQNIPSK

SEQ ID NO: 2260195 - protein, 6 aa, Cryptosporidium parvum
GNQNIT

SEQ ID NO: 2260196 - protein, 10 aa, Cryptosporidium parvum
GNQSQRLSIP

SEQ ID NO: 2260197 - protein, 4 aa, Cryptosporidium parvum
GNQT

SEQ ID NO: 2260198 - protein, 62 aa, Cryptosporidium parvum
GNQTRNSSNTKKSSNKINVKKDKDKYKDKYKDKSNSNNYPISESETKTKIKPSNSHVIFSDS

SEQ ID NO: 2260199 - protein, 4 aa, Cryptosporidium parvum
GNQY

SEQ ID NO: 2260200 - protein, 7 aa, Cryptosporidium parvum
GNQYGRD

SEQ ID NO: 2260201 - protein, 4 aa, Cryptosporidium parvum
GNRD

SEQ ID NO: 2260202 - protein, 9 aa, Cryptosporidium parvum
GNRDTDYRS

SEQ ID NO: 2260203 - protein, 6 aa, Cryptosporidium parvum
GNRELK

SEQ ID NO: 2260204 - protein, 19 aa, Cryptosporidium parvum
GNREQENNQKNAELNDELS

SEQ ID NO: 2260205 - protein, 6 aa, Cryptosporidium parvum
GNRGNC

SEQ ID NO: 2260206 - protein, 4 aa, Cryptosporidium parvum
GNRS

SEQ ID NO: 2260207 - protein, 12 aa, Cryptosporidium parvum
GNRSCLGRNLIP

SEQ ID NO: 2260208 - protein, 9 aa, Cryptosporidium parvum
GNSAPPNAA

SEQ ID NO: 2260209 - protein, 60 aa, Cryptosporidium parvum
GNSARAKSISNQSGHFETNNEPESVEKRRENQSTAIPPPPLSPPPPPPSSTIKSAVTNRI

SEQ ID NO: 2260210 - protein, 8 aa, Cryptosporidium parvum
GNSDFTSD

SEQ ID NO: 2260211 - protein, 13 aa, Cryptosporidium parvum
GNSDGTSTKSRQE

SEQ ID NO: 2260212 - protein, 6 aa, Cryptosporidium parvum
GNSEDF

SEQ ID NO: 2260213 - protein, 19 aa, Cryptosporidium parvum
GNSESSGTKLTPQHARNGH

SEQ ID NO: 2260214 - protein, 5 aa, Cryptosporidium parvum
GNSFS

SEQ ID NO: 2260215 - protein, 11 aa, Cryptosporidium parvum
GNSFSESPDND

SEQ ID NO: 2260216 - protein, 4 aa, Cryptosporidium parvum
GNSG

SEQ ID NO: 2260217 - protein, 24 aa, Cryptosporidium parvum
GNSGGIDELKQSGHSSSNPKLTGI

SEQ ID NO: 2260218 - protein, 11 aa, Cryptosporidium parvum
GNSGKLKHRGE

SEQ ID NO: 2260219 - protein, 19 aa, Cryptosporidium parvum
GNSGQENKKLEDKNKTSNL

SEQ ID NO: 2260220 - protein, 19 aa, Cryptosporidium parvum
GNSHFSTYNGGGVSGIGNG

SEQ ID NO: 2260221 - protein, 6 aa, Cryptosporidium parvum
GNSHGF

SEQ ID NO: 2260222 - protein, 10 aa, Cryptosporidium parvum
GNSHSRTHGY

SEQ ID NO: 2260223 - protein, 6 aa, Cryptosporidium parvum
GNSKEF

SEQ ID NO: 2260224 - protein, 9 aa, Cryptosporidium parvum
GNSKKEAYD

SEQ ID NO: 2260225 - protein, 36 aa, Cryptosporidium parvum
GNSKRKGRSITRKKANNLVPNKANSCTINEDNTSFK

SEQ ID NO: 2260226 - protein, 10 aa, Cryptosporidium parvum
GNSKSKMAGK

SEQ ID NO: 2260227 - protein, 15 aa, Cryptosporidium parvum
GNSLSSSGSTDSLNL

SEQ ID NO: 2260228 - protein, 18 aa, Cryptosporidium parvum
GNSNDDTGRDEEDEKDLE

SEQ ID NO: 2260229 - protein, 8 aa, Cryptosporidium parvum
GNSNNSNI

SEQ ID NO: 2260230 - protein, 39 aa, Cryptosporidium parvum; identical to SEQ ID NO: 2143677

SEQ ID NO: 2260231 - protein, 5 aa, Cryptosporidium parvum
GNSNR

SEQ ID NO: 2260232 - protein, 8 aa, Cryptosporidium parvum
GNSNSESM

SEQ ID NO: 2260233 - protein, 9 aa, Cryptosporidium parvum
GNSQDPSQV

SEQ ID NO: 2260234 - protein, 10 aa, Cryptosporidium parvum
GNSQENSSSI

SEQ ID NO: 2260235 - protein, 12 aa, Cryptosporidium parvum
GNSQSYDQQRDE

SEQ ID NO: 2260236 - protein, 4 aa, Cryptosporidium parvum
GNSR

SEQ ID NO: 2260237 - protein, 20 aa, Cryptosporidium parvum
GNSSFSNNSNNNNSSNNNNI

SEQ ID NO: 2260238 - protein, 5 aa, Cryptosporidium parvum
GNSSI

SEQ ID NO: 2260239 - protein, 14 aa, Cryptosporidium parvum
GNSSKKNSESRYFT

SEQ ID NO: 2260240 - protein, 12 aa, Cryptosporidium parvum
GNSSKYRRHSSL

SEQ ID NO: 2260241 - protein, 8 aa, Cryptosporidium parvum
GNSSLESG

SEQ ID NO: 2260242 - protein, 9 aa, Cryptosporidium parvum
GNSSNSIEP

SEQ ID NO: 2260243 - protein, 15 aa, Cryptosporidium parvum
GNSSTNACVSTGTSL

SEQ ID NO: 2260244 - protein, 8 aa, Cryptosporidium parvum
GNSSYNYQ

SEQ ID NO: 2260245 - protein, 4 aa, Cryptosporidium parvum
GNST

SEQ ID NO: 2260246 - protein, 8 aa, Cryptosporidium parvum
GNSTHQSN

SEQ ID NO: 2260247 - protein, 8 aa, Cryptosporidium parvum
GNSTNKTG

SEQ ID NO: 2260248 - protein, 19 aa, Cryptosporidium parvum
GNSTNNRNDGNSNSDNNVN

SEQ ID NO: 2260249 - protein, 9 aa, Cryptosporidium parvum
GNSTPNSSI

SEQ ID NO: 2260250 - protein, 7 aa, Cryptosporidium parvum
GNSTSND

SEQ ID NO: 2260251 - protein, 7 aa, Cryptosporidium parvum
GNSVNTR

SEQ ID NO: 2260252 - protein, 10 aa, Cryptosporidium parvum
GNSYSGSSTH

SEQ ID NO: 2260253 - protein, 23 aa, Cryptosporidium parvum
GNTAHIPGKTPVPFNPPQQPPQN

SEQ ID NO: 2260254 - protein, 6 aa, Cryptosporidium parvum
GNTERF

SEQ ID NO: 2260255 - protein, 9 aa, Cryptosporidium parvum
GNTNDYAEN

SEQ ID NO: 2260256 - protein, 16 aa, Cryptosporidium parvum
GNTNEKGEYTTNYNPI

SEQ ID NO: 2260257 - protein, 10 aa, Cryptosporidium parvum
GNTNGSLNTP

SEQ ID NO: 2260258 - protein, 12 aa, Cryptosporidium parvum
GNTNHKKISESI

SEQ ID NO: 2260259 - protein, 6 aa, Cryptosporidium parvum
GNTQSY

SEQ ID NO: 2260260 - protein, 12 aa, Cryptosporidium parvum
GNTRIYDTPNRH

SEQ ID NO: 2260261 - protein, 13 aa, Cryptosporidium parvum
GNTSGDDRDRQIS

SEQ ID NO: 2260262 - protein, 9 aa, Cryptosporidium parvum
GNTSNDNSD

SEQ ID NO: 2260263 - protein, 9 aa, Cryptosporidium parvum
GNTSNGRGY

SEQ ID NO: 2260264 - protein, 4 aa, Cryptosporidium parvum
GNVC

SEQ ID NO: 2260265 - protein, 5 aa, Cryptosporidium parvum
GNVGS

SEQ ID NO: 2260266 - protein, 5 aa, Cryptosporidium parvum
GNVKT

SEQ ID NO: 2260267 - protein, 6 aa, Cryptosporidium parvum
GNVPQS

SEQ ID NO: 2260268 - protein, 4 aa, Cryptosporidium parvum
GNVS

SEQ ID NO: 2260269 - protein, 12 aa, Cryptosporidium parvum
GNWGKDKDGKII

SEQ ID NO: 2260270 - protein, 14 aa, Cryptosporidium parvum
GNYEKGSTKDESFP

SEQ ID NO: 2260271 - protein, 11 aa, Cryptosporidium parvum
GNYESDRNNDI

SEQ ID NO: 2260272 - protein, 5 aa, Cryptosporidium parvum
GNYNN

SEQ ID NO: 2260273 - protein, 10 aa, Cryptosporidium parvum
GNYQNSDISV

SEQ ID NO: 2260274 - protein, 8 aa, Cryptosporidium parvum
GPASSGRT

SEQ ID NO: 2260275 - protein, 5 aa, Cryptosporidium parvum
GPCVD

SEQ ID NO: 2260276 - protein, 9 aa, Cryptosporidium parvum
GPDDSSYAG

SEQ ID NO: 2260277 - protein, 34 aa, Cryptosporidium parvum
GPDEIISSKGKDRYSVGGDSISSIDSSSSAISRS

SEQ ID NO: 2260278 - protein, 6 aa, Cryptosporidium parvum
GPDKPW

SEQ ID NO: 2260279 - protein, 4 aa, Cryptosporidium parvum
GPDN

SEQ ID NO: 2260280 - protein, 8 aa, Cryptosporidium parvum
GPDNLSES

SEQ ID NO: 2260281 - protein, 5 aa, Cryptosporidium parvum
GPDVG

SEQ ID NO: 2260282 - protein, 7 aa, Cryptosporidium parvum
GPEDGIT

SEQ ID NO: 2260283 - protein, 10 aa, Cryptosporidium parvum
GPEEDLDENE

SEQ ID NO: 2260284 - protein, 4 aa, Cryptosporidium parvum
GPEG

SEQ ID NO: 2260285 - protein, 5 aa, Cryptosporidium parvum
GPEKT

SEQ ID NO: 2260286 - protein, 10 aa, Cryptosporidium parvum
GPEPGFKDHP

SEQ ID NO: 2260287 - protein, 8 aa, Cryptosporidium parvum
GPESSNSF

SEQ ID NO: 2260288 - protein, 4 aa, Cryptosporidium parvum
GPFG

SEQ ID NO: 2260289 - protein, 13 aa, Cryptosporidium parvum
GPFSDPKLHPNNG

SEQ ID NO: 2260290 - protein, 12 aa, Cryptosporidium parvum
GPFSPRKSKQPP

SEQ ID NO: 2260291 - protein, 10 aa, Cryptosporidium parvum
GPFSQSNHTS

SEQ ID NO: 2260292 - protein, 7 aa, Cryptosporidium parvum
GPGEKYG

SEQ ID NO: 2260293 - protein, 42 aa, Cryptosporidium parvum
GPGIPGGPGTPGGPGIPGGPSGPAMPGGPATPGGPSGPAKPV

SEQ ID NO: 2260294 - protein, 4 aa, Cryptosporidium parvum
GPGM

SEQ ID NO: 2260295 - protein, 45 aa, Cryptosporidium parvum
GPGNINNNNNNNNNNNNTNNSGNNNNNNNHNNLGNSVGNYTNTGV

SEQ ID NO: 2260296 - protein, 16 aa, Cryptosporidium parvum
GPGNNSTVHASHGGRV

SEQ ID NO: 2260297 - protein, 6 aa, Cryptosporidium parvum
GPGNVP

SEQ ID NO: 2260298 - protein, 5 aa, Cryptosporidium parvum
GPGQR

SEQ ID NO: 2260299 - protein, 10 aa, Cryptosporidium parvum
GPGSAPTSAP

SEQ ID NO: 2260300 - protein, 11 aa, Cryptosporidium parvum
GPGTGKTATLT

SEQ ID NO: 2260301 - protein, 7 aa, Cryptosporidium parvum
GPHPKSS

SEQ ID NO: 2260302 - protein, 18 aa, Cryptosporidium parvum
GPIKTKRLREDTSWIHPR

SEQ ID NO: 2260303 - protein, 4 aa, Cryptosporidium parvum
GPIS

SEQ ID NO: 2260304 - protein, 8 aa, Cryptosporidium parvum
GPKDTFWE

SEQ ID NO: 2260305 - protein, 9 aa, Cryptosporidium parvum
GPKSFSERA

SEQ ID NO: 2260306 - protein, 8 aa, Cryptosporidium parvum
GPKTMNSG

SEQ ID NO: 2260307 - protein, 14 aa, Cryptosporidium parvum
GPLDDRSDPSTTGY

SEQ ID NO: 2260308 - protein, 8 aa, Cryptosporidium parvum
GPLENDGS

SEQ ID NO: 2260309 - protein, 21 aa, Cryptosporidium parvum
GPLGMSPKKVGDDIAKGTAAW

SEQ ID NO: 2260310 - protein, 4 aa, Cryptosporidium parvum
GPLK

SEQ ID NO: 2260311 - protein, 9 aa, Cryptosporidium parvum
GPLKNEEEN

SEQ ID NO: 2260312 - protein, 5 aa, Cryptosporidium parvum
GPMDQ

SEQ ID NO: 2260313 - protein, 5 aa, Cryptosporidium parvum
GPMIG

SEQ ID NO: 2260314 - protein, 7 aa, Cryptosporidium parvum
GPNDHSI

SEQ ID NO: 2260315 - protein, 5 aa, Cryptosporidium parvum
GPNEY

SEQ ID NO: 2260316 - protein, 6 aa, Cryptosporidium parvum
GPNGGQ

SEQ ID NO: 2260317 - protein, 10 aa, Cryptosporidium parvum
GPNGSGKSNL

SEQ ID NO: 2260318 - protein, 10 aa, Cryptosporidium parvum
GPNGSGKSNV

SEQ ID NO: 2260319 - protein, 7 aa, Cryptosporidium parvum
GPNHPKV

SEQ ID NO: 2260320 - protein, 4 aa, Cryptosporidium parvum
GPNI

SEQ ID NO: 2260321 - protein, 14 aa, Cryptosporidium parvum
GPNKPYATVRDAEK

SEQ ID NO: 2260322 - protein, 12 aa, Cryptosporidium parvum
GPNKVESSTNGG

SEQ ID NO: 2260323 - protein, 8 aa, Cryptosporidium parvum
GPNMGGKS

SEQ ID NO: 2260324 - protein, 10 aa, Cryptosporidium parvum
GPNMGGKSTY

SEQ ID NO: 2260325 - protein, 7 aa, Cryptosporidium parvum
GPNSDRL

SEQ ID NO: 2260326 - protein, 11 aa, Cryptosporidium parvum
GPNSETSKSYY

SEQ ID NO: 2260327 - protein, 5 aa, Cryptosporidium parvum
GPNSI

SEQ ID NO: 2260328 - protein, 8 aa, Cryptosporidium parvum
GPNSNSMT

SEQ ID NO: 2260329 - protein, 9 aa, Cryptosporidium parvum
GPNSSISPG

SEQ ID NO: 2260330 - protein, 8 aa, Cryptosporidium parvum
GPNYPDEA

SEQ ID NO: 2260331 - protein, 9 aa, Cryptosporidium parvum
GPNYRSRHG

SEQ ID NO: 2260332 - protein, 6 aa, Cryptosporidium parvum
GPPDTL

SEQ ID NO: 2260333 - protein, 4 aa, Cryptosporidium parvum
GPPF

SEQ ID NO: 2260334 - protein, 6 aa, Cryptosporidium parvum
GPPFAT

SEQ ID NO: 2260335 - protein, 7 aa, Cryptosporidium parvum
GPPGCSK

SEQ ID NO: 2260336 - protein, 8 aa, Cryptosporidium parvum
GPPGSGKT

SEQ ID NO: 2260337 - protein, 9 aa, Cryptosporidium parvum
GPPGSGKTM

SEQ ID NO: 2260338 - protein, 8 aa, Cryptosporidium parvum
GPPGTGKS

SEQ ID NO: 2260339 - protein, 11 aa, Cryptosporidium parvum
GPPGTGKTLTA

SEQ ID NO: 2260340 - protein, 9 aa, Cryptosporidium parvum
GPPGTGKTS

SEQ ID NO: 2260341 - protein, 11 aa, Cryptosporidium parvum
GPPGTGKTSTI

SEQ ID NO: 2260342 - protein, 12 aa, Cryptosporidium parvum
GPPGTGKTTSAK

SEQ ID NO: 2260343 - protein, 7 aa, Cryptosporidium parvum
GPPGVGK

SEQ ID NO: 2260344 - protein, 6 aa, Cryptosporidium parvum
GPPPED

SEQ ID NO: 2260345 - protein, 16 aa, Cryptosporidium parvum
GPQKCDPETLHKGEES

SEQ ID NO: 2260346 - protein, 27 aa, Cryptosporidium parvum
GPQVPQNINGTGGPSGLAVTGSTGTIS

SEQ ID NO: 2260347 - protein, 8 aa, Cryptosporidium parvum
GPRASEKK

SEQ ID NO: 2260348 - protein, 11 aa, Cryptosporidium parvum
GPREGETKGRL

SEQ ID NO: 2260349 - protein, 6 aa, Cryptosporidium parvum
GPRNQS

SEQ ID NO: 2260350 - protein, 10 aa, Cryptosporidium parvum
GPRRTGRTTR

SEQ ID NO: 2260351 - protein, 5 aa, Cryptosporidium parvum
GPSDE

SEQ ID NO: 2260352 - protein, 9 aa, Cryptosporidium parvum
GPSGSGKTS

SEQ ID NO: 2260353 - protein, 11 aa, Cryptosporidium parvum
GPSKNRQQKSF

SEQ ID NO: 2260354 - protein, 10 aa, Cryptosporidium parvum
GPSKQSATIS

SEQ ID NO: 2260355 - protein, 7 aa, Cryptosporidium parvum
GPSKSRS

SEQ ID NO: 2260356 - protein, 6 aa, Cryptosporidium parvum
GPSLQR

SEQ ID NO: 2260357 - protein, 15 aa, Cryptosporidium parvum
GPSPSDIKKTAINQN

SEQ ID NO: 2260358 - protein, 10 aa, Cryptosporidium parvum
GPSQTIDTAC

SEQ ID NO: 2260359 - protein, 4 aa, Cryptosporidium parvum
GPSR

SEQ ID NO: 2260360 - protein, 6 aa, Cryptosporidium parvum
GPSSFS

SEQ ID NO: 2260361 - protein, 8 aa, Cryptosporidium parvum
GPSSWSET

SEQ ID NO: 2260362 - protein, 9 aa, Cryptosporidium parvum
GPSTNVARQ

SEQ ID NO: 2260363 - protein, 4 aa, Cryptosporidium parvum
GPTN

SEQ ID NO: 2260364 - protein, 5 aa, Cryptosporidium parvum
GPVAT

SEQ ID NO: 2260365 - protein, 5 aa, Cryptosporidium parvum
GPVRE

SEQ ID NO: 2260366 - protein, 7 aa, Cryptosporidium parvum
GPYISSE

SEQ ID NO: 2260367 - protein, 15 aa, Cryptosporidium parvum
GPYNEDESLGTEHSE

SEQ ID NO: 2260368 - protein, 5 aa, Cryptosporidium parvum
GPYTE

SEQ ID NO: 2260369 - protein, 6 aa, Cryptosporidium parvum
GQADAT

SEQ ID NO: 2260370 - protein, 13 aa, Cryptosporidium parvum
GQAEKDEDQTFPS

SEQ ID NO: 2260371 - protein, 9 aa, Cryptosporidium parvum
GQAFNSPAI

SEQ ID NO: 2260372 - protein, 10 aa, Cryptosporidium parvum
GQAPPQPQGI

SEQ ID NO: 2260373 - protein, 7 aa, Cryptosporidium parvum
GQAPTSI

SEQ ID NO: 2260374 - protein, 4 aa, Cryptosporidium parvum
GQAV

SEQ ID NO: 2260375 - protein, 8 aa, Cryptosporidium parvum
GQDGHDLG

SEQ ID NO: 2260376 - protein, 7 aa, Cryptosporidium parvum
GQDGRKR

SEQ ID NO: 2260377 - protein, 7 aa, Cryptosporidium parvum
GQDHYDR

SEQ ID NO: 2260378 - protein, 5 aa, Cryptosporidium parvum
GQDQE

SEQ ID NO: 2260379 - protein, 9 aa, Cryptosporidium parvum
GQDSPETCQ

SEQ ID NO: 2260380 - protein, 4 aa, Cryptosporidium parvum
GQDT

SEQ ID NO: 2260381 - protein, 8 aa, Cryptosporidium parvum
GQEISRNG

SEQ ID NO: 2260382 - protein, 13 aa, Cryptosporidium parvum
GQEKMSKSDTSSA

SEQ ID NO: 2260383 - protein, 6 aa, Cryptosporidium parvum
GQEKVE

SEQ ID NO: 2260384 - protein, 11 aa, Cryptosporidium parvum
GQEPRQTTSNI

SEQ ID NO: 2260385 - protein, 11 aa, Cryptosporidium parvum
GQERGMRSGTM

SEQ ID NO: 2260386 - protein, 4 aa, Cryptosporidium parvum
GQES

SEQ ID NO: 2260387 - protein, 9 aa, Cryptosporidium parvum
GQESSLNQS

SEQ ID NO: 2260388 - protein, 6 aa, Cryptosporidium parvum
GQFGNT

SEQ ID NO: 2260389 - protein, 8 aa, Cryptosporidium parvum
GQGDENQE

SEQ ID NO: 2260390 - protein, 4 aa, Cryptosporidium parvum
GQGG

SEQ ID NO: 2260391 - protein, 5 aa, Cryptosporidium parvum
GQGGI

SEQ ID NO: 2260392 - protein, 8 aa, Cryptosporidium parvum
GQGGRPFA

SEQ ID NO: 2260393 - protein, 9 aa, Cryptosporidium parvum
GQGISGNDS

SEQ ID NO: 2260394 - protein, 6 aa, Cryptosporidium parvum
GQGKDR

SEQ ID NO: 2260395 - protein, 15 aa, Cryptosporidium parvum
GQGLGFGGGTTSNFS

SEQ ID NO: 2260396 - protein, 8 aa, Cryptosporidium parvum
GQGTYGKV

SEQ ID NO: 2260397 - protein, 26 aa, Cryptosporidium parvum
GQHSSSNNNNNHNNSGNGISSSYGGV

SEQ ID NO: 2260398 - protein, 19 aa, Cryptosporidium parvum
GQHTKTTGRGSRAAAAAKK

SEQ ID NO: 2260399 - protein, 12 aa, Cryptosporidium parvum
GQIDDEEHISRE

SEQ ID NO: 2260400 - protein, 6 aa, Cryptosporidium parvum
GQIDQN

SEQ ID NO: 2260401 - protein, 5 aa, Cryptosporidium parvum
GQIGG

SEQ ID NO: 2260402 - protein, 5 aa, Cryptosporidium parvum
GQING

SEQ ID NO: 2260403 - protein, 16 aa, Cryptosporidium parvum
GQKAGTAPIQSQKPEV

SEQ ID NO: 2260404 - protein, 7 aa, Cryptosporidium parvum
GQKKGLF

SEQ ID NO: 2260405 - protein, 5 aa, Cryptosporidium parvum
GQKLD

SEQ ID NO: 2260406 - protein, 5 aa, Cryptosporidium parvum
GQKTI

SEQ ID NO: 2260407 - protein, 11 aa, Cryptosporidium parvum
GQKVKLDSTQG

SEQ ID NO: 2260408 - protein, 4 aa, Cryptosporidium parvum
GQLP

SEQ ID NO: 2260409 - protein, 10 aa, Cryptosporidium parvum
GQLPSKKSVQ

SEQ ID NO: 2260410 - protein, 10 aa, Cryptosporidium parvum
GQLRSEKSDN

SEQ ID NO: 2260411 - protein, 8 aa, Cryptosporidium parvum
GQNDGGLL

SEQ ID NO: 2260412 - protein, 6 aa, Cryptosporidium parvum
GQNEEA

SEQ ID NO: 2260413 - protein, 11 aa, Cryptosporidium parvum
GQNEKKYNAEM

SEQ ID NO: 2260414 - protein, 16 aa, Cryptosporidium parvum
GQNKAPMTPSTLSPAS

SEQ ID NO: 2260415 - protein, 12 aa, Cryptosporidium parvum
GQNKKNTSTQKV

SEQ ID NO: 2260416 - protein, 53 aa, Cryptosporidium parvum
GQNKSKSQDQSKSGAQDENIGEYDHTNDYLDKDETKVKNEQKSQKEDLDPKSQ

SEQ ID NO: 2260417 - protein, 11 aa, Cryptosporidium parvum
GQNKTQSPTHF

SEQ ID NO: 2260418 - protein, 9 aa, Cryptosporidium parvum
GQNNSAGGY

SEQ ID NO: 2260419 - protein, 7 aa, Cryptosporidium parvum
GQNPTEA

SEQ ID NO: 2260420 - protein, 7 aa, Cryptosporidium parvum
GQNPVNE

SEQ ID NO: 2260421 - protein, 4 aa, Cryptosporidium parvum
GQNR

SEQ ID NO: 2260422 - protein, 6 aa, Cryptosporidium parvum
GQNSLP

SEQ ID NO: 2260423 - protein, 5 aa, Cryptosporidium parvum
GQNSP

SEQ ID NO: 2260424 - protein, 24 aa, Cryptosporidium parvum
GQNSQIEDNQQKNIGKKNNKLIQK

SEQ ID NO: 2260425 - protein, 17 aa, Cryptosporidium parvum
GQNTNDLRTNGGVKTRK

SEQ ID NO: 2260426 - protein, 6 aa, Cryptosporidium parvum
GQNVQR

SEQ ID NO: 2260427 - protein, 7 aa, Cryptosporidium parvum
GQPFNSE

SEQ ID NO: 2260428 - protein, 8 aa, Cryptosporidium parvum
GQPGTGKT

SEQ ID NO: 2260429 - protein, 4 aa, Cryptosporidium parvum
GQPI

SEQ ID NO: 2260430 - protein, 13 aa, Cryptosporidium parvum
GQPLNPYISPTDQ

SEQ ID NO: 2260431 - protein, 6 aa, Cryptosporidium parvum
GQPQSS

SEQ ID NO: 2260432 - protein, 31 aa, Cryptosporidium parvum
GQPSNLGSLDSSLKTSGSLFGGSSTTSNSAS

SEQ ID NO: 2260433 - protein, 16 aa, Cryptosporidium parvum
GQQGEANIQTEQTEKK

SEQ ID NO: 2260434 - protein, 4 aa, Cryptosporidium parvum
GQQI

SEQ ID NO: 2260435 - protein, 11 aa, Cryptosporidium parvum
GQQNNNNNKNY

SEQ ID NO: 2260436 - protein, 8 aa, Cryptosporidium parvum
GQQNNSGL

SEQ ID NO: 2260437 - protein, 13 aa, Cryptosporidium parvum
GQQRALEKQKQKI

SEQ ID NO: 2260438 - protein, 19 aa, Cryptosporidium parvum
GQRAGSGEFGSSLSPPTPF

SEQ ID NO: 2260439 - protein, 4 aa, Cryptosporidium parvum
GQRK

SEQ ID NO: 2260440 - protein, 10 aa, Cryptosporidium parvum
GQRRRSKTFN

SEQ ID NO: 2260441 - protein, 10 aa, Cryptosporidium parvum
GQSAPKLKGK

SEQ ID NO: 2260442 - protein, 4 aa, Cryptosporidium parvum
GQSD

SEQ ID NO: 2260443 - protein, 8 aa, Cryptosporidium parvum
GQSDSIEG

SEQ ID NO: 2260444 - protein, 7 aa, Cryptosporidium parvum
GQSEENI

SEQ ID NO: 2260445 - protein, 8 aa, Cryptosporidium parvum
GQSEGNLA

SEQ ID NO: 2260446 - protein, 27 aa, Cryptosporidium parvum
GQSEPTPPAPPPTPSGGQESSWFSGFG

SEQ ID NO: 2260447 - protein, 9 aa, Cryptosporidium parvum
GQSGDRLTR

SEQ ID NO: 2260448 - protein, 35 aa, Cryptosporidium parvum
GQSKNSPSSRERSGSRRQNESQASLQSSSEGNDDI

SEQ ID NO: 2260449 - protein, 7 aa, Cryptosporidium parvum
GQSLSSI

SEQ ID NO: 2260450 - protein, 4 aa, Cryptosporidium parvum
GQSM

SEQ ID NO: 2260451 - protein, 11 aa, Cryptosporidium parvum
GQSQNHTQGHT

SEQ ID NO: 2260452 - protein, 4 aa, Cryptosporidium parvum
GQSR

SEQ ID NO: 2260453 - protein, 15 aa, Cryptosporidium parvum
GQSSYLSRNSEDNRR

SEQ ID NO: 2260454 - protein, 4 aa, Cryptosporidium parvum
GQSY

SEQ ID NO: 2260455 - protein, 6 aa, Cryptosporidium parvum
GQTEQA

SEQ ID NO: 2260456 - protein, 8 aa, Cryptosporidium parvum
GQTGSGKT

SEQ ID NO: 2260457 - protein, 9 aa, Cryptosporidium parvum
GQTGSGKTY

SEQ ID NO: 2260458 - protein, 10 aa, Cryptosporidium parvum
GQTKETISDQ

SEQ ID NO: 2260459 - protein, 7 aa, Cryptosporidium parvum
GQTPAGR

SEQ ID NO: 2260460 - protein, 5 aa, Cryptosporidium parvum
GQTQF

SEQ ID NO: 2260461 - protein, 42 aa, Cryptosporidium parvum
GQTQGQSYLQNSSSSHHSPSSFSLKTSRGMIDSSGGGTIGSR

SEQ ID NO: 2260462 - protein, 9 aa, Cryptosporidium parvum
GQTQNPTGV

SEQ ID NO: 2260463 - protein, 9 aa, Cryptosporidium parvum
GQTSSGKTF

SEQ ID NO: 2260464 - protein, 15 aa, Cryptosporidium parvum
GQVKSGSKSGGTKEE

SEQ ID NO: 2260465 - protein, 22 aa, Cryptosporidium parvum
GQVQETKNVTSLSESNNTRKSQ

SEQ ID NO: 2260466 - protein, 10 aa, Cryptosporidium parvum
GQVSEGFDDT

SEQ ID NO: 2260467 - protein, 13 aa, Cryptosporidium parvum
GQYKARSVAKNTE

SEQ ID NO: 2260468 - protein, 5 aa, Cryptosporidium parvum
GQYNS

SEQ ID NO: 2260469 - protein, 21 aa, Cryptosporidium parvum
GQYSRDMRNGQGTSRYTDGSV

SEQ ID NO: 2260470 - protein, 4 aa, Cryptosporidium parvum
GQYY

SEQ ID NO: 2260471 - protein, 16 aa, Cryptosporidium parvum
GRAETKFKGNMEINDT

SEQ ID NO: 2260472 - protein, 8 aa, Cryptosporidium parvum
GRAGRSHE

SEQ ID NO: 2260473 - protein, 7 aa, Cryptosporidium parvum
GRAGRTG

SEQ ID NO: 2260474 - protein, 7 aa, Cryptosporidium parvum
GRANKTG

SEQ ID NO: 2260475 - protein, 5 aa, Cryptosporidium parvum
GRARS

SEQ ID NO: 2260476 - protein, 9 aa, Cryptosporidium parvum
GRCKSSSVT

SEQ ID NO: 2260477 - protein, 16 aa, Cryptosporidium parvum
GRDDQELPPSPSNEAK

SEQ ID NO: 2260478 - protein, 12 aa, Cryptosporidium parvum
GRDGASKQNLAA

SEQ ID NO: 2260479 - protein, 6 aa, Cryptosporidium parvum
GRDKTL

SEQ ID NO: 2260480 - protein, 5 aa, Cryptosporidium parvum
GRDNE

SEQ ID NO: 2260481 - protein, 6 aa, Cryptosporidium parvum
GRDPID

SEQ ID NO: 2260482 - protein, 17 aa, Cryptosporidium parvum
GREAGRGSENIKSSLYE

SEQ ID NO: 2260483 - protein, 4 aa, Cryptosporidium parvum
GRED

SEQ ID NO: 2260484 - protein, 56 aa, Cryptosporidium parvum
GREDVEIDSEKDERNKVKSKKSNPNKTSKNNKSRLRGKSLNNNEIEGSKKKPELGN

SEQ ID NO: 2260485 - protein, 12 aa, Cryptosporidium parvum
GREGTKLGSNDR

SEQ ID NO: 2260486 - protein, 4 aa, Cryptosporidium parvum
GREH

SEQ ID NO: 2260487 - protein, 7 aa, Cryptosporidium parvum
GRENISE

SEQ ID NO: 2260488 - protein, 13 aa, Cryptosporidium parvum
GREPSKGVNPDEA

SEQ ID NO: 2260489 - protein, 6 aa, Cryptosporidium parvum
GREQSF

SEQ ID NO: 2260490 - protein, 24 aa, Cryptosporidium parvum
GRESEEAKKLAQEKMNRSEALGDD

SEQ ID NO: 2260491 - protein, 4 aa, Cryptosporidium parvum
GRFG

SEQ ID NO: 2260492 - protein, 6 aa, Cryptosporidium parvum
GRFPEK

SEQ ID NO: 2260493 - protein, 18 aa, Cryptosporidium parvum
GRFPTSSSLEKKGGFSAF

SEQ ID NO: 2260494 - protein, 6 aa, Cryptosporidium parvum
GRGDDM

SEQ ID NO: 2260495 - protein, 9 aa, Cryptosporidium parvum
GRGEHPKSG

SEQ ID NO: 2260496 - protein, 12 aa, Cryptosporidium parvum
GRGEKRGDNGIR

SEQ ID NO: 2260497 - protein, 6 aa, Cryptosporidium parvum
GRGETR

SEQ ID NO: 2260498 - protein, 52 aa, Cryptosporidium parvum; identical to SEQ ID NO: 2143909

SEQ ID NO: 2260499 - protein, 6 aa, Cryptosporidium parvum
GRGGGS

SEQ ID NO: 2260500 - protein, 4 aa, Cryptosporidium parvum
GRGI

SEQ ID NO: 2260501 - protein, 6 aa, Cryptosporidium parvum
GRGKYS

SEQ ID NO: 2260502 - protein, 18 aa, Cryptosporidium parvum
GRGNPNSNSWQKKRSGKK

SEQ ID NO: 2260503 - protein, 7 aa, Cryptosporidium parvum
GRGPRST

SEQ ID NO: 2260504 - protein, 5 aa, Cryptosporidium parvum
GRGQL

SEQ ID NO: 2260505 - protein, 12 aa, Cryptosporidium parvum
GRGRSSSYNSFG

SEQ ID NO: 2260506 - protein, 4 aa, Cryptosporidium parvum
GRGS

SEQ ID NO: 2260507 - protein, 7 aa, Cryptosporidium parvum
GRGTSTF

SEQ ID NO: 2260508 - protein, 10 aa, Cryptosporidium parvum
GRGTSTFDGT

SEQ ID NO: 2260509 - protein, 5 aa, Cryptosporidium parvum
GRHDP

SEQ ID NO: 2260510 - protein, 14 aa, Cryptosporidium parvum
GRHFTGKVSEKGDL

SEQ ID NO: 2260511 - protein, 25 aa, Cryptosporidium parvum
GRHPPYPGGVPGQVHQNTKPKGPTL

SEQ ID NO: 2260512 - protein, 5 aa, Cryptosporidium parvum
GRHYP

SEQ ID NO: 2260513 - protein, 10 aa, Cryptosporidium parvum
GRIEGRNGSI

SEQ ID NO: 2260514 - protein, 6 aa, Cryptosporidium parvum
GRIGEY

SEQ ID NO: 2260515 - protein, 18 aa, Cryptosporidium parvum
GRIGKGTYGSVKSGTNRL

SEQ ID NO: 2260516 - protein, 11 aa, Cryptosporidium parvum
GRIKSDQENLN

SEQ ID NO: 2260517 - protein, 10 aa, Cryptosporidium parvum
GRINGEQDLE

SEQ ID NO: 2260518 - protein, 11 aa, Cryptosporidium parvum
GRISDGKDLSR

SEQ ID NO: 2260519 - protein, 13 aa, Cryptosporidium parvum
GRISRSPSPVRGN

SEQ ID NO: 2260520 - protein, 5 aa, Cryptosporidium parvum
GRITS

SEQ ID NO: 2260521 - protein, 4 aa, Cryptosporidium parvum
GRIV

SEQ ID NO: 2260522 - protein, 10 aa, Cryptosporidium parvum
GRKAGKDANL

SEQ ID NO: 2260523 - protein, 7 aa, Cryptosporidium parvum
GRKDPIE

SEQ ID NO: 2260524 - protein, 8 aa, Cryptosporidium parvum
GRKGGRKK

SEQ ID NO: 2260525 - protein, 10 aa, Cryptosporidium parvum
GRKGHSVGDI

SEQ ID NO: 2260526 - protein, 35 aa, Cryptosporidium parvum
GRKGIQGGTGGLNKVNNGEEEDEDDEEEDEDSREF

SEQ ID NO: 2260527 - protein, 6 aa, Cryptosporidium parvum
GRKKLN

SEQ ID NO: 2260528 - protein, 11 aa, Cryptosporidium parvum
GRKKNGDEPSI

SEQ ID NO: 2260529 - protein, 14 aa, Cryptosporidium parvum
GRKLQTEKRDPQSI

SEQ ID NO: 2260530 - protein, 9 aa, Cryptosporidium parvum
GRKNDHGRQ

SEQ ID NO: 2260531 - protein, 9 aa, Cryptosporidium parvum
GRKNREETE

SEQ ID NO: 2260532 - protein, 6 aa, Cryptosporidium parvum
GRKPNS

SEQ ID NO: 2260533 - protein, 39 aa, Cryptosporidium parvum; identical to SEQ ID NO: 2143931

SEQ ID NO: 2260534 - protein, 17 aa, Cryptosporidium parvum
GRKQRNGTARNHSAVAS

SEQ ID NO: 2260535 - protein, 10 aa, Cryptosporidium parvum
GRKSTSSGVG

SEQ ID NO: 2260536 - protein, 7 aa, Cryptosporidium parvum
GRKYDNE

SEQ ID NO: 2260537 - protein, 9 aa, Cryptosporidium parvum
GRKYNLDNR

SEQ ID NO: 2260538 - protein, 13 aa, Cryptosporidium parvum
GRLHPAEEQVQRQ

SEQ ID NO: 2260539 - protein, 19 aa, Cryptosporidium parvum
GRLPSKAGYKTSKVNKSSV

SEQ ID NO: 2260540 - protein, 4 aa, Cryptosporidium parvum
GRMD

SEQ ID NO: 2260541 - protein, 28 aa, Cryptosporidium parvum
GRMKKGGKHQKDEEKREKTKHGKKKKAP

SEQ ID NO: 2260542 - protein, 4 aa, Cryptosporidium parvum
GRMQ

SEQ ID NO: 2260543 - protein, 12 aa, Cryptosporidium parvum
GRNAHKENPIGA

SEQ ID NO: 2260544 - protein, 4 aa, Cryptosporidium parvum
GRNG

SEQ ID NO: 2260545 - protein, 6 aa, Cryptosporidium parvum
GRNIET

SEQ ID NO: 2260546 - protein, 12 aa, Cryptosporidium parvum
GRNRTNKKRLRK

SEQ ID NO: 2260547 - protein, 6 aa, Cryptosporidium parvum
GRNTTN

SEQ ID NO: 2260548 - protein, 9 aa, Cryptosporidium parvum
GRPDGQRKM

SEQ ID NO: 2260549 - protein, 9 aa, Cryptosporidium parvum
GRPGNALEP

SEQ ID NO: 2260550 - protein, 5 aa, Cryptosporidium parvum
GRPIN

SEQ ID NO: 2260551 - protein, 14 aa, Cryptosporidium parvum
GRPIPELESNSSPL

SEQ ID NO: 2260552 - protein, 4 aa, Cryptosporidium parvum
GRPK

SEQ ID NO: 2260553 - protein, 5 aa, Cryptosporidium parvum
GRPRV

SEQ ID NO: 2260554 - protein, 4 aa, Cryptosporidium parvum
GRPV

SEQ ID NO: 2260555 - protein, 6 aa, Cryptosporidium parvum
GRQFAR

SEQ ID NO: 2260556 - protein, 6 aa, Cryptosporidium parvum
GRQNHQ

SEQ ID NO: 2260557 - protein, 5 aa, Cryptosporidium parvum
GRQNW

SEQ ID NO: 2260558 - protein, 4 aa, Cryptosporidium parvum
GRQS

SEQ ID NO: 2260559 - protein, 5 aa, Cryptosporidium parvum
GRQTQ

SEQ ID NO: 2260560 - protein, 16 aa, Cryptosporidium parvum
GRRAGSRGGGKRRGED

SEQ ID NO: 2260561 - protein, 13 aa, Cryptosporidium parvum
GRRHKQNSSESAI

SEQ ID NO: 2260562 - protein, 20 aa, Cryptosporidium parvum
GRRKNADEKSDEKDAQKASG

SEQ ID NO: 2260563 - protein, 7 aa, Cryptosporidium parvum
GRRLEPT

SEQ ID NO: 2260564 - protein, 6 aa, Cryptosporidium parvum
GRRPLK

SEQ ID NO: 2260565 - protein, 13 aa, Cryptosporidium parvum
GRRSLGKGPFPQY

SEQ ID NO: 2260566 - protein, 27 aa, Cryptosporidium parvum
GRRSRTRGGAPEHHISDKSSGKPAGLY

SEQ ID NO: 2260567 - protein, 7 aa, Cryptosporidium parvum
GRSDSFA

SEQ ID NO: 2260568 - protein, 8 aa, Cryptosporidium parvum
GRSGRFGQ

SEQ ID NO: 2260569 - protein, 5 aa, Cryptosporidium parvum
GRSKI

SEQ ID NO: 2260570 - protein, 12 aa, Cryptosporidium parvum
GRSKNEYRDHRR

SEQ ID NO: 2260571 - protein, 112 aa, Cryptosporidium parvum
GRSKTGSDSDSDSDSDSDTSSDSDSDSDSDSDSDSDSDSDSDSDSNSNSDPNSESGGLGGGTGGLEGTGGGGEAGTGGLGGGGGTGGLGGGGGGTGAGEAGAGTAMGRGAGR

SEQ ID NO: 2260572 - protein, 13 aa, Cryptosporidium parvum
GRSKTKKNNLTNL

SEQ ID NO: 2260573 - protein, 23 aa, Cryptosporidium parvum
GRSLPSNTATNDKNNNSSYSNAA

SEQ ID NO: 2260574 - protein, 22 aa, Cryptosporidium parvum
GRSLYRDDEDKIFSKSKEHRAG

SEQ ID NO: 2260575 - protein, 4 aa, Cryptosporidium parvum
GRSN

SEQ ID NO: 2260576 - protein, 24 aa, Cryptosporidium parvum
GRSQDHGQTQDQGQTQDQGQIQDQ

SEQ ID NO: 2260577 - protein, 5 aa, Cryptosporidium parvum
GRSRG

SEQ ID NO: 2260578 - protein, 6 aa, Cryptosporidium parvum
GRSRGI

SEQ ID NO: 2260579 - protein, 13 aa, Cryptosporidium parvum
GRSRSPNQRNFER

SEQ ID NO: 2260580 - protein, 4 aa, Cryptosporidium parvum
GRSS

SEQ ID NO: 2260581 - protein, 4 aa, Cryptosporidium parvum
GRST

SEQ ID NO: 2260582 - protein, 9 aa, Cryptosporidium parvum
GRTARAGKI

SEQ ID NO: 2260583 - protein, 11 aa, Cryptosporidium parvum
GRTARAGQHGR

SEQ ID NO: 2260584 - protein, 10 aa, Cryptosporidium parvum
GRTARASRQG

SEQ ID NO: 2260585 - protein, 9 aa, Cryptosporidium parvum
GRTDSDATH

SEQ ID NO: 2260586 - protein, 8 aa, Cryptosporidium parvum
GRTDSEIG

SEQ ID NO: 2260587 - protein, 10 aa, Cryptosporidium parvum
GRTGRAGKNG

SEQ ID NO: 2260588 - protein, 11 aa, Cryptosporidium parvum
GRTGRAGNTGL

SEQ ID NO: 2260589 - protein, 11 aa, Cryptosporidium parvum
GRTGRGGSVGV

SEQ ID NO: 2260590 - protein, 9 aa, Cryptosporidium parvum
GRTGSRGGV

SEQ ID NO: 2260591 - protein, 24 aa, Cryptosporidium parvum
GRTKKKESNMDHKKRKLESEVDGS

SEQ ID NO: 2260592 - protein, 6 aa, Cryptosporidium parvum
GRTLSP

SEQ ID NO: 2260593 - protein, 10 aa, Cryptosporidium parvum
GRTSESKASL

SEQ ID NO: 2260594 - protein, 6 aa, Cryptosporidium parvum
GRTTGL

SEQ ID NO: 2260595 - protein, 8 aa, Cryptosporidium parvum
GRVEPNNS

SEQ ID NO: 2260596 - protein, 6 aa, Cryptosporidium parvum
GRVEVS

SEQ ID NO: 2260597 - protein, 17 aa, Cryptosporidium parvum
GRVKKTQSKRTRSTNPY

SEQ ID NO: 2260598 - protein, 10 aa, Cryptosporidium parvum
GRVKTNEEQK

SEQ ID NO: 2260599 - protein, 5 aa, Cryptosporidium parvum
GRVRE

SEQ ID NO: 2260600 - protein, 7 aa, Cryptosporidium parvum
GRYAKRI

SEQ ID NO: 2260601 - protein, 7 aa, Cryptosporidium parvum
GRYCGGN

SEQ ID NO: 2260602 - protein, 6 aa, Cryptosporidium parvum
GRYEEQ

SEQ ID NO: 2260603 - protein, 4 aa, Cryptosporidium parvum
GRYG

SEQ ID NO: 2260604 - protein, 4 aa, Cryptosporidium parvum
GRYN

SEQ ID NO: 2260605 - protein, 6 aa, Cryptosporidium parvum
GRYPPI

SEQ ID NO: 2260606 - protein, 7 aa, Cryptosporidium parvum
GSAADTQ

SEQ ID NO: 2260607 - protein, 4 aa, Cryptosporidium parvum
GSAE

SEQ ID NO: 2260608 - protein, 9 aa, Cryptosporidium parvum
GSAENKNHK

SEQ ID NO: 2260609 - protein, 10 aa, Cryptosporidium parvum
GSAIPSPYRN

SEQ ID NO: 2260610 - protein, 12 aa, Cryptosporidium parvum
GSAIRDDESREK

SEQ ID NO: 2260611 - protein, 10 aa, Cryptosporidium parvum
GSAKGRKNIN

SEQ ID NO: 2260612 - protein, 10 aa, Cryptosporidium parvum
GSANEGSEID

SEQ ID NO: 2260613 - protein, 28 aa, Cryptosporidium parvum
GSANSNTDPKLEPNSNYNSSESDPGQDP

SEQ ID NO: 2260614 - protein, 14 aa, Cryptosporidium parvum
GSARDDNHNQAESV

SEQ ID NO: 2260615 - protein, 6 aa, Cryptosporidium parvum
GSASAQ

SEQ ID NO: 2260616 - protein, 9 aa, Cryptosporidium parvum
GSASKRIST

SEQ ID NO: 2260617 - protein, 9 aa, Cryptosporidium parvum
GSASTAKRA

SEQ ID NO: 2260618 - protein, 6 aa, Cryptosporidium parvum
GSATFT

SEQ ID NO: 2260619 - protein, 27 aa, Cryptosporidium parvum
GSATNKTTSFGNSPAISNFSNGKVDEK

SEQ ID NO: 2260620 - protein, 5 aa, Cryptosporidium parvum
GSAVG

SEQ ID NO: 2260621 - protein, 9 aa, Cryptosporidium parvum
GSDAQETVR

SEQ ID NO: 2260622 - protein, 8 aa, Cryptosporidium parvum
GSDDGQVR

SEQ ID NO: 2260623 - protein, 7 aa, Cryptosporidium parvum
GSDDQEI

SEQ ID NO: 2260624 - protein, 10 aa, Cryptosporidium parvum
GSDGGMSSGA

SEQ ID NO: 2260625 - protein, 4 aa, Cryptosporidium parvum
GSDH

SEQ ID NO: 2260626 - protein, 4 aa, Cryptosporidium parvum
GSDI

SEQ ID NO: 2260627 - protein, 10 aa, Cryptosporidium parvum
GSDNNTGNGN

SEQ ID NO: 2260628 - protein, 4 aa, Cryptosporidium parvum
GSDP

SEQ ID NO: 2260629 - protein, 4 aa, Cryptosporidium parvum
GSDQ

SEQ ID NO: 2260630 - protein, 7 aa, Cryptosporidium parvum
GSDQIEA

SEQ ID NO: 2260631 - protein, 16 aa, Cryptosporidium parvum
GSDQTPLSSKFESRAD

SEQ ID NO: 2260632 - protein, 9 aa, Cryptosporidium parvum
GSDRSEDDL

SEQ ID NO: 2260633 - protein, 10 aa, Cryptosporidium parvum
GSDSAESAKR

SEQ ID NO: 2260634 - protein, 27 aa, Cryptosporidium parvum
GSDSIPGAPKLTDEEALEKAKELQRRA

SEQ ID NO: 2260635 - protein, 7 aa, Cryptosporidium parvum
GSDSTGN

SEQ ID NO: 2260636 - protein, 10 aa, Cryptosporidium parvum
GSDTSQGKGQ

SEQ ID NO: 2260637 - protein, 4 aa, Cryptosporidium parvum
GSDY

SEQ ID NO: 2260638 - protein, 11 aa, Cryptosporidium parvum
GSEASRQFQES

SEQ ID NO: 2260639 - protein, 8 aa, Cryptosporidium parvum
GSEEPLKR

SEQ ID NO: 2260640 - protein, 4 aa, Cryptosporidium parvum
GSEI

SEQ ID NO: 2260641 - protein, 8 aa, Cryptosporidium parvum
GSEIQQGP

SEQ ID NO: 2260642 - protein, 6 aa, Cryptosporidium parvum
GSEKEC

SEQ ID NO: 2260643 - protein, 13 aa, Cryptosporidium parvum
GSEKETSTSLGPN

SEQ ID NO: 2260644 - protein, 14 aa, Cryptosporidium parvum
GSEKISKTGAEGLT

SEQ ID NO: 2260645 - protein, 8 aa, Cryptosporidium parvum
GSELRNKG

SEQ ID NO: 2260646 - protein, 22 aa, Cryptosporidium parvum
GSENIQRSGANAVKDRAKEAGM

SEQ ID NO: 2260647 - protein, 5 aa, Cryptosporidium parvum
GSEPD

SEQ ID NO: 2260648 - protein, 8 aa, Cryptosporidium parvum
GSEPRRLQ

SEQ ID NO: 2260649 - protein, 9 aa, Cryptosporidium parvum
GSEQPLATL

SEQ ID NO: 2260650 - protein, 10 aa, Cryptosporidium parvum
GSEQSDKSEL

SEQ ID NO: 2260651 - protein, 13 aa, Cryptosporidium parvum
GSERASATQNRGI

SEQ ID NO: 2260652 - protein, 23 aa, Cryptosporidium parvum
GSERGADTVHSTRQTQQDGAGIN

SEQ ID NO: 2260653 - protein, 13 aa, Cryptosporidium parvum
GSERRRGGGRYKF

SEQ ID NO: 2260654 - protein, 15 aa, Cryptosporidium parvum
GSERVNKSGVAGERM

SEQ ID NO: 2260655 - protein, 9 aa, Cryptosporidium parvum
GSESEHNLT

SEQ ID NO: 2260656 - protein, 7 aa, Cryptosporidium parvum
GSESENI

SEQ ID NO: 2260657 - protein, 20 aa, Cryptosporidium parvum
GSESIKRTQLEGDRRKEGMS

SEQ ID NO: 2260658 - protein, 7 aa, Cryptosporidium parvum
GSESQRN

SEQ ID NO: 2260659 - protein, 6 aa, Cryptosporidium parvum
GSETQF

SEQ ID NO: 2260660 - protein, 28 aa, Cryptosporidium parvum
GSETSLDSNSNPISKSSSNPSSNSNFNT

SEQ ID NO: 2260661 - protein, 5 aa, Cryptosporidium parvum
GSEVA

SEQ ID NO: 2260662 - protein, 5 aa, Cryptosporidium parvum
GSEVR

SEQ ID NO: 2260663 - protein, 6 aa, Cryptosporidium parvum
GSEVRA

SEQ ID NO: 2260664 - protein, 9 aa, Cryptosporidium parvum
GSFANDGSA

SEQ ID NO: 2260665 - protein, 10 aa, Cryptosporidium parvum
GSFDKEEERI

SEQ ID NO: 2260666 - protein, 9 aa, Cryptosporidium parvum
GSFEDPLDS

SEQ ID NO: 2260667 - protein, 23 aa, Cryptosporidium parvum
GSFEEQQFNEKSTSDYQKAKNEK

SEQ ID NO: 2260668 - protein, 6 aa, Cryptosporidium parvum
GSFGSQ

SEQ ID NO: 2260669 - protein, 4 aa, Cryptosporidium parvum
GSFN

SEQ ID NO: 2260670 - protein, 49 aa, Cryptosporidium parvum; identical to SEQ ID NO: 2144057

SEQ ID NO: 2260671 - protein, 13 aa, Cryptosporidium parvum
GSFSQNSHLGSAG

SEQ ID NO: 2260672 - protein, 7 aa, Cryptosporidium parvum
GSFSSNA

SEQ ID NO: 2260673 - protein, 10 aa, Cryptosporidium parvum
GSGALASSQD

SEQ ID NO: 2260674 - protein, 9 aa, Cryptosporidium parvum
GSGANASVF

SEQ ID NO: 2260675 - protein, 16 aa, Cryptosporidium parvum
GSGASISSSSTSFATQ

SEQ ID NO: 2260676 - protein, 5 aa, Cryptosporidium parvum
GSGAY

SEQ ID NO: 2260677 - protein, 8 aa, Cryptosporidium parvum
GSGDKRYS

SEQ ID NO: 2260678 - protein, 13 aa, Cryptosporidium parvum
GSGFPQNQPNKPI

SEQ ID NO: 2260679 - protein, 5 aa, Cryptosporidium parvum
GSGGN

SEQ ID NO: 2260680 - protein, 6 aa, Cryptosporidium parvum
GSGHRR

SEQ ID NO: 2260681 - protein, 4 aa, Cryptosporidium parvum
GSGK

SEQ ID NO: 2260682 - protein, 9 aa, Cryptosporidium parvum
GSGKSTYCS

SEQ ID NO: 2260683 - protein, 9 aa, Cryptosporidium parvum
GSGKTTTCT

SEQ ID NO: 2260684 - protein, 6 aa, Cryptosporidium parvum
GSGKYS

SEQ ID NO: 2260685 - protein, 11 aa, Cryptosporidium parvum
GSGLGNSELNN

SEQ ID NO: 2260686 - protein, 7 aa, Cryptosporidium parvum
GSGLPPM

SEQ ID NO: 2260687 - protein, 37 aa, Cryptosporidium parvum
GSGLTGATGLTGATGLTGTTGLTGTTGLTGTTGASSS

SEQ ID NO: 2260688 - protein, 21 aa, Cryptosporidium parvum
GSGNGSSSGITTGDDSSLKIS

SEQ ID NO: 2260689 - protein, 13 aa, Cryptosporidium parvum
GSGNSLGQTRSSA

SEQ ID NO: 2260690 - protein, 11 aa, Cryptosporidium parvum
GSGRKHERSLS

SEQ ID NO: 2260691 - protein, 5 aa, Cryptosporidium parvum
GSGSF

SEQ ID NO: 2260692 - protein, 6 aa, Cryptosporidium parvum
GSGSIE

SEQ ID NO: 2260693 - protein, 11 aa, Cryptosporidium parvum
GSGSRDTARNA

SEQ ID NO: 2260694 - protein, 21 aa, Cryptosporidium parvum
GSGSVYSSNPTLLSGNSGMNY

SEQ ID NO: 2260695 - protein, 4 aa, Cryptosporidium parvum
GSGT

SEQ ID NO: 2260696 - protein, 9 aa, Cryptosporidium parvum
GSGTSGHVQ

SEQ ID NO: 2260697 - protein, 6 aa, Cryptosporidium parvum
GSGTTV

SEQ ID NO: 2260698 - protein, 6 aa, Cryptosporidium parvum
GSGTYG

SEQ ID NO: 2260699 - protein, 10 aa, Cryptosporidium parvum
GSGYEKPSIG

SEQ ID NO: 2260700 - protein, 26 aa, Cryptosporidium parvum
GSGYGEDGGANGGDQIGGGNSLPPIS

SEQ ID NO: 2260701 - protein, 5 aa, Cryptosporidium parvum
GSHDS

SEQ ID NO: 2260702 - protein, 6 aa, Cryptosporidium parvum
GSHGNT

SEQ ID NO: 2260703 - protein, 6 aa, Cryptosporidium parvum
GSHQQF

SEQ ID NO: 2260704 - protein, 8 aa, Cryptosporidium parvum
GSHRAQRS

SEQ ID NO: 2260705 - protein, 7 aa, Cryptosporidium parvum
GSHSRDI

SEQ ID NO: 2260706 - protein, 4 aa, Cryptosporidium parvum
GSIE

SEQ ID NO: 2260707 - protein, 4 aa, Cryptosporidium parvum
GSIK

SEQ ID NO: 2260708 - protein, 19 aa, Cryptosporidium parvum
GSINDDINEKEENKDDNSF

SEQ ID NO: 2260709 - protein, 10 aa, Cryptosporidium parvum
GSIRGTDRNA

SEQ ID NO: 2260710 - protein, 11 aa, Cryptosporidium parvum
GSIRSSDNKHI

SEQ ID NO: 2260711 - protein, 6 aa, Cryptosporidium parvum
GSITSE

SEQ ID NO: 2260712 - protein, 12 aa, Cryptosporidium parvum
GSKDESSGIQNN

SEQ ID NO: 2260713 - protein, 5 aa, Cryptosporidium parvum
GSKDV

SEQ ID NO: 2260714 - protein, 26 aa, Cryptosporidium parvum
GSKEKSKDNDSSSQNDESGSSAQASA

SEQ ID NO: 2260715 - protein, 8 aa, Cryptosporidium parvum
GSKEKSLQ

SEQ ID NO: 2260716 - protein, 18 aa, Cryptosporidium parvum
GSKELDRDGGHRGRGWSG

SEQ ID NO: 2260717 - protein, 18 aa, Cryptosporidium parvum
GSKETDSYFDNTSKYQRS

SEQ ID NO: 2260718 - protein, 6 aa, Cryptosporidium parvum
GSKGFG

SEQ ID NO: 2260719 - protein, 8 aa, Cryptosporidium parvum
GSKGSTIN

SEQ ID NO: 2260720 - protein, 8 aa, Cryptosporidium parvum
GSKINSDI

SEQ ID NO: 2260721 - protein, 9 aa, Cryptosporidium parvum
GSKKDSVGR

SEQ ID NO: 2260722 - protein, 4 aa, Cryptosporidium parvum
GSKN

SEQ ID NO: 2260723 - protein, 51 aa, Cryptosporidium parvum
GSKQIKTSNTGCINTQSRENLNKSSENCIDPQDNNNNNNDNNVQQEEISDV

SEQ ID NO: 2260724 - protein, 10 aa, Cryptosporidium parvum
GSKQRPVSSK

SEQ ID NO: 2260725 - protein, 6 aa, Cryptosporidium parvum
GSKRIS

SEQ ID NO: 2260726 - protein, 10 aa, Cryptosporidium parvum
GSKRKEEFPN

SEQ ID NO: 2260727 - protein, 25 aa, Cryptosporidium parvum
GSKSGKSVKPNNRSSIGGNSCGSGA

SEQ ID NO: 2260728 - protein, 9 aa, Cryptosporidium parvum
GSKSNSHIK

SEQ ID NO: 2260729 - protein, 13 aa, Cryptosporidium parvum
GSKYNGKELKSNI

SEQ ID NO: 2260730 - protein, 27 aa, Cryptosporidium parvum
GSLNSSKISHEGSGRSIIQDNNSNTIK

SEQ ID NO: 2260731 - protein, 8 aa, Cryptosporidium parvum
GSLQSQKH

SEQ ID NO: 2260732 - protein, 4 aa, Cryptosporidium parvum
GSLR

SEQ ID NO: 2260733 - protein, 21 aa, Cryptosporidium parvum
GSLSEDGTIDLDSSSNSISFG

SEQ ID NO: 2260734 - protein, 8 aa, Cryptosporidium parvum
GSLSESSA

SEQ ID NO: 2260735 - protein, 19 aa, Cryptosporidium parvum
GSMNYGGAGDSVKDSNQSI

SEQ ID NO: 2260736 - protein, 36 aa, Cryptosporidium parvum
GSNDESDLSDENNDDYDTNNSDIDEDDSHSPVRSSR

SEQ ID NO: 2260737 - protein, 15 aa, Cryptosporidium parvum
GSNDYHKAEKSSFGT

SEQ ID NO: 2260738 - protein, 12 aa, Cryptosporidium parvum
GSNESAINKNRE

SEQ ID NO: 2260739 - protein, 5 aa, Cryptosporidium parvum
GSNGI

SEQ ID NO: 2260740 - protein, 7 aa, Cryptosporidium parvum
GSNGQRL

SEQ ID NO: 2260741 - protein, 9 aa, Cryptosporidium parvum
GSNGYRTIS

SEQ ID NO: 2260742 - protein, 6 aa, Cryptosporidium parvum
GSNKSS

SEQ ID NO: 2260743 - protein, 28 aa, Cryptosporidium parvum
GSNLAQNSISGSGIGGNPSFVDSGDNSM

SEQ ID NO: 2260744 - protein, 13 aa, Cryptosporidium parvum
GSNLTENKLENRD

SEQ ID NO: 2260745 - protein, 5 aa, Cryptosporidium parvum
GSNND

SEQ ID NO: 2260746 - protein, 10 aa, Cryptosporidium parvum
GSNNGNNRFD

SEQ ID NO: 2260747 - protein, 13 aa, Cryptosporidium parvum
GSNNNIGNQSQRS

SEQ ID NO: 2260748 - protein, 10 aa, Cryptosporidium parvum
GSNNSSPNRN

SEQ ID NO: 2260749 - protein, 14 aa, Cryptosporidium parvum
GSNNVTENNSEEKM

SEQ ID NO: 2260750 - protein, 7 aa, Cryptosporidium parvum
GSNPITA

SEQ ID NO: 2260751 - protein, 32 aa, Cryptosporidium parvum
GSNPNAVNGTGGNSSGNGVKSVGGNNPDVDDL

SEQ ID NO: 2260752 - protein, 7 aa, Cryptosporidium parvum
GSNPTNL

SEQ ID NO: 2260753 - protein, 9 aa, Cryptosporidium parvum
GSNQKIENH

SEQ ID NO: 2260754 - protein, 5 aa, Cryptosporidium parvum
GSNQV

SEQ ID NO: 2260755 - protein, 10 aa, Cryptosporidium parvum
GSNSAASRQT

SEQ ID NO: 2260756 - protein, 13 aa, Cryptosporidium parvum
GSNSDSWPRQPAE

SEQ ID NO: 2260757 - protein, 17 aa, Cryptosporidium parvum
GSNSGGTLNIQTDETRK

SEQ ID NO: 2260758 - protein, 9 aa, Cryptosporidium parvum
GSNSNLDAN

SEQ ID NO: 2260759 - protein, 16 aa, Cryptosporidium parvum
GSNSRYNTELSQSSAV

SEQ ID NO: 2260760 - protein, 30 aa, Cryptosporidium parvum
GSNSSQQNPIGGIGGSSTGGISSNNNNTGL

SEQ ID NO: 2260761 - protein, 10 aa, Cryptosporidium parvum
GSNTNEATDK

SEQ ID NO: 2260762 - protein, 6 aa, Cryptosporidium parvum
GSNTQI

SEQ ID NO: 2260763 - protein, 24 aa, Cryptosporidium parvum
GSNTTGTGVGTGTGTGTTNTLGGG

SEQ ID NO: 2260764 - protein, 4 aa, Cryptosporidium parvum
GSNV

SEQ ID NO: 2260765 - protein, 23 aa, Cryptosporidium parvum
GSNVESDYENGEEEDDDDEEDTF

SEQ ID NO: 2260766 - protein, 9 aa, Cryptosporidium parvum
GSPDREGTV

SEQ ID NO: 2260767 - protein, 16 aa, Cryptosporidium parvum
GSPDSEYSAADAPKGY

SEQ ID NO: 2260768 - protein, 7 aa, Cryptosporidium parvum
GSPDVTG

SEQ ID NO: 2260769 - protein, 4 aa, Cryptosporidium parvum
GSPE

SEQ ID NO: 2260770 - protein, 8 aa, Cryptosporidium parvum
GSPESTKA

SEQ ID NO: 2260771 - protein, 9 aa, Cryptosporidium parvum
GSPGTGKTC

SEQ ID NO: 2260772 - protein, 7 aa, Cryptosporidium parvum
GSPGTIN

SEQ ID NO: 2260773 - protein, 6 aa, Cryptosporidium parvum
GSPGTK

SEQ ID NO: 2260774 - protein, 5 aa, Cryptosporidium parvum
GSPGY

SEQ ID NO: 2260775 - protein, 4 aa, Cryptosporidium parvum
GSPI

SEQ ID NO: 2260776 - protein, 12 aa, Cryptosporidium parvum
GSPKVNDSENFS

SEQ ID NO: 2260777 - protein, 6 aa, Cryptosporidium parvum
GSPMNP

SEQ ID NO: 2260778 - protein, 5 aa, Cryptosporidium parvum
GSPMQ

SEQ ID NO: 2260779 - protein, 9 aa, Cryptosporidium parvum
GSPPFPGSN

SEQ ID NO: 2260780 - protein, 4 aa, Cryptosporidium parvum
GSPS

SEQ ID NO: 2260781 - protein, 35 aa, Cryptosporidium parvum
GSPSMQNNDSGNLSNINNQNGASNNGNDNGGQNYN

SEQ ID NO: 2260782 - protein, 6 aa, Cryptosporidium parvum
GSPYTN

SEQ ID NO: 2260783 - protein, 6 aa, Cryptosporidium parvum
GSQGEE

SEQ ID NO: 2260784 - protein, 9 aa, Cryptosporidium parvum
GSQGSSGFI

SEQ ID NO: 2260785 - protein, 4 aa, Cryptosporidium parvum
GSQH

SEQ ID NO: 2260786 - protein, 14 aa, Cryptosporidium parvum
GSQKDLDKTPESLG

SEQ ID NO: 2260787 - protein, 8 aa, Cryptosporidium parvum
GSQKENNK

SEQ ID NO: 2260788 - protein, 13 aa, Cryptosporidium parvum
GSQLSREYDHDSS

SEQ ID NO: 2260789 - protein, 9 aa, Cryptosporidium parvum
GSQNPPLGG

SEQ ID NO: 2260790 - protein, 12 aa, Cryptosporidium parvum
GSQNVPKNSANT

SEQ ID NO: 2260791 - protein, 5 aa, Cryptosporidium parvum
GSQPS

SEQ ID NO: 2260792 - protein, 7 aa, Cryptosporidium parvum
GSQPSKI

SEQ ID NO: 2260793 - protein, 14 aa, Cryptosporidium parvum
GSQQPNGSGNSLQN

SEQ ID NO: 2260794 - protein, 5 aa, Cryptosporidium parvum
GSQRS

SEQ ID NO: 2260795 - protein, 8 aa, Cryptosporidium parvum
GSQSMGVQ

SEQ ID NO: 2260796 - protein, 8 aa, Cryptosporidium parvum
GSQSSSLV

SEQ ID NO: 2260797 - protein, 5 aa, Cryptosporidium parvum
GSRGL

SEQ ID NO: 2260798 - protein, 8 aa, Cryptosporidium parvum
GSRIPSIS

SEQ ID NO: 2260799 - protein, 17 aa, Cryptosporidium parvum
GSRLSSGSKDCIVKIWR

SEQ ID NO: 2260800 - protein, 7 aa, Cryptosporidium parvum
GSRPGDE

SEQ ID NO: 2260801 - protein, 5 aa, Cryptosporidium parvum
GSRPI

SEQ ID NO: 2260802 - protein, 13 aa, Cryptosporidium parvum
GSRPSKRKSGGIE

SEQ ID NO: 2260803 - protein, 11 aa, Cryptosporidium parvum
GSRRDEDPKKL

SEQ ID NO: 2260804 - protein, 62 aa, Cryptosporidium parvum
GSRRPIEECSSNHNEDNSNRNKSRNNSENERSVNGGSINVNNENSDRRNVSSDVNRNNGNPW

SEQ ID NO: 2260805 - protein, 11 aa, Cryptosporidium parvum
GSRSSAIISPT

SEQ ID NO: 2260806 - protein, 4 aa, Cryptosporidium parvum
GSSA

SEQ ID NO: 2260807 - protein, 8 aa, Cryptosporidium parvum
GSSCTDPV

SEQ ID NO: 2260808 - protein, 4 aa, Cryptosporidium parvum
GSSD

SEQ ID NO: 2260809 - protein, 7 aa, Cryptosporidium parvum
GSSDNFP

SEQ ID NO: 2260810 - protein, 11 aa, Cryptosporidium parvum
GSSEAKNTSQV

SEQ ID NO: 2260811 - protein, 11 aa, Cryptosporidium parvum
GSSEIKSSEDN

SEQ ID NO: 2260812 - protein, 18 aa, Cryptosporidium parvum
GSSGGSGNIGITNNNGLT

SEQ ID NO: 2260813 - protein, 7 aa, Cryptosporidium parvum
GSSGKTS

SEQ ID NO: 2260814 - protein, 9 aa, Cryptosporidium parvum
GSSGSGDKQ

SEQ ID NO: 2260815 - protein, 11 aa, Cryptosporidium parvum
GSSGSSINVEN

SEQ ID NO: 2260816 - protein, 10 aa, Cryptosporidium parvum
GSSGTNGGRQ

SEQ ID NO: 2260817 - protein, 5 aa, Cryptosporidium parvum
GSSIA

SEQ ID NO: 2260818 - protein, 7 aa, Cryptosporidium parvum
GSSISNL

SEQ ID NO: 2260819 - protein, 6 aa, Cryptosporidium parvum
GSSKKK

SEQ ID NO: 2260820 - protein, 48 aa, Cryptosporidium parvum
GSSLSSGGLFGSGTSPLGLPSSSTAATATTNVNNNNNGINTNSQSTNN

SEQ ID NO: 2260821 - protein, 7 aa, Cryptosporidium parvum
GSSNLAD

SEQ ID NO: 2260822 - protein, 24 aa, Cryptosporidium parvum
GSSNRGRGSDRGGSGRGGSSRIGA

SEQ ID NO: 2260823 - protein, 9 aa, Cryptosporidium parvum
GSSNSGKST

SEQ ID NO: 2260824 - protein, 12 aa, Cryptosporidium parvum
GSSNVDGNDNIG

SEQ ID NO: 2260825 - protein, 13 aa, Cryptosporidium parvum
GSSNYNYRSTNKD

SEQ ID NO: 2260826 - protein, 9 aa, Cryptosporidium parvum
GSSPDSRFD

SEQ ID NO: 2260827 - protein, 13 aa, Cryptosporidium parvum
GSSQANEYGESDI

SEQ ID NO: 2260828 - protein, 5 aa, Cryptosporidium parvum
GSSQG

SEQ ID NO: 2260829 - protein, 29 aa, Cryptosporidium parvum
GSSQINSQERDQDHARNEGNSNNAASSNF

SEQ ID NO: 2260830 - protein, 9 aa, Cryptosporidium parvum
GSSQLQTDP

SEQ ID NO: 2260831 - protein, 10 aa, Cryptosporidium parvum
GSSQPSLNPK

SEQ ID NO: 2260832 - protein, 7 aa, Cryptosporidium parvum
GSSQTSL

SEQ ID NO: 2260833 - protein, 9 aa, Cryptosporidium parvum
GSSQTSNED

SEQ ID NO: 2260834 - protein, 4 aa, Cryptosporidium parvum
GSSR

SEQ ID NO: 2260835 - protein, 5 aa, Cryptosporidium parvum
GSSSA

SEQ ID NO: 2260836 - protein, 14 aa, Cryptosporidium parvum
GSSSASSSTQNAFS

SEQ ID NO: 2260837 - protein, 11 aa, Cryptosporidium parvum
GSSSFQSGNNT

SEQ ID NO: 2260838 - protein, 18 aa, Cryptosporidium parvum
GSSSKKKSKLYAPKHPNL

SEQ ID NO: 2260839 - protein, 12 aa, Cryptosporidium parvum
GSSSKWVPKETE

SEQ ID NO: 2260840 - protein, 7 aa, Cryptosporidium parvum
GSSSLNN

SEQ ID NO: 2260841 - protein, 5 aa, Cryptosporidium parvum
GSSSR

SEQ ID NO: 2260842 - protein, 14 aa, Cryptosporidium parvum
GSSSSGTRNGLSNY

SEQ ID NO: 2260843 - protein, 18 aa, Cryptosporidium parvum
GSSSSIEWNPSGVEQSQE

SEQ ID NO: 2260844 - protein, 18 aa, Cryptosporidium parvum
GSSTKNTNSNAGNSSGTN

SEQ ID NO: 2260845 - protein, 13 aa, Cryptosporidium parvum
GSSTPPSHLSPNH

SEQ ID NO: 2260846 - protein, 13 aa, Cryptosporidium parvum
GSSTRDGDFWTEG

SEQ ID NO: 2260847 - protein, 4 aa, Cryptosporidium parvum
GSSV

SEQ ID NO: 2260848 - protein, 20 aa, Cryptosporidium parvum
GSSVKANNKGIPSSPRDGAD

SEQ ID NO: 2260849 - protein, 6 aa, Cryptosporidium parvum
GSSVTK

SEQ ID NO: 2260850 - protein, 8 aa, Cryptosporidium parvum
GSSVTVDS

SEQ ID NO: 2260851 - protein, 4 aa, Cryptosporidium parvum
GSSW

SEQ ID NO: 2260852 - protein, 13 aa, Cryptosporidium parvum
GSTGPGAASNSLN

SEQ ID NO: 2260853 - protein, 7 aa, Cryptosporidium parvum
GSTGSNV

SEQ ID NO: 2260854 - protein, 14 aa, Cryptosporidium parvum
GSTIEKNDDGISCK

SEQ ID NO: 2260855 - protein, 4 aa, Cryptosporidium parvum
GSTK

SEQ ID NO: 2260856 - protein, 9 aa, Cryptosporidium parvum
GSTKVDDRQ

SEQ ID NO: 2260857 - protein, 5 aa, Cryptosporidium parvum
GSTNK

SEQ ID NO: 2260858 - protein, 9 aa, Cryptosporidium parvum
GSTPGIERQ

SEQ ID NO: 2260859 - protein, 7 aa, Cryptosporidium parvum
GSTPLPS

SEQ ID NO: 2260860 - protein, 4 aa, Cryptosporidium parvum
GSTR

SEQ ID NO: 2260861 - protein, 13 aa, Cryptosporidium parvum
GSTRPGEAAPGTI

SEQ ID NO: 2260862 - protein, 9 aa, Cryptosporidium parvum
GSTRSTGPN

SEQ ID NO: 2260863 - protein, 16 aa, Cryptosporidium parvum
GSTSESKTKFRTGESI

SEQ ID NO: 2260864 - protein, 7 aa, Cryptosporidium parvum
GSTSITR

SEQ ID NO: 2260865 - protein, 9 aa, Cryptosporidium parvum
GSTSNQTKN

SEQ ID NO: 2260866 - protein, 8 aa, Cryptosporidium parvum
GSTSTGFA

SEQ ID NO: 2260867 - protein, 4 aa, Cryptosporidium parvum
GSTT

SEQ ID NO: 2260868 - protein, 8 aa, Cryptosporidium parvum
GSVDNTDE

SEQ ID NO: 2260869 - protein, 8 aa, Cryptosporidium parvum
GSVEESTK

SEQ ID NO: 2260870 - protein, 9 aa, Cryptosporidium parvum
GSVEGTNIS

SEQ ID NO: 2260871 - protein, 9 aa, Cryptosporidium parvum
GSVGKGPGV

SEQ ID NO: 2260872 - protein, 5 aa, Cryptosporidium parvum
GSVNN

SEQ ID NO: 2260873 - protein, 6 aa, Cryptosporidium parvum
GSVPHS

SEQ ID NO: 2260874 - protein, 13 aa, Cryptosporidium parvum
GSVQTVPSNTVKN

SEQ ID NO: 2260875 - protein, 10 aa, Cryptosporidium parvum
GSVSNNNRYA

SEQ ID NO: 2260876 - protein, 16 aa, Cryptosporidium parvum
GSVSNSISNSNSSSIK

SEQ ID NO: 2260877 - protein, 26 aa, Cryptosporidium parvum
GSVSQHNGNNNNKSLLSTSSSSIKSM

SEQ ID NO: 2260878 - protein, 5 aa, Cryptosporidium parvum
GSYAP

SEQ ID NO: 2260879 - protein, 8 aa, Cryptosporidium parvum
GSYIENKG

SEQ ID NO: 2260880 - protein, 24 aa, Cryptosporidium parvum
GSYKRKNKSLAEYSESCDSIKTEE

SEQ ID NO: 2260881 - protein, 10 aa, Cryptosporidium parvum
GSYPNGYRNF

SEQ ID NO: 2260882 - protein, 10 aa, Cryptosporidium parvum
GSYSTSSLPA

SEQ ID NO: 2260883 - protein, 5 aa, Cryptosporidium parvum
GSYYD

SEQ ID NO: 2260884 - protein, 8 aa, Cryptosporidium parvum
GTAEYERP

SEQ ID NO: 2260885 - protein, 5 aa, Cryptosporidium parvum
GTANG

SEQ ID NO: 2260886 - protein, 11 aa, Cryptosporidium parvum
GTANGSNNDID

SEQ ID NO: 2260887 - protein, 5 aa, Cryptosporidium parvum
GTASD

SEQ ID NO: 2260888 - protein, 20 aa, Cryptosporidium parvum
GTASNHNSNANSPIDPNNTL

SEQ ID NO: 2260889 - protein, 4 aa, Cryptosporidium parvum
GTAY

SEQ ID NO: 2260890 - protein, 4 aa, Cryptosporidium parvum
GTCE

SEQ ID NO: 2260891 - protein, 11 aa, Cryptosporidium parvum
GTCSGTPKNLN

SEQ ID NO: 2260892 - protein, 8 aa, Cryptosporidium parvum
GTDDESFS

SEQ ID NO: 2260893 - protein, 6 aa, Cryptosporidium parvum
GTDDIK

SEQ ID NO: 2260894 - protein, 9 aa, Cryptosporidium parvum
GTDGTLSAV

SEQ ID NO: 2260895 - protein, 7 aa, Cryptosporidium parvum
GTDHEQV

SEQ ID NO: 2260896 - protein, 9 aa, Cryptosporidium parvum
GTDKRISGH

SEQ ID NO: 2260897 - protein, 12 aa, Cryptosporidium parvum
GTDNTSKQIGKE

SEQ ID NO: 2260898 - protein, 7 aa, Cryptosporidium parvum
GTDSDDF

SEQ ID NO: 2260899 - protein, 6 aa, Cryptosporidium parvum
GTEDDR

SEQ ID NO: 2260900 - protein, 6 aa, Cryptosporidium parvum
GTEDRC

SEQ ID NO: 2260901 - protein, 11 aa, Cryptosporidium parvum
GTEESPGEKEL

SEQ ID NO: 2260902 - protein, 7 aa, Cryptosporidium parvum
GTEGFNG

SEQ ID NO: 2260903 - protein, 9 aa, Cryptosporidium parvum
GTEGNKREL

SEQ ID NO: 2260904 - protein, 10 aa, Cryptosporidium parvum
GTEGSIAGDG

SEQ ID NO: 2260905 - protein, 4 aa, Cryptosporidium parvum
GTEH

SEQ ID NO: 2260906 - protein, 26 aa, Cryptosporidium parvum
GTEIDSSTEDKDLNLASKSSSRGRTR

SEQ ID NO: 2260907 - protein, 9 aa, Cryptosporidium parvum
GTEKKSNNY

SEQ ID NO: 2260908 - protein, 4 aa, Cryptosporidium parvum
GTEN

SEQ ID NO: 2260909 - protein, 5 aa, Cryptosporidium parvum
GTENI

SEQ ID NO: 2260910 - protein, 4 aa, Cryptosporidium parvum
GTEP

SEQ ID NO: 2260911 - protein, 8 aa, Cryptosporidium parvum
GTEQGTPN

SEQ ID NO: 2260912 - protein, 9 aa, Cryptosporidium parvum
GTESQRMET

SEQ ID NO: 2260913 - protein, 9 aa, Cryptosporidium parvum
GTESSNESI

SEQ ID NO: 2260914 - protein, 10 aa, Cryptosporidium parvum
GTESTTEDIY

SEQ ID NO: 2260915 - protein, 5 aa, Cryptosporidium parvum
GTETA

SEQ ID NO: 2260916 - protein, 6 aa, Cryptosporidium parvum
GTFDPV

SEQ ID NO: 2260917 - protein, 18 aa, Cryptosporidium parvum
GTFSSRKKSSFTRKRSKE

SEQ ID NO: 2260918 - protein, 27 aa, Cryptosporidium parvum
GTGAGAGGAGNGAGGVAEYGGTPSQMR

SEQ ID NO: 2260919 - protein, 5 aa, Cryptosporidium parvum
GTGDI

SEQ ID NO: 2260920 - protein, 19 aa, Cryptosporidium parvum
GTGDSFERSAKDLTTPRLK

SEQ ID NO: 2260921 - protein, 4 aa, Cryptosporidium parvum
GTGK

SEQ ID NO: 2260922 - protein, 8 aa, Cryptosporidium parvum
GTGMPASG

SEQ ID NO: 2260923 - protein, 48 aa, Cryptosporidium parvum
GTGNTPSSVNKSKPTKLEKVPENEESGDSCTKNGSESLSKKIKPSNAG

SEQ ID NO: 2260924 - protein, 9 aa, Cryptosporidium parvum
GTGPSTRQA

SEQ ID NO: 2260925 - protein, 15 aa, Cryptosporidium parvum
GTGQLKTGAPCRSER

SEQ ID NO: 2260926 - protein, 4 aa, Cryptosporidium parvum
GTGS

SEQ ID NO: 2260927 - protein, 5 aa, Cryptosporidium parvum
GTGSI

SEQ ID NO: 2260928 - protein, 11 aa, Cryptosporidium parvum
GTGSRGKHHGK

SEQ ID NO: 2260929 - protein, 6 aa, Cryptosporidium parvum
GTGSVG

SEQ ID NO: 2260930 - protein, 20 aa, Cryptosporidium parvum
GTGTGSFSRTTSNLSPAQQN

SEQ ID NO: 2260931 - protein, 30 aa, Cryptosporidium parvum
GTGTGSGSGTGTGAGAGTVTVTGSGTGSTV

SEQ ID NO: 2260932 - protein, 10 aa, Cryptosporidium parvum
GTGTNNIRPE

SEQ ID NO: 2260933 - protein, 4 aa, Cryptosporidium parvum
GTGY

SEQ ID NO: 2260934 - protein, 9 aa, Cryptosporidium parvum
GTHPTHGRG

SEQ ID NO: 2260935 - protein, 10 aa, Cryptosporidium parvum
GTHSTLTTKQ

SEQ ID NO: 2260936 - protein, 8 aa, Cryptosporidium parvum
GTHTSGMD

SEQ ID NO: 2260937 - protein, 4 aa, Cryptosporidium parvum
GTIA

SEQ ID NO: 2260938 - protein, 4 aa, Cryptosporidium parvum
GTIE

SEQ ID NO: 2260939 - protein, 4 aa, Cryptosporidium parvum
GTIP

SEQ ID NO: 2260940 - protein, 6 aa, Cryptosporidium parvum
GTIPEE

SEQ ID NO: 2260941 - protein, 24 aa, Cryptosporidium parvum
GTIPLDSNTENQNKKKRAKSKYGD

SEQ ID NO: 2260942 - protein, 19 aa, Cryptosporidium parvum
GTIQSKSEVIQKKDSGLDS

SEQ ID NO: 2260943 - protein, 6 aa, Cryptosporidium parvum
GTISDS

SEQ ID NO: 2260944 - protein, 16 aa, Cryptosporidium parvum
GTISDTGNKSGAMNTG

SEQ ID NO: 2260945 - protein, 17 aa, Cryptosporidium parvum
GTITNYKSNKGQFNQSN

SEQ ID NO: 2260946 - protein, 11 aa, Cryptosporidium parvum
GTITTSETAHN

SEQ ID NO: 2260947 - protein, 16 aa, Cryptosporidium parvum
GTKAQTLKRGFLDYSK

SEQ ID NO: 2260948 - protein, 10 aa, Cryptosporidium parvum
GTKDNDFNNS

SEQ ID NO: 2260949 - protein, 10 aa, Cryptosporidium parvum
GTKEREGNNA

SEQ ID NO: 2260950 - protein, 5 aa, Cryptosporidium parvum
GTKGF

SEQ ID NO: 2260951 - protein, 12 aa, Cryptosporidium parvum
GTKGYNQLNQNQ

SEQ ID NO: 2260952 - protein, 4 aa, Cryptosporidium parvum
GTKL

SEQ ID NO: 2260953 - protein, 6 aa, Cryptosporidium parvum
GTKNVE

SEQ ID NO: 2260954 - protein, 4 aa, Cryptosporidium parvum
GTKS

SEQ ID NO: 2260955 - protein, 11 aa, Cryptosporidium parvum
GTLANNENQLS

SEQ ID NO: 2260956 - protein, 5 aa, Cryptosporidium parvum
GTLDS

SEQ ID NO: 2260957 - protein, 19 aa, Cryptosporidium parvum
GTLEGSKENFKNSEENSPI

SEQ ID NO: 2260958 - protein, 4 aa, Cryptosporidium parvum
GTLP

SEQ ID NO: 2260959 - protein, 5 aa, Cryptosporidium parvum
GTLPE

SEQ ID NO: 2260960 - protein, 6 aa, Cryptosporidium parvum
GTLSEK

SEQ ID NO: 2260961 - protein, 7 aa, Cryptosporidium parvum
GTLSGLG

SEQ ID NO: 2260962 - protein, 5 aa, Cryptosporidium parvum
GTLSP

SEQ ID NO: 2260963 - protein, 5 aa, Cryptosporidium parvum
GTLTP

SEQ ID NO: 2260964 - protein, 6 aa, Cryptosporidium parvum
GTMEGV

SEQ ID NO: 2260965 - protein, 7 aa, Cryptosporidium parvum
GTMGKEL

SEQ ID NO: 2260966 - protein, 36 aa, Cryptosporidium parvum
GTNCQSSEGNNNKEIPTKTLPSNITGNKTTLYGRNP

SEQ ID NO: 2260967 - protein, 9 aa, Cryptosporidium parvum
GTNETLPYS

SEQ ID NO: 2260968 - protein, 4 aa, Cryptosporidium parvum
GTNI

SEQ ID NO: 2260969 - protein, 8 aa, Cryptosporidium parvum
GTNIPKNS

SEQ ID NO: 2260970 - protein, 14 aa, Cryptosporidium parvum
GTNNNDKEKSSKKA

SEQ ID NO: 2260971 - protein, 5 aa, Cryptosporidium parvum
GTNNS

SEQ ID NO: 2260972 - protein, 18 aa, Cryptosporidium parvum
GTNNSNFGANTGNVGTNN

SEQ ID NO: 2260973 - protein, 7 aa, Cryptosporidium parvum
GTNQQKI

SEQ ID NO: 2260974 - protein, 10 aa, Cryptosporidium parvum
GTNRTSTVPS

SEQ ID NO: 2260975 - protein, 4 aa, Cryptosporidium parvum
GTNS

SEQ ID NO: 2260976 - protein, 11 aa, Cryptosporidium parvum
GTNSQQASSLR

SEQ ID NO: 2260977 - protein, 5 aa, Cryptosporidium parvum
GTNTL

SEQ ID NO: 2260978 - protein, 7 aa, Cryptosporidium parvum
GTNTNDI

SEQ ID NO: 2260979 - protein, 14 aa, Cryptosporidium parvum
GTNYQKGSSDKHSM

SEQ ID NO: 2260980 - protein, 6 aa, Cryptosporidium parvum
GTPEKI

SEQ ID NO: 2260981 - protein, 5 aa, Cryptosporidium parvum
GTPGR

SEQ ID NO: 2260982 - protein, 7 aa, Cryptosporidium parvum
GTPLQND

SEQ ID NO: 2260983 - protein, 7 aa, Cryptosporidium parvum
GTPNPKV

SEQ ID NO: 2260984 - protein, 8 aa, Cryptosporidium parvum
GTPPDIKK

SEQ ID NO: 2260985 - protein, 5 aa, Cryptosporidium parvum
GTPQY

SEQ ID NO: 2260986 - protein, 24 aa, Cryptosporidium parvum
GTPRRVNSNSSKEGQSKKKRDLEV

SEQ ID NO: 2260987 - protein, 9 aa, Cryptosporidium parvum
GTPSPNITS

SEQ ID NO: 2260988 - protein, 8 aa, Cryptosporidium parvum
GTPSRDDL

SEQ ID NO: 2260989 - protein, 18 aa, Cryptosporidium parvum
GTPTYEYGDPREGEHKQW

SEQ ID NO: 2260990 - protein, 14 aa, Cryptosporidium parvum
GTQNNTPNKPTNTY

SEQ ID NO: 2260991 - protein, 7 aa, Cryptosporidium parvum
GTQPDLE

SEQ ID NO: 2260992 - protein, 17 aa, Cryptosporidium parvum
GTQPKVLENSEGMRTTP

SEQ ID NO: 2260993 - protein, 22 aa, Cryptosporidium parvum
GTQSISEEDRNIHSTGSYSPFG

SEQ ID NO: 2260994 - protein, 6 aa, Cryptosporidium parvum
GTRFGG

SEQ ID NO: 2260995 - protein, 26 aa, Cryptosporidium parvum
GTRKYHPENIDNPTNLSIGKEGGYFP

SEQ ID NO: 2260996 - protein, 4 aa, Cryptosporidium parvum
GTRN

SEQ ID NO: 2260997 - protein, 20 aa, Cryptosporidium parvum
GTRNNSISAVSSSNSSNITN

SEQ ID NO: 2260998 - protein, 7 aa, Cryptosporidium parvum
GTRNSND

SEQ ID NO: 2260999 - protein, 6 aa, Cryptosporidium parvum
GTRQGS

SEQ ID NO: 2261000 - protein, 8 aa, Cryptosporidium parvum
GTRTEPNE

SEQ ID NO: 2261001 - protein, 9 aa, Cryptosporidium parvum
GTSAQDAPI

SEQ ID NO: 2261002 - protein, 7 aa, Cryptosporidium parvum
GTSCEPP

SEQ ID NO: 2261003 - protein, 12 aa, Cryptosporidium parvum
GTSDPSHEVSPE

SEQ ID NO: 2261004 - protein, 10 aa, Cryptosporidium parvum
GTSERGEPVD

SEQ ID NO: 2261005 - protein, 12 aa, Cryptosporidium parvum
GTSFTNGRKSRE

SEQ ID NO: 2261006 - protein, 8 aa, Cryptosporidium parvum
GTSGDEGS

SEQ ID NO: 2261007 - protein, 10 aa, Cryptosporidium parvum
GTSGYEYKDG

SEQ ID NO: 2261008 - protein, 37 aa, Cryptosporidium parvum; identical to SEQ ID NO: 2144369

SEQ ID NO: 2261009 - protein, 6 aa, Cryptosporidium parvum
GTSLTP

SEQ ID NO: 2261010 - protein, 14 aa, Cryptosporidium parvum
GTSNSNQSQGTGLN

SEQ ID NO: 2261011 - protein, 4 aa, Cryptosporidium parvum
GTSS

SEQ ID NO: 2261012 - protein, 6 aa, Cryptosporidium parvum
GTSSRE

SEQ ID NO: 2261013 - protein, 7 aa, Cryptosporidium parvum
GTSTENA

SEQ ID NO: 2261014 - protein, 8 aa, Cryptosporidium parvum
GTSVRDDM

SEQ ID NO: 2261015 - protein, 7 aa, Cryptosporidium parvum
GTSWNSK

SEQ ID NO: 2261016 - protein, 12 aa, Cryptosporidium parvum
GTSYESSSCAGL

SEQ ID NO: 2261017 - protein, 14 aa, Cryptosporidium parvum
GTSYLGSSAKFSND

SEQ ID NO: 2261018 - protein, 9 aa, Cryptosporidium parvum
GTTEPAKVN

SEQ ID NO: 2261019 - protein, 8 aa, Cryptosporidium parvum
GTTGIDNQ

SEQ ID NO: 2261020 - protein, 12 aa, Cryptosporidium parvum
GTTGSEAAKSIA

SEQ ID NO: 2261021 - protein, 5 aa, Cryptosporidium parvum
GTTHK

SEQ ID NO: 2261022 - protein, 17 aa, Cryptosporidium parvum
GTTIGGSGIGQNGQINM

SEQ ID NO: 2261023 - protein, 36 aa, Cryptosporidium parvum; identical to SEQ ID NO: 2144382

SEQ ID NO: 2261024 - protein, 11 aa, Cryptosporidium parvum
GTTKKSQKELN

SEQ ID NO: 2261025 - protein, 28 aa, Cryptosporidium parvum
GTTLSSSSTTPNLSISNSSTSPSPSLET

SEQ ID NO: 2261026 - protein, 4 aa, Cryptosporidium parvum
GTTN

SEQ ID NO: 2261027 - protein, 9 aa, Cryptosporidium parvum
GTTPKSTIH

SEQ ID NO: 2261028 - protein, 11 aa, Cryptosporidium parvum
GTTPNTGAHSG

SEQ ID NO: 2261029 - protein, 6 aa, Cryptosporidium parvum
GTTQKN

SEQ ID NO: 2261030 - protein, 24 aa, Cryptosporidium parvum
GTTQVGGKGTARRKKRAQKPTGVD

SEQ ID NO: 2261031 - protein, 8 aa, Cryptosporidium parvum
GTVEGSID

SEQ ID NO: 2261032 - protein, 11 aa, Cryptosporidium parvum
GTVENGRVDGN

SEQ ID NO: 2261033 - protein, 9 aa, Cryptosporidium parvum
GTVKTENNP

SEQ ID NO: 2261034 - protein, 4 aa, Cryptosporidium parvum
GTYD

SEQ ID NO: 2261035 - protein, 28 aa, Cryptosporidium parvum
GTYESFTNSAHKNCGKKSGYKLPKGNVP

SEQ ID NO: 2261036 - protein, 5 aa, Cryptosporidium parvum
GTYGS

SEQ ID NO: 2261037 - protein, 52 aa, Cryptosporidium parvum
GTYHNEQSTGIATNNGISSINTSNTSTTTTTTNNNNNNNNNINNNINSSNID

SEQ ID NO: 2261038 - protein, 5 aa, Cryptosporidium parvum
GTYLP

SEQ ID NO: 2261039 - protein, 35 aa, Cryptosporidium parvum
GTYPINNSKQDGSSNSENNNNSQKNESIQQNSTEI

SEQ ID NO: 2261040 - protein, 4 aa, Cryptosporidium parvum
GTYV

SEQ ID NO: 2261041 - protein, 4 aa, Cryptosporidium parvum
GTYY

SEQ ID NO: 2261042 - protein, 19 aa, Cryptosporidium parvum
GVAEIDPNNIQENKKPDID

SEQ ID NO: 2261043 - protein, 4 aa, Cryptosporidium parvum
GVAK

SEQ ID NO: 2261044 - protein, 9 aa, Cryptosporidium parvum
GVAPDRYTG

SEQ ID NO: 2261045 - protein, 5 aa, Cryptosporidium parvum
GVAPS

SEQ ID NO: 2261046 - protein, 29 aa, Cryptosporidium parvum
GVARAKKELVDRRNQRRSDQTNKSNTDVE

SEQ ID NO: 2261047 - protein, 15 aa, Cryptosporidium parvum
GVCNTGRNALPKKSV

SEQ ID NO: 2261048 - protein, 10 aa, Cryptosporidium parvum
GVEEAKNRAC

SEQ ID NO: 2261049 - protein, 5 aa, Cryptosporidium parvum
GVEES

SEQ ID NO: 2261050 - protein, 4 aa, Cryptosporidium parvum
GVEG

SEQ ID NO: 2261051 - protein, 10 aa, Cryptosporidium parvum
GVENGEPIED

SEQ ID NO: 2261052 - protein, 10 aa, Cryptosporidium parvum
GVENQNENIN

SEQ ID NO: 2261053 - protein, 10 aa, Cryptosporidium parvum
GVEPQSNSAH

SEQ ID NO: 2261054 - protein, 8 aa, Cryptosporidium parvum
GVESADQR

SEQ ID NO: 2261055 - protein, 39 aa, Cryptosporidium parvum
GVGAGAGAVHGSSSSSIGTNQEKRKENNERKSEKNNQSV

SEQ ID NO: 2261056 - protein, 29 aa, Cryptosporidium parvum
GVGAGGIGAGIGADEDFNAENENSSEKER

SEQ ID NO: 2261057 - protein, 11 aa, Cryptosporidium parvum
GVGASSGAIPG

SEQ ID NO: 2261058 - protein, 4 aa, Cryptosporidium parvum
GVGE

SEQ ID NO: 2261059 - protein, 9 aa, Cryptosporidium parvum
GVGEDTKGT

SEQ ID NO: 2261060 - protein, 5 aa, Cryptosporidium parvum
GVGER

SEQ ID NO: 2261061 - protein, 27 aa, Cryptosporidium parvum
GVGGAGVGVGAATGATGATGATGVGYP

SEQ ID NO: 2261062 - protein, 5 aa, Cryptosporidium parvum
GVGGG

SEQ ID NO: 2261063 - protein, 8 aa, Cryptosporidium parvum
GVGGPKDA

SEQ ID NO: 2261064 - protein, 4 aa, Cryptosporidium parvum
GVGK

SEQ ID NO: 2261065 - protein, 5 aa, Cryptosporidium parvum
GVGKG

SEQ ID NO: 2261066 - protein, 5 aa, Cryptosporidium parvum
GVGQP

SEQ ID NO: 2261067 - protein, 11 aa, Cryptosporidium parvum
GVGRTAKANEF

SEQ ID NO: 2261068 - protein, 15 aa, Cryptosporidium parvum
GVGSGVGSGSPTGGF

SEQ ID NO: 2261069 - protein, 8 aa, Cryptosporidium parvum
GVGSIRSN

SEQ ID NO: 2261070 - protein, 6 aa, Cryptosporidium parvum
GVGSTY

SEQ ID NO: 2261071 - protein, 6 aa, Cryptosporidium parvum
GVGTRE

SEQ ID NO: 2261072 - protein, 29 aa, Cryptosporidium parvum
GVIEEDDSMEEKDSAKKEEGNKDKKPENI

SEQ ID NO: 2261073 - protein, 8 aa, Cryptosporidium parvum
GVKKGNVH

SEQ ID NO: 2261074 - protein, 29 aa, Cryptosporidium parvum
GVKNPNFEYSESDISDFSDPSGVDDASNL

SEQ ID NO: 2261075 - protein, 23 aa, Cryptosporidium parvum
GVKNRSSADLKAGKSIKDALEDE

SEQ ID NO: 2261076 - protein, 12 aa, Cryptosporidium parvum
GVKNSGKGTATV

SEQ ID NO: 2261077 - protein, 13 aa, Cryptosporidium parvum
GVKQNSGKQNSNF

SEQ ID NO: 2261078 - protein, 9 aa, Cryptosporidium parvum
GVKSGKALS

SEQ ID NO: 2261079 - protein, 6 aa, Cryptosporidium parvum
GVKSPK

SEQ ID NO: 2261080 - protein, 9 aa, Cryptosporidium parvum
GVNDPLNDE

SEQ ID NO: 2261081 - protein, 15 aa, Cryptosporidium parvum
GVNNGNSNNVIGSRS

SEQ ID NO: 2261082 - protein, 7 aa, Cryptosporidium parvum
GVNNGVG

SEQ ID NO: 2261083 - protein, 12 aa, Cryptosporidium parvum
GVNPSTVASETG

SEQ ID NO: 2261084 - protein, 9 aa, Cryptosporidium parvum
GVNSDKYKR

SEQ ID NO: 2261085 - protein, 5 aa, Cryptosporidium parvum
GVNSE

SEQ ID NO: 2261086 - protein, 26 aa, Cryptosporidium parvum
GVNTNGDNLVKQSDSTNQKKGALNNP

SEQ ID NO: 2261087 - protein, 5 aa, Cryptosporidium parvum
GVNTS

SEQ ID NO: 2261088 - protein, 10 aa, Cryptosporidium parvum
GVPDLNGSQL

SEQ ID NO: 2261089 - protein, 14 aa, Cryptosporidium parvum
GVPFRSADSDPSTL

SEQ ID NO: 2261090 - protein, 84 aa, Cryptosporidium parvum
GVPGVPATATTASATATTDTDAPAAPAPAPAPAPAPAPAPAPAPAPAPAPAPAPAPAPSSSSALGAPSDSNSLPETENVSRTAI

SEQ ID NO: 2261091 - protein, 6 aa, Cryptosporidium parvum
GVPKEY

SEQ ID NO: 2261092 - protein, 7 aa, Cryptosporidium parvum
GVPNEKF

SEQ ID NO: 2261093 - protein, 7 aa, Cryptosporidium parvum
GVPNPLP

SEQ ID NO: 2261094 - protein, 4 aa, Cryptosporidium parvum
GVPQ

SEQ ID NO: 2261095 - protein, 4 aa, Cryptosporidium parvum
GVPS

SEQ ID NO: 2261096 - protein, 10 aa, Cryptosporidium parvum
GVPSSGNSNM

SEQ ID NO: 2261097 - protein, 26 aa, Cryptosporidium parvum
GVPSSSSSSVSVSSKLNRNNSDPSVF

SEQ ID NO: 2261098 - protein, 7 aa, Cryptosporidium parvum
GVPVPPS

SEQ ID NO: 2261099 - protein, 5 aa, Cryptosporidium parvum
GVQDA

SEQ ID NO: 2261100 - protein, 11 aa, Cryptosporidium parvum
GVQGKGSGTMP

SEQ ID NO: 2261101 - protein, 5 aa, Cryptosporidium parvum
GVQPK

SEQ ID NO: 2261102 - protein, 39 aa, Cryptosporidium parvum
GVQQQQQQQKQQQQQQQQQQQQQQQQQQQQINGNGQLPG

SEQ ID NO: 2261103 - protein, 10 aa, Cryptosporidium parvum
GVRKNYDQDD

SEQ ID NO: 2261104 - protein, 5 aa, Cryptosporidium parvum
GVRPE

SEQ ID NO: 2261105 - protein, 12 aa, Cryptosporidium parvum
GVRSSAPFPPGY

SEQ ID NO: 2261106 - protein, 17 aa, Cryptosporidium parvum
GVRTTGTSKLASSPSIG

SEQ ID NO: 2261107 - protein, 44 aa, Cryptosporidium parvum
GVSDTSSSSSSGNSSNSSSSSSSSSSSSSSSSEYSESSGNDDRI

SEQ ID NO: 2261108 - protein, 5 aa, Cryptosporidium parvum
GVSGA

SEQ ID NO: 2261109 - protein, 14 aa, Cryptosporidium parvum
GVSGQSSSEITTTS

SEQ ID NO: 2261110 - protein, 4 aa, Cryptosporidium parvum
GVSI

SEQ ID NO: 2261111 - protein, 7 aa, Cryptosporidium parvum
GVSKREK

SEQ ID NO: 2261112 - protein, 6 aa, Cryptosporidium parvum
GVSPHV

SEQ ID NO: 2261113 - protein, 10 aa, Cryptosporidium parvum
GVSPKDIYQR

SEQ ID NO: 2261114 - protein, 9 aa, Cryptosporidium parvum
GVSPTQDDV

SEQ ID NO: 2261115 - protein, 13 aa, Cryptosporidium parvum
GVSQNSNVQNNEN

SEQ ID NO: 2261116 - protein, 8 aa, Cryptosporidium parvum
GVSQSDLE

SEQ ID NO: 2261117 - protein, 9 aa, Cryptosporidium parvum
GVSRDDQTI

SEQ ID NO: 2261118 - protein, 14 aa, Cryptosporidium parvum
GVSRSMPTSTSLNN

SEQ ID NO: 2261119 - protein, 7 aa, Cryptosporidium parvum
GVSRSSS

SEQ ID NO: 2261120 - protein, 31 aa, Cryptosporidium parvum
GVSSETKSNNVSKSNSSYSVTNAARPSNSIR

SEQ ID NO: 2261121 - protein, 9 aa, Cryptosporidium parvum
GVSSRKRRE

SEQ ID NO: 2261122 - protein, 14 aa, Cryptosporidium parvum
GVSSSSSEGVPTQE

SEQ ID NO: 2261123 - protein, 17 aa, Cryptosporidium parvum
GVSTRNSRKGRVSNRGR

SEQ ID NO: 2261124 - protein, 6 aa, Cryptosporidium parvum
GVSTSI

SEQ ID NO: 2261125 - protein, 6 aa, Cryptosporidium parvum
GVTNER

SEQ ID NO: 2261126 - protein, 8 aa, Cryptosporidium parvum
GVTPPEPK

SEQ ID NO: 2261127 - protein, 5 aa, Cryptosporidium parvum
GVTPR

SEQ ID NO: 2261128 - protein, 5 aa, Cryptosporidium parvum
GVTQR

SEQ ID NO: 2261129 - protein, 7 aa, Cryptosporidium parvum
GVTTTPE

SEQ ID NO: 2261130 - protein, 7 aa, Cryptosporidium parvum
GWKKNSA

SEQ ID NO: 2261131 - protein, 23 aa, Cryptosporidium parvum
GYAGNSLSKQSQASNTQGSNPIN

SEQ ID NO: 2261132 - protein, 13 aa, Cryptosporidium parvum
GYANSKSNNNGNE

SEQ ID NO: 2261133 - protein, 5 aa, Cryptosporidium parvum
GYDDK

SEQ ID NO: 2261134 - protein, 7 aa, Cryptosporidium parvum
GYDGKPV

SEQ ID NO: 2261135 - protein, 4 aa, Cryptosporidium parvum
GYDT

SEQ ID NO: 2261136 - protein, 5 aa, Cryptosporidium parvum
GYDTA

SEQ ID NO: 2261137 - protein, 4 aa, Cryptosporidium parvum
GYEE

SEQ ID NO: 2261138 - protein, 8 aa, Cryptosporidium parvum
GYEGDSKV

SEQ ID NO: 2261139 - protein, 9 aa, Cryptosporidium parvum
GYESSGGLS

SEQ ID NO: 2261140 - protein, 4 aa, Cryptosporidium parvum
GYFE

SEQ ID NO: 2261141 - protein, 8 aa, Cryptosporidium parvum
GYGEDSGK

SEQ ID NO: 2261142 - protein, 25 aa, Cryptosporidium parvum
GYGPNMNTNNLPASSSINPPPPGSL

SEQ ID NO: 2261143 - protein, 5 aa, Cryptosporidium parvum
GYGSR

SEQ ID NO: 2261144 - protein, 9 aa, Cryptosporidium parvum
GYHENPEYE

SEQ ID NO: 2261145 - protein, 7 aa, Cryptosporidium parvum
GYHPEEN

SEQ ID NO: 2261146 - protein, 8 aa, Cryptosporidium parvum
GYISTEQN

SEQ ID NO: 2261147 - protein, 32 aa, Cryptosporidium parvum; identical to SEQ ID NO: 2144471

SEQ ID NO: 2261148 - protein, 4 aa, Cryptosporidium parvum
GYKN

SEQ ID NO: 2261149 - protein, 9 aa, Cryptosporidium parvum
GYKWTQTEE

SEQ ID NO: 2261150 - protein, 5 aa, Cryptosporidium parvum
GYKYS

SEQ ID NO: 2261151 - protein, 9 aa, Cryptosporidium parvum
GYLSPKEKK

SEQ ID NO: 2261152 - protein, 8 aa, Cryptosporidium parvum
GYNEGSRE

SEQ ID NO: 2261153 - protein, 38 aa, Cryptosporidium parvum
GYNNNSESNNGQMNITENGSQFQSNGDPSQASTLTTGV

SEQ ID NO: 2261154 - protein, 5 aa, Cryptosporidium parvum
GYNPA

SEQ ID NO: 2261155 - protein, 7 aa, Cryptosporidium parvum
GYNPSEL

SEQ ID NO: 2261156 - protein, 5 aa, Cryptosporidium parvum
GYNTE

SEQ ID NO: 2261157 - protein, 10 aa, Cryptosporidium parvum
GYPDTRQHGS

SEQ ID NO: 2261158 - protein, 11 aa, Cryptosporidium parvum
GYPEKSPPEIN

SEQ ID NO: 2261159 - protein, 34 aa, Cryptosporidium parvum
GYPPPQMEGGSAHHYPPAPEPYESSFQGNYRYSR

SEQ ID NO: 2261160 - protein, 17 aa, Cryptosporidium parvum
GYPPSLGSGPGSGTGSM

SEQ ID NO: 2261161 - protein, 7 aa, Cryptosporidium parvum
GYQGTDE

SEQ ID NO: 2261162 - protein, 4 aa, Cryptosporidium parvum
GYQS

SEQ ID NO: 2261163 - protein, 33 aa, Cryptosporidium parvum; identical to SEQ ID NO: 2144484

SEQ ID NO: 2261164 - protein, 7 aa, Cryptosporidium parvum
GYRDYNK

SEQ ID NO: 2261165 - protein, 5 aa, Cryptosporidium parvum
GYRET

SEQ ID NO: 2261166 - protein, 38 aa, Cryptosporidium parvum
GYRQSGGSRGGGSGSMGSRGGGSGSMGSRGGFSRGGRR

SEQ ID NO: 2261167 - protein, 48 aa, Cryptosporidium parvum
GYRREKSKSQAQMKASTESIETTDSDAAAIAATSEGAQIKQGQQGRDF

SEQ ID NO: 2261168 - protein, 4 aa, Cryptosporidium parvum
GYRT

SEQ ID NO: 2261169 - protein, 10 aa, Cryptosporidium parvum
GYSAPYGSAM

SEQ ID NO: 2261170 - protein, 9 aa, Cryptosporidium parvum
GYSDTEISE

SEQ ID NO: 2261171 - protein, 4 aa, Cryptosporidium parvum
GYSG

SEQ ID NO: 2261172 - protein, 7 aa, Cryptosporidium parvum
GYSKGQS

SEQ ID NO: 2261173 - protein, 10 aa, Cryptosporidium parvum
GYSKSNNESF

SEQ ID NO: 2261174 - protein, 8 aa, Cryptosporidium parvum
GYSNEPRL

SEQ ID NO: 2261175 - protein, 6 aa, Cryptosporidium parvum
GYSNRQ

SEQ ID NO: 2261176 - protein, 8 aa, Cryptosporidium parvum
GYSPFTDY

SEQ ID NO: 2261177 - protein, 24 aa, Cryptosporidium parvum
GYSSKSNNFPEKLSNGSNSANELS

SEQ ID NO: 2261178 - protein, 18 aa, Cryptosporidium parvum
GYSSPPSLNNDKNSSQSN

SEQ ID NO: 2261179 - protein, 5 aa, Cryptosporidium parvum
GYSSS

SEQ ID NO: 2261180 - protein, 10 aa, Cryptosporidium parvum
GYSSSLNDKE

SEQ ID NO: 2261181 - protein, 12 aa, Cryptosporidium parvum
GYTESTKRKHEV

SEQ ID NO: 2261182 - protein, 6 aa, Cryptosporidium parvum
GYTPSR

SEQ ID NO: 2261183 - protein, 4 aa, Cryptosporidium parvum
GYTQ

SEQ ID NO: 2261184 - protein, 6 aa, Cryptosporidium parvum
GYVDDG

SEQ ID NO: 2261185 - protein, 20 aa, Cryptosporidium parvum
GYVTNDSVKQENSKKADTFN

SEQ ID NO: 2261186 - protein, 8 aa, Cryptosporidium parvum
GYYDSSDN

SEQ ID NO: 2261187 - protein, 6 aa, Cryptosporidium parvum
GYYEEG

SEQ ID NO: 2261188 - protein, 7 aa, Cryptosporidium parvum
GYYEPPT

SEQ ID NO: 2261189 - protein, 5 aa, Cryptosporidium parvum
GYYRG

SEQ ID NO: 2261190 - protein, 8 aa, Cryptosporidium parvum
HAAKENRL

SEQ ID NO: 2261191 - protein, 9 aa, Cryptosporidium parvum
HADNKGSIE

SEQ ID NO: 2261192 - protein, 30 aa, Cryptosporidium parvum; identical to SEQ ID NO: 2144506

SEQ ID NO: 2261193 - protein, 9 aa, Cryptosporidium parvum
HAENGGELY

SEQ ID NO: 2261194 - protein, 8 aa, Cryptosporidium parvum
HAESDDGS

SEQ ID NO: 2261195 - protein, 7 aa, Cryptosporidium parvum
HAGDDES

SEQ ID NO: 2261196 - protein, 6 aa, Cryptosporidium parvum
HAGIAT

SEQ ID NO: 2261197 - protein, 4 aa, Cryptosporidium parvum
HAGN

SEQ ID NO: 2261198 - protein, 7 aa, Cryptosporidium parvum
HAGTPDY

SEQ ID NO: 2261199 - protein, 5 aa, Cryptosporidium parvum
HANEN

SEQ ID NO: 2261200 - protein, 11 aa, Cryptosporidium parvum
HANKGKYPQFN

SEQ ID NO: 2261201 - protein, 8 aa, Cryptosporidium parvum
HANTGIEN

SEQ ID NO: 2261202 - protein, 13 aa, Cryptosporidium parvum
HAPGGANSKINTS

SEQ ID NO: 2261203 - protein, 4 aa, Cryptosporidium parvum
HAPL

SEQ ID NO: 2261204 - protein, 6 aa, Cryptosporidium parvum
HAPRNI

SEQ ID NO: 2261205 - protein, 6 aa, Cryptosporidium parvum
HAQGKK

SEQ ID NO: 2261206 - protein, 8 aa, Cryptosporidium parvum
HASESASV

SEQ ID NO: 2261207 - protein, 4 aa, Cryptosporidium parvum
HASF

SEQ ID NO: 2261208 - protein, 7 aa, Cryptosporidium parvum
HASLNNH

SEQ ID NO: 2261209 - protein, 9 aa, Cryptosporidium parvum
HASNSSNNI

SEQ ID NO: 2261210 - protein, 6 aa, Cryptosporidium parvum
HATQND

SEQ ID NO: 2261211 - protein, 4 aa, Cryptosporidium parvum
HATS

SEQ ID NO: 2261212 - protein, 17 aa, Cryptosporidium parvum
HAVSEGTKAVTKYTSAS

SEQ ID NO: 2261213 - protein, 4 aa, Cryptosporidium parvum
HAYS

SEQ ID NO: 2261214 - protein, 15 aa, Cryptosporidium parvum
HCNNKQENTKYNSSL

SEQ ID NO: 2261215 - protein, 11 aa, Cryptosporidium parvum
HCPNSSVSRNI

SEQ ID NO: 2261216 - protein, 6 aa, Cryptosporidium parvum
HCSDNT

SEQ ID NO: 2261217 - protein, 5 aa, Cryptosporidium parvum
HCSHS

SEQ ID NO: 2261218 - protein, 13 aa, Cryptosporidium parvum
HCYSNEKNKTGIP

SEQ ID NO: 2261219 - protein, 6 aa, Cryptosporidium parvum
HDASQN

SEQ ID NO: 2261220 - protein, 7 aa, Cryptosporidium parvum
HDATPNM

SEQ ID NO: 2261221 - protein, 4 aa, Cryptosporidium parvum
HDDI

SEQ ID NO: 2261222 - protein, 8 aa, Cryptosporidium parvum
HDDKSESL

SEQ ID NO: 2261223 - protein, 6 aa, Cryptosporidium parvum
HDDPDL

SEQ ID NO: 2261224 - protein, 5 aa, Cryptosporidium parvum
HDDYP

SEQ ID NO: 2261225 - protein, 17 aa, Cryptosporidium parvum
HDEATNENNELKETFSE

SEQ ID NO: 2261226 - protein, 8 aa, Cryptosporidium parvum
HDEESDDN

SEQ ID NO: 2261227 - protein, 4 aa, Cryptosporidium parvum
HDEF

SEQ ID NO: 2261228 - protein, 8 aa, Cryptosporidium parvum
HDEIDQYE

SEQ ID NO: 2261229 - protein, 10 aa, Cryptosporidium parvum
HDEKEDSDNI

SEQ ID NO: 2261230 - protein, 8 aa, Cryptosporidium parvum
HDETNNSA

SEQ ID NO: 2261231 - protein, 8 aa, Cryptosporidium parvum
HDGNSSKI

SEQ ID NO: 2261232 - protein, 4 aa, Cryptosporidium parvum
HDGT

SEQ ID NO: 2261233 - protein, 12 aa, Cryptosporidium parvum
HDGYNQSASYGT

SEQ ID NO: 2261234 - protein, 4 aa, Cryptosporidium parvum
HDHS

SEQ ID NO: 2261235 - protein, 32 aa, Cryptosporidium parvum
HDHSNAHKEQEEKNSEKDLCPPSGGRSRKSIR

SEQ ID NO: 2261236 - protein, 7 aa, Cryptosporidium parvum
HDKGAGS

SEQ ID NO: 2261237 - protein, 17 aa, Cryptosporidium parvum
HDKKSNKKQTSRDNTNI

SEQ ID NO: 2261238 - protein, 6 aa, Cryptosporidium parvum
HDKTES

SEQ ID NO: 2261239 - protein, 21 aa, Cryptosporidium parvum
HDKTKNDFYHTDTDKPINPNN

SEQ ID NO: 2261240 - protein, 11 aa, Cryptosporidium parvum
HDNDEDSDDDI

SEQ ID NO: 2261241 - protein, 4 aa, Cryptosporidium parvum
HDNP

SEQ ID NO: 2261242 - protein, 6 aa, Cryptosporidium parvum
HDNYAG

SEQ ID NO: 2261243 - protein, 29 aa, Cryptosporidium parvum
HDPNPPKKETSKSIYSEKKYDTLESRNPN

SEQ ID NO: 2261244 - protein, 5 aa, Cryptosporidium parvum
HDPSN

SEQ ID NO: 2261245 - protein, 19 aa, Cryptosporidium parvum
HDQAGNRCNGGNPSGDDRI

SEQ ID NO: 2261246 - protein, 21 aa, Cryptosporidium parvum
HDQAGNVAVRSDQSGEEKAST

SEQ ID NO: 2261247 - protein, 6 aa, Cryptosporidium parvum
HDQDEH

SEQ ID NO: 2261248 - protein, 7 aa, Cryptosporidium parvum
HDQKNED

SEQ ID NO: 2261249 - protein, 6 aa, Cryptosporidium parvum
HDQSKG

SEQ ID NO: 2261250 - protein, 11 aa, Cryptosporidium parvum
HDRNSGVTKQK

SEQ ID NO: 2261251 - protein, 5 aa, Cryptosporidium parvum
HDSDP

SEQ ID NO: 2261252 - protein, 8 aa, Cryptosporidium parvum
HDSNGQPL

SEQ ID NO: 2261253 - protein, 9 aa, Cryptosporidium parvum
HDSNSEKIR

SEQ ID NO: 2261254 - protein, 19 aa, Cryptosporidium parvum
HDSRIPPIDTNNNNNNTGL

SEQ ID NO: 2261255 - protein, 70 aa, Cryptosporidium parvum
HDTLKSNSPKNSTNQTGGSSKDNLDSNKAKDSKKSREKFNSLENSKSSKREASKKSDLDEKQKVKKPESS

SEQ ID NO: 2261256 - protein, 8 aa, Cryptosporidium parvum
HDTSAPDL

SEQ ID NO: 2261257 - protein, 5 aa, Cryptosporidium parvum
HDVEG

SEQ ID NO: 2261258 - protein, 10 aa, Cryptosporidium parvum
HDVGKNDNTG

SEQ ID NO: 2261259 - protein, 11 aa, Cryptosporidium parvum
HEASAAEITGE

SEQ ID NO: 2261260 - protein, 11 aa, Cryptosporidium parvum
HEAVKESHQRY

SEQ ID NO: 2261261 - protein, 7 aa, Cryptosporidium parvum
HEDASNP

SEQ ID NO: 2261262 - protein, 6 aa, Cryptosporidium parvum
HEDASV

SEQ ID NO: 2261263 - protein, 10 aa, Cryptosporidium parvum
HEDEGVPATS

SEQ ID NO: 2261264 - protein, 37 aa, Cryptosporidium parvum
HEDENEDDDDEDEDDDNDEVDDNGNEDEDDEDYNSKI

SEQ ID NO: 2261265 - protein, 4 aa, Cryptosporidium parvum
HEDQ

SEQ ID NO: 2261266 - protein, 4 aa, Cryptosporidium parvum
HEDR

SEQ ID NO: 2261267 - protein, 10 aa, Cryptosporidium parvum
HEDTIDKSTQ

SEQ ID NO: 2261268 - protein, 6 aa, Cryptosporidium parvum
HEDVDK

SEQ ID NO: 2261269 - protein, 4 aa, Cryptosporidium parvum
HEEE

SEQ ID NO: 2261270 - protein, 19 aa, Cryptosporidium parvum
HEEEQRRKEEEAKREEEEA

SEQ ID NO: 2261271 - protein, 8 aa, Cryptosporidium parvum
HEENRKNL

SEQ ID NO: 2261272 - protein, 7 aa, Cryptosporidium parvum
HEETQPK

SEQ ID NO: 2261273 - protein, 7 aa, Cryptosporidium parvum
HEETSIS

SEQ ID NO: 2261274 - protein, 4 aa, Cryptosporidium parvum
HEFP

SEQ ID NO: 2261275 - protein, 15 aa, Cryptosporidium parvum
HEGEKKNKDLDSKNK

SEQ ID NO: 2261276 - protein, 10 aa, Cryptosporidium parvum
HEGPGSLTSA

SEQ ID NO: 2261277 - protein, 7 aa, Cryptosporidium parvum
HEGRGET

SEQ ID NO: 2261278 - protein, 23 aa, Cryptosporidium parvum
HEGRVDTQLDSSNLQSKLSSREF

SEQ ID NO: 2261279 - protein, 6 aa, Cryptosporidium parvum
HEITNE

SEQ ID NO: 2261280 - protein, 6 aa, Cryptosporidium parvum
HEKESC

SEQ ID NO: 2261281 - protein, 13 aa, Cryptosporidium parvum
HEKKYNNRNPSLN

SEQ ID NO: 2261282 - protein, 4 aa, Cryptosporidium parvum
HEKN

SEQ ID NO: 2261283 - protein, 18 aa, Cryptosporidium parvum
HEKSGNNEKKDSSSPVKD

SEQ ID NO: 2261284 - protein, 10 aa, Cryptosporidium parvum
HEKSVESELE

SEQ ID NO: 2261285 - protein, 8 aa, Cryptosporidium parvum
HEKTEQEK

SEQ ID NO: 2261286 - protein, 4 aa, Cryptosporidium parvum
HENA

SEQ ID NO: 2261287 - protein, 22 aa, Cryptosporidium parvum
HENDQTEEIGEKAPKKRKSSAH

SEQ ID NO: 2261288 - protein, 7 aa, Cryptosporidium parvum
HENENTD

SEQ ID NO: 2261289 - protein, 9 aa, Cryptosporidium parvum
HENKGDAGI

SEQ ID NO: 2261290 - protein, 5 aa, Cryptosporidium parvum
HENKT

SEQ ID NO: 2261291 - protein, 8 aa, Cryptosporidium parvum
HENPTKNP

SEQ ID NO: 2261292 - protein, 10 aa, Cryptosporidium parvum
HENSNQEEAM

SEQ ID NO: 2261293 - protein, 5 aa, Cryptosporidium parvum
HEPEV

SEQ ID NO: 2261294 - protein, 4 aa, Cryptosporidium parvum
HEPK

SEQ ID NO: 2261295 - protein, 15 aa, Cryptosporidium parvum
HEPNELKTENSKDPQ

SEQ ID NO: 2261296 - protein, 7 aa, Cryptosporidium parvum
HEPRYTS

SEQ ID NO: 2261297 - protein, 6 aa, Cryptosporidium parvum
HEPTGR

SEQ ID NO: 2261298 - protein, 7 aa, Cryptosporidium parvum
HEQKLET

SEQ ID NO: 2261299 - protein, 4 aa, Cryptosporidium parvum
HEQN

SEQ ID NO: 2261300 - protein, 15 aa, Cryptosporidium parvum
HERPEERSKSEANIE

SEQ ID NO: 2261301 - protein, 10 aa, Cryptosporidium parvum
HERPTPNIQK

SEQ ID NO: 2261302 - protein, 4 aa, Cryptosporidium parvum
HERS

SEQ ID NO: 2261303 - protein, 5 aa, Cryptosporidium parvum
HERSI

SEQ ID NO: 2261304 - protein, 5 aa, Cryptosporidium parvum
HERTV

SEQ ID NO: 2261305 - protein, 11 aa, Cryptosporidium parvum
HESEHASNSTY

SEQ ID NO: 2261306 - protein, 6 aa, Cryptosporidium parvum
HESFPT

SEQ ID NO: 2261307 - protein, 15 aa, Cryptosporidium parvum
HESGNTSSNRSHDFN

SEQ ID NO: 2261308 - protein, 8 aa, Cryptosporidium parvum
HESHSSRR

SEQ ID NO: 2261309 - protein, 23 aa, Cryptosporidium parvum
HESPIGIEGSGLSKIKDKDQTSI

SEQ ID NO: 2261310 - protein, 7 aa, Cryptosporidium parvum
HESPTQP

SEQ ID NO: 2261311 - protein, 6 aa, Cryptosporidium parvum
HESRQI

SEQ ID NO: 2261312 - protein, 5 aa, Cryptosporidium parvum
HESSH

SEQ ID NO: 2261313 - protein, 10 aa, Cryptosporidium parvum
HESSSGPMVG

SEQ ID NO: 2261314 - protein, 10 aa, Cryptosporidium parvum
HESSSSSSQL

SEQ ID NO: 2261315 - protein, 4 aa, Cryptosporidium parvum
HETI

SEQ ID NO: 2261316 - protein, 7 aa, Cryptosporidium parvum
HETKQKR

SEQ ID NO: 2261317 - protein, 4 aa, Cryptosporidium parvum
HETR

SEQ ID NO: 2261318 - protein, 5 aa, Cryptosporidium parvum
HETRQ

SEQ ID NO: 2261319 - protein, 4 aa, Cryptosporidium parvum
HEVS

SEQ ID NO: 2261320 - protein, 33 aa, Cryptosporidium parvum
HEYIETQSSPHQNTKKIQKKKPPISLRSGFNFN

SEQ ID NO: 2261321 - protein, 7 aa, Cryptosporidium parvum
HEYNEND

SEQ ID NO: 2261322 - protein, 10 aa, Cryptosporidium parvum
HFSQNDSEGV

SEQ ID NO: 2261323 - protein, 32 aa, Cryptosporidium parvum
HFSRENSKYTELPNEEKDRLRGESLERDKSIA

SEQ ID NO: 2261324 - protein, 6 aa, Cryptosporidium parvum
HFSSNT

SEQ ID NO: 2261325 - protein, 11 aa, Cryptosporidium parvum
HFTDENKNSVN

SEQ ID NO: 2261326 - protein, 15 aa, Cryptosporidium parvum
HGAEENDYTGNEEDD

SEQ ID NO: 2261327 - protein, 15 aa, Cryptosporidium parvum
HGDGGLISGVLSSCC

SEQ ID NO: 2261328 - protein, 17 aa, Cryptosporidium parvum
HGDQCSRNHYKPTSSPT

SEQ ID NO: 2261329 - protein, 6 aa, Cryptosporidium parvum
HGDQLP

SEQ ID NO: 2261330 - protein, 6 aa, Cryptosporidium parvum
HGDSST

SEQ ID NO: 2261331 - protein, 4 aa, Cryptosporidium parvum
HGEF

SEQ ID NO: 2261332 - protein, 14 aa, Cryptosporidium parvum
HGERQHGSDVRSNN

SEQ ID NO: 2261333 - protein, 5 aa, Cryptosporidium parvum
HGESI

SEQ ID NO: 2261334 - protein, 7 aa, Cryptosporidium parvum
HGESSLQ

SEQ ID NO: 2261335 - protein, 14 aa, Cryptosporidium parvum
HGFSQGSKCNTENL

SEQ ID NO: 2261336 - protein, 4 aa, Cryptosporidium parvum
HGFT

SEQ ID NO: 2261337 - protein, 11 aa, Cryptosporidium parvum
HGGDPTQVQAP

SEQ ID NO: 2261338 - protein, 4 aa, Cryptosporidium parvum
HGGI

SEQ ID NO: 2261339 - protein, 15 aa, Cryptosporidium parvum
HGGKRHGSTTRSTTT

SEQ ID NO: 2261340 - protein, 8 aa, Cryptosporidium parvum
HGGQTVDS

SEQ ID NO: 2261341 - protein, 4 aa, Cryptosporidium parvum
HGGS

SEQ ID NO: 2261342 - protein, 14 aa, Cryptosporidium parvum
HGGSSSGGSNTKVS

SEQ ID NO: 2261343 - protein, 14 aa, Cryptosporidium parvum
HGIDPTGTYHGESD

SEQ ID NO: 2261344 - protein, 6 aa, Cryptosporidium parvum
HGKGLS

SEQ ID NO: 2261345 - protein, 10 aa, Cryptosporidium parvum
HGKKKQTSRM

SEQ ID NO: 2261346 - protein, 6 aa, Cryptosporidium parvum
HGKPEY

SEQ ID NO: 2261347 - protein, 38 aa, Cryptosporidium parvum
HGKQSDGYSNNNHSYGNKSINHKGKGNAAKSNYQESKE

SEQ ID NO: 2261348 - protein, 8 aa, Cryptosporidium parvum
HGNGTEQI

SEQ ID NO: 2261349 - protein, 11 aa, Cryptosporidium parvum
HGNIGSKLNTS

SEQ ID NO: 2261350 - protein, 20 aa, Cryptosporidium parvum
HGNSHYNDYERDSYNHGDRN

SEQ ID NO: 2261351 - protein, 5 aa, Cryptosporidium parvum
HGNTL

SEQ ID NO: 2261352 - protein, 7 aa, Cryptosporidium parvum
HGPDSDL

SEQ ID NO: 2261353 - protein, 5 aa, Cryptosporidium parvum
HGPHG

SEQ ID NO: 2261354 - protein, 14 aa, Cryptosporidium parvum
HGSCDGSKSYSGIS

SEQ ID NO: 2261355 - protein, 8 aa, Cryptosporidium parvum
HGSKNRST

SEQ ID NO: 2261356 - protein, 5 aa, Cryptosporidium parvum
HGSNN

SEQ ID NO: 2261357 - protein, 7 aa, Cryptosporidium parvum
HGSNQTS

SEQ ID NO: 2261358 - protein, 4 aa, Cryptosporidium parvum
HGSP

SEQ ID NO: 2261359 - protein, 10 aa, Cryptosporidium parvum
HGSQKERRQI

SEQ ID NO: 2261360 - protein, 10 aa, Cryptosporidium parvum
HGSRKPNKAI

SEQ ID NO: 2261361 - protein, 11 aa, Cryptosporidium parvum
HGTGTSLGDPI

SEQ ID NO: 2261362 - protein, 8 aa, Cryptosporidium parvum
HGTNRGKS

SEQ ID NO: 2261363 - protein, 14 aa, Cryptosporidium parvum
HGTPKDKLRRERER

SEQ ID NO: 2261364 - protein, 6 aa, Cryptosporidium parvum
HGTSQN

SEQ ID NO: 2261365 - protein, 6 aa, Cryptosporidium parvum
HGYSSS

SEQ ID NO: 2261366 - protein, 9 aa, Cryptosporidium parvum
HHDGDNRTH

SEQ ID NO: 2261367 - protein, 5 aa, Cryptosporidium parvum
HHDNN

SEQ ID NO: 2261368 - protein, 11 aa, Cryptosporidium parvum
HHESSKTNHRL

SEQ ID NO: 2261369 - protein, 15 aa, Cryptosporidium parvum
HHHKHDHKNDIDYND

SEQ ID NO: 2261370 - protein, 16 aa, Cryptosporidium parvum
HHLTDDDLKTPLPRTY

SEQ ID NO: 2261371 - protein, 6 aa, Cryptosporidium parvum
HHNNNR

SEQ ID NO: 2261372 - protein, 5 aa, Cryptosporidium parvum
HHPDS

SEQ ID NO: 2261373 - protein, 26 aa, Cryptosporidium parvum
HHPDSENKLGVPTRIQKESDKIKSKL

SEQ ID NO: 2261374 - protein, 56 aa, Cryptosporidium parvum
HHPPFNGDNSSSSSTSTSSTSTSTSTSTTSTSTSTTTTTTTTTTTTTTTTTNEEVN

SEQ ID NO: 2261375 - protein, 22 aa, Cryptosporidium parvum
HHSASNSPVLSRDGEKNELSSV

SEQ ID NO: 2261376 - protein, 10 aa, Cryptosporidium parvum
HHSGSPHPTR

SEQ ID NO: 2261377 - protein, 7 aa, Cryptosporidium parvum
HIENGNN

SEQ ID NO: 2261378 - protein, 7 aa, Cryptosporidium parvum
HIQNQPT

SEQ ID NO: 2261379 - protein, 4 aa, Cryptosporidium parvum
HIQS

SEQ ID NO: 2261380 - protein, 13 aa, Cryptosporidium parvum
HIQTQKQEQSQGY

SEQ ID NO: 2261381 - protein, 4 aa, Cryptosporidium parvum
HIRS

SEQ ID NO: 2261382 - protein, 7 aa, Cryptosporidium parvum
HISKSSM

SEQ ID NO: 2261383 - protein, 4 aa, Cryptosporidium parvum
HISP

SEQ ID NO: 2261384 - protein, 9 aa, Cryptosporidium parvum
HITGGNDEY

SEQ ID NO: 2261385 - protein, 15 aa, Cryptosporidium parvum
HITSNNNNNNINTDP

SEQ ID NO: 2261386 - protein, 6 aa, Cryptosporidium parvum
HKDGPL

SEQ ID NO: 2261387 - protein, 19 aa, Cryptosporidium parvum
HKDGSSKSIYNESKSISMN

SEQ ID NO: 2261388 - protein, 10 aa, Cryptosporidium parvum
HKDGTSPTPE

SEQ ID NO: 2261389 - protein, 21 aa, Cryptosporidium parvum
HKDMTKDDYSNTQKSNTDHNL

SEQ ID NO: 2261390 - protein, 4 aa, Cryptosporidium parvum
HKDN

SEQ ID NO: 2261391 - protein, 8 aa, Cryptosporidium parvum
HKDQKVDD

SEQ ID NO: 2261392 - protein, 27 aa, Cryptosporidium parvum
HKDSIGKGGSHGVNQKDNNDASLKESR

SEQ ID NO: 2261393 - protein, 10 aa, Cryptosporidium parvum
HKEGNTVRED

SEQ ID NO: 2261394 - protein, 29 aa, Cryptosporidium parvum
HKEIQEKSADPDSANESISNNNKSPTNTI

SEQ ID NO: 2261395 - protein, 5 aa, Cryptosporidium parvum
HKEIT

SEQ ID NO: 2261396 - protein, 20 aa, Cryptosporidium parvum
HKENDSEERRVTRSMRKSGE

SEQ ID NO: 2261397 - protein, 5 aa, Cryptosporidium parvum
HKENF

SEQ ID NO: 2261398 - protein, 8 aa, Cryptosporidium parvum
HKEQSRDL

SEQ ID NO: 2261399 - protein, 12 aa, Cryptosporidium parvum
HKERDDKSQDFE

SEQ ID NO: 2261400 - protein, 4 aa, Cryptosporidium parvum
HKET

SEQ ID NO: 2261401 - protein, 7 aa, Cryptosporidium parvum
HKEYSGD

SEQ ID NO: 2261402 - protein, 18 aa, Cryptosporidium parvum
HKFSKSGNSGALLGQTSG

SEQ ID NO: 2261403 - protein, 4 aa, Cryptosporidium parvum
HKGE

SEQ ID NO: 2261404 - protein, 6 aa, Cryptosporidium parvum
HKGGEG

SEQ ID NO: 2261405 - protein, 4 aa, Cryptosporidium parvum
HKGT

SEQ ID NO: 2261406 - protein, 4 aa, Cryptosporidium parvum
HKHN

SEQ ID NO: 2261407 - protein, 23 aa, Cryptosporidium parvum
HKKDKKVKLDEDDNIRDNKSQTF

SEQ ID NO: 2261408 - protein, 8 aa, Cryptosporidium parvum
HKKPDKQN

SEQ ID NO: 2261409 - protein, 11 aa, Cryptosporidium parvum
HKKSNVESNSH

SEQ ID NO: 2261410 - protein, 8 aa, Cryptosporidium parvum
HKKSPPTK

SEQ ID NO: 2261411 - protein, 11 aa, Cryptosporidium parvum
HKLNGKNFKTE

SEQ ID NO: 2261412 - protein, 7 aa, Cryptosporidium parvum
HKNEVSD

SEQ ID NO: 2261413 - protein, 9 aa, Cryptosporidium parvum
HKNGGSLDN

SEQ ID NO: 2261414 - protein, 8 aa, Cryptosporidium parvum
HKNGYFNN

SEQ ID NO: 2261415 - protein, 13 aa, Cryptosporidium parvum
HKNKRKKGKKVDS

SEQ ID NO: 2261416 - protein, 9 aa, Cryptosporidium parvum
HKNSEQTKY

SEQ ID NO: 2261417 - protein, 9 aa, Cryptosporidium parvum
HKNSSSINN

SEQ ID NO: 2261418 - protein, 12 aa, Cryptosporidium parvum
HKNYDNSNLNAK

SEQ ID NO: 2261419 - protein, 10 aa, Cryptosporidium parvum
HKPAHQKIGR

SEQ ID NO: 2261420 - protein, 4 aa, Cryptosporidium parvum
HKPE

SEQ ID NO: 2261421 - protein, 7 aa, Cryptosporidium parvum
HKPELPL

SEQ ID NO: 2261422 - protein, 8 aa, Cryptosporidium parvum
HKPPGRAD

SEQ ID NO: 2261423 - protein, 10 aa, Cryptosporidium parvum
HKQNNNEVPV

SEQ ID NO: 2261424 - protein, 36 aa, Cryptosporidium parvum
HKREGKQIKSRFGEKPPDFDESARKGSSSSASGGFT

SEQ ID NO: 2261425 - protein, 8 aa, Cryptosporidium parvum
HKRQEGRS

SEQ ID NO: 2261426 - protein, 18 aa, Cryptosporidium parvum
HKSNSSHNSSPSSNSSLA

SEQ ID NO: 2261427 - protein, 9 aa, Cryptosporidium parvum
HKSQNDNEA

SEQ ID NO: 2261428 - protein, 22 aa, Cryptosporidium parvum
HKSSNIGNTYRGDNAIRNSGEV

SEQ ID NO: 2261429 - protein, 4 aa, Cryptosporidium parvum
HKST

SEQ ID NO: 2261430 - protein, 5 aa, Cryptosporidium parvum
HKTDA

SEQ ID NO: 2261431 - protein, 6 aa, Cryptosporidium parvum
HKTGKT

SEQ ID NO: 2261432 - protein, 8 aa, Cryptosporidium parvum
HKTLRGPR

SEQ ID NO: 2261433 - protein, 6 aa, Cryptosporidium parvum
HKTNGG

SEQ ID NO: 2261434 - protein, 7 aa, Cryptosporidium parvum
HKTNLDP

SEQ ID NO: 2261435 - protein, 8 aa, Cryptosporidium parvum
HKTPRGAA

SEQ ID NO: 2261436 - protein, 16 aa, Cryptosporidium parvum
HKTQSYSDNRDPAEES

SEQ ID NO: 2261437 - protein, 7 aa, Cryptosporidium parvum
HKTSGIS

SEQ ID NO: 2261438 - protein, 10 aa, Cryptosporidium parvum
HKVSDGTDHK

SEQ ID NO: 2261439 - protein, 9 aa, Cryptosporidium parvum
HKYNQDDEL

SEQ ID NO: 2261440 - protein, 6 aa, Cryptosporidium parvum
HKYSPE

SEQ ID NO: 2261441 - protein, 38 aa, Cryptosporidium parvum
HLEDNERTTTRIYPNSRRNHQNTKNCSNSSSSSNTNNH

SEQ ID NO: 2261442 - protein, 13 aa, Cryptosporidium parvum
HLEEQEGNSYSNY

SEQ ID NO: 2261443 - protein, 5 aa, Cryptosporidium parvum
HLESQ

SEQ ID NO: 2261444 - protein, 16 aa, Cryptosporidium parvum
HLGSSFGDNGTNNSSD

SEQ ID NO: 2261445 - protein, 10 aa, Cryptosporidium parvum
HLNDSSNNEH

SEQ ID NO: 2261446 - protein, 8 aa, Cryptosporidium parvum
HLPKSSTN

SEQ ID NO: 2261447 - protein, 9 aa, Cryptosporidium parvum
HLPKTSRRK

SEQ ID NO: 2261448 - protein, 12 aa, Cryptosporidium parvum
HLPPTEKDGLSG

SEQ ID NO: 2261449 - protein, 5 aa, Cryptosporidium parvum
HLPQL

SEQ ID NO: 2261450 - protein, 7 aa, Cryptosporidium parvum
HLPSRSQ

SEQ ID NO: 2261451 - protein, 9 aa, Cryptosporidium parvum
HLQSSDKER

SEQ ID NO: 2261452 - protein, 4 aa, Cryptosporidium parvum
HLRS

SEQ ID NO: 2261453 - protein, 10 aa, Cryptosporidium parvum
HLTPTSSNVM

SEQ ID NO: 2261454 - protein, 5 aa, Cryptosporidium parvum
HMDPQ

SEQ ID NO: 2261455 - protein, 10 aa, Cryptosporidium parvum
HMPSNQRNLQ

SEQ ID NO: 2261456 - protein, 6 aa, Cryptosporidium parvum
HMSTNP

SEQ ID NO: 2261457 - protein, 6 aa, Cryptosporidium parvum
HNALNS

SEQ ID NO: 2261458 - protein, 16 aa, Cryptosporidium parvum
HNDGSPGLYQTDPSGI

SEQ ID NO: 2261459 - protein, 6 aa, Cryptosporidium parvum
HNDSIS

SEQ ID NO: 2261460 - protein, 8 aa, Cryptosporidium parvum
HNEAPSPR

SEQ ID NO: 2261461 - protein, 10 aa, Cryptosporidium parvum
HNEDEKTTGE

SEQ ID NO: 2261462 - protein, 9 aa, Cryptosporidium parvum
HNEDGSRIK

SEQ ID NO: 2261463 - protein, 16 aa, Cryptosporidium parvum
HNEKNYDRSDSDRQMS

SEQ ID NO: 2261464 - protein, 7 aa, Cryptosporidium parvum
HNEQQTK

SEQ ID NO: 2261465 - protein, 7 aa, Cryptosporidium parvum
HNESSLT

SEQ ID NO: 2261466 - protein, 9 aa, Cryptosporidium parvum
HNGDGTREK

SEQ ID NO: 2261467 - protein, 4 aa, Cryptosporidium parvum
HNGE

SEQ ID NO: 2261468 - protein, 17 aa, Cryptosporidium parvum
HNGEIKKGAKKTKSGVP

SEQ ID NO: 2261469 - protein, 6 aa, Cryptosporidium parvum
HNGNSK

SEQ ID NO: 2261470 - protein, 11 aa, Cryptosporidium parvum
HNGSDAEADQI

SEQ ID NO: 2261471 - protein, 9 aa, Cryptosporidium parvum
HNGSGKTAT

SEQ ID NO: 2261472 - protein, 8 aa, Cryptosporidium parvum
HNGSRKSR

SEQ ID NO: 2261473 - protein, 5 aa, Cryptosporidium parvum
HNGTQ

SEQ ID NO: 2261474 - protein, 76 aa, Cryptosporidium parvum
HNHNHGHSHGHGHGHGQGHVQGHSHGHGQRHGHGHGHGHTQTQNQNHSHQARTTGDQSIQQESNNASKVATTIGSN

SEQ ID NO: 2261475 - protein, 6 aa, Cryptosporidium parvum
HNHPAG

SEQ ID NO: 2261476 - protein, 8 aa, Cryptosporidium parvum
HNHPNHEK

SEQ ID NO: 2261477 - protein, 36 aa, Cryptosporidium parvum
HNHQNSGNSSSGVETTSTIEDSSSSSSTSAKPVESH

SEQ ID NO: 2261478 - protein, 15 aa, Cryptosporidium parvum
HNIPQTVPSPAVSGG

SEQ ID NO: 2261479 - protein, 9 aa, Cryptosporidium parvum
HNKEQNSYN

SEQ ID NO: 2261480 - protein, 14 aa, Cryptosporidium parvum
HNKETEKKSNGLSI

SEQ ID NO: 2261481 - protein, 23 aa, Cryptosporidium parvum
HNKFDQAHSPRKDFARARQNMTN

SEQ ID NO: 2261482 - protein, 13 aa, Cryptosporidium parvum
HNKHHKHAKSDLF

SEQ ID NO: 2261483 - protein, 23 aa, Cryptosporidium parvum
HNKKKKNKKKKDIKKGKHVTING

SEQ ID NO: 2261484 - protein, 41 aa, Cryptosporidium parvum
HNKNESKNGVYGQGIKGGNKVKDKDRVSSEEENMSEDETKN

SEQ ID NO: 2261485 - protein, 7 aa, Cryptosporidium parvum
HNKPSLE

SEQ ID NO: 2261486 - protein, 12 aa, Cryptosporidium parvum
HNLPGPNPKKEY

SEQ ID NO: 2261487 - protein, 6 aa, Cryptosporidium parvum
HNNGIT

SEQ ID NO: 2261488 - protein, 4 aa, Cryptosporidium parvum
HNNN

SEQ ID NO: 2261489 - protein, 14 aa, Cryptosporidium parvum
HNNQKKNKYTEKNQ

SEQ ID NO: 2261490 - protein, 5 aa, Cryptosporidium parvum
HNNSM

SEQ ID NO: 2261491 - protein, 9 aa, Cryptosporidium parvum
HNPEERPTS

SEQ ID NO: 2261492 - protein, 7 aa, Cryptosporidium parvum
HNPIQDN

SEQ ID NO: 2261493 - protein, 4 aa, Cryptosporidium parvum
HNPK

SEQ ID NO: 2261494 - protein, 18 aa, Cryptosporidium parvum
HNPRKSKWTKAYRKTRGK

SEQ ID NO: 2261495 - protein, 6 aa, Cryptosporidium parvum
HNQDTV

SEQ ID NO: 2261496 - protein, 32 aa, Cryptosporidium parvum; identical to SEQ ID NO: 2144753

SEQ ID NO: 2261497 - protein, 16 aa, Cryptosporidium parvum
HNQGNNKKGEDSEKRI

SEQ ID NO: 2261498 - protein, 27 aa, Cryptosporidium parvum
HNQNESKLESHKKTKIESNDSNRKNHI

SEQ ID NO: 2261499 - protein, 6 aa, Cryptosporidium parvum
HNQPVI

SEQ ID NO: 2261500 - protein, 20 aa, Cryptosporidium parvum
HNQSCSHNQGPIQKNPTGGC

SEQ ID NO: 2261501 - protein, 11 aa, Cryptosporidium parvum
HNQTSKSISTN

SEQ ID NO: 2261502 - protein, 4 aa, Cryptosporidium parvum
HNRN

SEQ ID NO: 2261503 - protein, 5 aa, Cryptosporidium parvum
HNRSS

SEQ ID NO: 2261504 - protein, 9 aa, Cryptosporidium parvum
HNRSSPQNI

SEQ ID NO: 2261505 - protein, 11 aa, Cryptosporidium parvum
HNSEDESTNPW

SEQ ID NO: 2261506 - protein, 18 aa, Cryptosporidium parvum
HNSEFNKDNYYNEKNNLN

SEQ ID NO: 2261507 - protein, 26 aa, Cryptosporidium parvum
HNSKGDSDLDDDLNSGGSTYDGEIEE

SEQ ID NO: 2261508 - protein, 6 aa, Cryptosporidium parvum
HNSKPI

SEQ ID NO: 2261509 - protein, 13 aa, Cryptosporidium parvum
HNSNNSETKPAFV

SEQ ID NO: 2261510 - protein, 8 aa, Cryptosporidium parvum
HNSPDFKR

SEQ ID NO: 2261511 - protein, 17 aa, Cryptosporidium parvum
HNSSDSTINTNSNSFEK

SEQ ID NO: 2261512 - protein, 11 aa, Cryptosporidium parvum
HNSSPPKALSS

SEQ ID NO: 2261513 - protein, 13 aa, Cryptosporidium parvum
HNSSSPVNKSKGL

SEQ ID NO: 2261514 - protein, 7 aa, Cryptosporidium parvum
HNSSTQQ

SEQ ID NO: 2261515 - protein, 30 aa, Cryptosporidium parvum
HNSYQNSEIDQENSINTSNNISKAPESESE

SEQ ID NO: 2261516 - protein, 9 aa, Cryptosporidium parvum
HNTCKKSHN

SEQ ID NO: 2261517 - protein, 8 aa, Cryptosporidium parvum
HNTGKSRK

SEQ ID NO: 2261518 - protein, 5 aa, Cryptosporidium parvum
HNTNE

SEQ ID NO: 2261519 - protein, 10 aa, Cryptosporidium parvum
HNTNVQSSIQ

SEQ ID NO: 2261520 - protein, 7 aa, Cryptosporidium parvum
HNTPNNF

SEQ ID NO: 2261521 - protein, 10 aa, Cryptosporidium parvum
HNTQTDEDRA

SEQ ID NO: 2261522 - protein, 9 aa, Cryptosporidium parvum
HNTSNKKFD

SEQ ID NO: 2261523 - protein, 9 aa, Cryptosporidium parvum
HNTTENEKT

SEQ ID NO: 2261524 - protein, 5 aa, Cryptosporidium parvum
HPAIR

SEQ ID NO: 2261525 - protein, 14 aa, Cryptosporidium parvum
HPDGKSILNKYKQG

SEQ ID NO: 2261526 - protein, 4 aa, Cryptosporidium parvum
HPDI

SEQ ID NO: 2261527 - protein, 13 aa, Cryptosporidium parvum
HPDKGGDQEKFKE

SEQ ID NO: 2261528 - protein, 19 aa, Cryptosporidium parvum
HPDKQANSTPEGKKKAEEM

SEQ ID NO: 2261529 - protein, 6 aa, Cryptosporidium parvum
HPDNTG

SEQ ID NO: 2261530 - protein, 9 aa, Cryptosporidium parvum
HPEKRVEAS

SEQ ID NO: 2261531 - protein, 5 aa, Cryptosporidium parvum
HPENE

SEQ ID NO: 2261532 - protein, 14 aa, Cryptosporidium parvum
HPESGYNLDNSPHL

SEQ ID NO: 2261533 - protein, 7 aa, Cryptosporidium parvum
HPETGIS

SEQ ID NO: 2261534 - protein, 10 aa, Cryptosporidium parvum
HPETGISKKS

SEQ ID NO: 2261535 - protein, 12 aa, Cryptosporidium parvum
HPFSGRSRAETR

SEQ ID NO: 2261536 - protein, 9 aa, Cryptosporidium parvum
HPGNSKNRE

SEQ ID NO: 2261537 - protein, 32 aa, Cryptosporidium parvum
HPGPISTRSQLRQDDNHNETTNHRKSSSIDNN

SEQ ID NO: 2261538 - protein, 4 aa, Cryptosporidium parvum
HPGQ

SEQ ID NO: 2261539 - protein, 4 aa, Cryptosporidium parvum
HPHQ

SEQ ID NO: 2261540 - protein, 14 aa, Cryptosporidium parvum
HPITTNSQVSAGRS

SEQ ID NO: 2261541 - protein, 7 aa, Cryptosporidium parvum
HPKDGKI

SEQ ID NO: 2261542 - protein, 6 aa, Cryptosporidium parvum
HPKHNT

SEQ ID NO: 2261543 - protein, 5 aa, Cryptosporidium parvum
HPKKP

SEQ ID NO: 2261544 - protein, 34 aa, Cryptosporidium parvum
HPKKSSGKEDKRKKTSGTSSGSESESDSDDVRDN

SEQ ID NO: 2261545 - protein, 10 aa, Cryptosporidium parvum
HPKSHASHNV

SEQ ID NO: 2261546 - protein, 7 aa, Cryptosporidium parvum
HPKTTNE

SEQ ID NO: 2261547 - protein, 4 aa, Cryptosporidium parvum
HPNG

SEQ ID NO: 2261548 - protein, 8 aa, Cryptosporidium parvum
HPNGWDPN

SEQ ID NO: 2261549 - protein, 7 aa, Cryptosporidium parvum
HPNIDDS

SEQ ID NO: 2261550 - protein, 26 aa, Cryptosporidium parvum
HPNNTNNSNVYPSEKPLPSARAKDDY

SEQ ID NO: 2261551 - protein, 16 aa, Cryptosporidium parvum
HPNPISEKATDSSNNA

SEQ ID NO: 2261552 - protein, 11 aa, Cryptosporidium parvum
HPNRRASQSLM

SEQ ID NO: 2261553 - protein, 13 aa, Cryptosporidium parvum
HPNSGSSVAPSEL

SEQ ID NO: 2261554 - protein, 5 aa, Cryptosporidium parvum
HPNTS

SEQ ID NO: 2261555 - protein, 6 aa, Cryptosporidium parvum
HPNVTS

SEQ ID NO: 2261556 - protein, 6 aa, Cryptosporidium parvum
HPQNSH

SEQ ID NO: 2261557 - protein, 6 aa, Cryptosporidium parvum
HPQPHT

SEQ ID NO: 2261558 - protein, 5 aa, Cryptosporidium parvum
HPQTE

SEQ ID NO: 2261559 - protein, 6 aa, Cryptosporidium parvum
HPRDNP

SEQ ID NO: 2261560 - protein, 5 aa, Cryptosporidium parvum
HPRFT

SEQ ID NO: 2261561 - protein, 8 aa, Cryptosporidium parvum
HPRIGSPV

SEQ ID NO: 2261562 - protein, 9 aa, Cryptosporidium parvum
HPRTARSSI

SEQ ID NO: 2261563 - protein, 32 aa, Cryptosporidium parvum
HPSADKLEQEHSGSVKFDEDHGELNSDSNVTI

SEQ ID NO: 2261564 - protein, 18 aa, Cryptosporidium parvum
HPSAPISSNQTREKIGSQ

SEQ ID NO: 2261565 - protein, 8 aa, Cryptosporidium parvum
HPSAQRMG

SEQ ID NO: 2261566 - protein, 7 aa, Cryptosporidium parvum
HPSGRKR

SEQ ID NO: 2261567 - protein, 6 aa, Cryptosporidium parvum
HPSNSL

SEQ ID NO: 2261568 - protein, 28 aa, Cryptosporidium parvum
HPSSGIRNSNSTSSISSSSSPQVLPQNT

SEQ ID NO: 2261569 - protein, 11 aa, Cryptosporidium parvum
HPSTSENSLKN

SEQ ID NO: 2261570 - protein, 13 aa, Cryptosporidium parvum
HPTATPGTGINPQ

SEQ ID NO: 2261571 - protein, 4 aa, Cryptosporidium parvum
HPTF

SEQ ID NO: 2261572 - protein, 6 aa, Cryptosporidium parvum
HPTQAQ

SEQ ID NO: 2261573 - protein, 29 aa, Cryptosporidium parvum
HPTQTSAIPKQGVQATAPPSGGNKPGVPL

SEQ ID NO: 2261574 - protein, 12 aa, Cryptosporidium parvum
HPTRPDKARRLG

SEQ ID NO: 2261575 - protein, 7 aa, Cryptosporidium parvum
HPTRTKD

SEQ ID NO: 2261576 - protein, 4 aa, Cryptosporidium parvum
HPTV

SEQ ID NO: 2261577 - protein, 5 aa, Cryptosporidium parvum
HPYEE

SEQ ID NO: 2261578 - protein, 12 aa, Cryptosporidium parvum
HPYPAYAPDGAS

SEQ ID NO: 2261579 - protein, 29 aa, Cryptosporidium parvum
HQAPTGEGVKKPSIASSLPKRVANYNYPG

SEQ ID NO: 2261580 - protein, 12 aa, Cryptosporidium parvum
HQAQGGEARNSI

SEQ ID NO: 2261581 - protein, 14 aa, Cryptosporidium parvum
HQDNMNSQITPPQH

SEQ ID NO: 2261582 - protein, 5 aa, Cryptosporidium parvum
HQDSA

SEQ ID NO: 2261583 - protein, 9 aa, Cryptosporidium parvum
HQEESLASY

SEQ ID NO: 2261584 - protein, 4 aa, Cryptosporidium parvum
HQFQ

SEQ ID NO: 2261585 - protein, 4 aa, Cryptosporidium parvum
HQGA

SEQ ID NO: 2261586 - protein, 4 aa, Cryptosporidium parvum
HQGS

SEQ ID NO: 2261587 - protein, 10 aa, Cryptosporidium parvum
HQHSPSYHPY

SEQ ID NO: 2261588 - protein, 7 aa, Cryptosporidium parvum
HQHSSRT

SEQ ID NO: 2261589 - protein, 16 aa, Cryptosporidium parvum
HQHTNSAGGAGGSNFN

SEQ ID NO: 2261590 - protein, 7 aa, Cryptosporidium parvum
HQINSTS

SEQ ID NO: 2261591 - protein, 9 aa, Cryptosporidium parvum
HQKNPDLGK

SEQ ID NO: 2261592 - protein, 8 aa, Cryptosporidium parvum
HQKNTGDH

SEQ ID NO: 2261593 - protein, 6 aa, Cryptosporidium parvum
HQKSSV

SEQ ID NO: 2261594 - protein, 12 aa, Cryptosporidium parvum
HQNETVSESSKP

SEQ ID NO: 2261595 - protein, 9 aa, Cryptosporidium parvum
HQNHKDGNH

SEQ ID NO: 2261596 - protein, 7 aa, Cryptosporidium parvum
HQNIGKE

SEQ ID NO: 2261597 - protein, 17 aa, Cryptosporidium parvum
HQNKNDTAIGNSENMSR

SEQ ID NO: 2261598 - protein, 4 aa, Cryptosporidium parvum
HQNL

SEQ ID NO: 2261599 - protein, 6 aa, Cryptosporidium parvum
HQNQAL

SEQ ID NO: 2261600 - protein, 20 aa, Cryptosporidium parvum
HQNQQQQQQFQRQNYGQNQL

SEQ ID NO: 2261601 - protein, 9 aa, Cryptosporidium parvum
HQNSVKPPH

SEQ ID NO: 2261602 - protein, 18 aa, Cryptosporidium parvum
HQNVQNPNTAVSNPRVNR

SEQ ID NO: 2261603 - protein, 40 aa, Cryptosporidium parvum
HQPMGDRNLGRARAQTRGPFSRTAASRSTTPTPMNRTTNL

SEQ ID NO: 2261604 - protein, 4 aa, Cryptosporidium parvum
HQQD

SEQ ID NO: 2261605 - protein, 29 aa, Cryptosporidium parvum
HQQQQQQHQQLQQQQQQQQQQQQQQQQQQ

SEQ ID NO: 2261606 - protein, 30 aa, Cryptosporidium parvum
HQQRQQQKQQQLHQQQQQHQQQQQHQQQQQ

SEQ ID NO: 2261607 - protein, 38 aa, Cryptosporidium parvum
HQRQDERDFSHSRRSQKLRSVSSSGDRIENRGRAHERS

SEQ ID NO: 2261608 - protein, 21 aa, Cryptosporidium parvum
HQSPTQSSSIDSYPSRIGGKL

SEQ ID NO: 2261609 - protein, 6 aa, Cryptosporidium parvum
HQSSTM

SEQ ID NO: 2261610 - protein, 16 aa, Cryptosporidium parvum
HQTETTRKNRTEYDKS

SEQ ID NO: 2261611 - protein, 8 aa, Cryptosporidium parvum
HQTGRHNS

SEQ ID NO: 2261612 - protein, 4 aa, Cryptosporidium parvum
HQTN

SEQ ID NO: 2261613 - protein, 6 aa, Cryptosporidium parvum
HQTNAQ

SEQ ID NO: 2261614 - protein, 5 aa, Cryptosporidium parvum
HQTNF

SEQ ID NO: 2261615 - protein, 8 aa, Cryptosporidium parvum
HQTNNSQV

SEQ ID NO: 2261616 - protein, 9 aa, Cryptosporidium parvum
HRARPSTNC

SEQ ID NO: 2261617 - protein, 9 aa, Cryptosporidium parvum
HRDEKNELG

SEQ ID NO: 2261618 - protein, 4 aa, Cryptosporidium parvum
HRDG

SEQ ID NO: 2261619 - protein, 7 aa, Cryptosporidium parvum
HRDPDQG

SEQ ID NO: 2261620 - protein, 6 aa, Cryptosporidium parvum
HRDSET

SEQ ID NO: 2261621 - protein, 8 aa, Cryptosporidium parvum
HREENDLG

SEQ ID NO: 2261622 - protein, 15 aa, Cryptosporidium parvum
HRGENKGSNFSTSET

SEQ ID NO: 2261623 - protein, 7 aa, Cryptosporidium parvum
HRGEPDG

SEQ ID NO: 2261624 - protein, 10 aa, Cryptosporidium parvum
HRGEYDTGVE

SEQ ID NO: 2261625 - protein, 8 aa, Cryptosporidium parvum
HRGRTADR

SEQ ID NO: 2261626 - protein, 5 aa, Cryptosporidium parvum
HRIEG

SEQ ID NO: 2261627 - protein, 8 aa, Cryptosporidium parvum
HRKEDNSN

SEQ ID NO: 2261628 - protein, 9 aa, Cryptosporidium parvum
HRKSKPEQI

SEQ ID NO: 2261629 - protein, 10 aa, Cryptosporidium parvum
HRKSTNSVTW

SEQ ID NO: 2261630 - protein, 8 aa, Cryptosporidium parvum
HRLPPSGG

SEQ ID NO: 2261631 - protein, 31 aa, Cryptosporidium parvum
HRMKKSEKLDANNPTQQGNVDPNKSKTYEKP

SEQ ID NO: 2261632 - protein, 8 aa, Cryptosporidium parvum
HRNNKTAT

SEQ ID NO: 2261633 - protein, 13 aa, Cryptosporidium parvum
HRNNQVPQYTQRA

SEQ ID NO: 2261634 - protein, 28 aa, Cryptosporidium parvum
HRNSRHNDSRYNDKGDNSGSLESQRFEE

SEQ ID NO: 2261635 - protein, 8 aa, Cryptosporidium parvum
HRNSSDLE

SEQ ID NO: 2261636 - protein, 6 aa, Cryptosporidium parvum
HRPDYV

SEQ ID NO: 2261637 - protein, 6 aa, Cryptosporidium parvum
HRPERN

SEQ ID NO: 2261638 - protein, 5 aa, Cryptosporidium parvum
HRPTL

SEQ ID NO: 2261639 - protein, 17 aa, Cryptosporidium parvum
HRSEASTDCNERSSRSH

SEQ ID NO: 2261640 - protein, 9 aa, Cryptosporidium parvum
HRSGETEDT

SEQ ID NO: 2261641 - protein, 9 aa, Cryptosporidium parvum
HRSGRDLTD

SEQ ID NO: 2261642 - protein, 7 aa, Cryptosporidium parvum
HRSKGAK

SEQ ID NO: 2261643 - protein, 7 aa, Cryptosporidium parvum
HRTGRSK

SEQ ID NO: 2261644 - protein, 6 aa, Cryptosporidium parvum
HRTGTK

SEQ ID NO: 2261645 - protein, 13 aa, Cryptosporidium parvum
HRTRSHRQSRTQN

SEQ ID NO: 2261646 - protein, 10 aa, Cryptosporidium parvum
HRYDTSEKVE

SEQ ID NO: 2261647 - protein, 10 aa, Cryptosporidium parvum
HSAAKSRMEQ

SEQ ID NO: 2261648 - protein, 7 aa, Cryptosporidium parvum
HSAGNIE

SEQ ID NO: 2261649 - protein, 5 aa, Cryptosporidium parvum
HSAQN

SEQ ID NO: 2261650 - protein, 4 aa, Cryptosporidium parvum
HSDH

SEQ ID NO: 2261651 - protein, 52 aa, Cryptosporidium parvum
HSDKYSSKHPLSRKTTAPANMSKKDASSSNESPRSCTEEEFEESNADTEFRE

SEQ ID NO: 2261652 - protein, 7 aa, Cryptosporidium parvum
HSDMSSI

SEQ ID NO: 2261653 - protein, 8 aa, Cryptosporidium parvum
HSDSGEMS

SEQ ID NO: 2261654 - protein, 12 aa, Cryptosporidium parvum
HSDSQDSPKGDI

SEQ ID NO: 2261655 - protein, 12 aa, Cryptosporidium parvum
HSDTTYTNTPSW

SEQ ID NO: 2261656 - protein, 6 aa, Cryptosporidium parvum
HSDVEE

SEQ ID NO: 2261657 - protein, 7 aa, Cryptosporidium parvum
HSDYTRK

SEQ ID NO: 2261658 - protein, 33 aa, Cryptosporidium parvum
HSEECEKPEYKESHPKCKKKKPRDTLPQNVNNE

SEQ ID NO: 2261659 - protein, 6 aa, Cryptosporidium parvum
HSEIRE

SEQ ID NO: 2261660 - protein, 22 aa, Cryptosporidium parvum
HSENLSDSSSYSSEESKSIEIE

SEQ ID NO: 2261661 - protein, 4 aa, Cryptosporidium parvum
HSER

SEQ ID NO: 2261662 - protein, 7 aa, Cryptosporidium parvum
HSESFRE

SEQ ID NO: 2261663 - protein, 5 aa, Cryptosporidium parvum
HSETR

SEQ ID NO: 2261664 - protein, 7 aa, Cryptosporidium parvum
HSETSQE

SEQ ID NO: 2261665 - protein, 10 aa, Cryptosporidium parvum
HSGKSSSPKF

SEQ ID NO: 2261666 - protein, 4 aa, Cryptosporidium parvum
HSGP

SEQ ID NO: 2261667 - protein, 33 aa, Cryptosporidium parvum; identical to SEQ ID NO: 2144909

SEQ ID NO: 2261668 - protein, 6 aa, Cryptosporidium parvum
HSGVGK

SEQ ID NO: 2261669 - protein, 12 aa, Cryptosporidium parvum
HSHPQPQPLPPQ

SEQ ID NO: 2261670 - protein, 11 aa, Cryptosporidium parvum
HSIKGQQNHPV

SEQ ID NO: 2261671 - protein, 24 aa, Cryptosporidium parvum
HSIKSQDSNEILQDNKKKCQSTQI

SEQ ID NO: 2261672 - protein, 6 aa, Cryptosporidium parvum
HSKEGY

SEQ ID NO: 2261673 - protein, 8 aa, Cryptosporidium parvum
HSKELGKQ

SEQ ID NO: 2261674 - protein, 8 aa, Cryptosporidium parvum
HSKGSQIE

SEQ ID NO: 2261675 - protein, 11 aa, Cryptosporidium parvum
HSKKDDPIKND

SEQ ID NO: 2261676 - protein, 10 aa, Cryptosporidium parvum
HSKKSISRHG

SEQ ID NO: 2261677 - protein, 13 aa, Cryptosporidium parvum
HSKNKQNKSQKNG

SEQ ID NO: 2261678 - protein, 34 aa, Cryptosporidium parvum
HSKPKHDHETQNSEASASTNEPPKPKLKASDISV

SEQ ID NO: 2261679 - protein, 7 aa, Cryptosporidium parvum
HSKSNCN

SEQ ID NO: 2261680 - protein, 10 aa, Cryptosporidium parvum
HSKSSGLNAS

SEQ ID NO: 2261681 - protein, 7 aa, Cryptosporidium parvum
HSKSTIQ

SEQ ID NO: 2261682 - protein, 22 aa, Cryptosporidium parvum
HSKTSTSATEGPKLGKETNQNA

SEQ ID NO: 2261683 - protein, 6 aa, Cryptosporidium parvum
HSKYTL

SEQ ID NO: 2261684 - protein, 5 aa, Cryptosporidium parvum
HSLTS

SEQ ID NO: 2261685 - protein, 106 aa, Cryptosporidium parvum
HSMPSSSKINDESDINPESEYSKHKSQLESGKSDKLSTPKQSQSKMPSMDHSKTHSQVSRSSLESSKALSQALPQSKSNASVSKLNTSKSHIEQSKTDISKKEGSI

SEQ ID NO: 2261686 - protein, 4 aa, Cryptosporidium parvum
HSND

SEQ ID NO: 2261687 - protein, 11 aa, Cryptosporidium parvum
HSNDGAYTKEN

SEQ ID NO: 2261688 - protein, 10 aa, Cryptosporidium parvum
HSNESSQGRE

SEQ ID NO: 2261689 - protein, 4 aa, Cryptosporidium parvum
HSNG

SEQ ID NO: 2261690 - protein, 4 aa, Cryptosporidium parvum
HSNL

SEQ ID NO: 2261691 - protein, 27 aa, Cryptosporidium parvum
HSNNDVKDKDNGNDTMRDTAVQEKMTL

SEQ ID NO: 2261692 - protein, 6 aa, Cryptosporidium parvum
HSNQSN

SEQ ID NO: 2261693 - protein, 7 aa, Cryptosporidium parvum
HSNQSYK

SEQ ID NO: 2261694 - protein, 24 aa, Cryptosporidium parvum
HSNSNANQGKGGGKLQTSTFSDSN

SEQ ID NO: 2261695 - protein, 7 aa, Cryptosporidium parvum
HSNSNEV

SEQ ID NO: 2261696 - protein, 8 aa, Cryptosporidium parvum
HSNSNSCQ

SEQ ID NO: 2261697 - protein, 17 aa, Cryptosporidium parvum
HSNSNTNTNNRKYSKNL

SEQ ID NO: 2261698 - protein, 8 aa, Cryptosporidium parvum
HSNSQSVK

SEQ ID NO: 2261699 - protein, 14 aa, Cryptosporidium parvum
HSNTLNKNIGPEEC

SEQ ID NO: 2261700 - protein, 24 aa, Cryptosporidium parvum
HSNYNSNTNTNPAFGSKFNQEKSH

SEQ ID NO: 2261701 - protein, 5 aa, Cryptosporidium parvum
HSPKK

SEQ ID NO: 2261702 - protein, 11 aa, Cryptosporidium parvum
HSPNRDSNYRH

SEQ ID NO: 2261703 - protein, 9 aa, Cryptosporidium parvum
HSPNTSQQL

SEQ ID NO: 2261704 - protein, 15 aa, Cryptosporidium parvum
HSPPPTAQGASQQGE

SEQ ID NO: 2261705 - protein, 26 aa, Cryptosporidium parvum
HSPSPSPQYSQSSHYSQPSRNSHPYQ

SEQ ID NO: 2261706 - protein, 23 aa, Cryptosporidium parvum
HSPTSSSRSIGNNANMNPPKSPS

SEQ ID NO: 2261707 - protein, 8 aa, Cryptosporidium parvum
HSQNNEIK

SEQ ID NO: 2261708 - protein, 6 aa, Cryptosporidium parvum
HSQRKN

SEQ ID NO: 2261709 - protein, 6 aa, Cryptosporidium parvum
HSQSMD

SEQ ID NO: 2261710 - protein, 6 aa, Cryptosporidium parvum
HSRGGV

SEQ ID NO: 2261711 - protein, 61 aa, Cryptosporidium parvum
HSRKHKKEAELKDTNSNSSNKESSDLSEAQIDQTPKESSNDKNKKSGERKSNQNDNTVSGT

SEQ ID NO: 2261712 - protein, 5 aa, Cryptosporidium parvum
HSRNR

SEQ ID NO: 2261713 - protein, 20 aa, Cryptosporidium parvum
HSRSGTPGKESCLENESERS

SEQ ID NO: 2261714 - protein, 21 aa, Cryptosporidium parvum
HSRTLNSDSRATASSRNSGVC

SEQ ID NO: 2261715 - protein, 16 aa, Cryptosporidium parvum
HSRYDGKPNEGPRITT

SEQ ID NO: 2261716 - protein, 20 aa, Cryptosporidium parvum
HSSDGGPQSAVSSNQTDTAN

SEQ ID NO: 2261717 - protein, 5 aa, Cryptosporidium parvum
HSSED

SEQ ID NO: 2261718 - protein, 7 aa, Cryptosporidium parvum
HSSEYKD

SEQ ID NO: 2261719 - protein, 7 aa, Cryptosporidium parvum
HSSFTQR

SEQ ID NO: 2261720 - protein, 7 aa, Cryptosporidium parvum
HSSGDAA

SEQ ID NO: 2261721 - protein, 15 aa, Cryptosporidium parvum
HSSGGGLQSSNKTIF

SEQ ID NO: 2261722 - protein, 4 aa, Cryptosporidium parvum
HSSI

SEQ ID NO: 2261723 - protein, 10 aa, Cryptosporidium parvum
HSSIVGESQH

SEQ ID NO: 2261724 - protein, 25 aa, Cryptosporidium parvum
HSSKGSGSKSGSGPSSQSISTNQEA

SEQ ID NO: 2261725 - protein, 6 aa, Cryptosporidium parvum
HSSKIG

SEQ ID NO: 2261726 - protein, 4 aa, Cryptosporidium parvum
HSSL

SEQ ID NO: 2261727 - protein, 12 aa, Cryptosporidium parvum
HSSNAKSNSKKK

SEQ ID NO: 2261728 - protein, 18 aa, Cryptosporidium parvum
HSSNNQSPITMGGNSAHN

SEQ ID NO: 2261729 - protein, 9 aa, Cryptosporidium parvum
HSSNPPINK

SEQ ID NO: 2261730 - protein, 11 aa, Cryptosporidium parvum
HSSNSKESNIN

SEQ ID NO: 2261731 - protein, 10 aa, Cryptosporidium parvum
HSSQNSDTNH

SEQ ID NO: 2261732 - protein, 12 aa, Cryptosporidium parvum
HSSSEYNPNGDY

SEQ ID NO: 2261733 - protein, 18 aa, Cryptosporidium parvum
HSSSNPCPSCSSSAKSCS

SEQ ID NO: 2261734 - protein, 7 aa, Cryptosporidium parvum
HSSSYSH

SEQ ID NO: 2261735 - protein, 5 aa, Cryptosporidium parvum
HSSTS

SEQ ID NO: 2261736 - protein, 13 aa, Cryptosporidium parvum
HSSVEKNGSISET

SEQ ID NO: 2261737 - protein, 11 aa, Cryptosporidium parvum
HSTKNKDKKYI

SEQ ID NO: 2261738 - protein, 8 aa, Cryptosporidium parvum
HSTPNDDA

SEQ ID NO: 2261739 - protein, 17 aa, Cryptosporidium parvum
HSTQKNTSKKKGLNTSF

SEQ ID NO: 2261740 - protein, 9 aa, Cryptosporidium parvum
HSTVGTPQY

SEQ ID NO: 2261741 - protein, 8 aa, Cryptosporidium parvum
HSVSGRNK

SEQ ID NO: 2261742 - protein, 12 aa, Cryptosporidium parvum
HTAQEDLPVYNS

SEQ ID NO: 2261743 - protein, 5 aa, Cryptosporidium parvum
HTEEE

SEQ ID NO: 2261744 - protein, 5 aa, Cryptosporidium parvum
HTGEP

SEQ ID NO: 2261745 - protein, 6 aa, Cryptosporidium parvum
HTGKRL

SEQ ID NO: 2261746 - protein, 6 aa, Cryptosporidium parvum
HTGPVH

SEQ ID NO: 2261747 - protein, 5 aa, Cryptosporidium parvum
HTGRA

SEQ ID NO: 2261748 - protein, 10 aa, Cryptosporidium parvum
HTHADEKTPS

SEQ ID NO: 2261749 - protein, 10 aa, Cryptosporidium parvum
HTKDDTEENI

SEQ ID NO: 2261750 - protein, 10 aa, Cryptosporidium parvum
HTKNKQDEND

SEQ ID NO: 2261751 - protein, 7 aa, Cryptosporidium parvum
HTNNKKI

SEQ ID NO: 2261752 - protein, 30 aa, Cryptosporidium parvum
HTNQKDQISQTQSPNKKKKVSDKVSVQPNT

SEQ ID NO: 2261753 - protein, 11 aa, Cryptosporidium parvum
HTNSEASLPTP

SEQ ID NO: 2261754 - protein, 41 aa, Cryptosporidium parvum
HTNSNGSEFSSKSGAKKINSTEKIDSQMATEECKNGVENRL

SEQ ID NO: 2261755 - protein, 7 aa, Cryptosporidium parvum
HTNTGAV

SEQ ID NO: 2261756 - protein, 28 aa, Cryptosporidium parvum
HTPKSTGSEDYDNNTNEIGHETTGNHSH

SEQ ID NO: 2261757 - protein, 8 aa, Cryptosporidium parvum
HTQDSTDN

SEQ ID NO: 2261758 - protein, 5 aa, Cryptosporidium parvum
HTQKT

SEQ ID NO: 2261759 - protein, 10 aa, Cryptosporidium parvum
HTQNPTKMEK

SEQ ID NO: 2261760 - protein, 9 aa, Cryptosporidium parvum
HTQNQSNRQ

SEQ ID NO: 2261761 - protein, 6 aa, Cryptosporidium parvum
HTQNRR

SEQ ID NO: 2261762 - protein, 43 aa, Cryptosporidium parvum
HTQPNNNMQPPSHPRTQPLPHPYSQGNPGHQVSSQNFSSSSIH

SEQ ID NO: 2261763 - protein, 21 aa, Cryptosporidium parvum
HTQRENSTGNNFQSRNTRYGG

SEQ ID NO: 2261764 - protein, 12 aa, Cryptosporidium parvum
HTRDSSSVTDED

SEQ ID NO: 2261765 - protein, 5 aa, Cryptosporidium parvum
HTRKP

SEQ ID NO: 2261766 - protein, 13 aa, Cryptosporidium parvum
HTSAPGEMAPAGL

SEQ ID NO: 2261767 - protein, 5 aa, Cryptosporidium parvum
HTSAY

SEQ ID NO: 2261768 - protein, 10 aa, Cryptosporidium parvum
HTSAYKTVGE

SEQ ID NO: 2261769 - protein, 8 aa, Cryptosporidium parvum
HTSDQEPN

SEQ ID NO: 2261770 - protein, 5 aa, Cryptosporidium parvum
HTSNN

SEQ ID NO: 2261771 - protein, 14 aa, Cryptosporidium parvum
HTSTAQLTADEFEN

SEQ ID NO: 2261772 - protein, 8 aa, Cryptosporidium parvum
HTYPSDTV

SEQ ID NO: 2261773 - protein, 5 aa, Cryptosporidium parvum
HVDEA

SEQ ID NO: 2261774 - protein, 6 aa, Cryptosporidium parvum
HVENTS

SEQ ID NO: 2261775 - protein, 12 aa, Cryptosporidium parvum
HVGNEKMNKQAV

SEQ ID NO: 2261776 - protein, 8 aa, Cryptosporidium parvum
HVHDTQGL

SEQ ID NO: 2261777 - protein, 10 aa, Cryptosporidium parvum
HVNNSENEQS

SEQ ID NO: 2261778 - protein, 16 aa, Cryptosporidium parvum
HVNSNESLVNTRAEKE

SEQ ID NO: 2261779 - protein, 5 aa, Cryptosporidium parvum
HVPNA

SEQ ID NO: 2261780 - protein, 10 aa, Cryptosporidium parvum
HVPNRPDELS

SEQ ID NO: 2261781 - protein, 8 aa, Cryptosporidium parvum
HVPSDNDK

SEQ ID NO: 2261782 - protein, 9 aa, Cryptosporidium parvum
HVPTGDIPR

SEQ ID NO: 2261783 - protein, 12 aa, Cryptosporidium parvum
HVSKQPFSSLFN

SEQ ID NO: 2261784 - protein, 10 aa, Cryptosporidium parvum
HWSSSNEPQP

SEQ ID NO: 2261785 - protein, 12 aa, Cryptosporidium parvum
HYEDDIEAKRRA

SEQ ID NO: 2261786 - protein, 12 aa, Cryptosporidium parvum
HYEEEKNKIDSE

SEQ ID NO: 2261787 - protein, 6 aa, Cryptosporidium parvum
HYEKKG

SEQ ID NO: 2261788 - protein, 5 aa, Cryptosporidium parvum
HYGQR

SEQ ID NO: 2261789 - protein, 8 aa, Cryptosporidium parvum
HYGSTGSD

SEQ ID NO: 2261790 - protein, 12 aa, Cryptosporidium parvum
HYKNNKAVGTMK

SEQ ID NO: 2261791 - protein, 7 aa, Cryptosporidium parvum
HYSSSSN

SEQ ID NO: 2261792 - protein, 11 aa, Cryptosporidium parvum
HYSSTSLSSHH

SEQ ID NO: 2261793 - protein, 10 aa, Cryptosporidium parvum
HYSTNAKNNV

SEQ ID NO: 2261794 - protein, 6 aa, Cryptosporidium parvum
HYTEGA

SEQ ID NO: 2261795 - protein, 19 aa, Cryptosporidium parvum
HYYSDNSNINECSSRPSIS

SEQ ID NO: 2261796 - protein, 11 aa, Cryptosporidium parvum
IAAAKQSVDNF

SEQ ID NO: 2261797 - protein, 17 aa, Cryptosporidium parvum
IAAPSANRSGHISPTTP

SEQ ID NO: 2261798 - protein, 18 aa, Cryptosporidium parvum
IADKRSQNNSKGSSEDKV

SEQ ID NO: 2261799 - protein, 5 aa, Cryptosporidium parvum
IAERE

SEQ ID NO: 2261800 - protein, 7 aa, Cryptosporidium parvum
IAESTLD

SEQ ID NO: 2261801 - protein, 4 aa, Cryptosporidium parvum
IAGE

SEQ ID NO: 2261802 - protein, 6 aa, Cryptosporidium parvum
IAGRSY

SEQ ID NO: 2261803 - protein, 8 aa, Cryptosporidium parvum
IAGSSSGS

SEQ ID NO: 2261804 - protein, 6 aa, Cryptosporidium parvum
IAHSDS

SEQ ID NO: 2261805 - protein, 8 aa, Cryptosporidium parvum
IAKEDPNR

SEQ ID NO: 2261806 - protein, 7 aa, Cryptosporidium parvum
IAKESGA

SEQ ID NO: 2261807 - protein, 14 aa, Cryptosporidium parvum
IAKESQNREAADDD

SEQ ID NO: 2261808 - protein, 8 aa, Cryptosporidium parvum
IAKKEPTI

SEQ ID NO: 2261809 - protein, 35 aa, Cryptosporidium parvum
IAKKESKKSETDEIKDEKTDDQDYKNEQDEDEDFC

SEQ ID NO: 2261810 - protein, 8 aa, Cryptosporidium parvum
IAKKRPAY

SEQ ID NO: 2261811 - protein, 10 aa, Cryptosporidium parvum
IANDQEQAKD

SEQ ID NO: 2261812 - protein, 12 aa, Cryptosporidium parvum
IANESEEELGED

SEQ ID NO: 2261813 - protein, 8 aa, Cryptosporidium parvum
IANRPQKP

SEQ ID NO: 2261814 - protein, 35 aa, Cryptosporidium parvum
IANSDLSTTIGSSGLEDRDDISSSDDLSDISDSEI

SEQ ID NO: 2261815 - protein, 20 aa, Cryptosporidium parvum
IANSNVNTADISTSKLTPAQ

SEQ ID NO: 2261816 - protein, 7 aa, Cryptosporidium parvum
IAPDFSS

SEQ ID NO: 2261817 - protein, 13 aa, Cryptosporidium parvum
IAPKREKTNGEVE

SEQ ID NO: 2261818 - protein, 4 aa, Cryptosporidium parvum
IAPT

SEQ ID NO: 2261819 - protein, 5 aa, Cryptosporidium parvum
IAQDE

SEQ ID NO: 2261820 - protein, 9 aa, Cryptosporidium parvum
IAQESNLGR

SEQ ID NO: 2261821 - protein, 11 aa, Cryptosporidium parvum
IAQGREWKENR

SEQ ID NO: 2261822 - protein, 4 aa, Cryptosporidium parvum
IAQR

SEQ ID NO: 2261823 - protein, 20 aa, Cryptosporidium parvum
IAQSPLSENVSKSSPKIEKE

SEQ ID NO: 2261824 - protein, 9 aa, Cryptosporidium parvum
IARAEYDKT

SEQ ID NO: 2261825 - protein, 6 aa, Cryptosporidium parvum
IARDTE

SEQ ID NO: 2261826 - protein, 6 aa, Cryptosporidium parvum
IARERR

SEQ ID NO: 2261827 - protein, 16 aa, Cryptosporidium parvum
IARNTYGKGSLFYSPI

SEQ ID NO: 2261828 - protein, 7 aa, Cryptosporidium parvum
IARSGTK

SEQ ID NO: 2261829 - protein, 10 aa, Cryptosporidium parvum
IASEKSANIN

SEQ ID NO: 2261830 - protein, 24 aa, Cryptosporidium parvum
IASGNIEPSGNSNNCSGNTQNGTL

SEQ ID NO: 2261831 - protein, 8 aa, Cryptosporidium parvum
IASGNNSP

SEQ ID NO: 2261832 - protein, 10 aa, Cryptosporidium parvum
IASKNQGTKL

SEQ ID NO: 2261833 - protein, 8 aa, Cryptosporidium parvum
IASNGNNN

SEQ ID NO: 2261834 - protein, 10 aa, Cryptosporidium parvum
IASQSSQNLN

SEQ ID NO: 2261835 - protein, 8 aa, Cryptosporidium parvum
IASSSDSG

SEQ ID NO: 2261836 - protein, 8 aa, Cryptosporidium parvum
IASSSPLG

SEQ ID NO: 2261837 - protein, 6 aa, Cryptosporidium parvum
IASTSY

SEQ ID NO: 2261838 - protein, 7 aa, Cryptosporidium parvum
IATDGGR

SEQ ID NO: 2261839 - protein, 12 aa, Cryptosporidium parvum
IATETHGWNGSD

SEQ ID NO: 2261840 - protein, 7 aa, Cryptosporidium parvum
IATGGRN

SEQ ID NO: 2261841 - protein, 35 aa, Cryptosporidium parvum
IATNGSGVAGGSCSAVGKSSLKWNGGGTGSNNGGI

SEQ ID NO: 2261842 - protein, 14 aa, Cryptosporidium parvum
IATSGDPSEREKIE

SEQ ID NO: 2261843 - protein, 7 aa, Cryptosporidium parvum
IAVTQSD

SEQ ID NO: 2261844 - protein, 18 aa, Cryptosporidium parvum
ICGDSKGLKDDESEIGVG

SEQ ID NO: 2261845 - protein, 63 aa, Cryptosporidium parvum; identical to SEQ ID NO: 2145081

SEQ ID NO: 2261846 - protein, 35 aa, Cryptosporidium parvum
ICSDESRELQDHEKNDNCSGESCKVNSKQIAQNGN

SEQ ID NO: 2261847 - protein, 28 aa, Cryptosporidium parvum
IDAKGSGLNGEQSDHHHRSEEKSKNYTS

SEQ ID NO: 2261848 - protein, 5 aa, Cryptosporidium parvum
IDAPK

SEQ ID NO: 2261849 - protein, 5 aa, Cryptosporidium parvum
IDASA

SEQ ID NO: 2261850 - protein, 11 aa, Cryptosporidium parvum
IDASDDNYSKQ

SEQ ID NO: 2261851 - protein, 6 aa, Cryptosporidium parvum
IDCGSR

SEQ ID NO: 2261852 - protein, 6 aa, Cryptosporidium parvum
IDDDNI

SEQ ID NO: 2261853 - protein, 10 aa, Cryptosporidium parvum
IDDDSEDELE

SEQ ID NO: 2261854 - protein, 19 aa, Cryptosporidium parvum
IDDDVESKSNISSSAPVTV

SEQ ID NO: 2261855 - protein, 4 aa, Cryptosporidium parvum
IDDE

SEQ ID NO: 2261856 - protein, 7 aa, Cryptosporidium parvum
IDDGQPL

SEQ ID NO: 2261857 - protein, 6 aa, Cryptosporidium parvum
IDDKAR

SEQ ID NO: 2261858 - protein, 9 aa, Cryptosporidium parvum
IDDKNETYR

SEQ ID NO: 2261859 - protein, 11 aa, Cryptosporidium parvum
IDDNFSGVDSN

SEQ ID NO: 2261860 - protein, 9 aa, Cryptosporidium parvum
IDDNGELER

SEQ ID NO: 2261861 - protein, 6 aa, Cryptosporidium parvum
IDDPAN

SEQ ID NO: 2261862 - protein, 10 aa, Cryptosporidium parvum
IDDPKSSNIQ

SEQ ID NO: 2261863 - protein, 8 aa, Cryptosporidium parvum
IDDPSVPF

SEQ ID NO: 2261864 - protein, 8 aa, Cryptosporidium parvum
IDDPSVST

SEQ ID NO: 2261865 - protein, 18 aa, Cryptosporidium parvum
IDDSKSRDNFRADSDLKQ

SEQ ID NO: 2261866 - protein, 6 aa, Cryptosporidium parvum
IDDSNS

SEQ ID NO: 2261867 - protein, 4 aa, Cryptosporidium parvum
IDEA

SEQ ID NO: 2261868 - protein, 43 aa, Cryptosporidium parvum
IDEAEDFEEEEEEDDEEDEEDEIQASSSKKQRIEQDDDDDDED

SEQ ID NO: 2261869 - protein, 30 aa, Cryptosporidium parvum
IDEDDDSFSESETEFDNNDSFDKDQVENTD

SEQ ID NO: 2261870 - protein, 42 aa, Cryptosporidium parvum
IDEDEEEEEEEEEEEDEEEEEKLEMTSDSDSAQSDERPEFER

SEQ ID NO: 2261871 - protein, 21 aa, Cryptosporidium parvum
IDEDNSDSKTDATLSGTPNIP

SEQ ID NO: 2261872 - protein, 11 aa, Cryptosporidium parvum
IDEDSAVKDRK

SEQ ID NO: 2261873 - protein, 4 aa, Cryptosporidium parvum
IDEE

SEQ ID NO: 2261874 - protein, 5 aa, Cryptosporidium parvum
IDEEF

SEQ ID NO: 2261875 - protein, 9 aa, Cryptosporidium parvum
IDEENEDDL

SEQ ID NO: 2261876 - protein, 5 aa, Cryptosporidium parvum
IDEET

SEQ ID NO: 2261877 - protein, 11 aa, Cryptosporidium parvum
IDEEVGDGTTS

SEQ ID NO: 2261878 - protein, 64 aa, Cryptosporidium parvum
IDEIEQSKNHDKNLESDYQHQNQNPVLNQEQEQDQEEQNQKEQDQIEDQYKSETDIETRQKECE

SEQ ID NO: 2261879 - protein, 12 aa, Cryptosporidium parvum
IDEKDETETSEE

SEQ ID NO: 2261880 - protein, 5 aa, Cryptosporidium parvum
IDEKS

SEQ ID NO: 2261881 - protein, 11 aa, Cryptosporidium parvum
IDEKSSQKNFN

SEQ ID NO: 2261882 - protein, 10 aa, Cryptosporidium parvum
IDENASTRSQ

SEQ ID NO: 2261883 - protein, 32 aa, Cryptosporidium parvum
IDENEKDLKNVSELKDETNGENIVTENTNHPM

SEQ ID NO: 2261884 - protein, 11 aa, Cryptosporidium parvum
IDENESNVDEI

SEQ ID NO: 2261885 - protein, 34 aa, Cryptosporidium parvum
IDENIEDDENIEDDGNSENNGNSENDENNESKKS

SEQ ID NO: 2261886 - protein, 4 aa, Cryptosporidium parvum
IDEP

SEQ ID NO: 2261887 - protein, 10 aa, Cryptosporidium parvum
IDEPQSSTCY

SEQ ID NO: 2261888 - protein, 6 aa, Cryptosporidium parvum
IDEPTS

SEQ ID NO: 2261889 - protein, 14 aa, Cryptosporidium parvum
IDEQGAEHNTSACA

SEQ ID NO: 2261890 - protein, 45 aa, Cryptosporidium parvum
IDEQSPKNTNRRSSELSIESSSPEAQKGAGHKKYQQNQHHNHNQS

SEQ ID NO: 2261891 - protein, 8 aa, Cryptosporidium parvum
IDESENER

SEQ ID NO: 2261892 - protein, 4 aa, Cryptosporidium parvum
IDET

SEQ ID NO: 2261893 - protein, 7 aa, Cryptosporidium parvum
IDETDIP

SEQ ID NO: 2261894 - protein, 8 aa, Cryptosporidium parvum
IDGAATSI

SEQ ID NO: 2261895 - protein, 18 aa, Cryptosporidium parvum
IDGDDEDDYEESEEGSDT

SEQ ID NO: 2261896 - protein, 4 aa, Cryptosporidium parvum
IDGE

SEQ ID NO: 2261897 - protein, 4 aa, Cryptosporidium parvum
IDGM

SEQ ID NO: 2261898 - protein, 4 aa, Cryptosporidium parvum
IDGN

SEQ ID NO: 2261899 - protein, 4 aa, Cryptosporidium parvum
IDGQ

SEQ ID NO: 2261900 - protein, 15 aa, Cryptosporidium parvum
IDGTSSNSNNTSSYS

SEQ ID NO: 2261901 - protein, 9 aa, Cryptosporidium parvum
IDHNSSDLA

SEQ ID NO: 2261902 - protein, 11 aa, Cryptosporidium parvum
IDKAQESNTKR

SEQ ID NO: 2261903 - protein, 4 aa, Cryptosporidium parvum
IDKE

SEQ ID NO: 2261904 - protein, 8 aa, Cryptosporidium parvum
IDKNGKKL

SEQ ID NO: 2261905 - protein, 154 aa, Cryptosporidium parvum
IDKNKSQDNLKNTSIKKNQSTEKKKSSLKSKKSLSSSETNQVIEDNNKVANKSTTVKGNKSTKADTKTKTKTTGTKSKTKISDEIETKSQSNTKTKTKSSTSSKNTLKNVKSEDDHNNLNKELKKSSKGRRERTESEDNTEQSKTRSTIKKRMK

SEQ ID NO: 2261906 - protein, 11 aa, Cryptosporidium parvum
IDKNQEDDHES

SEQ ID NO: 2261907 - protein, 12 aa, Cryptosporidium parvum
IDKNSPLKSSQF

SEQ ID NO: 2261908 - protein, 9 aa, Cryptosporidium parvum
IDKPENSTD

SEQ ID NO: 2261909 - protein, 8 aa, Cryptosporidium parvum
IDKQPTGI

SEQ ID NO: 2261910 - protein, 10 aa, Cryptosporidium parvum
IDKSTGKKHE

SEQ ID NO: 2261911 - protein, 6 aa, Cryptosporidium parvum
IDKSTL

SEQ ID NO: 2261912 - protein, 8 aa, Cryptosporidium parvum
IDNGDTRN

SEQ ID NO: 2261913 - protein, 7 aa, Cryptosporidium parvum
IDNGKEF

SEQ ID NO: 2261914 - protein, 21 aa, Cryptosporidium parvum
IDNKNPSKKGNLKGGDAKYNK

SEQ ID NO: 2261915 - protein, 35 aa, Cryptosporidium parvum; identical to SEQ ID NO: 2145136

SEQ ID NO: 2261916 - protein, 11 aa, Cryptosporidium parvum
IDNNEEVKEHI

SEQ ID NO: 2261917 - protein, 5 aa, Cryptosporidium parvum
IDNNQ

SEQ ID NO: 2261918 - protein, 7 aa, Cryptosporidium parvum
IDNNQQN

SEQ ID NO: 2261919 - protein, 5 aa, Cryptosporidium parvum
IDNPA

SEQ ID NO: 2261920 - protein, 6 aa, Cryptosporidium parvum
IDNQNN

SEQ ID NO: 2261921 - protein, 15 aa, Cryptosporidium parvum
IDNQSESSSSKNVKK

SEQ ID NO: 2261922 - protein, 6 aa, Cryptosporidium parvum
IDNRQD

SEQ ID NO: 2261923 - protein, 4 aa, Cryptosporidium parvum
IDNS

SEQ ID NO: 2261924 - protein, 8 aa, Cryptosporidium parvum
IDNSASSN

SEQ ID NO: 2261925 - protein, 7 aa, Cryptosporidium parvum
IDNSERK

SEQ ID NO: 2261926 - protein, 6 aa, Cryptosporidium parvum
IDNSGI

SEQ ID NO: 2261927 - protein, 18 aa, Cryptosporidium parvum
IDNSNDEKKIKSSGSNQI

SEQ ID NO: 2261928 - protein, 22 aa, Cryptosporidium parvum
IDNSSEPKNTIRSSNNKSVPGW

SEQ ID NO: 2261929 - protein, 8 aa, Cryptosporidium parvum
IDNTNESL

SEQ ID NO: 2261930 - protein, 6 aa, Cryptosporidium parvum
IDNTQK

SEQ ID NO: 2261931 - protein, 9 aa, Cryptosporidium parvum
IDPEGTDTI

SEQ ID NO: 2261932 - protein, 9 aa, Cryptosporidium parvum
IDPENVSKE

SEQ ID NO: 2261933 - protein, 5 aa, Cryptosporidium parvum
IDPER

SEQ ID NO: 2261934 - protein, 9 aa, Cryptosporidium parvum
IDPESKALQ

SEQ ID NO: 2261935 - protein, 9 aa, Cryptosporidium parvum
IDPESPPDL

SEQ ID NO: 2261936 - protein, 35 aa, Cryptosporidium parvum
IDPFQSYSSKTIPSQDPGAVDGAQNKSRKRKSSLE

SEQ ID NO: 2261937 - protein, 6 aa, Cryptosporidium parvum
IDPKSI

SEQ ID NO: 2261938 - protein, 9 aa, Cryptosporidium parvum
IDPNPTNGG

SEQ ID NO: 2261939 - protein, 16 aa, Cryptosporidium parvum
IDPPSVAGLSRRRDSG

SEQ ID NO: 2261940 - protein, 5 aa, Cryptosporidium parvum
IDPPT

SEQ ID NO: 2261941 - protein, 12 aa, Cryptosporidium parvum
IDPSLSGSQAEA

SEQ ID NO: 2261942 - protein, 16 aa, Cryptosporidium parvum
IDPTDLSDSEEGEVVE

SEQ ID NO: 2261943 - protein, 7 aa, Cryptosporidium parvum
IDPTLTR

SEQ ID NO: 2261944 - protein, 6 aa, Cryptosporidium parvum
IDPTQD

SEQ ID NO: 2261945 - protein, 4 aa, Cryptosporidium parvum
IDQD

SEQ ID NO: 2261946 - protein, 7 aa, Cryptosporidium parvum
IDQEPIE

SEQ ID NO: 2261947 - protein, 13 aa, Cryptosporidium parvum
IDQEREERRRGRL

SEQ ID NO: 2261948 - protein, 14 aa, Cryptosporidium parvum
IDQGTGGASDDSQY

SEQ ID NO: 2261949 - protein, 4 aa, Cryptosporidium parvum
IDQK

SEQ ID NO: 2261950 - protein, 5 aa, Cryptosporidium parvum
IDQNK

SEQ ID NO: 2261951 - protein, 11 aa, Cryptosporidium parvum
IDQNNSSRQIQ

SEQ ID NO: 2261952 - protein, 10 aa, Cryptosporidium parvum
IDQRDLENGT

SEQ ID NO: 2261953 - protein, 20 aa, Cryptosporidium parvum
IDRAEKNKTYDKSLKREVPT

SEQ ID NO: 2261954 - protein, 14 aa, Cryptosporidium parvum
IDRLSSSANSNDLN

SEQ ID NO: 2261955 - protein, 11 aa, Cryptosporidium parvum
IDRNSSSNQFD

SEQ ID NO: 2261956 - protein, 6 aa, Cryptosporidium parvum
IDRSSG

SEQ ID NO: 2261957 - protein, 9 aa, Cryptosporidium parvum
IDSDDEALQ

SEQ ID NO: 2261958 - protein, 11 aa, Cryptosporidium parvum
IDSEDSQQSLV

SEQ ID NO: 2261959 - protein, 6 aa, Cryptosporidium parvum
IDSESN

SEQ ID NO: 2261960 - protein, 6 aa, Cryptosporidium parvum
IDSNNE

SEQ ID NO: 2261961 - protein, 10 aa, Cryptosporidium parvum
IDSNNSQNQI

SEQ ID NO: 2261962 - protein, 22 aa, Cryptosporidium parvum
IDSNNSSKKMPENISKAEKSNV

SEQ ID NO: 2261963 - protein, 13 aa, Cryptosporidium parvum
IDSNSEGISESSK

SEQ ID NO: 2261964 - protein, 11 aa, Cryptosporidium parvum
IDSNTNNRPNI

SEQ ID NO: 2261965 - protein, 14 aa, Cryptosporidium parvum
IDSNTSSDVGNGCP

SEQ ID NO: 2261966 - protein, 13 aa, Cryptosporidium parvum
IDSQDTNHSSIDE

SEQ ID NO: 2261967 - protein, 7 aa, Cryptosporidium parvum
IDSRPNW

SEQ ID NO: 2261968 - protein, 17 aa, Cryptosporidium parvum
IDSSINPSNQPTESSCS

SEQ ID NO: 2261969 - protein, 8 aa, Cryptosporidium parvum
IDSSSNGH

SEQ ID NO: 2261970 - protein, 6 aa, Cryptosporidium parvum
IDSTES

SEQ ID NO: 2261971 - protein, 11 aa, Cryptosporidium parvum
IDSTNTNNNQK

SEQ ID NO: 2261972 - protein, 8 aa, Cryptosporidium parvum
IDSVEQKK

SEQ ID NO: 2261973 - protein, 13 aa, Cryptosporidium parvum
IDTENAENLIENV

SEQ ID NO: 2261974 - protein, 5 aa, Cryptosporidium parvum
IDTFN

SEQ ID NO: 2261975 - protein, 8 aa, Cryptosporidium parvum
IDTNNKDL

SEQ ID NO: 2261976 - protein, 8 aa, Cryptosporidium parvum
IDTNQYYE

SEQ ID NO: 2261977 - protein, 7 aa, Cryptosporidium parvum
IDTNRDG

SEQ ID NO: 2261978 - protein, 6 aa, Cryptosporidium parvum
IDTNSK

SEQ ID NO: 2261979 - protein, 4 aa, Cryptosporidium parvum
IDTQ

SEQ ID NO: 2261980 - protein, 6 aa, Cryptosporidium parvum
IDTSDE

SEQ ID NO: 2261981 - protein, 9 aa, Cryptosporidium parvum
IDTSGEGSV

SEQ ID NO: 2261982 - protein, 10 aa, Cryptosporidium parvum
IDTSPSIKGN

SEQ ID NO: 2261983 - protein, 11 aa, Cryptosporidium parvum
IDTSSDEDKSI

SEQ ID NO: 2261984 - protein, 13 aa, Cryptosporidium parvum
IDTSSISLSSSST

SEQ ID NO: 2261985 - protein, 11 aa, Cryptosporidium parvum
IDYDDNKGSLI

SEQ ID NO: 2261986 - protein, 31 aa, Cryptosporidium parvum; identical to SEQ ID NO: 2145205

SEQ ID NO: 2261987 - protein, 6 aa, Cryptosporidium parvum
IEADSK

SEQ ID NO: 2261988 - protein, 14 aa, Cryptosporidium parvum
IEAENQQRNEIQSN

SEQ ID NO: 2261989 - protein, 12 aa, Cryptosporidium parvum
IEAPKRERVTTE

SEQ ID NO: 2261990 - protein, 6 aa, Cryptosporidium parvum
IEAQKQ

SEQ ID NO: 2261991 - protein, 5 aa, Cryptosporidium parvum
IEAQT

SEQ ID NO: 2261992 - protein, 12 aa, Cryptosporidium parvum
IEASKTKPQKIK

SEQ ID NO: 2261993 - protein, 16 aa, Cryptosporidium parvum
IEDDDSNNSKNTNNLY

SEQ ID NO: 2261994 - protein, 8 aa, Cryptosporidium parvum
IEDERDVS

SEQ ID NO: 2261995 - protein, 4 aa, Cryptosporidium parvum
IEDG

SEQ ID NO: 2261996 - protein, 15 aa, Cryptosporidium parvum
IEDKSSPQAQTSSPL

SEQ ID NO: 2261997 - protein, 17 aa, Cryptosporidium parvum
IEDNPNNQKSINKSSDL

SEQ ID NO: 2261998 - protein, 8 aa, Cryptosporidium parvum
IEDRQHER

SEQ ID NO: 2261999 - protein, 13 aa, Cryptosporidium parvum
IEDSEGESSNHKK

SEQ ID NO: 2262000 - protein, 21 aa, Cryptosporidium parvum
IEDSTSNNSSEKQEETSGRKE

SEQ ID NO: 2262001 - protein, 12 aa, Cryptosporidium parvum
IEDTESRNNIEQ

SEQ ID NO: 2262002 - protein, 6 aa, Cryptosporidium parvum
IEEDSG

SEQ ID NO: 2262003 - protein, 11 aa, Cryptosporidium parvum
IEEDSKKSSEL

SEQ ID NO: 2262004 - protein, 33 aa, Cryptosporidium parvum
IEEEEEEEEEEEEEEGKRRKKKNANSILEENDD

SEQ ID NO: 2262005 - protein, 23 aa, Cryptosporidium parvum
IEEEIQQDENNSDIDNAEGNPKE

SEQ ID NO: 2262006 - protein, 7 aa, Cryptosporidium parvum
IEEENSL

SEQ ID NO: 2262007 - protein, 6 aa, Cryptosporidium parvum
IEEESM

SEQ ID NO: 2262008 - protein, 7 aa, Cryptosporidium parvum
IEEFPSD

SEQ ID NO: 2262009 - protein, 4 aa, Cryptosporidium parvum
IEEG

SEQ ID NO: 2262010 - protein, 10 aa, Cryptosporidium parvum
IEEGGDPIES

SEQ ID NO: 2262011 - protein, 7 aa, Cryptosporidium parvum
IEEKENE

SEQ ID NO: 2262012 - protein, 18 aa, Cryptosporidium parvum
IEEKESTHRTKESNLGRR

SEQ ID NO: 2262013 - protein, 19 aa, Cryptosporidium parvum
IEEKKLDSEINNNEIDTIN

SEQ ID NO: 2262014 - protein, 13 aa, Cryptosporidium parvum
IEEKNNKVSDKAL

SEQ ID NO: 2262015 - protein, 10 aa, Cryptosporidium parvum
IEEKNSEIES

SEQ ID NO: 2262016 - protein, 10 aa, Cryptosporidium parvum
IEEKQNPLRT

SEQ ID NO: 2262017 - protein, 12 aa, Cryptosporidium parvum
IEENDAIKTYTS

SEQ ID NO: 2262018 - protein, 10 aa, Cryptosporidium parvum
IEENDESKQE

SEQ ID NO: 2262019 - protein, 14 aa, Cryptosporidium parvum
IEENNNKSNIKSNI

SEQ ID NO: 2262020 - protein, 19 aa, Cryptosporidium parvum
IEENNTANNSVNTEPGQKR

SEQ ID NO: 2262021 - protein, 24 aa, Cryptosporidium parvum
IEENYNKDEGPVPEAECETNEQES

SEQ ID NO: 2262022 - protein, 6 aa, Cryptosporidium parvum
IEEQPK

SEQ ID NO: 2262023 - protein, 5 aa, Cryptosporidium parvum
IEERE

SEQ ID NO: 2262024 - protein, 35 aa, Cryptosporidium parvum; identical to SEQ ID NO: 2145237

SEQ ID NO: 2262025 - protein, 16 aa, Cryptosporidium parvum
IEESEEALSETCSEDH

SEQ ID NO: 2262026 - protein, 9 aa, Cryptosporidium parvum
IEESEEQPK

SEQ ID NO: 2262027 - protein, 13 aa, Cryptosporidium parvum
IEESGVTNRTAES

SEQ ID NO: 2262028 - protein, 10 aa, Cryptosporidium parvum
IEESINSKAP

SEQ ID NO: 2262029 - protein, 10 aa, Cryptosporidium parvum
IEESKNDKLD

SEQ ID NO: 2262030 - protein, 10 aa, Cryptosporidium parvum
IEESPKTNHI

SEQ ID NO: 2262031 - protein, 5 aa, Cryptosporidium parvum
IEESQ

SEQ ID NO: 2262032 - protein, 25 aa, Cryptosporidium parvum
IEETEKSRSEIQSKTGQESPSNQTE

SEQ ID NO: 2262033 - protein, 5 aa, Cryptosporidium parvum
IEETK

SEQ ID NO: 2262034 - protein, 16 aa, Cryptosporidium parvum
IEETKNEQENCGGSEN

SEQ ID NO: 2262035 - protein, 5 aa, Cryptosporidium parvum
IEETT

SEQ ID NO: 2262036 - protein, 9 aa, Cryptosporidium parvum
IEGDGVEGS

SEQ ID NO: 2262037 - protein, 9 aa, Cryptosporidium parvum
IEGEEGKKF

SEQ ID NO: 2262038 - protein, 17 aa, Cryptosporidium parvum
IEGENDNKNGSHSSGYS

SEQ ID NO: 2262039 - protein, 9 aa, Cryptosporidium parvum
IEGGKPDDI

SEQ ID NO: 2262040 - protein, 4 aa, Cryptosporidium parvum
IEGK

SEQ ID NO: 2262041 - protein, 12 aa, Cryptosporidium parvum
IEGKEKTKAPKI

SEQ ID NO: 2262042 - protein, 6 aa, Cryptosporidium parvum
IEGNPD

SEQ ID NO: 2262043 - protein, 7 aa, Cryptosporidium parvum
IEGPATY

SEQ ID NO: 2262044 - protein, 9 aa, Cryptosporidium parvum
IEGQSDPVG

SEQ ID NO: 2262045 - protein, 8 aa, Cryptosporidium parvum
IEGRGNGI

SEQ ID NO: 2262046 - protein, 11 aa, Cryptosporidium parvum
IEGTQNQEEQI

SEQ ID NO: 2262047 - protein, 10 aa, Cryptosporidium parvum
IEHDDSRLSK

SEQ ID NO: 2262048 - protein, 9 aa, Cryptosporidium parvum
IEIDGQGSE

SEQ ID NO: 2262049 - protein, 5 aa, Cryptosporidium parvum
IEIND

SEQ ID NO: 2262050 - protein, 19 aa, Cryptosporidium parvum
IEKDNKNLISTKNSQSPYD

SEQ ID NO: 2262051 - protein, 9 aa, Cryptosporidium parvum
IEKDSEDKI

SEQ ID NO: 2262052 - protein, 64 aa, Cryptosporidium parvum
IEKEEEEQEEEQEEEQEEEEVEEEVEDEEEEEEKEKEEEEEKKRKNTKTLSRGGRAGKNDTAKT

SEQ ID NO: 2262053 - protein, 12 aa, Cryptosporidium parvum
IEKENEKVKNSD

SEQ ID NO: 2262054 - protein, 8 aa, Cryptosporidium parvum
IEKETETS

SEQ ID NO: 2262055 - protein, 13 aa, Cryptosporidium parvum
IEKKKNELLSIIT

SEQ ID NO: 2262056 - protein, 4 aa, Cryptosporidium parvum
IEKN

SEQ ID NO: 2262057 - protein, 13 aa, Cryptosporidium parvum
IEKNGDSNQRDNN

SEQ ID NO: 2262058 - protein, 9 aa, Cryptosporidium parvum
IEKPGTHRG

SEQ ID NO: 2262059 - protein, 5 aa, Cryptosporidium parvum
IEKPL

SEQ ID NO: 2262060 - protein, 23 aa, Cryptosporidium parvum
IEKPSKKYYTSKNNSSNNKSTID

SEQ ID NO: 2262061 - protein, 64 aa, Cryptosporidium parvum
IEKRKKSNNIENEEDNEDGNNDNNNNNNNNNSDSNDESDKDSIDENNNNNNNNNNELSESEKKI

SEQ ID NO: 2262062 - protein, 9 aa, Cryptosporidium parvum
IEKRRGASV

SEQ ID NO: 2262063 - protein, 25 aa, Cryptosporidium parvum
IEKRRKEREELEKRDGGKNESLQKR

SEQ ID NO: 2262064 - protein, 21 aa, Cryptosporidium parvum
IEKSDDNQQVEVKEKQNHSTN

SEQ ID NO: 2262065 - protein, 8 aa, Cryptosporidium parvum
IEKSSNEI

SEQ ID NO: 2262066 - protein, 6 aa, Cryptosporidium parvum
IELEEE

SEQ ID NO: 2262067 - protein, 5 aa, Cryptosporidium parvum
IENDD

SEQ ID NO: 2262068 - protein, 4 aa, Cryptosporidium parvum
IENE

SEQ ID NO: 2262069 - protein, 10 aa, Cryptosporidium parvum
IENEDNNSLA

SEQ ID NO: 2262070 - protein, 5 aa, Cryptosporidium parvum
IENEI

SEQ ID NO: 2262071 - protein, 7 aa, Cryptosporidium parvum
IENEQEI

SEQ ID NO: 2262072 - protein, 21 aa, Cryptosporidium parvum
IENEQNKEKEEEDYDEKDPYA

SEQ ID NO: 2262073 - protein, 8 aa, Cryptosporidium parvum
IENEQNKR

SEQ ID NO: 2262074 - protein, 10 aa, Cryptosporidium parvum
IENGDTSNSI

SEQ ID NO: 2262075 - protein, 24 aa, Cryptosporidium parvum
IENGLKGGKGGFGATIKSQKRKVN

SEQ ID NO: 2262076 - protein, 4 aa, Cryptosporidium parvum
IENI

SEQ ID NO: 2262077 - protein, 5 aa, Cryptosporidium parvum
IENKD

SEQ ID NO: 2262078 - protein, 4 aa, Cryptosporidium parvum
IENN

SEQ ID NO: 2262079 - protein, 41 aa, Cryptosporidium parvum
IENNDKNNNEIGNEDGNEDGNENENENENEKNKKLNDNSPI

SEQ ID NO: 2262080 - protein, 7 aa, Cryptosporidium parvum
IENNGGT

SEQ ID NO: 2262081 - protein, 11 aa, Cryptosporidium parvum
IENNNESNNGY

SEQ ID NO: 2262082 - protein, 8 aa, Cryptosporidium parvum
IENPEASE

SEQ ID NO: 2262083 - protein, 8 aa, Cryptosporidium parvum
IENPQKAE

SEQ ID NO: 2262084 - protein, 10 aa, Cryptosporidium parvum
IENPVTPKKQ

SEQ ID NO: 2262085 - protein, 10 aa, Cryptosporidium parvum
IENREIPQAP

SEQ ID NO: 2262086 - protein, 9 aa, Cryptosporidium parvum
IENRRRKNV

SEQ ID NO: 2262087 - protein, 8 aa, Cryptosporidium parvum
IENSDDSR

SEQ ID NO: 2262088 - protein, 7 aa, Cryptosporidium parvum
IENSTRK

SEQ ID NO: 2262089 - protein, 4 aa, Cryptosporidium parvum
IEPD

SEQ ID NO: 2262090 - protein, 24 aa, Cryptosporidium parvum
IEPEDVGGGVEGSRIADSSRESFN

SEQ ID NO: 2262091 - protein, 9 aa, Cryptosporidium parvum
IEPEESNEL

SEQ ID NO: 2262092 - protein, 4 aa, Cryptosporidium parvum
IEPF

SEQ ID NO: 2262093 - protein, 7 aa, Cryptosporidium parvum
IEPGHVS

SEQ ID NO: 2262094 - protein, 8 aa, Cryptosporidium parvum
IEPISKDE

SEQ ID NO: 2262095 - protein, 9 aa, Cryptosporidium parvum
IEPKDKRYK

SEQ ID NO: 2262096 - protein, 9 aa, Cryptosporidium parvum
IEPNNNPKE

SEQ ID NO: 2262097 - protein, 7 aa, Cryptosporidium parvum
IEPQDQN

SEQ ID NO: 2262098 - protein, 8 aa, Cryptosporidium parvum
IEPSEKNS

SEQ ID NO: 2262099 - protein, 7 aa, Cryptosporidium parvum
IEPTNNI

SEQ ID NO: 2262100 - protein, 7 aa, Cryptosporidium parvum
IEPTTNS

SEQ ID NO: 2262101 - protein, 5 aa, Cryptosporidium parvum
IEQEK

SEQ ID NO: 2262102 - protein, 9 aa, Cryptosporidium parvum
IEQESRPIF

SEQ ID NO: 2262103 - protein, 15 aa, Cryptosporidium parvum
IEQGIKQRSQDNALQ

SEQ ID NO: 2262104 - protein, 10 aa, Cryptosporidium parvum
IEQGQSTQIE

SEQ ID NO: 2262105 - protein, 11 aa, Cryptosporidium parvum
IEQINSGDEPC

SEQ ID NO: 2262106 - protein, 4 aa, Cryptosporidium parvum
IEQK

SEQ ID NO: 2262107 - protein, 6 aa, Cryptosporidium parvum
IEQNRR

SEQ ID NO: 2262108 - protein, 19 aa, Cryptosporidium parvum
IEQPKSTAPPEKAIPTKSV

SEQ ID NO: 2262109 - protein, 8 aa, Cryptosporidium parvum
IEQTTEEE

SEQ ID NO: 2262110 - protein, 12 aa, Cryptosporidium parvum
IEREEGEVENIQ

SEQ ID NO: 2262111 - protein, 19 aa, Cryptosporidium parvum
IEREERERIEREEKERIER

SEQ ID NO: 2262112 - protein, 10 aa, Cryptosporidium parvum
IERENRKKLD

SEQ ID NO: 2262113 - protein, 7 aa, Cryptosporidium parvum
IERKDPV

SEQ ID NO: 2262114 - protein, 11 aa, Cryptosporidium parvum
IERNIDDSLNS

SEQ ID NO: 2262115 - protein, 13 aa, Cryptosporidium parvum
IERPGSGKTPAEV

SEQ ID NO: 2262116 - protein, 9 aa, Cryptosporidium parvum
IERSDKSKC

SEQ ID NO: 2262117 - protein, 4 aa, Cryptosporidium parvum
IESA

SEQ ID NO: 2262118 - protein, 12 aa, Cryptosporidium parvum
IESDKVKNNKEK

SEQ ID NO: 2262119 - protein, 10 aa, Cryptosporidium parvum
IESDNTDIYS

SEQ ID NO: 2262120 - protein, 9 aa, Cryptosporidium parvum
IESDPEIKS

SEQ ID NO: 2262121 - protein, 9 aa, Cryptosporidium parvum
IESDSDQLN

SEQ ID NO: 2262122 - protein, 8 aa, Cryptosporidium parvum
IESEAQRL

SEQ ID NO: 2262123 - protein, 6 aa, Cryptosporidium parvum
IESERE

SEQ ID NO: 2262124 - protein, 8 aa, Cryptosporidium parvum
IESERPKR

SEQ ID NO: 2262125 - protein, 13 aa, Cryptosporidium parvum
IESESSSNSKITT

SEQ ID NO: 2262126 - protein, 44 aa, Cryptosporidium parvum
IESFTNDDSHSNENKPEKSKNVKNKRTRADSQKKHARGKTINRR

SEQ ID NO: 2262127 - protein, 7 aa, Cryptosporidium parvum
IESGEGK

SEQ ID NO: 2262128 - protein, 8 aa, Cryptosporidium parvum
IESKRSIS

SEQ ID NO: 2262129 - protein, 13 aa, Cryptosporidium parvum
IESNETPNDDSNC

SEQ ID NO: 2262130 - protein, 7 aa, Cryptosporidium parvum
IESPSYD

SEQ ID NO: 2262131 - protein, 13 aa, Cryptosporidium parvum
IESRKNASIEDKR

SEQ ID NO: 2262132 - protein, 17 aa, Cryptosporidium parvum
IESRSQKALAGKSEDLR

SEQ ID NO: 2262133 - protein, 31 aa, Cryptosporidium parvum
IESSKSTYSKRKTADCSNKNLNKNSKVVQET

SEQ ID NO: 2262134 - protein, 13 aa, Cryptosporidium parvum
IESSQESYTQNSN

SEQ ID NO: 2262135 - protein, 11 aa, Cryptosporidium parvum
IESTESSKNPI

SEQ ID NO: 2262136 - protein, 11 aa, Cryptosporidium parvum
IESTQKSQNYF

SEQ ID NO: 2262137 - protein, 7 aa, Cryptosporidium parvum
IESTTPR

SEQ ID NO: 2262138 - protein, 5 aa, Cryptosporidium parvum
IETCS

SEQ ID NO: 2262139 - protein, 4 aa, Cryptosporidium parvum
IETD

SEQ ID NO: 2262140 - protein, 16 aa, Cryptosporidium parvum
IETEDKRDNQSNDNDS

SEQ ID NO: 2262141 - protein, 6 aa, Cryptosporidium parvum
IETEKN

SEQ ID NO: 2262142 - protein, 43 aa, Cryptosporidium parvum
IETESHNITETNSEKVSNQQVDSQNCEKDNQIKETGNDKTKNI

SEQ ID NO: 2262143 - protein, 8 aa, Cryptosporidium parvum
IETESKNI

SEQ ID NO: 2262144 - protein, 5 aa, Cryptosporidium parvum
IETGT

SEQ ID NO: 2262145 - protein, 4 aa, Cryptosporidium parvum
IETM

SEQ ID NO: 2262146 - protein, 6 aa, Cryptosporidium parvum
IETNDK

SEQ ID NO: 2262147 - protein, 13 aa, Cryptosporidium parvum
IETNKGERVSPCP

SEQ ID NO: 2262148 - protein, 10 aa, Cryptosporidium parvum
IETNPEATLP

SEQ ID NO: 2262149 - protein, 8 aa, Cryptosporidium parvum
IETPSKIG

SEQ ID NO: 2262150 - protein, 7 aa, Cryptosporidium parvum
IETPSRK

SEQ ID NO: 2262151 - protein, 5 aa, Cryptosporidium parvum
IETQE

SEQ ID NO: 2262152 - protein, 7 aa, Cryptosporidium parvum
IETRKEL

SEQ ID NO: 2262153 - protein, 6 aa, Cryptosporidium parvum
IETRRF

SEQ ID NO: 2262154 - protein, 19 aa, Cryptosporidium parvum
IETTSASTSVAAAASTREG

SEQ ID NO: 2262155 - protein, 4 aa, Cryptosporidium parvum
IEVD

SEQ ID NO: 2262156 - protein, 6 aa, Cryptosporidium parvum
IEVDGQ

SEQ ID NO: 2262157 - protein, 4 aa, Cryptosporidium parvum
IEVE

SEQ ID NO: 2262158 - protein, 6 aa, Cryptosporidium parvum
IEYPSY

SEQ ID NO: 2262159 - protein, 11 aa, Cryptosporidium parvum
IEYSGTSPRTV

SEQ ID NO: 2262160 - protein, 16 aa, Cryptosporidium parvum
IFEGNNKNEEEDEQKL

SEQ ID NO: 2262161 - protein, 91 aa, Cryptosporidium parvum
IFGSQNGGGRDGFGGVGRDGFGGVGRDGFGGVGRDGFGGGGRGGKGGFGGGRGGFGGGRGGFGGGRGGFGGDGLTGGRGRTGDYRGDPGHH

SEQ ID NO: 2262162 - protein, 12 aa, Cryptosporidium parvum
IFPQKNRNASID

SEQ ID NO: 2262163 - protein, 23 aa, Cryptosporidium parvum
IFPSTSKYKAGKCDMNKKSSYNF

SEQ ID NO: 2262164 - protein, 13 aa, Cryptosporidium parvum
IGAEDNNNRQKQK

SEQ ID NO: 2262165 - protein, 8 aa, Cryptosporidium parvum
IGAGKKSI

SEQ ID NO: 2262166 - protein, 12 aa, Cryptosporidium parvum
IGAGTGKQDGQG

SEQ ID NO: 2262167 - protein, 6 aa, Cryptosporidium parvum
IGDDES

SEQ ID NO: 2262168 - protein, 4 aa, Cryptosporidium parvum
IGDG

SEQ ID NO: 2262169 - protein, 11 aa, Cryptosporidium parvum
IGDLSEERSEL

SEQ ID NO: 2262170 - protein, 11 aa, Cryptosporidium parvum
IGDPSGGRGEG

SEQ ID NO: 2262171 - protein, 13 aa, Cryptosporidium parvum
IGDSNSSQIASNT

SEQ ID NO: 2262172 - protein, 5 aa, Cryptosporidium parvum
IGEAS

SEQ ID NO: 2262173 - protein, 9 aa, Cryptosporidium parvum
IGEDSSNFK

SEQ ID NO: 2262174 - protein, 12 aa, Cryptosporidium parvum
IGEENEEKEYSY

SEQ ID NO: 2262175 - protein, 17 aa, Cryptosporidium parvum
IGEETQDYQLNNSFVKA

SEQ ID NO: 2262176 - protein, 6 aa, Cryptosporidium parvum
IGEGTY

SEQ ID NO: 2262177 - protein, 6 aa, Cryptosporidium parvum
IGEKSN

SEQ ID NO: 2262178 - protein, 9 aa, Cryptosporidium parvum
IGEKSSIEN

SEQ ID NO: 2262179 - protein, 4 aa, Cryptosporidium parvum
IGEL

SEQ ID NO: 2262180 - protein, 8 aa, Cryptosporidium parvum
IGENVSSD

SEQ ID NO: 2262181 - protein, 8 aa, Cryptosporidium parvum
IGEPDKLD

SEQ ID NO: 2262182 - protein, 6 aa, Cryptosporidium parvum
IGEPHT

SEQ ID NO: 2262183 - protein, 6 aa, Cryptosporidium parvum
IGEPTY

SEQ ID NO: 2262184 - protein, 9 aa, Cryptosporidium parvum
IGERGVTSK

SEQ ID NO: 2262185 - protein, 7 aa, Cryptosporidium parvum
IGERKEL

SEQ ID NO: 2262186 - protein, 19 aa, Cryptosporidium parvum
IGESASKTLKSISKSNPEF

SEQ ID NO: 2262187 - protein, 9 aa, Cryptosporidium parvum
IGFGGEPEY

SEQ ID NO: 2262188 - protein, 16 aa, Cryptosporidium parvum
IGGARGDESAHGDHEV

SEQ ID NO: 2262189 - protein, 9 aa, Cryptosporidium parvum
IGGDNSTKK

SEQ ID NO: 2262190 - protein, 16 aa, Cryptosporidium parvum
IGGDYSDDDDDDDDID

SEQ ID NO: 2262191 - protein, 11 aa, Cryptosporidium parvum
IGGEKTQSSSV

SEQ ID NO: 2262192 - protein, 15 aa, Cryptosporidium parvum
IGGFNNREKSPKYIR

SEQ ID NO: 2262193 - protein, 9 aa, Cryptosporidium parvum
IGGGGGISA

SEQ ID NO: 2262194 - protein, 16 aa, Cryptosporidium parvum
IGGGGSDSTRGAGGVG

SEQ ID NO: 2262195 - protein, 26 aa, Cryptosporidium parvum
IGGGVGSSSNNSISGSSGIPSPPPLP

SEQ ID NO: 2262196 - protein, 23 aa, Cryptosporidium parvum
IGGPDRGGSTRGRGSGRGGLSSG

SEQ ID NO: 2262197 - protein, 7 aa, Cryptosporidium parvum
IGGSPYD

SEQ ID NO: 2262198 - protein, 13 aa, Cryptosporidium parvum
IGGSTKSIPSTNT

SEQ ID NO: 2262199 - protein, 24 aa, Cryptosporidium parvum
IGGYPKRKFEEDTEEGFEKGNRKK

SEQ ID NO: 2262200 - protein, 9 aa, Cryptosporidium parvum
IGHDSSSEF

SEQ ID NO: 2262201 - protein, 10 aa, Cryptosporidium parvum
IGHKKDDGEL

SEQ ID NO: 2262202 - protein, 25 aa, Cryptosporidium parvum
IGHNGERDKESKLDNENPNMGGNYQ

SEQ ID NO: 2262203 - protein, 6 aa, Cryptosporidium parvum
IGIETK

SEQ ID NO: 2262204 - protein, 4 aa, Cryptosporidium parvum
IGIG

SEQ ID NO: 2262205 - protein, 6 aa, Cryptosporidium parvum
IGINNN

SEQ ID NO: 2262206 - protein, 31 aa, Cryptosporidium parvum; identical to SEQ ID NO: 2145394

SEQ ID NO: 2262207 - protein, 22 aa, Cryptosporidium parvum
IGITSSSNFRNRTLNSQNSPTL

SEQ ID NO: 2262208 - protein, 14 aa, Cryptosporidium parvum
IGKDDDDDDDDDEV

SEQ ID NO: 2262209 - protein, 14 aa, Cryptosporidium parvum
IGKDSQGKSIGDKK

SEQ ID NO: 2262210 - protein, 16 aa, Cryptosporidium parvum
IGKKESSSESVEKKRA

SEQ ID NO: 2262211 - protein, 10 aa, Cryptosporidium parvum
IGKNGKIEGC

SEQ ID NO: 2262212 - protein, 6 aa, Cryptosporidium parvum
IGKPES

SEQ ID NO: 2262213 - protein, 11 aa, Cryptosporidium parvum
IGKSPKDLPGL

SEQ ID NO: 2262214 - protein, 9 aa, Cryptosporidium parvum
IGLGGTPSV

SEQ ID NO: 2262215 - protein, 13 aa, Cryptosporidium parvum
IGNCASADTKVRS

SEQ ID NO: 2262216 - protein, 12 aa, Cryptosporidium parvum
IGNDNIDPKTKV

SEQ ID NO: 2262217 - protein, 6 aa, Cryptosporidium parvum
IGNEDD

SEQ ID NO: 2262218 - protein, 16 aa, Cryptosporidium parvum
IGNEDHSMSSNTGNAS

SEQ ID NO: 2262219 - protein, 6 aa, Cryptosporidium parvum
IGNEPI

SEQ ID NO: 2262220 - protein, 4 aa, Cryptosporidium parvum
IGNH

SEQ ID NO: 2262221 - protein, 7 aa, Cryptosporidium parvum
IGNNNRT

SEQ ID NO: 2262222 - protein, 11 aa, Cryptosporidium parvum
IGNQGSFSKTV

SEQ ID NO: 2262223 - protein, 28 aa, Cryptosporidium parvum
IGNSNNNNNNNNNNNINNTTNTSSINGL

SEQ ID NO: 2262224 - protein, 15 aa, Cryptosporidium parvum
IGNSSSSPNYIQTQN

SEQ ID NO: 2262225 - protein, 7 aa, Cryptosporidium parvum
IGPGPSE

SEQ ID NO: 2262226 - protein, 5 aa, Cryptosporidium parvum
IGPGS

SEQ ID NO: 2262227 - protein, 7 aa, Cryptosporidium parvum
IGPGTGN

SEQ ID NO: 2262228 - protein, 10 aa, Cryptosporidium parvum
IGPSLKNSRI

SEQ ID NO: 2262229 - protein, 6 aa, Cryptosporidium parvum
IGPTQR

SEQ ID NO: 2262230 - protein, 6 aa, Cryptosporidium parvum
IGQGSY

SEQ ID NO: 2262231 - protein, 6 aa, Cryptosporidium parvum
IGQKKK

SEQ ID NO: 2262232 - protein, 11 aa, Cryptosporidium parvum
IGQNKEKVTLS

SEQ ID NO: 2262233 - protein, 8 aa, Cryptosporidium parvum
IGQPQESH

SEQ ID NO: 2262234 - protein, 5 aa, Cryptosporidium parvum
IGQSK

SEQ ID NO: 2262235 - protein, 5 aa, Cryptosporidium parvum
IGQTR

SEQ ID NO: 2262236 - protein, 6 aa, Cryptosporidium parvum
IGREVN

SEQ ID NO: 2262237 - protein, 6 aa, Cryptosporidium parvum
IGRGSW

SEQ ID NO: 2262238 - protein, 6 aa, Cryptosporidium parvum
IGRNVT

SEQ ID NO: 2262239 - protein, 5 aa, Cryptosporidium parvum
IGRPD

SEQ ID NO: 2262240 - protein, 8 aa, Cryptosporidium parvum
IGRPGERT

SEQ ID NO: 2262241 - protein, 6 aa, Cryptosporidium parvum
IGSAPT

SEQ ID NO: 2262242 - protein, 7 aa, Cryptosporidium parvum
IGSASRS

SEQ ID NO: 2262243 - protein, 6 aa, Cryptosporidium parvum
IGSDET

SEQ ID NO: 2262244 - protein, 5 aa, Cryptosporidium parvum
IGSDP

SEQ ID NO: 2262245 - protein, 9 aa, Cryptosporidium parvum
IGSDSNHSI

SEQ ID NO: 2262246 - protein, 12 aa, Cryptosporidium parvum
IGSDSQEEFNTQ

SEQ ID NO: 2262247 - protein, 7 aa, Cryptosporidium parvum
IGSDTPF

SEQ ID NO: 2262248 - protein, 22 aa, Cryptosporidium parvum
IGSETEKCTQKTSDDDAKTSIY

SEQ ID NO: 2262249 - protein, 4 aa, Cryptosporidium parvum
IGSG

SEQ ID NO: 2262250 - protein, 21 aa, Cryptosporidium parvum
IGSGDEVDPSINSYSNRSTGI

SEQ ID NO: 2262251 - protein, 15 aa, Cryptosporidium parvum
IGSGGGPSNATIQTY

SEQ ID NO: 2262252 - protein, 5 aa, Cryptosporidium parvum
IGSGK

SEQ ID NO: 2262253 - protein, 50 aa, Cryptosporidium parvum
IGSGQASSFGGQARQMNTQPASQVKQPNWTGGKELSQQNSGHTDENSNNH

SEQ ID NO: 2262254 - protein, 15 aa, Cryptosporidium parvum
IGSGQSNLASLSGTH

SEQ ID NO: 2262255 - protein, 13 aa, Cryptosporidium parvum
IGSIEKSTSSEKI

SEQ ID NO: 2262256 - protein, 5 aa, Cryptosporidium parvum
IGSNP

SEQ ID NO: 2262257 - protein, 17 aa, Cryptosporidium parvum
IGSNTEGTEGQSSCQGI

SEQ ID NO: 2262258 - protein, 8 aa, Cryptosporidium parvum
IGSNTNSI

SEQ ID NO: 2262259 - protein, 5 aa, Cryptosporidium parvum
IGSPG

SEQ ID NO: 2262260 - protein, 5 aa, Cryptosporidium parvum
IGSQR

SEQ ID NO: 2262261 - protein, 10 aa, Cryptosporidium parvum
IGSSDQKIVS

SEQ ID NO: 2262262 - protein, 7 aa, Cryptosporidium parvum
IGSSGSM

SEQ ID NO: 2262263 - protein, 21 aa, Cryptosporidium parvum
IGSSIRNSNRTGFSSKPNLSG

SEQ ID NO: 2262264 - protein, 10 aa, Cryptosporidium parvum
IGSSKFQQTP

SEQ ID NO: 2262265 - protein, 16 aa, Cryptosporidium parvum
IGSSTQNKSIKKVSQN

SEQ ID NO: 2262266 - protein, 6 aa, Cryptosporidium parvum
IGSSTS

SEQ ID NO: 2262267 - protein, 5 aa, Cryptosporidium parvum
IGSTE

SEQ ID NO: 2262268 - protein, 8 aa, Cryptosporidium parvum
IGSTGEKL

SEQ ID NO: 2262269 - protein, 12 aa, Cryptosporidium parvum
IGSTSPKIVGSG

SEQ ID NO: 2262270 - protein, 19 aa, Cryptosporidium parvum
IGSTTGSGSVSSSISGPGL

SEQ ID NO: 2262271 - protein, 5 aa, Cryptosporidium parvum
IGTAT

SEQ ID NO: 2262272 - protein, 13 aa, Cryptosporidium parvum
IGTDSISASRANG

SEQ ID NO: 2262273 - protein, 5 aa, Cryptosporidium parvum
IGTEE

SEQ ID NO: 2262274 - protein, 9 aa, Cryptosporidium parvum
IGTEENTSQ

SEQ ID NO: 2262275 - protein, 19 aa, Cryptosporidium parvum
IGTEINNTNGNFETRRKSS

SEQ ID NO: 2262276 - protein, 22 aa, Cryptosporidium parvum
IGTEPLNNNSEIDISKNKKPAL

SEQ ID NO: 2262277 - protein, 9 aa, Cryptosporidium parvum
IGTGAGGSI

SEQ ID NO: 2262278 - protein, 15 aa, Cryptosporidium parvum
IGTGLTREDHPSVSD

SEQ ID NO: 2262279 - protein, 14 aa, Cryptosporidium parvum
IGTGSNSSGRSGTR

SEQ ID NO: 2262280 - protein, 9 aa, Cryptosporidium parvum
IGTNNTPVE

SEQ ID NO: 2262281 - protein, 6 aa, Cryptosporidium parvum
IGTPYE

SEQ ID NO: 2262282 - protein, 6 aa, Cryptosporidium parvum
IGTSTA

SEQ ID NO: 2262283 - protein, 7 aa, Cryptosporidium parvum
IGVGKES

SEQ ID NO: 2262284 - protein, 10 aa, Cryptosporidium parvum
IGVPEESDKL

SEQ ID NO: 2262285 - protein, 13 aa, Cryptosporidium parvum
IGVPTTSSTGYDD

SEQ ID NO: 2262286 - protein, 12 aa, Cryptosporidium parvum
IGYDSEEKGLDY

SEQ ID NO: 2262287 - protein, 9 aa, Cryptosporidium parvum
IHDQSQEDP

SEQ ID NO: 2262288 - protein, 7 aa, Cryptosporidium parvum
IHDSDQR

SEQ ID NO: 2262289 - protein, 17 aa, Cryptosporidium parvum
IHEGPEEVGREEAEQLP

SEQ ID NO: 2262290 - protein, 10 aa, Cryptosporidium parvum
IHEKEEPNIP

SEQ ID NO: 2262291 - protein, 4 aa, Cryptosporidium parvum
IHET

SEQ ID NO: 2262292 - protein, 20 aa, Cryptosporidium parvum
IHGQGKASFSSGNTYEGQWE

SEQ ID NO: 2262293 - protein, 11 aa, Cryptosporidium parvum
IHGSNKTKTVR

SEQ ID NO: 2262294 - protein, 13 aa, Cryptosporidium parvum
IHKPSKESDNEEI

SEQ ID NO: 2262295 - protein, 7 aa, Cryptosporidium parvum
IHNEESH

SEQ ID NO: 2262296 - protein, 8 aa, Cryptosporidium parvum
IHNKEGNI

SEQ ID NO: 2262297 - protein, 4 aa, Cryptosporidium parvum
IHNN

SEQ ID NO: 2262298 - protein, 18 aa, Cryptosporidium parvum
IHNSEDEDLIGSSEKVHE

SEQ ID NO: 2262299 - protein, 13 aa, Cryptosporidium parvum
IHNTKSEASQQIK

SEQ ID NO: 2262300 - protein, 6 aa, Cryptosporidium parvum
IHPRKS

SEQ ID NO: 2262301 - protein, 10 aa, Cryptosporidium parvum
IHSNTQSVND

SEQ ID NO: 2262302 - protein, 18 aa, Cryptosporidium parvum
IHSSEENDSISPSITSGV

SEQ ID NO: 2262303 - protein, 7 aa, Cryptosporidium parvum
IHTPNET

SEQ ID NO: 2262304 - protein, 27 aa, Cryptosporidium parvum
IIAGGQEYDHENEEFDPYSSGSIPPDD

SEQ ID NO: 2262305 - protein, 4 aa, Cryptosporidium parvum
IIDG

SEQ ID NO: 2262306 - protein, 5 aa, Cryptosporidium parvum
IIESS

SEQ ID NO: 2262307 - protein, 11 aa, Cryptosporidium parvum
IIESSNSNSLI

SEQ ID NO: 2262308 - protein, 5 aa, Cryptosporidium parvum
IIKDT

SEQ ID NO: 2262309 - protein, 12 aa, Cryptosporidium parvum
IIPNSTGPNNIQ

SEQ ID NO: 2262310 - protein, 17 aa, Cryptosporidium parvum
IIPSPASNTINSFPNTT

SEQ ID NO: 2262311 - protein, 8 aa, Cryptosporidium parvum
IIPSTTSV

SEQ ID NO: 2262312 - protein, 5 aa, Cryptosporidium parvum
IIQQK

SEQ ID NO: 2262313 - protein, 4 aa, Cryptosporidium parvum
IISE

SEQ ID NO: 2262314 - protein, 10 aa, Cryptosporidium parvum
IISEDSEEKL

SEQ ID NO: 2262315 - protein, 12 aa, Cryptosporidium parvum
IISEDTKKDVHS

SEQ ID NO: 2262316 - protein, 9 aa, Cryptosporidium parvum
IISSSDTQG

SEQ ID NO: 2262317 - protein, 14 aa, Cryptosporidium parvum
IISTENDVKRIKVD

SEQ ID NO: 2262318 - protein, 20 aa, Cryptosporidium parvum
IKADEGKKHENGIKNKEQEL

SEQ ID NO: 2262319 - protein, 14 aa, Cryptosporidium parvum
IKAEEEKKVQVASQ

SEQ ID NO: 2262320 - protein, 8 aa, Cryptosporidium parvum
IKAENEQC

SEQ ID NO: 2262321 - protein, 6 aa, Cryptosporidium parvum
IKAETT

SEQ ID NO: 2262322 - protein, 11 aa, Cryptosporidium parvum
IKAGESNERGL

SEQ ID NO: 2262323 - protein, 9 aa, Cryptosporidium parvum
IKAKEKTYT

SEQ ID NO: 2262324 - protein, 12 aa, Cryptosporidium parvum
IKASEEEMATLL

SEQ ID NO: 2262325 - protein, 7 aa, Cryptosporidium parvum
IKASESI

SEQ ID NO: 2262326 - protein, 10 aa, Cryptosporidium parvum
IKDANNIKQS

SEQ ID NO: 2262327 - protein, 10 aa, Cryptosporidium parvum
IKDARENYGD

SEQ ID NO: 2262328 - protein, 9 aa, Cryptosporidium parvum
IKDDEREIK

SEQ ID NO: 2262329 - protein, 6 aa, Cryptosporidium parvum
IKDDGN

SEQ ID NO: 2262330 - protein, 9 aa, Cryptosporidium parvum
IKDEYNNYK

SEQ ID NO: 2262331 - protein, 4 aa, Cryptosporidium parvum
IKDP

SEQ ID NO: 2262332 - protein, 5 aa, Cryptosporidium parvum
IKDPD

SEQ ID NO: 2262333 - protein, 25 aa, Cryptosporidium parvum
IKDSPYTNSKTKRSHNSYSKARRSF

SEQ ID NO: 2262334 - protein, 10 aa, Cryptosporidium parvum
IKDTSKEEEY

SEQ ID NO: 2262335 - protein, 10 aa, Cryptosporidium parvum
IKEARKQREI

SEQ ID NO: 2262336 - protein, 11 aa, Cryptosporidium parvum
IKEDERKGRSI

SEQ ID NO: 2262337 - protein, 14 aa, Cryptosporidium parvum
IKEEIPALDNYLDK

SEQ ID NO: 2262338 - protein, 6 aa, Cryptosporidium parvum
IKEENR

SEQ ID NO: 2262339 - protein, 11 aa, Cryptosporidium parvum
IKEERREEQNL

SEQ ID NO: 2262340 - protein, 4 aa, Cryptosporidium parvum
IKEG

SEQ ID NO: 2262341 - protein, 9 aa, Cryptosporidium parvum
IKEGESIEN

SEQ ID NO: 2262342 - protein, 4 aa, Cryptosporidium parvum
IKEI

SEQ ID NO: 2262343 - protein, 4 aa, Cryptosporidium parvum
IKEK

SEQ ID NO: 2262344 - protein, 13 aa, Cryptosporidium parvum
IKEKGKKKSMSRP

SEQ ID NO: 2262345 - protein, 14 aa, Cryptosporidium parvum
IKEKTKKSSTIEDT

SEQ ID NO: 2262346 - protein, 4 aa, Cryptosporidium parvum
IKEN

SEQ ID NO: 2262347 - protein, 16 aa, Cryptosporidium parvum
IKENGHLNNQENQNIQ

SEQ ID NO: 2262348 - protein, 6 aa, Cryptosporidium parvum
IKENQH

SEQ ID NO: 2262349 - protein, 5 aa, Cryptosporidium parvum
IKENT

SEQ ID NO: 2262350 - protein, 15 aa, Cryptosporidium parvum
IKEPNSGENQHTTTK

SEQ ID NO: 2262351 - protein, 16 aa, Cryptosporidium parvum
IKESKNGLLVVPISYN

SEQ ID NO: 2262352 - protein, 39 aa, Cryptosporidium parvum
IKESKTSNNSSSLRSTNELSSVGGNNRGFSNNNSHNSVQ

SEQ ID NO: 2262353 - protein, 8 aa, Cryptosporidium parvum
IKESRKER

SEQ ID NO: 2262354 - protein, 9 aa, Cryptosporidium parvum
IKESSNRFT

SEQ ID NO: 2262355 - protein, 14 aa, Cryptosporidium parvum
IKESTRDVANEDIN

SEQ ID NO: 2262356 - protein, 45 aa, Cryptosporidium parvum
IKESTSVPPPAPPAPPAPPAPPAPPAPPSPPTLSKSEAQESPSVL

SEQ ID NO: 2262357 - protein, 14 aa, Cryptosporidium parvum
IKESVGDEKGTKSR

SEQ ID NO: 2262358 - protein, 17 aa, Cryptosporidium parvum
IKETEERKQSEKDDVYD

SEQ ID NO: 2262359 - protein, 12 aa, Cryptosporidium parvum
IKETNTSSNAYS

SEQ ID NO: 2262360 - protein, 15 aa, Cryptosporidium parvum
IKGAYEASFKKKSKK

SEQ ID NO: 2262361 - protein, 8 aa, Cryptosporidium parvum
IKGEAGLK

SEQ ID NO: 2262362 - protein, 11 aa, Cryptosporidium parvum
IKGEDDEIDNT

SEQ ID NO: 2262363 - protein, 10 aa, Cryptosporidium parvum
IKGEDSKNIE

SEQ ID NO: 2262364 - protein, 8 aa, Cryptosporidium parvum
IKGGQSKE

SEQ ID NO: 2262365 - protein, 17 aa, Cryptosporidium parvum
IKGGSGNANYNTGNPYV

SEQ ID NO: 2262366 - protein, 9 aa, Cryptosporidium parvum
IKGKEDNCE

SEQ ID NO: 2262367 - protein, 11 aa, Cryptosporidium parvum
IKGKKGRTKEL

SEQ ID NO: 2262368 - protein, 14 aa, Cryptosporidium parvum
IKGKNESNSDVAEN

SEQ ID NO: 2262369 - protein, 11 aa, Cryptosporidium parvum
IKGRSDSKCRE

SEQ ID NO: 2262370 - protein, 5 aa, Cryptosporidium parvum
IKGSD

SEQ ID NO: 2262371 - protein, 6 aa, Cryptosporidium parvum
IKGTAS

SEQ ID NO: 2262372 - protein, 8 aa, Cryptosporidium parvum
IKGTPNGP

SEQ ID NO: 2262373 - protein, 8 aa, Cryptosporidium parvum
IKGYRDDS

SEQ ID NO: 2262374 - protein, 5 aa, Cryptosporidium parvum
IKIDG

SEQ ID NO: 2262375 - protein, 12 aa, Cryptosporidium parvum
IKIEGYSDSHSL

SEQ ID NO: 2262376 - protein, 15 aa, Cryptosporidium parvum
IKKAQNEISNFVFEI

SEQ ID NO: 2262377 - protein, 9 aa, Cryptosporidium parvum
IKKEEDKFG

SEQ ID NO: 2262378 - protein, 16 aa, Cryptosporidium parvum
IKKEKELTPKKNDDIN

SEQ ID NO: 2262379 - protein, 15 aa, Cryptosporidium parvum
IKKENEESDPQNNEE

SEQ ID NO: 2262380 - protein, 10 aa, Cryptosporidium parvum
IKKENENKIT

SEQ ID NO: 2262381 - protein, 4 aa, Cryptosporidium parvum
IKKG

SEQ ID NO: 2262382 - protein, 9 aa, Cryptosporidium parvum
IKKKGNSHS

SEQ ID NO: 2262383 - protein, 13 aa, Cryptosporidium parvum
IKKKKKGSKKKQS

SEQ ID NO: 2262384 - protein, 5 aa, Cryptosporidium parvum
IKKNN

SEQ ID NO: 2262385 - protein, 19 aa, Cryptosporidium parvum
IKKRDNTLKEKFKEKEANL

SEQ ID NO: 2262386 - protein, 29 aa, Cryptosporidium parvum
IKKRKELGSDSKIDAKLSSKIKGKSLNKR

SEQ ID NO: 2262387 - protein, 8 aa, Cryptosporidium parvum
IKKRKRSR

SEQ ID NO: 2262388 - protein, 7 aa, Cryptosporidium parvum
IKKSGSL

SEQ ID NO: 2262389 - protein, 14 aa, Cryptosporidium parvum
IKKSNTGQKKKKWH

SEQ ID NO: 2262390 - protein, 9 aa, Cryptosporidium parvum
IKKSTSSGR

SEQ ID NO: 2262391 - protein, 11 aa, Cryptosporidium parvum
IKKTDNSGNKM

SEQ ID NO: 2262392 - protein, 10 aa, Cryptosporidium parvum
IKKTRRGKIR

SEQ ID NO: 2262393 - protein, 12 aa, Cryptosporidium parvum
IKNANSKLSQTV

SEQ ID NO: 2262394 - protein, 10 aa, Cryptosporidium parvum
IKNDLNHSNQ

SEQ ID NO: 2262395 - protein, 6 aa, Cryptosporidium parvum
IKNDNP

SEQ ID NO: 2262396 - protein, 4 aa, Cryptosporidium parvum
IKNE

SEQ ID NO: 2262397 - protein, 9 aa, Cryptosporidium parvum
IKNEDTPYF

SEQ ID NO: 2262398 - protein, 8 aa, Cryptosporidium parvum
IKNEGGRI

SEQ ID NO: 2262399 - protein, 9 aa, Cryptosporidium parvum
IKNENSKIN

SEQ ID NO: 2262400 - protein, 34 aa, Cryptosporidium parvum
IKNETDGSVTETERTIHENENEKESQLKTPPKRP

SEQ ID NO: 2262401 - protein, 8 aa, Cryptosporidium parvum
IKNGESDL

SEQ ID NO: 2262402 - protein, 26 aa, Cryptosporidium parvum
IKNGSGIQKQTSNSQNSSHNKGGGSS

SEQ ID NO: 2262403 - protein, 8 aa, Cryptosporidium parvum
IKNKNTNN

SEQ ID NO: 2262404 - protein, 23 aa, Cryptosporidium parvum
IKNKSGSGRSKPFQPASSHKNNH

SEQ ID NO: 2262405 - protein, 498 aa, Cryptosporidium parvum
IKNKSNDNKKGSKKSEMNNTKIPESSTDSSSGSSSSSEDEKSKKNTKAVIPTPAKKAMSDSSSSSDSSSSSEDEQPKKNTKAAAPVKKNISNSSSSSSDSDSSSEDEQPKKNAKAAAPMKKSISNSSSSSSSSDSDSSSEDEQPKKNAKAATPMKKNISNSSSDSSSSSDSSSSEDEKSKKNTKAVIPTPAKKAMSDSSSSSDSSSSSEDEQPKKNIKVTTQASAKKAVSDSSSSSSDSSSSSEDEQPKKNTKAAASIPAKKAMSDSSSSSDSSSSSEDEQPKKNSKAAASTPAKKAMSDSSSSSSSSDSSSSSEDEQPKKNSKAATPMKKNISNSSSSSSSSDSDSSSEDEQPKKNAKAATPMKKNISNSSSDSSSSSDSSSSEDEKPKKNTKAAASTTAKKAMSDSSSSDSSSSSDSESDNEKAKKVSKSVKSSNSSSESEVEMNKSKRKAESELNNNKENKITKNDTPKRSYQGNDDNSQPRKRQNTNNKDSREV

SEQ ID NO: 2262406 - protein, 5 aa, Cryptosporidium parvum
IKNNF

SEQ ID NO: 2262407 - protein, 10 aa, Cryptosporidium parvum
IKNNSDRFKP

SEQ ID NO: 2262408 - protein, 9 aa, Cryptosporidium parvum
IKNNSSQAM

SEQ ID NO: 2262409 - protein, 6 aa, Cryptosporidium parvum
IKNPNL

SEQ ID NO: 2262410 - protein, 10 aa, Cryptosporidium parvum
IKNQPGQKGD

SEQ ID NO: 2262411 - protein, 8 aa, Cryptosporidium parvum
IKNQSDNK

SEQ ID NO: 2262412 - protein, 16 aa, Cryptosporidium parvum
IKNSPSQAIPSPFGND

SEQ ID NO: 2262413 - protein, 7 aa, Cryptosporidium parvum
IKNSQKK

SEQ ID NO: 2262414 - protein, 8 aa, Cryptosporidium parvum
IKNSSDQT

SEQ ID NO: 2262415 - protein, 5 aa, Cryptosporidium parvum
IKNST

SEQ ID NO: 2262416 - protein, 9 aa, Cryptosporidium parvum
IKNTNCDSK

SEQ ID NO: 2262417 - protein, 10 aa, Cryptosporidium parvum
IKNTSQNNTS

SEQ ID NO: 2262418 - protein, 7 aa, Cryptosporidium parvum
IKPASAE

SEQ ID NO: 2262419 - protein, 4 aa, Cryptosporidium parvum
IKPD

SEQ ID NO: 2262420 - protein, 14 aa, Cryptosporidium parvum
IKPDATKKMTMESR

SEQ ID NO: 2262421 - protein, 6 aa, Cryptosporidium parvum
IKPDSV

SEQ ID NO: 2262422 - protein, 10 aa, Cryptosporidium parvum
IKPEGSKKID

SEQ ID NO: 2262423 - protein, 8 aa, Cryptosporidium parvum
IKPEGTNS

SEQ ID NO: 2262424 - protein, 4 aa, Cryptosporidium parvum
IKPG

SEQ ID NO: 2262425 - protein, 8 aa, Cryptosporidium parvum
IKPGGAPR

SEQ ID NO: 2262426 - protein, 7 aa, Cryptosporidium parvum
IKPGNNR

SEQ ID NO: 2262427 - protein, 8 aa, Cryptosporidium parvum
IKPKESSF

SEQ ID NO: 2262428 - protein, 12 aa, Cryptosporidium parvum
IKPKITTEDITN

SEQ ID NO: 2262429 - protein, 7 aa, Cryptosporidium parvum
IKPKKRV

SEQ ID NO: 2262430 - protein, 9 aa, Cryptosporidium parvum
IKPKNDDNY

SEQ ID NO: 2262431 - protein, 4 aa, Cryptosporidium parvum
IKPL

SEQ ID NO: 2262432 - protein, 6 aa, Cryptosporidium parvum
IKPNNR

SEQ ID NO: 2262433 - protein, 5 aa, Cryptosporidium parvum
IKPPK

SEQ ID NO: 2262434 - protein, 12 aa, Cryptosporidium parvum
IKPSGKNTEPEF

SEQ ID NO: 2262435 - protein, 5 aa, Cryptosporidium parvum
IKPSK

SEQ ID NO: 2262436 - protein, 6 aa, Cryptosporidium parvum
IKPSSF

SEQ ID NO: 2262437 - protein, 9 aa, Cryptosporidium parvum
IKPSTMSQS

SEQ ID NO: 2262438 - protein, 6 aa, Cryptosporidium parvum
IKPTDT

SEQ ID NO: 2262439 - protein, 4 aa, Cryptosporidium parvum
IKQD

SEQ ID NO: 2262440 - protein, 9 aa, Cryptosporidium parvum
IKQDGTEIS

SEQ ID NO: 2262441 - protein, 10 aa, Cryptosporidium parvum
IKQETTDSLN

SEQ ID NO: 2262442 - protein, 9 aa, Cryptosporidium parvum
IKQGSKISE

SEQ ID NO: 2262443 - protein, 8 aa, Cryptosporidium parvum
IKQNDPYG

SEQ ID NO: 2262444 - protein, 11 aa, Cryptosporidium parvum
IKQNETTNNDN

SEQ ID NO: 2262445 - protein, 16 aa, Cryptosporidium parvum
IKQNPETDETDETDKK

SEQ ID NO: 2262446 - protein, 11 aa, Cryptosporidium parvum
IKQPNNKLTEF

SEQ ID NO: 2262447 - protein, 11 aa, Cryptosporidium parvum
IKQSLKDDAKL

SEQ ID NO: 2262448 - protein, 7 aa, Cryptosporidium parvum
IKQSSIN

SEQ ID NO: 2262449 - protein, 5 aa, Cryptosporidium parvum
IKRAE

SEQ ID NO: 2262450 - protein, 15 aa, Cryptosporidium parvum
IKRDDATYDDPNAGF

SEQ ID NO: 2262451 - protein, 12 aa, Cryptosporidium parvum
IKREEEDKAKIQ

SEQ ID NO: 2262452 - protein, 7 aa, Cryptosporidium parvum
IKRNTKQ

SEQ ID NO: 2262453 - protein, 6 aa, Cryptosporidium parvum
IKRNYD

SEQ ID NO: 2262454 - protein, 10 aa, Cryptosporidium parvum
IKRPEGVSKK

SEQ ID NO: 2262455 - protein, 9 aa, Cryptosporidium parvum
IKSAAREEI

SEQ ID NO: 2262456 - protein, 6 aa, Cryptosporidium parvum
IKSARG

SEQ ID NO: 2262457 - protein, 7 aa, Cryptosporidium parvum
IKSDEKI

SEQ ID NO: 2262458 - protein, 20 aa, Cryptosporidium parvum
IKSDGEINDDDEDYEDNQSI

SEQ ID NO: 2262459 - protein, 10 aa, Cryptosporidium parvum
IKSEKSPTTI

SEQ ID NO: 2262460 - protein, 45 aa, Cryptosporidium parvum
IKSENKQKKGTSTSKKASTKSKSNVGSKTKSKAKGNTGNKTKSVV

SEQ ID NO: 2262461 - protein, 15 aa, Cryptosporidium parvum
IKSESNSINNDIKDE

SEQ ID NO: 2262462 - protein, 5 aa, Cryptosporidium parvum
IKSEV

SEQ ID NO: 2262463 - protein, 4 aa, Cryptosporidium parvum
IKSG

SEQ ID NO: 2262464 - protein, 9 aa, Cryptosporidium parvum
IKSGGKSIK

SEQ ID NO: 2262465 - protein, 9 aa, Cryptosporidium parvum
IKSGPVPIS

SEQ ID NO: 2262466 - protein, 7 aa, Cryptosporidium parvum
IKSKGGN

SEQ ID NO: 2262467 - protein, 6 aa, Cryptosporidium parvum
IKSKGL

SEQ ID NO: 2262468 - protein, 12 aa, Cryptosporidium parvum
IKSKKEQGDETA

SEQ ID NO: 2262469 - protein, 8 aa, Cryptosporidium parvum
IKSKNSDN

SEQ ID NO: 2262470 - protein, 23 aa, Cryptosporidium parvum
IKSKQACSNYDNNELKDNQEKVD

SEQ ID NO: 2262471 - protein, 17 aa, Cryptosporidium parvum
IKSKSKEHIELSEEDKN

SEQ ID NO: 2262472 - protein, 25 aa, Cryptosporidium parvum
IKSKSSSDLTATSSIDSSSITPETL

SEQ ID NO: 2262473 - protein, 17 aa, Cryptosporidium parvum
IKSNELNQKTLANPKTL

SEQ ID NO: 2262474 - protein, 5 aa, Cryptosporidium parvum
IKSNN

SEQ ID NO: 2262475 - protein, 6 aa, Cryptosporidium parvum
IKSPDL

SEQ ID NO: 2262476 - protein, 11 aa, Cryptosporidium parvum
IKSPKLTTSSV

SEQ ID NO: 2262477 - protein, 8 aa, Cryptosporidium parvum
IKSRNMDP

SEQ ID NO: 2262478 - protein, 6 aa, Cryptosporidium parvum
IKSRSN

SEQ ID NO: 2262479 - protein, 4 aa, Cryptosporidium parvum
IKSS

SEQ ID NO: 2262480 - protein, 6 aa, Cryptosporidium parvum
IKSSSD

SEQ ID NO: 2262481 - protein, 10 aa, Cryptosporidium parvum
IKSVNGGRGI

SEQ ID NO: 2262482 - protein, 8 aa, Cryptosporidium parvum
IKSYNAKK

SEQ ID NO: 2262483 - protein, 10 aa, Cryptosporidium parvum
IKTASKNPDL

SEQ ID NO: 2262484 - protein, 10 aa, Cryptosporidium parvum
IKTDESGVSR

SEQ ID NO: 2262485 - protein, 4 aa, Cryptosporidium parvum
IKTE

SEQ ID NO: 2262486 - protein, 8 aa, Cryptosporidium parvum
IKTKGDPT

SEQ ID NO: 2262487 - protein, 15 aa, Cryptosporidium parvum
IKTNRGERISKSDSL

SEQ ID NO: 2262488 - protein, 5 aa, Cryptosporidium parvum
IKTPK

SEQ ID NO: 2262489 - protein, 13 aa, Cryptosporidium parvum
IKTPKSQKKVQFG

SEQ ID NO: 2262490 - protein, 7 aa, Cryptosporidium parvum
IKTPNGI

SEQ ID NO: 2262491 - protein, 5 aa, Cryptosporidium parvum
IKTQQ

SEQ ID NO: 2262492 - protein, 6 aa, Cryptosporidium parvum
IKTRDE

SEQ ID NO: 2262493 - protein, 9 aa, Cryptosporidium parvum
IKTSELDEL

SEQ ID NO: 2262494 - protein, 7 aa, Cryptosporidium parvum
IKTSKNL

SEQ ID NO: 2262495 - protein, 10 aa, Cryptosporidium parvum
IKTTSRNARD

SEQ ID NO: 2262496 - protein, 7 aa, Cryptosporidium parvum
IKVENKE

SEQ ID NO: 2262497 - protein, 12 aa, Cryptosporidium parvum
IKVTKNGDENNQ

SEQ ID NO: 2262498 - protein, 17 aa, Cryptosporidium parvum
IKYESPTNLKNNSFYED

SEQ ID NO: 2262499 - protein, 17 aa, Cryptosporidium parvum
IKYPRNNYGNDEDQNPH

SEQ ID NO: 2262500 - protein, 5 aa, Cryptosporidium parvum
ILESE

SEQ ID NO: 2262501 - protein, 4 aa, Cryptosporidium parvum
ILGG

SEQ ID NO: 2262502 - protein, 7 aa, Cryptosporidium parvum
ILGPTTM

SEQ ID NO: 2262503 - protein, 4 aa, Cryptosporidium parvum
ILPG

SEQ ID NO: 2262504 - protein, 12 aa, Cryptosporidium parvum
ILSGEKKDPMLP

SEQ ID NO: 2262505 - protein, 8 aa, Cryptosporidium parvum
ILSPPGDT

SEQ ID NO: 2262506 - protein, 15 aa, Cryptosporidium parvum
ILSSSSNIDSQNSKY

SEQ ID NO: 2262507 - protein, 10 aa, Cryptosporidium parvum
ILSSTSSDGE

SEQ ID NO: 2262508 - protein, 10 aa, Cryptosporidium parvum
IMPENSNKAM

SEQ ID NO: 2262509 - protein, 9 aa, Cryptosporidium parvum
IMSESSDSN

SEQ ID NO: 2262510 - protein, 8 aa, Cryptosporidium parvum
INAHESGS

SEQ ID NO: 2262511 - protein, 9 aa, Cryptosporidium parvum
INAKPKTNI

SEQ ID NO: 2262512 - protein, 5 aa, Cryptosporidium parvum
INANS

SEQ ID NO: 2262513 - protein, 11 aa, Cryptosporidium parvum
INASSSPPNKV

SEQ ID NO: 2262514 - protein, 24 aa, Cryptosporidium parvum
INDDDDDNNNNNNNSVGTGDHDRD

SEQ ID NO: 2262515 - protein, 5 aa, Cryptosporidium parvum
INDDN

SEQ ID NO: 2262516 - protein, 5 aa, Cryptosporidium parvum
INDEK

SEQ ID NO: 2262517 - protein, 7 aa, Cryptosporidium parvum
INDEKNR

SEQ ID NO: 2262518 - protein, 24 aa, Cryptosporidium parvum
INDENDNDEIDCTETDKDIKEGYG

SEQ ID NO: 2262519 - protein, 10 aa, Cryptosporidium parvum
INDENSKLGN

SEQ ID NO: 2262520 - protein, 9 aa, Cryptosporidium parvum
INDETNNIE

SEQ ID NO: 2262521 - protein, 4 aa, Cryptosporidium parvum
INDG

SEQ ID NO: 2262522 - protein, 5 aa, Cryptosporidium parvum
INDGN

SEQ ID NO: 2262523 - protein, 7 aa, Cryptosporidium parvum
INDKAKV

SEQ ID NO: 2262524 - protein, 10 aa, Cryptosporidium parvum
INDKDEISNS

SEQ ID NO: 2262525 - protein, 4 aa, Cryptosporidium parvum
INDN

SEQ ID NO: 2262526 - protein, 6 aa, Cryptosporidium parvum
INDNIE

SEQ ID NO: 2262527 - protein, 15 aa, Cryptosporidium parvum
INDNNNDENIENNKK

SEQ ID NO: 2262528 - protein, 12 aa, Cryptosporidium parvum
INDNNSNNNKII

SEQ ID NO: 2262529 - protein, 14 aa, Cryptosporidium parvum
INDNSKNIIGGPPG

SEQ ID NO: 2262530 - protein, 18 aa, Cryptosporidium parvum
INDQKGEIYSSDSAKGIL

SEQ ID NO: 2262531 - protein, 19 aa, Cryptosporidium parvum
INDQKHKSLSISNSQPPKI

SEQ ID NO: 2262532 - protein, 5 aa, Cryptosporidium parvum
INDSF

SEQ ID NO: 2262533 - protein, 7 aa, Cryptosporidium parvum
INDSGDY

SEQ ID NO: 2262534 - protein, 74 aa, Cryptosporidium parvum
INDSKNSLNNSAQVTSNSSVKRKNKKVLRKSKRGRHKNKSKYKIESTSLDKDGDKIGSQARNLDNRIGKDTYSV

SEQ ID NO: 2262535 - protein, 21 aa, Cryptosporidium parvum
INDTGKRLKDLENRSKRISNE

SEQ ID NO: 2262536 - protein, 36 aa, Cryptosporidium parvum
INEAETDRSGQIDPQKSLDSINSNSFNSSNSNFTRT

SEQ ID NO: 2262537 - protein, 4 aa, Cryptosporidium parvum
INEE

SEQ ID NO: 2262538 - protein, 12 aa, Cryptosporidium parvum
INEEDPNSHIGK

SEQ ID NO: 2262539 - protein, 6 aa, Cryptosporidium parvum
INEEER

SEQ ID NO: 2262540 - protein, 12 aa, Cryptosporidium parvum
INEEYKKELEEL

SEQ ID NO: 2262541 - protein, 4 aa, Cryptosporidium parvum
INEG

SEQ ID NO: 2262542 - protein, 7 aa, Cryptosporidium parvum
INEHKQR

SEQ ID NO: 2262543 - protein, 23 aa, Cryptosporidium parvum
INEKRKSKKRSIKNENKFTKDPE

SEQ ID NO: 2262544 - protein, 24 aa, Cryptosporidium parvum
INEKSKKRAKNTKFKGNSKINNED

SEQ ID NO: 2262545 - protein, 10 aa, Cryptosporidium parvum
INEKSSTNDL

SEQ ID NO: 2262546 - protein, 5 aa, Cryptosporidium parvum
INELN

SEQ ID NO: 2262547 - protein, 17 aa, Cryptosporidium parvum
INENETENVETLSKQSK

SEQ ID NO: 2262548 - protein, 6 aa, Cryptosporidium parvum
INENQN

SEQ ID NO: 2262549 - protein, 5 aa, Cryptosporidium parvum
INENS

SEQ ID NO: 2262550 - protein, 4 aa, Cryptosporidium parvum
INEP

SEQ ID NO: 2262551 - protein, 8 aa, Cryptosporidium parvum
INEPDQDL

SEQ ID NO: 2262552 - protein, 7 aa, Cryptosporidium parvum
INEQPNK

SEQ ID NO: 2262553 - protein, 4 aa, Cryptosporidium parvum
INES

SEQ ID NO: 2262554 - protein, 10 aa, Cryptosporidium parvum
INESNTSIPN

SEQ ID NO: 2262555 - protein, 5 aa, Cryptosporidium parvum
INESS

SEQ ID NO: 2262556 - protein, 24 aa, Cryptosporidium parvum
INEVTGNTSTNNINNSKVESTNGN

SEQ ID NO: 2262557 - protein, 5 aa, Cryptosporidium parvum
INEYK

SEQ ID NO: 2262558 - protein, 5 aa, Cryptosporidium parvum
INEYS

SEQ ID NO: 2262559 - protein, 10 aa, Cryptosporidium parvum
INGDDNSVND

SEQ ID NO: 2262560 - protein, 22 aa, Cryptosporidium parvum
INGEKSDGTYLSSSNHETEGKN

SEQ ID NO: 2262561 - protein, 12 aa, Cryptosporidium parvum
INGLSRSSQDLR

SEQ ID NO: 2262562 - protein, 4 aa, Cryptosporidium parvum
INGN

SEQ ID NO: 2262563 - protein, 16 aa, Cryptosporidium parvum
INGNKEIDNHDEEKIS

SEQ ID NO: 2262564 - protein, 24 aa, Cryptosporidium parvum
INGNNDEKSNSNSNWNDLNWSDDE

SEQ ID NO: 2262565 - protein, 10 aa, Cryptosporidium parvum
INGNNNITDS

SEQ ID NO: 2262566 - protein, 10 aa, Cryptosporidium parvum
INGPTPDIRT

SEQ ID NO: 2262567 - protein, 5 aa, Cryptosporidium parvum
INGSG

SEQ ID NO: 2262568 - protein, 11 aa, Cryptosporidium parvum
INGSQSKITLN

SEQ ID NO: 2262569 - protein, 9 aa, Cryptosporidium parvum
INGSSEKLA

SEQ ID NO: 2262570 - protein, 11 aa, Cryptosporidium parvum
INGSSKLGAYS

SEQ ID NO: 2262571 - protein, 9 aa, Cryptosporidium parvum
INGTESNMN

SEQ ID NO: 2262572 - protein, 14 aa, Cryptosporidium parvum
INIDNNTNIENEAV

SEQ ID NO: 2262573 - protein, 5 aa, Cryptosporidium parvum
INIEE

SEQ ID NO: 2262574 - protein, 5 aa, Cryptosporidium parvum
INIPK

SEQ ID NO: 2262575 - protein, 7 aa, Cryptosporidium parvum
INKEKEM

SEQ ID NO: 2262576 - protein, 11 aa, Cryptosporidium parvum
INKEKNQSSNI

SEQ ID NO: 2262577 - protein, 15 aa, Cryptosporidium parvum
INKENSDFSNSKGAN

SEQ ID NO: 2262578 - protein, 9 aa, Cryptosporidium parvum
INKEPSNSF

SEQ ID NO: 2262579 - protein, 5 aa, Cryptosporidium parvum
INKET

SEQ ID NO: 2262580 - protein, 8 aa, Cryptosporidium parvum
INKGGNYT

SEQ ID NO: 2262581 - protein, 11 aa, Cryptosporidium parvum
INKHQEKLSNN

SEQ ID NO: 2262582 - protein, 4 aa, Cryptosporidium parvum
INKK

SEQ ID NO: 2262583 - protein, 16 aa, Cryptosporidium parvum
INKKDAKIEKKQRLPE

SEQ ID NO: 2262584 - protein, 7 aa, Cryptosporidium parvum
INKKSEK

SEQ ID NO: 2262585 - protein, 7 aa, Cryptosporidium parvum
INKNGSD

SEQ ID NO: 2262586 - protein, 6 aa, Cryptosporidium parvum
INKNKK

SEQ ID NO: 2262587 - protein, 5 aa, Cryptosporidium parvum
INKNR

SEQ ID NO: 2262588 - protein, 7 aa, Cryptosporidium parvum
INKNSNS

SEQ ID NO: 2262589 - protein, 9 aa, Cryptosporidium parvum
INKNSSDYI

SEQ ID NO: 2262590 - protein, 9 aa, Cryptosporidium parvum
INKQYNKRM

SEQ ID NO: 2262591 - protein, 23 aa, Cryptosporidium parvum
INKRAPPIITKSTPSKRAPPHKS

SEQ ID NO: 2262592 - protein, 4 aa, Cryptosporidium parvum
INKS

SEQ ID NO: 2262593 - protein, 10 aa, Cryptosporidium parvum
INKSKKIPYR

SEQ ID NO: 2262594 - protein, 18 aa, Cryptosporidium parvum
INKSNTRRLVDLEPILCL

SEQ ID NO: 2262595 - protein, 10 aa, Cryptosporidium parvum
INKTHNSERY

SEQ ID NO: 2262596 - protein, 5 aa, Cryptosporidium parvum
INKTT

SEQ ID NO: 2262597 - protein, 9 aa, Cryptosporidium parvum
INLERKERE

SEQ ID NO: 2262598 - protein, 5 aa, Cryptosporidium parvum
INLNN

SEQ ID NO: 2262599 - protein, 15 aa, Cryptosporidium parvum
INLNPKKVDESNTLE

SEQ ID NO: 2262600 - protein, 4 aa, Cryptosporidium parvum
INLP

SEQ ID NO: 2262601 - protein, 4 aa, Cryptosporidium parvum
INND

SEQ ID NO: 2262602 - protein, 11 aa, Cryptosporidium parvum
INNDENNEPVL

SEQ ID NO: 2262603 - protein, 5 aa, Cryptosporidium parvum
INNDL

SEQ ID NO: 2262604 - protein, 7 aa, Cryptosporidium parvum
INNEKET

SEQ ID NO: 2262605 - protein, 16 aa, Cryptosporidium parvum
INNEKNNNKNKEEYEE

SEQ ID NO: 2262606 - protein, 13 aa, Cryptosporidium parvum
INNELESAKNEIE

SEQ ID NO: 2262607 - protein, 18 aa, Cryptosporidium parvum
INNENNDDEEARRLSQEE

SEQ ID NO: 2262608 - protein, 10 aa, Cryptosporidium parvum
INNEPHTTNT

SEQ ID NO: 2262609 - protein, 6 aa, Cryptosporidium parvum
INNEPI

SEQ ID NO: 2262610 - protein, 24 aa, Cryptosporidium parvum
INNGFTKSSTKANSKNSNLQEPIT

SEQ ID NO: 2262611 - protein, 6 aa, Cryptosporidium parvum
INNGNK

SEQ ID NO: 2262612 - protein, 38 aa, Cryptosporidium parvum; identical to SEQ ID NO: 2145713

SEQ ID NO: 2262613 - protein, 18 aa, Cryptosporidium parvum
INNKNDNKHSNSIKRRPP

SEQ ID NO: 2262614 - protein, 6 aa, Cryptosporidium parvum
INNKNT

SEQ ID NO: 2262615 - protein, 6 aa, Cryptosporidium parvum
INNKQD

SEQ ID NO: 2262616 - protein, 15 aa, Cryptosporidium parvum
INNKQDQSKAISQSC

SEQ ID NO: 2262617 - protein, 26 aa, Cryptosporidium parvum
INNLSDSKQKLNPAKSLKNENKENNL

SEQ ID NO: 2262618 - protein, 4 aa, Cryptosporidium parvum
INNN

SEQ ID NO: 2262619 - protein, 15 aa, Cryptosporidium parvum
INNNDKSKDNMSSLN

SEQ ID NO: 2262620 - protein, 15 aa, Cryptosporidium parvum
INNNEGNSITESTEE

SEQ ID NO: 2262621 - protein, 13 aa, Cryptosporidium parvum
INNNGKGKNKDEL

SEQ ID NO: 2262622 - protein, 58 aa, Cryptosporidium parvum
INNNKEESDLSDYGSGNTNTTETNYSRINKTKEKYINKGDSSCEEDDNNNNNNSTQNV

SEQ ID NO: 2262623 - protein, 27 aa, Cryptosporidium parvum
INNNKNSHQNNNMSERLDKSEDRRTSL

SEQ ID NO: 2262624 - protein, 9 aa, Cryptosporidium parvum
INNNNDKKK

SEQ ID NO: 2262625 - protein, 9 aa, Cryptosporidium parvum
INNNNNNKD

SEQ ID NO: 2262626 - protein, 17 aa, Cryptosporidium parvum
INNNNNNNNCNSGNKRP

SEQ ID NO: 2262627 - protein, 22 aa, Cryptosporidium parvum
INNNNQSRISKKPIQNIRESSP

SEQ ID NO: 2262628 - protein, 22 aa, Cryptosporidium parvum
INNNNSNNSCNNNNHNFSSGPS

SEQ ID NO: 2262629 - protein, 14 aa, Cryptosporidium parvum
INNQKRRNRSFSRE

SEQ ID NO: 2262630 - protein, 8 aa, Cryptosporidium parvum
INNQNKKD

SEQ ID NO: 2262631 - protein, 12 aa, Cryptosporidium parvum
INNQSSLPPQPI

SEQ ID NO: 2262632 - protein, 7 aa, Cryptosporidium parvum
INNQTKT

SEQ ID NO: 2262633 - protein, 11 aa, Cryptosporidium parvum
INNRKSSSISE

SEQ ID NO: 2262634 - protein, 6 aa, Cryptosporidium parvum
INNSAN

SEQ ID NO: 2262635 - protein, 5 aa, Cryptosporidium parvum
INNSI

SEQ ID NO: 2262636 - protein, 12 aa, Cryptosporidium parvum
INNSNTGLPNPN

SEQ ID NO: 2262637 - protein, 6 aa, Cryptosporidium parvum
INNSTG

SEQ ID NO: 2262638 - protein, 9 aa, Cryptosporidium parvum
INNTESEKR

SEQ ID NO: 2262639 - protein, 12 aa, Cryptosporidium parvum
INNTSEGSKLVQ

SEQ ID NO: 2262640 - protein, 9 aa, Cryptosporidium parvum
INNTTNNCN

SEQ ID NO: 2262641 - protein, 20 aa, Cryptosporidium parvum
INNYGKSSAFGNLSNTRNIP

SEQ ID NO: 2262642 - protein, 4 aa, Cryptosporidium parvum
INPC

SEQ ID NO: 2262643 - protein, 9 aa, Cryptosporidium parvum
INPDNSKDF

SEQ ID NO: 2262644 - protein, 10 aa, Cryptosporidium parvum
INPDTTKYRN

SEQ ID NO: 2262645 - protein, 23 aa, Cryptosporidium parvum
INPEGSHNTKKPSECRLTRGKFI

SEQ ID NO: 2262646 - protein, 15 aa, Cryptosporidium parvum
INPGGATITQPNSYN

SEQ ID NO: 2262647 - protein, 9 aa, Cryptosporidium parvum
INPGLNSHA

SEQ ID NO: 2262648 - protein, 6 aa, Cryptosporidium parvum
INPGSS

SEQ ID NO: 2262649 - protein, 22 aa, Cryptosporidium parvum
INPKSNSSHSSSESNSEDEEYL

SEQ ID NO: 2262650 - protein, 7 aa, Cryptosporidium parvum
INPNNEL

SEQ ID NO: 2262651 - protein, 8 aa, Cryptosporidium parvum
INPNNTAG

SEQ ID NO: 2262652 - protein, 52 aa, Cryptosporidium parvum
INPPENNTETVTKVNPDPVIEPEPEPEPEPKPKPENEPKPENELKPENEPKL

SEQ ID NO: 2262653 - protein, 4 aa, Cryptosporidium parvum
INPR

SEQ ID NO: 2262654 - protein, 6 aa, Cryptosporidium parvum
INPRAS

SEQ ID NO: 2262655 - protein, 5 aa, Cryptosporidium parvum
INPRT

SEQ ID NO: 2262656 - protein, 16 aa, Cryptosporidium parvum
INPSDKEKKKTKRQIR

SEQ ID NO: 2262657 - protein, 10 aa, Cryptosporidium parvum
INPSKNRTIP

SEQ ID NO: 2262658 - protein, 10 aa, Cryptosporidium parvum
INPSKWGGSV

SEQ ID NO: 2262659 - protein, 25 aa, Cryptosporidium parvum
INPSNQSNSSLPLNSSSSNKVNKEN

SEQ ID NO: 2262660 - protein, 6 aa, Cryptosporidium parvum
INPSNT

SEQ ID NO: 2262661 - protein, 8 aa, Cryptosporidium parvum
INPSNTRY

SEQ ID NO: 2262662 - protein, 6 aa, Cryptosporidium parvum
INPTEF

SEQ ID NO: 2262663 - protein, 7 aa, Cryptosporidium parvum
INQEDDK

SEQ ID NO: 2262664 - protein, 6 aa, Cryptosporidium parvum
INQEER

SEQ ID NO: 2262665 - protein, 6 aa, Cryptosporidium parvum
INQGKD

SEQ ID NO: 2262666 - protein, 17 aa, Cryptosporidium parvum
INQKNDNEGDQSGSSCN

SEQ ID NO: 2262667 - protein, 18 aa, Cryptosporidium parvum
INQNHSTNTDYSSTKKEN

SEQ ID NO: 2262668 - protein, 38 aa, Cryptosporidium parvum
INQPQGQNFSQNSSKFNNKNSNRQAGNNYHHNSSNNPK

SEQ ID NO: 2262669 - protein, 17 aa, Cryptosporidium parvum
INQPYINSSSNNYSDDK

SEQ ID NO: 2262670 - protein, 12 aa, Cryptosporidium parvum
INQSSDIKETQK

SEQ ID NO: 2262671 - protein, 11 aa, Cryptosporidium parvum
INQSSKRSIPR

SEQ ID NO: 2262672 - protein, 15 aa, Cryptosporidium parvum
INQTPEGSKHSEPNI

SEQ ID NO: 2262673 - protein, 13 aa, Cryptosporidium parvum
INRGGSNFRSSSS

SEQ ID NO: 2262674 - protein, 27 aa, Cryptosporidium parvum
INRNTSNSHHSNSSFYQTSNNGVRYDP

SEQ ID NO: 2262675 - protein, 6 aa, Cryptosporidium parvum
INRRGK

SEQ ID NO: 2262676 - protein, 13 aa, Cryptosporidium parvum
INRSGEIHFIQSS

SEQ ID NO: 2262677 - protein, 12 aa, Cryptosporidium parvum
INRTRKDQNSLD

SEQ ID NO: 2262678 - protein, 9 aa, Cryptosporidium parvum
INSAKDATD

SEQ ID NO: 2262679 - protein, 9 aa, Cryptosporidium parvum
INSASTSPM

SEQ ID NO: 2262680 - protein, 43 aa, Cryptosporidium parvum
INSDSGTIEDEGRNLTPIQNQNQNLSLPQEESFENSSTGPQPI

SEQ ID NO: 2262681 - protein, 42 aa, Cryptosporidium parvum
INSDSYSKKKNNSIKKATEKSPTESLSDDDSDYVGSGSMDEN

SEQ ID NO: 2262682 - protein, 5 aa, Cryptosporidium parvum
INSEN

SEQ ID NO: 2262683 - protein, 11 aa, Cryptosporidium parvum
INSENNDDFND

SEQ ID NO: 2262684 - protein, 7 aa, Cryptosporidium parvum
INSENSL

SEQ ID NO: 2262685 - protein, 11 aa, Cryptosporidium parvum
INSERSQKNGL

SEQ ID NO: 2262686 - protein, 16 aa, Cryptosporidium parvum
INSESLQNGNLNQTDS

SEQ ID NO: 2262687 - protein, 6 aa, Cryptosporidium parvum
INSEWS

SEQ ID NO: 2262688 - protein, 6 aa, Cryptosporidium parvum
INSGSN

SEQ ID NO: 2262689 - protein, 15 aa, Cryptosporidium parvum
INSGSNSNDDEHDDI

SEQ ID NO: 2262690 - protein, 4 aa, Cryptosporidium parvum
INSH

SEQ ID NO: 2262691 - protein, 4 aa, Cryptosporidium parvum
INSK

SEQ ID NO: 2262692 - protein, 10 aa, Cryptosporidium parvum
INSKDTDKSI

SEQ ID NO: 2262693 - protein, 6 aa, Cryptosporidium parvum
INSKSL

SEQ ID NO: 2262694 - protein, 6 aa, Cryptosporidium parvum
INSNDD

SEQ ID NO: 2262695 - protein, 11 aa, Cryptosporidium parvum
INSNGITGIGS

SEQ ID NO: 2262696 - protein, 9 aa, Cryptosporidium parvum
INSNGRRLT

SEQ ID NO: 2262697 - protein, 25 aa, Cryptosporidium parvum
INSNNGENTPSTITSDDAENSPSIL

SEQ ID NO: 2262698 - protein, 9 aa, Cryptosporidium parvum
INSNPKKEL

SEQ ID NO: 2262699 - protein, 15 aa, Cryptosporidium parvum
INSNSSKASDISIES

SEQ ID NO: 2262700 - protein, 20 aa, Cryptosporidium parvum
INSNTEDSEKINSRKLSTLS

SEQ ID NO: 2262701 - protein, 6 aa, Cryptosporidium parvum
INSPKK

SEQ ID NO: 2262702 - protein, 10 aa, Cryptosporidium parvum
INSPSLNSIG

SEQ ID NO: 2262703 - protein, 20 aa, Cryptosporidium parvum
INSQDSDGSSKTKSGGNMNT

SEQ ID NO: 2262704 - protein, 19 aa, Cryptosporidium parvum
INSQEELNNGSKCSSKLSG

SEQ ID NO: 2262705 - protein, 38 aa, Cryptosporidium parvum
INSRGGNVLSGTNTSGFGVGGGQFNPFSGSIGKPLGDM

SEQ ID NO: 2262706 - protein, 45 aa, Cryptosporidium parvum
INSSKQQDNPNQNRDSGTKLKNTNSINTSSISEKKDTSIKPNYPF

SEQ ID NO: 2262707 - protein, 22 aa, Cryptosporidium parvum
INSSNATPKSYFSSRTPRNLPD

SEQ ID NO: 2262708 - protein, 7 aa, Cryptosporidium parvum
INSSPNK

SEQ ID NO: 2262709 - protein, 10 aa, Cryptosporidium parvum
INSSQDLVNS

SEQ ID NO: 2262710 - protein, 8 aa, Cryptosporidium parvum
INSSQKLS

SEQ ID NO: 2262711 - protein, 9 aa, Cryptosporidium parvum
INSSTNKKL

SEQ ID NO: 2262712 - protein, 6 aa, Cryptosporidium parvum
INSTEK

SEQ ID NO: 2262713 - protein, 8 aa, Cryptosporidium parvum
INSTGKTH

SEQ ID NO: 2262714 - protein, 14 aa, Cryptosporidium parvum
INSTSNSKNGNNDL

SEQ ID NO: 2262715 - protein, 9 aa, Cryptosporidium parvum
INSYDSSKI

SEQ ID NO: 2262716 - protein, 19 aa, Cryptosporidium parvum
INTAQGASSVAKGSKSKAN

SEQ ID NO: 2262717 - protein, 8 aa, Cryptosporidium parvum
INTDDQEE

SEQ ID NO: 2262718 - protein, 7 aa, Cryptosporidium parvum
INTDSNY

SEQ ID NO: 2262719 - protein, 16 aa, Cryptosporidium parvum
INTEFEEKEKKHNKKS

SEQ ID NO: 2262720 - protein, 44 aa, Cryptosporidium parvum
INTETTKANKTSENTHSGNNSKVSKFKQKEGKIGQIDNTSMTKS

SEQ ID NO: 2262721 - protein, 23 aa, Cryptosporidium parvum
INTISTTSNSNSSSAVPIESYPG

SEQ ID NO: 2262722 - protein, 12 aa, Cryptosporidium parvum
INTKKDSQKKIN

SEQ ID NO: 2262723 - protein, 9 aa, Cryptosporidium parvum
INTNSEPST

SEQ ID NO: 2262724 - protein, 15 aa, Cryptosporidium parvum
INTNSKGSSEYSPQK

SEQ ID NO: 2262725 - protein, 5 aa, Cryptosporidium parvum
INTPE

SEQ ID NO: 2262726 - protein, 4 aa, Cryptosporidium parvum
INTQ

SEQ ID NO: 2262727 - protein, 4 aa, Cryptosporidium parvum
INTR

SEQ ID NO: 2262728 - protein, 8 aa, Cryptosporidium parvum
INTRSSTQ

SEQ ID NO: 2262729 - protein, 8 aa, Cryptosporidium parvum
INTSDESI

SEQ ID NO: 2262730 - protein, 8 aa, Cryptosporidium parvum
INTSDGGC

SEQ ID NO: 2262731 - protein, 20 aa, Cryptosporidium parvum
INTTGKHSAVGSDHNQGKNN

SEQ ID NO: 2262732 - protein, 9 aa, Cryptosporidium parvum
INTTTGTKD

SEQ ID NO: 2262733 - protein, 13 aa, Cryptosporidium parvum
INVDSNSITDSET

SEQ ID NO: 2262734 - protein, 8 aa, Cryptosporidium parvum
INVPKNSS

SEQ ID NO: 2262735 - protein, 8 aa, Cryptosporidium parvum
INVPNDED

SEQ ID NO: 2262736 - protein, 10 aa, Cryptosporidium parvum
INYSDKQLNR

SEQ ID NO: 2262737 - protein, 13 aa, Cryptosporidium parvum
IPAKPLDKSNRSE

SEQ ID NO: 2262738 - protein, 5 aa, Cryptosporidium parvum
IPANR

SEQ ID NO: 2262739 - protein, 7 aa, Cryptosporidium parvum
IPAPSGI

SEQ ID NO: 2262740 - protein, 14 aa, Cryptosporidium parvum
IPASSKSKKEDPYY

SEQ ID NO: 2262741 - protein, 11 aa, Cryptosporidium parvum
IPASTGAAKAV

SEQ ID NO: 2262742 - protein, 12 aa, Cryptosporidium parvum
IPASTSATAAAA

SEQ ID NO: 2262743 - protein, 6 aa, Cryptosporidium parvum
IPDEDP

SEQ ID NO: 2262744 - protein, 6 aa, Cryptosporidium parvum
IPDGSL

SEQ ID NO: 2262745 - protein, 22 aa, Cryptosporidium parvum
IPDGYDEDEDDDDGQEESGDDI

SEQ ID NO: 2262746 - protein, 9 aa, Cryptosporidium parvum
IPDNSEVSE

SEQ ID NO: 2262747 - protein, 11 aa, Cryptosporidium parvum
IPDPPPKVPRE

SEQ ID NO: 2262748 - protein, 8 aa, Cryptosporidium parvum
IPDPSGKR

SEQ ID NO: 2262749 - protein, 5 aa, Cryptosporidium parvum
IPDQI

SEQ ID NO: 2262750 - protein, 6 aa, Cryptosporidium parvum
IPDSID

SEQ ID NO: 2262751 - protein, 5 aa, Cryptosporidium parvum
IPDSS

SEQ ID NO: 2262752 - protein, 8 aa, Cryptosporidium parvum
IPEDSKTS

SEQ ID NO: 2262753 - protein, 5 aa, Cryptosporidium parvum
IPEEE

SEQ ID NO: 2262754 - protein, 6 aa, Cryptosporidium parvum
IPEEEL

SEQ ID NO: 2262755 - protein, 21 aa, Cryptosporidium parvum
IPEEGGGATSFVDESQKTQKR

SEQ ID NO: 2262756 - protein, 11 aa, Cryptosporidium parvum
IPEEMQSHPSY

SEQ ID NO: 2262757 - protein, 14 aa, Cryptosporidium parvum
IPEESSTSGVAEGG

SEQ ID NO: 2262758 - protein, 20 aa, Cryptosporidium parvum
IPEESTLDESIDSSASTGIA

SEQ ID NO: 2262759 - protein, 14 aa, Cryptosporidium parvum
IPEKSSKKIRSSSD

SEQ ID NO: 2262760 - protein, 4 aa, Cryptosporidium parvum
IPEM

SEQ ID NO: 2262761 - protein, 4 aa, Cryptosporidium parvum
IPEN

SEQ ID NO: 2262762 - protein, 5 aa, Cryptosporidium parvum
IPENK

SEQ ID NO: 2262763 - protein, 16 aa, Cryptosporidium parvum
IPESISKKNTKVTTPV

SEQ ID NO: 2262764 - protein, 6 aa, Cryptosporidium parvum
IPESSF

SEQ ID NO: 2262765 - protein, 12 aa, Cryptosporidium parvum
IPESSKLSKDSI

SEQ ID NO: 2262766 - protein, 8 aa, Cryptosporidium parvum
IPETTSQQ

SEQ ID NO: 2262767 - protein, 8 aa, Cryptosporidium parvum
IPFDSDSS

SEQ ID NO: 2262768 - protein, 8 aa, Cryptosporidium parvum
IPGAPNGG

SEQ ID NO: 2262769 - protein, 6 aa, Cryptosporidium parvum
IPGDNL

SEQ ID NO: 2262770 - protein, 9 aa, Cryptosporidium parvum
IPGDTPESL

SEQ ID NO: 2262771 - protein, 4 aa, Cryptosporidium parvum
IPGG

SEQ ID NO: 2262772 - protein, 6 aa, Cryptosporidium parvum
IPGGNI

SEQ ID NO: 2262773 - protein, 5 aa, Cryptosporidium parvum
IPGMA

SEQ ID NO: 2262774 - protein, 9 aa, Cryptosporidium parvum
IPGNSTGNQ

SEQ ID NO: 2262775 - protein, 9 aa, Cryptosporidium parvum
IPGRDDCSE

SEQ ID NO: 2262776 - protein, 11 aa, Cryptosporidium parvum
IPGRPKDDRSE

SEQ ID NO: 2262777 - protein, 4 aa, Cryptosporidium parvum
IPGS

SEQ ID NO: 2262778 - protein, 9 aa, Cryptosporidium parvum
IPGSEKTTL

SEQ ID NO: 2262779 - protein, 6 aa, Cryptosporidium parvum
IPGSFS

SEQ ID NO: 2262780 - protein, 6 aa, Cryptosporidium parvum
IPGSGK

SEQ ID NO: 2262781 - protein, 8 aa, Cryptosporidium parvum
IPGSPSMS

SEQ ID NO: 2262782 - protein, 6 aa, Cryptosporidium parvum
IPGSSV

SEQ ID NO: 2262783 - protein, 8 aa, Cryptosporidium parvum
IPHPPPGR

SEQ ID NO: 2262784 - protein, 33 aa, Cryptosporidium parvum
IPHSSTAPQQLSPTVSSSISSASTLSTSGIAGN

SEQ ID NO: 2262785 - protein, 5 aa, Cryptosporidium parvum
IPINS

SEQ ID NO: 2262786 - protein, 13 aa, Cryptosporidium parvum
IPIPASASNSLGI

SEQ ID NO: 2262787 - protein, 12 aa, Cryptosporidium parvum
IPIPNSEPFGSP

SEQ ID NO: 2262788 - protein, 5 aa, Cryptosporidium parvum
IPKAG

SEQ ID NO: 2262789 - protein, 13 aa, Cryptosporidium parvum
IPKARKSTKVLGM

SEQ ID NO: 2262790 - protein, 4 aa, Cryptosporidium parvum
IPKE

SEQ ID NO: 2262791 - protein, 13 aa, Cryptosporidium parvum
IPKGSSISEYEEN

SEQ ID NO: 2262792 - protein, 6 aa, Cryptosporidium parvum
IPKINT

SEQ ID NO: 2262793 - protein, 10 aa, Cryptosporidium parvum
IPKKKKVGRF

SEQ ID NO: 2262794 - protein, 18 aa, Cryptosporidium parvum
IPKNTDSMNFQDKDNDDD

SEQ ID NO: 2262795 - protein, 17 aa, Cryptosporidium parvum
IPKTERLDTDVNSPVSY

SEQ ID NO: 2262796 - protein, 8 aa, Cryptosporidium parvum
IPKTNTPS

SEQ ID NO: 2262797 - protein, 7 aa, Cryptosporidium parvum
IPKTTKR

SEQ ID NO: 2262798 - protein, 7 aa, Cryptosporidium parvum
IPKTYTN

SEQ ID NO: 2262799 - protein, 4 aa, Cryptosporidium parvum
IPLP

SEQ ID NO: 2262800 - protein, 4 aa, Cryptosporidium parvum
IPND

SEQ ID NO: 2262801 - protein, 4 aa, Cryptosporidium parvum
IPNE

SEQ ID NO: 2262802 - protein, 6 aa, Cryptosporidium parvum
IPNNLK

SEQ ID NO: 2262803 - protein, 5 aa, Cryptosporidium parvum
IPNNS

SEQ ID NO: 2262804 - protein, 9 aa, Cryptosporidium parvum
IPNPASESL

SEQ ID NO: 2262805 - protein, 13 aa, Cryptosporidium parvum
IPNPIQSASDNVE

SEQ ID NO: 2262806 - protein, 5 aa, Cryptosporidium parvum
IPNQA

SEQ ID NO: 2262807 - protein, 17 aa, Cryptosporidium parvum
IPNQKIQSTNNEDRDLS

SEQ ID NO: 2262808 - protein, 4 aa, Cryptosporidium parvum
IPNS

SEQ ID NO: 2262809 - protein, 13 aa, Cryptosporidium parvum
IPNSGEDSTITKS

SEQ ID NO: 2262810 - protein, 18 aa, Cryptosporidium parvum
IPNSSDDNIEDKEEEERI

SEQ ID NO: 2262811 - protein, 4 aa, Cryptosporidium parvum
IPPA

SEQ ID NO: 2262812 - protein, 9 aa, Cryptosporidium parvum
IPPAPRGVP

SEQ ID NO: 2262813 - protein, 6 aa, Cryptosporidium parvum
IPPDNQ

SEQ ID NO: 2262814 - protein, 14 aa, Cryptosporidium parvum
IPPDSSNPSTNSVH

SEQ ID NO: 2262815 - protein, 4 aa, Cryptosporidium parvum
IPPE

SEQ ID NO: 2262816 - protein, 10 aa, Cryptosporidium parvum
IPPEKKCDEK

SEQ ID NO: 2262817 - protein, 4 aa, Cryptosporidium parvum
IPPG

SEQ ID NO: 2262818 - protein, 11 aa, Cryptosporidium parvum
IPPIPPQSQPP

SEQ ID NO: 2262819 - protein, 9 aa, Cryptosporidium parvum
IPPKDTDSL

SEQ ID NO: 2262820 - protein, 5 aa, Cryptosporidium parvum
IPPKG

SEQ ID NO: 2262821 - protein, 10 aa, Cryptosporidium parvum
IPPKKDASVP

SEQ ID NO: 2262822 - protein, 6 aa, Cryptosporidium parvum
IPPKSL

SEQ ID NO: 2262823 - protein, 6 aa, Cryptosporidium parvum
IPPLSQ

SEQ ID NO: 2262824 - protein, 15 aa, Cryptosporidium parvum
IPPNDGSDRLPTPNE

SEQ ID NO: 2262825 - protein, 70 aa, Cryptosporidium parvum
IPPNSNKRSSLSSQKGSNNTTSKPQVNSRTRKRERRSSTKTEDKENANNLNNLDDKNPIYAEKDEDYSWE

SEQ ID NO: 2262826 - protein, 5 aa, Cryptosporidium parvum
IPPPA

SEQ ID NO: 2262827 - protein, 6 aa, Cryptosporidium parvum
IPPPIP

SEQ ID NO: 2262828 - protein, 17 aa, Cryptosporidium parvum
IPPPPPPPPPKIKQSSS

SEQ ID NO: 2262829 - protein, 6 aa, Cryptosporidium parvum
IPPPSV

SEQ ID NO: 2262830 - protein, 4 aa, Cryptosporidium parvum
IPPQ

SEQ ID NO: 2262831 - protein, 11 aa, Cryptosporidium parvum
IPPSGKQRTLE

SEQ ID NO: 2262832 - protein, 5 aa, Cryptosporidium parvum
IPPSV

SEQ ID NO: 2262833 - protein, 7 aa, Cryptosporidium parvum
IPQDGNS

SEQ ID NO: 2262834 - protein, 8 aa, Cryptosporidium parvum
IPQEPELG

SEQ ID NO: 2262835 - protein, 10 aa, Cryptosporidium parvum
IPQERRQNSV

SEQ ID NO: 2262836 - protein, 5 aa, Cryptosporidium parvum
IPQGA

SEQ ID NO: 2262837 - protein, 7 aa, Cryptosporidium parvum
IPQGSED

SEQ ID NO: 2262838 - protein, 5 aa, Cryptosporidium parvum
IPQHL

SEQ ID NO: 2262839 - protein, 5 aa, Cryptosporidium parvum
IPQNK

SEQ ID NO: 2262840 - protein, 10 aa, Cryptosporidium parvum
IPQSNDKTQA

SEQ ID NO: 2262841 - protein, 5 aa, Cryptosporidium parvum
IPQSP

SEQ ID NO: 2262842 - protein, 9 aa, Cryptosporidium parvum
IPQTERPYK

SEQ ID NO: 2262843 - protein, 7 aa, Cryptosporidium parvum
IPRDSQS

SEQ ID NO: 2262844 - protein, 4 aa, Cryptosporidium parvum
IPRG

SEQ ID NO: 2262845 - protein, 9 aa, Cryptosporidium parvum
IPRNNGSCV

SEQ ID NO: 2262846 - protein, 19 aa, Cryptosporidium parvum
IPRRRSRSPSLEEGQSVEE

SEQ ID NO: 2262847 - protein, 11 aa, Cryptosporidium parvum
IPRSNQRETIG

SEQ ID NO: 2262848 - protein, 5 aa, Cryptosporidium parvum
IPSAV

SEQ ID NO: 2262849 - protein, 5 aa, Cryptosporidium parvum
IPSDH

SEQ ID NO: 2262850 - protein, 58 aa, Cryptosporidium parvum
IPSGNLTATSTSTFTSSTSGGSSVSSSIQSKGLKQQSGNGKNGSNASYAATAASSLTN

SEQ ID NO: 2262851 - protein, 4 aa, Cryptosporidium parvum
IPSH

SEQ ID NO: 2262852 - protein, 9 aa, Cryptosporidium parvum
IPSHQEKEC

SEQ ID NO: 2262853 - protein, 11 aa, Cryptosporidium parvum
IPSKINPSMPP

SEQ ID NO: 2262854 - protein, 25 aa, Cryptosporidium parvum
IPSLPSPNNNNNRISNIPNSNNYYD

SEQ ID NO: 2262855 - protein, 8 aa, Cryptosporidium parvum
IPSNEGRG

SEQ ID NO: 2262856 - protein, 23 aa, Cryptosporidium parvum
IPSNNKEISKNNNQNHHKNTNIG

SEQ ID NO: 2262857 - protein, 16 aa, Cryptosporidium parvum
IPSNNTNDDYSQLNEY

SEQ ID NO: 2262858 - protein, 7 aa, Cryptosporidium parvum
IPSNSKY

SEQ ID NO: 2262859 - protein, 17 aa, Cryptosporidium parvum
IPSNSVKSVSTIPSNGV

SEQ ID NO: 2262860 - protein, 5 aa, Cryptosporidium parvum
IPSNT

SEQ ID NO: 2262861 - protein, 5 aa, Cryptosporidium parvum
IPSNY

SEQ ID NO: 2262862 - protein, 6 aa, Cryptosporidium parvum
IPSQNE

SEQ ID NO: 2262863 - protein, 66 aa, Cryptosporidium parvum
IPSSKDSTKISSVTSSINNNNGLNTGNSQQNECLNSSNSPKLSSISTSGSNQNINNNNPSTGSNPK

SEQ ID NO: 2262864 - protein, 62 aa, Cryptosporidium parvum
IPSSNQSNKKNYSINPNSNGNNNKLGNNISKNSSQIPSYCNSSNNNSISEKLTEVDDEEEHK

SEQ ID NO: 2262865 - protein, 6 aa, Cryptosporidium parvum
IPSSSE

SEQ ID NO: 2262866 - protein, 10 aa, Cryptosporidium parvum
IPSSSQTASM

SEQ ID NO: 2262867 - protein, 9 aa, Cryptosporidium parvum
IPSSSSGRQ

SEQ ID NO: 2262868 - protein, 4 aa, Cryptosporidium parvum
IPST

SEQ ID NO: 2262869 - protein, 8 aa, Cryptosporidium parvum
IPSYGKRH

SEQ ID NO: 2262870 - protein, 32 aa, Cryptosporidium parvum
IPTKDVGSSSQTANQISSAALGSLGGIPGIGT

SEQ ID NO: 2262871 - protein, 10 aa, Cryptosporidium parvum
IPTSSNMSAA

SEQ ID NO: 2262872 - protein, 11 aa, Cryptosporidium parvum
IPTSTTQSTQI

SEQ ID NO: 2262873 - protein, 4 aa, Cryptosporidium parvum
IPTY

SEQ ID NO: 2262874 - protein, 9 aa, Cryptosporidium parvum
IPYEPNTSI

SEQ ID NO: 2262875 - protein, 14 aa, Cryptosporidium parvum
IQAEKFGKSTGRCN

SEQ ID NO: 2262876 - protein, 8 aa, Cryptosporidium parvum
IQANQGSY

SEQ ID NO: 2262877 - protein, 4 aa, Cryptosporidium parvum
IQAS

SEQ ID NO: 2262878 - protein, 8 aa, Cryptosporidium parvum
IQASNSSY

SEQ ID NO: 2262879 - protein, 4 aa, Cryptosporidium parvum
IQDD

SEQ ID NO: 2262880 - protein, 15 aa, Cryptosporidium parvum
IQDENQGSQNNEDHK

SEQ ID NO: 2262881 - protein, 9 aa, Cryptosporidium parvum
IQDGKVDGT

SEQ ID NO: 2262882 - protein, 6 aa, Cryptosporidium parvum
IQDGNN

SEQ ID NO: 2262883 - protein, 12 aa, Cryptosporidium parvum
IQDQGQNRNQNL

SEQ ID NO: 2262884 - protein, 10 aa, Cryptosporidium parvum
IQDSQNSSKL

SEQ ID NO: 2262885 - protein, 8 aa, Cryptosporidium parvum
IQEDGTPT

SEQ ID NO: 2262886 - protein, 20 aa, Cryptosporidium parvum
IQEDGTSMPSIPNNNANFDN

SEQ ID NO: 2262887 - protein, 12 aa, Cryptosporidium parvum
IQEDNEKNKSGF

SEQ ID NO: 2262888 - protein, 5 aa, Cryptosporidium parvum
IQEEN

SEQ ID NO: 2262889 - protein, 6 aa, Cryptosporidium parvum
IQEGGH

SEQ ID NO: 2262890 - protein, 4 aa, Cryptosporidium parvum
IQEK

SEQ ID NO: 2262891 - protein, 8 aa, Cryptosporidium parvum
IQEKAENE

SEQ ID NO: 2262892 - protein, 4 aa, Cryptosporidium parvum
IQEL

SEQ ID NO: 2262893 - protein, 8 aa, Cryptosporidium parvum
IQENSSFR

SEQ ID NO: 2262894 - protein, 23 aa, Cryptosporidium parvum
IQEPKVKEKLSQSEIDEAEKKIK

SEQ ID NO: 2262895 - protein, 7 aa, Cryptosporidium parvum
IQEPSKV

SEQ ID NO: 2262896 - protein, 9 aa, Cryptosporidium parvum
IQEQDEAKD

SEQ ID NO: 2262897 - protein, 6 aa, Cryptosporidium parvum
IQEQSE

SEQ ID NO: 2262898 - protein, 34 aa, Cryptosporidium parvum
IQERPSNTNLDTTKTTVKENSNAQEKIKSENEHD

SEQ ID NO: 2262899 - protein, 16 aa, Cryptosporidium parvum
IQESPGSVPAGRVPRS

SEQ ID NO: 2262900 - protein, 10 aa, Cryptosporidium parvum
IQESSREIYQ

SEQ ID NO: 2262901 - protein, 8 aa, Cryptosporidium parvum
IQESTDEN

SEQ ID NO: 2262902 - protein, 4 aa, Cryptosporidium parvum
IQGD

SEQ ID NO: 2262903 - protein, 8 aa, Cryptosporidium parvum
IQGDSKSM

SEQ ID NO: 2262904 - protein, 12 aa, Cryptosporidium parvum
IQGGGGKSSLVK

SEQ ID NO: 2262905 - protein, 9 aa, Cryptosporidium parvum
IQGHNPAKT

SEQ ID NO: 2262906 - protein, 5 aa, Cryptosporidium parvum
IQGTA

SEQ ID NO: 2262907 - protein, 4 aa, Cryptosporidium parvum
IQGV

SEQ ID NO: 2262908 - protein, 23 aa, Cryptosporidium parvum
IQISNKEAKDLDNSERHDTKNEI

SEQ ID NO: 2262909 - protein, 15 aa, Cryptosporidium parvum
IQKDENDENQMGNST

SEQ ID NO: 2262910 - protein, 4 aa, Cryptosporidium parvum
IQKE

SEQ ID NO: 2262911 - protein, 13 aa, Cryptosporidium parvum
IQKEKTAKRIEKK

SEQ ID NO: 2262912 - protein, 10 aa, Cryptosporidium parvum
IQKESGNEKL

SEQ ID NO: 2262913 - protein, 7 aa, Cryptosporidium parvum
IQKGGKK

SEQ ID NO: 2262914 - protein, 4 aa, Cryptosporidium parvum
IQKK

SEQ ID NO: 2262915 - protein, 7 aa, Cryptosporidium parvum
IQKKGQA

SEQ ID NO: 2262916 - protein, 6 aa, Cryptosporidium parvum
IQKKHN

SEQ ID NO: 2262917 - protein, 9 aa, Cryptosporidium parvum
IQKQDEKEK

SEQ ID NO: 2262918 - protein, 4 aa, Cryptosporidium parvum
IQKS

SEQ ID NO: 2262919 - protein, 9 aa, Cryptosporidium parvum
IQKSNGKDS

SEQ ID NO: 2262920 - protein, 8 aa, Cryptosporidium parvum
IQNDDDKL

SEQ ID NO: 2262921 - protein, 6 aa, Cryptosporidium parvum
IQNEET

SEQ ID NO: 2262922 - protein, 31 aa, Cryptosporidium parvum
IQNENQSKRPIDSKKEKNESGCSTKINPQQC

SEQ ID NO: 2262923 - protein, 24 aa, Cryptosporidium parvum
IQNGGRAPHHPPPSYHKKHEEHEP

SEQ ID NO: 2262924 - protein, 9 aa, Cryptosporidium parvum
IQNGNATEE

SEQ ID NO: 2262925 - protein, 5 aa, Cryptosporidium parvum
IQNND

SEQ ID NO: 2262926 - protein, 9 aa, Cryptosporidium parvum
IQNNEQNIN

SEQ ID NO: 2262927 - protein, 5 aa, Cryptosporidium parvum
IQNNN

SEQ ID NO: 2262928 - protein, 6 aa, Cryptosporidium parvum
IQNNPA

SEQ ID NO: 2262929 - protein, 9 aa, Cryptosporidium parvum
IQNNPNSMK

SEQ ID NO: 2262930 - protein, 21 aa, Cryptosporidium parvum
IQNPKDTLGEKMEEASTSQNQ

SEQ ID NO: 2262931 - protein, 37 aa, Cryptosporidium parvum; identical to SEQ ID NO: 2145993

SEQ ID NO: 2262932 - protein, 17 aa, Cryptosporidium parvum
IQNQDNSNKLKESEEEI

SEQ ID NO: 2262933 - protein, 10 aa, Cryptosporidium parvum
IQNQNTTETF

SEQ ID NO: 2262934 - protein, 31 aa, Cryptosporidium parvum
IQNQVSSNDIPKKECKKKLKATKLKNSTELN

SEQ ID NO: 2262935 - protein, 5 aa, Cryptosporidium parvum
IQNSK

SEQ ID NO: 2262936 - protein, 12 aa, Cryptosporidium parvum
IQNSKNDKCSPF

SEQ ID NO: 2262937 - protein, 11 aa, Cryptosporidium parvum
IQNTDRANGSL

SEQ ID NO: 2262938 - protein, 8 aa, Cryptosporidium parvum
IQNTENLT

SEQ ID NO: 2262939 - protein, 8 aa, Cryptosporidium parvum
IQNTSNKL

SEQ ID NO: 2262940 - protein, 13 aa, Cryptosporidium parvum
IQNYQNSNKNRQI

SEQ ID NO: 2262941 - protein, 14 aa, Cryptosporidium parvum
IQPAGMTAASGSQC

SEQ ID NO: 2262942 - protein, 6 aa, Cryptosporidium parvum
IQPEET

SEQ ID NO: 2262943 - protein, 6 aa, Cryptosporidium parvum
IQPETG

SEQ ID NO: 2262944 - protein, 24 aa, Cryptosporidium parvum
IQPNNNTEESKADDSNQDDSAEIS

SEQ ID NO: 2262945 - protein, 5 aa, Cryptosporidium parvum
IQPNS

SEQ ID NO: 2262946 - protein, 5 aa, Cryptosporidium parvum
IQPNT

SEQ ID NO: 2262947 - protein, 6 aa, Cryptosporidium parvum
IQPQNY

SEQ ID NO: 2262948 - protein, 11 aa, Cryptosporidium parvum
IQQEEDMNPEL

SEQ ID NO: 2262949 - protein, 7 aa, Cryptosporidium parvum
IQQGSSK

SEQ ID NO: 2262950 - protein, 6 aa, Cryptosporidium parvum
IQQNQR

SEQ ID NO: 2262951 - protein, 6 aa, Cryptosporidium parvum
IQQNRG

SEQ ID NO: 2262952 - protein, 7 aa, Cryptosporidium parvum
IQQPSEI

SEQ ID NO: 2262953 - protein, 5 aa, Cryptosporidium parvum
IQRGE

SEQ ID NO: 2262954 - protein, 10 aa, Cryptosporidium parvum
IQRNGNTSEQ

SEQ ID NO: 2262955 - protein, 20 aa, Cryptosporidium parvum
IQSDETKDKGFKKIDTSSLA

SEQ ID NO: 2262956 - protein, 19 aa, Cryptosporidium parvum
IQSELDSSKQINGNNLSEN

SEQ ID NO: 2262957 - protein, 16 aa, Cryptosporidium parvum
IQSETTHGTGIATHSQ

SEQ ID NO: 2262958 - protein, 10 aa, Cryptosporidium parvum
IQSGCSEGDG

SEQ ID NO: 2262959 - protein, 12 aa, Cryptosporidium parvum
IQSIDGQNINSV

SEQ ID NO: 2262960 - protein, 11 aa, Cryptosporidium parvum
IQSKSSKSNSC

SEQ ID NO: 2262961 - protein, 12 aa, Cryptosporidium parvum
IQSLPQDDRIPK

SEQ ID NO: 2262962 - protein, 6 aa, Cryptosporidium parvum
IQSNYN

SEQ ID NO: 2262963 - protein, 19 aa, Cryptosporidium parvum
IQSPEDYTRNPLYGQSQQL

SEQ ID NO: 2262964 - protein, 5 aa, Cryptosporidium parvum
IQSRG

SEQ ID NO: 2262965 - protein, 7 aa, Cryptosporidium parvum
IQSRSNS

SEQ ID NO: 2262966 - protein, 5 aa, Cryptosporidium parvum
IQSSD

SEQ ID NO: 2262967 - protein, 6 aa, Cryptosporidium parvum
IQSSGL

SEQ ID NO: 2262968 - protein, 5 aa, Cryptosporidium parvum
IQSSN

SEQ ID NO: 2262969 - protein, 11 aa, Cryptosporidium parvum
IQSSSKKRMGG

SEQ ID NO: 2262970 - protein, 7 aa, Cryptosporidium parvum
IQSSVEG

SEQ ID NO: 2262971 - protein, 4 aa, Cryptosporidium parvum
IQSV

SEQ ID NO: 2262972 - protein, 5 aa, Cryptosporidium parvum
IQTEH

SEQ ID NO: 2262973 - protein, 16 aa, Cryptosporidium parvum
IQTKEGYNSLKTEKDE

SEQ ID NO: 2262974 - protein, 5 aa, Cryptosporidium parvum
IQTNQ

SEQ ID NO: 2262975 - protein, 12 aa, Cryptosporidium parvum
IQTNRNPENPHS

SEQ ID NO: 2262976 - protein, 10 aa, Cryptosporidium parvum
IQTPKDSTRP

SEQ ID NO: 2262977 - protein, 15 aa, Cryptosporidium parvum
IQTSEDNSITGGSIG

SEQ ID NO: 2262978 - protein, 11 aa, Cryptosporidium parvum
IQTSGDIHQTS

SEQ ID NO: 2262979 - protein, 14 aa, Cryptosporidium parvum
IQTSSNDSELKNTF

SEQ ID NO: 2262980 - protein, 9 aa, Cryptosporidium parvum
IRCGNKSGN

SEQ ID NO: 2262981 - protein, 14 aa, Cryptosporidium parvum
IRDEEEKKRKLNPH

SEQ ID NO: 2262982 - protein, 8 aa, Cryptosporidium parvum
IRDENDLQ

SEQ ID NO: 2262983 - protein, 4 aa, Cryptosporidium parvum
IRDG

SEQ ID NO: 2262984 - protein, 13 aa, Cryptosporidium parvum
IRDGRTPSRRAPS

SEQ ID NO: 2262985 - protein, 8 aa, Cryptosporidium parvum
IREASSDQ

SEQ ID NO: 2262986 - protein, 10 aa, Cryptosporidium parvum
IREEEEKGMR

SEQ ID NO: 2262987 - protein, 8 aa, Cryptosporidium parvum
IRENSETK

SEQ ID NO: 2262988 - protein, 14 aa, Cryptosporidium parvum
IRENSQSKSSMGNS

SEQ ID NO: 2262989 - protein, 8 aa, Cryptosporidium parvum
IRESSTYS

SEQ ID NO: 2262990 - protein, 4 aa, Cryptosporidium parvum
IRGE

SEQ ID NO: 2262991 - protein, 7 aa, Cryptosporidium parvum
IRGEASI

SEQ ID NO: 2262992 - protein, 8 aa, Cryptosporidium parvum
IRGKKSWR

SEQ ID NO: 2262993 - protein, 6 aa, Cryptosporidium parvum
IRGKYD

SEQ ID NO: 2262994 - protein, 4 aa, Cryptosporidium parvum
IRGP

SEQ ID NO: 2262995 - protein, 8 aa, Cryptosporidium parvum
IRGSSKPS

SEQ ID NO: 2262996 - protein, 10 aa, Cryptosporidium parvum
IRGTEKSRNI

SEQ ID NO: 2262997 - protein, 17 aa, Cryptosporidium parvum
IRGTGSYIRGTNGRSNG

SEQ ID NO: 2262998 - protein, 16 aa, Cryptosporidium parvum
IRKERNKKLKEFNNDG

SEQ ID NO: 2262999 - protein, 13 aa, Cryptosporidium parvum
IRKFSSSKTKEGK

SEQ ID NO: 2263000 - protein, 4 aa, Cryptosporidium parvum
IRKG

SEQ ID NO: 2263001 - protein, 14 aa, Cryptosporidium parvum
IRKNRGDSNTPAVE

SEQ ID NO: 2263002 - protein, 4 aa, Cryptosporidium parvum
IRKT

SEQ ID NO: 2263003 - protein, 6 aa, Cryptosporidium parvum
IRNAAA

SEQ ID NO: 2263004 - protein, 7 aa, Cryptosporidium parvum
IRNATTK

SEQ ID NO: 2263005 - protein, 4 aa, Cryptosporidium parvum
IRNG

SEQ ID NO: 2263006 - protein, 6 aa, Cryptosporidium parvum
IRNGKK

SEQ ID NO: 2263007 - protein, 9 aa, Cryptosporidium parvum
IRNKPPTKA

SEQ ID NO: 2263008 - protein, 10 aa, Cryptosporidium parvum
IRNRSNKAIK

SEQ ID NO: 2263009 - protein, 4 aa, Cryptosporidium parvum
IRNS

SEQ ID NO: 2263010 - protein, 10 aa, Cryptosporidium parvum
IRNSTNYYGT

SEQ ID NO: 2263011 - protein, 5 aa, Cryptosporidium parvum
IRPDR

SEQ ID NO: 2263012 - protein, 21 aa, Cryptosporidium parvum
IRPPGMNGKSTGVYSTRTPHR

SEQ ID NO: 2263013 - protein, 6 aa, Cryptosporidium parvum
IRPSSK

SEQ ID NO: 2263014 - protein, 4 aa, Cryptosporidium parvum
IRQG

SEQ ID NO: 2263015 - protein, 7 aa, Cryptosporidium parvum
IRQKDGD

SEQ ID NO: 2263016 - protein, 5 aa, Cryptosporidium parvum
IRQNP

SEQ ID NO: 2263017 - protein, 6 aa, Cryptosporidium parvum
IRQNPK

SEQ ID NO: 2263018 - protein, 13 aa, Cryptosporidium parvum
IRRQNSRKSINEK

SEQ ID NO: 2263019 - protein, 17 aa, Cryptosporidium parvum
IRRTKNDSLYRETTSAF

SEQ ID NO: 2263020 - protein, 5 aa, Cryptosporidium parvum
IRSCS

SEQ ID NO: 2263021 - protein, 9 aa, Cryptosporidium parvum
IRSDTKNKH

SEQ ID NO: 2263022 - protein, 8 aa, Cryptosporidium parvum
IRSENLSK

SEQ ID NO: 2263023 - protein, 13 aa, Cryptosporidium parvum
IRSETQNPNGSIS

SEQ ID NO: 2263024 - protein, 5 aa, Cryptosporidium parvum
IRSGS

SEQ ID NO: 2263025 - protein, 10 aa, Cryptosporidium parvum
IRSNNSSNSV

SEQ ID NO: 2263026 - protein, 8 aa, Cryptosporidium parvum
IRSNPSSA

SEQ ID NO: 2263027 - protein, 46 aa, Cryptosporidium parvum
IRSNQGGSNCSSVNSSYGYSGNNSSSGNQGSNNEQWRNRKGPVNHS

SEQ ID NO: 2263028 - protein, 12 aa, Cryptosporidium parvum
IRSNTPTQSQSN

SEQ ID NO: 2263029 - protein, 8 aa, Cryptosporidium parvum
IRSPIEAR

SEQ ID NO: 2263030 - protein, 15 aa, Cryptosporidium parvum
IRSPKNEEIVNTTNK

SEQ ID NO: 2263031 - protein, 5 aa, Cryptosporidium parvum
IRSPQ

SEQ ID NO: 2263032 - protein, 11 aa, Cryptosporidium parvum
IRSPVNRKKSN

SEQ ID NO: 2263033 - protein, 7 aa, Cryptosporidium parvum
IRSPYEE

SEQ ID NO: 2263034 - protein, 5 aa, Cryptosporidium parvum
IRSSE

SEQ ID NO: 2263035 - protein, 10 aa, Cryptosporidium parvum
IRSSKNVGYH

SEQ ID NO: 2263036 - protein, 7 aa, Cryptosporidium parvum
IRTNSGS

SEQ ID NO: 2263037 - protein, 11 aa, Cryptosporidium parvum
IRTSPRKRRPS

SEQ ID NO: 2263038 - protein, 7 aa, Cryptosporidium parvum
IRTSTDD

SEQ ID NO: 2263039 - protein, 8 aa, Cryptosporidium parvum
IRVNDEGS

SEQ ID NO: 2263040 - protein, 5 aa, Cryptosporidium parvum
IRVSP

SEQ ID NO: 2263041 - protein, 6 aa, Cryptosporidium parvum
IRYSGD

SEQ ID NO: 2263042 - protein, 10 aa, Cryptosporidium parvum
ISAEAELESE

SEQ ID NO: 2263043 - protein, 10 aa, Cryptosporidium parvum
ISAEHQESEI

SEQ ID NO: 2263044 - protein, 7 aa, Cryptosporidium parvum
ISAGEKA

SEQ ID NO: 2263045 - protein, 5 aa, Cryptosporidium parvum
ISAGP

SEQ ID NO: 2263046 - protein, 11 aa, Cryptosporidium parvum
ISAGTATTPDF

SEQ ID NO: 2263047 - protein, 8 aa, Cryptosporidium parvum
ISASNHDQ

SEQ ID NO: 2263048 - protein, 12 aa, Cryptosporidium parvum
ISATKEDVENGM

SEQ ID NO: 2263049 - protein, 12 aa, Cryptosporidium parvum
ISCTGNGAFTGE

SEQ ID NO: 2263050 - protein, 6 aa, Cryptosporidium parvum
ISDASN

SEQ ID NO: 2263051 - protein, 11 aa, Cryptosporidium parvum
ISDDGSGIDKN

SEQ ID NO: 2263052 - protein, 6 aa, Cryptosporidium parvum
ISDDNQ

SEQ ID NO: 2263053 - protein, 7 aa, Cryptosporidium parvum
ISDDSGG

SEQ ID NO: 2263054 - protein, 7 aa, Cryptosporidium parvum
ISDEKAR

SEQ ID NO: 2263055 - protein, 9 aa, Cryptosporidium parvum
ISDEKKKGI

SEQ ID NO: 2263056 - protein, 6 aa, Cryptosporidium parvum
ISDELK

SEQ ID NO: 2263057 - protein, 9 aa, Cryptosporidium parvum
ISDENLDSL

SEQ ID NO: 2263058 - protein, 20 aa, Cryptosporidium parvum
ISDERIRQTPEGNSTSPANL

SEQ ID NO: 2263059 - protein, 5 aa, Cryptosporidium parvum
ISDES

SEQ ID NO: 2263060 - protein, 6 aa, Cryptosporidium parvum
ISDETS

SEQ ID NO: 2263061 - protein, 5 aa, Cryptosporidium parvum
ISDGG

SEQ ID NO: 2263062 - protein, 4 aa, Cryptosporidium parvum
ISDI

SEQ ID NO: 2263063 - protein, 25 aa, Cryptosporidium parvum
ISDKPGSVLSSEELKPVNNGNGKVY

SEQ ID NO: 2263064 - protein, 4 aa, Cryptosporidium parvum
ISDL

SEQ ID NO: 2263065 - protein, 5 aa, Cryptosporidium parvum
ISDNN

SEQ ID NO: 2263066 - protein, 18 aa, Cryptosporidium parvum
ISDPKPSSNTASNHSSSL

SEQ ID NO: 2263067 - protein, 9 aa, Cryptosporidium parvum
ISDPPSSNL

SEQ ID NO: 2263068 - protein, 15 aa, Cryptosporidium parvum
ISDRRNEDKQDEESR

SEQ ID NO: 2263069 - protein, 10 aa, Cryptosporidium parvum
ISDSEDNISI

SEQ ID NO: 2263070 - protein, 9 aa, Cryptosporidium parvum
ISDSEDNNV

SEQ ID NO: 2263071 - protein, 12 aa, Cryptosporidium parvum
ISDSEDSELDQD

SEQ ID NO: 2263072 - protein, 5 aa, Cryptosporidium parvum
ISDSS

SEQ ID NO: 2263073 - protein, 7 aa, Cryptosporidium parvum
ISDTETH

SEQ ID NO: 2263074 - protein, 6 aa, Cryptosporidium parvum
ISDYQN

SEQ ID NO: 2263075 - protein, 10 aa, Cryptosporidium parvum
ISEAQGDLGP

SEQ ID NO: 2263076 - protein, 4 aa, Cryptosporidium parvum
ISED

SEQ ID NO: 2263077 - protein, 9 aa, Cryptosporidium parvum
ISEDGSTNC

SEQ ID NO: 2263078 - protein, 5 aa, Cryptosporidium parvum
ISEDT

SEQ ID NO: 2263079 - protein, 9 aa, Cryptosporidium parvum
ISEEKGAKI

SEQ ID NO: 2263080 - protein, 19 aa, Cryptosporidium parvum
ISEENLSKTTIRENSSNNK

SEQ ID NO: 2263081 - protein, 4 aa, Cryptosporidium parvum
ISEG

SEQ ID NO: 2263082 - protein, 6 aa, Cryptosporidium parvum
ISEGDG

SEQ ID NO: 2263083 - protein, 7 aa, Cryptosporidium parvum
ISEGETH

SEQ ID NO: 2263084 - protein, 8 aa, Cryptosporidium parvum
ISEGTNVT

SEQ ID NO: 2263085 - protein, 10 aa, Cryptosporidium parvum
ISEKGKEKDI

SEQ ID NO: 2263086 - protein, 11 aa, Cryptosporidium parvum
ISENDQGDYKN

SEQ ID NO: 2263087 - protein, 6 aa, Cryptosporidium parvum
ISENKN

SEQ ID NO: 2263088 - protein, 10 aa, Cryptosporidium parvum
ISENKNDQEF

SEQ ID NO: 2263089 - protein, 10 aa, Cryptosporidium parvum
ISENNKINSL

SEQ ID NO: 2263090 - protein, 37 aa, Cryptosporidium parvum
ISENPKPSNSKRSKRKSSTNSCDSNSTMEETKNDRNI

SEQ ID NO: 2263091 - protein, 7 aa, Cryptosporidium parvum
ISENQQE

SEQ ID NO: 2263092 - protein, 20 aa, Cryptosporidium parvum
ISENTQKKISNYTSKIDNQQ

SEQ ID NO: 2263093 - protein, 15 aa, Cryptosporidium parvum
ISENTSGIGGAGVTG

SEQ ID NO: 2263094 - protein, 8 aa, Cryptosporidium parvum
ISENTSKN

SEQ ID NO: 2263095 - protein, 10 aa, Cryptosporidium parvum
ISEPEYSPSN

SEQ ID NO: 2263096 - protein, 11 aa, Cryptosporidium parvum
ISEQKCDKIKS

SEQ ID NO: 2263097 - protein, 18 aa, Cryptosporidium parvum
ISEQNSTSNSFSNNSSSN

SEQ ID NO: 2263098 - protein, 8 aa, Cryptosporidium parvum
ISERELER

SEQ ID NO: 2263099 - protein, 7 aa, Cryptosporidium parvum
ISESEPA

SEQ ID NO: 2263100 - protein, 16 aa, Cryptosporidium parvum
ISESGHDIDGETLTSN

SEQ ID NO: 2263101 - protein, 8 aa, Cryptosporidium parvum
ISESGTAF

SEQ ID NO: 2263102 - protein, 11 aa, Cryptosporidium parvum
ISESLNNSKTV

SEQ ID NO: 2263103 - protein, 7 aa, Cryptosporidium parvum
ISESNNY

SEQ ID NO: 2263104 - protein, 8 aa, Cryptosporidium parvum
ISESTNLN

SEQ ID NO: 2263105 - protein, 22 aa, Cryptosporidium parvum
ISETDNNLNYNDEVSSSKNNLN

SEQ ID NO: 2263106 - protein, 5 aa, Cryptosporidium parvum
ISETP

SEQ ID NO: 2263107 - protein, 31 aa, Cryptosporidium parvum
ISETYNSNDNWNNESHNGDKNIESHNKPSFA

SEQ ID NO: 2263108 - protein, 10 aa, Cryptosporidium parvum
ISFGSEGSVN

SEQ ID NO: 2263109 - protein, 9 aa, Cryptosporidium parvum
ISGDPEQIP

SEQ ID NO: 2263110 - protein, 7 aa, Cryptosporidium parvum
ISGEEDI

SEQ ID NO: 2263111 - protein, 9 aa, Cryptosporidium parvum
ISGEKNKAN

SEQ ID NO: 2263112 - protein, 9 aa, Cryptosporidium parvum
ISGEKSSEI

SEQ ID NO: 2263113 - protein, 13 aa, Cryptosporidium parvum
ISGELPPSSKSGQ

SEQ ID NO: 2263114 - protein, 11 aa, Cryptosporidium parvum
ISGGSSNNLKS

SEQ ID NO: 2263115 - protein, 9 aa, Cryptosporidium parvum
ISGKAINQE

SEQ ID NO: 2263116 - protein, 34 aa, Cryptosporidium parvum
ISGKTYKALPSKTLDSIKDSDKVGKEKTATTATG

SEQ ID NO: 2263117 - protein, 4 aa, Cryptosporidium parvum
ISGM

SEQ ID NO: 2263118 - protein, 21 aa, Cryptosporidium parvum
ISGNDNNGVNTEGSNNHTIPG

SEQ ID NO: 2263119 - protein, 18 aa, Cryptosporidium parvum
ISGNTNNCTSSSSSESNS

SEQ ID NO: 2263120 - protein, 37 aa, Cryptosporidium parvum
ISGPTNSGANNNNNNNVGATNSSSSSSGLSGTPSAIG

SEQ ID NO: 2263121 - protein, 6 aa, Cryptosporidium parvum
ISGQNF

SEQ ID NO: 2263122 - protein, 17 aa, Cryptosporidium parvum
ISGRDGKTKYAIENSTR

SEQ ID NO: 2263123 - protein, 10 aa, Cryptosporidium parvum
ISGRSKGDLT

SEQ ID NO: 2263124 - protein, 4 aa, Cryptosporidium parvum
ISGS

SEQ ID NO: 2263125 - protein, 9 aa, Cryptosporidium parvum
ISGSLSKNI

SEQ ID NO: 2263126 - protein, 9 aa, Cryptosporidium parvum
ISGSNVRGR

SEQ ID NO: 2263127 - protein, 7 aa, Cryptosporidium parvum
ISGSTES

SEQ ID NO: 2263128 - protein, 5 aa, Cryptosporidium parvum
ISGTL

SEQ ID NO: 2263129 - protein, 6 aa, Cryptosporidium parvum
ISGTSG

SEQ ID NO: 2263130 - protein, 8 aa, Cryptosporidium parvum
ISGTTSDG

SEQ ID NO: 2263131 - protein, 5 aa, Cryptosporidium parvum
ISHEE

SEQ ID NO: 2263132 - protein, 6 aa, Cryptosporidium parvum
ISHSDS

SEQ ID NO: 2263133 - protein, 26 aa, Cryptosporidium parvum
ISIEKEKKSKGKKRKVSSDSTKSNYY

SEQ ID NO: 2263134 - protein, 6 aa, Cryptosporidium parvum
ISIPKQ

SEQ ID NO: 2263135 - protein, 33 aa, Cryptosporidium parvum
ISISNTGNALGGIEEGTNESNPNLSNSTKNFPG

SEQ ID NO: 2263136 - protein, 24 aa, Cryptosporidium parvum
ISITDKQNSSEVNNNNNNNCNDSD

SEQ ID NO: 2263137 - protein, 19 aa, Cryptosporidium parvum
ISKASAKQRMGRAGRTREG

SEQ ID NO: 2263138 - protein, 7 aa, Cryptosporidium parvum
ISKATSL

SEQ ID NO: 2263139 - protein, 12 aa, Cryptosporidium parvum
ISKDARPSRFPP

SEQ ID NO: 2263140 - protein, 7 aa, Cryptosporidium parvum
ISKDPRA

SEQ ID NO: 2263141 - protein, 12 aa, Cryptosporidium parvum
ISKDREKEHEND

SEQ ID NO: 2263142 - protein, 28 aa, Cryptosporidium parvum
ISKDSKASSLPSSSTGASSTATTINGES

SEQ ID NO: 2263143 - protein, 13 aa, Cryptosporidium parvum
ISKGGFSDRPGNV

SEQ ID NO: 2263144 - protein, 7 aa, Cryptosporidium parvum
ISKGHQL

SEQ ID NO: 2263145 - protein, 16 aa, Cryptosporidium parvum
ISKGNPEFSSSHQQDT

SEQ ID NO: 2263146 - protein, 4 aa, Cryptosporidium parvum
ISKI

SEQ ID NO: 2263147 - protein, 6 aa, Cryptosporidium parvum
ISKKNK

SEQ ID NO: 2263148 - protein, 8 aa, Cryptosporidium parvum
ISKKPTIG

SEQ ID NO: 2263149 - protein, 10 aa, Cryptosporidium parvum
ISKNGNYDQS

SEQ ID NO: 2263150 - protein, 21 aa, Cryptosporidium parvum
ISKNNKDLNSEFQELVKLVTN

SEQ ID NO: 2263151 - protein, 9 aa, Cryptosporidium parvum
ISKNSETYN

SEQ ID NO: 2263152 - protein, 16 aa, Cryptosporidium parvum
ISKNSRETSTNSPSNV

SEQ ID NO: 2263153 - protein, 8 aa, Cryptosporidium parvum
ISKPADKK

SEQ ID NO: 2263154 - protein, 11 aa, Cryptosporidium parvum
ISKPKTNASLG

SEQ ID NO: 2263155 - protein, 6 aa, Cryptosporidium parvum
ISKPNT

SEQ ID NO: 2263156 - protein, 6 aa, Cryptosporidium parvum
ISKPTL

SEQ ID NO: 2263157 - protein, 24 aa, Cryptosporidium parvum
ISKRSSKSCANIKNEELDSDFSDN

SEQ ID NO: 2263158 - protein, 16 aa, Cryptosporidium parvum
ISKSESENNNCENMKS

SEQ ID NO: 2263159 - protein, 10 aa, Cryptosporidium parvum
ISKSKDEIGT

SEQ ID NO: 2263160 - protein, 11 aa, Cryptosporidium parvum
ISKSKIDAGYD

SEQ ID NO: 2263161 - protein, 11 aa, Cryptosporidium parvum
ISKSKNSSIDK

SEQ ID NO: 2263162 - protein, 39 aa, Cryptosporidium parvum; identical to SEQ ID NO: 2146176

SEQ ID NO: 2263163 - protein, 9 aa, Cryptosporidium parvum
ISKSQKNNI

SEQ ID NO: 2263164 - protein, 16 aa, Cryptosporidium parvum
ISKSQSSNSRKSLNNF

SEQ ID NO: 2263165 - protein, 12 aa, Cryptosporidium parvum
ISKSSLRYSIMI

SEQ ID NO: 2263166 - protein, 4 aa, Cryptosporidium parvum
ISKT

SEQ ID NO: 2263167 - protein, 7 aa, Cryptosporidium parvum
ISKTTGQ

SEQ ID NO: 2263168 - protein, 10 aa, Cryptosporidium parvum
ISLSGDGKCR

SEQ ID NO: 2263169 - protein, 22 aa, Cryptosporidium parvum
ISMDSSSNKGYNTKKWSPEGFG

SEQ ID NO: 2263170 - protein, 9 aa, Cryptosporidium parvum
ISNASSDPF

SEQ ID NO: 2263171 - protein, 20 aa, Cryptosporidium parvum
ISNDIPKQIKKDRSKSNSYI

SEQ ID NO: 2263172 - protein, 11 aa, Cryptosporidium parvum
ISNDKSKVEDI

SEQ ID NO: 2263173 - protein, 12 aa, Cryptosporidium parvum
ISNDQHNFPSET

SEQ ID NO: 2263174 - protein, 9 aa, Cryptosporidium parvum
ISNDTENKM

SEQ ID NO: 2263175 - protein, 13 aa, Cryptosporidium parvum
ISNEIGEKSPQTF

SEQ ID NO: 2263176 - protein, 10 aa, Cryptosporidium parvum
ISNESETSCI

SEQ ID NO: 2263177 - protein, 12 aa, Cryptosporidium parvum
ISNESKSNSMNK

SEQ ID NO: 2263178 - protein, 12 aa, Cryptosporidium parvum
ISNGDNKLEGRN

SEQ ID NO: 2263179 - protein, 10 aa, Cryptosporidium parvum
ISNGNTKNEY

SEQ ID NO: 2263180 - protein, 14 aa, Cryptosporidium parvum
ISNGSETVKTGGTY

SEQ ID NO: 2263181 - protein, 7 aa, Cryptosporidium parvum
ISNISNN

SEQ ID NO: 2263182 - protein, 8 aa, Cryptosporidium parvum
ISNKSNGS

SEQ ID NO: 2263183 - protein, 13 aa, Cryptosporidium parvum
ISNKTRKARENDI

SEQ ID NO: 2263184 - protein, 18 aa, Cryptosporidium parvum
ISNNNINDNNNKNTTSSS

SEQ ID NO: 2263185 - protein, 10 aa, Cryptosporidium parvum
ISNNSLKSVP

SEQ ID NO: 2263186 - protein, 12 aa, Cryptosporidium parvum
ISNPEDSNSNKI

SEQ ID NO: 2263187 - protein, 5 aa, Cryptosporidium parvum
ISNSE

SEQ ID NO: 2263188 - protein, 8 aa, Cryptosporidium parvum
ISNSGREH

SEQ ID NO: 2263189 - protein, 10 aa, Cryptosporidium parvum
ISNSNNIENL

SEQ ID NO: 2263190 - protein, 13 aa, Cryptosporidium parvum
ISNSNTGKMNISN

SEQ ID NO: 2263191 - protein, 7 aa, Cryptosporidium parvum
ISNSPYK

SEQ ID NO: 2263192 - protein, 9 aa, Cryptosporidium parvum
ISNSSNNDH

SEQ ID NO: 2263193 - protein, 11 aa, Cryptosporidium parvum
ISNSSNNSPSM

SEQ ID NO: 2263194 - protein, 4 aa, Cryptosporidium parvum
ISNT

SEQ ID NO: 2263195 - protein, 7 aa, Cryptosporidium parvum
ISNTNEH

SEQ ID NO: 2263196 - protein, 28 aa, Cryptosporidium parvum
ISNTSKGSSSTTAGGKKGGSSGKSNIAP

SEQ ID NO: 2263197 - protein, 10 aa, Cryptosporidium parvum
ISNTSSEPIK

SEQ ID NO: 2263198 - protein, 5 aa, Cryptosporidium parvum
ISNYE

SEQ ID NO: 2263199 - protein, 14 aa, Cryptosporidium parvum
ISPAPEPTQPTVEE

SEQ ID NO: 2263200 - protein, 17 aa, Cryptosporidium parvum
ISPDANDKSVNKNIKKN

SEQ ID NO: 2263201 - protein, 8 aa, Cryptosporidium parvum
ISPDPNIE

SEQ ID NO: 2263202 - protein, 6 aa, Cryptosporidium parvum
ISPDSN

SEQ ID NO: 2263203 - protein, 4 aa, Cryptosporidium parvum
ISPE

SEQ ID NO: 2263204 - protein, 7 aa, Cryptosporidium parvum
ISPEERK

SEQ ID NO: 2263205 - protein, 6 aa, Cryptosporidium parvum
ISPEIS

SEQ ID NO: 2263206 - protein, 7 aa, Cryptosporidium parvum
ISPEKQS

SEQ ID NO: 2263207 - protein, 4 aa, Cryptosporidium parvum
ISPG

SEQ ID NO: 2263208 - protein, 5 aa, Cryptosporidium parvum
ISPGD

SEQ ID NO: 2263209 - protein, 15 aa, Cryptosporidium parvum
ISPIEKDNTFNQETL

SEQ ID NO: 2263210 - protein, 7 aa, Cryptosporidium parvum
ISPITKN

SEQ ID NO: 2263211 - protein, 6 aa, Cryptosporidium parvum
ISPKDL

SEQ ID NO: 2263212 - protein, 14 aa, Cryptosporidium parvum
ISPMGQASSNIPNI

SEQ ID NO: 2263213 - protein, 4 aa, Cryptosporidium parvum
ISPN

SEQ ID NO: 2263214 - protein, 6 aa, Cryptosporidium parvum
ISPNGK

SEQ ID NO: 2263215 - protein, 6 aa, Cryptosporidium parvum
ISPNNS

SEQ ID NO: 2263216 - protein, 9 aa, Cryptosporidium parvum
ISPNSNSNL

SEQ ID NO: 2263217 - protein, 8 aa, Cryptosporidium parvum
ISPPPSTY

SEQ ID NO: 2263218 - protein, 6 aa, Cryptosporidium parvum
ISPQQY

SEQ ID NO: 2263219 - protein, 4 aa, Cryptosporidium parvum
ISPR

SEQ ID NO: 2263220 - protein, 5 aa, Cryptosporidium parvum
ISPRE

SEQ ID NO: 2263221 - protein, 6 aa, Cryptosporidium parvum
ISPRGA

SEQ ID NO: 2263222 - protein, 19 aa, Cryptosporidium parvum
ISPRPSVGKESGTQSGSNY

SEQ ID NO: 2263223 - protein, 6 aa, Cryptosporidium parvum
ISPSFE

SEQ ID NO: 2263224 - protein, 16 aa, Cryptosporidium parvum
ISPSKTPRTGVNPPPI

SEQ ID NO: 2263225 - protein, 15 aa, Cryptosporidium parvum
ISPSNKQDYSLSSDI

SEQ ID NO: 2263226 - protein, 6 aa, Cryptosporidium parvum
ISPSPF

SEQ ID NO: 2263227 - protein, 15 aa, Cryptosporidium parvum
ISPSRPTGLPPPLPY

SEQ ID NO: 2263228 - protein, 20 aa, Cryptosporidium parvum
ISPSRRPSMATNNSANLIPE

SEQ ID NO: 2263229 - protein, 18 aa, Cryptosporidium parvum
ISPSTQVPEGGQNLNESY

SEQ ID NO: 2263230 - protein, 7 aa, Cryptosporidium parvum
ISPTENE

SEQ ID NO: 2263231 - protein, 7 aa, Cryptosporidium parvum
ISPTGNK

SEQ ID NO: 2263232 - protein, 54 aa, Cryptosporidium parvum
ISPTSQSSQLVSQTPSSSSSSSSSTNANNNTSKSIMGGDNNSSGISNNTIGNEG

SEQ ID NO: 2263233 - protein, 11 aa, Cryptosporidium parvum
ISQAGDISARI

SEQ ID NO: 2263234 - protein, 9 aa, Cryptosporidium parvum
ISQAMQTNK

SEQ ID NO: 2263235 - protein, 9 aa, Cryptosporidium parvum
ISQANDPIN

SEQ ID NO: 2263236 - protein, 5 aa, Cryptosporidium parvum
ISQDG

SEQ ID NO: 2263237 - protein, 7 aa, Cryptosporidium parvum
ISQEAKS

SEQ ID NO: 2263238 - protein, 7 aa, Cryptosporidium parvum
ISQEGKN

SEQ ID NO: 2263239 - protein, 12 aa, Cryptosporidium parvum
ISQEKLKKEREI

SEQ ID NO: 2263240 - protein, 7 aa, Cryptosporidium parvum
ISQEQRI

SEQ ID NO: 2263241 - protein, 11 aa, Cryptosporidium parvum
ISQNQEEDVSG

SEQ ID NO: 2263242 - protein, 23 aa, Cryptosporidium parvum
ISQNSSSKSHCSESSELETQSDV

SEQ ID NO: 2263243 - protein, 5 aa, Cryptosporidium parvum
ISQNY

SEQ ID NO: 2263244 - protein, 9 aa, Cryptosporidium parvum
ISQPQSKMN

SEQ ID NO: 2263245 - protein, 5 aa, Cryptosporidium parvum
ISQTK

SEQ ID NO: 2263246 - protein, 14 aa, Cryptosporidium parvum
ISQYSRGVTSNTSS

SEQ ID NO: 2263247 - protein, 16 aa, Cryptosporidium parvum
ISRASKRRRSSAATHI

SEQ ID NO: 2263248 - protein, 4 aa, Cryptosporidium parvum
ISRD

SEQ ID NO: 2263249 - protein, 11 aa, Cryptosporidium parvum
ISRDKKNLSKN

SEQ ID NO: 2263250 - protein, 11 aa, Cryptosporidium parvum
ISRDQSGASKG

SEQ ID NO: 2263251 - protein, 4 aa, Cryptosporidium parvum
ISRG

SEQ ID NO: 2263252 - protein, 5 aa, Cryptosporidium parvum
ISRKI

SEQ ID NO: 2263253 - protein, 12 aa, Cryptosporidium parvum
ISRKNNDEVSRR

SEQ ID NO: 2263254 - protein, 9 aa, Cryptosporidium parvum
ISRKSNKLG

SEQ ID NO: 2263255 - protein, 14 aa, Cryptosporidium parvum
ISRKYERNNQPSIS

SEQ ID NO: 2263256 - protein, 20 aa, Cryptosporidium parvum
ISRNDNNLVNNSDPAGDSRN

SEQ ID NO: 2263257 - protein, 6 aa, Cryptosporidium parvum
ISRNRR

SEQ ID NO: 2263258 - protein, 11 aa, Cryptosporidium parvum
ISRNSNGQSYL

SEQ ID NO: 2263259 - protein, 9 aa, Cryptosporidium parvum
ISRNSSLSS

SEQ ID NO: 2263260 - protein, 5 aa, Cryptosporidium parvum
ISRPK

SEQ ID NO: 2263261 - protein, 8 aa, Cryptosporidium parvum
ISRQGSSI

SEQ ID NO: 2263262 - protein, 7 aa, Cryptosporidium parvum
ISRQKGR

SEQ ID NO: 2263263 - protein, 14 aa, Cryptosporidium parvum
ISRQRGKELTSNET

SEQ ID NO: 2263264 - protein, 9 aa, Cryptosporidium parvum
ISRRENNAI

SEQ ID NO: 2263265 - protein, 5 aa, Cryptosporidium parvum
ISRSD

SEQ ID NO: 2263266 - protein, 5 aa, Cryptosporidium parvum
ISRSS

SEQ ID NO: 2263267 - protein, 20 aa, Cryptosporidium parvum
ISRSVTSSSVDSSISSNSTS

SEQ ID NO: 2263268 - protein, 4 aa, Cryptosporidium parvum
ISRT

SEQ ID NO: 2263269 - protein, 5 aa, Cryptosporidium parvum
ISRTG

SEQ ID NO: 2263270 - protein, 8 aa, Cryptosporidium parvum
ISSANQHK

SEQ ID NO: 2263271 - protein, 10 aa, Cryptosporidium parvum
ISSDDKEKYL

SEQ ID NO: 2263272 - protein, 12 aa, Cryptosporidium parvum
ISSDEESEKFGS

SEQ ID NO: 2263273 - protein, 12 aa, Cryptosporidium parvum
ISSDEETPKNIV

SEQ ID NO: 2263274 - protein, 5 aa, Cryptosporidium parvum
ISSDN

SEQ ID NO: 2263275 - protein, 15 aa, Cryptosporidium parvum
ISSDSSNKVARSKSL

SEQ ID NO: 2263276 - protein, 4 aa, Cryptosporidium parvum
ISSE

SEQ ID NO: 2263277 - protein, 9 aa, Cryptosporidium parvum
ISSEEEYPD

SEQ ID NO: 2263278 - protein, 26 aa, Cryptosporidium parvum
ISSEERYKQQSSLNTKKKYKPIKCGT

SEQ ID NO: 2263279 - protein, 5 aa, Cryptosporidium parvum
ISSEG

SEQ ID NO: 2263280 - protein, 40 aa, Cryptosporidium parvum
ISSEKHKKHIKEDTKIYPPSDGEISPESDSSRSLSRSISP

SEQ ID NO: 2263281 - protein, 14 aa, Cryptosporidium parvum
ISSEKKKPGEDSND

SEQ ID NO: 2263282 - protein, 14 aa, Cryptosporidium parvum
ISSENQRKKTNARI

SEQ ID NO: 2263283 - protein, 7 aa, Cryptosporidium parvum
ISSEPSA

SEQ ID NO: 2263284 - protein, 6 aa, Cryptosporidium parvum
ISSEQP

SEQ ID NO: 2263285 - protein, 8 aa, Cryptosporidium parvum
ISSESNNA

SEQ ID NO: 2263286 - protein, 10 aa, Cryptosporidium parvum
ISSESTLQER

SEQ ID NO: 2263287 - protein, 20 aa, Cryptosporidium parvum
ISSGGKVPSSRKNLKRKIHN

SEQ ID NO: 2263288 - protein, 11 aa, Cryptosporidium parvum
ISSGGLAETTR

SEQ ID NO: 2263289 - protein, 35 aa, Cryptosporidium parvum
ISSGQSPNKLGHTSLAPNHAQHRKKKPDKSNCGEI

SEQ ID NO: 2263290 - protein, 6 aa, Cryptosporidium parvum
ISSGST

SEQ ID NO: 2263291 - protein, 9 aa, Cryptosporidium parvum
ISSGTTEQT

SEQ ID NO: 2263292 - protein, 13 aa, Cryptosporidium parvum
ISSIPNNNNNRVS

SEQ ID NO: 2263293 - protein, 98 aa, Cryptosporidium parvum
ISSKGNASGGKNPNVINNRNSAGVGNPNNQGGIGPGSVQGGGPNNTSNTNSSGTGNQSFNSNYYSRKTNSGQYNKHKNTSSSSSSVPSSSSMNLRPIR

SEQ ID NO: 2263294 - protein, 9 aa, Cryptosporidium parvum
ISSKGTKIR

SEQ ID NO: 2263295 - protein, 6 aa, Cryptosporidium parvum
ISSKQG

SEQ ID NO: 2263296 - protein, 9 aa, Cryptosporidium parvum
ISSKQKPIS

SEQ ID NO: 2263297 - protein, 9 aa, Cryptosporidium parvum
ISSLSTGEV

SEQ ID NO: 2263298 - protein, 4 aa, Cryptosporidium parvum
ISSN

SEQ ID NO: 2263299 - protein, 6 aa, Cryptosporidium parvum
ISSNAA

SEQ ID NO: 2263300 - protein, 8 aa, Cryptosporidium parvum
ISSNDRNP

SEQ ID NO: 2263301 - protein, 8 aa, Cryptosporidium parvum
ISSNPNEL

SEQ ID NO: 2263302 - protein, 12 aa, Cryptosporidium parvum
ISSNSGGNYANA

SEQ ID NO: 2263303 - protein, 23 aa, Cryptosporidium parvum
ISSNSSNSSINESNIKSTTTFRK

SEQ ID NO: 2263304 - protein, 5 aa, Cryptosporidium parvum
ISSNV

SEQ ID NO: 2263305 - protein, 7 aa, Cryptosporidium parvum
ISSPLSQ

SEQ ID NO: 2263306 - protein, 10 aa, Cryptosporidium parvum
ISSPNTADAT

SEQ ID NO: 2263307 - protein, 8 aa, Cryptosporidium parvum
ISSPSQIS

SEQ ID NO: 2263308 - protein, 9 aa, Cryptosporidium parvum
ISSQSEDER

SEQ ID NO: 2263309 - protein, 6 aa, Cryptosporidium parvum
ISSQTG

SEQ ID NO: 2263310 - protein, 9 aa, Cryptosporidium parvum
ISSQTNSNY

SEQ ID NO: 2263311 - protein, 12 aa, Cryptosporidium parvum
ISSREHVGKESF

SEQ ID NO: 2263312 - protein, 6 aa, Cryptosporidium parvum
ISSRES

SEQ ID NO: 2263313 - protein, 8 aa, Cryptosporidium parvum
ISSSDAKT

SEQ ID NO: 2263314 - protein, 12 aa, Cryptosporidium parvum
ISSSDFEDEEVE

SEQ ID NO: 2263315 - protein, 9 aa, Cryptosporidium parvum
ISSSEEQCT

SEQ ID NO: 2263316 - protein, 6 aa, Cryptosporidium parvum
ISSSKN

SEQ ID NO: 2263317 - protein, 30 aa, Cryptosporidium parvum
ISSSKNSVTSSSKYSYNHSRTQSQSNRDSI

SEQ ID NO: 2263318 - protein, 32 aa, Cryptosporidium parvum
ISSSPTSSSSQKPILQASGSSCSSSSSNSNLS

SEQ ID NO: 2263319 - protein, 7 aa, Cryptosporidium parvum
ISSSRNA

SEQ ID NO: 2263320 - protein, 11 aa, Cryptosporidium parvum
ISSSSNNTGIH

SEQ ID NO: 2263321 - protein, 14 aa, Cryptosporidium parvum
ISSSSSIAEADGNH

SEQ ID NO: 2263322 - protein, 7 aa, Cryptosporidium parvum
ISSSTPI

SEQ ID NO: 2263323 - protein, 18 aa, Cryptosporidium parvum
ISSTCTSTAPSTPNSREF

SEQ ID NO: 2263324 - protein, 5 aa, Cryptosporidium parvum
ISSTE

SEQ ID NO: 2263325 - protein, 12 aa, Cryptosporidium parvum
ISSTGSPRPASS

SEQ ID NO: 2263326 - protein, 7 aa, Cryptosporidium parvum
ISSTNIG

SEQ ID NO: 2263327 - protein, 25 aa, Cryptosporidium parvum
ISSTSNYSKNSNETSTLNTSKRLQR

SEQ ID NO: 2263328 - protein, 14 aa, Cryptosporidium parvum
ISSTSVSTNNDVSR

SEQ ID NO: 2263329 - protein, 24 aa, Cryptosporidium parvum
ISSTTPQNSLFGSSGSSSGLGQTS

SEQ ID NO: 2263330 - protein, 13 aa, Cryptosporidium parvum
ISTAGTEASGTSN

SEQ ID NO: 2263331 - protein, 18 aa, Cryptosporidium parvum
ISTARKQSLGRNEPSDSI

SEQ ID NO: 2263332 - protein, 12 aa, Cryptosporidium parvum
ISTASEQSTSIT

SEQ ID NO: 2263333 - protein, 9 aa, Cryptosporidium parvum
ISTDGSARS

SEQ ID NO: 2263334 - protein, 6 aa, Cryptosporidium parvum
ISTDKE

SEQ ID NO: 2263335 - protein, 11 aa, Cryptosporidium parvum
ISTEEKTNQEK

SEQ ID NO: 2263336 - protein, 10 aa, Cryptosporidium parvum
ISTENQEDAT

SEQ ID NO: 2263337 - protein, 6 aa, Cryptosporidium parvum
ISTEQE

SEQ ID NO: 2263338 - protein, 10 aa, Cryptosporidium parvum
ISTGKEANVY

SEQ ID NO: 2263339 - protein, 21 aa, Cryptosporidium parvum
ISTGNCHSTSGTGGGKGGVSE

SEQ ID NO: 2263340 - protein, 95 aa, Cryptosporidium parvum
ISTGNKKKKPESNLKENKISKANSKEKKSASTEKATKPKSKTSSSSSKLKKLPASATSLTARKNSMKVDAKNGGDSSLRTPTRTSRLSYSSTPIS

SEQ ID NO: 2263341 - protein, 6 aa, Cryptosporidium parvum
ISTGQC

SEQ ID NO: 2263342 - protein, 12 aa, Cryptosporidium parvum
ISTGYNGTPKNM

SEQ ID NO: 2263343 - protein, 14 aa, Cryptosporidium parvum
ISTHNIDSKTESPG

SEQ ID NO: 2263344 - protein, 5 aa, Cryptosporidium parvum
ISTKR

SEQ ID NO: 2263345 - protein, 20 aa, Cryptosporidium parvum
ISTKSEPPKVVTRKASSNLP

SEQ ID NO: 2263346 - protein, 6 aa, Cryptosporidium parvum
ISTLSR

SEQ ID NO: 2263347 - protein, 8 aa, Cryptosporidium parvum
ISTNGIPH

SEQ ID NO: 2263348 - protein, 11 aa, Cryptosporidium parvum
ISTNNSNTNEL

SEQ ID NO: 2263349 - protein, 9 aa, Cryptosporidium parvum
ISTNSKQVF

SEQ ID NO: 2263350 - protein, 7 aa, Cryptosporidium parvum
ISTPTQV

SEQ ID NO: 2263351 - protein, 4 aa, Cryptosporidium parvum
ISTQ

SEQ ID NO: 2263352 - protein, 10 aa, Cryptosporidium parvum
ISTQEQEENI

SEQ ID NO: 2263353 - protein, 10 aa, Cryptosporidium parvum
ISTQSQIENE

SEQ ID NO: 2263354 - protein, 7 aa, Cryptosporidium parvum
ISTSNTG

SEQ ID NO: 2263355 - protein, 5 aa, Cryptosporidium parvum
ISTSR

SEQ ID NO: 2263356 - protein, 24 aa, Cryptosporidium parvum
ISTSRKAKIQRKVSQVSNKASYKL

SEQ ID NO: 2263357 - protein, 35 aa, Cryptosporidium parvum
ISTSSSSSSSLTTTSSSIPASNTGGTVNVGRGETE

SEQ ID NO: 2263358 - protein, 19 aa, Cryptosporidium parvum
ISTTETFHTTSNQDPISTD

SEQ ID NO: 2263359 - protein, 10 aa, Cryptosporidium parvum
ISTTTDPSEF

SEQ ID NO: 2263360 - protein, 6 aa, Cryptosporidium parvum
ISTVGN

SEQ ID NO: 2263361 - protein, 10 aa, Cryptosporidium parvum
ISVNGKKSFE

SEQ ID NO: 2263362 - protein, 24 aa, Cryptosporidium parvum
ISVPNTIEQQPNEASSASNSNAGA

SEQ ID NO: 2263363 - protein, 9 aa, Cryptosporidium parvum
ISVSKDETI

SEQ ID NO: 2263364 - protein, 6 aa, Cryptosporidium parvum
ISVTEK

SEQ ID NO: 2263365 - protein, 8 aa, Cryptosporidium parvum
ISYAKDKG

SEQ ID NO: 2263366 - protein, 12 aa, Cryptosporidium parvum
ISYDPKSSICQS

SEQ ID NO: 2263367 - protein, 7 aa, Cryptosporidium parvum
ISYNGKQ

SEQ ID NO: 2263368 - protein, 10 aa, Cryptosporidium parvum
ISYNSGIDES

SEQ ID NO: 2263369 - protein, 5 aa, Cryptosporidium parvum
ITDDS

SEQ ID NO: 2263370 - protein, 9 aa, Cryptosporidium parvum
ITDDTDEGK

SEQ ID NO: 2263371 - protein, 6 aa, Cryptosporidium parvum
ITDELN

SEQ ID NO: 2263372 - protein, 9 aa, Cryptosporidium parvum
ITDNDKNVS

SEQ ID NO: 2263373 - protein, 8 aa, Cryptosporidium parvum
ITDPQKKR

SEQ ID NO: 2263374 - protein, 5 aa, Cryptosporidium parvum
ITDQD

SEQ ID NO: 2263375 - protein, 5 aa, Cryptosporidium parvum
ITDRD

SEQ ID NO: 2263376 - protein, 10 aa, Cryptosporidium parvum
ITDSESSDLS

SEQ ID NO: 2263377 - protein, 5 aa, Cryptosporidium parvum
ITDSS

SEQ ID NO: 2263378 - protein, 9 aa, Cryptosporidium parvum
ITDTSENKS

SEQ ID NO: 2263379 - protein, 5 aa, Cryptosporidium parvum
ITEDS

SEQ ID NO: 2263380 - protein, 7 aa, Cryptosporidium parvum
ITEERRH

SEQ ID NO: 2263381 - protein, 12 aa, Cryptosporidium parvum
ITEGGINDPKDE

SEQ ID NO: 2263382 - protein, 8 aa, Cryptosporidium parvum
ITEGPAGA

SEQ ID NO: 2263383 - protein, 10 aa, Cryptosporidium parvum
ITENDQNNPI

SEQ ID NO: 2263384 - protein, 10 aa, Cryptosporidium parvum
ITENSKNQMD

SEQ ID NO: 2263385 - protein, 5 aa, Cryptosporidium parvum
ITEPD

SEQ ID NO: 2263386 - protein, 17 aa, Cryptosporidium parvum
ITEQNSVNNLKNDEQTM

SEQ ID NO: 2263387 - protein, 19 aa, Cryptosporidium parvum
ITEQSNSNKGVNSKLQNES

SEQ ID NO: 2263388 - protein, 13 aa, Cryptosporidium parvum
ITESQNKKRKNHL

SEQ ID NO: 2263389 - protein, 5 aa, Cryptosporidium parvum
ITETS

SEQ ID NO: 2263390 - protein, 4 aa, Cryptosporidium parvum
ITGC

SEQ ID NO: 2263391 - protein, 6 aa, Cryptosporidium parvum
ITGDRE

SEQ ID NO: 2263392 - protein, 11 aa, Cryptosporidium parvum
ITGETISENEQ

SEQ ID NO: 2263393 - protein, 19 aa, Cryptosporidium parvum
ITGGRTRSLSRSVSPFHSN

SEQ ID NO: 2263394 - protein, 4 aa, Cryptosporidium parvum
ITGK

SEQ ID NO: 2263395 - protein, 6 aa, Cryptosporidium parvum
ITGKER

SEQ ID NO: 2263396 - protein, 7 aa, Cryptosporidium parvum
ITGKKYA

SEQ ID NO: 2263397 - protein, 12 aa, Cryptosporidium parvum
ITGKQSQQLKKD

SEQ ID NO: 2263398 - protein, 14 aa, Cryptosporidium parvum
ITGNATVNSNTNLP

SEQ ID NO: 2263399 - protein, 11 aa, Cryptosporidium parvum
ITGNKSTKIQE

SEQ ID NO: 2263400 - protein, 24 aa, Cryptosporidium parvum
ITGSSIGTGNTSGNSVSNNSTYQD

SEQ ID NO: 2263401 - protein, 23 aa, Cryptosporidium parvum
ITGTQTNGVKEVEQEQGEIESKR

SEQ ID NO: 2263402 - protein, 10 aa, Cryptosporidium parvum
ITHNEESRLS

SEQ ID NO: 2263403 - protein, 13 aa, Cryptosporidium parvum
ITIPPSKRQIKEK

SEQ ID NO: 2263404 - protein, 10 aa, Cryptosporidium parvum
ITKDNCNNFS

SEQ ID NO: 2263405 - protein, 4 aa, Cryptosporidium parvum
ITKE

SEQ ID NO: 2263406 - protein, 8 aa, Cryptosporidium parvum
ITKEGKCK

SEQ ID NO: 2263407 - protein, 5 aa, Cryptosporidium parvum
ITKND

SEQ ID NO: 2263408 - protein, 4 aa, Cryptosporidium parvum
ITKQ

SEQ ID NO: 2263409 - protein, 6 aa, Cryptosporidium parvum
ITKSTK

SEQ ID NO: 2263410 - protein, 12 aa, Cryptosporidium parvum
ITKTNELGSSTI

SEQ ID NO: 2263411 - protein, 7 aa, Cryptosporidium parvum
ITNDDES

SEQ ID NO: 2263412 - protein, 7 aa, Cryptosporidium parvum
ITNDNLN

SEQ ID NO: 2263413 - protein, 5 aa, Cryptosporidium parvum
ITNDS

SEQ ID NO: 2263414 - protein, 21 aa, Cryptosporidium parvum
ITNEGHKTKSIDESSDDSTLV

SEQ ID NO: 2263415 - protein, 5 aa, Cryptosporidium parvum
ITNEN

SEQ ID NO: 2263416 - protein, 5 aa, Cryptosporidium parvum
ITNES

SEQ ID NO: 2263417 - protein, 25 aa, Cryptosporidium parvum
ITNNEDSNCQRNNPNNEDKANANSG

SEQ ID NO: 2263418 - protein, 9 aa, Cryptosporidium parvum
ITNNKSQLE

SEQ ID NO: 2263419 - protein, 12 aa, Cryptosporidium parvum
ITNNNEKDINNS

SEQ ID NO: 2263420 - protein, 12 aa, Cryptosporidium parvum
ITNNNNNNRNNG

SEQ ID NO: 2263421 - protein, 70 aa, Cryptosporidium parvum
ITNNTNTTSTGVSGGSNSNVVGSTNNNYPNQPTITTTATTTTATTTTSSSSSSSSSSSSSSSSSSSNMKR

SEQ ID NO: 2263422 - protein, 7 aa, Cryptosporidium parvum
ITNPSKI

SEQ ID NO: 2263423 - protein, 10 aa, Cryptosporidium parvum
ITNPSTGSSM

SEQ ID NO: 2263424 - protein, 6 aa, Cryptosporidium parvum
ITNSIS

SEQ ID NO: 2263425 - protein, 14 aa, Cryptosporidium parvum
ITNSNDEDATEIGS

SEQ ID NO: 2263426 - protein, 6 aa, Cryptosporidium parvum
ITNSSE

SEQ ID NO: 2263427 - protein, 19 aa, Cryptosporidium parvum
ITNSTELSNQESKSHEVSN

SEQ ID NO: 2263428 - protein, 6 aa, Cryptosporidium parvum
ITNTKH

SEQ ID NO: 2263429 - protein, 8 aa, Cryptosporidium parvum
ITPDISDA

SEQ ID NO: 2263430 - protein, 6 aa, Cryptosporidium parvum
ITPGGT

SEQ ID NO: 2263431 - protein, 6 aa, Cryptosporidium parvum
ITPGTP

SEQ ID NO: 2263432 - protein, 6 aa, Cryptosporidium parvum
ITPNKS

SEQ ID NO: 2263433 - protein, 6 aa, Cryptosporidium parvum
ITPNNI

SEQ ID NO: 2263434 - protein, 7 aa, Cryptosporidium parvum
ITPTPYK

SEQ ID NO: 2263435 - protein, 10 aa, Cryptosporidium parvum
ITQAKDDNSI

SEQ ID NO: 2263436 - protein, 17 aa, Cryptosporidium parvum
ITQEPTKLRPSLEESNF

SEQ ID NO: 2263437 - protein, 14 aa, Cryptosporidium parvum
ITQGQGSPKDVKDT

SEQ ID NO: 2263438 - protein, 6 aa, Cryptosporidium parvum
ITQNDS

SEQ ID NO: 2263439 - protein, 8 aa, Cryptosporidium parvum
ITQQNSTH

SEQ ID NO: 2263440 - protein, 9 aa, Cryptosporidium parvum
ITQTSRKGR

SEQ ID NO: 2263441 - protein, 11 aa, Cryptosporidium parvum
ITQVEKQGGIG

SEQ ID NO: 2263442 - protein, 12 aa, Cryptosporidium parvum
ITRAGRLDIHIP

SEQ ID NO: 2263443 - protein, 11 aa, Cryptosporidium parvum
ITRDNQSLKKN

SEQ ID NO: 2263444 - protein, 6 aa, Cryptosporidium parvum
ITRETY

SEQ ID NO: 2263445 - protein, 17 aa, Cryptosporidium parvum
ITRGGQNNNNSYKESKN

SEQ ID NO: 2263446 - protein, 8 aa, Cryptosporidium parvum
ITRGKTDE

SEQ ID NO: 2263447 - protein, 6 aa, Cryptosporidium parvum
ITRNQE

SEQ ID NO: 2263448 - protein, 6 aa, Cryptosporidium parvum
ITRSNN

SEQ ID NO: 2263449 - protein, 8 aa, Cryptosporidium parvum
ITRTGTLR

SEQ ID NO: 2263450 - protein, 6 aa, Cryptosporidium parvum
ITRTNE

SEQ ID NO: 2263451 - protein, 9 aa, Cryptosporidium parvum
ITRTSDVRP

SEQ ID NO: 2263452 - protein, 9 aa, Cryptosporidium parvum
ITSDSKGDE

SEQ ID NO: 2263453 - protein, 4 aa, Cryptosporidium parvum
ITSE

SEQ ID NO: 2263454 - protein, 4 aa, Cryptosporidium parvum
ITSF

SEQ ID NO: 2263455 - protein, 8 aa, Cryptosporidium parvum
ITSGEYSR

SEQ ID NO: 2263456 - protein, 8 aa, Cryptosporidium parvum
ITSGPIGH

SEQ ID NO: 2263457 - protein, 10 aa, Cryptosporidium parvum
ITSIKSGSGK

SEQ ID NO: 2263458 - protein, 4 aa, Cryptosporidium parvum
ITSK

SEQ ID NO: 2263459 - protein, 7 aa, Cryptosporidium parvum
ITSKDQI

SEQ ID NO: 2263460 - protein, 6 aa, Cryptosporidium parvum
ITSNGE

SEQ ID NO: 2263461 - protein, 9 aa, Cryptosporidium parvum
ITSNSNGNI

SEQ ID NO: 2263462 - protein, 6 aa, Cryptosporidium parvum
ITSPEM

SEQ ID NO: 2263463 - protein, 11 aa, Cryptosporidium parvum
ITSRDKKIQDL

SEQ ID NO: 2263464 - protein, 5 aa, Cryptosporidium parvum
ITSRE

SEQ ID NO: 2263465 - protein, 12 aa, Cryptosporidium parvum
ITSRERPLPSIP

SEQ ID NO: 2263466 - protein, 14 aa, Cryptosporidium parvum
ITSRSSSKAESGKI

SEQ ID NO: 2263467 - protein, 5 aa, Cryptosporidium parvum
ITSSI

SEQ ID NO: 2263468 - protein, 49 aa, Cryptosporidium parvum
ITSSNSQLEDSKKVQEEEERTSKEDDMERKDTENDDIDDFKSPKSDNSA

SEQ ID NO: 2263469 - protein, 5 aa, Cryptosporidium parvum
ITSST

SEQ ID NO: 2263470 - protein, 9 aa, Cryptosporidium parvum
ITTDPGRGC

SEQ ID NO: 2263471 - protein, 11 aa, Cryptosporidium parvum
ITTETSTTAEL

SEQ ID NO: 2263472 - protein, 18 aa, Cryptosporidium parvum
ITTNNTTINSNNRNENMN

SEQ ID NO: 2263473 - protein, 10 aa, Cryptosporidium parvum
ITTNSESNIE

SEQ ID NO: 2263474 - protein, 9 aa, Cryptosporidium parvum
ITTPAGYKI

SEQ ID NO: 2263475 - protein, 7 aa, Cryptosporidium parvum
ITTPETK

SEQ ID NO: 2263476 - protein, 7 aa, Cryptosporidium parvum
ITTPSKN

SEQ ID NO: 2263477 - protein, 15 aa, Cryptosporidium parvum
ITTRSNNNNNSQNSI

SEQ ID NO: 2263478 - protein, 10 aa, Cryptosporidium parvum
ITTSNDSSVK

SEQ ID NO: 2263479 - protein, 19 aa, Cryptosporidium parvum
ITVPSDDKETKVNTETEED

SEQ ID NO: 2263480 - protein, 5 aa, Cryptosporidium parvum
IVEDN

SEQ ID NO: 2263481 - protein, 7 aa, Cryptosporidium parvum
IVEPESR

SEQ ID NO: 2263482 - protein, 6 aa, Cryptosporidium parvum
IVGNEQ

SEQ ID NO: 2263483 - protein, 18 aa, Cryptosporidium parvum
IVPENSKLSDLDPETRAT

SEQ ID NO: 2263484 - protein, 29 aa, Cryptosporidium parvum
IVPESRSNISNPTTNINKSSSNLRTSTSV

SEQ ID NO: 2263485 - protein, 11 aa, Cryptosporidium parvum
IVSNNESVTQP

SEQ ID NO: 2263486 - protein, 28 aa, Cryptosporidium parvum
IVSNSSEVNAYNRSVNPNRRGGKLKPRH

SEQ ID NO: 2263487 - protein, 10 aa, Cryptosporidium parvum
IVSPEQYSSV

SEQ ID NO: 2263488 - protein, 24 aa, Cryptosporidium parvum
IVSTSNDNDNDNDNSTLKSSPYYN

SEQ ID NO: 2263489 - protein, 6 aa, Cryptosporidium parvum
IYDDSD

SEQ ID NO: 2263490 - protein, 5 aa, Cryptosporidium parvum
IYDNG

SEQ ID NO: 2263491 - protein, 12 aa, Cryptosporidium parvum
IYDNSSEATLSD

SEQ ID NO: 2263492 - protein, 18 aa, Cryptosporidium parvum
IYDPSGTLSGGSIPSNQR

SEQ ID NO: 2263493 - protein, 11 aa, Cryptosporidium parvum
IYENPNNTKGC

SEQ ID NO: 2263494 - protein, 11 aa, Cryptosporidium parvum
IYGSDKKNHYT

SEQ ID NO: 2263495 - protein, 8 aa, Cryptosporidium parvum
IYGSSQTS

SEQ ID NO: 2263496 - protein, 9 aa, Cryptosporidium parvum
IYKGVTEKG

SEQ ID NO: 2263497 - protein, 5 aa, Cryptosporidium parvum
IYNNK

SEQ ID NO: 2263498 - protein, 9 aa, Cryptosporidium parvum
IYNNNNNNN

SEQ ID NO: 2263499 - protein, 6 aa, Cryptosporidium parvum
IYNRDK

SEQ ID NO: 2263500 - protein, 9 aa, Cryptosporidium parvum
IYQPERGEW

SEQ ID NO: 2263501 - protein, 5 aa, Cryptosporidium parvum
IYSGK

SEQ ID NO: 2263502 - protein, 23 aa, Cryptosporidium parvum
IYSNNKSDNDKDFQYQDENINDE

SEQ ID NO: 2263503 - protein, 13 aa, Cryptosporidium parvum
IYSNSGKYIIWRN

SEQ ID NO: 2263504 - protein, 20 aa, Cryptosporidium parvum
IYSQDGPKEGKYDNSKQSFG

SEQ ID NO: 2263505 - protein, 4 aa, Cryptosporidium parvum
IYST

SEQ ID NO: 2263506 - protein, 21 aa, Cryptosporidium parvum
IYTKDKNEKTSKEKKHNSGND

SEQ ID NO: 2263507 - protein, 10 aa, Cryptosporidium parvum
KAAAKEKERQ

SEQ ID NO: 2263508 - protein, 19 aa, Cryptosporidium parvum
KAAEAAQGYDNNNNNNNVK

SEQ ID NO: 2263509 - protein, 19 aa, Cryptosporidium parvum
KAAFTQNNPNAVNNPDSVS

SEQ ID NO: 2263510 - protein, 7 aa, Cryptosporidium parvum
KAAGQGL

SEQ ID NO: 2263511 - protein, 14 aa, Cryptosporidium parvum
KAAKEKNAHEVERQ

SEQ ID NO: 2263512 - protein, 7 aa, Cryptosporidium parvum
KAANELK

SEQ ID NO: 2263513 - protein, 10 aa, Cryptosporidium parvum
KAAPGYATAK

SEQ ID NO: 2263514 - protein, 16 aa, Cryptosporidium parvum
KAAQAKEEKKKQAQQQ

SEQ ID NO: 2263515 - protein, 13 aa, Cryptosporidium parvum
KAAQMNDSQLDQT

SEQ ID NO: 2263516 - protein, 9 aa, Cryptosporidium parvum
KACADKDQI

SEQ ID NO: 2263517 - protein, 7 aa, Cryptosporidium parvum
KADDTPL

SEQ ID NO: 2263518 - protein, 19 aa, Cryptosporidium parvum
KADELDPKNASFAQNKKEL

SEQ ID NO: 2263519 - protein, 7 aa, Cryptosporidium parvum
KADGFTE

SEQ ID NO: 2263520 - protein, 9 aa, Cryptosporidium parvum
KADGSTVTT

SEQ ID NO: 2263521 - protein, 7 aa, Cryptosporidium parvum
KADHNNA

SEQ ID NO: 2263522 - protein, 13 aa, Cryptosporidium parvum
KADIASSKLREQS

SEQ ID NO: 2263523 - protein, 7 aa, Cryptosporidium parvum
KADITEK

SEQ ID NO: 2263524 - protein, 7 aa, Cryptosporidium parvum
KADKTGG

SEQ ID NO: 2263525 - protein, 9 aa, Cryptosporidium parvum
KADLEDRRQ

SEQ ID NO: 2263526 - protein, 4 aa, Cryptosporidium parvum
KADN

SEQ ID NO: 2263527 - protein, 16 aa, Cryptosporidium parvum
KADPDSQESSEYSPPI

SEQ ID NO: 2263528 - protein, 5 aa, Cryptosporidium parvum
KADRW

SEQ ID NO: 2263529 - protein, 4 aa, Cryptosporidium parvum
KADS

SEQ ID NO: 2263530 - protein, 4 aa, Cryptosporidium parvum
KAEE

SEQ ID NO: 2263531 - protein, 5 aa, Cryptosporidium parvum
KAEEE

SEQ ID NO: 2263532 - protein, 7 aa, Cryptosporidium parvum
KAEEEIN

SEQ ID NO: 2263533 - protein, 12 aa, Cryptosporidium parvum
KAEEKEEKEKEE

SEQ ID NO: 2263534 - protein, 11 aa, Cryptosporidium parvum
KAEEKKNKERM

SEQ ID NO: 2263535 - protein, 8 aa, Cryptosporidium parvum
KAEESISI

SEQ ID NO: 2263536 - protein, 4 aa, Cryptosporidium parvum
KAEG

SEQ ID NO: 2263537 - protein, 18 aa, Cryptosporidium parvum
KAEKDNAEVRISDPTAYQ

SEQ ID NO: 2263538 - protein, 6 aa, Cryptosporidium parvum
KAEKTI

SEQ ID NO: 2263539 - protein, 13 aa, Cryptosporidium parvum
KAELTKSEKFSSE

SEQ ID NO: 2263540 - protein, 5 aa, Cryptosporidium parvum
KAENF

SEQ ID NO: 2263541 - protein, 26 aa, Cryptosporidium parvum
KAENISGTENSISRSSLESRTITTDA

SEQ ID NO: 2263542 - protein, 13 aa, Cryptosporidium parvum
KAENSEETAGQNY

SEQ ID NO: 2263543 - protein, 7 aa, Cryptosporidium parvum
KAENSGI

SEQ ID NO: 2263544 - protein, 4 aa, Cryptosporidium parvum
KAER

SEQ ID NO: 2263545 - protein, 8 aa, Cryptosporidium parvum
KAERENAD

SEQ ID NO: 2263546 - protein, 7 aa, Cryptosporidium parvum
KAERERG

SEQ ID NO: 2263547 - protein, 7 aa, Cryptosporidium parvum
KAESHDH

SEQ ID NO: 2263548 - protein, 7 aa, Cryptosporidium parvum
KAESTPV

SEQ ID NO: 2263549 - protein, 14 aa, Cryptosporidium parvum
KAFSRKRSIESNEY

SEQ ID NO: 2263550 - protein, 5 aa, Cryptosporidium parvum
KAFST

SEQ ID NO: 2263551 - protein, 11 aa, Cryptosporidium parvum
KAFTGEEHEET

SEQ ID NO: 2263552 - protein, 11 aa, Cryptosporidium parvum
KAGEGSNVTGI

SEQ ID NO: 2263553 - protein, 5 aa, Cryptosporidium parvum
KAGGC

SEQ ID NO: 2263554 - protein, 9 aa, Cryptosporidium parvum
KAGGQDYQS

SEQ ID NO: 2263555 - protein, 8 aa, Cryptosporidium parvum
KAGKSIND

SEQ ID NO: 2263556 - protein, 7 aa, Cryptosporidium parvum
KAGNQQC

SEQ ID NO: 2263557 - protein, 17 aa, Cryptosporidium parvum
KAGNSEINNNLEENDHN

SEQ ID NO: 2263558 - protein, 11 aa, Cryptosporidium parvum
KAGNYQEASRS

SEQ ID NO: 2263559 - protein, 21 aa, Cryptosporidium parvum
KAGPGAAKHVNSDTLAKLFTV

SEQ ID NO: 2263560 - protein, 9 aa, Cryptosporidium parvum
KAGQDITKS

SEQ ID NO: 2263561 - protein, 7 aa, Cryptosporidium parvum
KAGREMK

SEQ ID NO: 2263562 - protein, 8 aa, Cryptosporidium parvum
KAGSNGEP

SEQ ID NO: 2263563 - protein, 6 aa, Cryptosporidium parvum
KAGTAD

SEQ ID NO: 2263564 - protein, 11 aa, Cryptosporidium parvum
KAGTDSDKSPT

SEQ ID NO: 2263565 - protein, 20 aa, Cryptosporidium parvum
KAHENTSNQQESGSDLDSEM

SEQ ID NO: 2263566 - protein, 8 aa, Cryptosporidium parvum
KAHQKRET

SEQ ID NO: 2263567 - protein, 10 aa, Cryptosporidium parvum
KAIDKNSDTI

SEQ ID NO: 2263568 - protein, 6 aa, Cryptosporidium parvum
KAIEEG

SEQ ID NO: 2263569 - protein, 19 aa, Cryptosporidium parvum
KAIENEFNSDPKSFNDESL

SEQ ID NO: 2263570 - protein, 12 aa, Cryptosporidium parvum
KAIGTEEDRWPG

SEQ ID NO: 2263571 - protein, 18 aa, Cryptosporidium parvum
KAIKEKQDIENKSAELTK

SEQ ID NO: 2263572 - protein, 10 aa, Cryptosporidium parvum
KAIKENNNSE

SEQ ID NO: 2263573 - protein, 8 aa, Cryptosporidium parvum
KAIKPDKN

SEQ ID NO: 2263574 - protein, 9 aa, Cryptosporidium parvum
KAINSSTNI

SEQ ID NO: 2263575 - protein, 9 aa, Cryptosporidium parvum
KAISDGKEK

SEQ ID NO: 2263576 - protein, 14 aa, Cryptosporidium parvum
KAISQTRNKGREIA

SEQ ID NO: 2263577 - protein, 6 aa, Cryptosporidium parvum
KAKANE

SEQ ID NO: 2263578 - protein, 11 aa, Cryptosporidium parvum
KAKAQEQIESC

SEQ ID NO: 2263579 - protein, 6 aa, Cryptosporidium parvum
KAKEEL

SEQ ID NO: 2263580 - protein, 8 aa, Cryptosporidium parvum
KAKFEKNS

SEQ ID NO: 2263581 - protein, 9 aa, Cryptosporidium parvum
KAKGGQEFS

SEQ ID NO: 2263582 - protein, 7 aa, Cryptosporidium parvum
KAKGSPI

SEQ ID NO: 2263583 - protein, 23 aa, Cryptosporidium parvum
KAKKLESSLPPTLKKTTISRSVK

SEQ ID NO: 2263584 - protein, 9 aa, Cryptosporidium parvum
KAKKNKKDY

SEQ ID NO: 2263585 - protein, 6 aa, Cryptosporidium parvum
KAKLTG

SEQ ID NO: 2263586 - protein, 8 aa, Cryptosporidium parvum
KAKNSLSE

SEQ ID NO: 2263587 - protein, 7 aa, Cryptosporidium parvum
KAKQHSQ

SEQ ID NO: 2263588 - protein, 7 aa, Cryptosporidium parvum
KAKRSFK

SEQ ID NO: 2263589 - protein, 43 aa, Cryptosporidium parvum
KAKSKFKSTFGSSRGFDKSNAEESAENSGFTEFGGSKSSLCGT

SEQ ID NO: 2263590 - protein, 12 aa, Cryptosporidium parvum
KAKSSNDQSSLN

SEQ ID NO: 2263591 - protein, 14 aa, Cryptosporidium parvum
KAKSTIEQREQNPL

SEQ ID NO: 2263592 - protein, 10 aa, Cryptosporidium parvum
KAKSYRKEFS

SEQ ID NO: 2263593 - protein, 6 aa, Cryptosporidium parvum
KAKTNM

SEQ ID NO: 2263594 - protein, 11 aa, Cryptosporidium parvum
KAKYTEQEKAK

SEQ ID NO: 2263595 - protein, 4 aa, Cryptosporidium parvum
KALA

SEQ ID NO: 2263596 - protein, 29 aa, Cryptosporidium parvum
KALKKQEKQALKEAKKAEAKSNQQQQQQS

SEQ ID NO: 2263597 - protein, 18 aa, Cryptosporidium parvum
KALKSNNNDVVEAILSLS

SEQ ID NO: 2263598 - protein, 24 aa, Cryptosporidium parvum
KALSKPSESNSSPSKSILKRRGIN

SEQ ID NO: 2263599 - protein, 10 aa, Cryptosporidium parvum
KALSSDTEQN

SEQ ID NO: 2263600 - protein, 4 aa, Cryptosporidium parvum
KANA

SEQ ID NO: 2263601 - protein, 6 aa, Cryptosporidium parvum
KANCES

SEQ ID NO: 2263602 - protein, 11 aa, Cryptosporidium parvum
KANDKNESRMN

SEQ ID NO: 2263603 - protein, 19 aa, Cryptosporidium parvum
KANDNSEIEQASEKPTNSS

SEQ ID NO: 2263604 - protein, 7 aa, Cryptosporidium parvum
KANDSNL

SEQ ID NO: 2263605 - protein, 6 aa, Cryptosporidium parvum
KANDTV

SEQ ID NO: 2263606 - protein, 8 aa, Cryptosporidium parvum
KANECDIT

SEQ ID NO: 2263607 - protein, 9 aa, Cryptosporidium parvum
KANEDDNPD

SEQ ID NO: 2263608 - protein, 5 aa, Cryptosporidium parvum
KANKD

SEQ ID NO: 2263609 - protein, 11 aa, Cryptosporidium parvum
KANLNGNSGSG

SEQ ID NO: 2263610 - protein, 8 aa, Cryptosporidium parvum
KANLNKDK

SEQ ID NO: 2263611 - protein, 12 aa, Cryptosporidium parvum
KANNRNITGKEE

SEQ ID NO: 2263612 - protein, 22 aa, Cryptosporidium parvum
KANNSNDYNNHNNSASPVDELG

SEQ ID NO: 2263613 - protein, 10 aa, Cryptosporidium parvum
KANNSSKWPR

SEQ ID NO: 2263614 - protein, 8 aa, Cryptosporidium parvum
KANPERSE

SEQ ID NO: 2263615 - protein, 23 aa, Cryptosporidium parvum
KANQGANNPLTSFQSSARSNSVF

SEQ ID NO: 2263616 - protein, 9 aa, Cryptosporidium parvum
KANSLNSPI

SEQ ID NO: 2263617 - protein, 6 aa, Cryptosporidium parvum
KANTNL

SEQ ID NO: 2263618 - protein, 8 aa, Cryptosporidium parvum
KANTYNEY

SEQ ID NO: 2263619 - protein, 7 aa, Cryptosporidium parvum
KANYGPR

SEQ ID NO: 2263620 - protein, 8 aa, Cryptosporidium parvum
KAPFDKQT

SEQ ID NO: 2263621 - protein, 8 aa, Cryptosporidium parvum
KAPHAPPL

SEQ ID NO: 2263622 - protein, 7 aa, Cryptosporidium parvum
KAPLESY

SEQ ID NO: 2263623 - protein, 6 aa, Cryptosporidium parvum
KAPPLP

SEQ ID NO: 2263624 - protein, 7 aa, Cryptosporidium parvum
KAPSWSS

SEQ ID NO: 2263625 - protein, 6 aa, Cryptosporidium parvum
KAPTNC

SEQ ID NO: 2263626 - protein, 7 aa, Cryptosporidium parvum
KAPTPQL

SEQ ID NO: 2263627 - protein, 4 aa, Cryptosporidium parvum
KAQD

SEQ ID NO: 2263628 - protein, 7 aa, Cryptosporidium parvum
KAQDEEA

SEQ ID NO: 2263629 - protein, 6 aa, Cryptosporidium parvum
KAQDIQ

SEQ ID NO: 2263630 - protein, 8 aa, Cryptosporidium parvum
KAQEIGDE

SEQ ID NO: 2263631 - protein, 9 aa, Cryptosporidium parvum
KAQGNTDSY

SEQ ID NO: 2263632 - protein, 10 aa, Cryptosporidium parvum
KAQKHTEAEA

SEQ ID NO: 2263633 - protein, 9 aa, Cryptosporidium parvum
KAQKTKVKG

SEQ ID NO: 2263634 - protein, 10 aa, Cryptosporidium parvum
KAQNHSRRAV

SEQ ID NO: 2263635 - protein, 4 aa, Cryptosporidium parvum
KARA

SEQ ID NO: 2263636 - protein, 8 aa, Cryptosporidium parvum
KARAGKAT

SEQ ID NO: 2263637 - protein, 7 aa, Cryptosporidium parvum
KARDDEL

SEQ ID NO: 2263638 - protein, 17 aa, Cryptosporidium parvum
KARDNLKNSKAKLQKLR

SEQ ID NO: 2263639 - protein, 7 aa, Cryptosporidium parvum
KAREEKL

SEQ ID NO: 2263640 - protein, 9 aa, Cryptosporidium parvum
KAREISTKN

SEQ ID NO: 2263641 - protein, 5 aa, Cryptosporidium parvum
KARKE

SEQ ID NO: 2263642 - protein, 25 aa, Cryptosporidium parvum
KARKKAQSIADSEEMNEASKSKTIN

SEQ ID NO: 2263643 - protein, 12 aa, Cryptosporidium parvum
KARPKEKKSRDE

SEQ ID NO: 2263644 - protein, 9 aa, Cryptosporidium parvum
KARSAGQRI

SEQ ID NO: 2263645 - protein, 9 aa, Cryptosporidium parvum
KARTTSTAK

SEQ ID NO: 2263646 - protein, 7 aa, Cryptosporidium parvum
KARYSEK

SEQ ID NO: 2263647 - protein, 12 aa, Cryptosporidium parvum
KASAKNKDTSTI

SEQ ID NO: 2263648 - protein, 8 aa, Cryptosporidium parvum
KASENEKY

SEQ ID NO: 2263649 - protein, 8 aa, Cryptosporidium parvum
KASERIYR

SEQ ID NO: 2263650 - protein, 8 aa, Cryptosporidium parvum
KASESQKE

SEQ ID NO: 2263651 - protein, 8 aa, Cryptosporidium parvum
KASEYEEM

SEQ ID NO: 2263652 - protein, 11 aa, Cryptosporidium parvum
KASGDAMEGSL

SEQ ID NO: 2263653 - protein, 6 aa, Cryptosporidium parvum
KASGFA

SEQ ID NO: 2263654 - protein, 4 aa, Cryptosporidium parvum
KASI

SEQ ID NO: 2263655 - protein, 5 aa, Cryptosporidium parvum
KASIN

SEQ ID NO: 2263656 - protein, 4 aa, Cryptosporidium parvum
KASK

SEQ ID NO: 2263657 - protein, 6 aa, Cryptosporidium parvum
KASKEK

SEQ ID NO: 2263658 - protein, 8 aa, Cryptosporidium parvum
KASKNEPI

SEQ ID NO: 2263659 - protein, 18 aa, Cryptosporidium parvum
KASKYPNNKKSESSTDNL

SEQ ID NO: 2263660 - protein, 8 aa, Cryptosporidium parvum
KASNDSEK

SEQ ID NO: 2263661 - protein, 6 aa, Cryptosporidium parvum
KASNEN

SEQ ID NO: 2263662 - protein, 19 aa, Cryptosporidium parvum
KASNHNEKPSQENISSLQS

SEQ ID NO: 2263663 - protein, 11 aa, Cryptosporidium parvum
KASNSKSVDER

SEQ ID NO: 2263664 - protein, 6 aa, Cryptosporidium parvum
KASPNG

SEQ ID NO: 2263665 - protein, 8 aa, Cryptosporidium parvum
KASQCHPN

SEQ ID NO: 2263666 - protein, 17 aa, Cryptosporidium parvum
KASQSNDDINSMIMSVK

SEQ ID NO: 2263667 - protein, 7 aa, Cryptosporidium parvum
KASRGSK

SEQ ID NO: 2263668 - protein, 4 aa, Cryptosporidium parvum
KASS

SEQ ID NO: 2263669 - protein, 7 aa, Cryptosporidium parvum
KASSDVL

SEQ ID NO: 2263670 - protein, 8 aa, Cryptosporidium parvum
KASSGGEV

SEQ ID NO: 2263671 - protein, 17 aa, Cryptosporidium parvum
KASSIQRAGRAGRLKPG

SEQ ID NO: 2263672 - protein, 8 aa, Cryptosporidium parvum
KASSNITN

SEQ ID NO: 2263673 - protein, 9 aa, Cryptosporidium parvum
KASTNHLSS

SEQ ID NO: 2263674 - protein, 7 aa, Cryptosporidium parvum
KASYSQR

SEQ ID NO: 2263675 - protein, 5 aa, Cryptosporidium parvum
KATAG

SEQ ID NO: 2263676 - protein, 12 aa, Cryptosporidium parvum
KATEDFSGDDDH

SEQ ID NO: 2263677 - protein, 26 aa, Cryptosporidium parvum
KATEEKKMEENEIKNNSSMKKVSNSI

SEQ ID NO: 2263678 - protein, 25 aa, Cryptosporidium parvum
KATEVSGREVTQDEASNSNTDNDCS

SEQ ID NO: 2263679 - protein, 5 aa, Cryptosporidium parvum
KATGA

SEQ ID NO: 2263680 - protein, 21 aa, Cryptosporidium parvum
KATGCNYSYSPGKETTSKNTI

SEQ ID NO: 2263681 - protein, 11 aa, Cryptosporidium parvum
KATKPQSSRNV

SEQ ID NO: 2263682 - protein, 15 aa, Cryptosporidium parvum
KATKSRMEQEKRQNY

SEQ ID NO: 2263683 - protein, 8 aa, Cryptosporidium parvum
KATPLSNS

SEQ ID NO: 2263684 - protein, 5 aa, Cryptosporidium parvum
KATQL

SEQ ID NO: 2263685 - protein, 12 aa, Cryptosporidium parvum
KATQRTKGVSTT

SEQ ID NO: 2263686 - protein, 9 aa, Cryptosporidium parvum
KATQYEQKY

SEQ ID NO: 2263687 - protein, 11 aa, Cryptosporidium parvum
KATSEKKLYDR

SEQ ID NO: 2263688 - protein, 11 aa, Cryptosporidium parvum
KATSKKDKYDK

SEQ ID NO: 2263689 - protein, 9 aa, Cryptosporidium parvum
KATTRPTDQ

SEQ ID NO: 2263690 - protein, 9 aa, Cryptosporidium parvum
KAVDNSGTT

SEQ ID NO: 2263691 - protein, 18 aa, Cryptosporidium parvum
KAVEQEDSVGGSNRRRQI

SEQ ID NO: 2263692 - protein, 13 aa, Cryptosporidium parvum
KAVKNESQSSEID

SEQ ID NO: 2263693 - protein, 13 aa, Cryptosporidium parvum
KAVPNLKNSGSSI

SEQ ID NO: 2263694 - protein, 6 aa, Cryptosporidium parvum
KAVSEV

SEQ ID NO: 2263695 - protein, 4 aa, Cryptosporidium parvum
KAVT

SEQ ID NO: 2263696 - protein, 4 aa, Cryptosporidium parvum
KAYL

SEQ ID NO: 2263697 - protein, 26 aa, Cryptosporidium parvum
KCANQLSNTDLKDNGIQRKSESKDIL

SEQ ID NO: 2263698 - protein, 22 aa, Cryptosporidium parvum
KCASENSQSGTSTCADSTSAED

SEQ ID NO: 2263699 - protein, 14 aa, Cryptosporidium parvum
KCDPDNKECNEGLK

SEQ ID NO: 2263700 - protein, 9 aa, Cryptosporidium parvum
KCEGFGERD

SEQ ID NO: 2263701 - protein, 13 aa, Cryptosporidium parvum
KCEGKKSSNRRIT

SEQ ID NO: 2263702 - protein, 7 aa, Cryptosporidium parvum
KCENKIE

SEQ ID NO: 2263703 - protein, 23 aa, Cryptosporidium parvum
KCENNQSQDQNDCDNDKINRSNW

SEQ ID NO: 2263704 - protein, 8 aa, Cryptosporidium parvum
KCETYGSE

SEQ ID NO: 2263705 - protein, 21 aa, Cryptosporidium parvum
KCGGTDLRSVGSSKTGSESIE

SEQ ID NO: 2263706 - protein, 7 aa, Cryptosporidium parvum
KCGNPKN

SEQ ID NO: 2263707 - protein, 21 aa, Cryptosporidium parvum
KCGSQNGKPTKSVCITASGVL

SEQ ID NO: 2263708 - protein, 6 aa, Cryptosporidium parvum
KCGSYP

SEQ ID NO: 2263709 - protein, 7 aa, Cryptosporidium parvum
KCGYTKS

SEQ ID NO: 2263710 - protein, 6 aa, Cryptosporidium parvum
KCKENI

SEQ ID NO: 2263711 - protein, 20 aa, Cryptosporidium parvum
KCKETKKLDLDEKKKENIRQ

SEQ ID NO: 2263712 - protein, 8 aa, Cryptosporidium parvum
KCKNSGNL

SEQ ID NO: 2263713 - protein, 6 aa, Cryptosporidium parvum
KCKPGD

SEQ ID NO: 2263714 - protein, 9 aa, Cryptosporidium parvum
KCKSQAHYT

SEQ ID NO: 2263715 - protein, 4 aa, Cryptosporidium parvum
KCNN

SEQ ID NO: 2263716 - protein, 6 aa, Cryptosporidium parvum
KCNNSE

SEQ ID NO: 2263717 - protein, 6 aa, Cryptosporidium parvum
KCNSPA

SEQ ID NO: 2263718 - protein, 5 aa, Cryptosporidium parvum
KCPPK

SEQ ID NO: 2263719 - protein, 5 aa, Cryptosporidium parvum
KCQSS

SEQ ID NO: 2263720 - protein, 14 aa, Cryptosporidium parvum
KCQTKNDKERDRER

SEQ ID NO: 2263721 - protein, 7 aa, Cryptosporidium parvum
KCSAEAS

SEQ ID NO: 2263722 - protein, 11 aa, Cryptosporidium parvum
KCSDSRNSMVS

SEQ ID NO: 2263723 - protein, 6 aa, Cryptosporidium parvum
KCSKNA

SEQ ID NO: 2263724 - protein, 10 aa, Cryptosporidium parvum
KCSNQNKSEM

SEQ ID NO: 2263725 - protein, 6 aa, Cryptosporidium parvum
KCTGQY

SEQ ID NO: 2263726 - protein, 10 aa, Cryptosporidium parvum
KCTKSTLSDI

SEQ ID NO: 2263727 - protein, 11 aa, Cryptosporidium parvum
KCTPPAFKSSP

SEQ ID NO: 2263728 - protein, 26 aa, Cryptosporidium parvum
KCTPTEAANELTKEAEKKGSLDDKTA

SEQ ID NO: 2263729 - protein, 7 aa, Cryptosporidium parvum
KDAEINR

SEQ ID NO: 2263730 - protein, 4 aa, Cryptosporidium parvum
KDAF

SEQ ID NO: 2263731 - protein, 7 aa, Cryptosporidium parvum
KDANDNR

SEQ ID NO: 2263732 - protein, 7 aa, Cryptosporidium parvum
KDAPTSW

SEQ ID NO: 2263733 - protein, 6 aa, Cryptosporidium parvum
KDAQGL

SEQ ID NO: 2263734 - protein, 19 aa, Cryptosporidium parvum
KDASEKSSSSTSIKAESLE

SEQ ID NO: 2263735 - protein, 11 aa, Cryptosporidium parvum
KDASKNMEATS

SEQ ID NO: 2263736 - protein, 7 aa, Cryptosporidium parvum
KDASNHY

SEQ ID NO: 2263737 - protein, 9 aa, Cryptosporidium parvum
KDASSDLDI

SEQ ID NO: 2263738 - protein, 4 aa, Cryptosporidium parvum
KDAY

SEQ ID NO: 2263739 - protein, 21 aa, Cryptosporidium parvum
KDCNNNSNSNIGNDIDKKDYS

SEQ ID NO: 2263740 - protein, 7 aa, Cryptosporidium parvum
KDCQEKS

SEQ ID NO: 2263741 - protein, 14 aa, Cryptosporidium parvum
KDCQNFSSKQREAN

SEQ ID NO: 2263742 - protein, 12 aa, Cryptosporidium parvum
KDCRGLESNRDS

SEQ ID NO: 2263743 - protein, 7 aa, Cryptosporidium parvum
KDCSKED

SEQ ID NO: 2263744 - protein, 19 aa, Cryptosporidium parvum
KDCVNPSGTSSETANVGND

SEQ ID NO: 2263745 - protein, 7 aa, Cryptosporidium parvum
KDCYSNG

SEQ ID NO: 2263746 - protein, 9 aa, Cryptosporidium parvum
KDDEDDCDQ

SEQ ID NO: 2263747 - protein, 17 aa, Cryptosporidium parvum
KDDEDEEERDRSGKGKF

SEQ ID NO: 2263748 - protein, 6 aa, Cryptosporidium parvum
KDDEDI

SEQ ID NO: 2263749 - protein, 7 aa, Cryptosporidium parvum
KDDEEVC

SEQ ID NO: 2263750 - protein, 7 aa, Cryptosporidium parvum
KDDEKNY

SEQ ID NO: 2263751 - protein, 8 aa, Cryptosporidium parvum
KDDENDYT

SEQ ID NO: 2263752 - protein, 13 aa, Cryptosporidium parvum
KDDEYSKMTQTNA

SEQ ID NO: 2263753 - protein, 4 aa, Cryptosporidium parvum
KDDG

SEQ ID NO: 2263754 - protein, 11 aa, Cryptosporidium parvum
KDDGEKSALPL

SEQ ID NO: 2263755 - protein, 9 aa, Cryptosporidium parvum
KDDGNSEKI

SEQ ID NO: 2263756 - protein, 8 aa, Cryptosporidium parvum
KDDHDNRR

SEQ ID NO: 2263757 - protein, 8 aa, Cryptosporidium parvum
KDDIKDNE

SEQ ID NO: 2263758 - protein, 9 aa, Cryptosporidium parvum
KDDISSNSL

SEQ ID NO: 2263759 - protein, 33 aa, Cryptosporidium parvum
KDDKIEAKEVTNYSKNTTECGSSSKTTIKSISK

SEQ ID NO: 2263760 - protein, 7 aa, Cryptosporidium parvum
KDDKLTY

SEQ ID NO: 2263761 - protein, 13 aa, Cryptosporidium parvum
KDDKTVVTGDRAD

SEQ ID NO: 2263762 - protein, 9 aa, Cryptosporidium parvum
KDDNKTVAL

SEQ ID NO: 2263763 - protein, 7 aa, Cryptosporidium parvum
KDDRLGQ

SEQ ID NO: 2263764 - protein, 12 aa, Cryptosporidium parvum
KDDSKRFSSPSS

SEQ ID NO: 2263765 - protein, 7 aa, Cryptosporidium parvum
KDDSLSS

SEQ ID NO: 2263766 - protein, 5 aa, Cryptosporidium parvum
KDDVS

SEQ ID NO: 2263767 - protein, 4 aa, Cryptosporidium parvum
KDDY

SEQ ID NO: 2263768 - protein, 25 aa, Cryptosporidium parvum
KDEADDDITSSDEDLSDEDEKGLGP

SEQ ID NO: 2263769 - protein, 11 aa, Cryptosporidium parvum
KDECTKLEQSE

SEQ ID NO: 2263770 - protein, 14 aa, Cryptosporidium parvum
KDEDINEESEKSKY

SEQ ID NO: 2263771 - protein, 6 aa, Cryptosporidium parvum
KDEDKI

SEQ ID NO: 2263772 - protein, 6 aa, Cryptosporidium parvum
KDEDLR

SEQ ID NO: 2263773 - protein, 19 aa, Cryptosporidium parvum
KDEEIQEKKSRKSISASPI

SEQ ID NO: 2263774 - protein, 7 aa, Cryptosporidium parvum
KDEEISD

SEQ ID NO: 2263775 - protein, 13 aa, Cryptosporidium parvum
KDEEKNKRTQKIK

SEQ ID NO: 2263776 - protein, 8 aa, Cryptosporidium parvum
KDEEKNQC

SEQ ID NO: 2263777 - protein, 13 aa, Cryptosporidium parvum
KDEELDDYDDQEI

SEQ ID NO: 2263778 - protein, 21 aa, Cryptosporidium parvum
KDEELGETVSPRKQNITNSAN

SEQ ID NO: 2263779 - protein, 7 aa, Cryptosporidium parvum
KDEEMED

SEQ ID NO: 2263780 - protein, 5 aa, Cryptosporidium parvum
KDEEQ

SEQ ID NO: 2263781 - protein, 8 aa, Cryptosporidium parvum
KDEETAIK

SEQ ID NO: 2263782 - protein, 7 aa, Cryptosporidium parvum
KDEFSNY

SEQ ID NO: 2263783 - protein, 4 aa, Cryptosporidium parvum
KDEI

SEQ ID NO: 2263784 - protein, 6 aa, Cryptosporidium parvum
KDEIAR

SEQ ID NO: 2263785 - protein, 7 aa, Cryptosporidium parvum
KDEIDQF

SEQ ID NO: 2263786 - protein, 7 aa, Cryptosporidium parvum
KDEILEN

SEQ ID NO: 2263787 - protein, 6 aa, Cryptosporidium parvum
KDEISR

SEQ ID NO: 2263788 - protein, 5 aa, Cryptosporidium parvum
KDEIT

SEQ ID NO: 2263789 - protein, 16 aa, Cryptosporidium parvum
KDEKDENYEDMGSIDS

SEQ ID NO: 2263790 - protein, 7 aa, Cryptosporidium parvum
KDEKKVD

SEQ ID NO: 2263791 - protein, 11 aa, Cryptosporidium parvum
KDEKSDRNQEW

SEQ ID NO: 2263792 - protein, 10 aa, Cryptosporidium parvum
KDEKSQSMES

SEQ ID NO: 2263793 - protein, 5 aa, Cryptosporidium parvum
KDEKV

SEQ ID NO: 2263794 - protein, 6 aa, Cryptosporidium parvum
KDELDE

SEQ ID NO: 2263795 - protein, 17 aa, Cryptosporidium parvum
KDELEEKVNENNNISAE

SEQ ID NO: 2263796 - protein, 6 aa, Cryptosporidium parvum
KDELEN

SEQ ID NO: 2263797 - protein, 14 aa, Cryptosporidium parvum
KDELPSTKTNQEGH

SEQ ID NO: 2263798 - protein, 14 aa, Cryptosporidium parvum
KDENDADKQTYNGT

SEQ ID NO: 2263799 - protein, 6 aa, Cryptosporidium parvum
KDENKL

SEQ ID NO: 2263800 - protein, 8 aa, Cryptosporidium parvum
KDENNKAF

SEQ ID NO: 2263801 - protein, 17 aa, Cryptosporidium parvum
KDENNNINDSNNEDIQD

SEQ ID NO: 2263802 - protein, 12 aa, Cryptosporidium parvum
KDENQDSSQLTG

SEQ ID NO: 2263803 - protein, 8 aa, Cryptosporidium parvum
KDENRKRK

SEQ ID NO: 2263804 - protein, 7 aa, Cryptosporidium parvum
KDEPALS

SEQ ID NO: 2263805 - protein, 5 aa, Cryptosporidium parvum
KDEPE

SEQ ID NO: 2263806 - protein, 20 aa, Cryptosporidium parvum
KDEPEDEVIQEESNELGESE

SEQ ID NO: 2263807 - protein, 8 aa, Cryptosporidium parvum
KDEQEQEL

SEQ ID NO: 2263808 - protein, 13 aa, Cryptosporidium parvum
KDEQGYSTIRQVD

SEQ ID NO: 2263809 - protein, 10 aa, Cryptosporidium parvum
KDEQKGLKRE

SEQ ID NO: 2263810 - protein, 7 aa, Cryptosporidium parvum
KDEQNKH

SEQ ID NO: 2263811 - protein, 21 aa, Cryptosporidium parvum
KDESCQKSQKKVGLTNNPITK

SEQ ID NO: 2263812 - protein, 9 aa, Cryptosporidium parvum
KDESKEGKI

SEQ ID NO: 2263813 - protein, 12 aa, Cryptosporidium parvum
KDESKTQYETSF

SEQ ID NO: 2263814 - protein, 5 aa, Cryptosporidium parvum
KDEVI

SEQ ID NO: 2263815 - protein, 12 aa, Cryptosporidium parvum
KDEYLKENEDPD

SEQ ID NO: 2263816 - protein, 11 aa, Cryptosporidium parvum
KDFASTPLPSY

SEQ ID NO: 2263817 - protein, 14 aa, Cryptosporidium parvum
KDFDKDEKNELNNN

SEQ ID NO: 2263818 - protein, 8 aa, Cryptosporidium parvum
KDFDKPGA

SEQ ID NO: 2263819 - protein, 5 aa, Cryptosporidium parvum
KDFEP

SEQ ID NO: 2263820 - protein, 5 aa, Cryptosporidium parvum
KDFQN

SEQ ID NO: 2263821 - protein, 13 aa, Cryptosporidium parvum
KDFSSEPDNKLES

SEQ ID NO: 2263822 - protein, 12 aa, Cryptosporidium parvum
KDFTDKSSNIYK

SEQ ID NO: 2263823 - protein, 14 aa, Cryptosporidium parvum
KDFTGGTSWYESPE

SEQ ID NO: 2263824 - protein, 13 aa, Cryptosporidium parvum
KDGADASMSKRPL

SEQ ID NO: 2263825 - protein, 11 aa, Cryptosporidium parvum
KDGDGSITTKE

SEQ ID NO: 2263826 - protein, 23 aa, Cryptosporidium parvum
KDGEDGKVGESSVGGSSSYNSGI

SEQ ID NO: 2263827 - protein, 6 aa, Cryptosporidium parvum
KDGELK

SEQ ID NO: 2263828 - protein, 5 aa, Cryptosporidium parvum
KDGGF

SEQ ID NO: 2263829 - protein, 7 aa, Cryptosporidium parvum
KDGGKKK

SEQ ID NO: 2263830 - protein, 5 aa, Cryptosporidium parvum
KDGGV

SEQ ID NO: 2263831 - protein, 5 aa, Cryptosporidium parvum
KDGGY

SEQ ID NO: 2263832 - protein, 5 aa, Cryptosporidium parvum
KDGHV

SEQ ID NO: 2263833 - protein, 6 aa, Cryptosporidium parvum
KDGIDG

SEQ ID NO: 2263834 - protein, 5 aa, Cryptosporidium parvum
KDGIE

SEQ ID NO: 2263835 - protein, 21 aa, Cryptosporidium parvum
KDGIEESRKKKDKAEQELSPL

SEQ ID NO: 2263836 - protein, 10 aa, Cryptosporidium parvum
KDGIESKPPH

SEQ ID NO: 2263837 - protein, 10 aa, Cryptosporidium parvum
KDGKLSAKRI

SEQ ID NO: 2263838 - protein, 6 aa, Cryptosporidium parvum
KDGKNV

SEQ ID NO: 2263839 - protein, 8 aa, Cryptosporidium parvum
KDGKSRGY

SEQ ID NO: 2263840 - protein, 8 aa, Cryptosporidium parvum
KDGKSTIA

SEQ ID NO: 2263841 - protein, 5 aa, Cryptosporidium parvum
KDGKV

SEQ ID NO: 2263842 - protein, 5 aa, Cryptosporidium parvum
KDGLG

SEQ ID NO: 2263843 - protein, 12 aa, Cryptosporidium parvum
KDGNDDKEVKTN

SEQ ID NO: 2263844 - protein, 7 aa, Cryptosporidium parvum
KDGNGRN

SEQ ID NO: 2263845 - protein, 4 aa, Cryptosporidium parvum
KDGP

SEQ ID NO: 2263846 - protein, 7 aa, Cryptosporidium parvum
KDGPDIP

SEQ ID NO: 2263847 - protein, 8 aa, Cryptosporidium parvum
KDGPHKGF

SEQ ID NO: 2263848 - protein, 8 aa, Cryptosporidium parvum
KDGQVDGD

SEQ ID NO: 2263849 - protein, 14 aa, Cryptosporidium parvum
KDGRLPQKKEFKGS

SEQ ID NO: 2263850 - protein, 11 aa, Cryptosporidium parvum
KDGRTAYTGGK

SEQ ID NO: 2263851 - protein, 7 aa, Cryptosporidium parvum
KDGSDLP

SEQ ID NO: 2263852 - protein, 10 aa, Cryptosporidium parvum
KDGSGKISTK

SEQ ID NO: 2263853 - protein, 11 aa, Cryptosporidium parvum
KDGTISKNKGT

SEQ ID NO: 2263854 - protein, 6 aa, Cryptosporidium parvum
KDGVDD

SEQ ID NO: 2263855 - protein, 4 aa, Cryptosporidium parvum
KDGY

SEQ ID NO: 2263856 - protein, 6 aa, Cryptosporidium parvum
KDHDDE

SEQ ID NO: 2263857 - protein, 16 aa, Cryptosporidium parvum
KDHEEYEGSQTREENC

SEQ ID NO: 2263858 - protein, 6 aa, Cryptosporidium parvum
KDHELN

SEQ ID NO: 2263859 - protein, 4 aa, Cryptosporidium parvum
KDHH

SEQ ID NO: 2263860 - protein, 4 aa, Cryptosporidium parvum
KDHI

SEQ ID NO: 2263861 - protein, 10 aa, Cryptosporidium parvum
KDHSKGCETQ

SEQ ID NO: 2263862 - protein, 76 aa, Cryptosporidium parvum
KDIDSDTQLKEKLQENNNNKIDNQENDQDKLEVDNNNNSDDSESDDSETDDSETDDSESNDSETDEKEEKSENEAY

SEQ ID NO: 2263863 - protein, 6 aa, Cryptosporidium parvum
KDIDSS

SEQ ID NO: 2263864 - protein, 19 aa, Cryptosporidium parvum
KDIEKSRKKMNVEEGNRKI

SEQ ID NO: 2263865 - protein, 6 aa, Cryptosporidium parvum
KDIENE

SEQ ID NO: 2263866 - protein, 18 aa, Cryptosporidium parvum
KDIGSPSKSLSKTLAPPS

SEQ ID NO: 2263867 - protein, 6 aa, Cryptosporidium parvum
KDIHTK

SEQ ID NO: 2263868 - protein, 15 aa, Cryptosporidium parvum
KDIKENDENGQGISN

SEQ ID NO: 2263869 - protein, 14 aa, Cryptosporidium parvum
KDIKPISKTELNNS

SEQ ID NO: 2263870 - protein, 9 aa, Cryptosporidium parvum
KDIKSESSR

SEQ ID NO: 2263871 - protein, 8 aa, Cryptosporidium parvum
KDINENIG

SEQ ID NO: 2263872 - protein, 8 aa, Cryptosporidium parvum
KDINEQSN

SEQ ID NO: 2263873 - protein, 8 aa, Cryptosporidium parvum
KDINQNNK

SEQ ID NO: 2263874 - protein, 15 aa, Cryptosporidium parvum
KDIQKKDDNKRRKID

SEQ ID NO: 2263875 - protein, 6 aa, Cryptosporidium parvum
KDIRQR

SEQ ID NO: 2263876 - protein, 8 aa, Cryptosporidium parvum
KDISNSSL

SEQ ID NO: 2263877 - protein, 6 aa, Cryptosporidium parvum
KDKADY

SEQ ID NO: 2263878 - protein, 9 aa, Cryptosporidium parvum
KDKALRAAQ

SEQ ID NO: 2263879 - protein, 9 aa, Cryptosporidium parvum
KDKANSLYS

SEQ ID NO: 2263880 - protein, 26 aa, Cryptosporidium parvum
KDKCGEKSLPATAVETGNKDQEITKS

SEQ ID NO: 2263881 - protein, 14 aa, Cryptosporidium parvum
KDKCYPKKQPIPDF

SEQ ID NO: 2263882 - protein, 9 aa, Cryptosporidium parvum
KDKDDKHQA

SEQ ID NO: 2263883 - protein, 7 aa, Cryptosporidium parvum
KDKDDPF

SEQ ID NO: 2263884 - protein, 7 aa, Cryptosporidium parvum
KDKDEVS

SEQ ID NO: 2263885 - protein, 12 aa, Cryptosporidium parvum
KDKDNKSPGRGL

SEQ ID NO: 2263886 - protein, 13 aa, Cryptosporidium parvum
KDKDNSPVTTADL

SEQ ID NO: 2263887 - protein, 9 aa, Cryptosporidium parvum
KDKDSPEKL

SEQ ID NO: 2263888 - protein, 8 aa, Cryptosporidium parvum
KDKESPDY

SEQ ID NO: 2263889 - protein, 14 aa, Cryptosporidium parvum
KDKFEDNEETRKKI

SEQ ID NO: 2263890 - protein, 6 aa, Cryptosporidium parvum
KDKGIR

SEQ ID NO: 2263891 - protein, 18 aa, Cryptosporidium parvum
KDKGKGKNNSKNQTFQGS

SEQ ID NO: 2263892 - protein, 5 aa, Cryptosporidium parvum
KDKIL

SEQ ID NO: 2263893 - protein, 8 aa, Cryptosporidium parvum
KDKIYTSD

SEQ ID NO: 2263894 - protein, 6 aa, Cryptosporidium parvum
KDKKQM

SEQ ID NO: 2263895 - protein, 7 aa, Cryptosporidium parvum
KDKKSPL

SEQ ID NO: 2263896 - protein, 13 aa, Cryptosporidium parvum
KDKLDSSELSQES

SEQ ID NO: 2263897 - protein, 16 aa, Cryptosporidium parvum
KDKLEKSKKETKTCSD

SEQ ID NO: 2263898 - protein, 9 aa, Cryptosporidium parvum
KDKNDTNFF

SEQ ID NO: 2263899 - protein, 9 aa, Cryptosporidium parvum
KDKNQNDEN

SEQ ID NO: 2263900 - protein, 17 aa, Cryptosporidium parvum
KDKPLKPGRTYKIPSRN

SEQ ID NO: 2263901 - protein, 9 aa, Cryptosporidium parvum
KDKQIKRDL

SEQ ID NO: 2263902 - protein, 10 aa, Cryptosporidium parvum
KDKRIASTCS

SEQ ID NO: 2263903 - protein, 10 aa, Cryptosporidium parvum
KDKVKKRKNW

SEQ ID NO: 2263904 - protein, 8 aa, Cryptosporidium parvum
KDKVKNDT

SEQ ID NO: 2263905 - protein, 9 aa, Cryptosporidium parvum
KDLDSAQEK

SEQ ID NO: 2263906 - protein, 8 aa, Cryptosporidium parvum
KDLDTLST

SEQ ID NO: 2263907 - protein, 8 aa, Cryptosporidium parvum
KDLEAARE

SEQ ID NO: 2263908 - protein, 20 aa, Cryptosporidium parvum
KDLEYKKEYKEEDNDEEKDV

SEQ ID NO: 2263909 - protein, 10 aa, Cryptosporidium parvum
KDLEYSSRDD

SEQ ID NO: 2263910 - protein, 11 aa, Cryptosporidium parvum
KDLKADSEALN

SEQ ID NO: 2263911 - protein, 12 aa, Cryptosporidium parvum
KDLKDEKSGIND

SEQ ID NO: 2263912 - protein, 6 aa, Cryptosporidium parvum
KDLKGQ

SEQ ID NO: 2263913 - protein, 23 aa, Cryptosporidium parvum
KDLNDENQSENIEMENDNESIKG

SEQ ID NO: 2263914 - protein, 11 aa, Cryptosporidium parvum
KDLNSRPENNY

SEQ ID NO: 2263915 - protein, 12 aa, Cryptosporidium parvum
KDLPKHSDESLA

SEQ ID NO: 2263916 - protein, 15 aa, Cryptosporidium parvum
KDLPRRGPTLSSSAA

SEQ ID NO: 2263917 - protein, 10 aa, Cryptosporidium parvum
KDLQNEKENL

SEQ ID NO: 2263918 - protein, 6 aa, Cryptosporidium parvum
KDLSFD

SEQ ID NO: 2263919 - protein, 9 aa, Cryptosporidium parvum
KDLSKKGIH

SEQ ID NO: 2263920 - protein, 6 aa, Cryptosporidium parvum
KDMSTD

SEQ ID NO: 2263921 - protein, 13 aa, Cryptosporidium parvum
KDNDDEVRDRTNT

SEQ ID NO: 2263922 - protein, 5 aa, Cryptosporidium parvum
KDNDK

SEQ ID NO: 2263923 - protein, 22 aa, Cryptosporidium parvum
KDNEKNPSSLKNDQNKKNRFRN

SEQ ID NO: 2263924 - protein, 9 aa, Cryptosporidium parvum
KDNEMNKET

SEQ ID NO: 2263925 - protein, 8 aa, Cryptosporidium parvum
KDNESNNK

SEQ ID NO: 2263926 - protein, 6 aa, Cryptosporidium parvum
KDNHIT

SEQ ID NO: 2263927 - protein, 20 aa, Cryptosporidium parvum
KDNHQNQITRRTSETEFGYN

SEQ ID NO: 2263928 - protein, 9 aa, Cryptosporidium parvum
KDNHTDKSE

SEQ ID NO: 2263929 - protein, 7 aa, Cryptosporidium parvum
KDNIPQT

SEQ ID NO: 2263930 - protein, 7 aa, Cryptosporidium parvum
KDNKDAM

SEQ ID NO: 2263931 - protein, 16 aa, Cryptosporidium parvum
KDNKDSVNAQKEKRKK

SEQ ID NO: 2263932 - protein, 18 aa, Cryptosporidium parvum
KDNKHKKNDNTNNSHKDH

SEQ ID NO: 2263933 - protein, 10 aa, Cryptosporidium parvum
KDNKQNSLRD

SEQ ID NO: 2263934 - protein, 8 aa, Cryptosporidium parvum
KDNLGRNG

SEQ ID NO: 2263935 - protein, 9 aa, Cryptosporidium parvum
KDNNERELE

SEQ ID NO: 2263936 - protein, 10 aa, Cryptosporidium parvum
KDNNKANSEI

SEQ ID NO: 2263937 - protein, 6 aa, Cryptosporidium parvum
KDNNQN

SEQ ID NO: 2263938 - protein, 22 aa, Cryptosporidium parvum
KDNNSDMSSSENNSSNELKPNS

SEQ ID NO: 2263939 - protein, 7 aa, Cryptosporidium parvum
KDNNSKK

SEQ ID NO: 2263940 - protein, 6 aa, Cryptosporidium parvum
KDNQGP

SEQ ID NO: 2263941 - protein, 6 aa, Cryptosporidium parvum
KDNSEQ

SEQ ID NO: 2263942 - protein, 8 aa, Cryptosporidium parvum
KDNSGECT

SEQ ID NO: 2263943 - protein, 13 aa, Cryptosporidium parvum
KDNSNMSESNNNL

SEQ ID NO: 2263944 - protein, 10 aa, Cryptosporidium parvum
KDNSSGDRSF

SEQ ID NO: 2263945 - protein, 7 aa, Cryptosporidium parvum
KDNTIEN

SEQ ID NO: 2263946 - protein, 9 aa, Cryptosporidium parvum
KDPAEIPWG

SEQ ID NO: 2263947 - protein, 6 aa, Cryptosporidium parvum
KDPEFS

SEQ ID NO: 2263948 - protein, 7 aa, Cryptosporidium parvum
KDPEIQE

SEQ ID NO: 2263949 - protein, 7 aa, Cryptosporidium parvum
KDPETGR

SEQ ID NO: 2263950 - protein, 8 aa, Cryptosporidium parvum
KDPGFSKN

SEQ ID NO: 2263951 - protein, 8 aa, Cryptosporidium parvum
KDPGLSSA

SEQ ID NO: 2263952 - protein, 4 aa, Cryptosporidium parvum
KDPI

SEQ ID NO: 2263953 - protein, 8 aa, Cryptosporidium parvum
KDPKARLK

SEQ ID NO: 2263954 - protein, 9 aa, Cryptosporidium parvum
KDPKSQSSL

SEQ ID NO: 2263955 - protein, 10 aa, Cryptosporidium parvum
KDPNPKKDIE

SEQ ID NO: 2263956 - protein, 8 aa, Cryptosporidium parvum
KDPNTNRK

SEQ ID NO: 2263957 - protein, 13 aa, Cryptosporidium parvum
KDPPEKESEVGNQ

SEQ ID NO: 2263958 - protein, 18 aa, Cryptosporidium parvum
KDPSVDTKNITRQKVPGF

SEQ ID NO: 2263959 - protein, 6 aa, Cryptosporidium parvum
KDPSYI

SEQ ID NO: 2263960 - protein, 8 aa, Cryptosporidium parvum
KDPTHQTE

SEQ ID NO: 2263961 - protein, 4 aa, Cryptosporidium parvum
KDPV

SEQ ID NO: 2263962 - protein, 4 aa, Cryptosporidium parvum
KDPY

SEQ ID NO: 2263963 - protein, 9 aa, Cryptosporidium parvum
KDQAENASI

SEQ ID NO: 2263964 - protein, 22 aa, Cryptosporidium parvum
KDQAKSKSWASRKGMNPEDAAN

SEQ ID NO: 2263965 - protein, 6 aa, Cryptosporidium parvum
KDQDRA

SEQ ID NO: 2263966 - protein, 11 aa, Cryptosporidium parvum
KDQEENKGDIH

SEQ ID NO: 2263967 - protein, 6 aa, Cryptosporidium parvum
KDQEIN

SEQ ID NO: 2263968 - protein, 6 aa, Cryptosporidium parvum
KDQESI

SEQ ID NO: 2263969 - protein, 7 aa, Cryptosporidium parvum
KDQHDND

SEQ ID NO: 2263970 - protein, 6 aa, Cryptosporidium parvum
KDQISE

SEQ ID NO: 2263971 - protein, 4 aa, Cryptosporidium parvum
KDQK

SEQ ID NO: 2263972 - protein, 9 aa, Cryptosporidium parvum
KDQKGVKGE

SEQ ID NO: 2263973 - protein, 18 aa, Cryptosporidium parvum
KDQKVASNEYSMKEEEDV

SEQ ID NO: 2263974 - protein, 23 aa, Cryptosporidium parvum
KDQNLSELPETSDKNEDTLEDQV

SEQ ID NO: 2263975 - protein, 7 aa, Cryptosporidium parvum
KDQNTNL

SEQ ID NO: 2263976 - protein, 6 aa, Cryptosporidium parvum
KDQSKF

SEQ ID NO: 2263977 - protein, 6 aa, Cryptosporidium parvum
KDQSNQ

SEQ ID NO: 2263978 - protein, 6 aa, Cryptosporidium parvum
KDQTEF

SEQ ID NO: 2263979 - protein, 4 aa, Cryptosporidium parvum
KDRC

SEQ ID NO: 2263980 - protein, 7 aa, Cryptosporidium parvum
KDRDGCP

SEQ ID NO: 2263981 - protein, 4 aa, Cryptosporidium parvum
KDRE

SEQ ID NO: 2263982 - protein, 7 aa, Cryptosporidium parvum
KDREGES

SEQ ID NO: 2263983 - protein, 16 aa, Cryptosporidium parvum
KDREQPNLKDASTLNT

SEQ ID NO: 2263984 - protein, 14 aa, Cryptosporidium parvum
KDRERELDEKERQL

SEQ ID NO: 2263985 - protein, 6 aa, Cryptosporidium parvum
KDRHPK

SEQ ID NO: 2263986 - protein, 7 aa, Cryptosporidium parvum
KDRKGEI

SEQ ID NO: 2263987 - protein, 5 aa, Cryptosporidium parvum
KDRPI

SEQ ID NO: 2263988 - protein, 9 aa, Cryptosporidium parvum
KDRPSSLET

SEQ ID NO: 2263989 - protein, 14 aa, Cryptosporidium parvum
KDRRSANQADQIPG

SEQ ID NO: 2263990 - protein, 6 aa, Cryptosporidium parvum
KDRSDR

SEQ ID NO: 2263991 - protein, 10 aa, Cryptosporidium parvum
KDRTSERSKL

SEQ ID NO: 2263992 - protein, 4 aa, Cryptosporidium parvum
KDRY

SEQ ID NO: 2263993 - protein, 4 aa, Cryptosporidium parvum
KDSA

SEQ ID NO: 2263994 - protein, 17 aa, Cryptosporidium parvum
KDSDEIEDSSIHDNELS

SEQ ID NO: 2263995 - protein, 17 aa, Cryptosporidium parvum
KDSDLVKDSDFEKDEKL

SEQ ID NO: 2263996 - protein, 13 aa, Cryptosporidium parvum
KDSDWNMSLKKLW

SEQ ID NO: 2263997 - protein, 4 aa, Cryptosporidium parvum
KDSE

SEQ ID NO: 2263998 - protein, 8 aa, Cryptosporidium parvum
KDSEEIKT

SEQ ID NO: 2263999 - protein, 6 aa, Cryptosporidium parvum
KDSENF

SEQ ID NO: 2264000 - protein, 7 aa, Cryptosporidium parvum
KDSENGE

SEQ ID NO: 2264001 - protein, 12 aa, Cryptosporidium parvum
KDSEQENNESMI

SEQ ID NO: 2264002 - protein, 8 aa, Cryptosporidium parvum
KDSESIVD

SEQ ID NO: 2264003 - protein, 5 aa, Cryptosporidium parvum
KDSFG

SEQ ID NO: 2264004 - protein, 6 aa, Cryptosporidium parvum
KDSGGY

SEQ ID NO: 2264005 - protein, 9 aa, Cryptosporidium parvum
KDSGPLEDR

SEQ ID NO: 2264006 - protein, 6 aa, Cryptosporidium parvum
KDSGRL

SEQ ID NO: 2264007 - protein, 9 aa, Cryptosporidium parvum
KDSGTTIDN

SEQ ID NO: 2264008 - protein, 6 aa, Cryptosporidium parvum
KDSGVF

SEQ ID NO: 2264009 - protein, 8 aa, Cryptosporidium parvum
KDSIGSYY

SEQ ID NO: 2264010 - protein, 28 aa, Cryptosporidium parvum
KDSIQQEVNSKENQPPESGGYKHRENDG

SEQ ID NO: 2264011 - protein, 14 aa, Cryptosporidium parvum
KDSKDGNLGVSNNT

SEQ ID NO: 2264012 - protein, 7 aa, Cryptosporidium parvum
KDSKEEN

SEQ ID NO: 2264013 - protein, 18 aa, Cryptosporidium parvum
KDSKNEQTIQDHAENTIE

SEQ ID NO: 2264014 - protein, 6 aa, Cryptosporidium parvum
KDSKNS

SEQ ID NO: 2264015 - protein, 9 aa, Cryptosporidium parvum
KDSKRQRNH

SEQ ID NO: 2264016 - protein, 8 aa, Cryptosporidium parvum
KDSKTKQA

SEQ ID NO: 2264017 - protein, 7 aa, Cryptosporidium parvum
KDSLRNN

SEQ ID NO: 2264018 - protein, 13 aa, Cryptosporidium parvum
KDSLTKNKDPQAN

SEQ ID NO: 2264019 - protein, 7 aa, Cryptosporidium parvum
KDSNAQC

SEQ ID NO: 2264020 - protein, 7 aa, Cryptosporidium parvum
KDSNDRR

SEQ ID NO: 2264021 - protein, 8 aa, Cryptosporidium parvum
KDSNKRQR

SEQ ID NO: 2264022 - protein, 13 aa, Cryptosporidium parvum
KDSNKVIQNSSSL

SEQ ID NO: 2264023 - protein, 8 aa, Cryptosporidium parvum
KDSNQYRQ

SEQ ID NO: 2264024 - protein, 20 aa, Cryptosporidium parvum
KDSPLKKTSATSDPSSGMGN

SEQ ID NO: 2264025 - protein, 9 aa, Cryptosporidium parvum
KDSPPASQL

SEQ ID NO: 2264026 - protein, 8 aa, Cryptosporidium parvum
KDSPSHSL

SEQ ID NO: 2264027 - protein, 19 aa, Cryptosporidium parvum
KDSQESQNKNESNKSNGPI

SEQ ID NO: 2264028 - protein, 8 aa, Cryptosporidium parvum
KDSQGNYG

SEQ ID NO: 2264029 - protein, 9 aa, Cryptosporidium parvum
KDSQKLEKI

SEQ ID NO: 2264030 - protein, 5 aa, Cryptosporidium parvum
KDSQS

SEQ ID NO: 2264031 - protein, 9 aa, Cryptosporidium parvum
KDSQSDTSV

SEQ ID NO: 2264032 - protein, 5 aa, Cryptosporidium parvum
KDSRE

SEQ ID NO: 2264033 - protein, 5 aa, Cryptosporidium parvum
KDSRI

SEQ ID NO: 2264034 - protein, 11 aa, Cryptosporidium parvum
KDSRTSKDPIV

SEQ ID NO: 2264035 - protein, 60 aa, Cryptosporidium parvum
KDSSKEDNDNYDEEEEEEEEEEEEEEEEEEDEDDDDEDDDDDEVNDYKESIKEEYNSSQL

SEQ ID NO: 2264036 - protein, 8 aa, Cryptosporidium parvum
KDSSKTKN

SEQ ID NO: 2264037 - protein, 6 aa, Cryptosporidium parvum
KDSSLS

SEQ ID NO: 2264038 - protein, 12 aa, Cryptosporidium parvum
KDSSTTKNLSSK

SEQ ID NO: 2264039 - protein, 8 aa, Cryptosporidium parvum
KDSTITNS

SEQ ID NO: 2264040 - protein, 9 aa, Cryptosporidium parvum
KDSTKSYNN

SEQ ID NO: 2264041 - protein, 6 aa, Cryptosporidium parvum
KDSTRI

SEQ ID NO: 2264042 - protein, 20 aa, Cryptosporidium parvum
KDSVENGLDNINSEKEELEK

SEQ ID NO: 2264043 - protein, 24 aa, Cryptosporidium parvum
KDSYSCGASQQNDLSSADIDKSRV

SEQ ID NO: 2264044 - protein, 9 aa, Cryptosporidium parvum
KDTCEQGGS

SEQ ID NO: 2264045 - protein, 5 aa, Cryptosporidium parvum
KDTCQ

SEQ ID NO: 2264046 - protein, 8 aa, Cryptosporidium parvum
KDTDTEDE

SEQ ID NO: 2264047 - protein, 4 aa, Cryptosporidium parvum
KDTE

SEQ ID NO: 2264048 - protein, 9 aa, Cryptosporidium parvum
KDTEEMEYA

SEQ ID NO: 2264049 - protein, 7 aa, Cryptosporidium parvum
KDTGISE

SEQ ID NO: 2264050 - protein, 7 aa, Cryptosporidium parvum
KDTGLSR

SEQ ID NO: 2264051 - protein, 5 aa, Cryptosporidium parvum
KDTIH

SEQ ID NO: 2264052 - protein, 7 aa, Cryptosporidium parvum
KDTNGEP

SEQ ID NO: 2264053 - protein, 12 aa, Cryptosporidium parvum
KDTNVKRSKTQV

SEQ ID NO: 2264054 - protein, 5 aa, Cryptosporidium parvum
KDTRE

SEQ ID NO: 2264055 - protein, 4 aa, Cryptosporidium parvum
KDTS

SEQ ID NO: 2264056 - protein, 10 aa, Cryptosporidium parvum
KDTSKPKGQV

SEQ ID NO: 2264057 - protein, 8 aa, Cryptosporidium parvum
KDTSTTTG

SEQ ID NO: 2264058 - protein, 6 aa, Cryptosporidium parvum
KDVESS

SEQ ID NO: 2264059 - protein, 16 aa, Cryptosporidium parvum
KDVKDGKYKHITSNNL

SEQ ID NO: 2264060 - protein, 7 aa, Cryptosporidium parvum
KDVQSSQ

SEQ ID NO: 2264061 - protein, 6 aa, Cryptosporidium parvum
KDVSRS

SEQ ID NO: 2264062 - protein, 13 aa, Cryptosporidium parvum
KDVTDNENRSSKE

SEQ ID NO: 2264063 - protein, 5 aa, Cryptosporidium parvum
KDYDK

SEQ ID NO: 2264064 - protein, 4 aa, Cryptosporidium parvum
KDYE

SEQ ID NO: 2264065 - protein, 21 aa, Cryptosporidium parvum
KDYEKITNNLENEKLSNNNLR

SEQ ID NO: 2264066 - protein, 21 aa, Cryptosporidium parvum
KDYEKKLSELTEEKNSLKTQL

SEQ ID NO: 2264067 - protein, 12 aa, Cryptosporidium parvum
KDYGNVDEDTLR

SEQ ID NO: 2264068 - protein, 8 aa, Cryptosporidium parvum
KDYGTESK

SEQ ID NO: 2264069 - protein, 5 aa, Cryptosporidium parvum
KDYIR

SEQ ID NO: 2264070 - protein, 5 aa, Cryptosporidium parvum
KDYKI

SEQ ID NO: 2264071 - protein, 4 aa, Cryptosporidium parvum
KDYN

SEQ ID NO: 2264072 - protein, 10 aa, Cryptosporidium parvum
KDYNNNTNSK

SEQ ID NO: 2264073 - protein, 20 aa, Cryptosporidium parvum
KDYNNSGNSSNSNSGSSITS

SEQ ID NO: 2264074 - protein, 8 aa, Cryptosporidium parvum
KDYNYNTQ

SEQ ID NO: 2264075 - protein, 4 aa, Cryptosporidium parvum
KDYQ

SEQ ID NO: 2264076 - protein, 5 aa, Cryptosporidium parvum
KDYRK

SEQ ID NO: 2264077 - protein, 9 aa, Cryptosporidium parvum
KDYSGVQSQ

SEQ ID NO: 2264078 - protein, 18 aa, Cryptosporidium parvum
KDYSKKFDAEDEAVRSEK

SEQ ID NO: 2264079 - protein, 20 aa, Cryptosporidium parvum
KDYSPTSSKAIREAPPEECS

SEQ ID NO: 2264080 - protein, 13 aa, Cryptosporidium parvum
KDYSSKHATKDIE

SEQ ID NO: 2264081 - protein, 23 aa, Cryptosporidium parvum
KDYTEKEKESQKKHKQTNKEKTI

SEQ ID NO: 2264082 - protein, 7 aa, Cryptosporidium parvum
KDYYGNK

SEQ ID NO: 2264083 - protein, 6 aa, Cryptosporidium parvum
KEAAGL

SEQ ID NO: 2264084 - protein, 7 aa, Cryptosporidium parvum
KEADSYY

SEQ ID NO: 2264085 - protein, 6 aa, Cryptosporidium parvum
KEAEEK

SEQ ID NO: 2264086 - protein, 5 aa, Cryptosporidium parvum
KEAER

SEQ ID NO: 2264087 - protein, 4 aa, Cryptosporidium parvum
KEAH

SEQ ID NO: 2264088 - protein, 8 aa, Cryptosporidium parvum
KEAIHNSS

SEQ ID NO: 2264089 - protein, 5 aa, Cryptosporidium parvum
KEAIQ

SEQ ID NO: 2264090 - protein, 9 aa, Cryptosporidium parvum
KEAKKALSN

SEQ ID NO: 2264091 - protein, 24 aa, Cryptosporidium parvum
KEAKMKKNSKKSGKKPSSKSTEEL

SEQ ID NO: 2264092 - protein, 6 aa, Cryptosporidium parvum
KEAKQE

SEQ ID NO: 2264093 - protein, 18 aa, Cryptosporidium parvum
KEANGKLVEKKEKEISNT

SEQ ID NO: 2264094 - protein, 24 aa, Cryptosporidium parvum
KEAPKRPNVNKSIKKNTSRGKPVM

SEQ ID NO: 2264095 - protein, 8 aa, Cryptosporidium parvum
KEARDKSW

SEQ ID NO: 2264096 - protein, 6 aa, Cryptosporidium parvum
KEARDL

SEQ ID NO: 2264097 - protein, 12 aa, Cryptosporidium parvum
KEARKSANGKAK

SEQ ID NO: 2264098 - protein, 6 aa, Cryptosporidium parvum
KEASGS

SEQ ID NO: 2264099 - protein, 6 aa, Cryptosporidium parvum
KEASKY

SEQ ID NO: 2264100 - protein, 9 aa, Cryptosporidium parvum
KEASNGPMK

SEQ ID NO: 2264101 - protein, 9 aa, Cryptosporidium parvum
KEASNNGDY

SEQ ID NO: 2264102 - protein, 5 aa, Cryptosporidium parvum
KECEA

SEQ ID NO: 2264103 - protein, 6 aa, Cryptosporidium parvum
KECPKS

SEQ ID NO: 2264104 - protein, 13 aa, Cryptosporidium parvum
KECSQADSDIRSS

SEQ ID NO: 2264105 - protein, 5 aa, Cryptosporidium parvum
KEDAE

SEQ ID NO: 2264106 - protein, 5 aa, Cryptosporidium parvum
KEDAK

SEQ ID NO: 2264107 - protein, 24 aa, Cryptosporidium parvum
KEDDAINDLDENDGVDFNNNNNLP

SEQ ID NO: 2264108 - protein, 15 aa, Cryptosporidium parvum
KEDDENKNNVYKEKR

SEQ ID NO: 2264109 - protein, 12 aa, Cryptosporidium parvum
KEDDSSEYYSDK

SEQ ID NO: 2264110 - protein, 7 aa, Cryptosporidium parvum
KEDDYDA

SEQ ID NO: 2264111 - protein, 10 aa, Cryptosporidium parvum
KEDEEDDYDD

SEQ ID NO: 2264112 - protein, 5 aa, Cryptosporidium parvum
KEDEK

SEQ ID NO: 2264113 - protein, 8 aa, Cryptosporidium parvum
KEDEKEEI

SEQ ID NO: 2264114 - protein, 5 aa, Cryptosporidium parvum
KEDEQ

SEQ ID NO: 2264115 - protein, 9 aa, Cryptosporidium parvum
KEDEQAGIE

SEQ ID NO: 2264116 - protein, 5 aa, Cryptosporidium parvum
KEDES

SEQ ID NO: 2264117 - protein, 17 aa, Cryptosporidium parvum
KEDFSSPKLSPEPKNRL

SEQ ID NO: 2264118 - protein, 9 aa, Cryptosporidium parvum
KEDGSKDQC

SEQ ID NO: 2264119 - protein, 6 aa, Cryptosporidium parvum
KEDIDK

SEQ ID NO: 2264120 - protein, 5 aa, Cryptosporidium parvum
KEDIN

SEQ ID NO: 2264121 - protein, 9 aa, Cryptosporidium parvum
KEDIQNQQE

SEQ ID NO: 2264122 - protein, 13 aa, Cryptosporidium parvum
KEDIVNSKSTGEC

SEQ ID NO: 2264123 - protein, 7 aa, Cryptosporidium parvum
KEDKEKR

SEQ ID NO: 2264124 - protein, 8 aa, Cryptosporidium parvum
KEDKTQTA

SEQ ID NO: 2264125 - protein, 14 aa, Cryptosporidium parvum
KEDLQRDFSSSSAD

SEQ ID NO: 2264126 - protein, 19 aa, Cryptosporidium parvum
KEDNEKKTIRNNKNNNNII

SEQ ID NO: 2264127 - protein, 9 aa, Cryptosporidium parvum
KEDNERETK

SEQ ID NO: 2264128 - protein, 331 aa, Cryptosporidium parvum
KEDNETKDNEDEAAKVRAQKEKEEAEAKALKEKEEAEAKAKKEKEEAEAKALKEKEEAEAKAKKEKEKEEAEAKAKKEKEEAEAKAKKEKEEAEAKALKEKEEAEAKAKKEKEKEEAEAKAKKEKEEAEAKAKKEKEEAEAKAKKEKEEAEAKAKKEKEEAEAKAKKEKEEAEAKAKKEKEEAEAKAKKEKEEAEAKAKKEKEEAEAEAEAKAKKEKEEAEAKAKKEKEEAEAKAKKEKEEAEAKAKKEKEEAEAKAKKEKEEAEAKAKKEKEEAEAKAKKEKEEAEAKAKKEKEEADTKEKEKTEIKENSKIDSDSEENSESKEKKSTGL

SEQ ID NO: 2264129 - protein, 8 aa, Cryptosporidium parvum
KEDNGELG

SEQ ID NO: 2264130 - protein, 34 aa, Cryptosporidium parvum
KEDNTLEEKDLNSLGKDFSQNSQSTIESENMEAS

SEQ ID NO: 2264131 - protein, 7 aa, Cryptosporidium parvum
KEDPEVK

SEQ ID NO: 2264132 - protein, 6 aa, Cryptosporidium parvum
KEDQSL

SEQ ID NO: 2264133 - protein, 11 aa, Cryptosporidium parvum
KEDSECDDHEI

SEQ ID NO: 2264134 - protein, 6 aa, Cryptosporidium parvum
KEDTEN

SEQ ID NO: 2264135 - protein, 4 aa, Cryptosporidium parvum
KEDV

SEQ ID NO: 2264136 - protein, 12 aa, Cryptosporidium parvum
KEEAEKRISNPD

SEQ ID NO: 2264137 - protein, 48 aa, Cryptosporidium parvum
KEEASSVSIPPAPAPAPAPPPTSAPPPPAPPLPPPSFPPYAASSQSKL

SEQ ID NO: 2264138 - protein, 5 aa, Cryptosporidium parvum
KEECF

SEQ ID NO: 2264139 - protein, 7 aa, Cryptosporidium parvum
KEEDVGK

SEQ ID NO: 2264140 - protein, 7 aa, Cryptosporidium parvum
KEEEAKA

SEQ ID NO: 2264141 - protein, 32 aa, Cryptosporidium parvum
KEEEDGVGEEDLDNGEKRRKGKGEKKDVERKD

SEQ ID NO: 2264142 - protein, 17 aa, Cryptosporidium parvum
KEEEEDKEENLGKEEQM

SEQ ID NO: 2264143 - protein, 8 aa, Cryptosporidium parvum
KEEEEEDE

SEQ ID NO: 2264144 - protein, 11 aa, Cryptosporidium parvum
KEEEEKGDDIQ

SEQ ID NO: 2264145 - protein, 11 aa, Cryptosporidium parvum
KEEEPGTQPIT

SEQ ID NO: 2264146 - protein, 7 aa, Cryptosporidium parvum
KEEEREG

SEQ ID NO: 2264147 - protein, 6 aa, Cryptosporidium parvum
KEEERI

SEQ ID NO: 2264148 - protein, 6 aa, Cryptosporidium parvum
KEEERW

SEQ ID NO: 2264149 - protein, 12 aa, Cryptosporidium parvum
KEEEYRRKQGEL

SEQ ID NO: 2264150 - protein, 10 aa, Cryptosporidium parvum
KEEFDEKSNE

SEQ ID NO: 2264151 - protein, 6 aa, Cryptosporidium parvum
KEEIDG

SEQ ID NO: 2264152 - protein, 16 aa, Cryptosporidium parvum
KEEIQDSVDDPNPTSE

SEQ ID NO: 2264153 - protein, 7 aa, Cryptosporidium parvum
KEEIQRK

SEQ ID NO: 2264154 - protein, 12 aa, Cryptosporidium parvum
KEEKAKLKEDYE

SEQ ID NO: 2264155 - protein, 14 aa, Cryptosporidium parvum
KEEKGEKNQSRNLK

SEQ ID NO: 2264156 - protein, 13 aa, Cryptosporidium parvum
KEEKKKSSFSELP

SEQ ID NO: 2264157 - protein, 12 aa, Cryptosporidium parvum
KEEKKSQDGQDL

SEQ ID NO: 2264158 - protein, 7 aa, Cryptosporidium parvum
KEEKNEF

SEQ ID NO: 2264159 - protein, 11 aa, Cryptosporidium parvum
KEEKTATKKNS

SEQ ID NO: 2264160 - protein, 8 aa, Cryptosporidium parvum
KEEKTFEE

SEQ ID NO: 2264161 - protein, 4 aa, Cryptosporidium parvum
KEEL

SEQ ID NO: 2264162 - protein, 5 aa, Cryptosporidium parvum
KEELR

SEQ ID NO: 2264163 - protein, 7 aa, Cryptosporidium parvum
KEENEDE

SEQ ID NO: 2264164 - protein, 10 aa, Cryptosporidium parvum
KEENFNERNN

SEQ ID NO: 2264165 - protein, 6 aa, Cryptosporidium parvum
KEENGR

SEQ ID NO: 2264166 - protein, 5 aa, Cryptosporidium parvum
KEENI

SEQ ID NO: 2264167 - protein, 8 aa, Cryptosporidium parvum
KEENNDDW

SEQ ID NO: 2264168 - protein, 7 aa, Cryptosporidium parvum
KEENNTY

SEQ ID NO: 2264169 - protein, 8 aa, Cryptosporidium parvum
KEENSTNF

SEQ ID NO: 2264170 - protein, 7 aa, Cryptosporidium parvum
KEENTAR

SEQ ID NO: 2264171 - protein, 4 aa, Cryptosporidium parvum
KEEQ

SEQ ID NO: 2264172 - protein, 6 aa, Cryptosporidium parvum
KEEQDF

SEQ ID NO: 2264173 - protein, 5 aa, Cryptosporidium parvum
KEEQL

SEQ ID NO: 2264174 - protein, 5 aa, Cryptosporidium parvum
KEEQN

SEQ ID NO: 2264175 - protein, 5 aa, Cryptosporidium parvum
KEERD

SEQ ID NO: 2264176 - protein, 23 aa, Cryptosporidium parvum
KEEREERMEDGGDCLNTSNQSIS

SEQ ID NO: 2264177 - protein, 7 aa, Cryptosporidium parvum
KEERETY

SEQ ID NO: 2264178 - protein, 7 aa, Cryptosporidium parvum
KEERNRH

SEQ ID NO: 2264179 - protein, 16 aa, Cryptosporidium parvum
KEERSNHTDSRKKKRF

SEQ ID NO: 2264180 - protein, 4 aa, Cryptosporidium parvum
KEES

SEQ ID NO: 2264181 - protein, 10 aa, Cryptosporidium parvum
KEESAESKIE

SEQ ID NO: 2264182 - protein, 6 aa, Cryptosporidium parvum
KEESSM

SEQ ID NO: 2264183 - protein, 9 aa, Cryptosporidium parvum
KEESYQQTK

SEQ ID NO: 2264184 - protein, 6 aa, Cryptosporidium parvum
KEETGE

SEQ ID NO: 2264185 - protein, 13 aa, Cryptosporidium parvum
KEETKNEKDSSIR

SEQ ID NO: 2264186 - protein, 7 aa, Cryptosporidium parvum
KEETNGL

SEQ ID NO: 2264187 - protein, 6 aa, Cryptosporidium parvum
KEETPN

SEQ ID NO: 2264188 - protein, 4 aa, Cryptosporidium parvum
KEEV

SEQ ID NO: 2264189 - protein, 18 aa, Cryptosporidium parvum
KEEVENTDESNDEPFQPR

SEQ ID NO: 2264190 - protein, 7 aa, Cryptosporidium parvum
KEEYGGD

SEQ ID NO: 2264191 - protein, 15 aa, Cryptosporidium parvum
KEEYKSDSRVTTPSE

SEQ ID NO: 2264192 - protein, 4 aa, Cryptosporidium parvum
KEFA

SEQ ID NO: 2264193 - protein, 7 aa, Cryptosporidium parvum
KEFEDSI

SEQ ID NO: 2264194 - protein, 10 aa, Cryptosporidium parvum
KEFEESTNTV

SEQ ID NO: 2264195 - protein, 6 aa, Cryptosporidium parvum
KEFEKI

SEQ ID NO: 2264196 - protein, 12 aa, Cryptosporidium parvum
KEFEKNDEIDQR

SEQ ID NO: 2264197 - protein, 5 aa, Cryptosporidium parvum
KEFES

SEQ ID NO: 2264198 - protein, 20 aa, Cryptosporidium parvum
KEFESKNGNNNSKYNNEDNL

SEQ ID NO: 2264199 - protein, 5 aa, Cryptosporidium parvum
KEFET

SEQ ID NO: 2264200 - protein, 7 aa, Cryptosporidium parvum
KEFGTSN

SEQ ID NO: 2264201 - protein, 4 aa, Cryptosporidium parvum
KEFK

SEQ ID NO: 2264202 - protein, 6 aa, Cryptosporidium parvum
KEFKGG

SEQ ID NO: 2264203 - protein, 12 aa, Cryptosporidium parvum
KEFKQESSSPTL

SEQ ID NO: 2264204 - protein, 14 aa, Cryptosporidium parvum
KEFSSMAPREEEIE

SEQ ID NO: 2264205 - protein, 6 aa, Cryptosporidium parvum
KEFTPG

SEQ ID NO: 2264206 - protein, 5 aa, Cryptosporidium parvum
KEGEM

SEQ ID NO: 2264207 - protein, 7 aa, Cryptosporidium parvum
KEGEREK

SEQ ID NO: 2264208 - protein, 5 aa, Cryptosporidium parvum
KEGET

SEQ ID NO: 2264209 - protein, 8 aa, Cryptosporidium parvum
KEGGDEEL

SEQ ID NO: 2264210 - protein, 34 aa, Cryptosporidium parvum
KEGITNKTVEKSEQERKLDEKDDYSEKETRKRIK

SEQ ID NO: 2264211 - protein, 21 aa, Cryptosporidium parvum
KEGKEGEENGEEEERKKKKGF

SEQ ID NO: 2264212 - protein, 16 aa, Cryptosporidium parvum
KEGKETDDEMDYSEDH

SEQ ID NO: 2264213 - protein, 5 aa, Cryptosporidium parvum
KEGKI

SEQ ID NO: 2264214 - protein, 8 aa, Cryptosporidium parvum
KEGKTGIN

SEQ ID NO: 2264215 - protein, 6 aa, Cryptosporidium parvum
KEGMKR

SEQ ID NO: 2264216 - protein, 7 aa, Cryptosporidium parvum
KEGNEEL

SEQ ID NO: 2264217 - protein, 12 aa, Cryptosporidium parvum
KEGNEKENSQEV

SEQ ID NO: 2264218 - protein, 16 aa, Cryptosporidium parvum
KEGPIDSTPIVTNDGA

SEQ ID NO: 2264219 - protein, 5 aa, Cryptosporidium parvum
KEGSE

SEQ ID NO: 2264220 - protein, 5 aa, Cryptosporidium parvum
KEGSI

SEQ ID NO: 2264221 - protein, 6 aa, Cryptosporidium parvum
KEGTSF

SEQ ID NO: 2264222 - protein, 5 aa, Cryptosporidium parvum
KEGTY

SEQ ID NO: 2264223 - protein, 5 aa, Cryptosporidium parvum
KEGVP

SEQ ID NO: 2264224 - protein, 6 aa, Cryptosporidium parvum
KEGYDG

SEQ ID NO: 2264225 - protein, 8 aa, Cryptosporidium parvum
KEHGDPES

SEQ ID NO: 2264226 - protein, 5 aa, Cryptosporidium parvum
KEHGH

SEQ ID NO: 2264227 - protein, 8 aa, Cryptosporidium parvum
KEHNQGIK

SEQ ID NO: 2264228 - protein, 4 aa, Cryptosporidium parvum
KEHR

SEQ ID NO: 2264229 - protein, 7 aa, Cryptosporidium parvum
KEHSKSL

SEQ ID NO: 2264230 - protein, 5 aa, Cryptosporidium parvum
KEIAD

SEQ ID NO: 2264231 - protein, 18 aa, Cryptosporidium parvum
KEIASENNAKNNSETNNQ

SEQ ID NO: 2264232 - protein, 4 aa, Cryptosporidium parvum
KEIE

SEQ ID NO: 2264233 - protein, 5 aa, Cryptosporidium parvum
KEIEK

SEQ ID NO: 2264234 - protein, 8 aa, Cryptosporidium parvum
KEIEKGNQ

SEQ ID NO: 2264235 - protein, 8 aa, Cryptosporidium parvum
KEIEKRTQ

SEQ ID NO: 2264236 - protein, 33 aa, Cryptosporidium parvum
KEIEREKEEEREKTRANERNAKELNEKKPATII

SEQ ID NO: 2264237 - protein, 4 aa, Cryptosporidium parvum
KEIF

SEQ ID NO: 2264238 - protein, 13 aa, Cryptosporidium parvum
KEIHDNTSEEDDE

SEQ ID NO: 2264239 - protein, 35 aa, Cryptosporidium parvum
KEIKAENEVLSNKASTMELSNTAGQNSQQENNEIN

SEQ ID NO: 2264240 - protein, 8 aa, Cryptosporidium parvum
KEIKDKVN

SEQ ID NO: 2264241 - protein, 9 aa, Cryptosporidium parvum
KEIKEEGNT

SEQ ID NO: 2264242 - protein, 25 aa, Cryptosporidium parvum
KEIKENSPVPVSNSEISEEINTKKE

SEQ ID NO: 2264243 - protein, 6 aa, Cryptosporidium parvum
KEIKEQ

SEQ ID NO: 2264244 - protein, 6 aa, Cryptosporidium parvum
KEIKNG

SEQ ID NO: 2264245 - protein, 19 aa, Cryptosporidium parvum
KEINNKTQKISSKQNDQIL

SEQ ID NO: 2264246 - protein, 12 aa, Cryptosporidium parvum
KEINSAKQIGES

SEQ ID NO: 2264247 - protein, 13 aa, Cryptosporidium parvum
KEINSSTGQLDER

SEQ ID NO: 2264248 - protein, 17 aa, Cryptosporidium parvum
KEINTEVENNKSKIKSN

SEQ ID NO: 2264249 - protein, 6 aa, Cryptosporidium parvum
KEIPSL

SEQ ID NO: 2264250 - protein, 6 aa, Cryptosporidium parvum
KEIQEN

SEQ ID NO: 2264251 - protein, 6 aa, Cryptosporidium parvum
KEISDS

SEQ ID NO: 2264252 - protein, 14 aa, Cryptosporidium parvum
KEISENKAPNKFGN

SEQ ID NO: 2264253 - protein, 13 aa, Cryptosporidium parvum
KEISKDASLMPDK

SEQ ID NO: 2264254 - protein, 7 aa, Cryptosporidium parvum
KEISNGK

SEQ ID NO: 2264255 - protein, 10 aa, Cryptosporidium parvum
KEKAKQADSI

SEQ ID NO: 2264256 - protein, 8 aa, Cryptosporidium parvum
KEKAKSQK

SEQ ID NO: 2264257 - protein, 17 aa, Cryptosporidium parvum
KEKANKKSLQSNQEEQK

SEQ ID NO: 2264258 - protein, 8 aa, Cryptosporidium parvum
KEKATNKV

SEQ ID NO: 2264259 - protein, 5 aa, Cryptosporidium parvum
KEKDC

SEQ ID NO: 2264260 - protein, 19 aa, Cryptosporidium parvum
KEKDHRDNINQNQNYSSLP

SEQ ID NO: 2264261 - protein, 17 aa, Cryptosporidium parvum
KEKDKLVTDSRISNNTN

SEQ ID NO: 2264262 - protein, 11 aa, Cryptosporidium parvum
KEKDLQAKNAN

SEQ ID NO: 2264263 - protein, 14 aa, Cryptosporidium parvum
KEKDSQGKSLSETF

SEQ ID NO: 2264264 - protein, 82 aa, Cryptosporidium parvum
KEKEEEEEKERERERIRKEKEEEEERERLRKEKEKEEEEKERERERIRKEKEKEEEEEKERERERIRKEKEKEEEEERERER

SEQ ID NO: 2264265 - protein, 8 aa, Cryptosporidium parvum
KEKEEKIE

SEQ ID NO: 2264266 - protein, 10 aa, Cryptosporidium parvum
KEKEIQNQRR

SEQ ID NO: 2264267 - protein, 23 aa, Cryptosporidium parvum
KEKEMQKKMEEEVRRRAREEARI

SEQ ID NO: 2264268 - protein, 5 aa, Cryptosporidium parvum
KEKEN

SEQ ID NO: 2264269 - protein, 16 aa, Cryptosporidium parvum
KEKENEIAQLKAKTSL

SEQ ID NO: 2264270 - protein, 9 aa, Cryptosporidium parvum
KEKEQEREI

SEQ ID NO: 2264271 - protein, 8 aa, Cryptosporidium parvum
KEKEQIEN

SEQ ID NO: 2264272 - protein, 9 aa, Cryptosporidium parvum
KEKERESMQ

SEQ ID NO: 2264273 - protein, 5 aa, Cryptosporidium parvum
KEKEV

SEQ ID NO: 2264274 - protein, 30 aa, Cryptosporidium parvum
KEKEYNKNEKTKNKSPYKEEPSRSNVSNGE

SEQ ID NO: 2264275 - protein, 4 aa, Cryptosporidium parvum
KEKF

SEQ ID NO: 2264276 - protein, 21 aa, Cryptosporidium parvum
KEKFREIENSSPLTSESTQKH

SEQ ID NO: 2264277 - protein, 6 aa, Cryptosporidium parvum
KEKGAC

SEQ ID NO: 2264278 - protein, 9 aa, Cryptosporidium parvum
KEKGEYQRD

SEQ ID NO: 2264279 - protein, 11 aa, Cryptosporidium parvum
KEKGSDKSRNF

SEQ ID NO: 2264280 - protein, 19 aa, Cryptosporidium parvum
KEKIDLEDDEVDSNIDNNC

SEQ ID NO: 2264281 - protein, 29 aa, Cryptosporidium parvum
KEKIERTDEVEKKDENNLNSKISKEEYEY

SEQ ID NO: 2264282 - protein, 10 aa, Cryptosporidium parvum
KEKINELQEE

SEQ ID NO: 2264283 - protein, 26 aa, Cryptosporidium parvum
KEKISQNSENDENIDQNSFKNNENVP

SEQ ID NO: 2264284 - protein, 12 aa, Cryptosporidium parvum
KEKKQDSNSGKE

SEQ ID NO: 2264285 - protein, 13 aa, Cryptosporidium parvum
KEKKRIRELNSEK

SEQ ID NO: 2264286 - protein, 5 aa, Cryptosporidium parvum
KEKKS

SEQ ID NO: 2264287 - protein, 43 aa, Cryptosporidium parvum
KEKKYNNTNSSDVASNNQLDDNVADSEESQNKVDETKEKESQM

SEQ ID NO: 2264288 - protein, 5 aa, Cryptosporidium parvum
KEKLN

SEQ ID NO: 2264289 - protein, 10 aa, Cryptosporidium parvum
KEKMYKDAKT

SEQ ID NO: 2264290 - protein, 4 aa, Cryptosporidium parvum
KEKN

SEQ ID NO: 2264291 - protein, 9 aa, Cryptosporidium parvum
KEKNKYRSS

SEQ ID NO: 2264292 - protein, 8 aa, Cryptosporidium parvum
KEKNMELD

SEQ ID NO: 2264293 - protein, 10 aa, Cryptosporidium parvum
KEKNNDKNQL

SEQ ID NO: 2264294 - protein, 7 aa, Cryptosporidium parvum
KEKNNEC

SEQ ID NO: 2264295 - protein, 6 aa, Cryptosporidium parvum
KEKNNI

SEQ ID NO: 2264296 - protein, 9 aa, Cryptosporidium parvum
KEKNSPNFN

SEQ ID NO: 2264297 - protein, 5 aa, Cryptosporidium parvum
KEKPK

SEQ ID NO: 2264298 - protein, 27 aa, Cryptosporidium parvum
KEKQSSQGSVLGSRKSKESELRKKEDY

SEQ ID NO: 2264299 - protein, 10 aa, Cryptosporidium parvum
KEKRDEVNRQ

SEQ ID NO: 2264300 - protein, 7 aa, Cryptosporidium parvum
KEKRDRM

SEQ ID NO: 2264301 - protein, 5 aa, Cryptosporidium parvum
KEKRI

SEQ ID NO: 2264302 - protein, 8 aa, Cryptosporidium parvum
KEKRPKPI

SEQ ID NO: 2264303 - protein, 8 aa, Cryptosporidium parvum
KEKSIENR

SEQ ID NO: 2264304 - protein, 5 aa, Cryptosporidium parvum
KEKSK

SEQ ID NO: 2264305 - protein, 12 aa, Cryptosporidium parvum
KEKSKINSEKPS

SEQ ID NO: 2264306 - protein, 12 aa, Cryptosporidium parvum
KEKSKRKNVPID

SEQ ID NO: 2264307 - protein, 6 aa, Cryptosporidium parvum
KEKSQI

SEQ ID NO: 2264308 - protein, 6 aa, Cryptosporidium parvum
KEKTEL

SEQ ID NO: 2264309 - protein, 7 aa, Cryptosporidium parvum
KEKTRQL

SEQ ID NO: 2264310 - protein, 7 aa, Cryptosporidium parvum
KEKTSKD

SEQ ID NO: 2264311 - protein, 7 aa, Cryptosporidium parvum
KEKTSQE

SEQ ID NO: 2264312 - protein, 4 aa, Cryptosporidium parvum
KEKV

SEQ ID NO: 2264313 - protein, 4 aa, Cryptosporidium parvum
KEKW

SEQ ID NO: 2264314 - protein, 10 aa, Cryptosporidium parvum
KEKYGNIGQR

SEQ ID NO: 2264315 - protein, 10 aa, Cryptosporidium parvum
KEKYNPSQMS

SEQ ID NO: 2264316 - protein, 4 aa, Cryptosporidium parvum
KELA

SEQ ID NO: 2264317 - protein, 17 aa, Cryptosporidium parvum
KELAENARKIASPGKGI

SEQ ID NO: 2264318 - protein, 10 aa, Cryptosporidium parvum
KELAPDEKMT

SEQ ID NO: 2264319 - protein, 6 aa, Cryptosporidium parvum
KELEDN

SEQ ID NO: 2264320 - protein, 13 aa, Cryptosporidium parvum
KELEESHSKPTIR

SEQ ID NO: 2264321 - protein, 9 aa, Cryptosporidium parvum
KELEKKSQF

SEQ ID NO: 2264322 - protein, 16 aa, Cryptosporidium parvum
KELERQNGNNKNNKEG

SEQ ID NO: 2264323 - protein, 31 aa, Cryptosporidium parvum
KELERQYNKRDRDSKSERKKAKDAIISGKAD

SEQ ID NO: 2264324 - protein, 14 aa, Cryptosporidium parvum
KELERSSKNEELEA

SEQ ID NO: 2264325 - protein, 5 aa, Cryptosporidium parvum
KELGE

SEQ ID NO: 2264326 - protein, 25 aa, Cryptosporidium parvum
KELKDAGNESYKGGNYSDAREKYEK

SEQ ID NO: 2264327 - protein, 14 aa, Cryptosporidium parvum
KELKEDFSREIGEK

SEQ ID NO: 2264328 - protein, 11 aa, Cryptosporidium parvum
KELKNKPRDEI

SEQ ID NO: 2264329 - protein, 10 aa, Cryptosporidium parvum
KELKNSEDLN

SEQ ID NO: 2264330 - protein, 4 aa, Cryptosporidium parvum
KELN

SEQ ID NO: 2264331 - protein, 82 aa, Cryptosporidium parvum
KELNKNQKSNISPSSNSNNNNTENGSNTNQYHSNSNQKNDSNSSINNNHSKSNKKNSPKVNNSTSSYSSPHSSSSSKGNTSR

SEQ ID NO: 2264332 - protein, 5 aa, Cryptosporidium parvum
KELNL

SEQ ID NO: 2264333 - protein, 5 aa, Cryptosporidium parvum
KELNT

SEQ ID NO: 2264334 - protein, 8 aa, Cryptosporidium parvum
KELNTKGI

SEQ ID NO: 2264335 - protein, 17 aa, Cryptosporidium parvum
KELPSDQNAQEKQLTRQ

SEQ ID NO: 2264336 - protein, 14 aa, Cryptosporidium parvum
KELQNTHTNYSNTL

SEQ ID NO: 2264337 - protein, 8 aa, Cryptosporidium parvum
KELQPESQ

SEQ ID NO: 2264338 - protein, 4 aa, Cryptosporidium parvum
KELR

SEQ ID NO: 2264339 - protein, 7 aa, Cryptosporidium parvum
KELRATS

SEQ ID NO: 2264340 - protein, 7 aa, Cryptosporidium parvum
KELREAK

SEQ ID NO: 2264341 - protein, 19 aa, Cryptosporidium parvum
KELSESSKREEAKQRTTGS

SEQ ID NO: 2264342 - protein, 6 aa, Cryptosporidium parvum
KELSGI

SEQ ID NO: 2264343 - protein, 5 aa, Cryptosporidium parvum
KELSL

SEQ ID NO: 2264344 - protein, 11 aa, Cryptosporidium parvum
KELSNKIETGS

SEQ ID NO: 2264345 - protein, 26 aa, Cryptosporidium parvum
KELSNQTKSLKDVNKKNNNNINDNSS

SEQ ID NO: 2264346 - protein, 16 aa, Cryptosporidium parvum
KELSQAAADSNKQKRL

SEQ ID NO: 2264347 - protein, 10 aa, Cryptosporidium parvum
KELSRDPDIK

SEQ ID NO: 2264348 - protein, 5 aa, Cryptosporidium parvum
KELSS

SEQ ID NO: 2264349 - protein, 7 aa, Cryptosporidium parvum
KELTEKE

SEQ ID NO: 2264350 - protein, 14 aa, Cryptosporidium parvum
KEMATNSQIIEHKK

SEQ ID NO: 2264351 - protein, 8 aa, Cryptosporidium parvum
KEMDDESQ

SEQ ID NO: 2264352 - protein, 7 aa, Cryptosporidium parvum
KEMENDE

SEQ ID NO: 2264353 - protein, 9 aa, Cryptosporidium parvum
KEMEQNNDK

SEQ ID NO: 2264354 - protein, 13 aa, Cryptosporidium parvum
KEMKEKQEKEQKK

SEQ ID NO: 2264355 - protein, 9 aa, Cryptosporidium parvum
KEMNGNSHE

SEQ ID NO: 2264356 - protein, 8 aa, Cryptosporidium parvum
KENATNQP

SEQ ID NO: 2264357 - protein, 18 aa, Cryptosporidium parvum
KENDEKLADRVKRNKRKC

SEQ ID NO: 2264358 - protein, 7 aa, Cryptosporidium parvum
KENDREL

SEQ ID NO: 2264359 - protein, 7 aa, Cryptosporidium parvum
KENDSCS

SEQ ID NO: 2264360 - protein, 6 aa, Cryptosporidium parvum
KENEIE

SEQ ID NO: 2264361 - protein, 6 aa, Cryptosporidium parvum
KENEKI

SEQ ID NO: 2264362 - protein, 12 aa, Cryptosporidium parvum
KENELSKREGAV

SEQ ID NO: 2264363 - protein, 23 aa, Cryptosporidium parvum
KENELVPPGKSERKKSETNISDH

SEQ ID NO: 2264364 - protein, 32 aa, Cryptosporidium parvum
KENENSCEEGSVNRRSQELETDKNVGQKKVKR

SEQ ID NO: 2264365 - protein, 7 aa, Cryptosporidium parvum
KENERRR

SEQ ID NO: 2264366 - protein, 5 aa, Cryptosporidium parvum
KENEY

SEQ ID NO: 2264367 - protein, 10 aa, Cryptosporidium parvum
KENGKDTFNE

SEQ ID NO: 2264368 - protein, 9 aa, Cryptosporidium parvum
KENGRVKTK

SEQ ID NO: 2264369 - protein, 8 aa, Cryptosporidium parvum
KENGYSAD

SEQ ID NO: 2264370 - protein, 8 aa, Cryptosporidium parvum
KENINNSN

SEQ ID NO: 2264371 - protein, 87 aa, Cryptosporidium parvum
KENIPGKKVESIKKDNSEKKISDTKENEEINEKMTKEKKPSKKQVQYSSSDSSSNPSPRIKKNSSEIASDESASIYTDSSNKIGKKI

SEQ ID NO: 2264372 - protein, 5 aa, Cryptosporidium parvum
KENKA

SEQ ID NO: 2264373 - protein, 9 aa, Cryptosporidium parvum
KENKLSDLD

SEQ ID NO: 2264374 - protein, 12 aa, Cryptosporidium parvum
KENKVENDENNN

SEQ ID NO: 2264375 - protein, 4 aa, Cryptosporidium parvum
KENL

SEQ ID NO: 2264376 - protein, 25 aa, Cryptosporidium parvum
KENLGYNSAYSRSVEYDSHEGSSLA

SEQ ID NO: 2264377 - protein, 14 aa, Cryptosporidium parvum
KENLKQEPKQENED

SEQ ID NO: 2264378 - protein, 11 aa, Cryptosporidium parvum
KENLQDDSTFP

SEQ ID NO: 2264379 - protein, 5 aa, Cryptosporidium parvum
KENNF

SEQ ID NO: 2264380 - protein, 5 aa, Cryptosporidium parvum
KENNR

SEQ ID NO: 2264381 - protein, 5 aa, Cryptosporidium parvum
KENNS

SEQ ID NO: 2264382 - protein, 12 aa, Cryptosporidium parvum
KENNSNASNNNF

SEQ ID NO: 2264383 - protein, 6 aa, Cryptosporidium parvum
KENPIE

SEQ ID NO: 2264384 - protein, 8 aa, Cryptosporidium parvum
KENPNSYA

SEQ ID NO: 2264385 - protein, 8 aa, Cryptosporidium parvum
KENPSNKN

SEQ ID NO: 2264386 - protein, 6 aa, Cryptosporidium parvum
KENPYF

SEQ ID NO: 2264387 - protein, 23 aa, Cryptosporidium parvum
KENQDELEDKESGDSKQNNENID

SEQ ID NO: 2264388 - protein, 6 aa, Cryptosporidium parvum
KENQKK

SEQ ID NO: 2264389 - protein, 8 aa, Cryptosporidium parvum
KENQKQRM

SEQ ID NO: 2264390 - protein, 7 aa, Cryptosporidium parvum
KENQVDD

SEQ ID NO: 2264391 - protein, 8 aa, Cryptosporidium parvum
KENSDDSR

SEQ ID NO: 2264392 - protein, 28 aa, Cryptosporidium parvum
KENSDNLNSSKNNLKTKISSSVSEKKNL

SEQ ID NO: 2264393 - protein, 5 aa, Cryptosporidium parvum
KENSE

SEQ ID NO: 2264394 - protein, 18 aa, Cryptosporidium parvum
KENSQDAKDCNENDPNEL

SEQ ID NO: 2264395 - protein, 9 aa, Cryptosporidium parvum
KENSQDEIR

SEQ ID NO: 2264396 - protein, 7 aa, Cryptosporidium parvum
KENSRMS

SEQ ID NO: 2264397 - protein, 10 aa, Cryptosporidium parvum
KENSSNPIEY

SEQ ID NO: 2264398 - protein, 6 aa, Cryptosporidium parvum
KENTEF

SEQ ID NO: 2264399 - protein, 12 aa, Cryptosporidium parvum
KENTEKSTGQSV

SEQ ID NO: 2264400 - protein, 6 aa, Cryptosporidium parvum
KENTKT

SEQ ID NO: 2264401 - protein, 9 aa, Cryptosporidium parvum
KENTSFKPG

SEQ ID NO: 2264402 - protein, 8 aa, Cryptosporidium parvum
KENVSEDE

SEQ ID NO: 2264403 - protein, 7 aa, Cryptosporidium parvum
KENYDEN

SEQ ID NO: 2264404 - protein, 9 aa, Cryptosporidium parvum
KENYTREEN

SEQ ID NO: 2264405 - protein, 13 aa, Cryptosporidium parvum
KEPCKAINPDEAV

SEQ ID NO: 2264406 - protein, 4 aa, Cryptosporidium parvum
KEPK

SEQ ID NO: 2264407 - protein, 8 aa, Cryptosporidium parvum
KEPKLNSI

SEQ ID NO: 2264408 - protein, 5 aa, Cryptosporidium parvum
KEPNL

SEQ ID NO: 2264409 - protein, 6 aa, Cryptosporidium parvum
KEPPQY

SEQ ID NO: 2264410 - protein, 8 aa, Cryptosporidium parvum
KEPRKGKI

SEQ ID NO: 2264411 - protein, 8 aa, Cryptosporidium parvum
KEQASSNE

SEQ ID NO: 2264412 - protein, 7 aa, Cryptosporidium parvum
KEQDKST

SEQ ID NO: 2264413 - protein, 6 aa, Cryptosporidium parvum
KEQEEL

SEQ ID NO: 2264414 - protein, 8 aa, Cryptosporidium parvum
KEQEKSSI

SEQ ID NO: 2264415 - protein, 15 aa, Cryptosporidium parvum
KEQENKLEPVDKKDI

SEQ ID NO: 2264416 - protein, 8 aa, Cryptosporidium parvum
KEQESQNA

SEQ ID NO: 2264417 - protein, 14 aa, Cryptosporidium parvum
KEQETFTNGGVSPQ

SEQ ID NO: 2264418 - protein, 6 aa, Cryptosporidium parvum
KEQEVS

SEQ ID NO: 2264419 - protein, 7 aa, Cryptosporidium parvum
KEQIEDA

SEQ ID NO: 2264420 - protein, 6 aa, Cryptosporidium parvum
KEQISK

SEQ ID NO: 2264421 - protein, 12 aa, Cryptosporidium parvum
KEQKAKGNQFET

SEQ ID NO: 2264422 - protein, 7 aa, Cryptosporidium parvum
KEQKNSL

SEQ ID NO: 2264423 - protein, 6 aa, Cryptosporidium parvum
KEQNID

SEQ ID NO: 2264424 - protein, 9 aa, Cryptosporidium parvum
KEQNIYSPT

SEQ ID NO: 2264425 - protein, 5 aa, Cryptosporidium parvum
KEQRE

SEQ ID NO: 2264426 - protein, 8 aa, Cryptosporidium parvum
KEQRSSFK

SEQ ID NO: 2264427 - protein, 4 aa, Cryptosporidium parvum
KEQS

SEQ ID NO: 2264428 - protein, 9 aa, Cryptosporidium parvum
KEQVNNNTI

SEQ ID NO: 2264429 - protein, 5 aa, Cryptosporidium parvum
KERAS

SEQ ID NO: 2264430 - protein, 6 aa, Cryptosporidium parvum
KEREEE

SEQ ID NO: 2264431 - protein, 9 aa, Cryptosporidium parvum
KEREKELNK

SEQ ID NO: 2264432 - protein, 7 aa, Cryptosporidium parvum
KERENYA

SEQ ID NO: 2264433 - protein, 11 aa, Cryptosporidium parvum
KERGADSDKQI

SEQ ID NO: 2264434 - protein, 11 aa, Cryptosporidium parvum
KERGENVKNQR

SEQ ID NO: 2264435 - protein, 5 aa, Cryptosporidium parvum
KERGI

SEQ ID NO: 2264436 - protein, 7 aa, Cryptosporidium parvum
KERGVGN

SEQ ID NO: 2264437 - protein, 4 aa, Cryptosporidium parvum
KERI

SEQ ID NO: 2264438 - protein, 9 aa, Cryptosporidium parvum
KERIQKHSN

SEQ ID NO: 2264439 - protein, 8 aa, Cryptosporidium parvum
KERKDETL

SEQ ID NO: 2264440 - protein, 11 aa, Cryptosporidium parvum
KERKISKQELQ

SEQ ID NO: 2264441 - protein, 5 aa, Cryptosporidium parvum
KERKL

SEQ ID NO: 2264442 - protein, 6 aa, Cryptosporidium parvum
KERKNK

SEQ ID NO: 2264443 - protein, 27 aa, Cryptosporidium parvum
KERKSQASCSTSDPTSPLAYRNGNDNY

SEQ ID NO: 2264444 - protein, 15 aa, Cryptosporidium parvum
KERMEASRLESENYS

SEQ ID NO: 2264445 - protein, 4 aa, Cryptosporidium parvum
KERN

SEQ ID NO: 2264446 - protein, 13 aa, Cryptosporidium parvum
KERNKSEKMEIEN

SEQ ID NO: 2264447 - protein, 6 aa, Cryptosporidium parvum
KERQTS

SEQ ID NO: 2264448 - protein, 8 aa, Cryptosporidium parvum
KERRETSD

SEQ ID NO: 2264449 - protein, 15 aa, Cryptosporidium parvum
KERRRLSTQNGIEKR

SEQ ID NO: 2264450 - protein, 7 aa, Cryptosporidium parvum
KERSESD

SEQ ID NO: 2264451 - protein, 8 aa, Cryptosporidium parvum
KERTDYQN

SEQ ID NO: 2264452 - protein, 23 aa, Cryptosporidium parvum
KERVTNEAFNQSNYASTNSNNNI

SEQ ID NO: 2264453 - protein, 8 aa, Cryptosporidium parvum
KERYKGRS

SEQ ID NO: 2264454 - protein, 9 aa, Cryptosporidium parvum
KESCGNEYI

SEQ ID NO: 2264455 - protein, 10 aa, Cryptosporidium parvum
KESDPPPPLP

SEQ ID NO: 2264456 - protein, 8 aa, Cryptosporidium parvum
KESEAERF

SEQ ID NO: 2264457 - protein, 8 aa, Cryptosporidium parvum
KESEESHL

SEQ ID NO: 2264458 - protein, 6 aa, Cryptosporidium parvum
KESEKY

SEQ ID NO: 2264459 - protein, 9 aa, Cryptosporidium parvum
KESELNTTT

SEQ ID NO: 2264460 - protein, 9 aa, Cryptosporidium parvum
KESENNSTK

SEQ ID NO: 2264461 - protein, 8 aa, Cryptosporidium parvum
KESEQVTT

SEQ ID NO: 2264462 - protein, 6 aa, Cryptosporidium parvum
KESESL

SEQ ID NO: 2264463 - protein, 19 aa, Cryptosporidium parvum
KESGHISSDNLKDSNSHHS

SEQ ID NO: 2264464 - protein, 7 aa, Cryptosporidium parvum
KESGIQT

SEQ ID NO: 2264465 - protein, 7 aa, Cryptosporidium parvum
KESGNLG

SEQ ID NO: 2264466 - protein, 8 aa, Cryptosporidium parvum
KESGSLGE

SEQ ID NO: 2264467 - protein, 4 aa, Cryptosporidium parvum
KESI

SEQ ID NO: 2264468 - protein, 6 aa, Cryptosporidium parvum
KESIEA

SEQ ID NO: 2264469 - protein, 9 aa, Cryptosporidium parvum
KESIESSEI

SEQ ID NO: 2264470 - protein, 11 aa, Cryptosporidium parvum
KESINKSSSAL

SEQ ID NO: 2264471 - protein, 6 aa, Cryptosporidium parvum
KESKKF

SEQ ID NO: 2264472 - protein, 6 aa, Cryptosporidium parvum
KESKNY

SEQ ID NO: 2264473 - protein, 7 aa, Cryptosporidium parvum
KESKSHL

SEQ ID NO: 2264474 - protein, 8 aa, Cryptosporidium parvum
KESKTGEL

SEQ ID NO: 2264475 - protein, 11 aa, Cryptosporidium parvum
KESLANNHSTD

SEQ ID NO: 2264476 - protein, 19 aa, Cryptosporidium parvum
KESLEDTINHDSDSKEDVD

SEQ ID NO: 2264477 - protein, 14 aa, Cryptosporidium parvum
KESLEKVSKEYSEL

SEQ ID NO: 2264478 - protein, 15 aa, Cryptosporidium parvum
KESLNSKKRNHEGGS

SEQ ID NO: 2264479 - protein, 11 aa, Cryptosporidium parvum
KESLNSRRSAN

SEQ ID NO: 2264480 - protein, 13 aa, Cryptosporidium parvum
KESLQSKSSLLSG

SEQ ID NO: 2264481 - protein, 7 aa, Cryptosporidium parvum
KESLREV

SEQ ID NO: 2264482 - protein, 10 aa, Cryptosporidium parvum
KESMEEDETI

SEQ ID NO: 2264483 - protein, 10 aa, Cryptosporidium parvum
KESMNSNNFQ

SEQ ID NO: 2264484 - protein, 17 aa, Cryptosporidium parvum
KESNCEEKSTPKESSND

SEQ ID NO: 2264485 - protein, 6 aa, Cryptosporidium parvum
KESNEN

SEQ ID NO: 2264486 - protein, 7 aa, Cryptosporidium parvum
KESNENY

SEQ ID NO: 2264487 - protein, 6 aa, Cryptosporidium parvum
KESNIE

SEQ ID NO: 2264488 - protein, 11 aa, Cryptosporidium parvum
KESNIKAKAPL

SEQ ID NO: 2264489 - protein, 20 aa, Cryptosporidium parvum
KESNKGAKKLDINDQDTKSM

SEQ ID NO: 2264490 - protein, 21 aa, Cryptosporidium parvum
KESNMGISSSASASSSSSEVK

SEQ ID NO: 2264491 - protein, 29 aa, Cryptosporidium parvum
KESNNAGNNLNQNSDDINKKLDDQGVNSA

SEQ ID NO: 2264492 - protein, 9 aa, Cryptosporidium parvum
KESNNDNEK

SEQ ID NO: 2264493 - protein, 30 aa, Cryptosporidium parvum
KESNSHKSQSCLSEDESTEIDELSEHDSDI

SEQ ID NO: 2264494 - protein, 13 aa, Cryptosporidium parvum
KESNSNLEKKNKL

SEQ ID NO: 2264495 - protein, 9 aa, Cryptosporidium parvum
KESPDPKSF

SEQ ID NO: 2264496 - protein, 9 aa, Cryptosporidium parvum
KESPTGNGL

SEQ ID NO: 2264497 - protein, 8 aa, Cryptosporidium parvum
KESPTPDE

SEQ ID NO: 2264498 - protein, 16 aa, Cryptosporidium parvum
KESPVASLKPNSDPFR

SEQ ID NO: 2264499 - protein, 17 aa, Cryptosporidium parvum
KESQAKEAEIKEENNKD

SEQ ID NO: 2264500 - protein, 5 aa, Cryptosporidium parvum
KESQL

SEQ ID NO: 2264501 - protein, 30 aa, Cryptosporidium parvum
KESQQNETREKISSNDNNHIEEDSDYEEFR

SEQ ID NO: 2264502 - protein, 6 aa, Cryptosporidium parvum
KESRLD

SEQ ID NO: 2264503 - protein, 16 aa, Cryptosporidium parvum
KESRQCPINKSPSWNS

SEQ ID NO: 2264504 - protein, 5 aa, Cryptosporidium parvum
KESRV

SEQ ID NO: 2264505 - protein, 9 aa, Cryptosporidium parvum
KESSESEMP

SEQ ID NO: 2264506 - protein, 8 aa, Cryptosporidium parvum
KESSFNTR

SEQ ID NO: 2264507 - protein, 5 aa, Cryptosporidium parvum
KESSK

SEQ ID NO: 2264508 - protein, 7 aa, Cryptosporidium parvum
KESSTLG

SEQ ID NO: 2264509 - protein, 5 aa, Cryptosporidium parvum
KESTI

SEQ ID NO: 2264510 - protein, 8 aa, Cryptosporidium parvum
KESTKNAI

SEQ ID NO: 2264511 - protein, 7 aa, Cryptosporidium parvum
KESTQNN

SEQ ID NO: 2264512 - protein, 5 aa, Cryptosporidium parvum
KESYN

SEQ ID NO: 2264513 - protein, 6 aa, Cryptosporidium parvum
KETEDL

SEQ ID NO: 2264514 - protein, 6 aa, Cryptosporidium parvum
KETEDS

SEQ ID NO: 2264515 - protein, 34 aa, Cryptosporidium parvum
KETEEEQDQDQDKQKQENEVKKINNNKKDIEIEE

SEQ ID NO: 2264516 - protein, 10 aa, Cryptosporidium parvum
KETEGPSTRE

SEQ ID NO: 2264517 - protein, 6 aa, Cryptosporidium parvum
KETEIR

SEQ ID NO: 2264518 - protein, 13 aa, Cryptosporidium parvum
KETGDGETHSRQN

SEQ ID NO: 2264519 - protein, 13 aa, Cryptosporidium parvum
KETHDESSRSLKR

SEQ ID NO: 2264520 - protein, 14 aa, Cryptosporidium parvum
KETHPTSNKSNNVY

SEQ ID NO: 2264521 - protein, 9 aa, Cryptosporidium parvum
KETHTGTVY

SEQ ID NO: 2264522 - protein, 10 aa, Cryptosporidium parvum
KETKPPPILS

SEQ ID NO: 2264523 - protein, 10 aa, Cryptosporidium parvum
KETLEEEVDQ

SEQ ID NO: 2264524 - protein, 8 aa, Cryptosporidium parvum
KETNIDGE

SEQ ID NO: 2264525 - protein, 12 aa, Cryptosporidium parvum
KETNKDGITKSE

SEQ ID NO: 2264526 - protein, 28 aa, Cryptosporidium parvum
KETNKRRRSLPSLSNESNSEFIGKGNNS

SEQ ID NO: 2264527 - protein, 7 aa, Cryptosporidium parvum
KETNQEL

SEQ ID NO: 2264528 - protein, 7 aa, Cryptosporidium parvum
KETNSDI

SEQ ID NO: 2264529 - protein, 9 aa, Cryptosporidium parvum
KETSVDGGS

SEQ ID NO: 2264530 - protein, 5 aa, Cryptosporidium parvum
KETTE

SEQ ID NO: 2264531 - protein, 9 aa, Cryptosporidium parvum
KETVTGTGT

SEQ ID NO: 2264532 - protein, 4 aa, Cryptosporidium parvum
KETY

SEQ ID NO: 2264533 - protein, 36 aa, Cryptosporidium parvum
KEVAGSESYSSSPLLDNSSQTLSESANSNSTKTDNL

SEQ ID NO: 2264534 - protein, 13 aa, Cryptosporidium parvum
KEVEQELSKKKEL

SEQ ID NO: 2264535 - protein, 5 aa, Cryptosporidium parvum
KEVGS

SEQ ID NO: 2264536 - protein, 15 aa, Cryptosporidium parvum
KEVKGKASSGSVGDV

SEQ ID NO: 2264537 - protein, 17 aa, Cryptosporidium parvum
KEVKKNRGEIEAERRNL

SEQ ID NO: 2264538 - protein, 9 aa, Cryptosporidium parvum
KEVNDRQKS

SEQ ID NO: 2264539 - protein, 14 aa, Cryptosporidium parvum
KEVNEKKKNELTAE

SEQ ID NO: 2264540 - protein, 12 aa, Cryptosporidium parvum
KEVNPNTKAISP

SEQ ID NO: 2264541 - protein, 10 aa, Cryptosporidium parvum
KEVNTPQDRE

SEQ ID NO: 2264542 - protein, 24 aa, Cryptosporidium parvum
KEVQSQTEKQDEEEISTKQNESHY

SEQ ID NO: 2264543 - protein, 8 aa, Cryptosporidium parvum
KEVRRETS

SEQ ID NO: 2264544 - protein, 10 aa, Cryptosporidium parvum
KEVSDTNSND

SEQ ID NO: 2264545 - protein, 8 aa, Cryptosporidium parvum
KEVTPGNV

SEQ ID NO: 2264546 - protein, 9 aa, Cryptosporidium parvum
KEWDGDNKR

SEQ ID NO: 2264547 - protein, 10 aa, Cryptosporidium parvum
KEWESEPRQS

SEQ ID NO: 2264548 - protein, 6 aa, Cryptosporidium parvum
KEWGGS

SEQ ID NO: 2264549 - protein, 7 aa, Cryptosporidium parvum
KEYAKQY

SEQ ID NO: 2264550 - protein, 4 aa, Cryptosporidium parvum
KEYE

SEQ ID NO: 2264551 - protein, 4 aa, Cryptosporidium parvum
KEYG

SEQ ID NO: 2264552 - protein, 10 aa, Cryptosporidium parvum
KEYKSNNIPN

SEQ ID NO: 2264553 - protein, 13 aa, Cryptosporidium parvum
KEYNEAKSKLNEI

SEQ ID NO: 2264554 - protein, 4 aa, Cryptosporidium parvum
KEYQ

SEQ ID NO: 2264555 - protein, 7 aa, Cryptosporidium parvum
KEYRSKD

SEQ ID NO: 2264556 - protein, 28 aa, Cryptosporidium parvum
KEYSDEEKQSKLDKKDNNQDDVDMDDSN

SEQ ID NO: 2264557 - protein, 10 aa, Cryptosporidium parvum
KEYSGANGGY

SEQ ID NO: 2264558 - protein, 10 aa, Cryptosporidium parvum
KFARQGTNPG

SEQ ID NO: 2264559 - protein, 7 aa, Cryptosporidium parvum
KFATQEH

SEQ ID NO: 2264560 - protein, 4 aa, Cryptosporidium parvum
KFDN

SEQ ID NO: 2264561 - protein, 18 aa, Cryptosporidium parvum
KFDSGETEEKSSDIYTRT

SEQ ID NO: 2264562 - protein, 6 aa, Cryptosporidium parvum
KFEDNN

SEQ ID NO: 2264563 - protein, 7 aa, Cryptosporidium parvum
KFEEKDD

SEQ ID NO: 2264564 - protein, 26 aa, Cryptosporidium parvum
KFEKSKQEIESEKRRLERENNKLTKD

SEQ ID NO: 2264565 - protein, 5 aa, Cryptosporidium parvum
KFEQN

SEQ ID NO: 2264566 - protein, 6 aa, Cryptosporidium parvum
KFESNE

SEQ ID NO: 2264567 - protein, 8 aa, Cryptosporidium parvum
KFESSRNE

SEQ ID NO: 2264568 - protein, 5 aa, Cryptosporidium parvum
KFETG

SEQ ID NO: 2264569 - protein, 19 aa, Cryptosporidium parvum
KFETNKKKSEIYSPKYPTF

SEQ ID NO: 2264570 - protein, 5 aa, Cryptosporidium parvum
KFGGD

SEQ ID NO: 2264571 - protein, 6 aa, Cryptosporidium parvum
KFGGNK

SEQ ID NO: 2264572 - protein, 5 aa, Cryptosporidium parvum
KFGKK

SEQ ID NO: 2264573 - protein, 10 aa, Cryptosporidium parvum
KFGKKIERQI

SEQ ID NO: 2264574 - protein, 8 aa, Cryptosporidium parvum
KFGNEEVA

SEQ ID NO: 2264575 - protein, 20 aa, Cryptosporidium parvum
KFGPPTTPKDLAKNNHGQNN

SEQ ID NO: 2264576 - protein, 5 aa, Cryptosporidium parvum
KFGPS

SEQ ID NO: 2264577 - protein, 4 aa, Cryptosporidium parvum
KFGS

SEQ ID NO: 2264578 - protein, 8 aa, Cryptosporidium parvum
KFKKDNSR

SEQ ID NO: 2264579 - protein, 6 aa, Cryptosporidium parvum
KFKKGK

SEQ ID NO: 2264580 - protein, 15 aa, Cryptosporidium parvum
KFKTRERKSNLSSEL

SEQ ID NO: 2264581 - protein, 4 aa, Cryptosporidium parvum
KFLD

SEQ ID NO: 2264582 - protein, 5 aa, Cryptosporidium parvum
KFNEN

SEQ ID NO: 2264583 - protein, 8 aa, Cryptosporidium parvum
KFNPYGGK

SEQ ID NO: 2264584 - protein, 7 aa, Cryptosporidium parvum
KFNSKPS

SEQ ID NO: 2264585 - protein, 6 aa, Cryptosporidium parvum
KFNSTD

SEQ ID NO: 2264586 - protein, 7 aa, Cryptosporidium parvum
KFPDNND

SEQ ID NO: 2264587 - protein, 7 aa, Cryptosporidium parvum
KFPGQNE

SEQ ID NO: 2264588 - protein, 5 aa, Cryptosporidium parvum
KFPGR

SEQ ID NO: 2264589 - protein, 9 aa, Cryptosporidium parvum
KFPPLPNSN

SEQ ID NO: 2264590 - protein, 7 aa, Cryptosporidium parvum
KFPPPIP

SEQ ID NO: 2264591 - protein, 7 aa, Cryptosporidium parvum
KFPRKSS

SEQ ID NO: 2264592 - protein, 10 aa, Cryptosporidium parvum
KFQAKTRNVA

SEQ ID NO: 2264593 - protein, 4 aa, Cryptosporidium parvum
KFQE

SEQ ID NO: 2264594 - protein, 11 aa, Cryptosporidium parvum
KFQESDSNGKE

SEQ ID NO: 2264595 - protein, 7 aa, Cryptosporidium parvum
KFQKKTS

SEQ ID NO: 2264596 - protein, 6 aa, Cryptosporidium parvum
KFQQRK

SEQ ID NO: 2264597 - protein, 6 aa, Cryptosporidium parvum
KFQSRY

SEQ ID NO: 2264598 - protein, 12 aa, Cryptosporidium parvum
KFQTNSETKLKN

SEQ ID NO: 2264599 - protein, 5 aa, Cryptosporidium parvum
KFQTS

SEQ ID NO: 2264600 - protein, 6 aa, Cryptosporidium parvum
KFRPRK

SEQ ID NO: 2264601 - protein, 20 aa, Cryptosporidium parvum
KFSASNPYGVRDKNDNRQFV

SEQ ID NO: 2264602 - protein, 11 aa, Cryptosporidium parvum
KFSASRKTGAF

SEQ ID NO: 2264603 - protein, 15 aa, Cryptosporidium parvum
KFSEESNQNNEEVNQ

SEQ ID NO: 2264604 - protein, 13 aa, Cryptosporidium parvum
KFSENSKKLTQKE

SEQ ID NO: 2264605 - protein, 12 aa, Cryptosporidium parvum
KFSERSQDESIE

SEQ ID NO: 2264606 - protein, 5 aa, Cryptosporidium parvum
KFSKN

SEQ ID NO: 2264607 - protein, 12 aa, Cryptosporidium parvum
KFSKRSDKNEYA

SEQ ID NO: 2264608 - protein, 8 aa, Cryptosporidium parvum
KFSKSDNL

SEQ ID NO: 2264609 - protein, 6 aa, Cryptosporidium parvum
KFSKYD

SEQ ID NO: 2264610 - protein, 4 aa, Cryptosporidium parvum
KFSN

SEQ ID NO: 2264611 - protein, 12 aa, Cryptosporidium parvum
KFSNSKKTDKSN

SEQ ID NO: 2264612 - protein, 6 aa, Cryptosporidium parvum
KFSPAN

SEQ ID NO: 2264613 - protein, 10 aa, Cryptosporidium parvum
KFSQNSSFEG

SEQ ID NO: 2264614 - protein, 31 aa, Cryptosporidium parvum
KFSSENSKNPLPNDITPIESGSFETNGQEID

SEQ ID NO: 2264615 - protein, 9 aa, Cryptosporidium parvum
KFSSSERDI

SEQ ID NO: 2264616 - protein, 13 aa, Cryptosporidium parvum
KFSSTRFQSEKSG

SEQ ID NO: 2264617 - protein, 5 aa, Cryptosporidium parvum
KFSTE

SEQ ID NO: 2264618 - protein, 7 aa, Cryptosporidium parvum
KFSTRSF

SEQ ID NO: 2264619 - protein, 6 aa, Cryptosporidium parvum
KFSTSE

SEQ ID NO: 2264620 - protein, 12 aa, Cryptosporidium parvum
KFTEASKNVGSK

SEQ ID NO: 2264621 - protein, 6 aa, Cryptosporidium parvum
KFTESK

SEQ ID NO: 2264622 - protein, 5 aa, Cryptosporidium parvum
KFTKD

SEQ ID NO: 2264623 - protein, 6 aa, Cryptosporidium parvum
KFTKTS

SEQ ID NO: 2264624 - protein, 6 aa, Cryptosporidium parvum
KFTNDR

SEQ ID NO: 2264625 - protein, 8 aa, Cryptosporidium parvum
KFTNSTSS

SEQ ID NO: 2264626 - protein, 6 aa, Cryptosporidium parvum
KFTSPK

SEQ ID NO: 2264627 - protein, 22 aa, Cryptosporidium parvum
KFYGSPELDNTDLEDSNNSELD

SEQ ID NO: 2264628 - protein, 8 aa, Cryptosporidium parvum
KGAASYPI

SEQ ID NO: 2264629 - protein, 5 aa, Cryptosporidium parvum
KGADD

SEQ ID NO: 2264630 - protein, 6 aa, Cryptosporidium parvum
KGADIP

SEQ ID NO: 2264631 - protein, 14 aa, Cryptosporidium parvum
KGADSSSQNDGYFK

SEQ ID NO: 2264632 - protein, 5 aa, Cryptosporidium parvum
KGAIL

SEQ ID NO: 2264633 - protein, 8 aa, Cryptosporidium parvum
KGAIPDWS

SEQ ID NO: 2264634 - protein, 14 aa, Cryptosporidium parvum
KGAKPDVEESGNER

SEQ ID NO: 2264635 - protein, 6 aa, Cryptosporidium parvum
KGAKSV

SEQ ID NO: 2264636 - protein, 10 aa, Cryptosporidium parvum
KGANSPCSHC

SEQ ID NO: 2264637 - protein, 9 aa, Cryptosporidium parvum
KGANTNFRD

SEQ ID NO: 2264638 - protein, 5 aa, Cryptosporidium parvum
KGAPN

SEQ ID NO: 2264639 - protein, 5 aa, Cryptosporidium parvum
KGAPV

SEQ ID NO: 2264640 - protein, 9 aa, Cryptosporidium parvum
KGAQEYRQA

SEQ ID NO: 2264641 - protein, 52 aa, Cryptosporidium parvum
KGASQKAAESQQNKQNNTSNESNTNTDPAASATTSNIQAQSGNSDPSIDSRA

SEQ ID NO: 2264642 - protein, 7 aa, Cryptosporidium parvum
KGASVKV

SEQ ID NO: 2264643 - protein, 7 aa, Cryptosporidium parvum
KGATDGG

SEQ ID NO: 2264644 - protein, 10 aa, Cryptosporidium parvum
KGATGDPNIS

SEQ ID NO: 2264645 - protein, 11 aa, Cryptosporidium parvum
KGDASNVPAAQ

SEQ ID NO: 2264646 - protein, 7 aa, Cryptosporidium parvum
KGDDKGV

SEQ ID NO: 2264647 - protein, 5 aa, Cryptosporidium parvum
KGDEL

SEQ ID NO: 2264648 - protein, 7 aa, Cryptosporidium parvum
KGDEYEF

SEQ ID NO: 2264649 - protein, 5 aa, Cryptosporidium parvum
KGDGN

SEQ ID NO: 2264650 - protein, 12 aa, Cryptosporidium parvum
KGDHLTNNSNID

SEQ ID NO: 2264651 - protein, 8 aa, Cryptosporidium parvum
KGDISESG

SEQ ID NO: 2264652 - protein, 7 aa, Cryptosporidium parvum
KGDNANS

SEQ ID NO: 2264653 - protein, 7 aa, Cryptosporidium parvum
KGDNFNS

SEQ ID NO: 2264654 - protein, 6 aa, Cryptosporidium parvum
KGDPDT

SEQ ID NO: 2264655 - protein, 7 aa, Cryptosporidium parvum
KGDPETC

SEQ ID NO: 2264656 - protein, 10 aa, Cryptosporidium parvum
KGDSSNDPMG

SEQ ID NO: 2264657 - protein, 4 aa, Cryptosporidium parvum
KGDT

SEQ ID NO: 2264658 - protein, 5 aa, Cryptosporidium parvum
KGDTA

SEQ ID NO: 2264659 - protein, 5 aa, Cryptosporidium parvum
KGDTN

SEQ ID NO: 2264660 - protein, 9 aa, Cryptosporidium parvum
KGDVQGSEN

SEQ ID NO: 2264661 - protein, 8 aa, Cryptosporidium parvum
KGEANDPL

SEQ ID NO: 2264662 - protein, 9 aa, Cryptosporidium parvum
KGEEGDNLS

SEQ ID NO: 2264663 - protein, 5 aa, Cryptosporidium parvum
KGEES

SEQ ID NO: 2264664 - protein, 16 aa, Cryptosporidium parvum
KGEFETGFERGGQTRE

SEQ ID NO: 2264665 - protein, 34 aa, Cryptosporidium parvum
KGEGDKNNEQNNFTSNDLNGNTSIVSKEDGSSRF

SEQ ID NO: 2264666 - protein, 8 aa, Cryptosporidium parvum
KGEGELEN

SEQ ID NO: 2264667 - protein, 7 aa, Cryptosporidium parvum
KGEGGIS

SEQ ID NO: 2264668 - protein, 6 aa, Cryptosporidium parvum
KGEGKI

SEQ ID NO: 2264669 - protein, 6 aa, Cryptosporidium parvum
KGEGKS

SEQ ID NO: 2264670 - protein, 4 aa, Cryptosporidium parvum
KGEI

SEQ ID NO: 2264671 - protein, 7 aa, Cryptosporidium parvum
KGEIENK

SEQ ID NO: 2264672 - protein, 7 aa, Cryptosporidium parvum
KGEISSL

SEQ ID NO: 2264673 - protein, 14 aa, Cryptosporidium parvum
KGEKIKSSVKLFYE

SEQ ID NO: 2264674 - protein, 6 aa, Cryptosporidium parvum
KGEKIS

SEQ ID NO: 2264675 - protein, 5 aa, Cryptosporidium parvum
KGEKS

SEQ ID NO: 2264676 - protein, 24 aa, Cryptosporidium parvum
KGELESRREEAKQMEEESQKELTR

SEQ ID NO: 2264677 - protein, 5 aa, Cryptosporidium parvum
KGELI

SEQ ID NO: 2264678 - protein, 6 aa, Cryptosporidium parvum
KGELRG

SEQ ID NO: 2264679 - protein, 4 aa, Cryptosporidium parvum
KGEM

SEQ ID NO: 2264680 - protein, 30 aa, Cryptosporidium parvum
KGENDPKKKLTLEERNYDYSSAGPEADRGW

SEQ ID NO: 2264681 - protein, 6 aa, Cryptosporidium parvum
KGEQEL

SEQ ID NO: 2264682 - protein, 8 aa, Cryptosporidium parvum
KGESERRT

SEQ ID NO: 2264683 - protein, 18 aa, Cryptosporidium parvum
KGESISTNDHTRKDEIDE

SEQ ID NO: 2264684 - protein, 8 aa, Cryptosporidium parvum
KGESSQRD

SEQ ID NO: 2264685 - protein, 13 aa, Cryptosporidium parvum
KGESSSSSPPLLS

SEQ ID NO: 2264686 - protein, 7 aa, Cryptosporidium parvum
KGETNKL

SEQ ID NO: 2264687 - protein, 7 aa, Cryptosporidium parvum
KGEVIGE

SEQ ID NO: 2264688 - protein, 5 aa, Cryptosporidium parvum
KGEVP

SEQ ID NO: 2264689 - protein, 9 aa, Cryptosporidium parvum
KGEYDEKSD

SEQ ID NO: 2264690 - protein, 6 aa, Cryptosporidium parvum
KGEYDN

SEQ ID NO: 2264691 - protein, 8 aa, Cryptosporidium parvum
KGEYNKKI

SEQ ID NO: 2264692 - protein, 6 aa, Cryptosporidium parvum
KGFEEG

SEQ ID NO: 2264693 - protein, 5 aa, Cryptosporidium parvum
KGFKS

SEQ ID NO: 2264694 - protein, 17 aa, Cryptosporidium parvum
KGFSSQNGRATGETSGG

SEQ ID NO: 2264695 - protein, 5 aa, Cryptosporidium parvum
KGFTD

SEQ ID NO: 2264696 - protein, 7 aa, Cryptosporidium parvum
KGFTDKS

SEQ ID NO: 2264697 - protein, 13 aa, Cryptosporidium parvum
KGGDYQKIAESEM

SEQ ID NO: 2264698 - protein, 13 aa, Cryptosporidium parvum
KGGFEEREKASVN

SEQ ID NO: 2264699 - protein, 6 aa, Cryptosporidium parvum
KGGGNL

SEQ ID NO: 2264700 - protein, 7 aa, Cryptosporidium parvum
KGGISSA

SEQ ID NO: 2264701 - protein, 9 aa, Cryptosporidium parvum
KGGRETRLS

SEQ ID NO: 2264702 - protein, 10 aa, Cryptosporidium parvum
KGGRNSQKCP

SEQ ID NO: 2264703 - protein, 26 aa, Cryptosporidium parvum
KGGSRPKGISKEQDLNQARRKGEEII

SEQ ID NO: 2264704 - protein, 5 aa, Cryptosporidium parvum
KGGTR

SEQ ID NO: 2264705 - protein, 40 aa, Cryptosporidium parvum
KGGVDNNGQDNISSSSFSSSSSSSSSSSSSSSSSSTPGFE

SEQ ID NO: 2264706 - protein, 12 aa, Cryptosporidium parvum
KGGVGKTTTSCS

SEQ ID NO: 2264707 - protein, 21 aa, Cryptosporidium parvum
KGGYDDFDNRRSKNSGKKEVI

SEQ ID NO: 2264708 - protein, 6 aa, Cryptosporidium parvum
KGHITK

SEQ ID NO: 2264709 - protein, 8 aa, Cryptosporidium parvum
KGIDPKKI

SEQ ID NO: 2264710 - protein, 20 aa, Cryptosporidium parvum
KGIEEDEKIQTSSNTKGGIQ

SEQ ID NO: 2264711 - protein, 6 aa, Cryptosporidium parvum
KGIGPH

SEQ ID NO: 2264712 - protein, 11 aa, Cryptosporidium parvum
KGIMTESNGDI

SEQ ID NO: 2264713 - protein, 4 aa, Cryptosporidium parvum
KGIN

SEQ ID NO: 2264714 - protein, 12 aa, Cryptosporidium parvum
KGINNQNNLKDQ

SEQ ID NO: 2264715 - protein, 7 aa, Cryptosporidium parvum
KGINSQS

SEQ ID NO: 2264716 - protein, 4 aa, Cryptosporidium parvum
KGIP

SEQ ID NO: 2264717 - protein, 25 aa, Cryptosporidium parvum
KGIPKDCKGEDKNDNLDKKNKERNK

SEQ ID NO: 2264718 - protein, 5 aa, Cryptosporidium parvum
KGIPN

SEQ ID NO: 2264719 - protein, 4 aa, Cryptosporidium parvum
KGIS

SEQ ID NO: 2264720 - protein, 15 aa, Cryptosporidium parvum
KGISSSAKPYRRRPP

SEQ ID NO: 2264721 - protein, 4 aa, Cryptosporidium parvum
KGIT

SEQ ID NO: 2264722 - protein, 4 aa, Cryptosporidium parvum
KGIY

SEQ ID NO: 2264723 - protein, 18 aa, Cryptosporidium parvum
KGKEGRFRGNLSGKRVDF

SEQ ID NO: 2264724 - protein, 6 aa, Cryptosporidium parvum
KGKEKY

SEQ ID NO: 2264725 - protein, 8 aa, Cryptosporidium parvum
KGKESPDV

SEQ ID NO: 2264726 - protein, 16 aa, Cryptosporidium parvum
KGKEVIKNTKNRHRTS

SEQ ID NO: 2264727 - protein, 4 aa, Cryptosporidium parvum
KGKF

SEQ ID NO: 2264728 - protein, 7 aa, Cryptosporidium parvum
KGKGEQR

SEQ ID NO: 2264729 - protein, 8 aa, Cryptosporidium parvum
KGKGRRAD

SEQ ID NO: 2264730 - protein, 6 aa, Cryptosporidium parvum
KGKGYG

SEQ ID NO: 2264731 - protein, 7 aa, Cryptosporidium parvum
KGKGYKG

SEQ ID NO: 2264732 - protein, 5 aa, Cryptosporidium parvum
KGKHI

SEQ ID NO: 2264733 - protein, 16 aa, Cryptosporidium parvum
KGKHSNIRKDGQLDNF

SEQ ID NO: 2264734 - protein, 15 aa, Cryptosporidium parvum
KGKINGDCSESTNSL

SEQ ID NO: 2264735 - protein, 8 aa, Cryptosporidium parvum
KGKIPPRK

SEQ ID NO: 2264736 - protein, 5 aa, Cryptosporidium parvum
KGKKS

SEQ ID NO: 2264737 - protein, 7 aa, Cryptosporidium parvum
KGKLGLG

SEQ ID NO: 2264738 - protein, 18 aa, Cryptosporidium parvum
KGKMEENQLEDDKSVSEC

SEQ ID NO: 2264739 - protein, 8 aa, Cryptosporidium parvum
KGKNMQED

SEQ ID NO: 2264740 - protein, 8 aa, Cryptosporidium parvum
KGKRLPRG

SEQ ID NO: 2264741 - protein, 12 aa, Cryptosporidium parvum
KGKRNSKLEGEH

SEQ ID NO: 2264742 - protein, 20 aa, Cryptosporidium parvum
KGKSDTNNSKIDTDNMDENE

SEQ ID NO: 2264743 - protein, 36 aa, Cryptosporidium parvum
KGKSVDSRKKLSTASNESENTGSAKVTTGSDSMSNK

SEQ ID NO: 2264744 - protein, 7 aa, Cryptosporidium parvum
KGKTGQF

SEQ ID NO: 2264745 - protein, 9 aa, Cryptosporidium parvum
KGKVEKGTI

SEQ ID NO: 2264746 - protein, 11 aa, Cryptosporidium parvum
KGKWTKEEEQE

SEQ ID NO: 2264747 - protein, 7 aa, Cryptosporidium parvum
KGKYGSV

SEQ ID NO: 2264748 - protein, 4 aa, Cryptosporidium parvum
KGLA

SEQ ID NO: 2264749 - protein, 15 aa, Cryptosporidium parvum
KGLANSDVWEDQSLL

SEQ ID NO: 2264750 - protein, 4 aa, Cryptosporidium parvum
KGLE

SEQ ID NO: 2264751 - protein, 6 aa, Cryptosporidium parvum
KGLEEE

SEQ ID NO: 2264752 - protein, 21 aa, Cryptosporidium parvum
KGLEETCSSKNSSTNKPVSSV

SEQ ID NO: 2264753 - protein, 11 aa, Cryptosporidium parvum
KGLGAEDQYKN

SEQ ID NO: 2264754 - protein, 24 aa, Cryptosporidium parvum
KGLHNKRKKQVNAQKNQEQTSKQF

SEQ ID NO: 2264755 - protein, 6 aa, Cryptosporidium parvum
KGLKSF

SEQ ID NO: 2264756 - protein, 8 aa, Cryptosporidium parvum
KGLNEGGS

SEQ ID NO: 2264757 - protein, 13 aa, Cryptosporidium parvum
KGLNSKKASRSEL

SEQ ID NO: 2264758 - protein, 6 aa, Cryptosporidium parvum
KGLPIQ

SEQ ID NO: 2264759 - protein, 8 aa, Cryptosporidium parvum
KGLQHDRY

SEQ ID NO: 2264760 - protein, 6 aa, Cryptosporidium parvum
KGLRGE

SEQ ID NO: 2264761 - protein, 5 aa, Cryptosporidium parvum
KGLSI

SEQ ID NO: 2264762 - protein, 8 aa, Cryptosporidium parvum
KGLSNIKN

SEQ ID NO: 2264763 - protein, 12 aa, Cryptosporidium parvum
KGLSQSSSHHSL

SEQ ID NO: 2264764 - protein, 7 aa, Cryptosporidium parvum
KGLSSRS

SEQ ID NO: 2264765 - protein, 4 aa, Cryptosporidium parvum
KGLT

SEQ ID NO: 2264766 - protein, 15 aa, Cryptosporidium parvum
KGLTRKRKKIEGNAR

SEQ ID NO: 2264767 - protein, 13 aa, Cryptosporidium parvum
KGMQSKGNQINSG

SEQ ID NO: 2264768 - protein, 10 aa, Cryptosporidium parvum
KGNCPSSKGL

SEQ ID NO: 2264769 - protein, 10 aa, Cryptosporidium parvum
KGNGMPNTRD

SEQ ID NO: 2264770 - protein, 6 aa, Cryptosporidium parvum
KGNGPC

SEQ ID NO: 2264771 - protein, 4 aa, Cryptosporidium parvum
KGNI

SEQ ID NO: 2264772 - protein, 7 aa, Cryptosporidium parvum
KGNKENF

SEQ ID NO: 2264773 - protein, 6 aa, Cryptosporidium parvum
KGNKNF

SEQ ID NO: 2264774 - protein, 11 aa, Cryptosporidium parvum
KGNLSEDLSPD

SEQ ID NO: 2264775 - protein, 8 aa, Cryptosporidium parvum
KGNNSNQM

SEQ ID NO: 2264776 - protein, 6 aa, Cryptosporidium parvum
KGNPVN

SEQ ID NO: 2264777 - protein, 5 aa, Cryptosporidium parvum
KGNQQ

SEQ ID NO: 2264778 - protein, 11 aa, Cryptosporidium parvum
KGNSAGAMGQP

SEQ ID NO: 2264779 - protein, 9 aa, Cryptosporidium parvum
KGNSNNKVL

SEQ ID NO: 2264780 - protein, 7 aa, Cryptosporidium parvum
KGNSRRN

SEQ ID NO: 2264781 - protein, 10 aa, Cryptosporidium parvum
KGNTNSKTSS

SEQ ID NO: 2264782 - protein, 4 aa, Cryptosporidium parvum
KGNV

SEQ ID NO: 2264783 - protein, 4 aa, Cryptosporidium parvum
KGNY

SEQ ID NO: 2264784 - protein, 6 aa, Cryptosporidium parvum
KGNYKK

SEQ ID NO: 2264785 - protein, 11 aa, Cryptosporidium parvum
KGNYKKGKGDI

SEQ ID NO: 2264786 - protein, 6 aa, Cryptosporidium parvum
KGNYSN

SEQ ID NO: 2264787 - protein, 6 aa, Cryptosporidium parvum
KGPEEL

SEQ ID NO: 2264788 - protein, 6 aa, Cryptosporidium parvum
KGPFIA

SEQ ID NO: 2264789 - protein, 5 aa, Cryptosporidium parvum
KGPGF

SEQ ID NO: 2264790 - protein, 4 aa, Cryptosporidium parvum
KGPM

SEQ ID NO: 2264791 - protein, 6 aa, Cryptosporidium parvum
KGPPIF

SEQ ID NO: 2264792 - protein, 7 aa, Cryptosporidium parvum
KGPSPFP

SEQ ID NO: 2264793 - protein, 31 aa, Cryptosporidium parvum
KGPSRNERENISDSIKEDNNKGNDKVTKQGL

SEQ ID NO: 2264794 - protein, 6 aa, Cryptosporidium parvum
KGPVRG

SEQ ID NO: 2264795 - protein, 9 aa, Cryptosporidium parvum
KGQESDDEY

SEQ ID NO: 2264796 - protein, 10 aa, Cryptosporidium parvum
KGQESEINSN

SEQ ID NO: 2264797 - protein, 10 aa, Cryptosporidium parvum
KGQLANSDDL

SEQ ID NO: 2264798 - protein, 7 aa, Cryptosporidium parvum
KGQMNQN

SEQ ID NO: 2264799 - protein, 8 aa, Cryptosporidium parvum
KGQNIESQ

SEQ ID NO: 2264800 - protein, 6 aa, Cryptosporidium parvum
KGQPFE

SEQ ID NO: 2264801 - protein, 22 aa, Cryptosporidium parvum
KGQRGFSGSSGSTSVSSTGAIA

SEQ ID NO: 2264802 - protein, 16 aa, Cryptosporidium parvum
KGRASTGMQQDPAISS

SEQ ID NO: 2264803 - protein, 17 aa, Cryptosporidium parvum
KGRESTTSSKSENSRNA

SEQ ID NO: 2264804 - protein, 4 aa, Cryptosporidium parvum
KGRG

SEQ ID NO: 2264805 - protein, 6 aa, Cryptosporidium parvum
KGRGIL

SEQ ID NO: 2264806 - protein, 18 aa, Cryptosporidium parvum
KGRKNENKSKSYEKESII

SEQ ID NO: 2264807 - protein, 5 aa, Cryptosporidium parvum
KGRNE

SEQ ID NO: 2264808 - protein, 10 aa, Cryptosporidium parvum
KGRNFQEKNQ

SEQ ID NO: 2264809 - protein, 7 aa, Cryptosporidium parvum
KGRPTIN

SEQ ID NO: 2264810 - protein, 9 aa, Cryptosporidium parvum
KGRTNEEMN

SEQ ID NO: 2264811 - protein, 6 aa, Cryptosporidium parvum
KGSDAS

SEQ ID NO: 2264812 - protein, 5 aa, Cryptosporidium parvum
KGSDG

SEQ ID NO: 2264813 - protein, 6 aa, Cryptosporidium parvum
KGSEEI

SEQ ID NO: 2264814 - protein, 10 aa, Cryptosporidium parvum
KGSGSGSKKG

SEQ ID NO: 2264815 - protein, 5 aa, Cryptosporidium parvum
KGSIG

SEQ ID NO: 2264816 - protein, 6 aa, Cryptosporidium parvum
KGSKGI

SEQ ID NO: 2264817 - protein, 19 aa, Cryptosporidium parvum
KGSKLESNYNRKNENITPE

SEQ ID NO: 2264818 - protein, 9 aa, Cryptosporidium parvum
KGSKNNNKF

SEQ ID NO: 2264819 - protein, 37 aa, Cryptosporidium parvum; identical to SEQ ID NO: 2147543

SEQ ID NO: 2264820 - protein, 10 aa, Cryptosporidium parvum
KGSNNPEISS

SEQ ID NO: 2264821 - protein, 7 aa, Cryptosporidium parvum
KGSPHSI

SEQ ID NO: 2264822 - protein, 25 aa, Cryptosporidium parvum
KGSQKPKNLSDNSLDHDSNVDNSQV

SEQ ID NO: 2264823 - protein, 6 aa, Cryptosporidium parvum
KGSRIN

SEQ ID NO: 2264824 - protein, 8 aa, Cryptosporidium parvum
KGSRNRIN

SEQ ID NO: 2264825 - protein, 8 aa, Cryptosporidium parvum
KGSRSQTE

SEQ ID NO: 2264826 - protein, 4 aa, Cryptosporidium parvum
KGSS

SEQ ID NO: 2264827 - protein, 21 aa, Cryptosporidium parvum
KGSSHIKNKQKIDGQENYKMN

SEQ ID NO: 2264828 - protein, 8 aa, Cryptosporidium parvum
KGSSREDG

SEQ ID NO: 2264829 - protein, 7 aa, Cryptosporidium parvum
KGSSTYG

SEQ ID NO: 2264830 - protein, 9 aa, Cryptosporidium parvum
KGSTENARK

SEQ ID NO: 2264831 - protein, 12 aa, Cryptosporidium parvum
KGSVKACSGGQT

SEQ ID NO: 2264832 - protein, 8 aa, Cryptosporidium parvum
KGSYDSYS

SEQ ID NO: 2264833 - protein, 6 aa, Cryptosporidium parvum
KGTDDF

SEQ ID NO: 2264834 - protein, 7 aa, Cryptosporidium parvum
KGTGISH

SEQ ID NO: 2264835 - protein, 6 aa, Cryptosporidium parvum
KGTGVV

SEQ ID NO: 2264836 - protein, 8 aa, Cryptosporidium parvum
KGTHTGEE

SEQ ID NO: 2264837 - protein, 6 aa, Cryptosporidium parvum
KGTIQS

SEQ ID NO: 2264838 - protein, 8 aa, Cryptosporidium parvum
KGTKDAIH

SEQ ID NO: 2264839 - protein, 6 aa, Cryptosporidium parvum
KGTNEV

SEQ ID NO: 2264840 - protein, 6 aa, Cryptosporidium parvum
KGTPEK

SEQ ID NO: 2264841 - protein, 8 aa, Cryptosporidium parvum
KGTPKYGE

SEQ ID NO: 2264842 - protein, 6 aa, Cryptosporidium parvum
KGTRAY

SEQ ID NO: 2264843 - protein, 8 aa, Cryptosporidium parvum
KGTRIRRA

SEQ ID NO: 2264844 - protein, 16 aa, Cryptosporidium parvum
KGTTIESDDKTVSQNE

SEQ ID NO: 2264845 - protein, 10 aa, Cryptosporidium parvum
KGVNTETTGN

SEQ ID NO: 2264846 - protein, 12 aa, Cryptosporidium parvum
KGVSQRGYNSSL

SEQ ID NO: 2264847 - protein, 17 aa, Cryptosporidium parvum
KGVSSSTKKVTKSEVAK

SEQ ID NO: 2264848 - protein, 8 aa, Cryptosporidium parvum
KGVTDNAL

SEQ ID NO: 2264849 - protein, 15 aa, Cryptosporidium parvum
KGVTYTNGAISNGAN

SEQ ID NO: 2264850 - protein, 11 aa, Cryptosporidium parvum
KGYDNTAINNS

SEQ ID NO: 2264851 - protein, 10 aa, Cryptosporidium parvum
KGYGGENETF

SEQ ID NO: 2264852 - protein, 7 aa, Cryptosporidium parvum
KGYGKDA

SEQ ID NO: 2264853 - protein, 8 aa, Cryptosporidium parvum
KGYKLEED

SEQ ID NO: 2264854 - protein, 7 aa, Cryptosporidium parvum
KGYPDDT

SEQ ID NO: 2264855 - protein, 7 aa, Cryptosporidium parvum
KGYRTGT

SEQ ID NO: 2264856 - protein, 6 aa, Cryptosporidium parvum
KGYTES

SEQ ID NO: 2264857 - protein, 18 aa, Cryptosporidium parvum
KHAGKKLEKTSEIPTPEQ

SEQ ID NO: 2264858 - protein, 18 aa, Cryptosporidium parvum
KHCQDADESNPDSRNISS

SEQ ID NO: 2264859 - protein, 16 aa, Cryptosporidium parvum
KHDALRKDDLTDEDYK

SEQ ID NO: 2264860 - protein, 12 aa, Cryptosporidium parvum
KHDENSKKESLD

SEQ ID NO: 2264861 - protein, 8 aa, Cryptosporidium parvum
KHDNAKKL

SEQ ID NO: 2264862 - protein, 6 aa, Cryptosporidium parvum
KHDRSS

SEQ ID NO: 2264863 - protein, 5 aa, Cryptosporidium parvum
KHDTG

SEQ ID NO: 2264864 - protein, 10 aa, Cryptosporidium parvum
KHEAKKTVKK

SEQ ID NO: 2264865 - protein, 20 aa, Cryptosporidium parvum
KHEEVKKTNSEYKRAEKTLT

SEQ ID NO: 2264866 - protein, 7 aa, Cryptosporidium parvum
KHEQTTQ

SEQ ID NO: 2264867 - protein, 7 aa, Cryptosporidium parvum
KHGEEID

SEQ ID NO: 2264868 - protein, 14 aa, Cryptosporidium parvum
KHGNDRSGNSPEKF

SEQ ID NO: 2264869 - protein, 8 aa, Cryptosporidium parvum
KHGNPNLR

SEQ ID NO: 2264870 - protein, 4 aa, Cryptosporidium parvum
KHGP

SEQ ID NO: 2264871 - protein, 12 aa, Cryptosporidium parvum
KHGPKESQYEHE

SEQ ID NO: 2264872 - protein, 4 aa, Cryptosporidium parvum
KHGS

SEQ ID NO: 2264873 - protein, 5 aa, Cryptosporidium parvum
KHGSA

SEQ ID NO: 2264874 - protein, 11 aa, Cryptosporidium parvum
KHGVASGGNYH

SEQ ID NO: 2264875 - protein, 6 aa, Cryptosporidium parvum
KHHKNG

SEQ ID NO: 2264876 - protein, 7 aa, Cryptosporidium parvum
KHITNSI

SEQ ID NO: 2264877 - protein, 7 aa, Cryptosporidium parvum
KHKHNKN

SEQ ID NO: 2264878 - protein, 4 aa, Cryptosporidium parvum
KHKK

SEQ ID NO: 2264879 - protein, 7 aa, Cryptosporidium parvum
KHKQGES

SEQ ID NO: 2264880 - protein, 7 aa, Cryptosporidium parvum
KHKQNSL

SEQ ID NO: 2264881 - protein, 18 aa, Cryptosporidium parvum
KHKQSSNANQNESKFSAT

SEQ ID NO: 2264882 - protein, 9 aa, Cryptosporidium parvum
KHKTGSKNY

SEQ ID NO: 2264883 - protein, 8 aa, Cryptosporidium parvum
KHKTKSEM

SEQ ID NO: 2264884 - protein, 11 aa, Cryptosporidium parvum
KHLSNPNNKQG

SEQ ID NO: 2264885 - protein, 12 aa, Cryptosporidium parvum
KHMKNYEKGRKA

SEQ ID NO: 2264886 - protein, 8 aa, Cryptosporidium parvum
KHNEHPDV

SEQ ID NO: 2264887 - protein, 13 aa, Cryptosporidium parvum
KHNENNEGNIPNR

SEQ ID NO: 2264888 - protein, 7 aa, Cryptosporidium parvum
KHNGDEQ

SEQ ID NO: 2264889 - protein, 8 aa, Cryptosporidium parvum
KHNGPNWN

SEQ ID NO: 2264890 - protein, 9 aa, Cryptosporidium parvum
KHNNDSQVI

SEQ ID NO: 2264891 - protein, 5 aa, Cryptosporidium parvum
KHNPQ

SEQ ID NO: 2264892 - protein, 6 aa, Cryptosporidium parvum
KHNQGV

SEQ ID NO: 2264893 - protein, 13 aa, Cryptosporidium parvum
KHNSESSNHLKNN

SEQ ID NO: 2264894 - protein, 10 aa, Cryptosporidium parvum
KHNSNEKEVT

SEQ ID NO: 2264895 - protein, 8 aa, Cryptosporidium parvum
KHNSRSNK

SEQ ID NO: 2264896 - protein, 6 aa, Cryptosporidium parvum
KHPDLN

SEQ ID NO: 2264897 - protein, 6 aa, Cryptosporidium parvum
KHPDNI

SEQ ID NO: 2264898 - protein, 4 aa, Cryptosporidium parvum
KHPG

SEQ ID NO: 2264899 - protein, 13 aa, Cryptosporidium parvum
KHPKLEFSQCFPN

SEQ ID NO: 2264900 - protein, 6 aa, Cryptosporidium parvum
KHPNGN

SEQ ID NO: 2264901 - protein, 16 aa, Cryptosporidium parvum
KHPPTKSPPGYWDLDE

SEQ ID NO: 2264902 - protein, 5 aa, Cryptosporidium parvum
KHPRG

SEQ ID NO: 2264903 - protein, 6 aa, Cryptosporidium parvum
KHPSST

SEQ ID NO: 2264904 - protein, 10 aa, Cryptosporidium parvum
KHQNDSRKKY

SEQ ID NO: 2264905 - protein, 9 aa, Cryptosporidium parvum
KHRKNDTVA

SEQ ID NO: 2264906 - protein, 6 aa, Cryptosporidium parvum
KHRNKI

SEQ ID NO: 2264907 - protein, 4 aa, Cryptosporidium parvum
KHSD

SEQ ID NO: 2264908 - protein, 14 aa, Cryptosporidium parvum
KHSDKKKDNKLSCE

SEQ ID NO: 2264909 - protein, 26 aa, Cryptosporidium parvum
KHSENNTPNPSTRYSSSSSSSSSDSL

SEQ ID NO: 2264910 - protein, 6 aa, Cryptosporidium parvum
KHSITE

SEQ ID NO: 2264911 - protein, 8 aa, Cryptosporidium parvum
KHSKGKEG

SEQ ID NO: 2264912 - protein, 16 aa, Cryptosporidium parvum
KHSKRFNSPIRVIKDK

SEQ ID NO: 2264913 - protein, 7 aa, Cryptosporidium parvum
KHSNQTS

SEQ ID NO: 2264914 - protein, 7 aa, Cryptosporidium parvum
KHSSKLQ

SEQ ID NO: 2264915 - protein, 20 aa, Cryptosporidium parvum
KHSSTTNSTASSSAIPSNNI

SEQ ID NO: 2264916 - protein, 11 aa, Cryptosporidium parvum
KHSTEGSGGHM

SEQ ID NO: 2264917 - protein, 8 aa, Cryptosporidium parvum
KHTDSIPA

SEQ ID NO: 2264918 - protein, 4 aa, Cryptosporidium parvum
KHTG

SEQ ID NO: 2264919 - protein, 6 aa, Cryptosporidium parvum
KHVTQE

SEQ ID NO: 2264920 - protein, 10 aa, Cryptosporidium parvum
KHYPNNEKAS

SEQ ID NO: 2264921 - protein, 14 aa, Cryptosporidium parvum
KHYSKSNRKPVENY

SEQ ID NO: 2264922 - protein, 6 aa, Cryptosporidium parvum
KIAKAT

SEQ ID NO: 2264923 - protein, 11 aa, Cryptosporidium parvum
KIANDKSDKTV

SEQ ID NO: 2264924 - protein, 5 aa, Cryptosporidium parvum
KIANR

SEQ ID NO: 2264925 - protein, 11 aa, Cryptosporidium parvum
KIDAKKRLNAD

SEQ ID NO: 2264926 - protein, 7 aa, Cryptosporidium parvum
KIDEELK

SEQ ID NO: 2264927 - protein, 6 aa, Cryptosporidium parvum
KIDERE

SEQ ID NO: 2264928 - protein, 19 aa, Cryptosporidium parvum
KIDGDITSRNGNIENDPTL

SEQ ID NO: 2264929 - protein, 12 aa, Cryptosporidium parvum
KIDGSSSNYKEA

SEQ ID NO: 2264930 - protein, 87 aa, Cryptosporidium parvum
KIDKSKKKYRTNKDDSNKGESSAGVQESTKELPQKSTEDSVSGDEKTSSSTKDKEETSSSTAPDSDQESTSKSSPPRVKPPLKPKPK

SEQ ID NO: 2264931 - protein, 7 aa, Cryptosporidium parvum
KIDQERR

SEQ ID NO: 2264932 - protein, 9 aa, Cryptosporidium parvum
KIDQGTTNK

SEQ ID NO: 2264933 - protein, 19 aa, Cryptosporidium parvum
KIDTENINTGTDNIKIDSR

SEQ ID NO: 2264934 - protein, 6 aa, Cryptosporidium parvum
KIEADT

SEQ ID NO: 2264935 - protein, 16 aa, Cryptosporidium parvum
KIEDEGSGNKKLSKGG

SEQ ID NO: 2264936 - protein, 9 aa, Cryptosporidium parvum
KIEDQNETL

SEQ ID NO: 2264937 - protein, 13 aa, Cryptosporidium parvum
KIEEEEEDRDDGG

SEQ ID NO: 2264938 - protein, 62 aa, Cryptosporidium parvum
KIEEENQKKLAKKAFEQAYSSDDDENNSDFENEKDMEKKSQKKNKVSDNNKNHESSDYKDEI

SEQ ID NO: 2264939 - protein, 51 aa, Cryptosporidium parvum
KIEENDDHINQEKSKIKQNSNGEFQNTNTNTTSNNSNSNCNINKGQLGNPI

SEQ ID NO: 2264940 - protein, 6 aa, Cryptosporidium parvum
KIEENK

SEQ ID NO: 2264941 - protein, 29 aa, Cryptosporidium parvum
KIEENKDSESSTVENTPSLQTKSPEPTMR

SEQ ID NO: 2264942 - protein, 8 aa, Cryptosporidium parvum
KIEESEKD

SEQ ID NO: 2264943 - protein, 4 aa, Cryptosporidium parvum
KIEG

SEQ ID NO: 2264944 - protein, 6 aa, Cryptosporidium parvum
KIEKQE

SEQ ID NO: 2264945 - protein, 8 aa, Cryptosporidium parvum
KIEKTQDK

SEQ ID NO: 2264946 - protein, 4 aa, Cryptosporidium parvum
KIEN

SEQ ID NO: 2264947 - protein, 18 aa, Cryptosporidium parvum
KIENDQPSLSLNSAEKNV

SEQ ID NO: 2264948 - protein, 9 aa, Cryptosporidium parvum
KIENSKCQK

SEQ ID NO: 2264949 - protein, 6 aa, Cryptosporidium parvum
KIEPER

SEQ ID NO: 2264950 - protein, 8 aa, Cryptosporidium parvum
KIEPESKK

SEQ ID NO: 2264951 - protein, 6 aa, Cryptosporidium parvum
KIEPKE

SEQ ID NO: 2264952 - protein, 5 aa, Cryptosporidium parvum
KIEQT

SEQ ID NO: 2264953 - protein, 4 aa, Cryptosporidium parvum
KIES

SEQ ID NO: 2264954 - protein, 5 aa, Cryptosporidium parvum
KIESE

SEQ ID NO: 2264955 - protein, 5 aa, Cryptosporidium parvum
KIESF

SEQ ID NO: 2264956 - protein, 17 aa, Cryptosporidium parvum
KIESPKEKLEIKSGEYI

SEQ ID NO: 2264957 - protein, 8 aa, Cryptosporidium parvum
KIETEEQM

SEQ ID NO: 2264958 - protein, 11 aa, Cryptosporidium parvum
KIETSSSSNNI

SEQ ID NO: 2264959 - protein, 5 aa, Cryptosporidium parvum
KIFGK

SEQ ID NO: 2264960 - protein, 12 aa, Cryptosporidium parvum
KIGEDRSAQYHY

SEQ ID NO: 2264961 - protein, 11 aa, Cryptosporidium parvum
KIGGNNYNEYN

SEQ ID NO: 2264962 - protein, 17 aa, Cryptosporidium parvum
KIGKQKPKSESKLVGQT

SEQ ID NO: 2264963 - protein, 13 aa, Cryptosporidium parvum
KIGKTGSDSEDDI

SEQ ID NO: 2264964 - protein, 5 aa, Cryptosporidium parvum
KIGNS

SEQ ID NO: 2264965 - protein, 7 aa, Cryptosporidium parvum
KIGRKQQ

SEQ ID NO: 2264966 - protein, 17 aa, Cryptosporidium parvum
KIGSESELSDNEKENKY

SEQ ID NO: 2264967 - protein, 7 aa, Cryptosporidium parvum
KIGSGSF

SEQ ID NO: 2264968 - protein, 8 aa, Cryptosporidium parvum
KIGSSQDK

SEQ ID NO: 2264969 - protein, 4 aa, Cryptosporidium parvum
KIGT

SEQ ID NO: 2264970 - protein, 5 aa, Cryptosporidium parvum
KIGTG

SEQ ID NO: 2264971 - protein, 12 aa, Cryptosporidium parvum
KIHDNGKNEEPV

SEQ ID NO: 2264972 - protein, 14 aa, Cryptosporidium parvum
KIHPSDTSKTPENI

SEQ ID NO: 2264973 - protein, 4 aa, Cryptosporidium parvum
KIIG

SEQ ID NO: 2264974 - protein, 6 aa, Cryptosporidium parvum
KIIGGE

SEQ ID NO: 2264975 - protein, 15 aa, Cryptosporidium parvum
KIKDNSKNSVGKTHS

SEQ ID NO: 2264976 - protein, 10 aa, Cryptosporidium parvum
KIKDQSEKSF

SEQ ID NO: 2264977 - protein, 8 aa, Cryptosporidium parvum
KIKESGDW

SEQ ID NO: 2264978 - protein, 10 aa, Cryptosporidium parvum
KIKETDSITY

SEQ ID NO: 2264979 - protein, 8 aa, Cryptosporidium parvum
KIKGTKKI

SEQ ID NO: 2264980 - protein, 6 aa, Cryptosporidium parvum
KIKIGE

SEQ ID NO: 2264981 - protein, 12 aa, Cryptosporidium parvum
KIKKSEEWKQSS

SEQ ID NO: 2264982 - protein, 26 aa, Cryptosporidium parvum
KIKNDSKDKGKKKKKKDCKVSSINEK

SEQ ID NO: 2264983 - protein, 11 aa, Cryptosporidium parvum
KIKNSQIKTNL

SEQ ID NO: 2264984 - protein, 6 aa, Cryptosporidium parvum
KIKPGE

SEQ ID NO: 2264985 - protein, 8 aa, Cryptosporidium parvum
KIKPPPCI

SEQ ID NO: 2264986 - protein, 6 aa, Cryptosporidium parvum
KIKQDE

SEQ ID NO: 2264987 - protein, 6 aa, Cryptosporidium parvum
KIKQPI

SEQ ID NO: 2264988 - protein, 12 aa, Cryptosporidium parvum
KIKSDKTRELEN

SEQ ID NO: 2264989 - protein, 7 aa, Cryptosporidium parvum
KIKSDRV

SEQ ID NO: 2264990 - protein, 7 aa, Cryptosporidium parvum
KIKSKRK

SEQ ID NO: 2264991 - protein, 7 aa, Cryptosporidium parvum
KIKSKSQ

SEQ ID NO: 2264992 - protein, 7 aa, Cryptosporidium parvum
KIKSSEL

SEQ ID NO: 2264993 - protein, 7 aa, Cryptosporidium parvum
KIKTDST

SEQ ID NO: 2264994 - protein, 8 aa, Cryptosporidium parvum
KIKTSEIN

SEQ ID NO: 2264995 - protein, 4 aa, Cryptosporidium parvum
KIKV

SEQ ID NO: 2264996 - protein, 31 aa, Cryptosporidium parvum
KILSNKKRENQVKKTSNEDIANRDFKEENNL

SEQ ID NO: 2264997 - protein, 100 aa, Cryptosporidium parvum
KINAERGESGGSSAKVSNSSQYKSQNGSSFKTSDKNATTDNNVKSAGASSNPWQKHATSSSSKGGPIGSNNSAKTSEKNKTSSQSTHDANIDKNGYGQKI

SEQ ID NO: 2264998 - protein, 30 aa, Cryptosporidium parvum
KINASSGSTVNTSENTISSNIATSNAETVE

SEQ ID NO: 2264999 - protein, 13 aa, Cryptosporidium parvum
KINDDQPSYQRPT

SEQ ID NO: 2265000 - protein, 23 aa, Cryptosporidium parvum
KINDNEDIKGEKDDEYEDGELSE

SEQ ID NO: 2265001 - protein, 10 aa, Cryptosporidium parvum
KINDSKGKES

SEQ ID NO: 2265002 - protein, 4 aa, Cryptosporidium parvum
KINE

SEQ ID NO: 2265003 - protein, 18 aa, Cryptosporidium parvum
KINEQEEKLSHSKETELE

SEQ ID NO: 2265004 - protein, 5 aa, Cryptosporidium parvum
KINEY

SEQ ID NO: 2265005 - protein, 23 aa, Cryptosporidium parvum
KINKRKYEYDSHTESEDEDSSNI

SEQ ID NO: 2265006 - protein, 10 aa, Cryptosporidium parvum
KINNGKNDKE

SEQ ID NO: 2265007 - protein, 8 aa, Cryptosporidium parvum
KINNSDSK

SEQ ID NO: 2265008 - protein, 14 aa, Cryptosporidium parvum
KINNSRLESPKNTL

SEQ ID NO: 2265009 - protein, 7 aa, Cryptosporidium parvum
KINPSEP

SEQ ID NO: 2265010 - protein, 6 aa, Cryptosporidium parvum
KIPDSQ

SEQ ID NO: 2265011 - protein, 8 aa, Cryptosporidium parvum
KIPENITK

SEQ ID NO: 2265012 - protein, 8 aa, Cryptosporidium parvum
KIPENPTR

SEQ ID NO: 2265013 - protein, 7 aa, Cryptosporidium parvum
KIPENQV

SEQ ID NO: 2265014 - protein, 16 aa, Cryptosporidium parvum
KIPENYRKKSSGTSIG

SEQ ID NO: 2265015 - protein, 9 aa, Cryptosporidium parvum
KIPFQSSRE

SEQ ID NO: 2265016 - protein, 4 aa, Cryptosporidium parvum
KIPG

SEQ ID NO: 2265017 - protein, 7 aa, Cryptosporidium parvum
KIPGDSA

SEQ ID NO: 2265018 - protein, 10 aa, Cryptosporidium parvum
KIPKDPVKKS

SEQ ID NO: 2265019 - protein, 6 aa, Cryptosporidium parvum
KIPKQF

SEQ ID NO: 2265020 - protein, 13 aa, Cryptosporidium parvum
KIPKSRENNEPCS

SEQ ID NO: 2265021 - protein, 7 aa, Cryptosporidium parvum
KIPMQDS

SEQ ID NO: 2265022 - protein, 7 aa, Cryptosporidium parvum
KIPNDED

SEQ ID NO: 2265023 - protein, 6 aa, Cryptosporidium parvum
KIPNSS

SEQ ID NO: 2265024 - protein, 16 aa, Cryptosporidium parvum
KIPPIKKEADTSIQTK

SEQ ID NO: 2265025 - protein, 41 aa, Cryptosporidium parvum
KIPPVKKEADTSIQTKSNLKVPPKKDFSTPPIKKEADTLIQ

SEQ ID NO: 2265026 - protein, 11 aa, Cryptosporidium parvum
KIPRGARTGTV

SEQ ID NO: 2265027 - protein, 30 aa, Cryptosporidium parvum
KIPSDGRTLGKAISGNESSKDLNLKSERAK

SEQ ID NO: 2265028 - protein, 6 aa, Cryptosporidium parvum
KIPSDN

SEQ ID NO: 2265029 - protein, 8 aa, Cryptosporidium parvum
KIPSPADL

SEQ ID NO: 2265030 - protein, 6 aa, Cryptosporidium parvum
KIPSSG

SEQ ID NO: 2265031 - protein, 6 aa, Cryptosporidium parvum
KIPSSP

SEQ ID NO: 2265032 - protein, 5 aa, Cryptosporidium parvum
KIPTN

SEQ ID NO: 2265033 - protein, 12 aa, Cryptosporidium parvum
KIPVDNNGHGTH

SEQ ID NO: 2265034 - protein, 6 aa, Cryptosporidium parvum
KIQDES

SEQ ID NO: 2265035 - protein, 9 aa, Cryptosporidium parvum
KIQENTDIY

SEQ ID NO: 2265036 - protein, 6 aa, Cryptosporidium parvum
KIQEPT

SEQ ID NO: 2265037 - protein, 6 aa, Cryptosporidium parvum
KIQESQ

SEQ ID NO: 2265038 - protein, 8 aa, Cryptosporidium parvum
KIQKDEEI

SEQ ID NO: 2265039 - protein, 6 aa, Cryptosporidium parvum
KIQPQV

SEQ ID NO: 2265040 - protein, 8 aa, Cryptosporidium parvum
KIQQEESI

SEQ ID NO: 2265041 - protein, 8 aa, Cryptosporidium parvum
KIQRENRW

SEQ ID NO: 2265042 - protein, 5 aa, Cryptosporidium parvum
KIQST

SEQ ID NO: 2265043 - protein, 4 aa, Cryptosporidium parvum
KIQT

SEQ ID NO: 2265044 - protein, 42 aa, Cryptosporidium parvum
KIQTGTPVQATRTNKRSRRSIEGTGRSGRSSPSAYNTRNSAI

SEQ ID NO: 2265045 - protein, 7 aa, Cryptosporidium parvum
KIQTPRE

SEQ ID NO: 2265046 - protein, 4 aa, Cryptosporidium parvum
KIRA

SEQ ID NO: 2265047 - protein, 4 aa, Cryptosporidium parvum
KIRE

SEQ ID NO: 2265048 - protein, 24 aa, Cryptosporidium parvum
KIRGRSDNIEKKRRAKSLSRSLSL

SEQ ID NO: 2265049 - protein, 4 aa, Cryptosporidium parvum
KIRK

SEQ ID NO: 2265050 - protein, 12 aa, Cryptosporidium parvum
KIRKEKNMDPDA

SEQ ID NO: 2265051 - protein, 7 aa, Cryptosporidium parvum
KIRNGAD

SEQ ID NO: 2265052 - protein, 9 aa, Cryptosporidium parvum
KIRNPDSGI

SEQ ID NO: 2265053 - protein, 10 aa, Cryptosporidium parvum
KIRQESENYK

SEQ ID NO: 2265054 - protein, 20 aa, Cryptosporidium parvum
KIRQKKLSKNLDDNEDINSN

SEQ ID NO: 2265055 - protein, 13 aa, Cryptosporidium parvum
KIRREKRSSWNSA

SEQ ID NO: 2265056 - protein, 10 aa, Cryptosporidium parvum
KIRRESSKID

SEQ ID NO: 2265057 - protein, 7 aa, Cryptosporidium parvum
KIRYPQT

SEQ ID NO: 2265058 - protein, 16 aa, Cryptosporidium parvum
KISAKSAVKSEKRTKM

SEQ ID NO: 2265059 - protein, 10 aa, Cryptosporidium parvum
KISEKQKNWT

SEQ ID NO: 2265060 - protein, 9 aa, Cryptosporidium parvum
KISEQHDRQ

SEQ ID NO: 2265061 - protein, 5 aa, Cryptosporidium parvum
KISET

SEQ ID NO: 2265062 - protein, 7 aa, Cryptosporidium parvum
KISGDGR

SEQ ID NO: 2265063 - protein, 12 aa, Cryptosporidium parvum
KISKDTTNNHDD

SEQ ID NO: 2265064 - protein, 73 aa, Cryptosporidium parvum
KISKNNNNQLHSGNSEIKSKKYNSTNINTNTINATNNYSHQISSSSPSNHHPSSSSSSSSSSSSSCNNINNSN

SEQ ID NO: 2265065 - protein, 12 aa, Cryptosporidium parvum
KISKSSYKTPID

SEQ ID NO: 2265066 - protein, 15 aa, Cryptosporidium parvum
KISNDSQADQSQKQP

SEQ ID NO: 2265067 - protein, 8 aa, Cryptosporidium parvum
KISNEQDQ

SEQ ID NO: 2265068 - protein, 12 aa, Cryptosporidium parvum
KISNKNSPENRK

SEQ ID NO: 2265069 - protein, 18 aa, Cryptosporidium parvum
KISNNNNNNNNNSGGDYN

SEQ ID NO: 2265070 - protein, 6 aa, Cryptosporidium parvum
KISNRS

SEQ ID NO: 2265071 - protein, 7 aa, Cryptosporidium parvum
KISNSNK

SEQ ID NO: 2265072 - protein, 5 aa, Cryptosporidium parvum
KISNT

SEQ ID NO: 2265073 - protein, 22 aa, Cryptosporidium parvum
KISNTKNIQSLPSYANDQKDSF

SEQ ID NO: 2265074 - protein, 17 aa, Cryptosporidium parvum
KISPDINNQPETNDSNS

SEQ ID NO: 2265075 - protein, 17 aa, Cryptosporidium parvum
KISPGGNLNQYAEKQSI

SEQ ID NO: 2265076 - protein, 5 aa, Cryptosporidium parvum
KISPK

SEQ ID NO: 2265077 - protein, 9 aa, Cryptosporidium parvum
KISPSGVNE

SEQ ID NO: 2265078 - protein, 11 aa, Cryptosporidium parvum
KISQDSENDSI

SEQ ID NO: 2265079 - protein, 6 aa, Cryptosporidium parvum
KISQRI

SEQ ID NO: 2265080 - protein, 12 aa, Cryptosporidium parvum
KISQSDKELHKQ

SEQ ID NO: 2265081 - protein, 8 aa, Cryptosporidium parvum
KISRKEDT

SEQ ID NO: 2265082 - protein, 6 aa, Cryptosporidium parvum
KISSGK

SEQ ID NO: 2265083 - protein, 5 aa, Cryptosporidium parvum
KISSK

SEQ ID NO: 2265084 - protein, 6 aa, Cryptosporidium parvum
KISSKN

SEQ ID NO: 2265085 - protein, 13 aa, Cryptosporidium parvum
KISSMSKNKISNV

SEQ ID NO: 2265086 - protein, 6 aa, Cryptosporidium parvum
KISSNK

SEQ ID NO: 2265087 - protein, 12 aa, Cryptosporidium parvum
KISSRSKDIQKA

SEQ ID NO: 2265088 - protein, 6 aa, Cryptosporidium parvum
KISTER

SEQ ID NO: 2265089 - protein, 7 aa, Cryptosporidium parvum
KISTLNK

SEQ ID NO: 2265090 - protein, 22 aa, Cryptosporidium parvum
KISTNTMRKTKQSNQNQNIPEN

SEQ ID NO: 2265091 - protein, 18 aa, Cryptosporidium parvum
KISYSGGSGVDENNCSDK

SEQ ID NO: 2265092 - protein, 8 aa, Cryptosporidium parvum
KITEDNKY

SEQ ID NO: 2265093 - protein, 10 aa, Cryptosporidium parvum
KITEKNGLLS

SEQ ID NO: 2265094 - protein, 5 aa, Cryptosporidium parvum
KITNI

SEQ ID NO: 2265095 - protein, 7 aa, Cryptosporidium parvum
KITPDKD

SEQ ID NO: 2265096 - protein, 9 aa, Cryptosporidium parvum
KITPPRGGT

SEQ ID NO: 2265097 - protein, 17 aa, Cryptosporidium parvum
KITQGRDGIASMYKNEI

SEQ ID NO: 2265098 - protein, 6 aa, Cryptosporidium parvum
KITQRD

SEQ ID NO: 2265099 - protein, 50 aa, Cryptosporidium parvum
KITSEKVVQGNDEKQIASKIKSKKRTQEEHADENNSTNKVSKEAPTLKKS

SEQ ID NO: 2265100 - protein, 12 aa, Cryptosporidium parvum
KITTPSPARAKT

SEQ ID NO: 2265101 - protein, 11 aa, Cryptosporidium parvum
KIVPSSAPSRR

SEQ ID NO: 2265102 - protein, 22 aa, Cryptosporidium parvum
KIVSSKKSHAEVGKNVSSVEES

SEQ ID NO: 2265103 - protein, 12 aa, Cryptosporidium parvum
KIYRPKDENTFL

SEQ ID NO: 2265104 - protein, 20 aa, Cryptosporidium parvum
KIYSPNSSSIEPQETSQEVN

SEQ ID NO: 2265105 - protein, 30 aa, Cryptosporidium parvum
KIYSSERDSTPSSTIRAQAKGSIQTSNSEP

SEQ ID NO: 2265106 - protein, 19 aa, Cryptosporidium parvum
KKAAEKREKQLCKSQNKHL

SEQ ID NO: 2265107 - protein, 21 aa, Cryptosporidium parvum
KKADSETEKGMQDSAQYYQTK

SEQ ID NO: 2265108 - protein, 6 aa, Cryptosporidium parvum
KKAEEI

SEQ ID NO: 2265109 - protein, 14 aa, Cryptosporidium parvum
KKAERFSEKDKTFT

SEQ ID NO: 2265110 - protein, 7 aa, Cryptosporidium parvum
KKAETEA

SEQ ID NO: 2265111 - protein, 13 aa, Cryptosporidium parvum
KKAGSKKCENEKI

SEQ ID NO: 2265112 - protein, 4 aa, Cryptosporidium parvum
KKAI

SEQ ID NO: 2265113 - protein, 11 aa, Cryptosporidium parvum
KKAISNNDFGN

SEQ ID NO: 2265114 - protein, 5 aa, Cryptosporidium parvum
KKAKI

SEQ ID NO: 2265115 - protein, 9 aa, Cryptosporidium parvum
KKALEDRRA

SEQ ID NO: 2265116 - protein, 6 aa, Cryptosporidium parvum
KKALKN

SEQ ID NO: 2265117 - protein, 26 aa, Cryptosporidium parvum
KKALSKSDNTQDLDSLSNSDNYTENH

SEQ ID NO: 2265118 - protein, 25 aa, Cryptosporidium parvum
KKAMEAKKKALQDKKAKEKPASKSS

SEQ ID NO: 2265119 - protein, 50 aa, Cryptosporidium parvum
KKANSTQNNNSVSEDPKENTPNKSKTEIVNDDSQISSSSPIKGQNQNETS

SEQ ID NO: 2265120 - protein, 4 aa, Cryptosporidium parvum
KKAP

SEQ ID NO: 2265121 - protein, 18 aa, Cryptosporidium parvum
KKAPNIKKASKSKKSKSK

SEQ ID NO: 2265122 - protein, 17 aa, Cryptosporidium parvum
KKAQGIKVKDNKSKLIK

SEQ ID NO: 2265123 - protein, 6 aa, Cryptosporidium parvum
KKAQIE

SEQ ID NO: 2265124 - protein, 8 aa, Cryptosporidium parvum
KKARDIKT

SEQ ID NO: 2265125 - protein, 9 aa, Cryptosporidium parvum
KKARTKDQK

SEQ ID NO: 2265126 - protein, 7 aa, Cryptosporidium parvum
KKASIDG

SEQ ID NO: 2265127 - protein, 7 aa, Cryptosporidium parvum
KKATFDD

SEQ ID NO: 2265128 - protein, 7 aa, Cryptosporidium parvum
KKCRETN

SEQ ID NO: 2265129 - protein, 9 aa, Cryptosporidium parvum
KKCSELKST

SEQ ID NO: 2265130 - protein, 12 aa, Cryptosporidium parvum
KKCSGSGSVKER

SEQ ID NO: 2265131 - protein, 17 aa, Cryptosporidium parvum
KKDDISEGEVRSKINKE

SEQ ID NO: 2265132 - protein, 7 aa, Cryptosporidium parvum
KKDELKE

SEQ ID NO: 2265133 - protein, 7 aa, Cryptosporidium parvum
KKDERAS

SEQ ID NO: 2265134 - protein, 8 aa, Cryptosporidium parvum
KKDERASV

SEQ ID NO: 2265135 - protein, 14 aa, Cryptosporidium parvum
KKDETKKELGSSGI

SEQ ID NO: 2265136 - protein, 34 aa, Cryptosporidium parvum
KKDETKKFSDEKNMKLNTKKKDNKNVKGKTKHKK

SEQ ID NO: 2265137 - protein, 9 aa, Cryptosporidium parvum
KKDGLSTGD

SEQ ID NO: 2265138 - protein, 14 aa, Cryptosporidium parvum
KKDHNESHDKTNEM

SEQ ID NO: 2265139 - protein, 6 aa, Cryptosporidium parvum
KKDIRK

SEQ ID NO: 2265140 - protein, 12 aa, Cryptosporidium parvum
KKDITKSNNNNN

SEQ ID NO: 2265141 - protein, 6 aa, Cryptosporidium parvum
KKDKEE

SEQ ID NO: 2265142 - protein, 15 aa, Cryptosporidium parvum
KKDKSKEELEEEERN

SEQ ID NO: 2265143 - protein, 6 aa, Cryptosporidium parvum
KKDKSL

SEQ ID NO: 2265144 - protein, 6 aa, Cryptosporidium parvum
KKDLQQ

SEQ ID NO: 2265145 - protein, 9 aa, Cryptosporidium parvum
KKDNQSDTE

SEQ ID NO: 2265146 - protein, 4 aa, Cryptosporidium parvum
KKDP

SEQ ID NO: 2265147 - protein, 7 aa, Cryptosporidium parvum
KKDPSTL

SEQ ID NO: 2265148 - protein, 13 aa, Cryptosporidium parvum
KKDQQDQETYKKE

SEQ ID NO: 2265149 - protein, 8 aa, Cryptosporidium parvum
KKDSEDLT

SEQ ID NO: 2265150 - protein, 15 aa, Cryptosporidium parvum
KKDSFDKAKYGDAPI

SEQ ID NO: 2265151 - protein, 8 aa, Cryptosporidium parvum
KKDSKLEE

SEQ ID NO: 2265152 - protein, 16 aa, Cryptosporidium parvum
KKDTIPSSESCSNQDL

SEQ ID NO: 2265153 - protein, 9 aa, Cryptosporidium parvum
KKDTSDDKE

SEQ ID NO: 2265154 - protein, 9 aa, Cryptosporidium parvum
KKEAHKEKE

SEQ ID NO: 2265155 - protein, 8 aa, Cryptosporidium parvum
KKEDGSEV

SEQ ID NO: 2265156 - protein, 20 aa, Cryptosporidium parvum
KKEDKSQGSNNIPPPPSPLE

SEQ ID NO: 2265157 - protein, 11 aa, Cryptosporidium parvum
KKEDLDDSEDL

SEQ ID NO: 2265158 - protein, 25 aa, Cryptosporidium parvum
KKEDNEIKSKLSNAKGQVISKQTLR

SEQ ID NO: 2265159 - protein, 8 aa, Cryptosporidium parvum
KKEEANRP

SEQ ID NO: 2265160 - protein, 5 aa, Cryptosporidium parvum
KKEEE

SEQ ID NO: 2265161 - protein, 14 aa, Cryptosporidium parvum
KKEEEDNNNNNTRR

SEQ ID NO: 2265162 - protein, 8 aa, Cryptosporidium parvum
KKEEEYKS

SEQ ID NO: 2265163 - protein, 12 aa, Cryptosporidium parvum
KKEEHPDQEMDI

SEQ ID NO: 2265164 - protein, 6 aa, Cryptosporidium parvum
KKEEIA

SEQ ID NO: 2265165 - protein, 8 aa, Cryptosporidium parvum
KKEEISKS

SEQ ID NO: 2265166 - protein, 7 aa, Cryptosporidium parvum
KKEENEQ

SEQ ID NO: 2265167 - protein, 8 aa, Cryptosporidium parvum
KKEENNRI

SEQ ID NO: 2265168 - protein, 17 aa, Cryptosporidium parvum
KKEESENNGSDGSRLKS

SEQ ID NO: 2265169 - protein, 8 aa, Cryptosporidium parvum
KKEESERR

SEQ ID NO: 2265170 - protein, 13 aa, Cryptosporidium parvum
KKEGINDGFSEKI

SEQ ID NO: 2265171 - protein, 7 aa, Cryptosporidium parvum
KKEGMSV

SEQ ID NO: 2265172 - protein, 6 aa, Cryptosporidium parvum
KKEIEG

SEQ ID NO: 2265173 - protein, 8 aa, Cryptosporidium parvum
KKEISEEE

SEQ ID NO: 2265174 - protein, 7 aa, Cryptosporidium parvum
KKEITAD

SEQ ID NO: 2265175 - protein, 8 aa, Cryptosporidium parvum
KKEITKEK

SEQ ID NO: 2265176 - protein, 4 aa, Cryptosporidium parvum
KKEK

SEQ ID NO: 2265177 - protein, 8 aa, Cryptosporidium parvum
KKEKCTED

SEQ ID NO: 2265178 - protein, 23 aa, Cryptosporidium parvum
KKEKEEEEKAKADAAKQGKQMSG

SEQ ID NO: 2265179 - protein, 106 aa, Cryptosporidium parvum
KKEKEEEIKRKKEEEIRRKEEKEEELKKKNEEDIKKKKEKEENKKKKEELKSKKEKEEENKRKKEKEEENKKKKEEEELKRKKEKIETEKKGQEVNLEKKKNGEIE

SEQ ID NO: 2265180 - protein, 8 aa, Cryptosporidium parvum
KKEKFPGQ

SEQ ID NO: 2265181 - protein, 15 aa, Cryptosporidium parvum
KKELETKLKGDIKDL

SEQ ID NO: 2265182 - protein, 7 aa, Cryptosporidium parvum
KKELYQD

SEQ ID NO: 2265183 - protein, 17 aa, Cryptosporidium parvum
KKEMERSKYRKSTTKKL

SEQ ID NO: 2265184 - protein, 4 aa, Cryptosporidium parvum
KKEN

SEQ ID NO: 2265185 - protein, 6 aa, Cryptosporidium parvum
KKENFE

SEQ ID NO: 2265186 - protein, 9 aa, Cryptosporidium parvum
KKENNNDSY

SEQ ID NO: 2265187 - protein, 16 aa, Cryptosporidium parvum
KKENSFNKAQLPENEP

SEQ ID NO: 2265188 - protein, 5 aa, Cryptosporidium parvum
KKEPE

SEQ ID NO: 2265189 - protein, 19 aa, Cryptosporidium parvum
KKEQDADSDYDEEDGYEYH

SEQ ID NO: 2265190 - protein, 10 aa, Cryptosporidium parvum
KKEQERRNIE

SEQ ID NO: 2265191 - protein, 6 aa, Cryptosporidium parvum
KKEREE

SEQ ID NO: 2265192 - protein, 7 aa, Cryptosporidium parvum
KKERSDY

SEQ ID NO: 2265193 - protein, 15 aa, Cryptosporidium parvum
KKERVEREKEKKNND

SEQ ID NO: 2265194 - protein, 7 aa, Cryptosporidium parvum
KKESEII

SEQ ID NO: 2265195 - protein, 7 aa, Cryptosporidium parvum
KKESELN

SEQ ID NO: 2265196 - protein, 5 aa, Cryptosporidium parvum
KKESI

SEQ ID NO: 2265197 - protein, 8 aa, Cryptosporidium parvum
KKESISEI

SEQ ID NO: 2265198 - protein, 17 aa, Cryptosporidium parvum
KKESKEEVKEIESTNKS

SEQ ID NO: 2265199 - protein, 8 aa, Cryptosporidium parvum
KKESNLAS

SEQ ID NO: 2265200 - protein, 9 aa, Cryptosporidium parvum
KKESNPTIQ

SEQ ID NO: 2265201 - protein, 8 aa, Cryptosporidium parvum
KKESPRSI

SEQ ID NO: 2265202 - protein, 15 aa, Cryptosporidium parvum
KKETGIDQTTKNNEF

SEQ ID NO: 2265203 - protein, 6 aa, Cryptosporidium parvum
KKETNI

SEQ ID NO: 2265204 - protein, 6 aa, Cryptosporidium parvum
KKEVRR

SEQ ID NO: 2265205 - protein, 4 aa, Cryptosporidium parvum
KKEW

SEQ ID NO: 2265206 - protein, 5 aa, Cryptosporidium parvum
KKEYG

SEQ ID NO: 2265207 - protein, 7 aa, Cryptosporidium parvum
KKEYKQI

SEQ ID NO: 2265208 - protein, 7 aa, Cryptosporidium parvum
KKEYRGI

SEQ ID NO: 2265209 - protein, 7 aa, Cryptosporidium parvum
KKEYSRQ

SEQ ID NO: 2265210 - protein, 8 aa, Cryptosporidium parvum
KKFATNKR

SEQ ID NO: 2265211 - protein, 22 aa, Cryptosporidium parvum
KKFKTKEKNTVNRTRGSSTNEL

SEQ ID NO: 2265212 - protein, 5 aa, Cryptosporidium parvum
KKFPK

SEQ ID NO: 2265213 - protein, 13 aa, Cryptosporidium parvum
KKFPSNKGSDTIE

SEQ ID NO: 2265214 - protein, 12 aa, Cryptosporidium parvum
KKFSATAKYMVY

SEQ ID NO: 2265215 - protein, 7 aa, Cryptosporidium parvum
KKFSDKK

SEQ ID NO: 2265216 - protein, 6 aa, Cryptosporidium parvum
KKFTKF

SEQ ID NO: 2265217 - protein, 5 aa, Cryptosporidium parvum
KKFTR

SEQ ID NO: 2265218 - protein, 10 aa, Cryptosporidium parvum
KKGDDDTIGP

SEQ ID NO: 2265219 - protein, 9 aa, Cryptosporidium parvum
KKGDKDIEL

SEQ ID NO: 2265220 - protein, 6 aa, Cryptosporidium parvum
KKGDRL

SEQ ID NO: 2265221 - protein, 21 aa, Cryptosporidium parvum
KKGDSSQSIKGSSNNLQNGSR

SEQ ID NO: 2265222 - protein, 6 aa, Cryptosporidium parvum
KKGDSV

SEQ ID NO: 2265223 - protein, 4 aa, Cryptosporidium parvum
KKGE

SEQ ID NO: 2265224 - protein, 8 aa, Cryptosporidium parvum
KKGEFHDE

SEQ ID NO: 2265225 - protein, 8 aa, Cryptosporidium parvum
KKGEFPDF

SEQ ID NO: 2265226 - protein, 7 aa, Cryptosporidium parvum
KKGEIGT

SEQ ID NO: 2265227 - protein, 14 aa, Cryptosporidium parvum
KKGENNNNVNEGQK

SEQ ID NO: 2265228 - protein, 10 aa, Cryptosporidium parvum
KKGESQTNVE

SEQ ID NO: 2265229 - protein, 6 aa, Cryptosporidium parvum
KKGFNN

SEQ ID NO: 2265230 - protein, 60 aa, Cryptosporidium parvum
KKGGSKADLSSFDSSDEKNSYSKSKSYDDKNKDSEDTNSQTSKFKKASRQWGNQKVTKKN

SEQ ID NO: 2265231 - protein, 8 aa, Cryptosporidium parvum
KKGHANLA

SEQ ID NO: 2265232 - protein, 4 aa, Cryptosporidium parvum
KKGI

SEQ ID NO: 2265233 - protein, 12 aa, Cryptosporidium parvum
KKGIEDEYGYGR

SEQ ID NO: 2265234 - protein, 7 aa, Cryptosporidium parvum
KKGKDKM

SEQ ID NO: 2265235 - protein, 5 aa, Cryptosporidium parvum
KKGKN

SEQ ID NO: 2265236 - protein, 10 aa, Cryptosporidium parvum
KKGKNRNQRN

SEQ ID NO: 2265237 - protein, 8 aa, Cryptosporidium parvum
KKGKPELR

SEQ ID NO: 2265238 - protein, 6 aa, Cryptosporidium parvum
KKGLEN

SEQ ID NO: 2265239 - protein, 8 aa, Cryptosporidium parvum
KKGLKEEI

SEQ ID NO: 2265240 - protein, 5 aa, Cryptosporidium parvum
KKGLP

SEQ ID NO: 2265241 - protein, 4 aa, Cryptosporidium parvum
KKGN

SEQ ID NO: 2265242 - protein, 14 aa, Cryptosporidium parvum
KKGNPPSARSGSTI

SEQ ID NO: 2265243 - protein, 12 aa, Cryptosporidium parvum
KKGPPPSPFSEE

SEQ ID NO: 2265244 - protein, 6 aa, Cryptosporidium parvum
KKGQHL

SEQ ID NO: 2265245 - protein, 21 aa, Cryptosporidium parvum
KKGQKGMSATHEGVSSYLKDS

SEQ ID NO: 2265246 - protein, 19 aa, Cryptosporidium parvum
KKGQKVSSGEQKKSGGMSG

SEQ ID NO: 2265247 - protein, 8 aa, Cryptosporidium parvum
KKGQSQSA

SEQ ID NO: 2265248 - protein, 6 aa, Cryptosporidium parvum
KKGRGF

SEQ ID NO: 2265249 - protein, 6 aa, Cryptosporidium parvum
KKGRGH

SEQ ID NO: 2265250 - protein, 7 aa, Cryptosporidium parvum
KKGRSVN

SEQ ID NO: 2265251 - protein, 7 aa, Cryptosporidium parvum
KKGSEFS

SEQ ID NO: 2265252 - protein, 15 aa, Cryptosporidium parvum
KKGSSNTDESSLSEI

SEQ ID NO: 2265253 - protein, 6 aa, Cryptosporidium parvum
KKGTEI

SEQ ID NO: 2265254 - protein, 14 aa, Cryptosporidium parvum
KKGTVGSRDFSSKD

SEQ ID NO: 2265255 - protein, 12 aa, Cryptosporidium parvum
KKGVERRNEEIE

SEQ ID NO: 2265256 - protein, 8 aa, Cryptosporidium parvum
KKGYKSEK

SEQ ID NO: 2265257 - protein, 9 aa, Cryptosporidium parvum
KKHDSGSLT

SEQ ID NO: 2265258 - protein, 7 aa, Cryptosporidium parvum
KKHGEGE

SEQ ID NO: 2265259 - protein, 10 aa, Cryptosporidium parvum
KKHGRGGQSA

SEQ ID NO: 2265260 - protein, 10 aa, Cryptosporidium parvum
KKHGSSNKLE

SEQ ID NO: 2265261 - protein, 7 aa, Cryptosporidium parvum
KKHNNKY

SEQ ID NO: 2265262 - protein, 5 aa, Cryptosporidium parvum
KKHTK

SEQ ID NO: 2265263 - protein, 9 aa, Cryptosporidium parvum
KKHTTSKIN

SEQ ID NO: 2265264 - protein, 6 aa, Cryptosporidium parvum
KKIAEE

SEQ ID NO: 2265265 - protein, 9 aa, Cryptosporidium parvum
KKIARKSSF

SEQ ID NO: 2265266 - protein, 24 aa, Cryptosporidium parvum
KKIDGESSSDTSDSRSRASSFQEL

SEQ ID NO: 2265267 - protein, 8 aa, Cryptosporidium parvum
KKIDKQKR

SEQ ID NO: 2265268 - protein, 9 aa, Cryptosporidium parvum
KKIEAPNKE

SEQ ID NO: 2265269 - protein, 7 aa, Cryptosporidium parvum
KKIERNR

SEQ ID NO: 2265270 - protein, 13 aa, Cryptosporidium parvum
KKIGEDENRARSL

SEQ ID NO: 2265271 - protein, 6 aa, Cryptosporidium parvum
KKIGGV

SEQ ID NO: 2265272 - protein, 7 aa, Cryptosporidium parvum
KKIGTGD

SEQ ID NO: 2265273 - protein, 16 aa, Cryptosporidium parvum
KKIKKLNKKKAKGTLV

SEQ ID NO: 2265274 - protein, 9 aa, Cryptosporidium parvum
KKIKPSDIP

SEQ ID NO: 2265275 - protein, 16 aa, Cryptosporidium parvum
KKIKSSTKCKAKEDIY

SEQ ID NO: 2265276 - protein, 32 aa, Cryptosporidium parvum
KKINKDTKLPTAVGTPLPSNGTCSHYKKSNRW

SEQ ID NO: 2265277 - protein, 8 aa, Cryptosporidium parvum
KKINYESA

SEQ ID NO: 2265278 - protein, 6 aa, Cryptosporidium parvum
KKIPID

SEQ ID NO: 2265279 - protein, 8 aa, Cryptosporidium parvum
KKIPQNRI

SEQ ID NO: 2265280 - protein, 5 aa, Cryptosporidium parvum
KKIQQ

SEQ ID NO: 2265281 - protein, 6 aa, Cryptosporidium parvum
KKIRES

SEQ ID NO: 2265282 - protein, 23 aa, Cryptosporidium parvum
KKISEKDIQEYKERYRGSDDEWE

SEQ ID NO: 2265283 - protein, 13 aa, Cryptosporidium parvum
KKISHSQAKVSIN

SEQ ID NO: 2265284 - protein, 11 aa, Cryptosporidium parvum
KKISKNNSSNH

SEQ ID NO: 2265285 - protein, 10 aa, Cryptosporidium parvum
KKISNEISKD

SEQ ID NO: 2265286 - protein, 11 aa, Cryptosporidium parvum
KKISNNNLSPI

SEQ ID NO: 2265287 - protein, 12 aa, Cryptosporidium parvum
KKISQDDTSASK

SEQ ID NO: 2265288 - protein, 6 aa, Cryptosporidium parvum
KKISSL

SEQ ID NO: 2265289 - protein, 8 aa, Cryptosporidium parvum
KKKAPKIQ

SEQ ID NO: 2265290 - protein, 17 aa, Cryptosporidium parvum
KKKAPPKASFSPGSRFP

SEQ ID NO: 2265291 - protein, 58 aa, Cryptosporidium parvum
KKKAQRPKKTAANTKNTKKASKKPTKKAKSASKPPSKPRKRQSIKSENDSEDDDINKD

SEQ ID NO: 2265292 - protein, 7 aa, Cryptosporidium parvum
KKKASYI

SEQ ID NO: 2265293 - protein, 5 aa, Cryptosporidium parvum
KKKAT

SEQ ID NO: 2265294 - protein, 18 aa, Cryptosporidium parvum
KKKDPKADCKDLQDKSVQ

SEQ ID NO: 2265295 - protein, 9 aa, Cryptosporidium parvum
KKKDPSIYD

SEQ ID NO: 2265296 - protein, 25 aa, Cryptosporidium parvum
KKKDSTHESNDPDSADAENSTGIQT

SEQ ID NO: 2265297 - protein, 25 aa, Cryptosporidium parvum
KKKEAAKLKKVKQNKVNDNDDNFNN

SEQ ID NO: 2265298 - protein, 6 aa, Cryptosporidium parvum
KKKESH

SEQ ID NO: 2265299 - protein, 9 aa, Cryptosporidium parvum
KKKETSPEI

SEQ ID NO: 2265300 - protein, 21 aa, Cryptosporidium parvum
KKKFEDHESDSENDDKMEFTG

SEQ ID NO: 2265301 - protein, 6 aa, Cryptosporidium parvum
KKKFNE

SEQ ID NO: 2265302 - protein, 10 aa, Cryptosporidium parvum
KKKGINQGQL

SEQ ID NO: 2265303 - protein, 6 aa, Cryptosporidium parvum
KKKIRN

SEQ ID NO: 2265304 - protein, 8 aa, Cryptosporidium parvum
KKKKERDL

SEQ ID NO: 2265305 - protein, 18 aa, Cryptosporidium parvum
KKKKKVKQKSKSKIKEVS

SEQ ID NO: 2265306 - protein, 9 aa, Cryptosporidium parvum
KKKKQSAEE

SEQ ID NO: 2265307 - protein, 7 aa, Cryptosporidium parvum
KKKKTQL

SEQ ID NO: 2265308 - protein, 8 aa, Cryptosporidium parvum
KKKLEPEL

SEQ ID NO: 2265309 - protein, 37 aa, Cryptosporidium parvum
KKKLQDNKKVDSNTQINKDEKNKVNVNSDNETKDNEI

SEQ ID NO: 2265310 - protein, 6 aa, Cryptosporidium parvum
KKKNDY

SEQ ID NO: 2265311 - protein, 7 aa, Cryptosporidium parvum
KKKNGLD

SEQ ID NO: 2265312 - protein, 7 aa, Cryptosporidium parvum
KKKNIIK

SEQ ID NO: 2265313 - protein, 8 aa, Cryptosporidium parvum
KKKNNGLE

SEQ ID NO: 2265314 - protein, 22 aa, Cryptosporidium parvum
KKKNNKPFQRNYESNSIQARSG

SEQ ID NO: 2265315 - protein, 13 aa, Cryptosporidium parvum
KKKNSEKDDKNKD

SEQ ID NO: 2265316 - protein, 28 aa, Cryptosporidium parvum
KKKNSSESNNALTEDEKQAKIDKSVLSK

SEQ ID NO: 2265317 - protein, 9 aa, Cryptosporidium parvum
KKKNTMNES

SEQ ID NO: 2265318 - protein, 16 aa, Cryptosporidium parvum
KKKNYAAKFDKESRID

SEQ ID NO: 2265319 - protein, 39 aa, Cryptosporidium parvum
KKKPATSSSQSSANIEGNNYSSGLSSSANNLNSSSLESL

SEQ ID NO: 2265320 - protein, 9 aa, Cryptosporidium parvum
KKKPTQHSV

SEQ ID NO: 2265321 - protein, 16 aa, Cryptosporidium parvum
KKKQSSGLSRSLRDSS

SEQ ID NO: 2265322 - protein, 10 aa, Cryptosporidium parvum
KKKRKDKSEI

SEQ ID NO: 2265323 - protein, 10 aa, Cryptosporidium parvum
KKKRKVSEGQ

SEQ ID NO: 2265324 - protein, 9 aa, Cryptosporidium parvum
KKKSEEFQG

SEQ ID NO: 2265325 - protein, 6 aa, Cryptosporidium parvum
KKKSGF

SEQ ID NO: 2265326 - protein, 16 aa, Cryptosporidium parvum
KKKSKGSKKAKKIKSG

SEQ ID NO: 2265327 - protein, 8 aa, Cryptosporidium parvum
KKKSNSFY

SEQ ID NO: 2265328 - protein, 27 aa, Cryptosporidium parvum
KKKSPNGKANQNSFNNDDNNGKVNATN

SEQ ID NO: 2265329 - protein, 30 aa, Cryptosporidium parvum
KKKSSGAEDGNGPPKDQAGISQGGHTNIST

SEQ ID NO: 2265330 - protein, 8 aa, Cryptosporidium parvum
KKKSTEDV

SEQ ID NO: 2265331 - protein, 8 aa, Cryptosporidium parvum
KKKTEDMT

SEQ ID NO: 2265332 - protein, 14 aa, Cryptosporidium parvum
KKKTEESEDDFENE

SEQ ID NO: 2265333 - protein, 19 aa, Cryptosporidium parvum
KKKTNDNRKNRNFKSNQDY

SEQ ID NO: 2265334 - protein, 8 aa, Cryptosporidium parvum
KKKTNQTW

SEQ ID NO: 2265335 - protein, 10 aa, Cryptosporidium parvum
KKKTPSVTSL

SEQ ID NO: 2265336 - protein, 8 aa, Cryptosporidium parvum
KKKTQIAE

SEQ ID NO: 2265337 - protein, 9 aa, Cryptosporidium parvum
KKKTSEPIK

SEQ ID NO: 2265338 - protein, 9 aa, Cryptosporidium parvum
KKKVKESNV

SEQ ID NO: 2265339 - protein, 38 aa, Cryptosporidium parvum
KKKVKKRKNNFNLDEEEDDDNDYRGHSGENLNNTSTND

SEQ ID NO: 2265340 - protein, 9 aa, Cryptosporidium parvum
KKKVSSGLD

SEQ ID NO: 2265341 - protein, 11 aa, Cryptosporidium parvum
KKKYAGENNPV

SEQ ID NO: 2265342 - protein, 5 aa, Cryptosporidium parvum
KKKYN

SEQ ID NO: 2265343 - protein, 7 aa, Cryptosporidium parvum
KKKYNSK

SEQ ID NO: 2265344 - protein, 29 aa, Cryptosporidium parvum
KKKYPKTSSKTNNINNKTLSNFSQNKYNN

SEQ ID NO: 2265345 - protein, 6 aa, Cryptosporidium parvum
KKKYSP

SEQ ID NO: 2265346 - protein, 4 aa, Cryptosporidium parvum
KKLA

SEQ ID NO: 2265347 - protein, 8 aa, Cryptosporidium parvum
KKLDQGNL

SEQ ID NO: 2265348 - protein, 7 aa, Cryptosporidium parvum
KKLEDNT

SEQ ID NO: 2265349 - protein, 62 aa, Cryptosporidium parvum
KKLEGSSSINSFSNNNNNNNNSNNNNNNNSNNINNSNTNNIPRIGTTGGSFSGSHDKPNQNM

SEQ ID NO: 2265350 - protein, 13 aa, Cryptosporidium parvum
KKLEKSSTEQSKL

SEQ ID NO: 2265351 - protein, 12 aa, Cryptosporidium parvum
KKLERQKHNRGR

SEQ ID NO: 2265352 - protein, 5 aa, Cryptosporidium parvum
KKLGL

SEQ ID NO: 2265353 - protein, 5 aa, Cryptosporidium parvum
KKLKA

SEQ ID NO: 2265354 - protein, 12 aa, Cryptosporidium parvum
KKLKANTLNREK

SEQ ID NO: 2265355 - protein, 8 aa, Cryptosporidium parvum
KKLKDDIK

SEQ ID NO: 2265356 - protein, 23 aa, Cryptosporidium parvum
KKLKNKKSQEKSKDNSDSKDNEI

SEQ ID NO: 2265357 - protein, 14 aa, Cryptosporidium parvum
KKLKPSSKKSKYNY

SEQ ID NO: 2265358 - protein, 9 aa, Cryptosporidium parvum
KKLKTGKIT

SEQ ID NO: 2265359 - protein, 15 aa, Cryptosporidium parvum
KKLNKPLNKKNINYN

SEQ ID NO: 2265360 - protein, 15 aa, Cryptosporidium parvum
KKLNRDSNVESNESN

SEQ ID NO: 2265361 - protein, 23 aa, Cryptosporidium parvum
KKLPNESSKLPIDEPQDKQQTFN

SEQ ID NO: 2265362 - protein, 6 aa, Cryptosporidium parvum
KKLREK

SEQ ID NO: 2265363 - protein, 6 aa, Cryptosporidium parvum
KKLSDL

SEQ ID NO: 2265364 - protein, 7 aa, Cryptosporidium parvum
KKLSGRS

SEQ ID NO: 2265365 - protein, 12 aa, Cryptosporidium parvum
KKLSKAKATSFN

SEQ ID NO: 2265366 - protein, 8 aa, Cryptosporidium parvum
KKLSKTEK

SEQ ID NO: 2265367 - protein, 13 aa, Cryptosporidium parvum
KKLSSESGSESEN

SEQ ID NO: 2265368 - protein, 15 aa, Cryptosporidium parvum
KKLTKEDVLRFKQKY

SEQ ID NO: 2265369 - protein, 7 aa, Cryptosporidium parvum
KKLTPGT

SEQ ID NO: 2265370 - protein, 19 aa, Cryptosporidium parvum
KKLTQEMESENSSSDSSEL

SEQ ID NO: 2265371 - protein, 8 aa, Cryptosporidium parvum
KKLTRKIS

SEQ ID NO: 2265372 - protein, 6 aa, Cryptosporidium parvum
KKLTRN

SEQ ID NO: 2265373 - protein, 22 aa, Cryptosporidium parvum
KKLTSNKKSTINGEVSNQNIDE

SEQ ID NO: 2265374 - protein, 6 aa, Cryptosporidium parvum
KKMENY

SEQ ID NO: 2265375 - protein, 19 aa, Cryptosporidium parvum
KKMSNKDNGLIPENNTNDF

SEQ ID NO: 2265376 - protein, 6 aa, Cryptosporidium parvum
KKMTES

SEQ ID NO: 2265377 - protein, 11 aa, Cryptosporidium parvum
KKNAKNKVNKI

SEQ ID NO: 2265378 - protein, 7 aa, Cryptosporidium parvum
KKNCTNE

SEQ ID NO: 2265379 - protein, 25 aa, Cryptosporidium parvum
KKNDEIDNNNNNNNNNNNNSNNSNT

SEQ ID NO: 2265380 - protein, 24 aa, Cryptosporidium parvum
KKNDEKSGGTGPLTPQLGAPGGTP

SEQ ID NO: 2265381 - protein, 15 aa, Cryptosporidium parvum
KKNDIQSDSDENFSN

SEQ ID NO: 2265382 - protein, 9 aa, Cryptosporidium parvum
KKNDLNDDC

SEQ ID NO: 2265383 - protein, 7 aa, Cryptosporidium parvum
KKNDRHE

SEQ ID NO: 2265384 - protein, 6 aa, Cryptosporidium parvum
KKNEEL

SEQ ID NO: 2265385 - protein, 8 aa, Cryptosporidium parvum
KKNEIKKN

SEQ ID NO: 2265386 - protein, 10 aa, Cryptosporidium parvum
KKNEKTTPTE

SEQ ID NO: 2265387 - protein, 4 aa, Cryptosporidium parvum
KKNF

SEQ ID NO: 2265388 - protein, 6 aa, Cryptosporidium parvum
KKNFKN

SEQ ID NO: 2265389 - protein, 11 aa, Cryptosporidium parvum
KKNGEKWGEKK

SEQ ID NO: 2265390 - protein, 4 aa, Cryptosporidium parvum
KKNI

SEQ ID NO: 2265391 - protein, 7 aa, Cryptosporidium parvum
KKNISNK

SEQ ID NO: 2265392 - protein, 11 aa, Cryptosporidium parvum
KKNKKNCNNNI

SEQ ID NO: 2265393 - protein, 6 aa, Cryptosporidium parvum
KKNKMN

SEQ ID NO: 2265394 - protein, 7 aa, Cryptosporidium parvum
KKNKQKT

SEQ ID NO: 2265395 - protein, 12 aa, Cryptosporidium parvum
KKNKRKMSKRNM

SEQ ID NO: 2265396 - protein, 13 aa, Cryptosporidium parvum
KKNKRRNISENSN

SEQ ID NO: 2265397 - protein, 5 aa, Cryptosporidium parvum
KKNKY

SEQ ID NO: 2265398 - protein, 6 aa, Cryptosporidium parvum
KKNKYF

SEQ ID NO: 2265399 - protein, 8 aa, Cryptosporidium parvum
KKNLEQLE

SEQ ID NO: 2265400 - protein, 16 aa, Cryptosporidium parvum
KKNLKGSKLPQEKKNE

SEQ ID NO: 2265401 - protein, 24 aa, Cryptosporidium parvum
KKNMDSNSQEGQGAGKQRKPLTKK

SEQ ID NO: 2265402 - protein, 4 aa, Cryptosporidium parvum
KKNN

SEQ ID NO: 2265403 - protein, 7 aa, Cryptosporidium parvum
KKNNLRR

SEQ ID NO: 2265404 - protein, 6 aa, Cryptosporidium parvum
KKNNPD

SEQ ID NO: 2265405 - protein, 4 aa, Cryptosporidium parvum
KKNP

SEQ ID NO: 2265406 - protein, 8 aa, Cryptosporidium parvum
KKNPGNSV

SEQ ID NO: 2265407 - protein, 5 aa, Cryptosporidium parvum
KKNPI

SEQ ID NO: 2265408 - protein, 6 aa, Cryptosporidium parvum
KKNPKF

SEQ ID NO: 2265409 - protein, 8 aa, Cryptosporidium parvum
KKNPNGQK

SEQ ID NO: 2265410 - protein, 7 aa, Cryptosporidium parvum
KKNPNNK

SEQ ID NO: 2265411 - protein, 8 aa, Cryptosporidium parvum
KKNPQSQL

SEQ ID NO: 2265412 - protein, 7 aa, Cryptosporidium parvum
KKNPVPE

SEQ ID NO: 2265413 - protein, 8 aa, Cryptosporidium parvum
KKNQKNDE

SEQ ID NO: 2265414 - protein, 18 aa, Cryptosporidium parvum
KKNRFNNDKTNSKNFTNI

SEQ ID NO: 2265415 - protein, 33 aa, Cryptosporidium parvum
KKNRKKRGHVSAGHGRVGKHRKHPGGRGACGGL

SEQ ID NO: 2265416 - protein, 8 aa, Cryptosporidium parvum
KKNRPSGL

SEQ ID NO: 2265417 - protein, 26 aa, Cryptosporidium parvum
KKNSEILTEDSSENGSFIDDEKSDIF

SEQ ID NO: 2265418 - protein, 8 aa, Cryptosporidium parvum
KKNSHPKD

SEQ ID NO: 2265419 - protein, 5 aa, Cryptosporidium parvum
KKNSI

SEQ ID NO: 2265420 - protein, 14 aa, Cryptosporidium parvum
KKNSIKKFNESGIK

SEQ ID NO: 2265421 - protein, 8 aa, Cryptosporidium parvum
KKNSINSI

SEQ ID NO: 2265422 - protein, 7 aa, Cryptosporidium parvum
KKNSISE

SEQ ID NO: 2265423 - protein, 8 aa, Cryptosporidium parvum
KKNSKNVK

SEQ ID NO: 2265424 - protein, 11 aa, Cryptosporidium parvum
KKNSKSLLSPT

SEQ ID NO: 2265425 - protein, 9 aa, Cryptosporidium parvum
KKNSPGFND

SEQ ID NO: 2265426 - protein, 5 aa, Cryptosporidium parvum
KKNTI

SEQ ID NO: 2265427 - protein, 7 aa, Cryptosporidium parvum
KKNTKTI

SEQ ID NO: 2265428 - protein, 6 aa, Cryptosporidium parvum
KKNTNV

SEQ ID NO: 2265429 - protein, 4 aa, Cryptosporidium parvum
KKNV

SEQ ID NO: 2265430 - protein, 14 aa, Cryptosporidium parvum
KKNVESNMKSSFTG

SEQ ID NO: 2265431 - protein, 8 aa, Cryptosporidium parvum
KKNYSKDD

SEQ ID NO: 2265432 - protein, 6 aa, Cryptosporidium parvum
KKPALK

SEQ ID NO: 2265433 - protein, 8 aa, Cryptosporidium parvum
KKPANDQI

SEQ ID NO: 2265434 - protein, 6 aa, Cryptosporidium parvum
KKPDSH

SEQ ID NO: 2265435 - protein, 8 aa, Cryptosporidium parvum
KKPDSNQE

SEQ ID NO: 2265436 - protein, 5 aa, Cryptosporidium parvum
KKPEF

SEQ ID NO: 2265437 - protein, 13 aa, Cryptosporidium parvum
KKPEKKRSSRISK

SEQ ID NO: 2265438 - protein, 14 aa, Cryptosporidium parvum
KKPESMSHLRNENS

SEQ ID NO: 2265439 - protein, 14 aa, Cryptosporidium parvum
KKPGTKLTKLNNDQ

SEQ ID NO: 2265440 - protein, 20 aa, Cryptosporidium parvum
KKPIENTSSAGVIKSEGGSI

SEQ ID NO: 2265441 - protein, 6 aa, Cryptosporidium parvum
KKPIGS

SEQ ID NO: 2265442 - protein, 14 aa, Cryptosporidium parvum
KKPITESKPNISLP

SEQ ID NO: 2265443 - protein, 7 aa, Cryptosporidium parvum
KKPKEIN

SEQ ID NO: 2265444 - protein, 6 aa, Cryptosporidium parvum
KKPKIP

SEQ ID NO: 2265445 - protein, 8 aa, Cryptosporidium parvum
KKPLNKTL

SEQ ID NO: 2265446 - protein, 6 aa, Cryptosporidium parvum
KKPLSA

SEQ ID NO: 2265447 - protein, 20 aa, Cryptosporidium parvum
KKPNEQIESSIQNSSGNENQ

SEQ ID NO: 2265448 - protein, 25 aa, Cryptosporidium parvum
KKPNTNDTQTRENKGAETKGYSNIG

SEQ ID NO: 2265449 - protein, 6 aa, Cryptosporidium parvum
KKPPQI

SEQ ID NO: 2265450 - protein, 7 aa, Cryptosporidium parvum
KKPQKHT

SEQ ID NO: 2265451 - protein, 10 aa, Cryptosporidium parvum
KKPQPPPEVV

SEQ ID NO: 2265452 - protein, 13 aa, Cryptosporidium parvum
KKPRKPKNYVSDP

SEQ ID NO: 2265453 - protein, 6 aa, Cryptosporidium parvum
KKPSTI

SEQ ID NO: 2265454 - protein, 6 aa, Cryptosporidium parvum
KKPTNV

SEQ ID NO: 2265455 - protein, 5 aa, Cryptosporidium parvum
KKPYI

SEQ ID NO: 2265456 - protein, 10 aa, Cryptosporidium parvum
KKQDSNLENT

SEQ ID NO: 2265457 - protein, 8 aa, Cryptosporidium parvum
KKQDSVIE

SEQ ID NO: 2265458 - protein, 8 aa, Cryptosporidium parvum
KKQEEESG

SEQ ID NO: 2265459 - protein, 9 aa, Cryptosporidium parvum
KKQEKEKID

SEQ ID NO: 2265460 - protein, 7 aa, Cryptosporidium parvum
KKQEQNT

SEQ ID NO: 2265461 - protein, 11 aa, Cryptosporidium parvum
KKQEVNEEETL

SEQ ID NO: 2265462 - protein, 8 aa, Cryptosporidium parvum
KKQEYSSS

SEQ ID NO: 2265463 - protein, 15 aa, Cryptosporidium parvum
KKQFNLSQNSSDSSS

SEQ ID NO: 2265464 - protein, 21 aa, Cryptosporidium parvum
KKQIKKKNKSIFPPEPTPRKE

SEQ ID NO: 2265465 - protein, 5 aa, Cryptosporidium parvum
KKQIR

SEQ ID NO: 2265466 - protein, 5 aa, Cryptosporidium parvum
KKQIS

SEQ ID NO: 2265467 - protein, 5 aa, Cryptosporidium parvum
KKQIT

SEQ ID NO: 2265468 - protein, 9 aa, Cryptosporidium parvum
KKQKAPDGT

SEQ ID NO: 2265469 - protein, 5 aa, Cryptosporidium parvum
KKQKI

SEQ ID NO: 2265470 - protein, 4 aa, Cryptosporidium parvum
KKQL

SEQ ID NO: 2265471 - protein, 7 aa, Cryptosporidium parvum
KKQMKET

SEQ ID NO: 2265472 - protein, 9 aa, Cryptosporidium parvum
KKQNQNPSI

SEQ ID NO: 2265473 - protein, 5 aa, Cryptosporidium parvum
KKQNS

SEQ ID NO: 2265474 - protein, 7 aa, Cryptosporidium parvum
KKQPFSE

SEQ ID NO: 2265475 - protein, 13 aa, Cryptosporidium parvum
KKQSNINNNNQKV

SEQ ID NO: 2265476 - protein, 8 aa, Cryptosporidium parvum
KKQSTSEA

SEQ ID NO: 2265477 - protein, 7 aa, Cryptosporidium parvum
KKQVTDE

SEQ ID NO: 2265478 - protein, 7 aa, Cryptosporidium parvum
KKQYDNE

SEQ ID NO: 2265479 - protein, 8 aa, Cryptosporidium parvum
KKRDEYTQ

SEQ ID NO: 2265480 - protein, 14 aa, Cryptosporidium parvum
KKRDGNGNTTANNG

SEQ ID NO: 2265481 - protein, 6 aa, Cryptosporidium parvum
KKRDPR

SEQ ID NO: 2265482 - protein, 7 aa, Cryptosporidium parvum
KKREDQL

SEQ ID NO: 2265483 - protein, 30 aa, Cryptosporidium parvum
KKREEEERRIKKEKEEEERRRAKKKMGEGV

SEQ ID NO: 2265484 - protein, 46 aa, Cryptosporidium parvum
KKREIRKKNDKTSNQDSSLNKEKQREERQKDKISKQINSKEDISSI

SEQ ID NO: 2265485 - protein, 6 aa, Cryptosporidium parvum
KKREIY

SEQ ID NO: 2265486 - protein, 13 aa, Cryptosporidium parvum
KKRESKRNQVPNS

SEQ ID NO: 2265487 - protein, 8 aa, Cryptosporidium parvum
KKRESNLA

SEQ ID NO: 2265488 - protein, 4 aa, Cryptosporidium parvum
KKRF

SEQ ID NO: 2265489 - protein, 11 aa, Cryptosporidium parvum
KKRGRKPNSLK

SEQ ID NO: 2265490 - protein, 11 aa, Cryptosporidium parvum
KKRHYSKGDEK

SEQ ID NO: 2265491 - protein, 6 aa, Cryptosporidium parvum
KKRIPE

SEQ ID NO: 2265492 - protein, 7 aa, Cryptosporidium parvum
KKRIQSC

SEQ ID NO: 2265493 - protein, 8 aa, Cryptosporidium parvum
KKRITAEE

SEQ ID NO: 2265494 - protein, 18 aa, Cryptosporidium parvum
KKRKGKLKRSKAKNTQSM

SEQ ID NO: 2265495 - protein, 7 aa, Cryptosporidium parvum
KKRKHQF

SEQ ID NO: 2265496 - protein, 6 aa, Cryptosporidium parvum
KKRKKY

SEQ ID NO: 2265497 - protein, 13 aa, Cryptosporidium parvum
KKRKPKKQCNRVK

SEQ ID NO: 2265498 - protein, 14 aa, Cryptosporidium parvum
KKRKRKKISQDSQV

SEQ ID NO: 2265499 - protein, 16 aa, Cryptosporidium parvum
KKRKSNNDSENASKIQ

SEQ ID NO: 2265500 - protein, 11 aa, Cryptosporidium parvum
KKRKTLENTKN

SEQ ID NO: 2265501 - protein, 38 aa, Cryptosporidium parvum
KKRLTASESDEEETIRSSQRIRYDEDDDEENIDLGRNE

SEQ ID NO: 2265502 - protein, 5 aa, Cryptosporidium parvum
KKRNI

SEQ ID NO: 2265503 - protein, 6 aa, Cryptosporidium parvum
KKRPAV

SEQ ID NO: 2265504 - protein, 33 aa, Cryptosporidium parvum
KKRPSSSETSEGEQDQEQNQQTRKDRRKQKKGL

SEQ ID NO: 2265505 - protein, 25 aa, Cryptosporidium parvum
KKRQGIKKKIGKSNWSGITPSEPKN

SEQ ID NO: 2265506 - protein, 16 aa, Cryptosporidium parvum
KKRQQRMNSGKSISLN

SEQ ID NO: 2265507 - protein, 7 aa, Cryptosporidium parvum
KKRQTKL

SEQ ID NO: 2265508 - protein, 5 aa, Cryptosporidium parvum
KKRRD

SEQ ID NO: 2265509 - protein, 25 aa, Cryptosporidium parvum
KKRRVSDDSSFESADVTNQEYNESK

SEQ ID NO: 2265510 - protein, 6 aa, Cryptosporidium parvum
KKRSIY

SEQ ID NO: 2265511 - protein, 8 aa, Cryptosporidium parvum
KKRSNHLN

SEQ ID NO: 2265512 - protein, 32 aa, Cryptosporidium parvum; identical to SEQ ID NO: 2148077

SEQ ID NO: 2265513 - protein, 16 aa, Cryptosporidium parvum
KKRSRSFDRSSPNNDN

SEQ ID NO: 2265514 - protein, 9 aa, Cryptosporidium parvum
KKRSSQVPN

SEQ ID NO: 2265515 - protein, 25 aa, Cryptosporidium parvum
KKRTDIENTTQSNGSNNVTNSSNID

SEQ ID NO: 2265516 - protein, 8 aa, Cryptosporidium parvum
KKRTEDRK

SEQ ID NO: 2265517 - protein, 5 aa, Cryptosporidium parvum
KKRTI

SEQ ID NO: 2265518 - protein, 12 aa, Cryptosporidium parvum
KKRTLSSREVQT

SEQ ID NO: 2265519 - protein, 33 aa, Cryptosporidium parvum
KKRTRNDQISENDCKEKDEIDQNKIDKEITKEQ

SEQ ID NO: 2265520 - protein, 7 aa, Cryptosporidium parvum
KKRTRYN

SEQ ID NO: 2265521 - protein, 9 aa, Cryptosporidium parvum
KKRYAEKAT

SEQ ID NO: 2265522 - protein, 5 aa, Cryptosporidium parvum
KKRYL

SEQ ID NO: 2265523 - protein, 10 aa, Cryptosporidium parvum
KKSASNSTLD

SEQ ID NO: 2265524 - protein, 8 aa, Cryptosporidium parvum
KKSATRAI

SEQ ID NO: 2265525 - protein, 12 aa, Cryptosporidium parvum
KKSCGGSSSGVQ

SEQ ID NO: 2265526 - protein, 8 aa, Cryptosporidium parvum
KKSDENPI

SEQ ID NO: 2265527 - protein, 14 aa, Cryptosporidium parvum
KKSDHKNSASIEES

SEQ ID NO: 2265528 - protein, 8 aa, Cryptosporidium parvum
KKSDNLGL

SEQ ID NO: 2265529 - protein, 11 aa, Cryptosporidium parvum
KKSDSDDVNSW

SEQ ID NO: 2265530 - protein, 17 aa, Cryptosporidium parvum
KKSEDDDDEKKDSSSYE

SEQ ID NO: 2265531 - protein, 8 aa, Cryptosporidium parvum
KKSEEKLE

SEQ ID NO: 2265532 - protein, 9 aa, Cryptosporidium parvum
KKSEESIES

SEQ ID NO: 2265533 - protein, 8 aa, Cryptosporidium parvum
KKSEISHK

SEQ ID NO: 2265534 - protein, 11 aa, Cryptosporidium parvum
KKSEKKALEQI

SEQ ID NO: 2265535 - protein, 12 aa, Cryptosporidium parvum
KKSFKDRTEKEV

SEQ ID NO: 2265536 - protein, 8 aa, Cryptosporidium parvum
KKSFTSQK

SEQ ID NO: 2265537 - protein, 7 aa, Cryptosporidium parvum
KKSGDDV

SEQ ID NO: 2265538 - protein, 5 aa, Cryptosporidium parvum
KKSGL

SEQ ID NO: 2265539 - protein, 6 aa, Cryptosporidium parvum
KKSGSW

SEQ ID NO: 2265540 - protein, 6 aa, Cryptosporidium parvum
KKSHSM

SEQ ID NO: 2265541 - protein, 6 aa, Cryptosporidium parvum
KKSINN

SEQ ID NO: 2265542 - protein, 7 aa, Cryptosporidium parvum
KKSINYK

SEQ ID NO: 2265543 - protein, 30 aa, Cryptosporidium parvum
KKSISAPKTDVKSSTSENTVSKEISAPTPI

SEQ ID NO: 2265544 - protein, 18 aa, Cryptosporidium parvum
KKSKENNLKDFPDGIPEC

SEQ ID NO: 2265545 - protein, 6 aa, Cryptosporidium parvum
KKSKKI

SEQ ID NO: 2265546 - protein, 11 aa, Cryptosporidium parvum
KKSKNKTSQTC

SEQ ID NO: 2265547 - protein, 14 aa, Cryptosporidium parvum
KKSKPNSRGGGYRK

SEQ ID NO: 2265548 - protein, 14 aa, Cryptosporidium parvum
KKSKQANRKLKKQN

SEQ ID NO: 2265549 - protein, 12 aa, Cryptosporidium parvum
KKSKSKQGNSQE

SEQ ID NO: 2265550 - protein, 26 aa, Cryptosporidium parvum
KKSKSNEKKDSIISDEPTQSKRKYGL

SEQ ID NO: 2265551 - protein, 9 aa, Cryptosporidium parvum
KKSKVPKLD

SEQ ID NO: 2265552 - protein, 7 aa, Cryptosporidium parvum
KKSLEDR

SEQ ID NO: 2265553 - protein, 5 aa, Cryptosporidium parvum
KKSLI

SEQ ID NO: 2265554 - protein, 24 aa, Cryptosporidium parvum
KKSLNNNENLPISSNTNNQSDYSV

SEQ ID NO: 2265555 - protein, 18 aa, Cryptosporidium parvum
KKSLTSTKNINSGSIATQ

SEQ ID NO: 2265556 - protein, 4 aa, Cryptosporidium parvum
KKSN

SEQ ID NO: 2265557 - protein, 6 aa, Cryptosporidium parvum
KKSNDE

SEQ ID NO: 2265558 - protein, 8 aa, Cryptosporidium parvum
KKSNGKFS

SEQ ID NO: 2265559 - protein, 15 aa, Cryptosporidium parvum
KKSNKLKKFIHANKS

SEQ ID NO: 2265560 - protein, 9 aa, Cryptosporidium parvum
KKSNKNDDS

SEQ ID NO: 2265561 - protein, 7 aa, Cryptosporidium parvum
KKSNLRH

SEQ ID NO: 2265562 - protein, 5 aa, Cryptosporidium parvum
KKSNN

SEQ ID NO: 2265563 - protein, 46 aa, Cryptosporidium parvum; identical to SEQ ID NO: 2148114

SEQ ID NO: 2265564 - protein, 12 aa, Cryptosporidium parvum
KKSNSNKNNEDK

SEQ ID NO: 2265565 - protein, 9 aa, Cryptosporidium parvum
KKSNTRPNL

SEQ ID NO: 2265566 - protein, 28 aa, Cryptosporidium parvum
KKSNYGSKNNLRSNDNNEGFISSNKERN

SEQ ID NO: 2265567 - protein, 5 aa, Cryptosporidium parvum
KKSPE

SEQ ID NO: 2265568 - protein, 7 aa, Cryptosporidium parvum
KKSPETL

SEQ ID NO: 2265569 - protein, 18 aa, Cryptosporidium parvum
KKSPRDEQLREKETKQAL

SEQ ID NO: 2265570 - protein, 11 aa, Cryptosporidium parvum
KKSQEKAKEMQ

SEQ ID NO: 2265571 - protein, 24 aa, Cryptosporidium parvum
KKSQTFYSSSSIDKTTNINTNNTE

SEQ ID NO: 2265572 - protein, 10 aa, Cryptosporidium parvum
KKSRAAKLNE

SEQ ID NO: 2265573 - protein, 8 aa, Cryptosporidium parvum
KKSRANTK

SEQ ID NO: 2265574 - protein, 13 aa, Cryptosporidium parvum
KKSRDLKSAKTVE

SEQ ID NO: 2265575 - protein, 6 aa, Cryptosporidium parvum
KKSRLL

SEQ ID NO: 2265576 - protein, 7 aa, Cryptosporidium parvum
KKSSFPR

SEQ ID NO: 2265577 - protein, 11 aa, Cryptosporidium parvum
KKSSKFKNSDV

SEQ ID NO: 2265578 - protein, 13 aa, Cryptosporidium parvum
KKSSLNDDSNKEI

SEQ ID NO: 2265579 - protein, 13 aa, Cryptosporidium parvum
KKSSSNHKLKNQC

SEQ ID NO: 2265580 - protein, 18 aa, Cryptosporidium parvum
KKSSSNVKITSKKSFELP

SEQ ID NO: 2265581 - protein, 115 aa, Cryptosporidium parvum
KKSSSVKKDDGEKKEEKEEKKEVKKDEKEEKKDEKEDKKDEKKEGIEETKEKKEEKKEGDEKKDETDNKEVKEIAEKEKTGVDPEKKAVKAKTKSKAKAKAKEEPPPAPPAEESS

SEQ ID NO: 2265582 - protein, 7 aa, Cryptosporidium parvum
KKSTKSL

SEQ ID NO: 2265583 - protein, 9 aa, Cryptosporidium parvum
KKSTSATPK

SEQ ID NO: 2265584 - protein, 13 aa, Cryptosporidium parvum
KKTAQQQSEAAKD

SEQ ID NO: 2265585 - protein, 8 aa, Cryptosporidium parvum
KKTATPEY

SEQ ID NO: 2265586 - protein, 27 aa, Cryptosporidium parvum
KKTATTGTQKQGENNTVTNTSTVNTET

SEQ ID NO: 2265587 - protein, 5 aa, Cryptosporidium parvum
KKTDA

SEQ ID NO: 2265588 - protein, 14 aa, Cryptosporidium parvum
KKTDLGTEAHATSK

SEQ ID NO: 2265589 - protein, 22 aa, Cryptosporidium parvum
KKTEKSDKKSKKSDKNKSKGNS

SEQ ID NO: 2265590 - protein, 5 aa, Cryptosporidium parvum
KKTEL

SEQ ID NO: 2265591 - protein, 15 aa, Cryptosporidium parvum
KKTERREASREHKAL

SEQ ID NO: 2265592 - protein, 8 aa, Cryptosporidium parvum
KKTETNHQ

SEQ ID NO: 2265593 - protein, 10 aa, Cryptosporidium parvum
KKTEWSRAEE

SEQ ID NO: 2265594 - protein, 10 aa, Cryptosporidium parvum
KKTGGNKQNS

SEQ ID NO: 2265595 - protein, 6 aa, Cryptosporidium parvum
KKTGNI

SEQ ID NO: 2265596 - protein, 8 aa, Cryptosporidium parvum
KKTIQKNN

SEQ ID NO: 2265597 - protein, 7 aa, Cryptosporidium parvum
KKTIRAN

SEQ ID NO: 2265598 - protein, 4 aa, Cryptosporidium parvum
KKTK

SEQ ID NO: 2265599 - protein, 6 aa, Cryptosporidium parvum
KKTLGT

SEQ ID NO: 2265600 - protein, 4 aa, Cryptosporidium parvum
KKTM

SEQ ID NO: 2265601 - protein, 21 aa, Cryptosporidium parvum
KKTNLKKSDLDDFSQSNKSIE

SEQ ID NO: 2265602 - protein, 5 aa, Cryptosporidium parvum
KKTNN

SEQ ID NO: 2265603 - protein, 8 aa, Cryptosporidium parvum
KKTPADNI

SEQ ID NO: 2265604 - protein, 7 aa, Cryptosporidium parvum
KKTPLAK

SEQ ID NO: 2265605 - protein, 6 aa, Cryptosporidium parvum
KKTQDI

SEQ ID NO: 2265606 - protein, 5 aa, Cryptosporidium parvum
KKTQE

SEQ ID NO: 2265607 - protein, 6 aa, Cryptosporidium parvum
KKTQKL

SEQ ID NO: 2265608 - protein, 8 aa, Cryptosporidium parvum
KKTQLNTR

SEQ ID NO: 2265609 - protein, 5 aa, Cryptosporidium parvum
KKTQR

SEQ ID NO: 2265610 - protein, 15 aa, Cryptosporidium parvum
KKTRKAVRPEIGESN

SEQ ID NO: 2265611 - protein, 8 aa, Cryptosporidium parvum
KKTRVNPE

SEQ ID NO: 2265612 - protein, 7 aa, Cryptosporidium parvum
KKTSGDL

SEQ ID NO: 2265613 - protein, 6 aa, Cryptosporidium parvum
KKTSKN

SEQ ID NO: 2265614 - protein, 6 aa, Cryptosporidium parvum
KKTSNF

SEQ ID NO: 2265615 - protein, 8 aa, Cryptosporidium parvum
KKTSRNYT

SEQ ID NO: 2265616 - protein, 12 aa, Cryptosporidium parvum
KKTSSGGHFGRS

SEQ ID NO: 2265617 - protein, 10 aa, Cryptosporidium parvum
KKTSSSSNNL

SEQ ID NO: 2265618 - protein, 12 aa, Cryptosporidium parvum
KKTTKPKRKRLG

SEQ ID NO: 2265619 - protein, 5 aa, Cryptosporidium parvum
KKTTL

SEQ ID NO: 2265620 - protein, 4 aa, Cryptosporidium parvum
KKTY

SEQ ID NO: 2265621 - protein, 12 aa, Cryptosporidium parvum
KKTYGKKGDAVV

SEQ ID NO: 2265622 - protein, 11 aa, Cryptosporidium parvum
KKTYRQNTRAG

SEQ ID NO: 2265623 - protein, 7 aa, Cryptosporidium parvum
KKVASPL

SEQ ID NO: 2265624 - protein, 5 aa, Cryptosporidium parvum
KKVDS

SEQ ID NO: 2265625 - protein, 14 aa, Cryptosporidium parvum
KKVETKSQNVEESI

SEQ ID NO: 2265626 - protein, 25 aa, Cryptosporidium parvum
KKVEVQKTKVKNEQEEDSFDDKETF

SEQ ID NO: 2265627 - protein, 8 aa, Cryptosporidium parvum
KKVNRDEK

SEQ ID NO: 2265628 - protein, 19 aa, Cryptosporidium parvum
KKVSAEDARKVDPSTIKAE

SEQ ID NO: 2265629 - protein, 19 aa, Cryptosporidium parvum
KKVSESKKLKVSENVPDDL

SEQ ID NO: 2265630 - protein, 67 aa, Cryptosporidium parvum
KKVTTNSTNEGRVQKTQPSKKLVNTEKSSIASKTKTDINSNNDKKTTQVKVSNKSLKPNNEISSNSK

SEQ ID NO: 2265631 - protein, 14 aa, Cryptosporidium parvum
KKVTTNTDSNSSLD

SEQ ID NO: 2265632 - protein, 8 aa, Cryptosporidium parvum
KKYAGEKI

SEQ ID NO: 2265633 - protein, 4 aa, Cryptosporidium parvum
KKYC

SEQ ID NO: 2265634 - protein, 7 aa, Cryptosporidium parvum
KKYEDTV

SEQ ID NO: 2265635 - protein, 6 aa, Cryptosporidium parvum
KKYEGG

SEQ ID NO: 2265636 - protein, 7 aa, Cryptosporidium parvum
KKYENSI

SEQ ID NO: 2265637 - protein, 6 aa, Cryptosporidium parvum
KKYGKE

SEQ ID NO: 2265638 - protein, 21 aa, Cryptosporidium parvum
KKYHGTASDVNSFREPVLPPL

SEQ ID NO: 2265639 - protein, 5 aa, Cryptosporidium parvum
KKYNE

SEQ ID NO: 2265640 - protein, 6 aa, Cryptosporidium parvum
KKYNSQ

SEQ ID NO: 2265641 - protein, 8 aa, Cryptosporidium parvum
KKYPSNNN

SEQ ID NO: 2265642 - protein, 7 aa, Cryptosporidium parvum
KKYQEEA

SEQ ID NO: 2265643 - protein, 5 aa, Cryptosporidium parvum
KKYQQ

SEQ ID NO: 2265644 - protein, 6 aa, Cryptosporidium parvum
KKYSTS

SEQ ID NO: 2265645 - protein, 6 aa, Cryptosporidium parvum
KLAEEE

SEQ ID NO: 2265646 - protein, 13 aa, Cryptosporidium parvum
KLAEGAYKYSTET

SEQ ID NO: 2265647 - protein, 7 aa, Cryptosporidium parvum
KLAEKKA

SEQ ID NO: 2265648 - protein, 8 aa, Cryptosporidium parvum
KLAEQSTQ

SEQ ID NO: 2265649 - protein, 8 aa, Cryptosporidium parvum
KLAGADSE

SEQ ID NO: 2265650 - protein, 19 aa, Cryptosporidium parvum
KLAGDSITMEGGPNKEEDL

SEQ ID NO: 2265651 - protein, 5 aa, Cryptosporidium parvum
KLAGK

SEQ ID NO: 2265652 - protein, 8 aa, Cryptosporidium parvum
KLAKQGEI

SEQ ID NO: 2265653 - protein, 45 aa, Cryptosporidium parvum
KLASQKEPKPNTGINSNNNNNNNNITQSSSNVFDQQSANLQNKHI

SEQ ID NO: 2265654 - protein, 6 aa, Cryptosporidium parvum
KLDDGG

SEQ ID NO: 2265655 - protein, 5 aa, Cryptosporidium parvum
KLDED

SEQ ID NO: 2265656 - protein, 7 aa, Cryptosporidium parvum
KLDESEE

SEQ ID NO: 2265657 - protein, 8 aa, Cryptosporidium parvum
KLDGNGTK

SEQ ID NO: 2265658 - protein, 6 aa, Cryptosporidium parvum
KLDKDK

SEQ ID NO: 2265659 - protein, 5 aa, Cryptosporidium parvum
KLDKI

SEQ ID NO: 2265660 - protein, 10 aa, Cryptosporidium parvum
KLDKNKLTNE

SEQ ID NO: 2265661 - protein, 12 aa, Cryptosporidium parvum
KLDKSKLTSGTR

SEQ ID NO: 2265662 - protein, 5 aa, Cryptosporidium parvum
KLDND

SEQ ID NO: 2265663 - protein, 8 aa, Cryptosporidium parvum
KLDPASSF

SEQ ID NO: 2265664 - protein, 13 aa, Cryptosporidium parvum
KLDRGESVDEQNI

SEQ ID NO: 2265665 - protein, 8 aa, Cryptosporidium parvum
KLDRGGKD

SEQ ID NO: 2265666 - protein, 11 aa, Cryptosporidium parvum
KLDSKSQGILE

SEQ ID NO: 2265667 - protein, 4 aa, Cryptosporidium parvum
KLEA

SEQ ID NO: 2265668 - protein, 11 aa, Cryptosporidium parvum
KLEDNDEITSI

SEQ ID NO: 2265669 - protein, 14 aa, Cryptosporidium parvum
KLEDRSNSELESNG

SEQ ID NO: 2265670 - protein, 7 aa, Cryptosporidium parvum
KLEEAER

SEQ ID NO: 2265671 - protein, 9 aa, Cryptosporidium parvum
KLEEDNKKY

SEQ ID NO: 2265672 - protein, 9 aa, Cryptosporidium parvum
KLEKDSTRK

SEQ ID NO: 2265673 - protein, 10 aa, Cryptosporidium parvum
KLEKEENPLK

SEQ ID NO: 2265674 - protein, 10 aa, Cryptosporidium parvum
KLEKKNPIPI

SEQ ID NO: 2265675 - protein, 10 aa, Cryptosporidium parvum
KLENAKKKNW

SEQ ID NO: 2265676 - protein, 11 aa, Cryptosporidium parvum
KLENDQPSVNN

SEQ ID NO: 2265677 - protein, 7 aa, Cryptosporidium parvum
KLENEKQ

SEQ ID NO: 2265678 - protein, 10 aa, Cryptosporidium parvum
KLENEQDLTR

SEQ ID NO: 2265679 - protein, 8 aa, Cryptosporidium parvum
KLENESSK

SEQ ID NO: 2265680 - protein, 21 aa, Cryptosporidium parvum
KLENNSELNPNEEKVTDNCDS

SEQ ID NO: 2265681 - protein, 7 aa, Cryptosporidium parvum
KLEQEEA

SEQ ID NO: 2265682 - protein, 10 aa, Cryptosporidium parvum
KLESAENKLS

SEQ ID NO: 2265683 - protein, 6 aa, Cryptosporidium parvum
KLESED

SEQ ID NO: 2265684 - protein, 22 aa, Cryptosporidium parvum
KLESTRSSLSLKSSDKNSSCPE

SEQ ID NO: 2265685 - protein, 8 aa, Cryptosporidium parvum
KLETEKDH

SEQ ID NO: 2265686 - protein, 9 aa, Cryptosporidium parvum
KLETTSKGL

SEQ ID NO: 2265687 - protein, 4 aa, Cryptosporidium parvum
KLEV

SEQ ID NO: 2265688 - protein, 9 aa, Cryptosporidium parvum
KLGDKKENF

SEQ ID NO: 2265689 - protein, 7 aa, Cryptosporidium parvum
KLGDKSG

SEQ ID NO: 2265690 - protein, 9 aa, Cryptosporidium parvum
KLGDNRTQF

SEQ ID NO: 2265691 - protein, 14 aa, Cryptosporidium parvum
KLGERNDSNDQKES

SEQ ID NO: 2265692 - protein, 14 aa, Cryptosporidium parvum
KLGGIDSRTSGSSY

SEQ ID NO: 2265693 - protein, 6 aa, Cryptosporidium parvum
KLGKDT

SEQ ID NO: 2265694 - protein, 12 aa, Cryptosporidium parvum
KLGKENQQEPDK

SEQ ID NO: 2265695 - protein, 57 aa, Cryptosporidium parvum
KLGNSEQKGRLKSSPSSSPSSSSSSSSSSRSRSRSGSRSGFKSESRTKSRSASEPRI

SEQ ID NO: 2265696 - protein, 7 aa, Cryptosporidium parvum
KLGNSTP

SEQ ID NO: 2265697 - protein, 6 aa, Cryptosporidium parvum
KLGPNG

SEQ ID NO: 2265698 - protein, 7 aa, Cryptosporidium parvum
KLGRNDE

SEQ ID NO: 2265699 - protein, 5 aa, Cryptosporidium parvum
KLGRP

SEQ ID NO: 2265700 - protein, 22 aa, Cryptosporidium parvum
KLGSSSRESKAIESPENNSISL

SEQ ID NO: 2265701 - protein, 18 aa, Cryptosporidium parvum
KLHSNTSANKDSGVNSLK

SEQ ID NO: 2265702 - protein, 10 aa, Cryptosporidium parvum
KLIQESATDY

SEQ ID NO: 2265703 - protein, 10 aa, Cryptosporidium parvum
KLKAHSDKRF

SEQ ID NO: 2265704 - protein, 10 aa, Cryptosporidium parvum
KLKEDLPGHA

SEQ ID NO: 2265705 - protein, 11 aa, Cryptosporidium parvum
KLKEKEKEYDD

SEQ ID NO: 2265706 - protein, 11 aa, Cryptosporidium parvum
KLKEPKKIQED

SEQ ID NO: 2265707 - protein, 10 aa, Cryptosporidium parvum
KLKESDSVEV

SEQ ID NO: 2265708 - protein, 25 aa, Cryptosporidium parvum
KLKKENNSVLTPTDDTLQKDSHTSN

SEQ ID NO: 2265709 - protein, 20 aa, Cryptosporidium parvum
KLKKNTGAGTTSDKSNIDCN

SEQ ID NO: 2265710 - protein, 20 aa, Cryptosporidium parvum
KLKNDDSPGNYGKKTLKSPN

SEQ ID NO: 2265711 - protein, 8 aa, Cryptosporidium parvum
KLKNEINT

SEQ ID NO: 2265712 - protein, 8 aa, Cryptosporidium parvum
KLKNESTI

SEQ ID NO: 2265713 - protein, 8 aa, Cryptosporidium parvum
KLKPDQKE

SEQ ID NO: 2265714 - protein, 14 aa, Cryptosporidium parvum
KLKQNKKEPNISNN

SEQ ID NO: 2265715 - protein, 10 aa, Cryptosporidium parvum
KLKSAGMDEA

SEQ ID NO: 2265716 - protein, 26 aa, Cryptosporidium parvum
KLKSKRGRRKINKQSSEKVKSRNKEA

SEQ ID NO: 2265717 - protein, 19 aa, Cryptosporidium parvum
KLKSKSHKIYKNDDRSSFN

SEQ ID NO: 2265718 - protein, 5 aa, Cryptosporidium parvum
KLKSS

SEQ ID NO: 2265719 - protein, 10 aa, Cryptosporidium parvum
KLKSYQSRCG

SEQ ID NO: 2265720 - protein, 12 aa, Cryptosporidium parvum
KLKTNKNRQVGT

SEQ ID NO: 2265721 - protein, 12 aa, Cryptosporidium parvum
KLKTQNEELRDS

SEQ ID NO: 2265722 - protein, 5 aa, Cryptosporidium parvum
KLKTR

SEQ ID NO: 2265723 - protein, 7 aa, Cryptosporidium parvum
KLKTSKK

SEQ ID NO: 2265724 - protein, 19 aa, Cryptosporidium parvum
KLNAERSKLSDRDKENQFM

SEQ ID NO: 2265725 - protein, 6 aa, Cryptosporidium parvum
KLNDAN

SEQ ID NO: 2265726 - protein, 5 aa, Cryptosporidium parvum
KLNDS

SEQ ID NO: 2265727 - protein, 8 aa, Cryptosporidium parvum
KLNEQTEQ

SEQ ID NO: 2265728 - protein, 14 aa, Cryptosporidium parvum
KLNESQNDNRVSEL

SEQ ID NO: 2265729 - protein, 10 aa, Cryptosporidium parvum
KLNGQKSKHF

SEQ ID NO: 2265730 - protein, 7 aa, Cryptosporidium parvum
KLNKEKN

SEQ ID NO: 2265731 - protein, 4 aa, Cryptosporidium parvum
KLNN

SEQ ID NO: 2265732 - protein, 10 aa, Cryptosporidium parvum
KLNNEDASDD

SEQ ID NO: 2265733 - protein, 11 aa, Cryptosporidium parvum
KLNNEEEKGDL

SEQ ID NO: 2265734 - protein, 6 aa, Cryptosporidium parvum
KLNNSK

SEQ ID NO: 2265735 - protein, 20 aa, Cryptosporidium parvum
KLNPTEPYRDPKKVSGKEQI

SEQ ID NO: 2265736 - protein, 7 aa, Cryptosporidium parvum
KLNPTES

SEQ ID NO: 2265737 - protein, 5 aa, Cryptosporidium parvum
KLNRT

SEQ ID NO: 2265738 - protein, 12 aa, Cryptosporidium parvum
KLNSNEESQPKD

SEQ ID NO: 2265739 - protein, 10 aa, Cryptosporidium parvum
KLNSSLKDDI

SEQ ID NO: 2265740 - protein, 6 aa, Cryptosporidium parvum
KLNSTE

SEQ ID NO: 2265741 - protein, 16 aa, Cryptosporidium parvum
KLNSTNEENINNSESS

SEQ ID NO: 2265742 - protein, 4 aa, Cryptosporidium parvum
KLNT

SEQ ID NO: 2265743 - protein, 4 aa, Cryptosporidium parvum
KLPD

SEQ ID NO: 2265744 - protein, 8 aa, Cryptosporidium parvum
KLPDKSEV

SEQ ID NO: 2265745 - protein, 6 aa, Cryptosporidium parvum
KLPDNS

SEQ ID NO: 2265746 - protein, 6 aa, Cryptosporidium parvum
KLPDNV

SEQ ID NO: 2265747 - protein, 7 aa, Cryptosporidium parvum
KLPDSLE

SEQ ID NO: 2265748 - protein, 12 aa, Cryptosporidium parvum
KLPEDSSLSNNE

SEQ ID NO: 2265749 - protein, 6 aa, Cryptosporidium parvum
KLPGTN

SEQ ID NO: 2265750 - protein, 6 aa, Cryptosporidium parvum
KLPKNI

SEQ ID NO: 2265751 - protein, 6 aa, Cryptosporidium parvum
KLPKQE

SEQ ID NO: 2265752 - protein, 48 aa, Cryptosporidium parvum
KLPNSLENDGNIDSKISDDQITKTSLSNETSTPISIDNNSSPISNQSN

SEQ ID NO: 2265753 - protein, 23 aa, Cryptosporidium parvum
KLPNTKKLDSNSMSTENNGKTGG

SEQ ID NO: 2265754 - protein, 13 aa, Cryptosporidium parvum
KLPPEDEFRKTTS

SEQ ID NO: 2265755 - protein, 6 aa, Cryptosporidium parvum
KLPPEH

SEQ ID NO: 2265756 - protein, 9 aa, Cryptosporidium parvum
KLPPKDGNV

SEQ ID NO: 2265757 - protein, 16 aa, Cryptosporidium parvum
KLPPKEVTEQIKKILE

SEQ ID NO: 2265758 - protein, 8 aa, Cryptosporidium parvum
KLPRQEYS

SEQ ID NO: 2265759 - protein, 79 aa, Cryptosporidium parvum
KLPTGPLARPDRESVKRDEDNENEDDVDDEDEDLDEEEEKEKSFELSNENNLEEKKIEPTNTENENEKQSTPNGNEFDG

SEQ ID NO: 2265760 - protein, 7 aa, Cryptosporidium parvum
KLPTKSD

SEQ ID NO: 2265761 - protein, 15 aa, Cryptosporidium parvum
KLPTSEQSSTQKNDT

SEQ ID NO: 2265762 - protein, 7 aa, Cryptosporidium parvum
KLQASVA

SEQ ID NO: 2265763 - protein, 7 aa, Cryptosporidium parvum
KLQEKSS

SEQ ID NO: 2265764 - protein, 6 aa, Cryptosporidium parvum
KLQEYE

SEQ ID NO: 2265765 - protein, 16 aa, Cryptosporidium parvum
KLQKQSSVSTDSTGEQ

SEQ ID NO: 2265766 - protein, 13 aa, Cryptosporidium parvum
KLQPDNKKSLNYS

SEQ ID NO: 2265767 - protein, 4 aa, Cryptosporidium parvum
KLQQ

SEQ ID NO: 2265768 - protein, 10 aa, Cryptosporidium parvum
KLQQARNTLQ

SEQ ID NO: 2265769 - protein, 7 aa, Cryptosporidium parvum
KLQSNSN

SEQ ID NO: 2265770 - protein, 7 aa, Cryptosporidium parvum
KLQSQAN

SEQ ID NO: 2265771 - protein, 19 aa, Cryptosporidium parvum
KLQTRGRDLGSKLTNNPKS

SEQ ID NO: 2265772 - protein, 9 aa, Cryptosporidium parvum
KLQTSSERV

SEQ ID NO: 2265773 - protein, 11 aa, Cryptosporidium parvum
KLQYSKPTITI

SEQ ID NO: 2265774 - protein, 13 aa, Cryptosporidium parvum
KLRCGSQEMSNSE

SEQ ID NO: 2265775 - protein, 41 aa, Cryptosporidium parvum
KLRDSNSTKKSTNTRNSCKQPKISQKLPSTINRTNSNASLR

SEQ ID NO: 2265776 - protein, 13 aa, Cryptosporidium parvum
KLRDVQKQANPLG

SEQ ID NO: 2265777 - protein, 9 aa, Cryptosporidium parvum
KLREKKQSV

SEQ ID NO: 2265778 - protein, 13 aa, Cryptosporidium parvum
KLRKQETKKNLRE

SEQ ID NO: 2265779 - protein, 7 aa, Cryptosporidium parvum
KLRNQNE

SEQ ID NO: 2265780 - protein, 9 aa, Cryptosporidium parvum
KLRSSEVSK

SEQ ID NO: 2265781 - protein, 13 aa, Cryptosporidium parvum
KLRSSPNKNSVSG

SEQ ID NO: 2265782 - protein, 19 aa, Cryptosporidium parvum
KLRTNDSSIFSSNDDFESR

SEQ ID NO: 2265783 - protein, 8 aa, Cryptosporidium parvum
KLSDQGQN

SEQ ID NO: 2265784 - protein, 4 aa, Cryptosporidium parvum
KLSE

SEQ ID NO: 2265785 - protein, 10 aa, Cryptosporidium parvum
KLSEEKNRIQ

SEQ ID NO: 2265786 - protein, 14 aa, Cryptosporidium parvum
KLSEGEDPRISGPS

SEQ ID NO: 2265787 - protein, 10 aa, Cryptosporidium parvum
KLSENKNLSG

SEQ ID NO: 2265788 - protein, 24 aa, Cryptosporidium parvum
KLSEPKINYPNNNNKADDYNDNAK

SEQ ID NO: 2265789 - protein, 11 aa, Cryptosporidium parvum
KLSESSRNCKS

SEQ ID NO: 2265790 - protein, 16 aa, Cryptosporidium parvum
KLSGSESSQNRSKDDM

SEQ ID NO: 2265791 - protein, 8 aa, Cryptosporidium parvum
KLSKECSD

SEQ ID NO: 2265792 - protein, 7 aa, Cryptosporidium parvum
KLSKEMT

SEQ ID NO: 2265793 - protein, 6 aa, Cryptosporidium parvum
KLSKGL

SEQ ID NO: 2265794 - protein, 12 aa, Cryptosporidium parvum
KLSKNGKKNPIL

SEQ ID NO: 2265795 - protein, 13 aa, Cryptosporidium parvum
KLSKNQSQGQFES

SEQ ID NO: 2265796 - protein, 8 aa, Cryptosporidium parvum
KLSKRTNM

SEQ ID NO: 2265797 - protein, 7 aa, Cryptosporidium parvum
KLSKSDP

SEQ ID NO: 2265798 - protein, 7 aa, Cryptosporidium parvum
KLSKTEF

SEQ ID NO: 2265799 - protein, 9 aa, Cryptosporidium parvum
KLSLSNDEE

SEQ ID NO: 2265800 - protein, 5 aa, Cryptosporidium parvum
KLSNE

SEQ ID NO: 2265801 - protein, 9 aa, Cryptosporidium parvum
KLSNEEEQQ

SEQ ID NO: 2265802 - protein, 7 aa, Cryptosporidium parvum
KLSNNTV

SEQ ID NO: 2265803 - protein, 8 aa, Cryptosporidium parvum
KLSNPDSK

SEQ ID NO: 2265804 - protein, 13 aa, Cryptosporidium parvum
KLSNRESNNLSAT

SEQ ID NO: 2265805 - protein, 20 aa, Cryptosporidium parvum
KLSNSNISPFNPSKSTSRLS

SEQ ID NO: 2265806 - protein, 14 aa, Cryptosporidium parvum
KLSNSNTKQNPSNL

SEQ ID NO: 2265807 - protein, 4 aa, Cryptosporidium parvum
KLSP

SEQ ID NO: 2265808 - protein, 9 aa, Cryptosporidium parvum
KLSPEDKKN

SEQ ID NO: 2265809 - protein, 5 aa, Cryptosporidium parvum
KLSPK

SEQ ID NO: 2265810 - protein, 17 aa, Cryptosporidium parvum
KLSPKGHQLNKDELTTK

SEQ ID NO: 2265811 - protein, 14 aa, Cryptosporidium parvum
KLSPKTVHTNNEKV

SEQ ID NO: 2265812 - protein, 12 aa, Cryptosporidium parvum
KLSRSSSNSGTI

SEQ ID NO: 2265813 - protein, 9 aa, Cryptosporidium parvum
KLSSSPDVF

SEQ ID NO: 2265814 - protein, 29 aa, Cryptosporidium parvum
KLSSSSNINKLDSQTQEDLNSFEKDPTKR

SEQ ID NO: 2265815 - protein, 4 aa, Cryptosporidium parvum
KLST

SEQ ID NO: 2265816 - protein, 8 aa, Cryptosporidium parvum
KLSTDSNN

SEQ ID NO: 2265817 - protein, 14 aa, Cryptosporidium parvum
KLTENTDLGEPSKR

SEQ ID NO: 2265818 - protein, 5 aa, Cryptosporidium parvum
KLTGE

SEQ ID NO: 2265819 - protein, 10 aa, Cryptosporidium parvum
KLTNDDGLTP

SEQ ID NO: 2265820 - protein, 9 aa, Cryptosporidium parvum
KLTNRDEVG

SEQ ID NO: 2265821 - protein, 24 aa, Cryptosporidium parvum
KLTNTNFEKKSNVDHHYSQNQNSY

SEQ ID NO: 2265822 - protein, 6 aa, Cryptosporidium parvum
KLTPQM

SEQ ID NO: 2265823 - protein, 15 aa, Cryptosporidium parvum
KLTPSSSKRRFSPQL

SEQ ID NO: 2265824 - protein, 5 aa, Cryptosporidium parvum
KLTQA

SEQ ID NO: 2265825 - protein, 10 aa, Cryptosporidium parvum
KLTREGETAL

SEQ ID NO: 2265826 - protein, 18 aa, Cryptosporidium parvum
KLTSEIESSAQCKSELSR

SEQ ID NO: 2265827 - protein, 6 aa, Cryptosporidium parvum
KLTSTS

SEQ ID NO: 2265828 - protein, 5 aa, Cryptosporidium parvum
KLVGG

SEQ ID NO: 2265829 - protein, 6 aa, Cryptosporidium parvum
KLYQPN

SEQ ID NO: 2265830 - protein, 10 aa, Cryptosporidium parvum
KLYSGKNSQN

SEQ ID NO: 2265831 - protein, 8 aa, Cryptosporidium parvum
KLYSSPHN

SEQ ID NO: 2265832 - protein, 10 aa, Cryptosporidium parvum
KMDESGGNLD

SEQ ID NO: 2265833 - protein, 4 aa, Cryptosporidium parvum
KMDG

SEQ ID NO: 2265834 - protein, 7 aa, Cryptosporidium parvum
KMDGPTS

SEQ ID NO: 2265835 - protein, 5 aa, Cryptosporidium parvum
KMDNA

SEQ ID NO: 2265836 - protein, 8 aa, Cryptosporidium parvum
KMDPETSS

SEQ ID NO: 2265837 - protein, 9 aa, Cryptosporidium parvum
KMDRKRSSS

SEQ ID NO: 2265838 - protein, 7 aa, Cryptosporidium parvum
KMDTKDA

SEQ ID NO: 2265839 - protein, 6 aa, Cryptosporidium parvum
KMEGSL

SEQ ID NO: 2265840 - protein, 11 aa, Cryptosporidium parvum
KMGGNSENACT

SEQ ID NO: 2265841 - protein, 15 aa, Cryptosporidium parvum
KMKAASGADISNANI

SEQ ID NO: 2265842 - protein, 9 aa, Cryptosporidium parvum
KMKDGSRSL

SEQ ID NO: 2265843 - protein, 17 aa, Cryptosporidium parvum
KMKDNSSNLDMNGKFIK

SEQ ID NO: 2265844 - protein, 11 aa, Cryptosporidium parvum
KMKNPTNSNQI

SEQ ID NO: 2265845 - protein, 12 aa, Cryptosporidium parvum
KMKPDNSQKMSS

SEQ ID NO: 2265846 - protein, 8 aa, Cryptosporidium parvum
KMKPDRPN

SEQ ID NO: 2265847 - protein, 15 aa, Cryptosporidium parvum
KMKRIDDSSNNKSLG

SEQ ID NO: 2265848 - protein, 11 aa, Cryptosporidium parvum
KMKSNQKNTVT

SEQ ID NO: 2265849 - protein, 21 aa, Cryptosporidium parvum
KMKTGLSDDSSTYRSNKKISG

SEQ ID NO: 2265850 - protein, 29 aa, Cryptosporidium parvum
KMLPNERGSIHPNSDISTYPASCKPNTDE

SEQ ID NO: 2265851 - protein, 12 aa, Cryptosporidium parvum
KMNKESEELKSI

SEQ ID NO: 2265852 - protein, 21 aa, Cryptosporidium parvum
KMNKNNIRNRTKQIDPDQAEI

SEQ ID NO: 2265853 - protein, 10 aa, Cryptosporidium parvum
KMNSSTNGKS

SEQ ID NO: 2265854 - protein, 10 aa, Cryptosporidium parvum
KMPNSPKKSL

SEQ ID NO: 2265855 - protein, 5 aa, Cryptosporidium parvum
KMRPM

SEQ ID NO: 2265856 - protein, 11 aa, Cryptosporidium parvum
KMRQDDENQLK

SEQ ID NO: 2265857 - protein, 9 aa, Cryptosporidium parvum
KMSDDEKRK

SEQ ID NO: 2265858 - protein, 5 aa, Cryptosporidium parvum
KMSKS

SEQ ID NO: 2265859 - protein, 5 aa, Cryptosporidium parvum
KMSLN

SEQ ID NO: 2265860 - protein, 10 aa, Cryptosporidium parvum
KMSNPNQNLG

SEQ ID NO: 2265861 - protein, 12 aa, Cryptosporidium parvum
KMSSRKNAMERR

SEQ ID NO: 2265862 - protein, 8 aa, Cryptosporidium parvum
KMTEDEIN

SEQ ID NO: 2265863 - protein, 5 aa, Cryptosporidium parvum
KMTTN

SEQ ID NO: 2265864 - protein, 9 aa, Cryptosporidium parvum
KMVGSESGF

SEQ ID NO: 2265865 - protein, 4 aa, Cryptosporidium parvum
KMYP

SEQ ID NO: 2265866 - protein, 7 aa, Cryptosporidium parvum
KNADSIY

SEQ ID NO: 2265867 - protein, 28 aa, Cryptosporidium parvum
KNAETYRKSNLNQQQNQSSNTTSGKKRR

SEQ ID NO: 2265868 - protein, 10 aa, Cryptosporidium parvum
KNAGTQSTQS

SEQ ID NO: 2265869 - protein, 29 aa, Cryptosporidium parvum
KNAGVNYSESGENLENDQNSWNVKEADEK

SEQ ID NO: 2265870 - protein, 7 aa, Cryptosporidium parvum
KNAISKK

SEQ ID NO: 2265871 - protein, 9 aa, Cryptosporidium parvum
KNANATHSV

SEQ ID NO: 2265872 - protein, 10 aa, Cryptosporidium parvum
KNAPKVNQQY

SEQ ID NO: 2265873 - protein, 5 aa, Cryptosporidium parvum
KNAPL

SEQ ID NO: 2265874 - protein, 8 aa, Cryptosporidium parvum
KNAQNSAK

SEQ ID NO: 2265875 - protein, 4 aa, Cryptosporidium parvum
KNAS

SEQ ID NO: 2265876 - protein, 26 aa, Cryptosporidium parvum
KNASEDSSDEENIETKKRKSNEENIS

SEQ ID NO: 2265877 - protein, 4 aa, Cryptosporidium parvum
KNAT

SEQ ID NO: 2265878 - protein, 5 aa, Cryptosporidium parvum
KNCKR

SEQ ID NO: 2265879 - protein, 4 aa, Cryptosporidium parvum
KNCP

SEQ ID NO: 2265880 - protein, 5 aa, Cryptosporidium parvum
KNCPD

SEQ ID NO: 2265881 - protein, 5 aa, Cryptosporidium parvum
KNCPP

SEQ ID NO: 2265882 - protein, 13 aa, Cryptosporidium parvum
KNCSNSELNTELT

SEQ ID NO: 2265883 - protein, 5 aa, Cryptosporidium parvum
KNCTE

SEQ ID NO: 2265884 - protein, 12 aa, Cryptosporidium parvum
KNDDSDIAGFGA

SEQ ID NO: 2265885 - protein, 8 aa, Cryptosporidium parvum
KNDDVDLK

SEQ ID NO: 2265886 - protein, 13 aa, Cryptosporidium parvum
KNDDVVKDKKHGN

SEQ ID NO: 2265887 - protein, 9 aa, Cryptosporidium parvum
KNDEIQQED

SEQ ID NO: 2265888 - protein, 21 aa, Cryptosporidium parvum
KNDEITKYKGSLTTKEAEINN

SEQ ID NO: 2265889 - protein, 17 aa, Cryptosporidium parvum
KNDELRREENESLKGES

SEQ ID NO: 2265890 - protein, 13 aa, Cryptosporidium parvum
KNDEQGSDIQDEP

SEQ ID NO: 2265891 - protein, 17 aa, Cryptosporidium parvum
KNDESEADGDRFPIPPE

SEQ ID NO: 2265892 - protein, 14 aa, Cryptosporidium parvum
KNDGERRVHASGHD

SEQ ID NO: 2265893 - protein, 8 aa, Cryptosporidium parvum
KNDGKKQL

SEQ ID NO: 2265894 - protein, 12 aa, Cryptosporidium parvum
KNDGTASNDGSC

SEQ ID NO: 2265895 - protein, 5 aa, Cryptosporidium parvum
KNDIE

SEQ ID NO: 2265896 - protein, 18 aa, Cryptosporidium parvum
KNDIEINNNKNENQNSNF

SEQ ID NO: 2265897 - protein, 10 aa, Cryptosporidium parvum
KNDKKHGRAI

SEQ ID NO: 2265898 - protein, 8 aa, Cryptosporidium parvum
KNDKPDAL

SEQ ID NO: 2265899 - protein, 5 aa, Cryptosporidium parvum
KNDKS

SEQ ID NO: 2265900 - protein, 7 aa, Cryptosporidium parvum
KNDKTSF

SEQ ID NO: 2265901 - protein, 6 aa, Cryptosporidium parvum
KNDLNN

SEQ ID NO: 2265902 - protein, 4 aa, Cryptosporidium parvum
KNDM

SEQ ID NO: 2265903 - protein, 6 aa, Cryptosporidium parvum
KNDMQG

SEQ ID NO: 2265904 - protein, 4 aa, Cryptosporidium parvum
KNDN

SEQ ID NO: 2265905 - protein, 7 aa, Cryptosporidium parvum
KNDNANL

SEQ ID NO: 2265906 - protein, 17 aa, Cryptosporidium parvum
KNDNDNVEANSNETITV

SEQ ID NO: 2265907 - protein, 16 aa, Cryptosporidium parvum
KNDNLNALDNGNQTEN

SEQ ID NO: 2265908 - protein, 15 aa, Cryptosporidium parvum
KNDNLNLDSKTNQSE

SEQ ID NO: 2265909 - protein, 12 aa, Cryptosporidium parvum
KNDNNKGINDEE

SEQ ID NO: 2265910 - protein, 7 aa, Cryptosporidium parvum
KNDNPIK

SEQ ID NO: 2265911 - protein, 7 aa, Cryptosporidium parvum
KNDPDLY

SEQ ID NO: 2265912 - protein, 7 aa, Cryptosporidium parvum
KNDPEPL

SEQ ID NO: 2265913 - protein, 13 aa, Cryptosporidium parvum
KNDPGDEKENSIN

SEQ ID NO: 2265914 - protein, 7 aa, Cryptosporidium parvum
KNDPGYS

SEQ ID NO: 2265915 - protein, 8 aa, Cryptosporidium parvum
KNDPKSYN

SEQ ID NO: 2265916 - protein, 8 aa, Cryptosporidium parvum
KNDPPTGE

SEQ ID NO: 2265917 - protein, 9 aa, Cryptosporidium parvum
KNDPTHSNL

SEQ ID NO: 2265918 - protein, 18 aa, Cryptosporidium parvum
KNDPVDKSLEEEDIDNKE

SEQ ID NO: 2265919 - protein, 28 aa, Cryptosporidium parvum
KNDREGEDDDESYSESDSSDEDEDSDAE

SEQ ID NO: 2265920 - protein, 9 aa, Cryptosporidium parvum
KNDSAGTDL

SEQ ID NO: 2265921 - protein, 40 aa, Cryptosporidium parvum
KNDSNSGGVTTTSSSTGRSENQASVNSDMSNISNDSSNNL

SEQ ID NO: 2265922 - protein, 9 aa, Cryptosporidium parvum
KNDSPLTQL

SEQ ID NO: 2265923 - protein, 8 aa, Cryptosporidium parvum
KNDSQDQI

SEQ ID NO: 2265924 - protein, 10 aa, Cryptosporidium parvum
KNDVNSEELT

SEQ ID NO: 2265925 - protein, 9 aa, Cryptosporidium parvum
KNEASLSGN

SEQ ID NO: 2265926 - protein, 11 aa, Cryptosporidium parvum
KNECKEKDNFM

SEQ ID NO: 2265927 - protein, 9 aa, Cryptosporidium parvum
KNEDKMTSD

SEQ ID NO: 2265928 - protein, 5 aa, Cryptosporidium parvum
KNEDS

SEQ ID NO: 2265929 - protein, 13 aa, Cryptosporidium parvum
KNEEKDTANNSKS

SEQ ID NO: 2265930 - protein, 5 aa, Cryptosporidium parvum
KNEEL

SEQ ID NO: 2265931 - protein, 5 aa, Cryptosporidium parvum
KNEET

SEQ ID NO: 2265932 - protein, 11 aa, Cryptosporidium parvum
KNEEVEDLNTN

SEQ ID NO: 2265933 - protein, 6 aa, Cryptosporidium parvum
KNEFQE

SEQ ID NO: 2265934 - protein, 5 aa, Cryptosporidium parvum
KNEIE

SEQ ID NO: 2265935 - protein, 16 aa, Cryptosporidium parvum
KNEIEQTSNSNTDQKI

SEQ ID NO: 2265936 - protein, 6 aa, Cryptosporidium parvum
KNEING

SEQ ID NO: 2265937 - protein, 5 aa, Cryptosporidium parvum
KNEIS

SEQ ID NO: 2265938 - protein, 6 aa, Cryptosporidium parvum
KNEIST

SEQ ID NO: 2265939 - protein, 6 aa, Cryptosporidium parvum
KNEKDF

SEQ ID NO: 2265940 - protein, 8 aa, Cryptosporidium parvum
KNEKGAQF

SEQ ID NO: 2265941 - protein, 6 aa, Cryptosporidium parvum
KNEKNR

SEQ ID NO: 2265942 - protein, 7 aa, Cryptosporidium parvum
KNEKSSL

SEQ ID NO: 2265943 - protein, 4 aa, Cryptosporidium parvum
KNEL

SEQ ID NO: 2265944 - protein, 13 aa, Cryptosporidium parvum
KNELSNTDRKQPR

SEQ ID NO: 2265945 - protein, 6 aa, Cryptosporidium parvum
KNELYT

SEQ ID NO: 2265946 - protein, 7 aa, Cryptosporidium parvum
KNENCRN

SEQ ID NO: 2265947 - protein, 17 aa, Cryptosporidium parvum
KNENESEKKNSKSQING

SEQ ID NO: 2265948 - protein, 6 aa, Cryptosporidium parvum
KNENGL

SEQ ID NO: 2265949 - protein, 7 aa, Cryptosporidium parvum
KNENKIK

SEQ ID NO: 2265950 - protein, 9 aa, Cryptosporidium parvum
KNENSLANF

SEQ ID NO: 2265951 - protein, 9 aa, Cryptosporidium parvum
KNEQESTKN

SEQ ID NO: 2265952 - protein, 20 aa, Cryptosporidium parvum
KNEQHKSPYTSNQTLKSESN

SEQ ID NO: 2265953 - protein, 6 aa, Cryptosporidium parvum
KNERIS

SEQ ID NO: 2265954 - protein, 4 aa, Cryptosporidium parvum
KNES

SEQ ID NO: 2265955 - protein, 6 aa, Cryptosporidium parvum
KNESDF

SEQ ID NO: 2265956 - protein, 6 aa, Cryptosporidium parvum
KNESIQ

SEQ ID NO: 2265957 - protein, 6 aa, Cryptosporidium parvum
KNESKN

SEQ ID NO: 2265958 - protein, 7 aa, Cryptosporidium parvum
KNESKYK

SEQ ID NO: 2265959 - protein, 7 aa, Cryptosporidium parvum
KNESNEK

SEQ ID NO: 2265960 - protein, 6 aa, Cryptosporidium parvum
KNESQF

SEQ ID NO: 2265961 - protein, 8 aa, Cryptosporidium parvum
KNESSSKM

SEQ ID NO: 2265962 - protein, 4 aa, Cryptosporidium parvum
KNET

SEQ ID NO: 2265963 - protein, 22 aa, Cryptosporidium parvum
KNETMNVTESDKNNGKKALSSA

SEQ ID NO: 2265964 - protein, 22 aa, Cryptosporidium parvum
KNETQSTVDPSEQKKREDKAEQ

SEQ ID NO: 2265965 - protein, 7 aa, Cryptosporidium parvum
KNFEERV

SEQ ID NO: 2265966 - protein, 6 aa, Cryptosporidium parvum
KNFGDN

SEQ ID NO: 2265967 - protein, 8 aa, Cryptosporidium parvum
KNFPEDDL

SEQ ID NO: 2265968 - protein, 24 aa, Cryptosporidium parvum
KNFPESLGNGENDQFVSKSDSNLY

SEQ ID NO: 2265969 - protein, 7 aa, Cryptosporidium parvum
KNFSGRS

SEQ ID NO: 2265970 - protein, 7 aa, Cryptosporidium parvum
KNFSPED

SEQ ID NO: 2265971 - protein, 10 aa, Cryptosporidium parvum
KNFSSESSFG

SEQ ID NO: 2265972 - protein, 12 aa, Cryptosporidium parvum
KNFSSPKNSNFQ

SEQ ID NO: 2265973 - protein, 7 aa, Cryptosporidium parvum
KNGDDLT

SEQ ID NO: 2265974 - protein, 6 aa, Cryptosporidium parvum
KNGEDW

SEQ ID NO: 2265975 - protein, 12 aa, Cryptosporidium parvum
KNGEEDEENIYN

SEQ ID NO: 2265976 - protein, 7 aa, Cryptosporidium parvum
KNGEEFE

SEQ ID NO: 2265977 - protein, 11 aa, Cryptosporidium parvum
KNGENETLGSG

SEQ ID NO: 2265978 - protein, 9 aa, Cryptosporidium parvum
KNGGNLDEI

SEQ ID NO: 2265979 - protein, 20 aa, Cryptosporidium parvum
KNGGPREDSTSIGSAGAVRR

SEQ ID NO: 2265980 - protein, 5 aa, Cryptosporidium parvum
KNGIR

SEQ ID NO: 2265981 - protein, 5 aa, Cryptosporidium parvum
KNGIS

SEQ ID NO: 2265982 - protein, 9 aa, Cryptosporidium parvum
KNGKGRNPD

SEQ ID NO: 2265983 - protein, 8 aa, Cryptosporidium parvum
KNGKLGHG

SEQ ID NO: 2265984 - protein, 11 aa, Cryptosporidium parvum
KNGKRARRDPR

SEQ ID NO: 2265985 - protein, 7 aa, Cryptosporidium parvum
KNGNEKI

SEQ ID NO: 2265986 - protein, 12 aa, Cryptosporidium parvum
KNGNKPKSTNVK

SEQ ID NO: 2265987 - protein, 29 aa, Cryptosporidium parvum
KNGPDEIPQIEQRSESSSCKYETVETKDL

SEQ ID NO: 2265988 - protein, 6 aa, Cryptosporidium parvum
KNGQGI

SEQ ID NO: 2265989 - protein, 9 aa, Cryptosporidium parvum
KNGQVTDKT

SEQ ID NO: 2265990 - protein, 9 aa, Cryptosporidium parvum
KNGRIQDEV

SEQ ID NO: 2265991 - protein, 18 aa, Cryptosporidium parvum
KNGRNLPSFDNHSDSEEL

SEQ ID NO: 2265992 - protein, 5 aa, Cryptosporidium parvum
KNGRW

SEQ ID NO: 2265993 - protein, 13 aa, Cryptosporidium parvum
KNGSISRKETQIN

SEQ ID NO: 2265994 - protein, 9 aa, Cryptosporidium parvum
KNGSKPDFH

SEQ ID NO: 2265995 - protein, 9 aa, Cryptosporidium parvum
KNGSKPNYD

SEQ ID NO: 2265996 - protein, 9 aa, Cryptosporidium parvum
KNGSLRTPA

SEQ ID NO: 2265997 - protein, 5 aa, Cryptosporidium parvum
KNGSM

SEQ ID NO: 2265998 - protein, 8 aa, Cryptosporidium parvum
KNGSNDGA

SEQ ID NO: 2265999 - protein, 7 aa, Cryptosporidium parvum
KNGTKIG

SEQ ID NO: 2266000 - protein, 14 aa, Cryptosporidium parvum
KNGTSHSTMEGSNN

SEQ ID NO: 2266001 - protein, 7 aa, Cryptosporidium parvum
KNGVDKI

SEQ ID NO: 2266002 - protein, 7 aa, Cryptosporidium parvum
KNGYDYK

SEQ ID NO: 2266003 - protein, 18 aa, Cryptosporidium parvum
KNHAQIKSSSNYKNSKVK

SEQ ID NO: 2266004 - protein, 12 aa, Cryptosporidium parvum
KNHNESEKHKSR

SEQ ID NO: 2266005 - protein, 7 aa, Cryptosporidium parvum
KNHPLEG

SEQ ID NO: 2266006 - protein, 5 aa, Cryptosporidium parvum
KNHPP

SEQ ID NO: 2266007 - protein, 18 aa, Cryptosporidium parvum
KNHQESREKKRKTPASIK

SEQ ID NO: 2266008 - protein, 12 aa, Cryptosporidium parvum
KNHQSSTSSSLI

SEQ ID NO: 2266009 - protein, 8 aa, Cryptosporidium parvum
KNHSEVQA

SEQ ID NO: 2266010 - protein, 39 aa, Cryptosporidium parvum
KNHSNKAGAINSRRQQQDKQTKGFGSNENVGKSLVDLGI

SEQ ID NO: 2266011 - protein, 17 aa, Cryptosporidium parvum
KNHSRITTTQRVGDEDY

SEQ ID NO: 2266012 - protein, 13 aa, Cryptosporidium parvum
KNHSTLKGLSRKS

SEQ ID NO: 2266013 - protein, 6 aa, Cryptosporidium parvum
KNHTGT

SEQ ID NO: 2266014 - protein, 24 aa, Cryptosporidium parvum
KNHYSPKNDNIEETNNTQQKTKEE

SEQ ID NO: 2266015 - protein, 10 aa, Cryptosporidium parvum
KNIDQTNKIN

SEQ ID NO: 2266016 - protein, 58 aa, Cryptosporidium parvum
KNIEEDIKAKNASKNEEIKVQQNSDTNSINNVDSSSAVDERKFKRSRSRESDDNLNGS

SEQ ID NO: 2266017 - protein, 4 aa, Cryptosporidium parvum
KNIG

SEQ ID NO: 2266018 - protein, 4 aa, Cryptosporidium parvum
KNIK

SEQ ID NO: 2266019 - protein, 11 aa, Cryptosporidium parvum
KNIKDSDIKEI

SEQ ID NO: 2266020 - protein, 9 aa, Cryptosporidium parvum
KNIKHSGNL

SEQ ID NO: 2266021 - protein, 16 aa, Cryptosporidium parvum
KNIPISSIPGGTTIPD

SEQ ID NO: 2266022 - protein, 9 aa, Cryptosporidium parvum
KNIPKAGRG

SEQ ID NO: 2266023 - protein, 10 aa, Cryptosporidium parvum
KNIPTAPNSI

SEQ ID NO: 2266024 - protein, 18 aa, Cryptosporidium parvum
KNISASSLSTFGQSSNTI

SEQ ID NO: 2266025 - protein, 6 aa, Cryptosporidium parvum
KNISNE

SEQ ID NO: 2266026 - protein, 9 aa, Cryptosporidium parvum
KNISRPTVS

SEQ ID NO: 2266027 - protein, 17 aa, Cryptosporidium parvum
KNISSKKVDKRTKFGQK

SEQ ID NO: 2266028 - protein, 9 aa, Cryptosporidium parvum
KNITGNSSN

SEQ ID NO: 2266029 - protein, 9 aa, Cryptosporidium parvum
KNKARENEI

SEQ ID NO: 2266030 - protein, 9 aa, Cryptosporidium parvum
KNKDCNTDN

SEQ ID NO: 2266031 - protein, 10 aa, Cryptosporidium parvum
KNKDDDSKYY

SEQ ID NO: 2266032 - protein, 9 aa, Cryptosporidium parvum
KNKDDHESI

SEQ ID NO: 2266033 - protein, 5 aa, Cryptosporidium parvum
KNKDE

SEQ ID NO: 2266034 - protein, 8 aa, Cryptosporidium parvum
KNKDKINF

SEQ ID NO: 2266035 - protein, 15 aa, Cryptosporidium parvum
KNKDNKIQNIAENEA

SEQ ID NO: 2266036 - protein, 9 aa, Cryptosporidium parvum
KNKDTLNSV

SEQ ID NO: 2266037 - protein, 9 aa, Cryptosporidium parvum
KNKDVSGDF

SEQ ID NO: 2266038 - protein, 16 aa, Cryptosporidium parvum
KNKEEYRTQEERELKN

SEQ ID NO: 2266039 - protein, 25 aa, Cryptosporidium parvum
KNKEMASNSYFPNGGSTSNNTGLGA

SEQ ID NO: 2266040 - protein, 6 aa, Cryptosporidium parvum
KNKFES

SEQ ID NO: 2266041 - protein, 18 aa, Cryptosporidium parvum
KNKGEEQESTGESNNNDI

SEQ ID NO: 2266042 - protein, 5 aa, Cryptosporidium parvum
KNKGR

SEQ ID NO: 2266043 - protein, 9 aa, Cryptosporidium parvum
KNKGRNLAS

SEQ ID NO: 2266044 - protein, 9 aa, Cryptosporidium parvum
KNKHASPTN

SEQ ID NO: 2266045 - protein, 7 aa, Cryptosporidium parvum
KNKHNEP

SEQ ID NO: 2266046 - protein, 19 aa, Cryptosporidium parvum
KNKHSFKSEVNNTSNYSDY

SEQ ID NO: 2266047 - protein, 37 aa, Cryptosporidium parvum
KNKINDEQNNQNNMNKNKNNNNNNNSNNNNIELGGNH

SEQ ID NO: 2266048 - protein, 12 aa, Cryptosporidium parvum
KNKIPSDNKKTI

SEQ ID NO: 2266049 - protein, 10 aa, Cryptosporidium parvum
KNKISSSSGI

SEQ ID NO: 2266050 - protein, 8 aa, Cryptosporidium parvum
KNKKNKAI

SEQ ID NO: 2266051 - protein, 8 aa, Cryptosporidium parvum
KNKKNSFQ

SEQ ID NO: 2266052 - protein, 7 aa, Cryptosporidium parvum
KNKKSGI

SEQ ID NO: 2266053 - protein, 8 aa, Cryptosporidium parvum
KNKKTGIE

SEQ ID NO: 2266054 - protein, 10 aa, Cryptosporidium parvum
KNKLTSENKD

SEQ ID NO: 2266055 - protein, 10 aa, Cryptosporidium parvum
KNKNEKSTGI

SEQ ID NO: 2266056 - protein, 7 aa, Cryptosporidium parvum
KNKNEMN

SEQ ID NO: 2266057 - protein, 6 aa, Cryptosporidium parvum
KNKNER

SEQ ID NO: 2266058 - protein, 12 aa, Cryptosporidium parvum
KNKNKKSIAESD

SEQ ID NO: 2266059 - protein, 9 aa, Cryptosporidium parvum
KNKNKVEQL

SEQ ID NO: 2266060 - protein, 13 aa, Cryptosporidium parvum
KNKNNSESVTNEQ

SEQ ID NO: 2266061 - protein, 19 aa, Cryptosporidium parvum
KNKNNSNIGNGNNNEKNNE

SEQ ID NO: 2266062 - protein, 6 aa, Cryptosporidium parvum
KNKNQS

SEQ ID NO: 2266063 - protein, 30 aa, Cryptosporidium parvum
KNKPITDNNVNQESKRGNHTKPSKNTEKVE

SEQ ID NO: 2266064 - protein, 4 aa, Cryptosporidium parvum
KNKR

SEQ ID NO: 2266065 - protein, 8 aa, Cryptosporidium parvum
KNKRLSST

SEQ ID NO: 2266066 - protein, 26 aa, Cryptosporidium parvum
KNKRQAYGVSTKAGHQHSAESWGTGR

SEQ ID NO: 2266067 - protein, 4 aa, Cryptosporidium parvum
KNKS

SEQ ID NO: 2266068 - protein, 17 aa, Cryptosporidium parvum
KNKSASSISNNSSNKRI

SEQ ID NO: 2266069 - protein, 12 aa, Cryptosporidium parvum
KNKSNTNSTFSS

SEQ ID NO: 2266070 - protein, 26 aa, Cryptosporidium parvum
KNKSQKGFEQDESELRSNSNSPSMNS

SEQ ID NO: 2266071 - protein, 5 aa, Cryptosporidium parvum
KNKSR

SEQ ID NO: 2266072 - protein, 6 aa, Cryptosporidium parvum
KNKTGT

SEQ ID NO: 2266073 - protein, 22 aa, Cryptosporidium parvum
KNKTHTEDLNKNKIADSNSNQF

SEQ ID NO: 2266074 - protein, 10 aa, Cryptosporidium parvum
KNKTTQFDKD

SEQ ID NO: 2266075 - protein, 14 aa, Cryptosporidium parvum
KNKTVDSNNQTTTV

SEQ ID NO: 2266076 - protein, 8 aa, Cryptosporidium parvum
KNKVQKNE

SEQ ID NO: 2266077 - protein, 6 aa, Cryptosporidium parvum
KNKYGR

SEQ ID NO: 2266078 - protein, 13 aa, Cryptosporidium parvum
KNKYKSTNDELNE

SEQ ID NO: 2266079 - protein, 20 aa, Cryptosporidium parvum
KNLDEGSELSDSDNETESNS

SEQ ID NO: 2266080 - protein, 5 aa, Cryptosporidium parvum
KNLDG

SEQ ID NO: 2266081 - protein, 6 aa, Cryptosporidium parvum
KNLEPK

SEQ ID NO: 2266082 - protein, 17 aa, Cryptosporidium parvum
KNLESTNKSLDNPVDPE

SEQ ID NO: 2266083 - protein, 4 aa, Cryptosporidium parvum
KNLG

SEQ ID NO: 2266084 - protein, 10 aa, Cryptosporidium parvum
KNLKESRRKR

SEQ ID NO: 2266085 - protein, 11 aa, Cryptosporidium parvum
KNLKNSKKQVS

SEQ ID NO: 2266086 - protein, 5 aa, Cryptosporidium parvum
KNLKS

SEQ ID NO: 2266087 - protein, 7 aa, Cryptosporidium parvum
KNLNENK

SEQ ID NO: 2266088 - protein, 5 aa, Cryptosporidium parvum
KNLPI

SEQ ID NO: 2266089 - protein, 10 aa, Cryptosporidium parvum
KNLQNQTNHI

SEQ ID NO: 2266090 - protein, 8 aa, Cryptosporidium parvum
KNLQTDQT

SEQ ID NO: 2266091 - protein, 10 aa, Cryptosporidium parvum
KNLQTEKSTR

SEQ ID NO: 2266092 - protein, 42 aa, Cryptosporidium parvum
KNLSSDTKANSNSGSNRSGGKDQVLDKSEDCQPDNLESSDLV

SEQ ID NO: 2266093 - protein, 5 aa, Cryptosporidium parvum
KNLTK

SEQ ID NO: 2266094 - protein, 4 aa, Cryptosporidium parvum
KNLY

SEQ ID NO: 2266095 - protein, 5 aa, Cryptosporidium parvum
KNMET

SEQ ID NO: 2266096 - protein, 9 aa, Cryptosporidium parvum
KNNADYPIR

SEQ ID NO: 2266097 - protein, 4 aa, Cryptosporidium parvum
KNNC

SEQ ID NO: 2266098 - protein, 27 aa, Cryptosporidium parvum
KNNDSALENKHQEMENADGGNEQLNTE

SEQ ID NO: 2266099 - protein, 10 aa, Cryptosporidium parvum
KNNEKNGENM

SEQ ID NO: 2266100 - protein, 7 aa, Cryptosporidium parvum
KNNENRI

SEQ ID NO: 2266101 - protein, 12 aa, Cryptosporidium parvum
KNNENSNTSNFF

SEQ ID NO: 2266102 - protein, 9 aa, Cryptosporidium parvum
KNNESNACY

SEQ ID NO: 2266103 - protein, 14 aa, Cryptosporidium parvum
KNNFDSENSAEYAS

SEQ ID NO: 2266104 - protein, 11 aa, Cryptosporidium parvum
KNNGDPKEERP

SEQ ID NO: 2266105 - protein, 9 aa, Cryptosporidium parvum
KNNGKKELL

SEQ ID NO: 2266106 - protein, 6 aa, Cryptosporidium parvum
KNNGKQ

SEQ ID NO: 2266107 - protein, 7 aa, Cryptosporidium parvum
KNNGNDN

SEQ ID NO: 2266108 - protein, 7 aa, Cryptosporidium parvum
KNNHSNN

SEQ ID NO: 2266109 - protein, 6 aa, Cryptosporidium parvum
KNNIKS

SEQ ID NO: 2266110 - protein, 13 aa, Cryptosporidium parvum
KNNISSSADTGLQ

SEQ ID NO: 2266111 - protein, 20 aa, Cryptosporidium parvum
KNNKERKVTESSQKCSERIE

SEQ ID NO: 2266112 - protein, 8 aa, Cryptosporidium parvum
KNNKGKDQ

SEQ ID NO: 2266113 - protein, 21 aa, Cryptosporidium parvum
KNNKNMAGTEYNNSFEENSNI

SEQ ID NO: 2266114 - protein, 6 aa, Cryptosporidium parvum
KNNKTF

SEQ ID NO: 2266115 - protein, 12 aa, Cryptosporidium parvum
KNNLDSSSQDIA

SEQ ID NO: 2266116 - protein, 9 aa, Cryptosporidium parvum
KNNLNGSNF

SEQ ID NO: 2266117 - protein, 12 aa, Cryptosporidium parvum
KNNMNSGYADPR

SEQ ID NO: 2266118 - protein, 22 aa, Cryptosporidium parvum
KNNNGTKNEDYDENDNEDDDED

SEQ ID NO: 2266119 - protein, 10 aa, Cryptosporidium parvum
KNNNGTNSAD

SEQ ID NO: 2266120 - protein, 6 aa, Cryptosporidium parvum
KNNNID

SEQ ID NO: 2266121 - protein, 5 aa, Cryptosporidium parvum
KNNNN

SEQ ID NO: 2266122 - protein, 7 aa, Cryptosporidium parvum
KNNNNDN

SEQ ID NO: 2266123 - protein, 9 aa, Cryptosporidium parvum
KNNNNGKSP

SEQ ID NO: 2266124 - protein, 9 aa, Cryptosporidium parvum
KNNNSNLNL

SEQ ID NO: 2266125 - protein, 18 aa, Cryptosporidium parvum
KNNNTGDYKEMTKNTDVI

SEQ ID NO: 2266126 - protein, 7 aa, Cryptosporidium parvum
KNNNVGV

SEQ ID NO: 2266127 - protein, 8 aa, Cryptosporidium parvum
KNNPKDRR

SEQ ID NO: 2266128 - protein, 9 aa, Cryptosporidium parvum
KNNPNNESQ

SEQ ID NO: 2266129 - protein, 6 aa, Cryptosporidium parvum
KNNQAC

SEQ ID NO: 2266130 - protein, 12 aa, Cryptosporidium parvum
KNNQSKKQNVTI

SEQ ID NO: 2266131 - protein, 9 aa, Cryptosporidium parvum
KNNQSPDSD

SEQ ID NO: 2266132 - protein, 7 aa, Cryptosporidium parvum
KNNQYVN

SEQ ID NO: 2266133 - protein, 8 aa, Cryptosporidium parvum
KNNRENCN

SEQ ID NO: 2266134 - protein, 8 aa, Cryptosporidium parvum
KNNSDGKT

SEQ ID NO: 2266135 - protein, 11 aa, Cryptosporidium parvum
KNNSESKQVYS

SEQ ID NO: 2266136 - protein, 31 aa, Cryptosporidium parvum
KNNSESNMDDDNDMTGDECGENHAETEQISE

SEQ ID NO: 2266137 - protein, 14 aa, Cryptosporidium parvum
KNNSIRNNSDLQNQ

SEQ ID NO: 2266138 - protein, 12 aa, Cryptosporidium parvum
KNNSISNKEYQN

SEQ ID NO: 2266139 - protein, 30 aa, Cryptosporidium parvum; identical to SEQ ID NO: 2148594

SEQ ID NO: 2266140 - protein, 17 aa, Cryptosporidium parvum
KNNSNASHSCNSNMTGG

SEQ ID NO: 2266141 - protein, 24 aa, Cryptosporidium parvum
KNNSNQLKSYSYSNPTTTTTTTRA

SEQ ID NO: 2266142 - protein, 11 aa, Cryptosporidium parvum
KNNSNSMNTQL

SEQ ID NO: 2266143 - protein, 14 aa, Cryptosporidium parvum
KNNSQDESKIGRDS

SEQ ID NO: 2266144 - protein, 8 aa, Cryptosporidium parvum
KNNSQDLK

SEQ ID NO: 2266145 - protein, 6 aa, Cryptosporidium parvum
KNNSQF

SEQ ID NO: 2266146 - protein, 14 aa, Cryptosporidium parvum
KNNSSIERINYYRL

SEQ ID NO: 2266147 - protein, 8 aa, Cryptosporidium parvum
KNNSTTFE

SEQ ID NO: 2266148 - protein, 4 aa, Cryptosporidium parvum
KNNT

SEQ ID NO: 2266149 - protein, 8 aa, Cryptosporidium parvum
KNNTFPKE

SEQ ID NO: 2266150 - protein, 5 aa, Cryptosporidium parvum
KNNTN

SEQ ID NO: 2266151 - protein, 8 aa, Cryptosporidium parvum
KNNTSKDK

SEQ ID NO: 2266152 - protein, 9 aa, Cryptosporidium parvum
KNNTSRIQS

SEQ ID NO: 2266153 - protein, 11 aa, Cryptosporidium parvum
KNNVSERANNI

SEQ ID NO: 2266154 - protein, 14 aa, Cryptosporidium parvum
KNNVSNDDVDLDEE

SEQ ID NO: 2266155 - protein, 11 aa, Cryptosporidium parvum
KNNYGLTQSET

SEQ ID NO: 2266156 - protein, 9 aa, Cryptosporidium parvum
KNNYSSKTC

SEQ ID NO: 2266157 - protein, 8 aa, Cryptosporidium parvum
KNNYSTPI

SEQ ID NO: 2266158 - protein, 9 aa, Cryptosporidium parvum
KNPDPTKPL

SEQ ID NO: 2266159 - protein, 9 aa, Cryptosporidium parvum
KNPEGINRD

SEQ ID NO: 2266160 - protein, 6 aa, Cryptosporidium parvum
KNPEIS

SEQ ID NO: 2266161 - protein, 6 aa, Cryptosporidium parvum
KNPELN

SEQ ID NO: 2266162 - protein, 5 aa, Cryptosporidium parvum
KNPEN

SEQ ID NO: 2266163 - protein, 8 aa, Cryptosporidium parvum
KNPEPTTK

SEQ ID NO: 2266164 - protein, 6 aa, Cryptosporidium parvum
KNPFSE

SEQ ID NO: 2266165 - protein, 6 aa, Cryptosporidium parvum
KNPGIK

SEQ ID NO: 2266166 - protein, 7 aa, Cryptosporidium parvum
KNPGLVE

SEQ ID NO: 2266167 - protein, 10 aa, Cryptosporidium parvum
KNPGSNNTIN

SEQ ID NO: 2266168 - protein, 5 aa, Cryptosporidium parvum
KNPGT

SEQ ID NO: 2266169 - protein, 7 aa, Cryptosporidium parvum
KNPHPKT

SEQ ID NO: 2266170 - protein, 7 aa, Cryptosporidium parvum
KNPIAEH

SEQ ID NO: 2266171 - protein, 5 aa, Cryptosporidium parvum
KNPID

SEQ ID NO: 2266172 - protein, 7 aa, Cryptosporidium parvum
KNPKDLE

SEQ ID NO: 2266173 - protein, 36 aa, Cryptosporidium parvum
KNPKSGDDAESSSRSESDSNYDLESESDINLDSDKS

SEQ ID NO: 2266174 - protein, 25 aa, Cryptosporidium parvum
KNPLNGSPTVSNNSNAFQSRNTISN

SEQ ID NO: 2266175 - protein, 7 aa, Cryptosporidium parvum
KNPNNQI

SEQ ID NO: 2266176 - protein, 8 aa, Cryptosporidium parvum
KNPNPGFM

SEQ ID NO: 2266177 - protein, 8 aa, Cryptosporidium parvum
KNPNSNDF

SEQ ID NO: 2266178 - protein, 64 aa, Cryptosporidium parvum; identical to SEQ ID NO: 2148621

SEQ ID NO: 2266179 - protein, 8 aa, Cryptosporidium parvum
KNPPLTRE

SEQ ID NO: 2266180 - protein, 11 aa, Cryptosporidium parvum
KNPPSAENRWD

SEQ ID NO: 2266181 - protein, 9 aa, Cryptosporidium parvum
KNPQWEETI

SEQ ID NO: 2266182 - protein, 7 aa, Cryptosporidium parvum
KNPRERI

SEQ ID NO: 2266183 - protein, 7 aa, Cryptosporidium parvum
KNPSERI

SEQ ID NO: 2266184 - protein, 8 aa, Cryptosporidium parvum
KNPSSKWN

SEQ ID NO: 2266185 - protein, 7 aa, Cryptosporidium parvum
KNPSTLA

SEQ ID NO: 2266186 - protein, 9 aa, Cryptosporidium parvum
KNPTTSGGK

SEQ ID NO: 2266187 - protein, 16 aa, Cryptosporidium parvum
KNPVKSSTGNHTPNIE

SEQ ID NO: 2266188 - protein, 5 aa, Cryptosporidium parvum
KNPYD

SEQ ID NO: 2266189 - protein, 13 aa, Cryptosporidium parvum
KNQAKNFRSESEE

SEQ ID NO: 2266190 - protein, 4 aa, Cryptosporidium parvum
KNQD

SEQ ID NO: 2266191 - protein, 4 aa, Cryptosporidium parvum
KNQE

SEQ ID NO: 2266192 - protein, 6 aa, Cryptosporidium parvum
KNQEIQ

SEQ ID NO: 2266193 - protein, 8 aa, Cryptosporidium parvum
KNQGDENV

SEQ ID NO: 2266194 - protein, 6 aa, Cryptosporidium parvum
KNQGGI

SEQ ID NO: 2266195 - protein, 7 aa, Cryptosporidium parvum
KNQIDNK

SEQ ID NO: 2266196 - protein, 17 aa, Cryptosporidium parvum
KNQKDKPSKVDGHDEIN

SEQ ID NO: 2266197 - protein, 5 aa, Cryptosporidium parvum
KNQKE

SEQ ID NO: 2266198 - protein, 10 aa, Cryptosporidium parvum
KNQKKTRSGI

SEQ ID NO: 2266199 - protein, 15 aa, Cryptosporidium parvum
KNQKNDKTSDVSNNV

SEQ ID NO: 2266200 - protein, 19 aa, Cryptosporidium parvum
KNQKRSAETSSSRDRQRIS

SEQ ID NO: 2266201 - protein, 20 aa, Cryptosporidium parvum
KNQNEKKNLSTNKSNGQPIR

SEQ ID NO: 2266202 - protein, 16 aa, Cryptosporidium parvum
KNQNNENDISTNISED

SEQ ID NO: 2266203 - protein, 14 aa, Cryptosporidium parvum
KNQNNINDSETHQA

SEQ ID NO: 2266204 - protein, 10 aa, Cryptosporidium parvum
KNQNNLDSSI

SEQ ID NO: 2266205 - protein, 33 aa, Cryptosporidium parvum; identical to SEQ ID NO: 2148644

SEQ ID NO: 2266206 - protein, 7 aa, Cryptosporidium parvum
KNQRISE

SEQ ID NO: 2266207 - protein, 15 aa, Cryptosporidium parvum
KNQRLKKRKEEEDKR

SEQ ID NO: 2266208 - protein, 7 aa, Cryptosporidium parvum
KNQRNEE

SEQ ID NO: 2266209 - protein, 13 aa, Cryptosporidium parvum
KNQSDGDNQYEGA

SEQ ID NO: 2266210 - protein, 26 aa, Cryptosporidium parvum
KNQSGSEIDQEETPDISEFSKNDGRL

SEQ ID NO: 2266211 - protein, 13 aa, Cryptosporidium parvum
KNQSSSFSPPNQQ

SEQ ID NO: 2266212 - protein, 6 aa, Cryptosporidium parvum
KNQTIE

SEQ ID NO: 2266213 - protein, 10 aa, Cryptosporidium parvum
KNRAEENSRF

SEQ ID NO: 2266214 - protein, 9 aa, Cryptosporidium parvum
KNRCNSQGK

SEQ ID NO: 2266215 - protein, 5 aa, Cryptosporidium parvum
KNRDK

SEQ ID NO: 2266216 - protein, 6 aa, Cryptosporidium parvum
KNRDSA

SEQ ID NO: 2266217 - protein, 8 aa, Cryptosporidium parvum
KNREREKG

SEQ ID NO: 2266218 - protein, 5 aa, Cryptosporidium parvum
KNRGV

SEQ ID NO: 2266219 - protein, 5 aa, Cryptosporidium parvum
KNRLS

SEQ ID NO: 2266220 - protein, 10 aa, Cryptosporidium parvum
KNRNEAYYTQ

SEQ ID NO: 2266221 - protein, 7 aa, Cryptosporidium parvum
KNRNNGV

SEQ ID NO: 2266222 - protein, 7 aa, Cryptosporidium parvum
KNRPESG

SEQ ID NO: 2266223 - protein, 5 aa, Cryptosporidium parvum
KNRPF

SEQ ID NO: 2266224 - protein, 11 aa, Cryptosporidium parvum
KNRRDNFNPRS

SEQ ID NO: 2266225 - protein, 5 aa, Cryptosporidium parvum
KNRRW

SEQ ID NO: 2266226 - protein, 7 aa, Cryptosporidium parvum
KNRTLGL

SEQ ID NO: 2266227 - protein, 6 aa, Cryptosporidium parvum
KNRTRI

SEQ ID NO: 2266228 - protein, 22 aa, Cryptosporidium parvum
KNSAIAGNNKSNSKEPNSTINE

SEQ ID NO: 2266229 - protein, 15 aa, Cryptosporidium parvum
KNSAYSTKTKTEELP

SEQ ID NO: 2266230 - protein, 8 aa, Cryptosporidium parvum
KNSDSECN

SEQ ID NO: 2266231 - protein, 12 aa, Cryptosporidium parvum
KNSDSIDNNNNN

SEQ ID NO: 2266232 - protein, 6 aa, Cryptosporidium parvum
KNSEDE

SEQ ID NO: 2266233 - protein, 7 aa, Cryptosporidium parvum
KNSEKSQ

SEQ ID NO: 2266234 - protein, 5 aa, Cryptosporidium parvum
KNSEM

SEQ ID NO: 2266235 - protein, 5 aa, Cryptosporidium parvum
KNSEN

SEQ ID NO: 2266236 - protein, 19 aa, Cryptosporidium parvum
KNSGKKSKSCLKSSNYCKN

SEQ ID NO: 2266237 - protein, 17 aa, Cryptosporidium parvum
KNSGLENEKTSFSEAKQ

SEQ ID NO: 2266238 - protein, 6 aa, Cryptosporidium parvum
KNSGNS

SEQ ID NO: 2266239 - protein, 15 aa, Cryptosporidium parvum
KNSGSNISGSISDGN

SEQ ID NO: 2266240 - protein, 23 aa, Cryptosporidium parvum
KNSGTTKARSNYSNVNGNSSPYQ

SEQ ID NO: 2266241 - protein, 16 aa, Cryptosporidium parvum
KNSHLSSSSPTSPNAI

SEQ ID NO: 2266242 - protein, 4 aa, Cryptosporidium parvum
KNSI

SEQ ID NO: 2266243 - protein, 6 aa, Cryptosporidium parvum
KNSIDT

SEQ ID NO: 2266244 - protein, 5 aa, Cryptosporidium parvum
KNSIE

SEQ ID NO: 2266245 - protein, 14 aa, Cryptosporidium parvum
KNSIEKSPGSSNFT

SEQ ID NO: 2266246 - protein, 6 aa, Cryptosporidium parvum
KNSIEN

SEQ ID NO: 2266247 - protein, 16 aa, Cryptosporidium parvum
KNSIKNAKNITNSGNE

SEQ ID NO: 2266248 - protein, 6 aa, Cryptosporidium parvum
KNSING

SEQ ID NO: 2266249 - protein, 6 aa, Cryptosporidium parvum
KNSIPS

SEQ ID NO: 2266250 - protein, 8 aa, Cryptosporidium parvum
KNSIPSSN

SEQ ID NO: 2266251 - protein, 15 aa, Cryptosporidium parvum
KNSKMSDSVNARESN

SEQ ID NO: 2266252 - protein, 9 aa, Cryptosporidium parvum
KNSKNNNLD

SEQ ID NO: 2266253 - protein, 11 aa, Cryptosporidium parvum
KNSKSNVNSPI

SEQ ID NO: 2266254 - protein, 6 aa, Cryptosporidium parvum
KNSLEE

SEQ ID NO: 2266255 - protein, 7 aa, Cryptosporidium parvum
KNSLESL

SEQ ID NO: 2266256 - protein, 5 aa, Cryptosporidium parvum
KNSLG

SEQ ID NO: 2266257 - protein, 4 aa, Cryptosporidium parvum
KNSN

SEQ ID NO: 2266258 - protein, 6 aa, Cryptosporidium parvum
KNSNEG

SEQ ID NO: 2266259 - protein, 13 aa, Cryptosporidium parvum
KNSNGTLNDEAIS

SEQ ID NO: 2266260 - protein, 19 aa, Cryptosporidium parvum
KNSNHLNSNIKSANNHDHY

SEQ ID NO: 2266261 - protein, 5 aa, Cryptosporidium parvum
KNSNI

SEQ ID NO: 2266262 - protein, 15 aa, Cryptosporidium parvum
KNSNKQNKRTTQIGQ

SEQ ID NO: 2266263 - protein, 19 aa, Cryptosporidium parvum
KNSNNGKKGSIDQSNTSKR

SEQ ID NO: 2266264 - protein, 8 aa, Cryptosporidium parvum
KNSNNNNS

SEQ ID NO: 2266265 - protein, 14 aa, Cryptosporidium parvum
KNSNNQNNSNNQNI

SEQ ID NO: 2266266 - protein, 18 aa, Cryptosporidium parvum
KNSNSGQKKIRKFISRNL

SEQ ID NO: 2266267 - protein, 8 aa, Cryptosporidium parvum
KNSNSKKM

SEQ ID NO: 2266268 - protein, 18 aa, Cryptosporidium parvum
KNSNSKLGIKSNEKNLVQ

SEQ ID NO: 2266269 - protein, 7 aa, Cryptosporidium parvum
KNSNSPV

SEQ ID NO: 2266270 - protein, 7 aa, Cryptosporidium parvum
KNSNYQQ

SEQ ID NO: 2266271 - protein, 8 aa, Cryptosporidium parvum
KNSPGKLK

SEQ ID NO: 2266272 - protein, 17 aa, Cryptosporidium parvum
KNSPSPRQRNSLTTIPG

SEQ ID NO: 2266273 - protein, 7 aa, Cryptosporidium parvum
KNSQENN

SEQ ID NO: 2266274 - protein, 10 aa, Cryptosporidium parvum
KNSQKHDIEE

SEQ ID NO: 2266275 - protein, 10 aa, Cryptosporidium parvum
KNSQKTVKNK

SEQ ID NO: 2266276 - protein, 24 aa, Cryptosporidium parvum
KNSQNSKGMDNSSTPQIIRSRYSD

SEQ ID NO: 2266277 - protein, 8 aa, Cryptosporidium parvum
KNSQSIEN

SEQ ID NO: 2266278 - protein, 16 aa, Cryptosporidium parvum
KNSQTEPLIYTLVHSI

SEQ ID NO: 2266279 - protein, 8 aa, Cryptosporidium parvum
KNSSDFSK

SEQ ID NO: 2266280 - protein, 8 aa, Cryptosporidium parvum
KNSSEMNQ

SEQ ID NO: 2266281 - protein, 6 aa, Cryptosporidium parvum
KNSSGV

SEQ ID NO: 2266282 - protein, 10 aa, Cryptosporidium parvum
KNSSKKLEIT

SEQ ID NO: 2266283 - protein, 5 aa, Cryptosporidium parvum
KNSSL

SEQ ID NO: 2266284 - protein, 21 aa, Cryptosporidium parvum
KNSSNDTNEDDLDSSTNKDNF

SEQ ID NO: 2266285 - protein, 9 aa, Cryptosporidium parvum
KNSSSSMIK

SEQ ID NO: 2266286 - protein, 15 aa, Cryptosporidium parvum
KNSSTCTSLSSHSSL

SEQ ID NO: 2266287 - protein, 8 aa, Cryptosporidium parvum
KNSSTISH

SEQ ID NO: 2266288 - protein, 6 aa, Cryptosporidium parvum
KNSTDV

SEQ ID NO: 2266289 - protein, 9 aa, Cryptosporidium parvum
KNSTGTKSS

SEQ ID NO: 2266290 - protein, 7 aa, Cryptosporidium parvum
KNSTIES

SEQ ID NO: 2266291 - protein, 7 aa, Cryptosporidium parvum
KNSTNKV

SEQ ID NO: 2266292 - protein, 7 aa, Cryptosporidium parvum
KNSTPTL

SEQ ID NO: 2266293 - protein, 17 aa, Cryptosporidium parvum
KNSTSIPHNKKTGEYCT

SEQ ID NO: 2266294 - protein, 9 aa, Cryptosporidium parvum
KNSTSRTRV

SEQ ID NO: 2266295 - protein, 10 aa, Cryptosporidium parvum
KNSTTNKNKR

SEQ ID NO: 2266296 - protein, 7 aa, Cryptosporidium parvum
KNSTTSI

SEQ ID NO: 2266297 - protein, 15 aa, Cryptosporidium parvum
KNSTVNDSDNMEIEE

SEQ ID NO: 2266298 - protein, 9 aa, Cryptosporidium parvum
KNSVDENHN

SEQ ID NO: 2266299 - protein, 7 aa, Cryptosporidium parvum
KNSVSNL

SEQ ID NO: 2266300 - protein, 14 aa, Cryptosporidium parvum
KNTALETDEEVKME

SEQ ID NO: 2266301 - protein, 29 aa, Cryptosporidium parvum
KNTANKKNASKSSKNVKDKVDKETELANK

SEQ ID NO: 2266302 - protein, 19 aa, Cryptosporidium parvum
KNTEGGSTANCSTAELSPV

SEQ ID NO: 2266303 - protein, 7 aa, Cryptosporidium parvum
KNTENEN

SEQ ID NO: 2266304 - protein, 8 aa, Cryptosporidium parvum
KNTEPPVL

SEQ ID NO: 2266305 - protein, 6 aa, Cryptosporidium parvum
KNTEQR

SEQ ID NO: 2266306 - protein, 7 aa, Cryptosporidium parvum
KNTERTY

SEQ ID NO: 2266307 - protein, 27 aa, Cryptosporidium parvum
KNTGIKQSNNSPNKKSIQSNSNNSHKS

SEQ ID NO: 2266308 - protein, 6 aa, Cryptosporidium parvum
KNTKFE

SEQ ID NO: 2266309 - protein, 7 aa, Cryptosporidium parvum
KNTKNVR

SEQ ID NO: 2266310 - protein, 8 aa, Cryptosporidium parvum
KNTKSIEE

SEQ ID NO: 2266311 - protein, 4 aa, Cryptosporidium parvum
KNTN

SEQ ID NO: 2266312 - protein, 33 aa, Cryptosporidium parvum; identical to SEQ ID NO: 2148731

SEQ ID NO: 2266313 - protein, 12 aa, Cryptosporidium parvum
KNTNGSHDNYPD

SEQ ID NO: 2266314 - protein, 5 aa, Cryptosporidium parvum
KNTNL

SEQ ID NO: 2266315 - protein, 20 aa, Cryptosporidium parvum
KNTNRHEPLNDAQNNKNKVE

SEQ ID NO: 2266316 - protein, 4 aa, Cryptosporidium parvum
KNTQ

SEQ ID NO: 2266317 - protein, 10 aa, Cryptosporidium parvum
KNTQSFGSST

SEQ ID NO: 2266318 - protein, 7 aa, Cryptosporidium parvum
KNTRDYL

SEQ ID NO: 2266319 - protein, 6 aa, Cryptosporidium parvum
KNTRIF

SEQ ID NO: 2266320 - protein, 17 aa, Cryptosporidium parvum
KNTRKKVQELNTTKDKN

SEQ ID NO: 2266321 - protein, 7 aa, Cryptosporidium parvum
KNTRTKP

SEQ ID NO: 2266322 - protein, 12 aa, Cryptosporidium parvum
KNTSDVRETPSG

SEQ ID NO: 2266323 - protein, 8 aa, Cryptosporidium parvum
KNTSEETV

SEQ ID NO: 2266324 - protein, 10 aa, Cryptosporidium parvum
KNTSSGGTLE

SEQ ID NO: 2266325 - protein, 15 aa, Cryptosporidium parvum
KNTSSKEKTEIDETE

SEQ ID NO: 2266326 - protein, 7 aa, Cryptosporidium parvum
KNTSTST

SEQ ID NO: 2266327 - protein, 8 aa, Cryptosporidium parvum
KNTTEVSD

SEQ ID NO: 2266328 - protein, 8 aa, Cryptosporidium parvum
KNTTGKQF

SEQ ID NO: 2266329 - protein, 5 aa, Cryptosporidium parvum
KNTTR

SEQ ID NO: 2266330 - protein, 8 aa, Cryptosporidium parvum
KNTWPDNS

SEQ ID NO: 2266331 - protein, 6 aa, Cryptosporidium parvum
KNVAAK

SEQ ID NO: 2266332 - protein, 10 aa, Cryptosporidium parvum
KNVDTQTEDV

SEQ ID NO: 2266333 - protein, 4 aa, Cryptosporidium parvum
KNVE

SEQ ID NO: 2266334 - protein, 4 aa, Cryptosporidium parvum
KNVK

SEQ ID NO: 2266335 - protein, 7 aa, Cryptosporidium parvum
KNVNSKN

SEQ ID NO: 2266336 - protein, 5 aa, Cryptosporidium parvum
KNVPV

SEQ ID NO: 2266337 - protein, 7 aa, Cryptosporidium parvum
KNVSDLD

SEQ ID NO: 2266338 - protein, 13 aa, Cryptosporidium parvum
KNVSESPKDQQIE

SEQ ID NO: 2266339 - protein, 8 aa, Cryptosporidium parvum
KNVSQEEL

SEQ ID NO: 2266340 - protein, 18 aa, Cryptosporidium parvum
KNVTDKNSTMDKKNIGST

SEQ ID NO: 2266341 - protein, 18 aa, Cryptosporidium parvum
KNVTNHEDSEIKREYSTS

SEQ ID NO: 2266342 - protein, 8 aa, Cryptosporidium parvum
KNWNKKAR

SEQ ID NO: 2266343 - protein, 13 aa, Cryptosporidium parvum
KNYCDQSKGFEED

SEQ ID NO: 2266344 - protein, 5 aa, Cryptosporidium parvum
KNYGE

SEQ ID NO: 2266345 - protein, 14 aa, Cryptosporidium parvum
KNYIKTKNVPTESL

SEQ ID NO: 2266346 - protein, 12 aa, Cryptosporidium parvum
KNYINEKAKENW

SEQ ID NO: 2266347 - protein, 22 aa, Cryptosporidium parvum
KNYNKNMRSQFKSDTSNKPSKI

SEQ ID NO: 2266348 - protein, 8 aa, Cryptosporidium parvum
KNYNNRSK

SEQ ID NO: 2266349 - protein, 17 aa, Cryptosporidium parvum
KNYNRDENASKYGNNKN

SEQ ID NO: 2266350 - protein, 4 aa, Cryptosporidium parvum
KNYP

SEQ ID NO: 2266351 - protein, 24 aa, Cryptosporidium parvum
KNYPAAKKEYDEAIKRNPSDSRLY

SEQ ID NO: 2266352 - protein, 6 aa, Cryptosporidium parvum
KNYPDP

SEQ ID NO: 2266353 - protein, 6 aa, Cryptosporidium parvum
KNYQEK

SEQ ID NO: 2266354 - protein, 17 aa, Cryptosporidium parvum
KNYQHDEPVSAGGIEGG

SEQ ID NO: 2266355 - protein, 10 aa, Cryptosporidium parvum
KNYSKNINSD

SEQ ID NO: 2266356 - protein, 7 aa, Cryptosporidium parvum
KNYSKQR

SEQ ID NO: 2266357 - protein, 8 aa, Cryptosporidium parvum
KNYSNEHP

SEQ ID NO: 2266358 - protein, 6 aa, Cryptosporidium parvum
KNYSSS

SEQ ID NO: 2266359 - protein, 13 aa, Cryptosporidium parvum
KNYSSSNLTNSQQ

SEQ ID NO: 2266360 - protein, 21 aa, Cryptosporidium parvum
KNYTTQSSSYTSNSSTQDINN

SEQ ID NO: 2266361 - protein, 12 aa, Cryptosporidium parvum
KNYYSNETLPPK

SEQ ID NO: 2266362 - protein, 15 aa, Cryptosporidium parvum
KPAGGPKPRSQNDDM

SEQ ID NO: 2266363 - protein, 6 aa, Cryptosporidium parvum
KPAGLI

SEQ ID NO: 2266364 - protein, 17 aa, Cryptosporidium parvum
KPAITKEQPTNNAPKAV

SEQ ID NO: 2266365 - protein, 8 aa, Cryptosporidium parvum
KPANPSSH

SEQ ID NO: 2266366 - protein, 5 aa, Cryptosporidium parvum
KPASI

SEQ ID NO: 2266367 - protein, 6 aa, Cryptosporidium parvum
KPCGET

SEQ ID NO: 2266368 - protein, 25 aa, Cryptosporidium parvum
KPCNAPKLSNEDLEKLSKKSTRPGN

SEQ ID NO: 2266369 - protein, 6 aa, Cryptosporidium parvum
KPCSEK

SEQ ID NO: 2266370 - protein, 9 aa, Cryptosporidium parvum
KPCSISPTT

SEQ ID NO: 2266371 - protein, 9 aa, Cryptosporidium parvum
KPDDEDSVS

SEQ ID NO: 2266372 - protein, 9 aa, Cryptosporidium parvum
KPDDHEDLT

SEQ ID NO: 2266373 - protein, 6 aa, Cryptosporidium parvum
KPDQPL

SEQ ID NO: 2266374 - protein, 11 aa, Cryptosporidium parvum
KPDSNGDISKQ

SEQ ID NO: 2266375 - protein, 6 aa, Cryptosporidium parvum
KPDSSV

SEQ ID NO: 2266376 - protein, 8 aa, Cryptosporidium parvum
KPEEKIDT

SEQ ID NO: 2266377 - protein, 11 aa, Cryptosporidium parvum
KPEGHLSNNVS

SEQ ID NO: 2266378 - protein, 15 aa, Cryptosporidium parvum
KPEKATYTNISRDRN

SEQ ID NO: 2266379 - protein, 5 aa, Cryptosporidium parvum
KPEKK

SEQ ID NO: 2266380 - protein, 7 aa, Cryptosporidium parvum
KPEKNSG

SEQ ID NO: 2266381 - protein, 4 aa, Cryptosporidium parvum
KPEN

SEQ ID NO: 2266382 - protein, 8 aa, Cryptosporidium parvum
KPENDGYS

SEQ ID NO: 2266383 - protein, 8 aa, Cryptosporidium parvum
KPENPNSP

SEQ ID NO: 2266384 - protein, 12 aa, Cryptosporidium parvum
KPESKSQPIDTS

SEQ ID NO: 2266385 - protein, 10 aa, Cryptosporidium parvum
KPESSRNSSL

SEQ ID NO: 2266386 - protein, 6 aa, Cryptosporidium parvum
KPETLE

SEQ ID NO: 2266387 - protein, 20 aa, Cryptosporidium parvum
KPFKKKKSSSNTLKKLGKIF

SEQ ID NO: 2266388 - protein, 6 aa, Cryptosporidium parvum
KPFPEN

SEQ ID NO: 2266389 - protein, 5 aa, Cryptosporidium parvum
KPFQS

SEQ ID NO: 2266390 - protein, 4 aa, Cryptosporidium parvum
KPGC

SEQ ID NO: 2266391 - protein, 5 aa, Cryptosporidium parvum
KPGCS

SEQ ID NO: 2266392 - protein, 8 aa, Cryptosporidium parvum
KPGGEQSY

SEQ ID NO: 2266393 - protein, 5 aa, Cryptosporidium parvum
KPGKN

SEQ ID NO: 2266394 - protein, 5 aa, Cryptosporidium parvum
KPGLQ

SEQ ID NO: 2266395 - protein, 17 aa, Cryptosporidium parvum
KPGNNTEIPIENTDEYK

SEQ ID NO: 2266396 - protein, 7 aa, Cryptosporidium parvum
KPGNTIQ

SEQ ID NO: 2266397 - protein, 5 aa, Cryptosporidium parvum
KPGRK

SEQ ID NO: 2266398 - protein, 9 aa, Cryptosporidium parvum
KPGSFRDDE

SEQ ID NO: 2266399 - protein, 8 aa, Cryptosporidium parvum
KPGSPIQI

SEQ ID NO: 2266400 - protein, 41 aa, Cryptosporidium parvum
KPGSTMGGKGKALENLNSRESSGEPNKITAKGSSDDPNSLN

SEQ ID NO: 2266401 - protein, 7 aa, Cryptosporidium parvum
KPGTGKT

SEQ ID NO: 2266402 - protein, 5 aa, Cryptosporidium parvum
KPHSE

SEQ ID NO: 2266403 - protein, 9 aa, Cryptosporidium parvum
KPHSGSPAN

SEQ ID NO: 2266404 - protein, 12 aa, Cryptosporidium parvum
KPIARDNGNKGK

SEQ ID NO: 2266405 - protein, 7 aa, Cryptosporidium parvum
KPIDSTA

SEQ ID NO: 2266406 - protein, 11 aa, Cryptosporidium parvum
KPIEGAQKSGF

SEQ ID NO: 2266407 - protein, 5 aa, Cryptosporidium parvum
KPIGE

SEQ ID NO: 2266408 - protein, 10 aa, Cryptosporidium parvum
KPIGNPGLPD

SEQ ID NO: 2266409 - protein, 8 aa, Cryptosporidium parvum
KPIKTPEG

SEQ ID NO: 2266410 - protein, 72 aa, Cryptosporidium parvum
KPINSSENQVSQVDSPPTFRENNDQEGENKKDESNQLEDRKTVDTSKNINQDLGSAPNLASNSVPISAPSSI

SEQ ID NO: 2266411 - protein, 5 aa, Cryptosporidium parvum
KPIQN

SEQ ID NO: 2266412 - protein, 6 aa, Cryptosporidium parvum
KPIQTQ

SEQ ID NO: 2266413 - protein, 8 aa, Cryptosporidium parvum
KPISDSGN

SEQ ID NO: 2266414 - protein, 5 aa, Cryptosporidium parvum
KPISE

SEQ ID NO: 2266415 - protein, 5 aa, Cryptosporidium parvum
KPIST

SEQ ID NO: 2266416 - protein, 13 aa, Cryptosporidium parvum
KPITRSMTSSAGN

SEQ ID NO: 2266417 - protein, 6 aa, Cryptosporidium parvum
KPITTY

SEQ ID NO: 2266418 - protein, 7 aa, Cryptosporidium parvum
KPIYDDN

SEQ ID NO: 2266419 - protein, 6 aa, Cryptosporidium parvum
KPKADA

SEQ ID NO: 2266420 - protein, 6 aa, Cryptosporidium parvum
KPKELN

SEQ ID NO: 2266421 - protein, 7 aa, Cryptosporidium parvum
KPKGEIK

SEQ ID NO: 2266422 - protein, 7 aa, Cryptosporidium parvum
KPKGFRT

SEQ ID NO: 2266423 - protein, 5 aa, Cryptosporidium parvum
KPKGG

SEQ ID NO: 2266424 - protein, 8 aa, Cryptosporidium parvum
KPKGNQAI

SEQ ID NO: 2266425 - protein, 9 aa, Cryptosporidium parvum
KPKGQIPDY

SEQ ID NO: 2266426 - protein, 4 aa, Cryptosporidium parvum
KPKK

SEQ ID NO: 2266427 - protein, 9 aa, Cryptosporidium parvum
KPKKIKNVT

SEQ ID NO: 2266428 - protein, 12 aa, Cryptosporidium parvum
KPKKLNKKEELG

SEQ ID NO: 2266429 - protein, 10 aa, Cryptosporidium parvum
KPKKRDTNIK

SEQ ID NO: 2266430 - protein, 8 aa, Cryptosporidium parvum
KPKKRGFS

SEQ ID NO: 2266431 - protein, 9 aa, Cryptosporidium parvum
KPKNSQNTK

SEQ ID NO: 2266432 - protein, 8 aa, Cryptosporidium parvum
KPKQNFEN

SEQ ID NO: 2266433 - protein, 16 aa, Cryptosporidium parvum
KPKRAIPSKDPQEIDE

SEQ ID NO: 2266434 - protein, 8 aa, Cryptosporidium parvum
KPKSLSGE

SEQ ID NO: 2266435 - protein, 11 aa, Cryptosporidium parvum
KPKSTNANEDG

SEQ ID NO: 2266436 - protein, 7 aa, Cryptosporidium parvum
KPKVSEN

SEQ ID NO: 2266437 - protein, 9 aa, Cryptosporidium parvum
KPLGETEID

SEQ ID NO: 2266438 - protein, 5 aa, Cryptosporidium parvum
KPLGS

SEQ ID NO: 2266439 - protein, 5 aa, Cryptosporidium parvum
KPLKQ

SEQ ID NO: 2266440 - protein, 11 aa, Cryptosporidium parvum
KPLNAETPKQF

SEQ ID NO: 2266441 - protein, 12 aa, Cryptosporidium parvum
KPLNTDSVPLNG

SEQ ID NO: 2266442 - protein, 6 aa, Cryptosporidium parvum
KPLPSY

SEQ ID NO: 2266443 - protein, 5 aa, Cryptosporidium parvum
KPLSY

SEQ ID NO: 2266444 - protein, 6 aa, Cryptosporidium parvum
KPLSYE

SEQ ID NO: 2266445 - protein, 17 aa, Cryptosporidium parvum
KPLTGQSEKSLKSRTPL

SEQ ID NO: 2266446 - protein, 7 aa, Cryptosporidium parvum
KPLTKQK

SEQ ID NO: 2266447 - protein, 9 aa, Cryptosporidium parvum
KPLVPGAKL

SEQ ID NO: 2266448 - protein, 9 aa, Cryptosporidium parvum
KPLYDSTCA

SEQ ID NO: 2266449 - protein, 4 aa, Cryptosporidium parvum
KPME

SEQ ID NO: 2266450 - protein, 11 aa, Cryptosporidium parvum
KPMNPRPELNK

SEQ ID NO: 2266451 - protein, 32 aa, Cryptosporidium parvum
KPNAHSSTSESKKDTKLKNDTQESSSLKHETE

SEQ ID NO: 2266452 - protein, 9 aa, Cryptosporidium parvum
KPNENITNL

SEQ ID NO: 2266453 - protein, 6 aa, Cryptosporidium parvum
KPNEPC

SEQ ID NO: 2266454 - protein, 7 aa, Cryptosporidium parvum
KPNHTQL

SEQ ID NO: 2266455 - protein, 4 aa, Cryptosporidium parvum
KPNL

SEQ ID NO: 2266456 - protein, 4 aa, Cryptosporidium parvum
KPNN

SEQ ID NO: 2266457 - protein, 29 aa, Cryptosporidium parvum
KPNPNIQSSKQKKKRSKQSESSDIENSQD

SEQ ID NO: 2266458 - protein, 5 aa, Cryptosporidium parvum
KPNSY

SEQ ID NO: 2266459 - protein, 4 aa, Cryptosporidium parvum
KPNT

SEQ ID NO: 2266460 - protein, 7 aa, Cryptosporidium parvum
KPNTCTE

SEQ ID NO: 2266461 - protein, 6 aa, Cryptosporidium parvum
KPNVTT

SEQ ID NO: 2266462 - protein, 7 aa, Cryptosporidium parvum
KPNYEYK

SEQ ID NO: 2266463 - protein, 8 aa, Cryptosporidium parvum
KPPKGIDA

SEQ ID NO: 2266464 - protein, 6 aa, Cryptosporidium parvum
KPPKLS

SEQ ID NO: 2266465 - protein, 28 aa, Cryptosporidium parvum
KPPPGIGTKPLSDEPSNFENSSRRYPKR

SEQ ID NO: 2266466 - protein, 11 aa, Cryptosporidium parvum
KPPPNNIASTP

SEQ ID NO: 2266467 - protein, 5 aa, Cryptosporidium parvum
KPPSG

SEQ ID NO: 2266468 - protein, 7 aa, Cryptosporidium parvum
KPPSTQA

SEQ ID NO: 2266469 - protein, 5 aa, Cryptosporidium parvum
KPPVA

SEQ ID NO: 2266470 - protein, 5 aa, Cryptosporidium parvum
KPPVK

SEQ ID NO: 2266471 - protein, 23 aa, Cryptosporidium parvum
KPQAENPEQAKPRAPRIGQPKYK

SEQ ID NO: 2266472 - protein, 10 aa, Cryptosporidium parvum
KPQEPPADWN

SEQ ID NO: 2266473 - protein, 4 aa, Cryptosporidium parvum
KPQG

SEQ ID NO: 2266474 - protein, 7 aa, Cryptosporidium parvum
KPQGQGY

SEQ ID NO: 2266475 - protein, 8 aa, Cryptosporidium parvum
KPQGYTSL

SEQ ID NO: 2266476 - protein, 4 aa, Cryptosporidium parvum
KPQL

SEQ ID NO: 2266477 - protein, 15 aa, Cryptosporidium parvum
KPQPQSERVNPPANT

SEQ ID NO: 2266478 - protein, 12 aa, Cryptosporidium parvum
KPQTISPKFEGS

SEQ ID NO: 2266479 - protein, 20 aa, Cryptosporidium parvum
KPQVGGGGGGTQSGVSGATV

SEQ ID NO: 2266480 - protein, 10 aa, Cryptosporidium parvum
KPQVNKYPTL

SEQ ID NO: 2266481 - protein, 4 aa, Cryptosporidium parvum
KPRE

SEQ ID NO: 2266482 - protein, 6 aa, Cryptosporidium parvum
KPRMAR

SEQ ID NO: 2266483 - protein, 11 aa, Cryptosporidium parvum
KPRNIKDQGQF

SEQ ID NO: 2266484 - protein, 5 aa, Cryptosporidium parvum
KPRRR

SEQ ID NO: 2266485 - protein, 14 aa, Cryptosporidium parvum
KPRRRREGKTDYQA

SEQ ID NO: 2266486 - protein, 7 aa, Cryptosporidium parvum
KPRSTRA

SEQ ID NO: 2266487 - protein, 8 aa, Cryptosporidium parvum
KPSAIQQR

SEQ ID NO: 2266488 - protein, 8 aa, Cryptosporidium parvum
KPSDGGVY

SEQ ID NO: 2266489 - protein, 14 aa, Cryptosporidium parvum
KPSEASTRNNSNDE

SEQ ID NO: 2266490 - protein, 16 aa, Cryptosporidium parvum
KPSEKNNSVAKSNSSI

SEQ ID NO: 2266491 - protein, 11 aa, Cryptosporidium parvum
KPSINNSTNPQ

SEQ ID NO: 2266492 - protein, 7 aa, Cryptosporidium parvum
KPSISDT

SEQ ID NO: 2266493 - protein, 9 aa, Cryptosporidium parvum
KPSKTTITS

SEQ ID NO: 2266494 - protein, 13 aa, Cryptosporidium parvum
KPSLGGGTNQGGL

SEQ ID NO: 2266495 - protein, 8 aa, Cryptosporidium parvum
KPSLQDKI

SEQ ID NO: 2266496 - protein, 6 aa, Cryptosporidium parvum
KPSLRS

SEQ ID NO: 2266497 - protein, 10 aa, Cryptosporidium parvum
KPSNETEEIR

SEQ ID NO: 2266498 - protein, 12 aa, Cryptosporidium parvum
KPSNSRPPSTKN

SEQ ID NO: 2266499 - protein, 5 aa, Cryptosporidium parvum
KPSPY

SEQ ID NO: 2266500 - protein, 9 aa, Cryptosporidium parvum
KPSQLGPRY

SEQ ID NO: 2266501 - protein, 5 aa, Cryptosporidium parvum
KPSRI

SEQ ID NO: 2266502 - protein, 7 aa, Cryptosporidium parvum
KPSRITD

SEQ ID NO: 2266503 - protein, 15 aa, Cryptosporidium parvum
KPSTTKHSDQGGDFD

SEQ ID NO: 2266504 - protein, 6 aa, Cryptosporidium parvum
KPSVRE

SEQ ID NO: 2266505 - protein, 7 aa, Cryptosporidium parvum
KPSYDPD

SEQ ID NO: 2266506 - protein, 6 aa, Cryptosporidium parvum
KPTAIQ

SEQ ID NO: 2266507 - protein, 18 aa, Cryptosporidium parvum
KPTDKQFGQFNGEQQQAP

SEQ ID NO: 2266508 - protein, 7 aa, Cryptosporidium parvum
KPTESGI

SEQ ID NO: 2266509 - protein, 6 aa, Cryptosporidium parvum
KPTGNF

SEQ ID NO: 2266510 - protein, 8 aa, Cryptosporidium parvum
KPTHSQNN

SEQ ID NO: 2266511 - protein, 5 aa, Cryptosporidium parvum
KPTLQ

SEQ ID NO: 2266512 - protein, 7 aa, Cryptosporidium parvum
KPTPCDE

SEQ ID NO: 2266513 - protein, 5 aa, Cryptosporidium parvum
KPTPI

SEQ ID NO: 2266514 - protein, 4 aa, Cryptosporidium parvum
KPTR

SEQ ID NO: 2266515 - protein, 9 aa, Cryptosporidium parvum
KPTSENNKF

SEQ ID NO: 2266516 - protein, 8 aa, Cryptosporidium parvum
KPTSYGKN

SEQ ID NO: 2266517 - protein, 11 aa, Cryptosporidium parvum
KPTVVTENQDK

SEQ ID NO: 2266518 - protein, 15 aa, Cryptosporidium parvum
KPVANSNADVSYNSK

SEQ ID NO: 2266519 - protein, 4 aa, Cryptosporidium parvum
KPVG

SEQ ID NO: 2266520 - protein, 7 aa, Cryptosporidium parvum
KPVPEEL

SEQ ID NO: 2266521 - protein, 14 aa, Cryptosporidium parvum
KPVQSRVDPSQIPR

SEQ ID NO: 2266522 - protein, 14 aa, Cryptosporidium parvum
KPVVATTSGGPRDF

SEQ ID NO: 2266523 - protein, 6 aa, Cryptosporidium parvum
KPVVGN

SEQ ID NO: 2266524 - protein, 6 aa, Cryptosporidium parvum
KPYETY

SEQ ID NO: 2266525 - protein, 4 aa, Cryptosporidium parvum
KPYY

SEQ ID NO: 2266526 - protein, 4 aa, Cryptosporidium parvum
KQAA

SEQ ID NO: 2266527 - protein, 7 aa, Cryptosporidium parvum
KQADELR

SEQ ID NO: 2266528 - protein, 7 aa, Cryptosporidium parvum
KQAEEIE

SEQ ID NO: 2266529 - protein, 7 aa, Cryptosporidium parvum
KQAGSAV

SEQ ID NO: 2266530 - protein, 6 aa, Cryptosporidium parvum
KQAKDL

SEQ ID NO: 2266531 - protein, 10 aa, Cryptosporidium parvum
KQANTSGVAA

SEQ ID NO: 2266532 - protein, 5 aa, Cryptosporidium parvum
KQAQR

SEQ ID NO: 2266533 - protein, 21 aa, Cryptosporidium parvum
KQASELQKDSSLISDADSRLS

SEQ ID NO: 2266534 - protein, 7 aa, Cryptosporidium parvum
KQATCTI

SEQ ID NO: 2266535 - protein, 5 aa, Cryptosporidium parvum
KQAVG

SEQ ID NO: 2266536 - protein, 5 aa, Cryptosporidium parvum
KQCKS

SEQ ID NO: 2266537 - protein, 8 aa, Cryptosporidium parvum
KQDDENRN

SEQ ID NO: 2266538 - protein, 6 aa, Cryptosporidium parvum
KQDGKY

SEQ ID NO: 2266539 - protein, 8 aa, Cryptosporidium parvum
KQDGPYAN

SEQ ID NO: 2266540 - protein, 6 aa, Cryptosporidium parvum
KQDIQI

SEQ ID NO: 2266541 - protein, 5 aa, Cryptosporidium parvum
KQDKF

SEQ ID NO: 2266542 - protein, 4 aa, Cryptosporidium parvum
KQDL

SEQ ID NO: 2266543 - protein, 10 aa, Cryptosporidium parvum
KQDPNGNKQR

SEQ ID NO: 2266544 - protein, 9 aa, Cryptosporidium parvum
KQDPSFESP

SEQ ID NO: 2266545 - protein, 10 aa, Cryptosporidium parvum
KQDQDELNED

SEQ ID NO: 2266546 - protein, 20 aa, Cryptosporidium parvum
KQDSEPREAQSQHTDQKPEL

SEQ ID NO: 2266547 - protein, 13 aa, Cryptosporidium parvum
KQDSTPEHNQFLD

SEQ ID NO: 2266548 - protein, 9 aa, Cryptosporidium parvum
KQDTHQQGY

SEQ ID NO: 2266549 - protein, 5 aa, Cryptosporidium parvum
KQEEI

SEQ ID NO: 2266550 - protein, 26 aa, Cryptosporidium parvum
KQEEKNLKSINSNTSPNVFGWIPDDS

SEQ ID NO: 2266551 - protein, 8 aa, Cryptosporidium parvum
KQEENNCE

SEQ ID NO: 2266552 - protein, 9 aa, Cryptosporidium parvum
KQEESNNNS

SEQ ID NO: 2266553 - protein, 8 aa, Cryptosporidium parvum
KQEGFRAR

SEQ ID NO: 2266554 - protein, 7 aa, Cryptosporidium parvum
KQEHSNA

SEQ ID NO: 2266555 - protein, 4 aa, Cryptosporidium parvum
KQEI

SEQ ID NO: 2266556 - protein, 9 aa, Cryptosporidium parvum
KQEIQEEKI

SEQ ID NO: 2266557 - protein, 6 aa, Cryptosporidium parvum
KQEKKM

SEQ ID NO: 2266558 - protein, 9 aa, Cryptosporidium parvum
KQEKNRNGI

SEQ ID NO: 2266559 - protein, 24 aa, Cryptosporidium parvum
KQENDNEENNRQWESLSSKSGWNK

SEQ ID NO: 2266560 - protein, 12 aa, Cryptosporidium parvum
KQENRDDYAEFG

SEQ ID NO: 2266561 - protein, 13 aa, Cryptosporidium parvum
KQENYDSNQEKKK

SEQ ID NO: 2266562 - protein, 12 aa, Cryptosporidium parvum
KQEPSERATIEE

SEQ ID NO: 2266563 - protein, 18 aa, Cryptosporidium parvum
KQEPVKSTAGNKENPSSL

SEQ ID NO: 2266564 - protein, 7 aa, Cryptosporidium parvum
KQEQDRI

SEQ ID NO: 2266565 - protein, 4 aa, Cryptosporidium parvum
KQER

SEQ ID NO: 2266566 - protein, 6 aa, Cryptosporidium parvum
KQERDS

SEQ ID NO: 2266567 - protein, 32 aa, Cryptosporidium parvum
KQESNHAFNTQSDQISSTPETSPSSNIPPTTY

SEQ ID NO: 2266568 - protein, 32 aa, Cryptosporidium parvum
KQESSNDNNRQKTSKNTEETRVSDEKTQNNLN

SEQ ID NO: 2266569 - protein, 26 aa, Cryptosporidium parvum
KQETAKEGDQTSPKSVENTPRENSKK

SEQ ID NO: 2266570 - protein, 8 aa, Cryptosporidium parvum
KQETGKIP

SEQ ID NO: 2266571 - protein, 6 aa, Cryptosporidium parvum
KQETKD

SEQ ID NO: 2266572 - protein, 31 aa, Cryptosporidium parvum
KQETNELKEKESEKLKEKKPDELKEKKSEKD

SEQ ID NO: 2266573 - protein, 6 aa, Cryptosporidium parvum
KQETRN

SEQ ID NO: 2266574 - protein, 4 aa, Cryptosporidium parvum
KQFG

SEQ ID NO: 2266575 - protein, 6 aa, Cryptosporidium parvum
KQFRDG

SEQ ID NO: 2266576 - protein, 6 aa, Cryptosporidium parvum
KQGEDS

SEQ ID NO: 2266577 - protein, 7 aa, Cryptosporidium parvum
KQGEQGD

SEQ ID NO: 2266578 - protein, 6 aa, Cryptosporidium parvum
KQGEVE

SEQ ID NO: 2266579 - protein, 5 aa, Cryptosporidium parvum
KQGIQ

SEQ ID NO: 2266580 - protein, 20 aa, Cryptosporidium parvum
KQGIQTSTNPFNRAGHKNSL

SEQ ID NO: 2266581 - protein, 21 aa, Cryptosporidium parvum
KQGKANSEDDFGSRKFGTSHH

SEQ ID NO: 2266582 - protein, 6 aa, Cryptosporidium parvum
KQGKHD

SEQ ID NO: 2266583 - protein, 9 aa, Cryptosporidium parvum
KQGNSDEPT

SEQ ID NO: 2266584 - protein, 4 aa, Cryptosporidium parvum
KQGQ

SEQ ID NO: 2266585 - protein, 7 aa, Cryptosporidium parvum
KQGRNIN

SEQ ID NO: 2266586 - protein, 4 aa, Cryptosporidium parvum
KQGY

SEQ ID NO: 2266587 - protein, 8 aa, Cryptosporidium parvum
KQHAKDAN

SEQ ID NO: 2266588 - protein, 6 aa, Cryptosporidium parvum
KQHDAS

SEQ ID NO: 2266589 - protein, 19 aa, Cryptosporidium parvum
KQHDEESIEKTQEKVRELE

SEQ ID NO: 2266590 - protein, 7 aa, Cryptosporidium parvum
KQIDSNV

SEQ ID NO: 2266591 - protein, 7 aa, Cryptosporidium parvum
KQIEEQQ

SEQ ID NO: 2266592 - protein, 13 aa, Cryptosporidium parvum
KQIELSGNSNTSL

SEQ ID NO: 2266593 - protein, 14 aa, Cryptosporidium parvum
KQIGQELEEEKQRN

SEQ ID NO: 2266594 - protein, 14 aa, Cryptosporidium parvum
KQIKNKEKSINTTN

SEQ ID NO: 2266595 - protein, 17 aa, Cryptosporidium parvum
KQINEGKDYSNSDRTPL

SEQ ID NO: 2266596 - protein, 6 aa, Cryptosporidium parvum
KQINKE

SEQ ID NO: 2266597 - protein, 42 aa, Cryptosporidium parvum
KQIPYSYSSNNNSHNIGSHSNSNSGSANLGGQMQQNQHQQHQ

SEQ ID NO: 2266598 - protein, 9 aa, Cryptosporidium parvum
KQISERKKG

SEQ ID NO: 2266599 - protein, 21 aa, Cryptosporidium parvum
KQISSKIGVKKKEKRKKKNKY

SEQ ID NO: 2266600 - protein, 25 aa, Cryptosporidium parvum
KQISSSAGAKGGSGGILSSAETKFK

SEQ ID NO: 2266601 - protein, 23 aa, Cryptosporidium parvum
KQISSTSTTTTTPSTSSSNSIST

SEQ ID NO: 2266602 - protein, 6 aa, Cryptosporidium parvum
KQKAKA

SEQ ID NO: 2266603 - protein, 9 aa, Cryptosporidium parvum
KQKAQQAYE

SEQ ID NO: 2266604 - protein, 10 aa, Cryptosporidium parvum
KQKCGNQPQK

SEQ ID NO: 2266605 - protein, 18 aa, Cryptosporidium parvum
KQKEAKYDSQSPNRKSHG

SEQ ID NO: 2266606 - protein, 21 aa, Cryptosporidium parvum
KQKEEIERTDLEQSVKNNEKK

SEQ ID NO: 2266607 - protein, 19 aa, Cryptosporidium parvum
KQKEENRVSQMGDETPNKN

SEQ ID NO: 2266608 - protein, 6 aa, Cryptosporidium parvum
KQKEER

SEQ ID NO: 2266609 - protein, 21 aa, Cryptosporidium parvum
KQKEKSSKFPVRGSKIKTDQV

SEQ ID NO: 2266610 - protein, 8 aa, Cryptosporidium parvum
KQKEVKES

SEQ ID NO: 2266611 - protein, 17 aa, Cryptosporidium parvum
KQKEYQKKPNNNNQGHY

SEQ ID NO: 2266612 - protein, 8 aa, Cryptosporidium parvum
KQKFEQGQ

SEQ ID NO: 2266613 - protein, 13 aa, Cryptosporidium parvum
KQKKASTQSLSGK

SEQ ID NO: 2266614 - protein, 8 aa, Cryptosporidium parvum
KQKLQKQL

SEQ ID NO: 2266615 - protein, 4 aa, Cryptosporidium parvum
KQKM

SEQ ID NO: 2266616 - protein, 12 aa, Cryptosporidium parvum
KQKNENEHEEEE

SEQ ID NO: 2266617 - protein, 5 aa, Cryptosporidium parvum
KQKNH

SEQ ID NO: 2266618 - protein, 8 aa, Cryptosporidium parvum
KQKNNIDE

SEQ ID NO: 2266619 - protein, 8 aa, Cryptosporidium parvum
KQKPEHDV

SEQ ID NO: 2266620 - protein, 11 aa, Cryptosporidium parvum
KQKQETKSKSM

SEQ ID NO: 2266621 - protein, 9 aa, Cryptosporidium parvum
KQKQISRDF

SEQ ID NO: 2266622 - protein, 10 aa, Cryptosporidium parvum
KQKQRESRDY

SEQ ID NO: 2266623 - protein, 34 aa, Cryptosporidium parvum; identical to SEQ ID NO: 2148984

SEQ ID NO: 2266624 - protein, 11 aa, Cryptosporidium parvum
KQKSEESPKEW

SEQ ID NO: 2266625 - protein, 18 aa, Cryptosporidium parvum
KQKSKGLGDLSSTKKPII

SEQ ID NO: 2266626 - protein, 10 aa, Cryptosporidium parvum
KQKSRGKSLD

SEQ ID NO: 2266627 - protein, 5 aa, Cryptosporidium parvum
KQKTI

SEQ ID NO: 2266628 - protein, 7 aa, Cryptosporidium parvum
KQKTMAS

SEQ ID NO: 2266629 - protein, 38 aa, Cryptosporidium parvum
KQKTSKNKAENDQESQDTSQKSSANIEKEYDNNAPDIS

SEQ ID NO: 2266630 - protein, 8 aa, Cryptosporidium parvum
KQKTTEIF

SEQ ID NO: 2266631 - protein, 6 aa, Cryptosporidium parvum
KQKYQF

SEQ ID NO: 2266632 - protein, 32 aa, Cryptosporidium parvum
KQLDETNKSEIKGIDPNKAEISISEKNNNLLE

SEQ ID NO: 2266633 - protein, 7 aa, Cryptosporidium parvum
KQLDTDT

SEQ ID NO: 2266634 - protein, 13 aa, Cryptosporidium parvum
KQLEQESRQSDPL

SEQ ID NO: 2266635 - protein, 9 aa, Cryptosporidium parvum
KQLESSKKN

SEQ ID NO: 2266636 - protein, 10 aa, Cryptosporidium parvum
KQLETKTRDL

SEQ ID NO: 2266637 - protein, 13 aa, Cryptosporidium parvum
KQLKDADETSNSF

SEQ ID NO: 2266638 - protein, 8 aa, Cryptosporidium parvum
KQLNGAER

SEQ ID NO: 2266639 - protein, 5 aa, Cryptosporidium parvum
KQLNP

SEQ ID NO: 2266640 - protein, 5 aa, Cryptosporidium parvum
KQLPA

SEQ ID NO: 2266641 - protein, 25 aa, Cryptosporidium parvum
KQLPTNQPNGNNSNNNHNNNINNNN

SEQ ID NO: 2266642 - protein, 11 aa, Cryptosporidium parvum
KQLQEDRQRFE

SEQ ID NO: 2266643 - protein, 7 aa, Cryptosporidium parvum
KQLSEEG

SEQ ID NO: 2266644 - protein, 10 aa, Cryptosporidium parvum
KQLSKGPPQI

SEQ ID NO: 2266645 - protein, 239 aa, Cryptosporidium parvum
KQLSNKPIEEQNDKKLSRSSSNKNINEAESSTKTPSESNKNSKSEPTSKSSNISKSKSVPSAKEEPKSETKLEGKESSPPPPKDPPASKGPPPPKGSPAPKGPPAPKGPPSPASKGPPPPKGPPAPKGPPGPPSESEGSPASKGPPPSKGPPAPKGPPGPSSESEGSPATKGPPAPKGPPGPPESEGSPASKGPPAPKGPPSPASKGPPPPKGPPPPSSKGPPTGKGPSLPKKAPPPKK

SEQ ID NO: 2266646 - protein, 8 aa, Cryptosporidium parvum
KQLSNTNT

SEQ ID NO: 2266647 - protein, 6 aa, Cryptosporidium parvum
KQLSST

SEQ ID NO: 2266648 - protein, 10 aa, Cryptosporidium parvum
KQLTENPINN

SEQ ID NO: 2266649 - protein, 22 aa, Cryptosporidium parvum
KQMESNSNKSEFDLNSSSQRFD

SEQ ID NO: 2266650 - protein, 9 aa, Cryptosporidium parvum
KQMNKKRSH

SEQ ID NO: 2266651 - protein, 5 aa, Cryptosporidium parvum
KQMNT

SEQ ID NO: 2266652 - protein, 5 aa, Cryptosporidium parvum
KQMSD

SEQ ID NO: 2266653 - protein, 11 aa, Cryptosporidium parvum
KQNAKNGHEMY

SEQ ID NO: 2266654 - protein, 6 aa, Cryptosporidium parvum
KQNATK

SEQ ID NO: 2266655 - protein, 6 aa, Cryptosporidium parvum
KQNDYN

SEQ ID NO: 2266656 - protein, 7 aa, Cryptosporidium parvum
KQNFNFE

SEQ ID NO: 2266657 - protein, 4 aa, Cryptosporidium parvum
KQNI

SEQ ID NO: 2266658 - protein, 6 aa, Cryptosporidium parvum
KQNMDP

SEQ ID NO: 2266659 - protein, 5 aa, Cryptosporidium parvum
KQNMR

SEQ ID NO: 2266660 - protein, 6 aa, Cryptosporidium parvum
KQNNCK

SEQ ID NO: 2266661 - protein, 7 aa, Cryptosporidium parvum
KQNNSNE

SEQ ID NO: 2266662 - protein, 4 aa, Cryptosporidium parvum
KQNP

SEQ ID NO: 2266663 - protein, 7 aa, Cryptosporidium parvum
KQNPATL

SEQ ID NO: 2266664 - protein, 5 aa, Cryptosporidium parvum
KQNPG

SEQ ID NO: 2266665 - protein, 5 aa, Cryptosporidium parvum
KQNPI

SEQ ID NO: 2266666 - protein, 4 aa, Cryptosporidium parvum
KQNS

SEQ ID NO: 2266667 - protein, 7 aa, Cryptosporidium parvum
KQNSEPD

SEQ ID NO: 2266668 - protein, 5 aa, Cryptosporidium parvum
KQNSK

SEQ ID NO: 2266669 - protein, 13 aa, Cryptosporidium parvum
KQNSKNEKHGNYA

SEQ ID NO: 2266670 - protein, 26 aa, Cryptosporidium parvum
KQNSREKPGDISSLSNKSKSPEPEEK

SEQ ID NO: 2266671 - protein, 10 aa, Cryptosporidium parvum
KQNTSNDKKN

SEQ ID NO: 2266672 - protein, 7 aa, Cryptosporidium parvum
KQPATNQ

SEQ ID NO: 2266673 - protein, 6 aa, Cryptosporidium parvum
KQPECL

SEQ ID NO: 2266674 - protein, 8 aa, Cryptosporidium parvum
KQPEYSPH

SEQ ID NO: 2266675 - protein, 5 aa, Cryptosporidium parvum
KQPHD

SEQ ID NO: 2266676 - protein, 27 aa, Cryptosporidium parvum
KQPISDGSSPGIRQKSLNTKTDQNSSL

SEQ ID NO: 2266677 - protein, 37 aa, Cryptosporidium parvum
  misc_feature (17)..(18): Xaa can be any naturally occurring amino acid
  misc_feature (20)..(21): Xaa can be any naturally occurring amino acid
  misc_feature (24)..(29): Xaa can be any naturally occurring amino acid
  misc_feature (31)..(32): Xaa can be any naturally occurring amino acid
  misc_feature (34)..(35): Xaa can be any naturally occurring amino acid
  misc_feature (37)..(37): Xaa can be any naturally occurring amino acid
KQPNTNKNNPSSSLAEXXGXXVNXXXXXXIXXEXXNX

SEQ ID NO: 2266678 - protein, 7 aa, Cryptosporidium parvum
KQPPNIS

SEQ ID NO: 2266679 - protein, 5 aa, Cryptosporidium parvum
KQQDF

SEQ ID NO: 2266680 - protein, 12 aa, Cryptosporidium parvum
KQQDNRCGDGTT

SEQ ID NO: 2266681 - protein, 19 aa, Cryptosporidium parvum
KQQKLQQKQKQQQQQQQQQ

SEQ ID NO: 2266682 - protein, 7 aa, Cryptosporidium parvum
KQQKNEI

SEQ ID NO: 2266683 - protein, 65 aa, Cryptosporidium parvum
KQQQQQQQQQQQQQQQQQQQQQQQHIKQQQQQQQQQQQQQQQQQQQQQQQQQQQQQQQAQNPSQL

SEQ ID NO: 2266684 - protein, 14 aa, Cryptosporidium parvum
KQQTAMSKSIESNS

SEQ ID NO: 2266685 - protein, 10 aa, Cryptosporidium parvum
KQQTSTANDF

SEQ ID NO: 2266686 - protein, 6 aa, Cryptosporidium parvum
KQQYEK

SEQ ID NO: 2266687 - protein, 4 aa, Cryptosporidium parvum
KQRE

SEQ ID NO: 2266688 - protein, 11 aa, Cryptosporidium parvum
KQRELDELEEE

SEQ ID NO: 2266689 - protein, 7 aa, Cryptosporidium parvum
KQRGNPN

SEQ ID NO: 2266690 - protein, 6 aa, Cryptosporidium parvum
KQRKSL

SEQ ID NO: 2266691 - protein, 4 aa, Cryptosporidium parvum
KQRL

SEQ ID NO: 2266692 - protein, 6 aa, Cryptosporidium parvum
KQRPFV

SEQ ID NO: 2266693 - protein, 9 aa, Cryptosporidium parvum
KQRQEESNL

SEQ ID NO: 2266694 - protein, 7 aa, Cryptosporidium parvum
KQRQNES

SEQ ID NO: 2266695 - protein, 7 aa, Cryptosporidium parvum
KQRQSTI

SEQ ID NO: 2266696 - protein, 6 aa, Cryptosporidium parvum
KQRRHN

SEQ ID NO: 2266697 - protein, 6 aa, Cryptosporidium parvum
KQRRQQ

SEQ ID NO: 2266698 - protein, 6 aa, Cryptosporidium parvum
KQRRTG

SEQ ID NO: 2266699 - protein, 4 aa, Cryptosporidium parvum
KQRS

SEQ ID NO: 2266700 - protein, 6 aa, Cryptosporidium parvum
KQRYLD

SEQ ID NO: 2266701 - protein, 10 aa, Cryptosporidium parvum
KQSCKKNNAL

SEQ ID NO: 2266702 - protein, 24 aa, Cryptosporidium parvum
KQSDNKSEDDHKDITKTAKPTNDI

SEQ ID NO: 2266703 - protein, 7 aa, Cryptosporidium parvum
KQSDPNT

SEQ ID NO: 2266704 - protein, 4 aa, Cryptosporidium parvum
KQSE

SEQ ID NO: 2266705 - protein, 13 aa, Cryptosporidium parvum
KQSEIQKSYSTGK

SEQ ID NO: 2266706 - protein, 7 aa, Cryptosporidium parvum
KQSELQS

SEQ ID NO: 2266707 - protein, 5 aa, Cryptosporidium parvum
KQSGE

SEQ ID NO: 2266708 - protein, 8 aa, Cryptosporidium parvum
KQSIKQTN

SEQ ID NO: 2266709 - protein, 6 aa, Cryptosporidium parvum
KQSKSN

SEQ ID NO: 2266710 - protein, 7 aa, Cryptosporidium parvum
KQSLENT

SEQ ID NO: 2266711 - protein, 5 aa, Cryptosporidium parvum
KQSLQ

SEQ ID NO: 2266712 - protein, 9 aa, Cryptosporidium parvum
KQSNNRQEA

SEQ ID NO: 2266713 - protein, 18 aa, Cryptosporidium parvum
KQSNNSSNTDKDDSKEAI

SEQ ID NO: 2266714 - protein, 19 aa, Cryptosporidium parvum
KQSNRFSSNDLSGSRHRSS

SEQ ID NO: 2266715 - protein, 5 aa, Cryptosporidium parvum
KQSQF

SEQ ID NO: 2266716 - protein, 6 aa, Cryptosporidium parvum
KQSQNS

SEQ ID NO: 2266717 - protein, 8 aa, Cryptosporidium parvum
KQSRKDRV

SEQ ID NO: 2266718 - protein, 6 aa, Cryptosporidium parvum
KQSRPI

SEQ ID NO: 2266719 - protein, 7 aa, Cryptosporidium parvum
KQSYTQF

SEQ ID NO: 2266720 - protein, 5 aa, Cryptosporidium parvum
KQTEE

SEQ ID NO: 2266721 - protein, 8 aa, Cryptosporidium parvum
KQTEKPPS

SEQ ID NO: 2266722 - protein, 10 aa, Cryptosporidium parvum
KQTENIEETR

SEQ ID NO: 2266723 - protein, 6 aa, Cryptosporidium parvum
KQTGKI

SEQ ID NO: 2266724 - protein, 9 aa, Cryptosporidium parvum
KQTGNSGRN

SEQ ID NO: 2266725 - protein, 20 aa, Cryptosporidium parvum
KQTGTTNQEDENNNSYQPGI

SEQ ID NO: 2266726 - protein, 11 aa, Cryptosporidium parvum
KQTKESNEEKS

SEQ ID NO: 2266727 - protein, 5 aa, Cryptosporidium parvum
KQTKF

SEQ ID NO: 2266728 - protein, 8 aa, Cryptosporidium parvum
KQTLESQG

SEQ ID NO: 2266729 - protein, 4 aa, Cryptosporidium parvum
KQTN

SEQ ID NO: 2266730 - protein, 26 aa, Cryptosporidium parvum
KQTNEEAENGDNEINSISERNASGKE

SEQ ID NO: 2266731 - protein, 9 aa, Cryptosporidium parvum
KQTNQFAND

SEQ ID NO: 2266732 - protein, 17 aa, Cryptosporidium parvum
KQTQINSSRSKTKNLSS

SEQ ID NO: 2266733 - protein, 10 aa, Cryptosporidium parvum
KQTRAGQRTR

SEQ ID NO: 2266734 - protein, 9 aa, Cryptosporidium parvum
KQTSPPTVP

SEQ ID NO: 2266735 - protein, 5 aa, Cryptosporidium parvum
KQTTK

SEQ ID NO: 2266736 - protein, 8 aa, Cryptosporidium parvum
KQTTKCEK

SEQ ID NO: 2266737 - protein, 17 aa, Cryptosporidium parvum
KQTVENKDFKNNTLNLS

SEQ ID NO: 2266738 - protein, 5 aa, Cryptosporidium parvum
KQVED

SEQ ID NO: 2266739 - protein, 10 aa, Cryptosporidium parvum
KQVEDEKNLQ

SEQ ID NO: 2266740 - protein, 5 aa, Cryptosporidium parvum
KQVEG

SEQ ID NO: 2266741 - protein, 6 aa, Cryptosporidium parvum
KQVEHN

SEQ ID NO: 2266742 - protein, 6 aa, Cryptosporidium parvum
KQVEYK

SEQ ID NO: 2266743 - protein, 9 aa, Cryptosporidium parvum
KQVGETPSQ

SEQ ID NO: 2266744 - protein, 4 aa, Cryptosporidium parvum
KQVI

SEQ ID NO: 2266745 - protein, 17 aa, Cryptosporidium parvum
KQVKKGSKFINQGDPNA

SEQ ID NO: 2266746 - protein, 10 aa, Cryptosporidium parvum
KQVSAKGVEE

SEQ ID NO: 2266747 - protein, 10 aa, Cryptosporidium parvum
KQWKDSINSS

SEQ ID NO: 2266748 - protein, 5 aa, Cryptosporidium parvum
KQYAA

SEQ ID NO: 2266749 - protein, 13 aa, Cryptosporidium parvum
KQYESERFTNNGI

SEQ ID NO: 2266750 - protein, 5 aa, Cryptosporidium parvum
KQYGN

SEQ ID NO: 2266751 - protein, 21 aa, Cryptosporidium parvum
KQYHPDKNPDDADAKDKFQKL

SEQ ID NO: 2266752 - protein, 11 aa, Cryptosporidium parvum
KQYKSKISEKP

SEQ ID NO: 2266753 - protein, 4 aa, Cryptosporidium parvum
KQYL

SEQ ID NO: 2266754 - protein, 7 aa, Cryptosporidium parvum
KQYNPGV

SEQ ID NO: 2266755 - protein, 21 aa, Cryptosporidium parvum
KQYSDIKASGMGRTKSSNKFN

SEQ ID NO: 2266756 - protein, 28 aa, Cryptosporidium parvum
KQYSGTNFASNEKSDSSNFEVSDDNQIV

SEQ ID NO: 2266757 - protein, 9 aa, Cryptosporidium parvum
KQYVTDQEL

SEQ ID NO: 2266758 - protein, 6 aa, Cryptosporidium parvum
KRAERN

SEQ ID NO: 2266759 - protein, 7 aa, Cryptosporidium parvum
KRAPRAI

SEQ ID NO: 2266760 - protein, 4 aa, Cryptosporidium parvum
KRAQ

SEQ ID NO: 2266761 - protein, 6 aa, Cryptosporidium parvum
KRAQEA

SEQ ID NO: 2266762 - protein, 8 aa, Cryptosporidium parvum
KRASPRNT

SEQ ID NO: 2266763 - protein, 15 aa, Cryptosporidium parvum
KRATNTELNKANRRT

SEQ ID NO: 2266764 - protein, 6 aa, Cryptosporidium parvum
KRCPTP

SEQ ID NO: 2266765 - protein, 5 aa, Cryptosporidium parvum
KRDGI

SEQ ID NO: 2266766 - protein, 4 aa, Cryptosporidium parvum
KRDN

SEQ ID NO: 2266767 - protein, 9 aa, Cryptosporidium parvum
KRDNIKSSK

SEQ ID NO: 2266768 - protein, 9 aa, Cryptosporidium parvum
KRDNPESKQ

SEQ ID NO: 2266769 - protein, 5 aa, Cryptosporidium parvum
KRDRG

SEQ ID NO: 2266770 - protein, 13 aa, Cryptosporidium parvum
KRDSNSKSQQVGE

SEQ ID NO: 2266771 - protein, 23 aa, Cryptosporidium parvum
KRDTRESSREADRKKNNDENAEE

SEQ ID NO: 2266772 - protein, 8 aa, Cryptosporidium parvum
KREDEIGD

SEQ ID NO: 2266773 - protein, 15 aa, Cryptosporidium parvum
KREDSQKKGAKQNTL

SEQ ID NO: 2266774 - protein, 8 aa, Cryptosporidium parvum
KREEAQNA

SEQ ID NO: 2266775 - protein, 17 aa, Cryptosporidium parvum
KREEDRRRREEARQLEE

SEQ ID NO: 2266776 - protein, 8 aa, Cryptosporidium parvum
KREENTNK

SEQ ID NO: 2266777 - protein, 10 aa, Cryptosporidium parvum
KREGTNSDNI

SEQ ID NO: 2266778 - protein, 5 aa, Cryptosporidium parvum
KREIQ

SEQ ID NO: 2266779 - protein, 10 aa, Cryptosporidium parvum
KRENEHKTSV

SEQ ID NO: 2266780 - protein, 13 aa, Cryptosporidium parvum
KRENESNNENSIK

SEQ ID NO: 2266781 - protein, 10 aa, Cryptosporidium parvum
KRENSDENNM

SEQ ID NO: 2266782 - protein, 5 aa, Cryptosporidium parvum
KREPS

SEQ ID NO: 2266783 - protein, 4 aa, Cryptosporidium parvum
KRER

SEQ ID NO: 2266784 - protein, 5 aa, Cryptosporidium parvum
KRERE

SEQ ID NO: 2266785 - protein, 15 aa, Cryptosporidium parvum
KRERTVARAYGGTKC

SEQ ID NO: 2266786 - protein, 11 aa, Cryptosporidium parvum
KRESSDAKTVE

SEQ ID NO: 2266787 - protein, 16 aa, Cryptosporidium parvum
KRETPELYDEKSNTLS

SEQ ID NO: 2266788 - protein, 5 aa, Cryptosporidium parvum
KRETS

SEQ ID NO: 2266789 - protein, 12 aa, Cryptosporidium parvum
KREYKSRKDFQD

SEQ ID NO: 2266790 - protein, 7 aa, Cryptosporidium parvum
KRFDNTK

SEQ ID NO: 2266791 - protein, 13 aa, Cryptosporidium parvum
KRFERSKNMTSSE

SEQ ID NO: 2266792 - protein, 18 aa, Cryptosporidium parvum
KRFGRIKSKDPKSASNTI

SEQ ID NO: 2266793 - protein, 6 aa, Cryptosporidium parvum
KRFNGR

SEQ ID NO: 2266794 - protein, 4 aa, Cryptosporidium parvum
KRFQ

SEQ ID NO: 2266795 - protein, 6 aa, Cryptosporidium parvum
KRFTKT

SEQ ID NO: 2266796 - protein, 4 aa, Cryptosporidium parvum
KRGK

SEQ ID NO: 2266797 - protein, 9 aa, Cryptosporidium parvum
KRGKANKAA

SEQ ID NO: 2266798 - protein, 8 aa, Cryptosporidium parvum
KRGNEDGI

SEQ ID NO: 2266799 - protein, 11 aa, Cryptosporidium parvum
KRGNNNSSKKF

SEQ ID NO: 2266800 - protein, 8 aa, Cryptosporidium parvum
KRGNQKAI

SEQ ID NO: 2266801 - protein, 28 aa, Cryptosporidium parvum
KRGRKSLSYNGSSINEQNSPSVTSNKRL

SEQ ID NO: 2266802 - protein, 9 aa, Cryptosporidium parvum
KRGRRKNEK

SEQ ID NO: 2266803 - protein, 14 aa, Cryptosporidium parvum
KRGSKGRSERNEVK

SEQ ID NO: 2266804 - protein, 12 aa, Cryptosporidium parvum
KRGYSQDKIKEN

SEQ ID NO: 2266805 - protein, 4 aa, Cryptosporidium parvum
KRIE

SEQ ID NO: 2266806 - protein, 6 aa, Cryptosporidium parvum
KRIEEG

SEQ ID NO: 2266807 - protein, 8 aa, Cryptosporidium parvum
KRIGSQYP

SEQ ID NO: 2266808 - protein, 4 aa, Cryptosporidium parvum
KRIN

SEQ ID NO: 2266809 - protein, 7 aa, Cryptosporidium parvum
KRIPANK

SEQ ID NO: 2266810 - protein, 8 aa, Cryptosporidium parvum
KRIPRRGE

SEQ ID NO: 2266811 - protein, 16 aa, Cryptosporidium parvum
KRISAKEALEHSFFQL

SEQ ID NO: 2266812 - protein, 7 aa, Cryptosporidium parvum
KRISARD

SEQ ID NO: 2266813 - protein, 8 aa, Cryptosporidium parvum
KRISNSES

SEQ ID NO: 2266814 - protein, 6 aa, Cryptosporidium parvum
KRISSP

SEQ ID NO: 2266815 - protein, 7 aa, Cryptosporidium parvum
KRISSSG

SEQ ID NO: 2266816 - protein, 28 aa, Cryptosporidium parvum
KRISTKSHRNSTKKEENDNYESEDQEEH

SEQ ID NO: 2266817 - protein, 7 aa, Cryptosporidium parvum
KRKDHKF

SEQ ID NO: 2266818 - protein, 9 aa, Cryptosporidium parvum
KRKDNDDFL

SEQ ID NO: 2266819 - protein, 4 aa, Cryptosporidium parvum
KRKE

SEQ ID NO: 2266820 - protein, 87 aa, Cryptosporidium parvum
KRKEAENKENNSSLKNGNSNISKSHESDSGKNVKLSESNTSEKPNYSGPQTKRISTKEMEGENLTNKSNKTLSAKPVTSKISGYNKQ

SEQ ID NO: 2266821 - protein, 113 aa, Cryptosporidium parvum
KRKENDDQELNSKREKEEEIKKKEKEEEIKRNKEEELKRKKEKEEELKKKKEKEEEIKRKKEEEEFKRKKEKEEENKKKKEEEELKSKKEKEGEIKRKKEEEENKKKKEEELK

SEQ ID NO: 2266822 - protein, 6 aa, Cryptosporidium parvum
KRKEPI

SEQ ID NO: 2266823 - protein, 6 aa, Cryptosporidium parvum
KRKERT

SEQ ID NO: 2266824 - protein, 5 aa, Cryptosporidium parvum
KRKES

SEQ ID NO: 2266825 - protein, 6 aa, Cryptosporidium parvum
KRKFPN

SEQ ID NO: 2266826 - protein, 10 aa, Cryptosporidium parvum
KRKGEIEKEV

SEQ ID NO: 2266827 - protein, 5 aa, Cryptosporidium parvum
KRKHR

SEQ ID NO: 2266828 - protein, 9 aa, Cryptosporidium parvum
KRKHTNNIS

SEQ ID NO: 2266829 - protein, 23 aa, Cryptosporidium parvum
KRKKDSNNQANSENTGSEPEGIF

SEQ ID NO: 2266830 - protein, 8 aa, Cryptosporidium parvum
KRKKETKV

SEQ ID NO: 2266831 - protein, 8 aa, Cryptosporidium parvum
KRKKNDYC

SEQ ID NO: 2266832 - protein, 12 aa, Cryptosporidium parvum
KRKKQRNEETSP

SEQ ID NO: 2266833 - protein, 7 aa, Cryptosporidium parvum
KRKKRKI

SEQ ID NO: 2266834 - protein, 9 aa, Cryptosporidium parvum
KRKKSSAIV

SEQ ID NO: 2266835 - protein, 7 aa, Cryptosporidium parvum
KRKLPKG

SEQ ID NO: 2266836 - protein, 7 aa, Cryptosporidium parvum
KRKNELG

SEQ ID NO: 2266837 - protein, 12 aa, Cryptosporidium parvum
KRKNKNNGKKGI

SEQ ID NO: 2266838 - protein, 13 aa, Cryptosporidium parvum
KRKNKQDTKNIKK

SEQ ID NO: 2266839 - protein, 10 aa, Cryptosporidium parvum
KRKPEDGDEI

SEQ ID NO: 2266840 - protein, 11 aa, Cryptosporidium parvum
KRKQKGPPQYA

SEQ ID NO: 2266841 - protein, 11 aa, Cryptosporidium parvum
KRKQKRKERKI

SEQ ID NO: 2266842 - protein, 8 aa, Cryptosporidium parvum
KRKQLEEE

SEQ ID NO: 2266843 - protein, 16 aa, Cryptosporidium parvum
KRKRISQKKIQGNIDN

SEQ ID NO: 2266844 - protein, 10 aa, Cryptosporidium parvum
KRKRNTSNEQ

SEQ ID NO: 2266845 - protein, 6 aa, Cryptosporidium parvum
KRKSEI

SEQ ID NO: 2266846 - protein, 7 aa, Cryptosporidium parvum
KRKSHDK

SEQ ID NO: 2266847 - protein, 15 aa, Cryptosporidium parvum
KRKSKEKETSNSQEI

SEQ ID NO: 2266848 - protein, 12 aa, Cryptosporidium parvum
KRKTMNPKPKLS

SEQ ID NO: 2266849 - protein, 6 aa, Cryptosporidium parvum
KRKYRQ

SEQ ID NO: 2266850 - protein, 55 aa, Cryptosporidium parvum
KRKYSPPVNTSNEAKSSNNMNKKHHNKGNKFKRSYSNNKNSLNTSHINKHRLESY

SEQ ID NO: 2266851 - protein, 13 aa, Cryptosporidium parvum
KRLEDPSDNEKCK

SEQ ID NO: 2266852 - protein, 5 aa, Cryptosporidium parvum
KRLGG

SEQ ID NO: 2266853 - protein, 7 aa, Cryptosporidium parvum
KRLKERY

SEQ ID NO: 2266854 - protein, 14 aa, Cryptosporidium parvum
KRLKESNKQDIDTN

SEQ ID NO: 2266855 - protein, 11 aa, Cryptosporidium parvum
KRLNKNSSRRF

SEQ ID NO: 2266856 - protein, 26 aa, Cryptosporidium parvum
KRLQQRKREWRTSLSKGGFDVEGNEQ

SEQ ID NO: 2266857 - protein, 6 aa, Cryptosporidium parvum
KRLRGG

SEQ ID NO: 2266858 - protein, 6 aa, Cryptosporidium parvum
KRLSKQ

SEQ ID NO: 2266859 - protein, 6 aa, Cryptosporidium parvum
KRLSQM

SEQ ID NO: 2266860 - protein, 11 aa, Cryptosporidium parvum
KRLSSDGSEMP

SEQ ID NO: 2266861 - protein, 6 aa, Cryptosporidium parvum
KRLSSS

SEQ ID NO: 2266862 - protein, 7 aa, Cryptosporidium parvum
KRNATPN

SEQ ID NO: 2266863 - protein, 8 aa, Cryptosporidium parvum
KRNDPDLK

SEQ ID NO: 2266864 - protein, 7 aa, Cryptosporidium parvum
KRNDPKV

SEQ ID NO: 2266865 - protein, 5 aa, Cryptosporidium parvum
KRNDQ

SEQ ID NO: 2266866 - protein, 6 aa, Cryptosporidium parvum
KRNDTL

SEQ ID NO: 2266867 - protein, 55 aa, Cryptosporidium parvum
KRNEQDTMNSFSSSSSSSSSSSSSSSSSSSSSSSSSSSSSSSSSSSSSSSSDPTF

SEQ ID NO: 2266868 - protein, 8 aa, Cryptosporidium parvum
KRNGISKE

SEQ ID NO: 2266869 - protein, 8 aa, Cryptosporidium parvum
KRNGNSNL

SEQ ID NO: 2266870 - protein, 20 aa, Cryptosporidium parvum
KRNKPNTRQPINSKIESSDI

SEQ ID NO: 2266871 - protein, 5 aa, Cryptosporidium parvum
KRNLE

SEQ ID NO: 2266872 - protein, 33 aa, Cryptosporidium parvum
KRNNGSAQVSSGRNNASGLYRGTYKKEGKSQSL

SEQ ID NO: 2266873 - protein, 6 aa, Cryptosporidium parvum
KRNNIS

SEQ ID NO: 2266874 - protein, 5 aa, Cryptosporidium parvum
KRNNS

SEQ ID NO: 2266875 - protein, 7 aa, Cryptosporidium parvum
KRNPNNF

SEQ ID NO: 2266876 - protein, 4 aa, Cryptosporidium parvum
KRNS

SEQ ID NO: 2266877 - protein, 13 aa, Cryptosporidium parvum
KRNSCSSTNKDSW

SEQ ID NO: 2266878 - protein, 9 aa, Cryptosporidium parvum
KRNSERQAE

SEQ ID NO: 2266879 - protein, 9 aa, Cryptosporidium parvum
KRNSKPSNK

SEQ ID NO: 2266880 - protein, 9 aa, Cryptosporidium parvum
KRNTSKPLT

SEQ ID NO: 2266881 - protein, 7 aa, Cryptosporidium parvum
KRNVNRN

SEQ ID NO: 2266882 - protein, 15 aa, Cryptosporidium parvum
KRPARAQSDGSLQSN

SEQ ID NO: 2266883 - protein, 16 aa, Cryptosporidium parvum
KRPESPLKKPISRSNI

SEQ ID NO: 2266884 - protein, 6 aa, Cryptosporidium parvum
KRPHLN

SEQ ID NO: 2266885 - protein, 20 aa, Cryptosporidium parvum
KRPISSKYKPKNTSGTNSNP

SEQ ID NO: 2266886 - protein, 14 aa, Cryptosporidium parvum
KRPKDGLPSRAPTK

SEQ ID NO: 2266887 - protein, 5 aa, Cryptosporidium parvum
KRPKK

SEQ ID NO: 2266888 - protein, 7 aa, Cryptosporidium parvum
KRPKSGE

SEQ ID NO: 2266889 - protein, 6 aa, Cryptosporidium parvum
KRPNNL

SEQ ID NO: 2266890 - protein, 7 aa, Cryptosporidium parvum
KRPPAYP

SEQ ID NO: 2266891 - protein, 11 aa, Cryptosporidium parvum
KRPPPNRSPAI

SEQ ID NO: 2266892 - protein, 11 aa, Cryptosporidium parvum
KRPPPPPPGVS

SEQ ID NO: 2266893 - protein, 12 aa, Cryptosporidium parvum
KRPYDNSSKGLD

SEQ ID NO: 2266894 - protein, 40 aa, Cryptosporidium parvum
KRQDRQERRKSSAYFSSNSSNSPPPDLNGSSSDNKSLSKR

SEQ ID NO: 2266895 - protein, 6 aa, Cryptosporidium parvum
KRQDYQ

SEQ ID NO: 2266896 - protein, 7 aa, Cryptosporidium parvum
KRQESPN

SEQ ID NO: 2266897 - protein, 5 aa, Cryptosporidium parvum
KRQKE

SEQ ID NO: 2266898 - protein, 12 aa, Cryptosporidium parvum
KRQKKYTESFIN

SEQ ID NO: 2266899 - protein, 6 aa, Cryptosporidium parvum
KRQLTN

SEQ ID NO: 2266900 - protein, 5 aa, Cryptosporidium parvum
KRQNF

SEQ ID NO: 2266901 - protein, 7 aa, Cryptosporidium parvum
KRQNRRL

SEQ ID NO: 2266902 - protein, 6 aa, Cryptosporidium parvum
KRQNSI

SEQ ID NO: 2266903 - protein, 9 aa, Cryptosporidium parvum
KRQPASNSC

SEQ ID NO: 2266904 - protein, 5 aa, Cryptosporidium parvum
KRQPL

SEQ ID NO: 2266905 - protein, 4 aa, Cryptosporidium parvum
KRQR

SEQ ID NO: 2266906 - protein, 6 aa, Cryptosporidium parvum
KRREKI

SEQ ID NO: 2266907 - protein, 5 aa, Cryptosporidium parvum
KRREL

SEQ ID NO: 2266908 - protein, 7 aa, Cryptosporidium parvum
KRRESIS

SEQ ID NO: 2266909 - protein, 8 aa, Cryptosporidium parvum
KRREYGDL

SEQ ID NO: 2266910 - protein, 14 aa, Cryptosporidium parvum
KRRGHAGKEIPIPA

SEQ ID NO: 2266911 - protein, 4 aa, Cryptosporidium parvum
KRRL

SEQ ID NO: 2266912 - protein, 23 aa, Cryptosporidium parvum
KRRLEEKQRASAKKRLNGEADYS

SEQ ID NO: 2266913 - protein, 6 aa, Cryptosporidium parvum
KRRNEE

SEQ ID NO: 2266914 - protein, 6 aa, Cryptosporidium parvum
KRRNLN

SEQ ID NO: 2266915 - protein, 7 aa, Cryptosporidium parvum
KRRPSFE

SEQ ID NO: 2266916 - protein, 6 aa, Cryptosporidium parvum
KRRQRS

SEQ ID NO: 2266917 - protein, 6 aa, Cryptosporidium parvum
KRRRNV

SEQ ID NO: 2266918 - protein, 11 aa, Cryptosporidium parvum
KRRRPGTVGND

SEQ ID NO: 2266919 - protein, 18 aa, Cryptosporidium parvum
KRRSGGNNNISSSSNASG

SEQ ID NO: 2266920 - protein, 11 aa, Cryptosporidium parvum
KRRSISSSSGL

SEQ ID NO: 2266921 - protein, 13 aa, Cryptosporidium parvum
KRRSKKIAKKVRF

SEQ ID NO: 2266922 - protein, 13 aa, Cryptosporidium parvum
KRRYRKDKPWDTD

SEQ ID NO: 2266923 - protein, 46 aa, Cryptosporidium parvum
KRSARNLSDSSSVSSSSIESIGKSDFTDLENSSQDDQTFEEKEAKR

SEQ ID NO: 2266924 - protein, 13 aa, Cryptosporidium parvum
KRSEKNPEVESSR

SEQ ID NO: 2266925 - protein, 7 aa, Cryptosporidium parvum
KRSGLTR

SEQ ID NO: 2266926 - protein, 12 aa, Cryptosporidium parvum
KRSGNSEESQSK

SEQ ID NO: 2266927 - protein, 15 aa, Cryptosporidium parvum
KRSGYKFKTSSNENK

SEQ ID NO: 2266928 - protein, 19 aa, Cryptosporidium parvum
KRSISQNSNSNENDITDDI

SEQ ID NO: 2266929 - protein, 6 aa, Cryptosporidium parvum
KRSKHE

SEQ ID NO: 2266930 - protein, 30 aa, Cryptosporidium parvum
KRSLGNHQEREAYSTKGAKDEGQSSGEMNR

SEQ ID NO: 2266931 - protein, 6 aa, Cryptosporidium parvum
KRSNCN

SEQ ID NO: 2266932 - protein, 10 aa, Cryptosporidium parvum
KRSNEQKREN

SEQ ID NO: 2266933 - protein, 10 aa, Cryptosporidium parvum
KRSNNKSTLN

SEQ ID NO: 2266934 - protein, 7 aa, Cryptosporidium parvum
KRSQDIS

SEQ ID NO: 2266935 - protein, 6 aa, Cryptosporidium parvum
KRSQNI

SEQ ID NO: 2266936 - protein, 23 aa, Cryptosporidium parvum
KRSRRADGKPNFDQEGDRAENDD

SEQ ID NO: 2266937 - protein, 10 aa, Cryptosporidium parvum
KRSRSITGNE

SEQ ID NO: 2266938 - protein, 4 aa, Cryptosporidium parvum
KRSS

SEQ ID NO: 2266939 - protein, 9 aa, Cryptosporidium parvum
KRSSNRRVT

SEQ ID NO: 2266940 - protein, 31 aa, Cryptosporidium parvum
KRSSNSDEDQNDENNTVLSTSSTQSRNQTQV

SEQ ID NO: 2266941 - protein, 14 aa, Cryptosporidium parvum
KRSSTRDRPRSSSL

SEQ ID NO: 2266942 - protein, 6 aa, Cryptosporidium parvum
KRSTSK

SEQ ID NO: 2266943 - protein, 8 aa, Cryptosporidium parvum
KRSVNSGF

SEQ ID NO: 2266944 - protein, 13 aa, Cryptosporidium parvum
KRSYEQKKNETLK

SEQ ID NO: 2266945 - protein, 7 aa, Cryptosporidium parvum
KRTGMPK

SEQ ID NO: 2266946 - protein, 19 aa, Cryptosporidium parvum
KRTGTRCSSYHQDSSCNSK

SEQ ID NO: 2266947 - protein, 10 aa, Cryptosporidium parvum
KRTKSSSKTE

SEQ ID NO: 2266948 - protein, 6 aa, Cryptosporidium parvum
KRTNEV

SEQ ID NO: 2266949 - protein, 13 aa, Cryptosporidium parvum
KRTPKNKGNEEIN

SEQ ID NO: 2266950 - protein, 5 aa, Cryptosporidium parvum
KRTRS

SEQ ID NO: 2266951 - protein, 20 aa, Cryptosporidium parvum
KRTSALKAEKKSEPRDENKV

SEQ ID NO: 2266952 - protein, 12 aa, Cryptosporidium parvum
KRTSKDDDNSIR

SEQ ID NO: 2266953 - protein, 20 aa, Cryptosporidium parvum
KRTTSTQNAEEQQDQAINSA

SEQ ID NO: 2266954 - protein, 13 aa, Cryptosporidium parvum
KRVETTDPETNEK

SEQ ID NO: 2266955 - protein, 4 aa, Cryptosporidium parvum
KRVK

SEQ ID NO: 2266956 - protein, 10 aa, Cryptosporidium parvum
KRVNKRKTIK

SEQ ID NO: 2266957 - protein, 9 aa, Cryptosporidium parvum
KRVQKSAED

SEQ ID NO: 2266958 - protein, 9 aa, Cryptosporidium parvum
KRVSQHKKK

SEQ ID NO: 2266959 - protein, 6 aa, Cryptosporidium parvum
KRYNDK

SEQ ID NO: 2266960 - protein, 6 aa, Cryptosporidium parvum
KRYPKY

SEQ ID NO: 2266961 - protein, 6 aa, Cryptosporidium parvum
KRYQDK

SEQ ID NO: 2266962 - protein, 4 aa, Cryptosporidium parvum
KRYS

SEQ ID NO: 2266963 - protein, 44 aa, Cryptosporidium parvum; identical to SEQ ID NO: 2149285

SEQ ID NO: 2266964 - protein, 9 aa, Cryptosporidium parvum
KSAAEEELQ

SEQ ID NO: 2266965 - protein, 5 aa, Cryptosporidium parvum
KSADA

SEQ ID NO: 2266966 - protein, 4 aa, Cryptosporidium parvum
KSAH

SEQ ID NO: 2266967 - protein, 14 aa, Cryptosporidium parvum
KSALSNFADEKSYY

SEQ ID NO: 2266968 - protein, 4 aa, Cryptosporidium parvum
KSAN

SEQ ID NO: 2266969 - protein, 8 aa, Cryptosporidium parvum
KSANNELP

SEQ ID NO: 2266970 - protein, 8 aa, Cryptosporidium parvum
KSANNQTL

SEQ ID NO: 2266971 - protein, 13 aa, Cryptosporidium parvum
KSANQSKSKDMNS

SEQ ID NO: 2266972 - protein, 10 aa, Cryptosporidium parvum
KSANSLEGVP

SEQ ID NO: 2266973 - protein, 7 aa, Cryptosporidium parvum
KSASQPE

SEQ ID NO: 2266974 - protein, 9 aa, Cryptosporidium parvum
KSASTGNHF

SEQ ID NO: 2266975 - protein, 5 aa, Cryptosporidium parvum
KSATL

SEQ ID NO: 2266976 - protein, 6 aa, Cryptosporidium parvum
KSCEEH

SEQ ID NO: 2266977 - protein, 6 aa, Cryptosporidium parvum
KSCSKT

SEQ ID NO: 2266978 - protein, 7 aa, Cryptosporidium parvum
KSDALSN

SEQ ID NO: 2266979 - protein, 18 aa, Cryptosporidium parvum
KSDCNKESNSEIKTSNKK

SEQ ID NO: 2266980 - protein, 12 aa, Cryptosporidium parvum
KSDCNNRLSESD

SEQ ID NO: 2266981 - protein, 6 aa, Cryptosporidium parvum
KSDELQ

SEQ ID NO: 2266982 - protein, 11 aa, Cryptosporidium parvum
KSDGLKSDFKE

SEQ ID NO: 2266983 - protein, 10 aa, Cryptosporidium parvum
KSDIFSGSDS

SEQ ID NO: 2266984 - protein, 6 aa, Cryptosporidium parvum
KSDKAA

SEQ ID NO: 2266985 - protein, 7 aa, Cryptosporidium parvum
KSDKANF

SEQ ID NO: 2266986 - protein, 13 aa, Cryptosporidium parvum
KSDKQDDDFFSEM

SEQ ID NO: 2266987 - protein, 8 aa, Cryptosporidium parvum
KSDKSVAN

SEQ ID NO: 2266988 - protein, 15 aa, Cryptosporidium parvum
KSDLDRREVTTEEGV

SEQ ID NO: 2266989 - protein, 5 aa, Cryptosporidium parvum
KSDLK

SEQ ID NO: 2266990 - protein, 11 aa, Cryptosporidium parvum
KSDLKEDFPSE

SEQ ID NO: 2266991 - protein, 5 aa, Cryptosporidium parvum
KSDLR

SEQ ID NO: 2266992 - protein, 8 aa, Cryptosporidium parvum
KSDMKGSN

SEQ ID NO: 2266993 - protein, 8 aa, Cryptosporidium parvum
KSDNEEQY

SEQ ID NO: 2266994 - protein, 9 aa, Cryptosporidium parvum
KSDNGNYYS

SEQ ID NO: 2266995 - protein, 6 aa, Cryptosporidium parvum
KSDNMK

SEQ ID NO: 2266996 - protein, 17 aa, Cryptosporidium parvum
KSDPCSQEQYKPLNDEE

SEQ ID NO: 2266997 - protein, 7 aa, Cryptosporidium parvum
KSDPFGV

SEQ ID NO: 2266998 - protein, 6 aa, Cryptosporidium parvum
KSDPIY

SEQ ID NO: 2266999 - protein, 7 aa, Cryptosporidium parvum
KSDPRDV

SEQ ID NO: 2267000 - protein, 8 aa, Cryptosporidium parvum
KSDPRWPG

SEQ ID NO: 2267001 - protein, 6 aa, Cryptosporidium parvum
KSDQNE

SEQ ID NO: 2267002 - protein, 7 aa, Cryptosporidium parvum
KSDQQKC

SEQ ID NO: 2267003 - protein, 7 aa, Cryptosporidium parvum
KSDREYS

SEQ ID NO: 2267004 - protein, 7 aa, Cryptosporidium parvum
KSDRSVN

SEQ ID NO: 2267005 - protein, 14 aa, Cryptosporidium parvum
KSDSDGIGNHPNSY

SEQ ID NO: 2267006 - protein, 8 aa, Cryptosporidium parvum
KSDSINGD

SEQ ID NO: 2267007 - protein, 11 aa, Cryptosporidium parvum
KSDSQPSSATL

SEQ ID NO: 2267008 - protein, 8 aa, Cryptosporidium parvum
KSDTASIE

SEQ ID NO: 2267009 - protein, 8 aa, Cryptosporidium parvum
KSDYTGEQ

SEQ ID NO: 2267010 - protein, 9 aa, Cryptosporidium parvum
KSEAAAKKL

SEQ ID NO: 2267011 - protein, 7 aa, Cryptosporidium parvum
KSEAEIR

SEQ ID NO: 2267012 - protein, 20 aa, Cryptosporidium parvum
KSEDDSNQNIDENNKIKPVT

SEQ ID NO: 2267013 - protein, 9 aa, Cryptosporidium parvum
KSEDNYKYD

SEQ ID NO: 2267014 - protein, 6 aa, Cryptosporidium parvum
KSEDSL

SEQ ID NO: 2267015 - protein, 7 aa, Cryptosporidium parvum
KSEEFDD

SEQ ID NO: 2267016 - protein, 9 aa, Cryptosporidium parvum
KSEEREGIS

SEQ ID NO: 2267017 - protein, 7 aa, Cryptosporidium parvum
KSEESKK

SEQ ID NO: 2267018 - protein, 15 aa, Cryptosporidium parvum
KSEEVGSCEKGMDKD

SEQ ID NO: 2267019 - protein, 13 aa, Cryptosporidium parvum
KSEFEQNPINTSN

SEQ ID NO: 2267020 - protein, 8 aa, Cryptosporidium parvum
KSEFSSEL

SEQ ID NO: 2267021 - protein, 7 aa, Cryptosporidium parvum
KSEGLDK

SEQ ID NO: 2267022 - protein, 7 aa, Cryptosporidium parvum
KSEGMTS

SEQ ID NO: 2267023 - protein, 7 aa, Cryptosporidium parvum
KSEGTME

SEQ ID NO: 2267024 - protein, 12 aa, Cryptosporidium parvum
KSEIEESQISSS

SEQ ID NO: 2267025 - protein, 7 aa, Cryptosporidium parvum
KSEINSR

SEQ ID NO: 2267026 - protein, 12 aa, Cryptosporidium parvum
KSEKSQGKQTEI

SEQ ID NO: 2267027 - protein, 17 aa, Cryptosporidium parvum
KSEKSYLNSSKLKKESI

SEQ ID NO: 2267028 - protein, 8 aa, Cryptosporidium parvum
KSELGNGN

SEQ ID NO: 2267029 - protein, 7 aa, Cryptosporidium parvum
KSELKGL

SEQ ID NO: 2267030 - protein, 36 aa, Cryptosporidium parvum
KSELKSSSAGIRGNGNSEVSAQSQISNAIKKGSSRI

SEQ ID NO: 2267031 - protein, 10 aa, Cryptosporidium parvum
KSELNPNSEI

SEQ ID NO: 2267032 - protein, 6 aa, Cryptosporidium parvum
KSELSD

SEQ ID NO: 2267033 - protein, 6 aa, Cryptosporidium parvum
KSENKN

SEQ ID NO: 2267034 - protein, 7 aa, Cryptosporidium parvum
KSENPSE

SEQ ID NO: 2267035 - protein, 16 aa, Cryptosporidium parvum
KSENRELMEQLSSSSN

SEQ ID NO: 2267036 - protein, 6 aa, Cryptosporidium parvum
KSEPEA

SEQ ID NO: 2267037 - protein, 9 aa, Cryptosporidium parvum
KSEQNSPKL

SEQ ID NO: 2267038 - protein, 6 aa, Cryptosporidium parvum
KSEQNW

SEQ ID NO: 2267039 - protein, 21 aa, Cryptosporidium parvum
KSERNENNSPKQGNNCQSPQN

SEQ ID NO: 2267040 - protein, 9 aa, Cryptosporidium parvum
KSESDVGSK

SEQ ID NO: 2267041 - protein, 13 aa, Cryptosporidium parvum
KSESELHSQEESK

SEQ ID NO: 2267042 - protein, 24 aa, Cryptosporidium parvum
KSESETESKSETDSESESEPESEF

SEQ ID NO: 2267043 - protein, 8 aa, Cryptosporidium parvum
KSESPNMA

SEQ ID NO: 2267044 - protein, 7 aa, Cryptosporidium parvum
KSESQGY

SEQ ID NO: 2267045 - protein, 6 aa, Cryptosporidium parvum
KSETAV

SEQ ID NO: 2267046 - protein, 9 aa, Cryptosporidium parvum
KSETDKVNT

SEQ ID NO: 2267047 - protein, 5 aa, Cryptosporidium parvum
KSETK

SEQ ID NO: 2267048 - protein, 22 aa, Cryptosporidium parvum
KSETKEKDSLETNKRQALEPEA

SEQ ID NO: 2267049 - protein, 6 aa, Cryptosporidium parvum
KSETVK

SEQ ID NO: 2267050 - protein, 20 aa, Cryptosporidium parvum
KSETYNSNKTIRSSPYESLQ

SEQ ID NO: 2267051 - protein, 16 aa, Cryptosporidium parvum
KSEYYDEYSTQNIRDD

SEQ ID NO: 2267052 - protein, 7 aa, Cryptosporidium parvum
KSFEDGS

SEQ ID NO: 2267053 - protein, 6 aa, Cryptosporidium parvum
KSFESD

SEQ ID NO: 2267054 - protein, 6 aa, Cryptosporidium parvum
KSFESN

SEQ ID NO: 2267055 - protein, 4 aa, Cryptosporidium parvum
KSFG

SEQ ID NO: 2267056 - protein, 18 aa, Cryptosporidium parvum
KSFGNELNSSNSPLNTTV

SEQ ID NO: 2267057 - protein, 7 aa, Cryptosporidium parvum
KSFHTTP

SEQ ID NO: 2267058 - protein, 7 aa, Cryptosporidium parvum
KSFNPTI

SEQ ID NO: 2267059 - protein, 7 aa, Cryptosporidium parvum
KSFNSDN

SEQ ID NO: 2267060 - protein, 6 aa, Cryptosporidium parvum
KSFQNK

SEQ ID NO: 2267061 - protein, 7 aa, Cryptosporidium parvum
KSFSNLR

SEQ ID NO: 2267062 - protein, 5 aa, Cryptosporidium parvum
KSFSR

SEQ ID NO: 2267063 - protein, 9 aa, Cryptosporidium parvum
KSFSSTNDV

SEQ ID NO: 2267064 - protein, 7 aa, Cryptosporidium parvum
KSFTDRD

SEQ ID NO: 2267065 - protein, 34 aa, Cryptosporidium parvum; identical to SEQ ID NO: 2149368

SEQ ID NO: 2267066 - protein, 4 aa, Cryptosporidium parvum
KSFY

SEQ ID NO: 2267067 - protein, 8 aa, Cryptosporidium parvum
KSGANQIN

SEQ ID NO: 2267068 - protein, 7 aa, Cryptosporidium parvum
KSGDRLQ

SEQ ID NO: 2267069 - protein, 4 aa, Cryptosporidium parvum
KSGE

SEQ ID NO: 2267070 - protein, 6 aa, Cryptosporidium parvum
KSGEIE

SEQ ID NO: 2267071 - protein, 9 aa, Cryptosporidium parvum
KSGESTNAD

SEQ ID NO: 2267072 - protein, 6 aa, Cryptosporidium parvum
KSGFGG

SEQ ID NO: 2267073 - protein, 10 aa, Cryptosporidium parvum
KSGGRREKDE

SEQ ID NO: 2267074 - protein, 7 aa, Cryptosporidium parvum
KSGGSDM

SEQ ID NO: 2267075 - protein, 8 aa, Cryptosporidium parvum
KSGGSEEV

SEQ ID NO: 2267076 - protein, 6 aa, Cryptosporidium parvum
KSGHKQ

SEQ ID NO: 2267077 - protein, 6 aa, Cryptosporidium parvum
KSGIGR

SEQ ID NO: 2267078 - protein, 5 aa, Cryptosporidium parvum
KSGIM

SEQ ID NO: 2267079 - protein, 7 aa, Cryptosporidium parvum
KSGIPAN

SEQ ID NO: 2267080 - protein, 7 aa, Cryptosporidium parvum
KSGKHSK

SEQ ID NO: 2267081 - protein, 7 aa, Cryptosporidium parvum
KSGKLPK

SEQ ID NO: 2267082 - protein, 9 aa, Cryptosporidium parvum
KSGKSDLAE

SEQ ID NO: 2267083 - protein, 8 aa, Cryptosporidium parvum
KSGKSDQE

SEQ ID NO: 2267084 - protein, 7 aa, Cryptosporidium parvum
KSGKVDW

SEQ ID NO: 2267085 - protein, 9 aa, Cryptosporidium parvum
KSGLGSKSL

SEQ ID NO: 2267086 - protein, 8 aa, Cryptosporidium parvum
KSGLRDAA

SEQ ID NO: 2267087 - protein, 6 aa, Cryptosporidium parvum
KSGLSL

SEQ ID NO: 2267088 - protein, 6 aa, Cryptosporidium parvum
KSGMGK

SEQ ID NO: 2267089 - protein, 8 aa, Cryptosporidium parvum
KSGNAKSL

SEQ ID NO: 2267090 - protein, 8 aa, Cryptosporidium parvum
KSGNCSNG

SEQ ID NO: 2267091 - protein, 6 aa, Cryptosporidium parvum
KSGNKY

SEQ ID NO: 2267092 - protein, 9 aa, Cryptosporidium parvum
KSGNNKGKR

SEQ ID NO: 2267093 - protein, 6 aa, Cryptosporidium parvum
KSGNNY

SEQ ID NO: 2267094 - protein, 15 aa, Cryptosporidium parvum
KSGNVTTSTKGIENS

SEQ ID NO: 2267095 - protein, 7 aa, Cryptosporidium parvum
KSGQASI

SEQ ID NO: 2267096 - protein, 76 aa, Cryptosporidium parvum
KSGQEKDDSESKITDQSSHKDSSSNSINTENDSKLKQELENPQVKKQPYGRASGGNTGNKTTSTSNGSQSKPSTSV

SEQ ID NO: 2267097 - protein, 33 aa, Cryptosporidium parvum
KSGQENISGSTQLDSENGVPLEGKKKNRRATDT

SEQ ID NO: 2267098 - protein, 7 aa, Cryptosporidium parvum
KSGRAEL

SEQ ID NO: 2267099 - protein, 10 aa, Cryptosporidium parvum
KSGSDSDDGL

SEQ ID NO: 2267100 - protein, 37 aa, Cryptosporidium parvum
KSGSESNKNTQISKETFSSKGSKLNWGSNSSTDQIQK

SEQ ID NO: 2267101 - protein, 7 aa, Cryptosporidium parvum
KSGSIAR

SEQ ID NO: 2267102 - protein, 13 aa, Cryptosporidium parvum
KSGSNSKDEEKEL

SEQ ID NO: 2267103 - protein, 14 aa, Cryptosporidium parvum
KSGSSRYDQENETK

SEQ ID NO: 2267104 - protein, 14 aa, Cryptosporidium parvum
KSGTVSVGTPTWKN

SEQ ID NO: 2267105 - protein, 6 aa, Cryptosporidium parvum
KSGTWY

SEQ ID NO: 2267106 - protein, 8 aa, Cryptosporidium parvum
KSGVHGAS

SEQ ID NO: 2267107 - protein, 11 aa, Cryptosporidium parvum
KSGVQSNSSIY

SEQ ID NO: 2267108 - protein, 5 aa, Cryptosporidium parvum
KSHAQ

SEQ ID NO: 2267109 - protein, 9 aa, Cryptosporidium parvum
KSHDPEKIK

SEQ ID NO: 2267110 - protein, 7 aa, Cryptosporidium parvum
KSHDSNG

SEQ ID NO: 2267111 - protein, 18 aa, Cryptosporidium parvum
KSHESQKISRKSKIKSKI

SEQ ID NO: 2267112 - protein, 30 aa, Cryptosporidium parvum
KSHNDKANTNTGSTINTCTNSDTSNFSNHT

SEQ ID NO: 2267113 - protein, 9 aa, Cryptosporidium parvum
KSHRPNSLA

SEQ ID NO: 2267114 - protein, 10 aa, Cryptosporidium parvum
KSHSESESVS

SEQ ID NO: 2267115 - protein, 7 aa, Cryptosporidium parvum
KSHSKGV

SEQ ID NO: 2267116 - protein, 10 aa, Cryptosporidium parvum
KSHSNQAYEK

SEQ ID NO: 2267117 - protein, 66 aa, Cryptosporidium parvum
KSIDANSGKEDKDLGNKSSEQHDSSLSGGKPKRLSDGSARITKTTNKNKSSTSNSKSGIGSNNPDD

SEQ ID NO: 2267118 - protein, 6 aa, Cryptosporidium parvum
KSIDNK

SEQ ID NO: 2267119 - protein, 6 aa, Cryptosporidium parvum
KSIEAE

SEQ ID NO: 2267120 - protein, 22 aa, Cryptosporidium parvum
KSIEANISKNQDETKANATPIL

SEQ ID NO: 2267121 - protein, 24 aa, Cryptosporidium parvum
KSIEKERCYQSENEYLKQNNQKCE

SEQ ID NO: 2267122 - protein, 6 aa, Cryptosporidium parvum
KSIEKG

SEQ ID NO: 2267123 - protein, 5 aa, Cryptosporidium parvum
KSIES

SEQ ID NO: 2267124 - protein, 4 aa, Cryptosporidium parvum
KSIF

SEQ ID NO: 2267125 - protein, 12 aa, Cryptosporidium parvum
KSIGDSSIPARN

SEQ ID NO: 2267126 - protein, 7 aa, Cryptosporidium parvum
KSIGGPG

SEQ ID NO: 2267127 - protein, 7 aa, Cryptosporidium parvum
KSIGREK

SEQ ID NO: 2267128 - protein, 5 aa, Cryptosporidium parvum
KSIGV

SEQ ID NO: 2267129 - protein, 4 aa, Cryptosporidium parvum
KSIK

SEQ ID NO: 2267130 - protein, 21 aa, Cryptosporidium parvum
KSIKQKSETALAAKALSGHNQ

SEQ ID NO: 2267131 - protein, 64 aa, Cryptosporidium parvum
KSIKSQMNDIKESTPLISNQTKPNKRSSITRENQESKNNKRNKSRKLESENSDELNTKPSTNEV

SEQ ID NO: 2267132 - protein, 8 aa, Cryptosporidium parvum
KSIKSSDC

SEQ ID NO: 2267133 - protein, 11 aa, Cryptosporidium parvum
KSINESEERDI

SEQ ID NO: 2267134 - protein, 11 aa, Cryptosporidium parvum
KSINSSKTSSI

SEQ ID NO: 2267135 - protein, 23 aa, Cryptosporidium parvum
KSINTEQNGQFTNEDSEDQNQNL

SEQ ID NO: 2267136 - protein, 20 aa, Cryptosporidium parvum
KSIPKNRDFDEESQRIQQTS

SEQ ID NO: 2267137 - protein, 12 aa, Cryptosporidium parvum
KSIPTGKSVNSL

SEQ ID NO: 2267138 - protein, 7 aa, Cryptosporidium parvum
KSIQKNL

SEQ ID NO: 2267139 - protein, 12 aa, Cryptosporidium parvum
KSIQSSSSCDNT

SEQ ID NO: 2267140 - protein, 6 aa, Cryptosporidium parvum
KSIQTH

SEQ ID NO: 2267141 - protein, 7 aa, Cryptosporidium parvum
KSIRNGT

SEQ ID NO: 2267142 - protein, 12 aa, Cryptosporidium parvum
KSISDENGHINQ

SEQ ID NO: 2267143 - protein, 11 aa, Cryptosporidium parvum
KSISNKHPSIS

SEQ ID NO: 2267144 - protein, 10 aa, Cryptosporidium parvum
KSISNSASDR

SEQ ID NO: 2267145 - protein, 5 aa, Cryptosporidium parvum
KSISV

SEQ ID NO: 2267146 - protein, 4 aa, Cryptosporidium parvum
KSKA

SEQ ID NO: 2267147 - protein, 10 aa, Cryptosporidium parvum
KSKAECPMGE

SEQ ID NO: 2267148 - protein, 6 aa, Cryptosporidium parvum
KSKAIQ

SEQ ID NO: 2267149 - protein, 16 aa, Cryptosporidium parvum
KSKALGRQTKETKKRT

SEQ ID NO: 2267150 - protein, 7 aa, Cryptosporidium parvum
KSKDSVN

SEQ ID NO: 2267151 - protein, 8 aa, Cryptosporidium parvum
KSKEEDKI

SEQ ID NO: 2267152 - protein, 10 aa, Cryptosporidium parvum
KSKEKGPKSL

SEQ ID NO: 2267153 - protein, 8 aa, Cryptosporidium parvum
KSKEKLKS

SEQ ID NO: 2267154 - protein, 6 aa, Cryptosporidium parvum
KSKENV

SEQ ID NO: 2267155 - protein, 10 aa, Cryptosporidium parvum
KSKERPVGSI

SEQ ID NO: 2267156 - protein, 191 aa, Cryptosporidium parvum
KSKFENGGVKTASKAKTKTKSEPKPKTEATSKTAKTKAKTEPKSTSKPVAKVKTTNSKTKAKTEPKTESKTKPKTSSSSSKAKTESNSIKTTSKAKTKVDSKTKATISKTKTKTEPKTKSKTEPKIEPKIKPKSSSTKSKAEPKTTKAASKTKAKTMTTTKTTKTKTTAKSKNDTSKSTTSCKKTTRCKTK

SEQ ID NO: 2267157 - protein, 12 aa, Cryptosporidium parvum
KSKFESGDNEMA

SEQ ID NO: 2267158 - protein, 9 aa, Cryptosporidium parvum
KSKGAKQGY

SEQ ID NO: 2267159 - protein, 9 aa, Cryptosporidium parvum
KSKGNTPKY

SEQ ID NO: 2267160 - protein, 10 aa, Cryptosporidium parvum
KSKGSEAKAI

SEQ ID NO: 2267161 - protein, 8 aa, Cryptosporidium parvum
KSKIGEQE

SEQ ID NO: 2267162 - protein, 6 aa, Cryptosporidium parvum
KSKIPE

SEQ ID NO: 2267163 - protein, 5 aa, Cryptosporidium parvum
KSKKA

SEQ ID NO: 2267164 - protein, 10 aa, Cryptosporidium parvum
KSKKDEDQQF

SEQ ID NO: 2267165 - protein, 17 aa, Cryptosporidium parvum
KSKKEKDLTRESAKKDL

SEQ ID NO: 2267166 - protein, 6 aa, Cryptosporidium parvum
KSKKEL

SEQ ID NO: 2267167 - protein, 6 aa, Cryptosporidium parvum
KSKKIN

SEQ ID NO: 2267168 - protein, 8 aa, Cryptosporidium parvum
KSKKLKDP

SEQ ID NO: 2267169 - protein, 7 aa, Cryptosporidium parvum
KSKKSVE

SEQ ID NO: 2267170 - protein, 6 aa, Cryptosporidium parvum
KSKKYT

SEQ ID NO: 2267171 - protein, 31 aa, Cryptosporidium parvum
KSKLDDSDSKYVGNEDEKDIEKEEEEGKERN

SEQ ID NO: 2267172 - protein, 19 aa, Cryptosporidium parvum
KSKLEDNNTRTLTDSTNRS

SEQ ID NO: 2267173 - protein, 13 aa, Cryptosporidium parvum
KSKLENEKGLEAA

SEQ ID NO: 2267174 - protein, 6 aa, Cryptosporidium parvum
KSKLPD

SEQ ID NO: 2267175 - protein, 8 aa, Cryptosporidium parvum
KSKMNKGE

SEQ ID NO: 2267176 - protein, 8 aa, Cryptosporidium parvum
KSKNFSSH

SEQ ID NO: 2267177 - protein, 10 aa, Cryptosporidium parvum
KSKNGKRLNK

SEQ ID NO: 2267178 - protein, 6 aa, Cryptosporidium parvum
KSKNLK

SEQ ID NO: 2267179 - protein, 8 aa, Cryptosporidium parvum
KSKNNSNQ

SEQ ID NO: 2267180 - protein, 6 aa, Cryptosporidium parvum
KSKNPL

SEQ ID NO: 2267181 - protein, 8 aa, Cryptosporidium parvum
KSKNPRKM

SEQ ID NO: 2267182 - protein, 16 aa, Cryptosporidium parvum
KSKNSEIGSDDEEEEA

SEQ ID NO: 2267183 - protein, 8 aa, Cryptosporidium parvum
KSKPALGV

SEQ ID NO: 2267184 - protein, 16 aa, Cryptosporidium parvum
KSKPEKCTSSEFQNER

SEQ ID NO: 2267185 - protein, 9 aa, Cryptosporidium parvum
KSKPPVPLY

SEQ ID NO: 2267186 - protein, 13 aa, Cryptosporidium parvum
KSKPTPADKPYRV

SEQ ID NO: 2267187 - protein, 6 aa, Cryptosporidium parvum
KSKQDA

SEQ ID NO: 2267188 - protein, 9 aa, Cryptosporidium parvum
KSKQNNNKN

SEQ ID NO: 2267189 - protein, 8 aa, Cryptosporidium parvum
KSKRFKND

SEQ ID NO: 2267190 - protein, 7 aa, Cryptosporidium parvum
KSKRGVS

SEQ ID NO: 2267191 - protein, 15 aa, Cryptosporidium parvum
KSKRISVSNQNGSNL

SEQ ID NO: 2267192 - protein, 21 aa, Cryptosporidium parvum
KSKRSIRAPEDPNKPKRPHTA

SEQ ID NO: 2267193 - protein, 16 aa, Cryptosporidium parvum
KSKRSNQKYSSSCNDK

SEQ ID NO: 2267194 - protein, 11 aa, Cryptosporidium parvum
KSKSDKLSSSN

SEQ ID NO: 2267195 - protein, 13 aa, Cryptosporidium parvum
KSKSDSEDDLETD

SEQ ID NO: 2267196 - protein, 7 aa, Cryptosporidium parvum
KSKSDSY

SEQ ID NO: 2267197 - protein, 14 aa, Cryptosporidium parvum
KSKSGGSIKSPRDI

SEQ ID NO: 2267198 - protein, 14 aa, Cryptosporidium parvum
KSKSIVPSKGTDIE

SEQ ID NO: 2267199 - protein, 9 aa, Cryptosporidium parvum
KSKSKLSSI

SEQ ID NO: 2267200 - protein, 6 aa, Cryptosporidium parvum
KSKSKW

SEQ ID NO: 2267201 - protein, 9 aa, Cryptosporidium parvum
KSKSLKSSE

SEQ ID NO: 2267202 - protein, 7 aa, Cryptosporidium parvum
KSKSNGM

SEQ ID NO: 2267203 - protein, 8 aa, Cryptosporidium parvum
KSKSPSGV

SEQ ID NO: 2267204 - protein, 7 aa, Cryptosporidium parvum
KSKSQVL

SEQ ID NO: 2267205 - protein, 19 aa, Cryptosporidium parvum
KSKSRDAETSVEENLSPSA

SEQ ID NO: 2267206 - protein, 10 aa, Cryptosporidium parvum
KSKSSRNEEL

SEQ ID NO: 2267207 - protein, 5 aa, Cryptosporidium parvum
KSKSY

SEQ ID NO: 2267208 - protein, 11 aa, Cryptosporidium parvum
KSKTGCDGDGM

SEQ ID NO: 2267209 - protein, 12 aa, Cryptosporidium parvum
KSKTGDSSGMNG

SEQ ID NO: 2267210 - protein, 16 aa, Cryptosporidium parvum
KSKTGQYEGKLPNAIQ

SEQ ID NO: 2267211 - protein, 5 aa, Cryptosporidium parvum
KSKTI

SEQ ID NO: 2267212 - protein, 6 aa, Cryptosporidium parvum
KSKTQG

SEQ ID NO: 2267213 - protein, 15 aa, Cryptosporidium parvum
KSKTWRKNRRKQMQI

SEQ ID NO: 2267214 - protein, 4 aa, Cryptosporidium parvum
KSKV

SEQ ID NO: 2267215 - protein, 20 aa, Cryptosporidium parvum
KSKYDDDDDNNNNNNNNNMQ

SEQ ID NO: 2267216 - protein, 7 aa, Cryptosporidium parvum
KSKYEKL

SEQ ID NO: 2267217 - protein, 7 aa, Cryptosporidium parvum
KSKYTNL

SEQ ID NO: 2267218 - protein, 27 aa, Cryptosporidium parvum
KSLASITSTSSSNSNNSINNKSKQDDI

SEQ ID NO: 2267219 - protein, 6 aa, Cryptosporidium parvum
KSLDDM

SEQ ID NO: 2267220 - protein, 6 aa, Cryptosporidium parvum
KSLDEK

SEQ ID NO: 2267221 - protein, 7 aa, Cryptosporidium parvum
KSLDEQQ

SEQ ID NO: 2267222 - protein, 6 aa, Cryptosporidium parvum
KSLEES

SEQ ID NO: 2267223 - protein, 13 aa, Cryptosporidium parvum
KSLEGSRARYEQS

SEQ ID NO: 2267224 - protein, 10 aa, Cryptosporidium parvum
KSLENERKQI

SEQ ID NO: 2267225 - protein, 8 aa, Cryptosporidium parvum
KSLESTNG

SEQ ID NO: 2267226 - protein, 7 aa, Cryptosporidium parvum
KSLESVK

SEQ ID NO: 2267227 - protein, 30 aa, Cryptosporidium parvum
KSLESYNKKKSSSSYDKVPESVKKLNDEKI

SEQ ID NO: 2267228 - protein, 5 aa, Cryptosporidium parvum
KSLGD

SEQ ID NO: 2267229 - protein, 10 aa, Cryptosporidium parvum
KSLGKHSKDS

SEQ ID NO: 2267230 - protein, 13 aa, Cryptosporidium parvum
KSLKDSKNQTKIL

SEQ ID NO: 2267231 - protein, 5 aa, Cryptosporidium parvum
KSLKE

SEQ ID NO: 2267232 - protein, 7 aa, Cryptosporidium parvum
KSLKSGA

SEQ ID NO: 2267233 - protein, 14 aa, Cryptosporidium parvum
KSLNGNFEDQNRET

SEQ ID NO: 2267234 - protein, 38 aa, Cryptosporidium parvum
KSLNITKPNENKDNFELKSKSDIQAKSSGIVKTSSKIS

SEQ ID NO: 2267235 - protein, 5 aa, Cryptosporidium parvum
KSLNP

SEQ ID NO: 2267236 - protein, 11 aa, Cryptosporidium parvum
KSLNPKKTIEL

SEQ ID NO: 2267237 - protein, 8 aa, Cryptosporidium parvum
KSLNSNQH

SEQ ID NO: 2267238 - protein, 6 aa, Cryptosporidium parvum
KSLNSS

SEQ ID NO: 2267239 - protein, 6 aa, Cryptosporidium parvum
KSLNST

SEQ ID NO: 2267240 - protein, 8 aa, Cryptosporidium parvum
KSLPADIQ

SEQ ID NO: 2267241 - protein, 6 aa, Cryptosporidium parvum
KSLPDT

SEQ ID NO: 2267242 - protein, 13 aa, Cryptosporidium parvum
KSLPKSRRKETEM

SEQ ID NO: 2267243 - protein, 5 aa, Cryptosporidium parvum
KSLPN

SEQ ID NO: 2267244 - protein, 34 aa, Cryptosporidium parvum
KSLPNLNKSRKGSYSLTDDSDDESEGGKKGKNTI

SEQ ID NO: 2267245 - protein, 7 aa, Cryptosporidium parvum
KSLPPDL

SEQ ID NO: 2267246 - protein, 7 aa, Cryptosporidium parvum
KSLQGIK

SEQ ID NO: 2267247 - protein, 5 aa, Cryptosporidium parvum
KSLSG

SEQ ID NO: 2267248 - protein, 6 aa, Cryptosporidium parvum
KSLSGT

SEQ ID NO: 2267249 - protein, 10 aa, Cryptosporidium parvum
KSLSNNNEDF

SEQ ID NO: 2267250 - protein, 6 aa, Cryptosporidium parvum
KSLSRQ

SEQ ID NO: 2267251 - protein, 14 aa, Cryptosporidium parvum
KSLSSSNNWNPQKK

SEQ ID NO: 2267252 - protein, 27 aa, Cryptosporidium parvum
KSLSTSASDCTKISKASVNNNNKNRNS

SEQ ID NO: 2267253 - protein, 5 aa, Cryptosporidium parvum
KSLTN

SEQ ID NO: 2267254 - protein, 12 aa, Cryptosporidium parvum
KSLTPLSSNHSE

SEQ ID NO: 2267255 - protein, 6 aa, Cryptosporidium parvum
KSMTSS

SEQ ID NO: 2267256 - protein, 6 aa, Cryptosporidium parvum
KSNDEI

SEQ ID NO: 2267257 - protein, 10 aa, Cryptosporidium parvum
KSNDKSSQNI

SEQ ID NO: 2267258 - protein, 40 aa, Cryptosporidium parvum
KSNDNNNESNERISGKYEGDNGNYDNSNLTSGDYSNSKVK

SEQ ID NO: 2267259 - protein, 5 aa, Cryptosporidium parvum
KSNEH

SEQ ID NO: 2267260 - protein, 6 aa, Cryptosporidium parvum
KSNELG

SEQ ID NO: 2267261 - protein, 10 aa, Cryptosporidium parvum
KSNENKPSIG

SEQ ID NO: 2267262 - protein, 15 aa, Cryptosporidium parvum
KSNENPFLIFALLAD

SEQ ID NO: 2267263 - protein, 9 aa, Cryptosporidium parvum
KSNERENQI

SEQ ID NO: 2267264 - protein, 23 aa, Cryptosporidium parvum
KSNESENNQNIKGINPNSTSSSN

SEQ ID NO: 2267265 - protein, 23 aa, Cryptosporidium parvum
KSNETNRSGRISNSGAGYSSGSK

SEQ ID NO: 2267266 - protein, 5 aa, Cryptosporidium parvum
KSNFE

SEQ ID NO: 2267267 - protein, 7 aa, Cryptosporidium parvum
KSNGKYI

SEQ ID NO: 2267268 - protein, 8 aa, Cryptosporidium parvum
KSNGLSST

SEQ ID NO: 2267269 - protein, 29 aa, Cryptosporidium parvum
KSNGNAITSSTNITGSTYGRYGGSNRING

SEQ ID NO: 2267270 - protein, 11 aa, Cryptosporidium parvum
KSNGSKSSLRY

SEQ ID NO: 2267271 - protein, 8 aa, Cryptosporidium parvum
KSNGTTAT

SEQ ID NO: 2267272 - protein, 14 aa, Cryptosporidium parvum
KSNHDLKQGEEEEV

SEQ ID NO: 2267273 - protein, 7 aa, Cryptosporidium parvum
KSNHKDY

SEQ ID NO: 2267274 - protein, 5 aa, Cryptosporidium parvum
KSNIN

SEQ ID NO: 2267275 - protein, 7 aa, Cryptosporidium parvum
KSNINSQ

SEQ ID NO: 2267276 - protein, 5 aa, Cryptosporidium parvum
KSNIS

SEQ ID NO: 2267277 - protein, 10 aa, Cryptosporidium parvum
KSNKENKDSI

SEQ ID NO: 2267278 - protein, 9 aa, Cryptosporidium parvum
KSNKGIKQN

SEQ ID NO: 2267279 - protein, 21 aa, Cryptosporidium parvum
KSNKGKQKVNKSVKVAKSIKK

SEQ ID NO: 2267280 - protein, 13 aa, Cryptosporidium parvum
KSNKNNEETQSQE

SEQ ID NO: 2267281 - protein, 10 aa, Cryptosporidium parvum
KSNKSSSTNI

SEQ ID NO: 2267282 - protein, 15 aa, Cryptosporidium parvum
KSNLAQQNSDKSITE

SEQ ID NO: 2267283 - protein, 22 aa, Cryptosporidium parvum
KSNLEERERVKNEGGTFDDEGY

SEQ ID NO: 2267284 - protein, 5 aa, Cryptosporidium parvum
KSNNH

SEQ ID NO: 2267285 - protein, 62 aa, Cryptosporidium parvum
KSNNNNNNNENKLNTGTKITNTGTKITNTGTKITNTGTSNNNNNTGVRKSSRSNNKNNSNNK

SEQ ID NO: 2267286 - protein, 19 aa, Cryptosporidium parvum
KSNNRDVSEAAEILLARVA

SEQ ID NO: 2267287 - protein, 7 aa, Cryptosporidium parvum
KSNNSFS

SEQ ID NO: 2267288 - protein, 10 aa, Cryptosporidium parvum
KSNNSNISTE

SEQ ID NO: 2267289 - protein, 10 aa, Cryptosporidium parvum
KSNNSRSGIP

SEQ ID NO: 2267290 - protein, 6 aa, Cryptosporidium parvum
KSNNTD

SEQ ID NO: 2267291 - protein, 17 aa, Cryptosporidium parvum
KSNNVTSKENYWVLKKR

SEQ ID NO: 2267292 - protein, 6 aa, Cryptosporidium parvum
KSNNYE

SEQ ID NO: 2267293 - protein, 13 aa, Cryptosporidium parvum
KSNPCGSNMQNQG

SEQ ID NO: 2267294 - protein, 6 aa, Cryptosporidium parvum
KSNPCL

SEQ ID NO: 2267295 - protein, 12 aa, Cryptosporidium parvum
KSNPGDITKPSD

SEQ ID NO: 2267296 - protein, 7 aa, Cryptosporidium parvum
KSNQEMM

SEQ ID NO: 2267297 - protein, 7 aa, Cryptosporidium parvum
KSNQERS

SEQ ID NO: 2267298 - protein, 6 aa, Cryptosporidium parvum
KSNQIE

SEQ ID NO: 2267299 - protein, 11 aa, Cryptosporidium parvum
KSNQKNQEGEI

SEQ ID NO: 2267300 - protein, 8 aa, Cryptosporidium parvum
KSNQNYTQ

SEQ ID NO: 2267301 - protein, 14 aa, Cryptosporidium parvum
KSNRDLHASESTEE

SEQ ID NO: 2267302 - protein, 42 aa, Cryptosporidium parvum
KSNRDVCSDKSKPRAENTNISKKVKSKVKRVSGNDQEKKSNA

SEQ ID NO: 2267303 - protein, 6 aa, Cryptosporidium parvum
KSNRNH

SEQ ID NO: 2267304 - protein, 8 aa, Cryptosporidium parvum
KSNRNSYG

SEQ ID NO: 2267305 - protein, 7 aa, Cryptosporidium parvum
KSNSFNN

SEQ ID NO: 2267306 - protein, 8 aa, Cryptosporidium parvum
KSNSFYKN

SEQ ID NO: 2267307 - protein, 13 aa, Cryptosporidium parvum
KSNSKQDSQNVNE

SEQ ID NO: 2267308 - protein, 25 aa, Cryptosporidium parvum
KSNSKSSINGKNNNSKESSNSESNL

SEQ ID NO: 2267309 - protein, 16 aa, Cryptosporidium parvum
KSNSKTYNVKNSLSNN

SEQ ID NO: 2267310 - protein, 20 aa, Cryptosporidium parvum
KSNSTFKTISDNNSQNASYD

SEQ ID NO: 2267311 - protein, 7 aa, Cryptosporidium parvum
KSNSTKR

SEQ ID NO: 2267312 - protein, 6 aa, Cryptosporidium parvum
KSNSVK

SEQ ID NO: 2267313 - protein, 9 aa, Cryptosporidium parvum
KSNTNSSLS

SEQ ID NO: 2267314 - protein, 9 aa, Cryptosporidium parvum
KSNTSNSFD

SEQ ID NO: 2267315 - protein, 6 aa, Cryptosporidium parvum
KSNYRN

SEQ ID NO: 2267316 - protein, 8 aa, Cryptosporidium parvum
KSPAQGQS

SEQ ID NO: 2267317 - protein, 7 aa, Cryptosporidium parvum
KSPASTI

SEQ ID NO: 2267318 - protein, 9 aa, Cryptosporidium parvum
KSPDEFNDQ

SEQ ID NO: 2267319 - protein, 7 aa, Cryptosporidium parvum
KSPEANF

SEQ ID NO: 2267320 - protein, 7 aa, Cryptosporidium parvum
KSPEEKY

SEQ ID NO: 2267321 - protein, 22 aa, Cryptosporidium parvum
KSPEKVDKSTPDFGAAGDGDCD

SEQ ID NO: 2267322 - protein, 13 aa, Cryptosporidium parvum
KSPEREAEDRDYL

SEQ ID NO: 2267323 - protein, 8 aa, Cryptosporidium parvum
KSPETYTS

SEQ ID NO: 2267324 - protein, 14 aa, Cryptosporidium parvum
KSPFNTDNKGHSDP

SEQ ID NO: 2267325 - protein, 5 aa, Cryptosporidium parvum
KSPIA

SEQ ID NO: 2267326 - protein, 5 aa, Cryptosporidium parvum
KSPIE

SEQ ID NO: 2267327 - protein, 4 aa, Cryptosporidium parvum
KSPK

SEQ ID NO: 2267328 - protein, 6 aa, Cryptosporidium parvum
KSPKDK

SEQ ID NO: 2267329 - protein, 7 aa, Cryptosporidium parvum
KSPKGLP

SEQ ID NO: 2267330 - protein, 8 aa, Cryptosporidium parvum
KSPKQRIT

SEQ ID NO: 2267331 - protein, 5 aa, Cryptosporidium parvum
KSPKR

SEQ ID NO: 2267332 - protein, 5 aa, Cryptosporidium parvum
KSPKT

SEQ ID NO: 2267333 - protein, 4 aa, Cryptosporidium parvum
KSPN

SEQ ID NO: 2267334 - protein, 8 aa, Cryptosporidium parvum
KSPNGNGG

SEQ ID NO: 2267335 - protein, 6 aa, Cryptosporidium parvum
KSPNIE

SEQ ID NO: 2267336 - protein, 8 aa, Cryptosporidium parvum
KSPNKKDK

SEQ ID NO: 2267337 - protein, 8 aa, Cryptosporidium parvum
KSPPMTPS

SEQ ID NO: 2267338 - protein, 7 aa, Cryptosporidium parvum
KSPQGVG

SEQ ID NO: 2267339 - protein, 6 aa, Cryptosporidium parvum
KSPSFS

SEQ ID NO: 2267340 - protein, 12 aa, Cryptosporidium parvum
KSPSKRISAQES

SEQ ID NO: 2267341 - protein, 7 aa, Cryptosporidium parvum
KSPSRPE

SEQ ID NO: 2267342 - protein, 14 aa, Cryptosporidium parvum
KSPVKTVKTTKSVS

SEQ ID NO: 2267343 - protein, 4 aa, Cryptosporidium parvum
KSPY

SEQ ID NO: 2267344 - protein, 6 aa, Cryptosporidium parvum
KSPYIG

SEQ ID NO: 2267345 - protein, 12 aa, Cryptosporidium parvum
KSQDAEIGDGTT

SEQ ID NO: 2267346 - protein, 6 aa, Cryptosporidium parvum
KSQDEK

SEQ ID NO: 2267347 - protein, 10 aa, Cryptosporidium parvum
KSQDKDQPGT

SEQ ID NO: 2267348 - protein, 11 aa, Cryptosporidium parvum
KSQDSMTTQNK

SEQ ID NO: 2267349 - protein, 14 aa, Cryptosporidium parvum
KSQEISGVKQTSVE

SEQ ID NO: 2267350 - protein, 8 aa, Cryptosporidium parvum
KSQELDHQ

SEQ ID NO: 2267351 - protein, 8 aa, Cryptosporidium parvum
KSQEQKNI

SEQ ID NO: 2267352 - protein, 11 aa, Cryptosporidium parvum
KSQFNQNSSYI

SEQ ID NO: 2267353 - protein, 8 aa, Cryptosporidium parvum
KSQFPNSD

SEQ ID NO: 2267354 - protein, 13 aa, Cryptosporidium parvum
KSQGTGDYSNNGD

SEQ ID NO: 2267355 - protein, 8 aa, Cryptosporidium parvum
KSQKETVN

SEQ ID NO: 2267356 - protein, 7 aa, Cryptosporidium parvum
KSQLDSV

SEQ ID NO: 2267357 - protein, 13 aa, Cryptosporidium parvum
KSQLGLGKPGSEL

SEQ ID NO: 2267358 - protein, 8 aa, Cryptosporidium parvum
KSQNAIKN

SEQ ID NO: 2267359 - protein, 10 aa, Cryptosporidium parvum
KSQNSQDVSF

SEQ ID NO: 2267360 - protein, 9 aa, Cryptosporidium parvum
KSQQSAGKE

SEQ ID NO: 2267361 - protein, 19 aa, Cryptosporidium parvum
KSQRESGRPWKDTPNLKSK

SEQ ID NO: 2267362 - protein, 6 aa, Cryptosporidium parvum
KSQRIN

SEQ ID NO: 2267363 - protein, 21 aa, Cryptosporidium parvum
KSQRVEERKRQRSQASSQRKE

SEQ ID NO: 2267364 - protein, 7 aa, Cryptosporidium parvum
KSQSDIP

SEQ ID NO: 2267365 - protein, 6 aa, Cryptosporidium parvum
KSQSGL

SEQ ID NO: 2267366 - protein, 8 aa, Cryptosporidium parvum
KSQSLTKD

SEQ ID NO: 2267367 - protein, 10 aa, Cryptosporidium parvum
KSQSNEYNLP

SEQ ID NO: 2267368 - protein, 14 aa, Cryptosporidium parvum
KSQSNIENSDHSEP

SEQ ID NO: 2267369 - protein, 7 aa, Cryptosporidium parvum
KSQSRPK

SEQ ID NO: 2267370 - protein, 7 aa, Cryptosporidium parvum
KSQSRSN

SEQ ID NO: 2267371 - protein, 12 aa, Cryptosporidium parvum
KSQTDTGHSRDK

SEQ ID NO: 2267372 - protein, 5 aa, Cryptosporidium parvum
KSQTN

SEQ ID NO: 2267373 - protein, 7 aa, Cryptosporidium parvum
KSQTVGP

SEQ ID NO: 2267374 - protein, 4 aa, Cryptosporidium parvum
KSQV

SEQ ID NO: 2267375 - protein, 8 aa, Cryptosporidium parvum
KSQVEGRI

SEQ ID NO: 2267376 - protein, 7 aa, Cryptosporidium parvum
KSQYNLD

SEQ ID NO: 2267377 - protein, 16 aa, Cryptosporidium parvum
KSQYSGNKQERVSNDY

SEQ ID NO: 2267378 - protein, 36 aa, Cryptosporidium parvum
KSRAKQKQQQQQQQQSQNGNNGQSGSLSPNHSDFAT

SEQ ID NO: 2267379 - protein, 5 aa, Cryptosporidium parvum
KSRCN

SEQ ID NO: 2267380 - protein, 7 aa, Cryptosporidium parvum
KSRDDAL

SEQ ID NO: 2267381 - protein, 17 aa, Cryptosporidium parvum
KSRDELSVAESQSRRFE

SEQ ID NO: 2267382 - protein, 5 aa, Cryptosporidium parvum
KSREK

SEQ ID NO: 2267383 - protein, 13 aa, Cryptosporidium parvum
KSREKKGFSNIDR

SEQ ID NO: 2267384 - protein, 14 aa, Cryptosporidium parvum
KSRETLSSTEANLR

SEQ ID NO: 2267385 - protein, 6 aa, Cryptosporidium parvum
KSRGLD

SEQ ID NO: 2267386 - protein, 8 aa, Cryptosporidium parvum
KSRGPESP

SEQ ID NO: 2267387 - protein, 6 aa, Cryptosporidium parvum
KSRGSY

SEQ ID NO: 2267388 - protein, 8 aa, Cryptosporidium parvum
KSRHGRKM

SEQ ID NO: 2267389 - protein, 4 aa, Cryptosporidium parvum
KSRI

SEQ ID NO: 2267390 - protein, 5 aa, Cryptosporidium parvum
KSRID

SEQ ID NO: 2267391 - protein, 11 aa, Cryptosporidium parvum
KSRKKTSNSIF

SEQ ID NO: 2267392 - protein, 10 aa, Cryptosporidium parvum
KSRNASLSDS

SEQ ID NO: 2267393 - protein, 11 aa, Cryptosporidium parvum
KSRNCNKGIPR

SEQ ID NO: 2267394 - protein, 110 aa, Cryptosporidium parvum
KSRNRRRRRSVSSSRSSSEVSSSSEYERRDRNYERGRGRDRDRYKRSRRNYSSDESSPERAYRHRENKYSKKHKNYYSESGSSSDSEIDRSGHKRRHEPDNYDWKDRSKD

SEQ ID NO: 2267395 - protein, 4 aa, Cryptosporidium parvum
KSRP

SEQ ID NO: 2267396 - protein, 7 aa, Cryptosporidium parvum
KSRQDGQ

SEQ ID NO: 2267397 - protein, 6 aa, Cryptosporidium parvum
KSRQGD

SEQ ID NO: 2267398 - protein, 6 aa, Cryptosporidium parvum
KSRQLR

SEQ ID NO: 2267399 - protein, 15 aa, Cryptosporidium parvum
KSRQNDFDYKGKQTY

SEQ ID NO: 2267400 - protein, 6 aa, Cryptosporidium parvum
KSRREC

SEQ ID NO: 2267401 - protein, 9 aa, Cryptosporidium parvum
KSRREGKEV

SEQ ID NO: 2267402 - protein, 10 aa, Cryptosporidium parvum
KSRSGSANTD

SEQ ID NO: 2267403 - protein, 13 aa, Cryptosporidium parvum
KSSADMKNADPET

SEQ ID NO: 2267404 - protein, 8 aa, Cryptosporidium parvum
KSSAPDVD

SEQ ID NO: 2267405 - protein, 17 aa, Cryptosporidium parvum
KSSAQQRMGRAGRTAPG

SEQ ID NO: 2267406 - protein, 8 aa, Cryptosporidium parvum
KSSASSSS

SEQ ID NO: 2267407 - protein, 14 aa, Cryptosporidium parvum
KSSCPTGSEQQQQM

SEQ ID NO: 2267408 - protein, 7 aa, Cryptosporidium parvum
KSSDDIV

SEQ ID NO: 2267409 - protein, 6 aa, Cryptosporidium parvum
KSSDGK

SEQ ID NO: 2267410 - protein, 8 aa, Cryptosporidium parvum
KSSDKDSA

SEQ ID NO: 2267411 - protein, 8 aa, Cryptosporidium parvum
KSSDLSAA

SEQ ID NO: 2267412 - protein, 11 aa, Cryptosporidium parvum
KSSDPRNDRIP

SEQ ID NO: 2267413 - protein, 9 aa, Cryptosporidium parvum
KSSEEKKGL

SEQ ID NO: 2267414 - protein, 11 aa, Cryptosporidium parvum
KSSEISSKRNT

SEQ ID NO: 2267415 - protein, 7 aa, Cryptosporidium parvum
KSSEKNI

SEQ ID NO: 2267416 - protein, 7 aa, Cryptosporidium parvum
KSSELSD

SEQ ID NO: 2267417 - protein, 15 aa, Cryptosporidium parvum
KSSENGCENNNNEED

SEQ ID NO: 2267418 - protein, 6 aa, Cryptosporidium parvum
KSSENI

SEQ ID NO: 2267419 - protein, 8 aa, Cryptosporidium parvum
KSSENSLN

SEQ ID NO: 2267420 - protein, 7 aa, Cryptosporidium parvum
KSSEQTI

SEQ ID NO: 2267421 - protein, 6 aa, Cryptosporidium parvum
KSSESI

SEQ ID NO: 2267422 - protein, 26 aa, Cryptosporidium parvum
KSSETRKPQSLAEDQEPKKADQSIEE

SEQ ID NO: 2267423 - protein, 8 aa, Cryptosporidium parvum
KSSETTDG

SEQ ID NO: 2267424 - protein, 17 aa, Cryptosporidium parvum
KSSFPHGSYRPSSSNIS

SEQ ID NO: 2267425 - protein, 8 aa, Cryptosporidium parvum
KSSGADVP

SEQ ID NO: 2267426 - protein, 8 aa, Cryptosporidium parvum
KSSGISDG

SEQ ID NO: 2267427 - protein, 10 aa, Cryptosporidium parvum
KSSGKTNNIQ

SEQ ID NO: 2267428 - protein, 8 aa, Cryptosporidium parvum
KSSGSKDS

SEQ ID NO: 2267429 - protein, 9 aa, Cryptosporidium parvum
KSSGSTSNA

SEQ ID NO: 2267430 - protein, 7 aa, Cryptosporidium parvum
KSSGTHE

SEQ ID NO: 2267431 - protein, 11 aa, Cryptosporidium parvum
KSSHKDYHLPS

SEQ ID NO: 2267432 - protein, 6 aa, Cryptosporidium parvum
KSSIDG

SEQ ID NO: 2267433 - protein, 15 aa, Cryptosporidium parvum
KSSIDNLTPSKEINT

SEQ ID NO: 2267434 - protein, 5 aa, Cryptosporidium parvum
KSSIE

SEQ ID NO: 2267435 - protein, 7 aa, Cryptosporidium parvum
KSSINNM

SEQ ID NO: 2267436 - protein, 5 aa, Cryptosporidium parvum
KSSIQ

SEQ ID NO: 2267437 - protein, 8 aa, Cryptosporidium parvum
KSSIQPSI

SEQ ID NO: 2267438 - protein, 5 aa, Cryptosporidium parvum
KSSIT

SEQ ID NO: 2267439 - protein, 9 aa, Cryptosporidium parvum
KSSKDFQQM

SEQ ID NO: 2267440 - protein, 5 aa, Cryptosporidium parvum
KSSKI

SEQ ID NO: 2267441 - protein, 6 aa, Cryptosporidium parvum
KSSKID

SEQ ID NO: 2267442 - protein, 16 aa, Cryptosporidium parvum
KSSKLEKKHRKSSCKH

SEQ ID NO: 2267443 - protein, 10 aa, Cryptosporidium parvum
KSSKLSPENR

SEQ ID NO: 2267444 - protein, 11 aa, Cryptosporidium parvum
KSSKLSTEKNC

SEQ ID NO: 2267445 - protein, 6 aa, Cryptosporidium parvum
KSSKPK

SEQ ID NO: 2267446 - protein, 15 aa, Cryptosporidium parvum
KSSKQQSDTKNQSSS

SEQ ID NO: 2267447 - protein, 9 aa, Cryptosporidium parvum
KSSKRENGI

SEQ ID NO: 2267448 - protein, 9 aa, Cryptosporidium parvum
KSSKSKITD

SEQ ID NO: 2267449 - protein, 6 aa, Cryptosporidium parvum
KSSLES

SEQ ID NO: 2267450 - protein, 9 aa, Cryptosporidium parvum
KSSLKSLKT

SEQ ID NO: 2267451 - protein, 7 aa, Cryptosporidium parvum
KSSLTHD

SEQ ID NO: 2267452 - protein, 9 aa, Cryptosporidium parvum
KSSLTSNPI

SEQ ID NO: 2267453 - protein, 9 aa, Cryptosporidium parvum
KSSMDESKG

SEQ ID NO: 2267454 - protein, 36 aa, Cryptosporidium parvum
KSSMNEKPRQGRRKRGSGSGSGSGSGPGSGPGSGVT

SEQ ID NO: 2267455 - protein, 8 aa, Cryptosporidium parvum
KSSNDSLG

SEQ ID NO: 2267456 - protein, 5 aa, Cryptosporidium parvum
KSSNK

SEQ ID NO: 2267457 - protein, 10 aa, Cryptosporidium parvum
KSSNKNIENL

SEQ ID NO: 2267458 - protein, 6 aa, Cryptosporidium parvum
KSSNLL

SEQ ID NO: 2267459 - protein, 15 aa, Cryptosporidium parvum
KSSNNYSGGPKPRCS

SEQ ID NO: 2267460 - protein, 9 aa, Cryptosporidium parvum
KSSNSNGGF

SEQ ID NO: 2267461 - protein, 18 aa, Cryptosporidium parvum
KSSNTNQGTKVSSGLVQQ

SEQ ID NO: 2267462 - protein, 18 aa, Cryptosporidium parvum
KSSQKQGKTQANSETFLP

SEQ ID NO: 2267463 - protein, 12 aa, Cryptosporidium parvum
KSSQSAIKEMKS

SEQ ID NO: 2267464 - protein, 7 aa, Cryptosporidium parvum
KSSRGDM

SEQ ID NO: 2267465 - protein, 17 aa, Cryptosporidium parvum
KSSRNNLNHDKTIDSLD

SEQ ID NO: 2267466 - protein, 6 aa, Cryptosporidium parvum
KSSSGV

SEQ ID NO: 2267467 - protein, 9 aa, Cryptosporidium parvum
KSSSKKEKN

SEQ ID NO: 2267468 - protein, 8 aa, Cryptosporidium parvum
KSSSMGSI

SEQ ID NO: 2267469 - protein, 13 aa, Cryptosporidium parvum
KSSSNEEGNNGLL

SEQ ID NO: 2267470 - protein, 23 aa, Cryptosporidium parvum
KSSSNIKNNSSYQIEKKSSQPLV

SEQ ID NO: 2267471 - protein, 9 aa, Cryptosporidium parvum
KSSSSGMDV

SEQ ID NO: 2267472 - protein, 18 aa, Cryptosporidium parvum
KSSSTSSKHKSMTPDEEY

SEQ ID NO: 2267473 - protein, 6 aa, Cryptosporidium parvum
KSSSYL

SEQ ID NO: 2267474 - protein, 8 aa, Cryptosporidium parvum
KSSTCSDF

SEQ ID NO: 2267475 - protein, 7 aa, Cryptosporidium parvum
KSSTSLL

SEQ ID NO: 2267476 - protein, 6 aa, Cryptosporidium parvum
KSSTTV

SEQ ID NO: 2267477 - protein, 7 aa, Cryptosporidium parvum
KSSTVDK

SEQ ID NO: 2267478 - protein, 9 aa, Cryptosporidium parvum
KSSVEKYSP

SEQ ID NO: 2267479 - protein, 14 aa, Cryptosporidium parvum
KSSVSSVKTASRIS

SEQ ID NO: 2267480 - protein, 8 aa, Cryptosporidium parvum
KSSVYQDG

SEQ ID NO: 2267481 - protein, 4 aa, Cryptosporidium parvum
KSSW

SEQ ID NO: 2267482 - protein, 7 aa, Cryptosporidium parvum
KSSWPKK

SEQ ID NO: 2267483 - protein, 6 aa, Cryptosporidium parvum
KSSYHP

SEQ ID NO: 2267484 - protein, 9 aa, Cryptosporidium parvum
KSSYQNSED

SEQ ID NO: 2267485 - protein, 4 aa, Cryptosporidium parvum
KSTE

SEQ ID NO: 2267486 - protein, 6 aa, Cryptosporidium parvum
KSTEAI

SEQ ID NO: 2267487 - protein, 6 aa, Cryptosporidium parvum
KSTEKI

SEQ ID NO: 2267488 - protein, 10 aa, Cryptosporidium parvum
KSTENDELTT

SEQ ID NO: 2267489 - protein, 6 aa, Cryptosporidium parvum
KSTENI

SEQ ID NO: 2267490 - protein, 11 aa, Cryptosporidium parvum
KSTGADTQKRE

SEQ ID NO: 2267491 - protein, 7 aa, Cryptosporidium parvum
KSTGIHR

SEQ ID NO: 2267492 - protein, 20 aa, Cryptosporidium parvum
KSTGQPNENIRSRPSQVASG

SEQ ID NO: 2267493 - protein, 10 aa, Cryptosporidium parvum
KSTGRGSEIS

SEQ ID NO: 2267494 - protein, 6 aa, Cryptosporidium parvum
KSTHGW

SEQ ID NO: 2267495 - protein, 5 aa, Cryptosporidium parvum
KSTIE

SEQ ID NO: 2267496 - protein, 8 aa, Cryptosporidium parvum
KSTIRENS

SEQ ID NO: 2267497 - protein, 5 aa, Cryptosporidium parvum
KSTIT

SEQ ID NO: 2267498 - protein, 16 aa, Cryptosporidium parvum
KSTITSGISNSNNVNA

SEQ ID NO: 2267499 - protein, 8 aa, Cryptosporidium parvum
KSTKIGNN

SEQ ID NO: 2267500 - protein, 13 aa, Cryptosporidium parvum
KSTKKESYYIDEF

SEQ ID NO: 2267501 - protein, 10 aa, Cryptosporidium parvum
KSTKKRMKAE

SEQ ID NO: 2267502 - protein, 21 aa, Cryptosporidium parvum
KSTKPPLPPKPNLTYGPQPFP

SEQ ID NO: 2267503 - protein, 9 aa, Cryptosporidium parvum
KSTKRNNKQ

SEQ ID NO: 2267504 - protein, 5 aa, Cryptosporidium parvum
KSTKY

SEQ ID NO: 2267505 - protein, 5 aa, Cryptosporidium parvum
KSTLL

SEQ ID NO: 2267506 - protein, 5 aa, Cryptosporidium parvum
KSTLN

SEQ ID NO: 2267507 - protein, 8 aa, Cryptosporidium parvum
KSTLVGDE

SEQ ID NO: 2267508 - protein, 7 aa, Cryptosporidium parvum
KSTNAKI

SEQ ID NO: 2267509 - protein, 5 aa, Cryptosporidium parvum
KSTNG

SEQ ID NO: 2267510 - protein, 26 aa, Cryptosporidium parvum
KSTNIEKGNSEDDESEKQENSIYDVI

SEQ ID NO: 2267511 - protein, 5 aa, Cryptosporidium parvum
KSTNK

SEQ ID NO: 2267512 - protein, 56 aa, Cryptosporidium parvum
KSTNSGGNSAFANYGRPEHSSYSNNYSNYYRGGQIDDGDGGSRSYKKGPVQNYGGR

SEQ ID NO: 2267513 - protein, 7 aa, Cryptosporidium parvum
KSTPEFI

SEQ ID NO: 2267514 - protein, 10 aa, Cryptosporidium parvum
KSTPEIEDDV

SEQ ID NO: 2267515 - protein, 17 aa, Cryptosporidium parvum
KSTPQDGIDQELDGSGM

SEQ ID NO: 2267516 - protein, 13 aa, Cryptosporidium parvum
KSTQISKEQLSNS

SEQ ID NO: 2267517 - protein, 28 aa, Cryptosporidium parvum
KSTQSLNNCRKNGSNILSSNTHSGLTAD

SEQ ID NO: 2267518 - protein, 7 aa, Cryptosporidium parvum
KSTRQVY

SEQ ID NO: 2267519 - protein, 68 aa, Cryptosporidium parvum; identical to SEQ ID NO: 2149765

SEQ ID NO: 2267520 - protein, 11 aa, Cryptosporidium parvum
KSTSGKINNST

SEQ ID NO: 2267521 - protein, 17 aa, Cryptosporidium parvum
KSTSMTNSGNAKPIQRN

SEQ ID NO: 2267522 - protein, 7 aa, Cryptosporidium parvum
KSTSNKF

SEQ ID NO: 2267523 - protein, 7 aa, Cryptosporidium parvum
KSTSNTL

SEQ ID NO: 2267524 - protein, 13 aa, Cryptosporidium parvum
KSTTETSNVKINE

SEQ ID NO: 2267525 - protein, 5 aa, Cryptosporidium parvum
KSTTV

SEQ ID NO: 2267526 - protein, 7 aa, Cryptosporidium parvum
KSTVGKV

SEQ ID NO: 2267527 - protein, 12 aa, Cryptosporidium parvum
KSTVSGGSSNVG

SEQ ID NO: 2267528 - protein, 4 aa, Cryptosporidium parvum
KSTY

SEQ ID NO: 2267529 - protein, 5 aa, Cryptosporidium parvum
KSTYN

SEQ ID NO: 2267530 - protein, 5 aa, Cryptosporidium parvum
KSVDD

SEQ ID NO: 2267531 - protein, 20 aa, Cryptosporidium parvum
KSVDSASFRNAAKDKAERVR

SEQ ID NO: 2267532 - protein, 8 aa, Cryptosporidium parvum
KSVDYQDH

SEQ ID NO: 2267533 - protein, 9 aa, Cryptosporidium parvum
KSVEEYRDQ

SEQ ID NO: 2267534 - protein, 22 aa, Cryptosporidium parvum
KSVGENNSKSTLSKRSEKLSKS

SEQ ID NO: 2267535 - protein, 12 aa, Cryptosporidium parvum
KSVGYKSEEEIE

SEQ ID NO: 2267536 - protein, 8 aa, Cryptosporidium parvum
KSVNISNE

SEQ ID NO: 2267537 - protein, 10 aa, Cryptosporidium parvum
KSVNSNYEAK

SEQ ID NO: 2267538 - protein, 20 aa, Cryptosporidium parvum
KSVPKKQASKVQNTHGETHS

SEQ ID NO: 2267539 - protein, 17 aa, Cryptosporidium parvum
KSVRQDRNYTTKSIGME

SEQ ID NO: 2267540 - protein, 10 aa, Cryptosporidium parvum
KSVSESNQDR

SEQ ID NO: 2267541 - protein, 5 aa, Cryptosporidium parvum
KSVSK

SEQ ID NO: 2267542 - protein, 11 aa, Cryptosporidium parvum
KSVSQSESEHE

SEQ ID NO: 2267543 - protein, 7 aa, Cryptosporidium parvum
KSVSSKD

SEQ ID NO: 2267544 - protein, 9 aa, Cryptosporidium parvum
KSVTADSKS

SEQ ID NO: 2267545 - protein, 24 aa, Cryptosporidium parvum
KSVTKPGNTSGFSNPGAKNKKHDF

SEQ ID NO: 2267546 - protein, 9 aa, Cryptosporidium parvum
KSVTSNLQT

SEQ ID NO: 2267547 - protein, 14 aa, Cryptosporidium parvum
KSVYTNETNEEAKP

SEQ ID NO: 2267548 - protein, 15 aa, Cryptosporidium parvum
KSWGEKWENSNITEK

SEQ ID NO: 2267549 - protein, 18 aa, Cryptosporidium parvum
KSWNENDNNEYQSAEKEL

SEQ ID NO: 2267550 - protein, 6 aa, Cryptosporidium parvum
KSWNNP

SEQ ID NO: 2267551 - protein, 17 aa, Cryptosporidium parvum
KSWSNSTQRSEYNKHSN

SEQ ID NO: 2267552 - protein, 6 aa, Cryptosporidium parvum
KSYDDQ

SEQ ID NO: 2267553 - protein, 5 aa, Cryptosporidium parvum
KSYDE

SEQ ID NO: 2267554 - protein, 8 aa, Cryptosporidium parvum
KSYEEHEH

SEQ ID NO: 2267555 - protein, 7 aa, Cryptosporidium parvum
KSYGGSK

SEQ ID NO: 2267556 - protein, 6 aa, Cryptosporidium parvum
KSYGKL

SEQ ID NO: 2267557 - protein, 6 aa, Cryptosporidium parvum
KSYGRP

SEQ ID NO: 2267558 - protein, 8 aa, Cryptosporidium parvum
KSYNNRNE

SEQ ID NO: 2267559 - protein, 8 aa, Cryptosporidium parvum
KSYNPHGN

SEQ ID NO: 2267560 - protein, 8 aa, Cryptosporidium parvum
KSYPCKDN

SEQ ID NO: 2267561 - protein, 6 aa, Cryptosporidium parvum
KSYSGD

SEQ ID NO: 2267562 - protein, 6 aa, Cryptosporidium parvum
KSYTEQ

SEQ ID NO: 2267563 - protein, 7 aa, Cryptosporidium parvum
KSYTNEM

SEQ ID NO: 2267564 - protein, 7 aa, Cryptosporidium parvum
KSYTQRR

SEQ ID NO: 2267565 - protein, 9 aa, Cryptosporidium parvum
KTAAEERSI

SEQ ID NO: 2267566 - protein, 8 aa, Cryptosporidium parvum
KTACNSGG

SEQ ID NO: 2267567 - protein, 5 aa, Cryptosporidium parvum
KTAEE

SEQ ID NO: 2267568 - protein, 8 aa, Cryptosporidium parvum
KTAEISPL

SEQ ID NO: 2267569 - protein, 7 aa, Cryptosporidium parvum
KTAETGY

SEQ ID NO: 2267570 - protein, 11 aa, Cryptosporidium parvum
KTAKDLKDTDK

SEQ ID NO: 2267571 - protein, 7 aa, Cryptosporidium parvum
KTAKGST

SEQ ID NO: 2267572 - protein, 9 aa, Cryptosporidium parvum
KTASRCPEP

SEQ ID NO: 2267573 - protein, 13 aa, Cryptosporidium parvum
KTASSKELPPQNS

SEQ ID NO: 2267574 - protein, 4 aa, Cryptosporidium parvum
KTAV

SEQ ID NO: 2267575 - protein, 7 aa, Cryptosporidium parvum
KTAVDQL

SEQ ID NO: 2267576 - protein, 8 aa, Cryptosporidium parvum
KTCENEQF

SEQ ID NO: 2267577 - protein, 4 aa, Cryptosporidium parvum
KTCN

SEQ ID NO: 2267578 - protein, 5 aa, Cryptosporidium parvum
KTDGC

SEQ ID NO: 2267579 - protein, 4 aa, Cryptosporidium parvum
KTDK

SEQ ID NO: 2267580 - protein, 5 aa, Cryptosporidium parvum
KTDKL

SEQ ID NO: 2267581 - protein, 9 aa, Cryptosporidium parvum
KTDKQSELG

SEQ ID NO: 2267582 - protein, 13 aa, Cryptosporidium parvum
KTDNNDENQNRSQ

SEQ ID NO: 2267583 - protein, 7 aa, Cryptosporidium parvum
KTDPNEL

SEQ ID NO: 2267584 - protein, 5 aa, Cryptosporidium parvum
KTDQF

SEQ ID NO: 2267585 - protein, 6 aa, Cryptosporidium parvum
KTDQKI

SEQ ID NO: 2267586 - protein, 10 aa, Cryptosporidium parvum
KTDTNDKYGE

SEQ ID NO: 2267587 - protein, 4 aa, Cryptosporidium parvum
KTDV

SEQ ID NO: 2267588 - protein, 6 aa, Cryptosporidium parvum
KTDYQN

SEQ ID NO: 2267589 - protein, 4 aa, Cryptosporidium parvum
KTEA

SEQ ID NO: 2267590 - protein, 22 aa, Cryptosporidium parvum
KTEAGKSEKISLSTDELDTGHK

SEQ ID NO: 2267591 - protein, 13 aa, Cryptosporidium parvum
KTEDGGFNSPQKS

SEQ ID NO: 2267592 - protein, 6 aa, Cryptosporidium parvum
KTEEYE

SEQ ID NO: 2267593 - protein, 7 aa, Cryptosporidium parvum
KTEGFSG

SEQ ID NO: 2267594 - protein, 8 aa, Cryptosporidium parvum
KTEGFSGA

SEQ ID NO: 2267595 - protein, 9 aa, Cryptosporidium parvum
KTEKRLGKA

SEQ ID NO: 2267596 - protein, 9 aa, Cryptosporidium parvum
KTENEKDTC

SEQ ID NO: 2267597 - protein, 8 aa, Cryptosporidium parvum
KTENGSSA

SEQ ID NO: 2267598 - protein, 9 aa, Cryptosporidium parvum
KTENGTPVI

SEQ ID NO: 2267599 - protein, 9 aa, Cryptosporidium parvum
KTENQLPSN

SEQ ID NO: 2267600 - protein, 30 aa, Cryptosporidium parvum
KTENSNGNIINQGTGSANINSSNSSGGFTE

SEQ ID NO: 2267601 - protein, 7 aa, Cryptosporidium parvum
KTEPISN

SEQ ID NO: 2267602 - protein, 6 aa, Cryptosporidium parvum
KTEPVS

SEQ ID NO: 2267603 - protein, 12 aa, Cryptosporidium parvum
KTEQVQKNFIYD

SEQ ID NO: 2267604 - protein, 8 aa, Cryptosporidium parvum
KTERKGEF

SEQ ID NO: 2267605 - protein, 7 aa, Cryptosporidium parvum
KTESNEF

SEQ ID NO: 2267606 - protein, 8 aa, Cryptosporidium parvum
KTETINDS

SEQ ID NO: 2267607 - protein, 25 aa, Cryptosporidium parvum
KTETRQRSVKYETSNIAEQDEQRES

SEQ ID NO: 2267608 - protein, 14 aa, Cryptosporidium parvum
KTEYPESSIEGEST

SEQ ID NO: 2267609 - protein, 15 aa, Cryptosporidium parvum
KTFDASADGYVRGEG

SEQ ID NO: 2267610 - protein, 18 aa, Cryptosporidium parvum
KTFDSEQSLTSKNSNHSV

SEQ ID NO: 2267611 - protein, 5 aa, Cryptosporidium parvum
KTFGK

SEQ ID NO: 2267612 - protein, 17 aa, Cryptosporidium parvum
KTFKGSIDREKLLEKIE

SEQ ID NO: 2267613 - protein, 4 aa, Cryptosporidium parvum
KTFN

SEQ ID NO: 2267614 - protein, 11 aa, Cryptosporidium parvum
KTFSDSSERLI

SEQ ID NO: 2267615 - protein, 6 aa, Cryptosporidium parvum
KTGDSL

SEQ ID NO: 2267616 - protein, 4 aa, Cryptosporidium parvum
KTGE

SEQ ID NO: 2267617 - protein, 9 aa, Cryptosporidium parvum
KTGEPSAPL

SEQ ID NO: 2267618 - protein, 11 aa, Cryptosporidium parvum
KTGHSGTLDPK

SEQ ID NO: 2267619 - protein, 24 aa, Cryptosporidium parvum
KTGIESSSYVSDNSQISDKTQKHM

SEQ ID NO: 2267620 - protein, 5 aa, Cryptosporidium parvum
KTGIK

SEQ ID NO: 2267621 - protein, 8 aa, Cryptosporidium parvum
KTGKPATQ

SEQ ID NO: 2267622 - protein, 43 aa, Cryptosporidium parvum
KTGKRIKDLNKSGNNVESKVEGSSRTKSSSSTNSGSISRNSKV

SEQ ID NO: 2267623 - protein, 5 aa, Cryptosporidium parvum
KTGKT

SEQ ID NO: 2267624 - protein, 6 aa, Cryptosporidium parvum
KTGMDS

SEQ ID NO: 2267625 - protein, 4 aa, Cryptosporidium parvum
KTGN

SEQ ID NO: 2267626 - protein, 8 aa, Cryptosporidium parvum
KTGNIEST

SEQ ID NO: 2267627 - protein, 5 aa, Cryptosporidium parvum
KTGNP

SEQ ID NO: 2267628 - protein, 9 aa, Cryptosporidium parvum
KTGNSSEFN

SEQ ID NO: 2267629 - protein, 7 aa, Cryptosporidium parvum
KTGQPLS

SEQ ID NO: 2267630 - protein, 6 aa, Cryptosporidium parvum
KTGRGP

SEQ ID NO: 2267631 - protein, 6 aa, Cryptosporidium parvum
KTGSDM

SEQ ID NO: 2267632 - protein, 16 aa, Cryptosporidium parvum
KTGSTASMDPATMNNT

SEQ ID NO: 2267633 - protein, 6 aa, Cryptosporidium parvum
KTGTID

SEQ ID NO: 2267634 - protein, 29 aa, Cryptosporidium parvum
KTGVRGRPPGSGNRGRPPGSTKKAKKDPQ

SEQ ID NO: 2267635 - protein, 27 aa, Cryptosporidium parvum
KTHENEHENEHEYEDENNNNEMNTENQ

SEQ ID NO: 2267636 - protein, 12 aa, Cryptosporidium parvum
KTHKENTSGTVS

SEQ ID NO: 2267637 - protein, 6 aa, Cryptosporidium parvum
KTHKKE

SEQ ID NO: 2267638 - protein, 11 aa, Cryptosporidium parvum
KTHPVSDNSMG

SEQ ID NO: 2267639 - protein, 11 aa, Cryptosporidium parvum
KTIDGDLKNPA

SEQ ID NO: 2267640 - protein, 6 aa, Cryptosporidium parvum
KTIDKE

SEQ ID NO: 2267641 - protein, 6 aa, Cryptosporidium parvum
KTIEDG

SEQ ID NO: 2267642 - protein, 14 aa, Cryptosporidium parvum
KTIENLKKKSNENR

SEQ ID NO: 2267643 - protein, 4 aa, Cryptosporidium parvum
KTIH

SEQ ID NO: 2267644 - protein, 6 aa, Cryptosporidium parvum
KTIPPT

SEQ ID NO: 2267645 - protein, 6 aa, Cryptosporidium parvum
KTIPYK

SEQ ID NO: 2267646 - protein, 12 aa, Cryptosporidium parvum
KTIQNANEQYQK

SEQ ID NO: 2267647 - protein, 11 aa, Cryptosporidium parvum
KTIRNDNSSRF

SEQ ID NO: 2267648 - protein, 12 aa, Cryptosporidium parvum
KTISDAQSNYLN

SEQ ID NO: 2267649 - protein, 13 aa, Cryptosporidium parvum
KTISGTKSSAKKG

SEQ ID NO: 2267650 - protein, 10 aa, Cryptosporidium parvum
KTISNTNKEI

SEQ ID NO: 2267651 - protein, 6 aa, Cryptosporidium parvum
KTITEK

SEQ ID NO: 2267652 - protein, 7 aa, Cryptosporidium parvum
KTKEDDL

SEQ ID NO: 2267653 - protein, 15 aa, Cryptosporidium parvum
KTKEDSIDETENQYE

SEQ ID NO: 2267654 - protein, 5 aa, Cryptosporidium parvum
KTKEN

SEQ ID NO: 2267655 - protein, 11 aa, Cryptosporidium parvum
KTKENNNQENI

SEQ ID NO: 2267656 - protein, 6 aa, Cryptosporidium parvum
KTKFNQ

SEQ ID NO: 2267657 - protein, 5 aa, Cryptosporidium parvum
KTKGN

SEQ ID NO: 2267658 - protein, 12 aa, Cryptosporidium parvum
KTKKAKLKDMEI

SEQ ID NO: 2267659 - protein, 6 aa, Cryptosporidium parvum
KTKKAV

SEQ ID NO: 2267660 - protein, 11 aa, Cryptosporidium parvum
KTKKDKREEKL

SEQ ID NO: 2267661 - protein, 16 aa, Cryptosporidium parvum
KTKKQEILNRENNSKL

SEQ ID NO: 2267662 - protein, 13 aa, Cryptosporidium parvum
KTKKRGNKREHRV

SEQ ID NO: 2267663 - protein, 16 aa, Cryptosporidium parvum
KTKNEELSNSTKNHQK

SEQ ID NO: 2267664 - protein, 10 aa, Cryptosporidium parvum
KTKNFNYTRE

SEQ ID NO: 2267665 - protein, 8 aa, Cryptosporidium parvum
KTKNQDFN

SEQ ID NO: 2267666 - protein, 9 aa, Cryptosporidium parvum
KTKPLPDTR

SEQ ID NO: 2267667 - protein, 6 aa, Cryptosporidium parvum
KTKQDT

SEQ ID NO: 2267668 - protein, 10 aa, Cryptosporidium parvum
KTKQGLEDKL

SEQ ID NO: 2267669 - protein, 7 aa, Cryptosporidium parvum
KTKQNGI

SEQ ID NO: 2267670 - protein, 6 aa, Cryptosporidium parvum
KTKQTG

SEQ ID NO: 2267671 - protein, 8 aa, Cryptosporidium parvum
KTKQYNHH

SEQ ID NO: 2267672 - protein, 32 aa, Cryptosporidium parvum; identical to SEQ ID NO: 2149892

SEQ ID NO: 2267673 - protein, 17 aa, Cryptosporidium parvum
KTKSKHKKRKPRYPKGF

SEQ ID NO: 2267674 - protein, 7 aa, Cryptosporidium parvum
KTKSNMY

SEQ ID NO: 2267675 - protein, 8 aa, Cryptosporidium parvum
KTKSSDTP

SEQ ID NO: 2267676 - protein, 6 aa, Cryptosporidium parvum
KTKSST

SEQ ID NO: 2267677 - protein, 11 aa, Cryptosporidium parvum
KTKTEAKTSLD

SEQ ID NO: 2267678 - protein, 4 aa, Cryptosporidium parvum
KTKY

SEQ ID NO: 2267679 - protein, 12 aa, Cryptosporidium parvum
KTLDKNSNFDNA

SEQ ID NO: 2267680 - protein, 7 aa, Cryptosporidium parvum
KTLDPQK

SEQ ID NO: 2267681 - protein, 35 aa, Cryptosporidium parvum
KTLEKKKKSKSKQLDENHEEKNICSDKQAKEEDLK

SEQ ID NO: 2267682 - protein, 6 aa, Cryptosporidium parvum
KTLNNQ

SEQ ID NO: 2267683 - protein, 23 aa, Cryptosporidium parvum
KTLNPNETFASERSNRNTKFKGP

SEQ ID NO: 2267684 - protein, 6 aa, Cryptosporidium parvum
KTLPQI

SEQ ID NO: 2267685 - protein, 5 aa, Cryptosporidium parvum
KTLSR

SEQ ID NO: 2267686 - protein, 12 aa, Cryptosporidium parvum
KTLSSVGKIGGE

SEQ ID NO: 2267687 - protein, 26 aa, Cryptosporidium parvum
KTLTDESEAKTKENEELRKQLNDEKT

SEQ ID NO: 2267688 - protein, 65 aa, Cryptosporidium parvum
KTNCETNMTSEQTKKRPSDVAKEEQSKKVCTETSGDVTTTTTTTTTTGVCDSASSVSVSGSIKSY

SEQ ID NO: 2267689 - protein, 9 aa, Cryptosporidium parvum
KTNDKNSVY

SEQ ID NO: 2267690 - protein, 10 aa, Cryptosporidium parvum
KTNDNNYQSD

SEQ ID NO: 2267691 - protein, 13 aa, Cryptosporidium parvum
KTNEAEKKSIKEC

SEQ ID NO: 2267692 - protein, 5 aa, Cryptosporidium parvum
KTNEF

SEQ ID NO: 2267693 - protein, 21 aa, Cryptosporidium parvum
KTNEKRLTNNISNREEKEEED

SEQ ID NO: 2267694 - protein, 7 aa, Cryptosporidium parvum
KTNEKSE

SEQ ID NO: 2267695 - protein, 5 aa, Cryptosporidium parvum
KTNGE

SEQ ID NO: 2267696 - protein, 15 aa, Cryptosporidium parvum
KTNGLDDATSSQYAQ

SEQ ID NO: 2267697 - protein, 15 aa, Cryptosporidium parvum
KTNHEKDATKTESQN

SEQ ID NO: 2267698 - protein, 7 aa, Cryptosporidium parvum
KTNKAIQ

SEQ ID NO: 2267699 - protein, 26 aa, Cryptosporidium parvum
KTNKDSKINEMPGTKLRSSTSEDNVQ

SEQ ID NO: 2267700 - protein, 7 aa, Cryptosporidium parvum
KTNKLPN

SEQ ID NO: 2267701 - protein, 12 aa, Cryptosporidium parvum
KTNKNNKNDHDS

SEQ ID NO: 2267702 - protein, 10 aa, Cryptosporidium parvum
KTNKNTFENS

SEQ ID NO: 2267703 - protein, 8 aa, Cryptosporidium parvum
KTNKSKYT

SEQ ID NO: 2267704 - protein, 7 aa, Cryptosporidium parvum
KTNKTTY

SEQ ID NO: 2267705 - protein, 4 aa, Cryptosporidium parvum
KTNL

SEQ ID NO: 2267706 - protein, 14 aa, Cryptosporidium parvum
KTNMNSNPPPPSGQ

SEQ ID NO: 2267707 - protein, 4 aa, Cryptosporidium parvum
KTNN

SEQ ID NO: 2267708 - protein, 9 aa, Cryptosporidium parvum
KTNNNPKWS

SEQ ID NO: 2267709 - protein, 11 aa, Cryptosporidium parvum
KTNNTKENDNF

SEQ ID NO: 2267710 - protein, 8 aa, Cryptosporidium parvum
KTNPQGLA

SEQ ID NO: 2267711 - protein, 8 aa, Cryptosporidium parvum
KTNQRGSN

SEQ ID NO: 2267712 - protein, 5 aa, Cryptosporidium parvum
KTNRK

SEQ ID NO: 2267713 - protein, 14 aa, Cryptosporidium parvum
KTNRNQVQDENNIE

SEQ ID NO: 2267714 - protein, 4 aa, Cryptosporidium parvum
KTNS

SEQ ID NO: 2267715 - protein, 13 aa, Cryptosporidium parvum
KTNSESKDEIKNK

SEQ ID NO: 2267716 - protein, 8 aa, Cryptosporidium parvum
KTNSGNYP

SEQ ID NO: 2267717 - protein, 7 aa, Cryptosporidium parvum
KTNSKDV

SEQ ID NO: 2267718 - protein, 6 aa, Cryptosporidium parvum
KTNSKL

SEQ ID NO: 2267719 - protein, 11 aa, Cryptosporidium parvum
KTNSKNEFQEN

SEQ ID NO: 2267720 - protein, 13 aa, Cryptosporidium parvum
KTNSNFSNPIGTS

SEQ ID NO: 2267721 - protein, 10 aa, Cryptosporidium parvum
KTNSSPEIIQ

SEQ ID NO: 2267722 - protein, 11 aa, Cryptosporidium parvum
KTNTNKEPQID

SEQ ID NO: 2267723 - protein, 11 aa, Cryptosporidium parvum
KTNVDNTTESG

SEQ ID NO: 2267724 - protein, 5 aa, Cryptosporidium parvum
KTNYT

SEQ ID NO: 2267725 - protein, 7 aa, Cryptosporidium parvum
KTPDSRK

SEQ ID NO: 2267726 - protein, 7 aa, Cryptosporidium parvum
KTPGGRN

SEQ ID NO: 2267727 - protein, 8 aa, Cryptosporidium parvum
KTPNPGEW

SEQ ID NO: 2267728 - protein, 7 aa, Cryptosporidium parvum
KTPNSKA

SEQ ID NO: 2267729 - protein, 14 aa, Cryptosporidium parvum
KTPPEIPKKPTFNP

SEQ ID NO: 2267730 - protein, 17 aa, Cryptosporidium parvum
KTPPPLKEPNLPEKEQS

SEQ ID NO: 2267731 - protein, 7 aa, Cryptosporidium parvum
KTPPSKR

SEQ ID NO: 2267732 - protein, 5 aa, Cryptosporidium parvum
KTPQE

SEQ ID NO: 2267733 - protein, 18 aa, Cryptosporidium parvum
KTPQGPGAKTEKEEKALS

SEQ ID NO: 2267734 - protein, 9 aa, Cryptosporidium parvum
KTPQSQIEE

SEQ ID NO: 2267735 - protein, 6 aa, Cryptosporidium parvum
KTPRLT

SEQ ID NO: 2267736 - protein, 9 aa, Cryptosporidium parvum
KTPSSKNAI

SEQ ID NO: 2267737 - protein, 8 aa, Cryptosporidium parvum
KTPTEIQK

SEQ ID NO: 2267738 - protein, 39 aa, Cryptosporidium parvum
KTPYDQLNKNDANDKETVVSDANDKETDVSDTNEEQASN

SEQ ID NO: 2267739 - protein, 9 aa, Cryptosporidium parvum
KTQDEITTR

SEQ ID NO: 2267740 - protein, 11 aa, Cryptosporidium parvum
KTQDSRIPSTY

SEQ ID NO: 2267741 - protein, 5 aa, Cryptosporidium parvum
KTQEA

SEQ ID NO: 2267742 - protein, 5 aa, Cryptosporidium parvum
KTQEV

SEQ ID NO: 2267743 - protein, 7 aa, Cryptosporidium parvum
KTQGGFS

SEQ ID NO: 2267744 - protein, 7 aa, Cryptosporidium parvum
KTQGIDL

SEQ ID NO: 2267745 - protein, 9 aa, Cryptosporidium parvum
KTQHSRSKV

SEQ ID NO: 2267746 - protein, 25 aa, Cryptosporidium parvum
KTQISGKGTTLGDNNKIHKNSGQLN

SEQ ID NO: 2267747 - protein, 13 aa, Cryptosporidium parvum
KTQKKVGTKNEQV

SEQ ID NO: 2267748 - protein, 7 aa, Cryptosporidium parvum
KTQKNDN

SEQ ID NO: 2267749 - protein, 8 aa, Cryptosporidium parvum
KTQKSQEI

SEQ ID NO: 2267750 - protein, 7 aa, Cryptosporidium parvum
KTQKTNI

SEQ ID NO: 2267751 - protein, 7 aa, Cryptosporidium parvum
KTQLNKD

SEQ ID NO: 2267752 - protein, 8 aa, Cryptosporidium parvum
KTQNEINC

SEQ ID NO: 2267753 - protein, 9 aa, Cryptosporidium parvum
KTQNKDENN

SEQ ID NO: 2267754 - protein, 8 aa, Cryptosporidium parvum
KTQNSNMK

SEQ ID NO: 2267755 - protein, 5 aa, Cryptosporidium parvum
KTQQK

SEQ ID NO: 2267756 - protein, 8 aa, Cryptosporidium parvum
KTQQNPEN

SEQ ID NO: 2267757 - protein, 6 aa, Cryptosporidium parvum
KTQRSY

SEQ ID NO: 2267758 - protein, 16 aa, Cryptosporidium parvum
KTQSYQSPNDDQNNYP

SEQ ID NO: 2267759 - protein, 8 aa, Cryptosporidium parvum
KTQTDKEI

SEQ ID NO: 2267760 - protein, 7 aa, Cryptosporidium parvum
KTQTHPT

SEQ ID NO: 2267761 - protein, 4 aa, Cryptosporidium parvum
KTQV

SEQ ID NO: 2267762 - protein, 28 aa, Cryptosporidium parvum
KTQVTDSSMGLSNGPISTPNSQSFNSSG

SEQ ID NO: 2267763 - protein, 5 aa, Cryptosporidium parvum
KTRDE

SEQ ID NO: 2267764 - protein, 11 aa, Cryptosporidium parvum
KTRDEDLSSTL

SEQ ID NO: 2267765 - protein, 6 aa, Cryptosporidium parvum
KTREET

SEQ ID NO: 2267766 - protein, 6 aa, Cryptosporidium parvum
KTRIKK

SEQ ID NO: 2267767 - protein, 9 aa, Cryptosporidium parvum
KTRISGQIS

SEQ ID NO: 2267768 - protein, 10 aa, Cryptosporidium parvum
KTRNDQTEYE

SEQ ID NO: 2267769 - protein, 8 aa, Cryptosporidium parvum
KTRNSTSI

SEQ ID NO: 2267770 - protein, 5 aa, Cryptosporidium parvum
KTRRE

SEQ ID NO: 2267771 - protein, 16 aa, Cryptosporidium parvum
KTRTEKAGDSNSQGIK

SEQ ID NO: 2267772 - protein, 4 aa, Cryptosporidium parvum
KTRY

SEQ ID NO: 2267773 - protein, 9 aa, Cryptosporidium parvum
KTSANSVYG

SEQ ID NO: 2267774 - protein, 5 aa, Cryptosporidium parvum
KTSDG

SEQ ID NO: 2267775 - protein, 14 aa, Cryptosporidium parvum
KTSEIGVGPSPKVD

SEQ ID NO: 2267776 - protein, 22 aa, Cryptosporidium parvum
KTSENQTYTQNQIQNPQGLQSH

SEQ ID NO: 2267777 - protein, 18 aa, Cryptosporidium parvum
KTSENSAAPEEPKPEEKA

SEQ ID NO: 2267778 - protein, 5 aa, Cryptosporidium parvum
KTSFS

SEQ ID NO: 2267779 - protein, 6 aa, Cryptosporidium parvum
KTSGNF

SEQ ID NO: 2267780 - protein, 8 aa, Cryptosporidium parvum
KTSGRNKG

SEQ ID NO: 2267781 - protein, 18 aa, Cryptosporidium parvum
KTSHSNSANSIRREEYRK

SEQ ID NO: 2267782 - protein, 4 aa, Cryptosporidium parvum
KTSI

SEQ ID NO: 2267783 - protein, 6 aa, Cryptosporidium parvum
KTSIGN

SEQ ID NO: 2267784 - protein, 23 aa, Cryptosporidium parvum
KTSKDSNNDFEKNEISRTYTNRP

SEQ ID NO: 2267785 - protein, 10 aa, Cryptosporidium parvum
KTSKNNINNR

SEQ ID NO: 2267786 - protein, 11 aa, Cryptosporidium parvum
KTSKNPNGTVS

SEQ ID NO: 2267787 - protein, 8 aa, Cryptosporidium parvum
KTSKNTKN

SEQ ID NO: 2267788 - protein, 4 aa, Cryptosporidium parvum
KTSM

SEQ ID NO: 2267789 - protein, 21 aa, Cryptosporidium parvum
KTSNSDNSDTADNKSKGQTKL

SEQ ID NO: 2267790 - protein, 47 aa, Cryptosporidium parvum
KTSNSGLESSSTEGGAGMGTGAEGIQSTNQEEKSTSNIENDQSQNIQ

SEQ ID NO: 2267791 - protein, 8 aa, Cryptosporidium parvum
KTSNSINF

SEQ ID NO: 2267792 - protein, 24 aa, Cryptosporidium parvum
KTSNSNRKNVKDKTSIYNSDKSFE

SEQ ID NO: 2267793 - protein, 16 aa, Cryptosporidium parvum
KTSPASGQTPSRRQSY

SEQ ID NO: 2267794 - protein, 9 aa, Cryptosporidium parvum
KTSPTPECD

SEQ ID NO: 2267795 - protein, 8 aa, Cryptosporidium parvum
KTSQEGPY

SEQ ID NO: 2267796 - protein, 9 aa, Cryptosporidium parvum
KTSQNMKDD

SEQ ID NO: 2267797 - protein, 6 aa, Cryptosporidium parvum
KTSRSG

SEQ ID NO: 2267798 - protein, 7 aa, Cryptosporidium parvum
KTSSEDH

SEQ ID NO: 2267799 - protein, 15 aa, Cryptosporidium parvum
KTSSGKIRRSQTRDA

SEQ ID NO: 2267800 - protein, 11 aa, Cryptosporidium parvum
KTSSNQDLSVG

SEQ ID NO: 2267801 - protein, 16 aa, Cryptosporidium parvum
KTSSPCSESRNSTPWT

SEQ ID NO: 2267802 - protein, 50 aa, Cryptosporidium parvum
KTSSSNDDSKGKGSDKNKKSQGGKKPTQKKDKKSGSDHATFPEDTNYSEY

SEQ ID NO: 2267803 - protein, 28 aa, Cryptosporidium parvum
KTSTEEAKKVERSNSPAYSCVYKTIPVE

SEQ ID NO: 2267804 - protein, 8 aa, Cryptosporidium parvum
KTSTEPRK

SEQ ID NO: 2267805 - protein, 7 aa, Cryptosporidium parvum
KTSTIQQ

SEQ ID NO: 2267806 - protein, 4 aa, Cryptosporidium parvum
KTSV

SEQ ID NO: 2267807 - protein, 10 aa, Cryptosporidium parvum
KTTAPNDISE

SEQ ID NO: 2267808 - protein, 23 aa, Cryptosporidium parvum
KTTASSSRSVKSNNSLDPEFNKQ

SEQ ID NO: 2267809 - protein, 6 aa, Cryptosporidium parvum
KTTCSS

SEQ ID NO: 2267810 - protein, 7 aa, Cryptosporidium parvum
KTTEEAL

SEQ ID NO: 2267811 - protein, 17 aa, Cryptosporidium parvum
KTTFDESNSVDSANSQA

SEQ ID NO: 2267812 - protein, 7 aa, Cryptosporidium parvum
KTTGEEM

SEQ ID NO: 2267813 - protein, 6 aa, Cryptosporidium parvum
KTTGRI

SEQ ID NO: 2267814 - protein, 7 aa, Cryptosporidium parvum
KTTIGTP

SEQ ID NO: 2267815 - protein, 43 aa, Cryptosporidium parvum
KTTKTVTTQEVKPSSESAKKSTSNMTASATTCKAGTAQSEAVT

SEQ ID NO: 2267816 - protein, 13 aa, Cryptosporidium parvum
KTTLKSIDPETIS

SEQ ID NO: 2267817 - protein, 13 aa, Cryptosporidium parvum
KTTNLNLDRPDSP

SEQ ID NO: 2267818 - protein, 15 aa, Cryptosporidium parvum
KTTNNVSAPINNGLQ

SEQ ID NO: 2267819 - protein, 8 aa, Cryptosporidium parvum
KTTPKDYI

SEQ ID NO: 2267820 - protein, 8 aa, Cryptosporidium parvum
KTTPKGNY

SEQ ID NO: 2267821 - protein, 7 aa, Cryptosporidium parvum
KTTPSID

SEQ ID NO: 2267822 - protein, 7 aa, Cryptosporidium parvum
KTTSDGK

SEQ ID NO: 2267823 - protein, 15 aa, Cryptosporidium parvum
KTTSDRKNYKSEKSH

SEQ ID NO: 2267824 - protein, 18 aa, Cryptosporidium parvum
KTTSNSNNTSLSSSLPQS

SEQ ID NO: 2267825 - protein, 6 aa, Cryptosporidium parvum
KTTSVA

SEQ ID NO: 2267826 - protein, 7 aa, Cryptosporidium parvum
KTTYGQK

SEQ ID NO: 2267827 - protein, 9 aa, Cryptosporidium parvum
KTVASPGLS

SEQ ID NO: 2267828 - protein, 8 aa, Cryptosporidium parvum
KTVDEAHE

SEQ ID NO: 2267829 - protein, 12 aa, Cryptosporidium parvum
KTVEEKTTIGEI

SEQ ID NO: 2267830 - protein, 6 aa, Cryptosporidium parvum
KTVEYA

SEQ ID NO: 2267831 - protein, 7 aa, Cryptosporidium parvum
KTVKPSY

SEQ ID NO: 2267832 - protein, 14 aa, Cryptosporidium parvum
KTVQTTDQLKTTEN

SEQ ID NO: 2267833 - protein, 5 aa, Cryptosporidium parvum
KTVSE

SEQ ID NO: 2267834 - protein, 5 aa, Cryptosporidium parvum
KTVSP

SEQ ID NO: 2267835 - protein, 9 aa, Cryptosporidium parvum
KTVSSPEDI

SEQ ID NO: 2267836 - protein, 12 aa, Cryptosporidium parvum
KTYNTSLSNQNF

SEQ ID NO: 2267837 - protein, 12 aa, Cryptosporidium parvum
KTYPGGNDHEIY

SEQ ID NO: 2267838 - protein, 7 aa, Cryptosporidium parvum
KTYPNHS

SEQ ID NO: 2267839 - protein, 4 aa, Cryptosporidium parvum
KTYS

SEQ ID NO: 2267840 - protein, 6 aa, Cryptosporidium parvum
KTYSEQ

SEQ ID NO: 2267841 - protein, 6 aa, Cryptosporidium parvum
KTYSPF

SEQ ID NO: 2267842 - protein, 10 aa, Cryptosporidium parvum
KTYSSAPIQG

SEQ ID NO: 2267843 - protein, 7 aa, Cryptosporidium parvum
KTYTTPR

SEQ ID NO: 2267844 - protein, 5 aa, Cryptosporidium parvum
KVAEG

SEQ ID NO: 2267845 - protein, 13 aa, Cryptosporidium parvum
KVANSDSQNIDKN

SEQ ID NO: 2267846 - protein, 5 aa, Cryptosporidium parvum
KVANY

SEQ ID NO: 2267847 - protein, 8 aa, Cryptosporidium parvum
KVAPTDIE

SEQ ID NO: 2267848 - protein, 22 aa, Cryptosporidium parvum
KVASTTSSSSSGGVPATKQTKI

SEQ ID NO: 2267849 - protein, 6 aa, Cryptosporidium parvum
KVATDK

SEQ ID NO: 2267850 - protein, 7 aa, Cryptosporidium parvum
KVDDNGD

SEQ ID NO: 2267851 - protein, 14 aa, Cryptosporidium parvum
KVDESEDTGNNTHV

SEQ ID NO: 2267852 - protein, 9 aa, Cryptosporidium parvum
KVDESETQK

SEQ ID NO: 2267853 - protein, 15 aa, Cryptosporidium parvum
KVDGEKSIDGKEYSK

SEQ ID NO: 2267854 - protein, 20 aa, Cryptosporidium parvum
KVDPETFSRKKARTSSTGMQ

SEQ ID NO: 2267855 - protein, 8 aa, Cryptosporidium parvum
KVDPPNPL

SEQ ID NO: 2267856 - protein, 11 aa, Cryptosporidium parvum
KVDQRNKTRSC

SEQ ID NO: 2267857 - protein, 6 aa, Cryptosporidium parvum
KVDRNA

SEQ ID NO: 2267858 - protein, 13 aa, Cryptosporidium parvum
KVDSTNNDSCTNV

SEQ ID NO: 2267859 - protein, 11 aa, Cryptosporidium parvum
KVEAGTQSVPP

SEQ ID NO: 2267860 - protein, 6 aa, Cryptosporidium parvum
KVEDET

SEQ ID NO: 2267861 - protein, 13 aa, Cryptosporidium parvum
KVEEKKKKGEGRI

SEQ ID NO: 2267862 - protein, 7 aa, Cryptosporidium parvum
KVEENGE

SEQ ID NO: 2267863 - protein, 7 aa, Cryptosporidium parvum
KVENNGF

SEQ ID NO: 2267864 - protein, 9 aa, Cryptosporidium parvum
KVENSSELV

SEQ ID NO: 2267865 - protein, 5 aa, Cryptosporidium parvum
KVEQN

SEQ ID NO: 2267866 - protein, 17 aa, Cryptosporidium parvum
KVEREEIKTNHKEWSER

SEQ ID NO: 2267867 - protein, 8 aa, Cryptosporidium parvum
KVESDYDE

SEQ ID NO: 2267868 - protein, 7 aa, Cryptosporidium parvum
KVESNEL

SEQ ID NO: 2267869 - protein, 16 aa, Cryptosporidium parvum
KVESNRTLEKDNVGNF

SEQ ID NO: 2267870 - protein, 25 aa, Cryptosporidium parvum
KVESNSRDTHKDDKNQTGNNNSQQI

SEQ ID NO: 2267871 - protein, 8 aa, Cryptosporidium parvum
KVESPPMK

SEQ ID NO: 2267872 - protein, 5 aa, Cryptosporidium parvum
KVFKD

SEQ ID NO: 2267873 - protein, 6 aa, Cryptosporidium parvum
KVFNAP

SEQ ID NO: 2267874 - protein, 14 aa, Cryptosporidium parvum
KVFQGSSTNNNSTS

SEQ ID NO: 2267875 - protein, 18 aa, Cryptosporidium parvum
KVFSKNEQAGLKSQRGRE

SEQ ID NO: 2267876 - protein, 10 aa, Cryptosporidium parvum
KVGEQNSWGE

SEQ ID NO: 2267877 - protein, 17 aa, Cryptosporidium parvum
KVGKGNGITTDSLNGRG

SEQ ID NO: 2267878 - protein, 7 aa, Cryptosporidium parvum
KVGKRGI

SEQ ID NO: 2267879 - protein, 6 aa, Cryptosporidium parvum
KVGNKV

SEQ ID NO: 2267880 - protein, 4 aa, Cryptosporidium parvum
KVGP

SEQ ID NO: 2267881 - protein, 51 aa, Cryptosporidium parvum; identical to SEQ ID NO: 2150078

SEQ ID NO: 2267882 - protein, 4 aa, Cryptosporidium parvum
KVGR

SEQ ID NO: 2267883 - protein, 7 aa, Cryptosporidium parvum
KVGRCPD

SEQ ID NO: 2267884 - protein, 13 aa, Cryptosporidium parvum
KVGRGRRQRIKNA

SEQ ID NO: 2267885 - protein, 6 aa, Cryptosporidium parvum
KVGRHG

SEQ ID NO: 2267886 - protein, 19 aa, Cryptosporidium parvum
KVHPDKNRGKHEKSAHESF

SEQ ID NO: 2267887 - protein, 6 aa, Cryptosporidium parvum
KVHPTK

SEQ ID NO: 2267888 - protein, 11 aa, Cryptosporidium parvum
KVHSEEPKALN

SEQ ID NO: 2267889 - protein, 7 aa, Cryptosporidium parvum
KVIGTND

SEQ ID NO: 2267890 - protein, 6 aa, Cryptosporidium parvum
KVIKDE

SEQ ID NO: 2267891 - protein, 16 aa, Cryptosporidium parvum
KVINKTSDSPNISEQP

SEQ ID NO: 2267892 - protein, 7 aa, Cryptosporidium parvum
KVKGEDY

SEQ ID NO: 2267893 - protein, 4 aa, Cryptosporidium parvum
KVKK

SEQ ID NO: 2267894 - protein, 19 aa, Cryptosporidium parvum
KVKKETPNIRKKSENKSNF

SEQ ID NO: 2267895 - protein, 8 aa, Cryptosporidium parvum
KVKNEDNL

SEQ ID NO: 2267896 - protein, 16 aa, Cryptosporidium parvum
KVLPRQENQLPVPDYF

SEQ ID NO: 2267897 - protein, 12 aa, Cryptosporidium parvum
KVLQNENTFENG

SEQ ID NO: 2267898 - protein, 11 aa, Cryptosporidium parvum
KVNDEGLRNDL

SEQ ID NO: 2267899 - protein, 6 aa, Cryptosporidium parvum
KVNDES

SEQ ID NO: 2267900 - protein, 6 aa, Cryptosporidium parvum
KVNEDE

SEQ ID NO: 2267901 - protein, 26 aa, Cryptosporidium parvum
KVNEQNKHPRTVSELKSGNNNEFKED

SEQ ID NO: 2267902 - protein, 23 aa, Cryptosporidium parvum
KVNEVNKEKTVSIDETKKLNKNA

SEQ ID NO: 2267903 - protein, 7 aa, Cryptosporidium parvum
KVNGNSS

SEQ ID NO: 2267904 - protein, 6 aa, Cryptosporidium parvum
KVNKNK

SEQ ID NO: 2267905 - protein, 5 aa, Cryptosporidium parvum
KVNNK

SEQ ID NO: 2267906 - protein, 7 aa, Cryptosporidium parvum
KVNNRGR

SEQ ID NO: 2267907 - protein, 11 aa, Cryptosporidium parvum
KVNPKNPPVPG

SEQ ID NO: 2267908 - protein, 12 aa, Cryptosporidium parvum
KVNQSLSKNYSE

SEQ ID NO: 2267909 - protein, 7 aa, Cryptosporidium parvum
KVPDSTY

SEQ ID NO: 2267910 - protein, 13 aa, Cryptosporidium parvum
KVPEDYASRPSFT

SEQ ID NO: 2267911 - protein, 6 aa, Cryptosporidium parvum
KVPEEQ

SEQ ID NO: 2267912 - protein, 16 aa, Cryptosporidium parvum
KVPEGKNQDIKQDSDS

SEQ ID NO: 2267913 - protein, 6 aa, Cryptosporidium parvum
KVPEHE

SEQ ID NO: 2267914 - protein, 25 aa, Cryptosporidium parvum
KVPENDDNSEINKKNAKSNDGCEKI

SEQ ID NO: 2267915 - protein, 6 aa, Cryptosporidium parvum
KVPITP

SEQ ID NO: 2267916 - protein, 5 aa, Cryptosporidium parvum
KVPPS

SEQ ID NO: 2267917 - protein, 4 aa, Cryptosporidium parvum
KVPR

SEQ ID NO: 2267918 - protein, 9 aa, Cryptosporidium parvum
KVPSRAAFK

SEQ ID NO: 2267919 - protein, 5 aa, Cryptosporidium parvum
KVPTN

SEQ ID NO: 2267920 - protein, 15 aa, Cryptosporidium parvum
KVPVSSANSDKQKSW

SEQ ID NO: 2267921 - protein, 14 aa, Cryptosporidium parvum
KVQEEPEKIQHSNT

SEQ ID NO: 2267922 - protein, 13 aa, Cryptosporidium parvum
KVQEKPKKKYIPP

SEQ ID NO: 2267923 - protein, 29 aa, Cryptosporidium parvum
KVQSKNTKTEIKQSSKTVTKKVSSSSQVN

SEQ ID NO: 2267924 - protein, 12 aa, Cryptosporidium parvum
KVQYEPKKGRYI

SEQ ID NO: 2267925 - protein, 21 aa, Cryptosporidium parvum
KVRQKQRNKKAKQGKIDEQLE

SEQ ID NO: 2267926 - protein, 8 aa, Cryptosporidium parvum
KVRRKQSN

SEQ ID NO: 2267927 - protein, 28 aa, Cryptosporidium parvum
KVSADEASKRKRQSNSFPGARKSSGGDL

SEQ ID NO: 2267928 - protein, 13 aa, Cryptosporidium parvum
KVSEAYSGRVGTK

SEQ ID NO: 2267929 - protein, 5 aa, Cryptosporidium parvum
KVSET

SEQ ID NO: 2267930 - protein, 17 aa, Cryptosporidium parvum
KVSIDTSSSDSESEKSV

SEQ ID NO: 2267931 - protein, 7 aa, Cryptosporidium parvum
KVSKEIR

SEQ ID NO: 2267932 - protein, 10 aa, Cryptosporidium parvum
KVSKRDARAF

SEQ ID NO: 2267933 - protein, 6 aa, Cryptosporidium parvum
KVSKTY

SEQ ID NO: 2267934 - protein, 6 aa, Cryptosporidium parvum
KVSLET

SEQ ID NO: 2267935 - protein, 8 aa, Cryptosporidium parvum
KVSQDEYK

SEQ ID NO: 2267936 - protein, 15 aa, Cryptosporidium parvum
KVSSESISKHLGEDN

SEQ ID NO: 2267937 - protein, 12 aa, Cryptosporidium parvum
KVSSNRKRESEK

SEQ ID NO: 2267938 - protein, 8 aa, Cryptosporidium parvum
KVSSQKEV

SEQ ID NO: 2267939 - protein, 16 aa, Cryptosporidium parvum
KVSSYGGRNSKFESEG

SEQ ID NO: 2267940 - protein, 12 aa, Cryptosporidium parvum
KVSTPGGSTQAG

SEQ ID NO: 2267941 - protein, 17 aa, Cryptosporidium parvum
KVTDSSSQPSDQSAYSA

SEQ ID NO: 2267942 - protein, 4 aa, Cryptosporidium parvum
KVTE

SEQ ID NO: 2267943 - protein, 6 aa, Cryptosporidium parvum
KVTEVK

SEQ ID NO: 2267944 - protein, 7 aa, Cryptosporidium parvum
KVTGGTV

SEQ ID NO: 2267945 - protein, 8 aa, Cryptosporidium parvum
KVTKDNNG

SEQ ID NO: 2267946 - protein, 10 aa, Cryptosporidium parvum
KVTPENSSNY

SEQ ID NO: 2267947 - protein, 6 aa, Cryptosporidium parvum
KVTPNS

SEQ ID NO: 2267948 - protein, 15 aa, Cryptosporidium parvum
KVTPPKIDSGEKRGC

SEQ ID NO: 2267949 - protein, 6 aa, Cryptosporidium parvum
KVTSET

SEQ ID NO: 2267950 - protein, 8 aa, Cryptosporidium parvum
KVTSQLSN

SEQ ID NO: 2267951 - protein, 70 aa, Cryptosporidium parvum
KVTTEDSISINEDDEEHIPEKDKDNNKVKVNTNAKDNDNDNDNNNNNVNDDDVNNDDNCDHDDDKKNHLE

SEQ ID NO: 2267952 - protein, 12 aa, Cryptosporidium parvum
KVTTGEQRKRIR

SEQ ID NO: 2267953 - protein, 9 aa, Cryptosporidium parvum
KVVPQRPPD

SEQ ID NO: 2267954 - protein, 4 aa, Cryptosporidium parvum
KVVT

SEQ ID NO: 2267955 - protein, 8 aa, Cryptosporidium parvum
KWAQNEGK

SEQ ID NO: 2267956 - protein, 6 aa, Cryptosporidium parvum
KWDKGP

SEQ ID NO: 2267957 - protein, 11 aa, Cryptosporidium parvum
KWEDKEEKSIV

SEQ ID NO: 2267958 - protein, 12 aa, Cryptosporidium parvum
KWGTPRQGKYGL

SEQ ID NO: 2267959 - protein, 44 aa, Cryptosporidium parvum
KWGTRTKSVKKKESGKKANRQKQVKKDLQDTTVSGGANNNIPSG

SEQ ID NO: 2267960 - protein, 8 aa, Cryptosporidium parvum
KWKNKKER

SEQ ID NO: 2267961 - protein, 16 aa, Cryptosporidium parvum
KWNESPNSSLSGAQGF

SEQ ID NO: 2267962 - protein, 7 aa, Cryptosporidium parvum
KWTDEEH

SEQ ID NO: 2267963 - protein, 5 aa, Cryptosporidium parvum
KWTGI

SEQ ID NO: 2267964 - protein, 20 aa, Cryptosporidium parvum
KYAEENNGILNPRNKSGNLV

SEQ ID NO: 2267965 - protein, 8 aa, Cryptosporidium parvum
KYAGETYT

SEQ ID NO: 2267966 - protein, 5 aa, Cryptosporidium parvum
KYANP

SEQ ID NO: 2267967 - protein, 12 aa, Cryptosporidium parvum
KYAPSEDGEGQD

SEQ ID NO: 2267968 - protein, 13 aa, Cryptosporidium parvum
KYATDGSGNEWGN

SEQ ID NO: 2267969 - protein, 7 aa, Cryptosporidium parvum
KYDESLK

SEQ ID NO: 2267970 - protein, 6 aa, Cryptosporidium parvum
KYDGER

SEQ ID NO: 2267971 - protein, 5 aa, Cryptosporidium parvum
KYDGP

SEQ ID NO: 2267972 - protein, 7 aa, Cryptosporidium parvum
KYDGRKN

SEQ ID NO: 2267973 - protein, 7 aa, Cryptosporidium parvum
KYDNKEN

SEQ ID NO: 2267974 - protein, 6 aa, Cryptosporidium parvum
KYDNQD

SEQ ID NO: 2267975 - protein, 5 aa, Cryptosporidium parvum
KYDQI

SEQ ID NO: 2267976 - protein, 10 aa, Cryptosporidium parvum
KYDSNGNPQY

SEQ ID NO: 2267977 - protein, 10 aa, Cryptosporidium parvum
KYDSPYKDSY

SEQ ID NO: 2267978 - protein, 9 aa, Cryptosporidium parvum
KYDSTRKRE

SEQ ID NO: 2267979 - protein, 6 aa, Cryptosporidium parvum
KYDTAA

SEQ ID NO: 2267980 - protein, 4 aa, Cryptosporidium parvum
KYEI

SEQ ID NO: 2267981 - protein, 18 aa, Cryptosporidium parvum
KYEMGRPASNTKLGASPR

SEQ ID NO: 2267982 - protein, 8 aa, Cryptosporidium parvum
KYEPEKKG

SEQ ID NO: 2267983 - protein, 19 aa, Cryptosporidium parvum
KYEQEKSNKDFKADNKKEY

SEQ ID NO: 2267984 - protein, 16 aa, Cryptosporidium parvum
KYEQNSEKANSNSNNI

SEQ ID NO: 2267985 - protein, 8 aa, Cryptosporidium parvum
KYESLQAE

SEQ ID NO: 2267986 - protein, 6 aa, Cryptosporidium parvum
KYESNE

SEQ ID NO: 2267987 - protein, 5 aa, Cryptosporidium parvum
KYESQ

SEQ ID NO: 2267988 - protein, 8 aa, Cryptosporidium parvum
KYGDSKDK

SEQ ID NO: 2267989 - protein, 6 aa, Cryptosporidium parvum
KYGEKK

SEQ ID NO: 2267990 - protein, 11 aa, Cryptosporidium parvum
KYGKRKNGYLT

SEQ ID NO: 2267991 - protein, 11 aa, Cryptosporidium parvum
KYGLKDKNIKK

SEQ ID NO: 2267992 - protein, 15 aa, Cryptosporidium parvum
KYGNKSEKQKLTFNS

SEQ ID NO: 2267993 - protein, 16 aa, Cryptosporidium parvum
KYGPYETYSGSPASKG

SEQ ID NO: 2267994 - protein, 8 aa, Cryptosporidium parvum
KYGQAPTN

SEQ ID NO: 2267995 - protein, 6 aa, Cryptosporidium parvum
KYGSVE

SEQ ID NO: 2267996 - protein, 7 aa, Cryptosporidium parvum
KYGTEDV

SEQ ID NO: 2267997 - protein, 5 aa, Cryptosporidium parvum
KYIPE

SEQ ID NO: 2267998 - protein, 8 aa, Cryptosporidium parvum
KYIPGSVG

SEQ ID NO: 2267999 - protein, 6 aa, Cryptosporidium parvum
KYITQN

SEQ ID NO: 2268000 - protein, 10 aa, Cryptosporidium parvum
KYKDDARPID

SEQ ID NO: 2268001 - protein, 21 aa, Cryptosporidium parvum
KYKEENKIESIERKKNENNSY

SEQ ID NO: 2268002 - protein, 5 aa, Cryptosporidium parvum
KYKEL

SEQ ID NO: 2268003 - protein, 11 aa, Cryptosporidium parvum
KYKERELESRK

SEQ ID NO: 2268004 - protein, 5 aa, Cryptosporidium parvum
KYKGN

SEQ ID NO: 2268005 - protein, 5 aa, Cryptosporidium parvum
KYKGV

SEQ ID NO: 2268006 - protein, 6 aa, Cryptosporidium parvum
KYKNEI

SEQ ID NO: 2268007 - protein, 47 aa, Cryptosporidium parvum
KYKSNHSSDTQSSTYNRSNIQDYNQNTDYNCSDTSRKENISQEQGIP

SEQ ID NO: 2268008 - protein, 20 aa, Cryptosporidium parvum
KYKSSKESLNKDESGLQNSQ

SEQ ID NO: 2268009 - protein, 16 aa, Cryptosporidium parvum
KYKSTNIVQELIDQLK

SEQ ID NO: 2268010 - protein, 29 aa, Cryptosporidium parvum
KYKTRTQELEKENSALRQELSEKNERISQ

SEQ ID NO: 2268011 - protein, 9 aa, Cryptosporidium parvum
KYKTSEESI

SEQ ID NO: 2268012 - protein, 11 aa, Cryptosporidium parvum
KYNENNKKNSL

SEQ ID NO: 2268013 - protein, 8 aa, Cryptosporidium parvum
KYNKEISQ

SEQ ID NO: 2268014 - protein, 13 aa, Cryptosporidium parvum
KYNKHKKNEPKRK

SEQ ID NO: 2268015 - protein, 13 aa, Cryptosporidium parvum
KYNKRNSSNSKGL

SEQ ID NO: 2268016 - protein, 11 aa, Cryptosporidium parvum
KYNNGQTNNYL

SEQ ID NO: 2268017 - protein, 6 aa, Cryptosporidium parvum
KYNPFG

SEQ ID NO: 2268018 - protein, 29 aa, Cryptosporidium parvum
KYNPSNESIERSDELQNTSTSVQNTKYIS

SEQ ID NO: 2268019 - protein, 5 aa, Cryptosporidium parvum
KYNQE

SEQ ID NO: 2268020 - protein, 12 aa, Cryptosporidium parvum
KYNQKSSRSSQI

SEQ ID NO: 2268021 - protein, 16 aa, Cryptosporidium parvum
KYNSKVKNNTNPTQLK

SEQ ID NO: 2268022 - protein, 15 aa, Cryptosporidium parvum
KYPEKRKISEEIQTE

SEQ ID NO: 2268023 - protein, 4 aa, Cryptosporidium parvum
KYPI

SEQ ID NO: 2268024 - protein, 6 aa, Cryptosporidium parvum
KYPLAK

SEQ ID NO: 2268025 - protein, 4 aa, Cryptosporidium parvum
KYPN

SEQ ID NO: 2268026 - protein, 5 aa, Cryptosporidium parvum
KYPNR

SEQ ID NO: 2268027 - protein, 6 aa, Cryptosporidium parvum
KYPNVD

SEQ ID NO: 2268028 - protein, 12 aa, Cryptosporidium parvum
KYPRDLKQEEAV

SEQ ID NO: 2268029 - protein, 9 aa, Cryptosporidium parvum
KYPSESSQI

SEQ ID NO: 2268030 - protein, 8 aa, Cryptosporidium parvum
KYPSPKDY

SEQ ID NO: 2268031 - protein, 7 aa, Cryptosporidium parvum
KYPTEKD

SEQ ID NO: 2268032 - protein, 5 aa, Cryptosporidium parvum
KYPTL

SEQ ID NO: 2268033 - protein, 7 aa, Cryptosporidium parvum
KYPYNPT

SEQ ID NO: 2268034 - protein, 10 aa, Cryptosporidium parvum
KYQDRSKGSV

SEQ ID NO: 2268035 - protein, 5 aa, Cryptosporidium parvum
KYQGE

SEQ ID NO: 2268036 - protein, 9 aa, Cryptosporidium parvum
KYQHGQDTS

SEQ ID NO: 2268037 - protein, 10 aa, Cryptosporidium parvum
KYQPSDPDFP

SEQ ID NO: 2268038 - protein, 10 aa, Cryptosporidium parvum
KYQPSQSDDE

SEQ ID NO: 2268039 - protein, 6 aa, Cryptosporidium parvum
KYQPSS

SEQ ID NO: 2268040 - protein, 6 aa, Cryptosporidium parvum
KYQQAI

SEQ ID NO: 2268041 - protein, 6 aa, Cryptosporidium parvum
KYQQTK

SEQ ID NO: 2268042 - protein, 8 aa, Cryptosporidium parvum
KYRDEPES

SEQ ID NO: 2268043 - protein, 14 aa, Cryptosporidium parvum
KYRDPKSQAHIPYR

SEQ ID NO: 2268044 - protein, 13 aa, Cryptosporidium parvum
KYRDSKPLKGARI

SEQ ID NO: 2268045 - protein, 6 aa, Cryptosporidium parvum
KYRETF

SEQ ID NO: 2268046 - protein, 4 aa, Cryptosporidium parvum
KYRN

SEQ ID NO: 2268047 - protein, 10 aa, Cryptosporidium parvum
KYRNGREKDL

SEQ ID NO: 2268048 - protein, 10 aa, Cryptosporidium parvum
KYRSNFSNEY

SEQ ID NO: 2268049 - protein, 5 aa, Cryptosporidium parvum
KYRTI

SEQ ID NO: 2268050 - protein, 7 aa, Cryptosporidium parvum
KYSAISS

SEQ ID NO: 2268051 - protein, 8 aa, Cryptosporidium parvum
KYSANNDY

SEQ ID NO: 2268052 - protein, 8 aa, Cryptosporidium parvum
KYSDPIEP

SEQ ID NO: 2268053 - protein, 15 aa, Cryptosporidium parvum
KYSEIQKTKLKGGKK

SEQ ID NO: 2268054 - protein, 5 aa, Cryptosporidium parvum
KYSES

SEQ ID NO: 2268055 - protein, 7 aa, Cryptosporidium parvum
KYSESSI

SEQ ID NO: 2268056 - protein, 22 aa, Cryptosporidium parvum
KYSESSSNTKALASLKGSLPED

SEQ ID NO: 2268057 - protein, 5 aa, Cryptosporidium parvum
KYSGF

SEQ ID NO: 2268058 - protein, 15 aa, Cryptosporidium parvum
KYSKDEMSGQPSKGI

SEQ ID NO: 2268059 - protein, 8 aa, Cryptosporidium parvum
KYSKGSYQ

SEQ ID NO: 2268060 - protein, 39 aa, Cryptosporidium parvum
KYSKKKERNYGLNSKEALESLEESDRNNNNHDQSRSPVP

SEQ ID NO: 2268061 - protein, 4 aa, Cryptosporidium parvum
KYSN

SEQ ID NO: 2268062 - protein, 13 aa, Cryptosporidium parvum
KYSNKNEDSAFSE

SEQ ID NO: 2268063 - protein, 6 aa, Cryptosporidium parvum
KYSNNS

SEQ ID NO: 2268064 - protein, 6 aa, Cryptosporidium parvum
KYSPER

SEQ ID NO: 2268065 - protein, 6 aa, Cryptosporidium parvum
KYSQEK

SEQ ID NO: 2268066 - protein, 4 aa, Cryptosporidium parvum
KYSS

SEQ ID NO: 2268067 - protein, 9 aa, Cryptosporidium parvum
KYSSAQNLA

SEQ ID NO: 2268068 - protein, 9 aa, Cryptosporidium parvum
KYSSDEEIF

SEQ ID NO: 2268069 - protein, 5 aa, Cryptosporidium parvum
KYSSL

SEQ ID NO: 2268070 - protein, 12 aa, Cryptosporidium parvum
KYSSLSASECQD

SEQ ID NO: 2268071 - protein, 40 aa, Cryptosporidium parvum
KYSSNSASSTSTNLPNKSISGSVSKSRFDNAYKGTNGIGS

SEQ ID NO: 2268072 - protein, 9 aa, Cryptosporidium parvum
KYSSRRKAS

SEQ ID NO: 2268073 - protein, 6 aa, Cryptosporidium parvum
KYSSSL

SEQ ID NO: 2268074 - protein, 5 aa, Cryptosporidium parvum
KYSWG

SEQ ID NO: 2268075 - protein, 7 aa, Cryptosporidium parvum
KYSYSSI

SEQ ID NO: 2268076 - protein, 16 aa, Cryptosporidium parvum
KYTDSEYSGLNTDDLR

SEQ ID NO: 2268077 - protein, 6 aa, Cryptosporidium parvum
KYTGNV

SEQ ID NO: 2268078 - protein, 5 aa, Cryptosporidium parvum
KYTHK

SEQ ID NO: 2268079 - protein, 9 aa, Cryptosporidium parvum
KYTKESPRQ

SEQ ID NO: 2268080 - protein, 20 aa, Cryptosporidium parvum
KYTNTNLSNTRPSESNTDRS

SEQ ID NO: 2268081 - protein, 8 aa, Cryptosporidium parvum
KYTRGNQT

SEQ ID NO: 2268082 - protein, 8 aa, Cryptosporidium parvum
KYTSESET

SEQ ID NO: 2268083 - protein, 9 aa, Cryptosporidium parvum
KYVNENSSQ

SEQ ID NO: 2268084 - protein, 4 aa, Cryptosporidium parvum
KYVP

SEQ ID NO: 2268085 - protein, 7 aa, Cryptosporidium parvum
KYYDQGA

SEQ ID NO: 2268086 - protein, 10 aa, Cryptosporidium parvum
LAAPTSEKMQ

SEQ ID NO: 2268087 - protein, 5 aa, Cryptosporidium parvum
LADED

SEQ ID NO: 2268088 - protein, 15 aa, Cryptosporidium parvum
LADGQENNKECDTNR

SEQ ID NO: 2268089 - protein, 14 aa, Cryptosporidium parvum
LADSSSSSSSSSSD

SEQ ID NO: 2268090 - protein, 7 aa, Cryptosporidium parvum
LAEATNE

SEQ ID NO: 2268091 - protein, 6 aa, Cryptosporidium parvum
LAEDPY

SEQ ID NO: 2268092 - protein, 5 aa, Cryptosporidium parvum
LAEER

SEQ ID NO: 2268093 - protein, 9 aa, Cryptosporidium parvum
LAEQTNMNS

SEQ ID NO: 2268094 - protein, 9 aa, Cryptosporidium parvum
LAERSKEIY

SEQ ID NO: 2268095 - protein, 13 aa, Cryptosporidium parvum
LAESKDPSSSLKT

SEQ ID NO: 2268096 - protein, 11 aa, Cryptosporidium parvum
LAESSRYERSS

SEQ ID NO: 2268097 - protein, 15 aa, Cryptosporidium parvum
LAESTNAEDRKIQKK

SEQ ID NO: 2268098 - protein, 10 aa, Cryptosporidium parvum
LAGAAGETSG

SEQ ID NO: 2268099 - protein, 10 aa, Cryptosporidium parvum
LAGENSQGTM

SEQ ID NO: 2268100 - protein, 6 aa, Cryptosporidium parvum
LAGNDD

SEQ ID NO: 2268101 - protein, 4 aa, Cryptosporidium parvum
LAHT

SEQ ID NO: 2268102 - protein, 7 aa, Cryptosporidium parvum
LAKEEKY

SEQ ID NO: 2268103 - protein, 12 aa, Cryptosporidium parvum
LAKGTKSGGFQH

SEQ ID NO: 2268104 - protein, 9 aa, Cryptosporidium parvum
LAKGTNRRS

SEQ ID NO: 2268105 - protein, 11 aa, Cryptosporidium parvum
LAKKNKEFAEK

SEQ ID NO: 2268106 - protein, 4 aa, Cryptosporidium parvum
LAKN

SEQ ID NO: 2268107 - protein, 11 aa, Cryptosporidium parvum
LAKNDPKTSIG

SEQ ID NO: 2268108 - protein, 6 aa, Cryptosporidium parvum
LAKNQF

SEQ ID NO: 2268109 - protein, 9 aa, Cryptosporidium parvum
LAKRPKTTQ

SEQ ID NO: 2268110 - protein, 11 aa, Cryptosporidium parvum
LAKSKVNTENI

SEQ ID NO: 2268111 - protein, 5 aa, Cryptosporidium parvum
LAKSP

SEQ ID NO: 2268112 - protein, 14 aa, Cryptosporidium parvum
LAKTQNENQTQPNK

SEQ ID NO: 2268113 - protein, 12 aa, Cryptosporidium parvum
LANAEGDANDHT

SEQ ID NO: 2268114 - protein, 16 aa, Cryptosporidium parvum
LANENKRLNDRLKQDK

SEQ ID NO: 2268115 - protein, 16 aa, Cryptosporidium parvum
LANKDGSPTKLGPPKI

SEQ ID NO: 2268116 - protein, 10 aa, Cryptosporidium parvum
LANKTTECSD

SEQ ID NO: 2268117 - protein, 6 aa, Cryptosporidium parvum
LANNPQ

SEQ ID NO: 2268118 - protein, 5 aa, Cryptosporidium parvum
LANPG

SEQ ID NO: 2268119 - protein, 6 aa, Cryptosporidium parvum
LANPSS

SEQ ID NO: 2268120 - protein, 12 aa, Cryptosporidium parvum
LANSKKTSEKVN

SEQ ID NO: 2268121 - protein, 8 aa, Cryptosporidium parvum
LAPAANAN

SEQ ID NO: 2268122 - protein, 9 aa, Cryptosporidium parvum
LAPAGTNDA

SEQ ID NO: 2268123 - protein, 15 aa, Cryptosporidium parvum
LAPDSVKQQRLEEQK

SEQ ID NO: 2268124 - protein, 12 aa, Cryptosporidium parvum
LAPGKVKQITPP

SEQ ID NO: 2268125 - protein, 5 aa, Cryptosporidium parvum
LAPLA

SEQ ID NO: 2268126 - protein, 48 aa, Cryptosporidium parvum
LAPPKNPPKVSHISPKTQKTSDLTKSKETSSTSSDEEAPPAPPAPLPL

SEQ ID NO: 2268127 - protein, 14 aa, Cryptosporidium parvum
LAQDVTTTGTQEGK

SEQ ID NO: 2268128 - protein, 12 aa, Cryptosporidium parvum
LAQESANFSGAE

SEQ ID NO: 2268129 - protein, 14 aa, Cryptosporidium parvum
LAQESLEESSIAPS

SEQ ID NO: 2268130 - protein, 9 aa, Cryptosporidium parvum
LAQQREDER

SEQ ID NO: 2268131 - protein, 13 aa, Cryptosporidium parvum
LARENDKKTRYDI

SEQ ID NO: 2268132 - protein, 7 aa, Cryptosporidium parvum
LARTGSS

SEQ ID NO: 2268133 - protein, 10 aa, Cryptosporidium parvum
LASEAQKSTF

SEQ ID NO: 2268134 - protein, 10 aa, Cryptosporidium parvum
LASENTGNLT

SEQ ID NO: 2268135 - protein, 7 aa, Cryptosporidium parvum
LASGDAD

SEQ ID NO: 2268136 - protein, 8 aa, Cryptosporidium parvum
LASGGQDD

SEQ ID NO: 2268137 - protein, 9 aa, Cryptosporidium parvum
LASGSADET

SEQ ID NO: 2268138 - protein, 14 aa, Cryptosporidium parvum
LASGSSSSSASPSI

SEQ ID NO: 2268139 - protein, 53 aa, Cryptosporidium parvum
LASIPSNIAGSASLANSSGKPNDSSSQNVDSGSISYGKVGSNSKFTNKAASNN

SEQ ID NO: 2268140 - protein, 4 aa, Cryptosporidium parvum
LASP

SEQ ID NO: 2268141 - protein, 7 aa, Cryptosporidium parvum
LASPDLN

SEQ ID NO: 2268142 - protein, 34 aa, Cryptosporidium parvum
LASPTYRKNVQQSRSNNNTTLPNSNLNNLTFSYK

SEQ ID NO: 2268143 - protein, 10 aa, Cryptosporidium parvum
LASPVSAKSI

SEQ ID NO: 2268144 - protein, 11 aa, Cryptosporidium parvum
LASQDGSIRKR

SEQ ID NO: 2268145 - protein, 9 aa, Cryptosporidium parvum
LASSGKDGA

SEQ ID NO: 2268146 - protein, 16 aa, Cryptosporidium parvum
LASSNSTISGNNSCPN

SEQ ID NO: 2268147 - protein, 8 aa, Cryptosporidium parvum
LASSRDKT

SEQ ID NO: 2268148 - protein, 13 aa, Cryptosporidium parvum
LASSSDESIDDYS

SEQ ID NO: 2268149 - protein, 9 aa, Cryptosporidium parvum
LASSTPNVT

SEQ ID NO: 2268150 - protein, 6 aa, Cryptosporidium parvum
LATGAS

SEQ ID NO: 2268151 - protein, 9 aa, Cryptosporidium parvum
LATGSGDTT

SEQ ID NO: 2268152 - protein, 18 aa, Cryptosporidium parvum
LATNNNNNNLEGNKGYNI

SEQ ID NO: 2268153 - protein, 7 aa, Cryptosporidium parvum
LATNYQP

SEQ ID NO: 2268154 - protein, 31 aa, Cryptosporidium parvum
LDANTSSVSKGIPNKTPPKSPENNDDNKNSL

SEQ ID NO: 2268155 - protein, 7 aa, Cryptosporidium parvum
LDASKQK

SEQ ID NO: 2268156 - protein, 8 aa, Cryptosporidium parvum
LDATNTGL

SEQ ID NO: 2268157 - protein, 5 aa, Cryptosporidium parvum
LDATP

SEQ ID NO: 2268158 - protein, 7 aa, Cryptosporidium parvum
LDDDDIK

SEQ ID NO: 2268159 - protein, 10 aa, Cryptosporidium parvum
LDDDKNSHLT

SEQ ID NO: 2268160 - protein, 16 aa, Cryptosporidium parvum
LDDEDKINEKVSQSLR

SEQ ID NO: 2268161 - protein, 7 aa, Cryptosporidium parvum
LDDESPA

SEQ ID NO: 2268162 - protein, 7 aa, Cryptosporidium parvum
LDDKEKA

SEQ ID NO: 2268163 - protein, 10 aa, Cryptosporidium parvum
LDDKGELTKV

SEQ ID NO: 2268164 - protein, 10 aa, Cryptosporidium parvum
LDDKKPDTFN

SEQ ID NO: 2268165 - protein, 10 aa, Cryptosporidium parvum
LDDNGSLTDL

SEQ ID NO: 2268166 - protein, 25 aa, Cryptosporidium parvum
LDDNQEKDNSNEKKNIKGLGEGEEL

SEQ ID NO: 2268167 - protein, 8 aa, Cryptosporidium parvum
LDDPDEAR

SEQ ID NO: 2268168 - protein, 12 aa, Cryptosporidium parvum
LDDSDSDNYQLE

SEQ ID NO: 2268169 - protein, 6 aa, Cryptosporidium parvum
LDDSSK

SEQ ID NO: 2268170 - protein, 15 aa, Cryptosporidium parvum
LDDTERFNSRTDPRF

SEQ ID NO: 2268171 - protein, 7 aa, Cryptosporidium parvum
LDDTPRC

SEQ ID NO: 2268172 - protein, 5 aa, Cryptosporidium parvum
LDDYP

SEQ ID NO: 2268173 - protein, 6 aa, Cryptosporidium parvum
LDEDDP

SEQ ID NO: 2268174 - protein, 5 aa, Cryptosporidium parvum
LDEEK

SEQ ID NO: 2268175 - protein, 9 aa, Cryptosporidium parvum
LDEKKSGYL

SEQ ID NO: 2268176 - protein, 4 aa, Cryptosporidium parvum
LDEN

SEQ ID NO: 2268177 - protein, 9 aa, Cryptosporidium parvum
LDENDPDSA

SEQ ID NO: 2268178 - protein, 15 aa, Cryptosporidium parvum
LDENGEQVQTMSQPN

SEQ ID NO: 2268179 - protein, 11 aa, Cryptosporidium parvum
LDENKTGLQDS

SEQ ID NO: 2268180 - protein, 9 aa, Cryptosporidium parvum
LDENNNSKL

SEQ ID NO: 2268181 - protein, 5 aa, Cryptosporidium parvum
LDEPQ

SEQ ID NO: 2268182 - protein, 5 aa, Cryptosporidium parvum
LDERD

SEQ ID NO: 2268183 - protein, 6 aa, Cryptosporidium parvum
LDERNT

SEQ ID NO: 2268184 - protein, 6 aa, Cryptosporidium parvum
LDERTY

SEQ ID NO: 2268185 - protein, 6 aa, Cryptosporidium parvum
LDESEA

SEQ ID NO: 2268186 - protein, 15 aa, Cryptosporidium parvum
LDESKDKKQVQDDEE

SEQ ID NO: 2268187 - protein, 6 aa, Cryptosporidium parvum
LDESRI

SEQ ID NO: 2268188 - protein, 22 aa, Cryptosporidium parvum
LDESSTDSESEESTVKKRVNRR

SEQ ID NO: 2268189 - protein, 13 aa, Cryptosporidium parvum
LDEVKGGRAAKLS

SEQ ID NO: 2268190 - protein, 12 aa, Cryptosporidium parvum
LDGDGDNAISPD

SEQ ID NO: 2268191 - protein, 7 aa, Cryptosporidium parvum
LDGENSQ

SEQ ID NO: 2268192 - protein, 6 aa, Cryptosporidium parvum
LDGETD

SEQ ID NO: 2268193 - protein, 11 aa, Cryptosporidium parvum
LDGKDGDDQTI

SEQ ID NO: 2268194 - protein, 16 aa, Cryptosporidium parvum
LDGNNGYRLGDTGQGI

SEQ ID NO: 2268195 - protein, 8 aa, Cryptosporidium parvum
LDGQARFE

SEQ ID NO: 2268196 - protein, 5 aa, Cryptosporidium parvum
LDGSH

SEQ ID NO: 2268197 - protein, 11 aa, Cryptosporidium parvum
LDGSKNEYGFT

SEQ ID NO: 2268198 - protein, 8 aa, Cryptosporidium parvum
LDGSTDIY

SEQ ID NO: 2268199 - protein, 7 aa, Cryptosporidium parvum
LDGTGAT

SEQ ID NO: 2268200 - protein, 10 aa, Cryptosporidium parvum
LDHGSPASSD

SEQ ID NO: 2268201 - protein, 7 aa, Cryptosporidium parvum
LDHNNSM

SEQ ID NO: 2268202 - protein, 4 aa, Cryptosporidium parvum
LDIP

SEQ ID NO: 2268203 - protein, 10 aa, Cryptosporidium parvum
LDIQNDKKSA

SEQ ID NO: 2268204 - protein, 11 aa, Cryptosporidium parvum
LDISDDSKLKS

SEQ ID NO: 2268205 - protein, 4 aa, Cryptosporidium parvum
LDIT

SEQ ID NO: 2268206 - protein, 5 aa, Cryptosporidium parvum
LDITN

SEQ ID NO: 2268207 - protein, 10 aa, Cryptosporidium parvum
LDKAEEDENL

SEQ ID NO: 2268208 - protein, 8 aa, Cryptosporidium parvum
LDKNHEPK

SEQ ID NO: 2268209 - protein, 14 aa, Cryptosporidium parvum
LDKNKQSKSNQSQN

SEQ ID NO: 2268210 - protein, 10 aa, Cryptosporidium parvum
LDKNSDLSKD

SEQ ID NO: 2268211 - protein, 11 aa, Cryptosporidium parvum
LDKNYDKGVSN

SEQ ID NO: 2268212 - protein, 23 aa, Cryptosporidium parvum
LDKPPEEHEAFGESSRSSIGSTA

SEQ ID NO: 2268213 - protein, 8 aa, Cryptosporidium parvum
LDKRSGNI

SEQ ID NO: 2268214 - protein, 8 aa, Cryptosporidium parvum
LDKYNSKN

SEQ ID NO: 2268215 - protein, 9 aa, Cryptosporidium parvum
LDLPKPQLS

SEQ ID NO: 2268216 - protein, 4 aa, Cryptosporidium parvum
LDND

SEQ ID NO: 2268217 - protein, 11 aa, Cryptosporidium parvum
LDNEDNQSMTG

SEQ ID NO: 2268218 - protein, 4 aa, Cryptosporidium parvum
LDNG

SEQ ID NO: 2268219 - protein, 15 aa, Cryptosporidium parvum
LDNGTSEPINLSVQN

SEQ ID NO: 2268220 - protein, 4 aa, Cryptosporidium parvum
LDNI

SEQ ID NO: 2268221 - protein, 4 aa, Cryptosporidium parvum
LDNN

SEQ ID NO: 2268222 - protein, 15 aa, Cryptosporidium parvum
LDNNDHKKTENKKNQ

SEQ ID NO: 2268223 - protein, 5 aa, Cryptosporidium parvum
LDNNE

SEQ ID NO: 2268224 - protein, 9 aa, Cryptosporidium parvum
LDNNENEKY

SEQ ID NO: 2268225 - protein, 8 aa, Cryptosporidium parvum
LDNNSNLA

SEQ ID NO: 2268226 - protein, 4 aa, Cryptosporidium parvum
LDNQ

SEQ ID NO: 2268227 - protein, 13 aa, Cryptosporidium parvum
LDNRNISDNEPTI

SEQ ID NO: 2268228 - protein, 9 aa, Cryptosporidium parvum
LDNSDSSCS

SEQ ID NO: 2268229 - protein, 7 aa, Cryptosporidium parvum
LDNSGSI

SEQ ID NO: 2268230 - protein, 8 aa, Cryptosporidium parvum
LDNSNENP

SEQ ID NO: 2268231 - protein, 55 aa, Cryptosporidium parvum
LDNSNNNNNNDNQEKEEISRKINKNSGLKTKKTISKKKDDIKTKTNQSDKSKKKV

SEQ ID NO: 2268232 - protein, 9 aa, Cryptosporidium parvum
LDNTGEYYS

SEQ ID NO: 2268233 - protein, 14 aa, Cryptosporidium parvum
LDNTPKDGGNGLIG

SEQ ID NO: 2268234 - protein, 4 aa, Cryptosporidium parvum
LDPA

SEQ ID NO: 2268235 - protein, 4 aa, Cryptosporidium parvum
LDPD

SEQ ID NO: 2268236 - protein, 11 aa, Cryptosporidium parvum
LDPDEENNQPD

SEQ ID NO: 2268237 - protein, 8 aa, Cryptosporidium parvum
LDPDYPPA

SEQ ID NO: 2268238 - protein, 5 aa, Cryptosporidium parvum
LDPEK

SEQ ID NO: 2268239 - protein, 7 aa, Cryptosporidium parvum
LDPGATN

SEQ ID NO: 2268240 - protein, 9 aa, Cryptosporidium parvum
LDPKAKTPF

SEQ ID NO: 2268241 - protein, 5 aa, Cryptosporidium parvum
LDPNQ

SEQ ID NO: 2268242 - protein, 12 aa, Cryptosporidium parvum
LDPQCGNISKDD

SEQ ID NO: 2268243 - protein, 7 aa, Cryptosporidium parvum
LDPQDPV

SEQ ID NO: 2268244 - protein, 8 aa, Cryptosporidium parvum
LDPREKYS

SEQ ID NO: 2268245 - protein, 21 aa, Cryptosporidium parvum
LDPSDYNYRPNYDNSNDSEDY

SEQ ID NO: 2268246 - protein, 26 aa, Cryptosporidium parvum
LDPSKKSNQSEKVDYNNNKKDKDDEH

SEQ ID NO: 2268247 - protein, 9 aa, Cryptosporidium parvum
LDPSNNKQY

SEQ ID NO: 2268248 - protein, 6 aa, Cryptosporidium parvum
LDPSQA

SEQ ID NO: 2268249 - protein, 7 aa, Cryptosporidium parvum
LDPSTEI

SEQ ID NO: 2268250 - protein, 16 aa, Cryptosporidium parvum
LDQENARAPSNGTSIE

SEQ ID NO: 2268251 - protein, 10 aa, Cryptosporidium parvum
LDQESDQNMK

SEQ ID NO: 2268252 - protein, 12 aa, Cryptosporidium parvum
LDQESNNAITNT

SEQ ID NO: 2268253 - protein, 13 aa, Cryptosporidium parvum
LDQETSNYFNGER

SEQ ID NO: 2268254 - protein, 8 aa, Cryptosporidium parvum
LDQGSKKC

SEQ ID NO: 2268255 - protein, 10 aa, Cryptosporidium parvum
LDQNKELTKT

SEQ ID NO: 2268256 - protein, 10 aa, Cryptosporidium parvum
LDQQKHEESY

SEQ ID NO: 2268257 - protein, 10 aa, Cryptosporidium parvum
LDQSEKEAER

SEQ ID NO: 2268258 - protein, 5 aa, Cryptosporidium parvum
LDRDE

SEQ ID NO: 2268259 - protein, 13 aa, Cryptosporidium parvum
LDRSERKSRWKSN

SEQ ID NO: 2268260 - protein, 8 aa, Cryptosporidium parvum
LDRSSNGD

SEQ ID NO: 2268261 - protein, 10 aa, Cryptosporidium parvum
LDRTQRKCGD

SEQ ID NO: 2268262 - protein, 31 aa, Cryptosporidium parvum
LDSDEDEVQNGKNLINGKDKDEESENFKDKQ

SEQ ID NO: 2268263 - protein, 16 aa, Cryptosporidium parvum
LDSDSVSEHYKEPDPI

SEQ ID NO: 2268264 - protein, 4 aa, Cryptosporidium parvum
LDSE

SEQ ID NO: 2268265 - protein, 7 aa, Cryptosporidium parvum
LDSEDFR

SEQ ID NO: 2268266 - protein, 17 aa, Cryptosporidium parvum
LDSEDTLKSKSLNTTDK

SEQ ID NO: 2268267 - protein, 6 aa, Cryptosporidium parvum
LDSETI

SEQ ID NO: 2268268 - protein, 9 aa, Cryptosporidium parvum
LDSGESNPN

SEQ ID NO: 2268269 - protein, 4 aa, Cryptosporidium parvum
LDSH

SEQ ID NO: 2268270 - protein, 5 aa, Cryptosporidium parvum
LDSKN

SEQ ID NO: 2268271 - protein, 7 aa, Cryptosporidium parvum
LDSKTQD

SEQ ID NO: 2268272 - protein, 7 aa, Cryptosporidium parvum
LDSNGKK

SEQ ID NO: 2268273 - protein, 5 aa, Cryptosporidium parvum
LDSNI

SEQ ID NO: 2268274 - protein, 10 aa, Cryptosporidium parvum
LDSNNQKKLY

SEQ ID NO: 2268275 - protein, 17 aa, Cryptosporidium parvum
LDSNSSKKVETSSMQTN

SEQ ID NO: 2268276 - protein, 7 aa, Cryptosporidium parvum
LDSNYTP

SEQ ID NO: 2268277 - protein, 17 aa, Cryptosporidium parvum
LDSPSKLGTPSSRSSVS

SEQ ID NO: 2268278 - protein, 7 aa, Cryptosporidium parvum
LDSQNES

SEQ ID NO: 2268279 - protein, 15 aa, Cryptosporidium parvum
LDSSKFGDSKYDDFG

SEQ ID NO: 2268280 - protein, 5 aa, Cryptosporidium parvum
LDSTL

SEQ ID NO: 2268281 - protein, 10 aa, Cryptosporidium parvum
LDSVGNDSSI

SEQ ID NO: 2268282 - protein, 6 aa, Cryptosporidium parvum
LDSVPS

SEQ ID NO: 2268283 - protein, 14 aa, Cryptosporidium parvum
LDTDLRAKSAQFNE

SEQ ID NO: 2268284 - protein, 8 aa, Cryptosporidium parvum
LDTDNDGV

SEQ ID NO: 2268285 - protein, 6 aa, Cryptosporidium parvum
LDTEAT

SEQ ID NO: 2268286 - protein, 13 aa, Cryptosporidium parvum
LDTEDKARNQEGR

SEQ ID NO: 2268287 - protein, 10 aa, Cryptosporidium parvum
LDTESSQNSG

SEQ ID NO: 2268288 - protein, 5 aa, Cryptosporidium parvum
LDTKE

SEQ ID NO: 2268289 - protein, 13 aa, Cryptosporidium parvum
LDTLTPKKVREEL

SEQ ID NO: 2268290 - protein, 11 aa, Cryptosporidium parvum
LDTPSKPKDGC

SEQ ID NO: 2268291 - protein, 7 aa, Cryptosporidium parvum
LDTQENK

SEQ ID NO: 2268292 - protein, 11 aa, Cryptosporidium parvum
LDTSSKMGQKD

SEQ ID NO: 2268293 - protein, 10 aa, Cryptosporidium parvum
LDTSSRKMGP

SEQ ID NO: 2268294 - protein, 4 aa, Cryptosporidium parvum
LDTY

SEQ ID NO: 2268295 - protein, 35 aa, Cryptosporidium parvum
LDTYTPETSPCSHRSYSSSKSLYSKDSSLISNTPL

SEQ ID NO: 2268296 - protein, 6 aa, Cryptosporidium parvum
LDVNSN

SEQ ID NO: 2268297 - protein, 10 aa, Cryptosporidium parvum
LDVRSGGSQL

SEQ ID NO: 2268298 - protein, 5 aa, Cryptosporidium parvum
LDYGE

SEQ ID NO: 2268299 - protein, 4 aa, Cryptosporidium parvum
LDYS

SEQ ID NO: 2268300 - protein, 6 aa, Cryptosporidium parvum
LDYSNT

SEQ ID NO: 2268301 - protein, 12 aa, Cryptosporidium parvum
LDYTSDKRGTLK

SEQ ID NO: 2268302 - protein, 4 aa, Cryptosporidium parvum
LEAE

SEQ ID NO: 2268303 - protein, 21 aa, Cryptosporidium parvum
LEAEKENSSSNSYFKGNSNHK

SEQ ID NO: 2268304 - protein, 34 aa, Cryptosporidium parvum
LEAERKKREEAERKRIEEEKRRQREEAERKMKAD

SEQ ID NO: 2268305 - protein, 7 aa, Cryptosporidium parvum
LEAETVE

SEQ ID NO: 2268306 - protein, 8 aa, Cryptosporidium parvum
LEAGNDPL

SEQ ID NO: 2268307 - protein, 7 aa, Cryptosporidium parvum
LEANTGG

SEQ ID NO: 2268308 - protein, 11 aa, Cryptosporidium parvum
LEASKDDDNEL

SEQ ID NO: 2268309 - protein, 6 aa, Cryptosporidium parvum
LEASNS

SEQ ID NO: 2268310 - protein, 10 aa, Cryptosporidium parvum
LEDANKRISQ

SEQ ID NO: 2268311 - protein, 8 aa, Cryptosporidium parvum
LEDDGSET

SEQ ID NO: 2268312 - protein, 10 aa, Cryptosporidium parvum
LEDDLTEKQL

SEQ ID NO: 2268313 - protein, 11 aa, Cryptosporidium parvum
LEDDQSENKKS

SEQ ID NO: 2268314 - protein, 13 aa, Cryptosporidium parvum
LEDEKKNEENDND

SEQ ID NO: 2268315 - protein, 6 aa, Cryptosporidium parvum
LEDERK

SEQ ID NO: 2268316 - protein, 7 aa, Cryptosporidium parvum
LEDGTSL

SEQ ID NO: 2268317 - protein, 7 aa, Cryptosporidium parvum
LEDKRKE

SEQ ID NO: 2268318 - protein, 21 aa, Cryptosporidium parvum
LEDRNTASQAAALANATSQLE

SEQ ID NO: 2268319 - protein, 14 aa, Cryptosporidium parvum
LEDRPDGSFIWKSV

SEQ ID NO: 2268320 - protein, 8 aa, Cryptosporidium parvum
LEDSGNRL

SEQ ID NO: 2268321 - protein, 5 aa, Cryptosporidium parvum
LEDSK

SEQ ID NO: 2268322 - protein, 6 aa, Cryptosporidium parvum
LEDSRT

SEQ ID NO: 2268323 - protein, 9 aa, Cryptosporidium parvum
LEDSSSGLN

SEQ ID NO: 2268324 - protein, 4 aa, Cryptosporidium parvum
LEDY

SEQ ID NO: 2268325 - protein, 7 aa, Cryptosporidium parvum
LEEADKG

SEQ ID NO: 2268326 - protein, 7 aa, Cryptosporidium parvum
LEEAEEL

SEQ ID NO: 2268327 - protein, 6 aa, Cryptosporidium parvum
LEEATT

SEQ ID NO: 2268328 - protein, 6 aa, Cryptosporidium parvum
LEEDKQ

SEQ ID NO: 2268329 - protein, 8 aa, Cryptosporidium parvum
LEEDSEMR

SEQ ID NO: 2268330 - protein, 4 aa, Cryptosporidium parvum
LEEE

SEQ ID NO: 2268331 - protein, 8 aa, Cryptosporidium parvum
LEEEMGGA

SEQ ID NO: 2268332 - protein, 6 aa, Cryptosporidium parvum
LEEETS

SEQ ID NO: 2268333 - protein, 6 aa, Cryptosporidium parvum
LEEGGQ

SEQ ID NO: 2268334 - protein, 9 aa, Cryptosporidium parvum
LEEGLSREK

SEQ ID NO: 2268335 - protein, 7 aa, Cryptosporidium parvum
LEEGTGN

SEQ ID NO: 2268336 - protein, 4 aa, Cryptosporidium parvum
LEEK

SEQ ID NO: 2268337 - protein, 5 aa, Cryptosporidium parvum
LEEKA

SEQ ID NO: 2268338 - protein, 11 aa, Cryptosporidium parvum
LEEKDDGTVGF

SEQ ID NO: 2268339 - protein, 11 aa, Cryptosporidium parvum
LEEKEKREFSM

SEQ ID NO: 2268340 - protein, 11 aa, Cryptosporidium parvum
LEEKNNPQNCL

SEQ ID NO: 2268341 - protein, 5 aa, Cryptosporidium parvum
LEELN

SEQ ID NO: 2268342 - protein, 5 aa, Cryptosporidium parvum
LEENE

SEQ ID NO: 2268343 - protein, 11 aa, Cryptosporidium parvum
LEENEVGQSMT

SEQ ID NO: 2268344 - protein, 26 aa, Cryptosporidium parvum
LEENGGGGGGGDGGDSEGNKKSSQLL

SEQ ID NO: 2268345 - protein, 12 aa, Cryptosporidium parvum
LEENKKLKDRIK

SEQ ID NO: 2268346 - protein, 14 aa, Cryptosporidium parvum
LEENSLEKTLTSSP

SEQ ID NO: 2268347 - protein, 18 aa, Cryptosporidium parvum
LEEQEAKSEEKSNTQNSK

SEQ ID NO: 2268348 - protein, 30 aa, Cryptosporidium parvum
LEEQEQEQEQEQELGQEHQERLDDNIKERP

SEQ ID NO: 2268349 - protein, 9 aa, Cryptosporidium parvum
LEEQNGKVE

SEQ ID NO: 2268350 - protein, 5 aa, Cryptosporidium parvum
LEEQQ

SEQ ID NO: 2268351 - protein, 4 aa, Cryptosporidium parvum
LEER

SEQ ID NO: 2268352 - protein, 10 aa, Cryptosporidium parvum
LEEREKQGHP

SEQ ID NO: 2268353 - protein, 10 aa, Cryptosporidium parvum
LEEREKSVKD

SEQ ID NO: 2268354 - protein, 21 aa, Cryptosporidium parvum
LEERRKTNNDLNVDSNQPIDE

SEQ ID NO: 2268355 - protein, 4 aa, Cryptosporidium parvum
LEES

SEQ ID NO: 2268356 - protein, 5 aa, Cryptosporidium parvum
LEESD

SEQ ID NO: 2268357 - protein, 16 aa, Cryptosporidium parvum
LEESGNANNSSSDQEI

SEQ ID NO: 2268358 - protein, 8 aa, Cryptosporidium parvum
LEESGSQD

SEQ ID NO: 2268359 - protein, 14 aa, Cryptosporidium parvum
LEESLEDSVENSIE

SEQ ID NO: 2268360 - protein, 10 aa, Cryptosporidium parvum
LEESNPDPKD

SEQ ID NO: 2268361 - protein, 6 aa, Cryptosporidium parvum
LEESRD

SEQ ID NO: 2268362 - protein, 11 aa, Cryptosporidium parvum
LEETAEEKEAF

SEQ ID NO: 2268363 - protein, 6 aa, Cryptosporidium parvum
LEETDY

SEQ ID NO: 2268364 - protein, 15 aa, Cryptosporidium parvum
LEETLTKSEETLHAE

SEQ ID NO: 2268365 - protein, 23 aa, Cryptosporidium parvum
LEEYGNSVENFEKEDKESKGETI

SEQ ID NO: 2268366 - protein, 7 aa, Cryptosporidium parvum
LEGDEDS

SEQ ID NO: 2268367 - protein, 12 aa, Cryptosporidium parvum
LEGDFDPDKHDK

SEQ ID NO: 2268368 - protein, 4 aa, Cryptosporidium parvum
LEGE

SEQ ID NO: 2268369 - protein, 5 aa, Cryptosporidium parvum
LEGEK

SEQ ID NO: 2268370 - protein, 13 aa, Cryptosporidium parvum
LEGESKEKSRERL

SEQ ID NO: 2268371 - protein, 13 aa, Cryptosporidium parvum
LEGKDTTKNKRGH

SEQ ID NO: 2268372 - protein, 17 aa, Cryptosporidium parvum
LEGNSDESKENKSNISK

SEQ ID NO: 2268373 - protein, 5 aa, Cryptosporidium parvum
LEGPK

SEQ ID NO: 2268374 - protein, 7 aa, Cryptosporidium parvum
LEGSGSG

SEQ ID NO: 2268375 - protein, 11 aa, Cryptosporidium parvum
LEGSKNKEGNN

SEQ ID NO: 2268376 - protein, 11 aa, Cryptosporidium parvum
LEGSNEPTIYT

SEQ ID NO: 2268377 - protein, 16 aa, Cryptosporidium parvum
LEGTPIDKNREEVGEN

SEQ ID NO: 2268378 - protein, 7 aa, Cryptosporidium parvum
LEGYNDS

SEQ ID NO: 2268379 - protein, 10 aa, Cryptosporidium parvum
LEIGSGAGKL

SEQ ID NO: 2268380 - protein, 14 aa, Cryptosporidium parvum
LEINKSRKIKEDSG

SEQ ID NO: 2268381 - protein, 7 aa, Cryptosporidium parvum
LEIPQNE

SEQ ID NO: 2268382 - protein, 7 aa, Cryptosporidium parvum
LEKDASG

SEQ ID NO: 2268383 - protein, 6 aa, Cryptosporidium parvum
LEKDEN

SEQ ID NO: 2268384 - protein, 11 aa, Cryptosporidium parvum
LEKELERKECG

SEQ ID NO: 2268385 - protein, 9 aa, Cryptosporidium parvum
LEKENQNIE

SEQ ID NO: 2268386 - protein, 6 aa, Cryptosporidium parvum
LEKETS

SEQ ID NO: 2268387 - protein, 4 aa, Cryptosporidium parvum
LEKG

SEQ ID NO: 2268388 - protein, 8 aa, Cryptosporidium parvum
LEKGDSYD

SEQ ID NO: 2268389 - protein, 5 aa, Cryptosporidium parvum
LEKGG

SEQ ID NO: 2268390 - protein, 11 aa, Cryptosporidium parvum
LEKKQREKKFQ

SEQ ID NO: 2268391 - protein, 19 aa, Cryptosporidium parvum
LEKKTGLNNNNSNNNNSDD

SEQ ID NO: 2268392 - protein, 8 aa, Cryptosporidium parvum
LEKNEDNI

SEQ ID NO: 2268393 - protein, 11 aa, Cryptosporidium parvum
LEKNSEKELAS

SEQ ID NO: 2268394 - protein, 4 aa, Cryptosporidium parvum
LEKP

SEQ ID NO: 2268395 - protein, 7 aa, Cryptosporidium parvum
LEKPTNI

SEQ ID NO: 2268396 - protein, 19 aa, Cryptosporidium parvum
LEKQNTNEKQETSTSIEDA

SEQ ID NO: 2268397 - protein, 9 aa, Cryptosporidium parvum
LEKSGINKN

SEQ ID NO: 2268398 - protein, 8 aa, Cryptosporidium parvum
LEKSNQRK

SEQ ID NO: 2268399 - protein, 8 aa, Cryptosporidium parvum
LEKSNSNL

SEQ ID NO: 2268400 - protein, 8 aa, Cryptosporidium parvum
LEKSPKGL

SEQ ID NO: 2268401 - protein, 9 aa, Cryptosporidium parvum
LEKTEKSLT

SEQ ID NO: 2268402 - protein, 12 aa, Cryptosporidium parvum
LEKTEVSIKENA

SEQ ID NO: 2268403 - protein, 22 aa, Cryptosporidium parvum
LEKTGLKDHGNELEAVSETNNL

SEQ ID NO: 2268404 - protein, 12 aa, Cryptosporidium parvum
LEKTSKNKRRIT

SEQ ID NO: 2268405 - protein, 7 aa, Cryptosporidium parvum
LENAPKS

SEQ ID NO: 2268406 - protein, 4 aa, Cryptosporidium parvum
LENE

SEQ ID NO: 2268407 - protein, 7 aa, Cryptosporidium parvum
LENEDQN

SEQ ID NO: 2268408 - protein, 11 aa, Cryptosporidium parvum
LENEKDLEKIE

SEQ ID NO: 2268409 - protein, 18 aa, Cryptosporidium parvum
LENEKNMNITNSKEFEEK

SEQ ID NO: 2268410 - protein, 8 aa, Cryptosporidium parvum
LENENKKR

SEQ ID NO: 2268411 - protein, 4 aa, Cryptosporidium parvum
LENF

SEQ ID NO: 2268412 - protein, 6 aa, Cryptosporidium parvum
LENGEL

SEQ ID NO: 2268413 - protein, 31 aa, Cryptosporidium parvum
LENGRYKKIGSDLQNGGLTSAEERKLAESQN

SEQ ID NO: 2268414 - protein, 5 aa, Cryptosporidium parvum
LENGS

SEQ ID NO: 2268415 - protein, 7 aa, Cryptosporidium parvum
LENGSEC

SEQ ID NO: 2268416 - protein, 4 aa, Cryptosporidium parvum
LENI

SEQ ID NO: 2268417 - protein, 7 aa, Cryptosporidium parvum
LENKGEP

SEQ ID NO: 2268418 - protein, 10 aa, Cryptosporidium parvum
LENKKLSEEI

SEQ ID NO: 2268419 - protein, 11 aa, Cryptosporidium parvum
LENKPSEPLSP

SEQ ID NO: 2268420 - protein, 7 aa, Cryptosporidium parvum
LENKYRS

SEQ ID NO: 2268421 - protein, 4 aa, Cryptosporidium parvum
LENL

SEQ ID NO: 2268422 - protein, 4 aa, Cryptosporidium parvum
LENM

SEQ ID NO: 2268423 - protein, 7 aa, Cryptosporidium parvum
LENNQNN

SEQ ID NO: 2268424 - protein, 9 aa, Cryptosporidium parvum
LENNSRETL

SEQ ID NO: 2268425 - protein, 10 aa, Cryptosporidium parvum
LENNTGNEYL

SEQ ID NO: 2268426 - protein, 8 aa, Cryptosporidium parvum
LENPNHSD

SEQ ID NO: 2268427 - protein, 14 aa, Cryptosporidium parvum
LENSASKAKGARKD

SEQ ID NO: 2268428 - protein, 14 aa, Cryptosporidium parvum
LENSDQDDEARDLH

SEQ ID NO: 2268429 - protein, 15 aa, Cryptosporidium parvum
LENSGAGAKHAGAKA

SEQ ID NO: 2268430 - protein, 7 aa, Cryptosporidium parvum
LENSGQT

SEQ ID NO: 2268431 - protein, 8 aa, Cryptosporidium parvum
LENSGQTI

SEQ ID NO: 2268432 - protein, 10 aa, Cryptosporidium parvum
LENSKSGGVC

SEQ ID NO: 2268433 - protein, 10 aa, Cryptosporidium parvum
LENSPTVKRE

SEQ ID NO: 2268434 - protein, 8 aa, Cryptosporidium parvum
LENSSNKE

SEQ ID NO: 2268435 - protein, 9 aa, Cryptosporidium parvum
LENSVTNEE

SEQ ID NO: 2268436 - protein, 33 aa, Cryptosporidium parvum; identical to SEQ ID NO: 2150528

SEQ ID NO: 2268437 - protein, 6 aa, Cryptosporidium parvum
LEPDNS

SEQ ID NO: 2268438 - protein, 9 aa, Cryptosporidium parvum
LEPEDDDPL

SEQ ID NO: 2268439 - protein, 4 aa, Cryptosporidium parvum
LEPS

SEQ ID NO: 2268440 - protein, 7 aa, Cryptosporidium parvum
LEPSPKS

SEQ ID NO: 2268441 - protein, 19 aa, Cryptosporidium parvum
LEPTENAYKNLNEQETDHS

SEQ ID NO: 2268442 - protein, 6 aa, Cryptosporidium parvum
LEPTHP

SEQ ID NO: 2268443 - protein, 12 aa, Cryptosporidium parvum
LEQDESSKKNEI

SEQ ID NO: 2268444 - protein, 10 aa, Cryptosporidium parvum
LEQDSDYKKR

SEQ ID NO: 2268445 - protein, 9 aa, Cryptosporidium parvum
LEQEETPES

SEQ ID NO: 2268446 - protein, 19 aa, Cryptosporidium parvum
LEQEKSSNIARKNKEERDQ

SEQ ID NO: 2268447 - protein, 8 aa, Cryptosporidium parvum
LEQKQKLE

SEQ ID NO: 2268448 - protein, 4 aa, Cryptosporidium parvum
LEQN

SEQ ID NO: 2268449 - protein, 5 aa, Cryptosporidium parvum
LEQNN

SEQ ID NO: 2268450 - protein, 20 aa, Cryptosporidium parvum
LEQPGPDNIQKSVSASRSEL

SEQ ID NO: 2268451 - protein, 10 aa, Cryptosporidium parvum
LEQQAAEKER

SEQ ID NO: 2268452 - protein, 26 aa, Cryptosporidium parvum
LEQQNSLNSNLPNDELGERKVSNSEI

SEQ ID NO: 2268453 - protein, 6 aa, Cryptosporidium parvum
LEQSLT

SEQ ID NO: 2268454 - protein, 11 aa, Cryptosporidium parvum
LEQSNSSPNYI

SEQ ID NO: 2268455 - protein, 8 aa, Cryptosporidium parvum
LEQTKFPT

SEQ ID NO: 2268456 - protein, 10 aa, Cryptosporidium parvum
LERDSNTETN

SEQ ID NO: 2268457 - protein, 25 aa, Cryptosporidium parvum
LERKQSESKTIEGESKNKDNDESEL

SEQ ID NO: 2268458 - protein, 24 aa, Cryptosporidium parvum
LERQEKKKLKQEKSFKNEKSNSLK

SEQ ID NO: 2268459 - protein, 12 aa, Cryptosporidium parvum
LERQEKSTYESI

SEQ ID NO: 2268460 - protein, 14 aa, Cryptosporidium parvum
LERSEKEKEDYKRL

SEQ ID NO: 2268461 - protein, 14 aa, Cryptosporidium parvum
LERSPWERKAQDVK

SEQ ID NO: 2268462 - protein, 4 aa, Cryptosporidium parvum
LERV

SEQ ID NO: 2268463 - protein, 11 aa, Cryptosporidium parvum
LESAEEQQSYG

SEQ ID NO: 2268464 - protein, 5 aa, Cryptosporidium parvum
LESDD

SEQ ID NO: 2268465 - protein, 8 aa, Cryptosporidium parvum
LESDDQQK

SEQ ID NO: 2268466 - protein, 5 aa, Cryptosporidium parvum
LESEK

SEQ ID NO: 2268467 - protein, 25 aa, Cryptosporidium parvum
LESETGRNKSLNDEVESLQTSNGTY

SEQ ID NO: 2268468 - protein, 33 aa, Cryptosporidium parvum
LESGNDSKKRESNMDGQNDREFGSIESKEQLSI

SEQ ID NO: 2268469 - protein, 11 aa, Cryptosporidium parvum
LESKNERTSNY

SEQ ID NO: 2268470 - protein, 13 aa, Cryptosporidium parvum
LESKNGKEKLKGC

SEQ ID NO: 2268471 - protein, 17 aa, Cryptosporidium parvum
LESKYSSNQGGSGSNSA

SEQ ID NO: 2268472 - protein, 8 aa, Cryptosporidium parvum
LESNDPDA

SEQ ID NO: 2268473 - protein, 13 aa, Cryptosporidium parvum
LESNKSEESDAEK

SEQ ID NO: 2268474 - protein, 20 aa, Cryptosporidium parvum
LESNNANNTSSSNIGTNTSS

SEQ ID NO: 2268475 - protein, 10 aa, Cryptosporidium parvum
LESNPSIEKQ

SEQ ID NO: 2268476 - protein, 18 aa, Cryptosporidium parvum
LESNTSNSMRSNASNLNL

SEQ ID NO: 2268477 - protein, 11 aa, Cryptosporidium parvum
LESPKSGVSGL

SEQ ID NO: 2268478 - protein, 6 aa, Cryptosporidium parvum
LESPTR

SEQ ID NO: 2268479 - protein, 5 aa, Cryptosporidium parvum
LESQE

SEQ ID NO: 2268480 - protein, 5 aa, Cryptosporidium parvum
LESQR

SEQ ID NO: 2268481 - protein, 7 aa, Cryptosporidium parvum
LESQRDI

SEQ ID NO: 2268482 - protein, 5 aa, Cryptosporidium parvum
LESRE

SEQ ID NO: 2268483 - protein, 9 aa, Cryptosporidium parvum
LESSDNGME

SEQ ID NO: 2268484 - protein, 8 aa, Cryptosporidium parvum
LESSEQYK

SEQ ID NO: 2268485 - protein, 13 aa, Cryptosporidium parvum
LESSPKLEILSEI

SEQ ID NO: 2268486 - protein, 6 aa, Cryptosporidium parvum
LESSPS

SEQ ID NO: 2268487 - protein, 7 aa, Cryptosporidium parvum
LESSSEL

SEQ ID NO: 2268488 - protein, 9 aa, Cryptosporidium parvum
LESSSSANN

SEQ ID NO: 2268489 - protein, 4 aa, Cryptosporidium parvum
LEST

SEQ ID NO: 2268490 - protein, 28 aa, Cryptosporidium parvum
LESTDSNLDDDDELAASNTLPQGIGHPR

SEQ ID NO: 2268491 - protein, 9 aa, Cryptosporidium parvum
LESTRQDDL

SEQ ID NO: 2268492 - protein, 6 aa, Cryptosporidium parvum
LETANE

SEQ ID NO: 2268493 - protein, 5 aa, Cryptosporidium parvum
LETAQ

SEQ ID NO: 2268494 - protein, 6 aa, Cryptosporidium parvum
LETEEV

SEQ ID NO: 2268495 - protein, 17 aa, Cryptosporidium parvum
LETENKQLKEGNKDETM

SEQ ID NO: 2268496 - protein, 15 aa, Cryptosporidium parvum
LETGEFKSNKKPNLS

SEQ ID NO: 2268497 - protein, 15 aa, Cryptosporidium parvum
LETGSDMSSGEEGDF

SEQ ID NO: 2268498 - protein, 6 aa, Cryptosporidium parvum
LETGSK

SEQ ID NO: 2268499 - protein, 10 aa, Cryptosporidium parvum
LETKEREAQT

SEQ ID NO: 2268500 - protein, 7 aa, Cryptosporidium parvum
LETPQTC

SEQ ID NO: 2268501 - protein, 18 aa, Cryptosporidium parvum
LETSDEKSMNDKKTVQAL

SEQ ID NO: 2268502 - protein, 19 aa, Cryptosporidium parvum
LETSSNNTISVKKQPKPKL

SEQ ID NO: 2268503 - protein, 17 aa, Cryptosporidium parvum
LETTDSIDRQSNDSISS

SEQ ID NO: 2268504 - protein, 23 aa, Cryptosporidium parvum
LETYSTGYTDEDSFSTFNDSGAQ

SEQ ID NO: 2268505 - protein, 6 aa, Cryptosporidium parvum
LEYESN

SEQ ID NO: 2268506 - protein, 27 aa, Cryptosporidium parvum
LEYNETDISKNHCTRNKNNDNNTPFNK

SEQ ID NO: 2268507 - protein, 5 aa, Cryptosporidium parvum
LFGRP

SEQ ID NO: 2268508 - protein, 4 aa, Cryptosporidium parvum
LFKS

SEQ ID NO: 2268509 - protein, 4 aa, Cryptosporidium parvum
LFPA

SEQ ID NO: 2268510 - protein, 7 aa, Cryptosporidium parvum
LFPGTSD

SEQ ID NO: 2268511 - protein, 10 aa, Cryptosporidium parvum
LFPTGETNDH

SEQ ID NO: 2268512 - protein, 5 aa, Cryptosporidium parvum
LFSTS

SEQ ID NO: 2268513 - protein, 7 aa, Cryptosporidium parvum
LFTDDSE

SEQ ID NO: 2268514 - protein, 9 aa, Cryptosporidium parvum
LGAAGNKKA

SEQ ID NO: 2268515 - protein, 7 aa, Cryptosporidium parvum
LGADGST

SEQ ID NO: 2268516 - protein, 11 aa, Cryptosporidium parvum
LGANGDIDGSL

SEQ ID NO: 2268517 - protein, 6 aa, Cryptosporidium parvum
LGDAYG

SEQ ID NO: 2268518 - protein, 5 aa, Cryptosporidium parvum
LGDDE

SEQ ID NO: 2268519 - protein, 10 aa, Cryptosporidium parvum
LGDDSPEKEA

SEQ ID NO: 2268520 - protein, 19 aa, Cryptosporidium parvum
LGDEEEREEEEEKKKEEEI

SEQ ID NO: 2268521 - protein, 41 aa, Cryptosporidium parvum
LGDEYGEISDGDGYSDGEQDDLDMKSGGSDVLNEKKSQTLR

SEQ ID NO: 2268522 - protein, 12 aa, Cryptosporidium parvum
LGDGEKDSSIGD

SEQ ID NO: 2268523 - protein, 27 aa, Cryptosporidium parvum
LGDNSSSSSSNSTSNSTSIEKSKLHNK

SEQ ID NO: 2268524 - protein, 13 aa, Cryptosporidium parvum
LGDPTSSDSSRKA

SEQ ID NO: 2268525 - protein, 16 aa, Cryptosporidium parvum
LGEAIDTEKSFPNNNI

SEQ ID NO: 2268526 - protein, 10 aa, Cryptosporidium parvum
LGEDLKTQDN

SEQ ID NO: 2268527 - protein, 11 aa, Cryptosporidium parvum
LGEDSNPKTIK

SEQ ID NO: 2268528 - protein, 11 aa, Cryptosporidium parvum
LGEEDITSTEL

SEQ ID NO: 2268529 - protein, 6 aa, Cryptosporidium parvum
LGENDL

SEQ ID NO: 2268530 - protein, 11 aa, Cryptosporidium parvum
LGENLSQDERK

SEQ ID NO: 2268531 - protein, 4 aa, Cryptosporidium parvum
LGEP

SEQ ID NO: 2268532 - protein, 11 aa, Cryptosporidium parvum
LGEPPESDNEM

SEQ ID NO: 2268533 - protein, 9 aa, Cryptosporidium parvum
LGESISDDE

SEQ ID NO: 2268534 - protein, 8 aa, Cryptosporidium parvum
LGESLENS

SEQ ID NO: 2268535 - protein, 6 aa, Cryptosporidium parvum
LGEYGR

SEQ ID NO: 2268536 - protein, 7 aa, Cryptosporidium parvum
LGGEVGG

SEQ ID NO: 2268537 - protein, 8 aa, Cryptosporidium parvum
LGGGGGIG

SEQ ID NO: 2268538 - protein, 13 aa, Cryptosporidium parvum
LGGGGSGSLEDPY

SEQ ID NO: 2268539 - protein, 22 aa, Cryptosporidium parvum
LGGGLGKVRGQEKPESKSFFGG

SEQ ID NO: 2268540 - protein, 19 aa, Cryptosporidium parvum
LGGGSPSLVQQGSTPEGKA

SEQ ID NO: 2268541 - protein, 10 aa, Cryptosporidium parvum
LGGGTGSGMG

SEQ ID NO: 2268542 - protein, 21 aa, Cryptosporidium parvum
LGGGTVSQGFSHGANPNGLSL

SEQ ID NO: 2268543 - protein, 50 aa, Cryptosporidium parvum
LGGKEQDHSKGEAQQSSSGGGSGNNCNTGGSSSSKPLSKAQQERQRRQKM

SEQ ID NO: 2268544 - protein, 6 aa, Cryptosporidium parvum
LGGKKQ

SEQ ID NO: 2268545 - protein, 13 aa, Cryptosporidium parvum
LGGKRSGSNAPIP

SEQ ID NO: 2268546 - protein, 7 aa, Cryptosporidium parvum
LGGNKGN

SEQ ID NO: 2268547 - protein, 21 aa, Cryptosporidium parvum
LGGNLKQNKDNIFDSNGKEYQ

SEQ ID NO: 2268548 - protein, 6 aa, Cryptosporidium parvum
LGGNTR

SEQ ID NO: 2268549 - protein, 8 aa, Cryptosporidium parvum
LGGPSTPG

SEQ ID NO: 2268550 - protein, 4 aa, Cryptosporidium parvum
LGGS

SEQ ID NO: 2268551 - protein, 24 aa, Cryptosporidium parvum
LGGSNNIRMGNNSSRLINGSGNGE

SEQ ID NO: 2268552 - protein, 6 aa, Cryptosporidium parvum
LGGSPG

SEQ ID NO: 2268553 - protein, 16 aa, Cryptosporidium parvum
LGGTNTNTGNNTGTGL

SEQ ID NO: 2268554 - protein, 11 aa, Cryptosporidium parvum
LGGVSKSDLKA

SEQ ID NO: 2268555 - protein, 8 aa, Cryptosporidium parvum
LGHGDTQD

SEQ ID NO: 2268556 - protein, 4 aa, Cryptosporidium parvum
LGHS

SEQ ID NO: 2268557 - protein, 13 aa, Cryptosporidium parvum
LGHVSGSNSNSNR

SEQ ID NO: 2268558 - protein, 4 aa, Cryptosporidium parvum
LGIE

SEQ ID NO: 2268559 - protein, 6 aa, Cryptosporidium parvum
LGIPDS

SEQ ID NO: 2268560 - protein, 8 aa, Cryptosporidium parvum
LGIPPGPL

SEQ ID NO: 2268561 - protein, 10 aa, Cryptosporidium parvum
LGIQEKNKNF

SEQ ID NO: 2268562 - protein, 11 aa, Cryptosporidium parvum
LGKAKTGTGKT

SEQ ID NO: 2268563 - protein, 4 aa, Cryptosporidium parvum
LGKD

SEQ ID NO: 2268564 - protein, 8 aa, Cryptosporidium parvum
LGKKGGLD

SEQ ID NO: 2268565 - protein, 5 aa, Cryptosporidium parvum
LGKNE

SEQ ID NO: 2268566 - protein, 56 aa, Cryptosporidium parvum
LGKNGTSSSSIDISGTGIGTGMGTGTGIGAGIGTGAGAGTGASGVPDFGQRSTSSV

SEQ ID NO: 2268567 - protein, 5 aa, Cryptosporidium parvum
LGKNQ

SEQ ID NO: 2268568 - protein, 54 aa, Cryptosporidium parvum
LGKQARGEVESSDNDDDNDDDIHNSTKNKNSKSSIKIRKSKQKLKKGQQERAQS

SEQ ID NO: 2268569 - protein, 8 aa, Cryptosporidium parvum
LGKRDDSW

SEQ ID NO: 2268570 - protein, 11 aa, Cryptosporidium parvum
LGKSSLKSNVG

SEQ ID NO: 2268571 - protein, 5 aa, Cryptosporidium parvum
LGKTA

SEQ ID NO: 2268572 - protein, 8 aa, Cryptosporidium parvum
LGKTNKRS

SEQ ID NO: 2268573 - protein, 12 aa, Cryptosporidium parvum
LGLDNSSKSNLG

SEQ ID NO: 2268574 - protein, 8 aa, Cryptosporidium parvum
LGNDASKA

SEQ ID NO: 2268575 - protein, 13 aa, Cryptosporidium parvum
LGNDGIETLEHSG

SEQ ID NO: 2268576 - protein, 7 aa, Cryptosporidium parvum
LGNEEDT

SEQ ID NO: 2268577 - protein, 13 aa, Cryptosporidium parvum
LGNGESKSQFSAS

SEQ ID NO: 2268578 - protein, 16 aa, Cryptosporidium parvum
LGNGGLNDIKTDQSGN

SEQ ID NO: 2268579 - protein, 5 aa, Cryptosporidium parvum
LGNGN

SEQ ID NO: 2268580 - protein, 9 aa, Cryptosporidium parvum
LGNNTNNDV

SEQ ID NO: 2268581 - protein, 7 aa, Cryptosporidium parvum
LGNPSKS

SEQ ID NO: 2268582 - protein, 6 aa, Cryptosporidium parvum
LGNQEG

SEQ ID NO: 2268583 - protein, 6 aa, Cryptosporidium parvum
LGNSFS

SEQ ID NO: 2268584 - protein, 15 aa, Cryptosporidium parvum
LGNSGNNTNNVTNTG

SEQ ID NO: 2268585 - protein, 9 aa, Cryptosporidium parvum
LGNSNESIS

SEQ ID NO: 2268586 - protein, 10 aa, Cryptosporidium parvum
LGNSNGCNNL

SEQ ID NO: 2268587 - protein, 9 aa, Cryptosporidium parvum
LGNSNSQCL

SEQ ID NO: 2268588 - protein, 4 aa, Cryptosporidium parvum
LGPA

SEQ ID NO: 2268589 - protein, 8 aa, Cryptosporidium parvum
LGPDAPHE

SEQ ID NO: 2268590 - protein, 7 aa, Cryptosporidium parvum
LGPDGRP

SEQ ID NO: 2268591 - protein, 6 aa, Cryptosporidium parvum
LGPDYD

SEQ ID NO: 2268592 - protein, 11 aa, Cryptosporidium parvum
LGPEIDENNGR

SEQ ID NO: 2268593 - protein, 24 aa, Cryptosporidium parvum
LGPGPGHGSGFNGTMEEEGRRAGL

SEQ ID NO: 2268594 - protein, 15 aa, Cryptosporidium parvum
LGPGSGTSNFSDGIK

SEQ ID NO: 2268595 - protein, 11 aa, Cryptosporidium parvum
LGPKSDELQEA

SEQ ID NO: 2268596 - protein, 9 aa, Cryptosporidium parvum
LGPNKTKRE

SEQ ID NO: 2268597 - protein, 20 aa, Cryptosporidium parvum
LGPNSGNRTSPYLSGRKRNI

SEQ ID NO: 2268598 - protein, 6 aa, Cryptosporidium parvum
LGPRGR

SEQ ID NO: 2268599 - protein, 7 aa, Cryptosporidium parvum
LGPRKAK

SEQ ID NO: 2268600 - protein, 6 aa, Cryptosporidium parvum
LGPSTS

SEQ ID NO: 2268601 - protein, 12 aa, Cryptosporidium parvum
LGPSYQSSSKNT

SEQ ID NO: 2268602 - protein, 4 aa, Cryptosporidium parvum
LGPY

SEQ ID NO: 2268603 - protein, 7 aa, Cryptosporidium parvum
LGPYEDN

SEQ ID NO: 2268604 - protein, 4 aa, Cryptosporidium parvum
LGQD

SEQ ID NO: 2268605 - protein, 16 aa, Cryptosporidium parvum
LGQGKESCKSKERACN

SEQ ID NO: 2268606 - protein, 20 aa, Cryptosporidium parvum
LGQKSESSSNYESNKSETKL

SEQ ID NO: 2268607 - protein, 4 aa, Cryptosporidium parvum
LGQV

SEQ ID NO: 2268608 - protein, 25 aa, Cryptosporidium parvum
LGREKDKDLLPNSVPNSNQISHNPN

SEQ ID NO: 2268609 - protein, 8 aa, Cryptosporidium parvum
LGRGSYGS

SEQ ID NO: 2268610 - protein, 7 aa, Cryptosporidium parvum
LGRKDKA

SEQ ID NO: 2268611 - protein, 16 aa, Cryptosporidium parvum
LGSDDQLSNYTGGDQF

SEQ ID NO: 2268612 - protein, 5 aa, Cryptosporidium parvum
LGSDQ

SEQ ID NO: 2268613 - protein, 10 aa, Cryptosporidium parvum
LGSDSEDLSI

SEQ ID NO: 2268614 - protein, 14 aa, Cryptosporidium parvum
LGSEGNYSGQDPQV

SEQ ID NO: 2268615 - protein, 7 aa, Cryptosporidium parvum
LGSEKYD

SEQ ID NO: 2268616 - protein, 21 aa, Cryptosporidium parvum
LGSENNRKNDDFRENKSQDKF

SEQ ID NO: 2268617 - protein, 20 aa, Cryptosporidium parvum
LGSGGIGTGTGQTGTGIGTG

SEQ ID NO: 2268618 - protein, 5 aa, Cryptosporidium parvum
LGSGK

SEQ ID NO: 2268619 - protein, 6 aa, Cryptosporidium parvum
LGSGQF

SEQ ID NO: 2268620 - protein, 16 aa, Cryptosporidium parvum
LGSGSGSGSGSDSGLE

SEQ ID NO: 2268621 - protein, 22 aa, Cryptosporidium parvum
LGSGSSGLSSSGLGSTNSTASI

SEQ ID NO: 2268622 - protein, 5 aa, Cryptosporidium parvum
LGSKT

SEQ ID NO: 2268623 - protein, 10 aa, Cryptosporidium parvum
LGSNRSKMRS

SEQ ID NO: 2268624 - protein, 6 aa, Cryptosporidium parvum
LGSNSF

SEQ ID NO: 2268625 - protein, 7 aa, Cryptosporidium parvum
LGSNSRN

SEQ ID NO: 2268626 - protein, 10 aa, Cryptosporidium parvum
LGSQHSAAVT

SEQ ID NO: 2268627 - protein, 4 aa, Cryptosporidium parvum
LGSS

SEQ ID NO: 2268628 - protein, 8 aa, Cryptosporidium parvum
LGSSEVSN

SEQ ID NO: 2268629 - protein, 18 aa, Cryptosporidium parvum
LGSSSDEDEFSKEGASLS

SEQ ID NO: 2268630 - protein, 8 aa, Cryptosporidium parvum
LGSTESRK

SEQ ID NO: 2268631 - protein, 6 aa, Cryptosporidium parvum
LGSTRG

SEQ ID NO: 2268632 - protein, 5 aa, Cryptosporidium parvum
LGTDF

SEQ ID NO: 2268633 - protein, 4 aa, Cryptosporidium parvum
LGTE

SEQ ID NO: 2268634 - protein, 13 aa, Cryptosporidium parvum
LGTERRAKKKRDE

SEQ ID NO: 2268635 - protein, 5 aa, Cryptosporidium parvum
LGTGT

SEQ ID NO: 2268636 - protein, 13 aa, Cryptosporidium parvum
LGTHRNQTESMQG

SEQ ID NO: 2268637 - protein, 4 aa, Cryptosporidium parvum
LGTL

SEQ ID NO: 2268638 - protein, 8 aa, Cryptosporidium parvum
LGTPNSRC

SEQ ID NO: 2268639 - protein, 16 aa, Cryptosporidium parvum
LGTSDEGMYGETREKG

SEQ ID NO: 2268640 - protein, 18 aa, Cryptosporidium parvum
LGTSNSQLNSSSTGIEGG

SEQ ID NO: 2268641 - protein, 6 aa, Cryptosporidium parvum
LGTSTD

SEQ ID NO: 2268642 - protein, 8 aa, Cryptosporidium parvum
LGTTETKQ

SEQ ID NO: 2268643 - protein, 6 aa, Cryptosporidium parvum
LGVGPG

SEQ ID NO: 2268644 - protein, 4 aa, Cryptosporidium parvum
LGVP

SEQ ID NO: 2268645 - protein, 6 aa, Cryptosporidium parvum
LGYPSN

SEQ ID NO: 2268646 - protein, 11 aa, Cryptosporidium parvum
LGYSEKSSVRA

SEQ ID NO: 2268647 - protein, 6 aa, Cryptosporidium parvum
LHDQEK

SEQ ID NO: 2268648 - protein, 26 aa, Cryptosporidium parvum
LHEKENKALRSVSKRGCKKKNNAVTS

SEQ ID NO: 2268649 - protein, 9 aa, Cryptosporidium parvum
LHKSDQRGH

SEQ ID NO: 2268650 - protein, 11 aa, Cryptosporidium parvum
LHNNPNNLNSS

SEQ ID NO: 2268651 - protein, 12 aa, Cryptosporidium parvum
LHPESGYDPKDD

SEQ ID NO: 2268652 - protein, 15 aa, Cryptosporidium parvum
LHPSSTGTSDINAAR

SEQ ID NO: 2268653 - protein, 15 aa, Cryptosporidium parvum
LHSKGQKLSGKTEAE

SEQ ID NO: 2268654 - protein, 13 aa, Cryptosporidium parvum
LHSSSKEKKKEAV

SEQ ID NO: 2268655 - protein, 4 aa, Cryptosporidium parvum
LIDR

SEQ ID NO: 2268656 - protein, 5 aa, Cryptosporidium parvum
LIGDP

SEQ ID NO: 2268657 - protein, 5 aa, Cryptosporidium parvum
LIGET

SEQ ID NO: 2268658 - protein, 5 aa, Cryptosporidium parvum
LIGQT

SEQ ID NO: 2268659 - protein, 8 aa, Cryptosporidium parvum
LIGSGDIS

SEQ ID NO: 2268660 - protein, 17 aa, Cryptosporidium parvum
LIKSDENSSAIIESTYL

SEQ ID NO: 2268661 - protein, 6 aa, Cryptosporidium parvum
LIKSGD

SEQ ID NO: 2268662 - protein, 7 aa, Cryptosporidium parvum
LIPSEPS

SEQ ID NO: 2268663 - protein, 10 aa, Cryptosporidium parvum
LITNSRDLNS

SEQ ID NO: 2268664 - protein, 12 aa, Cryptosporidium parvum
LKAEGGRVEENR

SEQ ID NO: 2268665 - protein, 9 aa, Cryptosporidium parvum
LKAGGDREK

SEQ ID NO: 2268666 - protein, 9 aa, Cryptosporidium parvum
LKAKKSEVA

SEQ ID NO: 2268667 - protein, 11 aa, Cryptosporidium parvum
LKAKNKANEYE

SEQ ID NO: 2268668 - protein, 23 aa, Cryptosporidium parvum
LKANSLTEKELEDIAENKGLEDS

SEQ ID NO: 2268669 - protein, 6 aa, Cryptosporidium parvum
LKATDI

SEQ ID NO: 2268670 - protein, 11 aa, Cryptosporidium parvum
LKDANKLHQET

SEQ ID NO: 2268671 - protein, 23 aa, Cryptosporidium parvum
LKDDESQRISTYQPKKDNSNVTF

SEQ ID NO: 2268672 - protein, 7 aa, Cryptosporidium parvum
LKDDSSI

SEQ ID NO: 2268673 - protein, 8 aa, Cryptosporidium parvum
LKDEANKA

SEQ ID NO: 2268674 - protein, 5 aa, Cryptosporidium parvum
LKDET

SEQ ID NO: 2268675 - protein, 12 aa, Cryptosporidium parvum
LKDGNENDNNHN

SEQ ID NO: 2268676 - protein, 9 aa, Cryptosporidium parvum
LKDNEQNLT

SEQ ID NO: 2268677 - protein, 23 aa, Cryptosporidium parvum
LKDNGDNDKINHKNSHKVNSKKK

SEQ ID NO: 2268678 - protein, 5 aa, Cryptosporidium parvum
LKDNN

SEQ ID NO: 2268679 - protein, 6 aa, Cryptosporidium parvum
LKDQGM

SEQ ID NO: 2268680 - protein, 18 aa, Cryptosporidium parvum
LKDREGLIGEEDEEVDNE

SEQ ID NO: 2268681 - protein, 7 aa, Cryptosporidium parvum
LKDSGFS

SEQ ID NO: 2268682 - protein, 9 aa, Cryptosporidium parvum
LKDSGGTCI

SEQ ID NO: 2268683 - protein, 21 aa, Cryptosporidium parvum
LKDSNNNNNNNNNSNNNEYSI

SEQ ID NO: 2268684 - protein, 19 aa, Cryptosporidium parvum
LKDSPTADSEQSDNESSLE

SEQ ID NO: 2268685 - protein, 20 aa, Cryptosporidium parvum
LKDSSSSSSSSSSSSSSSSL

SEQ ID NO: 2268686 - protein, 4 aa, Cryptosporidium parvum
LKEA

SEQ ID NO: 2268687 - protein, 8 aa, Cryptosporidium parvum
LKEARRTK

SEQ ID NO: 2268688 - protein, 19 aa, Cryptosporidium parvum
LKEDQNEANSSKKRSIRGS

SEQ ID NO: 2268689 - protein, 12 aa, Cryptosporidium parvum
LKEDTKEGSKIT

SEQ ID NO: 2268690 - protein, 16 aa, Cryptosporidium parvum
LKEEEINEQTKPESIY

SEQ ID NO: 2268691 - protein, 11 aa, Cryptosporidium parvum
LKEEERKQEEL

SEQ ID NO: 2268692 - protein, 14 aa, Cryptosporidium parvum
LKEEKKKEIKEGIN

SEQ ID NO: 2268693 - protein, 7 aa, Cryptosporidium parvum
LKEENIE

SEQ ID NO: 2268694 - protein, 8 aa, Cryptosporidium parvum
LKEGTSTF

SEQ ID NO: 2268695 - protein, 12 aa, Cryptosporidium parvum
LKEKDKVNSQKI

SEQ ID NO: 2268696 - protein, 17 aa, Cryptosporidium parvum
LKEKDSEVTEAKKDEPV

SEQ ID NO: 2268697 - protein, 19 aa, Cryptosporidium parvum
LKEKEKEEEKEREEKDYIN

SEQ ID NO: 2268698 - protein, 8 aa, Cryptosporidium parvum
LKEKGINE

SEQ ID NO: 2268699 - protein, 6 aa, Cryptosporidium parvum
LKEKIS

SEQ ID NO: 2268700 - protein, 15 aa, Cryptosporidium parvum
LKEKQEEEKRRKEAL

SEQ ID NO: 2268701 - protein, 8 aa, Cryptosporidium parvum
LKEKTNHP

SEQ ID NO: 2268702 - protein, 6 aa, Cryptosporidium parvum
LKELSP

SEQ ID NO: 2268703 - protein, 9 aa, Cryptosporidium parvum
LKENATGDT

SEQ ID NO: 2268704 - protein, 16 aa, Cryptosporidium parvum
LKENNETNEKKKVSIE

SEQ ID NO: 2268705 - protein, 9 aa, Cryptosporidium parvum
LKEPTYPNS

SEQ ID NO: 2268706 - protein, 22 aa, Cryptosporidium parvum
LKEQEKNYKSEISELKTDNEAK

SEQ ID NO: 2268707 - protein, 27 aa, Cryptosporidium parvum
LKEQKIDTTLSGKQKTECKVKSSSKFT

SEQ ID NO: 2268708 - protein, 14 aa, Cryptosporidium parvum
LKEQKPDQEPTMEN

SEQ ID NO: 2268709 - protein, 12 aa, Cryptosporidium parvum
LKEQNKSLENQL

SEQ ID NO: 2268710 - protein, 10 aa, Cryptosporidium parvum
LKERNTPGYA

SEQ ID NO: 2268711 - protein, 19 aa, Cryptosporidium parvum
LKESHKNIGRRAEAALDDK

SEQ ID NO: 2268712 - protein, 11 aa, Cryptosporidium parvum
LKESNNSTTGV

SEQ ID NO: 2268713 - protein, 17 aa, Cryptosporidium parvum
LKESPTSNDNSSNSNNF

SEQ ID NO: 2268714 - protein, 13 aa, Cryptosporidium parvum
LKESTGRDRPTVI

SEQ ID NO: 2268715 - protein, 7 aa, Cryptosporidium parvum
LKETEEI

SEQ ID NO: 2268716 - protein, 8 aa, Cryptosporidium parvum
LKETTHEK

SEQ ID NO: 2268717 - protein, 7 aa, Cryptosporidium parvum
LKGAQDV

SEQ ID NO: 2268718 - protein, 8 aa, Cryptosporidium parvum
LKGDDKAL

SEQ ID NO: 2268719 - protein, 12 aa, Cryptosporidium parvum
LKGDGLNSSDSD

SEQ ID NO: 2268720 - protein, 7 aa, Cryptosporidium parvum
LKGDPNK

SEQ ID NO: 2268721 - protein, 10 aa, Cryptosporidium parvum
LKGDSLKSKC

SEQ ID NO: 2268722 - protein, 4 aa, Cryptosporidium parvum
LKGE

SEQ ID NO: 2268723 - protein, 12 aa, Cryptosporidium parvum
LKGEQKKANEHL

SEQ ID NO: 2268724 - protein, 15 aa, Cryptosporidium parvum
LKGEVNSKESPKDNY

SEQ ID NO: 2268725 - protein, 5 aa, Cryptosporidium parvum
LKGGA

SEQ ID NO: 2268726 - protein, 10 aa, Cryptosporidium parvum
LKGGRNPEIG

SEQ ID NO: 2268727 - protein, 8 aa, Cryptosporidium parvum
LKGKDNST

SEQ ID NO: 2268728 - protein, 9 aa, Cryptosporidium parvum
LKGKTPVQI

SEQ ID NO: 2268729 - protein, 14 aa, Cryptosporidium parvum
LKGNRASSKRKGNL

SEQ ID NO: 2268730 - protein, 28 aa, Cryptosporidium parvum
LKGNSFNKLPSSDEDKLSIRAKSNKRKT

SEQ ID NO: 2268731 - protein, 9 aa, Cryptosporidium parvum
LKGSDQCDN

SEQ ID NO: 2268732 - protein, 5 aa, Cryptosporidium parvum
LKGTA

SEQ ID NO: 2268733 - protein, 30 aa, Cryptosporidium parvum
LKHKDKSDSDETNIPIKSKTEHYDEPNEDF

SEQ ID NO: 2268734 - protein, 9 aa, Cryptosporidium parvum
LKIEKSENY

SEQ ID NO: 2268735 - protein, 25 aa, Cryptosporidium parvum
LKIPPKKDFSTPPIKKEADTSIQTK

SEQ ID NO: 2268736 - protein, 25 aa, Cryptosporidium parvum
LKIPPKKDFSTPPVKKEADTSIQTK

SEQ ID NO: 2268737 - protein, 54 aa, Cryptosporidium parvum
LKIPPKKDFSTPPVKKETDTSIQTKSNLKIPPKKDFSTPPVKKEADTSIQTKSN

SEQ ID NO: 2268738 - protein, 27 aa, Cryptosporidium parvum
LKIPPKKDFSTPPVNKEADTSIQTKSN

SEQ ID NO: 2268739 - protein, 4 aa, Cryptosporidium parvum
LKIT

SEQ ID NO: 2268740 - protein, 11 aa, Cryptosporidium parvum
LKKAKSSKKLS

SEQ ID NO: 2268741 - protein, 11 aa, Cryptosporidium parvum
LKKASGDDSAM

SEQ ID NO: 2268742 - protein, 8 aa, Cryptosporidium parvum
LKKDKRAI

SEQ ID NO: 2268743 - protein, 8 aa, Cryptosporidium parvum
LKKDKRKI

SEQ ID NO: 2268744 - protein, 6 aa, Cryptosporidium parvum
LKKEDG

SEQ ID NO: 2268745 - protein, 9 aa, Cryptosporidium parvum
LKKENNSIA

SEQ ID NO: 2268746 - protein, 9 aa, Cryptosporidium parvum
LKKESPPNF

SEQ ID NO: 2268747 - protein, 4 aa, Cryptosporidium parvum
LKKH

SEQ ID NO: 2268748 - protein, 11 aa, Cryptosporidium parvum
LKKIPEKNGIS

SEQ ID NO: 2268749 - protein, 10 aa, Cryptosporidium parvum
LKKKAVEKVP

SEQ ID NO: 2268750 - protein, 9 aa, Cryptosporidium parvum
LKKKDPEKY

SEQ ID NO: 2268751 - protein, 14 aa, Cryptosporidium parvum
LKKNEEELGNEKDL

SEQ ID NO: 2268752 - protein, 20 aa, Cryptosporidium parvum
LKKNEQLKKESQKKESKGRY

SEQ ID NO: 2268753 - protein, 7 aa, Cryptosporidium parvum
LKKNQKL

SEQ ID NO: 2268754 - protein, 11 aa, Cryptosporidium parvum
LKKPSTISSQI

SEQ ID NO: 2268755 - protein, 4 aa, Cryptosporidium parvum
LKKQ

SEQ ID NO: 2268756 - protein, 19 aa, Cryptosporidium parvum
LKKQNNGELSKSSTYLNPN

SEQ ID NO: 2268757 - protein, 14 aa, Cryptosporidium parvum
LKKRKQDNKYNGNF

SEQ ID NO: 2268758 - protein, 10 aa, Cryptosporidium parvum
LKKSDQAVGF

SEQ ID NO: 2268759 - protein, 13 aa, Cryptosporidium parvum
LKKSSREIATEND

SEQ ID NO: 2268760 - protein, 10 aa, Cryptosporidium parvum
LKKSTNKAKI

SEQ ID NO: 2268761 - protein, 9 aa, Cryptosporidium parvum
LKKTSKRSR

SEQ ID NO: 2268762 - protein, 11 aa, Cryptosporidium parvum
LKLGRGHESDV

SEQ ID NO: 2268763 - protein, 15 aa, Cryptosporidium parvum
LKLPGTSTSTSASNI

SEQ ID NO: 2268764 - protein, 8 aa, Cryptosporidium parvum
LKLTGEKK

SEQ ID NO: 2268765 - protein, 9 aa, Cryptosporidium parvum
LKNDKTKTA

SEQ ID NO: 2268766 - protein, 5 aa, Cryptosporidium parvum
LKNDP

SEQ ID NO: 2268767 - protein, 10 aa, Cryptosporidium parvum
LKNENNKLSR

SEQ ID NO: 2268768 - protein, 19 aa, Cryptosporidium parvum
LKNENSQIEKKKKKSKKTI

SEQ ID NO: 2268769 - protein, 28 aa, Cryptosporidium parvum
LKNGEQANAVSRGRMATNTANINNANTV

SEQ ID NO: 2268770 - protein, 9 aa, Cryptosporidium parvum
LKNGESVQI

SEQ ID NO: 2268771 - protein, 14 aa, Cryptosporidium parvum
LKNGETSSKPINSQ

SEQ ID NO: 2268772 - protein, 8 aa, Cryptosporidium parvum
LKNGNKVK

SEQ ID NO: 2268773 - protein, 6 aa, Cryptosporidium parvum
LKNGQY

SEQ ID NO: 2268774 - protein, 9 aa, Cryptosporidium parvum
LKNKAINKL

SEQ ID NO: 2268775 - protein, 12 aa, Cryptosporidium parvum
LKNKNKSKSVQK

SEQ ID NO: 2268776 - protein, 11 aa, Cryptosporidium parvum
LKNNTNIKEDP

SEQ ID NO: 2268777 - protein, 7 aa, Cryptosporidium parvum
LKNNTQV

SEQ ID NO: 2268778 - protein, 8 aa, Cryptosporidium parvum
LKNPAKCS

SEQ ID NO: 2268779 - protein, 7 aa, Cryptosporidium parvum
LKNPEGL

SEQ ID NO: 2268780 - protein, 8 aa, Cryptosporidium parvum
LKNQKNDS

SEQ ID NO: 2268781 - protein, 8 aa, Cryptosporidium parvum
LKNRGAKT

SEQ ID NO: 2268782 - protein, 12 aa, Cryptosporidium parvum
LKNRSSNAKERI

SEQ ID NO: 2268783 - protein, 14 aa, Cryptosporidium parvum
LKNSEEVSYSVPDT

SEQ ID NO: 2268784 - protein, 7 aa, Cryptosporidium parvum
LKNSEQF

SEQ ID NO: 2268785 - protein, 19 aa, Cryptosporidium parvum
LKNSRFPSTTDDYNSSKKP

SEQ ID NO: 2268786 - protein, 8 aa, Cryptosporidium parvum
LKNSTGSG

SEQ ID NO: 2268787 - protein, 34 aa, Cryptosporidium parvum
LKPENEPKLEHEPKPENGPGIESKSEPEPSSSAP

SEQ ID NO: 2268788 - protein, 10 aa, Cryptosporidium parvum
LKPESKKKSK

SEQ ID NO: 2268789 - protein, 9 aa, Cryptosporidium parvum
LKPESPNQD

SEQ ID NO: 2268790 - protein, 4 aa, Cryptosporidium parvum
LKPG

SEQ ID NO: 2268791 - protein, 6 aa, Cryptosporidium parvum
LKPGQR

SEQ ID NO: 2268792 - protein, 5 aa, Cryptosporidium parvum
LKPGS

SEQ ID NO: 2268793 - protein, 5 aa, Cryptosporidium parvum
LKPHI

SEQ ID NO: 2268794 - protein, 10 aa, Cryptosporidium parvum
LKPKANKNFS

SEQ ID NO: 2268795 - protein, 9 aa, Cryptosporidium parvum
LKPKKNQIN

SEQ ID NO: 2268796 - protein, 11 aa, Cryptosporidium parvum
LKPNSKNSNFY

SEQ ID NO: 2268797 - protein, 7 aa, Cryptosporidium parvum
LKPPEGE

SEQ ID NO: 2268798 - protein, 8 aa, Cryptosporidium parvum
LKPPIENA

SEQ ID NO: 2268799 - protein, 8 aa, Cryptosporidium parvum
LKPPKKVS

SEQ ID NO: 2268800 - protein, 5 aa, Cryptosporidium parvum
LKPPV

SEQ ID NO: 2268801 - protein, 4 aa, Cryptosporidium parvum
LKPS

SEQ ID NO: 2268802 - protein, 5 aa, Cryptosporidium parvum
LKPSL

SEQ ID NO: 2268803 - protein, 7 aa, Cryptosporidium parvum
LKPSRDF

SEQ ID NO: 2268804 - protein, 13 aa, Cryptosporidium parvum
LKQDSSIDNDSVE

SEQ ID NO: 2268805 - protein, 4 aa, Cryptosporidium parvum
LKQE

SEQ ID NO: 2268806 - protein, 7 aa, Cryptosporidium parvum
LKQEDQS

SEQ ID NO: 2268807 - protein, 11 aa, Cryptosporidium parvum
LKQKQVQKERL

SEQ ID NO: 2268808 - protein, 8 aa, Cryptosporidium parvum
LKQKTDSW

SEQ ID NO: 2268809 - protein, 12 aa, Cryptosporidium parvum
LKQLDSSPNAQK

SEQ ID NO: 2268810 - protein, 15 aa, Cryptosporidium parvum
LKQNQRQRLRSKYGA

SEQ ID NO: 2268811 - protein, 21 aa, Cryptosporidium parvum
LKQNSDKSSSQPLHKKPNVKV

SEQ ID NO: 2268812 - protein, 16 aa, Cryptosporidium parvum
LKQNSQEKLSKLDNEK

SEQ ID NO: 2268813 - protein, 10 aa, Cryptosporidium parvum
LKQSSLNSTL

SEQ ID NO: 2268814 - protein, 13 aa, Cryptosporidium parvum
LKQTDSKDSLSNC

SEQ ID NO: 2268815 - protein, 6 aa, Cryptosporidium parvum
LKRDNT

SEQ ID NO: 2268816 - protein, 8 aa, Cryptosporidium parvum
LKRGKSST

SEQ ID NO: 2268817 - protein, 6 aa, Cryptosporidium parvum
LKRNKT

SEQ ID NO: 2268818 - protein, 12 aa, Cryptosporidium parvum
LKRNSKGGESLG

SEQ ID NO: 2268819 - protein, 9 aa, Cryptosporidium parvum
LKRPTESEE

SEQ ID NO: 2268820 - protein, 10 aa, Cryptosporidium parvum
LKRQEKKRKI

SEQ ID NO: 2268821 - protein, 108 aa, Cryptosporidium parvum
LKRRKKGSYSLTADESDGNMSDTESSDDEDSYKRRKGANKGSEVELKSTGKIDSDSFVSSDDSTSIGSQDAKSIGDDSTTSSTSSIKSAGKRAAKKLKDKSKSLKRQL

SEQ ID NO: 2268822 - protein, 7 aa, Cryptosporidium parvum
LKRSEIN

SEQ ID NO: 2268823 - protein, 13 aa, Cryptosporidium parvum
LKRSQAEYESRKK

SEQ ID NO: 2268824 - protein, 12 aa, Cryptosporidium parvum
LKRSSQSKINSV

SEQ ID NO: 2268825 - protein, 7 aa, Cryptosporidium parvum
LKRTKTL

SEQ ID NO: 2268826 - protein, 7 aa, Cryptosporidium parvum
LKSAGYS

SEQ ID NO: 2268827 - protein, 24 aa, Cryptosporidium parvum
LKSAQDALKANRTMDSKNLSSNLN

SEQ ID NO: 2268828 - protein, 8 aa, Cryptosporidium parvum
LKSDHDKR

SEQ ID NO: 2268829 - protein, 9 aa, Cryptosporidium parvum
LKSDHSQHK

SEQ ID NO: 2268830 - protein, 5 aa, Cryptosporidium parvum
LKSDS

SEQ ID NO: 2268831 - protein, 8 aa, Cryptosporidium parvum
LKSEPPSN

SEQ ID NO: 2268832 - protein, 32 aa, Cryptosporidium parvum; identical to SEQ ID NO: 2150845

SEQ ID NO: 2268833 - protein, 10 aa, Cryptosporidium parvum
LKSGDFGAKL

SEQ ID NO: 2268834 - protein, 25 aa, Cryptosporidium parvum
LKSGGKASRNAGNKSKNKSSNPYFK

SEQ ID NO: 2268835 - protein, 18 aa, Cryptosporidium parvum
LKSGKSVTYTNSSHNNAE

SEQ ID NO: 2268836 - protein, 6 aa, Cryptosporidium parvum
LKSGSY

SEQ ID NO: 2268837 - protein, 18 aa, Cryptosporidium parvum
LKSHKQRLQEEQSDLKKS

SEQ ID NO: 2268838 - protein, 8 aa, Cryptosporidium parvum
LKSIENKE

SEQ ID NO: 2268839 - protein, 10 aa, Cryptosporidium parvum
LKSKASQNET

SEQ ID NO: 2268840 - protein, 26 aa, Cryptosporidium parvum
LKSKGKKKKVVTKNGNTEYVWYPKRK

SEQ ID NO: 2268841 - protein, 7 aa, Cryptosporidium parvum
LKSKNKL

SEQ ID NO: 2268842 - protein, 8 aa, Cryptosporidium parvum
LKSKNYRS

SEQ ID NO: 2268843 - protein, 15 aa, Cryptosporidium parvum
LKSKSNLTNENNNTL

SEQ ID NO: 2268844 - protein, 15 aa, Cryptosporidium parvum
LKSNQISDSLQSDQN

SEQ ID NO: 2268845 - protein, 24 aa, Cryptosporidium parvum
LKSNQPNDAKQSIKTENKECKEKK

SEQ ID NO: 2268846 - protein, 11 aa, Cryptosporidium parvum
LKSPDKKIGKI

SEQ ID NO: 2268847 - protein, 13 aa, Cryptosporidium parvum
LKSPTNKRKITPL

SEQ ID NO: 2268848 - protein, 4 aa, Cryptosporidium parvum
LKSQ

SEQ ID NO: 2268849 - protein, 8 aa, Cryptosporidium parvum
LKSQLDTA

SEQ ID NO: 2268850 - protein, 12 aa, Cryptosporidium parvum
LKSQNSSTISNK

SEQ ID NO: 2268851 - protein, 9 aa, Cryptosporidium parvum
LKSRGGNLS

SEQ ID NO: 2268852 - protein, 8 aa, Cryptosporidium parvum
LKSSKDID

SEQ ID NO: 2268853 - protein, 5 aa, Cryptosporidium parvum
LKSSL

SEQ ID NO: 2268854 - protein, 9 aa, Cryptosporidium parvum
LKSSNKKLR

SEQ ID NO: 2268855 - protein, 5 aa, Cryptosporidium parvum
LKSSQ

SEQ ID NO: 2268856 - protein, 14 aa, Cryptosporidium parvum
LKSSQNNQQDQNKK

SEQ ID NO: 2268857 - protein, 6 aa, Cryptosporidium parvum
LKSSSM

SEQ ID NO: 2268858 - protein, 12 aa, Cryptosporidium parvum
LKSSTNTSSNQQ

SEQ ID NO: 2268859 - protein, 4 aa, Cryptosporidium parvum
LKST

SEQ ID NO: 2268860 - protein, 11 aa, Cryptosporidium parvum
LKSTNSGSKLL

SEQ ID NO: 2268861 - protein, 10 aa, Cryptosporidium parvum
LKSVGYKGST

SEQ ID NO: 2268862 - protein, 7 aa, Cryptosporidium parvum
LKSVSKD

SEQ ID NO: 2268863 - protein, 4 aa, Cryptosporidium parvum
LKTE

SEQ ID NO: 2268864 - protein, 6 aa, Cryptosporidium parvum
LKTEKG

SEQ ID NO: 2268865 - protein, 10 aa, Cryptosporidium parvum
LKTENKSKGF

SEQ ID NO: 2268866 - protein, 8 aa, Cryptosporidium parvum
LKTHNSEK

SEQ ID NO: 2268867 - protein, 8 aa, Cryptosporidium parvum
LKTKENNG

SEQ ID NO: 2268868 - protein, 12 aa, Cryptosporidium parvum
LKTKGEYSIPGR

SEQ ID NO: 2268869 - protein, 6 aa, Cryptosporidium parvum
LKTKLS

SEQ ID NO: 2268870 - protein, 8 aa, Cryptosporidium parvum
LKTNAPNK

SEQ ID NO: 2268871 - protein, 6 aa, Cryptosporidium parvum
LKTQDN

SEQ ID NO: 2268872 - protein, 5 aa, Cryptosporidium parvum
LKTQK

SEQ ID NO: 2268873 - protein, 8 aa, Cryptosporidium parvum
LKTQKSTS

SEQ ID NO: 2268874 - protein, 13 aa, Cryptosporidium parvum
LKTRTQWDQEQRE

SEQ ID NO: 2268875 - protein, 6 aa, Cryptosporidium parvum
LKTSSK

SEQ ID NO: 2268876 - protein, 9 aa, Cryptosporidium parvum
LKTSSQISN

SEQ ID NO: 2268877 - protein, 17 aa, Cryptosporidium parvum
LKTTKKKSNYQNNTKKI

SEQ ID NO: 2268878 - protein, 8 aa, Cryptosporidium parvum
LKTTSESL

SEQ ID NO: 2268879 - protein, 15 aa, Cryptosporidium parvum
LKTTTKKKNKVNGPM

SEQ ID NO: 2268880 - protein, 13 aa, Cryptosporidium parvum
LKVSRGEKSEKKG

SEQ ID NO: 2268881 - protein, 11 aa, Cryptosporidium parvum
LKYESDNDNEF

SEQ ID NO: 2268882 - protein, 87 aa, Cryptosporidium parvum
LKYRDDGYTYVGGDNSGSEDGRTGRIGDQGLEADENFGTKGKKQSKKKTKEKSVKKSSGSGSSGKSRASSSSGGSKKTEVGSSEQIE

SEQ ID NO: 2268883 - protein, 11 aa, Cryptosporidium parvum
LLESNSNLKDN

SEQ ID NO: 2268884 - protein, 12 aa, Cryptosporidium parvum
LLGEDSKLGRKN

SEQ ID NO: 2268885 - protein, 16 aa, Cryptosporidium parvum
LLGQNGGISIQGPHSQ

SEQ ID NO: 2268886 - protein, 6 aa, Cryptosporidium parvum
LLGSTG

SEQ ID NO: 2268887 - protein, 11 aa, Cryptosporidium parvum
LLKKNKPNLIE

SEQ ID NO: 2268888 - protein, 9 aa, Cryptosporidium parvum
LLPGDDEVR

SEQ ID NO: 2268889 - protein, 17 aa, Cryptosporidium parvum
LLPPPPPPPPPPPPPHT

SEQ ID NO: 2268890 - protein, 7 aa, Cryptosporidium parvum
LLPSEAR

SEQ ID NO: 2268891 - protein, 4 aa, Cryptosporidium parvum
LLQT

SEQ ID NO: 2268892 - protein, 19 aa, Cryptosporidium parvum
LLSDKQNDLGRSNPYPERK

SEQ ID NO: 2268893 - protein, 12 aa, Cryptosporidium parvum
LLSDPQKRSEYK

SEQ ID NO: 2268894 - protein, 7 aa, Cryptosporidium parvum
LLSNSEP

SEQ ID NO: 2268895 - protein, 28 aa, Cryptosporidium parvum
LMEASKDEMESERRKLKEELESKTEEYN

SEQ ID NO: 2268896 - protein, 11 aa, Cryptosporidium parvum
LMNDKNKKNYL

SEQ ID NO: 2268897 - protein, 54 aa, Cryptosporidium parvum
LNAAASAIETQISQAQQGNKTDSSPGNFSDDDGTLRNEQSSRMETQARKAPDAV

SEQ ID NO: 2268898 - protein, 10 aa, Cryptosporidium parvum
LNAKAGGNYY

SEQ ID NO: 2268899 - protein, 5 aa, Cryptosporidium parvum
LNANP

SEQ ID NO: 2268900 - protein, 5 aa, Cryptosporidium parvum
LNAQG

SEQ ID NO: 2268901 - protein, 7 aa, Cryptosporidium parvum
LNATNHN

SEQ ID NO: 2268902 - protein, 10 aa, Cryptosporidium parvum
LNDAASKKYD

SEQ ID NO: 2268903 - protein, 17 aa, Cryptosporidium parvum
LNDDENGDIKTDNDVEL

SEQ ID NO: 2268904 - protein, 7 aa, Cryptosporidium parvum
LNDERDM

SEQ ID NO: 2268905 - protein, 20 aa, Cryptosporidium parvum
LNDNSQKEVEGSKERSEMKQ

SEQ ID NO: 2268906 - protein, 12 aa, Cryptosporidium parvum
LNDSRTKESIKM

SEQ ID NO: 2268907 - protein, 10 aa, Cryptosporidium parvum
LNDSSSEYQC

SEQ ID NO: 2268908 - protein, 5 aa, Cryptosporidium parvum
LNDTN

SEQ ID NO: 2268909 - protein, 9 aa, Cryptosporidium parvum
LNDTVPSEI

SEQ ID NO: 2268910 - protein, 15 aa, Cryptosporidium parvum
LNDYPSKGSYSQSSQ

SEQ ID NO: 2268911 - protein, 14 aa, Cryptosporidium parvum
LNEDQKKVTKEKIK

SEQ ID NO: 2268912 - protein, 11 aa, Cryptosporidium parvum
LNEDSKTKLDE

SEQ ID NO: 2268913 - protein, 5 aa, Cryptosporidium parvum
LNEEI

SEQ ID NO: 2268914 - protein, 9 aa, Cryptosporidium parvum
LNEENSKQE

SEQ ID NO: 2268915 - protein, 9 aa, Cryptosporidium parvum
LNEEPNSQL

SEQ ID NO: 2268916 - protein, 10 aa, Cryptosporidium parvum
LNEGESSCEQ

SEQ ID NO: 2268917 - protein, 8 aa, Cryptosporidium parvum
LNEGPGLT

SEQ ID NO: 2268918 - protein, 5 aa, Cryptosporidium parvum
LNEHT

SEQ ID NO: 2268919 - protein, 4 aa, Cryptosporidium parvum
LNEI

SEQ ID NO: 2268920 - protein, 24 aa, Cryptosporidium parvum
LNEKNKRRRLDSDNSTNTKNGETQ

SEQ ID NO: 2268921 - protein, 7 aa, Cryptosporidium parvum
LNEKPQI

SEQ ID NO: 2268922 - protein, 21 aa, Cryptosporidium parvum
LNEKVNENQTKQKSEKNVSEG

SEQ ID NO: 2268923 - protein, 6 aa, Cryptosporidium parvum
LNENEP

SEQ ID NO: 2268924 - protein, 7 aa, Cryptosporidium parvum
LNEPNSI

SEQ ID NO: 2268925 - protein, 8 aa, Cryptosporidium parvum
LNEPSESR

SEQ ID NO: 2268926 - protein, 21 aa, Cryptosporidium parvum
LNEQKKNIQKNLKPTDQNEIS

SEQ ID NO: 2268927 - protein, 7 aa, Cryptosporidium parvum
LNEQQEN

SEQ ID NO: 2268928 - protein, 5 aa, Cryptosporidium parvum
LNEQR

SEQ ID NO: 2268929 - protein, 8 aa, Cryptosporidium parvum
LNERNEEF

SEQ ID NO: 2268930 - protein, 5 aa, Cryptosporidium parvum
LNESG

SEQ ID NO: 2268931 - protein, 10 aa, Cryptosporidium parvum
LNESNHEEDS

SEQ ID NO: 2268932 - protein, 27 aa, Cryptosporidium parvum
LNESYSQNNQNAYQGSPPKESVVAQLH

SEQ ID NO: 2268933 - protein, 9 aa, Cryptosporidium parvum
LNETQSGVD

SEQ ID NO: 2268934 - protein, 10 aa, Cryptosporidium parvum
LNGDSNSKLS

SEQ ID NO: 2268935 - protein, 11 aa, Cryptosporidium parvum
LNGDTTSKSAM

SEQ ID NO: 2268936 - protein, 6 aa, Cryptosporidium parvum
LNGESK

SEQ ID NO: 2268937 - protein, 9 aa, Cryptosporidium parvum
LNGGSECNT

SEQ ID NO: 2268938 - protein, 16 aa, Cryptosporidium parvum
LNGIGETNNVKYSSNN

SEQ ID NO: 2268939 - protein, 9 aa, Cryptosporidium parvum
LNGKNENKI

SEQ ID NO: 2268940 - protein, 6 aa, Cryptosporidium parvum
LNGNDE

SEQ ID NO: 2268941 - protein, 7 aa, Cryptosporidium parvum
LNGNDET

SEQ ID NO: 2268942 - protein, 7 aa, Cryptosporidium parvum
LNGNEFN

SEQ ID NO: 2268943 - protein, 12 aa, Cryptosporidium parvum
LNGNNSNNMSIS

SEQ ID NO: 2268944 - protein, 8 aa, Cryptosporidium parvum
LNGNPSLS

SEQ ID NO: 2268945 - protein, 10 aa, Cryptosporidium parvum
LNGNQGEIEI

SEQ ID NO: 2268946 - protein, 7 aa, Cryptosporidium parvum
LNGSAEV

SEQ ID NO: 2268947 - protein, 9 aa, Cryptosporidium parvum
LNGSGKSSV

SEQ ID NO: 2268948 - protein, 13 aa, Cryptosporidium parvum
LNGSQSRKSKIPK

SEQ ID NO: 2268949 - protein, 12 aa, Cryptosporidium parvum
LNGSSNPASTNN

SEQ ID NO: 2268950 - protein, 10 aa, Cryptosporidium parvum
LNGSSSEYIH

SEQ ID NO: 2268951 - protein, 7 aa, Cryptosporidium parvum
LNHGLSE

SEQ ID NO: 2268952 - protein, 8 aa, Cryptosporidium parvum
LNHNPEVN

SEQ ID NO: 2268953 - protein, 7 aa, Cryptosporidium parvum
LNHPEEV

SEQ ID NO: 2268954 - protein, 17 aa, Cryptosporidium parvum
LNHQESVVNKGDNMMGG

SEQ ID NO: 2268955 - protein, 18 aa, Cryptosporidium parvum
LNHSDHDNFKSGRSLGDC

SEQ ID NO: 2268956 - protein, 16 aa, Cryptosporidium parvum
LNHSRNRFDRTPHGNY

SEQ ID NO: 2268957 - protein, 8 aa, Cryptosporidium parvum
LNIPTDPI

SEQ ID NO: 2268958 - protein, 10 aa, Cryptosporidium parvum
LNKDRGDDEM

SEQ ID NO: 2268959 - protein, 10 aa, Cryptosporidium parvum
LNKDSQKHRL

SEQ ID NO: 2268960 - protein, 10 aa, Cryptosporidium parvum
LNKEHDTLKR

SEQ ID NO: 2268961 - protein, 8 aa, Cryptosporidium parvum
LNKEQARE

SEQ ID NO: 2268962 - protein, 10 aa, Cryptosporidium parvum
LNKGRSSNSE

SEQ ID NO: 2268963 - protein, 18 aa, Cryptosporidium parvum
LNKGSNNSNNNNNNNNNH

SEQ ID NO: 2268964 - protein, 17 aa, Cryptosporidium parvum
LNKHDETSSKSTTLEKL

SEQ ID NO: 2268965 - protein, 10 aa, Cryptosporidium parvum
LNKKERREAS

SEQ ID NO: 2268966 - protein, 5 aa, Cryptosporidium parvum
LNKNG

SEQ ID NO: 2268967 - protein, 55 aa, Cryptosporidium parvum
LNKNRSSKKGQIGKGGHQGAIPTSNIEAKPTVPSTAKQAALSSSSGIRRSHKKKR

SEQ ID NO: 2268968 - protein, 17 aa, Cryptosporidium parvum
LNKPEPTVQSPNFESHE

SEQ ID NO: 2268969 - protein, 7 aa, Cryptosporidium parvum
LNKPNQV

SEQ ID NO: 2268970 - protein, 10 aa, Cryptosporidium parvum
LNKPTGPPST

SEQ ID NO: 2268971 - protein, 12 aa, Cryptosporidium parvum
LNKRKESSIDKK

SEQ ID NO: 2268972 - protein, 10 aa, Cryptosporidium parvum
LNKSASSWKK

SEQ ID NO: 2268973 - protein, 12 aa, Cryptosporidium parvum
LNKSDSEDKKDK

SEQ ID NO: 2268974 - protein, 13 aa, Cryptosporidium parvum
LNKSETASKFGED

SEQ ID NO: 2268975 - protein, 8 aa, Cryptosporidium parvum
LNKSGGSL

SEQ ID NO: 2268976 - protein, 6 aa, Cryptosporidium parvum
LNKSGI

SEQ ID NO: 2268977 - protein, 6 aa, Cryptosporidium parvum
LNKSGK

SEQ ID NO: 2268978 - protein, 10 aa, Cryptosporidium parvum
LNKSNPSSQV

SEQ ID NO: 2268979 - protein, 8 aa, Cryptosporidium parvum
LNKSNVDN

SEQ ID NO: 2268980 - protein, 10 aa, Cryptosporidium parvum
LNKSRPNANS

SEQ ID NO: 2268981 - protein, 16 aa, Cryptosporidium parvum
LNKSSQDDLVDSDNNE

SEQ ID NO: 2268982 - protein, 11 aa, Cryptosporidium parvum
LNKSVPTQITD

SEQ ID NO: 2268983 - protein, 8 aa, Cryptosporidium parvum
LNLPQNPE

SEQ ID NO: 2268984 - protein, 11 aa, Cryptosporidium parvum
LNNANNRKAFP

SEQ ID NO: 2268985 - protein, 9 aa, Cryptosporidium parvum
LNNDEDQAF

SEQ ID NO: 2268986 - protein, 8 aa, Cryptosporidium parvum
LNNDGEIK

SEQ ID NO: 2268987 - protein, 11 aa, Cryptosporidium parvum
LNNEEDENPQF

SEQ ID NO: 2268988 - protein, 14 aa, Cryptosporidium parvum
LNNEISEEKNEAIA

SEQ ID NO: 2268989 - protein, 9 aa, Cryptosporidium parvum
LNNEKEREL

SEQ ID NO: 2268990 - protein, 9 aa, Cryptosporidium parvum
LNNEKQEKK

SEQ ID NO: 2268991 - protein, 6 aa, Cryptosporidium parvum
LNNEQS

SEQ ID NO: 2268992 - protein, 9 aa, Cryptosporidium parvum
LNNGKGPEL

SEQ ID NO: 2268993 - protein, 10 aa, Cryptosporidium parvum
LNNGQNSKIV

SEQ ID NO: 2268994 - protein, 7 aa, Cryptosporidium parvum
LNNGSVK

SEQ ID NO: 2268995 - protein, 6 aa, Cryptosporidium parvum
LNNHED

SEQ ID NO: 2268996 - protein, 15 aa, Cryptosporidium parvum
LNNKENTNFNSQNDR

SEQ ID NO: 2268997 - protein, 19 aa, Cryptosporidium parvum
LNNKNSPSSQSLLSDPNDL

SEQ ID NO: 2268998 - protein, 33 aa, Cryptosporidium parvum
LNNKSNSKRQSTSNQKRKSTTANSKSNQTIENP

SEQ ID NO: 2268999 - protein, 4 aa, Cryptosporidium parvum
LNNL

SEQ ID NO: 2269000 - protein, 4 aa, Cryptosporidium parvum
LNNN

SEQ ID NO: 2269001 - protein, 5 aa, Cryptosporidium parvum
LNNNN

SEQ ID NO: 2269002 - protein, 30 aa, Cryptosporidium parvum
LNNNNKSQLNNVGNDLKSDVNNSIQTDTHC

SEQ ID NO: 2269003 - protein, 18 aa, Cryptosporidium parvum
LNNNNNNTQQKKVSINQN

SEQ ID NO: 2269004 - protein, 30 aa, Cryptosporidium parvum; identical to SEQ ID NO: 2151010

SEQ ID NO: 2269005 - protein, 7 aa, Cryptosporidium parvum
LNNNSKQ

SEQ ID NO: 2269006 - protein, 4 aa, Cryptosporidium parvum
LNNP

SEQ ID NO: 2269007 - protein, 4 aa, Cryptosporidium parvum
LNNS

SEQ ID NO: 2269008 - protein, 23 aa, Cryptosporidium parvum
LNNSDSIENKGGDNFVGDEDDEF

SEQ ID NO: 2269009 - protein, 5 aa, Cryptosporidium parvum
LNNSE

SEQ ID NO: 2269010 - protein, 40 aa, Cryptosporidium parvum
LNNSNSNIINSSNSSNSSNSSISSSSSSSSSSSSINSNNS

SEQ ID NO: 2269011 - protein, 8 aa, Cryptosporidium parvum
LNNSRSRN

SEQ ID NO: 2269012 - protein, 23 aa, Cryptosporidium parvum
LNNSSSSLSSLSYSSDSSSSIEY

SEQ ID NO: 2269013 - protein, 10 aa, Cryptosporidium parvum
LNNSSTEDKE

SEQ ID NO: 2269014 - protein, 26 aa, Cryptosporidium parvum
LNNTLSSSKLNSENTKLSENTNSNFN

SEQ ID NO: 2269015 - protein, 10 aa, Cryptosporidium parvum
LNNTNRPSFG

SEQ ID NO: 2269016 - protein, 15 aa, Cryptosporidium parvum
LNNTNVGGKKRHNAW

SEQ ID NO: 2269017 - protein, 5 aa, Cryptosporidium parvum
LNPCS

SEQ ID NO: 2269018 - protein, 5 aa, Cryptosporidium parvum
LNPDA

SEQ ID NO: 2269019 - protein, 5 aa, Cryptosporidium parvum
LNPDD

SEQ ID NO: 2269020 - protein, 9 aa, Cryptosporidium parvum
LNPDEESKN

SEQ ID NO: 2269021 - protein, 14 aa, Cryptosporidium parvum
LNPEGDKIAVSTSN

SEQ ID NO: 2269022 - protein, 10 aa, Cryptosporidium parvum
LNPGDGAFYG

SEQ ID NO: 2269023 - protein, 13 aa, Cryptosporidium parvum
LNPKGHGNTIRNR

SEQ ID NO: 2269024 - protein, 8 aa, Cryptosporidium parvum
LNPKPEKY

SEQ ID NO: 2269025 - protein, 11 aa, Cryptosporidium parvum
LNPKSGSHPHT

SEQ ID NO: 2269026 - protein, 7 aa, Cryptosporidium parvum
LNPKSRN

SEQ ID NO: 2269027 - protein, 24 aa, Cryptosporidium parvum
LNPNHPKSKKDQPNDQNHIDPEDS

SEQ ID NO: 2269028 - protein, 14 aa, Cryptosporidium parvum
LNPNMKSKGKLKEI

SEQ ID NO: 2269029 - protein, 7 aa, Cryptosporidium parvum
LNPNQHS

SEQ ID NO: 2269030 - protein, 19 aa, Cryptosporidium parvum
LNPPPASSNANNPISDELK

SEQ ID NO: 2269031 - protein, 19 aa, Cryptosporidium parvum
LNPPYSSESASTKSTTLTN

SEQ ID NO: 2269032 - protein, 13 aa, Cryptosporidium parvum
LNPQNESHCQEND

SEQ ID NO: 2269033 - protein, 9 aa, Cryptosporidium parvum
LNPRKHREK

SEQ ID NO: 2269034 - protein, 6 aa, Cryptosporidium parvum
LNPRSG

SEQ ID NO: 2269035 - protein, 9 aa, Cryptosporidium parvum
LNPSHKDSV

SEQ ID NO: 2269036 - protein, 5 aa, Cryptosporidium parvum
LNPSL

SEQ ID NO: 2269037 - protein, 9 aa, Cryptosporidium parvum
LNPSNGGAG

SEQ ID NO: 2269038 - protein, 7 aa, Cryptosporidium parvum
LNPSSID

SEQ ID NO: 2269039 - protein, 10 aa, Cryptosporidium parvum
LNPSSRSRSL

SEQ ID NO: 2269040 - protein, 12 aa, Cryptosporidium parvum
LNPSSTERITAK

SEQ ID NO: 2269041 - protein, 5 aa, Cryptosporidium parvum
LNPTG

SEQ ID NO: 2269042 - protein, 5 aa, Cryptosporidium parvum
LNPTN

SEQ ID NO: 2269043 - protein, 7 aa, Cryptosporidium parvum
LNPTPFK

SEQ ID NO: 2269044 - protein, 13 aa, Cryptosporidium parvum
LNPWNNDKPYSNK

SEQ ID NO: 2269045 - protein, 10 aa, Cryptosporidium parvum
LNQASKSSNF

SEQ ID NO: 2269046 - protein, 9 aa, Cryptosporidium parvum
LNQDSRENV

SEQ ID NO: 2269047 - protein, 5 aa, Cryptosporidium parvum
LNQEE

SEQ ID NO: 2269048 - protein, 16 aa, Cryptosporidium parvum
LNQGKKPVSELDNSEL

SEQ ID NO: 2269049 - protein, 14 aa, Cryptosporidium parvum
LNQGTSNNNNNNNI

SEQ ID NO: 2269050 - protein, 41 aa, Cryptosporidium parvum
LNQNNKNQLEINSTNDCNASQLNTRPSSGFSAGNNDSFSFS

SEQ ID NO: 2269051 - protein, 6 aa, Cryptosporidium parvum
LNQQRR

SEQ ID NO: 2269052 - protein, 8 aa, Cryptosporidium parvum
LNQSDTPT

SEQ ID NO: 2269053 - protein, 7 aa, Cryptosporidium parvum
LNQSPGD

SEQ ID NO: 2269054 - protein, 8 aa, Cryptosporidium parvum
LNQTEDEN

SEQ ID NO: 2269055 - protein, 5 aa, Cryptosporidium parvum
LNQTS

SEQ ID NO: 2269056 - protein, 14 aa, Cryptosporidium parvum
LNQYNDNLQGQNTY

SEQ ID NO: 2269057 - protein, 8 aa, Cryptosporidium parvum
LNRDGTYG

SEQ ID NO: 2269058 - protein, 15 aa, Cryptosporidium parvum
LNRDPPTNCSAGPIG

SEQ ID NO: 2269059 - protein, 6 aa, Cryptosporidium parvum
LNREIT

SEQ ID NO: 2269060 - protein, 9 aa, Cryptosporidium parvum
LNRGEDKPD

SEQ ID NO: 2269061 - protein, 8 aa, Cryptosporidium parvum
LNRPPEID

SEQ ID NO: 2269062 - protein, 6 aa, Cryptosporidium parvum
LNRSQA

SEQ ID NO: 2269063 - protein, 15 aa, Cryptosporidium parvum
LNRTETESSQETTRN

SEQ ID NO: 2269064 - protein, 39 aa, Cryptosporidium parvum
LNRTRDEIYESSKRSSCDSSSKKKLIKPSRKSISKENAA

SEQ ID NO: 2269065 - protein, 4 aa, Cryptosporidium parvum
LNSD

SEQ ID NO: 2269066 - protein, 7 aa, Cryptosporidium parvum
LNSDEYN

SEQ ID NO: 2269067 - protein, 19 aa, Cryptosporidium parvum
LNSDKETNFNNNENETTSE

SEQ ID NO: 2269068 - protein, 6 aa, Cryptosporidium parvum
LNSDKN

SEQ ID NO: 2269069 - protein, 9 aa, Cryptosporidium parvum
LNSDSNKWD

SEQ ID NO: 2269070 - protein, 4 aa, Cryptosporidium parvum
LNSE

SEQ ID NO: 2269071 - protein, 16 aa, Cryptosporidium parvum
LNSEASPDQDKDQEEY

SEQ ID NO: 2269072 - protein, 28 aa, Cryptosporidium parvum
LNSEISSKLPPIKKKPKKLSGVEGAPIK

SEQ ID NO: 2269073 - protein, 12 aa, Cryptosporidium parvum
LNSEKKTSNSAN

SEQ ID NO: 2269074 - protein, 5 aa, Cryptosporidium parvum
LNSES

SEQ ID NO: 2269075 - protein, 7 aa, Cryptosporidium parvum
LNSGEKY

SEQ ID NO: 2269076 - protein, 8 aa, Cryptosporidium parvum
LNSGGDDL

SEQ ID NO: 2269077 - protein, 15 aa, Cryptosporidium parvum
LNSGIERQSRNSSNW

SEQ ID NO: 2269078 - protein, 9 aa, Cryptosporidium parvum
LNSGQSSNS

SEQ ID NO: 2269079 - protein, 7 aa, Cryptosporidium parvum
LNSGRTP

SEQ ID NO: 2269080 - protein, 16 aa, Cryptosporidium parvum
LNSGSGNDNDQETSEF

SEQ ID NO: 2269081 - protein, 9 aa, Cryptosporidium parvum
LNSKEKKFE

SEQ ID NO: 2269082 - protein, 13 aa, Cryptosporidium parvum
LNSKETKKNEYSS

SEQ ID NO: 2269083 - protein, 14 aa, Cryptosporidium parvum
LNSKGQTNCPTPTR

SEQ ID NO: 2269084 - protein, 10 aa, Cryptosporidium parvum
LNSKGSKEDL

SEQ ID NO: 2269085 - protein, 24 aa, Cryptosporidium parvum
LNSKTLKPSNLAKKSTTKPKFSYD

SEQ ID NO: 2269086 - protein, 9 aa, Cryptosporidium parvum
LNSKTNQNK

SEQ ID NO: 2269087 - protein, 5 aa, Cryptosporidium parvum
LNSND

SEQ ID NO: 2269088 - protein, 10 aa, Cryptosporidium parvum
LNSNGERLES

SEQ ID NO: 2269089 - protein, 5 aa, Cryptosporidium parvum
LNSNN

SEQ ID NO: 2269090 - protein, 10 aa, Cryptosporidium parvum
LNSNNELDPD

SEQ ID NO: 2269091 - protein, 10 aa, Cryptosporidium parvum
LNSNQSADEL

SEQ ID NO: 2269092 - protein, 5 aa, Cryptosporidium parvum
LNSNS

SEQ ID NO: 2269093 - protein, 19 aa, Cryptosporidium parvum
LNSNSGEGDDDDIEDDDED

SEQ ID NO: 2269094 - protein, 17 aa, Cryptosporidium parvum
LNSNSVNTTKSNITTKY

SEQ ID NO: 2269095 - protein, 7 aa, Cryptosporidium parvum
LNSPKAL

SEQ ID NO: 2269096 - protein, 20 aa, Cryptosporidium parvum
LNSQDSHNISSNNNNNNNFQ

SEQ ID NO: 2269097 - protein, 12 aa, Cryptosporidium parvum
LNSREKKTLEND

SEQ ID NO: 2269098 - protein, 4 aa, Cryptosporidium parvum
LNSS

SEQ ID NO: 2269099 - protein, 16 aa, Cryptosporidium parvum
LNSSDQKGSENNHSIS

SEQ ID NO: 2269100 - protein, 5 aa, Cryptosporidium parvum
LNSSK

SEQ ID NO: 2269101 - protein, 9 aa, Cryptosporidium parvum
LNSSNMSQE

SEQ ID NO: 2269102 - protein, 12 aa, Cryptosporidium parvum
LNSSNNCNKQKN

SEQ ID NO: 2269103 - protein, 7 aa, Cryptosporidium parvum
LNSSNVD

SEQ ID NO: 2269104 - protein, 7 aa, Cryptosporidium parvum
LNSSPVT

SEQ ID NO: 2269105 - protein, 9 aa, Cryptosporidium parvum
LNSSQESNT

SEQ ID NO: 2269106 - protein, 17 aa, Cryptosporidium parvum
LNSSRISPISKSKALQT

SEQ ID NO: 2269107 - protein, 10 aa, Cryptosporidium parvum
LNSSSGSQIT

SEQ ID NO: 2269108 - protein, 18 aa, Cryptosporidium parvum
LNSSSNNNDNNGNQTNGI

SEQ ID NO: 2269109 - protein, 11 aa, Cryptosporidium parvum
LNSSSPSFYDP

SEQ ID NO: 2269110 - protein, 40 aa, Cryptosporidium parvum
LNSSSSNSQDGSNSNNNSSSTSSGNSSSSLDYKPTAQEIK

SEQ ID NO: 2269111 - protein, 32 aa, Cryptosporidium parvum
LNSSTSGGMSGSDSSSSSSSSSSNNPNPPLSS

SEQ ID NO: 2269112 - protein, 17 aa, Cryptosporidium parvum
LNSTKQDHENPSFSSSG

SEQ ID NO: 2269113 - protein, 23 aa, Cryptosporidium parvum
LNSTNPESGGNNLTQNQNTKPHP

SEQ ID NO: 2269114 - protein, 8 aa, Cryptosporidium parvum
LNSTPPTL

SEQ ID NO: 2269115 - protein, 5 aa, Cryptosporidium parvum
LNSTT

SEQ ID NO: 2269116 - protein, 28 aa, Cryptosporidium parvum
LNTAKKTEFGGYANAKSTVTKPNSSNWK

SEQ ID NO: 2269117 - protein, 10 aa, Cryptosporidium parvum
LNTDSSSNIY

SEQ ID NO: 2269118 - protein, 9 aa, Cryptosporidium parvum
LNTENESEL

SEQ ID NO: 2269119 - protein, 8 aa, Cryptosporidium parvum
LNTETGEM

SEQ ID NO: 2269120 - protein, 9 aa, Cryptosporidium parvum
LNTETTKVK

SEQ ID NO: 2269121 - protein, 6 aa, Cryptosporidium parvum
LNTGEN

SEQ ID NO: 2269122 - protein, 6 aa, Cryptosporidium parvum
LNTGNS

SEQ ID NO: 2269123 - protein, 14 aa, Cryptosporidium parvum
LNTGNVSSQEITPN

SEQ ID NO: 2269124 - protein, 8 aa, Cryptosporidium parvum
LNTGRESS

SEQ ID NO: 2269125 - protein, 6 aa, Cryptosporidium parvum
LNTGSA

SEQ ID NO: 2269126 - protein, 5 aa, Cryptosporidium parvum
LNTKD

SEQ ID NO: 2269127 - protein, 8 aa, Cryptosporidium parvum
LNTNSSSI

SEQ ID NO: 2269128 - protein, 6 aa, Cryptosporidium parvum
LNTNST

SEQ ID NO: 2269129 - protein, 8 aa, Cryptosporidium parvum
LNTNTYQK

SEQ ID NO: 2269130 - protein, 10 aa, Cryptosporidium parvum
LNTPSYGNNS

SEQ ID NO: 2269131 - protein, 13 aa, Cryptosporidium parvum
LNTPTGSAIAEAS

SEQ ID NO: 2269132 - protein, 25 aa, Cryptosporidium parvum
LNTSDTGKKPNSSTPNSSNIANPTI

SEQ ID NO: 2269133 - protein, 14 aa, Cryptosporidium parvum
LNTSGRDDKNSKDF

SEQ ID NO: 2269134 - protein, 12 aa, Cryptosporidium parvum
LNTSSTSNDSED

SEQ ID NO: 2269135 - protein, 43 aa, Cryptosporidium parvum
LNTTSPEATKETNKTYDNNSDAKNRINQSNNATDKRSEKQTDL

SEQ ID NO: 2269136 - protein, 4 aa, Cryptosporidium parvum
LNTV

SEQ ID NO: 2269137 - protein, 4 aa, Cryptosporidium parvum
LNTY

SEQ ID NO: 2269138 - protein, 9 aa, Cryptosporidium parvum
LNVPRSSAS

SEQ ID NO: 2269139 - protein, 6 aa, Cryptosporidium parvum
LNYQTQ

SEQ ID NO: 2269140 - protein, 9 aa, Cryptosporidium parvum
LNYSNDEIN

SEQ ID NO: 2269141 - protein, 9 aa, Cryptosporidium parvum
LPAENRESF

SEQ ID NO: 2269142 - protein, 8 aa, Cryptosporidium parvum
LPAPKTIS

SEQ ID NO: 2269143 - protein, 6 aa, Cryptosporidium parvum
LPAWSE

SEQ ID NO: 2269144 - protein, 13 aa, Cryptosporidium parvum
LPCSNNNEQEKNI

SEQ ID NO: 2269145 - protein, 4 aa, Cryptosporidium parvum
LPDD

SEQ ID NO: 2269146 - protein, 4 aa, Cryptosporidium parvum
LPDE

SEQ ID NO: 2269147 - protein, 16 aa, Cryptosporidium parvum
LPDETSPYVKNSKEAK

SEQ ID NO: 2269148 - protein, 6 aa, Cryptosporidium parvum
LPDFSS

SEQ ID NO: 2269149 - protein, 5 aa, Cryptosporidium parvum
LPDGE

SEQ ID NO: 2269150 - protein, 18 aa, Cryptosporidium parvum
LPDGNSDKKLEKPNYLSP

SEQ ID NO: 2269151 - protein, 7 aa, Cryptosporidium parvum
LPDIEDG

SEQ ID NO: 2269152 - protein, 5 aa, Cryptosporidium parvum
LPDKM

SEQ ID NO: 2269153 - protein, 16 aa, Cryptosporidium parvum
LPDLESKKKTKEKNLI

SEQ ID NO: 2269154 - protein, 4 aa, Cryptosporidium parvum
LPDN

SEQ ID NO: 2269155 - protein, 37 aa, Cryptosporidium parvum
LPDNSSENEEATNEGNEKIKKDQKAESVENQSKTNVL

SEQ ID NO: 2269156 - protein, 9 aa, Cryptosporidium parvum
LPDPNGQTP

SEQ ID NO: 2269157 - protein, 7 aa, Cryptosporidium parvum
LPDSEGR

SEQ ID NO: 2269158 - protein, 16 aa, Cryptosporidium parvum
LPDTGSIYEENGGGTV

SEQ ID NO: 2269159 - protein, 5 aa, Cryptosporidium parvum
LPDTN

SEQ ID NO: 2269160 - protein, 18 aa, Cryptosporidium parvum
LPEDSQNANRGNYKEAPK

SEQ ID NO: 2269161 - protein, 8 aa, Cryptosporidium parvum
LPEEDEFE

SEQ ID NO: 2269162 - protein, 9 aa, Cryptosporidium parvum
LPEEEQKAK

SEQ ID NO: 2269163 - protein, 8 aa, Cryptosporidium parvum
LPEESTGY

SEQ ID NO: 2269164 - protein, 4 aa, Cryptosporidium parvum
LPEG

SEQ ID NO: 2269165 - protein, 8 aa, Cryptosporidium parvum
LPEGDSTS

SEQ ID NO: 2269166 - protein, 7 aa, Cryptosporidium parvum
LPEGNRA

SEQ ID NO: 2269167 - protein, 7 aa, Cryptosporidium parvum
LPEGSIS

SEQ ID NO: 2269168 - protein, 11 aa, Cryptosporidium parvum
LPEKEKEQRKK

SEQ ID NO: 2269169 - protein, 6 aa, Cryptosporidium parvum
LPEKSR

SEQ ID NO: 2269170 - protein, 8 aa, Cryptosporidium parvum
LPENENGI

SEQ ID NO: 2269171 - protein, 11 aa, Cryptosporidium parvum
LPENGDYDPSL

SEQ ID NO: 2269172 - protein, 12 aa, Cryptosporidium parvum
LPENVESPATSV

SEQ ID NO: 2269173 - protein, 9 aa, Cryptosporidium parvum
LPEPDRYGT

SEQ ID NO: 2269174 - protein, 11 aa, Cryptosporidium parvum
LPERASRGKRY

SEQ ID NO: 2269175 - protein, 6 aa, Cryptosporidium parvum
LPESDS

SEQ ID NO: 2269176 - protein, 11 aa, Cryptosporidium parvum
LPETIGGGIGQ

SEQ ID NO: 2269177 - protein, 6 aa, Cryptosporidium parvum
LPEYSS

SEQ ID NO: 2269178 - protein, 4 aa, Cryptosporidium parvum
LPFS

SEQ ID NO: 2269179 - protein, 10 aa, Cryptosporidium parvum
LPGASESGAT

SEQ ID NO: 2269180 - protein, 5 aa, Cryptosporidium parvum
LPGEL

SEQ ID NO: 2269181 - protein, 8 aa, Cryptosporidium parvum
LPGGGGTE

SEQ ID NO: 2269182 - protein, 16 aa, Cryptosporidium parvum
LPGLPQSRTRSNRPIK

SEQ ID NO: 2269183 - protein, 20 aa, Cryptosporidium parvum
LPGLQQSKSLKEISNLNKGS

SEQ ID NO: 2269184 - protein, 5 aa, Cryptosporidium parvum
LPGND

SEQ ID NO: 2269185 - protein, 8 aa, Cryptosporidium parvum
LPGPGTPV

SEQ ID NO: 2269186 - protein, 5 aa, Cryptosporidium parvum
LPGQS

SEQ ID NO: 2269187 - protein, 7 aa, Cryptosporidium parvum
LPGRTPF

SEQ ID NO: 2269188 - protein, 8 aa, Cryptosporidium parvum
LPGSDSDF

SEQ ID NO: 2269189 - protein, 10 aa, Cryptosporidium parvum
LPGTKLNTSS

SEQ ID NO: 2269190 - protein, 12 aa, Cryptosporidium parvum
LPGTTETSGVSN

SEQ ID NO: 2269191 - protein, 6 aa, Cryptosporidium parvum
LPGWGA

SEQ ID NO: 2269192 - protein, 11 aa, Cryptosporidium parvum
LPHKSYSYNGI

SEQ ID NO: 2269193 - protein, 5 aa, Cryptosporidium parvum
LPHND

SEQ ID NO: 2269194 - protein, 10 aa, Cryptosporidium parvum
LPHNNNNKNS

SEQ ID NO: 2269195 - protein, 10 aa, Cryptosporidium parvum
LPHNSSGTPC

SEQ ID NO: 2269196 - protein, 5 aa, Cryptosporidium parvum
LPHPS

SEQ ID NO: 2269197 - protein, 11 aa, Cryptosporidium parvum
LPIPSSIQGRN

SEQ ID NO: 2269198 - protein, 4 aa, Cryptosporidium parvum
LPIS

SEQ ID NO: 2269199 - protein, 15 aa, Cryptosporidium parvum
LPISSQKSPRIEESE

SEQ ID NO: 2269200 - protein, 33 aa, Cryptosporidium parvum
LPITSTEQNSKPATYPNQENENHNNQEGNSSFN

SEQ ID NO: 2269201 - protein, 4 aa, Cryptosporidium parvum
LPKA

SEQ ID NO: 2269202 - protein, 4 aa, Cryptosporidium parvum
LPKD

SEQ ID NO: 2269203 - protein, 7 aa, Cryptosporidium parvum
LPKENPF

SEQ ID NO: 2269204 - protein, 4 aa, Cryptosporidium parvum
LPKI

SEQ ID NO: 2269205 - protein, 4 aa, Cryptosporidium parvum
LPKK

SEQ ID NO: 2269206 - protein, 5 aa, Cryptosporidium parvum
LPKND

SEQ ID NO: 2269207 - protein, 8 aa, Cryptosporidium parvum
LPKNQQKN

SEQ ID NO: 2269208 - protein, 4 aa, Cryptosporidium parvum
LPKS

SEQ ID NO: 2269209 - protein, 41 aa, Cryptosporidium parvum
LPKSNGVTTPGAGGKHTTSTTATTVAASATTTTTPSSPSSV

SEQ ID NO: 2269210 - protein, 6 aa, Cryptosporidium parvum
LPKSQV

SEQ ID NO: 2269211 - protein, 11 aa, Cryptosporidium parvum
LPKSYANEEEL

SEQ ID NO: 2269212 - protein, 4 aa, Cryptosporidium parvum
LPKT

SEQ ID NO: 2269213 - protein, 6 aa, Cryptosporidium parvum
LPLGTQ

SEQ ID NO: 2269214 - protein, 8 aa, Cryptosporidium parvum
LPLSSKSH

SEQ ID NO: 2269215 - protein, 6 aa, Cryptosporidium parvum
LPLTQP

SEQ ID NO: 2269216 - protein, 4 aa, Cryptosporidium parvum
LPNE

SEQ ID NO: 2269217 - protein, 5 aa, Cryptosporidium parvum
LPNGE

SEQ ID NO: 2269218 - protein, 5 aa, Cryptosporidium parvum
LPNGK

SEQ ID NO: 2269219 - protein, 5 aa, Cryptosporidium parvum
LPNKD

SEQ ID NO: 2269220 - protein, 8 aa, Cryptosporidium parvum
LPNKDQQF

SEQ ID NO: 2269221 - protein, 7 aa, Cryptosporidium parvum
LPNKQNS

SEQ ID NO: 2269222 - protein, 5 aa, Cryptosporidium parvum
LPNKS

SEQ ID NO: 2269223 - protein, 8 aa, Cryptosporidium parvum
LPNNPNTK

SEQ ID NO: 2269224 - protein, 6 aa, Cryptosporidium parvum
LPNNQN

SEQ ID NO: 2269225 - protein, 8 aa, Cryptosporidium parvum
LPNNSQAQ

SEQ ID NO: 2269226 - protein, 21 aa, Cryptosporidium parvum
LPNNSVENESVKEFSSNPEID

SEQ ID NO: 2269227 - protein, 9 aa, Cryptosporidium parvum
LPNPDCKTK

SEQ ID NO: 2269228 - protein, 9 aa, Cryptosporidium parvum
LPNPQRPSD

SEQ ID NO: 2269229 - protein, 8 aa, Cryptosporidium parvum
LPNPSIEE

SEQ ID NO: 2269230 - protein, 9 aa, Cryptosporidium parvum
LPNQGGSEL

SEQ ID NO: 2269231 - protein, 5 aa, Cryptosporidium parvum
LPNRS

SEQ ID NO: 2269232 - protein, 22 aa, Cryptosporidium parvum
LPNSNQQPCSPSSPPNSMNPGH

SEQ ID NO: 2269233 - protein, 4 aa, Cryptosporidium parvum
LPPD

SEQ ID NO: 2269234 - protein, 16 aa, Cryptosporidium parvum
LPPDKDSNLASSRGLR

SEQ ID NO: 2269235 - protein, 6 aa, Cryptosporidium parvum
LPPDKL

SEQ ID NO: 2269236 - protein, 7 aa, Cryptosporidium parvum
LPPDSTY

SEQ ID NO: 2269237 - protein, 11 aa, Cryptosporidium parvum
LPPEDSEIGDP

SEQ ID NO: 2269238 - protein, 23 aa, Cryptosporidium parvum
LPPESKNNISNIPASKIEGSQDM

SEQ ID NO: 2269239 - protein, 26 aa, Cryptosporidium parvum
LPPFPKPREGIKSQQHSLEQNKSIPP

SEQ ID NO: 2269240 - protein, 9 aa, Cryptosporidium parvum
LPPHNDLGR

SEQ ID NO: 2269241 - protein, 6 aa, Cryptosporidium parvum
LPPHPG

SEQ ID NO: 2269242 - protein, 6 aa, Cryptosporidium parvum
LPPIAD

SEQ ID NO: 2269243 - protein, 5 aa, Cryptosporidium parvum
LPPIS

SEQ ID NO: 2269244 - protein, 13 aa, Cryptosporidium parvum
LPPKLDDSNTNKN

SEQ ID NO: 2269245 - protein, 9 aa, Cryptosporidium parvum
LPPKQRSKI

SEQ ID NO: 2269246 - protein, 8 aa, Cryptosporidium parvum
LPPKSPGL

SEQ ID NO: 2269247 - protein, 9 aa, Cryptosporidium parvum
LPPKTDASP

SEQ ID NO: 2269248 - protein, 23 aa, Cryptosporidium parvum
LPPNNMNPGANTAFNARSKKRPA

SEQ ID NO: 2269249 - protein, 10 aa, Cryptosporidium parvum
LPPNTEPSSN

SEQ ID NO: 2269250 - protein, 20 aa, Cryptosporidium parvum
LPPPADTKPKTSKFAKLFKK

SEQ ID NO: 2269251 - protein, 16 aa, Cryptosporidium parvum
LPPPIDTSDLKPYPTS

SEQ ID NO: 2269252 - protein, 5 aa, Cryptosporidium parvum
LPPPK

SEQ ID NO: 2269253 - protein, 9 aa, Cryptosporidium parvum
LPPPPPITG

SEQ ID NO: 2269254 - protein, 36 aa, Cryptosporidium parvum
LPPPPPPLEEPLSSPSDEPLPPPPPEVSSSSNESLL

SEQ ID NO: 2269255 - protein, 22 aa, Cryptosporidium parvum
LPPPPPPQYSSYKSSNSSNNDS

SEQ ID NO: 2269256 - protein, 4 aa, Cryptosporidium parvum
LPPR

SEQ ID NO: 2269257 - protein, 25 aa, Cryptosporidium parvum
LPPRATNCRKRKCGRTSQIRPKKKL

SEQ ID NO: 2269258 - protein, 5 aa, Cryptosporidium parvum
LPPSD

SEQ ID NO: 2269259 - protein, 7 aa, Cryptosporidium parvum
LPPSGGK

SEQ ID NO: 2269260 - protein, 12 aa, Cryptosporidium parvum
LPPSPDASITSV

SEQ ID NO: 2269261 - protein, 17 aa, Cryptosporidium parvum
LPPTEETFKKLSSSVNI

SEQ ID NO: 2269262 - protein, 5 aa, Cryptosporidium parvum
LPPTG

SEQ ID NO: 2269263 - protein, 15 aa, Cryptosporidium parvum
LPPTSKNNLKPENID

SEQ ID NO: 2269264 - protein, 6 aa, Cryptosporidium parvum
LPPYKQ

SEQ ID NO: 2269265 - protein, 4 aa, Cryptosporidium parvum
LPQD

SEQ ID NO: 2269266 - protein, 14 aa, Cryptosporidium parvum
LPQDNTSNTQNYPP

SEQ ID NO: 2269267 - protein, 4 aa, Cryptosporidium parvum
LPQL

SEQ ID NO: 2269268 - protein, 4 aa, Cryptosporidium parvum
LPQN

SEQ ID NO: 2269269 - protein, 29 aa, Cryptosporidium parvum
LPQNNRKRTYYESRRTGIKHRKNEINNTY

SEQ ID NO: 2269270 - protein, 13 aa, Cryptosporidium parvum
LPQPSSGNKPLTR

SEQ ID NO: 2269271 - protein, 4 aa, Cryptosporidium parvum
LPQT

SEQ ID NO: 2269272 - protein, 12 aa, Cryptosporidium parvum
LPQTAGFSTPST

SEQ ID NO: 2269273 - protein, 4 aa, Cryptosporidium parvum
LPQY

SEQ ID NO: 2269274 - protein, 9 aa, Cryptosporidium parvum
LPRKDGLDL

SEQ ID NO: 2269275 - protein, 9 aa, Cryptosporidium parvum
LPRKTRRGV

SEQ ID NO: 2269276 - protein, 11 aa, Cryptosporidium parvum
LPRPRGRPKRE

SEQ ID NO: 2269277 - protein, 7 aa, Cryptosporidium parvum
LPRPTEY

SEQ ID NO: 2269278 - protein, 15 aa, Cryptosporidium parvum
LPSAGSSMKSNRSDV

SEQ ID NO: 2269279 - protein, 8 aa, Cryptosporidium parvum
LPSDNQDL

SEQ ID NO: 2269280 - protein, 4 aa, Cryptosporidium parvum
LPSE

SEQ ID NO: 2269281 - protein, 13 aa, Cryptosporidium parvum
LPSEDLSTQTTYE

SEQ ID NO: 2269282 - protein, 20 aa, Cryptosporidium parvum
LPSENNVAKRNDKKRRKEHI

SEQ ID NO: 2269283 - protein, 7 aa, Cryptosporidium parvum
LPSEQQA

SEQ ID NO: 2269284 - protein, 13 aa, Cryptosporidium parvum
LPSERVGNGSPNW

SEQ ID NO: 2269285 - protein, 15 aa, Cryptosporidium parvum
LPSETPINSEGYKND

SEQ ID NO: 2269286 - protein, 20 aa, Cryptosporidium parvum
LPSGSSSSSGTSRPDQKNQV

SEQ ID NO: 2269287 - protein, 9 aa, Cryptosporidium parvum
LPSKARDSQ

SEQ ID NO: 2269288 - protein, 16 aa, Cryptosporidium parvum
LPSKFTPSKPKSEMYE

SEQ ID NO: 2269289 - protein, 11 aa, Cryptosporidium parvum
LPSKSDKEPLK

SEQ ID NO: 2269290 - protein, 11 aa, Cryptosporidium parvum
LPSKSERSNSF

SEQ ID NO: 2269291 - protein, 39 aa, Cryptosporidium parvum
LPSKVNKETSKAENDLENEIEKDDESNKKETKKEEDSIA

SEQ ID NO: 2269292 - protein, 5 aa, Cryptosporidium parvum
LPSLE

SEQ ID NO: 2269293 - protein, 5 aa, Cryptosporidium parvum
LPSLN

SEQ ID NO: 2269294 - protein, 5 aa, Cryptosporidium parvum
LPSMN

SEQ ID NO: 2269295 - protein, 4 aa, Cryptosporidium parvum
LPSN

SEQ ID NO: 2269296 - protein, 11 aa, Cryptosporidium parvum
LPSNGSGNPEI

SEQ ID NO: 2269297 - protein, 17 aa, Cryptosporidium parvum
LPSPSDNSGDLKGNENI

SEQ ID NO: 2269298 - protein, 7 aa, Cryptosporidium parvum
LPSPVTK

SEQ ID NO: 2269299 - protein, 20 aa, Cryptosporidium parvum
LPSSAAGIISENGKSQIKPI

SEQ ID NO: 2269300 - protein, 23 aa, Cryptosporidium parvum
LPSSETINLNESDDLNQDDNNRI

SEQ ID NO: 2269301 - protein, 6 aa, Cryptosporidium parvum
LPSSID

SEQ ID NO: 2269302 - protein, 5 aa, Cryptosporidium parvum
LPSTA

SEQ ID NO: 2269303 - protein, 5 aa, Cryptosporidium parvum
LPSTL

SEQ ID NO: 2269304 - protein, 11 aa, Cryptosporidium parvum
LPTAGDKVSGY

SEQ ID NO: 2269305 - protein, 20 aa, Cryptosporidium parvum
LPTDPVESTVNGSQITSNIT

SEQ ID NO: 2269306 - protein, 9 aa, Cryptosporidium parvum
LPTEHTGDT

SEQ ID NO: 2269307 - protein, 5 aa, Cryptosporidium parvum
LPTGD

SEQ ID NO: 2269308 - protein, 6 aa, Cryptosporidium parvum
LPTGNT

SEQ ID NO: 2269309 - protein, 12 aa, Cryptosporidium parvum
LPTLGNSFTGGI

SEQ ID NO: 2269310 - protein, 10 aa, Cryptosporidium parvum
LPTNKDEDSE

SEQ ID NO: 2269311 - protein, 6 aa, Cryptosporidium parvum
LPTPED

SEQ ID NO: 2269312 - protein, 7 aa, Cryptosporidium parvum
LPTPNGT

SEQ ID NO: 2269313 - protein, 21 aa, Cryptosporidium parvum
LPTPSTSTLPLTSSPHSSSVF

SEQ ID NO: 2269314 - protein, 5 aa, Cryptosporidium parvum
LPTSR

SEQ ID NO: 2269315 - protein, 4 aa, Cryptosporidium parvum
LPVG

SEQ ID NO: 2269316 - protein, 5 aa, Cryptosporidium parvum
LPVGS

SEQ ID NO: 2269317 - protein, 8 aa, Cryptosporidium parvum
LPVPKTSA

SEQ ID NO: 2269318 - protein, 8 aa, Cryptosporidium parvum
LPVSSGTE

SEQ ID NO: 2269319 - protein, 6 aa, Cryptosporidium parvum
LPWDTN

SEQ ID NO: 2269320 - protein, 4 aa, Cryptosporidium parvum
LPYD

SEQ ID NO: 2269321 - protein, 4 aa, Cryptosporidium parvum
LPYG

SEQ ID NO: 2269322 - protein, 13 aa, Cryptosporidium parvum
LPYTSDDKGNTNN

SEQ ID NO: 2269323 - protein, 4 aa, Cryptosporidium parvum
LQAE

SEQ ID NO: 2269324 - protein, 22 aa, Cryptosporidium parvum
LQAQSSNGPSNTRTTSNTTGPT

SEQ ID NO: 2269325 - protein, 11 aa, Cryptosporidium parvum
LQASSESQNHS

SEQ ID NO: 2269326 - protein, 4 aa, Cryptosporidium parvum
LQDD

SEQ ID NO: 2269327 - protein, 4 aa, Cryptosporidium parvum
LQDE

SEQ ID NO: 2269328 - protein, 4 aa, Cryptosporidium parvum
LQDG

SEQ ID NO: 2269329 - protein, 6 aa, Cryptosporidium parvum
LQDGTK

SEQ ID NO: 2269330 - protein, 10 aa, Cryptosporidium parvum
LQDPNWEKQE

SEQ ID NO: 2269331 - protein, 7 aa, Cryptosporidium parvum
LQDPRSA

SEQ ID NO: 2269332 - protein, 6 aa, Cryptosporidium parvum
LQDQNN

SEQ ID NO: 2269333 - protein, 6 aa, Cryptosporidium parvum
LQDSEL

SEQ ID NO: 2269334 - protein, 9 aa, Cryptosporidium parvum
LQDSSSEYD

SEQ ID NO: 2269335 - protein, 9 aa, Cryptosporidium parvum
LQEAPSKAI

SEQ ID NO: 2269336 - protein, 11 aa, Cryptosporidium parvum
LQEDHDSLSRE

SEQ ID NO: 2269337 - protein, 4 aa, Cryptosporidium parvum
LQEE

SEQ ID NO: 2269338 - protein, 8 aa, Cryptosporidium parvum
LQEEKERC

SEQ ID NO: 2269339 - protein, 8 aa, Cryptosporidium parvum
LQEKEGID

SEQ ID NO: 2269340 - protein, 8 aa, Cryptosporidium parvum
LQENQISN

SEQ ID NO: 2269341 - protein, 6 aa, Cryptosporidium parvum
LQEPKK

SEQ ID NO: 2269342 - protein, 8 aa, Cryptosporidium parvum
LQESGIDN

SEQ ID NO: 2269343 - protein, 22 aa, Cryptosporidium parvum
LQESSRRESVENTFRSSRIGSN

SEQ ID NO: 2269344 - protein, 5 aa, Cryptosporidium parvum
LQETR

SEQ ID NO: 2269345 - protein, 8 aa, Cryptosporidium parvum
LQGGPHNH

SEQ ID NO: 2269346 - protein, 7 aa, Cryptosporidium parvum
LQGHDGS

SEQ ID NO: 2269347 - protein, 4 aa, Cryptosporidium parvum
LQGR

SEQ ID NO: 2269348 - protein, 4 aa, Cryptosporidium parvum
LQGS

SEQ ID NO: 2269349 - protein, 6 aa, Cryptosporidium parvum
LQGTTG

SEQ ID NO: 2269350 - protein, 8 aa, Cryptosporidium parvum
LQHKPELG

SEQ ID NO: 2269351 - protein, 4 aa, Cryptosporidium parvum
LQHP

SEQ ID NO: 2269352 - protein, 7 aa, Cryptosporidium parvum
LQIPETS

SEQ ID NO: 2269353 - protein, 12 aa, Cryptosporidium parvum
LQKDRDKDEEKV

SEQ ID NO: 2269354 - protein, 10 aa, Cryptosporidium parvum
LQKKESKMKK

SEQ ID NO: 2269355 - protein, 11 aa, Cryptosporidium parvum
LQKKGTEYQGN

SEQ ID NO: 2269356 - protein, 9 aa, Cryptosporidium parvum
LQKSSDKSH

SEQ ID NO: 2269357 - protein, 11 aa, Cryptosporidium parvum
LQLNNGNSVSK

SEQ ID NO: 2269358 - protein, 12 aa, Cryptosporidium parvum
LQLSSNEDSINK

SEQ ID NO: 2269359 - protein, 9 aa, Cryptosporidium parvum
LQNDSKRYI

SEQ ID NO: 2269360 - protein, 10 aa, Cryptosporidium parvum
LQNEDSSHGE

SEQ ID NO: 2269361 - protein, 17 aa, Cryptosporidium parvum
LQNESTEFTNSYQTPLS

SEQ ID NO: 2269362 - protein, 5 aa, Cryptosporidium parvum
LQNGN

SEQ ID NO: 2269363 - protein, 9 aa, Cryptosporidium parvum
LQNNNLAQN

SEQ ID NO: 2269364 - protein, 9 aa, Cryptosporidium parvum
LQNPESKDN

SEQ ID NO: 2269365 - protein, 12 aa, Cryptosporidium parvum
LQNPTGAMSPGP

SEQ ID NO: 2269366 - protein, 9 aa, Cryptosporidium parvum
LQNSKASHD

SEQ ID NO: 2269367 - protein, 13 aa, Cryptosporidium parvum
LQNSQNENGYSTQ

SEQ ID NO: 2269368 - protein, 10 aa, Cryptosporidium parvum
LQNSTAKKIN

SEQ ID NO: 2269369 - protein, 10 aa, Cryptosporidium parvum
LQNTKNSEKI

SEQ ID NO: 2269370 - protein, 6 aa, Cryptosporidium parvum
LQNTRK

SEQ ID NO: 2269371 - protein, 4 aa, Cryptosporidium parvum
LQPN

SEQ ID NO: 2269372 - protein, 36 aa, Cryptosporidium parvum
LQPNNENIDENDEDNLETDGRSKSRKKSRRATRAKE

SEQ ID NO: 2269373 - protein, 12 aa, Cryptosporidium parvum
LQPRRSKDLPLS

SEQ ID NO: 2269374 - protein, 10 aa, Cryptosporidium parvum
LQQDQGYDNL

SEQ ID NO: 2269375 - protein, 4 aa, Cryptosporidium parvum
LQQE

SEQ ID NO: 2269376 - protein, 22 aa, Cryptosporidium parvum
LQQPESDSQDSPIENTKRRKIS

SEQ ID NO: 2269377 - protein, 5 aa, Cryptosporidium parvum
LQQQE

SEQ ID NO: 2269378 - protein, 17 aa, Cryptosporidium parvum
LQQSQDWESQGNWKLNN

SEQ ID NO: 2269379 - protein, 9 aa, Cryptosporidium parvum
LQRSTRPTW

SEQ ID NO: 2269380 - protein, 10 aa, Cryptosporidium parvum
LQSEESNKLE

SEQ ID NO: 2269381 - protein, 37 aa, Cryptosporidium parvum
LQSEGTSFKAGVSKSIQGGSSNSSFSSSSLSGAGEKS

SEQ ID NO: 2269382 - protein, 9 aa, Cryptosporidium parvum
LQSKPKMKD

SEQ ID NO: 2269383 - protein, 9 aa, Cryptosporidium parvum
LQSLSSTEE

SEQ ID NO: 2269384 - protein, 9 aa, Cryptosporidium parvum
LQSNAPNRG

SEQ ID NO: 2269385 - protein, 11 aa, Cryptosporidium parvum
LQSNNSNTSPF

SEQ ID NO: 2269386 - protein, 7 aa, Cryptosporidium parvum
LQSNPTI

SEQ ID NO: 2269387 - protein, 8 aa, Cryptosporidium parvum
LQSNQNKS

SEQ ID NO: 2269388 - protein, 6 aa, Cryptosporidium parvum
LQSRED

SEQ ID NO: 2269389 - protein, 24 aa, Cryptosporidium parvum
LQSSTETTVGPDELEKSSASADCS

SEQ ID NO: 2269390 - protein, 9 aa, Cryptosporidium parvum
LQSSTREEL

SEQ ID NO: 2269391 - protein, 5 aa, Cryptosporidium parvum
LQTEN

SEQ ID NO: 2269392 - protein, 15 aa, Cryptosporidium parvum
LQTNPNSSSNSNSNN

SEQ ID NO: 2269393 - protein, 8 aa, Cryptosporidium parvum
LQTNSDAE

SEQ ID NO: 2269394 - protein, 7 aa, Cryptosporidium parvum
LQTSGQV

SEQ ID NO: 2269395 - protein, 11 aa, Cryptosporidium parvum
LQTSNKKISEL

SEQ ID NO: 2269396 - protein, 6 aa, Cryptosporidium parvum
LQTTNE

SEQ ID NO: 2269397 - protein, 15 aa, Cryptosporidium parvum
LQTTTSISSNSSGSF

SEQ ID NO: 2269398 - protein, 10 aa, Cryptosporidium parvum
LRADGQTVSF

SEQ ID NO: 2269399 - protein, 8 aa, Cryptosporidium parvum
LRARPEGF

SEQ ID NO: 2269400 - protein, 18 aa, Cryptosporidium parvum
LRDEKEKINQYKKHDDDF

SEQ ID NO: 2269401 - protein, 7 aa, Cryptosporidium parvum
LRDNNSS

SEQ ID NO: 2269402 - protein, 9 aa, Cryptosporidium parvum
LRDNNSSTF

SEQ ID NO: 2269403 - protein, 12 aa, Cryptosporidium parvum
LRDPGSAPNIGD

SEQ ID NO: 2269404 - protein, 4 aa, Cryptosporidium parvum
LRDQ

SEQ ID NO: 2269405 - protein, 4 aa, Cryptosporidium parvum
LRDS

SEQ ID NO: 2269406 - protein, 19 aa, Cryptosporidium parvum
LRDSEELKPGEKPFPEGVD

SEQ ID NO: 2269407 - protein, 8 aa, Cryptosporidium parvum
LRDSEKQS

SEQ ID NO: 2269408 - protein, 6 aa, Cryptosporidium parvum
LRDSNK

SEQ ID NO: 2269409 - protein, 6 aa, Cryptosporidium parvum
LRDSRS

SEQ ID NO: 2269410 - protein, 5 aa, Cryptosporidium parvum
LRDTS

SEQ ID NO: 2269411 - protein, 5 aa, Cryptosporidium parvum
LREEE

SEQ ID NO: 2269412 - protein, 6 aa, Cryptosporidium parvum
LREKGS

SEQ ID NO: 2269413 - protein, 10 aa, Cryptosporidium parvum
LRENSNEQSL

SEQ ID NO: 2269414 - protein, 16 aa, Cryptosporidium parvum
LRENTNSSQKASKSSL

SEQ ID NO: 2269415 - protein, 10 aa, Cryptosporidium parvum
LRESEELEQL

SEQ ID NO: 2269416 - protein, 12 aa, Cryptosporidium parvum
LRESNNEVIKSK

SEQ ID NO: 2269417 - protein, 10 aa, Cryptosporidium parvum
LRESNQGLYS

SEQ ID NO: 2269418 - protein, 7 aa, Cryptosporidium parvum
LRESQNQ

SEQ ID NO: 2269419 - protein, 6 aa, Cryptosporidium parvum
LRETTS

SEQ ID NO: 2269420 - protein, 8 aa, Cryptosporidium parvum
LRGDTNRL

SEQ ID NO: 2269421 - protein, 19 aa, Cryptosporidium parvum
LRGKGSGYLEGYNKQEADE

SEQ ID NO: 2269422 - protein, 9 aa, Cryptosporidium parvum
LRGKRGSLR

SEQ ID NO: 2269423 - protein, 16 aa, Cryptosporidium parvum
LRHRKPKNSDNFSHAD

SEQ ID NO: 2269424 - protein, 10 aa, Cryptosporidium parvum
LRKAQENRKW

SEQ ID NO: 2269425 - protein, 6 aa, Cryptosporidium parvum
LRKEGK

SEQ ID NO: 2269426 - protein, 10 aa, Cryptosporidium parvum
LRKEIEEKEI

SEQ ID NO: 2269427 - protein, 6 aa, Cryptosporidium parvum
LRKETN

SEQ ID NO: 2269428 - protein, 7 aa, Cryptosporidium parvum
LRKGEQY

SEQ ID NO: 2269429 - protein, 8 aa, Cryptosporidium parvum
LRKGTSRR

SEQ ID NO: 2269430 - protein, 10 aa, Cryptosporidium parvum
LRKKTNDRKR

SEQ ID NO: 2269431 - protein, 4 aa, Cryptosporidium parvum
LRKP

SEQ ID NO: 2269432 - protein, 13 aa, Cryptosporidium parvum
LRKQNKAGNISTV

SEQ ID NO: 2269433 - protein, 7 aa, Cryptosporidium parvum
LRKRGKV

SEQ ID NO: 2269434 - protein, 12 aa, Cryptosporidium parvum
LRKTPQTKGRGS

SEQ ID NO: 2269435 - protein, 4 aa, Cryptosporidium parvum
LRLT

SEQ ID NO: 2269436 - protein, 5 aa, Cryptosporidium parvum
LRNDG

SEQ ID NO: 2269437 - protein, 14 aa, Cryptosporidium parvum
LRNDTRQKREYEEN

SEQ ID NO: 2269438 - protein, 39 aa, Cryptosporidium parvum
LRNENNGEQMNKIGTNQASIGEITKRDRKKKGDSPKNQH

SEQ ID NO: 2269439 - protein, 6 aa, Cryptosporidium parvum
LRNENV

SEQ ID NO: 2269440 - protein, 8 aa, Cryptosporidium parvum
LRNEPGQL

SEQ ID NO: 2269441 - protein, 5 aa, Cryptosporidium parvum
LRNGE

SEQ ID NO: 2269442 - protein, 12 aa, Cryptosporidium parvum
LRNKERKTKEYR

SEQ ID NO: 2269443 - protein, 6 aa, Cryptosporidium parvum
LRNNED

SEQ ID NO: 2269444 - protein, 5 aa, Cryptosporidium parvum
LRNNP

SEQ ID NO: 2269445 - protein, 6 aa, Cryptosporidium parvum
LRNPET

SEQ ID NO: 2269446 - protein, 5 aa, Cryptosporidium parvum
LRNPK

SEQ ID NO: 2269447 - protein, 11 aa, Cryptosporidium parvum
LRNYNSNPGSF

SEQ ID NO: 2269448 - protein, 9 aa, Cryptosporidium parvum
LRPPPIPIS

SEQ ID NO: 2269449 - protein, 8 aa, Cryptosporidium parvum
LRPTSDQL

SEQ ID NO: 2269450 - protein, 6 aa, Cryptosporidium parvum
LRQRDE

SEQ ID NO: 2269451 - protein, 12 aa, Cryptosporidium parvum
LRQSNKKVKNQL

SEQ ID NO: 2269452 - protein, 6 aa, Cryptosporidium parvum
LRRSDQ

SEQ ID NO: 2269453 - protein, 6 aa, Cryptosporidium parvum
LRRTGS

SEQ ID NO: 2269454 - protein, 8 aa, Cryptosporidium parvum
LRSEGKAT

SEQ ID NO: 2269455 - protein, 9 aa, Cryptosporidium parvum
LRSKPQKGE

SEQ ID NO: 2269456 - protein, 10 aa, Cryptosporidium parvum
LRSKSENTNF

SEQ ID NO: 2269457 - protein, 10 aa, Cryptosporidium parvum
LRSPKETKDI

SEQ ID NO: 2269458 - protein, 13 aa, Cryptosporidium parvum
LRSQNDKESSHKI

SEQ ID NO: 2269459 - protein, 9 aa, Cryptosporidium parvum
LRSSTQKYK

SEQ ID NO: 2269460 - protein, 9 aa, Cryptosporidium parvum
LRSTPDLGN

SEQ ID NO: 2269461 - protein, 11 aa, Cryptosporidium parvum
LRTAKNDSKVE

SEQ ID NO: 2269462 - protein, 8 aa, Cryptosporidium parvum
LRTKRQQN

SEQ ID NO: 2269463 - protein, 35 aa, Cryptosporidium parvum
LRTRRRTQKWADKQYKRANLGTRYKSNPFGGASHA

SEQ ID NO: 2269464 - protein, 10 aa, Cryptosporidium parvum
LSADKRREEK

SEQ ID NO: 2269465 - protein, 5 aa, Cryptosporidium parvum
LSAEE

SEQ ID NO: 2269466 - protein, 9 aa, Cryptosporidium parvum
LSAKKTKSL

SEQ ID NO: 2269467 - protein, 12 aa, Cryptosporidium parvum
LSALQESGGDIN

SEQ ID NO: 2269468 - protein, 10 aa, Cryptosporidium parvum
LSARNEEYDE

SEQ ID NO: 2269469 - protein, 12 aa, Cryptosporidium parvum
LSATQKKNLKRR

SEQ ID NO: 2269470 - protein, 4 aa, Cryptosporidium parvum
LSDD

SEQ ID NO: 2269471 - protein, 10 aa, Cryptosporidium parvum
LSDDEDDQQI

SEQ ID NO: 2269472 - protein, 7 aa, Cryptosporidium parvum
LSDDQEE

SEQ ID NO: 2269473 - protein, 10 aa, Cryptosporidium parvum
LSDDSARGIE

SEQ ID NO: 2269474 - protein, 17 aa, Cryptosporidium parvum
LSDDSYGKKFSNKTNYR

SEQ ID NO: 2269475 - protein, 5 aa, Cryptosporidium parvum
LSDDV

SEQ ID NO: 2269476 - protein, 4 aa, Cryptosporidium parvum
LSDE

SEQ ID NO: 2269477 - protein, 6 aa, Cryptosporidium parvum
LSDERK

SEQ ID NO: 2269478 - protein, 7 aa, Cryptosporidium parvum
LSDESRE

SEQ ID NO: 2269479 - protein, 7 aa, Cryptosporidium parvum
LSDKEES

SEQ ID NO: 2269480 - protein, 5 aa, Cryptosporidium parvum
LSDKK

SEQ ID NO: 2269481 - protein, 13 aa, Cryptosporidium parvum
LSDNSDDDLSSAF

SEQ ID NO: 2269482 - protein, 7 aa, Cryptosporidium parvum
LSDPELE

SEQ ID NO: 2269483 - protein, 7 aa, Cryptosporidium parvum
LSDPELP

SEQ ID NO: 2269484 - protein, 9 aa, Cryptosporidium parvum
LSDPNAAYK

SEQ ID NO: 2269485 - protein, 22 aa, Cryptosporidium parvum
LSDQEDDHSEREDDQNESNSLG

SEQ ID NO: 2269486 - protein, 14 aa, Cryptosporidium parvum
LSDSDSDDNINNNS

SEQ ID NO: 2269487 - protein, 8 aa, Cryptosporidium parvum
LSDSLKEK

SEQ ID NO: 2269488 - protein, 6 aa, Cryptosporidium parvum
LSDSSI

SEQ ID NO: 2269489 - protein, 8 aa, Cryptosporidium parvum
LSDSSIHS

SEQ ID NO: 2269490 - protein, 28 aa, Cryptosporidium parvum
LSDSSNMSKSGTMDKERSEKSSAEIKKE

SEQ ID NO: 2269491 - protein, 15 aa, Cryptosporidium parvum
LSDSTELKTVKTGTT

SEQ ID NO: 2269492 - protein, 26 aa, Cryptosporidium parvum
LSDSTTKYNLGSNDYDLQRDTQTCRK

SEQ ID NO: 2269493 - protein, 21 aa, Cryptosporidium parvum
LSDTELQKNETIQDPNISTQN

SEQ ID NO: 2269494 - protein, 7 aa, Cryptosporidium parvum
LSDTSSY

SEQ ID NO: 2269495 - protein, 6 aa, Cryptosporidium parvum
LSEAAA

SEQ ID NO: 2269496 - protein, 47 aa, Cryptosporidium parvum
LSEDSDTNDYKDIGQEYNSDYEYRRGQNVSRNNCERQFSDEYSDLSE

SEQ ID NO: 2269497 - protein, 23 aa, Cryptosporidium parvum
LSEDTASMSPNSDIGCDNEEKIE

SEQ ID NO: 2269498 - protein, 18 aa, Cryptosporidium parvum
LSEEEAKSKANSNNSRRR

SEQ ID NO: 2269499 - protein, 33 aa, Cryptosporidium parvum
LSEEGNKDHTSVTLQEDNEKEIIEENKQSQTNI

SEQ ID NO: 2269500 - protein, 18 aa, Cryptosporidium parvum
LSEENKSLTEKTDKISNE

SEQ ID NO: 2269501 - protein, 7 aa, Cryptosporidium parvum
LSEEPSE

SEQ ID NO: 2269502 - protein, 9 aa, Cryptosporidium parvum
LSEEQEKYS

SEQ ID NO: 2269503 - protein, 18 aa, Cryptosporidium parvum
LSEESKAKFKDGEARMST

SEQ ID NO: 2269504 - protein, 4 aa, Cryptosporidium parvum
LSEG

SEQ ID NO: 2269505 - protein, 6 aa, Cryptosporidium parvum
LSEGEK

SEQ ID NO: 2269506 - protein, 7 aa, Cryptosporidium parvum
LSEIPGT

SEQ ID NO: 2269507 - protein, 6 aa, Cryptosporidium parvum
LSEKEI

SEQ ID NO: 2269508 - protein, 12 aa, Cryptosporidium parvum
LSELSDTDFGNP

SEQ ID NO: 2269509 - protein, 5 aa, Cryptosporidium parvum
LSEND

SEQ ID NO: 2269510 - protein, 7 aa, Cryptosporidium parvum
LSENKGF

SEQ ID NO: 2269511 - protein, 8 aa, Cryptosporidium parvum
LSENTTNN

SEQ ID NO: 2269512 - protein, 9 aa, Cryptosporidium parvum
LSEPKDNGR

SEQ ID NO: 2269513 - protein, 11 aa, Cryptosporidium parvum
LSEQDLNSNKI

SEQ ID NO: 2269514 - protein, 10 aa, Cryptosporidium parvum
LSEQGVSEAI

SEQ ID NO: 2269515 - protein, 8 aa, Cryptosporidium parvum
LSEREKEL

SEQ ID NO: 2269516 - protein, 12 aa, Cryptosporidium parvum
LSERETGKTNDV

SEQ ID NO: 2269517 - protein, 23 aa, Cryptosporidium parvum
LSERSNSICESSASDLDEDQTNE

SEQ ID NO: 2269518 - protein, 6 aa, Cryptosporidium parvum
LSERTT

SEQ ID NO: 2269519 - protein, 7 aa, Cryptosporidium parvum
LSESDRN

SEQ ID NO: 2269520 - protein, 10 aa, Cryptosporidium parvum
LSESERTPKE

SEQ ID NO: 2269521 - protein, 5 aa, Cryptosporidium parvum
LSESI

SEQ ID NO: 2269522 - protein, 7 aa, Cryptosporidium parvum
LSESSRK

SEQ ID NO: 2269523 - protein, 20 aa, Cryptosporidium parvum
LSESSSGAYNEDDPNYDPSE

SEQ ID NO: 2269524 - protein, 7 aa, Cryptosporidium parvum
LSESTVD

SEQ ID NO: 2269525 - protein, 14 aa, Cryptosporidium parvum
LSETALESSFSEPL

SEQ ID NO: 2269526 - protein, 13 aa, Cryptosporidium parvum
LSETDEKYIQESS

SEQ ID NO: 2269527 - protein, 7 aa, Cryptosporidium parvum
LSETENL

SEQ ID NO: 2269528 - protein, 14 aa, Cryptosporidium parvum
LSETGNGFKSLPTN

SEQ ID NO: 2269529 - protein, 7 aa, Cryptosporidium parvum
LSEVSTK

SEQ ID NO: 2269530 - protein, 5 aa, Cryptosporidium parvum
LSGCG

SEQ ID NO: 2269531 - protein, 4 aa, Cryptosporidium parvum
LSGE

SEQ ID NO: 2269532 - protein, 10 aa, Cryptosporidium parvum
LSGEGASREV

SEQ ID NO: 2269533 - protein, 4 aa, Cryptosporidium parvum
LSGG

SEQ ID NO: 2269534 - protein, 5 aa, Cryptosporidium parvum
LSGGE

SEQ ID NO: 2269535 - protein, 8 aa, Cryptosporidium parvum
LSGGEKTM

SEQ ID NO: 2269536 - protein, 8 aa, Cryptosporidium parvum
LSGGEQTK

SEQ ID NO: 2269537 - protein, 14 aa, Cryptosporidium parvum
LSGGGQPGAGNMRQ

SEQ ID NO: 2269538 - protein, 11 aa, Cryptosporidium parvum
LSGGRTKRKAA

SEQ ID NO: 2269539 - protein, 7 aa, Cryptosporidium parvum
LSGHTSN

SEQ ID NO: 2269540 - protein, 4 aa, Cryptosporidium parvum
LSGI

SEQ ID NO: 2269541 - protein, 5 aa, Cryptosporidium parvum
LSGKG

SEQ ID NO: 2269542 - protein, 12 aa, Cryptosporidium parvum
LSGKNKVSQLSS

SEQ ID NO: 2269543 - protein, 4 aa, Cryptosporidium parvum
LSGP

SEQ ID NO: 2269544 - protein, 9 aa, Cryptosporidium parvum
LSGPQGSNY

SEQ ID NO: 2269545 - protein, 9 aa, Cryptosporidium parvum
LSGRRNQSV

SEQ ID NO: 2269546 - protein, 9 aa, Cryptosporidium parvum
LSGSERSNL

SEQ ID NO: 2269547 - protein, 21 aa, Cryptosporidium parvum
LSGSGSKGFSGSKNLTKKPPK

SEQ ID NO: 2269548 - protein, 19 aa, Cryptosporidium parvum
LSGSGTGTTGFGNNSGGGL

SEQ ID NO: 2269549 - protein, 8 aa, Cryptosporidium parvum
LSGSGTPN

SEQ ID NO: 2269550 - protein, 10 aa, Cryptosporidium parvum
LSGSKKEKDQ

SEQ ID NO: 2269551 - protein, 7 aa, Cryptosporidium parvum
LSGSNSI

SEQ ID NO: 2269552 - protein, 14 aa, Cryptosporidium parvum
LSGSSPSNINNANN

SEQ ID NO: 2269553 - protein, 12 aa, Cryptosporidium parvum
LSGVDSAEGRRE

SEQ ID NO: 2269554 - protein, 4 aa, Cryptosporidium parvum
LSHG

SEQ ID NO: 2269555 - protein, 15 aa, Cryptosporidium parvum
  misc_feature (15)..(15): Xaa can be any naturally occurring amino acid
LSHNNNNNNNNDSSX

SEQ ID NO: 2269556 - protein, 11 aa, Cryptosporidium parvum
LSHSDNRENLN

SEQ ID NO: 2269557 - protein, 9 aa, Cryptosporidium parvum
LSHSNDRNG

SEQ ID NO: 2269558 - protein, 12 aa, Cryptosporidium parvum
LSHTQGRKHQTN

SEQ ID NO: 2269559 - protein, 6 aa, Cryptosporidium parvum
LSIETK

SEQ ID NO: 2269560 - protein, 10 aa, Cryptosporidium parvum
LSITDDQDQK

SEQ ID NO: 2269561 - protein, 15 aa, Cryptosporidium parvum
LSKAKRETLFTISTK

SEQ ID NO: 2269562 - protein, 10 aa, Cryptosporidium parvum
LSKCSPDLKK

SEQ ID NO: 2269563 - protein, 4 aa, Cryptosporidium parvum
LSKD

SEQ ID NO: 2269564 - protein, 8 aa, Cryptosporidium parvum
LSKDDNFE

SEQ ID NO: 2269565 - protein, 6 aa, Cryptosporidium parvum
LSKDDP

SEQ ID NO: 2269566 - protein, 31 aa, Cryptosporidium parvum
LSKDERKDLNGVKDSKSIGGSDDANNSANGT

SEQ ID NO: 2269567 - protein, 7 aa, Cryptosporidium parvum
LSKDSQD

SEQ ID NO: 2269568 - protein, 7 aa, Cryptosporidium parvum
LSKDTDS

SEQ ID NO: 2269569 - protein, 4 aa, Cryptosporidium parvum
LSKE

SEQ ID NO: 2269570 - protein, 13 aa, Cryptosporidium parvum
LSKEKTDNEPSKL

SEQ ID NO: 2269571 - protein, 7 aa, Cryptosporidium parvum
LSKEKTY

SEQ ID NO: 2269572 - protein, 6 aa, Cryptosporidium parvum
LSKGDI

SEQ ID NO: 2269573 - protein, 14 aa, Cryptosporidium parvum
LSKGGIKIQSSQGK

SEQ ID NO: 2269574 - protein, 5 aa, Cryptosporidium parvum
LSKGT

SEQ ID NO: 2269575 - protein, 5 aa, Cryptosporidium parvum
LSKKS

SEQ ID NO: 2269576 - protein, 14 aa, Cryptosporidium parvum
LSKLKTVSNEYKSF

SEQ ID NO: 2269577 - protein, 19 aa, Cryptosporidium parvum
LSKLSNKDMSKSLNKDASK

SEQ ID NO: 2269578 - protein, 4 aa, Cryptosporidium parvum
LSKP

SEQ ID NO: 2269579 - protein, 13 aa, Cryptosporidium parvum
LSKPRNSEGASMV

SEQ ID NO: 2269580 - protein, 9 aa, Cryptosporidium parvum
LSKQGYNGL

SEQ ID NO: 2269581 - protein, 17 aa, Cryptosporidium parvum
LSKQHKEHQKRPIRKKK

SEQ ID NO: 2269582 - protein, 9 aa, Cryptosporidium parvum
LSKQSTKNS

SEQ ID NO: 2269583 - protein, 23 aa, Cryptosporidium parvum
LSKSAPELGSQDKKNKKSRSNPM

SEQ ID NO: 2269584 - protein, 11 aa, Cryptosporidium parvum
LSKSCNNESNS

SEQ ID NO: 2269585 - protein, 8 aa, Cryptosporidium parvum
LSKSEGED

SEQ ID NO: 2269586 - protein, 7 aa, Cryptosporidium parvum
LSKSNRD

SEQ ID NO: 2269587 - protein, 9 aa, Cryptosporidium parvum
LSKSPNKHN

SEQ ID NO: 2269588 - protein, 7 aa, Cryptosporidium parvum
LSKTYEK

SEQ ID NO: 2269589 - protein, 9 aa, Cryptosporidium parvum
LSKYQKQNL

SEQ ID NO: 2269590 - protein, 9 aa, Cryptosporidium parvum
LSLNGTQKN

SEQ ID NO: 2269591 - protein, 9 aa, Cryptosporidium parvum
LSLPPGGPI

SEQ ID NO: 2269592 - protein, 26 aa, Cryptosporidium parvum
LSLPSTTTTTTTTTTTTTTTTTAPPK

SEQ ID NO: 2269593 - protein, 9 aa, Cryptosporidium parvum
LSLSKNNTC

SEQ ID NO: 2269594 - protein, 6 aa, Cryptosporidium parvum
LSMNDK

SEQ ID NO: 2269595 - protein, 9 aa, Cryptosporidium parvum
LSNAPTATQ

SEQ ID NO: 2269596 - protein, 5 aa, Cryptosporidium parvum
LSNDE

SEQ ID NO: 2269597 - protein, 29 aa, Cryptosporidium parvum
LSNDGFKENEDDNTDDENSGEEGDSKDEI

SEQ ID NO: 2269598 - protein, 7 aa, Cryptosporidium parvum
LSNDPTI

SEQ ID NO: 2269599 - protein, 4 aa, Cryptosporidium parvum
LSNE

SEQ ID NO: 2269600 - protein, 6 aa, Cryptosporidium parvum
LSNEND

SEQ ID NO: 2269601 - protein, 7 aa, Cryptosporidium parvum
LSNEQSL

SEQ ID NO: 2269602 - protein, 19 aa, Cryptosporidium parvum
LSNESNKSDENKSLLGTTP

SEQ ID NO: 2269603 - protein, 32 aa, Cryptosporidium parvum
LSNESSNHDTVKSNDLQKNSNSLKVRKSKRIQ

SEQ ID NO: 2269604 - protein, 6 aa, Cryptosporidium parvum
LSNETK

SEQ ID NO: 2269605 - protein, 5 aa, Cryptosporidium parvum
LSNGE

SEQ ID NO: 2269606 - protein, 14 aa, Cryptosporidium parvum
LSNGNKKEHSDSKN

SEQ ID NO: 2269607 - protein, 5 aa, Cryptosporidium parvum
LSNHS

SEQ ID NO: 2269608 - protein, 4 aa, Cryptosporidium parvum
LSNI

SEQ ID NO: 2269609 - protein, 4 aa, Cryptosporidium parvum
LSNK

SEQ ID NO: 2269610 - protein, 12 aa, Cryptosporidium parvum
LSNKDEKNKDDS

SEQ ID NO: 2269611 - protein, 9 aa, Cryptosporidium parvum
LSNKIKKNG

SEQ ID NO: 2269612 - protein, 11 aa, Cryptosporidium parvum
LSNKISKNQYY

SEQ ID NO: 2269613 - protein, 5 aa, Cryptosporidium parvum
LSNKN

SEQ ID NO: 2269614 - protein, 6 aa, Cryptosporidium parvum
LSNKNC

SEQ ID NO: 2269615 - protein, 6 aa, Cryptosporidium parvum
LSNKNI

SEQ ID NO: 2269616 - protein, 8 aa, Cryptosporidium parvum
LSNKNQSK

SEQ ID NO: 2269617 - protein, 9 aa, Cryptosporidium parvum
LSNKSAGTI

SEQ ID NO: 2269618 - protein, 17 aa, Cryptosporidium parvum
LSNNDEKDDETDQNNSP

SEQ ID NO: 2269619 - protein, 6 aa, Cryptosporidium parvum
LSNNDQ

SEQ ID NO: 2269620 - protein, 8 aa, Cryptosporidium parvum
LSNNGETE

SEQ ID NO: 2269621 - protein, 6 aa, Cryptosporidium parvum
LSNNNE

SEQ ID NO: 2269622 - protein, 10 aa, Cryptosporidium parvum
LSNNNISDEY

SEQ ID NO: 2269623 - protein, 9 aa, Cryptosporidium parvum
LSNPPSEPY

SEQ ID NO: 2269624 - protein, 24 aa, Cryptosporidium parvum
LSNQGYSKKTSEDAYYNKNGRKNA

SEQ ID NO: 2269625 - protein, 8 aa, Cryptosporidium parvum
LSNQQDAF

SEQ ID NO: 2269626 - protein, 9 aa, Cryptosporidium parvum
LSNQSTFNK

SEQ ID NO: 2269627 - protein, 12 aa, Cryptosporidium parvum
LSNRIGEELNDS

SEQ ID NO: 2269628 - protein, 16 aa, Cryptosporidium parvum
LSNRPKRKSPKCIKDE

SEQ ID NO: 2269629 - protein, 11 aa, Cryptosporidium parvum
LSNSDPSLDTI

SEQ ID NO: 2269630 - protein, 11 aa, Cryptosporidium parvum
LSNSDRLSRQR

SEQ ID NO: 2269631 - protein, 5 aa, Cryptosporidium parvum
LSNSE

SEQ ID NO: 2269632 - protein, 10 aa, Cryptosporidium parvum
LSNSEKTTLG

SEQ ID NO: 2269633 - protein, 5 aa, Cryptosporidium parvum
LSNSR

SEQ ID NO: 2269634 - protein, 5 aa, Cryptosporidium parvum
LSNSS

SEQ ID NO: 2269635 - protein, 10 aa, Cryptosporidium parvum
LSNSSDNKLD

SEQ ID NO: 2269636 - protein, 14 aa, Cryptosporidium parvum
LSNSSNNPNEVPES

SEQ ID NO: 2269637 - protein, 7 aa, Cryptosporidium parvum
LSNSTLS

SEQ ID NO: 2269638 - protein, 24 aa, Cryptosporidium parvum
LSNSTSHDNHEESNIMNEQSKGEL

SEQ ID NO: 2269639 - protein, 6 aa, Cryptosporidium parvum
LSNTCS

SEQ ID NO: 2269640 - protein, 8 aa, Cryptosporidium parvum
LSNTNQNL

SEQ ID NO: 2269641 - protein, 12 aa, Cryptosporidium parvum
LSNTQSGTGQPR

SEQ ID NO: 2269642 - protein, 9 aa, Cryptosporidium parvum
LSNTRRDGS

SEQ ID NO: 2269643 - protein, 8 aa, Cryptosporidium parvum
LSPDESEF

SEQ ID NO: 2269644 - protein, 5 aa, Cryptosporidium parvum
LSPDI

SEQ ID NO: 2269645 - protein, 12 aa, Cryptosporidium parvum
LSPDNKQQTEDY

SEQ ID NO: 2269646 - protein, 4 aa, Cryptosporidium parvum
LSPE

SEQ ID NO: 2269647 - protein, 8 aa, Cryptosporidium parvum
LSPEEMNE

SEQ ID NO: 2269648 - protein, 5 aa, Cryptosporidium parvum
LSPER

SEQ ID NO: 2269649 - protein, 5 aa, Cryptosporidium parvum
LSPEY

SEQ ID NO: 2269650 - protein, 16 aa, Cryptosporidium parvum
LSPFGGTGGGNGIGSG

SEQ ID NO: 2269651 - protein, 7 aa, Cryptosporidium parvum
LSPGDKD

SEQ ID NO: 2269652 - protein, 9 aa, Cryptosporidium parvum
LSPKQVESD

SEQ ID NO: 2269653 - protein, 19 aa, Cryptosporidium parvum
LSPKSSTRLVNTDEKPITP

SEQ ID NO: 2269654 - protein, 5 aa, Cryptosporidium parvum
LSPKT

SEQ ID NO: 2269655 - protein, 5 aa, Cryptosporidium parvum
LSPLN

SEQ ID NO: 2269656 - protein, 22 aa, Cryptosporidium parvum
LSPLSSTSSSCSSSSSSSSSCS

SEQ ID NO: 2269657 - protein, 10 aa, Cryptosporidium parvum
LSPMESSKLR

SEQ ID NO: 2269658 - protein, 6 aa, Cryptosporidium parvum
LSPNLS

SEQ ID NO: 2269659 - protein, 20 aa, Cryptosporidium parvum
LSPNNSNNNNNNNNDNPNHT

SEQ ID NO: 2269660 - protein, 22 aa, Cryptosporidium parvum
LSPNPTLTRRKSKAKNKDIHEY

SEQ ID NO: 2269661 - protein, 122 aa, Cryptosporidium parvum
LSPPGGKKPPPPAKPLGGKPATKIPPPSKLSSTPSPNLSESPPPKPSSPPPPKPSTPPPPKSASPSPSPPGPKVSKGPPTALKPAPKAPIPKNSSEPLNDTPVSNGHAPPVSVPSKPASAKT

SEQ ID NO: 2269662 - protein, 30 aa, Cryptosporidium parvum; identical to SEQ ID NO: 2151578

SEQ ID NO: 2269663 - protein, 8 aa, Cryptosporidium parvum
LSPQNRNR

SEQ ID NO: 2269664 - protein, 6 aa, Cryptosporidium parvum
LSPRTR

SEQ ID NO: 2269665 - protein, 7 aa, Cryptosporidium parvum
LSPSAFS

SEQ ID NO: 2269666 - protein, 6 aa, Cryptosporidium parvum
LSPSCE

SEQ ID NO: 2269667 - protein, 6 aa, Cryptosporidium parvum
LSPSET

SEQ ID NO: 2269668 - protein, 8 aa, Cryptosporidium parvum
LSPSKNDN

SEQ ID NO: 2269669 - protein, 8 aa, Cryptosporidium parvum
LSPSNDGV

SEQ ID NO: 2269670 - protein, 16 aa, Cryptosporidium parvum
LSPSNVNAAKQRIPSN

SEQ ID NO: 2269671 - protein, 16 aa, Cryptosporidium parvum
LSPSQAPKVYQNEKAS

SEQ ID NO: 2269672 - protein, 6 aa, Cryptosporidium parvum
LSPSQG

SEQ ID NO: 2269673 - protein, 8 aa, Cryptosporidium parvum
LSPSRVTR

SEQ ID NO: 2269674 - protein, 7 aa, Cryptosporidium parvum
LSPSSET

SEQ ID NO: 2269675 - protein, 37 aa, Cryptosporidium parvum
LSPSVRSASPQLPSSPTDSSSSKFADNSEANKASTRY

SEQ ID NO: 2269676 - protein, 9 aa, Cryptosporidium parvum
LSPTNRNIN

SEQ ID NO: 2269677 - protein, 6 aa, Cryptosporidium parvum
LSPTTF

SEQ ID NO: 2269678 - protein, 4 aa, Cryptosporidium parvum
LSQD

SEQ ID NO: 2269679 - protein, 4 aa, Cryptosporidium parvum
LSQK

SEQ ID NO: 2269680 - protein, 5 aa, Cryptosporidium parvum
LSQKE

SEQ ID NO: 2269681 - protein, 8 aa, Cryptosporidium parvum
LSQKKIDQ

SEQ ID NO: 2269682 - protein, 6 aa, Cryptosporidium parvum
LSQKQR

SEQ ID NO: 2269683 - protein, 5 aa, Cryptosporidium parvum
LSQND

SEQ ID NO: 2269684 - protein, 15 aa, Cryptosporidium parvum
LSQNDQNDDNSDLNK

SEQ ID NO: 2269685 - protein, 6 aa, Cryptosporidium parvum
LSQNTN

SEQ ID NO: 2269686 - protein, 6 aa, Cryptosporidium parvum
LSQNTT

SEQ ID NO: 2269687 - protein, 13 aa, Cryptosporidium parvum
LSQPGREVSEEVE

SEQ ID NO: 2269688 - protein, 21 aa, Cryptosporidium parvum
LSQRSAASNGISGLTEKNEQI

SEQ ID NO: 2269689 - protein, 9 aa, Cryptosporidium parvum
LSQSNDKSL

SEQ ID NO: 2269690 - protein, 6 aa, Cryptosporidium parvum
LSQTGT

SEQ ID NO: 2269691 - protein, 13 aa, Cryptosporidium parvum
LSRNERSRTTRHE

SEQ ID NO: 2269692 - protein, 28 aa, Cryptosporidium parvum
LSRNNNNYENKSEEDDLTKNNASPNLSS

SEQ ID NO: 2269693 - protein, 7 aa, Cryptosporidium parvum
LSRNNYS

SEQ ID NO: 2269694 - protein, 13 aa, Cryptosporidium parvum
LSRNTEKSNALRE

SEQ ID NO: 2269695 - protein, 11 aa, Cryptosporidium parvum
LSRPKSSEGGV

SEQ ID NO: 2269696 - protein, 11 aa, Cryptosporidium parvum
LSRQEPPLNEY

SEQ ID NO: 2269697 - protein, 5 aa, Cryptosporidium parvum
LSRSK

SEQ ID NO: 2269698 - protein, 9 aa, Cryptosporidium parvum
LSRSKNYYS

SEQ ID NO: 2269699 - protein, 42 aa, Cryptosporidium parvum
LSRSNSSSHISSLKDGEEAERLTSNEVSEHSEISNDECEKDL

SEQ ID NO: 2269700 - protein, 9 aa, Cryptosporidium parvum
LSRSSSGIS

SEQ ID NO: 2269701 - protein, 18 aa, Cryptosporidium parvum
LSRSSTNMGASKTPEFAT

SEQ ID NO: 2269702 - protein, 11 aa, Cryptosporidium parvum
LSSAKPGNGIQ

SEQ ID NO: 2269703 - protein, 8 aa, Cryptosporidium parvum
LSSASKPC

SEQ ID NO: 2269704 - protein, 4 aa, Cryptosporidium parvum
LSSD

SEQ ID NO: 2269705 - protein, 7 aa, Cryptosporidium parvum
LSSDDSY

SEQ ID NO: 2269706 - protein, 12 aa, Cryptosporidium parvum
LSSDSQSSSELS

SEQ ID NO: 2269707 - protein, 19 aa, Cryptosporidium parvum
LSSETRDQANDGSNSIPVQ

SEQ ID NO: 2269708 - protein, 18 aa, Cryptosporidium parvum
LSSGADLGCGTTKNVSAR

SEQ ID NO: 2269709 - protein, 8 aa, Cryptosporidium parvum
LSSGATFN

SEQ ID NO: 2269710 - protein, 8 aa, Cryptosporidium parvum
LSSGPYNG

SEQ ID NO: 2269711 - protein, 8 aa, Cryptosporidium parvum
LSSGRKDE

SEQ ID NO: 2269712 - protein, 7 aa, Cryptosporidium parvum
LSSGSQS

SEQ ID NO: 2269713 - protein, 4 aa, Cryptosporidium parvum
LSSI

SEQ ID NO: 2269714 - protein, 6 aa, Cryptosporidium parvum
LSSKEI

SEQ ID NO: 2269715 - protein, 9 aa, Cryptosporidium parvum
LSSKEIEDA

SEQ ID NO: 2269716 - protein, 16 aa, Cryptosporidium parvum
LSSKENGKNEEGIGGD

SEQ ID NO: 2269717 - protein, 12 aa, Cryptosporidium parvum
LSSKTKGREKYS

SEQ ID NO: 2269718 - protein, 12 aa, Cryptosporidium parvum
LSSLDEKSKGMK

SEQ ID NO: 2269719 - protein, 4 aa, Cryptosporidium parvum
LSSM

SEQ ID NO: 2269720 - protein, 9 aa, Cryptosporidium parvum
LSSNDRERE

SEQ ID NO: 2269721 - protein, 10 aa, Cryptosporidium parvum
LSSNERKDAI

SEQ ID NO: 2269722 - protein, 14 aa, Cryptosporidium parvum
LSSNSSDSSKVTVK

SEQ ID NO: 2269723 - protein, 8 aa, Cryptosporidium parvum
LSSNTHNN

SEQ ID NO: 2269724 - protein, 8 aa, Cryptosporidium parvum
LSSNTSQP

SEQ ID NO: 2269725 - protein, 19 aa, Cryptosporidium parvum
LSSPTKLNNWKSSETPIRS

SEQ ID NO: 2269726 - protein, 12 aa, Cryptosporidium parvum
LSSQARSTGNLY

SEQ ID NO: 2269727 - protein, 7 aa, Cryptosporidium parvum
LSSRQSN

SEQ ID NO: 2269728 - protein, 19 aa, Cryptosporidium parvum
LSSRSENAGRDTTHSSESG

SEQ ID NO: 2269729 - protein, 5 aa, Cryptosporidium parvum
LSSSE

SEQ ID NO: 2269730 - protein, 8 aa, Cryptosporidium parvum
LSSSENPW

SEQ ID NO: 2269731 - protein, 8 aa, Cryptosporidium parvum
LSSSHSPW

SEQ ID NO: 2269732 - protein, 14 aa, Cryptosporidium parvum
LSSSHSSSIQNNNL

SEQ ID NO: 2269733 - protein, 10 aa, Cryptosporidium parvum
LSSSKSSSPF

SEQ ID NO: 2269734 - protein, 8 aa, Cryptosporidium parvum
LSSSNRDV

SEQ ID NO: 2269735 - protein, 22 aa, Cryptosporidium parvum
LSSSNSQSSSSSSSSNSSPVSM

SEQ ID NO: 2269736 - protein, 7 aa, Cryptosporidium parvum
LSSSNYG

SEQ ID NO: 2269737 - protein, 7 aa, Cryptosporidium parvum
LSSSPRN

SEQ ID NO: 2269738 - protein, 8 aa, Cryptosporidium parvum
LSSSSHET

SEQ ID NO: 2269739 - protein, 20 aa, Cryptosporidium parvum
LSSSSPSPGNTNSSSSAKRL

SEQ ID NO: 2269740 - protein, 8 aa, Cryptosporidium parvum
LSSSSSKV

SEQ ID NO: 2269741 - protein, 33 aa, Cryptosporidium parvum
LSSSSSSSSSTSSSSSSSSSSSSSSSSSSSSNF

SEQ ID NO: 2269742 - protein, 11 aa, Cryptosporidium parvum
LSSSTDASRNI

SEQ ID NO: 2269743 - protein, 13 aa, Cryptosporidium parvum
LSSSTGSTHNPIP

SEQ ID NO: 2269744 - protein, 30 aa, Cryptosporidium parvum
LSSSTSNSIQPIGNTSPHKCEQRCNAGNEH

SEQ ID NO: 2269745 - protein, 6 aa, Cryptosporidium parvum
LSSTEA

SEQ ID NO: 2269746 - protein, 24 aa, Cryptosporidium parvum
LSSTNDNTTKATNSSTKNSKYIST

SEQ ID NO: 2269747 - protein, 11 aa, Cryptosporidium parvum
LSSTNNKEKCH

SEQ ID NO: 2269748 - protein, 11 aa, Cryptosporidium parvum
LSSTPTKGNKK

SEQ ID NO: 2269749 - protein, 13 aa, Cryptosporidium parvum
LSSTSDSNSKENV

SEQ ID NO: 2269750 - protein, 8 aa, Cryptosporidium parvum
LSSTTESK

SEQ ID NO: 2269751 - protein, 7 aa, Cryptosporidium parvum
LSSTTKE

SEQ ID NO: 2269752 - protein, 10 aa, Cryptosporidium parvum
LSSYQKEDTF

SEQ ID NO: 2269753 - protein, 5 aa, Cryptosporidium parvum
LSTDD

SEQ ID NO: 2269754 - protein, 9 aa, Cryptosporidium parvum
LSTDGNIKK

SEQ ID NO: 2269755 - protein, 14 aa, Cryptosporidium parvum
LSTEEQTILRLAGQ

SEQ ID NO: 2269756 - protein, 6 aa, Cryptosporidium parvum
LSTEQL

SEQ ID NO: 2269757 - protein, 12 aa, Cryptosporidium parvum
LSTERSLEELSR

SEQ ID NO: 2269758 - protein, 16 aa, Cryptosporidium parvum
LSTESKCQQSNTHDKC

SEQ ID NO: 2269759 - protein, 4 aa, Cryptosporidium parvum
LSTG

SEQ ID NO: 2269760 - protein, 5 aa, Cryptosporidium parvum
LSTGN

SEQ ID NO: 2269761 - protein, 20 aa, Cryptosporidium parvum
LSTGNSNSNGIGTGNGNGIG

SEQ ID NO: 2269762 - protein, 8 aa, Cryptosporidium parvum
LSTHPSNY

SEQ ID NO: 2269763 - protein, 12 aa, Cryptosporidium parvum
LSTKGKDSKSQS

SEQ ID NO: 2269764 - protein, 28 aa, Cryptosporidium parvum
LSTKKEENHDSIQEVSKSESSSPKKFSK

SEQ ID NO: 2269765 - protein, 12 aa, Cryptosporidium parvum
LSTKKKKSRPAF

SEQ ID NO: 2269766 - protein, 6 aa, Cryptosporidium parvum
LSTNAL

SEQ ID NO: 2269767 - protein, 55 aa, Cryptosporidium parvum
LSTNINDSRYEDLNSDDLSTDSEDESQSISSKSSKSSNSKKDKKKTKSKQKFESN

SEQ ID NO: 2269768 - protein, 6 aa, Cryptosporidium parvum
LSTNSI

SEQ ID NO: 2269769 - protein, 13 aa, Cryptosporidium parvum
LSTPRRSRNIEDE

SEQ ID NO: 2269770 - protein, 14 aa, Cryptosporidium parvum
LSTQLDSNTNKENH

SEQ ID NO: 2269771 - protein, 4 aa, Cryptosporidium parvum
LSTR

SEQ ID NO: 2269772 - protein, 8 aa, Cryptosporidium parvum
LSTRDQQQ

SEQ ID NO: 2269773 - protein, 14 aa, Cryptosporidium parvum
LSTRKKKQNSDSGI

SEQ ID NO: 2269774 - protein, 14 aa, Cryptosporidium parvum
LSTRRKKQKEKKIR

SEQ ID NO: 2269775 - protein, 8 aa, Cryptosporidium parvum
LSTSDSKL

SEQ ID NO: 2269776 - protein, 6 aa, Cryptosporidium parvum
LSTSNG

SEQ ID NO: 2269777 - protein, 12 aa, Cryptosporidium parvum
LSTSNWKGENLP

SEQ ID NO: 2269778 - protein, 9 aa, Cryptosporidium parvum
LSTSSPATL

SEQ ID NO: 2269779 - protein, 9 aa, Cryptosporidium parvum
LSTSTIPTH

SEQ ID NO: 2269780 - protein, 11 aa, Cryptosporidium parvum
LSTTATANFTR

SEQ ID NO: 2269781 - protein, 8 aa, Cryptosporidium parvum
LSTTSNLA

SEQ ID NO: 2269782 - protein, 20 aa, Cryptosporidium parvum
LSTTTTNTGQMQSNSINNTN

SEQ ID NO: 2269783 - protein, 7 aa, Cryptosporidium parvum
LSTVSNK

SEQ ID NO: 2269784 - protein, 6 aa, Cryptosporidium parvum
LSTYSN

SEQ ID NO: 2269785 - protein, 14 aa, Cryptosporidium parvum
LSVKKKKKNKPIVS

SEQ ID NO: 2269786 - protein, 11 aa, Cryptosporidium parvum
LSVKSSNNSFP

SEQ ID NO: 2269787 - protein, 6 aa, Cryptosporidium parvum
LSYDSN

SEQ ID NO: 2269788 - protein, 12 aa, Cryptosporidium parvum
LSYNTKGSGNNQ

SEQ ID NO: 2269789 - protein, 28 aa, Cryptosporidium parvum
LSYSGEESSYSQSRRRTHDYSKTCPSFQ

SEQ ID NO: 2269790 - protein, 5 aa, Cryptosporidium parvum
LSYTS

SEQ ID NO: 2269791 - protein, 6 aa, Cryptosporidium parvum
LTAQDQ

SEQ ID NO: 2269792 - protein, 4 aa, Cryptosporidium parvum
LTAS

SEQ ID NO: 2269793 - protein, 15 aa, Cryptosporidium parvum
LTASVTSEYSMSNTD

SEQ ID NO: 2269794 - protein, 9 aa, Cryptosporidium parvum
LTDESENRD

SEQ ID NO: 2269795 - protein, 14 aa, Cryptosporidium parvum
LTDGETSTTGLDGL

SEQ ID NO: 2269796 - protein, 6 aa, Cryptosporidium parvum
LTDGGL

SEQ ID NO: 2269797 - protein, 8 aa, Cryptosporidium parvum
LTDNQNNP

SEQ ID NO: 2269798 - protein, 5 aa, Cryptosporidium parvum
LTDNT

SEQ ID NO: 2269799 - protein, 11 aa, Cryptosporidium parvum
LTDPEQLKSNE

SEQ ID NO: 2269800 - protein, 6 aa, Cryptosporidium parvum
LTDQDA

SEQ ID NO: 2269801 - protein, 5 aa, Cryptosporidium parvum
LTDQE

SEQ ID NO: 2269802 - protein, 4 aa, Cryptosporidium parvum
LTDS

SEQ ID NO: 2269803 - protein, 13 aa, Cryptosporidium parvum
LTDSPGSMNISDF

SEQ ID NO: 2269804 - protein, 6 aa, Cryptosporidium parvum
LTEAAE

SEQ ID NO: 2269805 - protein, 10 aa, Cryptosporidium parvum
LTEDNRRERR

SEQ ID NO: 2269806 - protein, 8 aa, Cryptosporidium parvum
LTEEEKQY

SEQ ID NO: 2269807 - protein, 7 aa, Cryptosporidium parvum
LTEENNN

SEQ ID NO: 2269808 - protein, 18 aa, Cryptosporidium parvum
LTEGDSISNESLETQKTD

SEQ ID NO: 2269809 - protein, 19 aa, Cryptosporidium parvum
LTEGQKNSSKSLKQIESEV

SEQ ID NO: 2269810 - protein, 20 aa, Cryptosporidium parvum
LTEGSSPDSYSKDENDDEDE

SEQ ID NO: 2269811 - protein, 15 aa, Cryptosporidium parvum
LTEKEKEALNSNERL

SEQ ID NO: 2269812 - protein, 18 aa, Cryptosporidium parvum
LTEKVNSDKFKSINKENN

SEQ ID NO: 2269813 - protein, 10 aa, Cryptosporidium parvum
LTENPNKNLN

SEQ ID NO: 2269814 - protein, 4 aa, Cryptosporidium parvum
LTEP

SEQ ID NO: 2269815 - protein, 11 aa, Cryptosporidium parvum
LTEQEKELNRQ

SEQ ID NO: 2269816 - protein, 6 aa, Cryptosporidium parvum
LTESEN

SEQ ID NO: 2269817 - protein, 20 aa, Cryptosporidium parvum
LTESNSVNSGTNGAIRTRGG

SEQ ID NO: 2269818 - protein, 9 aa, Cryptosporidium parvum
LTESRELDK

SEQ ID NO: 2269819 - protein, 6 aa, Cryptosporidium parvum
LTETHV

SEQ ID NO: 2269820 - protein, 6 aa, Cryptosporidium parvum
LTETQA

SEQ ID NO: 2269821 - protein, 4 aa, Cryptosporidium parvum
LTEY

SEQ ID NO: 2269822 - protein, 12 aa, Cryptosporidium parvum
LTGANDNVEIDN

SEQ ID NO: 2269823 - protein, 19 aa, Cryptosporidium parvum
LTGHSGDNKISQGLGNGDL

SEQ ID NO: 2269824 - protein, 14 aa, Cryptosporidium parvum
LTGKPEKNAQNTTL

SEQ ID NO: 2269825 - protein, 8 aa, Cryptosporidium parvum
LTGKRASI

SEQ ID NO: 2269826 - protein, 12 aa, Cryptosporidium parvum
LTGKSGNASGRF

SEQ ID NO: 2269827 - protein, 11 aa, Cryptosporidium parvum
LTGNSSGVNNR

SEQ ID NO: 2269828 - protein, 12 aa, Cryptosporidium parvum
LTGSNKNDGFKP

SEQ ID NO: 2269829 - protein, 12 aa, Cryptosporidium parvum
LTGSTLNNSNHL

SEQ ID NO: 2269830 - protein, 10 aa, Cryptosporidium parvum
LTHESSDDES

SEQ ID NO: 2269831 - protein, 4 aa, Cryptosporidium parvum
LTIE

SEQ ID NO: 2269832 - protein, 5 aa, Cryptosporidium parvum
LTKDS

SEQ ID NO: 2269833 - protein, 13 aa, Cryptosporidium parvum
LTKEINTKDTPIK

SEQ ID NO: 2269834 - protein, 9 aa, Cryptosporidium parvum
LTKKDNYAT

SEQ ID NO: 2269835 - protein, 4 aa, Cryptosporidium parvum
LTKM

SEQ ID NO: 2269836 - protein, 7 aa, Cryptosporidium parvum
LTKNDQD

SEQ ID NO: 2269837 - protein, 12 aa, Cryptosporidium parvum
LTKNETQKENYE

SEQ ID NO: 2269838 - protein, 6 aa, Cryptosporidium parvum
LTKNKK

SEQ ID NO: 2269839 - protein, 10 aa, Cryptosporidium parvum
LTKNKTGNRE

SEQ ID NO: 2269840 - protein, 4 aa, Cryptosporidium parvum
LTKR

SEQ ID NO: 2269841 - protein, 37 aa, Cryptosporidium parvum
LTKTELGNGNISSNQGESIHTSANDLGNDSRPESRLE

SEQ ID NO: 2269842 - protein, 8 aa, Cryptosporidium parvum
LTKTSPNL

SEQ ID NO: 2269843 - protein, 13 aa, Cryptosporidium parvum
LTNAQRSGLNQIP

SEQ ID NO: 2269844 - protein, 5 aa, Cryptosporidium parvum
LTNDS

SEQ ID NO: 2269845 - protein, 9 aa, Cryptosporidium parvum
LTNEENSTK

SEQ ID NO: 2269846 - protein, 13 aa, Cryptosporidium parvum
LTNETEDQETRQE

SEQ ID NO: 2269847 - protein, 11 aa, Cryptosporidium parvum
LTNKNNPTSEL

SEQ ID NO: 2269848 - protein, 11 aa, Cryptosporidium parvum
LTNNQNRPHAP

SEQ ID NO: 2269849 - protein, 8 aa, Cryptosporidium parvum
LTNNSSLG

SEQ ID NO: 2269850 - protein, 8 aa, Cryptosporidium parvum
LTNPEEIP

SEQ ID NO: 2269851 - protein, 8 aa, Cryptosporidium parvum
LTNPGNSL

SEQ ID NO: 2269852 - protein, 16 aa, Cryptosporidium parvum
LTNQGATSKRRNKKTV

SEQ ID NO: 2269853 - protein, 6 aa, Cryptosporidium parvum
LTNSSN

SEQ ID NO: 2269854 - protein, 13 aa, Cryptosporidium parvum
LTNSSNNDNNKGL

SEQ ID NO: 2269855 - protein, 10 aa, Cryptosporidium parvum
LTNTSDLEIS

SEQ ID NO: 2269856 - protein, 8 aa, Cryptosporidium parvum
LTPDAPPS

SEQ ID NO: 2269857 - protein, 9 aa, Cryptosporidium parvum
LTPEDNPHG

SEQ ID NO: 2269858 - protein, 9 aa, Cryptosporidium parvum
LTPEMEKAA

SEQ ID NO: 2269859 - protein, 13 aa, Cryptosporidium parvum
LTPEQKKLIKEAL

SEQ ID NO: 2269860 - protein, 18 aa, Cryptosporidium parvum
LTPFGAPVSAGASTSFKR

SEQ ID NO: 2269861 - protein, 12 aa, Cryptosporidium parvum
LTPPSAKTAVHD

SEQ ID NO: 2269862 - protein, 7 aa, Cryptosporidium parvum
LTPRQQS

SEQ ID NO: 2269863 - protein, 13 aa, Cryptosporidium parvum
LTPSDQNNNKPSD

SEQ ID NO: 2269864 - protein, 94 aa, Cryptosporidium parvum
LTPSEDEEDSEEEEYQGKDSDENDNTDSEDDDGDYYGEYDSRHQKTDKISKSKRKLRHSESDSEEYDDDNNNYERLKSKGQKRSRRNSSNIQKS

SEQ ID NO: 2269865 - protein, 6 aa, Cryptosporidium parvum
LTPSQE

SEQ ID NO: 2269866 - protein, 6 aa, Cryptosporidium parvum
LTPSSE

SEQ ID NO: 2269867 - protein, 8 aa, Cryptosporidium parvum
LTPSSPIK

SEQ ID NO: 2269868 - protein, 5 aa, Cryptosporidium parvum
LTPTQ

SEQ ID NO: 2269869 - protein, 13 aa, Cryptosporidium parvum
LTQDNNAAGEEYN

SEQ ID NO: 2269870 - protein, 11 aa, Cryptosporidium parvum
LTQEEKEKAAK

SEQ ID NO: 2269871 - protein, 6 aa, Cryptosporidium parvum
LTQEQR

SEQ ID NO: 2269872 - protein, 5 aa, Cryptosporidium parvum
LTQER

SEQ ID NO: 2269873 - protein, 5 aa, Cryptosporidium parvum
LTQPK

SEQ ID NO: 2269874 - protein, 50 aa, Cryptosporidium parvum
LTQPSQLTQPSQLTQPSQLAQASQLSQSSQLAQASQSSQQSYLAPSNPLR

SEQ ID NO: 2269875 - protein, 21 aa, Cryptosporidium parvum
LTQPSQMSQQTQLQSSQPHKQ

SEQ ID NO: 2269876 - protein, 32 aa, Cryptosporidium parvum
LTQQPKSNGGYGRRANNSERGRIRPRKSEAVE

SEQ ID NO: 2269877 - protein, 23 aa, Cryptosporidium parvum
LTQRENAPKKSKREREAEQADAE

SEQ ID NO: 2269878 - protein, 8 aa, Cryptosporidium parvum
LTQRTTDS

SEQ ID NO: 2269879 - protein, 11 aa, Cryptosporidium parvum
LTQSEHDLKEQ

SEQ ID NO: 2269880 - protein, 20 aa, Cryptosporidium parvum
LTQSSTKYTFEDENRKSSSH

SEQ ID NO: 2269881 - protein, 6 aa, Cryptosporidium parvum
LTQTNK

SEQ ID NO: 2269882 - protein, 36 aa, Cryptosporidium parvum
LTRAKRRALTPQQAKKMTVKASKKALNFPKRKFAII

SEQ ID NO: 2269883 - protein, 6 aa, Cryptosporidium parvum
LTRPGR

SEQ ID NO: 2269884 - protein, 9 aa, Cryptosporidium parvum
LTSAERKKG

SEQ ID NO: 2269885 - protein, 4 aa, Cryptosporidium parvum
LTSE

SEQ ID NO: 2269886 - protein, 35 aa, Cryptosporidium parvum
LTSEEDSVKPNIEKTKKKKSENKTPEIKSHKKERC

SEQ ID NO: 2269887 - protein, 5 aa, Cryptosporidium parvum
LTSEG

SEQ ID NO: 2269888 - protein, 7 aa, Cryptosporidium parvum
LTSERDE

SEQ ID NO: 2269889 - protein, 5 aa, Cryptosporidium parvum
LTSET

SEQ ID NO: 2269890 - protein, 12 aa, Cryptosporidium parvum
LTSETENGGSGL

SEQ ID NO: 2269891 - protein, 9 aa, Cryptosporidium parvum
LTSGGSLEG

SEQ ID NO: 2269892 - protein, 5 aa, Cryptosporidium parvum
LTSKG

SEQ ID NO: 2269893 - protein, 6 aa, Cryptosporidium parvum
LTSKKE

SEQ ID NO: 2269894 - protein, 31 aa, Cryptosporidium parvum
LTSKQTTDSSNYSLNTENRVEAGIRDDDIHE

SEQ ID NO: 2269895 - protein, 29 aa, Cryptosporidium parvum
LTSNSSIQSFQSKAKDFKEARKSETGSSL

SEQ ID NO: 2269896 - protein, 15 aa, Cryptosporidium parvum
LTSNSSTFSSSDSSF

SEQ ID NO: 2269897 - protein, 17 aa, Cryptosporidium parvum
LTSNTSLSEPLNTKSYN

SEQ ID NO: 2269898 - protein, 4 aa, Cryptosporidium parvum
LTSR

SEQ ID NO: 2269899 - protein, 10 aa, Cryptosporidium parvum
LTSRGSQQYR

SEQ ID NO: 2269900 - protein, 30 aa, Cryptosporidium parvum
LTSSDSSSSSSSSSASNTSKTNNSASHQDL

SEQ ID NO: 2269901 - protein, 10 aa, Cryptosporidium parvum
LTSSKNSLPQ

SEQ ID NO: 2269902 - protein, 10 aa, Cryptosporidium parvum
LTSSRESISI

SEQ ID NO: 2269903 - protein, 26 aa, Cryptosporidium parvum
LTSSRGSRRGGNGAYSSGNNTGTGGM

SEQ ID NO: 2269904 - protein, 7 aa, Cryptosporidium parvum
LTSSVEE

SEQ ID NO: 2269905 - protein, 22 aa, Cryptosporidium parvum
LTSTGENNISSLRGKEDGIPKN

SEQ ID NO: 2269906 - protein, 9 aa, Cryptosporidium parvum
LTSTKKNVK

SEQ ID NO: 2269907 - protein, 13 aa, Cryptosporidium parvum
LTSTPVTSSKREI

SEQ ID NO: 2269908 - protein, 16 aa, Cryptosporidium parvum
LTSVPKKQYGVTPPIS

SEQ ID NO: 2269909 - protein, 7 aa, Cryptosporidium parvum
LTSYEST

SEQ ID NO: 2269910 - protein, 28 aa, Cryptosporidium parvum
LTTGINSENSVNHSKNNITSRNESEEEI

SEQ ID NO: 2269911 - protein, 10 aa, Cryptosporidium parvum
LTTKEIENAS

SEQ ID NO: 2269912 - protein, 12 aa, Cryptosporidium parvum
LTTPKQKNSEVK

SEQ ID NO: 2269913 - protein, 15 aa, Cryptosporidium parvum
LTTQSTTDTSIETPG

SEQ ID NO: 2269914 - protein, 7 aa, Cryptosporidium parvum
LTTSEKN

SEQ ID NO: 2269915 - protein, 10 aa, Cryptosporidium parvum
LTTSESSHLS

SEQ ID NO: 2269916 - protein, 7 aa, Cryptosporidium parvum
LTTTTKE

SEQ ID NO: 2269917 - protein, 11 aa, Cryptosporidium parvum
LTYRGKMDEAN

SEQ ID NO: 2269918 - protein, 29 aa, Cryptosporidium parvum
LVAPSSSLNKPEVNDKENISSNTLGKQLN

SEQ ID NO: 2269919 - protein, 6 aa, Cryptosporidium parvum
LVEGNQ

SEQ ID NO: 2269920 - protein, 5 aa, Cryptosporidium parvum
LVEKE

SEQ ID NO: 2269921 - protein, 23 aa, Cryptosporidium parvum
LVESNGLTNISGASNSTIQSNQI

SEQ ID NO: 2269922 - protein, 36 aa, Cryptosporidium parvum
LVGENKKRRCSHSSSSKNSNLQSKRRVQSRSRKNES

SEQ ID NO: 2269923 - protein, 15 aa, Cryptosporidium parvum
LVGNKSKVISVEYLI

SEQ ID NO: 2269924 - protein, 22 aa, Cryptosporidium parvum
LVNPNSASSLQISTSQPSSQKL

SEQ ID NO: 2269925 - protein, 17 aa, Cryptosporidium parvum
LVNPTNQDKSSNSTSEC

SEQ ID NO: 2269926 - protein, 4 aa, Cryptosporidium parvum
LVNS

SEQ ID NO: 2269927 - protein, 6 aa, Cryptosporidium parvum
LVPGNN

SEQ ID NO: 2269928 - protein, 5 aa, Cryptosporidium parvum
LVQEH

SEQ ID NO: 2269929 - protein, 10 aa, Cryptosporidium parvum
LVTKTPAPHA

SEQ ID NO: 2269930 - protein, 6 aa, Cryptosporidium parvum
LWKNKD

SEQ ID NO: 2269931 - protein, 5 aa, Cryptosporidium parvum
LYGES

SEQ ID NO: 2269932 - protein, 8 aa, Cryptosporidium parvum
LYGPGKSQ

SEQ ID NO: 2269933 - protein, 6 aa, Cryptosporidium parvum
LYGRDS

SEQ ID NO: 2269934 - protein, 27 aa, Cryptosporidium parvum
LYGRSSPNQRTQNSKFQGLPNSRPDCT

SEQ ID NO: 2269935 - protein, 14 aa, Cryptosporidium parvum
LYKPNSVPMTGGGS

SEQ ID NO: 2269936 - protein, 10 aa, Cryptosporidium parvum
LYKTEENKKI

SEQ ID NO: 2269937 - protein, 5 aa, Cryptosporidium parvum
LYNED

SEQ ID NO: 2269938 - protein, 10 aa, Cryptosporidium parvum
LYNRDKSASL

SEQ ID NO: 2269939 - protein, 7 aa, Cryptosporidium parvum
LYNSSSN

SEQ ID NO: 2269940 - protein, 18 aa, Cryptosporidium parvum
LYPNGKKPGSGGASFSRD

SEQ ID NO: 2269941 - protein, 5 aa, Cryptosporidium parvum
LYSDT

SEQ ID NO: 2269942 - protein, 11 aa, Cryptosporidium parvum
LYSGNNNNFEM

SEQ ID NO: 2269943 - protein, 5 aa, Cryptosporidium parvum
LYSPR

SEQ ID NO: 2269944 - protein, 5 aa, Cryptosporidium parvum
LYSPT

SEQ ID NO: 2269945 - protein, 10 aa, Cryptosporidium parvum
MAASASNSVS

SEQ ID NO: 2269946 - protein, 8 aa, Cryptosporidium parvum
MAETNSKE

SEQ ID NO: 2269947 - protein, 10 aa, Cryptosporidium parvum
MAGGPPPHIQ

SEQ ID NO: 2269948 - protein, 9 aa, Cryptosporidium parvum
MAGGRSVEG

SEQ ID NO: 2269949 - protein, 13 aa, Cryptosporidium parvum
MAGSASERTSMNS

SEQ ID NO: 2269950 - protein, 15 aa, Cryptosporidium parvum
MAGSNSNSEEEYLPT

SEQ ID NO: 2269951 - protein, 6 aa, Cryptosporidium parvum
MAKEET

SEQ ID NO: 2269952 - protein, 8 aa, Cryptosporidium parvum
MAKGKSNS

SEQ ID NO: 2269953 - protein, 9 aa, Cryptosporidium parvum
MANINSSNQ

SEQ ID NO: 2269954 - protein, 5 aa, Cryptosporidium parvum
MANNP

SEQ ID NO: 2269955 - protein, 13 aa, Cryptosporidium parvum
MANPVRGNRDPRR

SEQ ID NO: 2269956 - protein, 9 aa, Cryptosporidium parvum
MANTSTDVP

SEQ ID NO: 2269957 - protein, 16 aa, Cryptosporidium parvum
MAPFTGTGAANTTISN

SEQ ID NO: 2269958 - protein, 7 aa, Cryptosporidium parvum
MAPSKST

SEQ ID NO: 2269959 - protein, 7 aa, Cryptosporidium parvum
MAQSLGD

SEQ ID NO: 2269960 - protein, 9 aa, Cryptosporidium parvum
MAQSMSSSK

SEQ ID NO: 2269961 - protein, 18 aa, Cryptosporidium parvum
MASATDSSLSNTNKRRKV

SEQ ID NO: 2269962 - protein, 20 aa, Cryptosporidium parvum
MASGEDDDIPDLVENFEDVE

SEQ ID NO: 2269963 - protein, 11 aa, Cryptosporidium parvum
MASSGGAGMGA

SEQ ID NO: 2269964 - protein, 69 aa, Cryptosporidium parvum
MASSNPSLSSTTGSESILGNSNTLSGGSSLFGTSSSSLASTNLTSGVTTTSLTSLSTSPSLANANTNSN

SEQ ID NO: 2269965 - protein, 7 aa, Cryptosporidium parvum
MATDSSY

SEQ ID NO: 2269966 - protein, 7 aa, Cryptosporidium parvum
MATPQDY

SEQ ID NO: 2269967 - protein, 12 aa, Cryptosporidium parvum
MAYRDSNKYNIN

SEQ ID NO: 2269968 - protein, 14 aa, Cryptosporidium parvum
MDDSQNKQTEEASE

SEQ ID NO: 2269969 - protein, 7 aa, Cryptosporidium parvum
MDDSSRS

SEQ ID NO: 2269970 - protein, 12 aa, Cryptosporidium parvum
MDDTNSGFEEDE

SEQ ID NO: 2269971 - protein, 22 aa, Cryptosporidium parvum
MDEKGKKDVKSSAGGRRNKNKE

SEQ ID NO: 2269972 - protein, 24 aa, Cryptosporidium parvum
MDEKNEEKNEESQELKGTREERKT

SEQ ID NO: 2269973 - protein, 45 aa, Cryptosporidium parvum
MDENKDKSKNKDKSKTKDKNKENEEKEEKEKYKEKYKEKDTDKGK

SEQ ID NO: 2269974 - protein, 8 aa, Cryptosporidium parvum
MDESDRTA

SEQ ID NO: 2269975 - protein, 14 aa, Cryptosporidium parvum
MDESHSDLTIPGTP

SEQ ID NO: 2269976 - protein, 10 aa, Cryptosporidium parvum
MDESKMDGRQ

SEQ ID NO: 2269977 - protein, 6 aa, Cryptosporidium parvum
MDGATL

SEQ ID NO: 2269978 - protein, 7 aa, Cryptosporidium parvum
MDGEINE

SEQ ID NO: 2269979 - protein, 49 aa, Cryptosporidium parvum
MDGNDENYDDEDSEIEAEIDTDNENESTVGAGGKRGGSKHSSSLENDEV

SEQ ID NO: 2269980 - protein, 22 aa, Cryptosporidium parvum
MDGNDNNNNNNNNKGIGDSNND

SEQ ID NO: 2269981 - protein, 6 aa, Cryptosporidium parvum
MDGQNN

SEQ ID NO: 2269982 - protein, 5 aa, Cryptosporidium parvum
MDHSD

SEQ ID NO: 2269983 - protein, 6 aa, Cryptosporidium parvum
MDHSSS

SEQ ID NO: 2269984 - protein, 26 aa, Cryptosporidium parvum
MDHTGRLSSGPDELRSEEQARAEVET

SEQ ID NO: 2269985 - protein, 14 aa, Cryptosporidium parvum
MDKRSGKVLEENPK

SEQ ID NO: 2269986 - protein, 7 aa, Cryptosporidium parvum
MDKSNQL

SEQ ID NO: 2269987 - protein, 5 aa, Cryptosporidium parvum
MDLNS

SEQ ID NO: 2269988 - protein, 11 aa, Cryptosporidium parvum
MDNASNNERAS

SEQ ID NO: 2269989 - protein, 10 aa, Cryptosporidium parvum
MDNDDKSSVV

SEQ ID NO: 2269990 - protein, 6 aa, Cryptosporidium parvum
MDNNAK

SEQ ID NO: 2269991 - protein, 9 aa, Cryptosporidium parvum
MDNNNVGQK

SEQ ID NO: 2269992 - protein, 13 aa, Cryptosporidium parvum
MDNTPKGSQYDSF

SEQ ID NO: 2269993 - protein, 8 aa, Cryptosporidium parvum
MDPSNSLE

SEQ ID NO: 2269994 - protein, 4 aa, Cryptosporidium parvum
MDQP

SEQ ID NO: 2269995 - protein, 4 aa, Cryptosporidium parvum
MDRN

SEQ ID NO: 2269996 - protein, 14 aa, Cryptosporidium parvum
MDRNDADENSIDER

SEQ ID NO: 2269997 - protein, 5 aa, Cryptosporidium parvum
MDSNP

SEQ ID NO: 2269998 - protein, 18 aa, Cryptosporidium parvum
MDSSEGNAAGITSPITSA

SEQ ID NO: 2269999 - protein, 6 aa, Cryptosporidium parvum
MDTGNE

SEQ ID NO: 2270000 - protein, 8 aa, Cryptosporidium parvum
MDVPERDD

SEQ ID NO: 2270001 - protein, 22 aa, Cryptosporidium parvum
MEADEEKKNREEALNSSGGGAY

SEQ ID NO: 2270002 - protein, 30 aa, Cryptosporidium parvum; identical to SEQ ID NO: 2151844

SEQ ID NO: 2270003 - protein, 20 aa, Cryptosporidium parvum
MEARERSALSEGDANSSKMT

SEQ ID NO: 2270004 - protein, 7 aa, Cryptosporidium parvum
MEDANNY

SEQ ID NO: 2270005 - protein, 8 aa, Cryptosporidium parvum
MEDGNNST

SEQ ID NO: 2270006 - protein, 11 aa, Cryptosporidium parvum
MEDNEFSSTPS

SEQ ID NO: 2270007 - protein, 7 aa, Cryptosporidium parvum
MEDSQGN

SEQ ID NO: 2270008 - protein, 9 aa, Cryptosporidium parvum
MEDSSNSLV

SEQ ID NO: 2270009 - protein, 4 aa, Cryptosporidium parvum
MEED

SEQ ID NO: 2270010 - protein, 4 aa, Cryptosporidium parvum
MEEE

SEQ ID NO: 2270011 - protein, 35 aa, Cryptosporidium parvum
MEEEGTGLDETQQSKMEDDNMESKSQVRPSRNSRK

SEQ ID NO: 2270012 - protein, 12 aa, Cryptosporidium parvum
MEEGEFSEARED

SEQ ID NO: 2270013 - protein, 5 aa, Cryptosporidium parvum
MEENT

SEQ ID NO: 2270014 - protein, 6 aa, Cryptosporidium parvum
MEEPSI

SEQ ID NO: 2270015 - protein, 4 aa, Cryptosporidium parvum
MEES

SEQ ID NO: 2270016 - protein, 11 aa, Cryptosporidium parvum
MEESKKNSSRV

SEQ ID NO: 2270017 - protein, 11 aa, Cryptosporidium parvum
MEGATKTDKDD

SEQ ID NO: 2270018 - protein, 4 aa, Cryptosporidium parvum
MEGP

SEQ ID NO: 2270019 - protein, 4 aa, Cryptosporidium parvum
MEID

SEQ ID NO: 2270020 - protein, 14 aa, Cryptosporidium parvum
MEKERLRKEEEERI

SEQ ID NO: 2270021 - protein, 26 aa, Cryptosporidium parvum
MEKNRGKTRTPVSRQGSKPASGLRSA

SEQ ID NO: 2270022 - protein, 10 aa, Cryptosporidium parvum
MEKNRSSLGM

SEQ ID NO: 2270023 - protein, 10 aa, Cryptosporidium parvum
MEKSNPDRVE

SEQ ID NO: 2270024 - protein, 14 aa, Cryptosporidium parvum
MEKYEREAKEKNRE

SEQ ID NO: 2270025 - protein, 9 aa, Cryptosporidium parvum
MELNSTSAQ

SEQ ID NO: 2270026 - protein, 12 aa, Cryptosporidium parvum
MELTGSKTGTVR

SEQ ID NO: 2270027 - protein, 8 aa, Cryptosporidium parvum
MENENKSL

SEQ ID NO: 2270028 - protein, 22 aa, Cryptosporidium parvum
MENRDKVESNRLNEREEEQEKG

SEQ ID NO: 2270029 - protein, 5 aa, Cryptosporidium parvum
MENSG

SEQ ID NO: 2270030 - protein, 7 aa, Cryptosporidium parvum
MENSKRE

SEQ ID NO: 2270031 - protein, 6 aa, Cryptosporidium parvum
MENSKT

SEQ ID NO: 2270032 - protein, 23 aa, Cryptosporidium parvum
MENSLRKRAEKGSSNLPPLPRTE

SEQ ID NO: 2270033 - protein, 4 aa, Cryptosporidium parvum
MENT

SEQ ID NO: 2270034 - protein, 5 aa, Cryptosporidium parvum
MEPEI

SEQ ID NO: 2270035 - protein, 12 aa, Cryptosporidium parvum
MEPPKRPTDKPL

SEQ ID NO: 2270036 - protein, 52 aa, Cryptosporidium parvum
MEQNDSNHQNSFQKGSNGYSNNKTCNTNNNNPRCNTQNITSNGNTNNNTLRE

SEQ ID NO: 2270037 - protein, 12 aa, Cryptosporidium parvum
MEQRPDEVEDGV

SEQ ID NO: 2270038 - protein, 13 aa, Cryptosporidium parvum
MEQSTSSSAVEQP

SEQ ID NO: 2270039 - protein, 11 aa, Cryptosporidium parvum
MERDNARLTRD

SEQ ID NO: 2270040 - protein, 5 aa, Cryptosporidium parvum
MERSD

SEQ ID NO: 2270041 - protein, 11 aa, Cryptosporidium parvum
MESESDSTLNP

SEQ ID NO: 2270042 - protein, 10 aa, Cryptosporidium parvum
MESGGEDEEA

SEQ ID NO: 2270043 - protein, 11 aa, Cryptosporidium parvum
MESGSLGSPMM

SEQ ID NO: 2270044 - protein, 5 aa, Cryptosporidium parvum
MESKE

SEQ ID NO: 2270045 - protein, 6 aa, Cryptosporidium parvum
MESNDP

SEQ ID NO: 2270046 - protein, 15 aa, Cryptosporidium parvum
MESNVGRETNSEGLN

SEQ ID NO: 2270047 - protein, 20 aa, Cryptosporidium parvum
METETSRISESYESQKSDLN

SEQ ID NO: 2270048 - protein, 59 aa, Cryptosporidium parvum
METGEQKEQSTEDEDDWETANGQSSRREEVQSGEDEEEEEECEEEECEEDEDVSKGLED

SEQ ID NO: 2270049 - protein, 7 aa, Cryptosporidium parvum
METKQQD

SEQ ID NO: 2270050 - protein, 13 aa, Cryptosporidium parvum
MEYSDSVTGSPND

SEQ ID NO: 2270051 - protein, 12 aa, Cryptosporidium parvum
MGANGAGYMPKP

SEQ ID NO: 2270052 - protein, 22 aa, Cryptosporidium parvum
MGASEGGEGGFNSKTENSSNKG

SEQ ID NO: 2270053 - protein, 9 aa, Cryptosporidium parvum
MGASSPQSI

SEQ ID NO: 2270054 - protein, 10 aa, Cryptosporidium parvum
MGAVSSQELE

SEQ ID NO: 2270055 - protein, 10 aa, Cryptosporidium parvum
MGDDGKSLIN

SEQ ID NO: 2270056 - protein, 11 aa, Cryptosporidium parvum
MGDDQSEEKYE

SEQ ID NO: 2270057 - protein, 5 aa, Cryptosporidium parvum
MGDSG

SEQ ID NO: 2270058 - protein, 50 aa, Cryptosporidium parvum
MGEENTSSKIELQDQQENLVSQQQQEKFEEVQQQQQQQQQQQQQQQQQQQ

SEQ ID NO: 2270059 - protein, 5 aa, Cryptosporidium parvum
MGEKQ

SEQ ID NO: 2270060 - protein, 10 aa, Cryptosporidium parvum
MGESGSNEDD

SEQ ID NO: 2270061 - protein, 5 aa, Cryptosporidium parvum
MGGDL

SEQ ID NO: 2270062 - protein, 11 aa, Cryptosporidium parvum
MGGGSNLGGDI

SEQ ID NO: 2270063 - protein, 5 aa, Cryptosporidium parvum
MGGNQ

SEQ ID NO: 2270064 - protein, 15 aa, Cryptosporidium parvum
MGGNTKNPSKVLLCD

SEQ ID NO: 2270065 - protein, 11 aa, Cryptosporidium parvum
MGKEKVAETSH

SEQ ID NO: 2270066 - protein, 11 aa, Cryptosporidium parvum
MGKKTNQNEKH

SEQ ID NO: 2270067 - protein, 11 aa, Cryptosporidium parvum
MGKSKEDTSLV

SEQ ID NO: 2270068 - protein, 10 aa, Cryptosporidium parvum
MGLPTSDNLK

SEQ ID NO: 2270069 - protein, 8 aa, Cryptosporidium parvum
MGNDGSDY

SEQ ID NO: 2270070 - protein, 17 aa, Cryptosporidium parvum
MGNEGDSIDYGENESSL

SEQ ID NO: 2270071 - protein, 12 aa, Cryptosporidium parvum
MGNKTKRGGDKY

SEQ ID NO: 2270072 - protein, 15 aa, Cryptosporidium parvum
MGNNTSNNNQSNHTN

SEQ ID NO: 2270073 - protein, 9 aa, Cryptosporidium parvum
MGNTEEKDL

SEQ ID NO: 2270074 - protein, 13 aa, Cryptosporidium parvum
MGPGNRRKYYPGE

SEQ ID NO: 2270075 - protein, 35 aa, Cryptosporidium parvum
MGPSSAEDLQQSTSASTTASASTATSSAASPLTSP

SEQ ID NO: 2270076 - protein, 10 aa, Cryptosporidium parvum
MGRTNYSRGE

SEQ ID NO: 2270077 - protein, 5 aa, Cryptosporidium parvum
MGSGE

SEQ ID NO: 2270078 - protein, 6 aa, Cryptosporidium parvum
MGSKES

SEQ ID NO: 2270079 - protein, 10 aa, Cryptosporidium parvum
MGSNGLAGSV

SEQ ID NO: 2270080 - protein, 34 aa, Cryptosporidium parvum
MGSPSSDSRHSYSQDKSQEADRTQNPFQSGKNSI

SEQ ID NO: 2270081 - protein, 12 aa, Cryptosporidium parvum
MGSSSSTIKQNH

SEQ ID NO: 2270082 - protein, 6 aa, Cryptosporidium parvum
MGTPGV

SEQ ID NO: 2270083 - protein, 5 aa, Cryptosporidium parvum
MGTSV

SEQ ID NO: 2270084 - protein, 6 aa, Cryptosporidium parvum
MGVPGT

SEQ ID NO: 2270085 - protein, 5 aa, Cryptosporidium parvum
MHQPP

SEQ ID NO: 2270086 - protein, 5 aa, Cryptosporidium parvum
MIGGS

SEQ ID NO: 2270087 - protein, 9 aa, Cryptosporidium parvum
MIGNNNKNI

SEQ ID NO: 2270088 - protein, 4 aa, Cryptosporidium parvum
MITG

SEQ ID NO: 2270089 - protein, 4 aa, Cryptosporidium parvum
MKAA

SEQ ID NO: 2270090 - protein, 11 aa, Cryptosporidium parvum
MKDEKNDDETE

SEQ ID NO: 2270091 - protein, 5 aa, Cryptosporidium parvum
MKDRI

SEQ ID NO: 2270092 - protein, 9 aa, Cryptosporidium parvum
MKEDKRNLA

SEQ ID NO: 2270093 - protein, 4 aa, Cryptosporidium parvum
MKEK

SEQ ID NO: 2270094 - protein, 13 aa, Cryptosporidium parvum
MKEKGNFDETGNF

SEQ ID NO: 2270095 - protein, 6 aa, Cryptosporidium parvum
MKENQK

SEQ ID NO: 2270096 - protein, 12 aa, Cryptosporidium parvum
MKENTPNESEIK

SEQ ID NO: 2270097 - protein, 29 aa, Cryptosporidium parvum
MKKAKYSKRKYNNNNAYSYNANNQKPQYN

SEQ ID NO: 2270098 - protein, 7 aa, Cryptosporidium parvum
MKKTASQ

SEQ ID NO: 2270099 - protein, 9 aa, Cryptosporidium parvum
MKNDKKTKL

SEQ ID NO: 2270100 - protein, 4 aa, Cryptosporidium parvum
MKNE

SEQ ID NO: 2270101 - protein, 8 aa, Cryptosporidium parvum
MKNESEDL

SEQ ID NO: 2270102 - protein, 7 aa, Cryptosporidium parvum
MKNNSDF

SEQ ID NO: 2270103 - protein, 6 aa, Cryptosporidium parvum
MKNRPT

SEQ ID NO: 2270104 - protein, 8 aa, Cryptosporidium parvum
MKNSKPCD

SEQ ID NO: 2270105 - protein, 19 aa, Cryptosporidium parvum
MKNYGAPSEMVDGSEANFS

SEQ ID NO: 2270106 - protein, 26 aa, Cryptosporidium parvum
MKPLDNSDNNACTGEGDGISVESGVN

SEQ ID NO: 2270107 - protein, 4 aa, Cryptosporidium parvum
MKPP

SEQ ID NO: 2270108 - protein, 10 aa, Cryptosporidium parvum
MKQKSMNSSI

SEQ ID NO: 2270109 - protein, 21 aa, Cryptosporidium parvum
MKSDLGKYKEIQDQEYDHDQA

SEQ ID NO: 2270110 - protein, 12 aa, Cryptosporidium parvum
MKSGKKGSAKYI

SEQ ID NO: 2270111 - protein, 13 aa, Cryptosporidium parvum
MKSPYGPGPLEFK

SEQ ID NO: 2270112 - protein, 19 aa, Cryptosporidium parvum
MKSRRVAETAMNERSSRSH

SEQ ID NO: 2270113 - protein, 9 aa, Cryptosporidium parvum
MKTKPSNDQ

SEQ ID NO: 2270114 - protein, 8 aa, Cryptosporidium parvum
MKTNSEES

SEQ ID NO: 2270115 - protein, 10 aa, Cryptosporidium parvum
MKTPNSSSTF

SEQ ID NO: 2270116 - protein, 36 aa, Cryptosporidium parvum
MKTQDDDASKNNPTTSSSKDDAADEEDVDETGVDSA

SEQ ID NO: 2270117 - protein, 11 aa, Cryptosporidium parvum
MKTVGKGVAAG

SEQ ID NO: 2270118 - protein, 4 aa, Cryptosporidium parvum
MKVD

SEQ ID NO: 2270119 - protein, 24 aa, Cryptosporidium parvum
MLNGNEKDIVNSSNTNPNPTTNSF

SEQ ID NO: 2270120 - protein, 6 aa, Cryptosporidium parvum
MMPGDN

SEQ ID NO: 2270121 - protein, 27 aa, Cryptosporidium parvum
MMQGGDSKLERKQSKLLGEKKETRRKK

SEQ ID NO: 2270122 - protein, 16 aa, Cryptosporidium parvum
MNANSSSLLASENNGL

SEQ ID NO: 2270123 - protein, 5 aa, Cryptosporidium parvum
MNATG

SEQ ID NO: 2270124 - protein, 12 aa, Cryptosporidium parvum
MNDPDSETALAA

SEQ ID NO: 2270125 - protein, 4 aa, Cryptosporidium parvum
MNDS

SEQ ID NO: 2270126 - protein, 10 aa, Cryptosporidium parvum
MNEASPQLRT

SEQ ID NO: 2270127 - protein, 9 aa, Cryptosporidium parvum
MNEPHSSNG

SEQ ID NO: 2270128 - protein, 7 aa, Cryptosporidium parvum
MNETKTK

SEQ ID NO: 2270129 - protein, 4 aa, Cryptosporidium parvum
MNFP

SEQ ID NO: 2270130 - protein, 6 aa, Cryptosporidium parvum
MNGGGM

SEQ ID NO: 2270131 - protein, 6 aa, Cryptosporidium parvum
MNGGNG

SEQ ID NO: 2270132 - protein, 19 aa, Cryptosporidium parvum
MNKENYDSQRQSYSRGMGG

SEQ ID NO: 2270133 - protein, 23 aa, Cryptosporidium parvum
MNKKPQQNDTSEEDSDFPTENDD

SEQ ID NO: 2270134 - protein, 10 aa, Cryptosporidium parvum
MNKNNSHDEN

SEQ ID NO: 2270135 - protein, 8 aa, Cryptosporidium parvum
MNKSERYK

SEQ ID NO: 2270136 - protein, 8 aa, Cryptosporidium parvum
MNKSKSDC

SEQ ID NO: 2270137 - protein, 9 aa, Cryptosporidium parvum
MNKSTQNNL

SEQ ID NO: 2270138 - protein, 9 aa, Cryptosporidium parvum
MNNQNSSSV

SEQ ID NO: 2270139 - protein, 8 aa, Cryptosporidium parvum
MNNSENLT

SEQ ID NO: 2270140 - protein, 11 aa, Cryptosporidium parvum
MNNTKRSESMK

SEQ ID NO: 2270141 - protein, 45 aa, Cryptosporidium parvum
MNNTNNIENNNNNNNNNEKKTSTTRTLRNTNKKNMSKNNSYDDEF

SEQ ID NO: 2270142 - protein, 13 aa, Cryptosporidium parvum
MNPGNDNSQSFGS

SEQ ID NO: 2270143 - protein, 22 aa, Cryptosporidium parvum
MNREPEKQDLTSPTPSPVEPAQ

SEQ ID NO: 2270144 - protein, 5 aa, Cryptosporidium parvum
MNRET

SEQ ID NO: 2270145 - protein, 12 aa, Cryptosporidium parvum
MNRKGRKNPYYS

SEQ ID NO: 2270146 - protein, 5 aa, Cryptosporidium parvum
MNRSN

SEQ ID NO: 2270147 - protein, 41 aa, Cryptosporidium parvum
MNSKDSTGAQSKDLSDLDGKAKSSISKASEIKKSPPAKKMN

SEQ ID NO: 2270148 - protein, 8 aa, Cryptosporidium parvum
MNSNNDCY

SEQ ID NO: 2270149 - protein, 6 aa, Cryptosporidium parvum
MNSNST

SEQ ID NO: 2270150 - protein, 6 aa, Cryptosporidium parvum
MNSPEH

SEQ ID NO: 2270151 - protein, 9 aa, Cryptosporidium parvum
MNSSEEKVT

SEQ ID NO: 2270152 - protein, 15 aa, Cryptosporidium parvum
MNSSSEQLKKKLGST

SEQ ID NO: 2270153 - protein, 22 aa, Cryptosporidium parvum
MNSTSTNSTSSTNLAENSPNTS

SEQ ID NO: 2270154 - protein, 7 aa, Cryptosporidium parvum
MNTDTKY

SEQ ID NO: 2270155 - protein, 9 aa, Cryptosporidium parvum
MNTENTDNL

SEQ ID NO: 2270156 - protein, 14 aa, Cryptosporidium parvum
MNTKESKINGIKEE

SEQ ID NO: 2270157 - protein, 8 aa, Cryptosporidium parvum
MNTNHQNS

SEQ ID NO: 2270158 - protein, 12 aa, Cryptosporidium parvum
MNTNTSGDKIEE

SEQ ID NO: 2270159 - protein, 8 aa, Cryptosporidium parvum
MNTTQSME

SEQ ID NO: 2270160 - protein, 10 aa, Cryptosporidium parvum
MNVGTSPNGR

SEQ ID NO: 2270161 - protein, 10 aa, Cryptosporidium parvum
MPADSGYPAY

SEQ ID NO: 2270162 - protein, 5 aa, Cryptosporidium parvum
MPDEA

SEQ ID NO: 2270163 - protein, 8 aa, Cryptosporidium parvum
MPDENARK

SEQ ID NO: 2270164 - protein, 12 aa, Cryptosporidium parvum
MPDHYSAPTLGP

SEQ ID NO: 2270165 - protein, 5 aa, Cryptosporidium parvum
MPDKN

SEQ ID NO: 2270166 - protein, 8 aa, Cryptosporidium parvum
MPESKKNY

SEQ ID NO: 2270167 - protein, 5 aa, Cryptosporidium parvum
MPGNL

SEQ ID NO: 2270168 - protein, 21 aa, Cryptosporidium parvum
MPGSANLPVGAASATQSQLTP

SEQ ID NO: 2270169 - protein, 6 aa, Cryptosporidium parvum
MPKPRS

SEQ ID NO: 2270170 - protein, 14 aa, Cryptosporidium parvum
MPKRSNKTLGSPIK

SEQ ID NO: 2270171 - protein, 4 aa, Cryptosporidium parvum
MPKV

SEQ ID NO: 2270172 - protein, 11 aa, Cryptosporidium parvum
MPPEQISPTVT

SEQ ID NO: 2270173 - protein, 5 aa, Cryptosporidium parvum
MPPHP

SEQ ID NO: 2270174 - protein, 14 aa, Cryptosporidium parvum
MPQGTSAGGTNEQL

SEQ ID NO: 2270175 - protein, 8 aa, Cryptosporidium parvum
MPRKTQEF

SEQ ID NO: 2270176 - protein, 8 aa, Cryptosporidium parvum
MPRNSGNC

SEQ ID NO: 2270177 - protein, 7 aa, Cryptosporidium parvum
MPSEQQS

SEQ ID NO: 2270178 - protein, 10 aa, Cryptosporidium parvum
MPSGTRKSQL

SEQ ID NO: 2270179 - protein, 4 aa, Cryptosporidium parvum
MPSK

SEQ ID NO: 2270180 - protein, 23 aa, Cryptosporidium parvum
MPSNPVATQFDPKPQVSGQPPIN

SEQ ID NO: 2270181 - protein, 13 aa, Cryptosporidium parvum
MPSSDSESNFGSK

SEQ ID NO: 2270182 - protein, 8 aa, Cryptosporidium parvum
MPSSNSPL

SEQ ID NO: 2270183 - protein, 7 aa, Cryptosporidium parvum
MPSTVGK

SEQ ID NO: 2270184 - protein, 9 aa, Cryptosporidium parvum
MPTAGRVSG

SEQ ID NO: 2270185 - protein, 11 aa, Cryptosporidium parvum
MPTASTSQILG

SEQ ID NO: 2270186 - protein, 4 aa, Cryptosporidium parvum
MPTR

SEQ ID NO: 2270187 - protein, 26 aa, Cryptosporidium parvum
MPTSSGSRDENQMGLSERSGSYTGKV

SEQ ID NO: 2270188 - protein, 5 aa, Cryptosporidium parvum
MPYSK

SEQ ID NO: 2270189 - protein, 10 aa, Cryptosporidium parvum
MQDEEARGIQ

SEQ ID NO: 2270190 - protein, 16 aa, Cryptosporidium parvum
MQDQPNQQGQMHPGGN

SEQ ID NO: 2270191 - protein, 5 aa, Cryptosporidium parvum
MQEQI

SEQ ID NO: 2270192 - protein, 8 aa, Cryptosporidium parvum
MQEQTSGQ

SEQ ID NO: 2270193 - protein, 20 aa, Cryptosporidium parvum
MQHSQSQNNFRNNQQSMPNQ

SEQ ID NO: 2270194 - protein, 6 aa, Cryptosporidium parvum
MQKRKK

SEQ ID NO: 2270195 - protein, 18 aa, Cryptosporidium parvum
MQNNNANHDYNDQVQSSN

SEQ ID NO: 2270196 - protein, 7 aa, Cryptosporidium parvum
MQPNRPH

SEQ ID NO: 2270197 - protein, 19 aa, Cryptosporidium parvum
MQQQSNSRNKGSEPQINSN

SEQ ID NO: 2270198 - protein, 15 aa, Cryptosporidium parvum
MRAPSTKASKSSNLY

SEQ ID NO: 2270199 - protein, 5 aa, Cryptosporidium parvum
MRDDD

SEQ ID NO: 2270200 - protein, 6 aa, Cryptosporidium parvum
MRGQRK

SEQ ID NO: 2270201 - protein, 13 aa, Cryptosporidium parvum
MRGRENKVNTSTF

SEQ ID NO: 2270202 - protein, 10 aa, Cryptosporidium parvum
MRNIDSKSKD

SEQ ID NO: 2270203 - protein, 66 aa, Cryptosporidium parvum
MRQTSSNQSVPSSISVENSSIAKGVSQGIGKLPADSHEAKSTNNENIAPSGDENNANDSKAEETIT

SEQ ID NO: 2270204 - protein, 7 aa, Cryptosporidium parvum
MRRETEK

SEQ ID NO: 2270205 - protein, 15 aa, Cryptosporidium parvum
MRSGNSQNHSSGLNI

SEQ ID NO: 2270206 - protein, 25 aa, Cryptosporidium parvum
MRSGPYGGGGMGSGQSKGPVSRNQE

SEQ ID NO: 2270207 - protein, 12 aa, Cryptosporidium parvum
MRSSPVSSSRSN

SEQ ID NO: 2270208 - protein, 6 aa, Cryptosporidium parvum
MSARER

SEQ ID NO: 2270209 - protein, 7 aa, Cryptosporidium parvum
MSDENEV

SEQ ID NO: 2270210 - protein, 5 aa, Cryptosporidium parvum
MSDGK

SEQ ID NO: 2270211 - protein, 7 aa, Cryptosporidium parvum
MSDKDRV

SEQ ID NO: 2270212 - protein, 14 aa, Cryptosporidium parvum
MSDSYKQTSPFGKA

SEQ ID NO: 2270213 - protein, 7 aa, Cryptosporidium parvum
MSENQPL

SEQ ID NO: 2270214 - protein, 5 aa, Cryptosporidium parvum
MSESR

SEQ ID NO: 2270215 - protein, 4 aa, Cryptosporidium parvum
MSGK

SEQ ID NO: 2270216 - protein, 4 aa, Cryptosporidium parvum
MSGL

SEQ ID NO: 2270217 - protein, 15 aa, Cryptosporidium parvum
MSGRAGRAGQKGAFG

SEQ ID NO: 2270218 - protein, 4 aa, Cryptosporidium parvum
MSGT

SEQ ID NO: 2270219 - protein, 5 aa, Cryptosporidium parvum
MSHES

SEQ ID NO: 2270220 - protein, 8 aa, Cryptosporidium parvum
MSKATEAC

SEQ ID NO: 2270221 - protein, 6 aa, Cryptosporidium parvum
MSKEIP

SEQ ID NO: 2270222 - protein, 10 aa, Cryptosporidium parvum
MSKPQDARVP

SEQ ID NO: 2270223 - protein, 4 aa, Cryptosporidium parvum
MSKS

SEQ ID NO: 2270224 - protein, 8 aa, Cryptosporidium parvum
MSKSNNIS

SEQ ID NO: 2270225 - protein, 8 aa, Cryptosporidium parvum
MSKSPKHL

SEQ ID NO: 2270226 - protein, 49 aa, Cryptosporidium parvum
MSKTGGRTGFSNRNKHSNSNSASSNTDVNNNGTNSGSSNLTDSKNGANE

SEQ ID NO: 2270227 - protein, 16 aa, Cryptosporidium parvum
MSNISNAGGGMEDDYE

SEQ ID NO: 2270228 - protein, 4 aa, Cryptosporidium parvum
MSPS

SEQ ID NO: 2270229 - protein, 8 aa, Cryptosporidium parvum
MSQSKKNS

SEQ ID NO: 2270230 - protein, 6 aa, Cryptosporidium parvum
MSQSQR

SEQ ID NO: 2270231 - protein, 7 aa, Cryptosporidium parvum
MSREVDN

SEQ ID NO: 2270232 - protein, 9 aa, Cryptosporidium parvum
MSRQQREKQ

SEQ ID NO: 2270233 - protein, 11 aa, Cryptosporidium parvum
MSRSYSKSYQG

SEQ ID NO: 2270234 - protein, 7 aa, Cryptosporidium parvum
MSSETNK

SEQ ID NO: 2270235 - protein, 18 aa, Cryptosporidium parvum
MSSGSNNKALGNSIGPSH

SEQ ID NO: 2270236 - protein, 28 aa, Cryptosporidium parvum
MSSGSNRTQLSGDSLDGIQGTTGSKEIS

SEQ ID NO: 2270237 - protein, 8 aa, Cryptosporidium parvum
MSSPKRER

SEQ ID NO: 2270238 - protein, 5 aa, Cryptosporidium parvum
MSSPN

SEQ ID NO: 2270239 - protein, 25 aa, Cryptosporidium parvum
MSSQSQPRTVSKSRSISHTRTQSQP

SEQ ID NO: 2270240 - protein, 46 aa, Cryptosporidium parvum
MSSSGLGTGAGGGAGATAGAGENNNTANRGSINTVRQSRGSTAANN

SEQ ID NO: 2270241 - protein, 25 aa, Cryptosporidium parvum
MSSSPDNMSHDSNNCNSQERQGSKF

SEQ ID NO: 2270242 - protein, 8 aa, Cryptosporidium parvum
MSSSVDQA

SEQ ID NO: 2270243 - protein, 7 aa, Cryptosporidium parvum
MSTGEVK

SEQ ID NO: 2270244 - protein, 30 aa, Cryptosporidium parvum
MTDCKPGNTGASNGNSSNINNQKMNTGDQN

SEQ ID NO: 2270245 - protein, 27 aa, Cryptosporidium parvum
MTDEQKKKFSEKDDACGDDDEEEEEEY

SEQ ID NO: 2270246 - protein, 5 aa, Cryptosporidium parvum
MTEKE

SEQ ID NO: 2270247 - protein, 19 aa, Cryptosporidium parvum
MTFGSEKDLATTLQSSNSE

SEQ ID NO: 2270248 - protein, 6 aa, Cryptosporidium parvum
MTGGRT

SEQ ID NO: 2270249 - protein, 10 aa, Cryptosporidium parvum
MTKASANNET

SEQ ID NO: 2270250 - protein, 16 aa, Cryptosporidium parvum
MTKEPTRIKDYGPVKE

SEQ ID NO: 2270251 - protein, 7 aa, Cryptosporidium parvum
MTNGGEI

SEQ ID NO: 2270252 - protein, 12 aa, Cryptosporidium parvum
MTNKADNSQDIS

SEQ ID NO: 2270253 - protein, 10 aa, Cryptosporidium parvum
MTNRGNSEME

SEQ ID NO: 2270254 - protein, 6 aa, Cryptosporidium parvum
MTPPGS

SEQ ID NO: 2270255 - protein, 6 aa, Cryptosporidium parvum
MTPSRF

SEQ ID NO: 2270256 - protein, 29 aa, Cryptosporidium parvum
MTPSSEGSSPEDVSFSKDPDIDDEFEGSE

SEQ ID NO: 2270257 - protein, 16 aa, Cryptosporidium parvum
MTPTTSASSSSVSPIS

SEQ ID NO: 2270258 - protein, 18 aa, Cryptosporidium parvum
MTSNNSKNRNISNRTKSS

SEQ ID NO: 2270259 - protein, 6 aa, Cryptosporidium parvum
MTSQPH

SEQ ID NO: 2270260 - protein, 97 aa, Cryptosporidium parvum
MTTTTTVPSTFTTQTTAGQATTSQTTTSQTITSQSTASQTTASQSTASQATTFQATTGQTTTGQVATGQATAGQATAGQATTTQTNKTTTTDSSTNV

SEQ ID NO: 2270261 - protein, 12 aa, Cryptosporidium parvum
MVSDDEGNYNGE

SEQ ID NO: 2270262 - protein, 16 aa, Cryptosporidium parvum
MVTPGSDCPKRASSQE

SEQ ID NO: 2270263 - protein, 28 aa, Cryptosporidium parvum
MVTPSKSNNNFNSESPSAKSTMKSEPIN

SEQ ID NO: 2270264 - protein, 12 aa, Cryptosporidium parvum
MYESEYKAGEFS

SEQ ID NO: 2270265 - protein, 6 aa, Cryptosporidium parvum
NAAHGY

SEQ ID NO: 2270266 - protein, 5 aa, Cryptosporidium parvum
NAAIE

SEQ ID NO: 2270267 - protein, 7 aa, Cryptosporidium parvum
NAAISNR

SEQ ID NO: 2270268 - protein, 13 aa, Cryptosporidium parvum
NAANKLKSTNKLE

SEQ ID NO: 2270269 - protein, 6 aa, Cryptosporidium parvum
NAAPSQ

SEQ ID NO: 2270270 - protein, 5 aa, Cryptosporidium parvum
NAAPT

SEQ ID NO: 2270271 - protein, 19 aa, Cryptosporidium parvum
NADDGDEGEIEKRRKRREA

SEQ ID NO: 2270272 - protein, 13 aa, Cryptosporidium parvum
NADDMNTAVSSYS

SEQ ID NO: 2270273 - protein, 5 aa, Cryptosporidium parvum
NADEA

SEQ ID NO: 2270274 - protein, 7 aa, Cryptosporidium parvum
NADEELG

SEQ ID NO: 2270275 - protein, 6 aa, Cryptosporidium parvum
NADGNQ

SEQ ID NO: 2270276 - protein, 18 aa, Cryptosporidium parvum
NADGNSNNNNNGNSSSSL

SEQ ID NO: 2270277 - protein, 5 aa, Cryptosporidium parvum
NADIR

SEQ ID NO: 2270278 - protein, 4 aa, Cryptosporidium parvum
NADK

SEQ ID NO: 2270279 - protein, 9 aa, Cryptosporidium parvum
NADMSTSDA

SEQ ID NO: 2270280 - protein, 14 aa, Cryptosporidium parvum
NADNETKKQITDNI

SEQ ID NO: 2270281 - protein, 9 aa, Cryptosporidium parvum
NADNGKKIK

SEQ ID NO: 2270282 - protein, 42 aa, Cryptosporidium parvum
NADNQNKDLDENREDEDLKEVKSEEVDIEGNDSSKPYKEESE

SEQ ID NO: 2270283 - protein, 9 aa, Cryptosporidium parvum
NADQVKKES

SEQ ID NO: 2270284 - protein, 12 aa, Cryptosporidium parvum
NADSYEDEVDPI

SEQ ID NO: 2270285 - protein, 11 aa, Cryptosporidium parvum
NAEATNREIET

SEQ ID NO: 2270286 - protein, 6 aa, Cryptosporidium parvum
NAEDSD

SEQ ID NO: 2270287 - protein, 8 aa, Cryptosporidium parvum
NAEESPIN

SEQ ID NO: 2270288 - protein, 4 aa, Cryptosporidium parvum
NAEL

SEQ ID NO: 2270289 - protein, 7 aa, Cryptosporidium parvum
NAEPNTK

SEQ ID NO: 2270290 - protein, 17 aa, Cryptosporidium parvum
NAEQVNQEDNISSPENE

SEQ ID NO: 2270291 - protein, 4 aa, Cryptosporidium parvum
NAES

SEQ ID NO: 2270292 - protein, 17 aa, Cryptosporidium parvum
NAESGDTSSASKRCSYS

SEQ ID NO: 2270293 - protein, 9 aa, Cryptosporidium parvum
NAETGSGKT

SEQ ID NO: 2270294 - protein, 13 aa, Cryptosporidium parvum
NAEYSSNNDINKH

SEQ ID NO: 2270295 - protein, 16 aa, Cryptosporidium parvum
NAFEGSGNLEKDASLD

SEQ ID NO: 2270296 - protein, 4 aa, Cryptosporidium parvum
NAFT

SEQ ID NO: 2270297 - protein, 4 aa, Cryptosporidium parvum
NAGF

SEQ ID NO: 2270298 - protein, 6 aa, Cryptosporidium parvum
NAGFDG

SEQ ID NO: 2270299 - protein, 8 aa, Cryptosporidium parvum
NAGHNSKS

SEQ ID NO: 2270300 - protein, 6 aa, Cryptosporidium parvum
NAGKST

SEQ ID NO: 2270301 - protein, 5 aa, Cryptosporidium parvum
NAGKT

SEQ ID NO: 2270302 - protein, 6 aa, Cryptosporidium parvum
NAGKTT

SEQ ID NO: 2270303 - protein, 5 aa, Cryptosporidium parvum
NAGLN

SEQ ID NO: 2270304 - protein, 46 aa, Cryptosporidium parvum
NAGPVTNSRGRARKRTSTTPLGGMRGRRDSTDANKRRGGSPGRHHT

SEQ ID NO: 2270305 - protein, 54 aa, Cryptosporidium parvum
NAHPSSSSSSNVHSQQYQYSKQQQQHTQYQKHQQHQQQQQQQQHQQHQQQQQQQ

SEQ ID NO: 2270306 - protein, 18 aa, Cryptosporidium parvum
NAINSTSKLRQEADDSIA

SEQ ID NO: 2270307 - protein, 7 aa, Cryptosporidium parvum
NAIPGRD

SEQ ID NO: 2270308 - protein, 16 aa, Cryptosporidium parvum
NAIQDEDDLGLSSNNY

SEQ ID NO: 2270309 - protein, 10 aa, Cryptosporidium parvum
NAISEKRKEL

SEQ ID NO: 2270310 - protein, 22 aa, Cryptosporidium parvum
NAITEEESSNYDESQSSKKNSR

SEQ ID NO: 2270311 - protein, 6 aa, Cryptosporidium parvum
NAKARQ

SEQ ID NO: 2270312 - protein, 13 aa, Cryptosporidium parvum
NAKASKPVVFKIP

SEQ ID NO: 2270313 - protein, 15 aa, Cryptosporidium parvum
NAKFKSNSCTCSKGG

SEQ ID NO: 2270314 - protein, 10 aa, Cryptosporidium parvum
NAKKGNGMNN

SEQ ID NO: 2270315 - protein, 23 aa, Cryptosporidium parvum
NAKKSNVSTYSSIESKQRAGGFT

SEQ ID NO: 2270316 - protein, 9 aa, Cryptosporidium parvum
NAKKSSECM

SEQ ID NO: 2270317 - protein, 7 aa, Cryptosporidium parvum
NAKNRAS

SEQ ID NO: 2270318 - protein, 10 aa, Cryptosporidium parvum
NAKNSSVSKD

SEQ ID NO: 2270319 - protein, 17 aa, Cryptosporidium parvum
NAKNSTLKADNKQETKP

SEQ ID NO: 2270320 - protein, 9 aa, Cryptosporidium parvum
NAKPQGGQD

SEQ ID NO: 2270321 - protein, 24 aa, Cryptosporidium parvum
NAKSNRDEKIKGNITEKDQEKDYD

SEQ ID NO: 2270322 - protein, 5 aa, Cryptosporidium parvum
NAKTI

SEQ ID NO: 2270323 - protein, 13 aa, Cryptosporidium parvum
NAKTTRNNNSSRF

SEQ ID NO: 2270324 - protein, 24 aa, Cryptosporidium parvum
NAKVEEPTEQKSLEDKPKNTKDIG

SEQ ID NO: 2270325 - protein, 5 aa, Cryptosporidium parvum
NAKYS

SEQ ID NO: 2270326 - protein, 23 aa, Cryptosporidium parvum
NAKYTSSISNTSENGNNQESEHI

SEQ ID NO: 2270327 - protein, 4 aa, Cryptosporidium parvum
NALE

SEQ ID NO: 2270328 - protein, 15 aa, Cryptosporidium parvum
NALETAKKANSPKTW

SEQ ID NO: 2270329 - protein, 13 aa, Cryptosporidium parvum
NALGNNAENDKEY

SEQ ID NO: 2270330 - protein, 13 aa, Cryptosporidium parvum
NALQRSGRAGRVS

SEQ ID NO: 2270331 - protein, 37 aa, Cryptosporidium parvum; identical to SEQ ID NO: 2152113

SEQ ID NO: 2270332 - protein, 24 aa, Cryptosporidium parvum
NALTNSSNNTKKQEKNKNGTDSSY

SEQ ID NO: 2270333 - protein, 8 aa, Cryptosporidium parvum
NAMDSQST

SEQ ID NO: 2270334 - protein, 5 aa, Cryptosporidium parvum
NAMNS

SEQ ID NO: 2270335 - protein, 12 aa, Cryptosporidium parvum
NANATEQVHDQE

SEQ ID NO: 2270336 - protein, 6 aa, Cryptosporidium parvum
NANFEE

SEQ ID NO: 2270337 - protein, 12 aa, Cryptosporidium parvum
NANFTKKTAEQL

SEQ ID NO: 2270338 - protein, 29 aa, Cryptosporidium parvum
NANITTNTTNTTTTTTNNNNNNNNNNNST

SEQ ID NO: 2270339 - protein, 9 aa, Cryptosporidium parvum
NANNASPGL

SEQ ID NO: 2270340 - protein, 19 aa, Cryptosporidium parvum
NANNNKKPNKRQKTTQISD

SEQ ID NO: 2270341 - protein, 13 aa, Cryptosporidium parvum
NANNNNENEMNNN

SEQ ID NO: 2270342 - protein, 5 aa, Cryptosporidium parvum
NANQP

SEQ ID NO: 2270343 - protein, 6 aa, Cryptosporidium parvum
NANSIV

SEQ ID NO: 2270344 - protein, 11 aa, Cryptosporidium parvum
NANSKKKLVEN

SEQ ID NO: 2270345 - protein, 7 aa, Cryptosporidium parvum
NANSTFS

SEQ ID NO: 2270346 - protein, 21 aa, Cryptosporidium parvum
NANTVTSNSSSKNVCLNDTGS

SEQ ID NO: 2270347 - protein, 12 aa, Cryptosporidium parvum
NAPISKLILNSA

SEQ ID NO: 2270348 - protein, 12 aa, Cryptosporidium parvum
NAPKTGSYVNDE

SEQ ID NO: 2270349 - protein, 6 aa, Cryptosporidium parvum
NAPLPS

SEQ ID NO: 2270350 - protein, 4 aa, Cryptosporidium parvum
NAPN

SEQ ID NO: 2270351 - protein, 6 aa, Cryptosporidium parvum
NAPQMI

SEQ ID NO: 2270352 - protein, 16 aa, Cryptosporidium parvum
NAPRRETGDLNNLDPS

SEQ ID NO: 2270353 - protein, 8 aa, Cryptosporidium parvum
NAPRSTKG

SEQ ID NO: 2270354 - protein, 7 aa, Cryptosporidium parvum
NAPSTLG

SEQ ID NO: 2270355 - protein, 5 aa, Cryptosporidium parvum
NAPTL

SEQ ID NO: 2270356 - protein, 36 aa, Cryptosporidium parvum; identical to SEQ ID NO: 2152134

SEQ ID NO: 2270357 - protein, 9 aa, Cryptosporidium parvum
NAQDTGNNT

SEQ ID NO: 2270358 - protein, 7 aa, Cryptosporidium parvum
NAQNIQK

SEQ ID NO: 2270359 - protein, 7 aa, Cryptosporidium parvum
NAQNTNG

SEQ ID NO: 2270360 - protein, 8 aa, Cryptosporidium parvum
NAQPPTAG

SEQ ID NO: 2270361 - protein, 5 aa, Cryptosporidium parvum
NAQQD

SEQ ID NO: 2270362 - protein, 6 aa, Cryptosporidium parvum
NARSTG

SEQ ID NO: 2270363 - protein, 5 aa, Cryptosporidium parvum
NASAA

SEQ ID NO: 2270364 - protein, 6 aa, Cryptosporidium parvum
NASDAL

SEQ ID NO: 2270365 - protein, 8 aa, Cryptosporidium parvum
NASEEELS

SEQ ID NO: 2270366 - protein, 7 aa, Cryptosporidium parvum
NASEIEE

SEQ ID NO: 2270367 - protein, 10 aa, Cryptosporidium parvum
NASGRRAIGG

SEQ ID NO: 2270368 - protein, 11 aa, Cryptosporidium parvum
NASHSAPDNRE

SEQ ID NO: 2270369 - protein, 5 aa, Cryptosporidium parvum
NASKL

SEQ ID NO: 2270370 - protein, 7 aa, Cryptosporidium parvum
NASKNTK

SEQ ID NO: 2270371 - protein, 10 aa, Cryptosporidium parvum
NASKTGELAA

SEQ ID NO: 2270372 - protein, 10 aa, Cryptosporidium parvum
NASLKESISQ

SEQ ID NO: 2270373 - protein, 7 aa, Cryptosporidium parvum
NASNSGC

SEQ ID NO: 2270374 - protein, 8 aa, Cryptosporidium parvum
NASPGNRK

SEQ ID NO: 2270375 - protein, 5 aa, Cryptosporidium parvum
NASQR

SEQ ID NO: 2270376 - protein, 35 aa, Cryptosporidium parvum; identical to SEQ ID NO: 2152153

SEQ ID NO: 2270377 - protein, 4 aa, Cryptosporidium parvum
NASR

SEQ ID NO: 2270378 - protein, 14 aa, Cryptosporidium parvum
NASRNLEDNQTSLD

SEQ ID NO: 2270379 - protein, 6 aa, Cryptosporidium parvum
NASSDR

SEQ ID NO: 2270380 - protein, 21 aa, Cryptosporidium parvum
NASSENTGSNVASGESNSNNH

SEQ ID NO: 2270381 - protein, 9 aa, Cryptosporidium parvum
NASSGGECS

SEQ ID NO: 2270382 - protein, 6 aa, Cryptosporidium parvum
NASSTL

SEQ ID NO: 2270383 - protein, 12 aa, Cryptosporidium parvum
NASSTSSSSSLK

SEQ ID NO: 2270384 - protein, 13 aa, Cryptosporidium parvum
NASTDFSKTPNKN

SEQ ID NO: 2270385 - protein, 21 aa, Cryptosporidium parvum
NASTNGSKQNISNSDYTDEEI

SEQ ID NO: 2270386 - protein, 5 aa, Cryptosporidium parvum
NASWR

SEQ ID NO: 2270387 - protein, 9 aa, Cryptosporidium parvum
NASYEPSKR

SEQ ID NO: 2270388 - protein, 9 aa, Cryptosporidium parvum
NATAGSFAE

SEQ ID NO: 2270389 - protein, 5 aa, Cryptosporidium parvum
NATDI

SEQ ID NO: 2270390 - protein, 7 aa, Cryptosporidium parvum
NATIERN

SEQ ID NO: 2270391 - protein, 8 aa, Cryptosporidium parvum
NATKDLSP

SEQ ID NO: 2270392 - protein, 4 aa, Cryptosporidium parvum
NATL

SEQ ID NO: 2270393 - protein, 18 aa, Cryptosporidium parvum
NATNLSTREKNNTSLLIK

SEQ ID NO: 2270394 - protein, 7 aa, Cryptosporidium parvum
NATPCDF

SEQ ID NO: 2270395 - protein, 8 aa, Cryptosporidium parvum
NATQNEFG

SEQ ID NO: 2270396 - protein, 8 aa, Cryptosporidium parvum
NATTGGTV

SEQ ID NO: 2270397 - protein, 9 aa, Cryptosporidium parvum
NATYTRNNS

SEQ ID NO: 2270398 - protein, 13 aa, Cryptosporidium parvum
NAVDTKDNMSQFS

SEQ ID NO: 2270399 - protein, 4 aa, Cryptosporidium parvum
NAVE

SEQ ID NO: 2270400 - protein, 8 aa, Cryptosporidium parvum
NAVGSRRS

SEQ ID NO: 2270401 - protein, 13 aa, Cryptosporidium parvum
NAVSNIPKKNLDE

SEQ ID NO: 2270402 - protein, 12 aa, Cryptosporidium parvum
NAVTNTNSSQIY

SEQ ID NO: 2270403 - protein, 5 aa, Cryptosporidium parvum
NAYNE

SEQ ID NO: 2270404 - protein, 10 aa, Cryptosporidium parvum
NAYNQEEFRE

SEQ ID NO: 2270405 - protein, 12 aa, Cryptosporidium parvum
NAYRGQNSPKNL

SEQ ID NO: 2270406 - protein, 14 aa, Cryptosporidium parvum
NCASESTFEGERQN

SEQ ID NO: 2270407 - protein, 12 aa, Cryptosporidium parvum
NCDNSNSDLTNL

SEQ ID NO: 2270408 - protein, 5 aa, Cryptosporidium parvum
NCDSH

SEQ ID NO: 2270409 - protein, 9 aa, Cryptosporidium parvum
NCEESLRNG

SEQ ID NO: 2270410 - protein, 4 aa, Cryptosporidium parvum
NCEK

SEQ ID NO: 2270411 - protein, 18 aa, Cryptosporidium parvum
NCEQENAKNSIKGGNQVQ

SEQ ID NO: 2270412 - protein, 9 aa, Cryptosporidium parvum
NCEQSKNGV

SEQ ID NO: 2270413 - protein, 5 aa, Cryptosporidium parvum
NCGDS

SEQ ID NO: 2270414 - protein, 9 aa, Cryptosporidium parvum
NCGNNSDTF

SEQ ID NO: 2270415 - protein, 12 aa, Cryptosporidium parvum
NCKNQGKYLKGD

SEQ ID NO: 2270416 - protein, 8 aa, Cryptosporidium parvum
NCKNYKDK

SEQ ID NO: 2270417 - protein, 11 aa, Cryptosporidium parvum
NCKSNKTNFNQ

SEQ ID NO: 2270418 - protein, 11 aa, Cryptosporidium parvum
NCNETSANRTK

SEQ ID NO: 2270419 - protein, 9 aa, Cryptosporidium parvum
NCNPATSQL

SEQ ID NO: 2270420 - protein, 4 aa, Cryptosporidium parvum
NCPE

SEQ ID NO: 2270421 - protein, 11 aa, Cryptosporidium parvum
NCPSDKSHKPI

SEQ ID NO: 2270422 - protein, 5 aa, Cryptosporidium parvum
NCQNQ

SEQ ID NO: 2270423 - protein, 9 aa, Cryptosporidium parvum
NCQTGKAQD

SEQ ID NO: 2270424 - protein, 6 aa, Cryptosporidium parvum
NCRATG

SEQ ID NO: 2270425 - protein, 5 aa, Cryptosporidium parvum
NCSKG

SEQ ID NO: 2270426 - protein, 5 aa, Cryptosporidium parvum
NCSLQ

SEQ ID NO: 2270427 - protein, 6 aa, Cryptosporidium parvum
NCSNGI

SEQ ID NO: 2270428 - protein, 14 aa, Cryptosporidium parvum
NCSSIGKSKPSLSL

SEQ ID NO: 2270429 - protein, 5 aa, Cryptosporidium parvum
NCTGK

SEQ ID NO: 2270430 - protein, 4 aa, Cryptosporidium parvum
NCTP

SEQ ID NO: 2270431 - protein, 13 aa, Cryptosporidium parvum
NCVEEEEERVDEV

SEQ ID NO: 2270432 - protein, 9 aa, Cryptosporidium parvum
NDAEPGPEE

SEQ ID NO: 2270433 - protein, 15 aa, Cryptosporidium parvum
NDAESDHGTTNGGAI

SEQ ID NO: 2270434 - protein, 10 aa, Cryptosporidium parvum
NDAKKKHDEI

SEQ ID NO: 2270435 - protein, 12 aa, Cryptosporidium parvum
NDAKNEDIDPHE

SEQ ID NO: 2270436 - protein, 9 aa, Cryptosporidium parvum
NDAPKLSEK

SEQ ID NO: 2270437 - protein, 26 aa, Cryptosporidium parvum
NDASKNSNITYSESDLNLDKNKTTNN

SEQ ID NO: 2270438 - protein, 5 aa, Cryptosporidium parvum
NDATK

SEQ ID NO: 2270439 - protein, 4 aa, Cryptosporidium parvum
NDAY

SEQ ID NO: 2270440 - protein, 27 aa, Cryptosporidium parvum
NDCEKNANFKEKKDLSKKVNKKENSEV

SEQ ID NO: 2270441 - protein, 7 aa, Cryptosporidium parvum
NDDDGEF

SEQ ID NO: 2270442 - protein, 8 aa, Cryptosporidium parvum
NDDDRDEL

SEQ ID NO: 2270443 - protein, 6 aa, Cryptosporidium parvum
NDDELT

SEQ ID NO: 2270444 - protein, 6 aa, Cryptosporidium parvum
NDDEMS

SEQ ID NO: 2270445 - protein, 8 aa, Cryptosporidium parvum
NDDERRVS

SEQ ID NO: 2270446 - protein, 5 aa, Cryptosporidium parvum
NDDFG

SEQ ID NO: 2270447 - protein, 9 aa, Cryptosporidium parvum
NDDFKEELN

SEQ ID NO: 2270448 - protein, 23 aa, Cryptosporidium parvum
NDDGLEDNNNERSDLPASQMDGD

SEQ ID NO: 2270449 - protein, 6 aa, Cryptosporidium parvum
NDDHKT

SEQ ID NO: 2270450 - protein, 9 aa, Cryptosporidium parvum
NDDKNEKQI

SEQ ID NO: 2270451 - protein, 17 aa, Cryptosporidium parvum
NDDNNNNQMNSEEFNEK

SEQ ID NO: 2270452 - protein, 12 aa, Cryptosporidium parvum
NDDSDDSDKSLS

SEQ ID NO: 2270453 - protein, 5 aa, Cryptosporidium parvum
NDDSE

SEQ ID NO: 2270454 - protein, 15 aa, Cryptosporidium parvum
NDDSGLDAQNSNSNT

SEQ ID NO: 2270455 - protein, 8 aa, Cryptosporidium parvum
NDDTHNPI

SEQ ID NO: 2270456 - protein, 8 aa, Cryptosporidium parvum
NDDTRMEE

SEQ ID NO: 2270457 - protein, 30 aa, Cryptosporidium parvum
NDDYDDDESSVRDDDSEEFEDLSSENEEDY

SEQ ID NO: 2270458 - protein, 6 aa, Cryptosporidium parvum
NDDYIT

SEQ ID NO: 2270459 - protein, 5 aa, Cryptosporidium parvum
NDEDA

SEQ ID NO: 2270460 - protein, 4 aa, Cryptosporidium parvum
NDEE

SEQ ID NO: 2270461 - protein, 23 aa, Cryptosporidium parvum
NDEEKNSSSSVNNNDIDNNTELT

SEQ ID NO: 2270462 - protein, 5 aa, Cryptosporidium parvum
NDEEL

SEQ ID NO: 2270463 - protein, 5 aa, Cryptosporidium parvum
NDEEN

SEQ ID NO: 2270464 - protein, 8 aa, Cryptosporidium parvum
NDEENKMN

SEQ ID NO: 2270465 - protein, 8 aa, Cryptosporidium parvum
NDEESKNF

SEQ ID NO: 2270466 - protein, 4 aa, Cryptosporidium parvum
NDEF

SEQ ID NO: 2270467 - protein, 8 aa, Cryptosporidium parvum
NDEGNKSN

SEQ ID NO: 2270468 - protein, 6 aa, Cryptosporidium parvum
NDEGSH

SEQ ID NO: 2270469 - protein, 8 aa, Cryptosporidium parvum
NDEGTVSG

SEQ ID NO: 2270470 - protein, 14 aa, Cryptosporidium parvum
NDEGVTSATGLTIS

SEQ ID NO: 2270471 - protein, 11 aa, Cryptosporidium parvum
NDEHSDEKKQL

SEQ ID NO: 2270472 - protein, 12 aa, Cryptosporidium parvum
NDEISSYQKENK

SEQ ID NO: 2270473 - protein, 9 aa, Cryptosporidium parvum
NDEKEAFPD

SEQ ID NO: 2270474 - protein, 6 aa, Cryptosporidium parvum
NDEKNN

SEQ ID NO: 2270475 - protein, 6 aa, Cryptosporidium parvum
NDEKNS

SEQ ID NO: 2270476 - protein, 4 aa, Cryptosporidium parvum
NDEL

SEQ ID NO: 2270477 - protein, 8 aa, Cryptosporidium parvum
NDELANQL

SEQ ID NO: 2270478 - protein, 22 aa, Cryptosporidium parvum
NDELDELEEAKQQLKENSEKIT

SEQ ID NO: 2270479 - protein, 4 aa, Cryptosporidium parvum
NDEN

SEQ ID NO: 2270480 - protein, 12 aa, Cryptosporidium parvum
NDENNNKNEDQM

SEQ ID NO: 2270481 - protein, 23 aa, Cryptosporidium parvum
NDENQSKNDFNNNNNNHNNYHKS

SEQ ID NO: 2270482 - protein, 6 aa, Cryptosporidium parvum
NDENSH

SEQ ID NO: 2270483 - protein, 14 aa, Cryptosporidium parvum
NDENSPNNESYNAN

SEQ ID NO: 2270484 - protein, 18 aa, Cryptosporidium parvum
NDENYSRDNDYNENHEHS

SEQ ID NO: 2270485 - protein, 5 aa, Cryptosporidium parvum
NDEQR

SEQ ID NO: 2270486 - protein, 5 aa, Cryptosporidium parvum
NDERN

SEQ ID NO: 2270487 - protein, 6 aa, Cryptosporidium parvum
NDERNR

SEQ ID NO: 2270488 - protein, 4 aa, Cryptosporidium parvum
NDES

SEQ ID NO: 2270489 - protein, 9 aa, Cryptosporidium parvum
NDESDFQKG

SEQ ID NO: 2270490 - protein, 13 aa, Cryptosporidium parvum
NDESGKLSKSKKR

SEQ ID NO: 2270491 - protein, 4 aa, Cryptosporidium parvum
NDET

SEQ ID NO: 2270492 - protein, 7 aa, Cryptosporidium parvum
NDETAQE

SEQ ID NO: 2270493 - protein, 5 aa, Cryptosporidium parvum
NDETI

SEQ ID NO: 2270494 - protein, 7 aa, Cryptosporidium parvum
NDEVSDS

SEQ ID NO: 2270495 - protein, 11 aa, Cryptosporidium parvum
NDFDEQYDNDL

SEQ ID NO: 2270496 - protein, 35 aa, Cryptosporidium parvum
NDFDNNNNSNNINNINNNNNNAEIQNNESEDEWEY

SEQ ID NO: 2270497 - protein, 6 aa, Cryptosporidium parvum
NDFGRN

SEQ ID NO: 2270498 - protein, 7 aa, Cryptosporidium parvum
NDFNESS

SEQ ID NO: 2270499 - protein, 6 aa, Cryptosporidium parvum
NDFNNT

SEQ ID NO: 2270500 - protein, 14 aa, Cryptosporidium parvum
NDFNTGIGNTGVGN

SEQ ID NO: 2270501 - protein, 8 aa, Cryptosporidium parvum
NDFSGSQT

SEQ ID NO: 2270502 - protein, 4 aa, Cryptosporidium parvum
NDGG

SEQ ID NO: 2270503 - protein, 63 aa, Cryptosporidium parvum
NDGGDENREGDRKIDESKSPSRERGVSDDEQRNNEGRNEDNREPVEERDRSRSREKSEVDVSE

SEQ ID NO: 2270504 - protein, 9 aa, Cryptosporidium parvum
NDGGGGSAS

SEQ ID NO: 2270505 - protein, 7 aa, Cryptosporidium parvum
NDGIDDD

SEQ ID NO: 2270506 - protein, 23 aa, Cryptosporidium parvum
NDGKVDDYSYRAKPGARYISPEN

SEQ ID NO: 2270507 - protein, 6 aa, Cryptosporidium parvum
NDGNSI

SEQ ID NO: 2270508 - protein, 6 aa, Cryptosporidium parvum
NDGQQH

SEQ ID NO: 2270509 - protein, 7 aa, Cryptosporidium parvum
NDGQRTL

SEQ ID NO: 2270510 - protein, 6 aa, Cryptosporidium parvum
NDGQYP

SEQ ID NO: 2270511 - protein, 22 aa, Cryptosporidium parvum
NDGTGHGGGSNNKKALETIDER

SEQ ID NO: 2270512 - protein, 5 aa, Cryptosporidium parvum
NDHDI

SEQ ID NO: 2270513 - protein, 33 aa, Cryptosporidium parvum; identical to SEQ ID NO: 2152266

SEQ ID NO: 2270514 - protein, 12 aa, Cryptosporidium parvum
NDHKPNSESEKR

SEQ ID NO: 2270515 - protein, 19 aa, Cryptosporidium parvum
NDHKSKGKANNGLKSSTGM

SEQ ID NO: 2270516 - protein, 4 aa, Cryptosporidium parvum
NDHR

SEQ ID NO: 2270517 - protein, 7 aa, Cryptosporidium parvum
NDIDNSN

SEQ ID NO: 2270518 - protein, 12 aa, Cryptosporidium parvum
NDIDTRNNEYYE

SEQ ID NO: 2270519 - protein, 5 aa, Cryptosporidium parvum
NDIEN

SEQ ID NO: 2270520 - protein, 6 aa, Cryptosporidium parvum
NDIEQN

SEQ ID NO: 2270521 - protein, 60 aa, Cryptosporidium parvum
NDIHNTNEKTTDNRNNKKPENTNLKNDEQIPLSDQKKYSKSSPLSKNQCPPKLGKRPPIK

SEQ ID NO: 2270522 - protein, 9 aa, Cryptosporidium parvum
NDISGGANQ

SEQ ID NO: 2270523 - protein, 7 aa, Cryptosporidium parvum
NDISSAK

SEQ ID NO: 2270524 - protein, 5 aa, Cryptosporidium parvum
NDIST

SEQ ID NO: 2270525 - protein, 5 aa, Cryptosporidium parvum
NDKAT

SEQ ID NO: 2270526 - protein, 8 aa, Cryptosporidium parvum
NDKDEEDF

SEQ ID NO: 2270527 - protein, 5 aa, Cryptosporidium parvum
NDKEK

SEQ ID NO: 2270528 - protein, 14 aa, Cryptosporidium parvum
NDKKDGDGKFTWPD

SEQ ID NO: 2270529 - protein, 9 aa, Cryptosporidium parvum
NDKKRKFRR

SEQ ID NO: 2270530 - protein, 6 aa, Cryptosporidium parvum
NDKLSK

SEQ ID NO: 2270531 - protein, 4 aa, Cryptosporidium parvum
NDKN

SEQ ID NO: 2270532 - protein, 8 aa, Cryptosporidium parvum
NDKNNTVT

SEQ ID NO: 2270533 - protein, 9 aa, Cryptosporidium parvum
NDKNSGYIT

SEQ ID NO: 2270534 - protein, 18 aa, Cryptosporidium parvum
NDKNTIDSKNLDKIEGKQ

SEQ ID NO: 2270535 - protein, 10 aa, Cryptosporidium parvum
NDKPLENNTD

SEQ ID NO: 2270536 - protein, 7 aa, Cryptosporidium parvum
NDKREEL

SEQ ID NO: 2270537 - protein, 6 aa, Cryptosporidium parvum
NDKRYE

SEQ ID NO: 2270538 - protein, 20 aa, Cryptosporidium parvum
NDKTLKANMDSNSVSGNSDY

SEQ ID NO: 2270539 - protein, 10 aa, Cryptosporidium parvum
NDLDNNSTDV

SEQ ID NO: 2270540 - protein, 11 aa, Cryptosporidium parvum
NDLEDPKKPFS

SEQ ID NO: 2270541 - protein, 6 aa, Cryptosporidium parvum
NDLEEN

SEQ ID NO: 2270542 - protein, 9 aa, Cryptosporidium parvum
NDLENYSTS

SEQ ID NO: 2270543 - protein, 8 aa, Cryptosporidium parvum
NDLGKEQI

SEQ ID NO: 2270544 - protein, 8 aa, Cryptosporidium parvum
NDLKSGEK

SEQ ID NO: 2270545 - protein, 6 aa, Cryptosporidium parvum
NDLPIN

SEQ ID NO: 2270546 - protein, 9 aa, Cryptosporidium parvum
NDLPPKDSV

SEQ ID NO: 2270547 - protein, 4 aa, Cryptosporidium parvum
NDLT

SEQ ID NO: 2270548 - protein, 12 aa, Cryptosporidium parvum
NDLTEETKNRYK

SEQ ID NO: 2270549 - protein, 19 aa, Cryptosporidium parvum
NDLTESENYNDTDDESDQE

SEQ ID NO: 2270550 - protein, 6 aa, Cryptosporidium parvum
NDMKNK

SEQ ID NO: 2270551 - protein, 7 aa, Cryptosporidium parvum
NDMKRES

SEQ ID NO: 2270552 - protein, 5 aa, Cryptosporidium parvum
NDMNP

SEQ ID NO: 2270553 - protein, 18 aa, Cryptosporidium parvum
NDMNSSPSTSTPSSFTGT

SEQ ID NO: 2270554 - protein, 49 aa, Cryptosporidium parvum; identical to SEQ ID NO: 2152300

SEQ ID NO: 2270555 - protein, 4 aa, Cryptosporidium parvum
NDNC

SEQ ID NO: 2270556 - protein, 8 aa, Cryptosporidium parvum
NDNDRPII

SEQ ID NO: 2270557 - protein, 13 aa, Cryptosporidium parvum
NDNDSNDNNSEVK

SEQ ID NO: 2270558 - protein, 13 aa, Cryptosporidium parvum
NDNDYDAKIASGS

SEQ ID NO: 2270559 - protein, 8 aa, Cryptosporidium parvum
NDNEENDL

SEQ ID NO: 2270560 - protein, 8 aa, Cryptosporidium parvum
NDNEENTF

SEQ ID NO: 2270561 - protein, 12 aa, Cryptosporidium parvum
NDNFDKSTNINN

SEQ ID NO: 2270562 - protein, 7 aa, Cryptosporidium parvum
NDNFGEG

SEQ ID NO: 2270563 - protein, 7 aa, Cryptosporidium parvum
NDNGPQL

SEQ ID NO: 2270564 - protein, 5 aa, Cryptosporidium parvum
NDNIN

SEQ ID NO: 2270565 - protein, 13 aa, Cryptosporidium parvum
NDNITHKKNKVQK

SEQ ID NO: 2270566 - protein, 8 aa, Cryptosporidium parvum
NDNNELKE

SEQ ID NO: 2270567 - protein, 8 aa, Cryptosporidium parvum
NDNNGALD

SEQ ID NO: 2270568 - protein, 12 aa, Cryptosporidium parvum
NDNNGSSTSNRE

SEQ ID NO: 2270569 - protein, 12 aa, Cryptosporidium parvum
NDNNKEKDNSIQ

SEQ ID NO: 2270570 - protein, 8 aa, Cryptosporidium parvum
NDNNNNAN

SEQ ID NO: 2270571 - protein, 7 aa, Cryptosporidium parvum
NDNPHSY

SEQ ID NO: 2270572 - protein, 11 aa, Cryptosporidium parvum
NDNPSSSAVSE

SEQ ID NO: 2270573 - protein, 14 aa, Cryptosporidium parvum
NDNQVEEKVTEISD

SEQ ID NO: 2270574 - protein, 20 aa, Cryptosporidium parvum
NDNSNGDHNKGSIKSSKPLV

SEQ ID NO: 2270575 - protein, 8 aa, Cryptosporidium parvum
NDNSPAVR

SEQ ID NO: 2270576 - protein, 8 aa, Cryptosporidium parvum
NDNSQPEN

SEQ ID NO: 2270577 - protein, 18 aa, Cryptosporidium parvum
NDNSTYKENNNLLGNNET

SEQ ID NO: 2270578 - protein, 6 aa, Cryptosporidium parvum
NDNSWE

SEQ ID NO: 2270579 - protein, 6 aa, Cryptosporidium parvum
NDNTGS

SEQ ID NO: 2270580 - protein, 8 aa, Cryptosporidium parvum
NDNTNSMR

SEQ ID NO: 2270581 - protein, 25 aa, Cryptosporidium parvum
NDNTQSSSPSTSNIYSPNSMTGSGI

SEQ ID NO: 2270582 - protein, 5 aa, Cryptosporidium parvum
NDNTT

SEQ ID NO: 2270583 - protein, 4 aa, Cryptosporidium parvum
NDNY

SEQ ID NO: 2270584 - protein, 7 aa, Cryptosporidium parvum
NDPDTKD

SEQ ID NO: 2270585 - protein, 5 aa, Cryptosporidium parvum
NDPEN

SEQ ID NO: 2270586 - protein, 6 aa, Cryptosporidium parvum
NDPETL

SEQ ID NO: 2270587 - protein, 9 aa, Cryptosporidium parvum
NDPEYKNET

SEQ ID NO: 2270588 - protein, 22 aa, Cryptosporidium parvum
  misc_feature (14)..(22): Xaa can be any naturally occurring amino acid
NDPHKSLGAWRLEXXXXXXXXX

SEQ ID NO: 2270589 - protein, 5 aa, Cryptosporidium parvum
NDPKF

SEQ ID NO: 2270590 - protein, 6 aa, Cryptosporidium parvum
NDPKGR

SEQ ID NO: 2270591 - protein, 10 aa, Cryptosporidium parvum
NDPMSKTRSE

SEQ ID NO: 2270592 - protein, 4 aa, Cryptosporidium parvum
NDPN

SEQ ID NO: 2270593 - protein, 9 aa, Cryptosporidium parvum
NDPNENDYH

SEQ ID NO: 2270594 - protein, 14 aa, Cryptosporidium parvum
NDPNENYDERNTES

SEQ ID NO: 2270595 - protein, 16 aa, Cryptosporidium parvum
NDPNNQSCLDSKDNCN

SEQ ID NO: 2270596 - protein, 13 aa, Cryptosporidium parvum
NDPNPNSPANAEA

SEQ ID NO: 2270597 - protein, 6 aa, Cryptosporidium parvum
NDPPNP

SEQ ID NO: 2270598 - protein, 5 aa, Cryptosporidium parvum
NDPRI

SEQ ID NO: 2270599 - protein, 57 aa, Cryptosporidium parvum
NDQEDYESNEEANDNEEEEDNEEEEDNEEEEDNEEEVEGVDYKDERDHEKEGKRVKY

SEQ ID NO: 2270600 - protein, 12 aa, Cryptosporidium parvum
NDQEKNINGYED

SEQ ID NO: 2270601 - protein, 4 aa, Cryptosporidium parvum
NDQI

SEQ ID NO: 2270602 - protein, 7 aa, Cryptosporidium parvum
NDQLRSK

SEQ ID NO: 2270603 - protein, 9 aa, Cryptosporidium parvum
NDQNEPTVA

SEQ ID NO: 2270604 - protein, 5 aa, Cryptosporidium parvum
NDQNK

SEQ ID NO: 2270605 - protein, 10 aa, Cryptosporidium parvum
NDQQNRDEVS

SEQ ID NO: 2270606 - protein, 5 aa, Cryptosporidium parvum
NDQRE

SEQ ID NO: 2270607 - protein, 9 aa, Cryptosporidium parvum
NDQTEVPKN

SEQ ID NO: 2270608 - protein, 5 aa, Cryptosporidium parvum
NDQVS

SEQ ID NO: 2270609 - protein, 7 aa, Cryptosporidium parvum
NDQVSQK

SEQ ID NO: 2270610 - protein, 7 aa, Cryptosporidium parvum
NDQVTQQ

SEQ ID NO: 2270611 - protein, 22 aa, Cryptosporidium parvum
NDQYGKEEQKETEKEKNEDKNE

SEQ ID NO: 2270612 - protein, 15 aa, Cryptosporidium parvum
NDREIDGREILVRID

SEQ ID NO: 2270613 - protein, 6 aa, Cryptosporidium parvum
NDREPE

SEQ ID NO: 2270614 - protein, 9 aa, Cryptosporidium parvum
NDREQVSND

SEQ ID NO: 2270615 - protein, 11 aa, Cryptosporidium parvum
NDRERINDARD

SEQ ID NO: 2270616 - protein, 11 aa, Cryptosporidium parvum
NDRERINDSRD

SEQ ID NO: 2270617 - protein, 13 aa, Cryptosporidium parvum
NDRETSKRQWNKN

SEQ ID NO: 2270618 - protein, 5 aa, Cryptosporidium parvum
NDRKQ

SEQ ID NO: 2270619 - protein, 8 aa, Cryptosporidium parvum
NDRTCEPN

SEQ ID NO: 2270620 - protein, 11 aa, Cryptosporidium parvum
NDSCYSTQNSQ

SEQ ID NO: 2270621 - protein, 32 aa, Cryptosporidium parvum
NDSDCEEDEKDQQEDDSSGNRLEESSKKKKYK

SEQ ID NO: 2270622 - protein, 15 aa, Cryptosporidium parvum
NDSDKNEDKEEAKQE

SEQ ID NO: 2270623 - protein, 17 aa, Cryptosporidium parvum
NDSDPESSYEKDHSPIK

SEQ ID NO: 2270624 - protein, 13 aa, Cryptosporidium parvum
NDSEEKHQSSKKY

SEQ ID NO: 2270625 - protein, 16 aa, Cryptosporidium parvum
NDSEINNGTYEYSSAY

SEQ ID NO: 2270626 - protein, 9 aa, Cryptosporidium parvum
NDSENKNGK

SEQ ID NO: 2270627 - protein, 9 aa, Cryptosporidium parvum
NDSEYEEGY

SEQ ID NO: 2270628 - protein, 6 aa, Cryptosporidium parvum
NDSFSS

SEQ ID NO: 2270629 - protein, 8 aa, Cryptosporidium parvum
NDSFTSSH

SEQ ID NO: 2270630 - protein, 9 aa, Cryptosporidium parvum
NDSGRHNYL

SEQ ID NO: 2270631 - protein, 8 aa, Cryptosporidium parvum
NDSGSSEI

SEQ ID NO: 2270632 - protein, 25 aa, Cryptosporidium parvum
NDSIEKVESENKDNKERERNREKEL

SEQ ID NO: 2270633 - protein, 6 aa, Cryptosporidium parvum
NDSIGR

SEQ ID NO: 2270634 - protein, 5 aa, Cryptosporidium parvum
NDSKV

SEQ ID NO: 2270635 - protein, 5 aa, Cryptosporidium parvum
NDSNI

SEQ ID NO: 2270636 - protein, 7 aa, Cryptosporidium parvum
NDSNKED

SEQ ID NO: 2270637 - protein, 9 aa, Cryptosporidium parvum
NDSNSDCNK

SEQ ID NO: 2270638 - protein, 7 aa, Cryptosporidium parvum
NDSPDIT

SEQ ID NO: 2270639 - protein, 5 aa, Cryptosporidium parvum
NDSPL

SEQ ID NO: 2270640 - protein, 11 aa, Cryptosporidium parvum
NDSQDEEFETL

SEQ ID NO: 2270641 - protein, 8 aa, Cryptosporidium parvum
NDSQPSIG

SEQ ID NO: 2270642 - protein, 8 aa, Cryptosporidium parvum
NDSRAQEC

SEQ ID NO: 2270643 - protein, 7 aa, Cryptosporidium parvum
NDSSCGQ

SEQ ID NO: 2270644 - protein, 5 aa, Cryptosporidium parvum
NDSSE

SEQ ID NO: 2270645 - protein, 9 aa, Cryptosporidium parvum
NDSSEDELD

SEQ ID NO: 2270646 - protein, 20 aa, Cryptosporidium parvum
NDSSEEKDVSDSPKDSDFDQ

SEQ ID NO: 2270647 - protein, 15 aa, Cryptosporidium parvum
NDSSHIENGTEDLAS

SEQ ID NO: 2270648 - protein, 6 aa, Cryptosporidium parvum
NDSSKL

SEQ ID NO: 2270649 - protein, 11 aa, Cryptosporidium parvum
NDSSLNDEANI

SEQ ID NO: 2270650 - protein, 22 aa, Cryptosporidium parvum
NDSSMQNGNERKQSVGNEQKLA

SEQ ID NO: 2270651 - protein, 7 aa, Cryptosporidium parvum
NDSSPDM

SEQ ID NO: 2270652 - protein, 7 aa, Cryptosporidium parvum
NDSTDRL

SEQ ID NO: 2270653 - protein, 7 aa, Cryptosporidium parvum
NDSTEIS

SEQ ID NO: 2270654 - protein, 6 aa, Cryptosporidium parvum
NDSTLQ

SEQ ID NO: 2270655 - protein, 5 aa, Cryptosporidium parvum
NDSVG

SEQ ID NO: 2270656 - protein, 5 aa, Cryptosporidium parvum
NDSVT

SEQ ID NO: 2270657 - protein, 14 aa, Cryptosporidium parvum
NDSVTKSKFDNTYG

SEQ ID NO: 2270658 - protein, 12 aa, Cryptosporidium parvum
NDSYKSGSDTAI

SEQ ID NO: 2270659 - protein, 5 aa, Cryptosporidium parvum
NDSYL

SEQ ID NO: 2270660 - protein, 9 aa, Cryptosporidium parvum
NDTAVQKTI

SEQ ID NO: 2270661 - protein, 4 aa, Cryptosporidium parvum
NDTD

SEQ ID NO: 2270662 - protein, 49 aa, Cryptosporidium parvum; identical to SEQ ID NO: 2152399

SEQ ID NO: 2270663 - protein, 11 aa, Cryptosporidium parvum
NDTEKKSTQDF

SEQ ID NO: 2270664 - protein, 6 aa, Cryptosporidium parvum
NDTELK

SEQ ID NO: 2270665 - protein, 13 aa, Cryptosporidium parvum
NDTITSLEQAQKS

SEQ ID NO: 2270666 - protein, 6 aa, Cryptosporidium parvum
NDTKNS

SEQ ID NO: 2270667 - protein, 28 aa, Cryptosporidium parvum
NDTLTGKSGLNLERNSTVQNDEKNIGSK

SEQ ID NO: 2270668 - protein, 13 aa, Cryptosporidium parvum
NDTLVNPNHSKTL

SEQ ID NO: 2270669 - protein, 4 aa, Cryptosporidium parvum
NDTR

SEQ ID NO: 2270670 - protein, 9 aa, Cryptosporidium parvum
NDTSNESSI

SEQ ID NO: 2270671 - protein, 8 aa, Cryptosporidium parvum
NDTYPKFS

SEQ ID NO: 2270672 - protein, 11 aa, Cryptosporidium parvum
NDVDEDNKTPL

SEQ ID NO: 2270673 - protein, 6 aa, Cryptosporidium parvum
NDVDRK

SEQ ID NO: 2270674 - protein, 36 aa, Cryptosporidium parvum
NDVDSENNKNSTLSNNEFQASGIAQPTNNTSGKSIN

SEQ ID NO: 2270675 - protein, 17 aa, Cryptosporidium parvum
NDVEMKDESDNNTEAEM

SEQ ID NO: 2270676 - protein, 7 aa, Cryptosporidium parvum
NDVGYRG

SEQ ID NO: 2270677 - protein, 4 aa, Cryptosporidium parvum
NDVS

SEQ ID NO: 2270678 - protein, 4 aa, Cryptosporidium parvum
NDVT

SEQ ID NO: 2270679 - protein, 5 aa, Cryptosporidium parvum
NDWED

SEQ ID NO: 2270680 - protein, 6 aa, Cryptosporidium parvum
NDYDNN

SEQ ID NO: 2270681 - protein, 6 aa, Cryptosporidium parvum
NDYNNH

SEQ ID NO: 2270682 - protein, 7 aa, Cryptosporidium parvum
NDYNPSL

SEQ ID NO: 2270683 - protein, 10 aa, Cryptosporidium parvum
NDYQSDGNEE

SEQ ID NO: 2270684 - protein, 8 aa, Cryptosporidium parvum
NEAAMGPE

SEQ ID NO: 2270685 - protein, 10 aa, Cryptosporidium parvum
NEAEESDDDG

SEQ ID NO: 2270686 - protein, 8 aa, Cryptosporidium parvum
NEAETTTV

SEQ ID NO: 2270687 - protein, 13 aa, Cryptosporidium parvum
NEAKLVESDTDLG

SEQ ID NO: 2270688 - protein, 23 aa, Cryptosporidium parvum
NEANSKSTNQGKNIGRNNHSKRV

SEQ ID NO: 2270689 - protein, 11 aa, Cryptosporidium parvum
NEASEYQSNSS

SEQ ID NO: 2270690 - protein, 6 aa, Cryptosporidium parvum
NEASKG

SEQ ID NO: 2270691 - protein, 6 aa, Cryptosporidium parvum
NEASRL

SEQ ID NO: 2270692 - protein, 4 aa, Cryptosporidium parvum
NECL

SEQ ID NO: 2270693 - protein, 21 aa, Cryptosporidium parvum
NECNSNDNNSMKNDDSNKPPI

SEQ ID NO: 2270694 - protein, 5 aa, Cryptosporidium parvum
NECTN

SEQ ID NO: 2270695 - protein, 5 aa, Cryptosporidium parvum
NEDAA

SEQ ID NO: 2270696 - protein, 7 aa, Cryptosporidium parvum
NEDAEGC

SEQ ID NO: 2270697 - protein, 19 aa, Cryptosporidium parvum
NEDCQQSQENQAQPGPSPA

SEQ ID NO: 2270698 - protein, 11 aa, Cryptosporidium parvum
NEDDEKNDLNP

SEQ ID NO: 2270699 - protein, 6 aa, Cryptosporidium parvum
NEDDRT

SEQ ID NO: 2270700 - protein, 10 aa, Cryptosporidium parvum
NEDEDLNEKN

SEQ ID NO: 2270701 - protein, 4 aa, Cryptosporidium parvum
NEDF

SEQ ID NO: 2270702 - protein, 30 aa, Cryptosporidium parvum
NEDGKCKPTKRRKTSKSKICNDNNDNENKI

SEQ ID NO: 2270703 - protein, 8 aa, Cryptosporidium parvum
NEDGTAVP

SEQ ID NO: 2270704 - protein, 7 aa, Cryptosporidium parvum
NEDIERN

SEQ ID NO: 2270705 - protein, 10 aa, Cryptosporidium parvum
NEDIKTESID

SEQ ID NO: 2270706 - protein, 10 aa, Cryptosporidium parvum
NEDKNGASEY

SEQ ID NO: 2270707 - protein, 14 aa, Cryptosporidium parvum
NEDKYQTVNSERDE

SEQ ID NO: 2270708 - protein, 16 aa, Cryptosporidium parvum
NEDLSTSAQTVPPQPT

SEQ ID NO: 2270709 - protein, 9 aa, Cryptosporidium parvum
NEDNDENPC

SEQ ID NO: 2270710 - protein, 8 aa, Cryptosporidium parvum
NEDNRNNF

SEQ ID NO: 2270711 - protein, 12 aa, Cryptosporidium parvum
NEDNSDVQSEIS

SEQ ID NO: 2270712 - protein, 16 aa, Cryptosporidium parvum
NEDNTEELRSNQIPPN

SEQ ID NO: 2270713 - protein, 6 aa, Cryptosporidium parvum
NEDPKE

SEQ ID NO: 2270714 - protein, 6 aa, Cryptosporidium parvum
NEDQIP

SEQ ID NO: 2270715 - protein, 13 aa, Cryptosporidium parvum
NEDRNYDQSRNNC

SEQ ID NO: 2270716 - protein, 5 aa, Cryptosporidium parvum
NEDSI

SEQ ID NO: 2270717 - protein, 18 aa, Cryptosporidium parvum
NEDSLKEAYKSFNKKSID

SEQ ID NO: 2270718 - protein, 7 aa, Cryptosporidium parvum
NEDSNIV

SEQ ID NO: 2270719 - protein, 11 aa, Cryptosporidium parvum
NEDTATEENPC

SEQ ID NO: 2270720 - protein, 10 aa, Cryptosporidium parvum
NEDTSDSGNV

SEQ ID NO: 2270721 - protein, 168 aa, Cryptosporidium parvum
NEDVAKNSNSNNKKGGQDENNQEDKKKKKKKKNKKKKKKHIDNEDENDEDEDGNKDDDEDNDDEDDDNEDGENEDGDDDDDDDDDEDDDDDDEEDGQVKDYKSKSKIAKHGKNKQDPEQHSDSDANSKSESGTDSDSDSDSDSDSDSDSKNKNREENEYDDDDDYCEE

SEQ ID NO: 2270722 - protein, 4 aa, Cryptosporidium parvum
NEDY

SEQ ID NO: 2270723 - protein, 21 aa, Cryptosporidium parvum
NEDYKRKYDERKRKEALSKAK

SEQ ID NO: 2270724 - protein, 6 aa, Cryptosporidium parvum
NEEAVN

SEQ ID NO: 2270725 - protein, 7 aa, Cryptosporidium parvum
NEEDEIN

SEQ ID NO: 2270726 - protein, 7 aa, Cryptosporidium parvum
NEEDLQT

SEQ ID NO: 2270727 - protein, 5 aa, Cryptosporidium parvum
NEEDS

SEQ ID NO: 2270728 - protein, 6 aa, Cryptosporidium parvum
NEEDTP

SEQ ID NO: 2270729 - protein, 21 aa, Cryptosporidium parvum
NEEEAARAKDALDGKEYQDAS

SEQ ID NO: 2270730 - protein, 8 aa, Cryptosporidium parvum
NEEELKEK

SEQ ID NO: 2270731 - protein, 13 aa, Cryptosporidium parvum
NEEERSKGKTVEV

SEQ ID NO: 2270732 - protein, 10 aa, Cryptosporidium parvum
NEEETKAVKC

SEQ ID NO: 2270733 - protein, 16 aa, Cryptosporidium parvum
NEEEVENNDCKASTSM

SEQ ID NO: 2270734 - protein, 6 aa, Cryptosporidium parvum
NEEGIP

SEQ ID NO: 2270735 - protein, 4 aa, Cryptosporidium parvum
NEEI

SEQ ID NO: 2270736 - protein, 10 aa, Cryptosporidium parvum
NEEISSNREG

SEQ ID NO: 2270737 - protein, 11 aa, Cryptosporidium parvum
NEEKLQRQIKR

SEQ ID NO: 2270738 - protein, 6 aa, Cryptosporidium parvum
NEEKNE

SEQ ID NO: 2270739 - protein, 6 aa, Cryptosporidium parvum
NEEKSF

SEQ ID NO: 2270740 - protein, 4 aa, Cryptosporidium parvum
NEEL

SEQ ID NO: 2270741 - protein, 16 aa, Cryptosporidium parvum
NEENEANNTNKVNQRY

SEQ ID NO: 2270742 - protein, 8 aa, Cryptosporidium parvum
NEENEDAD

SEQ ID NO: 2270743 - protein, 5 aa, Cryptosporidium parvum
NEENG

SEQ ID NO: 2270744 - protein, 14 aa, Cryptosporidium parvum
NEENKKRDEIEKTL

SEQ ID NO: 2270745 - protein, 7 aa, Cryptosporidium parvum
NEENNEI

SEQ ID NO: 2270746 - protein, 8 aa, Cryptosporidium parvum
NEENNTVK

SEQ ID NO: 2270747 - protein, 9 aa, Cryptosporidium parvum
NEEQITPEE

SEQ ID NO: 2270748 - protein, 12 aa, Cryptosporidium parvum
NEEQNDKDNVFK

SEQ ID NO: 2270749 - protein, 13 aa, Cryptosporidium parvum
NEEQSMATNVDHE

SEQ ID NO: 2270750 - protein, 11 aa, Cryptosporidium parvum
NEERKCPSANT

SEQ ID NO: 2270751 - protein, 11 aa, Cryptosporidium parvum
NEESENEEFDN

SEQ ID NO: 2270752 - protein, 5 aa, Cryptosporidium parvum
NEESF

SEQ ID NO: 2270753 - protein, 7 aa, Cryptosporidium parvum
NEESGLE

SEQ ID NO: 2270754 - protein, 9 aa, Cryptosporidium parvum
NEESRKLYD

SEQ ID NO: 2270755 - protein, 54 aa, Cryptosporidium parvum
NEESSNERSNSGSSNTSEDELDRNESKHSSDNENNEEKKLVGNSDKNNEVKEEV

SEQ ID NO: 2270756 - protein, 6 aa, Cryptosporidium parvum
NEESVL

SEQ ID NO: 2270757 - protein, 8 aa, Cryptosporidium parvum
NEETRQGL

SEQ ID NO: 2270758 - protein, 11 aa, Cryptosporidium parvum
NEETSNSLSNF

SEQ ID NO: 2270759 - protein, 9 aa, Cryptosporidium parvum
NEEVDSNSS

SEQ ID NO: 2270760 - protein, 7 aa, Cryptosporidium parvum
NEEVSPE

SEQ ID NO: 2270761 - protein, 5 aa, Cryptosporidium parvum
NEEYA

SEQ ID NO: 2270762 - protein, 16 aa, Cryptosporidium parvum
NEEYNDELTEEKDQEL

SEQ ID NO: 2270763 - protein, 6 aa, Cryptosporidium parvum
NEEYSD

SEQ ID NO: 2270764 - protein, 6 aa, Cryptosporidium parvum
NEFEGG

SEQ ID NO: 2270765 - protein, 5 aa, Cryptosporidium parvum
NEFEK

SEQ ID NO: 2270766 - protein, 6 aa, Cryptosporidium parvum
NEFKSL

SEQ ID NO: 2270767 - protein, 7 aa, Cryptosporidium parvum
NEFNSDN

SEQ ID NO: 2270768 - protein, 6 aa, Cryptosporidium parvum
NEFPQN

SEQ ID NO: 2270769 - protein, 6 aa, Cryptosporidium parvum
NEFQNR

SEQ ID NO: 2270770 - protein, 8 aa, Cryptosporidium parvum
NEFTPNMD

SEQ ID NO: 2270771 - protein, 9 aa, Cryptosporidium parvum
NEGESSIPH

SEQ ID NO: 2270772 - protein, 7 aa, Cryptosporidium parvum
NEGHRGI

SEQ ID NO: 2270773 - protein, 5 aa, Cryptosporidium parvum
NEGIS

SEQ ID NO: 2270774 - protein, 5 aa, Cryptosporidium parvum
NEGKK

SEQ ID NO: 2270775 - protein, 25 aa, Cryptosporidium parvum
NEGKNKLEVQDEDEDKKSRIDPKDL

SEQ ID NO: 2270776 - protein, 37 aa, Cryptosporidium parvum
NEGLNGGGVNNSSTGNSLSNNPSISNELKDKPQLSGL

SEQ ID NO: 2270777 - protein, 6 aa, Cryptosporidium parvum
NEGQSE

SEQ ID NO: 2270778 - protein, 6 aa, Cryptosporidium parvum
NEGSIR

SEQ ID NO: 2270779 - protein, 7 aa, Cryptosporidium parvum
NEGSPNK

SEQ ID NO: 2270780 - protein, 7 aa, Cryptosporidium parvum
NEGSRVK

SEQ ID NO: 2270781 - protein, 5 aa, Cryptosporidium parvum
NEGVE

SEQ ID NO: 2270782 - protein, 16 aa, Cryptosporidium parvum
NEGVSQKKIRPATGIP

SEQ ID NO: 2270783 - protein, 13 aa, Cryptosporidium parvum
NEHDAALGNGGLG

SEQ ID NO: 2270784 - protein, 4 aa, Cryptosporidium parvum
NEHP

SEQ ID NO: 2270785 - protein, 17 aa, Cryptosporidium parvum
NEIDGGSDLGEEGSKLS

SEQ ID NO: 2270786 - protein, 18 aa, Cryptosporidium parvum
NEIEGKVSNNNNNIKKNS

SEQ ID NO: 2270787 - protein, 6 aa, Cryptosporidium parvum
NEIESS

SEQ ID NO: 2270788 - protein, 7 aa, Cryptosporidium parvum
NEIKSDK

SEQ ID NO: 2270789 - protein, 4 aa, Cryptosporidium parvum
NEIN

SEQ ID NO: 2270790 - protein, 18 aa, Cryptosporidium parvum
NEINKTRSLSERKLSRNE

SEQ ID NO: 2270791 - protein, 14 aa, Cryptosporidium parvum
NEINPDEENNEEYK

SEQ ID NO: 2270792 - protein, 7 aa, Cryptosporidium parvum
NEINSNI

SEQ ID NO: 2270793 - protein, 4 aa, Cryptosporidium parvum
NEIP

SEQ ID NO: 2270794 - protein, 8 aa, Cryptosporidium parvum
NEIPEDAR

SEQ ID NO: 2270795 - protein, 6 aa, Cryptosporidium parvum
NEIPLN

SEQ ID NO: 2270796 - protein, 12 aa, Cryptosporidium parvum
NEIQQKNNLNDS

SEQ ID NO: 2270797 - protein, 12 aa, Cryptosporidium parvum
NEIQSGGVLQDK

SEQ ID NO: 2270798 - protein, 4 aa, Cryptosporidium parvum
NEIS

SEQ ID NO: 2270799 - protein, 12 aa, Cryptosporidium parvum
NEISDEQKQEIK

SEQ ID NO: 2270800 - protein, 8 aa, Cryptosporidium parvum
NEISGQKY

SEQ ID NO: 2270801 - protein, 13 aa, Cryptosporidium parvum
NEISKKDVEREEL

SEQ ID NO: 2270802 - protein, 11 aa, Cryptosporidium parvum
NEISQESKSEW

SEQ ID NO: 2270803 - protein, 6 aa, Cryptosporidium parvum
NEISRN

SEQ ID NO: 2270804 - protein, 6 aa, Cryptosporidium parvum
NEISSP

SEQ ID NO: 2270805 - protein, 7 aa, Cryptosporidium parvum
NEITPTN

SEQ ID NO: 2270806 - protein, 5 aa, Cryptosporidium parvum
NEITT

SEQ ID NO: 2270807 - protein, 10 aa, Cryptosporidium parvum
NEITTPNSTL

SEQ ID NO: 2270808 - protein, 18 aa, Cryptosporidium parvum
NEITTTKDQMQNHDSQNE

SEQ ID NO: 2270809 - protein, 8 aa, Cryptosporidium parvum
NEKAPLSK

SEQ ID NO: 2270810 - protein, 9 aa, Cryptosporidium parvum
NEKAPSGDF

SEQ ID NO: 2270811 - protein, 18 aa, Cryptosporidium parvum
NEKDPDNESFPKYNNHKA

SEQ ID NO: 2270812 - protein, 6 aa, Cryptosporidium parvum
NEKDPR

SEQ ID NO: 2270813 - protein, 8 aa, Cryptosporidium parvum
NEKEHENH

SEQ ID NO: 2270814 - protein, 6 aa, Cryptosporidium parvum
NEKELT

SEQ ID NO: 2270815 - protein, 13 aa, Cryptosporidium parvum
NEKESFYKKQQEL

SEQ ID NO: 2270816 - protein, 5 aa, Cryptosporidium parvum
NEKFE

SEQ ID NO: 2270817 - protein, 4 aa, Cryptosporidium parvum
NEKH

SEQ ID NO: 2270818 - protein, 14 aa, Cryptosporidium parvum
NEKHYDSKPDSNAF

SEQ ID NO: 2270819 - protein, 11 aa, Cryptosporidium parvum
NEKKKEDNEVD

SEQ ID NO: 2270820 - protein, 8 aa, Cryptosporidium parvum
NEKKNGLK

SEQ ID NO: 2270821 - protein, 7 aa, Cryptosporidium parvum
NEKKVPN

SEQ ID NO: 2270822 - protein, 5 aa, Cryptosporidium parvum
NEKLE

SEQ ID NO: 2270823 - protein, 6 aa, Cryptosporidium parvum
NEKLEE

SEQ ID NO: 2270824 - protein, 4 aa, Cryptosporidium parvum
NEKN

SEQ ID NO: 2270825 - protein, 10 aa, Cryptosporidium parvum
NEKNESKDKL

SEQ ID NO: 2270826 - protein, 16 aa, Cryptosporidium parvum
NEKNIPSNSKSSISQN

SEQ ID NO: 2270827 - protein, 5 aa, Cryptosporidium parvum
NEKNL

SEQ ID NO: 2270828 - protein, 5 aa, Cryptosporidium parvum
NEKNN

SEQ ID NO: 2270829 - protein, 6 aa, Cryptosporidium parvum
NEKNPG

SEQ ID NO: 2270830 - protein, 5 aa, Cryptosporidium parvum
NEKNQ

SEQ ID NO: 2270831 - protein, 10 aa, Cryptosporidium parvum
NEKNQEARER

SEQ ID NO: 2270832 - protein, 9 aa, Cryptosporidium parvum
NEKNTSNCS

SEQ ID NO: 2270833 - protein, 6 aa, Cryptosporidium parvum
NEKNYN

SEQ ID NO: 2270834 - protein, 7 aa, Cryptosporidium parvum
NEKRDTL

SEQ ID NO: 2270835 - protein, 7 aa, Cryptosporidium parvum
NEKRGKR

SEQ ID NO: 2270836 - protein, 8 aa, Cryptosporidium parvum
NEKSEEEY

SEQ ID NO: 2270837 - protein, 6 aa, Cryptosporidium parvum
NEKSGL

SEQ ID NO: 2270838 - protein, 11 aa, Cryptosporidium parvum
NEKSKEGREMK

SEQ ID NO: 2270839 - protein, 10 aa, Cryptosporidium parvum
NEKSKTKIDN

SEQ ID NO: 2270840 - protein, 11 aa, Cryptosporidium parvum
NEKSPKSKSLE

SEQ ID NO: 2270841 - protein, 24 aa, Cryptosporidium parvum
NEKSRQSNDISANGSDNSSSNSMI

SEQ ID NO: 2270842 - protein, 4 aa, Cryptosporidium parvum
NEKT

SEQ ID NO: 2270843 - protein, 11 aa, Cryptosporidium parvum
NEKTETEKRDE

SEQ ID NO: 2270844 - protein, 6 aa, Cryptosporidium parvum
NEKTIR

SEQ ID NO: 2270845 - protein, 11 aa, Cryptosporidium parvum
NEKTKAEVESL

SEQ ID NO: 2270846 - protein, 6 aa, Cryptosporidium parvum
NEKYEG

SEQ ID NO: 2270847 - protein, 5 aa, Cryptosporidium parvum
NEKYK

SEQ ID NO: 2270848 - protein, 5 aa, Cryptosporidium parvum
NEKYY

SEQ ID NO: 2270849 - protein, 4 aa, Cryptosporidium parvum
NELD

SEQ ID NO: 2270850 - protein, 9 aa, Cryptosporidium parvum
NELDEEKDN

SEQ ID NO: 2270851 - protein, 15 aa, Cryptosporidium parvum
NELDGDNTGSKYAGA

SEQ ID NO: 2270852 - protein, 11 aa, Cryptosporidium parvum
NELDKPSESVS

SEQ ID NO: 2270853 - protein, 8 aa, Cryptosporidium parvum
NELDSRNF

SEQ ID NO: 2270854 - protein, 31 aa, Cryptosporidium parvum
NELESDKEETLTTKVKDTKNNITDNQNPQCN

SEQ ID NO: 2270855 - protein, 12 aa, Cryptosporidium parvum
NELESEKVNRNE

SEQ ID NO: 2270856 - protein, 6 aa, Cryptosporidium parvum
NELKGL

SEQ ID NO: 2270857 - protein, 11 aa, Cryptosporidium parvum
NELKPSGAYGE

SEQ ID NO: 2270858 - protein, 36 aa, Cryptosporidium parvum
NELKRSNESNINRTVQTDEKFNGNISRPGEKTNGVT

SEQ ID NO: 2270859 - protein, 7 aa, Cryptosporidium parvum
NELNDGK

SEQ ID NO: 2270860 - protein, 8 aa, Cryptosporidium parvum
NELNNKTS

SEQ ID NO: 2270861 - protein, 8 aa, Cryptosporidium parvum
NELNNSEI

SEQ ID NO: 2270862 - protein, 6 aa, Cryptosporidium parvum
NELPNR

SEQ ID NO: 2270863 - protein, 12 aa, Cryptosporidium parvum
NELQKQEKLHEN

SEQ ID NO: 2270864 - protein, 25 aa, Cryptosporidium parvum
NELQNAYSKGMDQSLTSKSYSFPNS

SEQ ID NO: 2270865 - protein, 19 aa, Cryptosporidium parvum
NELSNNGSISNFNGNDPMY

SEQ ID NO: 2270866 - protein, 6 aa, Cryptosporidium parvum
NELTED

SEQ ID NO: 2270867 - protein, 25 aa, Cryptosporidium parvum
NELTEEEVTEAQSNELNQEERESSI

SEQ ID NO: 2270868 - protein, 7 aa, Cryptosporidium parvum
NEMDEDP

SEQ ID NO: 2270869 - protein, 8 aa, Cryptosporidium parvum
NENASKEK

SEQ ID NO: 2270870 - protein, 9 aa, Cryptosporidium parvum
NENDKNEIS

SEQ ID NO: 2270871 - protein, 8 aa, Cryptosporidium parvum
NENDRNDL

SEQ ID NO: 2270872 - protein, 5 aa, Cryptosporidium parvum
NENDY

SEQ ID NO: 2270873 - protein, 4 aa, Cryptosporidium parvum
NENE

SEQ ID NO: 2270874 - protein, 18 aa, Cryptosporidium parvum
NENEGGDDSEGISNSLGD

SEQ ID NO: 2270875 - protein, 10 aa, Cryptosporidium parvum
NENEINQTNI

SEQ ID NO: 2270876 - protein, 6 aa, Cryptosporidium parvum
NENEKY

SEQ ID NO: 2270877 - protein, 6 aa, Cryptosporidium parvum
NENEPF

SEQ ID NO: 2270878 - protein, 5 aa, Cryptosporidium parvum
NENER

SEQ ID NO: 2270879 - protein, 16 aa, Cryptosporidium parvum
NENETSLSLKESENTF

SEQ ID NO: 2270880 - protein, 4 aa, Cryptosporidium parvum
NENG

SEQ ID NO: 2270881 - protein, 17 aa, Cryptosporidium parvum
NENGNKYQGNLPPVNET

SEQ ID NO: 2270882 - protein, 9 aa, Cryptosporidium parvum
NENGPGRSL

SEQ ID NO: 2270883 - protein, 17 aa, Cryptosporidium parvum
NENIGEKSTSNSSSSIL

SEQ ID NO: 2270884 - protein, 6 aa, Cryptosporidium parvum
NENIGS

SEQ ID NO: 2270885 - protein, 12 aa, Cryptosporidium parvum
NENIQESQIQNK

SEQ ID NO: 2270886 - protein, 8 aa, Cryptosporidium parvum
NENKANMG

SEQ ID NO: 2270887 - protein, 7 aa, Cryptosporidium parvum
NENKDSY

SEQ ID NO: 2270888 - protein, 23 aa, Cryptosporidium parvum
NENKEKDKNIDKISREKTDVEEK

SEQ ID NO: 2270889 - protein, 6 aa, Cryptosporidium parvum
NENKKA

SEQ ID NO: 2270890 - protein, 8 aa, Cryptosporidium parvum
NENKKKEI

SEQ ID NO: 2270891 - protein, 5 aa, Cryptosporidium parvum
NENKM

SEQ ID NO: 2270892 - protein, 8 aa, Cryptosporidium parvum
NENKRPLT

SEQ ID NO: 2270893 - protein, 5 aa, Cryptosporidium parvum
NENKY

SEQ ID NO: 2270894 - protein, 5 aa, Cryptosporidium parvum
NENLK

SEQ ID NO: 2270895 - protein, 7 aa, Cryptosporidium parvum
NENLPNI

SEQ ID NO: 2270896 - protein, 11 aa, Cryptosporidium parvum
NENLQTQEHSK

SEQ ID NO: 2270897 - protein, 18 aa, Cryptosporidium parvum
NENNDTESSDVSNNGDIS

SEQ ID NO: 2270898 - protein, 14 aa, Cryptosporidium parvum
NENNNSSNQKFQSE

SEQ ID NO: 2270899 - protein, 7 aa, Cryptosporidium parvum
NENNSQY

SEQ ID NO: 2270900 - protein, 11 aa, Cryptosporidium parvum
NENNYNRINNG

SEQ ID NO: 2270901 - protein, 8 aa, Cryptosporidium parvum
NENPTLKR

SEQ ID NO: 2270902 - protein, 13 aa, Cryptosporidium parvum
NENQIQKTPSMPT

SEQ ID NO: 2270903 - protein, 7 aa, Cryptosporidium parvum
NENRTLN

SEQ ID NO: 2270904 - protein, 4 aa, Cryptosporidium parvum
NENS

SEQ ID NO: 2270905 - protein, 14 aa, Cryptosporidium parvum
NENSGKDKSITDQD

SEQ ID NO: 2270906 - protein, 8 aa, Cryptosporidium parvum
NENSIGKK

SEQ ID NO: 2270907 - protein, 16 aa, Cryptosporidium parvum
NENSKKRQDSNDEKKE

SEQ ID NO: 2270908 - protein, 8 aa, Cryptosporidium parvum
NENSKPPI

SEQ ID NO: 2270909 - protein, 6 aa, Cryptosporidium parvum
NENSNI

SEQ ID NO: 2270910 - protein, 15 aa, Cryptosporidium parvum
NENSNIYKRKKTQCN

SEQ ID NO: 2270911 - protein, 7 aa, Cryptosporidium parvum
NENSQNQ

SEQ ID NO: 2270912 - protein, 27 aa, Cryptosporidium parvum
NENSSQNSQDKYKTKIKTKTTKNYYNN

SEQ ID NO: 2270913 - protein, 5 aa, Cryptosporidium parvum
NENTA

SEQ ID NO: 2270914 - protein, 23 aa, Cryptosporidium parvum
NENTEDANDSNGNLNNTKYVSGN

SEQ ID NO: 2270915 - protein, 18 aa, Cryptosporidium parvum
NENTEKEKKVTNDKVERG

SEQ ID NO: 2270916 - protein, 21 aa, Cryptosporidium parvum
NENTKDNAMKENDNSTPKNKS

SEQ ID NO: 2270917 - protein, 12 aa, Cryptosporidium parvum
NENTPALKTEDS

SEQ ID NO: 2270918 - protein, 5 aa, Cryptosporidium parvum
NENTS

SEQ ID NO: 2270919 - protein, 5 aa, Cryptosporidium parvum
NENVQ

SEQ ID NO: 2270920 - protein, 5 aa, Cryptosporidium parvum
NENVT

SEQ ID NO: 2270921 - protein, 5 aa, Cryptosporidium parvum
NENYK

SEQ ID NO: 2270922 - protein, 5 aa, Cryptosporidium parvum
NENYR

SEQ ID NO: 2270923 - protein, 6 aa, Cryptosporidium parvum
NEPASK

SEQ ID NO: 2270924 - protein, 28 aa, Cryptosporidium parvum
NEPDTPYYYGSSSSSDYEEPNTKSKVRQ

SEQ ID NO: 2270925 - protein, 4 aa, Cryptosporidium parvum
NEPI

SEQ ID NO: 2270926 - protein, 14 aa, Cryptosporidium parvum
NEPKAEEDSKEEVK

SEQ ID NO: 2270927 - protein, 6 aa, Cryptosporidium parvum
NEPLNS

SEQ ID NO: 2270928 - protein, 6 aa, Cryptosporidium parvum
NEPNYD

SEQ ID NO: 2270929 - protein, 7 aa, Cryptosporidium parvum
NEPSHTH

SEQ ID NO: 2270930 - protein, 6 aa, Cryptosporidium parvum
NEPSSY

SEQ ID NO: 2270931 - protein, 35 aa, Cryptosporidium parvum
NEQEVSNKQHDSQEPIEASSNDQNTPTSQETPEEC

SEQ ID NO: 2270932 - protein, 7 aa, Cryptosporidium parvum
NEQGDLN

SEQ ID NO: 2270933 - protein, 7 aa, Cryptosporidium parvum
NEQIPKE

SEQ ID NO: 2270934 - protein, 5 aa, Cryptosporidium parvum
NEQIQ

SEQ ID NO: 2270935 - protein, 8 aa, Cryptosporidium parvum
NEQNEDLG

SEQ ID NO: 2270936 - protein, 10 aa, Cryptosporidium parvum
NEQNKTQGHT

SEQ ID NO: 2270937 - protein, 5 aa, Cryptosporidium parvum
NEQNN

SEQ ID NO: 2270938 - protein, 7 aa, Cryptosporidium parvum
NEQNNNK

SEQ ID NO: 2270939 - protein, 20 aa, Cryptosporidium parvum
NEQSGEIANRRRDNQEYQEK

SEQ ID NO: 2270940 - protein, 7 aa, Cryptosporidium parvum
NEQSSEE

SEQ ID NO: 2270941 - protein, 5 aa, Cryptosporidium parvum
NEQTN

SEQ ID NO: 2270942 - protein, 4 aa, Cryptosporidium parvum
NERC

SEQ ID NO: 2270943 - protein, 8 aa, Cryptosporidium parvum
NERDDTQK

SEQ ID NO: 2270944 - protein, 4 aa, Cryptosporidium parvum
NERE

SEQ ID NO: 2270945 - protein, 8 aa, Cryptosporidium parvum
NEREATEK

SEQ ID NO: 2270946 - protein, 5 aa, Cryptosporidium parvum
NEREN

SEQ ID NO: 2270947 - protein, 8 aa, Cryptosporidium parvum
NERKKKLG

SEQ ID NO: 2270948 - protein, 12 aa, Cryptosporidium parvum
NERKQDCEHGSD

SEQ ID NO: 2270949 - protein, 50 aa, Cryptosporidium parvum
NERKSTRSSMSLRSQERKGRLSTKDEGKADEHAIRRSRGRPRASDRPEVD

SEQ ID NO: 2270950 - protein, 10 aa, Cryptosporidium parvum
NERNISNLNN

SEQ ID NO: 2270951 - protein, 9 aa, Cryptosporidium parvum
NERNKDPLN

SEQ ID NO: 2270952 - protein, 17 aa, Cryptosporidium parvum
NERNNRSNNGGATLSSH

SEQ ID NO: 2270953 - protein, 9 aa, Cryptosporidium parvum
NERQKRREL

SEQ ID NO: 2270954 - protein, 14 aa, Cryptosporidium parvum
NERQSYNKLGNSIE

SEQ ID NO: 2270955 - protein, 10 aa, Cryptosporidium parvum
NERQTPDPGH

SEQ ID NO: 2270956 - protein, 15 aa, Cryptosporidium parvum
NERTKGDKEDVRSKV

SEQ ID NO: 2270957 - protein, 8 aa, Cryptosporidium parvum
NERTNKSL

SEQ ID NO: 2270958 - protein, 12 aa, Cryptosporidium parvum
NERTRIEKAGGK

SEQ ID NO: 2270959 - protein, 8 aa, Cryptosporidium parvum
NESAEYGE

SEQ ID NO: 2270960 - protein, 27 aa, Cryptosporidium parvum
NESASTSNPRKKSRKNTGKDNKVDNFD

SEQ ID NO: 2270961 - protein, 20 aa, Cryptosporidium parvum
NESCNGEPTNFRNSGNLNSM

SEQ ID NO: 2270962 - protein, 6 aa, Cryptosporidium parvum
NESDLS

SEQ ID NO: 2270963 - protein, 10 aa, Cryptosporidium parvum
NESDPNSGVE

SEQ ID NO: 2270964 - protein, 14 aa, Cryptosporidium parvum
NESDTFDGECNYDN

SEQ ID NO: 2270965 - protein, 10 aa, Cryptosporidium parvum
NESEDANLDG

SEQ ID NO: 2270966 - protein, 5 aa, Cryptosporidium parvum
NESEF

SEQ ID NO: 2270967 - protein, 6 aa, Cryptosporidium parvum
NESEIG

SEQ ID NO: 2270968 - protein, 9 aa, Cryptosporidium parvum
NESEQEELE

SEQ ID NO: 2270969 - protein, 6 aa, Cryptosporidium parvum
NESETI

SEQ ID NO: 2270970 - protein, 4 aa, Cryptosporidium parvum
NESG

SEQ ID NO: 2270971 - protein, 7 aa, Cryptosporidium parvum
NESGLKT

SEQ ID NO: 2270972 - protein, 11 aa, Cryptosporidium parvum
NESGTFPNQED

SEQ ID NO: 2270973 - protein, 19 aa, Cryptosporidium parvum
NESGVSELKDTENDQSSNR

SEQ ID NO: 2270974 - protein, 7 aa, Cryptosporidium parvum
NESGYSN

SEQ ID NO: 2270975 - protein, 4 aa, Cryptosporidium parvum
NESH

SEQ ID NO: 2270976 - protein, 4 aa, Cryptosporidium parvum
NESI

SEQ ID NO: 2270977 - protein, 7 aa, Cryptosporidium parvum
NESIETS

SEQ ID NO: 2270978 - protein, 7 aa, Cryptosporidium parvum
NESKFDR

SEQ ID NO: 2270979 - protein, 6 aa, Cryptosporidium parvum
NESKQQ

SEQ ID NO: 2270980 - protein, 19 aa, Cryptosporidium parvum
NESKRPSISSKAENLPLES

SEQ ID NO: 2270981 - protein, 11 aa, Cryptosporidium parvum
NESKSDDKEFF

SEQ ID NO: 2270982 - protein, 4 aa, Cryptosporidium parvum
NESL

SEQ ID NO: 2270983 - protein, 11 aa, Cryptosporidium parvum
NESLGNDISTQ

SEQ ID NO: 2270984 - protein, 41 aa, Cryptosporidium parvum
NESLNRKHRKGRGGKREEDVKQLEGREEEGRERGGGTSIPE

SEQ ID NO: 2270985 - protein, 7 aa, Cryptosporidium parvum
NESLQNQ

SEQ ID NO: 2270986 - protein, 5 aa, Cryptosporidium parvum
NESLY

SEQ ID NO: 2270987 - protein, 8 aa, Cryptosporidium parvum
NESMGDGG

SEQ ID NO: 2270988 - protein, 5 aa, Cryptosporidium parvum
NESNI

SEQ ID NO: 2270989 - protein, 20 aa, Cryptosporidium parvum
NESNLESSSNCKKNINSTLE

SEQ ID NO: 2270990 - protein, 11 aa, Cryptosporidium parvum
NESNNAARTPY

SEQ ID NO: 2270991 - protein, 8 aa, Cryptosporidium parvum
NESNSWSV

SEQ ID NO: 2270992 - protein, 13 aa, Cryptosporidium parvum
NESPKKGQNTNTV

SEQ ID NO: 2270993 - protein, 9 aa, Cryptosporidium parvum
NESPKSLSF

SEQ ID NO: 2270994 - protein, 8 aa, Cryptosporidium parvum
NESQEDHH

SEQ ID NO: 2270995 - protein, 17 aa, Cryptosporidium parvum
NESQEDSVNKNKKKLEY

SEQ ID NO: 2270996 - protein, 9 aa, Cryptosporidium parvum
NESQEDYKV

SEQ ID NO: 2270997 - protein, 12 aa, Cryptosporidium parvum
NESRESSSKEIS

SEQ ID NO: 2270998 - protein, 7 aa, Cryptosporidium parvum
NESRFES

SEQ ID NO: 2270999 - protein, 7 aa, Cryptosporidium parvum
NESRISE

SEQ ID NO: 2271000 - protein, 8 aa, Cryptosporidium parvum
NESSAADL

SEQ ID NO: 2271001 - protein, 5 aa, Cryptosporidium parvum
NESSD

SEQ ID NO: 2271002 - protein, 8 aa, Cryptosporidium parvum
NESSQEIK

SEQ ID NO: 2271003 - protein, 6 aa, Cryptosporidium parvum
NESTGT

SEQ ID NO: 2271004 - protein, 11 aa, Cryptosporidium parvum
NESTSNASLSR

SEQ ID NO: 2271005 - protein, 6 aa, Cryptosporidium parvum
NESWNE

SEQ ID NO: 2271006 - protein, 13 aa, Cryptosporidium parvum
NETASNSNINNIQ

SEQ ID NO: 2271007 - protein, 8 aa, Cryptosporidium parvum
NETDESEL

SEQ ID NO: 2271008 - protein, 6 aa, Cryptosporidium parvum
NETDQV

SEQ ID NO: 2271009 - protein, 12 aa, Cryptosporidium parvum
NETEINKSGANN

SEQ ID NO: 2271010 - protein, 7 aa, Cryptosporidium parvum
NETELDE

SEQ ID NO: 2271011 - protein, 12 aa, Cryptosporidium parvum
NETENCKNSPDW

SEQ ID NO: 2271012 - protein, 4 aa, Cryptosporidium parvum
NETF

SEQ ID NO: 2271013 - protein, 5 aa, Cryptosporidium parvum
NETGD

SEQ ID NO: 2271014 - protein, 11 aa, Cryptosporidium parvum
NETGGSSTGVR

SEQ ID NO: 2271015 - protein, 13 aa, Cryptosporidium parvum
NETHSNKNTKNNR

SEQ ID NO: 2271016 - protein, 4 aa, Cryptosporidium parvum
NETI

SEQ ID NO: 2271017 - protein, 12 aa, Cryptosporidium parvum
NETIDQNNQKLN

SEQ ID NO: 2271018 - protein, 10 aa, Cryptosporidium parvum
NETIEENTTN

SEQ ID NO: 2271019 - protein, 13 aa, Cryptosporidium parvum
NETKRSPESGCVS

SEQ ID NO: 2271020 - protein, 5 aa, Cryptosporidium parvum
NETLS

SEQ ID NO: 2271021 - protein, 8 aa, Cryptosporidium parvum
NETNGQFK

SEQ ID NO: 2271022 - protein, 9 aa, Cryptosporidium parvum
NETNSVEVN

SEQ ID NO: 2271023 - protein, 7 aa, Cryptosporidium parvum
NETQKTR

SEQ ID NO: 2271024 - protein, 5 aa, Cryptosporidium parvum
NETSF

SEQ ID NO: 2271025 - protein, 9 aa, Cryptosporidium parvum
NETYRRSQQ

SEQ ID NO: 2271026 - protein, 6 aa, Cryptosporidium parvum
NEVDSI

SEQ ID NO: 2271027 - protein, 5 aa, Cryptosporidium parvum
NEVEA

SEQ ID NO: 2271028 - protein, 77 aa, Cryptosporidium parvum
NEVEGENTQRRDRKESRSPSPKQSGRGGGGGGGGGGRRTGKKGQEAGANAAEPSSMGSPKPPSKYKKNNGKKQPKPK

SEQ ID NO: 2271029 - protein, 6 aa, Cryptosporidium parvum
NEVNEE

SEQ ID NO: 2271030 - protein, 45 aa, Cryptosporidium parvum
NEVNNNPSIHNKKRSSLESRSSVVKNGKESTIQNEDASKGYTSGV

SEQ ID NO: 2271031 - protein, 5 aa, Cryptosporidium parvum
NEVPG

SEQ ID NO: 2271032 - protein, 6 aa, Cryptosporidium parvum
NEVPPK

SEQ ID NO: 2271033 - protein, 4 aa, Cryptosporidium parvum
NEVS

SEQ ID NO: 2271034 - protein, 8 aa, Cryptosporidium parvum
NEVSNEGQ

SEQ ID NO: 2271035 - protein, 41 aa, Cryptosporidium parvum; identical to SEQ ID NO: 2152699

SEQ ID NO: 2271036 - protein, 4 aa, Cryptosporidium parvum
NEWK

SEQ ID NO: 2271037 - protein, 5 aa, Cryptosporidium parvum
NEWNS

SEQ ID NO: 2271038 - protein, 5 aa, Cryptosporidium parvum
NEYEK

SEQ ID NO: 2271039 - protein, 17 aa, Cryptosporidium parvum
NEYHDRGSGKKRRTFSR

SEQ ID NO: 2271040 - protein, 7 aa, Cryptosporidium parvum
NEYKSQI

SEQ ID NO: 2271041 - protein, 12 aa, Cryptosporidium parvum
NEYNQQDNKLKS

SEQ ID NO: 2271042 - protein, 5 aa, Cryptosporidium parvum
NEYTD

SEQ ID NO: 2271043 - protein, 8 aa, Cryptosporidium parvum
NEYTSSSH

SEQ ID NO: 2271044 - protein, 6 aa, Cryptosporidium parvum
NFAPQK

SEQ ID NO: 2271045 - protein, 5 aa, Cryptosporidium parvum
NFDEQ

SEQ ID NO: 2271046 - protein, 7 aa, Cryptosporidium parvum
NFDGENP

SEQ ID NO: 2271047 - protein, 19 aa, Cryptosporidium parvum
NFDKSNEVEVGNSKIQQVQ

SEQ ID NO: 2271048 - protein, 9 aa, Cryptosporidium parvum
NFDNNKDEF

SEQ ID NO: 2271049 - protein, 4 aa, Cryptosporidium parvum
NFDP

SEQ ID NO: 2271050 - protein, 6 aa, Cryptosporidium parvum
NFDPEF

SEQ ID NO: 2271051 - protein, 7 aa, Cryptosporidium parvum
NFDQSYA

SEQ ID NO: 2271052 - protein, 12 aa, Cryptosporidium parvum
NFDSEGSSIRDK

SEQ ID NO: 2271053 - protein, 12 aa, Cryptosporidium parvum
NFDSKEANNEGD

SEQ ID NO: 2271054 - protein, 12 aa, Cryptosporidium parvum
NFEDNGGTHKNS

SEQ ID NO: 2271055 - protein, 7 aa, Cryptosporidium parvum
NFEDRNK

SEQ ID NO: 2271056 - protein, 8 aa, Cryptosporidium parvum
NFEERDKQ

SEQ ID NO: 2271057 - protein, 11 aa, Cryptosporidium parvum
NFEPKKTMDAR

SEQ ID NO: 2271058 - protein, 7 aa, Cryptosporidium parvum
NFEPTSK

SEQ ID NO: 2271059 - protein, 8 aa, Cryptosporidium parvum
NFEQTRSE

SEQ ID NO: 2271060 - protein, 4 aa, Cryptosporidium parvum
NFET

SEQ ID NO: 2271061 - protein, 35 aa, Cryptosporidium parvum
NFGESSSSESDSDSESDSDSESDSSSSCNNKCGKS

SEQ ID NO: 2271062 - protein, 6 aa, Cryptosporidium parvum
NFGQRS

SEQ ID NO: 2271063 - protein, 5 aa, Cryptosporidium parvum
NFHRN

SEQ ID NO: 2271064 - protein, 10 aa, Cryptosporidium parvum
NFKQENRKTI

SEQ ID NO: 2271065 - protein, 10 aa, Cryptosporidium parvum
NFKSSSPITH

SEQ ID NO: 2271066 - protein, 5 aa, Cryptosporidium parvum
NFKTN

SEQ ID NO: 2271067 - protein, 10 aa, Cryptosporidium parvum
NFNATDKNHH

SEQ ID NO: 2271068 - protein, 5 aa, Cryptosporidium parvum
NFNEA

SEQ ID NO: 2271069 - protein, 8 aa, Cryptosporidium parvum
NFNHPAKQ

SEQ ID NO: 2271070 - protein, 8 aa, Cryptosporidium parvum
NFNNKSTS

SEQ ID NO: 2271071 - protein, 7 aa, Cryptosporidium parvum
NFNNNEA

SEQ ID NO: 2271072 - protein, 13 aa, Cryptosporidium parvum
NFNNSRDSRNYGP

SEQ ID NO: 2271073 - protein, 5 aa, Cryptosporidium parvum
NFNNV

SEQ ID NO: 2271074 - protein, 7 aa, Cryptosporidium parvum
NFNPNTE

SEQ ID NO: 2271075 - protein, 11 aa, Cryptosporidium parvum
NFNSESELSPE

SEQ ID NO: 2271076 - protein, 21 aa, Cryptosporidium parvum
NFNTSNNGFKDEDADQDQDEI

SEQ ID NO: 2271077 - protein, 14 aa, Cryptosporidium parvum
NFPEEKKPESDEDI

SEQ ID NO: 2271078 - protein, 8 aa, Cryptosporidium parvum
NFPHNNES

SEQ ID NO: 2271079 - protein, 6 aa, Cryptosporidium parvum
NFPKGL

SEQ ID NO: 2271080 - protein, 4 aa, Cryptosporidium parvum
NFPN

SEQ ID NO: 2271081 - protein, 72 aa, Cryptosporidium parvum
NFPPLKSKRVKETHVTDQEKDTKHNKHLKQKKHGKNAGNLIGNESASPPNKIESASKGFSFSSQSSNQHNSL

SEQ ID NO: 2271082 - protein, 7 aa, Cryptosporidium parvum
NFQGERE

SEQ ID NO: 2271083 - protein, 10 aa, Cryptosporidium parvum
NFQNSSNYTQ

SEQ ID NO: 2271084 - protein, 6 aa, Cryptosporidium parvum
NFQNVG

SEQ ID NO: 2271085 - protein, 6 aa, Cryptosporidium parvum
NFSATG

SEQ ID NO: 2271086 - protein, 6 aa, Cryptosporidium parvum
NFSEKN

SEQ ID NO: 2271087 - protein, 6 aa, Cryptosporidium parvum
NFSENP

SEQ ID NO: 2271088 - protein, 4 aa, Cryptosporidium parvum
NFSG

SEQ ID NO: 2271089 - protein, 8 aa, Cryptosporidium parvum
NFSNKNNR

SEQ ID NO: 2271090 - protein, 11 aa, Cryptosporidium parvum
NFSNPDNQENY

SEQ ID NO: 2271091 - protein, 21 aa, Cryptosporidium parvum
NFTKPTVNSLSKKRTKSKERL

SEQ ID NO: 2271092 - protein, 11 aa, Cryptosporidium parvum
NFTPKNNNGSG

SEQ ID NO: 2271093 - protein, 13 aa, Cryptosporidium parvum
NFTSSSSSSSSYF

SEQ ID NO: 2271094 - protein, 10 aa, Cryptosporidium parvum
NFYQSDDREI

SEQ ID NO: 2271095 - protein, 15 aa, Cryptosporidium parvum
NGAAGNSGSCGRSTC

SEQ ID NO: 2271096 - protein, 25 aa, Cryptosporidium parvum
NGADPRYKNKQGLTPKDAAESQGHS

SEQ ID NO: 2271097 - protein, 12 aa, Cryptosporidium parvum
NGAEEEESNISL

SEQ ID NO: 2271098 - protein, 8 aa, Cryptosporidium parvum
NGAEKNDL

SEQ ID NO: 2271099 - protein, 14 aa, Cryptosporidium parvum
NGAERNLSHESGFG

SEQ ID NO: 2271100 - protein, 17 aa, Cryptosporidium parvum
NGAGFANANPMKGQNGN

SEQ ID NO: 2271101 - protein, 6 aa, Cryptosporidium parvum
NGAGKT

SEQ ID NO: 2271102 - protein, 9 aa, Cryptosporidium parvum
NGAHQQNDL

SEQ ID NO: 2271103 - protein, 9 aa, Cryptosporidium parvum
NGAKGYSSQ

SEQ ID NO: 2271104 - protein, 4 aa, Cryptosporidium parvum
NGAP

SEQ ID NO: 2271105 - protein, 10 aa, Cryptosporidium parvum
NGASRSTAYR

SEQ ID NO: 2271106 - protein, 8 aa, Cryptosporidium parvum
NGDDSGKV

SEQ ID NO: 2271107 - protein, 63 aa, Cryptosporidium parvum
NGDEESNSSENGNADGDKVEEVDEIKESSAKNEDSSYGRQPAENIPSTDLDENQNYSDEITPF

SEQ ID NO: 2271108 - protein, 14 aa, Cryptosporidium parvum
NGDEKSQPKGKESI

SEQ ID NO: 2271109 - protein, 8 aa, Cryptosporidium parvum
NGDERPAQ

SEQ ID NO: 2271110 - protein, 7 aa, Cryptosporidium parvum
NGDKTII

SEQ ID NO: 2271111 - protein, 10 aa, Cryptosporidium parvum
NGDQSVSRPY

SEQ ID NO: 2271112 - protein, 12 aa, Cryptosporidium parvum
NGDSITEGEDSM

SEQ ID NO: 2271113 - protein, 6 aa, Cryptosporidium parvum
NGDSNY

SEQ ID NO: 2271114 - protein, 20 aa, Cryptosporidium parvum
NGDTRDSLQESNENDEKTPT

SEQ ID NO: 2271115 - protein, 4 aa, Cryptosporidium parvum
NGDY

SEQ ID NO: 2271116 - protein, 15 aa, Cryptosporidium parvum
NGDYKDKLSKKNVKL

SEQ ID NO: 2271117 - protein, 7 aa, Cryptosporidium parvum
NGEDSNE

SEQ ID NO: 2271118 - protein, 5 aa, Cryptosporidium parvum
NGEGV

SEQ ID NO: 2271119 - protein, 10 aa, Cryptosporidium parvum
NGEITTESEV

SEQ ID NO: 2271120 - protein, 5 aa, Cryptosporidium parvum
NGEKN

SEQ ID NO: 2271121 - protein, 4 aa, Cryptosporidium parvum
NGEL

SEQ ID NO: 2271122 - protein, 7 aa, Cryptosporidium parvum
NGELADT

SEQ ID NO: 2271123 - protein, 5 aa, Cryptosporidium parvum
NGELP

SEQ ID NO: 2271124 - protein, 5 aa, Cryptosporidium parvum
NGELS

SEQ ID NO: 2271125 - protein, 5 aa, Cryptosporidium parvum
NGEND

SEQ ID NO: 2271126 - protein, 21 aa, Cryptosporidium parvum
NGENKHGNEVREKDPNAIRRE

SEQ ID NO: 2271127 - protein, 14 aa, Cryptosporidium parvum
NGENLKSKNSQNEN

SEQ ID NO: 2271128 - protein, 9 aa, Cryptosporidium parvum
NGENNSNNS

SEQ ID NO: 2271129 - protein, 7 aa, Cryptosporidium parvum
NGEPSQL

SEQ ID NO: 2271130 - protein, 8 aa, Cryptosporidium parvum
NGEQSSAV

SEQ ID NO: 2271131 - protein, 7 aa, Cryptosporidium parvum
NGERPEK

SEQ ID NO: 2271132 - protein, 11 aa, Cryptosporidium parvum
NGESHERYSEN

SEQ ID NO: 2271133 - protein, 9 aa, Cryptosporidium parvum
NGESIEKKN

SEQ ID NO: 2271134 - protein, 11 aa, Cryptosporidium parvum
NGESPTTNSPF

SEQ ID NO: 2271135 - protein, 7 aa, Cryptosporidium parvum
NGESSDL

SEQ ID NO: 2271136 - protein, 4 aa, Cryptosporidium parvum
NGET

SEQ ID NO: 2271137 - protein, 9 aa, Cryptosporidium parvum
NGETTSLPI

SEQ ID NO: 2271138 - protein, 4 aa, Cryptosporidium parvum
NGFD

SEQ ID NO: 2271139 - protein, 6 aa, Cryptosporidium parvum
NGFPGG

SEQ ID NO: 2271140 - protein, 10 aa, Cryptosporidium parvum
NGFSNQHGTH

SEQ ID NO: 2271141 - protein, 4 aa, Cryptosporidium parvum
NGFT

SEQ ID NO: 2271142 - protein, 10 aa, Cryptosporidium parvum
NGGANTNIGN

SEQ ID NO: 2271143 - protein, 7 aa, Cryptosporidium parvum
NGGAQVD

SEQ ID NO: 2271144 - protein, 18 aa, Cryptosporidium parvum
NGGESNKGSTANENINEA

SEQ ID NO: 2271145 - protein, 9 aa, Cryptosporidium parvum
NGGEYSAAS

SEQ ID NO: 2271146 - protein, 5 aa, Cryptosporidium parvum
NGGFP

SEQ ID NO: 2271147 - protein, 4 aa, Cryptosporidium parvum
NGGG

SEQ ID NO: 2271148 - protein, 5 aa, Cryptosporidium parvum
NGGGD

SEQ ID NO: 2271149 - protein, 29 aa, Cryptosporidium parvum
NGGGICGNNDKGIEGSITTSDINNTLGNS

SEQ ID NO: 2271150 - protein, 56 aa, Cryptosporidium parvum
NGGGIEGNSTTVLEGGSTCRNTTDDHSSSMTISGTNINSNSGSSSSLTTALNGGGV

SEQ ID NO: 2271151 - protein, 8 aa, Cryptosporidium parvum
NGGGSRVG

SEQ ID NO: 2271152 - protein, 5 aa, Cryptosporidium parvum
NGGIH

SEQ ID NO: 2271153 - protein, 10 aa, Cryptosporidium parvum
NGGNKSEISN

SEQ ID NO: 2271154 - protein, 37 aa, Cryptosporidium parvum
NGGNNGLIETTGTGAVQTGLNGPDGNLQGGNLTGRIQ

SEQ ID NO: 2271155 - protein, 16 aa, Cryptosporidium parvum
NGGNSTASSSYNGNNN

SEQ ID NO: 2271156 - protein, 7 aa, Cryptosporidium parvum
NGGRIGN

SEQ ID NO: 2271157 - protein, 4 aa, Cryptosporidium parvum
NGGS

SEQ ID NO: 2271158 - protein, 102 aa, Cryptosporidium parvum
NGGSGTTSAQSQGQSHVADTSSVNQQKPLETSSSNSRRSPKMSYSNAVSGGKPSGTNQGSSSISNGRKDHSRNRQRGGGYSGKSYKGSGGSSHYNNGGGSQR

SEQ ID NO: 2271159 - protein, 9 aa, Cryptosporidium parvum
NGGSQAPNM

SEQ ID NO: 2271160 - protein, 9 aa, Cryptosporidium parvum
NGGSRSQIY

SEQ ID NO: 2271161 - protein, 11 aa, Cryptosporidium parvum
NGGSSNAFTDN

SEQ ID NO: 2271162 - protein, 5 aa, Cryptosporidium parvum
NGGSV

SEQ ID NO: 2271163 - protein, 6 aa, Cryptosporidium parvum
NGGTLE

SEQ ID NO: 2271164 - protein, 11 aa, Cryptosporidium parvum
NGGVDSKFQTR

SEQ ID NO: 2271165 - protein, 9 aa, Cryptosporidium parvum
NGGVGTGGG

SEQ ID NO: 2271166 - protein, 8 aa, Cryptosporidium parvum
NGGYDSAE

SEQ ID NO: 2271167 - protein, 4 aa, Cryptosporidium parvum
NGHD

SEQ ID NO: 2271168 - protein, 7 aa, Cryptosporidium parvum
NGHSGQI

SEQ ID NO: 2271169 - protein, 5 aa, Cryptosporidium parvum
NGIEQ

SEQ ID NO: 2271170 - protein, 22 aa, Cryptosporidium parvum
NGIESRHSSHPALSNSDIGGPF

SEQ ID NO: 2271171 - protein, 21 aa, Cryptosporidium parvum
NGIGGGGLDDDCRDGLTSMQS

SEQ ID NO: 2271172 - protein, 12 aa, Cryptosporidium parvum
NGIGKLSQRGEF

SEQ ID NO: 2271173 - protein, 6 aa, Cryptosporidium parvum
NGIGKS

SEQ ID NO: 2271174 - protein, 17 aa, Cryptosporidium parvum
NGIGSFEEQKSLDTSEI

SEQ ID NO: 2271175 - protein, 7 aa, Cryptosporidium parvum
NGIGTDA

SEQ ID NO: 2271176 - protein, 4 aa, Cryptosporidium parvum
NGIN

SEQ ID NO: 2271177 - protein, 5 aa, Cryptosporidium parvum
NGINE

SEQ ID NO: 2271178 - protein, 8 aa, Cryptosporidium parvum
NGINPSNV

SEQ ID NO: 2271179 - protein, 16 aa, Cryptosporidium parvum
NGIPSSISEKNKIQDG

SEQ ID NO: 2271180 - protein, 10 aa, Cryptosporidium parvum
NGKEDAANNF

SEQ ID NO: 2271181 - protein, 6 aa, Cryptosporidium parvum
NGKFSN

SEQ ID NO: 2271182 - protein, 5 aa, Cryptosporidium parvum
NGKHS

SEQ ID NO: 2271183 - protein, 10 aa, Cryptosporidium parvum
NGKIQATGGV

SEQ ID NO: 2271184 - protein, 4 aa, Cryptosporidium parvum
NGKK

SEQ ID NO: 2271185 - protein, 13 aa, Cryptosporidium parvum
NGKNGGPAQDSVT

SEQ ID NO: 2271186 - protein, 5 aa, Cryptosporidium parvum
NGKPI

SEQ ID NO: 2271187 - protein, 6 aa, Cryptosporidium parvum
NGKPTL

SEQ ID NO: 2271188 - protein, 5 aa, Cryptosporidium parvum
NGKQG

SEQ ID NO: 2271189 - protein, 6 aa, Cryptosporidium parvum
NGKQHG

SEQ ID NO: 2271190 - protein, 8 aa, Cryptosporidium parvum
NGKQKRVK

SEQ ID NO: 2271191 - protein, 9 aa, Cryptosporidium parvum
NGKRSQIER

SEQ ID NO: 2271192 - protein, 4 aa, Cryptosporidium parvum
NGKS

SEQ ID NO: 2271193 - protein, 10 aa, Cryptosporidium parvum
NGKSEDNSKE

SEQ ID NO: 2271194 - protein, 9 aa, Cryptosporidium parvum
NGKSIENQI

SEQ ID NO: 2271195 - protein, 9 aa, Cryptosporidium parvum
NGKSKHIER

SEQ ID NO: 2271196 - protein, 9 aa, Cryptosporidium parvum
NGKVGESRK

SEQ ID NO: 2271197 - protein, 5 aa, Cryptosporidium parvum
NGKVI

SEQ ID NO: 2271198 - protein, 5 aa, Cryptosporidium parvum
NGKVS

SEQ ID NO: 2271199 - protein, 9 aa, Cryptosporidium parvum
NGKYPQEEY

SEQ ID NO: 2271200 - protein, 17 aa, Cryptosporidium parvum
NGLDSSEESIDDNEIGS

SEQ ID NO: 2271201 - protein, 6 aa, Cryptosporidium parvum
NGLHPS

SEQ ID NO: 2271202 - protein, 20 aa, Cryptosporidium parvum
NGLNSSSSSNNGITSTNSNA

SEQ ID NO: 2271203 - protein, 6 aa, Cryptosporidium parvum
NGLPEK

SEQ ID NO: 2271204 - protein, 12 aa, Cryptosporidium parvum
NGLPPITEAEGD

SEQ ID NO: 2271205 - protein, 7 aa, Cryptosporidium parvum
NGLPVPV

SEQ ID NO: 2271206 - protein, 5 aa, Cryptosporidium parvum
NGLQR

SEQ ID NO: 2271207 - protein, 11 aa, Cryptosporidium parvum
NGLTDGPGSLT

SEQ ID NO: 2271208 - protein, 11 aa, Cryptosporidium parvum
NGMNSTDIKSQ

SEQ ID NO: 2271209 - protein, 11 aa, Cryptosporidium parvum
NGMTSSNSNFE

SEQ ID NO: 2271210 - protein, 4 aa, Cryptosporidium parvum
NGNA

SEQ ID NO: 2271211 - protein, 13 aa, Cryptosporidium parvum
NGNANCSEQSKET

SEQ ID NO: 2271212 - protein, 7 aa, Cryptosporidium parvum
NGNANIS

SEQ ID NO: 2271213 - protein, 7 aa, Cryptosporidium parvum
NGNANKN

SEQ ID NO: 2271214 - protein, 44 aa, Cryptosporidium parvum
NGNCRGSSSSSSSSSTSGGNVNSNNNSNNNNASNSNNNSNNNIN

SEQ ID NO: 2271215 - protein, 10 aa, Cryptosporidium parvum
NGNDNTNESS

SEQ ID NO: 2271216 - protein, 17 aa, Cryptosporidium parvum
NGNDYSNSEDDEGPDGI

SEQ ID NO: 2271217 - protein, 4 aa, Cryptosporidium parvum
NGNE

SEQ ID NO: 2271218 - protein, 6 aa, Cryptosporidium parvum
NGNFKN

SEQ ID NO: 2271219 - protein, 4 aa, Cryptosporidium parvum
NGNH

SEQ ID NO: 2271220 - protein, 7 aa, Cryptosporidium parvum
NGNHGEI

SEQ ID NO: 2271221 - protein, 4 aa, Cryptosporidium parvum
NGNI

SEQ ID NO: 2271222 - protein, 20 aa, Cryptosporidium parvum
NGNINGNNVSTSNNNQNNLP

SEQ ID NO: 2271223 - protein, 6 aa, Cryptosporidium parvum
NGNINN

SEQ ID NO: 2271224 - protein, 14 aa, Cryptosporidium parvum
NGNISADSSRNQMS

SEQ ID NO: 2271225 - protein, 4 aa, Cryptosporidium parvum
NGNK

SEQ ID NO: 2271226 - protein, 6 aa, Cryptosporidium parvum
NGNKRL

SEQ ID NO: 2271227 - protein, 9 aa, Cryptosporidium parvum
NGNMNPKSV

SEQ ID NO: 2271228 - protein, 4 aa, Cryptosporidium parvum
NGNN

SEQ ID NO: 2271229 - protein, 5 aa, Cryptosporidium parvum
NGNPT

SEQ ID NO: 2271230 - protein, 7 aa, Cryptosporidium parvum
NGNRYEG

SEQ ID NO: 2271231 - protein, 4 aa, Cryptosporidium parvum
NGNS

SEQ ID NO: 2271232 - protein, 13 aa, Cryptosporidium parvum
NGNSGGTGNENYT

SEQ ID NO: 2271233 - protein, 8 aa, Cryptosporidium parvum
NGNSGTNI

SEQ ID NO: 2271234 - protein, 6 aa, Cryptosporidium parvum
NGNSPL

SEQ ID NO: 2271235 - protein, 8 aa, Cryptosporidium parvum
NGNTQPEI

SEQ ID NO: 2271236 - protein, 6 aa, Cryptosporidium parvum
NGNVPE

SEQ ID NO: 2271237 - protein, 7 aa, Cryptosporidium parvum
NGNVSNS

SEQ ID NO: 2271238 - protein, 13 aa, Cryptosporidium parvum
NGNVTSDLSSDDM

SEQ ID NO: 2271239 - protein, 4 aa, Cryptosporidium parvum
NGNY

SEQ ID NO: 2271240 - protein, 36 aa, Cryptosporidium parvum
NGNYDEEGDEEEDEEEEEEEDEEEDEEEENDDKNNH

SEQ ID NO: 2271241 - protein, 14 aa, Cryptosporidium parvum
NGNYEDWKIDELIL

SEQ ID NO: 2271242 - protein, 5 aa, Cryptosporidium parvum
NGPDA

SEQ ID NO: 2271243 - protein, 38 aa, Cryptosporidium parvum
NGPDGRRSNVRRASQSTEKLSNKENNIESLKDDDTLYD

SEQ ID NO: 2271244 - protein, 7 aa, Cryptosporidium parvum
NGPDGSP

SEQ ID NO: 2271245 - protein, 9 aa, Cryptosporidium parvum
NGPISGSDA

SEQ ID NO: 2271246 - protein, 6 aa, Cryptosporidium parvum
NGPNFG

SEQ ID NO: 2271247 - protein, 17 aa, Cryptosporidium parvum
NGPNSKVSKAHQGRGGR

SEQ ID NO: 2271248 - protein, 17 aa, Cryptosporidium parvum
NGPNSYRISSEELKDKE

SEQ ID NO: 2271249 - protein, 6 aa, Cryptosporidium parvum
NGPPHN

SEQ ID NO: 2271250 - protein, 5 aa, Cryptosporidium parvum
NGPSL

SEQ ID NO: 2271251 - protein, 6 aa, Cryptosporidium parvum
NGQGNI

SEQ ID NO: 2271252 - protein, 23 aa, Cryptosporidium parvum
NGQPESLDKELDGGELENDENLN

SEQ ID NO: 2271253 - protein, 13 aa, Cryptosporidium parvum
NGQTQTTTTGVTV

SEQ ID NO: 2271254 - protein, 25 aa, Cryptosporidium parvum
NGQVEPESSPIYRNPSYSKGELSNL

SEQ ID NO: 2271255 - protein, 7 aa, Cryptosporidium parvum
NGQWETK

SEQ ID NO: 2271256 - protein, 8 aa, Cryptosporidium parvum
NGRDSGKY

SEQ ID NO: 2271257 - protein, 9 aa, Cryptosporidium parvum
NGRFSQSGK

SEQ ID NO: 2271258 - protein, 8 aa, Cryptosporidium parvum
NGRFTEPV

SEQ ID NO: 2271259 - protein, 8 aa, Cryptosporidium parvum
NGRIPKPI

SEQ ID NO: 2271260 - protein, 14 aa, Cryptosporidium parvum
NGRMQAAGSGDRTA

SEQ ID NO: 2271261 - protein, 4 aa, Cryptosporidium parvum
NGRN

SEQ ID NO: 2271262 - protein, 20 aa, Cryptosporidium parvum
NGRNETGSWEDPIPSNNGVP

SEQ ID NO: 2271263 - protein, 9 aa, Cryptosporidium parvum
NGRPEKAPD

SEQ ID NO: 2271264 - protein, 73 aa, Cryptosporidium parvum
NGRQGGLTSSKSVRFEDSRGISTSSTSLGKNSSVISASSELTNESSFGSIRNDNNNTTSVSVPSTMNNNQTNS

SEQ ID NO: 2271265 - protein, 6 aa, Cryptosporidium parvum
NGRRKE

SEQ ID NO: 2271266 - protein, 7 aa, Cryptosporidium parvum
NGRSTQV

SEQ ID NO: 2271267 - protein, 7 aa, Cryptosporidium parvum
NGRTGVR

SEQ ID NO: 2271268 - protein, 5 aa, Cryptosporidium parvum
NGRTN

SEQ ID NO: 2271269 - protein, 8 aa, Cryptosporidium parvum
NGRTQTRN

SEQ ID NO: 2271270 - protein, 14 aa, Cryptosporidium parvum
NGRYKNGMNTYGGY

SEQ ID NO: 2271271 - protein, 23 aa, Cryptosporidium parvum
NGSAPSAALQESSLNNNRKNEIS

SEQ ID NO: 2271272 - protein, 8 aa, Cryptosporidium parvum
NGSASIEL

SEQ ID NO: 2271273 - protein, 9 aa, Cryptosporidium parvum
NGSEKRNDY

SEQ ID NO: 2271274 - protein, 18 aa, Cryptosporidium parvum
NGSFATENNSEESSQALK

SEQ ID NO: 2271275 - protein, 8 aa, Cryptosporidium parvum
NGSFGSTN

SEQ ID NO: 2271276 - protein, 5 aa, Cryptosporidium parvum
NGSGM

SEQ ID NO: 2271277 - protein, 24 aa, Cryptosporidium parvum
NGSGNNMGLNSSSVNSKGVENDKI

SEQ ID NO: 2271278 - protein, 6 aa, Cryptosporidium parvum
NGSIET

SEQ ID NO: 2271279 - protein, 5 aa, Cryptosporidium parvum
NGSKK

SEQ ID NO: 2271280 - protein, 13 aa, Cryptosporidium parvum
NGSLSENGLVSSK

SEQ ID NO: 2271281 - protein, 13 aa, Cryptosporidium parvum
NGSNYSKTQSFNS

SEQ ID NO: 2271282 - protein, 21 aa, Cryptosporidium parvum
NGSPCENTVDNKKKRRIDLSK

SEQ ID NO: 2271283 - protein, 24 aa, Cryptosporidium parvum
NGSQSGGKGDSEKIINTGSTNTNS

SEQ ID NO: 2271284 - protein, 7 aa, Cryptosporidium parvum
NGSREAL

SEQ ID NO: 2271285 - protein, 15 aa, Cryptosporidium parvum
NGSSENESKPDNLSS

SEQ ID NO: 2271286 - protein, 5 aa, Cryptosporidium parvum
NGSVG

SEQ ID NO: 2271287 - protein, 7 aa, Cryptosporidium parvum
NGSVSQN

SEQ ID NO: 2271288 - protein, 5 aa, Cryptosporidium parvum
NGTAS

SEQ ID NO: 2271289 - protein, 6 aa, Cryptosporidium parvum
NGTEGF

SEQ ID NO: 2271290 - protein, 28 aa, Cryptosporidium parvum
NGTENDSSDNSNIDDVDSDISQKSEPII

SEQ ID NO: 2271291 - protein, 6 aa, Cryptosporidium parvum
NGTETI

SEQ ID NO: 2271292 - protein, 6 aa, Cryptosporidium parvum
NGTGIN

SEQ ID NO: 2271293 - protein, 14 aa, Cryptosporidium parvum
NGTNRTLKTNSSCK

SEQ ID NO: 2271294 - protein, 13 aa, Cryptosporidium parvum
NGTRAQSNSNNRP

SEQ ID NO: 2271295 - protein, 7 aa, Cryptosporidium parvum
NGTSQGK

SEQ ID NO: 2271296 - protein, 9 aa, Cryptosporidium parvum
NGTSRLPEE

SEQ ID NO: 2271297 - protein, 7 aa, Cryptosporidium parvum
NGTVSDI

SEQ ID NO: 2271298 - protein, 25 aa, Cryptosporidium parvum
NGVAGNGNNASHSKVSNRDFDHDDA

SEQ ID NO: 2271299 - protein, 7 aa, Cryptosporidium parvum
NGVENCD

SEQ ID NO: 2271300 - protein, 6 aa, Cryptosporidium parvum
NGVENL

SEQ ID NO: 2271301 - protein, 4 aa, Cryptosporidium parvum
NGVK

SEQ ID NO: 2271302 - protein, 10 aa, Cryptosporidium parvum
NGVNNSHNVS

SEQ ID NO: 2271303 - protein, 7 aa, Cryptosporidium parvum
NGVNPIN

SEQ ID NO: 2271304 - protein, 8 aa, Cryptosporidium parvum
NGVQSTNN

SEQ ID NO: 2271305 - protein, 5 aa, Cryptosporidium parvum
NGVSW

SEQ ID NO: 2271306 - protein, 9 aa, Cryptosporidium parvum
NGYEGTGRA

SEQ ID NO: 2271307 - protein, 18 aa, Cryptosporidium parvum
NGYNGEVSNSVGSQYYGG

SEQ ID NO: 2271308 - protein, 7 aa, Cryptosporidium parvum
NGYNNKD

SEQ ID NO: 2271309 - protein, 4 aa, Cryptosporidium parvum
NGYR

SEQ ID NO: 2271310 - protein, 12 aa, Cryptosporidium parvum
NGYRKPHNLATA

SEQ ID NO: 2271311 - protein, 6 aa, Cryptosporidium parvum
NGYSGA

SEQ ID NO: 2271312 - protein, 15 aa, Cryptosporidium parvum
NHAGSERYRTKNEGV

SEQ ID NO: 2271313 - protein, 13 aa, Cryptosporidium parvum
NHANDKYKQPINA

SEQ ID NO: 2271314 - protein, 12 aa, Cryptosporidium parvum
NHCTSQSQSQSH

SEQ ID NO: 2271315 - protein, 10 aa, Cryptosporidium parvum
NHDDPGEEGL

SEQ ID NO: 2271316 - protein, 7 aa, Cryptosporidium parvum
NHDGTYT

SEQ ID NO: 2271317 - protein, 9 aa, Cryptosporidium parvum
NHDINKDNN

SEQ ID NO: 2271318 - protein, 5 aa, Cryptosporidium parvum
NHDYE

SEQ ID NO: 2271319 - protein, 14 aa, Cryptosporidium parvum
NHDYTQVSGSNTLP

SEQ ID NO: 2271320 - protein, 6 aa, Cryptosporidium parvum
NHEDPV

SEQ ID NO: 2271321 - protein, 20 aa, Cryptosporidium parvum
NHEKNYSGFKEGASNNGKGF

SEQ ID NO: 2271322 - protein, 5 aa, Cryptosporidium parvum
NHETP

SEQ ID NO: 2271323 - protein, 5 aa, Cryptosporidium parvum
NHFAK

SEQ ID NO: 2271324 - protein, 7 aa, Cryptosporidium parvum
NHFPEEG

SEQ ID NO: 2271325 - protein, 7 aa, Cryptosporidium parvum
NHGKEEM

SEQ ID NO: 2271326 - protein, 9 aa, Cryptosporidium parvum
NHGNAKELD

SEQ ID NO: 2271327 - protein, 10 aa, Cryptosporidium parvum
NHGSSSDENL

SEQ ID NO: 2271328 - protein, 4 aa, Cryptosporidium parvum
NHGT

SEQ ID NO: 2271329 - protein, 7 aa, Cryptosporidium parvum
NHGYSPY

SEQ ID NO: 2271330 - protein, 7 aa, Cryptosporidium parvum
NHHENKL

SEQ ID NO: 2271331 - protein, 4 aa, Cryptosporidium parvum
NHHF

SEQ ID NO: 2271332 - protein, 5 aa, Cryptosporidium parvum
NHHHE

SEQ ID NO: 2271333 - protein, 11 aa, Cryptosporidium parvum
NHHHNSNDSLY

SEQ ID NO: 2271334 - protein, 11 aa, Cryptosporidium parvum
NHHNDSISEFN

SEQ ID NO: 2271335 - protein, 26 aa, Cryptosporidium parvum
NHHNSNNSSSNSAHSYSKHPSLKKRS

SEQ ID NO: 2271336 - protein, 6 aa, Cryptosporidium parvum
NHHPSH

SEQ ID NO: 2271337 - protein, 9 aa, Cryptosporidium parvum
NHHSGSPTH

SEQ ID NO: 2271338 - protein, 10 aa, Cryptosporidium parvum
NHIDNQKSNI

SEQ ID NO: 2271339 - protein, 13 aa, Cryptosporidium parvum
NHINSDNDQISES

SEQ ID NO: 2271340 - protein, 4 aa, Cryptosporidium parvum
NHKI

SEQ ID NO: 2271341 - protein, 26 aa, Cryptosporidium parvum
NHKPSSESLQDRGKENSVDGKKLDNL

SEQ ID NO: 2271342 - protein, 6 aa, Cryptosporidium parvum
NHLDSD

SEQ ID NO: 2271343 - protein, 13 aa, Cryptosporidium parvum
NHLTDSNKNAKNF

SEQ ID NO: 2271344 - protein, 5 aa, Cryptosporidium parvum
NHLYG

SEQ ID NO: 2271345 - protein, 7 aa, Cryptosporidium parvum
NHNASSQ

SEQ ID NO: 2271346 - protein, 10 aa, Cryptosporidium parvum
NHNDKNNQDL

SEQ ID NO: 2271347 - protein, 6 aa, Cryptosporidium parvum
NHNDTG

SEQ ID NO: 2271348 - protein, 12 aa, Cryptosporidium parvum
NHNGSPTDDRTI

SEQ ID NO: 2271349 - protein, 10 aa, Cryptosporidium parvum
NHNHNNPNIG

SEQ ID NO: 2271350 - protein, 29 aa, Cryptosporidium parvum
NHNHRNSHPHNHQSPSNSPNRIKNDKASY

SEQ ID NO: 2271351 - protein, 6 aa, Cryptosporidium parvum
NHNKNQ

SEQ ID NO: 2271352 - protein, 10 aa, Cryptosporidium parvum
NHNNNDNNIA

SEQ ID NO: 2271353 - protein, 10 aa, Cryptosporidium parvum
NHNPSENNAY

SEQ ID NO: 2271354 - protein, 5 aa, Cryptosporidium parvum
NHNSE

SEQ ID NO: 2271355 - protein, 9 aa, Cryptosporidium parvum
NHNSERPKF

SEQ ID NO: 2271356 - protein, 16 aa, Cryptosporidium parvum
NHNSNSNFKPNNSLDG

SEQ ID NO: 2271357 - protein, 34 aa, Cryptosporidium parvum; identical to SEQ ID NO: 2152983

SEQ ID NO: 2271358 - protein, 13 aa, Cryptosporidium parvum
NHNTSSKNSIRQN

SEQ ID NO: 2271359 - protein, 30 aa, Cryptosporidium parvum; identical to SEQ ID NO: 2152984

SEQ ID NO: 2271360 - protein, 8 aa, Cryptosporidium parvum
NHPDDNID

SEQ ID NO: 2271361 - protein, 5 aa, Cryptosporidium parvum
NHPHS

SEQ ID NO: 2271362 - protein, 5 aa, Cryptosporidium parvum
NHPQQ

SEQ ID NO: 2271363 - protein, 5 aa, Cryptosporidium parvum
NHPSH

SEQ ID NO: 2271364 - protein, 12 aa, Cryptosporidium parvum
NHPTNNDQLNNP

SEQ ID NO: 2271365 - protein, 4 aa, Cryptosporidium parvum
NHQD

SEQ ID NO: 2271366 - protein, 6 aa, Cryptosporidium parvum
NHQGNE

SEQ ID NO: 2271367 - protein, 7 aa, Cryptosporidium parvum
NHQKGSE

SEQ ID NO: 2271368 - protein, 8 aa, Cryptosporidium parvum
NHQNKNQV

SEQ ID NO: 2271369 - protein, 20 aa, Cryptosporidium parvum
NHREKDFQSKSDSTQNEDNM

SEQ ID NO: 2271370 - protein, 8 aa, Cryptosporidium parvum
NHRISNKT

SEQ ID NO: 2271371 - protein, 9 aa, Cryptosporidium parvum
NHSDGKQAT

SEQ ID NO: 2271372 - protein, 11 aa, Cryptosporidium parvum
NHSIKEGITEY

SEQ ID NO: 2271373 - protein, 5 aa, Cryptosporidium parvum
NHSKS

SEQ ID NO: 2271374 - protein, 33 aa, Cryptosporidium parvum
NHSNNNSSSINNNQSKSSNNNKSSHKTNRSSSI

SEQ ID NO: 2271375 - protein, 10 aa, Cryptosporidium parvum
NHSNPDDKQT

SEQ ID NO: 2271376 - protein, 10 aa, Cryptosporidium parvum
NHSNYSGNEF

SEQ ID NO: 2271377 - protein, 5 aa, Cryptosporidium parvum
NHSRG

SEQ ID NO: 2271378 - protein, 7 aa, Cryptosporidium parvum
NHSSTGY

SEQ ID NO: 2271379 - protein, 22 aa, Cryptosporidium parvum
NHSSTNKKRSKDHTENSEYSEN

SEQ ID NO: 2271380 - protein, 7 aa, Cryptosporidium parvum
NHTDRVN

SEQ ID NO: 2271381 - protein, 14 aa, Cryptosporidium parvum
NHTEENNNTSISVT

SEQ ID NO: 2271382 - protein, 8 aa, Cryptosporidium parvum
NHTKKKPL

SEQ ID NO: 2271383 - protein, 10 aa, Cryptosporidium parvum
NHTTGGSNKH

SEQ ID NO: 2271384 - protein, 32 aa, Cryptosporidium parvum
NHTTSNNNDNNNNNNSKGSYSYTSSYEEETDL

SEQ ID NO: 2271385 - protein, 11 aa, Cryptosporidium parvum
NHYNEGENKLA

SEQ ID NO: 2271386 - protein, 6 aa, Cryptosporidium parvum
NIAEGS

SEQ ID NO: 2271387 - protein, 14 aa, Cryptosporidium parvum
NIAGSSNSVPGSNN

SEQ ID NO: 2271388 - protein, 14 aa, Cryptosporidium parvum
NIAKKDAEKASKGL

SEQ ID NO: 2271389 - protein, 19 aa, Cryptosporidium parvum
NIANTKSNLSRESSNVNSV

SEQ ID NO: 2271390 - protein, 9 aa, Cryptosporidium parvum
NICDQTKEE

SEQ ID NO: 2271391 - protein, 6 aa, Cryptosporidium parvum
NIDDDQ

SEQ ID NO: 2271392 - protein, 23 aa, Cryptosporidium parvum
NIDDTKTYLSNDEKFKPPNLSDN

SEQ ID NO: 2271393 - protein, 15 aa, Cryptosporidium parvum
NIDGSNNNSSSSSSL

SEQ ID NO: 2271394 - protein, 48 aa, Cryptosporidium parvum
NIDNESELSDESLSEFGQTSKMQKTRERSNRSKGGKSRSQSQKSEDLD

SEQ ID NO: 2271395 - protein, 31 aa, Cryptosporidium parvum
NIDNETIENNLKESGSSNFENQIKPSNSTVA

SEQ ID NO: 2271396 - protein, 9 aa, Cryptosporidium parvum
NIDNKEDTV

SEQ ID NO: 2271397 - protein, 10 aa, Cryptosporidium parvum
NIDNTGQNNI

SEQ ID NO: 2271398 - protein, 14 aa, Cryptosporidium parvum
NIDPSNLNQKQLNN

SEQ ID NO: 2271399 - protein, 5 aa, Cryptosporidium parvum
NIDQR

SEQ ID NO: 2271400 - protein, 13 aa, Cryptosporidium parvum
NIEAGNKSAPITI

SEQ ID NO: 2271401 - protein, 10 aa, Cryptosporidium parvum
NIEDDKMSRN

SEQ ID NO: 2271402 - protein, 7 aa, Cryptosporidium parvum
NIEESCN

SEQ ID NO: 2271403 - protein, 13 aa, Cryptosporidium parvum
NIEFDSKEQINRR

SEQ ID NO: 2271404 - protein, 6 aa, Cryptosporidium parvum
NIEGDG

SEQ ID NO: 2271405 - protein, 11 aa, Cryptosporidium parvum
NIEGGSIGARG

SEQ ID NO: 2271406 - protein, 4 aa, Cryptosporidium parvum
NIEK

SEQ ID NO: 2271407 - protein, 39 aa, Cryptosporidium parvum
NIEKEKNNRRSLSADNIKKDESNQTFTTPLRSKQSKCEA

SEQ ID NO: 2271408 - protein, 15 aa, Cryptosporidium parvum
NIEKHKDSGELNGAS

SEQ ID NO: 2271409 - protein, 29 aa, Cryptosporidium parvum
NIEKNKVKSIKDNSNINKMEQNKENMNSY

SEQ ID NO: 2271410 - protein, 5 aa, Cryptosporidium parvum
NIEKY

SEQ ID NO: 2271411 - protein, 7 aa, Cryptosporidium parvum
NIENGEY

SEQ ID NO: 2271412 - protein, 17 aa, Cryptosporidium parvum
NIENKIKKNDEISNVPE

SEQ ID NO: 2271413 - protein, 5 aa, Cryptosporidium parvum
NIENS

SEQ ID NO: 2271414 - protein, 7 aa, Cryptosporidium parvum
NIENTER

SEQ ID NO: 2271415 - protein, 13 aa, Cryptosporidium parvum
NIENTNANDTENI

SEQ ID NO: 2271416 - protein, 4 aa, Cryptosporidium parvum
NIEP

SEQ ID NO: 2271417 - protein, 9 aa, Cryptosporidium parvum
NIEQQQTSR

SEQ ID NO: 2271418 - protein, 4 aa, Cryptosporidium parvum
NIER

SEQ ID NO: 2271419 - protein, 6 aa, Cryptosporidium parvum
NIESHS

SEQ ID NO: 2271420 - protein, 9 aa, Cryptosporidium parvum
NIESNPNIT

SEQ ID NO: 2271421 - protein, 5 aa, Cryptosporidium parvum
NIGEK

SEQ ID NO: 2271422 - protein, 10 aa, Cryptosporidium parvum
NIGGGTGQDI

SEQ ID NO: 2271423 - protein, 11 aa, Cryptosporidium parvum
NIGGNKAEYEE

SEQ ID NO: 2271424 - protein, 8 aa, Cryptosporidium parvum
NIGNNEAK

SEQ ID NO: 2271425 - protein, 58 aa, Cryptosporidium parvum
NIGNQEMYTNGSGHHGGGISTVSSSLEGLNSTGTVIGTGTSIARSGTISGSVAGTGNV

SEQ ID NO: 2271426 - protein, 6 aa, Cryptosporidium parvum
NIGQPS

SEQ ID NO: 2271427 - protein, 12 aa, Cryptosporidium parvum
NIGRNSKSSYDG

SEQ ID NO: 2271428 - protein, 37 aa, Cryptosporidium parvum
NIGSKNMSSTSSSSSYDESHNSVNDRHIEGGDNGNSK

SEQ ID NO: 2271429 - protein, 10 aa, Cryptosporidium parvum
NIGSNDQLSE

SEQ ID NO: 2271430 - protein, 6 aa, Cryptosporidium parvum
NIGSNE

SEQ ID NO: 2271431 - protein, 8 aa, Cryptosporidium parvum
NIGSNSIS

SEQ ID NO: 2271432 - protein, 10 aa, Cryptosporidium parvum
NIGSNTDGVN

SEQ ID NO: 2271433 - protein, 8 aa, Cryptosporidium parvum
NIGSPLPE

SEQ ID NO: 2271434 - protein, 6 aa, Cryptosporidium parvum
NIGTQT

SEQ ID NO: 2271435 - protein, 20 aa, Cryptosporidium parvum
NIHEDIENKSNQVDFGTQQS

SEQ ID NO: 2271436 - protein, 32 aa, Cryptosporidium parvum
NIKDDKKKNNNNNNNNNNNIQQEYPPKISSNS

SEQ ID NO: 2271437 - protein, 11 aa, Cryptosporidium parvum
NIKDLQRKEDL

SEQ ID NO: 2271438 - protein, 7 aa, Cryptosporidium parvum
NIKEKGE

SEQ ID NO: 2271439 - protein, 8 aa, Cryptosporidium parvum
NIKESNPE

SEQ ID NO: 2271440 - protein, 4 aa, Cryptosporidium parvum
NIKN

SEQ ID NO: 2271441 - protein, 6 aa, Cryptosporidium parvum
NIKNEN

SEQ ID NO: 2271442 - protein, 14 aa, Cryptosporidium parvum
NIKNEQDKEKRGLI

SEQ ID NO: 2271443 - protein, 12 aa, Cryptosporidium parvum
NIKNGQTTDELR

SEQ ID NO: 2271444 - protein, 75 aa, Cryptosporidium parvum
NIKNNEHNNIQNDNNNNNNNSNINNSNNSNNGNNNISSNNINNTSDFGIPRKSSFNNGLSDQMNTNTSLNDNQNF

SEQ ID NO: 2271445 - protein, 9 aa, Cryptosporidium parvum
NIKNNNKVS

SEQ ID NO: 2271446 - protein, 12 aa, Cryptosporidium parvum
NIKNSASQRYKS

SEQ ID NO: 2271447 - protein, 7 aa, Cryptosporidium parvum
NIKPENQ

SEQ ID NO: 2271448 - protein, 7 aa, Cryptosporidium parvum
NIKPGTP

SEQ ID NO: 2271449 - protein, 7 aa, Cryptosporidium parvum
NIKPPSG

SEQ ID NO: 2271450 - protein, 6 aa, Cryptosporidium parvum
NIKPSA

SEQ ID NO: 2271451 - protein, 12 aa, Cryptosporidium parvum
NIKRQNNYEKAD

SEQ ID NO: 2271452 - protein, 14 aa, Cryptosporidium parvum
NIKSNANKNMQRDS

SEQ ID NO: 2271453 - protein, 13 aa, Cryptosporidium parvum
NIKSQEFEKETEL

SEQ ID NO: 2271454 - protein, 5 aa, Cryptosporidium parvum
NIKSS

SEQ ID NO: 2271455 - protein, 46 aa, Cryptosporidium parvum
NILGETSPEISGESKDFMSDNDKLGNSIGEKSNDFTNEVSQISDKN

SEQ ID NO: 2271456 - protein, 12 aa, Cryptosporidium parvum
NINENDGKSFIQ

SEQ ID NO: 2271457 - protein, 30 aa, Cryptosporidium parvum
NINENENEQEDQWKKNGYLKENENNTDPYP

SEQ ID NO: 2271458 - protein, 11 aa, Cryptosporidium parvum
NINETNGSQTQ

SEQ ID NO: 2271459 - protein, 12 aa, Cryptosporidium parvum
NINGSPYETAYN

SEQ ID NO: 2271460 - protein, 4 aa, Cryptosporidium parvum
NINI

SEQ ID NO: 2271461 - protein, 4 aa, Cryptosporidium parvum
NINK

SEQ ID NO: 2271462 - protein, 7 aa, Cryptosporidium parvum
NINKKGN

SEQ ID NO: 2271463 - protein, 15 aa, Cryptosporidium parvum
NINKTSNDLNQPYSS

SEQ ID NO: 2271464 - protein, 8 aa, Cryptosporidium parvum
NINKTSTA

SEQ ID NO: 2271465 - protein, 4 aa, Cryptosporidium parvum
NINN

SEQ ID NO: 2271466 - protein, 6 aa, Cryptosporidium parvum
NINNKE

SEQ ID NO: 2271467 - protein, 26 aa, Cryptosporidium parvum
NINNNNISNSGNTNNNNNNNNNTGIE

SEQ ID NO: 2271468 - protein, 22 aa, Cryptosporidium parvum
NINNNNSNSNNNNNNKKEKNVS

SEQ ID NO: 2271469 - protein, 43 aa, Cryptosporidium parvum
NINNPSGGTNGGQMSTGHQVGGHPKERPKYVTGDQQKTHNGDV

SEQ ID NO: 2271470 - protein, 16 aa, Cryptosporidium parvum
NINNTRTKVNNNSTKI

SEQ ID NO: 2271471 - protein, 13 aa, Cryptosporidium parvum
NINNTSKSSSDNL

SEQ ID NO: 2271472 - protein, 5 aa, Cryptosporidium parvum
NINPG

SEQ ID NO: 2271473 - protein, 10 aa, Cryptosporidium parvum
NINQENDFKE

SEQ ID NO: 2271474 - protein, 14 aa, Cryptosporidium parvum
NINQIGSENITGNR

SEQ ID NO: 2271475 - protein, 24 aa, Cryptosporidium parvum
NINQNNQTYEDPNKAHSQKDSFDP

SEQ ID NO: 2271476 - protein, 9 aa, Cryptosporidium parvum
NINQPENDA

SEQ ID NO: 2271477 - protein, 5 aa, Cryptosporidium parvum
NINRG

SEQ ID NO: 2271478 - protein, 6 aa, Cryptosporidium parvum
NINRNT

SEQ ID NO: 2271479 - protein, 38 aa, Cryptosporidium parvum
NINSASGITGATGTGAMAAGTTGTTGTTGTGTGIETGV

SEQ ID NO: 2271480 - protein, 25 aa, Cryptosporidium parvum
NINSQKYPENTIEDTNAHYSTNKSH

SEQ ID NO: 2271481 - protein, 12 aa, Cryptosporidium parvum
NINSSNNTGINT

SEQ ID NO: 2271482 - protein, 34 aa, Cryptosporidium parvum
  misc_feature (19)..(21): Xaa can be any naturally occurring amino acid
NINTNDQIDDDLRCISYQXXXLIFHGTQLKEQKD

SEQ ID NO: 2271483 - protein, 13 aa, Cryptosporidium parvum
NIPDEDDLADPAL

SEQ ID NO: 2271484 - protein, 6 aa, Cryptosporidium parvum
NIPDSI

SEQ ID NO: 2271485 - protein, 7 aa, Cryptosporidium parvum
NIPESSL

SEQ ID NO: 2271486 - protein, 84 aa, Cryptosporidium parvum
NIPITSNPTGTGTSTTNTTNTTTTSNNNNNNNNNNNNLTTGTINTTNTNTNTNNSNNNNNTNTNSNSANTNTGTGNTNTCNTGI

SEQ ID NO: 2271487 - protein, 4 aa, Cryptosporidium parvum
NIPK

SEQ ID NO: 2271488 - protein, 22 aa, Cryptosporidium parvum
NIPKDSNISQMPYSEDESPNNI

SEQ ID NO: 2271489 - protein, 5 aa, Cryptosporidium parvum
NIPKE

SEQ ID NO: 2271490 - protein, 7 aa, Cryptosporidium parvum
NIPKGGK

SEQ ID NO: 2271491 - protein, 7 aa, Cryptosporidium parvum
NIPNPID

SEQ ID NO: 2271492 - protein, 7 aa, Cryptosporidium parvum
NIPNSGE

SEQ ID NO: 2271493 - protein, 13 aa, Cryptosporidium parvum
NIPNSPQTTYQYQ

SEQ ID NO: 2271494 - protein, 6 aa, Cryptosporidium parvum
NIPPGI

SEQ ID NO: 2271495 - protein, 22 aa, Cryptosporidium parvum
NIPPKDPRFKTDDVTKTKGSDF

SEQ ID NO: 2271496 - protein, 6 aa, Cryptosporidium parvum
NIPPNY

SEQ ID NO: 2271497 - protein, 6 aa, Cryptosporidium parvum
NIPPPA

SEQ ID NO: 2271498 - protein, 8 aa, Cryptosporidium parvum
NIPPPPYN

SEQ ID NO: 2271499 - protein, 5 aa, Cryptosporidium parvum
NIPQN

SEQ ID NO: 2271500 - protein, 4 aa, Cryptosporidium parvum
NIPS

SEQ ID NO: 2271501 - protein, 14 aa, Cryptosporidium parvum
NIPSEGRPNFNFSP

SEQ ID NO: 2271502 - protein, 10 aa, Cryptosporidium parvum
NIPSENNSAL

SEQ ID NO: 2271503 - protein, 9 aa, Cryptosporidium parvum
NIPSETPQK

SEQ ID NO: 2271504 - protein, 8 aa, Cryptosporidium parvum
NIPSQNRL

SEQ ID NO: 2271505 - protein, 4 aa, Cryptosporidium parvum
NIPT

SEQ ID NO: 2271506 - protein, 6 aa, Cryptosporidium parvum
NIPTKN

SEQ ID NO: 2271507 - protein, 6 aa, Cryptosporidium parvum
NIPTQS

SEQ ID NO: 2271508 - protein, 5 aa, Cryptosporidium parvum
NIPTS

SEQ ID NO: 2271509 - protein, 5 aa, Cryptosporidium parvum
NIQES

SEQ ID NO: 2271510 - protein, 10 aa, Cryptosporidium parvum
NIQKDPEKEM

SEQ ID NO: 2271511 - protein, 23 aa, Cryptosporidium parvum
NIQKQQANNTPSNTSNNNEAVSS

SEQ ID NO: 2271512 - protein, 11 aa, Cryptosporidium parvum
NIQKSSSCKNK

SEQ ID NO: 2271513 - protein, 14 aa, Cryptosporidium parvum
NIQKTQDKSENPNI

SEQ ID NO: 2271514 - protein, 16 aa, Cryptosporidium parvum
NIQNEKELNSQTRRDK

SEQ ID NO: 2271515 - protein, 6 aa, Cryptosporidium parvum
NIQNSN

SEQ ID NO: 2271516 - protein, 11 aa, Cryptosporidium parvum
NIQPGSVEAEN

SEQ ID NO: 2271517 - protein, 5 aa, Cryptosporidium parvum
NIQQG

SEQ ID NO: 2271518 - protein, 9 aa, Cryptosporidium parvum
NIRKKSSDC

SEQ ID NO: 2271519 - protein, 7 aa, Cryptosporidium parvum
NIRPGND

SEQ ID NO: 2271520 - protein, 20 aa, Cryptosporidium parvum
NIRSDYDKEYDKGKVKKPLR

SEQ ID NO: 2271521 - protein, 7 aa, Cryptosporidium parvum
NIRSEKG

SEQ ID NO: 2271522 - protein, 13 aa, Cryptosporidium parvum
NISAQKATSADEL

SEQ ID NO: 2271523 - protein, 5 aa, Cryptosporidium parvum
NISDE

SEQ ID NO: 2271524 - protein, 9 aa, Cryptosporidium parvum
NISENSNTV

SEQ ID NO: 2271525 - protein, 25 aa, Cryptosporidium parvum
NISGAGEASLGIGSGNRSNNGSWNR

SEQ ID NO: 2271526 - protein, 10 aa, Cryptosporidium parvum
NISGAKAEKA

SEQ ID NO: 2271527 - protein, 48 aa, Cryptosporidium parvum
NISGDDDNNDDGNSNNDSSNNKNNNNSNNNNNNNNTNTNDNNDSQKMS

SEQ ID NO: 2271528 - protein, 8 aa, Cryptosporidium parvum
NISKESDF

SEQ ID NO: 2271529 - protein, 9 aa, Cryptosporidium parvum
NISKNGFSN

SEQ ID NO: 2271530 - protein, 19 aa, Cryptosporidium parvum
NISKNHSVNTNQALKRPTL

SEQ ID NO: 2271531 - protein, 13 aa, Cryptosporidium parvum
NISKNKEYSEEST

SEQ ID NO: 2271532 - protein, 8 aa, Cryptosporidium parvum
NISKPSDR

SEQ ID NO: 2271533 - protein, 11 aa, Cryptosporidium parvum
NISKSSEAAFS

SEQ ID NO: 2271534 - protein, 9 aa, Cryptosporidium parvum
NISKTAGGL

SEQ ID NO: 2271535 - protein, 11 aa, Cryptosporidium parvum
NISLGEGEDDL

SEQ ID NO: 2271536 - protein, 7 aa, Cryptosporidium parvum
NISNANN

SEQ ID NO: 2271537 - protein, 26 aa, Cryptosporidium parvum
NISNSNSNNVNTSSYYYNGGDNHTQI

SEQ ID NO: 2271538 - protein, 7 aa, Cryptosporidium parvum
NISNSPD

SEQ ID NO: 2271539 - protein, 25 aa, Cryptosporidium parvum
NISNSTNETLNTVSNTRRKRGTGGI

SEQ ID NO: 2271540 - protein, 8 aa, Cryptosporidium parvum
NISPKRSK

SEQ ID NO: 2271541 - protein, 8 aa, Cryptosporidium parvum
NISPSSEI

SEQ ID NO: 2271542 - protein, 33 aa, Cryptosporidium parvum
NISQNNASNSNTSTDNNTTINSNTNNSQTTPQL

SEQ ID NO: 2271543 - protein, 5 aa, Cryptosporidium parvum
NISQY

SEQ ID NO: 2271544 - protein, 35 aa, Cryptosporidium parvum
NISRSSSVSYKSKNEEDSDRNEYEFESDGEDGEEY

SEQ ID NO: 2271545 - protein, 12 aa, Cryptosporidium parvum
NISRTNNTSNYS

SEQ ID NO: 2271546 - protein, 19 aa, Cryptosporidium parvum
NISSETKQLNNLNDEQSEL

SEQ ID NO: 2271547 - protein, 8 aa, Cryptosporidium parvum
NISSGNNV

SEQ ID NO: 2271548 - protein, 10 aa, Cryptosporidium parvum
NISSKKDFGT

SEQ ID NO: 2271549 - protein, 9 aa, Cryptosporidium parvum
NISSKLNDK

SEQ ID NO: 2271550 - protein, 11 aa, Cryptosporidium parvum
NISSNESPNNF

SEQ ID NO: 2271551 - protein, 6 aa, Cryptosporidium parvum
NISSNP

SEQ ID NO: 2271552 - protein, 31 aa, Cryptosporidium parvum
NISSPTDSRESSPSDVEISTPSQPANNSSLN

SEQ ID NO: 2271553 - protein, 42 aa, Cryptosporidium parvum; identical to SEQ ID NO: 2153140

SEQ ID NO: 2271554 - protein, 5 aa, Cryptosporidium parvum
NISSR

SEQ ID NO: 2271555 - protein, 6 aa, Cryptosporidium parvum
NISSSV

SEQ ID NO: 2271556 - protein, 12 aa, Cryptosporidium parvum
NISTKASDTTIV

SEQ ID NO: 2271557 - protein, 5 aa, Cryptosporidium parvum
NISTQ

SEQ ID NO: 2271558 - protein, 6 aa, Cryptosporidium parvum
NISTRS

SEQ ID NO: 2271559 - protein, 5 aa, Cryptosporidium parvum
NISTS

SEQ ID NO: 2271560 - protein, 7 aa, Cryptosporidium parvum
NISTSEL

SEQ ID NO: 2271561 - protein, 9 aa, Cryptosporidium parvum
NISTSSNSF

SEQ ID NO: 2271562 - protein, 18 aa, Cryptosporidium parvum
NISTSSSQTQASSSAAAS

SEQ ID NO: 2271563 - protein, 12 aa, Cryptosporidium parvum
NISYDSQSLENN

SEQ ID NO: 2271564 - protein, 5 aa, Cryptosporidium parvum
NITEE

SEQ ID NO: 2271565 - protein, 10 aa, Cryptosporidium parvum
NITEKNGNKT

SEQ ID NO: 2271566 - protein, 17 aa, Cryptosporidium parvum
NITNNNSTSNVAGNINN

SEQ ID NO: 2271567 - protein, 6 aa, Cryptosporidium parvum
NITPRN

SEQ ID NO: 2271568 - protein, 5 aa, Cryptosporidium parvum
NITQE

SEQ ID NO: 2271569 - protein, 14 aa, Cryptosporidium parvum
NITQNKKPNSVTSN

SEQ ID NO: 2271570 - protein, 10 aa, Cryptosporidium parvum
NITQYGTNQF

SEQ ID NO: 2271571 - protein, 21 aa, Cryptosporidium parvum
NITSNNNNNNNNENRKTTSIS

SEQ ID NO: 2271572 - protein, 10 aa, Cryptosporidium parvum
NITTNVNYSE

SEQ ID NO: 2271573 - protein, 4 aa, Cryptosporidium parvum
NIVG

SEQ ID NO: 2271574 - protein, 12 aa, Cryptosporidium parvum
NIYGASEHSTEV

SEQ ID NO: 2271575 - protein, 4 aa, Cryptosporidium parvum
NIYY

SEQ ID NO: 2271576 - protein, 19 aa, Cryptosporidium parvum
NKAAENKQNLEKQKAANGL

SEQ ID NO: 2271577 - protein, 8 aa, Cryptosporidium parvum
NKADHSKA

SEQ ID NO: 2271578 - protein, 7 aa, Cryptosporidium parvum
NKAEGTC

SEQ ID NO: 2271579 - protein, 17 aa, Cryptosporidium parvum
NKAEKFDRTTVKGSQFQ

SEQ ID NO: 2271580 - protein, 12 aa, Cryptosporidium parvum
NKAEKSKKKCDN

SEQ ID NO: 2271581 - protein, 8 aa, Cryptosporidium parvum
NKAESSII

SEQ ID NO: 2271582 - protein, 8 aa, Cryptosporidium parvum
NKAGEATA

SEQ ID NO: 2271583 - protein, 15 aa, Cryptosporidium parvum
NKAHYSSENISIPSD

SEQ ID NO: 2271584 - protein, 46 aa, Cryptosporidium parvum
NKALPEDHNDNVSSNNGNNDNDSDNINSGNSNDHNIANSDSNINNL

SEQ ID NO: 2271585 - protein, 10 aa, Cryptosporidium parvum
NKANRDDPGA

SEQ ID NO: 2271586 - protein, 11 aa, Cryptosporidium parvum
NKANSDEKDNV

SEQ ID NO: 2271587 - protein, 9 aa, Cryptosporidium parvum
NKAQEELYQ

SEQ ID NO: 2271588 - protein, 8 aa, Cryptosporidium parvum
NKAQNINK

SEQ ID NO: 2271589 - protein, 31 aa, Cryptosporidium parvum
NKAQSSLYKSNSKGMGTTENKKNKDLSSKEC

SEQ ID NO: 2271590 - protein, 9 aa, Cryptosporidium parvum
NKASKSKKV

SEQ ID NO: 2271591 - protein, 14 aa, Cryptosporidium parvum
NKASTYNLTNSEHG

SEQ ID NO: 2271592 - protein, 8 aa, Cryptosporidium parvum
NKATGAGF

SEQ ID NO: 2271593 - protein, 11 aa, Cryptosporidium parvum
NKATNYQNSDE

SEQ ID NO: 2271594 - protein, 8 aa, Cryptosporidium parvum
NKDADGEF

SEQ ID NO: 2271595 - protein, 26 aa, Cryptosporidium parvum
NKDANTIQVTGESKLNRNKDSDTEWG

SEQ ID NO: 2271596 - protein, 9 aa, Cryptosporidium parvum
NKDDGTINL

SEQ ID NO: 2271597 - protein, 9 aa, Cryptosporidium parvum
NKDDKISED

SEQ ID NO: 2271598 - protein, 6 aa, Cryptosporidium parvum
NKDDPD

SEQ ID NO: 2271599 - protein, 7 aa, Cryptosporidium parvum
NKDEKKV

SEQ ID NO: 2271600 - protein, 5 aa, Cryptosporidium parvum
NKDEL

SEQ ID NO: 2271601 - protein, 8 aa, Cryptosporidium parvum
NKDEMNTN

SEQ ID NO: 2271602 - protein, 5 aa, Cryptosporidium parvum
NKDEN

SEQ ID NO: 2271603 - protein, 9 aa, Cryptosporidium parvum
NKDERSVQF

SEQ ID NO: 2271604 - protein, 7 aa, Cryptosporidium parvum
NKDFSKR

SEQ ID NO: 2271605 - protein, 17 aa, Cryptosporidium parvum
NKDGGFGKRYKDESHAG

SEQ ID NO: 2271606 - protein, 9 aa, Cryptosporidium parvum
NKDGKMTGE

SEQ ID NO: 2271607 - protein, 10 aa, Cryptosporidium parvum
NKDGSASNFG

SEQ ID NO: 2271608 - protein, 5 aa, Cryptosporidium parvum
NKDGV

SEQ ID NO: 2271609 - protein, 10 aa, Cryptosporidium parvum
NKDHETQTNQ

SEQ ID NO: 2271610 - protein, 7 aa, Cryptosporidium parvum
NKDKACS

SEQ ID NO: 2271611 - protein, 5 aa, Cryptosporidium parvum
NKDKC

SEQ ID NO: 2271612 - protein, 6 aa, Cryptosporidium parvum
NKDKEG

SEQ ID NO: 2271613 - protein, 8 aa, Cryptosporidium parvum
NKDLSEKY

SEQ ID NO: 2271614 - protein, 14 aa, Cryptosporidium parvum
NKDNNNNGTSFEGN

SEQ ID NO: 2271615 - protein, 9 aa, Cryptosporidium parvum
NKDNNSVAD

SEQ ID NO: 2271616 - protein, 13 aa, Cryptosporidium parvum
NKDNSDEKQKKDG

SEQ ID NO: 2271617 - protein, 31 aa, Cryptosporidium parvum
NKDPFSECKKNESKKNKSSYKIRHTKSSGSL

SEQ ID NO: 2271618 - protein, 6 aa, Cryptosporidium parvum
NKDPNL

SEQ ID NO: 2271619 - protein, 6 aa, Cryptosporidium parvum
NKDPRN

SEQ ID NO: 2271620 - protein, 6 aa, Cryptosporidium parvum
NKDPSL

SEQ ID NO: 2271621 - protein, 8 aa, Cryptosporidium parvum
NKDPTKKE

SEQ ID NO: 2271622 - protein, 8 aa, Cryptosporidium parvum
NKDQLSHY

SEQ ID NO: 2271623 - protein, 4 aa, Cryptosporidium parvum
NKDS

SEQ ID NO: 2271624 - protein, 7 aa, Cryptosporidium parvum
NKDSELN

SEQ ID NO: 2271625 - protein, 7 aa, Cryptosporidium parvum
NKDSGEL

SEQ ID NO: 2271626 - protein, 8 aa, Cryptosporidium parvum
NKDSNEGL

SEQ ID NO: 2271627 - protein, 28 aa, Cryptosporidium parvum
NKDTQITTGSENGKTVGNIASPATINGS

SEQ ID NO: 2271628 - protein, 10 aa, Cryptosporidium parvum
NKDTTQDHEE

SEQ ID NO: 2271629 - protein, 7 aa, Cryptosporidium parvum
NKDVDGA

SEQ ID NO: 2271630 - protein, 9 aa, Cryptosporidium parvum
NKDVNESIS

SEQ ID NO: 2271631 - protein, 6 aa, Cryptosporidium parvum
NKEADI

SEQ ID NO: 2271632 - protein, 4 aa, Cryptosporidium parvum
NKEC

SEQ ID NO: 2271633 - protein, 46 aa, Cryptosporidium parvum
NKEDSDTSNSELKKHESTLTINSSDSEKSFQWEGESDDLASDEDTL

SEQ ID NO: 2271634 - protein, 12 aa, Cryptosporidium parvum
NKEEEEKEEEET

SEQ ID NO: 2271635 - protein, 7 aa, Cryptosporidium parvum
NKEEIST

SEQ ID NO: 2271636 - protein, 14 aa, Cryptosporidium parvum
NKEELDKENENKRY

SEQ ID NO: 2271637 - protein, 8 aa, Cryptosporidium parvum
NKEENVDI

SEQ ID NO: 2271638 - protein, 10 aa, Cryptosporidium parvum
NKEENYKEIS

SEQ ID NO: 2271639 - protein, 9 aa, Cryptosporidium parvum
NKEESRYQV

SEQ ID NO: 2271640 - protein, 6 aa, Cryptosporidium parvum
NKEETK

SEQ ID NO: 2271641 - protein, 9 aa, Cryptosporidium parvum
NKEFSNNSE

SEQ ID NO: 2271642 - protein, 6 aa, Cryptosporidium parvum
NKEGEI

SEQ ID NO: 2271643 - protein, 15 aa, Cryptosporidium parvum
NKEGKEVEDYGYDDE

SEQ ID NO: 2271644 - protein, 7 aa, Cryptosporidium parvum
NKEGSNI

SEQ ID NO: 2271645 - protein, 18 aa, Cryptosporidium parvum
NKEGSNPKIDRPQNHSKQ

SEQ ID NO: 2271646 - protein, 8 aa, Cryptosporidium parvum
NKEGTYNH

SEQ ID NO: 2271647 - protein, 12 aa, Cryptosporidium parvum
NKEHTKNDVQEP

SEQ ID NO: 2271648 - protein, 7 aa, Cryptosporidium parvum
NKEIKNM

SEQ ID NO: 2271649 - protein, 8 aa, Cryptosporidium parvum
NKEIQNEG

SEQ ID NO: 2271650 - protein, 9 aa, Cryptosporidium parvum
NKEKEYQEK

SEQ ID NO: 2271651 - protein, 9 aa, Cryptosporidium parvum
NKEKKLDKV

SEQ ID NO: 2271652 - protein, 14 aa, Cryptosporidium parvum
NKEKNKQNKRPLSR

SEQ ID NO: 2271653 - protein, 7 aa, Cryptosporidium parvum
NKEKNLK

SEQ ID NO: 2271654 - protein, 7 aa, Cryptosporidium parvum
NKELESS

SEQ ID NO: 2271655 - protein, 17 aa, Cryptosporidium parvum
NKENDDASTISSSFSNQ

SEQ ID NO: 2271656 - protein, 22 aa, Cryptosporidium parvum
NKENDQRKIETERVKREEEIKT

SEQ ID NO: 2271657 - protein, 8 aa, Cryptosporidium parvum
NKENDSFD

SEQ ID NO: 2271658 - protein, 11 aa, Cryptosporidium parvum
NKENEEQDKEQ

SEQ ID NO: 2271659 - protein, 9 aa, Cryptosporidium parvum
NKENENNKW

SEQ ID NO: 2271660 - protein, 6 aa, Cryptosporidium parvum
NKENGH

SEQ ID NO: 2271661 - protein, 7 aa, Cryptosporidium parvum
NKENNRC

SEQ ID NO: 2271662 - protein, 16 aa, Cryptosporidium parvum
NKENSIDNINDENNRK

SEQ ID NO: 2271663 - protein, 8 aa, Cryptosporidium parvum
NKENSSDF

SEQ ID NO: 2271664 - protein, 10 aa, Cryptosporidium parvum
NKEPVQEQKK

SEQ ID NO: 2271665 - protein, 4 aa, Cryptosporidium parvum
NKER

SEQ ID NO: 2271666 - protein, 4 aa, Cryptosporidium parvum
NKES

SEQ ID NO: 2271667 - protein, 27 aa, Cryptosporidium parvum
NKESEKKTIMGEESDVQYATNESKVDD

SEQ ID NO: 2271668 - protein, 29 aa, Cryptosporidium parvum
NKESERKQLNEQVKDAQQSYQQNKEIQSK

SEQ ID NO: 2271669 - protein, 15 aa, Cryptosporidium parvum
NKESKNSNHKDFKDQ

SEQ ID NO: 2271670 - protein, 5 aa, Cryptosporidium parvum
NKESL

SEQ ID NO: 2271671 - protein, 13 aa, Cryptosporidium parvum
NKESNSSKPHPDV

SEQ ID NO: 2271672 - protein, 6 aa, Cryptosporidium parvum
NKESRW

SEQ ID NO: 2271673 - protein, 9 aa, Cryptosporidium parvum
NKESRWKNK

SEQ ID NO: 2271674 - protein, 7 aa, Cryptosporidium parvum
NKESSEI

SEQ ID NO: 2271675 - protein, 26 aa, Cryptosporidium parvum
NKETNAANKPQYNRPLPSDGRGPPRK

SEQ ID NO: 2271676 - protein, 6 aa, Cryptosporidium parvum
NKETVA

SEQ ID NO: 2271677 - protein, 6 aa, Cryptosporidium parvum
NKETVN

SEQ ID NO: 2271678 - protein, 4 aa, Cryptosporidium parvum
NKEV

SEQ ID NO: 2271679 - protein, 5 aa, Cryptosporidium parvum
NKEVD

SEQ ID NO: 2271680 - protein, 12 aa, Cryptosporidium parvum
NKEYGKDTLSKR

SEQ ID NO: 2271681 - protein, 10 aa, Cryptosporidium parvum
NKFEKEEKLD

SEQ ID NO: 2271682 - protein, 9 aa, Cryptosporidium parvum
NKFNQRETN

SEQ ID NO: 2271683 - protein, 11 aa, Cryptosporidium parvum
NKFSPSSPQQM

SEQ ID NO: 2271684 - protein, 8 aa, Cryptosporidium parvum
NKFSTSLP

SEQ ID NO: 2271685 - protein, 8 aa, Cryptosporidium parvum
NKFTPPEI

SEQ ID NO: 2271686 - protein, 8 aa, Cryptosporidium parvum
NKGDINEE

SEQ ID NO: 2271687 - protein, 7 aa, Cryptosporidium parvum
NKGDNFS

SEQ ID NO: 2271688 - protein, 8 aa, Cryptosporidium parvum
NKGDSRDV

SEQ ID NO: 2271689 - protein, 8 aa, Cryptosporidium parvum
NKGDWHET

SEQ ID NO: 2271690 - protein, 10 aa, Cryptosporidium parvum
NKGEEENQES

SEQ ID NO: 2271691 - protein, 13 aa, Cryptosporidium parvum
NKGELNIGDQNKK

SEQ ID NO: 2271692 - protein, 10 aa, Cryptosporidium parvum
NKGEYNSESS

SEQ ID NO: 2271693 - protein, 59 aa, Cryptosporidium parvum
NKGFEVKSNGTKFERETSERIGTVTQQTNNISDEKNSRSNHRKNKESISDMKGDGDLEG

SEQ ID NO: 2271694 - protein, 44 aa, Cryptosporidium parvum
NKGGAAAVSGPGSASGSYSSSSGGSSNSSSTKDKDSKANKDNTI

SEQ ID NO: 2271695 - protein, 25 aa, Cryptosporidium parvum
NKGGKINKKKSEMNYSEGRNIQRRS

SEQ ID NO: 2271696 - protein, 22 aa, Cryptosporidium parvum
NKGGTTIGNPIQDPTNNNNSLK

SEQ ID NO: 2271697 - protein, 4 aa, Cryptosporidium parvum
NKGI

SEQ ID NO: 2271698 - protein, 6 aa, Cryptosporidium parvum
NKGINI

SEQ ID NO: 2271699 - protein, 16 aa, Cryptosporidium parvum
NKGKHIHSSKEIPDGT

SEQ ID NO: 2271700 - protein, 13 aa, Cryptosporidium parvum
NKGKKSSEEISDK

SEQ ID NO: 2271701 - protein, 9 aa, Cryptosporidium parvum
NKGKNKAKR

SEQ ID NO: 2271702 - protein, 6 aa, Cryptosporidium parvum
NKGLGL

SEQ ID NO: 2271703 - protein, 12 aa, Cryptosporidium parvum
NKGLYETGKLSN

SEQ ID NO: 2271704 - protein, 4 aa, Cryptosporidium parvum
NKGM

SEQ ID NO: 2271705 - protein, 9 aa, Cryptosporidium parvum
NKGMNNENN

SEQ ID NO: 2271706 - protein, 6 aa, Cryptosporidium parvum
NKGNEI

SEQ ID NO: 2271707 - protein, 5 aa, Cryptosporidium parvum
NKGNF

SEQ ID NO: 2271708 - protein, 8 aa, Cryptosporidium parvum
NKGNKDLE

SEQ ID NO: 2271709 - protein, 16 aa, Cryptosporidium parvum
NKGNLKNKNKRKNVRI

SEQ ID NO: 2271710 - protein, 7 aa, Cryptosporidium parvum
NKGNRGP

SEQ ID NO: 2271711 - protein, 8 aa, Cryptosporidium parvum
NKGPSRTL

SEQ ID NO: 2271712 - protein, 7 aa, Cryptosporidium parvum
NKGRMSK

SEQ ID NO: 2271713 - protein, 11 aa, Cryptosporidium parvum
NKGSEGTSSFE

SEQ ID NO: 2271714 - protein, 6 aa, Cryptosporidium parvum
NKGSGV

SEQ ID NO: 2271715 - protein, 11 aa, Cryptosporidium parvum
NKGSTDNSNLG

SEQ ID NO: 2271716 - protein, 5 aa, Cryptosporidium parvum
NKGSY

SEQ ID NO: 2271717 - protein, 27 aa, Cryptosporidium parvum
NKGTETNPSNLEETNHNNSNVSVSRNS

SEQ ID NO: 2271718 - protein, 14 aa, Cryptosporidium parvum
NKGVEVKNNGIQSI

SEQ ID NO: 2271719 - protein, 9 aa, Cryptosporidium parvum
NKGVPSKAY

SEQ ID NO: 2271720 - protein, 5 aa, Cryptosporidium parvum
NKGYI

SEQ ID NO: 2271721 - protein, 7 aa, Cryptosporidium parvum
NKGYNNS

SEQ ID NO: 2271722 - protein, 16 aa, Cryptosporidium parvum
NKHDSSKKGNDPRFND

SEQ ID NO: 2271723 - protein, 7 aa, Cryptosporidium parvum
NKHGEKD

SEQ ID NO: 2271724 - protein, 6 aa, Cryptosporidium parvum
NKHGYG

SEQ ID NO: 2271725 - protein, 14 aa, Cryptosporidium parvum
NKHLSERLKDSNEQ

SEQ ID NO: 2271726 - protein, 13 aa, Cryptosporidium parvum
NKHQSNTPLSHST

SEQ ID NO: 2271727 - protein, 13 aa, Cryptosporidium parvum
NKHSKKSSNIPNT

SEQ ID NO: 2271728 - protein, 10 aa, Cryptosporidium parvum
NKHTGKSRGY

SEQ ID NO: 2271729 - protein, 21 aa, Cryptosporidium parvum
NKIASEKAERLESRRKLLSKN

SEQ ID NO: 2271730 - protein, 4 aa, Cryptosporidium parvum
NKIE

SEQ ID NO: 2271731 - protein, 6 aa, Cryptosporidium parvum
NKIEED

SEQ ID NO: 2271732 - protein, 8 aa, Cryptosporidium parvum
NKIENGGT

SEQ ID NO: 2271733 - protein, 7 aa, Cryptosporidium parvum
NKIIPDG

SEQ ID NO: 2271734 - protein, 10 aa, Cryptosporidium parvum
NKIKSASNNE

SEQ ID NO: 2271735 - protein, 9 aa, Cryptosporidium parvum
NKIKSECKD

SEQ ID NO: 2271736 - protein, 10 aa, Cryptosporidium parvum
NKINASKKNI

SEQ ID NO: 2271737 - protein, 11 aa, Cryptosporidium parvum
NKINSKTKYNR

SEQ ID NO: 2271738 - protein, 6 aa, Cryptosporidium parvum
NKIQDK

SEQ ID NO: 2271739 - protein, 20 aa, Cryptosporidium parvum
NKISNYEQGSGYPGDPKTKD

SEQ ID NO: 2271740 - protein, 6 aa, Cryptosporidium parvum
NKKCRN

SEQ ID NO: 2271741 - protein, 9 aa, Cryptosporidium parvum
NKKDIKRSQ

SEQ ID NO: 2271742 - protein, 10 aa, Cryptosporidium parvum
NKKDKREKIP

SEQ ID NO: 2271743 - protein, 7 aa, Cryptosporidium parvum
NKKDSNF

SEQ ID NO: 2271744 - protein, 11 aa, Cryptosporidium parvum
NKKDTSSTIHS

SEQ ID NO: 2271745 - protein, 7 aa, Cryptosporidium parvum
NKKDVDE

SEQ ID NO: 2271746 - protein, 18 aa, Cryptosporidium parvum
NKKEEDRIKTLEREKEIE

SEQ ID NO: 2271747 - protein, 7 aa, Cryptosporidium parvum
NKKEFSG

SEQ ID NO: 2271748 - protein, 9 aa, Cryptosporidium parvum
NKKELKNGC

SEQ ID NO: 2271749 - protein, 5 aa, Cryptosporidium parvum
NKKEN

SEQ ID NO: 2271750 - protein, 10 aa, Cryptosporidium parvum
NKKEQGGLKR

SEQ ID NO: 2271751 - protein, 15 aa, Cryptosporidium parvum
NKKERSDSNDEQCEN

SEQ ID NO: 2271752 - protein, 7 aa, Cryptosporidium parvum
NKKETFP

SEQ ID NO: 2271753 - protein, 6 aa, Cryptosporidium parvum
NKKEYV

SEQ ID NO: 2271754 - protein, 11 aa, Cryptosporidium parvum
NKKGGEPNKYS

SEQ ID NO: 2271755 - protein, 5 aa, Cryptosporidium parvum
NKKGK

SEQ ID NO: 2271756 - protein, 24 aa, Cryptosporidium parvum
NKKHEKNSKVSFSSVNQNDQDTEP

SEQ ID NO: 2271757 - protein, 7 aa, Cryptosporidium parvum
NKKHFDE

SEQ ID NO: 2271758 - protein, 7 aa, Cryptosporidium parvum
NKKHLRN

SEQ ID NO: 2271759 - protein, 8 aa, Cryptosporidium parvum
NKKIEQPE

SEQ ID NO: 2271760 - protein, 8 aa, Cryptosporidium parvum
NKKISTYS

SEQ ID NO: 2271761 - protein, 9 aa, Cryptosporidium parvum
NKKKKETGG

SEQ ID NO: 2271762 - protein, 31 aa, Cryptosporidium parvum
NKKKKKIESESKPNKKNIRNKSCDKSFNSKN

SEQ ID NO: 2271763 - protein, 14 aa, Cryptosporidium parvum
NKKKKYSKYEEEQI

SEQ ID NO: 2271764 - protein, 7 aa, Cryptosporidium parvum
NKKKRIE

SEQ ID NO: 2271765 - protein, 6 aa, Cryptosporidium parvum
NKKKSK

SEQ ID NO: 2271766 - protein, 9 aa, Cryptosporidium parvum
NKKKTESLT

SEQ ID NO: 2271767 - protein, 9 aa, Cryptosporidium parvum
NKKNDDGIR

SEQ ID NO: 2271768 - protein, 10 aa, Cryptosporidium parvum
NKKNDKNIDN

SEQ ID NO: 2271769 - protein, 6 aa, Cryptosporidium parvum
NKKNEI

SEQ ID NO: 2271770 - protein, 10 aa, Cryptosporidium parvum
NKKNSTNNEM

SEQ ID NO: 2271771 - protein, 7 aa, Cryptosporidium parvum
NKKPAEE

SEQ ID NO: 2271772 - protein, 8 aa, Cryptosporidium parvum
NKKPLENE

SEQ ID NO: 2271773 - protein, 23 aa, Cryptosporidium parvum
NKKQEKVELDEEKGKKGKGFSSK

SEQ ID NO: 2271774 - protein, 9 aa, Cryptosporidium parvum
NKKQTSEVI

SEQ ID NO: 2271775 - protein, 6 aa, Cryptosporidium parvum
NKKRIT

SEQ ID NO: 2271776 - protein, 7 aa, Cryptosporidium parvum
NKKSEEI

SEQ ID NO: 2271777 - protein, 14 aa, Cryptosporidium parvum
NKKSEQLLASPNEN

SEQ ID NO: 2271778 - protein, 11 aa, Cryptosporidium parvum
NKKSMDESENN

SEQ ID NO: 2271779 - protein, 9 aa, Cryptosporidium parvum
NKKSNLSLN

SEQ ID NO: 2271780 - protein, 11 aa, Cryptosporidium parvum
NKKSTPTKMPT

SEQ ID NO: 2271781 - protein, 13 aa, Cryptosporidium parvum
NKKTVSNGQDAGD

SEQ ID NO: 2271782 - protein, 7 aa, Cryptosporidium parvum
NKKVEEL

SEQ ID NO: 2271783 - protein, 4 aa, Cryptosporidium parvum
NKKY

SEQ ID NO: 2271784 - protein, 8 aa, Cryptosporidium parvum
NKKYASVD

SEQ ID NO: 2271785 - protein, 7 aa, Cryptosporidium parvum
NKKYKPQ

SEQ ID NO: 2271786 - protein, 13 aa, Cryptosporidium parvum
NKLEKKKNESLSA

SEQ ID NO: 2271787 - protein, 9 aa, Cryptosporidium parvum
NKLGGDEIE

SEQ ID NO: 2271788 - protein, 10 aa, Cryptosporidium parvum
NKLKKPSARA

SEQ ID NO: 2271789 - protein, 24 aa, Cryptosporidium parvum
NKLKKQRNKENRKKRKSEQVGNQY

SEQ ID NO: 2271790 - protein, 18 aa, Cryptosporidium parvum
NKLKNKGCTKEKKSNDDD

SEQ ID NO: 2271791 - protein, 4 aa, Cryptosporidium parvum
NKLN

SEQ ID NO: 2271792 - protein, 6 aa, Cryptosporidium parvum
NKLPPS

SEQ ID NO: 2271793 - protein, 8 aa, Cryptosporidium parvum
NKLSALSE

SEQ ID NO: 2271794 - protein, 5 aa, Cryptosporidium parvum
NKLSE

SEQ ID NO: 2271795 - protein, 5 aa, Cryptosporidium parvum
NKLSS

SEQ ID NO: 2271796 - protein, 8 aa, Cryptosporidium parvum
NKLTINTS

SEQ ID NO: 2271797 - protein, 44 aa, Cryptosporidium parvum; identical to SEQ ID NO: 2153326

SEQ ID NO: 2271798 - protein, 16 aa, Cryptosporidium parvum
NKMNSSKNINNQKSDE

SEQ ID NO: 2271799 - protein, 7 aa, Cryptosporidium parvum
NKNAELP

SEQ ID NO: 2271800 - protein, 11 aa, Cryptosporidium parvum
NKNDDSDDNEQ

SEQ ID NO: 2271801 - protein, 7 aa, Cryptosporidium parvum
NKNDDVS

SEQ ID NO: 2271802 - protein, 8 aa, Cryptosporidium parvum
NKNDNIPD

SEQ ID NO: 2271803 - protein, 5 aa, Cryptosporidium parvum
NKNDS

SEQ ID NO: 2271804 - protein, 11 aa, Cryptosporidium parvum
NKNDTKFDSEY

SEQ ID NO: 2271805 - protein, 10 aa, Cryptosporidium parvum
NKNENTRDGI

SEQ ID NO: 2271806 - protein, 14 aa, Cryptosporidium parvum
NKNESDNESLQQKI

SEQ ID NO: 2271807 - protein, 7 aa, Cryptosporidium parvum
NKNESKK

SEQ ID NO: 2271808 - protein, 7 aa, Cryptosporidium parvum
NKNEVSY

SEQ ID NO: 2271809 - protein, 8 aa, Cryptosporidium parvum
NKNGNEQA

SEQ ID NO: 2271810 - protein, 7 aa, Cryptosporidium parvum
NKNGNSG

SEQ ID NO: 2271811 - protein, 10 aa, Cryptosporidium parvum
NKNGRKAIYT

SEQ ID NO: 2271812 - protein, 34 aa, Cryptosporidium parvum
NKNGSNKDYQLESNTQKTSSDKSNSKLTRNDLEQ

SEQ ID NO: 2271813 - protein, 6 aa, Cryptosporidium parvum
NKNGTL

SEQ ID NO: 2271814 - protein, 9 aa, Cryptosporidium parvum
NKNGWSGRK

SEQ ID NO: 2271815 - protein, 12 aa, Cryptosporidium parvum
NKNKANNSMENR

SEQ ID NO: 2271816 - protein, 14 aa, Cryptosporidium parvum
NKNKDRIELETKDK

SEQ ID NO: 2271817 - protein, 7 aa, Cryptosporidium parvum
NKNKEIT

SEQ ID NO: 2271818 - protein, 5 aa, Cryptosporidium parvum
NKNKN

SEQ ID NO: 2271819 - protein, 10 aa, Cryptosporidium parvum
NKNKNRKNEI

SEQ ID NO: 2271820 - protein, 9 aa, Cryptosporidium parvum
NKNKQTLSK

SEQ ID NO: 2271821 - protein, 26 aa, Cryptosporidium parvum
NKNKSKGDRDSNKMEFDTDSDDDFDE

SEQ ID NO: 2271822 - protein, 10 aa, Cryptosporidium parvum
NKNKTDSEEF

SEQ ID NO: 2271823 - protein, 4 aa, Cryptosporidium parvum
NKNL

SEQ ID NO: 2271824 - protein, 21 aa, Cryptosporidium parvum
NKNLGDDEDTTVQENKDTYNE

SEQ ID NO: 2271825 - protein, 9 aa, Cryptosporidium parvum
NKNLTGTAR

SEQ ID NO: 2271826 - protein, 7 aa, Cryptosporidium parvum
NKNMEAR

SEQ ID NO: 2271827 - protein, 6 aa, Cryptosporidium parvum
NKNNGS

SEQ ID NO: 2271828 - protein, 9 aa, Cryptosporidium parvum
NKNNKNHNF

SEQ ID NO: 2271829 - protein, 13 aa, Cryptosporidium parvum
NKNNLSDSYEEIS

SEQ ID NO: 2271830 - protein, 14 aa, Cryptosporidium parvum
NKNNNNNNNIKPQN

SEQ ID NO: 2271831 - protein, 6 aa, Cryptosporidium parvum
NKNNNS

SEQ ID NO: 2271832 - protein, 11 aa, Cryptosporidium parvum
NKNNQNNSISK

SEQ ID NO: 2271833 - protein, 27 aa, Cryptosporidium parvum
NKNNRRASNQNLTNSSGKFQYNKDKNF

SEQ ID NO: 2271834 - protein, 12 aa, Cryptosporidium parvum
NKNNSGKLPNTD

SEQ ID NO: 2271835 - protein, 10 aa, Cryptosporidium parvum
NKNNSKNTKG

SEQ ID NO: 2271836 - protein, 27 aa, Cryptosporidium parvum
NKNNSLTQKSPIKQTSSPIKSVSASTI

SEQ ID NO: 2271837 - protein, 9 aa, Cryptosporidium parvum
NKNNTNTRS

SEQ ID NO: 2271838 - protein, 12 aa, Cryptosporidium parvum
NKNPELDKYDPE

SEQ ID NO: 2271839 - protein, 7 aa, Cryptosporidium parvum
NKNPNNT

SEQ ID NO: 2271840 - protein, 8 aa, Cryptosporidium parvum
NKNQNSDK

SEQ ID NO: 2271841 - protein, 9 aa, Cryptosporidium parvum
NKNQQSPYN

SEQ ID NO: 2271842 - protein, 25 aa, Cryptosporidium parvum
NKNQTYQGFNSKNNSIYRTKYDPGQ

SEQ ID NO: 2271843 - protein, 18 aa, Cryptosporidium parvum
NKNRTASKNKLRNSRSNR

SEQ ID NO: 2271844 - protein, 17 aa, Cryptosporidium parvum
NKNSANKDNASTRDPRA

SEQ ID NO: 2271845 - protein, 8 aa, Cryptosporidium parvum
NKNSDLSK

SEQ ID NO: 2271846 - protein, 16 aa, Cryptosporidium parvum
NKNSEYGNRPSHGYNY

SEQ ID NO: 2271847 - protein, 6 aa, Cryptosporidium parvum
NKNSLR

SEQ ID NO: 2271848 - protein, 23 aa, Cryptosporidium parvum
NKNSNISNKDNSQVEKNDSETEF

SEQ ID NO: 2271849 - protein, 14 aa, Cryptosporidium parvum
NKNSQDSNSSSHIN

SEQ ID NO: 2271850 - protein, 6 aa, Cryptosporidium parvum
NKNSQF

SEQ ID NO: 2271851 - protein, 15 aa, Cryptosporidium parvum
NKNSSINDTRINKAN

SEQ ID NO: 2271852 - protein, 9 aa, Cryptosporidium parvum
NKNTLSNPF

SEQ ID NO: 2271853 - protein, 23 aa, Cryptosporidium parvum
NKNTSNSASDQKQDVLSPERASA

SEQ ID NO: 2271854 - protein, 6 aa, Cryptosporidium parvum
NKNVNY

SEQ ID NO: 2271855 - protein, 6 aa, Cryptosporidium parvum
NKNVRN

SEQ ID NO: 2271856 - protein, 8 aa, Cryptosporidium parvum
NKNYDTHL

SEQ ID NO: 2271857 - protein, 10 aa, Cryptosporidium parvum
NKPDNSTIQG

SEQ ID NO: 2271858 - protein, 4 aa, Cryptosporidium parvum
NKPF

SEQ ID NO: 2271859 - protein, 13 aa, Cryptosporidium parvum
NKPFENESNNKGI

SEQ ID NO: 2271860 - protein, 18 aa, Cryptosporidium parvum
NKPGEDAQNMRGGVAGGS

SEQ ID NO: 2271861 - protein, 6 aa, Cryptosporidium parvum
NKPGVI

SEQ ID NO: 2271862 - protein, 7 aa, Cryptosporidium parvum
NKPIYSE

SEQ ID NO: 2271863 - protein, 7 aa, Cryptosporidium parvum
NKPLGGY

SEQ ID NO: 2271864 - protein, 12 aa, Cryptosporidium parvum
NKPLSDNNTFSL

SEQ ID NO: 2271865 - protein, 6 aa, Cryptosporidium parvum
NKPNIQ

SEQ ID NO: 2271866 - protein, 7 aa, Cryptosporidium parvum
NKPPESN

SEQ ID NO: 2271867 - protein, 9 aa, Cryptosporidium parvum
NKPQSNELL

SEQ ID NO: 2271868 - protein, 9 aa, Cryptosporidium parvum
NKPQSNIND

SEQ ID NO: 2271869 - protein, 4 aa, Cryptosporidium parvum
NKPS

SEQ ID NO: 2271870 - protein, 46 aa, Cryptosporidium parvum
NKPSKRRSQTQPRSGSNNEPIRENEADSVSNSELETESDSESETSS

SEQ ID NO: 2271871 - protein, 7 aa, Cryptosporidium parvum
NKPSSIN

SEQ ID NO: 2271872 - protein, 6 aa, Cryptosporidium parvum
NKPSTW

SEQ ID NO: 2271873 - protein, 13 aa, Cryptosporidium parvum
NKPTITTKSSPFE

SEQ ID NO: 2271874 - protein, 5 aa, Cryptosporidium parvum
NKPTL

SEQ ID NO: 2271875 - protein, 7 aa, Cryptosporidium parvum
NKPYTYK

SEQ ID NO: 2271876 - protein, 7 aa, Cryptosporidium parvum
NKQDELK

SEQ ID NO: 2271877 - protein, 6 aa, Cryptosporidium parvum
NKQDHT

SEQ ID NO: 2271878 - protein, 6 aa, Cryptosporidium parvum
NKQDYD

SEQ ID NO: 2271879 - protein, 10 aa, Cryptosporidium parvum
NKQGNSNIQL

SEQ ID NO: 2271880 - protein, 5 aa, Cryptosporidium parvum
NKQHN

SEQ ID NO: 2271881 - protein, 12 aa, Cryptosporidium parvum
NKQIKQSSNIVN

SEQ ID NO: 2271882 - protein, 8 aa, Cryptosporidium parvum
NKQKNDSN

SEQ ID NO: 2271883 - protein, 23 aa, Cryptosporidium parvum
NKQKQKNSFNEEKNELIKSESNI

SEQ ID NO: 2271884 - protein, 7 aa, Cryptosporidium parvum
NKQNERI

SEQ ID NO: 2271885 - protein, 28 aa, Cryptosporidium parvum
NKQNKDFSKNLKDSKALLDEKSKKLEQL

SEQ ID NO: 2271886 - protein, 19 aa, Cryptosporidium parvum
NKQNSKDHINSKDTNSTEF

SEQ ID NO: 2271887 - protein, 17 aa, Cryptosporidium parvum
NKQQESSSSDLDKDDER

SEQ ID NO: 2271888 - protein, 6 aa, Cryptosporidium parvum
NKQRDC

SEQ ID NO: 2271889 - protein, 5 aa, Cryptosporidium parvum
NKQRL

SEQ ID NO: 2271890 - protein, 26 aa, Cryptosporidium parvum
NKQSGIQSNTREHNEGGEARHGHSSG

SEQ ID NO: 2271891 - protein, 8 aa, Cryptosporidium parvum
NKQSIQDV

SEQ ID NO: 2271892 - protein, 8 aa, Cryptosporidium parvum
NKQSPPPF

SEQ ID NO: 2271893 - protein, 8 aa, Cryptosporidium parvum
NKQSQKSF

SEQ ID NO: 2271894 - protein, 26 aa, Cryptosporidium parvum
NKQSQTIGNANSNSAESNNDNSTNTI

SEQ ID NO: 2271895 - protein, 12 aa, Cryptosporidium parvum
NKQTKSIQDSER

SEQ ID NO: 2271896 - protein, 8 aa, Cryptosporidium parvum
NKQVNSCS

SEQ ID NO: 2271897 - protein, 7 aa, Cryptosporidium parvum
NKRENEI

SEQ ID NO: 2271898 - protein, 7 aa, Cryptosporidium parvum
NKRERTS

SEQ ID NO: 2271899 - protein, 15 aa, Cryptosporidium parvum
NKRFSEGSLQSIPTP

SEQ ID NO: 2271900 - protein, 12 aa, Cryptosporidium parvum
NKRGLSKTNNAI

SEQ ID NO: 2271901 - protein, 10 aa, Cryptosporidium parvum
NKRGRKGKNV

SEQ ID NO: 2271902 - protein, 8 aa, Cryptosporidium parvum
NKRISAND

SEQ ID NO: 2271903 - protein, 14 aa, Cryptosporidium parvum
NKRKNSDENPEDVN

SEQ ID NO: 2271904 - protein, 7 aa, Cryptosporidium parvum
NKRKNSL

SEQ ID NO: 2271905 - protein, 9 aa, Cryptosporidium parvum
NKRLPRRSN

SEQ ID NO: 2271906 - protein, 7 aa, Cryptosporidium parvum
NKRNSFK

SEQ ID NO: 2271907 - protein, 14 aa, Cryptosporidium parvum
NKRRNPDEHDEQTK

SEQ ID NO: 2271908 - protein, 12 aa, Cryptosporidium parvum
NKRSPSNKQDSA

SEQ ID NO: 2271909 - protein, 7 aa, Cryptosporidium parvum
NKRTSIR

SEQ ID NO: 2271910 - protein, 9 aa, Cryptosporidium parvum
NKRVEEAAC

SEQ ID NO: 2271911 - protein, 12 aa, Cryptosporidium parvum
NKSASLNGPLSG

SEQ ID NO: 2271912 - protein, 10 aa, Cryptosporidium parvum
NKSDEVKERM

SEQ ID NO: 2271913 - protein, 10 aa, Cryptosporidium parvum
NKSDSKDMIN

SEQ ID NO: 2271914 - protein, 13 aa, Cryptosporidium parvum
NKSEATQLNSSHD

SEQ ID NO: 2271915 - protein, 9 aa, Cryptosporidium parvum
NKSEENNKK

SEQ ID NO: 2271916 - protein, 11 aa, Cryptosporidium parvum
NKSEKSQRCNA

SEQ ID NO: 2271917 - protein, 5 aa, Cryptosporidium parvum
NKSEV

SEQ ID NO: 2271918 - protein, 8 aa, Cryptosporidium parvum
NKSFGGAR

SEQ ID NO: 2271919 - protein, 32 aa, Cryptosporidium parvum
NKSFTNLNGQNTSNNSQNTSNSSNNNSNCSNV

SEQ ID NO: 2271920 - protein, 13 aa, Cryptosporidium parvum
NKSGDKNKEFDGV

SEQ ID NO: 2271921 - protein, 7 aa, Cryptosporidium parvum
NKSGKIG

SEQ ID NO: 2271922 - protein, 8 aa, Cryptosporidium parvum
NKSGNITE

SEQ ID NO: 2271923 - protein, 6 aa, Cryptosporidium parvum
NKSGTR

SEQ ID NO: 2271924 - protein, 7 aa, Cryptosporidium parvum
NKSHNNH

SEQ ID NO: 2271925 - protein, 8 aa, Cryptosporidium parvum
NKSIENKN

SEQ ID NO: 2271926 - protein, 10 aa, Cryptosporidium parvum
NKSKAKTDSE

SEQ ID NO: 2271927 - protein, 10 aa, Cryptosporidium parvum
NKSKEINKNH

SEQ ID NO: 2271928 - protein, 19 aa, Cryptosporidium parvum
NKSKGERDLAQNQDQDPNL

SEQ ID NO: 2271929 - protein, 29 aa, Cryptosporidium parvum
NKSKINSNSSDNGGDHEGDNGEESSNNNI

SEQ ID NO: 2271930 - protein, 23 aa, Cryptosporidium parvum
NKSKKKSLGNESTSTLNDDIEND

SEQ ID NO: 2271931 - protein, 24 aa, Cryptosporidium parvum
NKSKLNKCQTDQIEAGNRGMGARK

SEQ ID NO: 2271932 - protein, 18 aa, Cryptosporidium parvum
NKSKRFDEEYDEKDSRNN

SEQ ID NO: 2271933 - protein, 15 aa, Cryptosporidium parvum
NKSKSLQNEIRTPQQ

SEQ ID NO: 2271934 - protein, 20 aa, Cryptosporidium parvum
NKSKTNLVPNKESHKGNEMP

SEQ ID NO: 2271935 - protein, 10 aa, Cryptosporidium parvum
NKSLEEQNTV

SEQ ID NO: 2271936 - protein, 7 aa, Cryptosporidium parvum
NKSMRSL

SEQ ID NO: 2271937 - protein, 9 aa, Cryptosporidium parvum
NKSNESEYN

SEQ ID NO: 2271938 - protein, 9 aa, Cryptosporidium parvum
NKSNINNDP

SEQ ID NO: 2271939 - protein, 9 aa, Cryptosporidium parvum
NKSNNFTAT

SEQ ID NO: 2271940 - protein, 11 aa, Cryptosporidium parvum
NKSNPNKAPLG

SEQ ID NO: 2271941 - protein, 12 aa, Cryptosporidium parvum
NKSNSRSEIKDN

SEQ ID NO: 2271942 - protein, 15 aa, Cryptosporidium parvum
NKSNSRSSAKDKGSL

SEQ ID NO: 2271943 - protein, 10 aa, Cryptosporidium parvum
NKSNYDGQMG

SEQ ID NO: 2271944 - protein, 37 aa, Cryptosporidium parvum
NKSPGLEHTNNKYSEEIGGAYSPFRKRNKNNEKYSLQ

SEQ ID NO: 2271945 - protein, 102 aa, Cryptosporidium parvum
NKSPPPQAKEGAPTEPKAEPAEAKGAPPAKGAPPAKGTPPAKGKGPPGKGKGPPGGKGPPGGKGPPGGKGPPTGKGPPKGKAGKFGGKTGSKPSGPESKTKK

SEQ ID NO: 2271946 - protein, 10 aa, Cryptosporidium parvum
NKSQEGNQFQ

SEQ ID NO: 2271947 - protein, 7 aa, Cryptosporidium parvum
NKSQLEQ

SEQ ID NO: 2271948 - protein, 6 aa, Cryptosporidium parvum
NKSQLR

SEQ ID NO: 2271949 - protein, 40 aa, Cryptosporidium parvum
NKSQNPAPSNSNVPASKETSQLKSSINSANTNSGNIPTNN

SEQ ID NO: 2271950 - protein, 11 aa, Cryptosporidium parvum
NKSQRDRQDRS

SEQ ID NO: 2271951 - protein, 4 aa, Cryptosporidium parvum
NKSR

SEQ ID NO: 2271952 - protein, 19 aa, Cryptosporidium parvum
NKSRKVNNSSKNGFESTNI

SEQ ID NO: 2271953 - protein, 12 aa, Cryptosporidium parvum
NKSSEDQTNENF

SEQ ID NO: 2271954 - protein, 28 aa, Cryptosporidium parvum
NKSSFKDPKSKSDDENHFSENDPLVPPK

SEQ ID NO: 2271955 - protein, 9 aa, Cryptosporidium parvum
NKSSGKITK

SEQ ID NO: 2271956 - protein, 30 aa, Cryptosporidium parvum
NKSSKSNIAPLSETEINKKRKQLKAAEMEE

SEQ ID NO: 2271957 - protein, 7 aa, Cryptosporidium parvum
NKSSLND

SEQ ID NO: 2271958 - protein, 6 aa, Cryptosporidium parvum
NKSSMA

SEQ ID NO: 2271959 - protein, 7 aa, Cryptosporidium parvum
NKSSNPR

SEQ ID NO: 2271960 - protein, 10 aa, Cryptosporidium parvum
NKSSQNNLKT

SEQ ID NO: 2271961 - protein, 8 aa, Cryptosporidium parvum
NKSSSEEV

SEQ ID NO: 2271962 - protein, 7 aa, Cryptosporidium parvum
NKSSSRS

SEQ ID NO: 2271963 - protein, 11 aa, Cryptosporidium parvum
NKSSSYTENSF

SEQ ID NO: 2271964 - protein, 9 aa, Cryptosporidium parvum
NKSTLRKKN

SEQ ID NO: 2271965 - protein, 16 aa, Cryptosporidium parvum
NKSYSNQFKDSLSKSV

SEQ ID NO: 2271966 - protein, 13 aa, Cryptosporidium parvum
NKTATDPNTEDDY

SEQ ID NO: 2271967 - protein, 6 aa, Cryptosporidium parvum
NKTDKS

SEQ ID NO: 2271968 - protein, 5 aa, Cryptosporidium parvum
NKTDL

SEQ ID NO: 2271969 - protein, 7 aa, Cryptosporidium parvum
NKTDTFS

SEQ ID NO: 2271970 - protein, 6 aa, Cryptosporidium parvum
NKTEET

SEQ ID NO: 2271971 - protein, 8 aa, Cryptosporidium parvum
NKTEQEGI

SEQ ID NO: 2271972 - protein, 8 aa, Cryptosporidium parvum
NKTESSEH

SEQ ID NO: 2271973 - protein, 12 aa, Cryptosporidium parvum
NKTGLVSEQTKG

SEQ ID NO: 2271974 - protein, 10 aa, Cryptosporidium parvum
NKTGTAPSTT

SEQ ID NO: 2271975 - protein, 7 aa, Cryptosporidium parvum
NKTGTKR

SEQ ID NO: 2271976 - protein, 5 aa, Cryptosporidium parvum
NKTHQ

SEQ ID NO: 2271977 - protein, 4 aa, Cryptosporidium parvum
NKTI

SEQ ID NO: 2271978 - protein, 6 aa, Cryptosporidium parvum
NKTIQN

SEQ ID NO: 2271979 - protein, 50 aa, Cryptosporidium parvum
NKTKEDESRRSTGTINDSKDGEKSTNSNSNFNTPTKYRNQYHKKQSVQKD

SEQ ID NO: 2271980 - protein, 5 aa, Cryptosporidium parvum
NKTKK

SEQ ID NO: 2271981 - protein, 7 aa, Cryptosporidium parvum
NKTKNSI

SEQ ID NO: 2271982 - protein, 12 aa, Cryptosporidium parvum
NKTLNSGYSPNY

SEQ ID NO: 2271983 - protein, 7 aa, Cryptosporidium parvum
NKTLQNT

SEQ ID NO: 2271984 - protein, 6 aa, Cryptosporidium parvum
NKTNEL

SEQ ID NO: 2271985 - protein, 7 aa, Cryptosporidium parvum
NKTNKNN

SEQ ID NO: 2271986 - protein, 12 aa, Cryptosporidium parvum
NKTNNEKTSNFD

SEQ ID NO: 2271987 - protein, 8 aa, Cryptosporidium parvum
NKTNNERN

SEQ ID NO: 2271988 - protein, 9 aa, Cryptosporidium parvum
NKTNQDNIE

SEQ ID NO: 2271989 - protein, 7 aa, Cryptosporidium parvum
NKTPKLS

SEQ ID NO: 2271990 - protein, 8 aa, Cryptosporidium parvum
NKTPRAVE

SEQ ID NO: 2271991 - protein, 7 aa, Cryptosporidium parvum
NKTPSIN

SEQ ID NO: 2271992 - protein, 8 aa, Cryptosporidium parvum
NKTQGEKA

SEQ ID NO: 2271993 - protein, 7 aa, Cryptosporidium parvum
NKTSHPM

SEQ ID NO: 2271994 - protein, 6 aa, Cryptosporidium parvum
NKTSIE

SEQ ID NO: 2271995 - protein, 9 aa, Cryptosporidium parvum
NKTSNNCSG

SEQ ID NO: 2271996 - protein, 9 aa, Cryptosporidium parvum
NKTSNQNEI

SEQ ID NO: 2271997 - protein, 7 aa, Cryptosporidium parvum
NKTSNYD

SEQ ID NO: 2271998 - protein, 11 aa, Cryptosporidium parvum
NKTTDGTKAEN

SEQ ID NO: 2271999 - protein, 7 aa, Cryptosporidium parvum
NKTTEPV

SEQ ID NO: 2272000 - protein, 27 aa, Cryptosporidium parvum
NKTTIEEGHTENGDNIEYSSNLSQHKN

SEQ ID NO: 2272001 - protein, 8 aa, Cryptosporidium parvum
NKTTKEQA

SEQ ID NO: 2272002 - protein, 17 aa, Cryptosporidium parvum
NKTTNREEDENNLQNEP

SEQ ID NO: 2272003 - protein, 7 aa, Cryptosporidium parvum
NKTTRRE

SEQ ID NO: 2272004 - protein, 29 aa, Cryptosporidium parvum
NKTTSLDDDFASTSTPSDSTNSDPEKTPY

SEQ ID NO: 2272005 - protein, 5 aa, Cryptosporidium parvum
NKTVS

SEQ ID NO: 2272006 - protein, 5 aa, Cryptosporidium parvum
NKVDE

SEQ ID NO: 2272007 - protein, 5 aa, Cryptosporidium parvum
NKVDS

SEQ ID NO: 2272008 - protein, 15 aa, Cryptosporidium parvum
NKVKNKSNSVINSTE

SEQ ID NO: 2272009 - protein, 11 aa, Cryptosporidium parvum
NKVKRAQYNSS

SEQ ID NO: 2272010 - protein, 12 aa, Cryptosporidium parvum
NKVMNSESISDA

SEQ ID NO: 2272011 - protein, 5 aa, Cryptosporidium parvum
NKVPL

SEQ ID NO: 2272012 - protein, 9 aa, Cryptosporidium parvum
NKVQTPNDS

SEQ ID NO: 2272013 - protein, 7 aa, Cryptosporidium parvum
NKVSDTF

SEQ ID NO: 2272014 - protein, 26 aa, Cryptosporidium parvum
NKVTDTMKSAQKSNERAGPMGEKDPI

SEQ ID NO: 2272015 - protein, 6 aa, Cryptosporidium parvum
NKVTEY

SEQ ID NO: 2272016 - protein, 7 aa, Cryptosporidium parvum
NKYEELG

SEQ ID NO: 2272017 - protein, 8 aa, Cryptosporidium parvum
NKYGEENA

SEQ ID NO: 2272018 - protein, 22 aa, Cryptosporidium parvum
NKYGKSVHGGNSTYGSTYSPNR

SEQ ID NO: 2272019 - protein, 5 aa, Cryptosporidium parvum
NKYIK

SEQ ID NO: 2272020 - protein, 6 aa, Cryptosporidium parvum
NKYKKI

SEQ ID NO: 2272021 - protein, 19 aa, Cryptosporidium parvum
NKYKNGPRYNIQKSDNDNF

SEQ ID NO: 2272022 - protein, 12 aa, Cryptosporidium parvum
NKYKNKKCLGTR

SEQ ID NO: 2272023 - protein, 6 aa, Cryptosporidium parvum
NKYNIS

SEQ ID NO: 2272024 - protein, 13 aa, Cryptosporidium parvum
NKYNRTGNNFSSL

SEQ ID NO: 2272025 - protein, 6 aa, Cryptosporidium parvum
NKYPAL

SEQ ID NO: 2272026 - protein, 4 aa, Cryptosporidium parvum
NKYR

SEQ ID NO: 2272027 - protein, 4 aa, Cryptosporidium parvum
NKYS

SEQ ID NO: 2272028 - protein, 9 aa, Cryptosporidium parvum
NKYSNLNNE

SEQ ID NO: 2272029 - protein, 6 aa, Cryptosporidium parvum
NLADSQ

SEQ ID NO: 2272030 - protein, 28 aa, Cryptosporidium parvum
NLANSKTNSNHINEGTNQLSSNAENKPK

SEQ ID NO: 2272031 - protein, 8 aa, Cryptosporidium parvum
NLASKKFN

SEQ ID NO: 2272032 - protein, 5 aa, Cryptosporidium parvum
NLDEE

SEQ ID NO: 2272033 - protein, 13 aa, Cryptosporidium parvum
NLDEIEDGTKIQE

SEQ ID NO: 2272034 - protein, 14 aa, Cryptosporidium parvum
NLDEKTSDSNLNEK

SEQ ID NO: 2272035 - protein, 7 aa, Cryptosporidium parvum
NLDGFQD

SEQ ID NO: 2272036 - protein, 8 aa, Cryptosporidium parvum
NLDKAAAA

SEQ ID NO: 2272037 - protein, 5 aa, Cryptosporidium parvum
NLDKG

SEQ ID NO: 2272038 - protein, 32 aa, Cryptosporidium parvum; identical to SEQ ID NO: 2153512

SEQ ID NO: 2272039 - protein, 8 aa, Cryptosporidium parvum
NLDNEGSY

SEQ ID NO: 2272040 - protein, 7 aa, Cryptosporidium parvum
NLDNGNK

SEQ ID NO: 2272041 - protein, 12 aa, Cryptosporidium parvum
NLDNNNNYTESL

SEQ ID NO: 2272042 - protein, 9 aa, Cryptosporidium parvum
NLDRPQSQN

SEQ ID NO: 2272043 - protein, 15 aa, Cryptosporidium parvum
NLDSKSKQASWRTSE

SEQ ID NO: 2272044 - protein, 9 aa, Cryptosporidium parvum
NLDSNSKDI

SEQ ID NO: 2272045 - protein, 8 aa, Cryptosporidium parvum
NLEANQSK

SEQ ID NO: 2272046 - protein, 13 aa, Cryptosporidium parvum
NLEDTSGKAVSSK

SEQ ID NO: 2272047 - protein, 11 aa, Cryptosporidium parvum
NLEEENDEEFE

SEQ ID NO: 2272048 - protein, 7 aa, Cryptosporidium parvum
NLEENSK

SEQ ID NO: 2272049 - protein, 9 aa, Cryptosporidium parvum
NLEGSKVDD

SEQ ID NO: 2272050 - protein, 6 aa, Cryptosporidium parvum
NLEKEV

SEQ ID NO: 2272051 - protein, 12 aa, Cryptosporidium parvum
NLENNINSSTSL

SEQ ID NO: 2272052 - protein, 13 aa, Cryptosporidium parvum
NLENNKEKLNEDK

SEQ ID NO: 2272053 - protein, 7 aa, Cryptosporidium parvum
NLENQNK

SEQ ID NO: 2272054 - protein, 43 aa, Cryptosporidium parvum
NLENSNIENKRIGNQSNKDDYSTDKFSDVGSEANNKVNKNTIV

SEQ ID NO: 2272055 - protein, 8 aa, Cryptosporidium parvum
NLENTDQI

SEQ ID NO: 2272056 - protein, 5 aa, Cryptosporidium parvum
NLEPE

SEQ ID NO: 2272057 - protein, 15 aa, Cryptosporidium parvum
NLEPNNKQNENDSQI

SEQ ID NO: 2272058 - protein, 8 aa, Cryptosporidium parvum
NLEPQNKL

SEQ ID NO: 2272059 - protein, 14 aa, Cryptosporidium parvum
NLESEDESSLDLDK

SEQ ID NO: 2272060 - protein, 12 aa, Cryptosporidium parvum
NLESKKYDSDEY

SEQ ID NO: 2272061 - protein, 10 aa, Cryptosporidium parvum
NLESSSNSNI

SEQ ID NO: 2272062 - protein, 9 aa, Cryptosporidium parvum
NLESYEPNK

SEQ ID NO: 2272063 - protein, 6 aa, Cryptosporidium parvum
NLETEA

SEQ ID NO: 2272064 - protein, 9 aa, Cryptosporidium parvum
NLETGSQKP

SEQ ID NO: 2272065 - protein, 5 aa, Cryptosporidium parvum
NLGEN

SEQ ID NO: 2272066 - protein, 7 aa, Cryptosporidium parvum
NLGHNKD

SEQ ID NO: 2272067 - protein, 18 aa, Cryptosporidium parvum
NLGNNIDGRTPQTTKSQV

SEQ ID NO: 2272068 - protein, 5 aa, Cryptosporidium parvum
NLGNV

SEQ ID NO: 2272069 - protein, 7 aa, Cryptosporidium parvum
NLGPKGT

SEQ ID NO: 2272070 - protein, 7 aa, Cryptosporidium parvum
NLGPRQL

SEQ ID NO: 2272071 - protein, 4 aa, Cryptosporidium parvum
NLHP

SEQ ID NO: 2272072 - protein, 9 aa, Cryptosporidium parvum
NLKAKGSQR

SEQ ID NO: 2272073 - protein, 12 aa, Cryptosporidium parvum
NLKEAGDLNNSI

SEQ ID NO: 2272074 - protein, 15 aa, Cryptosporidium parvum
NLKIPPKKNGLVTSL

SEQ ID NO: 2272075 - protein, 9 aa, Cryptosporidium parvum
NLKKEENNL

SEQ ID NO: 2272076 - protein, 18 aa, Cryptosporidium parvum
NLKKNDKSRSSENNININ

SEQ ID NO: 2272077 - protein, 7 aa, Cryptosporidium parvum
NLKNNQN

SEQ ID NO: 2272078 - protein, 5 aa, Cryptosporidium parvum
NLKNS

SEQ ID NO: 2272079 - protein, 19 aa, Cryptosporidium parvum
NLKNSKKSDKNENTEGDER

SEQ ID NO: 2272080 - protein, 12 aa, Cryptosporidium parvum
NLKSPRSPTITS

SEQ ID NO: 2272081 - protein, 23 aa, Cryptosporidium parvum
NLKSPSQSTDQEQLNSKQNLDPL

SEQ ID NO: 2272082 - protein, 11 aa, Cryptosporidium parvum
NLKSTDNWKNS

SEQ ID NO: 2272083 - protein, 4 aa, Cryptosporidium parvum
NLKT

SEQ ID NO: 2272084 - protein, 5 aa, Cryptosporidium parvum
NLKTD

SEQ ID NO: 2272085 - protein, 8 aa, Cryptosporidium parvum
NLKTTDTN

SEQ ID NO: 2272086 - protein, 29 aa, Cryptosporidium parvum
NLLAPKSDLIKSDSLKKSTELGKSQLDSK

SEQ ID NO: 2272087 - protein, 8 aa, Cryptosporidium parvum
NLLTPSQR

SEQ ID NO: 2272088 - protein, 7 aa, Cryptosporidium parvum
NLNDSEI

SEQ ID NO: 2272089 - protein, 4 aa, Cryptosporidium parvum
NLNE

SEQ ID NO: 2272090 - protein, 5 aa, Cryptosporidium parvum
NLNEL

SEQ ID NO: 2272091 - protein, 10 aa, Cryptosporidium parvum
NLNESDVDDE

SEQ ID NO: 2272092 - protein, 9 aa, Cryptosporidium parvum
NLNGNELNT

SEQ ID NO: 2272093 - protein, 15 aa, Cryptosporidium parvum
NLNGNNNSNSNIGSG

SEQ ID NO: 2272094 - protein, 37 aa, Cryptosporidium parvum
NLNKDTSAESNKDGSDSDDTGDNTHDNEGNSSSRQDA

SEQ ID NO: 2272095 - protein, 12 aa, Cryptosporidium parvum
NLNKSTNLDETN

SEQ ID NO: 2272096 - protein, 10 aa, Cryptosporidium parvum
NLNKTDITSI

SEQ ID NO: 2272097 - protein, 5 aa, Cryptosporidium parvum
NLNNN

SEQ ID NO: 2272098 - protein, 5 aa, Cryptosporidium parvum
NLNPN

SEQ ID NO: 2272099 - protein, 7 aa, Cryptosporidium parvum
NLNPQDR

SEQ ID NO: 2272100 - protein, 7 aa, Cryptosporidium parvum
NLNPSNE

SEQ ID NO: 2272101 - protein, 20 aa, Cryptosporidium parvum
NLNPTNVNKTGNLNSGKKRI

SEQ ID NO: 2272102 - protein, 15 aa, Cryptosporidium parvum
NLNQDSSSVPVGESL

SEQ ID NO: 2272103 - protein, 21 aa, Cryptosporidium parvum
NLNSNKKKKRIPDSENPDEIW

SEQ ID NO: 2272104 - protein, 25 aa, Cryptosporidium parvum
NLNSSSNMSFTGGSTASQTTLQTPG

SEQ ID NO: 2272105 - protein, 5 aa, Cryptosporidium parvum
NLNTI

SEQ ID NO: 2272106 - protein, 6 aa, Cryptosporidium parvum
NLNTSQ

SEQ ID NO: 2272107 - protein, 8 aa, Cryptosporidium parvum
NLNTSTTN

SEQ ID NO: 2272108 - protein, 63 aa, Cryptosporidium parvum
NLNYEDSNFSPNNEKPSKKTSKSNQVHTQNKDIDTEEENDSSLKTNDESNPNSPSLSKTTNDV

SEQ ID NO: 2272109 - protein, 33 aa, Cryptosporidium parvum; identical to SEQ ID NO: 2153563

SEQ ID NO: 2272110 - protein, 7 aa, Cryptosporidium parvum
NLPEYSG

SEQ ID NO: 2272111 - protein, 27 aa, Cryptosporidium parvum
NLPHSAYNQYDNSIEKNKFHSKESQQK

SEQ ID NO: 2272112 - protein, 6 aa, Cryptosporidium parvum
NLPNDN

SEQ ID NO: 2272113 - protein, 11 aa, Cryptosporidium parvum
NLPNKTSVEQQ

SEQ ID NO: 2272114 - protein, 9 aa, Cryptosporidium parvum
NLPPGGEAL

SEQ ID NO: 2272115 - protein, 8 aa, Cryptosporidium parvum
NLPPKLKE

SEQ ID NO: 2272116 - protein, 14 aa, Cryptosporidium parvum
NLPPLSTSCSPTSV

SEQ ID NO: 2272117 - protein, 24 aa, Cryptosporidium parvum
NLPQGGCSQTGYMENSQNNIQSDS

SEQ ID NO: 2272118 - protein, 10 aa, Cryptosporidium parvum
NLPSDGNEHS

SEQ ID NO: 2272119 - protein, 12 aa, Cryptosporidium parvum
NLPSNDSTNPIP

SEQ ID NO: 2272120 - protein, 6 aa, Cryptosporidium parvum
NLPSSL

SEQ ID NO: 2272121 - protein, 6 aa, Cryptosporidium parvum
NLPSVN

SEQ ID NO: 2272122 - protein, 4 aa, Cryptosporidium parvum
NLQD

SEQ ID NO: 2272123 - protein, 7 aa, Cryptosporidium parvum
NLQDGNP

SEQ ID NO: 2272124 - protein, 10 aa, Cryptosporidium parvum
NLQETNKNIR

SEQ ID NO: 2272125 - protein, 7 aa, Cryptosporidium parvum
NLQGSEF

SEQ ID NO: 2272126 - protein, 12 aa, Cryptosporidium parvum
NLQKKDQITPKT

SEQ ID NO: 2272127 - protein, 4 aa, Cryptosporidium parvum
NLQL

SEQ ID NO: 2272128 - protein, 5 aa, Cryptosporidium parvum
NLQPS

SEQ ID NO: 2272129 - protein, 12 aa, Cryptosporidium parvum
NLQSNETPEGVN

SEQ ID NO: 2272130 - protein, 4 aa, Cryptosporidium parvum
NLQT

SEQ ID NO: 2272131 - protein, 6 aa, Cryptosporidium parvum
NLRDYS

SEQ ID NO: 2272132 - protein, 6 aa, Cryptosporidium parvum
NLREDL

SEQ ID NO: 2272133 - protein, 10 aa, Cryptosporidium parvum
NLREVSPGNL

SEQ ID NO: 2272134 - protein, 5 aa, Cryptosporidium parvum
NLRKD

SEQ ID NO: 2272135 - protein, 6 aa, Cryptosporidium parvum
NLSDSN

SEQ ID NO: 2272136 - protein, 8 aa, Cryptosporidium parvum
NLSEEDAL

SEQ ID NO: 2272137 - protein, 6 aa, Cryptosporidium parvum
NLSEGA

SEQ ID NO: 2272138 - protein, 22 aa, Cryptosporidium parvum
NLSENNMNNGITTASKTNKTCN

SEQ ID NO: 2272139 - protein, 34 aa, Cryptosporidium parvum
NLSESKDKSTSVRSKNIRKSRKKSRRPASRSRRK

SEQ ID NO: 2272140 - protein, 6 aa, Cryptosporidium parvum
NLSESN

SEQ ID NO: 2272141 - protein, 12 aa, Cryptosporidium parvum
NLSETRNSIIET

SEQ ID NO: 2272142 - protein, 19 aa, Cryptosporidium parvum
NLSGSGGIAGETSKASKSI

SEQ ID NO: 2272143 - protein, 21 aa, Cryptosporidium parvum
NLSGSGGSTQNVTAVGPSVSC

SEQ ID NO: 2272144 - protein, 40 aa, Cryptosporidium parvum
NLSGSKAEPGTGQSTNGTQSFSSEHNTGGRSESRKSASGE

SEQ ID NO: 2272145 - protein, 56 aa, Cryptosporidium parvum
NLSHSTGNKHYHRETGNYGPNNRRDRFQSHGNTQNSQGSKRVNDNANGGAQNSTLD

SEQ ID NO: 2272146 - protein, 9 aa, Cryptosporidium parvum
NLSINRDKV

SEQ ID NO: 2272147 - protein, 16 aa, Cryptosporidium parvum
NLSKDGRYSELSNRST

SEQ ID NO: 2272148 - protein, 5 aa, Cryptosporidium parvum
NLSKE

SEQ ID NO: 2272149 - protein, 10 aa, Cryptosporidium parvum
NLSLNSKSRY

SEQ ID NO: 2272150 - protein, 15 aa, Cryptosporidium parvum
NLSNDSSLSSSRISS

SEQ ID NO: 2272151 - protein, 7 aa, Cryptosporidium parvum
NLSNLSQ

SEQ ID NO: 2272152 - protein, 7 aa, Cryptosporidium parvum
NLSNTEK

SEQ ID NO: 2272153 - protein, 12 aa, Cryptosporidium parvum
NLSNTKQEKESD

SEQ ID NO: 2272154 - protein, 5 aa, Cryptosporidium parvum
NLSPD

SEQ ID NO: 2272155 - protein, 8 aa, Cryptosporidium parvum
NLSPKDSL

SEQ ID NO: 2272156 - protein, 8 aa, Cryptosporidium parvum
NLSPKNPN

SEQ ID NO: 2272157 - protein, 22 aa, Cryptosporidium parvum
NLSPNTNFQTPSGRDPKRRNIS

SEQ ID NO: 2272158 - protein, 4 aa, Cryptosporidium parvum
NLSQ

SEQ ID NO: 2272159 - protein, 8 aa, Cryptosporidium parvum
NLSQNSNF

SEQ ID NO: 2272160 - protein, 5 aa, Cryptosporidium parvum
NLSSK

SEQ ID NO: 2272161 - protein, 11 aa, Cryptosporidium parvum
NLSSNFGTKYS

SEQ ID NO: 2272162 - protein, 7 aa, Cryptosporidium parvum
NLSSQNI

SEQ ID NO: 2272163 - protein, 8 aa, Cryptosporidium parvum
NLSSRNRK

SEQ ID NO: 2272164 - protein, 10 aa, Cryptosporidium parvum
NLSSSSPTSH

SEQ ID NO: 2272165 - protein, 17 aa, Cryptosporidium parvum
NLSSTSSEQVDEPSKRI

SEQ ID NO: 2272166 - protein, 8 aa, Cryptosporidium parvum
NLSTAKNT

SEQ ID NO: 2272167 - protein, 16 aa, Cryptosporidium parvum
NLSTGRSVNGGQSKRV

SEQ ID NO: 2272168 - protein, 15 aa, Cryptosporidium parvum
NLSVTSNKHTGEDSH

SEQ ID NO: 2272169 - protein, 4 aa, Cryptosporidium parvum
NLSY

SEQ ID NO: 2272170 - protein, 7 aa, Cryptosporidium parvum
NLTDDGK

SEQ ID NO: 2272171 - protein, 10 aa, Cryptosporidium parvum
NLTDEQFDET

SEQ ID NO: 2272172 - protein, 11 aa, Cryptosporidium parvum
NLTENNDNLSD

SEQ ID NO: 2272173 - protein, 7 aa, Cryptosporidium parvum
NLTNDPN

SEQ ID NO: 2272174 - protein, 7 aa, Cryptosporidium parvum
NLTNETT

SEQ ID NO: 2272175 - protein, 10 aa, Cryptosporidium parvum
NLTNNSHSEM

SEQ ID NO: 2272176 - protein, 11 aa, Cryptosporidium parvum
NLTNSEDSRFP

SEQ ID NO: 2272177 - protein, 21 aa, Cryptosporidium parvum
NLTQKNDNQSVNTNEKTGMRT

SEQ ID NO: 2272178 - protein, 47 aa, Cryptosporidium parvum
NLTSNGPEQKSDNKDDSSELNKNPLVENEDEQNHSNDKTLVTESRTE

SEQ ID NO: 2272179 - protein, 6 aa, Cryptosporidium parvum
NLTSPI

SEQ ID NO: 2272180 - protein, 4 aa, Cryptosporidium parvum
NLVG

SEQ ID NO: 2272181 - protein, 4 aa, Cryptosporidium parvum
NLVS

SEQ ID NO: 2272182 - protein, 6 aa, Cryptosporidium parvum
NLYSET

SEQ ID NO: 2272183 - protein, 10 aa, Cryptosporidium parvum
NLYSSEGISA

SEQ ID NO: 2272184 - protein, 5 aa, Cryptosporidium parvum
NMDEG

SEQ ID NO: 2272185 - protein, 12 aa, Cryptosporidium parvum
NMDENKDPREAI

SEQ ID NO: 2272186 - protein, 4 aa, Cryptosporidium parvum
NMEE

SEQ ID NO: 2272187 - protein, 26 aa, Cryptosporidium parvum
NMGEDSLSDEEYYSGEYDVSENTEDV

SEQ ID NO: 2272188 - protein, 12 aa, Cryptosporidium parvum
NMGEPIDLFFAI

SEQ ID NO: 2272189 - protein, 27 aa, Cryptosporidium parvum
NMGGSQSSVGSLSRSGGAKSMEGESSL

SEQ ID NO: 2272190 - protein, 4 aa, Cryptosporidium parvum
NMGV

SEQ ID NO: 2272191 - protein, 69 aa, Cryptosporidium parvum
NMKEGSERGSGGGSGANSKKSSGGSTTLGGNSLEYGKSSKSSLKKHRSSSESSRSRSPQRKSSSKHVRK

SEQ ID NO: 2272192 - protein, 6 aa, Cryptosporidium parvum
NMKENT

SEQ ID NO: 2272193 - protein, 9 aa, Cryptosporidium parvum
NMKKESSQW

SEQ ID NO: 2272194 - protein, 17 aa, Cryptosporidium parvum
NMKSQERTPEQERAEKR

SEQ ID NO: 2272195 - protein, 17 aa, Cryptosporidium parvum
NMNENEDSNNKENTRLG

SEQ ID NO: 2272196 - protein, 10 aa, Cryptosporidium parvum
NMNHNNNNNN

SEQ ID NO: 2272197 - protein, 10 aa, Cryptosporidium parvum
NMNSDTSEEI

SEQ ID NO: 2272198 - protein, 13 aa, Cryptosporidium parvum
NMSKDTTHRYGKN

SEQ ID NO: 2272199 - protein, 9 aa, Cryptosporidium parvum
NMSKGRDQR

SEQ ID NO: 2272200 - protein, 24 aa, Cryptosporidium parvum
NMSNDTEKEETGEKFSPPSTPHSS

SEQ ID NO: 2272201 - protein, 9 aa, Cryptosporidium parvum
NMSSSNKSF

SEQ ID NO: 2272202 - protein, 11 aa, Cryptosporidium parvum
NMSTKGGISEE

SEQ ID NO: 2272203 - protein, 22 aa, Cryptosporidium parvum
NMTESTTYNSELSKQLKENSNF

SEQ ID NO: 2272204 - protein, 18 aa, Cryptosporidium parvum
NMTSGIGSYDHKTRTPRT

SEQ ID NO: 2272205 - protein, 7 aa, Cryptosporidium parvum
NNAEKTL

SEQ ID NO: 2272206 - protein, 12 aa, Cryptosporidium parvum
NNAFKTNSRRVN

SEQ ID NO: 2272207 - protein, 9 aa, Cryptosporidium parvum
NNAGDSSYL

SEQ ID NO: 2272208 - protein, 10 aa, Cryptosporidium parvum
NNAGNKTSRI

SEQ ID NO: 2272209 - protein, 7 aa, Cryptosporidium parvum
NNAISNP

SEQ ID NO: 2272210 - protein, 7 aa, Cryptosporidium parvum
NNAKENL

SEQ ID NO: 2272211 - protein, 7 aa, Cryptosporidium parvum
NNAKNEI

SEQ ID NO: 2272212 - protein, 4 aa, Cryptosporidium parvum
NNAQ

SEQ ID NO: 2272213 - protein, 5 aa, Cryptosporidium parvum
NNARL

SEQ ID NO: 2272214 - protein, 12 aa, Cryptosporidium parvum
NNASATSGGSKK

SEQ ID NO: 2272215 - protein, 8 aa, Cryptosporidium parvum
NNASDIYQ

SEQ ID NO: 2272216 - protein, 8 aa, Cryptosporidium parvum
NNASPLEV

SEQ ID NO: 2272217 - protein, 45 aa, Cryptosporidium parvum
NNASSGNNNCNNGGNNSGNKVGSSAGNNGNGGVSNSISNGNGGSN

SEQ ID NO: 2272218 - protein, 27 aa, Cryptosporidium parvum
NNATNNNDSTDLGEKYSDERVPDPTLT

SEQ ID NO: 2272219 - protein, 15 aa, Cryptosporidium parvum
NNATNTLDNKSENEL

SEQ ID NO: 2272220 - protein, 4 aa, Cryptosporidium parvum
NNAY

SEQ ID NO: 2272221 - protein, 6 aa, Cryptosporidium parvum
NNCANE

SEQ ID NO: 2272222 - protein, 14 aa, Cryptosporidium parvum
NNCDNNNDNNHDIT

SEQ ID NO: 2272223 - protein, 17 aa, Cryptosporidium parvum
NNCENGHVRALRESGFC

SEQ ID NO: 2272224 - protein, 9 aa, Cryptosporidium parvum
NNCNNNSSF

SEQ ID NO: 2272225 - protein, 6 aa, Cryptosporidium parvum
NNCQTS

SEQ ID NO: 2272226 - protein, 16 aa, Cryptosporidium parvum
NNCRDFNNNNTRMTDE

SEQ ID NO: 2272227 - protein, 6 aa, Cryptosporidium parvum
NNCSNS

SEQ ID NO: 2272228 - protein, 13 aa, Cryptosporidium parvum
NNDDETTKDSFQK

SEQ ID NO: 2272229 - protein, 4 aa, Cryptosporidium parvum
NNDE

SEQ ID NO: 2272230 - protein, 25 aa, Cryptosporidium parvum
NNDEGLNELSDGNIKNEKEAKKHKK

SEQ ID NO: 2272231 - protein, 14 aa, Cryptosporidium parvum
NNDEPNTRNYNPSS

SEQ ID NO: 2272232 - protein, 4 aa, Cryptosporidium parvum
NNDG

SEQ ID NO: 2272233 - protein, 17 aa, Cryptosporidium parvum
NNDGENNKEADGTLDSK

SEQ ID NO: 2272234 - protein, 20 aa, Cryptosporidium parvum
NNDGFDYENENISTGNDNNS

SEQ ID NO: 2272235 - protein, 8 aa, Cryptosporidium parvum
NNDHGNDQ

SEQ ID NO: 2272236 - protein, 10 aa, Cryptosporidium parvum
NNDHSQGDKK

SEQ ID NO: 2272237 - protein, 19 aa, Cryptosporidium parvum
NNDIKKSESSNKRLTKSQK

SEQ ID NO: 2272238 - protein, 5 aa, Cryptosporidium parvum
NNDIS

SEQ ID NO: 2272239 - protein, 10 aa, Cryptosporidium parvum
NNDKDEKVES

SEQ ID NO: 2272240 - protein, 6 aa, Cryptosporidium parvum
NNDKDV

SEQ ID NO: 2272241 - protein, 4 aa, Cryptosporidium parvum
NNDL

SEQ ID NO: 2272242 - protein, 15 aa, Cryptosporidium parvum
NNDLETDSSQDPQYE

SEQ ID NO: 2272243 - protein, 6 aa, Cryptosporidium parvum
NNDNDI

SEQ ID NO: 2272244 - protein, 19 aa, Cryptosporidium parvum
NNDNESQPPVHPGYTGDNE

SEQ ID NO: 2272245 - protein, 12 aa, Cryptosporidium parvum
NNDNNSLSDSKE

SEQ ID NO: 2272246 - protein, 21 aa, Cryptosporidium parvum
NNDNPSSSSLSENHSKFPENA

SEQ ID NO: 2272247 - protein, 7 aa, Cryptosporidium parvum
NNDNVSN

SEQ ID NO: 2272248 - protein, 24 aa, Cryptosporidium parvum
NNDNVTDSNSSNDNNTDSNNNNIT

SEQ ID NO: 2272249 - protein, 8 aa, Cryptosporidium parvum
NNDSDTNN

SEQ ID NO: 2272250 - protein, 18 aa, Cryptosporidium parvum
NNDSGSSNSYSGRNSLQG

SEQ ID NO: 2272251 - protein, 5 aa, Cryptosporidium parvum
NNDSI

SEQ ID NO: 2272252 - protein, 8 aa, Cryptosporidium parvum
NNDSLNNS

SEQ ID NO: 2272253 - protein, 9 aa, Cryptosporidium parvum
NNDSTINKE

SEQ ID NO: 2272254 - protein, 5 aa, Cryptosporidium parvum
NNDSW

SEQ ID NO: 2272255 - protein, 7 aa, Cryptosporidium parvum
NNDTDSN

SEQ ID NO: 2272256 - protein, 13 aa, Cryptosporidium parvum
NNDTPNSKRASEG

SEQ ID NO: 2272257 - protein, 16 aa, Cryptosporidium parvum
NNDVSNGNILEFLKKK

SEQ ID NO: 2272258 - protein, 10 aa, Cryptosporidium parvum
NNDYDKYDPI

SEQ ID NO: 2272259 - protein, 14 aa, Cryptosporidium parvum
NNDYLSKNNHHGNL

SEQ ID NO: 2272260 - protein, 7 aa, Cryptosporidium parvum
NNEAPQL

SEQ ID NO: 2272261 - protein, 6 aa, Cryptosporidium parvum
NNEAVR

SEQ ID NO: 2272262 - protein, 6 aa, Cryptosporidium parvum
NNECDG

SEQ ID NO: 2272263 - protein, 4 aa, Cryptosporidium parvum
NNED

SEQ ID NO: 2272264 - protein, 28 aa, Cryptosporidium parvum
NNEDDDYIEDYDDNNNNMNNSNNNNNNN

SEQ ID NO: 2272265 - protein, 8 aa, Cryptosporidium parvum
NNEDTFSL

SEQ ID NO: 2272266 - protein, 17 aa, Cryptosporidium parvum
NNEEKMDDSTLENKVGE

SEQ ID NO: 2272267 - protein, 14 aa, Cryptosporidium parvum
NNEENLEKAGISQV

SEQ ID NO: 2272268 - protein, 23 aa, Cryptosporidium parvum
NNEESPKRNSSISKEVNSNVGKP

SEQ ID NO: 2272269 - protein, 4 aa, Cryptosporidium parvum
NNEF

SEQ ID NO: 2272270 - protein, 21 aa, Cryptosporidium parvum
NNEFGNSNNESRSSNHEEIES

SEQ ID NO: 2272271 - protein, 7 aa, Cryptosporidium parvum
NNEFGQL

SEQ ID NO: 2272272 - protein, 7 aa, Cryptosporidium parvum
NNEFTTN

SEQ ID NO: 2272273 - protein, 4 aa, Cryptosporidium parvum
NNEI

SEQ ID NO: 2272274 - protein, 15 aa, Cryptosporidium parvum
NNEIKKRRGLSSASG

SEQ ID NO: 2272275 - protein, 5 aa, Cryptosporidium parvum
NNEIL

SEQ ID NO: 2272276 - protein, 15 aa, Cryptosporidium parvum
NNEINSVKNDSSVKI

SEQ ID NO: 2272277 - protein, 4 aa, Cryptosporidium parvum
NNEK

SEQ ID NO: 2272278 - protein, 9 aa, Cryptosporidium parvum
NNEKCSLSS

SEQ ID NO: 2272279 - protein, 10 aa, Cryptosporidium parvum
NNEKRKPPSI

SEQ ID NO: 2272280 - protein, 9 aa, Cryptosporidium parvum
NNEKYNESS

SEQ ID NO: 2272281 - protein, 7 aa, Cryptosporidium parvum
NNELKER

SEQ ID NO: 2272282 - protein, 21 aa, Cryptosporidium parvum
NNELNKKNCNSGTDTDSNTGL

SEQ ID NO: 2272283 - protein, 15 aa, Cryptosporidium parvum
NNELSCSESDEVNEY

SEQ ID NO: 2272284 - protein, 12 aa, Cryptosporidium parvum
NNELTNDSQKIY

SEQ ID NO: 2272285 - protein, 10 aa, Cryptosporidium parvum
NNENEGDDEV

SEQ ID NO: 2272286 - protein, 5 aa, Cryptosporidium parvum
NNENI

SEQ ID NO: 2272287 - protein, 28 aa, Cryptosporidium parvum
NNENISQNTVNSVNQEYKRVSNQGVSQK

SEQ ID NO: 2272288 - protein, 5 aa, Cryptosporidium parvum
NNENK

SEQ ID NO: 2272289 - protein, 19 aa, Cryptosporidium parvum
NNENKLKGKGAVPLDQSAE

SEQ ID NO: 2272290 - protein, 14 aa, Cryptosporidium parvum
NNENNNHSNNNSLD

SEQ ID NO: 2272291 - protein, 8 aa, Cryptosporidium parvum
NNENNSIK

SEQ ID NO: 2272292 - protein, 13 aa, Cryptosporidium parvum
NNEPDKSDNEVSS

SEQ ID NO: 2272293 - protein, 4 aa, Cryptosporidium parvum
NNEQ

SEQ ID NO: 2272294 - protein, 5 aa, Cryptosporidium parvum
NNEQG

SEQ ID NO: 2272295 - protein, 4 aa, Cryptosporidium parvum
NNER

SEQ ID NO: 2272296 - protein, 8 aa, Cryptosporidium parvum
NNERGKAY

SEQ ID NO: 2272297 - protein, 7 aa, Cryptosporidium parvum
NNESNGM

SEQ ID NO: 2272298 - protein, 9 aa, Cryptosporidium parvum
NNESNKCSQ

SEQ ID NO: 2272299 - protein, 12 aa, Cryptosporidium parvum
NNETGSIYPRGG

SEQ ID NO: 2272300 - protein, 5 aa, Cryptosporidium parvum
NNETL

SEQ ID NO: 2272301 - protein, 8 aa, Cryptosporidium parvum
NNETQDLS

SEQ ID NO: 2272302 - protein, 6 aa, Cryptosporidium parvum
NNETRS

SEQ ID NO: 2272303 - protein, 4 aa, Cryptosporidium parvum
NNEY

SEQ ID NO: 2272304 - protein, 14 aa, Cryptosporidium parvum
NNEYKQEERRIEES

SEQ ID NO: 2272305 - protein, 7 aa, Cryptosporidium parvum
NNEYRQE

SEQ ID NO: 2272306 - protein, 9 aa, Cryptosporidium parvum
NNFEETEHA

SEQ ID NO: 2272307 - protein, 7 aa, Cryptosporidium parvum
NNFENNN

SEQ ID NO: 2272308 - protein, 20 aa, Cryptosporidium parvum
NNFKQAKKTIKNQISSRPDL

SEQ ID NO: 2272309 - protein, 12 aa, Cryptosporidium parvum
NNFNKDEGIKDH

SEQ ID NO: 2272310 - protein, 5 aa, Cryptosporidium parvum
NNFNQ

SEQ ID NO: 2272311 - protein, 12 aa, Cryptosporidium parvum
NNFNSQNDVSNY

SEQ ID NO: 2272312 - protein, 19 aa, Cryptosporidium parvum
NNFPNSNNRNGYSNNNNIN

SEQ ID NO: 2272313 - protein, 8 aa, Cryptosporidium parvum
NNFQNPHN

SEQ ID NO: 2272314 - protein, 15 aa, Cryptosporidium parvum
NNFSSTSNSSPNSFR

SEQ ID NO: 2272315 - protein, 4 aa, Cryptosporidium parvum
NNGE

SEQ ID NO: 2272316 - protein, 5 aa, Cryptosporidium parvum
NNGEF

SEQ ID NO: 2272317 - protein, 6 aa, Cryptosporidium parvum
NNGEFQ

SEQ ID NO: 2272318 - protein, 8 aa, Cryptosporidium parvum
NNGGNGVN

SEQ ID NO: 2272319 - protein, 17 aa, Cryptosporidium parvum
NNGGNNIYNEQNMNTQN

SEQ ID NO: 2272320 - protein, 5 aa, Cryptosporidium parvum
NNGGP

SEQ ID NO: 2272321 - protein, 15 aa, Cryptosporidium parvum
NNGGSAGNNADTHAL

SEQ ID NO: 2272322 - protein, 17 aa, Cryptosporidium parvum
NNGGTDGMRNESSTPRF

SEQ ID NO: 2272323 - protein, 5 aa, Cryptosporidium parvum
NNGGY

SEQ ID NO: 2272324 - protein, 14 aa, Cryptosporidium parvum
NNGHGGSVTSTLPS

SEQ ID NO: 2272325 - protein, 18 aa, Cryptosporidium parvum
NNGINTGAPGSNNNPIII

SEQ ID NO: 2272326 - protein, 13 aa, Cryptosporidium parvum
NNGLDPKKEYEHI

SEQ ID NO: 2272327 - protein, 15 aa, Cryptosporidium parvum
NNGMSNSGKSSNSIG

SEQ ID NO: 2272328 - protein, 6 aa, Cryptosporidium parvum
NNGNEE

SEQ ID NO: 2272329 - protein, 8 aa, Cryptosporidium parvum
NNGNITRN

SEQ ID NO: 2272330 - protein, 8 aa, Cryptosporidium parvum
NNGNPHDN

SEQ ID NO: 2272331 - protein, 8 aa, Cryptosporidium parvum
NNGNQYQE

SEQ ID NO: 2272332 - protein, 11 aa, Cryptosporidium parvum
NNGNVNTNCTT

SEQ ID NO: 2272333 - protein, 14 aa, Cryptosporidium parvum
NNGNYFDQENDQIS

SEQ ID NO: 2272334 - protein, 7 aa, Cryptosporidium parvum
NNGRADL

SEQ ID NO: 2272335 - protein, 4 aa, Cryptosporidium parvum
NNGS

SEQ ID NO: 2272336 - protein, 10 aa, Cryptosporidium parvum
NNGSAKYGSE

SEQ ID NO: 2272337 - protein, 7 aa, Cryptosporidium parvum
NNGSFSD

SEQ ID NO: 2272338 - protein, 9 aa, Cryptosporidium parvum
NNGSPNTNG

SEQ ID NO: 2272339 - protein, 4 aa, Cryptosporidium parvum
NNGT

SEQ ID NO: 2272340 - protein, 5 aa, Cryptosporidium parvum
NNGTA

SEQ ID NO: 2272341 - protein, 17 aa, Cryptosporidium parvum
NNGTQSKNKEGDDSMRE

SEQ ID NO: 2272342 - protein, 4 aa, Cryptosporidium parvum
NNGV

SEQ ID NO: 2272343 - protein, 34 aa, Cryptosporidium parvum
NNGVNNNNGNHSDSTNEDENSSVNGGHSGNGIEH

SEQ ID NO: 2272344 - protein, 29 aa, Cryptosporidium parvum
NNGVNTTSSVNNSTSDSTNINSQSNHNQT

SEQ ID NO: 2272345 - protein, 4 aa, Cryptosporidium parvum
NNGY

SEQ ID NO: 2272346 - protein, 4 aa, Cryptosporidium parvum
NNHD

SEQ ID NO: 2272347 - protein, 6 aa, Cryptosporidium parvum
NNHKPF

SEQ ID NO: 2272348 - protein, 14 aa, Cryptosporidium parvum
NNHNSNNSTYRDNS

SEQ ID NO: 2272349 - protein, 4 aa, Cryptosporidium parvum
NNHQ

SEQ ID NO: 2272350 - protein, 13 aa, Cryptosporidium parvum
NNHSTSNTNKNMS

SEQ ID NO: 2272351 - protein, 5 aa, Cryptosporidium parvum
NNHTM

SEQ ID NO: 2272352 - protein, 12 aa, Cryptosporidium parvum
NNIDSSANTQNV

SEQ ID NO: 2272353 - protein, 8 aa, Cryptosporidium parvum
NNIDSSNN

SEQ ID NO: 2272354 - protein, 7 aa, Cryptosporidium parvum
NNIENSS

SEQ ID NO: 2272355 - protein, 17 aa, Cryptosporidium parvum
NNIEVETSESKLSRDSS

SEQ ID NO: 2272356 - protein, 13 aa, Cryptosporidium parvum
NNIGTGSATTSVN

SEQ ID NO: 2272357 - protein, 7 aa, Cryptosporidium parvum
NNIKDEE

SEQ ID NO: 2272358 - protein, 9 aa, Cryptosporidium parvum
NNIKEKETK

SEQ ID NO: 2272359 - protein, 5 aa, Cryptosporidium parvum
NNIKN

SEQ ID NO: 2272360 - protein, 8 aa, Cryptosporidium parvum
NNIKNSRS

SEQ ID NO: 2272361 - protein, 7 aa, Cryptosporidium parvum
NNIKPKE

SEQ ID NO: 2272362 - protein, 5 aa, Cryptosporidium parvum
NNINN

SEQ ID NO: 2272363 - protein, 5 aa, Cryptosporidium parvum
NNINP

SEQ ID NO: 2272364 - protein, 14 aa, Cryptosporidium parvum
NNINQQVNRQREYG

SEQ ID NO: 2272365 - protein, 16 aa, Cryptosporidium parvum
NNIPNQNFKDDQQIES

SEQ ID NO: 2272366 - protein, 6 aa, Cryptosporidium parvum
NNIQGD

SEQ ID NO: 2272367 - protein, 27 aa, Cryptosporidium parvum
NNIQKQGSLINQKGRRLDENFDFDSLV

SEQ ID NO: 2272368 - protein, 8 aa, Cryptosporidium parvum
NNIRKGAN

SEQ ID NO: 2272369 - protein, 5 aa, Cryptosporidium parvum
NNISD

SEQ ID NO: 2272370 - protein, 6 aa, Cryptosporidium parvum
NNISDE

SEQ ID NO: 2272371 - protein, 10 aa, Cryptosporidium parvum
NNISNKKQTY

SEQ ID NO: 2272372 - protein, 6 aa, Cryptosporidium parvum
NNISNN

SEQ ID NO: 2272373 - protein, 11 aa, Cryptosporidium parvum
NNISSKPSFHN

SEQ ID NO: 2272374 - protein, 10 aa, Cryptosporidium parvum
NNISTEDHSL

SEQ ID NO: 2272375 - protein, 18 aa, Cryptosporidium parvum
NNISTPPKSEVKMGPTTK

SEQ ID NO: 2272376 - protein, 12 aa, Cryptosporidium parvum
NNISVEPTIDNR

SEQ ID NO: 2272377 - protein, 12 aa, Cryptosporidium parvum
NNITGNCNSMDN

SEQ ID NO: 2272378 - protein, 5 aa, Cryptosporidium parvum
NNITN

SEQ ID NO: 2272379 - protein, 10 aa, Cryptosporidium parvum
NNITPPTRQQ

SEQ ID NO: 2272380 - protein, 9 aa, Cryptosporidium parvum
NNITSTQKN

SEQ ID NO: 2272381 - protein, 17 aa, Cryptosporidium parvum
NNITSTSQSNPSHSNSC

SEQ ID NO: 2272382 - protein, 5 aa, Cryptosporidium parvum
NNKDI

SEQ ID NO: 2272383 - protein, 14 aa, Cryptosporidium parvum
NNKDKTINSQARTH

SEQ ID NO: 2272384 - protein, 8 aa, Cryptosporidium parvum
NNKDPDNV

SEQ ID NO: 2272385 - protein, 8 aa, Cryptosporidium parvum
NNKDQFSS

SEQ ID NO: 2272386 - protein, 10 aa, Cryptosporidium parvum
NNKDQLGGMN

SEQ ID NO: 2272387 - protein, 10 aa, Cryptosporidium parvum
NNKDTPKGWK

SEQ ID NO: 2272388 - protein, 4 aa, Cryptosporidium parvum
NNKE

SEQ ID NO: 2272389 - protein, 9 aa, Cryptosporidium parvum
NNKEEESMD

SEQ ID NO: 2272390 - protein, 10 aa, Cryptosporidium parvum
NNKEETEKTF

SEQ ID NO: 2272391 - protein, 5 aa, Cryptosporidium parvum
NNKER

SEQ ID NO: 2272392 - protein, 22 aa, Cryptosporidium parvum
NNKETSIKTPPPSNFPTNNSNC

SEQ ID NO: 2272393 - protein, 4 aa, Cryptosporidium parvum
NNKF

SEQ ID NO: 2272394 - protein, 15 aa, Cryptosporidium parvum
NNKGETDTGNIVEGT

SEQ ID NO: 2272395 - protein, 5 aa, Cryptosporidium parvum
NNKGN

SEQ ID NO: 2272396 - protein, 9 aa, Cryptosporidium parvum
NNKGPISNT

SEQ ID NO: 2272397 - protein, 7 aa, Cryptosporidium parvum
NNKGQKL

SEQ ID NO: 2272398 - protein, 4 aa, Cryptosporidium parvum
NNKH

SEQ ID NO: 2272399 - protein, 8 aa, Cryptosporidium parvum
NNKHQNYN

SEQ ID NO: 2272400 - protein, 7 aa, Cryptosporidium parvum
NNKINSP

SEQ ID NO: 2272401 - protein, 6 aa, Cryptosporidium parvum
NNKKKI

SEQ ID NO: 2272402 - protein, 8 aa, Cryptosporidium parvum
NNKKNGDK

SEQ ID NO: 2272403 - protein, 8 aa, Cryptosporidium parvum
NNKNDMAE

SEQ ID NO: 2272404 - protein, 8 aa, Cryptosporidium parvum
NNKNQNNK

SEQ ID NO: 2272405 - protein, 7 aa, Cryptosporidium parvum
NNKNTIK

SEQ ID NO: 2272406 - protein, 7 aa, Cryptosporidium parvum
NNKQSKC

SEQ ID NO: 2272407 - protein, 8 aa, Cryptosporidium parvum
NNKREEQM

SEQ ID NO: 2272408 - protein, 13 aa, Cryptosporidium parvum
NNKRHHNNEFDGR

SEQ ID NO: 2272409 - protein, 7 aa, Cryptosporidium parvum
NNKRYSG

SEQ ID NO: 2272410 - protein, 6 aa, Cryptosporidium parvum
NNKSAN

SEQ ID NO: 2272411 - protein, 7 aa, Cryptosporidium parvum
NNKSFPN

SEQ ID NO: 2272412 - protein, 10 aa, Cryptosporidium parvum
NNKSKDLKSV

SEQ ID NO: 2272413 - protein, 6 aa, Cryptosporidium parvum
NNKSRI

SEQ ID NO: 2272414 - protein, 11 aa, Cryptosporidium parvum
NNKSTYQKTRK

SEQ ID NO: 2272415 - protein, 7 aa, Cryptosporidium parvum
NNKSVTI

SEQ ID NO: 2272416 - protein, 6 aa, Cryptosporidium parvum
NNKSWL

SEQ ID NO: 2272417 - protein, 9 aa, Cryptosporidium parvum
NNKTEENKK

SEQ ID NO: 2272418 - protein, 5 aa, Cryptosporidium parvum
NNKTS

SEQ ID NO: 2272419 - protein, 13 aa, Cryptosporidium parvum
NNKVTNNNDNNNN

SEQ ID NO: 2272420 - protein, 4 aa, Cryptosporidium parvum
NNKY

SEQ ID NO: 2272421 - protein, 9 aa, Cryptosporidium parvum
NNLANDQKT

SEQ ID NO: 2272422 - protein, 31 aa, Cryptosporidium parvum
NNLDNERDSNRASTFNHTGTSSNISGTTLTT

SEQ ID NO: 2272423 - protein, 8 aa, Cryptosporidium parvum
NNLEEEEL

SEQ ID NO: 2272424 - protein, 32 aa, Cryptosporidium parvum
NNLETSNNNCNNNNNNNNNNNNNNNNHNDSSC

SEQ ID NO: 2272425 - protein, 11 aa, Cryptosporidium parvum
NNLGNLPNGRE

SEQ ID NO: 2272426 - protein, 37 aa, Cryptosporidium parvum
NNLKESSKKKETESNGTEEVTNSIDTHNGALEGNVGT

SEQ ID NO: 2272427 - protein, 8 aa, Cryptosporidium parvum
NNLKQGNI

SEQ ID NO: 2272428 - protein, 6 aa, Cryptosporidium parvum
NNLNDL

SEQ ID NO: 2272429 - protein, 6 aa, Cryptosporidium parvum
NNLNNQ

SEQ ID NO: 2272430 - protein, 13 aa, Cryptosporidium parvum
NNLPKTKETPAIN

SEQ ID NO: 2272431 - protein, 6 aa, Cryptosporidium parvum
NNLQNT

SEQ ID NO: 2272432 - protein, 4 aa, Cryptosporidium parvum
NNLR

SEQ ID NO: 2272433 - protein, 21 aa, Cryptosporidium parvum
NNLSGSDDNTPVVTSSPETGG

SEQ ID NO: 2272434 - protein, 4 aa, Cryptosporidium parvum
NNLT

SEQ ID NO: 2272435 - protein, 21 aa, Cryptosporidium parvum
NNLTDSSQRNQTNNDTYNEPN

SEQ ID NO: 2272436 - protein, 21 aa, Cryptosporidium parvum
NNLTSGSSQYPQDGINHLGQK

SEQ ID NO: 2272437 - protein, 7 aa, Cryptosporidium parvum
NNLVPDK

SEQ ID NO: 2272438 - protein, 6 aa, Cryptosporidium parvum
NNMGDF

SEQ ID NO: 2272439 - protein, 4 aa, Cryptosporidium parvum
NNMK

SEQ ID NO: 2272440 - protein, 6 aa, Cryptosporidium parvum
NNMKST

SEQ ID NO: 2272441 - protein, 12 aa, Cryptosporidium parvum
NNMNDDNSSLTS

SEQ ID NO: 2272442 - protein, 17 aa, Cryptosporidium parvum
NNMSRSGSYSATETSEL

SEQ ID NO: 2272443 - protein, 7 aa, Cryptosporidium parvum
NNNAKSV

SEQ ID NO: 2272444 - protein, 18 aa, Cryptosporidium parvum
NNNALTGQGSRPGSGTGI

SEQ ID NO: 2272445 - protein, 6 aa, Cryptosporidium parvum
NNNAPA

SEQ ID NO: 2272446 - protein, 6 aa, Cryptosporidium parvum
NNNCDA

SEQ ID NO: 2272447 - protein, 11 aa, Cryptosporidium parvum
NNNDDNSFGMG

SEQ ID NO: 2272448 - protein, 11 aa, Cryptosporidium parvum
NNNDELNDSSV

SEQ ID NO: 2272449 - protein, 10 aa, Cryptosporidium parvum
NNNDSDWSLS

SEQ ID NO: 2272450 - protein, 6 aa, Cryptosporidium parvum
NNNDTC

SEQ ID NO: 2272451 - protein, 4 aa, Cryptosporidium parvum
NNNE

SEQ ID NO: 2272452 - protein, 6 aa, Cryptosporidium parvum
NNNEIT

SEQ ID NO: 2272453 - protein, 11 aa, Cryptosporidium parvum
NNNELSPDSLK

SEQ ID NO: 2272454 - protein, 51 aa, Cryptosporidium parvum
NNNFGNNNEIEESMNNNNNINNNNNNINNNDNLTSIDNNNHKFSNKENIKS

SEQ ID NO: 2272455 - protein, 10 aa, Cryptosporidium parvum
NNNGDHEGIN

SEQ ID NO: 2272456 - protein, 8 aa, Cryptosporidium parvum
NNNGEKCN

SEQ ID NO: 2272457 - protein, 10 aa, Cryptosporidium parvum
NNNGESVGNN

SEQ ID NO: 2272458 - protein, 10 aa, Cryptosporidium parvum
NNNGGSNEFG

SEQ ID NO: 2272459 - protein, 8 aa, Cryptosporidium parvum
NNNGKETI

SEQ ID NO: 2272460 - protein, 48 aa, Cryptosporidium parvum
NNNGKGSKTISNPNLASTSTPGLSSSSSSENISKSSQNPSNINDPLKD

SEQ ID NO: 2272461 - protein, 7 aa, Cryptosporidium parvum
NNNGSGV

SEQ ID NO: 2272462 - protein, 8 aa, Cryptosporidium parvum
NNNGTDSG

SEQ ID NO: 2272463 - protein, 12 aa, Cryptosporidium parvum
NNNHNDNNGNNT

SEQ ID NO: 2272464 - protein, 5 aa, Cryptosporidium parvum
NNNHV

SEQ ID NO: 2272465 - protein, 19 aa, Cryptosporidium parvum
NNNIHGSFSNEDTNNTSVL

SEQ ID NO: 2272466 - protein, 7 aa, Cryptosporidium parvum
NNNISDS

SEQ ID NO: 2272467 - protein, 31 aa, Cryptosporidium parvum
NNNISNNGNSNNNSNINDYNNMNNSNNYNRH

SEQ ID NO: 2272468 - protein, 23 aa, Cryptosporidium parvum
NNNITRCSSNYREENFDRDSGSN

SEQ ID NO: 2272469 - protein, 11 aa, Cryptosporidium parvum
NNNIYSGGSSF

SEQ ID NO: 2272470 - protein, 4 aa, Cryptosporidium parvum
NNNK

SEQ ID NO: 2272471 - protein, 25 aa, Cryptosporidium parvum
NNNKNFSKSINSNSDQDKKLETDNN

SEQ ID NO: 2272472 - protein, 6 aa, Cryptosporidium parvum
NNNKNR

SEQ ID NO: 2272473 - protein, 8 aa, Cryptosporidium parvum
NNNKQTII

SEQ ID NO: 2272474 - protein, 9 aa, Cryptosporidium parvum
NNNKSRRRT

SEQ ID NO: 2272475 - protein, 6 aa, Cryptosporidium parvum
NNNLTS

SEQ ID NO: 2272476 - protein, 4 aa, Cryptosporidium parvum
NNNN

SEQ ID NO: 2272477 - protein, 10 aa, Cryptosporidium parvum
NNNNDNNNNN

SEQ ID NO: 2272478 - protein, 13 aa, Cryptosporidium parvum
NNNNDNNNNNDFK

SEQ ID NO: 2272479 - protein, 8 aa, Cryptosporidium parvum
NNNNEENI

SEQ ID NO: 2272480 - protein, 9 aa, Cryptosporidium parvum
NNNNGANSN

SEQ ID NO: 2272481 - protein, 14 aa, Cryptosporidium parvum
NNNNHEISSSQNQF

SEQ ID NO: 2272482 - protein, 10 aa, Cryptosporidium parvum
NNNNHHPSEE

SEQ ID NO: 2272483 - protein, 13 aa, Cryptosporidium parvum
NNNNKNNNNCNGN

SEQ ID NO: 2272484 - protein, 17 aa, Cryptosporidium parvum
NNNNKTNGISQSSNSRL

SEQ ID NO: 2272485 - protein, 10 aa, Cryptosporidium parvum
NNNNLDNETS

SEQ ID NO: 2272486 - protein, 8 aa, Cryptosporidium parvum
NNNNLGEG

SEQ ID NO: 2272487 - protein, 5 aa, Cryptosporidium parvum
NNNNN

SEQ ID NO: 2272488 - protein, 15 aa, Cryptosporidium parvum
NNNNNDNNKLTKNNG

SEQ ID NO: 2272489 - protein, 13 aa, Cryptosporidium parvum
NNNNNDNNNQLDR

SEQ ID NO: 2272490 - protein, 11 aa, Cryptosporidium parvum
NNNNNISIPDT

SEQ ID NO: 2272491 - protein, 8 aa, Cryptosporidium parvum
NNNNNKNY

SEQ ID NO: 2272492 - protein, 11 aa, Cryptosporidium parvum
NNNNNNINEEH

SEQ ID NO: 2272493 - protein, 25 aa, Cryptosporidium parvum
NNNNNNINNNINNNNNNNNNSVNDK

SEQ ID NO: 2272494 - protein, 10 aa, Cryptosporidium parvum
NNNNNNKRRI

SEQ ID NO: 2272495 - protein, 14 aa, Cryptosporidium parvum
NNNNNNNKCQYKES

SEQ ID NO: 2272496 - protein, 11 aa, Cryptosporidium parvum
NNNNNNNKQKH

SEQ ID NO: 2272497 - protein, 11 aa, Cryptosporidium parvum
NNNNNNNKSIN

SEQ ID NO: 2272498 - protein, 38 aa, Cryptosporidium parvum
NNNNNNNMNNMNNNDNNDNMNNVNNGNNGSNGSNNNDL

SEQ ID NO: 2272499 - protein, 12 aa, Cryptosporidium parvum
NNNNNNNNKREY

SEQ ID NO: 2272500 - protein, 13 aa, Cryptosporidium parvum
NNNNNNNNNDNNS

SEQ ID NO: 2272501 - protein, 10 aa, Cryptosporidium parvum
NNNNNNNNNI

SEQ ID NO: 2272502 - protein, 12 aa, Cryptosporidium parvum
NNNNNNNNNNNG

SEQ ID NO: 2272503 - protein, 13 aa, Cryptosporidium parvum
NNNNNNNNNNNNH

SEQ ID NO: 2272504 - protein, 20 aa, Cryptosporidium parvum
NNNNNNNNNNNNNDKKEFNR

SEQ ID NO: 2272505 - protein, 15 aa, Cryptosporidium parvum
NNNNNNNNNNNNNNN

SEQ ID NO: 2272506 - protein, 16 aa, Cryptosporidium parvum
NNNNNNNNNNNNNNNN

SEQ ID NO: 2272507 - protein, 22 aa, Cryptosporidium parvum
NNNNNNNNNNNNNNNNNINNNN

SEQ ID NO: 2272508 - protein, 30 aa, Cryptosporidium parvum
NNNNNNNNNNNNNNRLNENKSFKTSANKNI

SEQ ID NO: 2272509 - protein, 16 aa, Cryptosporidium parvum
NNNNNNNNNNNNNNSL

SEQ ID NO: 2272510 - protein, 43 aa, Cryptosporidium parvum
NNNNNNNNNNNNNSNNNNLGSNSTNGSGSSKTNDEQNSTISNQ

SEQ ID NO: 2272511 - protein, 17 aa, Cryptosporidium parvum
NNNNNNNNNNSNNNGCV

SEQ ID NO: 2272512 - protein, 7 aa, Cryptosporidium parvum
NNNNNNQ

SEQ ID NO: 2272513 - protein, 15 aa, Cryptosporidium parvum
NNNNNNSDDNDDDDY

SEQ ID NO: 2272514 - protein, 5 aa, Cryptosporidium parvum
NNNNP

SEQ ID NO: 2272515 - protein, 54 aa, Cryptosporidium parvum
NNNNQEKDLSIDDNNVANTPSDDFGHKEEVTQDSSPVSLNSSPMQEHKSEVEDI

SEQ ID NO: 2272516 - protein, 10 aa, Cryptosporidium parvum
NNNNQNMEEN

SEQ ID NO: 2272517 - protein, 9 aa, Cryptosporidium parvum
NNNNRNFGQ

SEQ ID NO: 2272518 - protein, 9 aa, Cryptosporidium parvum
NNNNSGKID

SEQ ID NO: 2272519 - protein, 19 aa, Cryptosporidium parvum
NNNNSIGMATNSNGANNAV

SEQ ID NO: 2272520 - protein, 18 aa, Cryptosporidium parvum
NNNNSNNNSNSNSSNTIN

SEQ ID NO: 2272521 - protein, 29 aa, Cryptosporidium parvum
NNNNTANVNNSITTTNTTSSNINNNPGIH

SEQ ID NO: 2272522 - protein, 9 aa, Cryptosporidium parvum
NNNNYNNSY

SEQ ID NO: 2272523 - protein, 4 aa, Cryptosporidium parvum
NNNP

SEQ ID NO: 2272524 - protein, 5 aa, Cryptosporidium parvum
NNNPA

SEQ ID NO: 2272525 - protein, 7 aa, Cryptosporidium parvum
NNNPELS

SEQ ID NO: 2272526 - protein, 5 aa, Cryptosporidium parvum
NNNPP

SEQ ID NO: 2272527 - protein, 4 aa, Cryptosporidium parvum
NNNQ

SEQ ID NO: 2272528 - protein, 16 aa, Cryptosporidium parvum
NNNQCEPNGNLGYGTK

SEQ ID NO: 2272529 - protein, 30 aa, Cryptosporidium parvum; identical to SEQ ID NO: 2153896

SEQ ID NO: 2272530 - protein, 7 aa, Cryptosporidium parvum
NNNQNND

SEQ ID NO: 2272531 - protein, 6 aa, Cryptosporidium parvum
NNNQQK

SEQ ID NO: 2272532 - protein, 6 aa, Cryptosporidium parvum
NNNRDD

SEQ ID NO: 2272533 - protein, 6 aa, Cryptosporidium parvum
NNNRGL

SEQ ID NO: 2272534 - protein, 5 aa, Cryptosporidium parvum
NNNRL

SEQ ID NO: 2272535 - protein, 12 aa, Cryptosporidium parvum
NNNRTQENHDNS

SEQ ID NO: 2272536 - protein, 10 aa, Cryptosporidium parvum
NNNRTSNSQS

SEQ ID NO: 2272537 - protein, 4 aa, Cryptosporidium parvum
NNNS

SEQ ID NO: 2272538 - protein, 8 aa, Cryptosporidium parvum
NNNSANMR

SEQ ID NO: 2272539 - protein, 20 aa, Cryptosporidium parvum
NNNSGDNSNIEEERNNNGLI

SEQ ID NO: 2272540 - protein, 6 aa, Cryptosporidium parvum
NNNSIE

SEQ ID NO: 2272541 - protein, 8 aa, Cryptosporidium parvum
NNNSNATL

SEQ ID NO: 2272542 - protein, 27 aa, Cryptosporidium parvum
NNNSNKIVTERNESSEINEQEECSQST

SEQ ID NO: 2272543 - protein, 9 aa, Cryptosporidium parvum
NNNSNNDYF

SEQ ID NO: 2272544 - protein, 9 aa, Cryptosporidium parvum
NNNSNSKVQ

SEQ ID NO: 2272545 - protein, 29 aa, Cryptosporidium parvum
NNNSQGNPNDPNAAGARAGQMGANGMQDP

SEQ ID NO: 2272546 - protein, 7 aa, Cryptosporidium parvum
NNNSRYK

SEQ ID NO: 2272547 - protein, 15 aa, Cryptosporidium parvum
NNNSTTSTTATTTTT

SEQ ID NO: 2272548 - protein, 9 aa, Cryptosporidium parvum
NNNTEKANA

SEQ ID NO: 2272549 - protein, 8 aa, Cryptosporidium parvum
NNNTGNNN

SEQ ID NO: 2272550 - protein, 10 aa, Cryptosporidium parvum
NNNTNDNNDL

SEQ ID NO: 2272551 - protein, 34 aa, Cryptosporidium parvum
NNNTNNTNNINTNTNNNNNNDNDDNDNKTEQDDI

SEQ ID NO: 2272552 - protein, 14 aa, Cryptosporidium parvum
NNNTNQQISRKNSG

SEQ ID NO: 2272553 - protein, 6 aa, Cryptosporidium parvum
NNNTQG

SEQ ID NO: 2272554 - protein, 12 aa, Cryptosporidium parvum
NNNTSSPIHKSK

SEQ ID NO: 2272555 - protein, 12 aa, Cryptosporidium parvum
NNNTTNSNSNIQ

SEQ ID NO: 2272556 - protein, 5 aa, Cryptosporidium parvum
NNNVD

SEQ ID NO: 2272557 - protein, 53 aa, Cryptosporidium parvum
NNNVDAKRSTDSDDGDEDFYEEPTQKKRSRKPSKTKVSQTSGVKRTVRSSRKA

SEQ ID NO: 2272558 - protein, 21 aa, Cryptosporidium parvum
NNNVGSSSNKHNPTQNTQVTS

SEQ ID NO: 2272559 - protein, 5 aa, Cryptosporidium parvum
NNNVS

SEQ ID NO: 2272560 - protein, 5 aa, Cryptosporidium parvum
NNNVY

SEQ ID NO: 2272561 - protein, 14 aa, Cryptosporidium parvum
NNNYDYNDNEQSSI

SEQ ID NO: 2272562 - protein, 6 aa, Cryptosporidium parvum
NNNYPF

SEQ ID NO: 2272563 - protein, 8 aa, Cryptosporidium parvum
NNNYSTNL

SEQ ID NO: 2272564 - protein, 5 aa, Cryptosporidium parvum
NNNYY

SEQ ID NO: 2272565 - protein, 5 aa, Cryptosporidium parvum
NNPAS

SEQ ID NO: 2272566 - protein, 9 aa, Cryptosporidium parvum
NNPDGISKD

SEQ ID NO: 2272567 - protein, 6 aa, Cryptosporidium parvum
NNPDRA

SEQ ID NO: 2272568 - protein, 8 aa, Cryptosporidium parvum
NNPEHSES

SEQ ID NO: 2272569 - protein, 6 aa, Cryptosporidium parvum
NNPENE

SEQ ID NO: 2272570 - protein, 4 aa, Cryptosporidium parvum
NNPF

SEQ ID NO: 2272571 - protein, 5 aa, Cryptosporidium parvum
NNPGI

SEQ ID NO: 2272572 - protein, 12 aa, Cryptosporidium parvum
NNPIKRCGSRTS

SEQ ID NO: 2272573 - protein, 6 aa, Cryptosporidium parvum
NNPKIS

SEQ ID NO: 2272574 - protein, 20 aa, Cryptosporidium parvum
NNPKTSASAETRGERGASAI

SEQ ID NO: 2272575 - protein, 4 aa, Cryptosporidium parvum
NNPL

SEQ ID NO: 2272576 - protein, 6 aa, Cryptosporidium parvum
NNPLVS

SEQ ID NO: 2272577 - protein, 4 aa, Cryptosporidium parvum
NNPN

SEQ ID NO: 2272578 - protein, 15 aa, Cryptosporidium parvum
NNPNIEQNDSKSAIN

SEQ ID NO: 2272579 - protein, 5 aa, Cryptosporidium parvum
NNPNY

SEQ ID NO: 2272580 - protein, 7 aa, Cryptosporidium parvum
NNPPGTL

SEQ ID NO: 2272581 - protein, 10 aa, Cryptosporidium parvum
NNPSEKRFES

SEQ ID NO: 2272582 - protein, 18 aa, Cryptosporidium parvum
NNPSFNYNNSQKNKQNWR

SEQ ID NO: 2272583 - protein, 5 aa, Cryptosporidium parvum
NNPTT

SEQ ID NO: 2272584 - protein, 12 aa, Cryptosporidium parvum
NNPWNEQHKNGE

SEQ ID NO: 2272585 - protein, 8 aa, Cryptosporidium parvum
NNQATTAP

SEQ ID NO: 2272586 - protein, 8 aa, Cryptosporidium parvum
NNQDETRE

SEQ ID NO: 2272587 - protein, 5 aa, Cryptosporidium parvum
NNQDK

SEQ ID NO: 2272588 - protein, 6 aa, Cryptosporidium parvum
NNQDLD

SEQ ID NO: 2272589 - protein, 7 aa, Cryptosporidium parvum
NNQDNQA

SEQ ID NO: 2272590 - protein, 13 aa, Cryptosporidium parvum
NNQDQSNSSFKVQ

SEQ ID NO: 2272591 - protein, 12 aa, Cryptosporidium parvum
NNQEHNSKEEKE

SEQ ID NO: 2272592 - protein, 9 aa, Cryptosporidium parvum
NNQEIQKQP

SEQ ID NO: 2272593 - protein, 7 aa, Cryptosporidium parvum
NNQENID

SEQ ID NO: 2272594 - protein, 16 aa, Cryptosporidium parvum
NNQERKYKGFKANQSQ

SEQ ID NO: 2272595 - protein, 14 aa, Cryptosporidium parvum
NNQGKVEQKNDTSI

SEQ ID NO: 2272596 - protein, 30 aa, Cryptosporidium parvum
NNQHPTQEPSLQEQGGQNSGTIGAQTPSQF

SEQ ID NO: 2272597 - protein, 17 aa, Cryptosporidium parvum
NNQIGSDNIKKDKELYD

SEQ ID NO: 2272598 - protein, 5 aa, Cryptosporidium parvum
NNQIS

SEQ ID NO: 2272599 - protein, 7 aa, Cryptosporidium parvum
NNQISGQ

SEQ ID NO: 2272600 - protein, 16 aa, Cryptosporidium parvum
NNQKADSFELGNSRRR

SEQ ID NO: 2272601 - protein, 17 aa, Cryptosporidium parvum
NNQKESIENNKHADECD

SEQ ID NO: 2272602 - protein, 7 aa, Cryptosporidium parvum
NNQKFND

SEQ ID NO: 2272603 - protein, 15 aa, Cryptosporidium parvum
NNQKNDIKALSQLRA

SEQ ID NO: 2272604 - protein, 9 aa, Cryptosporidium parvum
NNQKSDPNI

SEQ ID NO: 2272605 - protein, 6 aa, Cryptosporidium parvum
NNQLRD

SEQ ID NO: 2272606 - protein, 11 aa, Cryptosporidium parvum
NNQMEDTNEHE

SEQ ID NO: 2272607 - protein, 18 aa, Cryptosporidium parvum
NNQNDDQFSSKNSNDSRT

SEQ ID NO: 2272608 - protein, 9 aa, Cryptosporidium parvum
NNQNSGDIS

SEQ ID NO: 2272609 - protein, 5 aa, Cryptosporidium parvum
NNQNT

SEQ ID NO: 2272610 - protein, 7 aa, Cryptosporidium parvum
NNQNTKI

SEQ ID NO: 2272611 - protein, 7 aa, Cryptosporidium parvum
NNQPNIE

SEQ ID NO: 2272612 - protein, 5 aa, Cryptosporidium parvum
NNQQH

SEQ ID NO: 2272613 - protein, 4 aa, Cryptosporidium parvum
NNQS

SEQ ID NO: 2272614 - protein, 14 aa, Cryptosporidium parvum
NNQSDIKRKPNYMR

SEQ ID NO: 2272615 - protein, 14 aa, Cryptosporidium parvum
NNQSDNNIDQIKEE

SEQ ID NO: 2272616 - protein, 9 aa, Cryptosporidium parvum
NNQSIQERS

SEQ ID NO: 2272617 - protein, 7 aa, Cryptosporidium parvum
NNQSIRS

SEQ ID NO: 2272618 - protein, 5 aa, Cryptosporidium parvum
NNQSL

SEQ ID NO: 2272619 - protein, 8 aa, Cryptosporidium parvum
NNQSLNEN

SEQ ID NO: 2272620 - protein, 11 aa, Cryptosporidium parvum
NNQSNSSSNHN

SEQ ID NO: 2272621 - protein, 24 aa, Cryptosporidium parvum
NNQSSNLNNSDNLDNNNDNSNIDQ

SEQ ID NO: 2272622 - protein, 9 aa, Cryptosporidium parvum
NNQSTIPEN

SEQ ID NO: 2272623 - protein, 6 aa, Cryptosporidium parvum
NNQVSG

SEQ ID NO: 2272624 - protein, 9 aa, Cryptosporidium parvum
NNRAEYNRR

SEQ ID NO: 2272625 - protein, 6 aa, Cryptosporidium parvum
NNREDF

SEQ ID NO: 2272626 - protein, 15 aa, Cryptosporidium parvum
NNRESGNSRNTDNNY

SEQ ID NO: 2272627 - protein, 11 aa, Cryptosporidium parvum
NNRGSASLGLN

SEQ ID NO: 2272628 - protein, 6 aa, Cryptosporidium parvum
NNRGSY

SEQ ID NO: 2272629 - protein, 8 aa, Cryptosporidium parvum
NNRIGNDP

SEQ ID NO: 2272630 - protein, 15 aa, Cryptosporidium parvum
NNRKCDNSSLQETFR

SEQ ID NO: 2272631 - protein, 7 aa, Cryptosporidium parvum
NNRKFSR

SEQ ID NO: 2272632 - protein, 11 aa, Cryptosporidium parvum
NNRKKAKANTL

SEQ ID NO: 2272633 - protein, 8 aa, Cryptosporidium parvum
NNRKPIPG

SEQ ID NO: 2272634 - protein, 14 aa, Cryptosporidium parvum
NNRLQPTNTQLNDD

SEQ ID NO: 2272635 - protein, 5 aa, Cryptosporidium parvum
NNRLS

SEQ ID NO: 2272636 - protein, 15 aa, Cryptosporidium parvum
NNRLTKDRLKGNEEL

SEQ ID NO: 2272637 - protein, 16 aa, Cryptosporidium parvum
NNRNDNSEESTPLNKT

SEQ ID NO: 2272638 - protein, 11 aa, Cryptosporidium parvum
NNRNNISEHNS

SEQ ID NO: 2272639 - protein, 13 aa, Cryptosporidium parvum
NNRQEEDKKKVQI

SEQ ID NO: 2272640 - protein, 9 aa, Cryptosporidium parvum
NNRREFDSK

SEQ ID NO: 2272641 - protein, 16 aa, Cryptosporidium parvum
NNRRKSSISGGRTASA

SEQ ID NO: 2272642 - protein, 9 aa, Cryptosporidium parvum
NNRSIDSND

SEQ ID NO: 2272643 - protein, 11 aa, Cryptosporidium parvum
NNSANKAKKSI

SEQ ID NO: 2272644 - protein, 9 aa, Cryptosporidium parvum
NNSAQTNDI

SEQ ID NO: 2272645 - protein, 10 aa, Cryptosporidium parvum
NNSCIDEEQN

SEQ ID NO: 2272646 - protein, 8 aa, Cryptosporidium parvum
NNSDKKAL

SEQ ID NO: 2272647 - protein, 6 aa, Cryptosporidium parvum
NNSDNK

SEQ ID NO: 2272648 - protein, 8 aa, Cryptosporidium parvum
NNSELAAT

SEQ ID NO: 2272649 - protein, 5 aa, Cryptosporidium parvum
NNSEN

SEQ ID NO: 2272650 - protein, 8 aa, Cryptosporidium parvum
NNSESFEM

SEQ ID NO: 2272651 - protein, 19 aa, Cryptosporidium parvum
NNSESKPEEEDANKSDFNI

SEQ ID NO: 2272652 - protein, 8 aa, Cryptosporidium parvum
NNSFNESN

SEQ ID NO: 2272653 - protein, 5 aa, Cryptosporidium parvum
NNSGD

SEQ ID NO: 2272654 - protein, 10 aa, Cryptosporidium parvum
NNSGNGGKNQ

SEQ ID NO: 2272655 - protein, 9 aa, Cryptosporidium parvum
NNSGNSNNN

SEQ ID NO: 2272656 - protein, 10 aa, Cryptosporidium parvum
NNSGSKYNNQ

SEQ ID NO: 2272657 - protein, 6 aa, Cryptosporidium parvum
NNSGYI

SEQ ID NO: 2272658 - protein, 4 aa, Cryptosporidium parvum
NNSH

SEQ ID NO: 2272659 - protein, 31 aa, Cryptosporidium parvum
NNSIHSNSNNNNNRDDDHYSSSRAGSNVSDG

SEQ ID NO: 2272660 - protein, 17 aa, Cryptosporidium parvum
NNSINNTNYSCQNQSQN

SEQ ID NO: 2272661 - protein, 11 aa, Cryptosporidium parvum
NNSINSSDLSN

SEQ ID NO: 2272662 - protein, 9 aa, Cryptosporidium parvum
NNSISNNNI

SEQ ID NO: 2272663 - protein, 8 aa, Cryptosporidium parvum
NNSITGVK

SEQ ID NO: 2272664 - protein, 4 aa, Cryptosporidium parvum
NNSK

SEQ ID NO: 2272665 - protein, 9 aa, Cryptosporidium parvum
NNSKDGIES

SEQ ID NO: 2272666 - protein, 11 aa, Cryptosporidium parvum
NNSKENDTSTL

SEQ ID NO: 2272667 - protein, 12 aa, Cryptosporidium parvum
NNSKGNLDNGQV

SEQ ID NO: 2272668 - protein, 7 aa, Cryptosporidium parvum
NNSKHDD

SEQ ID NO: 2272669 - protein, 12 aa, Cryptosporidium parvum
NNSKLIEVEKWK

SEQ ID NO: 2272670 - protein, 45 aa, Cryptosporidium parvum
NNSKSGGMSNNNNNNNNIKSGEFNTPPREVGQELKDDDFKTAQAN

SEQ ID NO: 2272671 - protein, 11 aa, Cryptosporidium parvum
NNSKSGGYDSL

SEQ ID NO: 2272672 - protein, 7 aa, Cryptosporidium parvum
NNSKYPG

SEQ ID NO: 2272673 - protein, 7 aa, Cryptosporidium parvum
NNSLDEQ

SEQ ID NO: 2272674 - protein, 17 aa, Cryptosporidium parvum
NNSLNDDISAKYSSYSS

SEQ ID NO: 2272675 - protein, 5 aa, Cryptosporidium parvum
NNSLS

SEQ ID NO: 2272676 - protein, 5 aa, Cryptosporidium parvum
NNSME

SEQ ID NO: 2272677 - protein, 6 aa, Cryptosporidium parvum
NNSMGG

SEQ ID NO: 2272678 - protein, 7 aa, Cryptosporidium parvum
NNSNDAI

SEQ ID NO: 2272679 - protein, 9 aa, Cryptosporidium parvum
NNSNGNSKK

SEQ ID NO: 2272680 - protein, 14 aa, Cryptosporidium parvum
NNSNKLKNKENSYS

SEQ ID NO: 2272681 - protein, 5 aa, Cryptosporidium parvum
NNSNL

SEQ ID NO: 2272682 - protein, 9 aa, Cryptosporidium parvum
NNSNNNQRV

SEQ ID NO: 2272683 - protein, 22 aa, Cryptosporidium parvum
NNSNNNTTNNLNSGSNTSISAG

SEQ ID NO: 2272684 - protein, 8 aa, Cryptosporidium parvum
NNSNQNYS

SEQ ID NO: 2272685 - protein, 8 aa, Cryptosporidium parvum
NNSNSETR

SEQ ID NO: 2272686 - protein, 10 aa, Cryptosporidium parvum
NNSNSGINTS

SEQ ID NO: 2272687 - protein, 9 aa, Cryptosporidium parvum
NNSPIQTIN

SEQ ID NO: 2272688 - protein, 8 aa, Cryptosporidium parvum
NNSPNPLT

SEQ ID NO: 2272689 - protein, 6 aa, Cryptosporidium parvum
NNSPPI

SEQ ID NO: 2272690 - protein, 10 aa, Cryptosporidium parvum
NNSPTNNQQI

SEQ ID NO: 2272691 - protein, 6 aa, Cryptosporidium parvum
NNSQGI

SEQ ID NO: 2272692 - protein, 6 aa, Cryptosporidium parvum
NNSQHI

SEQ ID NO: 2272693 - protein, 7 aa, Cryptosporidium parvum
NNSQHTI

SEQ ID NO: 2272694 - protein, 6 aa, Cryptosporidium parvum
NNSQKK

SEQ ID NO: 2272695 - protein, 11 aa, Cryptosporidium parvum
NNSQKQNKSME

SEQ ID NO: 2272696 - protein, 9 aa, Cryptosporidium parvum
NNSQNQNYS

SEQ ID NO: 2272697 - protein, 12 aa, Cryptosporidium parvum
NNSQSNNSNSFN

SEQ ID NO: 2272698 - protein, 6 aa, Cryptosporidium parvum
NNSQTT

SEQ ID NO: 2272699 - protein, 9 aa, Cryptosporidium parvum
NNSQYSGSI

SEQ ID NO: 2272700 - protein, 4 aa, Cryptosporidium parvum
NNSR

SEQ ID NO: 2272701 - protein, 8 aa, Cryptosporidium parvum
NNSRGLDC

SEQ ID NO: 2272702 - protein, 9 aa, Cryptosporidium parvum
NNSRPEKFT

SEQ ID NO: 2272703 - protein, 9 aa, Cryptosporidium parvum
NNSSADPRG

SEQ ID NO: 2272704 - protein, 7 aa, Cryptosporidium parvum
NNSSAKH

SEQ ID NO: 2272705 - protein, 10 aa, Cryptosporidium parvum
NNSSANEIQE

SEQ ID NO: 2272706 - protein, 7 aa, Cryptosporidium parvum
NNSSDGS

SEQ ID NO: 2272707 - protein, 8 aa, Cryptosporidium parvum
NNSSESSL

SEQ ID NO: 2272708 - protein, 7 aa, Cryptosporidium parvum
NNSSGKQ

SEQ ID NO: 2272709 - protein, 22 aa, Cryptosporidium parvum
NNSSGQNSSSSSSKCKSGLPGV

SEQ ID NO: 2272710 - protein, 9 aa, Cryptosporidium parvum
NNSSKGKEM

SEQ ID NO: 2272711 - protein, 6 aa, Cryptosporidium parvum
NNSSLN

SEQ ID NO: 2272712 - protein, 19 aa, Cryptosporidium parvum
NNSSNEIEDGERTLQTNQA

SEQ ID NO: 2272713 - protein, 10 aa, Cryptosporidium parvum
NNSSNGGGYN

SEQ ID NO: 2272714 - protein, 8 aa, Cryptosporidium parvum
NNSSNNKY

SEQ ID NO: 2272715 - protein, 8 aa, Cryptosporidium parvum
NNSSPHPF

SEQ ID NO: 2272716 - protein, 13 aa, Cryptosporidium parvum
NNSSPRNQTSSFQ

SEQ ID NO: 2272717 - protein, 8 aa, Cryptosporidium parvum
NNSSYGGV

SEQ ID NO: 2272718 - protein, 23 aa, Cryptosporidium parvum
NNSSYTNLNSPSPSPSPSPSPSI

SEQ ID NO: 2272719 - protein, 12 aa, Cryptosporidium parvum
NNSTKPQAWEES

SEQ ID NO: 2272720 - protein, 5 aa, Cryptosporidium parvum
NNSTS

SEQ ID NO: 2272721 - protein, 17 aa, Cryptosporidium parvum
NNSTTIGNENYKGELEN

SEQ ID NO: 2272722 - protein, 10 aa, Cryptosporidium parvum
NNSTYPLSGN

SEQ ID NO: 2272723 - protein, 5 aa, Cryptosporidium parvum
NNSVE

SEQ ID NO: 2272724 - protein, 7 aa, Cryptosporidium parvum
NNSVGAK

SEQ ID NO: 2272725 - protein, 11 aa, Cryptosporidium parvum
NNSVSKSSFSS

SEQ ID NO: 2272726 - protein, 7 aa, Cryptosporidium parvum
NNSYAKQ

SEQ ID NO: 2272727 - protein, 26 aa, Cryptosporidium parvum
NNSYQDNNVNNAEKLPTRTESNSGAV

SEQ ID NO: 2272728 - protein, 6 aa, Cryptosporidium parvum
NNSYSS

SEQ ID NO: 2272729 - protein, 36 aa, Cryptosporidium parvum
NNTAKDNTNTGQPKKRKTEQSEKESSKAQKVQPENA

SEQ ID NO: 2272730 - protein, 5 aa, Cryptosporidium parvum
NNTDA

SEQ ID NO: 2272731 - protein, 7 aa, Cryptosporidium parvum
NNTDIGT

SEQ ID NO: 2272732 - protein, 8 aa, Cryptosporidium parvum
NNTEDSSK

SEQ ID NO: 2272733 - protein, 14 aa, Cryptosporidium parvum
NNTEEPNDSIKRNV

SEQ ID NO: 2272734 - protein, 16 aa, Cryptosporidium parvum
NNTENEATGESIGNSN

SEQ ID NO: 2272735 - protein, 9 aa, Cryptosporidium parvum
NNTERNMNE

SEQ ID NO: 2272736 - protein, 8 aa, Cryptosporidium parvum
NNTESTDS

SEQ ID NO: 2272737 - protein, 10 aa, Cryptosporidium parvum
NNTGNSFGSS

SEQ ID NO: 2272738 - protein, 4 aa, Cryptosporidium parvum
NNTH

SEQ ID NO: 2272739 - protein, 4 aa, Cryptosporidium parvum
NNTI

SEQ ID NO: 2272740 - protein, 7 aa, Cryptosporidium parvum
NNTIGGK

SEQ ID NO: 2272741 - protein, 11 aa, Cryptosporidium parvum
NNTIVSNPESI

SEQ ID NO: 2272742 - protein, 4 aa, Cryptosporidium parvum
NNTK

SEQ ID NO: 2272743 - protein, 9 aa, Cryptosporidium parvum
NNTKTEIDA

SEQ ID NO: 2272744 - protein, 4 aa, Cryptosporidium parvum
NNTL

SEQ ID NO: 2272745 - protein, 9 aa, Cryptosporidium parvum
NNTLSSSGE

SEQ ID NO: 2272746 - protein, 4 aa, Cryptosporidium parvum
NNTN

SEQ ID NO: 2272747 - protein, 9 aa, Cryptosporidium parvum
NNTNESSEH

SEQ ID NO: 2272748 - protein, 9 aa, Cryptosporidium parvum
NNTNNDNNT

SEQ ID NO: 2272749 - protein, 9 aa, Cryptosporidium parvum
NNTNNESRL

SEQ ID NO: 2272750 - protein, 9 aa, Cryptosporidium parvum
NNTNNGKAL

SEQ ID NO: 2272751 - protein, 11 aa, Cryptosporidium parvum
NNTNNIKNDEV

SEQ ID NO: 2272752 - protein, 18 aa, Cryptosporidium parvum
NNTNNNNINHKSNDFGFP

SEQ ID NO: 2272753 - protein, 6 aa, Cryptosporidium parvum
NNTNPN

SEQ ID NO: 2272754 - protein, 33 aa, Cryptosporidium parvum; identical to SEQ ID NO: 2154070

SEQ ID NO: 2272755 - protein, 8 aa, Cryptosporidium parvum
NNTPFDDA

SEQ ID NO: 2272756 - protein, 6 aa, Cryptosporidium parvum
NNTPKH

SEQ ID NO: 2272757 - protein, 18 aa, Cryptosporidium parvum
NNTPMTQMTPTSSGNNNF

SEQ ID NO: 2272758 - protein, 12 aa, Cryptosporidium parvum
NNTPSGSRNDKR

SEQ ID NO: 2272759 - protein, 21 aa, Cryptosporidium parvum
NNTPTSPPTVESPNSSNQRSM

SEQ ID NO: 2272760 - protein, 4 aa, Cryptosporidium parvum
NNTQ

SEQ ID NO: 2272761 - protein, 10 aa, Cryptosporidium parvum
NNTSAASNTI

SEQ ID NO: 2272762 - protein, 6 aa, Cryptosporidium parvum
NNTSEL

SEQ ID NO: 2272763 - protein, 40 aa, Cryptosporidium parvum
NNTSNKENIGSHNREEENSGTFNKKKDNRNVESDDNEEEM

SEQ ID NO: 2272764 - protein, 20 aa, Cryptosporidium parvum
NNTTGELSENSNQSYGTMDE

SEQ ID NO: 2272765 - protein, 9 aa, Cryptosporidium parvum
NNTTITKNK

SEQ ID NO: 2272766 - protein, 8 aa, Cryptosporidium parvum
NNTTPDDV

SEQ ID NO: 2272767 - protein, 8 aa, Cryptosporidium parvum
NNTTTRGT

SEQ ID NO: 2272768 - protein, 8 aa, Cryptosporidium parvum
NNTTYYNK

SEQ ID NO: 2272769 - protein, 18 aa, Cryptosporidium parvum
NNTVENNNTSNNNEITND

SEQ ID NO: 2272770 - protein, 16 aa, Cryptosporidium parvum
NNVDQSNEMTSEEKEL

SEQ ID NO: 2272771 - protein, 11 aa, Cryptosporidium parvum
NNVDSKEIEGI

SEQ ID NO: 2272772 - protein, 4 aa, Cryptosporidium parvum
NNVE

SEQ ID NO: 2272773 - protein, 5 aa, Cryptosporidium parvum
NNVGT

SEQ ID NO: 2272774 - protein, 5 aa, Cryptosporidium parvum
NNVKS

SEQ ID NO: 2272775 - protein, 23 aa, Cryptosporidium parvum
NNVNKKAKQDLEGDNTGKSQENM

SEQ ID NO: 2272776 - protein, 47 aa, Cryptosporidium parvum
NNVNTGPNSSNTGGGGGGSSKISESATSDQLGEGSDNIGNNTTGMEE

SEQ ID NO: 2272777 - protein, 4 aa, Cryptosporidium parvum
NNVP

SEQ ID NO: 2272778 - protein, 6 aa, Cryptosporidium parvum
NNVPDI

SEQ ID NO: 2272779 - protein, 4 aa, Cryptosporidium parvum
NNWD

SEQ ID NO: 2272780 - protein, 12 aa, Cryptosporidium parvum
NNYENGELDGDA

SEQ ID NO: 2272781 - protein, 16 aa, Cryptosporidium parvum
NNYENTLNKKNRKLTR

SEQ ID NO: 2272782 - protein, 4 aa, Cryptosporidium parvum
NNYH

SEQ ID NO: 2272783 - protein, 10 aa, Cryptosporidium parvum
NNYKGKNGPL

SEQ ID NO: 2272784 - protein, 8 aa, Cryptosporidium parvum
NNYKNDNI

SEQ ID NO: 2272785 - protein, 23 aa, Cryptosporidium parvum
NNYKTNNAIEPSTCETNQDNEYI

SEQ ID NO: 2272786 - protein, 11 aa, Cryptosporidium parvum
NNYLSQKTALN

SEQ ID NO: 2272787 - protein, 6 aa, Cryptosporidium parvum
NNYNFQ

SEQ ID NO: 2272788 - protein, 5 aa, Cryptosporidium parvum
NNYNQ

SEQ ID NO: 2272789 - protein, 6 aa, Cryptosporidium parvum
NNYNQN

SEQ ID NO: 2272790 - protein, 8 aa, Cryptosporidium parvum
NNYQEKGV

SEQ ID NO: 2272791 - protein, 8 aa, Cryptosporidium parvum
NNYQKTNQ

SEQ ID NO: 2272792 - protein, 11 aa, Cryptosporidium parvum
NNYQNDPGNLG

SEQ ID NO: 2272793 - protein, 7 aa, Cryptosporidium parvum
NNYSDEN

SEQ ID NO: 2272794 - protein, 24 aa, Cryptosporidium parvum
NNYSEITDSNNNNNNNNNGNNINN

SEQ ID NO: 2272795 - protein, 10 aa, Cryptosporidium parvum
NNYSGSSGIT

SEQ ID NO: 2272796 - protein, 8 aa, Cryptosporidium parvum
NNYSKSEN

SEQ ID NO: 2272797 - protein, 11 aa, Cryptosporidium parvum
NNYSRSLNSNN

SEQ ID NO: 2272798 - protein, 21 aa, Cryptosporidium parvum
NNYSSDPRQNPQYPNFAPSTF

SEQ ID NO: 2272799 - protein, 6 aa, Cryptosporidium parvum
NNYSSG

SEQ ID NO: 2272800 - protein, 7 aa, Cryptosporidium parvum
NNYTPKV

SEQ ID NO: 2272801 - protein, 9 aa, Cryptosporidium parvum
NPAKNKFTH

SEQ ID NO: 2272802 - protein, 4 aa, Cryptosporidium parvum
NPAM

SEQ ID NO: 2272803 - protein, 6 aa, Cryptosporidium parvum
NPASSS

SEQ ID NO: 2272804 - protein, 4 aa, Cryptosporidium parvum
NPAV

SEQ ID NO: 2272805 - protein, 4 aa, Cryptosporidium parvum
NPCE

SEQ ID NO: 2272806 - protein, 4 aa, Cryptosporidium parvum
NPCP

SEQ ID NO: 2272807 - protein, 8 aa, Cryptosporidium parvum
NPCSYRGN

SEQ ID NO: 2272808 - protein, 6 aa, Cryptosporidium parvum
NPDATL

SEQ ID NO: 2272809 - protein, 5 aa, Cryptosporidium parvum
NPDEY

SEQ ID NO: 2272810 - protein, 4 aa, Cryptosporidium parvum
NPDG

SEQ ID NO: 2272811 - protein, 9 aa, Cryptosporidium parvum
NPDGTMPMS

SEQ ID NO: 2272812 - protein, 5 aa, Cryptosporidium parvum
NPDKG

SEQ ID NO: 2272813 - protein, 9 aa, Cryptosporidium parvum
NPDKVQKSV

SEQ ID NO: 2272814 - protein, 7 aa, Cryptosporidium parvum
NPDKYDR

SEQ ID NO: 2272815 - protein, 5 aa, Cryptosporidium parvum
NPDLA

SEQ ID NO: 2272816 - protein, 9 aa, Cryptosporidium parvum
NPDLRASSK

SEQ ID NO: 2272817 - protein, 7 aa, Cryptosporidium parvum
NPDNPAL

SEQ ID NO: 2272818 - protein, 9 aa, Cryptosporidium parvum
NPDPESNGV

SEQ ID NO: 2272819 - protein, 5 aa, Cryptosporidium parvum
NPDQA

SEQ ID NO: 2272820 - protein, 5 aa, Cryptosporidium parvum
NPDSE

SEQ ID NO: 2272821 - protein, 4 aa, Cryptosporidium parvum
NPDV

SEQ ID NO: 2272822 - protein, 8 aa, Cryptosporidium parvum
NPDYKSPT

SEQ ID NO: 2272823 - protein, 6 aa, Cryptosporidium parvum
NPEAND

SEQ ID NO: 2272824 - protein, 17 aa, Cryptosporidium parvum
NPEANWGPISRPKNSGQ

SEQ ID NO: 2272825 - protein, 5 aa, Cryptosporidium parvum
NPEDL

SEQ ID NO: 2272826 - protein, 8 aa, Cryptosporidium parvum
NPEDMPPL

SEQ ID NO: 2272827 - protein, 7 aa, Cryptosporidium parvum
NPEEKIQ

SEQ ID NO: 2272828 - protein, 7 aa, Cryptosporidium parvum
NPEENAL

SEQ ID NO: 2272829 - protein, 5 aa, Cryptosporidium parvum
NPEET

SEQ ID NO: 2272830 - protein, 33 aa, Cryptosporidium parvum
NPEGKIDEKDSEKETLNHSKTKEIAKTKAAAQL

SEQ ID NO: 2272831 - protein, 16 aa, Cryptosporidium parvum
NPEGNHTASGGARGMG

SEQ ID NO: 2272832 - protein, 6 aa, Cryptosporidium parvum
NPELAS

SEQ ID NO: 2272833 - protein, 17 aa, Cryptosporidium parvum
NPELDNSNTQKKLQSEE

SEQ ID NO: 2272834 - protein, 5 aa, Cryptosporidium parvum
NPELS

SEQ ID NO: 2272835 - protein, 9 aa, Cryptosporidium parvum
NPENDETYT

SEQ ID NO: 2272836 - protein, 5 aa, Cryptosporidium parvum
NPENP

SEQ ID NO: 2272837 - protein, 7 aa, Cryptosporidium parvum
NPENSPD

SEQ ID NO: 2272838 - protein, 16 aa, Cryptosporidium parvum
NPENSSKELKNDEDSI

SEQ ID NO: 2272839 - protein, 6 aa, Cryptosporidium parvum
NPEQES

SEQ ID NO: 2272840 - protein, 14 aa, Cryptosporidium parvum
NPESDIPKRSKTHS

SEQ ID NO: 2272841 - protein, 18 aa, Cryptosporidium parvum
NPESEKKPYLPKDEDDLA

SEQ ID NO: 2272842 - protein, 6 aa, Cryptosporidium parvum
NPFGGT

SEQ ID NO: 2272843 - protein, 15 aa, Cryptosporidium parvum
NPFGPAGTGKTETVK

SEQ ID NO: 2272844 - protein, 5 aa, Cryptosporidium parvum
NPFPP

SEQ ID NO: 2272845 - protein, 6 aa, Cryptosporidium parvum
NPFSES

SEQ ID NO: 2272846 - protein, 11 aa, Cryptosporidium parvum
NPGDFANEENN

SEQ ID NO: 2272847 - protein, 5 aa, Cryptosporidium parvum
NPGDL

SEQ ID NO: 2272848 - protein, 9 aa, Cryptosporidium parvum
NPGENENHR

SEQ ID NO: 2272849 - protein, 7 aa, Cryptosporidium parvum
NPGENHG

SEQ ID NO: 2272850 - protein, 8 aa, Cryptosporidium parvum
NPGERELN

SEQ ID NO: 2272851 - protein, 4 aa, Cryptosporidium parvum
NPGF

SEQ ID NO: 2272852 - protein, 5 aa, Cryptosporidium parvum
NPGHN

SEQ ID NO: 2272853 - protein, 24 aa, Cryptosporidium parvum
NPGNLNVNGTTNQIQTSSAPMSTP

SEQ ID NO: 2272854 - protein, 6 aa, Cryptosporidium parvum
NPGVEK

SEQ ID NO: 2272855 - protein, 6 aa, Cryptosporidium parvum
NPHFES

SEQ ID NO: 2272856 - protein, 4 aa, Cryptosporidium parvum
NPHH

SEQ ID NO: 2272857 - protein, 18 aa, Cryptosporidium parvum
NPHPTTTSGTGTNPQSFA

SEQ ID NO: 2272858 - protein, 4 aa, Cryptosporidium parvum
NPHQ

SEQ ID NO: 2272859 - protein, 19 aa, Cryptosporidium parvum
NPHQDLQAQSRAHRMGQKN

SEQ ID NO: 2272860 - protein, 4 aa, Cryptosporidium parvum
NPID

SEQ ID NO: 2272861 - protein, 13 aa, Cryptosporidium parvum
NPIGQEPDIEDGE

SEQ ID NO: 2272862 - protein, 15 aa, Cryptosporidium parvum
NPIHSPESTSGPKKD

SEQ ID NO: 2272863 - protein, 5 aa, Cryptosporidium parvum
NPIKG

SEQ ID NO: 2272864 - protein, 6 aa, Cryptosporidium parvum
NPIPGF

SEQ ID NO: 2272865 - protein, 7 aa, Cryptosporidium parvum
NPIPRSD

SEQ ID NO: 2272866 - protein, 6 aa, Cryptosporidium parvum
NPIQNK

SEQ ID NO: 2272867 - protein, 17 aa, Cryptosporidium parvum
NPIQSNQNKKKQNQFDN

SEQ ID NO: 2272868 - protein, 4 aa, Cryptosporidium parvum
NPIT

SEQ ID NO: 2272869 - protein, 7 aa, Cryptosporidium parvum
NPITDEQ

SEQ ID NO: 2272870 - protein, 8 aa, Cryptosporidium parvum
NPITGEGG

SEQ ID NO: 2272871 - protein, 24 aa, Cryptosporidium parvum
NPKAPENKRKRPLKALNCTLPLYK

SEQ ID NO: 2272872 - protein, 4 aa, Cryptosporidium parvum
NPKD

SEQ ID NO: 2272873 - protein, 8 aa, Cryptosporidium parvum
NPKDNRYK

SEQ ID NO: 2272874 - protein, 8 aa, Cryptosporidium parvum
NPKDPNSC

SEQ ID NO: 2272875 - protein, 11 aa, Cryptosporidium parvum
NPKDSDIENQK

SEQ ID NO: 2272876 - protein, 37 aa, Cryptosporidium parvum
NPKGDFNRACTNKKSLEELNKKEKENKEGSTDKIEDD

SEQ ID NO: 2272877 - protein, 4 aa, Cryptosporidium parvum
NPKK

SEQ ID NO: 2272878 - protein, 31 aa, Cryptosporidium parvum
NPKNALSSGLTPNKQSNRKNKRRKSSNLSEE

SEQ ID NO: 2272879 - protein, 15 aa, Cryptosporidium parvum
NPKNHDGSQSERKID

SEQ ID NO: 2272880 - protein, 6 aa, Cryptosporidium parvum
NPKNLP

SEQ ID NO: 2272881 - protein, 13 aa, Cryptosporidium parvum
NPKNSGLITQPEN

SEQ ID NO: 2272882 - protein, 5 aa, Cryptosporidium parvum
NPKPG

SEQ ID NO: 2272883 - protein, 7 aa, Cryptosporidium parvum
NPKPKDV

SEQ ID NO: 2272884 - protein, 10 aa, Cryptosporidium parvum
NPKPKKYDTT

SEQ ID NO: 2272885 - protein, 6 aa, Cryptosporidium parvum
NPKPLH

SEQ ID NO: 2272886 - protein, 7 aa, Cryptosporidium parvum
NPKSNLT

SEQ ID NO: 2272887 - protein, 9 aa, Cryptosporidium parvum
NPKTELDAQ

SEQ ID NO: 2272888 - protein, 12 aa, Cryptosporidium parvum
NPKTRKIVPNEG

SEQ ID NO: 2272889 - protein, 4 aa, Cryptosporidium parvum
NPKY

SEQ ID NO: 2272890 - protein, 6 aa, Cryptosporidium parvum
NPLDDL

SEQ ID NO: 2272891 - protein, 4 aa, Cryptosporidium parvum
NPLE

SEQ ID NO: 2272892 - protein, 5 aa, Cryptosporidium parvum
NPLGL

SEQ ID NO: 2272893 - protein, 6 aa, Cryptosporidium parvum
NPLGYP

SEQ ID NO: 2272894 - protein, 15 aa, Cryptosporidium parvum
NPLPESQEDFTEDSD

SEQ ID NO: 2272895 - protein, 13 aa, Cryptosporidium parvum
NPLSLGNATDESL

SEQ ID NO: 2272896 - protein, 11 aa, Cryptosporidium parvum
NPLSQKKKQMS

SEQ ID NO: 2272897 - protein, 7 aa, Cryptosporidium parvum
NPLSQPP

SEQ ID NO: 2272898 - protein, 6 aa, Cryptosporidium parvum
NPLSRS

SEQ ID NO: 2272899 - protein, 6 aa, Cryptosporidium parvum
NPLSSD

SEQ ID NO: 2272900 - protein, 6 aa, Cryptosporidium parvum
NPMDKN

SEQ ID NO: 2272901 - protein, 6 aa, Cryptosporidium parvum
NPMFSS

SEQ ID NO: 2272902 - protein, 8 aa, Cryptosporidium parvum
NPNCPPPK

SEQ ID NO: 2272903 - protein, 9 aa, Cryptosporidium parvum
NPNDPRHSE

SEQ ID NO: 2272904 - protein, 11 aa, Cryptosporidium parvum
NPNDSDFKSNK

SEQ ID NO: 2272905 - protein, 12 aa, Cryptosporidium parvum
NPNDTIQQLSRL

SEQ ID NO: 2272906 - protein, 7 aa, Cryptosporidium parvum
NPNEHGD

SEQ ID NO: 2272907 - protein, 5 aa, Cryptosporidium parvum
NPNEI

SEQ ID NO: 2272908 - protein, 8 aa, Cryptosporidium parvum
NPNENFGK

SEQ ID NO: 2272909 - protein, 7 aa, Cryptosporidium parvum
NPNFNAP

SEQ ID NO: 2272910 - protein, 14 aa, Cryptosporidium parvum
NPNGGYIATGGADG

SEQ ID NO: 2272911 - protein, 12 aa, Cryptosporidium parvum
NPNGPNGQQNGA

SEQ ID NO: 2272912 - protein, 6 aa, Cryptosporidium parvum
NPNGSV

SEQ ID NO: 2272913 - protein, 35 aa, Cryptosporidium parvum
NPNGTLDKTNLDTSSISTKTIEKHSNSVRSGCSNA

SEQ ID NO: 2272914 - protein, 4 aa, Cryptosporidium parvum
NPNI

SEQ ID NO: 2272915 - protein, 13 aa, Cryptosporidium parvum
NPNIKSPAQAESY

SEQ ID NO: 2272916 - protein, 13 aa, Cryptosporidium parvum
NPNISGRMGEKQT

SEQ ID NO: 2272917 - protein, 11 aa, Cryptosporidium parvum
NPNKSETEDKS

SEQ ID NO: 2272918 - protein, 10 aa, Cryptosporidium parvum
NPNKTSYYKK

SEQ ID NO: 2272919 - protein, 19 aa, Cryptosporidium parvum
NPNNDIKQLNESGNEINCN

SEQ ID NO: 2272920 - protein, 11 aa, Cryptosporidium parvum
NPNNLKGKFSP

SEQ ID NO: 2272921 - protein, 10 aa, Cryptosporidium parvum
NPNNPEATPP

SEQ ID NO: 2272922 - protein, 9 aa, Cryptosporidium parvum
NPNPQERPN

SEQ ID NO: 2272923 - protein, 4 aa, Cryptosporidium parvum
NPNQ

SEQ ID NO: 2272924 - protein, 6 aa, Cryptosporidium parvum
NPNRIE

SEQ ID NO: 2272925 - protein, 7 aa, Cryptosporidium parvum
NPNSEEV

SEQ ID NO: 2272926 - protein, 9 aa, Cryptosporidium parvum
NPNSNNENE

SEQ ID NO: 2272927 - protein, 5 aa, Cryptosporidium parvum
NPNSP

SEQ ID NO: 2272928 - protein, 9 aa, Cryptosporidium parvum
NPNSSESDR

SEQ ID NO: 2272929 - protein, 8 aa, Cryptosporidium parvum
NPNSSFRG

SEQ ID NO: 2272930 - protein, 4 aa, Cryptosporidium parvum
NPNT

SEQ ID NO: 2272931 - protein, 9 aa, Cryptosporidium parvum
NPNTFSRNE

SEQ ID NO: 2272932 - protein, 25 aa, Cryptosporidium parvum
NPNTGTRRLSPQGQRELDSIARQCK

SEQ ID NO: 2272933 - protein, 5 aa, Cryptosporidium parvum
NPNTI

SEQ ID NO: 2272934 - protein, 6 aa, Cryptosporidium parvum
NPNVAA

SEQ ID NO: 2272935 - protein, 21 aa, Cryptosporidium parvum
NPNVDSNADVSYNSKLQPRKD

SEQ ID NO: 2272936 - protein, 15 aa, Cryptosporidium parvum
NPNVIGPDKQRQLED

SEQ ID NO: 2272937 - protein, 13 aa, Cryptosporidium parvum
NPPKQPGIDDVTG

SEQ ID NO: 2272938 - protein, 7 aa, Cryptosporidium parvum
NPPPITE

SEQ ID NO: 2272939 - protein, 8 aa, Cryptosporidium parvum
NPPSNDTE

SEQ ID NO: 2272940 - protein, 4 aa, Cryptosporidium parvum
NPPT

SEQ ID NO: 2272941 - protein, 11 aa, Cryptosporidium parvum
NPPTDTGRHPL

SEQ ID NO: 2272942 - protein, 14 aa, Cryptosporidium parvum
NPPTKNVDKPESWY

SEQ ID NO: 2272943 - protein, 11 aa, Cryptosporidium parvum
NPQIEKQAEDR

SEQ ID NO: 2272944 - protein, 7 aa, Cryptosporidium parvum
NPQISPR

SEQ ID NO: 2272945 - protein, 4 aa, Cryptosporidium parvum
NPQL

SEQ ID NO: 2272946 - protein, 4 aa, Cryptosporidium parvum
NPQN

SEQ ID NO: 2272947 - protein, 11 aa, Cryptosporidium parvum
NPQSQSNSGIK

SEQ ID NO: 2272948 - protein, 9 aa, Cryptosporidium parvum
NPQTEDGVN

SEQ ID NO: 2272949 - protein, 4 aa, Cryptosporidium parvum
NPRI

SEQ ID NO: 2272950 - protein, 12 aa, Cryptosporidium parvum
NPRINSNQGNLI

SEQ ID NO: 2272951 - protein, 7 aa, Cryptosporidium parvum
NPRLQGS

SEQ ID NO: 2272952 - protein, 18 aa, Cryptosporidium parvum
NPRNVGSLPSDDKNVGTA

SEQ ID NO: 2272953 - protein, 12 aa, Cryptosporidium parvum
NPRQKAPNSSLE

SEQ ID NO: 2272954 - protein, 19 aa, Cryptosporidium parvum
NPSATHNTLSGATFDSVSD

SEQ ID NO: 2272955 - protein, 5 aa, Cryptosporidium parvum
NPSDI

SEQ ID NO: 2272956 - protein, 8 aa, Cryptosporidium parvum
NPSDITSK

SEQ ID NO: 2272957 - protein, 6 aa, Cryptosporidium parvum
NPSDSL

SEQ ID NO: 2272958 - protein, 15 aa, Cryptosporidium parvum
NPSEIYSPSKEDRNF

SEQ ID NO: 2272959 - protein, 8 aa, Cryptosporidium parvum
NPSERITA

SEQ ID NO: 2272960 - protein, 13 aa, Cryptosporidium parvum
NPSGGDKPKDEAE

SEQ ID NO: 2272961 - protein, 23 aa, Cryptosporidium parvum
NPSGLNQTTQAQNPNSNSILNNN

SEQ ID NO: 2272962 - protein, 6 aa, Cryptosporidium parvum
NPSHSS

SEQ ID NO: 2272963 - protein, 10 aa, Cryptosporidium parvum
NPSKNTKPSF

SEQ ID NO: 2272964 - protein, 7 aa, Cryptosporidium parvum
NPSKYKD

SEQ ID NO: 2272965 - protein, 4 aa, Cryptosporidium parvum
NPSN

SEQ ID NO: 2272966 - protein, 10 aa, Cryptosporidium parvum
NPSNNSSNCQ

SEQ ID NO: 2272967 - protein, 10 aa, Cryptosporidium parvum
NPSQDYRSRS

SEQ ID NO: 2272968 - protein, 16 aa, Cryptosporidium parvum
NPSQGTPPLPKDGLSS

SEQ ID NO: 2272969 - protein, 6 aa, Cryptosporidium parvum
NPSQNK

SEQ ID NO: 2272970 - protein, 6 aa, Cryptosporidium parvum
NPSQTP

SEQ ID NO: 2272971 - protein, 4 aa, Cryptosporidium parvum
NPSS

SEQ ID NO: 2272972 - protein, 8 aa, Cryptosporidium parvum
NPSSESLK

SEQ ID NO: 2272973 - protein, 7 aa, Cryptosporidium parvum
NPSSKSV

SEQ ID NO: 2272974 - protein, 7 aa, Cryptosporidium parvum
NPSTGEE

SEQ ID NO: 2272975 - protein, 12 aa, Cryptosporidium parvum
NPSTGVQTEDSL

SEQ ID NO: 2272976 - protein, 5 aa, Cryptosporidium parvum
NPSTI

SEQ ID NO: 2272977 - protein, 6 aa, Cryptosporidium parvum
NPSTNS

SEQ ID NO: 2272978 - protein, 19 aa, Cryptosporidium parvum
NPSVPSLPQSQSNKQQISQ

SEQ ID NO: 2272979 - protein, 5 aa, Cryptosporidium parvum
NPSYK

SEQ ID NO: 2272980 - protein, 6 aa, Cryptosporidium parvum
NPTEIT

SEQ ID NO: 2272981 - protein, 6 aa, Cryptosporidium parvum
NPTFAQ

SEQ ID NO: 2272982 - protein, 5 aa, Cryptosporidium parvum
NPTFE

SEQ ID NO: 2272983 - protein, 17 aa, Cryptosporidium parvum
NPTFGSYDDSKDLTQQH

SEQ ID NO: 2272984 - protein, 6 aa, Cryptosporidium parvum
NPTGCA

SEQ ID NO: 2272985 - protein, 6 aa, Cryptosporidium parvum
NPTGQA

SEQ ID NO: 2272986 - protein, 15 aa, Cryptosporidium parvum
NPTHPTLRGTATSSD

SEQ ID NO: 2272987 - protein, 8 aa, Cryptosporidium parvum
NPTHTQVR

SEQ ID NO: 2272988 - protein, 6 aa, Cryptosporidium parvum
NPTKGM

SEQ ID NO: 2272989 - protein, 5 aa, Cryptosporidium parvum
NPTKI

SEQ ID NO: 2272990 - protein, 95 aa, Cryptosporidium parvum
NPTKSDESNPKNQSSANSSSSNNTSSSGSKPTSSAQKDYFSDKSKSASKSRSNNSSDQPHSSSNTHSETSNNSTNKNTVTSYESERSGGASGNRR

SEQ ID NO: 2272991 - protein, 13 aa, Cryptosporidium parvum
NPTNKAECNASDA

SEQ ID NO: 2272992 - protein, 6 aa, Cryptosporidium parvum
NPTNTP

SEQ ID NO: 2272993 - protein, 9 aa, Cryptosporidium parvum
NPTPLGHGR

SEQ ID NO: 2272994 - protein, 6 aa, Cryptosporidium parvum
NPTSAE

SEQ ID NO: 2272995 - protein, 6 aa, Cryptosporidium parvum
NPTSTL

SEQ ID NO: 2272996 - protein, 8 aa, Cryptosporidium parvum
NPTTNSYK

SEQ ID NO: 2272997 - protein, 7 aa, Cryptosporidium parvum
NPVASRQ

SEQ ID NO: 2272998 - protein, 9 aa, Cryptosporidium parvum
NPVENPSTK

SEQ ID NO: 2272999 - protein, 8 aa, Cryptosporidium parvum
NPVGPNHP

SEQ ID NO: 2273000 - protein, 4 aa, Cryptosporidium parvum
NPVL

SEQ ID NO: 2273001 - protein, 5 aa, Cryptosporidium parvum
NPVNN

SEQ ID NO: 2273002 - protein, 4 aa, Cryptosporidium parvum
NPVR

SEQ ID NO: 2273003 - protein, 13 aa, Cryptosporidium parvum
NPWRPNPTRMPYT

SEQ ID NO: 2273004 - protein, 4 aa, Cryptosporidium parvum
NPYA

SEQ ID NO: 2273005 - protein, 4 aa, Cryptosporidium parvum
NPYI

SEQ ID NO: 2273006 - protein, 6 aa, Cryptosporidium parvum
NPYNES

SEQ ID NO: 2273007 - protein, 10 aa, Cryptosporidium parvum
NPYQRSAASQ

SEQ ID NO: 2273008 - protein, 7 aa, Cryptosporidium parvum
NPYSGPE

SEQ ID NO: 2273009 - protein, 5 aa, Cryptosporidium parvum
NPYST

SEQ ID NO: 2273010 - protein, 4 aa, Cryptosporidium parvum
NPYT

SEQ ID NO: 2273011 - protein, 6 aa, Cryptosporidium parvum
NPYTEP

SEQ ID NO: 2273012 - protein, 6 aa, Cryptosporidium parvum
NQAEKL

SEQ ID NO: 2273013 - protein, 6 aa, Cryptosporidium parvum
NQAGFN

SEQ ID NO: 2273014 - protein, 9 aa, Cryptosporidium parvum
NQAHPSSGY

SEQ ID NO: 2273015 - protein, 8 aa, Cryptosporidium parvum
NQALSQKL

SEQ ID NO: 2273016 - protein, 8 aa, Cryptosporidium parvum
NQANNHNG

SEQ ID NO: 2273017 - protein, 7 aa, Cryptosporidium parvum
NQANSNY

SEQ ID NO: 2273018 - protein, 8 aa, Cryptosporidium parvum
NQAPPSRM

SEQ ID NO: 2273019 - protein, 14 aa, Cryptosporidium parvum
NQAQTERKKTGNTL

SEQ ID NO: 2273020 - protein, 24 aa, Cryptosporidium parvum
NQARASDEKGQKHRSRGLTRDTRA

SEQ ID NO: 2273021 - protein, 6 aa, Cryptosporidium parvum
NQASSE

SEQ ID NO: 2273022 - protein, 10 aa, Cryptosporidium parvum
NQCDGSKSLE

SEQ ID NO: 2273023 - protein, 12 aa, Cryptosporidium parvum
NQCPAKSQNTEF

SEQ ID NO: 2273024 - protein, 27 aa, Cryptosporidium parvum
NQDDNRFKPLNNNSSKSMGISPSTTAK

SEQ ID NO: 2273025 - protein, 5 aa, Cryptosporidium parvum
NQDDY

SEQ ID NO: 2273026 - protein, 5 aa, Cryptosporidium parvum
NQDEC

SEQ ID NO: 2273027 - protein, 6 aa, Cryptosporidium parvum
NQDEIN

SEQ ID NO: 2273028 - protein, 8 aa, Cryptosporidium parvum
NQDGDLGN

SEQ ID NO: 2273029 - protein, 5 aa, Cryptosporidium parvum
NQDGI

SEQ ID NO: 2273030 - protein, 10 aa, Cryptosporidium parvum
NQDGSGGEKV

SEQ ID NO: 2273031 - protein, 7 aa, Cryptosporidium parvum
NQDGTRI

SEQ ID NO: 2273032 - protein, 9 aa, Cryptosporidium parvum
NQDITQTEG

SEQ ID NO: 2273033 - protein, 11 aa, Cryptosporidium parvum
NQDKPRQSDTY

SEQ ID NO: 2273034 - protein, 12 aa, Cryptosporidium parvum
NQDLKKERDQMK

SEQ ID NO: 2273035 - protein, 4 aa, Cryptosporidium parvum
NQDN

SEQ ID NO: 2273036 - protein, 6 aa, Cryptosporidium parvum
NQDNED

SEQ ID NO: 2273037 - protein, 6 aa, Cryptosporidium parvum
NQDPEA

SEQ ID NO: 2273038 - protein, 6 aa, Cryptosporidium parvum
NQDRPR

SEQ ID NO: 2273039 - protein, 11 aa, Cryptosporidium parvum
NQDTSISGEAL

SEQ ID NO: 2273040 - protein, 7 aa, Cryptosporidium parvum
NQDVSNK

SEQ ID NO: 2273041 - protein, 10 aa, Cryptosporidium parvum
NQEDFDYEAD

SEQ ID NO: 2273042 - protein, 6 aa, Cryptosporidium parvum
NQEDSF

SEQ ID NO: 2273043 - protein, 7 aa, Cryptosporidium parvum
NQEENVT

SEQ ID NO: 2273044 - protein, 5 aa, Cryptosporidium parvum
NQEGP

SEQ ID NO: 2273045 - protein, 25 aa, Cryptosporidium parvum
NQELNSARELSGTIATENLDSSKNN

SEQ ID NO: 2273046 - protein, 8 aa, Cryptosporidium parvum
NQENKQEL

SEQ ID NO: 2273047 - protein, 5 aa, Cryptosporidium parvum
NQEPA

SEQ ID NO: 2273048 - protein, 5 aa, Cryptosporidium parvum
NQEPT

SEQ ID NO: 2273049 - protein, 4 aa, Cryptosporidium parvum
NQER

SEQ ID NO: 2273050 - protein, 10 aa, Cryptosporidium parvum
NQESSIDTTK

SEQ ID NO: 2273051 - protein, 17 aa, Cryptosporidium parvum
NQEVEEATNARDESRRH

SEQ ID NO: 2273052 - protein, 18 aa, Cryptosporidium parvum
NQEVNEKQDLNVNNDKIS

SEQ ID NO: 2273053 - protein, 16 aa, Cryptosporidium parvum
NQEYYSQENEIKPELE

SEQ ID NO: 2273054 - protein, 5 aa, Cryptosporidium parvum
NQFER

SEQ ID NO: 2273055 - protein, 4 aa, Cryptosporidium parvum
NQFN

SEQ ID NO: 2273056 - protein, 6 aa, Cryptosporidium parvum
NQFNSG

SEQ ID NO: 2273057 - protein, 14 aa, Cryptosporidium parvum
NQFQGTSGLLKFSK

SEQ ID NO: 2273058 - protein, 16 aa, Cryptosporidium parvum
NQFSKDYDKIDQTIKT

SEQ ID NO: 2273059 - protein, 7 aa, Cryptosporidium parvum
NQFSKQE

SEQ ID NO: 2273060 - protein, 13 aa, Cryptosporidium parvum
NQFTNDSDISGEE

SEQ ID NO: 2273061 - protein, 13 aa, Cryptosporidium parvum
NQGAGVSSEYSDC

SEQ ID NO: 2273062 - protein, 6 aa, Cryptosporidium parvum
NQGEEE

SEQ ID NO: 2273063 - protein, 5 aa, Cryptosporidium parvum
NQGGE

SEQ ID NO: 2273064 - protein, 5 aa, Cryptosporidium parvum
NQGIR

SEQ ID NO: 2273065 - protein, 22 aa, Cryptosporidium parvum
NQGKKKNENEEIVSSSDDESFL

SEQ ID NO: 2273066 - protein, 8 aa, Cryptosporidium parvum
NQGNENKF

SEQ ID NO: 2273067 - protein, 13 aa, Cryptosporidium parvum
NQGNGQQNQIQNQ

SEQ ID NO: 2273068 - protein, 6 aa, Cryptosporidium parvum
NQGNNF

SEQ ID NO: 2273069 - protein, 5 aa, Cryptosporidium parvum
NQGQT

SEQ ID NO: 2273070 - protein, 5 aa, Cryptosporidium parvum
NQGRN

SEQ ID NO: 2273071 - protein, 4 aa, Cryptosporidium parvum
NQGT

SEQ ID NO: 2273072 - protein, 21 aa, Cryptosporidium parvum
NQHETVNKAPSLTNDDFRKLF

SEQ ID NO: 2273073 - protein, 10 aa, Cryptosporidium parvum
NQHGSDAPSH

SEQ ID NO: 2273074 - protein, 9 aa, Cryptosporidium parvum
NQHKKKEKT

SEQ ID NO: 2273075 - protein, 14 aa, Cryptosporidium parvum
NQHPGTNDQSGYPD

SEQ ID NO: 2273076 - protein, 11 aa, Cryptosporidium parvum
NQIAGSPSHPN

SEQ ID NO: 2273077 - protein, 8 aa, Cryptosporidium parvum
NQIDPDRQ

SEQ ID NO: 2273078 - protein, 5 aa, Cryptosporidium parvum
NQIKR

SEQ ID NO: 2273079 - protein, 13 aa, Cryptosporidium parvum
NQIKSQNTVQEEI

SEQ ID NO: 2273080 - protein, 9 aa, Cryptosporidium parvum
NQINSSYSS

SEQ ID NO: 2273081 - protein, 11 aa, Cryptosporidium parvum
NQINYSSSGCN

SEQ ID NO: 2273082 - protein, 4 aa, Cryptosporidium parvum
NQIP

SEQ ID NO: 2273083 - protein, 8 aa, Cryptosporidium parvum
NQIPPGKQ

SEQ ID NO: 2273084 - protein, 18 aa, Cryptosporidium parvum
NQIRNGQSYKSNSTGQIS

SEQ ID NO: 2273085 - protein, 17 aa, Cryptosporidium parvum
NQISEEKKKYENEKSER

SEQ ID NO: 2273086 - protein, 5 aa, Cryptosporidium parvum
NQISH

SEQ ID NO: 2273087 - protein, 4 aa, Cryptosporidium parvum
NQIV

SEQ ID NO: 2273088 - protein, 18 aa, Cryptosporidium parvum
NQKDNDNNKNNLLEKNSA

SEQ ID NO: 2273089 - protein, 8 aa, Cryptosporidium parvum
NQKDPCGN

SEQ ID NO: 2273090 - protein, 9 aa, Cryptosporidium parvum
NQKESRISQ

SEQ ID NO: 2273091 - protein, 8 aa, Cryptosporidium parvum
NQKFDQKE

SEQ ID NO: 2273092 - protein, 5 aa, Cryptosporidium parvum
NQKFE

SEQ ID NO: 2273093 - protein, 54 aa, Cryptosporidium parvum
NQKHSSKLTDANSKNSNAAKPGSKAIPGPSYNEKFNGKESPTNKENVVNPNTFA

SEQ ID NO: 2273094 - protein, 7 aa, Cryptosporidium parvum
NQKKDNI

SEQ ID NO: 2273095 - protein, 15 aa, Cryptosporidium parvum
NQKKTNIDTNDEIAD

SEQ ID NO: 2273096 - protein, 8 aa, Cryptosporidium parvum
NQKNGPKI

SEQ ID NO: 2273097 - protein, 15 aa, Cryptosporidium parvum
NQKPQCISDNTEANI

SEQ ID NO: 2273098 - protein, 16 aa, Cryptosporidium parvum
NQKQISSLEERMKFMK

SEQ ID NO: 2273099 - protein, 14 aa, Cryptosporidium parvum
NQKQSIKSLSSTKR

SEQ ID NO: 2273100 - protein, 6 aa, Cryptosporidium parvum
NQKRPT

SEQ ID NO: 2273101 - protein, 10 aa, Cryptosporidium parvum
NQKSGSPISV

SEQ ID NO: 2273102 - protein, 9 aa, Cryptosporidium parvum
NQKSNNFKR

SEQ ID NO: 2273103 - protein, 12 aa, Cryptosporidium parvum
NQKTKSSEIGTT

SEQ ID NO: 2273104 - protein, 7 aa, Cryptosporidium parvum
NQKTPDY

SEQ ID NO: 2273105 - protein, 14 aa, Cryptosporidium parvum
NQKTQQEWNSGYSK

SEQ ID NO: 2273106 - protein, 4 aa, Cryptosporidium parvum
NQKY

SEQ ID NO: 2273107 - protein, 7 aa, Cryptosporidium parvum
NQKYPEY

SEQ ID NO: 2273108 - protein, 4 aa, Cryptosporidium parvum
NQLE

SEQ ID NO: 2273109 - protein, 7 aa, Cryptosporidium parvum
NQLEPGS

SEQ ID NO: 2273110 - protein, 5 aa, Cryptosporidium parvum
NQLGD

SEQ ID NO: 2273111 - protein, 26 aa, Cryptosporidium parvum
NQLGSETANSSLKNKHNLENQAERAL

SEQ ID NO: 2273112 - protein, 28 aa, Cryptosporidium parvum
NQLKREKKLEKSKRRRENREKEKRGEEV

SEQ ID NO: 2273113 - protein, 7 aa, Cryptosporidium parvum
NQLNEPH

SEQ ID NO: 2273114 - protein, 19 aa, Cryptosporidium parvum
NQLNSSNNNDDDDDNMDES

SEQ ID NO: 2273115 - protein, 7 aa, Cryptosporidium parvum
NQLRGND

SEQ ID NO: 2273116 - protein, 29 aa, Cryptosporidium parvum
NQLSNKNEIQVSSSDISSTISPNHSEKPK

SEQ ID NO: 2273117 - protein, 24 aa, Cryptosporidium parvum
NQLSSGSTPLNTTKYSKDNLPNIN

SEQ ID NO: 2273118 - protein, 5 aa, Cryptosporidium parvum
NQLTD

SEQ ID NO: 2273119 - protein, 7 aa, Cryptosporidium parvum
NQLTPVD

SEQ ID NO: 2273120 - protein, 35 aa, Cryptosporidium parvum; identical to SEQ ID NO: 2154392

SEQ ID NO: 2273121 - protein, 5 aa, Cryptosporidium parvum
NQMND

SEQ ID NO: 2273122 - protein, 5 aa, Cryptosporidium parvum
NQNDK

SEQ ID NO: 2273123 - protein, 15 aa, Cryptosporidium parvum
NQNGPNNFDSGNEIY

SEQ ID NO: 2273124 - protein, 14 aa, Cryptosporidium parvum
NQNHQNQNNTNGYQ

SEQ ID NO: 2273125 - protein, 4 aa, Cryptosporidium parvum
NQNI

SEQ ID NO: 2273126 - protein, 8 aa, Cryptosporidium parvum
NQNIEDSS

SEQ ID NO: 2273127 - protein, 6 aa, Cryptosporidium parvum
NQNIGH

SEQ ID NO: 2273128 - protein, 4 aa, Cryptosporidium parvum
NQNK

SEQ ID NO: 2273129 - protein, 9 aa, Cryptosporidium parvum
NQNKTISGK

SEQ ID NO: 2273130 - protein, 4 aa, Cryptosporidium parvum
NQNL

SEQ ID NO: 2273131 - protein, 7 aa, Cryptosporidium parvum
NQNLESN

SEQ ID NO: 2273132 - protein, 8 aa, Cryptosporidium parvum
NQNNDNRY

SEQ ID NO: 2273133 - protein, 10 aa, Cryptosporidium parvum
NQNNKYKQTK

SEQ ID NO: 2273134 - protein, 19 aa, Cryptosporidium parvum
NQNNSETQAEDINVEGDGL

SEQ ID NO: 2273135 - protein, 41 aa, Cryptosporidium parvum
NQNNSQTQAKSEPENAQSLSTSTTGCSSSAQVLPNNSSNTM

SEQ ID NO: 2273136 - protein, 17 aa, Cryptosporidium parvum
NQNNTNNNNNNNLISPY

SEQ ID NO: 2273137 - protein, 15 aa, Cryptosporidium parvum
NQNPHNPSFNSNNQY

SEQ ID NO: 2273138 - protein, 8 aa, Cryptosporidium parvum
NQNPVKNE

SEQ ID NO: 2273139 - protein, 11 aa, Cryptosporidium parvum
NQNQNTNIGTS

SEQ ID NO: 2273140 - protein, 17 aa, Cryptosporidium parvum
NQNQRENNAYSGTNQEG

SEQ ID NO: 2273141 - protein, 8 aa, Cryptosporidium parvum
NQNRTNLN

SEQ ID NO: 2273142 - protein, 4 aa, Cryptosporidium parvum
NQNS

SEQ ID NO: 2273143 - protein, 5 aa, Cryptosporidium parvum
NQNSF

SEQ ID NO: 2273144 - protein, 8 aa, Cryptosporidium parvum
NQNSNKKH

SEQ ID NO: 2273145 - protein, 38 aa, Cryptosporidium parvum
NQNSPSKDQGFETLNNSQSRIHSNSNSSLGAQGDISNY

SEQ ID NO: 2273146 - protein, 16 aa, Cryptosporidium parvum
NQNSQEDSSSSSQEYV

SEQ ID NO: 2273147 - protein, 19 aa, Cryptosporidium parvum
NQNTNSKNSNDYLDESNNQ

SEQ ID NO: 2273148 - protein, 8 aa, Cryptosporidium parvum
NQNTYNPQ

SEQ ID NO: 2273149 - protein, 6 aa, Cryptosporidium parvum
NQNVAQ

SEQ ID NO: 2273150 - protein, 13 aa, Cryptosporidium parvum
NQPGRKQSRRIAR

SEQ ID NO: 2273151 - protein, 5 aa, Cryptosporidium parvum
NQPIL

SEQ ID NO: 2273152 - protein, 9 aa, Cryptosporidium parvum
NQPKAPNHL

SEQ ID NO: 2273153 - protein, 5 aa, Cryptosporidium parvum
NQPKE

SEQ ID NO: 2273154 - protein, 35 aa, Cryptosporidium parvum
NQPKTNDEHSEATEELSNKDSLSKSRKSKFSFNPN

SEQ ID NO: 2273155 - protein, 6 aa, Cryptosporidium parvum
NQPSKY

SEQ ID NO: 2273156 - protein, 8 aa, Cryptosporidium parvum
NQPSNQYH

SEQ ID NO: 2273157 - protein, 4 aa, Cryptosporidium parvum
NQPY

SEQ ID NO: 2273158 - protein, 8 aa, Cryptosporidium parvum
NQQDKELS

SEQ ID NO: 2273159 - protein, 4 aa, Cryptosporidium parvum
NQQL

SEQ ID NO: 2273160 - protein, 5 aa, Cryptosporidium parvum
NQQNH

SEQ ID NO: 2273161 - protein, 7 aa, Cryptosporidium parvum
NQQNNNN

SEQ ID NO: 2273162 - protein, 12 aa, Cryptosporidium parvum
NQQNSTEAEIGS

SEQ ID NO: 2273163 - protein, 39 aa, Cryptosporidium parvum
NQQPPKEDLKSSIKAPPVPKSGPGNEKTEEEKLKSSEPI

SEQ ID NO: 2273164 - protein, 12 aa, Cryptosporidium parvum
NQQPSIATNGNN

SEQ ID NO: 2273165 - protein, 10 aa, Cryptosporidium parvum
NQQQQKQQQL

SEQ ID NO: 2273166 - protein, 14 aa, Cryptosporidium parvum
NQQRNGKKSLTTVQ

SEQ ID NO: 2273167 - protein, 13 aa, Cryptosporidium parvum
NQQSSGGLFGTSN

SEQ ID NO: 2273168 - protein, 8 aa, Cryptosporidium parvum
NQQSVTSK

SEQ ID NO: 2273169 - protein, 8 aa, Cryptosporidium parvum
NQQVENER

SEQ ID NO: 2273170 - protein, 5 aa, Cryptosporidium parvum
NQQVS

SEQ ID NO: 2273171 - protein, 13 aa, Cryptosporidium parvum
NQRHPSPNKLYTG

SEQ ID NO: 2273172 - protein, 4 aa, Cryptosporidium parvum
NQRI

SEQ ID NO: 2273173 - protein, 6 aa, Cryptosporidium parvum
NQRKNF

SEQ ID NO: 2273174 - protein, 6 aa, Cryptosporidium parvum
NQRNAA

SEQ ID NO: 2273175 - protein, 18 aa, Cryptosporidium parvum
NQRNTNQKDEFQFESDSE

SEQ ID NO: 2273176 - protein, 9 aa, Cryptosporidium parvum
NQRQQSNRV

SEQ ID NO: 2273177 - protein, 8 aa, Cryptosporidium parvum
NQRSDASK

SEQ ID NO: 2273178 - protein, 5 aa, Cryptosporidium parvum
NQRSG

SEQ ID NO: 2273179 - protein, 9 aa, Cryptosporidium parvum
NQSADTDEF

SEQ ID NO: 2273180 - protein, 5 aa, Cryptosporidium parvum
NQSAH

SEQ ID NO: 2273181 - protein, 4 aa, Cryptosporidium parvum
NQSC

SEQ ID NO: 2273182 - protein, 12 aa, Cryptosporidium parvum
NQSDTSEPESLD

SEQ ID NO: 2273183 - protein, 6 aa, Cryptosporidium parvum
NQSEFG

SEQ ID NO: 2273184 - protein, 17 aa, Cryptosporidium parvum
NQSETETEQTTSVSSQE

SEQ ID NO: 2273185 - protein, 12 aa, Cryptosporidium parvum
NQSFDSNLDQES

SEQ ID NO: 2273186 - protein, 4 aa, Cryptosporidium parvum
NQSI

SEQ ID NO: 2273187 - protein, 9 aa, Cryptosporidium parvum
NQSIGTNSK

SEQ ID NO: 2273188 - protein, 10 aa, Cryptosporidium parvum
NQSINEAHSE

SEQ ID NO: 2273189 - protein, 6 aa, Cryptosporidium parvum
NQSKGA

SEQ ID NO: 2273190 - protein, 12 aa, Cryptosporidium parvum
NQSKGGTTCTTR

SEQ ID NO: 2273191 - protein, 6 aa, Cryptosporidium parvum
NQSKNL

SEQ ID NO: 2273192 - protein, 17 aa, Cryptosporidium parvum
NQSKNSKISNGKSSSMM

SEQ ID NO: 2273193 - protein, 9 aa, Cryptosporidium parvum
NQSKQNENE

SEQ ID NO: 2273194 - protein, 13 aa, Cryptosporidium parvum
NQSNKYGDDGYCS

SEQ ID NO: 2273195 - protein, 12 aa, Cryptosporidium parvum
NQSNYNSNWKQT

SEQ ID NO: 2273196 - protein, 6 aa, Cryptosporidium parvum
NQSPRN

SEQ ID NO: 2273197 - protein, 26 aa, Cryptosporidium parvum
NQSQTQSQQQQQQTSPFSGGNIQTNI

SEQ ID NO: 2273198 - protein, 8 aa, Cryptosporidium parvum
NQSSAEFN

SEQ ID NO: 2273199 - protein, 5 aa, Cryptosporidium parvum
NQSSC

SEQ ID NO: 2273200 - protein, 6 aa, Cryptosporidium parvum
NQSSDY

SEQ ID NO: 2273201 - protein, 16 aa, Cryptosporidium parvum
NQSSNEQNCETGQGKY

SEQ ID NO: 2273202 - protein, 9 aa, Cryptosporidium parvum
NQSSTDLGD

SEQ ID NO: 2273203 - protein, 5 aa, Cryptosporidium parvum
NQSTT

SEQ ID NO: 2273204 - protein, 7 aa, Cryptosporidium parvum
NQSTTNT

SEQ ID NO: 2273205 - protein, 14 aa, Cryptosporidium parvum
NQTAEKDEFEHQQK

SEQ ID NO: 2273206 - protein, 6 aa, Cryptosporidium parvum
NQTEGL

SEQ ID NO: 2273207 - protein, 5 aa, Cryptosporidium parvum
NQTFG

SEQ ID NO: 2273208 - protein, 10 aa, Cryptosporidium parvum
NQTHKSEKSP

SEQ ID NO: 2273209 - protein, 5 aa, Cryptosporidium parvum
NQTHP

SEQ ID NO: 2273210 - protein, 4 aa, Cryptosporidium parvum
NQTI

SEQ ID NO: 2273211 - protein, 15 aa, Cryptosporidium parvum
NQTKPYRHSPGPQTY

SEQ ID NO: 2273212 - protein, 5 aa, Cryptosporidium parvum
NQTLE

SEQ ID NO: 2273213 - protein, 6 aa, Cryptosporidium parvum
NQTNFA

SEQ ID NO: 2273214 - protein, 9 aa, Cryptosporidium parvum
NQTPSNTDQ

SEQ ID NO: 2273215 - protein, 4 aa, Cryptosporidium parvum
NQTR

SEQ ID NO: 2273216 - protein, 5 aa, Cryptosporidium parvum
NQTRA

SEQ ID NO: 2273217 - protein, 5 aa, Cryptosporidium parvum
NQTSD

SEQ ID NO: 2273218 - protein, 6 aa, Cryptosporidium parvum
NQTSEI

SEQ ID NO: 2273219 - protein, 4 aa, Cryptosporidium parvum
NQVE

SEQ ID NO: 2273220 - protein, 7 aa, Cryptosporidium parvum
NQVNSQV

SEQ ID NO: 2273221 - protein, 4 aa, Cryptosporidium parvum
NQVP

SEQ ID NO: 2273222 - protein, 5 aa, Cryptosporidium parvum
NQYEE

SEQ ID NO: 2273223 - protein, 10 aa, Cryptosporidium parvum
NQYEEPPVDN

SEQ ID NO: 2273224 - protein, 4 aa, Cryptosporidium parvum
NQYK

SEQ ID NO: 2273225 - protein, 7 aa, Cryptosporidium parvum
NQYNSES

SEQ ID NO: 2273226 - protein, 8 aa, Cryptosporidium parvum
NQYPSSTR

SEQ ID NO: 2273227 - protein, 16 aa, Cryptosporidium parvum
NQYREAETLEELNTSE

SEQ ID NO: 2273228 - protein, 4 aa, Cryptosporidium parvum
NRAE

SEQ ID NO: 2273229 - protein, 10 aa, Cryptosporidium parvum
NRAREGNYPI

SEQ ID NO: 2273230 - protein, 6 aa, Cryptosporidium parvum
NRASGG

SEQ ID NO: 2273231 - protein, 9 aa, Cryptosporidium parvum
NRDDPKNAE

SEQ ID NO: 2273232 - protein, 4 aa, Cryptosporidium parvum
NRDE

SEQ ID NO: 2273233 - protein, 4 aa, Cryptosporidium parvum
NRDG

SEQ ID NO: 2273234 - protein, 8 aa, Cryptosporidium parvum
NRDGGSGG

SEQ ID NO: 2273235 - protein, 4 aa, Cryptosporidium parvum
NRDL

SEQ ID NO: 2273236 - protein, 26 aa, Cryptosporidium parvum
NRDPSLIPSEEQDKSFFNSDDSGGRL

SEQ ID NO: 2273237 - protein, 4 aa, Cryptosporidium parvum
NRDR

SEQ ID NO: 2273238 - protein, 10 aa, Cryptosporidium parvum
NRDSDTNLVT

SEQ ID NO: 2273239 - protein, 6 aa, Cryptosporidium parvum
NRDTSI

SEQ ID NO: 2273240 - protein, 8 aa, Cryptosporidium parvum
NREEDDNR

SEQ ID NO: 2273241 - protein, 5 aa, Cryptosporidium parvum
NREHQ

SEQ ID NO: 2273242 - protein, 5 aa, Cryptosporidium parvum
NREKK

SEQ ID NO: 2273243 - protein, 4 aa, Cryptosporidium parvum
NREN

SEQ ID NO: 2273244 - protein, 9 aa, Cryptosporidium parvum
NRENEPNTY

SEQ ID NO: 2273245 - protein, 8 aa, Cryptosporidium parvum
NRENSPMK

SEQ ID NO: 2273246 - protein, 7 aa, Cryptosporidium parvum
NRENSQV

SEQ ID NO: 2273247 - protein, 9 aa, Cryptosporidium parvum
NRENTLNDE

SEQ ID NO: 2273248 - protein, 6 aa, Cryptosporidium parvum
NRESLE

SEQ ID NO: 2273249 - protein, 6 aa, Cryptosporidium parvum
NRESRE

SEQ ID NO: 2273250 - protein, 5 aa, Cryptosporidium parvum
NRESY

SEQ ID NO: 2273251 - protein, 24 aa, Cryptosporidium parvum
NRETLNSRKKENDKLESEKSDLRR

SEQ ID NO: 2273252 - protein, 8 aa, Cryptosporidium parvum
NRETNKNK

SEQ ID NO: 2273253 - protein, 4 aa, Cryptosporidium parvum
NREY

SEQ ID NO: 2273254 - protein, 6 aa, Cryptosporidium parvum
NREYDN

SEQ ID NO: 2273255 - protein, 11 aa, Cryptosporidium parvum
NRFGDSKTNLD

SEQ ID NO: 2273256 - protein, 12 aa, Cryptosporidium parvum
NRFNSNNDQYEF

SEQ ID NO: 2273257 - protein, 18 aa, Cryptosporidium parvum
NRFPGFTKGENGAEDSFD

SEQ ID NO: 2273258 - protein, 6 aa, Cryptosporidium parvum
NRGIYS

SEQ ID NO: 2273259 - protein, 5 aa, Cryptosporidium parvum
NRGNL

SEQ ID NO: 2273260 - protein, 14 aa, Cryptosporidium parvum
NRGSLGSISKSTGI

SEQ ID NO: 2273261 - protein, 5 aa, Cryptosporidium parvum
NRGSR

SEQ ID NO: 2273262 - protein, 14 aa, Cryptosporidium parvum
NRIANTGSSPNISL

SEQ ID NO: 2273263 - protein, 4 aa, Cryptosporidium parvum
NRID

SEQ ID NO: 2273264 - protein, 5 aa, Cryptosporidium parvum
NRIQN

SEQ ID NO: 2273265 - protein, 5 aa, Cryptosporidium parvum
NRISN

SEQ ID NO: 2273266 - protein, 9 aa, Cryptosporidium parvum
NRISTGGHQ

SEQ ID NO: 2273267 - protein, 42 aa, Cryptosporidium parvum
NRITKSREKVSQESEIPSKRSNKTKKSQTSNINSGTSKQQTL

SEQ ID NO: 2273268 - protein, 14 aa, Cryptosporidium parvum
NRKANKNNHSDSKK

SEQ ID NO: 2273269 - protein, 6 aa, Cryptosporidium parvum
NRKDSY

SEQ ID NO: 2273270 - protein, 9 aa, Cryptosporidium parvum
NRKGTKGKN

SEQ ID NO: 2273271 - protein, 11 aa, Cryptosporidium parvum
NRKISNDSDQI

SEQ ID NO: 2273272 - protein, 9 aa, Cryptosporidium parvum
NRKKKEEID

SEQ ID NO: 2273273 - protein, 7 aa, Cryptosporidium parvum
NRKNQTY

SEQ ID NO: 2273274 - protein, 13 aa, Cryptosporidium parvum
NRKNTTGGDINNT

SEQ ID NO: 2273275 - protein, 5 aa, Cryptosporidium parvum
NRKNV

SEQ ID NO: 2273276 - protein, 8 aa, Cryptosporidium parvum
NRKPGPAD

SEQ ID NO: 2273277 - protein, 7 aa, Cryptosporidium parvum
NRKPQYS

SEQ ID NO: 2273278 - protein, 6 aa, Cryptosporidium parvum
NRKPRV

SEQ ID NO: 2273279 - protein, 8 aa, Cryptosporidium parvum
NRKPWEKA

SEQ ID NO: 2273280 - protein, 4 aa, Cryptosporidium parvum
NRKS

SEQ ID NO: 2273281 - protein, 18 aa, Cryptosporidium parvum
NRKSDLSLSSSSIAKKLN

SEQ ID NO: 2273282 - protein, 6 aa, Cryptosporidium parvum
NRLASG

SEQ ID NO: 2273283 - protein, 8 aa, Cryptosporidium parvum
NRLKEENQ

SEQ ID NO: 2273284 - protein, 6 aa, Cryptosporidium parvum
NRLKER

SEQ ID NO: 2273285 - protein, 12 aa, Cryptosporidium parvum
NRLNSNKDSISN

SEQ ID NO: 2273286 - protein, 7 aa, Cryptosporidium parvum
NRLSKNN

SEQ ID NO: 2273287 - protein, 5 aa, Cryptosporidium parvum
NRLST

SEQ ID NO: 2273288 - protein, 9 aa, Cryptosporidium parvum
NRMNSRQTD

SEQ ID NO: 2273289 - protein, 24 aa, Cryptosporidium parvum
NRMSNSQPAQSGTIIPSNDYDVGS

SEQ ID NO: 2273290 - protein, 8 aa, Cryptosporidium parvum
NRNDPRIS

SEQ ID NO: 2273291 - protein, 5 aa, Cryptosporidium parvum
NRNDY

SEQ ID NO: 2273292 - protein, 7 aa, Cryptosporidium parvum
NRNEIDK

SEQ ID NO: 2273293 - protein, 4 aa, Cryptosporidium parvum
NRNF

SEQ ID NO: 2273294 - protein, 28 aa, Cryptosporidium parvum
NRNHPSEKKMNTKQNVNTPNGQNNYNKN

SEQ ID NO: 2273295 - protein, 12 aa, Cryptosporidium parvum
NRNIENNSDEKK

SEQ ID NO: 2273296 - protein, 4 aa, Cryptosporidium parvum
NRNK

SEQ ID NO: 2273297 - protein, 18 aa, Cryptosporidium parvum
NRNKAYSSSKSSSGKPIS

SEQ ID NO: 2273298 - protein, 8 aa, Cryptosporidium parvum
NRNNNEDE

SEQ ID NO: 2273299 - protein, 37 aa, Cryptosporidium parvum
NRNPPDSQPSIVKDSTNQSKNVLGNKAATTKSKYISH

SEQ ID NO: 2273300 - protein, 8 aa, Cryptosporidium parvum
NRNPSEDV

SEQ ID NO: 2273301 - protein, 30 aa, Cryptosporidium parvum
NRNQLHPNATNTIAGDGRGGGGNAGITEPA

SEQ ID NO: 2273302 - protein, 14 aa, Cryptosporidium parvum
NRNREINDGKSSIL

SEQ ID NO: 2273303 - protein, 9 aa, Cryptosporidium parvum
NRNSEVNSM

SEQ ID NO: 2273304 - protein, 10 aa, Cryptosporidium parvum
NRNSGTPNNH

SEQ ID NO: 2273305 - protein, 12 aa, Cryptosporidium parvum
NRNSLGNEDTEI

SEQ ID NO: 2273306 - protein, 5 aa, Cryptosporidium parvum
NRNSP

SEQ ID NO: 2273307 - protein, 22 aa, Cryptosporidium parvum
NRNSSNNSSNSNNIGSSSPADI

SEQ ID NO: 2273308 - protein, 7 aa, Cryptosporidium parvum
NRNVDSK

SEQ ID NO: 2273309 - protein, 4 aa, Cryptosporidium parvum
NRNW

SEQ ID NO: 2273310 - protein, 5 aa, Cryptosporidium parvum
NRPDI

SEQ ID NO: 2273311 - protein, 8 aa, Cryptosporidium parvum
NRPDSSNA

SEQ ID NO: 2273312 - protein, 7 aa, Cryptosporidium parvum
NRPDTLD

SEQ ID NO: 2273313 - protein, 5 aa, Cryptosporidium parvum
NRPEI

SEQ ID NO: 2273314 - protein, 4 aa, Cryptosporidium parvum
NRPG

SEQ ID NO: 2273315 - protein, 10 aa, Cryptosporidium parvum
NRPGHSKEQC

SEQ ID NO: 2273316 - protein, 19 aa, Cryptosporidium parvum
NRPIRKESEALARKKRRYE

SEQ ID NO: 2273317 - protein, 10 aa, Cryptosporidium parvum
NRPNAYGYSR

SEQ ID NO: 2273318 - protein, 6 aa, Cryptosporidium parvum
NRPNKL

SEQ ID NO: 2273319 - protein, 8 aa, Cryptosporidium parvum
NRPQQNGK

SEQ ID NO: 2273320 - protein, 40 aa, Cryptosporidium parvum
NRPQQSNNTQTTSKVEKKPKQVKKIQPVKETKKIDDSETN

SEQ ID NO: 2273321 - protein, 8 aa, Cryptosporidium parvum
NRPRLNPN

SEQ ID NO: 2273322 - protein, 9 aa, Cryptosporidium parvum
NRPSLDETI

SEQ ID NO: 2273323 - protein, 8 aa, Cryptosporidium parvum
NRPTAADF

SEQ ID NO: 2273324 - protein, 7 aa, Cryptosporidium parvum
NRPVPKR

SEQ ID NO: 2273325 - protein, 7 aa, Cryptosporidium parvum
NRPYPQN

SEQ ID NO: 2273326 - protein, 19 aa, Cryptosporidium parvum
NRQAERTTRGGEDDESMTD

SEQ ID NO: 2273327 - protein, 10 aa, Cryptosporidium parvum
NRQDSSNVNG

SEQ ID NO: 2273328 - protein, 15 aa, Cryptosporidium parvum
NRQFTSEYNPENLGT

SEQ ID NO: 2273329 - protein, 7 aa, Cryptosporidium parvum
NRQGVPI

SEQ ID NO: 2273330 - protein, 9 aa, Cryptosporidium parvum
NRQNRPNKG

SEQ ID NO: 2273331 - protein, 9 aa, Cryptosporidium parvum
NRQNTTSSV

SEQ ID NO: 2273332 - protein, 9 aa, Cryptosporidium parvum
NRQSTTKVS

SEQ ID NO: 2273333 - protein, 8 aa, Cryptosporidium parvum
NRQTNTEH

SEQ ID NO: 2273334 - protein, 5 aa, Cryptosporidium parvum
NRRAA

SEQ ID NO: 2273335 - protein, 10 aa, Cryptosporidium parvum
NRRATAPDNM

SEQ ID NO: 2273336 - protein, 5 aa, Cryptosporidium parvum
NRRGA

SEQ ID NO: 2273337 - protein, 9 aa, Cryptosporidium parvum
NRRGGPDDA

SEQ ID NO: 2273338 - protein, 9 aa, Cryptosporidium parvum
NRRKELTKK

SEQ ID NO: 2273339 - protein, 6 aa, Cryptosporidium parvum
NRRKKQ

SEQ ID NO: 2273340 - protein, 7 aa, Cryptosporidium parvum
NRSAESD

SEQ ID NO: 2273341 - protein, 8 aa, Cryptosporidium parvum
NRSDSPEK

SEQ ID NO: 2273342 - protein, 7 aa, Cryptosporidium parvum
NRSECRN

SEQ ID NO: 2273343 - protein, 7 aa, Cryptosporidium parvum
NRSEDEA

SEQ ID NO: 2273344 - protein, 8 aa, Cryptosporidium parvum
NRSEKGGQ

SEQ ID NO: 2273345 - protein, 6 aa, Cryptosporidium parvum
NRSGYQ

SEQ ID NO: 2273346 - protein, 9 aa, Cryptosporidium parvum
NRSKDQNNR

SEQ ID NO: 2273347 - protein, 6 aa, Cryptosporidium parvum
NRSKKI

SEQ ID NO: 2273348 - protein, 9 aa, Cryptosporidium parvum
NRSKSTQEK

SEQ ID NO: 2273349 - protein, 18 aa, Cryptosporidium parvum
NRSNEFPNATKPSQIGGD

SEQ ID NO: 2273350 - protein, 5 aa, Cryptosporidium parvum
NRSNH

SEQ ID NO: 2273351 - protein, 38 aa, Cryptosporidium parvum
NRSPSAIEKEIDEKEKNKKLKETKDANNKECSTISSDI

SEQ ID NO: 2273352 - protein, 10 aa, Cryptosporidium parvum
NRSQNNQQNI

SEQ ID NO: 2273353 - protein, 9 aa, Cryptosporidium parvum
NRSQTINET

SEQ ID NO: 2273354 - protein, 6 aa, Cryptosporidium parvum
NRSRDQ

SEQ ID NO: 2273355 - protein, 10 aa, Cryptosporidium parvum
NRSRGRGRFS

SEQ ID NO: 2273356 - protein, 17 aa, Cryptosporidium parvum
NRSRNPKKSTSNQSSGI

SEQ ID NO: 2273357 - protein, 10 aa, Cryptosporidium parvum
NRSRVDYGTG

SEQ ID NO: 2273358 - protein, 11 aa, Cryptosporidium parvum
NRSSRTRNRSK

SEQ ID NO: 2273359 - protein, 20 aa, Cryptosporidium parvum
NRSSVTDQLTPQELRPAPID

SEQ ID NO: 2273360 - protein, 14 aa, Cryptosporidium parvum
NRSTDNKDEFNSES

SEQ ID NO: 2273361 - protein, 5 aa, Cryptosporidium parvum
NRSTI

SEQ ID NO: 2273362 - protein, 7 aa, Cryptosporidium parvum
NRTKDHA

SEQ ID NO: 2273363 - protein, 23 aa, Cryptosporidium parvum
NRTKNTISKETKTLEDEDVHDTQ

SEQ ID NO: 2273364 - protein, 6 aa, Cryptosporidium parvum
NRTPQN

SEQ ID NO: 2273365 - protein, 6 aa, Cryptosporidium parvum
NRTTHE

SEQ ID NO: 2273366 - protein, 11 aa, Cryptosporidium parvum
NRVETEDEDST

SEQ ID NO: 2273367 - protein, 8 aa, Cryptosporidium parvum
NRVSQPKK

SEQ ID NO: 2273368 - protein, 4 aa, Cryptosporidium parvum
NRYK

SEQ ID NO: 2273369 - protein, 4 aa, Cryptosporidium parvum
NRYQ

SEQ ID NO: 2273370 - protein, 4 aa, Cryptosporidium parvum
NRYS

SEQ ID NO: 2273371 - protein, 14 aa, Cryptosporidium parvum
NRYSTSASSNISSQ

SEQ ID NO: 2273372 - protein, 9 aa, Cryptosporidium parvum
NSAGEMSEI

SEQ ID NO: 2273373 - protein, 10 aa, Cryptosporidium parvum
NSAGVGLENG

SEQ ID NO: 2273374 - protein, 18 aa, Cryptosporidium parvum
NSAKTNSAEAKKIKNQAS

SEQ ID NO: 2273375 - protein, 11 aa, Cryptosporidium parvum
NSALKTSKSTW

SEQ ID NO: 2273376 - protein, 50 aa, Cryptosporidium parvum
NSALRSENYGLETPKGLSSKRASINIDDKESINQTKSETPIENNLSEANT

SEQ ID NO: 2273377 - protein, 31 aa, Cryptosporidium parvum
NSAMQYSDEVNSGDLRSNSFANSNISNSSIT

SEQ ID NO: 2273378 - protein, 15 aa, Cryptosporidium parvum
NSANKSGNKSKKRNV

SEQ ID NO: 2273379 - protein, 28 aa, Cryptosporidium parvum
NSAPSKHKSKSKSRSSSSNTSVRLPRKT

SEQ ID NO: 2273380 - protein, 7 aa, Cryptosporidium parvum
NSARNDS

SEQ ID NO: 2273381 - protein, 9 aa, Cryptosporidium parvum
NSASSNKTQ

SEQ ID NO: 2273382 - protein, 7 aa, Cryptosporidium parvum
NSATSLK

SEQ ID NO: 2273383 - protein, 5 aa, Cryptosporidium parvum
NSATV

SEQ ID NO: 2273384 - protein, 4 aa, Cryptosporidium parvum
NSAY

SEQ ID NO: 2273385 - protein, 12 aa, Cryptosporidium parvum
NSCKSKDLNKEI

SEQ ID NO: 2273386 - protein, 7 aa, Cryptosporidium parvum
NSCNDTE

SEQ ID NO: 2273387 - protein, 24 aa, Cryptosporidium parvum
NSCSNIEKNSQNSARATDSDFPTL

SEQ ID NO: 2273388 - protein, 9 aa, Cryptosporidium parvum
NSCTPNNVE

SEQ ID NO: 2273389 - protein, 7 aa, Cryptosporidium parvum
NSDASKV

SEQ ID NO: 2273390 - protein, 22 aa, Cryptosporidium parvum
NSDDKKNDDNNYNNNSCSSNSI

SEQ ID NO: 2273391 - protein, 7 aa, Cryptosporidium parvum
NSDERFE

SEQ ID NO: 2273392 - protein, 10 aa, Cryptosporidium parvum
NSDESIENLN

SEQ ID NO: 2273393 - protein, 15 aa, Cryptosporidium parvum
NSDFDNKRKKRTATW

SEQ ID NO: 2273394 - protein, 6 aa, Cryptosporidium parvum
NSDFGD

SEQ ID NO: 2273395 - protein, 8 aa, Cryptosporidium parvum
NSDGEARE

SEQ ID NO: 2273396 - protein, 9 aa, Cryptosporidium parvum
NSDGSKRLN

SEQ ID NO: 2273397 - protein, 6 aa, Cryptosporidium parvum
NSDGTF

SEQ ID NO: 2273398 - protein, 4 aa, Cryptosporidium parvum
NSDI

SEQ ID NO: 2273399 - protein, 9 aa, Cryptosporidium parvum
NSDISSNTV

SEQ ID NO: 2273400 - protein, 5 aa, Cryptosporidium parvum
NSDKD

SEQ ID NO: 2273401 - protein, 20 aa, Cryptosporidium parvum
NSDKGSNCNEKDYSKSQEDI

SEQ ID NO: 2273402 - protein, 8 aa, Cryptosporidium parvum
NSDKHKAD

SEQ ID NO: 2273403 - protein, 6 aa, Cryptosporidium parvum
NSDKNH

SEQ ID NO: 2273404 - protein, 7 aa, Cryptosporidium parvum
NSDKNKA

SEQ ID NO: 2273405 - protein, 26 aa, Cryptosporidium parvum
NSDNEDSFNNNSEFQTNSNNITSTSI

SEQ ID NO: 2273406 - protein, 7 aa, Cryptosporidium parvum
NSDNHKV

SEQ ID NO: 2273407 - protein, 10 aa, Cryptosporidium parvum
NSDNNTSIRD

SEQ ID NO: 2273408 - protein, 17 aa, Cryptosporidium parvum
NSDNNYNINDENNNNNY

SEQ ID NO: 2273409 - protein, 9 aa, Cryptosporidium parvum
NSDNTETRR

SEQ ID NO: 2273410 - protein, 12 aa, Cryptosporidium parvum
NSDNTVNTSPQP

SEQ ID NO: 2273411 - protein, 4 aa, Cryptosporidium parvum
NSDP

SEQ ID NO: 2273412 - protein, 5 aa, Cryptosporidium parvum
NSDPQ

SEQ ID NO: 2273413 - protein, 12 aa, Cryptosporidium parvum
NSDQNRNDSNGL

SEQ ID NO: 2273414 - protein, 10 aa, Cryptosporidium parvum
NSDSDESENG

SEQ ID NO: 2273415 - protein, 6 aa, Cryptosporidium parvum
NSDSDY

SEQ ID NO: 2273416 - protein, 5 aa, Cryptosporidium parvum
NSDSE

SEQ ID NO: 2273417 - protein, 10 aa, Cryptosporidium parvum
NSDSENFNSK

SEQ ID NO: 2273418 - protein, 33 aa, Cryptosporidium parvum
NSDSIGQKGEDLQTLTGTKSEVTDTAKSKDVEM

SEQ ID NO: 2273419 - protein, 13 aa, Cryptosporidium parvum
NSDSQNKNDQAVD

SEQ ID NO: 2273420 - protein, 20 aa, Cryptosporidium parvum
NSDSSIENSLSEYSQGELPY

SEQ ID NO: 2273421 - protein, 8 aa, Cryptosporidium parvum
NSDTKSPE

SEQ ID NO: 2273422 - protein, 4 aa, Cryptosporidium parvum
NSDV

SEQ ID NO: 2273423 - protein, 4 aa, Cryptosporidium parvum
NSDY

SEQ ID NO: 2273424 - protein, 12 aa, Cryptosporidium parvum
NSDYSSGNDGYG

SEQ ID NO: 2273425 - protein, 15 aa, Cryptosporidium parvum
NSDYYENSNKENYPL

SEQ ID NO: 2273426 - protein, 7 aa, Cryptosporidium parvum
NSEAQEL

SEQ ID NO: 2273427 - protein, 6 aa, Cryptosporidium parvum
NSEATK

SEQ ID NO: 2273428 - protein, 12 aa, Cryptosporidium parvum
NSECSEDSEQTA

SEQ ID NO: 2273429 - protein, 6 aa, Cryptosporidium parvum
NSEDIK

SEQ ID NO: 2273430 - protein, 6 aa, Cryptosporidium parvum
NSEDRT

SEQ ID NO: 2273431 - protein, 7 aa, Cryptosporidium parvum
NSEDTTL

SEQ ID NO: 2273432 - protein, 13 aa, Cryptosporidium parvum
NSEDVPQDLPSHS

SEQ ID NO: 2273433 - protein, 43 aa, Cryptosporidium parvum; identical to SEQ ID NO: 2154669

SEQ ID NO: 2273434 - protein, 6 aa, Cryptosporidium parvum
NSEELK

SEQ ID NO: 2273435 - protein, 14 aa, Cryptosporidium parvum
NSEENSNDTTTQNE

SEQ ID NO: 2273436 - protein, 13 aa, Cryptosporidium parvum
NSEERSRIPDKDI

SEQ ID NO: 2273437 - protein, 8 aa, Cryptosporidium parvum
NSEFDDEE

SEQ ID NO: 2273438 - protein, 15 aa, Cryptosporidium parvum
NSEGEVSRSTGLQLE

SEQ ID NO: 2273439 - protein, 25 aa, Cryptosporidium parvum
NSEGFTTKNNNTNNINGNYNNSPSL

SEQ ID NO: 2273440 - protein, 6 aa, Cryptosporidium parvum
NSEGLD

SEQ ID NO: 2273441 - protein, 6 aa, Cryptosporidium parvum
NSEHSH

SEQ ID NO: 2273442 - protein, 13 aa, Cryptosporidium parvum
NSEINEESHSQHS

SEQ ID NO: 2273443 - protein, 8 aa, Cryptosporidium parvum
NSEINQPT

SEQ ID NO: 2273444 - protein, 9 aa, Cryptosporidium parvum
NSEITEHSR

SEQ ID NO: 2273445 - protein, 6 aa, Cryptosporidium parvum
NSEKEK

SEQ ID NO: 2273446 - protein, 7 aa, Cryptosporidium parvum
NSEKQSV

SEQ ID NO: 2273447 - protein, 6 aa, Cryptosporidium parvum
NSEKRK

SEQ ID NO: 2273448 - protein, 6 aa, Cryptosporidium parvum
NSELDT

SEQ ID NO: 2273449 - protein, 7 aa, Cryptosporidium parvum
NSELENN

SEQ ID NO: 2273450 - protein, 6 aa, Cryptosporidium parvum
NSELKD

SEQ ID NO: 2273451 - protein, 5 aa, Cryptosporidium parvum
NSELS

SEQ ID NO: 2273452 - protein, 12 aa, Cryptosporidium parvum
NSELSSSEGVEN

SEQ ID NO: 2273453 - protein, 4 aa, Cryptosporidium parvum
NSEN

SEQ ID NO: 2273454 - protein, 26 aa, Cryptosporidium parvum
NSENAKKSPTMRKSNYAKTNKIDTIA

SEQ ID NO: 2273455 - protein, 9 aa, Cryptosporidium parvum
NSENKSDFE

SEQ ID NO: 2273456 - protein, 10 aa, Cryptosporidium parvum
NSENKSKIEI

SEQ ID NO: 2273457 - protein, 9 aa, Cryptosporidium parvum
NSENNINTT

SEQ ID NO: 2273458 - protein, 57 aa, Cryptosporidium parvum
NSENQDGDSKSKDSPKNQNSIGESGSGSPNAGNGSTTNGSGDLHPIGGNGGGNEVPS

SEQ ID NO: 2273459 - protein, 26 aa, Cryptosporidium parvum
NSENSDTDEVQESDDERFTKPENEED

SEQ ID NO: 2273460 - protein, 14 aa, Cryptosporidium parvum
NSEPELNSNAPKLN

SEQ ID NO: 2273461 - protein, 8 aa, Cryptosporidium parvum
NSEPKKRW

SEQ ID NO: 2273462 - protein, 7 aa, Cryptosporidium parvum
NSEPYHR

SEQ ID NO: 2273463 - protein, 16 aa, Cryptosporidium parvum
NSEQGSAGINDKALSD

SEQ ID NO: 2273464 - protein, 8 aa, Cryptosporidium parvum
NSESKIPI

SEQ ID NO: 2273465 - protein, 6 aa, Cryptosporidium parvum
NSESLR

SEQ ID NO: 2273466 - protein, 16 aa, Cryptosporidium parvum
NSESYSEFEPSSNEGF

SEQ ID NO: 2273467 - protein, 9 aa, Cryptosporidium parvum
NSETQRWTN

SEQ ID NO: 2273468 - protein, 6 aa, Cryptosporidium parvum
NSETRK

SEQ ID NO: 2273469 - protein, 12 aa, Cryptosporidium parvum
NSETRLKASIYK

SEQ ID NO: 2273470 - protein, 5 aa, Cryptosporidium parvum
NSETV

SEQ ID NO: 2273471 - protein, 7 aa, Cryptosporidium parvum
NSEVDLR

SEQ ID NO: 2273472 - protein, 12 aa, Cryptosporidium parvum
NSEVKERSKPKC

SEQ ID NO: 2273473 - protein, 20 aa, Cryptosporidium parvum
NSEVNSLKEAAEVNKKQFEN

SEQ ID NO: 2273474 - protein, 46 aa, Cryptosporidium parvum
NSEVSTNKEAAEDRDRYDCDSNESIKEEIRDSDPRISNSESKPQHT

SEQ ID NO: 2273475 - protein, 14 aa, Cryptosporidium parvum
NSEYEKGKKNLQSR

SEQ ID NO: 2273476 - protein, 23 aa, Cryptosporidium parvum
NSEYNEGQPKETDQIDSNNGEAP

SEQ ID NO: 2273477 - protein, 9 aa, Cryptosporidium parvum
NSEYQETDE

SEQ ID NO: 2273478 - protein, 7 aa, Cryptosporidium parvum
NSEYRSN

SEQ ID NO: 2273479 - protein, 18 aa, Cryptosporidium parvum
NSFDISPSSEQNHVESPS

SEQ ID NO: 2273480 - protein, 5 aa, Cryptosporidium parvum
NSFDK

SEQ ID NO: 2273481 - protein, 11 aa, Cryptosporidium parvum
NSFEPRSSEEI

SEQ ID NO: 2273482 - protein, 4 aa, Cryptosporidium parvum
NSFG

SEQ ID NO: 2273483 - protein, 6 aa, Cryptosporidium parvum
NSFGNA

SEQ ID NO: 2273484 - protein, 11 aa, Cryptosporidium parvum
NSFKSGKDIQK

SEQ ID NO: 2273485 - protein, 13 aa, Cryptosporidium parvum
NSFNESNIGIDSN

SEQ ID NO: 2273486 - protein, 5 aa, Cryptosporidium parvum
NSFPP

SEQ ID NO: 2273487 - protein, 5 aa, Cryptosporidium parvum
NSFQQ

SEQ ID NO: 2273488 - protein, 5 aa, Cryptosporidium parvum
NSFRS

SEQ ID NO: 2273489 - protein, 12 aa, Cryptosporidium parvum
NSFSQNQDGKFS

SEQ ID NO: 2273490 - protein, 7 aa, Cryptosporidium parvum
NSFSTEV

SEQ ID NO: 2273491 - protein, 10 aa, Cryptosporidium parvum
NSFTPTNSGS

SEQ ID NO: 2273492 - protein, 8 aa, Cryptosporidium parvum
NSGADNDM

SEQ ID NO: 2273493 - protein, 4 aa, Cryptosporidium parvum
NSGC

SEQ ID NO: 2273494 - protein, 21 aa, Cryptosporidium parvum
NSGDSGSGGTSNKRRKRSVSR

SEQ ID NO: 2273495 - protein, 8 aa, Cryptosporidium parvum
NSGENPVQ

SEQ ID NO: 2273496 - protein, 5 aa, Cryptosporidium parvum
NSGGL

SEQ ID NO: 2273497 - protein, 23 aa, Cryptosporidium parvum
NSGGNYRRKSMNNNNCSDFNSSS

SEQ ID NO: 2273498 - protein, 5 aa, Cryptosporidium parvum
NSGKE

SEQ ID NO: 2273499 - protein, 11 aa, Cryptosporidium parvum
NSGKGVVDTSS

SEQ ID NO: 2273500 - protein, 9 aa, Cryptosporidium parvum
NSGKNNKLK

SEQ ID NO: 2273501 - protein, 7 aa, Cryptosporidium parvum
NSGLNST

SEQ ID NO: 2273502 - protein, 7 aa, Cryptosporidium parvum
NSGLPNG

SEQ ID NO: 2273503 - protein, 8 aa, Cryptosporidium parvum
NSGLSSSF

SEQ ID NO: 2273504 - protein, 17 aa, Cryptosporidium parvum
NSGMLNNPTGQGETIEP

SEQ ID NO: 2273505 - protein, 7 aa, Cryptosporidium parvum
NSGMSIG

SEQ ID NO: 2273506 - protein, 6 aa, Cryptosporidium parvum
NSGNLS

SEQ ID NO: 2273507 - protein, 9 aa, Cryptosporidium parvum
NSGPNTNSS

SEQ ID NO: 2273508 - protein, 7 aa, Cryptosporidium parvum
NSGPQTL

SEQ ID NO: 2273509 - protein, 53 aa, Cryptosporidium parvum
NSGQNSNEIDKKGVVSNSEGIYNAGRSTRSSINTISNRRSLNTEESNEDVEMK

SEQ ID NO: 2273510 - protein, 17 aa, Cryptosporidium parvum
NSGQNTSQAINSSLGQN

SEQ ID NO: 2273511 - protein, 8 aa, Cryptosporidium parvum
NSGQVQDE

SEQ ID NO: 2273512 - protein, 6 aa, Cryptosporidium parvum
NSGRIQ

SEQ ID NO: 2273513 - protein, 27 aa, Cryptosporidium parvum
NSGSDSVLQKPAKRQKIRSKKKNALAD

SEQ ID NO: 2273514 - protein, 6 aa, Cryptosporidium parvum
NSGSLD

SEQ ID NO: 2273515 - protein, 8 aa, Cryptosporidium parvum
NSGSRSNI

SEQ ID NO: 2273516 - protein, 8 aa, Cryptosporidium parvum
NSGTNQVD

SEQ ID NO: 2273517 - protein, 9 aa, Cryptosporidium parvum
NSGTTPIYE

SEQ ID NO: 2273518 - protein, 6 aa, Cryptosporidium parvum
NSGVSK

SEQ ID NO: 2273519 - protein, 7 aa, Cryptosporidium parvum
NSGWGGK

SEQ ID NO: 2273520 - protein, 14 aa, Cryptosporidium parvum
NSGYDSPKSSSAHN

SEQ ID NO: 2273521 - protein, 12 aa, Cryptosporidium parvum
NSGYNSNSNTME

SEQ ID NO: 2273522 - protein, 6 aa, Cryptosporidium parvum
NSGYSD

SEQ ID NO: 2273523 - protein, 4 aa, Cryptosporidium parvum
NSHI

SEQ ID NO: 2273524 - protein, 7 aa, Cryptosporidium parvum
NSHLGGE

SEQ ID NO: 2273525 - protein, 11 aa, Cryptosporidium parvum
NSHPKTYGQGS

SEQ ID NO: 2273526 - protein, 11 aa, Cryptosporidium parvum
NSHRDIARSPS

SEQ ID NO: 2273527 - protein, 7 aa, Cryptosporidium parvum
NSHTKNE

SEQ ID NO: 2273528 - protein, 44 aa, Cryptosporidium parvum
NSIAKSSSKISDEEINKIESTSIPRNKSYNIDEDEEELKVDEEE

SEQ ID NO: 2273529 - protein, 7 aa, Cryptosporidium parvum
NSIANYT

SEQ ID NO: 2273530 - protein, 5 aa, Cryptosporidium parvum
NSIAS

SEQ ID NO: 2273531 - protein, 4 aa, Cryptosporidium parvum
NSIE

SEQ ID NO: 2273532 - protein, 5 aa, Cryptosporidium parvum
NSIED

SEQ ID NO: 2273533 - protein, 15 aa, Cryptosporidium parvum
NSIEEAVKSNSRDAS

SEQ ID NO: 2273534 - protein, 26 aa, Cryptosporidium parvum
NSIEKDDDKSQKSAQKLEKISQTEEM

SEQ ID NO: 2273535 - protein, 6 aa, Cryptosporidium parvum
NSIESK

SEQ ID NO: 2273536 - protein, 22 aa, Cryptosporidium parvum
NSIESTISEETLNSSLNNTTID

SEQ ID NO: 2273537 - protein, 5 aa, Cryptosporidium parvum
NSIET

SEQ ID NO: 2273538 - protein, 6 aa, Cryptosporidium parvum
NSIEYG

SEQ ID NO: 2273539 - protein, 8 aa, Cryptosporidium parvum
NSIGCPGN

SEQ ID NO: 2273540 - protein, 21 aa, Cryptosporidium parvum
NSIGSSNNSSCSANSHTERST

SEQ ID NO: 2273541 - protein, 5 aa, Cryptosporidium parvum
NSIHK

SEQ ID NO: 2273542 - protein, 13 aa, Cryptosporidium parvum
NSIKLDKDENNEV

SEQ ID NO: 2273543 - protein, 5 aa, Cryptosporidium parvum
NSIKS

SEQ ID NO: 2273544 - protein, 8 aa, Cryptosporidium parvum
NSINGSKK

SEQ ID NO: 2273545 - protein, 12 aa, Cryptosporidium parvum
NSINNTASEELT

SEQ ID NO: 2273546 - protein, 14 aa, Cryptosporidium parvum
NSINRNSSQRLKPG

SEQ ID NO: 2273547 - protein, 5 aa, Cryptosporidium parvum
NSIPD

SEQ ID NO: 2273548 - protein, 7 aa, Cryptosporidium parvum
NSIPGLS

SEQ ID NO: 2273549 - protein, 11 aa, Cryptosporidium parvum
NSIPNDSSSFS

SEQ ID NO: 2273550 - protein, 5 aa, Cryptosporidium parvum
NSIPQ

SEQ ID NO: 2273551 - protein, 13 aa, Cryptosporidium parvum
NSIRSDKDNDPNI

SEQ ID NO: 2273552 - protein, 9 aa, Cryptosporidium parvum
NSISGGEQS

SEQ ID NO: 2273553 - protein, 8 aa, Cryptosporidium parvum
NSISKSHQ

SEQ ID NO: 2273554 - protein, 5 aa, Cryptosporidium parvum
NSISN

SEQ ID NO: 2273555 - protein, 16 aa, Cryptosporidium parvum
NSISSSSSSSSTFTTS

SEQ ID NO: 2273556 - protein, 4 aa, Cryptosporidium parvum
NSIT

SEQ ID NO: 2273557 - protein, 10 aa, Cryptosporidium parvum
NSITNSPTTI

SEQ ID NO: 2273558 - protein, 8 aa, Cryptosporidium parvum
NSITPETS

SEQ ID NO: 2273559 - protein, 10 aa, Cryptosporidium parvum
NSITQTRSIT

SEQ ID NO: 2273560 - protein, 8 aa, Cryptosporidium parvum
NSITSERI

SEQ ID NO: 2273561 - protein, 14 aa, Cryptosporidium parvum
NSITSKNTEKVEAG

SEQ ID NO: 2273562 - protein, 5 aa, Cryptosporidium parvum
NSKAN

SEQ ID NO: 2273563 - protein, 4 aa, Cryptosporidium parvum
NSKD

SEQ ID NO: 2273564 - protein, 8 aa, Cryptosporidium parvum
NSKDDAQR

SEQ ID NO: 2273565 - protein, 8 aa, Cryptosporidium parvum
NSKDRSDS

SEQ ID NO: 2273566 - protein, 7 aa, Cryptosporidium parvum
NSKDYIK

SEQ ID NO: 2273567 - protein, 4 aa, Cryptosporidium parvum
NSKE

SEQ ID NO: 2273568 - protein, 22 aa, Cryptosporidium parvum
NSKEDIANEDHSSNINHQSKSE

SEQ ID NO: 2273569 - protein, 11 aa, Cryptosporidium parvum
NSKEKLDNNED

SEQ ID NO: 2273570 - protein, 7 aa, Cryptosporidium parvum
NSKENSH

SEQ ID NO: 2273571 - protein, 4 aa, Cryptosporidium parvum
NSKF

SEQ ID NO: 2273572 - protein, 8 aa, Cryptosporidium parvum
NSKFESDG

SEQ ID NO: 2273573 - protein, 6 aa, Cryptosporidium parvum
NSKIEG

SEQ ID NO: 2273574 - protein, 13 aa, Cryptosporidium parvum
NSKIKDKKTNFDL

SEQ ID NO: 2273575 - protein, 27 aa, Cryptosporidium parvum
NSKITSKPKMVNKSKKTVEERYQKKTQ

SEQ ID NO: 2273576 - protein, 16 aa, Cryptosporidium parvum
NSKKENSQANVPREDI

SEQ ID NO: 2273577 - protein, 16 aa, Cryptosporidium parvum
NSKKGRGKGAFENKGK

SEQ ID NO: 2273578 - protein, 13 aa, Cryptosporidium parvum
NSKKKKVSNKLTN

SEQ ID NO: 2273579 - protein, 20 aa, Cryptosporidium parvum
NSKKKSNDSSMMNSQAKSSP

SEQ ID NO: 2273580 - protein, 8 aa, Cryptosporidium parvum
NSKKRRSR

SEQ ID NO: 2273581 - protein, 10 aa, Cryptosporidium parvum
NSKKSSNLTV

SEQ ID NO: 2273582 - protein, 9 aa, Cryptosporidium parvum
NSKKVTTEE

SEQ ID NO: 2273583 - protein, 4 aa, Cryptosporidium parvum
NSKL

SEQ ID NO: 2273584 - protein, 7 aa, Cryptosporidium parvum
NSKLSRD

SEQ ID NO: 2273585 - protein, 7 aa, Cryptosporidium parvum
NSKLSRE

SEQ ID NO: 2273586 - protein, 15 aa, Cryptosporidium parvum
NSKLTKNPTGSNDER

SEQ ID NO: 2273587 - protein, 4 aa, Cryptosporidium parvum
NSKN

SEQ ID NO: 2273588 - protein, 13 aa, Cryptosporidium parvum
NSKNDAGSDKSSI

SEQ ID NO: 2273589 - protein, 9 aa, Cryptosporidium parvum
NSKNDTEND

SEQ ID NO: 2273590 - protein, 12 aa, Cryptosporidium parvum
NSKNETEPKSSI

SEQ ID NO: 2273591 - protein, 9 aa, Cryptosporidium parvum
NSKNGSGLQ

SEQ ID NO: 2273592 - protein, 8 aa, Cryptosporidium parvum
NSKNMKEI

SEQ ID NO: 2273593 - protein, 8 aa, Cryptosporidium parvum
NSKNNTLD

SEQ ID NO: 2273594 - protein, 7 aa, Cryptosporidium parvum
NSKNPNI

SEQ ID NO: 2273595 - protein, 25 aa, Cryptosporidium parvum
NSKNSKSRPTSAINSGLDSTRGSSI

SEQ ID NO: 2273596 - protein, 16 aa, Cryptosporidium parvum
NSKNVGPSISKTSSNL

SEQ ID NO: 2273597 - protein, 4 aa, Cryptosporidium parvum
NSKP

SEQ ID NO: 2273598 - protein, 7 aa, Cryptosporidium parvum
NSKPKNI

SEQ ID NO: 2273599 - protein, 5 aa, Cryptosporidium parvum
NSKPL

SEQ ID NO: 2273600 - protein, 12 aa, Cryptosporidium parvum
NSKQSGNSDILN

SEQ ID NO: 2273601 - protein, 10 aa, Cryptosporidium parvum
NSKQSSSDIN

SEQ ID NO: 2273602 - protein, 9 aa, Cryptosporidium parvum
NSKQTYENK

SEQ ID NO: 2273603 - protein, 8 aa, Cryptosporidium parvum
NSKRASKV

SEQ ID NO: 2273604 - protein, 13 aa, Cryptosporidium parvum
NSKREKEKREEEK

SEQ ID NO: 2273605 - protein, 7 aa, Cryptosporidium parvum
NSKRLNS

SEQ ID NO: 2273606 - protein, 7 aa, Cryptosporidium parvum
NSKRNTH

SEQ ID NO: 2273607 - protein, 11 aa, Cryptosporidium parvum
NSKSDNAMEDP

SEQ ID NO: 2273608 - protein, 8 aa, Cryptosporidium parvum
NSKSEISL

SEQ ID NO: 2273609 - protein, 10 aa, Cryptosporidium parvum
NSKSSNKRIK

SEQ ID NO: 2273610 - protein, 12 aa, Cryptosporidium parvum
NSKSVKERIPRP

SEQ ID NO: 2273611 - protein, 9 aa, Cryptosporidium parvum
NSKSVNSSQ

SEQ ID NO: 2273612 - protein, 14 aa, Cryptosporidium parvum
NSKTEIKKMSGPIE

SEQ ID NO: 2273613 - protein, 8 aa, Cryptosporidium parvum
NSKTPIYP

SEQ ID NO: 2273614 - protein, 9 aa, Cryptosporidium parvum
NSKTRSNLQ

SEQ ID NO: 2273615 - protein, 7 aa, Cryptosporidium parvum
NSKTSQF

SEQ ID NO: 2273616 - protein, 7 aa, Cryptosporidium parvum
NSKTTIS

SEQ ID NO: 2273617 - protein, 4 aa, Cryptosporidium parvum
NSKV

SEQ ID NO: 2273618 - protein, 11 aa, Cryptosporidium parvum
NSKVEKVQSES

SEQ ID NO: 2273619 - protein, 7 aa, Cryptosporidium parvum
NSKVKPD

SEQ ID NO: 2273620 - protein, 5 aa, Cryptosporidium parvum
NSKYF

SEQ ID NO: 2273621 - protein, 8 aa, Cryptosporidium parvum
NSKYPNIT

SEQ ID NO: 2273622 - protein, 12 aa, Cryptosporidium parvum
NSKYSDSNERGK

SEQ ID NO: 2273623 - protein, 20 aa, Cryptosporidium parvum
NSLAKGESAPSNSEEHSGSI

SEQ ID NO: 2273624 - protein, 6 aa, Cryptosporidium parvum
NSLATG

SEQ ID NO: 2273625 - protein, 4 aa, Cryptosporidium parvum
NSLD

SEQ ID NO: 2273626 - protein, 5 aa, Cryptosporidium parvum
NSLEE

SEQ ID NO: 2273627 - protein, 5 aa, Cryptosporidium parvum
NSLET

SEQ ID NO: 2273628 - protein, 20 aa, Cryptosporidium parvum
NSLGRDYEGGGSSGGGSVED

SEQ ID NO: 2273629 - protein, 13 aa, Cryptosporidium parvum
NSLGRKFSETEVR

SEQ ID NO: 2273630 - protein, 15 aa, Cryptosporidium parvum
NSLGSYNNTNNGSGC

SEQ ID NO: 2273631 - protein, 12 aa, Cryptosporidium parvum
NSLITKNSNINK

SEQ ID NO: 2273632 - protein, 8 aa, Cryptosporidium parvum
NSLKNNGH

SEQ ID NO: 2273633 - protein, 39 aa, Cryptosporidium parvum; identical to SEQ ID NO: 2154857

SEQ ID NO: 2273634 - protein, 11 aa, Cryptosporidium parvum
NSLNKDNLNEL

SEQ ID NO: 2273635 - protein, 7 aa, Cryptosporidium parvum
NSLNNKK

SEQ ID NO: 2273636 - protein, 41 aa, Cryptosporidium parvum
NSLNSTESNPNYIKDKSDQLDRAPGSSNTMNQTTNLNNERY

SEQ ID NO: 2273637 - protein, 18 aa, Cryptosporidium parvum
NSLPKKTNSSDESLNEQR

SEQ ID NO: 2273638 - protein, 34 aa, Cryptosporidium parvum
NSLPKVSKNKKRNSLNKQGSANYESKNEDKEKRV

SEQ ID NO: 2273639 - protein, 10 aa, Cryptosporidium parvum
NSLPSTLEKD

SEQ ID NO: 2273640 - protein, 19 aa, Cryptosporidium parvum
NSLQGSNTVQNDFTNNENI

SEQ ID NO: 2273641 - protein, 7 aa, Cryptosporidium parvum
NSLQGTV

SEQ ID NO: 2273642 - protein, 6 aa, Cryptosporidium parvum
NSLRDG

SEQ ID NO: 2273643 - protein, 13 aa, Cryptosporidium parvum
NSLRNSSNNPTSF

SEQ ID NO: 2273644 - protein, 8 aa, Cryptosporidium parvum
NSLSENQA

SEQ ID NO: 2273645 - protein, 7 aa, Cryptosporidium parvum
NSLSNSS

SEQ ID NO: 2273646 - protein, 8 aa, Cryptosporidium parvum
NSLSPKSE

SEQ ID NO: 2273647 - protein, 5 aa, Cryptosporidium parvum
NSLSQ

SEQ ID NO: 2273648 - protein, 6 aa, Cryptosporidium parvum
NSLSSE

SEQ ID NO: 2273649 - protein, 10 aa, Cryptosporidium parvum
NSLSSKNEQE

SEQ ID NO: 2273650 - protein, 8 aa, Cryptosporidium parvum
NSLTDDDS

SEQ ID NO: 2273651 - protein, 5 aa, Cryptosporidium parvum
NSMIE

SEQ ID NO: 2273652 - protein, 8 aa, Cryptosporidium parvum
NSMRGRRR

SEQ ID NO: 2273653 - protein, 20 aa, Cryptosporidium parvum
NSMRTAKQALTERKNEGLKK

SEQ ID NO: 2273654 - protein, 7 aa, Cryptosporidium parvum
NSMSEQT

SEQ ID NO: 2273655 - protein, 5 aa, Cryptosporidium parvum
NSNAR

SEQ ID NO: 2273656 - protein, 21 aa, Cryptosporidium parvum
NSNATTSSLPSSLSDNNNINN

SEQ ID NO: 2273657 - protein, 33 aa, Cryptosporidium parvum
NSNCSEDESQHFSEGNLTKPSLNTDTELKDGET

SEQ ID NO: 2273658 - protein, 6 aa, Cryptosporidium parvum
NSNDDF

SEQ ID NO: 2273659 - protein, 10 aa, Cryptosporidium parvum
NSNDENSNAL

SEQ ID NO: 2273660 - protein, 14 aa, Cryptosporidium parvum
NSNDQYKEKETSYV

SEQ ID NO: 2273661 - protein, 19 aa, Cryptosporidium parvum
NSNDSSSDEVDKSDGGSLG

SEQ ID NO: 2273662 - protein, 7 aa, Cryptosporidium parvum
NSNEIQD

SEQ ID NO: 2273663 - protein, 14 aa, Cryptosporidium parvum
NSNEISTSNSTRVS

SEQ ID NO: 2273664 - protein, 14 aa, Cryptosporidium parvum
NSNELRPGGNGHRI

SEQ ID NO: 2273665 - protein, 9 aa, Cryptosporidium parvum
NSNERASPI

SEQ ID NO: 2273666 - protein, 4 aa, Cryptosporidium parvum
NSNF

SEQ ID NO: 2273667 - protein, 10 aa, Cryptosporidium parvum
NSNGRGIPEN

SEQ ID NO: 2273668 - protein, 8 aa, Cryptosporidium parvum
NSNHQEEK

SEQ ID NO: 2273669 - protein, 4 aa, Cryptosporidium parvum
NSNI

SEQ ID NO: 2273670 - protein, 6 aa, Cryptosporidium parvum
NSNIDD

SEQ ID NO: 2273671 - protein, 8 aa, Cryptosporidium parvum
NSNINNNF

SEQ ID NO: 2273672 - protein, 13 aa, Cryptosporidium parvum
NSNIPSNVEQKVE

SEQ ID NO: 2273673 - protein, 7 aa, Cryptosporidium parvum
NSNISDF

SEQ ID NO: 2273674 - protein, 14 aa, Cryptosporidium parvum
NSNKEESINSSSSP

SEQ ID NO: 2273675 - protein, 9 aa, Cryptosporidium parvum
NSNKHDGNM

SEQ ID NO: 2273676 - protein, 29 aa, Cryptosporidium parvum
NSNKRSQDKSDNAVSGNGNPERENNNRPK

SEQ ID NO: 2273677 - protein, 5 aa, Cryptosporidium parvum
NSNKY

SEQ ID NO: 2273678 - protein, 26 aa, Cryptosporidium parvum
NSNLAPNSKNSNTKNMLPSKNTEIEK

SEQ ID NO: 2273679 - protein, 20 aa, Cryptosporidium parvum
NSNLNKSTPKGVVNANRNSD

SEQ ID NO: 2273680 - protein, 6 aa, Cryptosporidium parvum
NSNLSL

SEQ ID NO: 2273681 - protein, 4 aa, Cryptosporidium parvum
NSNM

SEQ ID NO: 2273682 - protein, 8 aa, Cryptosporidium parvum
NSNNNENI

SEQ ID NO: 2273683 - protein, 12 aa, Cryptosporidium parvum
NSNNNNKSKNTN

SEQ ID NO: 2273684 - protein, 60 aa, Cryptosporidium parvum
NSNNNNNNNNNNTNTNNLTNTNNNNNNNNNTNNNNSGNNNNNMATHTNNTQNQETISGDH

SEQ ID NO: 2273685 - protein, 16 aa, Cryptosporidium parvum
NSNNNNTNNNTNNNNY

SEQ ID NO: 2273686 - protein, 26 aa, Cryptosporidium parvum
NSNNNSNNNNNNNNVNDNGSSNNNSV

SEQ ID NO: 2273687 - protein, 11 aa, Cryptosporidium parvum
NSNNQKAQDLS

SEQ ID NO: 2273688 - protein, 24 aa, Cryptosporidium parvum
NSNNQNKYYKNNDNNENSCNSGKY

SEQ ID NO: 2273689 - protein, 11 aa, Cryptosporidium parvum
NSNNTKSSGRL

SEQ ID NO: 2273690 - protein, 18 aa, Cryptosporidium parvum
NSNNVDESNTKDPEKNDN

SEQ ID NO: 2273691 - protein, 10 aa, Cryptosporidium parvum
NSNPDSLTTS

SEQ ID NO: 2273692 - protein, 12 aa, Cryptosporidium parvum
NSNPIPSTSHQD

SEQ ID NO: 2273693 - protein, 16 aa, Cryptosporidium parvum
NSNPISKDIGNNTTIG

SEQ ID NO: 2273694 - protein, 6 aa, Cryptosporidium parvum
NSNPKI

SEQ ID NO: 2273695 - protein, 6 aa, Cryptosporidium parvum
NSNPLD

SEQ ID NO: 2273696 - protein, 5 aa, Cryptosporidium parvum
NSNQI

SEQ ID NO: 2273697 - protein, 9 aa, Cryptosporidium parvum
NSNRSIDKK

SEQ ID NO: 2273698 - protein, 15 aa, Cryptosporidium parvum
NSNRVGNEDQLENSS

SEQ ID NO: 2273699 - protein, 9 aa, Cryptosporidium parvum
NSNSEKGYK

SEQ ID NO: 2273700 - protein, 6 aa, Cryptosporidium parvum
NSNSEQ

SEQ ID NO: 2273701 - protein, 5 aa, Cryptosporidium parvum
NSNSF

SEQ ID NO: 2273702 - protein, 8 aa, Cryptosporidium parvum
NSNSGNNM

SEQ ID NO: 2273703 - protein, 5 aa, Cryptosporidium parvum
NSNSI

SEQ ID NO: 2273704 - protein, 8 aa, Cryptosporidium parvum
NSNSIPEN

SEQ ID NO: 2273705 - protein, 7 aa, Cryptosporidium parvum
NSNSIRN

SEQ ID NO: 2273706 - protein, 8 aa, Cryptosporidium parvum
NSNSLQDE

SEQ ID NO: 2273707 - protein, 12 aa, Cryptosporidium parvum
NSNSNFDNATHI

SEQ ID NO: 2273708 - protein, 25 aa, Cryptosporidium parvum
NSNSNNGSSSTGVTGVSNSSGTAPV

SEQ ID NO: 2273709 - protein, 6 aa, Cryptosporidium parvum
NSNSSE

SEQ ID NO: 2273710 - protein, 9 aa, Cryptosporidium parvum
NSNSSQKFR

SEQ ID NO: 2273711 - protein, 7 aa, Cryptosporidium parvum
NSNSSQR

SEQ ID NO: 2273712 - protein, 26 aa, Cryptosporidium parvum
NSNSSVTDNNGNDNNIQSSDKNIEEL

SEQ ID NO: 2273713 - protein, 9 aa, Cryptosporidium parvum
NSNSTGTNL

SEQ ID NO: 2273714 - protein, 9 aa, Cryptosporidium parvum
NSNSWSSSN

SEQ ID NO: 2273715 - protein, 18 aa, Cryptosporidium parvum
NSNTENGMIQGTDPDITG

SEQ ID NO: 2273716 - protein, 13 aa, Cryptosporidium parvum
NSNTIDNNNSKDI

SEQ ID NO: 2273717 - protein, 7 aa, Cryptosporidium parvum
NSNTNEL

SEQ ID NO: 2273718 - protein, 12 aa, Cryptosporidium parvum
NSNTNNNTSKNL

SEQ ID NO: 2273719 - protein, 29 aa, Cryptosporidium parvum
NSNTTTTTTTTTTTTTTSSFTKNNDNSIN

SEQ ID NO: 2273720 - protein, 4 aa, Cryptosporidium parvum
NSNY

SEQ ID NO: 2273721 - protein, 7 aa, Cryptosporidium parvum
NSNYKNT

SEQ ID NO: 2273722 - protein, 13 aa, Cryptosporidium parvum
NSNYNGNKMRPET

SEQ ID NO: 2273723 - protein, 8 aa, Cryptosporidium parvum
NSNYQNKI

SEQ ID NO: 2273724 - protein, 13 aa, Cryptosporidium parvum
NSNYSEDQQKEVD

SEQ ID NO: 2273725 - protein, 4 aa, Cryptosporidium parvum
NSPD

SEQ ID NO: 2273726 - protein, 8 aa, Cryptosporidium parvum
NSPDGHGD

SEQ ID NO: 2273727 - protein, 10 aa, Cryptosporidium parvum
NSPDTPLSSN

SEQ ID NO: 2273728 - protein, 11 aa, Cryptosporidium parvum
NSPGNKVSKGK

SEQ ID NO: 2273729 - protein, 7 aa, Cryptosporidium parvum
NSPGNVN

SEQ ID NO: 2273730 - protein, 4 aa, Cryptosporidium parvum
NSPI

SEQ ID NO: 2273731 - protein, 8 aa, Cryptosporidium parvum
NSPIDKSS

SEQ ID NO: 2273732 - protein, 20 aa, Cryptosporidium parvum
NSPISNTGESSNATSETRNG

SEQ ID NO: 2273733 - protein, 10 aa, Cryptosporidium parvum
NSPKKADSNY

SEQ ID NO: 2273734 - protein, 4 aa, Cryptosporidium parvum
NSPL

SEQ ID NO: 2273735 - protein, 5 aa, Cryptosporidium parvum
NSPLL

SEQ ID NO: 2273736 - protein, 5 aa, Cryptosporidium parvum
NSPLT

SEQ ID NO: 2273737 - protein, 9 aa, Cryptosporidium parvum
NSPNTRGTL

SEQ ID NO: 2273738 - protein, 5 aa, Cryptosporidium parvum
NSPRY

SEQ ID NO: 2273739 - protein, 8 aa, Cryptosporidium parvum
NSPRYYNE

SEQ ID NO: 2273740 - protein, 7 aa, Cryptosporidium parvum
NSPSCKG

SEQ ID NO: 2273741 - protein, 48 aa, Cryptosporidium parvum
NSPSLSPQQPPSSLSLPPPPSSLSPPPQVTSSSLQPSLSSSPPPISRQ

SEQ ID NO: 2273742 - protein, 10 aa, Cryptosporidium parvum
NSPTESQIQQ

SEQ ID NO: 2273743 - protein, 6 aa, Cryptosporidium parvum
NSPTLD

SEQ ID NO: 2273744 - protein, 9 aa, Cryptosporidium parvum
NSQAKNESQ

SEQ ID NO: 2273745 - protein, 13 aa, Cryptosporidium parvum
NSQCVSNNNSNSP

SEQ ID NO: 2273746 - protein, 31 aa, Cryptosporidium parvum
NSQDISSDQEDQTEKDTISEVNNAGNQNIPR

SEQ ID NO: 2273747 - protein, 4 aa, Cryptosporidium parvum
NSQE

SEQ ID NO: 2273748 - protein, 6 aa, Cryptosporidium parvum
NSQENL

SEQ ID NO: 2273749 - protein, 24 aa, Cryptosporidium parvum
NSQFKDSSYNSDAFSESDPESAVD

SEQ ID NO: 2273750 - protein, 6 aa, Cryptosporidium parvum
NSQIPN

SEQ ID NO: 2273751 - protein, 8 aa, Cryptosporidium parvum
NSQKEESL

SEQ ID NO: 2273752 - protein, 8 aa, Cryptosporidium parvum
NSQKNIND

SEQ ID NO: 2273753 - protein, 4 aa, Cryptosporidium parvum
NSQL

SEQ ID NO: 2273754 - protein, 5 aa, Cryptosporidium parvum
NSQME

SEQ ID NO: 2273755 - protein, 6 aa, Cryptosporidium parvum
NSQMGS

SEQ ID NO: 2273756 - protein, 7 aa, Cryptosporidium parvum
NSQNCKK

SEQ ID NO: 2273757 - protein, 6 aa, Cryptosporidium parvum
NSQNFS

SEQ ID NO: 2273758 - protein, 13 aa, Cryptosporidium parvum
NSQNNASPHLIFK

SEQ ID NO: 2273759 - protein, 8 aa, Cryptosporidium parvum
NSQNPEHL

SEQ ID NO: 2273760 - protein, 6 aa, Cryptosporidium parvum
NSQNYL

SEQ ID NO: 2273761 - protein, 12 aa, Cryptosporidium parvum
NSQSGISNSSNL

SEQ ID NO: 2273762 - protein, 14 aa, Cryptosporidium parvum
NSQSSDEVAPKSSM

SEQ ID NO: 2273763 - protein, 9 aa, Cryptosporidium parvum
NSQSSQTNI

SEQ ID NO: 2273764 - protein, 11 aa, Cryptosporidium parvum
NSQTDNNDQEK

SEQ ID NO: 2273765 - protein, 13 aa, Cryptosporidium parvum
NSQTLRNNNSSRF

SEQ ID NO: 2273766 - protein, 6 aa, Cryptosporidium parvum
NSQTQQ

SEQ ID NO: 2273767 - protein, 8 aa, Cryptosporidium parvum
NSQTTPEW

SEQ ID NO: 2273768 - protein, 4 aa, Cryptosporidium parvum
NSQV

SEQ ID NO: 2273769 - protein, 17 aa, Cryptosporidium parvum
NSQVNQSSSRSRNPKCD

SEQ ID NO: 2273770 - protein, 8 aa, Cryptosporidium parvum
NSRDDALQ

SEQ ID NO: 2273771 - protein, 7 aa, Cryptosporidium parvum
NSRDDSI

SEQ ID NO: 2273772 - protein, 5 aa, Cryptosporidium parvum
NSRDE

SEQ ID NO: 2273773 - protein, 11 aa, Cryptosporidium parvum
NSRDEDLASGF

SEQ ID NO: 2273774 - protein, 8 aa, Cryptosporidium parvum
NSRDEKEK

SEQ ID NO: 2273775 - protein, 5 aa, Cryptosporidium parvum
NSRDS

SEQ ID NO: 2273776 - protein, 6 aa, Cryptosporidium parvum
NSREIQ

SEQ ID NO: 2273777 - protein, 8 aa, Cryptosporidium parvum
NSRESNYK

SEQ ID NO: 2273778 - protein, 10 aa, Cryptosporidium parvum
NSRGRKRSNE

SEQ ID NO: 2273779 - protein, 10 aa, Cryptosporidium parvum
NSRGSTTGLG

SEQ ID NO: 2273780 - protein, 8 aa, Cryptosporidium parvum
NSRIESDN

SEQ ID NO: 2273781 - protein, 5 aa, Cryptosporidium parvum
NSRIH

SEQ ID NO: 2273782 - protein, 22 aa, Cryptosporidium parvum
NSRKANGESISRRSSQIRSNAA

SEQ ID NO: 2273783 - protein, 11 aa, Cryptosporidium parvum
NSRKQSETFSN

SEQ ID NO: 2273784 - protein, 8 aa, Cryptosporidium parvum
NSRKTSSL

SEQ ID NO: 2273785 - protein, 6 aa, Cryptosporidium parvum
NSRKYP

SEQ ID NO: 2273786 - protein, 19 aa, Cryptosporidium parvum
NSRLNGGDANASNEKCDNN

SEQ ID NO: 2273787 - protein, 7 aa, Cryptosporidium parvum
NSRQNNL

SEQ ID NO: 2273788 - protein, 10 aa, Cryptosporidium parvum
NSRQSDNSKF

SEQ ID NO: 2273789 - protein, 38 aa, Cryptosporidium parvum; identical to SEQ ID NO: 2154990

SEQ ID NO: 2273790 - protein, 4 aa, Cryptosporidium parvum
NSRS

SEQ ID NO: 2273791 - protein, 11 aa, Cryptosporidium parvum
NSRSIASNNAP

SEQ ID NO: 2273792 - protein, 7 aa, Cryptosporidium parvum
NSRSNSS

SEQ ID NO: 2273793 - protein, 69 aa, Cryptosporidium parvum
NSRSRSSSKSITRSRSRSRTRSRTRTRTRSRSRSRSRSRTKTDPESNSRSSPKSGISSNTSPAKDISGL

SEQ ID NO: 2273794 - protein, 5 aa, Cryptosporidium parvum
NSRSS

SEQ ID NO: 2273795 - protein, 9 aa, Cryptosporidium parvum
NSRSSEGSY

SEQ ID NO: 2273796 - protein, 43 aa, Cryptosporidium parvum
NSRTGYSRSSHRGNSFRHSTRSRYDYPPPSHSRGDQYNRHNDD

SEQ ID NO: 2273797 - protein, 18 aa, Cryptosporidium parvum
NSRTNNDLNSESNISPEE

SEQ ID NO: 2273798 - protein, 6 aa, Cryptosporidium parvum
NSRTVQ

SEQ ID NO: 2273799 - protein, 4 aa, Cryptosporidium parvum
NSSD

SEQ ID NO: 2273800 - protein, 7 aa, Cryptosporidium parvum
NSSDDEI

SEQ ID NO: 2273801 - protein, 13 aa, Cryptosporidium parvum
NSSDDLENSTGYT

SEQ ID NO: 2273802 - protein, 18 aa, Cryptosporidium parvum
NSSDKSSLEAYSSNNSNF

SEQ ID NO: 2273803 - protein, 8 aa, Cryptosporidium parvum
NSSDLSTA

SEQ ID NO: 2273804 - protein, 23 aa, Cryptosporidium parvum
NSSDNNNNNNNNDQTGSGGVGGI

SEQ ID NO: 2273805 - protein, 18 aa, Cryptosporidium parvum
NSSDSSYSSDTSSSFNSY

SEQ ID NO: 2273806 - protein, 9 aa, Cryptosporidium parvum
NSSDSTERK

SEQ ID NO: 2273807 - protein, 5 aa, Cryptosporidium parvum
NSSDV

SEQ ID NO: 2273808 - protein, 6 aa, Cryptosporidium parvum
NSSEIN

SEQ ID NO: 2273809 - protein, 9 aa, Cryptosporidium parvum
NSSELSSNV

SEQ ID NO: 2273810 - protein, 9 aa, Cryptosporidium parvum
NSSENEFDN

SEQ ID NO: 2273811 - protein, 8 aa, Cryptosporidium parvum
NSSEQWNA

SEQ ID NO: 2273812 - protein, 5 aa, Cryptosporidium parvum
NSSFE

SEQ ID NO: 2273813 - protein, 6 aa, Cryptosporidium parvum
NSSFNS

SEQ ID NO: 2273814 - protein, 8 aa, Cryptosporidium parvum
NSSGAGGL

SEQ ID NO: 2273815 - protein, 5 aa, Cryptosporidium parvum
NSSGI

SEQ ID NO: 2273816 - protein, 6 aa, Cryptosporidium parvum
NSSGQL

SEQ ID NO: 2273817 - protein, 7 aa, Cryptosporidium parvum
NSSGQPY

SEQ ID NO: 2273818 - protein, 8 aa, Cryptosporidium parvum
NSSGSGLE

SEQ ID NO: 2273819 - protein, 26 aa, Cryptosporidium parvum
NSSGSKDKEEKFDSKVGEPTEGGSTP

SEQ ID NO: 2273820 - protein, 5 aa, Cryptosporidium parvum
NSSGY

SEQ ID NO: 2273821 - protein, 4 aa, Cryptosporidium parvum
NSSI

SEQ ID NO: 2273822 - protein, 26 aa, Cryptosporidium parvum
NSSIDLTKSSNSSFNSVNNGHTKDEE

SEQ ID NO: 2273823 - protein, 24 aa, Cryptosporidium parvum
NSSIEANKTLRDEIDKKKKEISEL

SEQ ID NO: 2273824 - protein, 6 aa, Cryptosporidium parvum
NSSIGS

SEQ ID NO: 2273825 - protein, 16 aa, Cryptosporidium parvum
NSSINASNSASESSFT

SEQ ID NO: 2273826 - protein, 5 aa, Cryptosporidium parvum
NSSIS

SEQ ID NO: 2273827 - protein, 8 aa, Cryptosporidium parvum
NSSISNIS

SEQ ID NO: 2273828 - protein, 6 aa, Cryptosporidium parvum
NSSISS

SEQ ID NO: 2273829 - protein, 6 aa, Cryptosporidium parvum
NSSIYQ

SEQ ID NO: 2273830 - protein, 17 aa, Cryptosporidium parvum
NSSKDKIKANSKRTSSL

SEQ ID NO: 2273831 - protein, 9 aa, Cryptosporidium parvum
NSSKEGQEL

SEQ ID NO: 2273832 - protein, 6 aa, Cryptosporidium parvum
NSSKKH

SEQ ID NO: 2273833 - protein, 14 aa, Cryptosporidium parvum
NSSKKQVEEKQTLN

SEQ ID NO: 2273834 - protein, 27 aa, Cryptosporidium parvum
NSSKKVNESNNDQTNRNRSFGGSSRNA

SEQ ID NO: 2273835 - protein, 15 aa, Cryptosporidium parvum
NSSKNNGIQSSCAQS

SEQ ID NO: 2273836 - protein, 22 aa, Cryptosporidium parvum
NSSKRDESSENQKKISMSSTDI

SEQ ID NO: 2273837 - protein, 7 aa, Cryptosporidium parvum
NSSKRRI

SEQ ID NO: 2273838 - protein, 8 aa, Cryptosporidium parvum
NSSKTFGC

SEQ ID NO: 2273839 - protein, 7 aa, Cryptosporidium parvum
NSSKVFN

SEQ ID NO: 2273840 - protein, 7 aa, Cryptosporidium parvum
NSSKYSD

SEQ ID NO: 2273841 - protein, 7 aa, Cryptosporidium parvum
NSSLDTV

SEQ ID NO: 2273842 - protein, 8 aa, Cryptosporidium parvum
NSSLGGSM

SEQ ID NO: 2273843 - protein, 9 aa, Cryptosporidium parvum
NSSLNNDNI

SEQ ID NO: 2273844 - protein, 5 aa, Cryptosporidium parvum
NSSLQ

SEQ ID NO: 2273845 - protein, 9 aa, Cryptosporidium parvum
NSSLSSDNL

SEQ ID NO: 2273846 - protein, 15 aa, Cryptosporidium parvum
NSSMGTNDKEYFPIE

SEQ ID NO: 2273847 - protein, 14 aa, Cryptosporidium parvum
NSSNAGADDRSGMQ

SEQ ID NO: 2273848 - protein, 8 aa, Cryptosporidium parvum
NSSNANAT

SEQ ID NO: 2273849 - protein, 5 aa, Cryptosporidium parvum
NSSNE

SEQ ID NO: 2273850 - protein, 8 aa, Cryptosporidium parvum
NSSNFEGN

SEQ ID NO: 2273851 - protein, 9 aa, Cryptosporidium parvum
NSSNKGTLK

SEQ ID NO: 2273852 - protein, 10 aa, Cryptosporidium parvum
NSSNKTNSDE

SEQ ID NO: 2273853 - protein, 13 aa, Cryptosporidium parvum
NSSNMQNDQGYNQ

SEQ ID NO: 2273854 - protein, 14 aa, Cryptosporidium parvum
NSSNNNKGSKRMKV

SEQ ID NO: 2273855 - protein, 8 aa, Cryptosporidium parvum
NSSNSKEV

SEQ ID NO: 2273856 - protein, 7 aa, Cryptosporidium parvum
NSSNYAK

SEQ ID NO: 2273857 - protein, 7 aa, Cryptosporidium parvum
NSSNYDS

SEQ ID NO: 2273858 - protein, 10 aa, Cryptosporidium parvum
NSSNYSYSTK

SEQ ID NO: 2273859 - protein, 5 aa, Cryptosporidium parvum
NSSPF

SEQ ID NO: 2273860 - protein, 6 aa, Cryptosporidium parvum
NSSPGC

SEQ ID NO: 2273861 - protein, 18 aa, Cryptosporidium parvum
NSSQENLTKPQSIDQNNR

SEQ ID NO: 2273862 - protein, 9 aa, Cryptosporidium parvum
NSSQSNSSK

SEQ ID NO: 2273863 - protein, 15 aa, Cryptosporidium parvum
NSSRIETEENGEVAN

SEQ ID NO: 2273864 - protein, 13 aa, Cryptosporidium parvum
NSSSANNSGGFGS

SEQ ID NO: 2273865 - protein, 10 aa, Cryptosporidium parvum
NSSSEEKTNQ

SEQ ID NO: 2273866 - protein, 12 aa, Cryptosporidium parvum
NSSSEPSKISEL

SEQ ID NO: 2273867 - protein, 9 aa, Cryptosporidium parvum
NSSSGNQWN

SEQ ID NO: 2273868 - protein, 6 aa, Cryptosporidium parvum
NSSSIS

SEQ ID NO: 2273869 - protein, 16 aa, Cryptosporidium parvum
NSSSKEDTNFDSSLNN

SEQ ID NO: 2273870 - protein, 8 aa, Cryptosporidium parvum
NSSSKEGL

SEQ ID NO: 2273871 - protein, 11 aa, Cryptosporidium parvum
NSSSKYPKEEH

SEQ ID NO: 2273872 - protein, 10 aa, Cryptosporidium parvum
NSSSMESLAD

SEQ ID NO: 2273873 - protein, 23 aa, Cryptosporidium parvum
NSSSNNDNNPPSVSGRGKRSNVK

SEQ ID NO: 2273874 - protein, 9 aa, Cryptosporidium parvum
NSSSSYYGT

SEQ ID NO: 2273875 - protein, 6 aa, Cryptosporidium parvum
NSSSTI

SEQ ID NO: 2273876 - protein, 11 aa, Cryptosporidium parvum
NSSSTSHDNFN

SEQ ID NO: 2273877 - protein, 16 aa, Cryptosporidium parvum
NSSSWTKNEKSDGPNE

SEQ ID NO: 2273878 - protein, 5 aa, Cryptosporidium parvum
NSSTS

SEQ ID NO: 2273879 - protein, 14 aa, Cryptosporidium parvum
NSSTSNLDEKIMEK

SEQ ID NO: 2273880 - protein, 15 aa, Cryptosporidium parvum
NSSVSGENGRHQKSY

SEQ ID NO: 2273881 - protein, 17 aa, Cryptosporidium parvum
NSSVSSSPTPLSCQSNE

SEQ ID NO: 2273882 - protein, 6 aa, Cryptosporidium parvum
NSSWLD

SEQ ID NO: 2273883 - protein, 18 aa, Cryptosporidium parvum
NSSYNKERNPFEDENRED

SEQ ID NO: 2273884 - protein, 7 aa, Cryptosporidium parvum
NSSYSEL

SEQ ID NO: 2273885 - protein, 18 aa, Cryptosporidium parvum
NSSYSSTSSKSSANQSSH

SEQ ID NO: 2273886 - protein, 7 aa, Cryptosporidium parvum
NSTAKRT

SEQ ID NO: 2273887 - protein, 8 aa, Cryptosporidium parvum
NSTAPGRF

SEQ ID NO: 2273888 - protein, 7 aa, Cryptosporidium parvum
NSTCAPI

SEQ ID NO: 2273889 - protein, 5 aa, Cryptosporidium parvum
NSTDD

SEQ ID NO: 2273890 - protein, 7 aa, Cryptosporidium parvum
NSTDPDA

SEQ ID NO: 2273891 - protein, 6 aa, Cryptosporidium parvum
NSTEEY

SEQ ID NO: 2273892 - protein, 4 aa, Cryptosporidium parvum
NSTG

SEQ ID NO: 2273893 - protein, 5 aa, Cryptosporidium parvum
NSTGF

SEQ ID NO: 2273894 - protein, 4 aa, Cryptosporidium parvum
NSTI

SEQ ID NO: 2273895 - protein, 14 aa, Cryptosporidium parvum
NSTIKDSNTGENNK

SEQ ID NO: 2273896 - protein, 10 aa, Cryptosporidium parvum
NSTISKSADY

SEQ ID NO: 2273897 - protein, 18 aa, Cryptosporidium parvum
NSTISNNGAGNNTIAQNT

SEQ ID NO: 2273898 - protein, 5 aa, Cryptosporidium parvum
NSTIT

SEQ ID NO: 2273899 - protein, 6 aa, Cryptosporidium parvum
NSTKLT

SEQ ID NO: 2273900 - protein, 9 aa, Cryptosporidium parvum
NSTKQNKRK

SEQ ID NO: 2273901 - protein, 6 aa, Cryptosporidium parvum
NSTLQE

SEQ ID NO: 2273902 - protein, 13 aa, Cryptosporidium parvum
NSTMGNGKLPPMD

SEQ ID NO: 2273903 - protein, 4 aa, Cryptosporidium parvum
NSTN

SEQ ID NO: 2273904 - protein, 34 aa, Cryptosporidium parvum
NSTNATTAITTNTTTATTGLNSSTTTASTTTVSS

SEQ ID NO: 2273905 - protein, 10 aa, Cryptosporidium parvum
NSTNISDDMN

SEQ ID NO: 2273906 - protein, 10 aa, Cryptosporidium parvum
NSTNKAETSI

SEQ ID NO: 2273907 - protein, 17 aa, Cryptosporidium parvum
NSTNPSNNSKNSSSEDA

SEQ ID NO: 2273908 - protein, 10 aa, Cryptosporidium parvum
NSTNSSTTKD

SEQ ID NO: 2273909 - protein, 8 aa, Cryptosporidium parvum
NSTNVQTN

SEQ ID NO: 2273910 - protein, 7 aa, Cryptosporidium parvum
NSTPDSA

SEQ ID NO: 2273911 - protein, 6 aa, Cryptosporidium parvum
NSTPEE

SEQ ID NO: 2273912 - protein, 13 aa, Cryptosporidium parvum
NSTPHSTSSPAGL

SEQ ID NO: 2273913 - protein, 41 aa, Cryptosporidium parvum; identical to SEQ ID NO: 2155086

SEQ ID NO: 2273914 - protein, 22 aa, Cryptosporidium parvum
NSTPKTVRQDISSPKVQNSTTF

SEQ ID NO: 2273915 - protein, 6 aa, Cryptosporidium parvum
NSTRLN

SEQ ID NO: 2273916 - protein, 19 aa, Cryptosporidium parvum
NSTRSRRTRNSNDNYHSSN

SEQ ID NO: 2273917 - protein, 8 aa, Cryptosporidium parvum
NSTSGCEL

SEQ ID NO: 2273918 - protein, 14 aa, Cryptosporidium parvum
NSTSLSRRGGDRNR

SEQ ID NO: 2273919 - protein, 9 aa, Cryptosporidium parvum
NSTSNQYSS

SEQ ID NO: 2273920 - protein, 6 aa, Cryptosporidium parvum
NSTSPS

SEQ ID NO: 2273921 - protein, 11 aa, Cryptosporidium parvum
NSTSVKKKSFK

SEQ ID NO: 2273922 - protein, 13 aa, Cryptosporidium parvum
NSTTNDEDNGIIN

SEQ ID NO: 2273923 - protein, 5 aa, Cryptosporidium parvum
NSVAK

SEQ ID NO: 2273924 - protein, 6 aa, Cryptosporidium parvum
NSVEDD

SEQ ID NO: 2273925 - protein, 14 aa, Cryptosporidium parvum
NSVEEGYDSKRQEI

SEQ ID NO: 2273926 - protein, 10 aa, Cryptosporidium parvum
NSVESPPSLN

SEQ ID NO: 2273927 - protein, 40 aa, Cryptosporidium parvum
NSVGAGAGAGAGAGAGAGAGAGAGAGAGAGSGAGAGSGVG

SEQ ID NO: 2273928 - protein, 7 aa, Cryptosporidium parvum
NSVGYQR

SEQ ID NO: 2273929 - protein, 10 aa, Cryptosporidium parvum
NSVHSNASNN

SEQ ID NO: 2273930 - protein, 9 aa, Cryptosporidium parvum
NSVKCEKES

SEQ ID NO: 2273931 - protein, 10 aa, Cryptosporidium parvum
NSVKEATSNF

SEQ ID NO: 2273932 - protein, 16 aa, Cryptosporidium parvum
NSVKNNIKSKTNTKEM

SEQ ID NO: 2273933 - protein, 12 aa, Cryptosporidium parvum
NSVNNSNKNTSH

SEQ ID NO: 2273934 - protein, 24 aa, Cryptosporidium parvum
NSVNSSEMRTPSNGINLSEKGSPE

SEQ ID NO: 2273935 - protein, 13 aa, Cryptosporidium parvum
NSVNSSTYGENGQ

SEQ ID NO: 2273936 - protein, 7 aa, Cryptosporidium parvum
NSVPGDN

SEQ ID NO: 2273937 - protein, 5 aa, Cryptosporidium parvum
NSVPH

SEQ ID NO: 2273938 - protein, 9 aa, Cryptosporidium parvum
NSVPVPSKL

SEQ ID NO: 2273939 - protein, 8 aa, Cryptosporidium parvum
NSVSESLN

SEQ ID NO: 2273940 - protein, 43 aa, Cryptosporidium parvum; identical to SEQ ID NO: 2155108

SEQ ID NO: 2273941 - protein, 44 aa, Cryptosporidium parvum
NSVSSKLTSPNLSTGSNIAPSSSVGINGTTTNTAETSHAGTEAA

SEQ ID NO: 2273942 - protein, 6 aa, Cryptosporidium parvum
NSWKPI

SEQ ID NO: 2273943 - protein, 10 aa, Cryptosporidium parvum
NSYNNSPQTV

SEQ ID NO: 2273944 - protein, 9 aa, Cryptosporidium parvum
NSYNPKTGL

SEQ ID NO: 2273945 - protein, 6 aa, Cryptosporidium parvum
NSYPSP

SEQ ID NO: 2273946 - protein, 6 aa, Cryptosporidium parvum
NSYRTN

SEQ ID NO: 2273947 - protein, 30 aa, Cryptosporidium parvum
NTAEEEDSESKKQKDDEKKEDTSDRQNEEK

SEQ ID NO: 2273948 - protein, 9 aa, Cryptosporidium parvum
NTASNNVGG

SEQ ID NO: 2273949 - protein, 18 aa, Cryptosporidium parvum
NTDEDSSTALGAHGEPYN

SEQ ID NO: 2273950 - protein, 10 aa, Cryptosporidium parvum
NTDESQTENN

SEQ ID NO: 2273951 - protein, 13 aa, Cryptosporidium parvum
NTDESSSGNNINT

SEQ ID NO: 2273952 - protein, 5 aa, Cryptosporidium parvum
NTDET

SEQ ID NO: 2273953 - protein, 9 aa, Cryptosporidium parvum
NTDHKGSIT

SEQ ID NO: 2273954 - protein, 11 aa, Cryptosporidium parvum
NTDHSKNGGNS

SEQ ID NO: 2273955 - protein, 10 aa, Cryptosporidium parvum
NTDIANSDSL

SEQ ID NO: 2273956 - protein, 5 aa, Cryptosporidium parvum
NTDIT

SEQ ID NO: 2273957 - protein, 7 aa, Cryptosporidium parvum
NTDITQE

SEQ ID NO: 2273958 - protein, 9 aa, Cryptosporidium parvum
NTDNATNTI

SEQ ID NO: 2273959 - protein, 6 aa, Cryptosporidium parvum
NTDNSA

SEQ ID NO: 2273960 - protein, 15 aa, Cryptosporidium parvum
NTDNSETNNDSSDNV

SEQ ID NO: 2273961 - protein, 19 aa, Cryptosporidium parvum
NTDNSTSLDEKGPKTITEI

SEQ ID NO: 2273962 - protein, 7 aa, Cryptosporidium parvum
NTDPRAK

SEQ ID NO: 2273963 - protein, 12 aa, Cryptosporidium parvum
NTDQRSGSGGTC

SEQ ID NO: 2273964 - protein, 4 aa, Cryptosporidium parvum
NTDS

SEQ ID NO: 2273965 - protein, 10 aa, Cryptosporidium parvum
NTDSGSKNLQ

SEQ ID NO: 2273966 - protein, 8 aa, Cryptosporidium parvum
NTDSIEEQ

SEQ ID NO: 2273967 - protein, 41 aa, Cryptosporidium parvum
NTDVSPSSSSNTISNSSMSKFGETNKEEGEKSGSKSQSGSK

SEQ ID NO: 2273968 - protein, 16 aa, Cryptosporidium parvum
NTEAPLYKKKRTDELN

SEQ ID NO: 2273969 - protein, 13 aa, Cryptosporidium parvum
NTEDKLLPSEVER

SEQ ID NO: 2273970 - protein, 9 aa, Cryptosporidium parvum
NTEEGEAEV

SEQ ID NO: 2273971 - protein, 5 aa, Cryptosporidium parvum
NTEFS

SEQ ID NO: 2273972 - protein, 19 aa, Cryptosporidium parvum
NTEIDGNESRSDGNSCTPH

SEQ ID NO: 2273973 - protein, 7 aa, Cryptosporidium parvum
NTEIEKE

SEQ ID NO: 2273974 - protein, 10 aa, Cryptosporidium parvum
NTEINEGEPL

SEQ ID NO: 2273975 - protein, 10 aa, Cryptosporidium parvum
NTEKGEAKGF

SEQ ID NO: 2273976 - protein, 5 aa, Cryptosporidium parvum
NTEKS

SEQ ID NO: 2273977 - protein, 5 aa, Cryptosporidium parvum
NTELN

SEQ ID NO: 2273978 - protein, 7 aa, Cryptosporidium parvum
NTENDAL

SEQ ID NO: 2273979 - protein, 7 aa, Cryptosporidium parvum
NTENENL

SEQ ID NO: 2273980 - protein, 18 aa, Cryptosporidium parvum
NTESEGSNYNISGTPARN

SEQ ID NO: 2273981 - protein, 12 aa, Cryptosporidium parvum
NTESESAPNERF

SEQ ID NO: 2273982 - protein, 7 aa, Cryptosporidium parvum
NTESGLY

SEQ ID NO: 2273983 - protein, 11 aa, Cryptosporidium parvum
NTESSKVGQHL

SEQ ID NO: 2273984 - protein, 7 aa, Cryptosporidium parvum
NTESTNP

SEQ ID NO: 2273985 - protein, 8 aa, Cryptosporidium parvum
NTETDEFG

SEQ ID NO: 2273986 - protein, 10 aa, Cryptosporidium parvum
NTETNTKRKS

SEQ ID NO: 2273987 - protein, 6 aa, Cryptosporidium parvum
NTETPD

SEQ ID NO: 2273988 - protein, 17 aa, Cryptosporidium parvum
NTETSRWSEETTVQSSV

SEQ ID NO: 2273989 - protein, 7 aa, Cryptosporidium parvum
NTEYDPS

SEQ ID NO: 2273990 - protein, 6 aa, Cryptosporidium parvum
NTEYKE

SEQ ID NO: 2273991 - protein, 9 aa, Cryptosporidium parvum
NTFDKTKND

SEQ ID NO: 2273992 - protein, 7 aa, Cryptosporidium parvum
NTFGDGK

SEQ ID NO: 2273993 - protein, 6 aa, Cryptosporidium parvum
NTFKTT

SEQ ID NO: 2273994 - protein, 6 aa, Cryptosporidium parvum
NTFSPE

SEQ ID NO: 2273995 - protein, 5 aa, Cryptosporidium parvum
NTGAF

SEQ ID NO: 2273996 - protein, 23 aa, Cryptosporidium parvum
NTGCNSPSLTSSSYSFSSSSAEP

SEQ ID NO: 2273997 - protein, 11 aa, Cryptosporidium parvum
NTGDDNKPRFE

SEQ ID NO: 2273998 - protein, 9 aa, Cryptosporidium parvum
NTGDPTNDY

SEQ ID NO: 2273999 - protein, 12 aa, Cryptosporidium parvum
NTGEETRSKSLN

SEQ ID NO: 2274000 - protein, 6 aa, Cryptosporidium parvum
NTGENV

SEQ ID NO: 2274001 - protein, 5 aa, Cryptosporidium parvum
NTGEY

SEQ ID NO: 2274002 - protein, 25 aa, Cryptosporidium parvum
NTGFTNKANRDSSEADSNKNTSIES

SEQ ID NO: 2274003 - protein, 16 aa, Cryptosporidium parvum
NTGGNLENTCKKEAGN

SEQ ID NO: 2274004 - protein, 8 aa, Cryptosporidium parvum
NTGINTPN

SEQ ID NO: 2274005 - protein, 7 aa, Cryptosporidium parvum
NTGISSV

SEQ ID NO: 2274006 - protein, 4 aa, Cryptosporidium parvum
NTGK

SEQ ID NO: 2274007 - protein, 7 aa, Cryptosporidium parvum
NTGKEYI

SEQ ID NO: 2274008 - protein, 6 aa, Cryptosporidium parvum
NTGKVG

SEQ ID NO: 2274009 - protein, 6 aa, Cryptosporidium parvum
NTGKWS

SEQ ID NO: 2274010 - protein, 5 aa, Cryptosporidium parvum
NTGQY

SEQ ID NO: 2274011 - protein, 8 aa, Cryptosporidium parvum
NTGSELNN

SEQ ID NO: 2274012 - protein, 5 aa, Cryptosporidium parvum
NTGSV

SEQ ID NO: 2274013 - protein, 7 aa, Cryptosporidium parvum
NTGTAIS

SEQ ID NO: 2274014 - protein, 8 aa, Cryptosporidium parvum
NTGTKYKQ

SEQ ID NO: 2274015 - protein, 7 aa, Cryptosporidium parvum
NTGYATS

SEQ ID NO: 2274016 - protein, 5 aa, Cryptosporidium parvum
NTHEG

SEQ ID NO: 2274017 - protein, 13 aa, Cryptosporidium parvum
NTHNSHNSNHHNN

SEQ ID NO: 2274018 - protein, 11 aa, Cryptosporidium parvum
NTIKNNTKTLY

SEQ ID NO: 2274019 - protein, 23 aa, Cryptosporidium parvum
NTIKNSSVSRIRNKSNSLEGHGD

SEQ ID NO: 2274020 - protein, 20 aa, Cryptosporidium parvum
NTIRNDEYKRKLDRTREEKL

SEQ ID NO: 2274021 - protein, 10 aa, Cryptosporidium parvum
NTISNTNECQ

SEQ ID NO: 2274022 - protein, 7 aa, Cryptosporidium parvum
NTITNKR

SEQ ID NO: 2274023 - protein, 10 aa, Cryptosporidium parvum
NTITPSNNNG

SEQ ID NO: 2274024 - protein, 35 aa, Cryptosporidium parvum
NTITTTTTNTTTAVPNANSTSNKGSHIDHTNNSSL

SEQ ID NO: 2274025 - protein, 20 aa, Cryptosporidium parvum
NTKAHNTNTSATHDKLSETF

SEQ ID NO: 2274026 - protein, 7 aa, Cryptosporidium parvum
NTKARSF

SEQ ID NO: 2274027 - protein, 9 aa, Cryptosporidium parvum
NTKCQEGEE

SEQ ID NO: 2274028 - protein, 4 aa, Cryptosporidium parvum
NTKD

SEQ ID NO: 2274029 - protein, 10 aa, Cryptosporidium parvum
NTKDEVSEIN

SEQ ID NO: 2274030 - protein, 16 aa, Cryptosporidium parvum
NTKESNLNAQNIKNEL

SEQ ID NO: 2274031 - protein, 7 aa, Cryptosporidium parvum
NTKKAGL

SEQ ID NO: 2274032 - protein, 9 aa, Cryptosporidium parvum
NTKKKPPKY

SEQ ID NO: 2274033 - protein, 9 aa, Cryptosporidium parvum
NTKLNDDFK

SEQ ID NO: 2274034 - protein, 19 aa, Cryptosporidium parvum
NTKLSSKSGSQSSLNQTNY

SEQ ID NO: 2274035 - protein, 5 aa, Cryptosporidium parvum
NTKNI

SEQ ID NO: 2274036 - protein, 6 aa, Cryptosporidium parvum
NTKNPY

SEQ ID NO: 2274037 - protein, 5 aa, Cryptosporidium parvum
NTKNS

SEQ ID NO: 2274038 - protein, 10 aa, Cryptosporidium parvum
NTKPNGHHHP

SEQ ID NO: 2274039 - protein, 5 aa, Cryptosporidium parvum
NTKQK

SEQ ID NO: 2274040 - protein, 16 aa, Cryptosporidium parvum
NTKQSIEKCIIRSINN

SEQ ID NO: 2274041 - protein, 11 aa, Cryptosporidium parvum
NTKRSISTDQT

SEQ ID NO: 2274042 - protein, 4 aa, Cryptosporidium parvum
NTKS

SEQ ID NO: 2274043 - protein, 10 aa, Cryptosporidium parvum
NTKSFEPAHA

SEQ ID NO: 2274044 - protein, 9 aa, Cryptosporidium parvum
NTKSYAEST

SEQ ID NO: 2274045 - protein, 7 aa, Cryptosporidium parvum
NTKTDSV

SEQ ID NO: 2274046 - protein, 8 aa, Cryptosporidium parvum
NTKTPLDI

SEQ ID NO: 2274047 - protein, 7 aa, Cryptosporidium parvum
NTKYDNK

SEQ ID NO: 2274048 - protein, 15 aa, Cryptosporidium parvum
NTLATDSSVPIPAPS

SEQ ID NO: 2274049 - protein, 14 aa, Cryptosporidium parvum
NTLDSLGKTKSKRI

SEQ ID NO: 2274050 - protein, 10 aa, Cryptosporidium parvum
NTLDSNSSLK

SEQ ID NO: 2274051 - protein, 9 aa, Cryptosporidium parvum
NTLEEETEI

SEQ ID NO: 2274052 - protein, 5 aa, Cryptosporidium parvum
NTLEN

SEQ ID NO: 2274053 - protein, 4 aa, Cryptosporidium parvum
NTLN

SEQ ID NO: 2274054 - protein, 6 aa, Cryptosporidium parvum
NTLNTG

SEQ ID NO: 2274055 - protein, 8 aa, Cryptosporidium parvum
NTLPGSNS

SEQ ID NO: 2274056 - protein, 5 aa, Cryptosporidium parvum
NTLPP

SEQ ID NO: 2274057 - protein, 25 aa, Cryptosporidium parvum
NTLQNDLKSSNKTVTNKNKKRKLSQ

SEQ ID NO: 2274058 - protein, 12 aa, Cryptosporidium parvum
NTLSTKTESYSL

SEQ ID NO: 2274059 - protein, 5 aa, Cryptosporidium parvum
NTLTI

SEQ ID NO: 2274060 - protein, 4 aa, Cryptosporidium parvum
NTLV

SEQ ID NO: 2274061 - protein, 7 aa, Cryptosporidium parvum
NTMQQKQ

SEQ ID NO: 2274062 - protein, 7 aa, Cryptosporidium parvum
NTNDNDL

SEQ ID NO: 2274063 - protein, 5 aa, Cryptosporidium parvum
NTNEN

SEQ ID NO: 2274064 - protein, 12 aa, Cryptosporidium parvum
NTNENEKSSEYF

SEQ ID NO: 2274065 - protein, 7 aa, Cryptosporidium parvum
NTNEWGG

SEQ ID NO: 2274066 - protein, 9 aa, Cryptosporidium parvum
NTNGILNSS

SEQ ID NO: 2274067 - protein, 5 aa, Cryptosporidium parvum
NTNGN

SEQ ID NO: 2274068 - protein, 9 aa, Cryptosporidium parvum
NTNHEHPLE

SEQ ID NO: 2274069 - protein, 5 aa, Cryptosporidium parvum
NTNIN

SEQ ID NO: 2274070 - protein, 15 aa, Cryptosporidium parvum
NTNINPSTNSNYNYN

SEQ ID NO: 2274071 - protein, 14 aa, Cryptosporidium parvum
NTNISSVSRSNSSA

SEQ ID NO: 2274072 - protein, 8 aa, Cryptosporidium parvum
NTNKEHSN

SEQ ID NO: 2274073 - protein, 10 aa, Cryptosporidium parvum
NTNKESSTNY

SEQ ID NO: 2274074 - protein, 8 aa, Cryptosporidium parvum
NTNKIQGE

SEQ ID NO: 2274075 - protein, 4 aa, Cryptosporidium parvum
NTNL

SEQ ID NO: 2274076 - protein, 7 aa, Cryptosporidium parvum
NTNLNTE

SEQ ID NO: 2274077 - protein, 12 aa, Cryptosporidium parvum
NTNLTSENVRNQ

SEQ ID NO: 2274078 - protein, 4 aa, Cryptosporidium parvum
NTNN

SEQ ID NO: 2274079 - protein, 10 aa, Cryptosporidium parvum
NTNNEDLNTS

SEQ ID NO: 2274080 - protein, 7 aa, Cryptosporidium parvum
NTNNGTT

SEQ ID NO: 2274081 - protein, 16 aa, Cryptosporidium parvum
NTNNKPNVTSKNPFDL

SEQ ID NO: 2274082 - protein, 5 aa, Cryptosporidium parvum
NTNNM

SEQ ID NO: 2274083 - protein, 9 aa, Cryptosporidium parvum
NTNPKHSPG

SEQ ID NO: 2274084 - protein, 6 aa, Cryptosporidium parvum
NTNPPV

SEQ ID NO: 2274085 - protein, 9 aa, Cryptosporidium parvum
NTNPRKGPF

SEQ ID NO: 2274086 - protein, 5 aa, Cryptosporidium parvum
NTNQR

SEQ ID NO: 2274087 - protein, 18 aa, Cryptosporidium parvum
NTNQVPTPMNTNKNKSVS

SEQ ID NO: 2274088 - protein, 22 aa, Cryptosporidium parvum
NTNSDGIENRWNNNNNSLVTPS

SEQ ID NO: 2274089 - protein, 10 aa, Cryptosporidium parvum
NTNSIASKEA

SEQ ID NO: 2274090 - protein, 15 aa, Cryptosporidium parvum
NTNSKRTETEFDANP

SEQ ID NO: 2274091 - protein, 6 aa, Cryptosporidium parvum
NTNSNI

SEQ ID NO: 2274092 - protein, 19 aa, Cryptosporidium parvum
NTNSRHNKYHDNSPKNIPF

SEQ ID NO: 2274093 - protein, 10 aa, Cryptosporidium parvum
NTNSRNNAFP

SEQ ID NO: 2274094 - protein, 9 aa, Cryptosporidium parvum
NTNSSSSEK

SEQ ID NO: 2274095 - protein, 8 aa, Cryptosporidium parvum
NTNSYSEK

SEQ ID NO: 2274096 - protein, 9 aa, Cryptosporidium parvum
NTNTASEKQ

SEQ ID NO: 2274097 - protein, 14 aa, Cryptosporidium parvum
NTNTIPNNNSKTIK

SEQ ID NO: 2274098 - protein, 12 aa, Cryptosporidium parvum
NTNTPDQDSEEF

SEQ ID NO: 2274099 - protein, 8 aa, Cryptosporidium parvum
NTNVQGTS

SEQ ID NO: 2274100 - protein, 5 aa, Cryptosporidium parvum
NTPAN

SEQ ID NO: 2274101 - protein, 5 aa, Cryptosporidium parvum
NTPEF

SEQ ID NO: 2274102 - protein, 7 aa, Cryptosporidium parvum
NTPGGYS

SEQ ID NO: 2274103 - protein, 7 aa, Cryptosporidium parvum
NTPIRKG

SEQ ID NO: 2274104 - protein, 18 aa, Cryptosporidium parvum
NTPKIGRESISGGSGNKS

SEQ ID NO: 2274105 - protein, 10 aa, Cryptosporidium parvum
NTPKLTDEAA

SEQ ID NO: 2274106 - protein, 16 aa, Cryptosporidium parvum
NTPKSDNTKISKGSRK

SEQ ID NO: 2274107 - protein, 4 aa, Cryptosporidium parvum
NTPL

SEQ ID NO: 2274108 - protein, 10 aa, Cryptosporidium parvum
NTPNHPSGNH

SEQ ID NO: 2274109 - protein, 6 aa, Cryptosporidium parvum
NTPNNV

SEQ ID NO: 2274110 - protein, 6 aa, Cryptosporidium parvum
NTPNSL

SEQ ID NO: 2274111 - protein, 8 aa, Cryptosporidium parvum
NTPPEPYI

SEQ ID NO: 2274112 - protein, 21 aa, Cryptosporidium parvum
NTPPTSSYRTSDQLNHPNQTT

SEQ ID NO: 2274113 - protein, 14 aa, Cryptosporidium parvum
NTPPVSSSPAHSPS

SEQ ID NO: 2274114 - protein, 6 aa, Cryptosporidium parvum
NTPQGL

SEQ ID NO: 2274115 - protein, 6 aa, Cryptosporidium parvum
NTPRKA

SEQ ID NO: 2274116 - protein, 5 aa, Cryptosporidium parvum
NTPRS

SEQ ID NO: 2274117 - protein, 20 aa, Cryptosporidium parvum
NTPSEKNSIQGSTKSSYYNP

SEQ ID NO: 2274118 - protein, 7 aa, Cryptosporidium parvum
NTPSGTV

SEQ ID NO: 2274119 - protein, 8 aa, Cryptosporidium parvum
NTPSSPLQ

SEQ ID NO: 2274120 - protein, 15 aa, Cryptosporidium parvum
NTPTRCRNRRGESLN

SEQ ID NO: 2274121 - protein, 8 aa, Cryptosporidium parvum
NTQASSDR

SEQ ID NO: 2274122 - protein, 5 aa, Cryptosporidium parvum
NTQFS

SEQ ID NO: 2274123 - protein, 4 aa, Cryptosporidium parvum
NTQG

SEQ ID NO: 2274124 - protein, 8 aa, Cryptosporidium parvum
NTQGFSGA

SEQ ID NO: 2274125 - protein, 14 aa, Cryptosporidium parvum
NTQNLKDPSLQSTQ

SEQ ID NO: 2274126 - protein, 14 aa, Cryptosporidium parvum
NTQQNRDSSACNSP

SEQ ID NO: 2274127 - protein, 6 aa, Cryptosporidium parvum
NTQSEV

SEQ ID NO: 2274128 - protein, 5 aa, Cryptosporidium parvum
NTQSG

SEQ ID NO: 2274129 - protein, 7 aa, Cryptosporidium parvum
NTQSNDF

SEQ ID NO: 2274130 - protein, 31 aa, Cryptosporidium parvum
NTQYESISQNCKNSNSNKYLSNSKEKSLQNN

SEQ ID NO: 2274131 - protein, 7 aa, Cryptosporidium parvum
NTRCQSV

SEQ ID NO: 2274132 - protein, 6 aa, Cryptosporidium parvum
NTRKQR

SEQ ID NO: 2274133 - protein, 8 aa, Cryptosporidium parvum
NTRNGFNN

SEQ ID NO: 2274134 - protein, 6 aa, Cryptosporidium parvum
NTRNPG

SEQ ID NO: 2274135 - protein, 19 aa, Cryptosporidium parvum
NTRNTGKQSKGKKDIQDNK

SEQ ID NO: 2274136 - protein, 12 aa, Cryptosporidium parvum
NTRRNKEKDQVS

SEQ ID NO: 2274137 - protein, 5 aa, Cryptosporidium parvum
NTRSL

SEQ ID NO: 2274138 - protein, 11 aa, Cryptosporidium parvum
NTRYNDEQEIK

SEQ ID NO: 2274139 - protein, 7 aa, Cryptosporidium parvum
NTSARKQ

SEQ ID NO: 2274140 - protein, 11 aa, Cryptosporidium parvum
NTSDDEQISED

SEQ ID NO: 2274141 - protein, 4 aa, Cryptosporidium parvum
NTSE

SEQ ID NO: 2274142 - protein, 5 aa, Cryptosporidium parvum
NTSEA

SEQ ID NO: 2274143 - protein, 6 aa, Cryptosporidium parvum
NTSFSN

SEQ ID NO: 2274144 - protein, 16 aa, Cryptosporidium parvum
NTSGSSPSKDGSTSGM

SEQ ID NO: 2274145 - protein, 26 aa, Cryptosporidium parvum
NTSGTAPVTATTQGGIGMGQQGTEGL

SEQ ID NO: 2274146 - protein, 6 aa, Cryptosporidium parvum
NTSIGT

SEQ ID NO: 2274147 - protein, 13 aa, Cryptosporidium parvum
NTSIQDLKDSDIT

SEQ ID NO: 2274148 - protein, 5 aa, Cryptosporidium parvum
NTSIS

SEQ ID NO: 2274149 - protein, 17 aa, Cryptosporidium parvum
NTSKNSNLGSSKNKLKQ

SEQ ID NO: 2274150 - protein, 18 aa, Cryptosporidium parvum
NTSKSNGVNQKRKANCEY

SEQ ID NO: 2274151 - protein, 61 aa, Cryptosporidium parvum
NTSLNTISNPLDDDSLYDSDDDEDYEAEDDEDDDDDDDDDDDDDDDEEEKKEERDDEELEF

SEQ ID NO: 2274152 - protein, 7 aa, Cryptosporidium parvum
NTSLSKN

SEQ ID NO: 2274153 - protein, 10 aa, Cryptosporidium parvum
NTSNNSGQYE

SEQ ID NO: 2274154 - protein, 10 aa, Cryptosporidium parvum
NTSQAFRTAR

SEQ ID NO: 2274155 - protein, 9 aa, Cryptosporidium parvum
NTSRNGKKN

SEQ ID NO: 2274156 - protein, 9 aa, Cryptosporidium parvum
NTSRNNPKF

SEQ ID NO: 2274157 - protein, 10 aa, Cryptosporidium parvum
NTSSSSDISY

SEQ ID NO: 2274158 - protein, 14 aa, Cryptosporidium parvum
NTSTNITSKLPELK

SEQ ID NO: 2274159 - protein, 6 aa, Cryptosporidium parvum
NTSTRQ

SEQ ID NO: 2274160 - protein, 7 aa, Cryptosporidium parvum
NTSVNIT

SEQ ID NO: 2274161 - protein, 8 aa, Cryptosporidium parvum
NTSYGGLN

SEQ ID NO: 2274162 - protein, 10 aa, Cryptosporidium parvum
NTTCNKEDSD

SEQ ID NO: 2274163 - protein, 11 aa, Cryptosporidium parvum
NTTDEVSWEDQ

SEQ ID NO: 2274164 - protein, 14 aa, Cryptosporidium parvum
NTTDNFDKNTHSEL

SEQ ID NO: 2274165 - protein, 19 aa, Cryptosporidium parvum
NTTEEAPHVGNGGTNDVAN

SEQ ID NO: 2274166 - protein, 44 aa, Cryptosporidium parvum
NTTEGINDHQSKNSVSQTITTGSGRIPSRGIKRRGSLKNQTDIT

SEQ ID NO: 2274167 - protein, 7 aa, Cryptosporidium parvum
NTTEKRH

SEQ ID NO: 2274168 - protein, 8 aa, Cryptosporidium parvum
NTTETKKK

SEQ ID NO: 2274169 - protein, 8 aa, Cryptosporidium parvum
NTTIPAKK

SEQ ID NO: 2274170 - protein, 22 aa, Cryptosporidium parvum
NTTIPTKKSQVFSTAADNQTQV

SEQ ID NO: 2274171 - protein, 6 aa, Cryptosporidium parvum
NTTKTC

SEQ ID NO: 2274172 - protein, 15 aa, Cryptosporidium parvum
NTTLRNKSDQAISKS

SEQ ID NO: 2274173 - protein, 6 aa, Cryptosporidium parvum
NTTNER

SEQ ID NO: 2274174 - protein, 39 aa, Cryptosporidium parvum
NTTNKKAPVSEKPSQPQIPNKTSDVKKGGTMGGERGSVT

SEQ ID NO: 2274175 - protein, 6 aa, Cryptosporidium parvum
NTTNSK

SEQ ID NO: 2274176 - protein, 5 aa, Cryptosporidium parvum
NTTSI

SEQ ID NO: 2274177 - protein, 18 aa, Cryptosporidium parvum
NTTSTPRKKLTQTSKSAG

SEQ ID NO: 2274178 - protein, 36 aa, Cryptosporidium parvum
NTTSTTNNTTNITNNNNTTNNNNSNNNNSNSKNTVL

SEQ ID NO: 2274179 - protein, 15 aa, Cryptosporidium parvum
NTTTNATNNISTINE

SEQ ID NO: 2274180 - protein, 35 aa, Cryptosporidium parvum; identical to SEQ ID NO: 2155314

SEQ ID NO: 2274181 - protein, 9 aa, Cryptosporidium parvum
NTTTTNNNY

SEQ ID NO: 2274182 - protein, 11 aa, Cryptosporidium parvum
NTTTTTTTTTI

SEQ ID NO: 2274183 - protein, 11 aa, Cryptosporidium parvum
NTTTVSSEISS

SEQ ID NO: 2274184 - protein, 7 aa, Cryptosporidium parvum
NTTVNQN

SEQ ID NO: 2274185 - protein, 5 aa, Cryptosporidium parvum
NTTVQ

SEQ ID NO: 2274186 - protein, 10 aa, Cryptosporidium parvum
NTTYRNSSGK

SEQ ID NO: 2274187 - protein, 9 aa, Cryptosporidium parvum
NTTYSYEKS

SEQ ID NO: 2274188 - protein, 8 aa, Cryptosporidium parvum
NTVNDNKE

SEQ ID NO: 2274189 - protein, 16 aa, Cryptosporidium parvum
NTVNHNTTGSSTNGSF

SEQ ID NO: 2274190 - protein, 11 aa, Cryptosporidium parvum
NTVQPASTGLF

SEQ ID NO: 2274191 - protein, 19 aa, Cryptosporidium parvum
NTVRNGFEESGKSKGISGQ

SEQ ID NO: 2274192 - protein, 28 aa, Cryptosporidium parvum
NTVSDGFEGDSSTSSNGTAEPKPELSKY

SEQ ID NO: 2274193 - protein, 9 aa, Cryptosporidium parvum
NTYANPGPI

SEQ ID NO: 2274194 - protein, 12 aa, Cryptosporidium parvum
NTYDSGKVQLSD

SEQ ID NO: 2274195 - protein, 7 aa, Cryptosporidium parvum
NTYETAT

SEQ ID NO: 2274196 - protein, 30 aa, Cryptosporidium parvum
NTYKDNQGDLNVSNKKRKKDHHSKSEKDMN

SEQ ID NO: 2274197 - protein, 4 aa, Cryptosporidium parvum
NTYL

SEQ ID NO: 2274198 - protein, 7 aa, Cryptosporidium parvum
NTYNNED

SEQ ID NO: 2274199 - protein, 5 aa, Cryptosporidium parvum
NTYNS

SEQ ID NO: 2274200 - protein, 13 aa, Cryptosporidium parvum
NTYSNLKEKKRET

SEQ ID NO: 2274201 - protein, 6 aa, Cryptosporidium parvum
NTYSSR

SEQ ID NO: 2274202 - protein, 4 aa, Cryptosporidium parvum
NTYT

SEQ ID NO: 2274203 - protein, 5 aa, Cryptosporidium parvum
NVAGT

SEQ ID NO: 2274204 - protein, 10 aa, Cryptosporidium parvum
NVAPNTKHRM

SEQ ID NO: 2274205 - protein, 8 aa, Cryptosporidium parvum
NVASNETD

SEQ ID NO: 2274206 - protein, 5 aa, Cryptosporidium parvum
NVDGR

SEQ ID NO: 2274207 - protein, 6 aa, Cryptosporidium parvum
NVDHAE

SEQ ID NO: 2274208 - protein, 26 aa, Cryptosporidium parvum
NVDNNDSRQNGGISPSINDSPKSSAA

SEQ ID NO: 2274209 - protein, 6 aa, Cryptosporidium parvum
NVDPAL

SEQ ID NO: 2274210 - protein, 12 aa, Cryptosporidium parvum
NVEDGKSKKRHR

SEQ ID NO: 2274211 - protein, 10 aa, Cryptosporidium parvum
NVEDNENDSF

SEQ ID NO: 2274212 - protein, 23 aa, Cryptosporidium parvum
NVEENDNNTKQTQVKRSREYSND

SEQ ID NO: 2274213 - protein, 15 aa, Cryptosporidium parvum
NVEGGSGSNNLNDVS

SEQ ID NO: 2274214 - protein, 13 aa, Cryptosporidium parvum
NVENSRLEESSDR

SEQ ID NO: 2274215 - protein, 36 aa, Cryptosporidium parvum
NVEQRQKNQPITQQQPQAQSQKPSHSQQSNNSDFAA

SEQ ID NO: 2274216 - protein, 5 aa, Cryptosporidium parvum
NVEQT

SEQ ID NO: 2274217 - protein, 7 aa, Cryptosporidium parvum
NVERSKD

SEQ ID NO: 2274218 - protein, 41 aa, Cryptosporidium parvum
NVESDSSEQEHSKNTNLEKHDKRSKETTSKDSKCKNSNKDI

SEQ ID NO: 2274219 - protein, 4 aa, Cryptosporidium parvum
NVGE

SEQ ID NO: 2274220 - protein, 14 aa, Cryptosporidium parvum
NVGEPKKSRDINYG

SEQ ID NO: 2274221 - protein, 11 aa, Cryptosporidium parvum
NVGGDGNSEGD

SEQ ID NO: 2274222 - protein, 6 aa, Cryptosporidium parvum
NVGHST

SEQ ID NO: 2274223 - protein, 4 aa, Cryptosporidium parvum
NVGK

SEQ ID NO: 2274224 - protein, 7 aa, Cryptosporidium parvum
NVGKSSL

SEQ ID NO: 2274225 - protein, 7 aa, Cryptosporidium parvum
NVGKSTT

SEQ ID NO: 2274226 - protein, 12 aa, Cryptosporidium parvum
NVGRSRTASNKL

SEQ ID NO: 2274227 - protein, 7 aa, Cryptosporidium parvum
NVGSNQQ

SEQ ID NO: 2274228 - protein, 8 aa, Cryptosporidium parvum
NVGTQNST

SEQ ID NO: 2274229 - protein, 6 aa, Cryptosporidium parvum
NVHSSN

SEQ ID NO: 2274230 - protein, 5 aa, Cryptosporidium parvum
NVIPN

SEQ ID NO: 2274231 - protein, 5 aa, Cryptosporidium parvum
NVISP

SEQ ID NO: 2274232 - protein, 16 aa, Cryptosporidium parvum
NVISTNTSQSNESLSI

SEQ ID NO: 2274233 - protein, 8 aa, Cryptosporidium parvum
NVKEADEF

SEQ ID NO: 2274234 - protein, 26 aa, Cryptosporidium parvum
NVKEGTKIDKSDNNNDIEDRDEEVQG

SEQ ID NO: 2274235 - protein, 5 aa, Cryptosporidium parvum
NVKPG

SEQ ID NO: 2274236 - protein, 5 aa, Cryptosporidium parvum
NVKPQ

SEQ ID NO: 2274237 - protein, 9 aa, Cryptosporidium parvum
NVKPSKNLV

SEQ ID NO: 2274238 - protein, 6 aa, Cryptosporidium parvum
NVKSDI

SEQ ID NO: 2274239 - protein, 6 aa, Cryptosporidium parvum
NVKTTQ

SEQ ID NO: 2274240 - protein, 12 aa, Cryptosporidium parvum
NVLSGSTSITNT

SEQ ID NO: 2274241 - protein, 19 aa, Cryptosporidium parvum
NVLSQKSKLSKDSVISSGI

SEQ ID NO: 2274242 - protein, 6 aa, Cryptosporidium parvum
NVLSSA

SEQ ID NO: 2274243 - protein, 10 aa, Cryptosporidium parvum
NVNDSQDNIY

SEQ ID NO: 2274244 - protein, 13 aa, Cryptosporidium parvum
NVNEGQLEENNKK

SEQ ID NO: 2274245 - protein, 7 aa, Cryptosporidium parvum
NVNKGDP

SEQ ID NO: 2274246 - protein, 8 aa, Cryptosporidium parvum
NVNKGNDP

SEQ ID NO: 2274247 - protein, 5 aa, Cryptosporidium parvum
NVNNP

SEQ ID NO: 2274248 - protein, 15 aa, Cryptosporidium parvum
NVNQNKGRLERANNP

SEQ ID NO: 2274249 - protein, 8 aa, Cryptosporidium parvum
NVNSNNIN

SEQ ID NO: 2274250 - protein, 8 aa, Cryptosporidium parvum
NVPADSNL

SEQ ID NO: 2274251 - protein, 7 aa, Cryptosporidium parvum
NVPEGEA

SEQ ID NO: 2274252 - protein, 15 aa, Cryptosporidium parvum
NVPESISKKQNENLP

SEQ ID NO: 2274253 - protein, 12 aa, Cryptosporidium parvum
NVPGLGKNISTN

SEQ ID NO: 2274254 - protein, 12 aa, Cryptosporidium parvum
NVPKERVERRND

SEQ ID NO: 2274255 - protein, 6 aa, Cryptosporidium parvum
NVPKPI

SEQ ID NO: 2274256 - protein, 20 aa, Cryptosporidium parvum
NVPLSPSQVGGKCNNKETQI

SEQ ID NO: 2274257 - protein, 6 aa, Cryptosporidium parvum
NVPRPN

SEQ ID NO: 2274258 - protein, 8 aa, Cryptosporidium parvum
NVPSSEAF

SEQ ID NO: 2274259 - protein, 11 aa, Cryptosporidium parvum
NVPSSRNSFTA

SEQ ID NO: 2274260 - protein, 12 aa, Cryptosporidium parvum
NVPSTETGKGKL

SEQ ID NO: 2274261 - protein, 13 aa, Cryptosporidium parvum
NVPSTSVDKKGTN

SEQ ID NO: 2274262 - protein, 22 aa, Cryptosporidium parvum
NVPTSAAAAPTNSSSISPTANV

SEQ ID NO: 2274263 - protein, 8 aa, Cryptosporidium parvum
NVQNKRDA

SEQ ID NO: 2274264 - protein, 13 aa, Cryptosporidium parvum
NVREKGAQEWEQA

SEQ ID NO: 2274265 - protein, 25 aa, Cryptosporidium parvum
NVRRGNKSAHNLESQSKKEPPRTLG

SEQ ID NO: 2274266 - protein, 12 aa, Cryptosporidium parvum
NVRSQNRSSNYN

SEQ ID NO: 2274267 - protein, 11 aa, Cryptosporidium parvum
NVSESQRFPSY

SEQ ID NO: 2274268 - protein, 18 aa, Cryptosporidium parvum
NVSGTSGTTGNEHGSGSG

SEQ ID NO: 2274269 - protein, 7 aa, Cryptosporidium parvum
NVSKEQI

SEQ ID NO: 2274270 - protein, 9 aa, Cryptosporidium parvum
NVSKIGRNL

SEQ ID NO: 2274271 - protein, 8 aa, Cryptosporidium parvum
NVSKYNQE

SEQ ID NO: 2274272 - protein, 5 aa, Cryptosporidium parvum
NVSNE

SEQ ID NO: 2274273 - protein, 21 aa, Cryptosporidium parvum
NVSNNNMNGNSSVSGFSTQSD

SEQ ID NO: 2274274 - protein, 10 aa, Cryptosporidium parvum
NVSNQTSDSF

SEQ ID NO: 2274275 - protein, 4 aa, Cryptosporidium parvum
NVSQ

SEQ ID NO: 2274276 - protein, 11 aa, Cryptosporidium parvum
NVSQDTLNDNL

SEQ ID NO: 2274277 - protein, 5 aa, Cryptosporidium parvum
NVSSA

SEQ ID NO: 2274278 - protein, 6 aa, Cryptosporidium parvum
NVSSGS

SEQ ID NO: 2274279 - protein, 9 aa, Cryptosporidium parvum
NVSSNTDIN

SEQ ID NO: 2274280 - protein, 21 aa, Cryptosporidium parvum
NVSTRESSPKYNRSPLDSQEV

SEQ ID NO: 2274281 - protein, 11 aa, Cryptosporidium parvum
NVSTSDACSAY

SEQ ID NO: 2274282 - protein, 33 aa, Cryptosporidium parvum
NVTGNSKSFESKEENKDLSSSISGSEKQNKDVN

SEQ ID NO: 2274283 - protein, 11 aa, Cryptosporidium parvum
NVTGSDEIEDD

SEQ ID NO: 2274284 - protein, 7 aa, Cryptosporidium parvum
NVTNSEE

SEQ ID NO: 2274285 - protein, 10 aa, Cryptosporidium parvum
NVTPNTGNPL

SEQ ID NO: 2274286 - protein, 11 aa, Cryptosporidium parvum
NVTPSSRREGF

SEQ ID NO: 2274287 - protein, 6 aa, Cryptosporidium parvum
NVTRHD

SEQ ID NO: 2274288 - protein, 4 aa, Cryptosporidium parvum
NVTS

SEQ ID NO: 2274289 - protein, 7 aa, Cryptosporidium parvum
NVTSQVN

SEQ ID NO: 2274290 - protein, 6 aa, Cryptosporidium parvum
NVTSSQ

SEQ ID NO: 2274291 - protein, 5 aa, Cryptosporidium parvum
NVTST

SEQ ID NO: 2274292 - protein, 15 aa, Cryptosporidium parvum
NVTTGTKTGETTRTA

SEQ ID NO: 2274293 - protein, 5 aa, Cryptosporidium parvum
NVTTS

SEQ ID NO: 2274294 - protein, 14 aa, Cryptosporidium parvum
NVYDENNDGVTGMS

SEQ ID NO: 2274295 - protein, 11 aa, Cryptosporidium parvum
NVYDSKKGSFK

SEQ ID NO: 2274296 - protein, 5 aa, Cryptosporidium parvum
NVYEG

SEQ ID NO: 2274297 - protein, 8 aa, Cryptosporidium parvum
NVYEPSED

SEQ ID NO: 2274298 - protein, 10 aa, Cryptosporidium parvum
NVYKPDSVSY

SEQ ID NO: 2274299 - protein, 62 aa, Cryptosporidium parvum
NWKKPEKEKDKANKDSQKENIPEQESESKTTTREDEKSKNNTQANSESQDIDEDEDIEPPPW

SEQ ID NO: 2274300 - protein, 7 aa, Cryptosporidium parvum
NWPTLDS

SEQ ID NO: 2274301 - protein, 7 aa, Cryptosporidium parvum
NWSPNAM

SEQ ID NO: 2274302 - protein, 8 aa, Cryptosporidium parvum
NYAENQRM

SEQ ID NO: 2274303 - protein, 6 aa, Cryptosporidium parvum
NYDDNL

SEQ ID NO: 2274304 - protein, 4 aa, Cryptosporidium parvum
NYDE

SEQ ID NO: 2274305 - protein, 15 aa, Cryptosporidium parvum
NYDPPGKIVYTDQGE

SEQ ID NO: 2274306 - protein, 12 aa, Cryptosporidium parvum
NYDTQKFPYNPE

SEQ ID NO: 2274307 - protein, 9 aa, Cryptosporidium parvum
NYEAETKEE

SEQ ID NO: 2274308 - protein, 6 aa, Cryptosporidium parvum
NYEAQE

SEQ ID NO: 2274309 - protein, 17 aa, Cryptosporidium parvum
NYEELGSKERIKYRNGN

SEQ ID NO: 2274310 - protein, 6 aa, Cryptosporidium parvum
NYEKEN

SEQ ID NO: 2274311 - protein, 4 aa, Cryptosporidium parvum
NYEN

SEQ ID NO: 2274312 - protein, 9 aa, Cryptosporidium parvum
NYENGKKDQ

SEQ ID NO: 2274313 - protein, 5 aa, Cryptosporidium parvum
NYENS

SEQ ID NO: 2274314 - protein, 6 aa, Cryptosporidium parvum
NYETEQ

SEQ ID NO: 2274315 - protein, 7 aa, Cryptosporidium parvum
NYGGGKL

SEQ ID NO: 2274316 - protein, 9 aa, Cryptosporidium parvum
NYGNENTRI

SEQ ID NO: 2274317 - protein, 16 aa, Cryptosporidium parvum
NYGNNTYNNSIYCPNC

SEQ ID NO: 2274318 - protein, 6 aa, Cryptosporidium parvum
NYGSQK

SEQ ID NO: 2274319 - protein, 12 aa, Cryptosporidium parvum
NYGSSSESDNYV

SEQ ID NO: 2274320 - protein, 4 aa, Cryptosporidium parvum
NYGT

SEQ ID NO: 2274321 - protein, 6 aa, Cryptosporidium parvum
NYHQDK

SEQ ID NO: 2274322 - protein, 11 aa, Cryptosporidium parvum
NYIESSSNNEL

SEQ ID NO: 2274323 - protein, 8 aa, Cryptosporidium parvum
NYKDNANW

SEQ ID NO: 2274324 - protein, 5 aa, Cryptosporidium parvum
NYKDS

SEQ ID NO: 2274325 - protein, 6 aa, Cryptosporidium parvum
NYKEEI

SEQ ID NO: 2274326 - protein, 13 aa, Cryptosporidium parvum
NYKESHDKYTREQ

SEQ ID NO: 2274327 - protein, 13 aa, Cryptosporidium parvum
NYKGNTNNSNFRR

SEQ ID NO: 2274328 - protein, 10 aa, Cryptosporidium parvum
NYKKSESHYK

SEQ ID NO: 2274329 - protein, 8 aa, Cryptosporidium parvum
NYKNNNLS

SEQ ID NO: 2274330 - protein, 7 aa, Cryptosporidium parvum
NYKQSRE

SEQ ID NO: 2274331 - protein, 5 aa, Cryptosporidium parvum
NYKSQ

SEQ ID NO: 2274332 - protein, 11 aa, Cryptosporidium parvum
NYKTKENTDID

SEQ ID NO: 2274333 - protein, 28 aa, Cryptosporidium parvum
NYKTTEKKVNKTISDQKNVQENERINGK

SEQ ID NO: 2274334 - protein, 22 aa, Cryptosporidium parvum
NYNDEDSNSQENVNITTSTRPD

SEQ ID NO: 2274335 - protein, 7 aa, Cryptosporidium parvum
NYNDKEV

SEQ ID NO: 2274336 - protein, 6 aa, Cryptosporidium parvum
NYNETN

SEQ ID NO: 2274337 - protein, 26 aa, Cryptosporidium parvum
NYNHSNSKCSFSTNNISEEVNASECN

SEQ ID NO: 2274338 - protein, 17 aa, Cryptosporidium parvum
NYNKKQSSVIQQKKNSN

SEQ ID NO: 2274339 - protein, 12 aa, Cryptosporidium parvum
NYNNENNLKKDQ

SEQ ID NO: 2274340 - protein, 10 aa, Cryptosporidium parvum
NYNNHENSSY

SEQ ID NO: 2274341 - protein, 10 aa, Cryptosporidium parvum
NYNPKKDKNF

SEQ ID NO: 2274342 - protein, 18 aa, Cryptosporidium parvum
NYNQSGLGADKEIGSISK

SEQ ID NO: 2274343 - protein, 8 aa, Cryptosporidium parvum
NYNSQNPK

SEQ ID NO: 2274344 - protein, 14 aa, Cryptosporidium parvum
NYNSSYEEGIPENS

SEQ ID NO: 2274345 - protein, 5 aa, Cryptosporidium parvum
NYNTE

SEQ ID NO: 2274346 - protein, 26 aa, Cryptosporidium parvum
NYNTNDNNSSFDDRSGFDDKDYESQA

SEQ ID NO: 2274347 - protein, 17 aa, Cryptosporidium parvum
NYPERHQSKHKPSPNNG

SEQ ID NO: 2274348 - protein, 10 aa, Cryptosporidium parvum
NYPGSSNSNN

SEQ ID NO: 2274349 - protein, 4 aa, Cryptosporidium parvum
NYPN

SEQ ID NO: 2274350 - protein, 12 aa, Cryptosporidium parvum
NYPNNKTEYPTV

SEQ ID NO: 2274351 - protein, 12 aa, Cryptosporidium parvum
NYPQTDSSYENL

SEQ ID NO: 2274352 - protein, 9 aa, Cryptosporidium parvum
NYPSQRQKG

SEQ ID NO: 2274353 - protein, 5 aa, Cryptosporidium parvum
NYPYN

SEQ ID NO: 2274354 - protein, 7 aa, Cryptosporidium parvum
NYQNSDE

SEQ ID NO: 2274355 - protein, 40 aa, Cryptosporidium parvum
NYQQQKRDDKVLNSSVKNPANLKRGKKKEIKGKEIEKEED

SEQ ID NO: 2274356 - protein, 10 aa, Cryptosporidium parvum
NYQSKEPFSS

SEQ ID NO: 2274357 - protein, 14 aa, Cryptosporidium parvum
NYQSSSKKTHQNNN

SEQ ID NO: 2274358 - protein, 4 aa, Cryptosporidium parvum
NYQV

SEQ ID NO: 2274359 - protein, 10 aa, Cryptosporidium parvum
NYRDRRNREH

SEQ ID NO: 2274360 - protein, 5 aa, Cryptosporidium parvum
NYREA

SEQ ID NO: 2274361 - protein, 12 aa, Cryptosporidium parvum
NYRKAQGEKEGL

SEQ ID NO: 2274362 - protein, 10 aa, Cryptosporidium parvum
NYRNDHFPSE

SEQ ID NO: 2274363 - protein, 9 aa, Cryptosporidium parvum
NYSDHSENI

SEQ ID NO: 2274364 - protein, 6 aa, Cryptosporidium parvum
NYSDTR

SEQ ID NO: 2274365 - protein, 23 aa, Cryptosporidium parvum
NYSGGQSPVSEDLAESQRSYYKS

SEQ ID NO: 2274366 - protein, 31 aa, Cryptosporidium parvum
NYSISNTKFNNNKSTSSSTSISSYSVSTNGV

SEQ ID NO: 2274367 - protein, 7 aa, Cryptosporidium parvum
NYSKDEV

SEQ ID NO: 2274368 - protein, 5 aa, Cryptosporidium parvum
NYSKE

SEQ ID NO: 2274369 - protein, 7 aa, Cryptosporidium parvum
NYSMGGQ

SEQ ID NO: 2274370 - protein, 10 aa, Cryptosporidium parvum
NYSNDGNSYY

SEQ ID NO: 2274371 - protein, 15 aa, Cryptosporidium parvum
NYSNTSSSTVSRGHT

SEQ ID NO: 2274372 - protein, 9 aa, Cryptosporidium parvum
NYSPETSLQ

SEQ ID NO: 2274373 - protein, 5 aa, Cryptosporidium parvum
NYSQE

SEQ ID NO: 2274374 - protein, 24 aa, Cryptosporidium parvum
NYSQSTEANGYGYNNENITSNNGS

SEQ ID NO: 2274375 - protein, 11 aa, Cryptosporidium parvum
NYSRESSNEYI

SEQ ID NO: 2274376 - protein, 5 aa, Cryptosporidium parvum
NYSRN

SEQ ID NO: 2274377 - protein, 8 aa, Cryptosporidium parvum
NYSRSNSD

SEQ ID NO: 2274378 - protein, 8 aa, Cryptosporidium parvum
NYSSNKGS

SEQ ID NO: 2274379 - protein, 9 aa, Cryptosporidium parvum
NYSTNSKLG

SEQ ID NO: 2274380 - protein, 18 aa, Cryptosporidium parvum
NYTANPEKVDTQSTGNVQ

SEQ ID NO: 2274381 - protein, 7 aa, Cryptosporidium parvum
NYTESCK

SEQ ID NO: 2274382 - protein, 14 aa, Cryptosporidium parvum
NYTGATTAPESVSI

SEQ ID NO: 2274383 - protein, 5 aa, Cryptosporidium parvum
NYTGS

SEQ ID NO: 2274384 - protein, 22 aa, Cryptosporidium parvum
NYTNEKKSIKLNGANTQDNTCS

SEQ ID NO: 2274385 - protein, 4 aa, Cryptosporidium parvum
NYTT

SEQ ID NO: 2274386 - protein, 6 aa, Cryptosporidium parvum
NYVNPK

SEQ ID NO: 2274387 - protein, 16 aa, Cryptosporidium parvum
NYYGDDHNNNNNSITD

SEQ ID NO: 2274388 - protein, 9 aa, Cryptosporidium parvum
NYYGNPNFE

SEQ ID NO: 2274389 - protein, 15 aa, Cryptosporidium parvum
NYYQESGRAGRDGLE

SEQ ID NO: 2274390 - protein, 14 aa, Cryptosporidium parvum
PAAATNNNGLPNDP

SEQ ID NO: 2274391 - protein, 31 aa, Cryptosporidium parvum
PAAPMSARSTSSIGAESRVSTFSKATTVPKP

SEQ ID NO: 2274392 - protein, 26 aa, Cryptosporidium parvum
PAASKSDSEKFKNRSLGNSTISSAVT

SEQ ID NO: 2274393 - protein, 7 aa, Cryptosporidium parvum
PAEASDD

SEQ ID NO: 2274394 - protein, 7 aa, Cryptosporidium parvum
PAEDAKS

SEQ ID NO: 2274395 - protein, 13 aa, Cryptosporidium parvum
PAEEFNSNNLSSD

SEQ ID NO: 2274396 - protein, 10 aa, Cryptosporidium parvum
PAEEKEVEKL

SEQ ID NO: 2274397 - protein, 10 aa, Cryptosporidium parvum
PAEGHSNLNE

SEQ ID NO: 2274398 - protein, 6 aa, Cryptosporidium parvum
PAERQN

SEQ ID NO: 2274399 - protein, 5 aa, Cryptosporidium parvum
PAESL

SEQ ID NO: 2274400 - protein, 10 aa, Cryptosporidium parvum
PAFGTDEDEL

SEQ ID NO: 2274401 - protein, 4 aa, Cryptosporidium parvum
PAFL

SEQ ID NO: 2274402 - protein, 10 aa, Cryptosporidium parvum
PAGLQDGQFA

SEQ ID NO: 2274403 - protein, 7 aa, Cryptosporidium parvum
PAGQNSS

SEQ ID NO: 2274404 - protein, 7 aa, Cryptosporidium parvum
PAGSRGV

SEQ ID NO: 2274405 - protein, 7 aa, Cryptosporidium parvum
PAGVSKP

SEQ ID NO: 2274406 - protein, 7 aa, Cryptosporidium parvum
PAHSQDR

SEQ ID NO: 2274407 - protein, 11 aa, Cryptosporidium parvum
PAHSSYKEKSE

SEQ ID NO: 2274408 - protein, 40 aa, Cryptosporidium parvum
PAIPQPPVPFQNNSSISGGIQYQSPKNTIPTQPPNNLQPV

SEQ ID NO: 2274409 - protein, 5 aa, Cryptosporidium parvum
PAITK

SEQ ID NO: 2274410 - protein, 6 aa, Cryptosporidium parvum
PAKIGG

SEQ ID NO: 2274411 - protein, 17 aa, Cryptosporidium parvum
PALESANKYSNKNRQNS

SEQ ID NO: 2274412 - protein, 5 aa, Cryptosporidium parvum
PANCS

SEQ ID NO: 2274413 - protein, 7 aa, Cryptosporidium parvum
PANENVP

SEQ ID NO: 2274414 - protein, 5 aa, Cryptosporidium parvum
PANNR

SEQ ID NO: 2274415 - protein, 13 aa, Cryptosporidium parvum
PANPNFKETQSLS

SEQ ID NO: 2274416 - protein, 6 aa, Cryptosporidium parvum
PANRPN

SEQ ID NO: 2274417 - protein, 7 aa, Cryptosporidium parvum
PAPARQG

SEQ ID NO: 2274418 - protein, 4 aa, Cryptosporidium parvum
PAPF

SEQ ID NO: 2274419 - protein, 15 aa, Cryptosporidium parvum
PAPKALNVDEDDPSI

SEQ ID NO: 2274420 - protein, 15 aa, Cryptosporidium parvum
PAPKYHSRSKTQNTS

SEQ ID NO: 2274421 - protein, 11 aa, Cryptosporidium parvum
PAPNADNDNIE

SEQ ID NO: 2274422 - protein, 10 aa, Cryptosporidium parvum
PAPNSTQTEL

SEQ ID NO: 2274423 - protein, 9 aa, Cryptosporidium parvum
PAPPSTKAI

SEQ ID NO: 2274424 - protein, 8 aa, Cryptosporidium parvum
PAPSDPLS

SEQ ID NO: 2274425 - protein, 10 aa, Cryptosporidium parvum
PAPSQGINGT

SEQ ID NO: 2274426 - protein, 13 aa, Cryptosporidium parvum
PAPWRGSDGEARI

SEQ ID NO: 2274427 - protein, 30 aa, Cryptosporidium parvum; identical to SEQ ID NO: 2155516

SEQ ID NO: 2274428 - protein, 58 aa, Cryptosporidium parvum
PAQSPEPNIHPSSEGNTRGRRCANKDMGGVSNDANNAETNANGVNYKGEYKSENSSIV

SEQ ID NO: 2274429 - protein, 18 aa, Cryptosporidium parvum
PARGPTPGSQPKKTGFYA

SEQ ID NO: 2274430 - protein, 10 aa, Cryptosporidium parvum
PASALPADQD

SEQ ID NO: 2274431 - protein, 11 aa, Cryptosporidium parvum
PASEIKKAKPN

SEQ ID NO: 2274432 - protein, 11 aa, Cryptosporidium parvum
PASGNTYSGQF

SEQ ID NO: 2274433 - protein, 6 aa, Cryptosporidium parvum
PASNKQ

SEQ ID NO: 2274434 - protein, 10 aa, Cryptosporidium parvum
PASRRNNDGN

SEQ ID NO: 2274435 - protein, 4 aa, Cryptosporidium parvum
PASS

SEQ ID NO: 2274436 - protein, 9 aa, Cryptosporidium parvum
PATAIKAQK

SEQ ID NO: 2274437 - protein, 8 aa, Cryptosporidium parvum
PATAPVGD

SEQ ID NO: 2274438 - protein, 7 aa, Cryptosporidium parvum
PATEQDI

SEQ ID NO: 2274439 - protein, 29 aa, Cryptosporidium parvum
PATHTKKTMDRPGRSEGNQGRGYGRNRQQ

SEQ ID NO: 2274440 - protein, 7 aa, Cryptosporidium parvum
PATQRGS

SEQ ID NO: 2274441 - protein, 26 aa, Cryptosporidium parvum
PATSTASTSSAAAPGAHPPRPAIPPP

SEQ ID NO: 2274442 - protein, 8 aa, Cryptosporidium parvum
PATTENTA

SEQ ID NO: 2274443 - protein, 25 aa, Cryptosporidium parvum
PATYQESERKLGTSIDSETFNKANE

SEQ ID NO: 2274444 - protein, 6 aa, Cryptosporidium parvum
PATYTT

SEQ ID NO: 2274445 - protein, 5 aa, Cryptosporidium parvum
PAVDS

SEQ ID NO: 2274446 - protein, 5 aa, Cryptosporidium parvum
PAVTI

SEQ ID NO: 2274447 - protein, 4 aa, Cryptosporidium parvum
PAYS

SEQ ID NO: 2274448 - protein, 13 aa, Cryptosporidium parvum
PCDPSELPLNYFK

SEQ ID NO: 2274449 - protein, 9 aa, Cryptosporidium parvum
PCISSSPKG

SEQ ID NO: 2274450 - protein, 14 aa, Cryptosporidium parvum
PCNGGAVGANLTPT

SEQ ID NO: 2274451 - protein, 6 aa, Cryptosporidium parvum
PCNNED

SEQ ID NO: 2274452 - protein, 9 aa, Cryptosporidium parvum
PCNQNSTPI

SEQ ID NO: 2274453 - protein, 4 aa, Cryptosporidium parvum
PCQT

SEQ ID NO: 2274454 - protein, 7 aa, Cryptosporidium parvum
PCRRSKQ

SEQ ID NO: 2274455 - protein, 9 aa, Cryptosporidium parvum
PCSGQDSSH

SEQ ID NO: 2274456 - protein, 5 aa, Cryptosporidium parvum
PCSSD

SEQ ID NO: 2274457 - protein, 13 aa, Cryptosporidium parvum
PCSTYDSPTLSSH

SEQ ID NO: 2274458 - protein, 9 aa, Cryptosporidium parvum
PCTNPTSTT

SEQ ID NO: 2274459 - protein, 8 aa, Cryptosporidium parvum
PDADAERL

SEQ ID NO: 2274460 - protein, 5 aa, Cryptosporidium parvum
PDAPE

SEQ ID NO: 2274461 - protein, 7 aa, Cryptosporidium parvum
PDARRAV

SEQ ID NO: 2274462 - protein, 4 aa, Cryptosporidium parvum
PDCT

SEQ ID NO: 2274463 - protein, 19 aa, Cryptosporidium parvum
PDDDISPEYSTLIQCEKLL

SEQ ID NO: 2274464 - protein, 7 aa, Cryptosporidium parvum
PDDGSED

SEQ ID NO: 2274465 - protein, 8 aa, Cryptosporidium parvum
PDDITNKT

SEQ ID NO: 2274466 - protein, 5 aa, Cryptosporidium parvum
PDDPI

SEQ ID NO: 2274467 - protein, 8 aa, Cryptosporidium parvum
PDEATKAI

SEQ ID NO: 2274468 - protein, 4 aa, Cryptosporidium parvum
PDED

SEQ ID NO: 2274469 - protein, 5 aa, Cryptosporidium parvum
PDEES

SEQ ID NO: 2274470 - protein, 17 aa, Cryptosporidium parvum
PDEESSELPQDEQNHNK

SEQ ID NO: 2274471 - protein, 9 aa, Cryptosporidium parvum
PDEIDDELK

SEQ ID NO: 2274472 - protein, 16 aa, Cryptosporidium parvum
PDEKPILASSSAGGMN

SEQ ID NO: 2274473 - protein, 22 aa, Cryptosporidium parvum
PDEKTSVSVGENDSELNQMTSQ

SEQ ID NO: 2274474 - protein, 4 aa, Cryptosporidium parvum
PDEN

SEQ ID NO: 2274475 - protein, 9 aa, Cryptosporidium parvum
PDENGKDYD

SEQ ID NO: 2274476 - protein, 4 aa, Cryptosporidium parvum
PDEQ

SEQ ID NO: 2274477 - protein, 6 aa, Cryptosporidium parvum
PDERYG

SEQ ID NO: 2274478 - protein, 4 aa, Cryptosporidium parvum
PDES

SEQ ID NO: 2274479 - protein, 24 aa, Cryptosporidium parvum
PDESLSSLNTSSTVEYEESSFDTN

SEQ ID NO: 2274480 - protein, 19 aa, Cryptosporidium parvum
PDESNFQPSNISEISNAKK

SEQ ID NO: 2274481 - protein, 4 aa, Cryptosporidium parvum
PDEV

SEQ ID NO: 2274482 - protein, 5 aa, Cryptosporidium parvum
PDEVT

SEQ ID NO: 2274483 - protein, 6 aa, Cryptosporidium parvum
PDEYQN

SEQ ID NO: 2274484 - protein, 4 aa, Cryptosporidium parvum
PDFD

SEQ ID NO: 2274485 - protein, 4 aa, Cryptosporidium parvum
PDFE

SEQ ID NO: 2274486 - protein, 7 aa, Cryptosporidium parvum
PDGAQTT

SEQ ID NO: 2274487 - protein, 4 aa, Cryptosporidium parvum
PDGE

SEQ ID NO: 2274488 - protein, 9 aa, Cryptosporidium parvum
PDGGKYTGE

SEQ ID NO: 2274489 - protein, 6 aa, Cryptosporidium parvum
PDGGTV

SEQ ID NO: 2274490 - protein, 8 aa, Cryptosporidium parvum
PDGKAQVT

SEQ ID NO: 2274491 - protein, 24 aa, Cryptosporidium parvum
PDGKSKASSTISSKVDAQKLAKGK

SEQ ID NO: 2274492 - protein, 9 aa, Cryptosporidium parvum
PDGNKVGDE

SEQ ID NO: 2274493 - protein, 11 aa, Cryptosporidium parvum
PDGNRSDTELK

SEQ ID NO: 2274494 - protein, 4 aa, Cryptosporidium parvum
PDGS

SEQ ID NO: 2274495 - protein, 6 aa, Cryptosporidium parvum
PDGSGI

SEQ ID NO: 2274496 - protein, 6 aa, Cryptosporidium parvum
PDGTPS

SEQ ID NO: 2274497 - protein, 5 aa, Cryptosporidium parvum
PDHIN

SEQ ID NO: 2274498 - protein, 8 aa, Cryptosporidium parvum
PDIAENEK

SEQ ID NO: 2274499 - protein, 8 aa, Cryptosporidium parvum
PDIDKKRT

SEQ ID NO: 2274500 - protein, 4 aa, Cryptosporidium parvum
PDIP

SEQ ID NO: 2274501 - protein, 8 aa, Cryptosporidium parvum
PDISSSST

SEQ ID NO: 2274502 - protein, 10 aa, Cryptosporidium parvum
PDKDELHPGT

SEQ ID NO: 2274503 - protein, 6 aa, Cryptosporidium parvum
PDKGGK

SEQ ID NO: 2274504 - protein, 7 aa, Cryptosporidium parvum
PDKHTKS

SEQ ID NO: 2274505 - protein, 6 aa, Cryptosporidium parvum
PDKKRL

SEQ ID NO: 2274506 - protein, 28 aa, Cryptosporidium parvum
PDKNISELNQEKDTQIANNGEQGDHNSR

SEQ ID NO: 2274507 - protein, 13 aa, Cryptosporidium parvum
PDKNPDNREEAEE

SEQ ID NO: 2274508 - protein, 15 aa, Cryptosporidium parvum
PDKNQNDEKSKERFQ

SEQ ID NO: 2274509 - protein, 7 aa, Cryptosporidium parvum
PDKNRNH

SEQ ID NO: 2274510 - protein, 11 aa, Cryptosporidium parvum
PDKNRNNIEEA

SEQ ID NO: 2274511 - protein, 9 aa, Cryptosporidium parvum
PDKRPFGNT

SEQ ID NO: 2274512 - protein, 4 aa, Cryptosporidium parvum
PDKS

SEQ ID NO: 2274513 - protein, 10 aa, Cryptosporidium parvum
PDKSDHPRSA

SEQ ID NO: 2274514 - protein, 4 aa, Cryptosporidium parvum
PDLA

SEQ ID NO: 2274515 - protein, 10 aa, Cryptosporidium parvum
PDLARKNENP

SEQ ID NO: 2274516 - protein, 8 aa, Cryptosporidium parvum
PDLGTKDG

SEQ ID NO: 2274517 - protein, 4 aa, Cryptosporidium parvum
PDLK

SEQ ID NO: 2274518 - protein, 8 aa, Cryptosporidium parvum
PDLSQEEI

SEQ ID NO: 2274519 - protein, 12 aa, Cryptosporidium parvum
PDNHNTNYQSEN

SEQ ID NO: 2274520 - protein, 5 aa, Cryptosporidium parvum
PDNMV

SEQ ID NO: 2274521 - protein, 8 aa, Cryptosporidium parvum
PDNNIPKE

SEQ ID NO: 2274522 - protein, 5 aa, Cryptosporidium parvum
PDNQA

SEQ ID NO: 2274523 - protein, 7 aa, Cryptosporidium parvum
PDNQGKC

SEQ ID NO: 2274524 - protein, 9 aa, Cryptosporidium parvum
PDNQKEETK

SEQ ID NO: 2274525 - protein, 10 aa, Cryptosporidium parvum
PDNSNSDSNS

SEQ ID NO: 2274526 - protein, 7 aa, Cryptosporidium parvum
PDNSPTK

SEQ ID NO: 2274527 - protein, 4 aa, Cryptosporidium parvum
PDNT

SEQ ID NO: 2274528 - protein, 7 aa, Cryptosporidium parvum
PDNYGSQ

SEQ ID NO: 2274529 - protein, 6 aa, Cryptosporidium parvum
PDPFGA

SEQ ID NO: 2274530 - protein, 4 aa, Cryptosporidium parvum
PDPI

SEQ ID NO: 2274531 - protein, 22 aa, Cryptosporidium parvum
PDPLEGPNCDGNTCYKPNPATM

SEQ ID NO: 2274532 - protein, 18 aa, Cryptosporidium parvum
PDPLSNYRSTYETSSPYY

SEQ ID NO: 2274533 - protein, 5 aa, Cryptosporidium parvum
PDPNI

SEQ ID NO: 2274534 - protein, 9 aa, Cryptosporidium parvum
PDPNKSNKL

SEQ ID NO: 2274535 - protein, 6 aa, Cryptosporidium parvum
PDPNLT

SEQ ID NO: 2274536 - protein, 8 aa, Cryptosporidium parvum
PDPPRFPT

SEQ ID NO: 2274537 - protein, 11 aa, Cryptosporidium parvum
PDPRGNNYPPL

SEQ ID NO: 2274538 - protein, 9 aa, Cryptosporidium parvum
PDPRVEAQK

SEQ ID NO: 2274539 - protein, 4 aa, Cryptosporidium parvum
PDPS

SEQ ID NO: 2274540 - protein, 10 aa, Cryptosporidium parvum
PDPSAEPSYD

SEQ ID NO: 2274541 - protein, 7 aa, Cryptosporidium parvum
PDPSIGS

SEQ ID NO: 2274542 - protein, 19 aa, Cryptosporidium parvum
PDQDHDLEQERYRNQDQNL

SEQ ID NO: 2274543 - protein, 7 aa, Cryptosporidium parvum
PDQLNKQ

SEQ ID NO: 2274544 - protein, 11 aa, Cryptosporidium parvum
PDQNKISSDSI

SEQ ID NO: 2274545 - protein, 6 aa, Cryptosporidium parvum
PDRKMR

SEQ ID NO: 2274546 - protein, 12 aa, Cryptosporidium parvum
PDRNITSISTTN

SEQ ID NO: 2274547 - protein, 9 aa, Cryptosporidium parvum
PDRNQAKDS

SEQ ID NO: 2274548 - protein, 4 aa, Cryptosporidium parvum
PDRP

SEQ ID NO: 2274549 - protein, 4 aa, Cryptosporidium parvum
PDRR

SEQ ID NO: 2274550 - protein, 11 aa, Cryptosporidium parvum
PDSAKDSNPEY

SEQ ID NO: 2274551 - protein, 11 aa, Cryptosporidium parvum
PDSDNVSKDEK

SEQ ID NO: 2274552 - protein, 15 aa, Cryptosporidium parvum
PDSENKNKKSSGIGG

SEQ ID NO: 2274553 - protein, 4 aa, Cryptosporidium parvum
PDSH

SEQ ID NO: 2274554 - protein, 76 aa, Cryptosporidium parvum
PDSHYRRSNNRKRALESLDEDPELPLGSNSDNRNVNGSNKDETQRSENNKAEKSTSKRKTSVELPRKNIKSSSSRR

SEQ ID NO: 2274555 - protein, 4 aa, Cryptosporidium parvum
PDSK

SEQ ID NO: 2274556 - protein, 7 aa, Cryptosporidium parvum
PDSKARK

SEQ ID NO: 2274557 - protein, 17 aa, Cryptosporidium parvum
PDSKGKHHSYSSKRSVN

SEQ ID NO: 2274558 - protein, 4 aa, Cryptosporidium parvum
PDSN

SEQ ID NO: 2274559 - protein, 12 aa, Cryptosporidium parvum
PDSNNNNEDFTR

SEQ ID NO: 2274560 - protein, 14 aa, Cryptosporidium parvum
PDSNVCSDNDNKKI

SEQ ID NO: 2274561 - protein, 7 aa, Cryptosporidium parvum
PDSPSQV

SEQ ID NO: 2274562 - protein, 11 aa, Cryptosporidium parvum
PDSSEELEEFE

SEQ ID NO: 2274563 - protein, 4 aa, Cryptosporidium parvum
PDST

SEQ ID NO: 2274564 - protein, 15 aa, Cryptosporidium parvum
PDSWPIPADTRPQRC

SEQ ID NO: 2274565 - protein, 6 aa, Cryptosporidium parvum
PDTEKL

SEQ ID NO: 2274566 - protein, 5 aa, Cryptosporidium parvum
PDTGK

SEQ ID NO: 2274567 - protein, 11 aa, Cryptosporidium parvum
PDTIPPGETPH

SEQ ID NO: 2274568 - protein, 4 aa, Cryptosporidium parvum
PDTK

SEQ ID NO: 2274569 - protein, 4 aa, Cryptosporidium parvum
PDTN

SEQ ID NO: 2274570 - protein, 9 aa, Cryptosporidium parvum
PDTNFQTPH

SEQ ID NO: 2274571 - protein, 19 aa, Cryptosporidium parvum
PDTPSTQAPPVLSSSSVGR

SEQ ID NO: 2274572 - protein, 4 aa, Cryptosporidium parvum
PDTQ

SEQ ID NO: 2274573 - protein, 8 aa, Cryptosporidium parvum
PDTSKKVQ

SEQ ID NO: 2274574 - protein, 8 aa, Cryptosporidium parvum
PDVPAGNT

SEQ ID NO: 2274575 - protein, 7 aa, Cryptosporidium parvum
PDVQPCG

SEQ ID NO: 2274576 - protein, 14 aa, Cryptosporidium parvum
PDVRGNGQSLAGDR

SEQ ID NO: 2274577 - protein, 6 aa, Cryptosporidium parvum
PDWTED

SEQ ID NO: 2274578 - protein, 6 aa, Cryptosporidium parvum
PDYGSQ

SEQ ID NO: 2274579 - protein, 4 aa, Cryptosporidium parvum
PDYK

SEQ ID NO: 2274580 - protein, 6 aa, Cryptosporidium parvum
PDYKKD

SEQ ID NO: 2274581 - protein, 8 aa, Cryptosporidium parvum
PDYRTPNY

SEQ ID NO: 2274582 - protein, 4 aa, Cryptosporidium parvum
PEAL

SEQ ID NO: 2274583 - protein, 4 aa, Cryptosporidium parvum
PEAP

SEQ ID NO: 2274584 - protein, 12 aa, Cryptosporidium parvum
PEAVASDSKEVI

SEQ ID NO: 2274585 - protein, 7 aa, Cryptosporidium parvum
PECDSKK

SEQ ID NO: 2274586 - protein, 10 aa, Cryptosporidium parvum
PEDDDNYQDR

SEQ ID NO: 2274587 - protein, 9 aa, Cryptosporidium parvum
PEDGPKYQE

SEQ ID NO: 2274588 - protein, 14 aa, Cryptosporidium parvum
PEDIQSNSESVSEA

SEQ ID NO: 2274589 - protein, 6 aa, Cryptosporidium parvum
PEDKGY

SEQ ID NO: 2274590 - protein, 12 aa, Cryptosporidium parvum
PEDLDKELDLIW

SEQ ID NO: 2274591 - protein, 7 aa, Cryptosporidium parvum
PEDSGLF

SEQ ID NO: 2274592 - protein, 7 aa, Cryptosporidium parvum
PEDSQKI

SEQ ID NO: 2274593 - protein, 4 aa, Cryptosporidium parvum
PEDT

SEQ ID NO: 2274594 - protein, 7 aa, Cryptosporidium parvum
PEDTTES

SEQ ID NO: 2274595 - protein, 5 aa, Cryptosporidium parvum
PEDVY

SEQ ID NO: 2274596 - protein, 10 aa, Cryptosporidium parvum
PEEANNDDYD

SEQ ID NO: 2274597 - protein, 7 aa, Cryptosporidium parvum
PEEAQRA

SEQ ID NO: 2274598 - protein, 10 aa, Cryptosporidium parvum
PEEASSNKCK

SEQ ID NO: 2274599 - protein, 5 aa, Cryptosporidium parvum
PEEDN

SEQ ID NO: 2274600 - protein, 4 aa, Cryptosporidium parvum
PEEI

SEQ ID NO: 2274601 - protein, 10 aa, Cryptosporidium parvum
PEEIGKASSI

SEQ ID NO: 2274602 - protein, 11 aa, Cryptosporidium parvum
PEEKKTWSNNE

SEQ ID NO: 2274603 - protein, 9 aa, Cryptosporidium parvum
PEELSNAPF

SEQ ID NO: 2274604 - protein, 4 aa, Cryptosporidium parvum
PEEN

SEQ ID NO: 2274605 - protein, 7 aa, Cryptosporidium parvum
PEESYVS

SEQ ID NO: 2274606 - protein, 8 aa, Cryptosporidium parvum
PEETNTSR

SEQ ID NO: 2274607 - protein, 9 aa, Cryptosporidium parvum
PEEWSNSTK

SEQ ID NO: 2274608 - protein, 4 aa, Cryptosporidium parvum
PEFE

SEQ ID NO: 2274609 - protein, 4 aa, Cryptosporidium parvum
PEFN

SEQ ID NO: 2274610 - protein, 38 aa, Cryptosporidium parvum
PEGESQNSVQSSNGFENVDPKSEPLSEIEAKNEEGGIK

SEQ ID NO: 2274611 - protein, 8 aa, Cryptosporidium parvum
PEGGWTKE

SEQ ID NO: 2274612 - protein, 4 aa, Cryptosporidium parvum
PEGL

SEQ ID NO: 2274613 - protein, 7 aa, Cryptosporidium parvum
PEGSHHN

SEQ ID NO: 2274614 - protein, 11 aa, Cryptosporidium parvum
PEGSIPEKKEG

SEQ ID NO: 2274615 - protein, 14 aa, Cryptosporidium parvum
PEGSLNKAAELASN

SEQ ID NO: 2274616 - protein, 11 aa, Cryptosporidium parvum
PEGSSSNTSIK

SEQ ID NO: 2274617 - protein, 7 aa, Cryptosporidium parvum
PEGTPSL

SEQ ID NO: 2274618 - protein, 6 aa, Cryptosporidium parvum
PEGTSI

SEQ ID NO: 2274619 - protein, 7 aa, Cryptosporidium parvum
PEGVYSG

SEQ ID NO: 2274620 - protein, 5 aa, Cryptosporidium parvum
PEIGE

SEQ ID NO: 2274621 - protein, 9 aa, Cryptosporidium parvum
PEIHNTKPK

SEQ ID NO: 2274622 - protein, 8 aa, Cryptosporidium parvum
PEINSANT

SEQ ID NO: 2274623 - protein, 11 aa, Cryptosporidium parvum
PEINSKPREFS

SEQ ID NO: 2274624 - protein, 4 aa, Cryptosporidium parvum
PEIP

SEQ ID NO: 2274625 - protein, 5 aa, Cryptosporidium parvum
PEIPS

SEQ ID NO: 2274626 - protein, 11 aa, Cryptosporidium parvum
PEISKISPKLP

SEQ ID NO: 2274627 - protein, 4 aa, Cryptosporidium parvum
PEIT

SEQ ID NO: 2274628 - protein, 5 aa, Cryptosporidium parvum
PEITE

SEQ ID NO: 2274629 - protein, 5 aa, Cryptosporidium parvum
PEITK

SEQ ID NO: 2274630 - protein, 10 aa, Cryptosporidium parvum
PEKAAKKKQY

SEQ ID NO: 2274631 - protein, 13 aa, Cryptosporidium parvum
PEKDRRRTGNSVG

SEQ ID NO: 2274632 - protein, 5 aa, Cryptosporidium parvum
PEKDY

SEQ ID NO: 2274633 - protein, 8 aa, Cryptosporidium parvum
PEKENSSI

SEQ ID NO: 2274634 - protein, 6 aa, Cryptosporidium parvum
PEKEQE

SEQ ID NO: 2274635 - protein, 8 aa, Cryptosporidium parvum
PEKETDDI

SEQ ID NO: 2274636 - protein, 4 aa, Cryptosporidium parvum
PEKI

SEQ ID NO: 2274637 - protein, 7 aa, Cryptosporidium parvum
PEKKLTS

SEQ ID NO: 2274638 - protein, 8 aa, Cryptosporidium parvum
PEKNENFR

SEQ ID NO: 2274639 - protein, 7 aa, Cryptosporidium parvum
PEKNGNY

SEQ ID NO: 2274640 - protein, 8 aa, Cryptosporidium parvum
PEKSLQDE

SEQ ID NO: 2274641 - protein, 4 aa, Cryptosporidium parvum
PEKT

SEQ ID NO: 2274642 - protein, 8 aa, Cryptosporidium parvum
PEKTATKC

SEQ ID NO: 2274643 - protein, 5 aa, Cryptosporidium parvum
PELDG

SEQ ID NO: 2274644 - protein, 4 aa, Cryptosporidium parvum
PELP

SEQ ID NO: 2274645 - protein, 8 aa, Cryptosporidium parvum
PELPDEGV

SEQ ID NO: 2274646 - protein, 4 aa, Cryptosporidium parvum
PELR

SEQ ID NO: 2274647 - protein, 10 aa, Cryptosporidium parvum
PELTNDNGSF

SEQ ID NO: 2274648 - protein, 15 aa, Cryptosporidium parvum
PEMEPKNEQNDDKNC

SEQ ID NO: 2274649 - protein, 12 aa, Cryptosporidium parvum
PEMNSEREIEQR

SEQ ID NO: 2274650 - protein, 5 aa, Cryptosporidium parvum
PEMQS

SEQ ID NO: 2274651 - protein, 5 aa, Cryptosporidium parvum
PENAD

SEQ ID NO: 2274652 - protein, 11 aa, Cryptosporidium parvum
PENAPATSPRY

SEQ ID NO: 2274653 - protein, 15 aa, Cryptosporidium parvum
PENESRNNTSLNITK

SEQ ID NO: 2274654 - protein, 8 aa, Cryptosporidium parvum
PENKFETE

SEQ ID NO: 2274655 - protein, 10 aa, Cryptosporidium parvum
PENKNLEEEY

SEQ ID NO: 2274656 - protein, 6 aa, Cryptosporidium parvum
PENLKN

SEQ ID NO: 2274657 - protein, 4 aa, Cryptosporidium parvum
PENN

SEQ ID NO: 2274658 - protein, 5 aa, Cryptosporidium parvum
PENPN

SEQ ID NO: 2274659 - protein, 7 aa, Cryptosporidium parvum
PENPVKG

SEQ ID NO: 2274660 - protein, 5 aa, Cryptosporidium parvum
PENRL

SEQ ID NO: 2274661 - protein, 5 aa, Cryptosporidium parvum
PENSE

SEQ ID NO: 2274662 - protein, 6 aa, Cryptosporidium parvum
PENSKT

SEQ ID NO: 2274663 - protein, 6 aa, Cryptosporidium parvum
PENTDS

SEQ ID NO: 2274664 - protein, 6 aa, Cryptosporidium parvum
PENTGL

SEQ ID NO: 2274665 - protein, 4 aa, Cryptosporidium parvum
PENW

SEQ ID NO: 2274666 - protein, 4 aa, Cryptosporidium parvum
PEPD

SEQ ID NO: 2274667 - protein, 9 aa, Cryptosporidium parvum
PEPENQDKD

SEQ ID NO: 2274668 - protein, 6 aa, Cryptosporidium parvum
PEPEYN

SEQ ID NO: 2274669 - protein, 16 aa, Cryptosporidium parvum
PEPGKRVTKSFNPRHY

SEQ ID NO: 2274670 - protein, 7 aa, Cryptosporidium parvum
PEPKYDQ

SEQ ID NO: 2274671 - protein, 7 aa, Cryptosporidium parvum
PEPNSRW

SEQ ID NO: 2274672 - protein, 10 aa, Cryptosporidium parvum
PEPSSISSIS

SEQ ID NO: 2274673 - protein, 45 aa, Cryptosporidium parvum
PEPVVDSNKKNSKKKSISGGAKANPSGTVIGEKRKSRSSRPSYSR

SEQ ID NO: 2274674 - protein, 8 aa, Cryptosporidium parvum
PEQDKTIV

SEQ ID NO: 2274675 - protein, 33 aa, Cryptosporidium parvum
PEQEGGPVDISQPNNTVGLSQKGSQSNLSNNAE

SEQ ID NO: 2274676 - protein, 10 aa, Cryptosporidium parvum
PEQEGTKEPS

SEQ ID NO: 2274677 - protein, 5 aa, Cryptosporidium parvum
PEQEK

SEQ ID NO: 2274678 - protein, 16 aa, Cryptosporidium parvum
PEQEKGPWERKAQEFK

SEQ ID NO: 2274679 - protein, 6 aa, Cryptosporidium parvum
PEQKGV

SEQ ID NO: 2274680 - protein, 5 aa, Cryptosporidium parvum
PEQKI

SEQ ID NO: 2274681 - protein, 48 aa, Cryptosporidium parvum
PEQNNNQNGGASGNNGSGNGGVSGVNRRSSGLNANSDVNGMNHQNSQG

SEQ ID NO: 2274682 - protein, 22 aa, Cryptosporidium parvum
PEQNQPSQSLEAGFTKKTDVNN

SEQ ID NO: 2274683 - protein, 14 aa, Cryptosporidium parvum
PEQQTQQIAGAQAQ

SEQ ID NO: 2274684 - protein, 17 aa, Cryptosporidium parvum
PEQTQIHDQESKSHNSS

SEQ ID NO: 2274685 - protein, 8 aa, Cryptosporidium parvum
PERGNVGF

SEQ ID NO: 2274686 - protein, 12 aa, Cryptosporidium parvum
PESDESVYGDSE

SEQ ID NO: 2274687 - protein, 10 aa, Cryptosporidium parvum
PESDGSESFN

SEQ ID NO: 2274688 - protein, 10 aa, Cryptosporidium parvum
PESDSYKINT

SEQ ID NO: 2274689 - protein, 5 aa, Cryptosporidium parvum
PESEI

SEQ ID NO: 2274690 - protein, 4 aa, Cryptosporidium parvum
PESF

SEQ ID NO: 2274691 - protein, 10 aa, Cryptosporidium parvum
PESGSNFNSY

SEQ ID NO: 2274692 - protein, 12 aa, Cryptosporidium parvum
PESKDEKHKEAY

SEQ ID NO: 2274693 - protein, 41 aa, Cryptosporidium parvum
PESNNKNNNVGSNNGFSPMRTGTSFSSSNSFGNNPSDDKYA

SEQ ID NO: 2274694 - protein, 10 aa, Cryptosporidium parvum
PESNRNQSSE

SEQ ID NO: 2274695 - protein, 7 aa, Cryptosporidium parvum
PESQNTL

SEQ ID NO: 2274696 - protein, 15 aa, Cryptosporidium parvum
PESSSNNNNRNKNQD

SEQ ID NO: 2274697 - protein, 4 aa, Cryptosporidium parvum
PESY

SEQ ID NO: 2274698 - protein, 7 aa, Cryptosporidium parvum
PETENLP

SEQ ID NO: 2274699 - protein, 16 aa, Cryptosporidium parvum
PETGEVTRENIPDTDE

SEQ ID NO: 2274700 - protein, 5 aa, Cryptosporidium parvum
PETGQ

SEQ ID NO: 2274701 - protein, 4 aa, Cryptosporidium parvum
PETI

SEQ ID NO: 2274702 - protein, 8 aa, Cryptosporidium parvum
PETKDLDH

SEQ ID NO: 2274703 - protein, 16 aa, Cryptosporidium parvum
PETKKFTKTQEPGSKR

SEQ ID NO: 2274704 - protein, 5 aa, Cryptosporidium parvum
PETKN

SEQ ID NO: 2274705 - protein, 7 aa, Cryptosporidium parvum
PETTGPN

SEQ ID NO: 2274706 - protein, 8 aa, Cryptosporidium parvum
PEVDSNKI

SEQ ID NO: 2274707 - protein, 10 aa, Cryptosporidium parvum
PEVRSPMDSL

SEQ ID NO: 2274708 - protein, 7 aa, Cryptosporidium parvum
PEYEQSK

SEQ ID NO: 2274709 - protein, 6 aa, Cryptosporidium parvum
PEYPKG

SEQ ID NO: 2274710 - protein, 7 aa, Cryptosporidium parvum
PEYSTLS

SEQ ID NO: 2274711 - protein, 8 aa, Cryptosporidium parvum
PFDPNTYP

SEQ ID NO: 2274712 - protein, 6 aa, Cryptosporidium parvum
PFEDSP

SEQ ID NO: 2274713 - protein, 6 aa, Cryptosporidium parvum
PFESDD

SEQ ID NO: 2274714 - protein, 7 aa, Cryptosporidium parvum
PFETPYE

SEQ ID NO: 2274715 - protein, 4 aa, Cryptosporidium parvum
PFHG

SEQ ID NO: 2274716 - protein, 6 aa, Cryptosporidium parvum
PFHGSN

SEQ ID NO: 2274717 - protein, 16 aa, Cryptosporidium parvum
PFHKTDDRIHQNSNNY

SEQ ID NO: 2274718 - protein, 7 aa, Cryptosporidium parvum
PFKRPSS

SEQ ID NO: 2274719 - protein, 4 aa, Cryptosporidium parvum
PFNA

SEQ ID NO: 2274720 - protein, 23 aa, Cryptosporidium parvum
PFNTRTNSGDNNSSSKNLSEEID

SEQ ID NO: 2274721 - protein, 13 aa, Cryptosporidium parvum
PFPEEKESKTNRE

SEQ ID NO: 2274722 - protein, 12 aa, Cryptosporidium parvum
PFPFETKRSDAI

SEQ ID NO: 2274723 - protein, 7 aa, Cryptosporidium parvum
PFPGPPA

SEQ ID NO: 2274724 - protein, 13 aa, Cryptosporidium parvum
PFPPSNQSNSQFY

SEQ ID NO: 2274725 - protein, 5 aa, Cryptosporidium parvum
PFPSE

SEQ ID NO: 2274726 - protein, 4 aa, Cryptosporidium parvum
PFQT

SEQ ID NO: 2274727 - protein, 11 aa, Cryptosporidium parvum
PFQTDSQPHFE

SEQ ID NO: 2274728 - protein, 4 aa, Cryptosporidium parvum
PFRS

SEQ ID NO: 2274729 - protein, 8 aa, Cryptosporidium parvum
PFSAPTDS

SEQ ID NO: 2274730 - protein, 9 aa, Cryptosporidium parvum
PFSKTERKK

SEQ ID NO: 2274731 - protein, 12 aa, Cryptosporidium parvum
PFSNDGNDRISV

SEQ ID NO: 2274732 - protein, 19 aa, Cryptosporidium parvum
PFSPSSNSIPQSQSQFPQI

SEQ ID NO: 2274733 - protein, 5 aa, Cryptosporidium parvum
PFSRS

SEQ ID NO: 2274734 - protein, 13 aa, Cryptosporidium parvum
PFSSNKSDNNLCA

SEQ ID NO: 2274735 - protein, 5 aa, Cryptosporidium parvum
PFSSS

SEQ ID NO: 2274736 - protein, 25 aa, Cryptosporidium parvum
PFSTRNECNSSTRSSSISKSESNNT

SEQ ID NO: 2274737 - protein, 8 aa, Cryptosporidium parvum
PFTDEDGK

SEQ ID NO: 2274738 - protein, 11 aa, Cryptosporidium parvum
PFTGSEDNTSR

SEQ ID NO: 2274739 - protein, 5 aa, Cryptosporidium parvum
PFYTP

SEQ ID NO: 2274740 - protein, 15 aa, Cryptosporidium parvum
PGAGKNELIKPNGRS

SEQ ID NO: 2274741 - protein, 9 aa, Cryptosporidium parvum
PGAGYANFD

SEQ ID NO: 2274742 - protein, 10 aa, Cryptosporidium parvum
PGAHKGEGLG

SEQ ID NO: 2274743 - protein, 8 aa, Cryptosporidium parvum
PGCDSPSS

SEQ ID NO: 2274744 - protein, 6 aa, Cryptosporidium parvum
PGCSNS

SEQ ID NO: 2274745 - protein, 5 aa, Cryptosporidium parvum
PGCTR

SEQ ID NO: 2274746 - protein, 5 aa, Cryptosporidium parvum
PGDAF

SEQ ID NO: 2274747 - protein, 5 aa, Cryptosporidium parvum
PGDEH

SEQ ID NO: 2274748 - protein, 4 aa, Cryptosporidium parvum
PGDG

SEQ ID NO: 2274749 - protein, 13 aa, Cryptosporidium parvum
PGDLETKVTENGL

SEQ ID NO: 2274750 - protein, 7 aa, Cryptosporidium parvum
PGDPKRR

SEQ ID NO: 2274751 - protein, 8 aa, Cryptosporidium parvum
PGDSCPPA

SEQ ID NO: 2274752 - protein, 8 aa, Cryptosporidium parvum
PGEDDPVP

SEQ ID NO: 2274753 - protein, 5 aa, Cryptosporidium parvum
PGEDV

SEQ ID NO: 2274754 - protein, 9 aa, Cryptosporidium parvum
PGEFDPSEP

SEQ ID NO: 2274755 - protein, 21 aa, Cryptosporidium parvum
PGEIDPNPETKPSKPDSIDMD

SEQ ID NO: 2274756 - protein, 8 aa, Cryptosporidium parvum
PGEIPSSV

SEQ ID NO: 2274757 - protein, 4 aa, Cryptosporidium parvum
PGEL

SEQ ID NO: 2274758 - protein, 5 aa, Cryptosporidium parvum
PGEQK

SEQ ID NO: 2274759 - protein, 8 aa, Cryptosporidium parvum
PGETDECQ

SEQ ID NO: 2274760 - protein, 4 aa, Cryptosporidium parvum
PGFD

SEQ ID NO: 2274761 - protein, 6 aa, Cryptosporidium parvum
PGFRDK

SEQ ID NO: 2274762 - protein, 6 aa, Cryptosporidium parvum
PGGEIE

SEQ ID NO: 2274763 - protein, 5 aa, Cryptosporidium parvum
PGGEL

SEQ ID NO: 2274764 - protein, 4 aa, Cryptosporidium parvum
PGGG

SEQ ID NO: 2274765 - protein, 9 aa, Cryptosporidium parvum
PGGNDGPSG

SEQ ID NO: 2274766 - protein, 20 aa, Cryptosporidium parvum
PGGPKFEPLNSTSFDEDEDW

SEQ ID NO: 2274767 - protein, 6 aa, Cryptosporidium parvum
PGGRPS

SEQ ID NO: 2274768 - protein, 5 aa, Cryptosporidium parvum
PGGTF

SEQ ID NO: 2274769 - protein, 15 aa, Cryptosporidium parvum
PGHDRYNEQESPDER

SEQ ID NO: 2274770 - protein, 4 aa, Cryptosporidium parvum
PGHK

SEQ ID NO: 2274771 - protein, 7 aa, Cryptosporidium parvum
PGHPMKP

SEQ ID NO: 2274772 - protein, 13 aa, Cryptosporidium parvum
PGHSSKKSYRNVD

SEQ ID NO: 2274773 - protein, 62 aa, Cryptosporidium parvum
PGIGAGAAGLGGRTYKSDPYSNNVGGIGSAGGVSMGGNSSIGTRGRRGYGSGSCTTTTRSGR

SEQ ID NO: 2274774 - protein, 4 aa, Cryptosporidium parvum
PGIS

SEQ ID NO: 2274775 - protein, 13 aa, Cryptosporidium parvum
PGKARFNETYEPS

SEQ ID NO: 2274776 - protein, 10 aa, Cryptosporidium parvum
PGKQEVPHNP

SEQ ID NO: 2274777 - protein, 7 aa, Cryptosporidium parvum
PGKSGTL

SEQ ID NO: 2274778 - protein, 6 aa, Cryptosporidium parvum
PGKSYP

SEQ ID NO: 2274779 - protein, 19 aa, Cryptosporidium parvum
PGLAEDKTGQVKLTGNPNF

SEQ ID NO: 2274780 - protein, 20 aa, Cryptosporidium parvum
PGLAEKKSSGYILGPKMPDN

SEQ ID NO: 2274781 - protein, 5 aa, Cryptosporidium parvum
PGLAK

SEQ ID NO: 2274782 - protein, 9 aa, Cryptosporidium parvum
PGLDPETNE

SEQ ID NO: 2274783 - protein, 9 aa, Cryptosporidium parvum
PGLNKAGKF

SEQ ID NO: 2274784 - protein, 15 aa, Cryptosporidium parvum
PGLSKDTSEILKSID

SEQ ID NO: 2274785 - protein, 37 aa, Cryptosporidium parvum
PGMPGGTSGPAMPGGTTKPGVPSGPGGQEASKPIAVP

SEQ ID NO: 2274786 - protein, 7 aa, Cryptosporidium parvum
PGNKDYC

SEQ ID NO: 2274787 - protein, 4 aa, Cryptosporidium parvum
PGNL

SEQ ID NO: 2274788 - protein, 8 aa, Cryptosporidium parvum
PGNLRGEA

SEQ ID NO: 2274789 - protein, 7 aa, Cryptosporidium parvum
PGNNTDY

SEQ ID NO: 2274790 - protein, 5 aa, Cryptosporidium parvum
PGNPL

SEQ ID NO: 2274791 - protein, 18 aa, Cryptosporidium parvum
PGNPVSAAAAAAAAAASA

SEQ ID NO: 2274792 - protein, 7 aa, Cryptosporidium parvum
PGNQNKE

SEQ ID NO: 2274793 - protein, 4 aa, Cryptosporidium parvum
PGNS

SEQ ID NO: 2274794 - protein, 9 aa, Cryptosporidium parvum
PGNSSTTEL

SEQ ID NO: 2274795 - protein, 4 aa, Cryptosporidium parvum
PGNT

SEQ ID NO: 2274796 - protein, 5 aa, Cryptosporidium parvum
PGNTA

SEQ ID NO: 2274797 - protein, 33 aa, Cryptosporidium parvum
PGNYSSDVKSKTSVHRDREKAEEGAGDENILEN

SEQ ID NO: 2274798 - protein, 4 aa, Cryptosporidium parvum
PGPG

SEQ ID NO: 2274799 - protein, 4 aa, Cryptosporidium parvum
PGPI

SEQ ID NO: 2274800 - protein, 6 aa, Cryptosporidium parvum
PGPPHH

SEQ ID NO: 2274801 - protein, 12 aa, Cryptosporidium parvum
PGQETKAMPSSS

SEQ ID NO: 2274802 - protein, 6 aa, Cryptosporidium parvum
PGQKYA

SEQ ID NO: 2274803 - protein, 16 aa, Cryptosporidium parvum
PGQPGDLETKHNIENG

SEQ ID NO: 2274804 - protein, 17 aa, Cryptosporidium parvum
PGQPVQPTWEPEENLNG

SEQ ID NO: 2274805 - protein, 6 aa, Cryptosporidium parvum
PGRAGV

SEQ ID NO: 2274806 - protein, 7 aa, Cryptosporidium parvum
PGRDQEE

SEQ ID NO: 2274807 - protein, 11 aa, Cryptosporidium parvum
PGRDSISKNVN

SEQ ID NO: 2274808 - protein, 8 aa, Cryptosporidium parvum
PGRGDTRH

SEQ ID NO: 2274809 - protein, 6 aa, Cryptosporidium parvum
PGRKLD

SEQ ID NO: 2274810 - protein, 9 aa, Cryptosporidium parvum
PGRTNQQCR

SEQ ID NO: 2274811 - protein, 7 aa, Cryptosporidium parvum
PGRTTHA

SEQ ID NO: 2274812 - protein, 7 aa, Cryptosporidium parvum
PGRVQDS

SEQ ID NO: 2274813 - protein, 10 aa, Cryptosporidium parvum
PGSAKISRES

SEQ ID NO: 2274814 - protein, 10 aa, Cryptosporidium parvum
PGSFNPPPKV

SEQ ID NO: 2274815 - protein, 5 aa, Cryptosporidium parvum
PGSGK

SEQ ID NO: 2274816 - protein, 7 aa, Cryptosporidium parvum
PGSGKTT

SEQ ID NO: 2274817 - protein, 7 aa, Cryptosporidium parvum
PGSHNSK

SEQ ID NO: 2274818 - protein, 16 aa, Cryptosporidium parvum
PGSIPGGPNFPCYGNK

SEQ ID NO: 2274819 - protein, 5 aa, Cryptosporidium parvum
PGSNT

SEQ ID NO: 2274820 - protein, 13 aa, Cryptosporidium parvum
PGSTVGQCSKEES

SEQ ID NO: 2274821 - protein, 8 aa, Cryptosporidium parvum
PGTATGAF

SEQ ID NO: 2274822 - protein, 5 aa, Cryptosporidium parvum
PGTCQ

SEQ ID NO: 2274823 - protein, 8 aa, Cryptosporidium parvum
PGTGKTAT

SEQ ID NO: 2274824 - protein, 6 aa, Cryptosporidium parvum
PGTGKY

SEQ ID NO: 2274825 - protein, 7 aa, Cryptosporidium parvum
PGTGQIQ

SEQ ID NO: 2274826 - protein, 5 aa, Cryptosporidium parvum
PGTMD

SEQ ID NO: 2274827 - protein, 8 aa, Cryptosporidium parvum
PGTPSSRE

SEQ ID NO: 2274828 - protein, 28 aa, Cryptosporidium parvum
PGTSRTRNFRSSHRNDISRSCNNYSSAD

SEQ ID NO: 2274829 - protein, 5 aa, Cryptosporidium parvum
PGVAK

SEQ ID NO: 2274830 - protein, 7 aa, Cryptosporidium parvum
PGVHPTT

SEQ ID NO: 2274831 - protein, 10 aa, Cryptosporidium parvum
PGVNDADTIS

SEQ ID NO: 2274832 - protein, 30 aa, Cryptosporidium parvum
PGVPQASHNGGTSVNSRDLQQANNTRSNSM

SEQ ID NO: 2274833 - protein, 4 aa, Cryptosporidium parvum
PGVR

SEQ ID NO: 2274834 - protein, 16 aa, Cryptosporidium parvum
PGVSPPSVDVDVYLNS

SEQ ID NO: 2274835 - protein, 9 aa, Cryptosporidium parvum
PGVTDDDQL

SEQ ID NO: 2274836 - protein, 8 aa, Cryptosporidium parvum
PGVTTDAI

SEQ ID NO: 2274837 - protein, 25 aa, Cryptosporidium parvum
PGWKDGTKLTYSGEGDQESPGTSPG

SEQ ID NO: 2274838 - protein, 11 aa, Cryptosporidium parvum
PGYAGRSELPD

SEQ ID NO: 2274839 - protein, 10 aa, Cryptosporidium parvum
PGYDSNSPNL

SEQ ID NO: 2274840 - protein, 4 aa, Cryptosporidium parvum
PGYS

SEQ ID NO: 2274841 - protein, 9 aa, Cryptosporidium parvum
PGYSRINQE

SEQ ID NO: 2274842 - protein, 5 aa, Cryptosporidium parvum
PHAGP

SEQ ID NO: 2274843 - protein, 5 aa, Cryptosporidium parvum
PHEKE

SEQ ID NO: 2274844 - protein, 6 aa, Cryptosporidium parvum
PHHEDS

SEQ ID NO: 2274845 - protein, 5 aa, Cryptosporidium parvum
PHHQE

SEQ ID NO: 2274846 - protein, 8 aa, Cryptosporidium parvum
PHKRPSAE

SEQ ID NO: 2274847 - protein, 7 aa, Cryptosporidium parvum
PHKSPQS

SEQ ID NO: 2274848 - protein, 4 aa, Cryptosporidium parvum
PHLN

SEQ ID NO: 2274849 - protein, 8 aa, Cryptosporidium parvum
PHLPPPPN

SEQ ID NO: 2274850 - protein, 5 aa, Cryptosporidium parvum
PHNAP

SEQ ID NO: 2274851 - protein, 7 aa, Cryptosporidium parvum
PHNPADL

SEQ ID NO: 2274852 - protein, 4 aa, Cryptosporidium parvum
PHPA

SEQ ID NO: 2274853 - protein, 10 aa, Cryptosporidium parvum
PHPKRGITSF

SEQ ID NO: 2274854 - protein, 9 aa, Cryptosporidium parvum
PHPNNGDNS

SEQ ID NO: 2274855 - protein, 6 aa, Cryptosporidium parvum
PHPRPK

SEQ ID NO: 2274856 - protein, 134 aa, Cryptosporidium parvum
PHPTEKPSNGEHQESGSEQAPITSPENESSSNHPSVTVPDTGSSSNHPSVTVPETGSSSNHPSVTIPDTGSSSNHPSVTIPETESSSNHPSVTIPETGSSSNHPSVTIPDTGSSSNHPSVTVPETGSDSDHAPV

SEQ ID NO: 2274857 - protein, 9 aa, Cryptosporidium parvum
PHPTTPTPD

SEQ ID NO: 2274858 - protein, 16 aa, Cryptosporidium parvum
PHPVGEESSDDFGTKK

SEQ ID NO: 2274859 - protein, 7 aa, Cryptosporidium parvum
PHPYTSS

SEQ ID NO: 2274860 - protein, 7 aa, Cryptosporidium parvum
PHQENTG

SEQ ID NO: 2274861 - protein, 4 aa, Cryptosporidium parvum
PHQL

SEQ ID NO: 2274862 - protein, 7 aa, Cryptosporidium parvum
PHQNQEM

SEQ ID NO: 2274863 - protein, 4 aa, Cryptosporidium parvum
PHSL

SEQ ID NO: 2274864 - protein, 11 aa, Cryptosporidium parvum
PHSNSPTHHGH

SEQ ID NO: 2274865 - protein, 5 aa, Cryptosporidium parvum
PHSPS

SEQ ID NO: 2274866 - protein, 7 aa, Cryptosporidium parvum
PHSTPHN

SEQ ID NO: 2274867 - protein, 7 aa, Cryptosporidium parvum
PHSVTTT

SEQ ID NO: 2274868 - protein, 4 aa, Cryptosporidium parvum
PHTI

SEQ ID NO: 2274869 - protein, 4 aa, Cryptosporidium parvum
PHYE

SEQ ID NO: 2274870 - protein, 5 aa, Cryptosporidium parvum
PHYKR

SEQ ID NO: 2274871 - protein, 6 aa, Cryptosporidium parvum
PHYTGY

SEQ ID NO: 2274872 - protein, 5 aa, Cryptosporidium parvum
PIADD

SEQ ID NO: 2274873 - protein, 12 aa, Cryptosporidium parvum
PIANSNADVGYN

SEQ ID NO: 2274874 - protein, 5 aa, Cryptosporidium parvum
PIDAD

SEQ ID NO: 2274875 - protein, 18 aa, Cryptosporidium parvum
PIDDNSRKVLGPSKNKFT

SEQ ID NO: 2274876 - protein, 6 aa, Cryptosporidium parvum
PIDGTD

SEQ ID NO: 2274877 - protein, 4 aa, Cryptosporidium parvum
PIDP

SEQ ID NO: 2274878 - protein, 7 aa, Cryptosporidium parvum
PIDPSIS

SEQ ID NO: 2274879 - protein, 8 aa, Cryptosporidium parvum
PIDSNYQG

SEQ ID NO: 2274880 - protein, 14 aa, Cryptosporidium parvum
PIDSSERSSIKEKI

SEQ ID NO: 2274881 - protein, 10 aa, Cryptosporidium parvum
PIEDNDESLS

SEQ ID NO: 2274882 - protein, 4 aa, Cryptosporidium parvum
PIEK

SEQ ID NO: 2274883 - protein, 7 aa, Cryptosporidium parvum
PIESTKN

SEQ ID NO: 2274884 - protein, 6 aa, Cryptosporidium parvum
PIETTT

SEQ ID NO: 2274885 - protein, 4 aa, Cryptosporidium parvum
PIEV

SEQ ID NO: 2274886 - protein, 7 aa, Cryptosporidium parvum
PIFPGDS

SEQ ID NO: 2274887 - protein, 5 aa, Cryptosporidium parvum
PIGTP

SEQ ID NO: 2274888 - protein, 4 aa, Cryptosporidium parvum
PIKE

SEQ ID NO: 2274889 - protein, 6 aa, Cryptosporidium parvum
PIKGGG

SEQ ID NO: 2274890 - protein, 14 aa, Cryptosporidium parvum
PIKKSKNKPGKRDR

SEQ ID NO: 2274891 - protein, 16 aa, Cryptosporidium parvum
PIKNGEYSKIESSSIK

SEQ ID NO: 2274892 - protein, 5 aa, Cryptosporidium parvum
PIKPG

SEQ ID NO: 2274893 - protein, 12 aa, Cryptosporidium parvum
PIKRGKDSLSSI

SEQ ID NO: 2274894 - protein, 4 aa, Cryptosporidium parvum
PIKT

SEQ ID NO: 2274895 - protein, 4 aa, Cryptosporidium parvum
PILN

SEQ ID NO: 2274896 - protein, 14 aa, Cryptosporidium parvum
PILSDESDEYSETC

SEQ ID NO: 2274897 - protein, 9 aa, Cryptosporidium parvum
PINDTNDVS

SEQ ID NO: 2274898 - protein, 10 aa, Cryptosporidium parvum
PINEDKRKSE

SEQ ID NO: 2274899 - protein, 10 aa, Cryptosporidium parvum
PINKTSPSHL

SEQ ID NO: 2274900 - protein, 4 aa, Cryptosporidium parvum
PINN

SEQ ID NO: 2274901 - protein, 12 aa, Cryptosporidium parvum
PINPEDRDTRIQ

SEQ ID NO: 2274902 - protein, 14 aa, Cryptosporidium parvum
PINPQEASTNLPRS

SEQ ID NO: 2274903 - protein, 15 aa, Cryptosporidium parvum
PINQPSQGQTVSYRN

SEQ ID NO: 2274904 - protein, 11 aa, Cryptosporidium parvum
PINSSKDCPNV

SEQ ID NO: 2274905 - protein, 11 aa, Cryptosporidium parvum
PINSSSTSVNK

SEQ ID NO: 2274906 - protein, 4 aa, Cryptosporidium parvum
PINT

SEQ ID NO: 2274907 - protein, 8 aa, Cryptosporidium parvum
PINTGYDK

SEQ ID NO: 2274908 - protein, 42 aa, Cryptosporidium parvum
PIPENPVAPNHTNITPVNSNASLNAGLTSSEDLSSEQLPGNL

SEQ ID NO: 2274909 - protein, 11 aa, Cryptosporidium parvum
PIPKLEPGQAE

SEQ ID NO: 2274910 - protein, 7 aa, Cryptosporidium parvum
PIPNQSS

SEQ ID NO: 2274911 - protein, 12 aa, Cryptosporidium parvum
PIPNSSEISNRD

SEQ ID NO: 2274912 - protein, 5 aa, Cryptosporidium parvum
PIPNY

SEQ ID NO: 2274913 - protein, 17 aa, Cryptosporidium parvum
PIPPPGVPPLPPNIHGN

SEQ ID NO: 2274914 - protein, 8 aa, Cryptosporidium parvum
PIPQEVNP

SEQ ID NO: 2274915 - protein, 7 aa, Cryptosporidium parvum
PIPQPGL

SEQ ID NO: 2274916 - protein, 7 aa, Cryptosporidium parvum
PIQNQLG

SEQ ID NO: 2274917 - protein, 4 aa, Cryptosporidium parvum
PIRN

SEQ ID NO: 2274918 - protein, 5 aa, Cryptosporidium parvum
PISEE

SEQ ID NO: 2274919 - protein, 7 aa, Cryptosporidium parvum
PISENKS

SEQ ID NO: 2274920 - protein, 5 aa, Cryptosporidium parvum
PISGE

SEQ ID NO: 2274921 - protein, 7 aa, Cryptosporidium parvum
PISIPSN

SEQ ID NO: 2274922 - protein, 8 aa, Cryptosporidium parvum
PISNTEDD

SEQ ID NO: 2274923 - protein, 11 aa, Cryptosporidium parvum
PISPHPNSHTY

SEQ ID NO: 2274924 - protein, 13 aa, Cryptosporidium parvum
PISPQKDTTDCKG

SEQ ID NO: 2274925 - protein, 6 aa, Cryptosporidium parvum
PISPSN

SEQ ID NO: 2274926 - protein, 21 aa, Cryptosporidium parvum
PISQASAKQRSGRAGRTGPGK

SEQ ID NO: 2274927 - protein, 12 aa, Cryptosporidium parvum
PISQEGKNPSSL

SEQ ID NO: 2274928 - protein, 11 aa, Cryptosporidium parvum
PISRSKKRNND

SEQ ID NO: 2274929 - protein, 22 aa, Cryptosporidium parvum
PISTNSGDQNINSDQNGSNNAK

SEQ ID NO: 2274930 - protein, 25 aa, Cryptosporidium parvum
PITPESLKSQIKSNNNESTSKKSSF

SEQ ID NO: 2274931 - protein, 4 aa, Cryptosporidium parvum
PITS

SEQ ID NO: 2274932 - protein, 32 aa, Cryptosporidium parvum
PITSSSSSSSSSSSSSSSSSSSSSSSSSVHNT

SEQ ID NO: 2274933 - protein, 4 aa, Cryptosporidium parvum
PITT

SEQ ID NO: 2274934 - protein, 6 aa, Cryptosporidium parvum
PITTES

SEQ ID NO: 2274935 - protein, 28 aa, Cryptosporidium parvum
PITTHSENKVCNTNSETKKTQESEYLTE

SEQ ID NO: 2274936 - protein, 20 aa, Cryptosporidium parvum
PITTPVKRSAKNKINNQNNE

SEQ ID NO: 2274937 - protein, 5 aa, Cryptosporidium parvum
PIYTE

SEQ ID NO: 2274938 - protein, 8 aa, Cryptosporidium parvum
PKADCNEE

SEQ ID NO: 2274939 - protein, 9 aa, Cryptosporidium parvum
PKADKREKI

SEQ ID NO: 2274940 - protein, 11 aa, Cryptosporidium parvum
PKAKRKSEQYF

SEQ ID NO: 2274941 - protein, 12 aa, Cryptosporidium parvum
PKANAVKTSKLD

SEQ ID NO: 2274942 - protein, 10 aa, Cryptosporidium parvum
PKAVTTKSDI

SEQ ID NO: 2274943 - protein, 13 aa, Cryptosporidium parvum
PKCKRRHEPKARH

SEQ ID NO: 2274944 - protein, 4 aa, Cryptosporidium parvum
PKDE

SEQ ID NO: 2274945 - protein, 10 aa, Cryptosporidium parvum
PKDIDHDQKV

SEQ ID NO: 2274946 - protein, 10 aa, Cryptosporidium parvum
PKDKDKDIAD

SEQ ID NO: 2274947 - protein, 19 aa, Cryptosporidium parvum
PKDKQAQADRKKSKFYHPQ

SEQ ID NO: 2274948 - protein, 4 aa, Cryptosporidium parvum
PKDN

SEQ ID NO: 2274949 - protein, 5 aa, Cryptosporidium parvum
PKDSE

SEQ ID NO: 2274950 - protein, 7 aa, Cryptosporidium parvum
PKDSTEL

SEQ ID NO: 2274951 - protein, 13 aa, Cryptosporidium parvum
PKDTSRLTATNNI

SEQ ID NO: 2274952 - protein, 5 aa, Cryptosporidium parvum
PKEAG

SEQ ID NO: 2274953 - protein, 6 aa, Cryptosporidium parvum
PKEAWK

SEQ ID NO: 2274954 - protein, 4 aa, Cryptosporidium parvum
PKEC

SEQ ID NO: 2274955 - protein, 9 aa, Cryptosporidium parvum
PKEGADSEA

SEQ ID NO: 2274956 - protein, 5 aa, Cryptosporidium parvum
PKENT

SEQ ID NO: 2274957 - protein, 11 aa, Cryptosporidium parvum
PKERNSDIKND

SEQ ID NO: 2274958 - protein, 8 aa, Cryptosporidium parvum
PKERPDSY

SEQ ID NO: 2274959 - protein, 8 aa, Cryptosporidium parvum
PKERSIKG

SEQ ID NO: 2274960 - protein, 10 aa, Cryptosporidium parvum
PKEVLGKNGL

SEQ ID NO: 2274961 - protein, 7 aa, Cryptosporidium parvum
PKEVPPS

SEQ ID NO: 2274962 - protein, 9 aa, Cryptosporidium parvum
PKFASTVGS

SEQ ID NO: 2274963 - protein, 13 aa, Cryptosporidium parvum
PKFNANATNEKGF

SEQ ID NO: 2274964 - protein, 4 aa, Cryptosporidium parvum
PKFT

SEQ ID NO: 2274965 - protein, 5 aa, Cryptosporidium parvum
PKGDT

SEQ ID NO: 2274966 - protein, 5 aa, Cryptosporidium parvum
PKGDV

SEQ ID NO: 2274967 - protein, 15 aa, Cryptosporidium parvum
PKGEMKGSAITGPVG

SEQ ID NO: 2274968 - protein, 5 aa, Cryptosporidium parvum
PKGGN

SEQ ID NO: 2274969 - protein, 5 aa, Cryptosporidium parvum
PKGMI

SEQ ID NO: 2274970 - protein, 7 aa, Cryptosporidium parvum
PKGNDQK

SEQ ID NO: 2274971 - protein, 7 aa, Cryptosporidium parvum
PKGPELS

SEQ ID NO: 2274972 - protein, 9 aa, Cryptosporidium parvum
PKGYDGRVS

SEQ ID NO: 2274973 - protein, 5 aa, Cryptosporidium parvum
PKHSN

SEQ ID NO: 2274974 - protein, 12 aa, Cryptosporidium parvum
PKIENETTKEIR

SEQ ID NO: 2274975 - protein, 4 aa, Cryptosporidium parvum
PKIF

SEQ ID NO: 2274976 - protein, 9 aa, Cryptosporidium parvum
PKIGHTNNP

SEQ ID NO: 2274977 - protein, 4 aa, Cryptosporidium parvum
PKIN

SEQ ID NO: 2274978 - protein, 7 aa, Cryptosporidium parvum
PKIPPEQ

SEQ ID NO: 2274979 - protein, 7 aa, Cryptosporidium parvum
PKISSGT

SEQ ID NO: 2274980 - protein, 5 aa, Cryptosporidium parvum
PKIVK

SEQ ID NO: 2274981 - protein, 10 aa, Cryptosporidium parvum
PKKANNALES

SEQ ID NO: 2274982 - protein, 12 aa, Cryptosporidium parvum
PKKDSLQNDEEI

SEQ ID NO: 2274983 - protein, 19 aa, Cryptosporidium parvum
PKKIEKEPNDNKKDESNKL

SEQ ID NO: 2274984 - protein, 34 aa, Cryptosporidium parvum
PKKKKTKKDFEEESNELENKLDKGQRTSRKRGNK

SEQ ID NO: 2274985 - protein, 7 aa, Cryptosporidium parvum
PKKKMKK

SEQ ID NO: 2274986 - protein, 9 aa, Cryptosporidium parvum
PKKLEESKK

SEQ ID NO: 2274987 - protein, 10 aa, Cryptosporidium parvum
PKKSDGTNKG

SEQ ID NO: 2274988 - protein, 7 aa, Cryptosporidium parvum
PKKSLGN

SEQ ID NO: 2274989 - protein, 41 aa, Cryptosporidium parvum
PKKSSEMIPKSNSSDISDYSPTKSTSGAHSQSGTGRSGSNF

SEQ ID NO: 2274990 - protein, 8 aa, Cryptosporidium parvum
PKKTEITE

SEQ ID NO: 2274991 - protein, 4 aa, Cryptosporidium parvum
PKKV

SEQ ID NO: 2274992 - protein, 12 aa, Cryptosporidium parvum
PKLETESEQDSI

SEQ ID NO: 2274993 - protein, 4 aa, Cryptosporidium parvum
PKLR

SEQ ID NO: 2274994 - protein, 4 aa, Cryptosporidium parvum
PKLS

SEQ ID NO: 2274995 - protein, 10 aa, Cryptosporidium parvum
PKLSEEEKQN

SEQ ID NO: 2274996 - protein, 8 aa, Cryptosporidium parvum
PKLSPSTT

SEQ ID NO: 2274997 - protein, 15 aa, Cryptosporidium parvum
PKLSSSSKDKIREEV

SEQ ID NO: 2274998 - protein, 26 aa, Cryptosporidium parvum
PKMSSKNNKGAAPKKIHKKKKESYST

SEQ ID NO: 2274999 - protein, 28 aa, Cryptosporidium parvum
PKNAQQNKEQNIEQNSQGSLNAQTSSTP

SEQ ID NO: 2275000 - protein, 5 aa, Cryptosporidium parvum
PKNEQ

SEQ ID NO: 2275001 - protein, 6 aa, Cryptosporidium parvum
PKNERK

SEQ ID NO: 2275002 - protein, 7 aa, Cryptosporidium parvum
PKNGESL

SEQ ID NO: 2275003 - protein, 13 aa, Cryptosporidium parvum
PKNKKKSKKHNIE

SEQ ID NO: 2275004 - protein, 4 aa, Cryptosporidium parvum
PKNL

SEQ ID NO: 2275005 - protein, 11 aa, Cryptosporidium parvum
PKNLSKDGSKY

SEQ ID NO: 2275006 - protein, 22 aa, Cryptosporidium parvum
PKNNNFDYSSGNVHNKKLTEKN

SEQ ID NO: 2275007 - protein, 10 aa, Cryptosporidium parvum
PKNNYNIPKN

SEQ ID NO: 2275008 - protein, 9 aa, Cryptosporidium parvum
PKNPNNPYS

SEQ ID NO: 2275009 - protein, 6 aa, Cryptosporidium parvum
PKNQDF

SEQ ID NO: 2275010 - protein, 8 aa, Cryptosporidium parvum
PKNSGKTT

SEQ ID NO: 2275011 - protein, 23 aa, Cryptosporidium parvum
PKNSKVASNYNSDINSYSRPSSL

SEQ ID NO: 2275012 - protein, 6 aa, Cryptosporidium parvum
PKNSLN

SEQ ID NO: 2275013 - protein, 20 aa, Cryptosporidium parvum
PKNSNFHSRGVKKNKQNYEH

SEQ ID NO: 2275014 - protein, 18 aa, Cryptosporidium parvum
PKNSSRRSSVDEGPPPLG

SEQ ID NO: 2275015 - protein, 5 aa, Cryptosporidium parvum
PKNVE

SEQ ID NO: 2275016 - protein, 14 aa, Cryptosporidium parvum
PKPAPKKKPDNNNN

SEQ ID NO: 2275017 - protein, 20 aa, Cryptosporidium parvum
PKPDNKDENIDGNSQKISTL

SEQ ID NO: 2275018 - protein, 6 aa, Cryptosporidium parvum
PKPDSD

SEQ ID NO: 2275019 - protein, 7 aa, Cryptosporidium parvum
PKPEREI

SEQ ID NO: 2275020 - protein, 7 aa, Cryptosporidium parvum
PKPGNSM

SEQ ID NO: 2275021 - protein, 12 aa, Cryptosporidium parvum
PKPGVKKEASNF

SEQ ID NO: 2275022 - protein, 5 aa, Cryptosporidium parvum
PKPID

SEQ ID NO: 2275023 - protein, 5 aa, Cryptosporidium parvum
PKPIK

SEQ ID NO: 2275024 - protein, 10 aa, Cryptosporidium parvum
PKPKNEPENI

SEQ ID NO: 2275025 - protein, 7 aa, Cryptosporidium parvum
PKPLRTG

SEQ ID NO: 2275026 - protein, 13 aa, Cryptosporidium parvum
PKPNQHNNKKGSM

SEQ ID NO: 2275027 - protein, 6 aa, Cryptosporidium parvum
PKPPLS

SEQ ID NO: 2275028 - protein, 8 aa, Cryptosporidium parvum
PKPRRGVR

SEQ ID NO: 2275029 - protein, 6 aa, Cryptosporidium parvum
PKPSDY

SEQ ID NO: 2275030 - protein, 56 aa, Cryptosporidium parvum
PKPSTQKTTKKTGEAAIGKKRGFNGSPGRGGQSRGVRGRGFARGASPRGFRGRGTS

SEQ ID NO: 2275031 - protein, 16 aa, Cryptosporidium parvum
PKPTPGVKASPQTTVI

SEQ ID NO: 2275032 - protein, 7 aa, Cryptosporidium parvum
PKPYLKR

SEQ ID NO: 2275033 - protein, 9 aa, Cryptosporidium parvum
PKPYSGMKS

SEQ ID NO: 2275034 - protein, 7 aa, Cryptosporidium parvum
PKQGRSM

SEQ ID NO: 2275035 - protein, 11 aa, Cryptosporidium parvum
PKQISNQSTNL

SEQ ID NO: 2275036 - protein, 7 aa, Cryptosporidium parvum
PKQLGNA

SEQ ID NO: 2275037 - protein, 6 aa, Cryptosporidium parvum
PKQLGQ

SEQ ID NO: 2275038 - protein, 7 aa, Cryptosporidium parvum
PKQLPAT

SEQ ID NO: 2275039 - protein, 6 aa, Cryptosporidium parvum
PKQPSI

SEQ ID NO: 2275040 - protein, 7 aa, Cryptosporidium parvum
PKQQEEI

SEQ ID NO: 2275041 - protein, 5 aa, Cryptosporidium parvum
PKQRV

SEQ ID NO: 2275042 - protein, 12 aa, Cryptosporidium parvum
PKQSYADAKSGN

SEQ ID NO: 2275043 - protein, 7 aa, Cryptosporidium parvum
PKQTSKY

SEQ ID NO: 2275044 - protein, 11 aa, Cryptosporidium parvum
PKRCSKGKEMS

SEQ ID NO: 2275045 - protein, 10 aa, Cryptosporidium parvum
PKREKKTKGI

SEQ ID NO: 2275046 - protein, 7 aa, Cryptosporidium parvum
PKRGIGD

SEQ ID NO: 2275047 - protein, 8 aa, Cryptosporidium parvum
PKRGLNRD

SEQ ID NO: 2275048 - protein, 8 aa, Cryptosporidium parvum
PKRISGKE

SEQ ID NO: 2275049 - protein, 6 aa, Cryptosporidium parvum
PKRNDK

SEQ ID NO: 2275050 - protein, 8 aa, Cryptosporidium parvum
PKRSNLSL

SEQ ID NO: 2275051 - protein, 9 aa, Cryptosporidium parvum
PKRTNELSD

SEQ ID NO: 2275052 - protein, 8 aa, Cryptosporidium parvum
PKSGCKGV

SEQ ID NO: 2275053 - protein, 16 aa, Cryptosporidium parvum
PKSKAALTAARTNANS

SEQ ID NO: 2275054 - protein, 17 aa, Cryptosporidium parvum
PKSKEEYDSEKAESFKE

SEQ ID NO: 2275055 - protein, 9 aa, Cryptosporidium parvum
PKSKEPHSK

SEQ ID NO: 2275056 - protein, 8 aa, Cryptosporidium parvum
PKSKKAEI

SEQ ID NO: 2275057 - protein, 14 aa, Cryptosporidium parvum
PKSLDNSSSTENQI

SEQ ID NO: 2275058 - protein, 14 aa, Cryptosporidium parvum
PKSLEENALSSKKE

SEQ ID NO: 2275059 - protein, 6 aa, Cryptosporidium parvum
PKSPLE

SEQ ID NO: 2275060 - protein, 7 aa, Cryptosporidium parvum
PKSPNST

SEQ ID NO: 2275061 - protein, 8 aa, Cryptosporidium parvum
PKSPSIPE

SEQ ID NO: 2275062 - protein, 6 aa, Cryptosporidium parvum
PKSRGY

SEQ ID NO: 2275063 - protein, 5 aa, Cryptosporidium parvum
PKSRS

SEQ ID NO: 2275064 - protein, 16 aa, Cryptosporidium parvum
PKSSCKKNTRSNEKNK

SEQ ID NO: 2275065 - protein, 12 aa, Cryptosporidium parvum
PKSSKGYYYDSP

SEQ ID NO: 2275066 - protein, 10 aa, Cryptosporidium parvum
PKSSPGIPLN

SEQ ID NO: 2275067 - protein, 8 aa, Cryptosporidium parvum
PKSSQGTW

SEQ ID NO: 2275068 - protein, 11 aa, Cryptosporidium parvum
PKSSSTNNTET

SEQ ID NO: 2275069 - protein, 7 aa, Cryptosporidium parvum
PKSSTVE

SEQ ID NO: 2275070 - protein, 9 aa, Cryptosporidium parvum
PKSTARSNV

SEQ ID NO: 2275071 - protein, 42 aa, Cryptosporidium parvum
PKSTGGNSFGGIGGGVAGTGISNTNSSSTSNNTSTKKENIES

SEQ ID NO: 2275072 - protein, 6 aa, Cryptosporidium parvum
PKSTLG

SEQ ID NO: 2275073 - protein, 12 aa, Cryptosporidium parvum
PKSTPPNPEKIK

SEQ ID NO: 2275074 - protein, 12 aa, Cryptosporidium parvum
PKSTSDADYKYN

SEQ ID NO: 2275075 - protein, 5 aa, Cryptosporidium parvum
PKSVA

SEQ ID NO: 2275076 - protein, 50 aa, Cryptosporidium parvum
PKSVSKTTNLEKNSLKSPSNSSSPKSLKNKSNNINKTDQSPKSAKYNSNL

SEQ ID NO: 2275077 - protein, 6 aa, Cryptosporidium parvum
PKTDIE

SEQ ID NO: 2275078 - protein, 10 aa, Cryptosporidium parvum
PKTDTNSNGI

SEQ ID NO: 2275079 - protein, 6 aa, Cryptosporidium parvum
PKTERE

SEQ ID NO: 2275080 - protein, 4 aa, Cryptosporidium parvum
PKTG

SEQ ID NO: 2275081 - protein, 4 aa, Cryptosporidium parvum
PKTH

SEQ ID NO: 2275082 - protein, 4 aa, Cryptosporidium parvum
PKTL

SEQ ID NO: 2275083 - protein, 5 aa, Cryptosporidium parvum
PKTNH

SEQ ID NO: 2275084 - protein, 9 aa, Cryptosporidium parvum
PKTPPASPV

SEQ ID NO: 2275085 - protein, 4 aa, Cryptosporidium parvum
PKTQ

SEQ ID NO: 2275086 - protein, 7 aa, Cryptosporidium parvum
PKTRSGK

SEQ ID NO: 2275087 - protein, 6 aa, Cryptosporidium parvum
PKTSEN

SEQ ID NO: 2275088 - protein, 15 aa, Cryptosporidium parvum
PKTSGGYGKGFEGSE

SEQ ID NO: 2275089 - protein, 5 aa, Cryptosporidium parvum
PKTSK

SEQ ID NO: 2275090 - protein, 7 aa, Cryptosporidium parvum
PKTSYNQ

SEQ ID NO: 2275091 - protein, 4 aa, Cryptosporidium parvum
PKTV

SEQ ID NO: 2275092 - protein, 7 aa, Cryptosporidium parvum
PKTVPTL

SEQ ID NO: 2275093 - protein, 20 aa, Cryptosporidium parvum
PKVAEDSSSEISQDQANETI

SEQ ID NO: 2275094 - protein, 17 aa, Cryptosporidium parvum
PKVAEYAKEYKNTGKIN

SEQ ID NO: 2275095 - protein, 6 aa, Cryptosporidium parvum
PKVTSS

SEQ ID NO: 2275096 - protein, 5 aa, Cryptosporidium parvum
PKYGS

SEQ ID NO: 2275097 - protein, 4 aa, Cryptosporidium parvum
PLAA

SEQ ID NO: 2275098 - protein, 10 aa, Cryptosporidium parvum
PLAKSGETVI

SEQ ID NO: 2275099 - protein, 5 aa, Cryptosporidium parvum
PLANK

SEQ ID NO: 2275100 - protein, 4 aa, Cryptosporidium parvum
PLAQ

SEQ ID NO: 2275101 - protein, 4 aa, Cryptosporidium parvum
PLDE

SEQ ID NO: 2275102 - protein, 5 aa, Cryptosporidium parvum
PLDPN

SEQ ID NO: 2275103 - protein, 11 aa, Cryptosporidium parvum
PLDRGISDELE

SEQ ID NO: 2275104 - protein, 14 aa, Cryptosporidium parvum
PLEAEKKGEENKRN

SEQ ID NO: 2275105 - protein, 25 aa, Cryptosporidium parvum
PLEDSASNISTNRGHLSKASSHNNL

SEQ ID NO: 2275106 - protein, 11 aa, Cryptosporidium parvum
PLEENDDSGMN

SEQ ID NO: 2275107 - protein, 9 aa, Cryptosporidium parvum
PLEKKNSWS

SEQ ID NO: 2275108 - protein, 7 aa, Cryptosporidium parvum
PLEKNPI

SEQ ID NO: 2275109 - protein, 19 aa, Cryptosporidium parvum
PLEPEEKVEPEAAPNKPLK

SEQ ID NO: 2275110 - protein, 4 aa, Cryptosporidium parvum
PLFT

SEQ ID NO: 2275111 - protein, 7 aa, Cryptosporidium parvum
PLGGGEF

SEQ ID NO: 2275112 - protein, 6 aa, Cryptosporidium parvum
PLGGPR

SEQ ID NO: 2275113 - protein, 10 aa, Cryptosporidium parvum
PLGNDNGSGM

SEQ ID NO: 2275114 - protein, 5 aa, Cryptosporidium parvum
PLGTS

SEQ ID NO: 2275115 - protein, 5 aa, Cryptosporidium parvum
PLKGG

SEQ ID NO: 2275116 - protein, 15 aa, Cryptosporidium parvum
PLKGKGSNQDEFDPA

SEQ ID NO: 2275117 - protein, 9 aa, Cryptosporidium parvum
PLKNKSEKF

SEQ ID NO: 2275118 - protein, 9 aa, Cryptosporidium parvum
PLKRGSPKI

SEQ ID NO: 2275119 - protein, 9 aa, Cryptosporidium parvum
PLKSSKNVN

SEQ ID NO: 2275120 - protein, 10 aa, Cryptosporidium parvum
PLKSTKSNIS

SEQ ID NO: 2275121 - protein, 10 aa, Cryptosporidium parvum
PLNGEDAERY

SEQ ID NO: 2275122 - protein, 7 aa, Cryptosporidium parvum
PLNGTEV

SEQ ID NO: 2275123 - protein, 6 aa, Cryptosporidium parvum
PLNKSG

SEQ ID NO: 2275124 - protein, 4 aa, Cryptosporidium parvum
PLNP

SEQ ID NO: 2275125 - protein, 7 aa, Cryptosporidium parvum
PLNPEIS

SEQ ID NO: 2275126 - protein, 6 aa, Cryptosporidium parvum
PLNPGE

SEQ ID NO: 2275127 - protein, 14 aa, Cryptosporidium parvum
PLNSNNPNGANSQI

SEQ ID NO: 2275128 - protein, 5 aa, Cryptosporidium parvum
PLPAE

SEQ ID NO: 2275129 - protein, 4 aa, Cryptosporidium parvum
PLPD

SEQ ID NO: 2275130 - protein, 10 aa, Cryptosporidium parvum
PLPDEPPADH

SEQ ID NO: 2275131 - protein, 26 aa, Cryptosporidium parvum
PLPDGLTDDIEEGKVSPRDDPKERSN

SEQ ID NO: 2275132 - protein, 15 aa, Cryptosporidium parvum
PLPETSIKKNGTNAG

SEQ ID NO: 2275133 - protein, 12 aa, Cryptosporidium parvum
PLPFNDNSETEV

SEQ ID NO: 2275134 - protein, 10 aa, Cryptosporidium parvum
PLPGNGQNHG

SEQ ID NO: 2275135 - protein, 17 aa, Cryptosporidium parvum
PLPKSSSSKGRSQYKED

SEQ ID NO: 2275136 - protein, 8 aa, Cryptosporidium parvum
PLPNETSR

SEQ ID NO: 2275137 - protein, 25 aa, Cryptosporidium parvum
PLPPKRNGPGWNSHSTGNKLEDSNN

SEQ ID NO: 2275138 - protein, 6 aa, Cryptosporidium parvum
PLPPTK

SEQ ID NO: 2275139 - protein, 5 aa, Cryptosporidium parvum
PLPRG

SEQ ID NO: 2275140 - protein, 31 aa, Cryptosporidium parvum
PLPSSARSNTSSMEDNKKKTIPPDVDPKEPF

SEQ ID NO: 2275141 - protein, 8 aa, Cryptosporidium parvum
PLPTKCTS

SEQ ID NO: 2275142 - protein, 11 aa, Cryptosporidium parvum
PLPTKKEKTRW

SEQ ID NO: 2275143 - protein, 10 aa, Cryptosporidium parvum
PLPTTKNGQS

SEQ ID NO: 2275144 - protein, 5 aa, Cryptosporidium parvum
PLPVG

SEQ ID NO: 2275145 - protein, 11 aa, Cryptosporidium parvum
PLPYGNSPLNR

SEQ ID NO: 2275146 - protein, 7 aa, Cryptosporidium parvum
PLQGDRE

SEQ ID NO: 2275147 - protein, 4 aa, Cryptosporidium parvum
PLQP

SEQ ID NO: 2275148 - protein, 4 aa, Cryptosporidium parvum
PLRS

SEQ ID NO: 2275149 - protein, 6 aa, Cryptosporidium parvum
PLSGES

SEQ ID NO: 2275150 - protein, 7 aa, Cryptosporidium parvum
PLSGGSF

SEQ ID NO: 2275151 - protein, 12 aa, Cryptosporidium parvum
PLSNLPPNISSS

SEQ ID NO: 2275152 - protein, 5 aa, Cryptosporidium parvum
PLSNP

SEQ ID NO: 2275153 - protein, 6 aa, Cryptosporidium parvum
PLSNSQ

SEQ ID NO: 2275154 - protein, 4 aa, Cryptosporidium parvum
PLSQ

SEQ ID NO: 2275155 - protein, 4 aa, Cryptosporidium parvum
PLSR

SEQ ID NO: 2275156 - protein, 11 aa, Cryptosporidium parvum
PLSREEREQLE

SEQ ID NO: 2275157 - protein, 6 aa, Cryptosporidium parvum
PLSSNN

SEQ ID NO: 2275158 - protein, 17 aa, Cryptosporidium parvum
PLSSSSSSSSSSPKNAI

SEQ ID NO: 2275159 - protein, 12 aa, Cryptosporidium parvum
PLSSSSSSSYIT

SEQ ID NO: 2275160 - protein, 11 aa, Cryptosporidium parvum
PLSTLRTKKNE

SEQ ID NO: 2275161 - protein, 13 aa, Cryptosporidium parvum
PLSVESSNNNNNN

SEQ ID NO: 2275162 - protein, 12 aa, Cryptosporidium parvum
PLSYDNTVDRSN

SEQ ID NO: 2275163 - protein, 17 aa, Cryptosporidium parvum
PLTAPKISNSKKSGEII

SEQ ID NO: 2275164 - protein, 4 aa, Cryptosporidium parvum
PLTE

SEQ ID NO: 2275165 - protein, 5 aa, Cryptosporidium parvum
PLTEK

SEQ ID NO: 2275166 - protein, 7 aa, Cryptosporidium parvum
PLTESES

SEQ ID NO: 2275167 - protein, 6 aa, Cryptosporidium parvum
PLTPQN

SEQ ID NO: 2275168 - protein, 13 aa, Cryptosporidium parvum
PLTPTSDPSDPKL

SEQ ID NO: 2275169 - protein, 4 aa, Cryptosporidium parvum
PLTS

SEQ ID NO: 2275170 - protein, 11 aa, Cryptosporidium parvum
PLTSNAAKCPT

SEQ ID NO: 2275171 - protein, 30 aa, Cryptosporidium parvum
PLTTASTAPTAPSTPTATPTSNTTHMETTN

SEQ ID NO: 2275172 - protein, 13 aa, Cryptosporidium parvum
PLVGNNSNPNPFV

SEQ ID NO: 2275173 - protein, 12 aa, Cryptosporidium parvum
PLYSESPKKINI

SEQ ID NO: 2275174 - protein, 13 aa, Cryptosporidium parvum
PMDDPKKRQPDIS

SEQ ID NO: 2275175 - protein, 4 aa, Cryptosporidium parvum
PMED

SEQ ID NO: 2275176 - protein, 10 aa, Cryptosporidium parvum
PMNPKVNRER

SEQ ID NO: 2275177 - protein, 10 aa, Cryptosporidium parvum
PMPSDPTHSS

SEQ ID NO: 2275178 - protein, 8 aa, Cryptosporidium parvum
PMRQGNTK

SEQ ID NO: 2275179 - protein, 5 aa, Cryptosporidium parvum
PMSAA

SEQ ID NO: 2275180 - protein, 6 aa, Cryptosporidium parvum
PMSPGN

SEQ ID NO: 2275181 - protein, 7 aa, Cryptosporidium parvum
PMSPNSS

SEQ ID NO: 2275182 - protein, 10 aa, Cryptosporidium parvum
PMSSRGQQPT

SEQ ID NO: 2275183 - protein, 5 aa, Cryptosporidium parvum
PMTKN

SEQ ID NO: 2275184 - protein, 5 aa, Cryptosporidium parvum
PMTSP

SEQ ID NO: 2275185 - protein, 22 aa, Cryptosporidium parvum
PMYGTNDPEDVASDGLPSHPAI

SEQ ID NO: 2275186 - protein, 10 aa, Cryptosporidium parvum
PNADGSDDED

SEQ ID NO: 2275187 - protein, 8 aa, Cryptosporidium parvum
PNADQETV

SEQ ID NO: 2275188 - protein, 9 aa, Cryptosporidium parvum
PNAGNTTES

SEQ ID NO: 2275189 - protein, 8 aa, Cryptosporidium parvum
PNAHNSEI

SEQ ID NO: 2275190 - protein, 5 aa, Cryptosporidium parvum
PNANK

SEQ ID NO: 2275191 - protein, 5 aa, Cryptosporidium parvum
PNASA

SEQ ID NO: 2275192 - protein, 5 aa, Cryptosporidium parvum
PNCDK

SEQ ID NO: 2275193 - protein, 8 aa, Cryptosporidium parvum
PNCDYSSS

SEQ ID NO: 2275194 - protein, 9 aa, Cryptosporidium parvum
PNDDNSQEK

SEQ ID NO: 2275195 - protein, 4 aa, Cryptosporidium parvum
PNDG

SEQ ID NO: 2275196 - protein, 6 aa, Cryptosporidium parvum
PNDGPD

SEQ ID NO: 2275197 - protein, 7 aa, Cryptosporidium parvum
PNDIGPD

SEQ ID NO: 2275198 - protein, 8 aa, Cryptosporidium parvum
PNDLDSNT

SEQ ID NO: 2275199 - protein, 5 aa, Cryptosporidium parvum
PNDLQ

SEQ ID NO: 2275200 - protein, 11 aa, Cryptosporidium parvum
PNDNTEQGKEL

SEQ ID NO: 2275201 - protein, 11 aa, Cryptosporidium parvum
PNDNVRKQCSN

SEQ ID NO: 2275202 - protein, 10 aa, Cryptosporidium parvum
PNDTRDPDGC

SEQ ID NO: 2275203 - protein, 10 aa, Cryptosporidium parvum
PNEDTSDSVK

SEQ ID NO: 2275204 - protein, 8 aa, Cryptosporidium parvum
PNEEDGTC

SEQ ID NO: 2275205 - protein, 6 aa, Cryptosporidium parvum
PNEEPN

SEQ ID NO: 2275206 - protein, 5 aa, Cryptosporidium parvum
PNEQI

SEQ ID NO: 2275207 - protein, 10 aa, Cryptosporidium parvum
PNESGSNIEP

SEQ ID NO: 2275208 - protein, 8 aa, Cryptosporidium parvum
PNESKKPL

SEQ ID NO: 2275209 - protein, 6 aa, Cryptosporidium parvum
PNESND

SEQ ID NO: 2275210 - protein, 14 aa, Cryptosporidium parvum
PNESNSLNNTSIPN

SEQ ID NO: 2275211 - protein, 12 aa, Cryptosporidium parvum
PNETKERLPNEQ

SEQ ID NO: 2275212 - protein, 13 aa, Cryptosporidium parvum
PNFEGNNNNLDSS

SEQ ID NO: 2275213 - protein, 5 aa, Cryptosporidium parvum
PNFGD

SEQ ID NO: 2275214 - protein, 12 aa, Cryptosporidium parvum
PNFNKEQVNSSN

SEQ ID NO: 2275215 - protein, 14 aa, Cryptosporidium parvum
PNFQNKRKEYGLNN

SEQ ID NO: 2275216 - protein, 42 aa, Cryptosporidium parvum
PNFQSNNNNHHHSTIPSNSSNSNSGNGNWSPTTLGVGGPNFA

SEQ ID NO: 2275217 - protein, 7 aa, Cryptosporidium parvum
PNGDRVS

SEQ ID NO: 2275218 - protein, 9 aa, Cryptosporidium parvum
PNGGNLEQG

SEQ ID NO: 2275219 - protein, 5 aa, Cryptosporidium parvum
PNGLS

SEQ ID NO: 2275220 - protein, 4 aa, Cryptosporidium parvum
PNGN

SEQ ID NO: 2275221 - protein, 4 aa, Cryptosporidium parvum
PNGP

SEQ ID NO: 2275222 - protein, 5 aa, Cryptosporidium parvum
PNGPS

SEQ ID NO: 2275223 - protein, 7 aa, Cryptosporidium parvum
PNGSDEK

SEQ ID NO: 2275224 - protein, 14 aa, Cryptosporidium parvum
PNGSYSTIKDSESS

SEQ ID NO: 2275225 - protein, 10 aa, Cryptosporidium parvum
PNHDSSTTDT

SEQ ID NO: 2275226 - protein, 5 aa, Cryptosporidium parvum
PNHEN

SEQ ID NO: 2275227 - protein, 4 aa, Cryptosporidium parvum
PNHH

SEQ ID NO: 2275228 - protein, 10 aa, Cryptosporidium parvum
PNHMNPTQNT

SEQ ID NO: 2275229 - protein, 11 aa, Cryptosporidium parvum
PNHNQSPRNTY

SEQ ID NO: 2275230 - protein, 4 aa, Cryptosporidium parvum
PNHT

SEQ ID NO: 2275231 - protein, 6 aa, Cryptosporidium parvum
PNHTTP

SEQ ID NO: 2275232 - protein, 7 aa, Cryptosporidium parvum
PNIDDET

SEQ ID NO: 2275233 - protein, 13 aa, Cryptosporidium parvum
PNIELDNSKEGKN

SEQ ID NO: 2275234 - protein, 5 aa, Cryptosporidium parvum
PNIEP

SEQ ID NO: 2275235 - protein, 8 aa, Cryptosporidium parvum
PNIEPNSK

SEQ ID NO: 2275236 - protein, 6 aa, Cryptosporidium parvum
PNIGDQ

SEQ ID NO: 2275237 - protein, 11 aa, Cryptosporidium parvum
PNIGGANGGMN

SEQ ID NO: 2275238 - protein, 9 aa, Cryptosporidium parvum
PNIGRRGKK

SEQ ID NO: 2275239 - protein, 12 aa, Cryptosporidium parvum
PNINQEKEEKPM

SEQ ID NO: 2275240 - protein, 6 aa, Cryptosporidium parvum
PNINRD

SEQ ID NO: 2275241 - protein, 14 aa, Cryptosporidium parvum
PNINTNDNNNNNKF

SEQ ID NO: 2275242 - protein, 42 aa, Cryptosporidium parvum
PNIPEASSSLSSVVGQSQNNELHQSETKGELMDSQGNNSNKS

SEQ ID NO: 2275243 - protein, 7 aa, Cryptosporidium parvum
PNIPEYD

SEQ ID NO: 2275244 - protein, 10 aa, Cryptosporidium parvum
PNISSNYDEY

SEQ ID NO: 2275245 - protein, 7 aa, Cryptosporidium parvum
PNITQEE

SEQ ID NO: 2275246 - protein, 4 aa, Cryptosporidium parvum
PNIV

SEQ ID NO: 2275247 - protein, 26 aa, Cryptosporidium parvum
PNKGIENRYNQKDRNSNYGKDENNSE

SEQ ID NO: 2275248 - protein, 13 aa, Cryptosporidium parvum
PNKGMEFLLLQLN

SEQ ID NO: 2275249 - protein, 6 aa, Cryptosporidium parvum
PNKIEN

SEQ ID NO: 2275250 - protein, 5 aa, Cryptosporidium parvum
PNKKS

SEQ ID NO: 2275251 - protein, 8 aa, Cryptosporidium parvum
PNKKSYAL

SEQ ID NO: 2275252 - protein, 4 aa, Cryptosporidium parvum
PNKN

SEQ ID NO: 2275253 - protein, 6 aa, Cryptosporidium parvum
PNKNSA

SEQ ID NO: 2275254 - protein, 8 aa, Cryptosporidium parvum
PNKPQYYN

SEQ ID NO: 2275255 - protein, 9 aa, Cryptosporidium parvum
PNKQNENEI

SEQ ID NO: 2275256 - protein, 9 aa, Cryptosporidium parvum
PNKRISAQD

SEQ ID NO: 2275257 - protein, 8 aa, Cryptosporidium parvum
PNKSEFPK

SEQ ID NO: 2275258 - protein, 22 aa, Cryptosporidium parvum
PNKSIKKEANNTLNTGTQNNSV

SEQ ID NO: 2275259 - protein, 9 aa, Cryptosporidium parvum
PNKSSNSDK

SEQ ID NO: 2275260 - protein, 8 aa, Cryptosporidium parvum
PNKSSSIA

SEQ ID NO: 2275261 - protein, 4 aa, Cryptosporidium parvum
PNKT

SEQ ID NO: 2275262 - protein, 14 aa, Cryptosporidium parvum
PNKTKNSETISSTQ

SEQ ID NO: 2275263 - protein, 23 aa, Cryptosporidium parvum
PNKTPDDYKDGNNIKHEQHQDFD

SEQ ID NO: 2275264 - protein, 16 aa, Cryptosporidium parvum
PNKTSSIKKKQAEPIE

SEQ ID NO: 2275265 - protein, 4 aa, Cryptosporidium parvum
PNLA

SEQ ID NO: 2275266 - protein, 6 aa, Cryptosporidium parvum
PNLEER

SEQ ID NO: 2275267 - protein, 26 aa, Cryptosporidium parvum
PNLESSQKECIDGSYTAENAQNTNEN

SEQ ID NO: 2275268 - protein, 6 aa, Cryptosporidium parvum
PNLGEE

SEQ ID NO: 2275269 - protein, 11 aa, Cryptosporidium parvum
PNLGNSQQTSL

SEQ ID NO: 2275270 - protein, 7 aa, Cryptosporidium parvum
PNLNKEK

SEQ ID NO: 2275271 - protein, 4 aa, Cryptosporidium parvum
PNLP

SEQ ID NO: 2275272 - protein, 9 aa, Cryptosporidium parvum
PNLSESTNI

SEQ ID NO: 2275273 - protein, 12 aa, Cryptosporidium parvum
PNLYNGTTSLDS

SEQ ID NO: 2275274 - protein, 5 aa, Cryptosporidium parvum
PNMAA

SEQ ID NO: 2275275 - protein, 8 aa, Cryptosporidium parvum
PNMDGASD

SEQ ID NO: 2275276 - protein, 4 aa, Cryptosporidium parvum
PNMP

SEQ ID NO: 2275277 - protein, 6 aa, Cryptosporidium parvum
PNNCES

SEQ ID NO: 2275278 - protein, 10 aa, Cryptosporidium parvum
PNNDDHSERN

SEQ ID NO: 2275279 - protein, 13 aa, Cryptosporidium parvum
PNNDRNDDWKPNE

SEQ ID NO: 2275280 - protein, 10 aa, Cryptosporidium parvum
PNNEIEQSNI

SEQ ID NO: 2275281 - protein, 4 aa, Cryptosporidium parvum
PNNG

SEQ ID NO: 2275282 - protein, 5 aa, Cryptosporidium parvum
PNNGL

SEQ ID NO: 2275283 - protein, 28 aa, Cryptosporidium parvum
PNNGSQQGQKIELGEEDGTKPSNSLKAA

SEQ ID NO: 2275284 - protein, 4 aa, Cryptosporidium parvum
PNNI

SEQ ID NO: 2275285 - protein, 5 aa, Cryptosporidium parvum
PNNIP

SEQ ID NO: 2275286 - protein, 14 aa, Cryptosporidium parvum
PNNIRSHQEGGRHN

SEQ ID NO: 2275287 - protein, 8 aa, Cryptosporidium parvum
PNNKDGGD

SEQ ID NO: 2275288 - protein, 5 aa, Cryptosporidium parvum
PNNKT

SEQ ID NO: 2275289 - protein, 6 aa, Cryptosporidium parvum
PNNKYG

SEQ ID NO: 2275290 - protein, 5 aa, Cryptosporidium parvum
PNNNN

SEQ ID NO: 2275291 - protein, 23 aa, Cryptosporidium parvum
PNNNNSNNINNNNNNNSNTTLTT

SEQ ID NO: 2275292 - protein, 20 aa, Cryptosporidium parvum
PNNNSSIYNTPINASTEQFP

SEQ ID NO: 2275293 - protein, 4 aa, Cryptosporidium parvum
PNNQ

SEQ ID NO: 2275294 - protein, 5 aa, Cryptosporidium parvum
PNNQQ

SEQ ID NO: 2275295 - protein, 9 aa, Cryptosporidium parvum
PNNQTQRGG

SEQ ID NO: 2275296 - protein, 16 aa, Cryptosporidium parvum
PNNSIQPQYVNGTSTH

SEQ ID NO: 2275297 - protein, 24 aa, Cryptosporidium parvum
PNNSSGGGGRGGREGECDGNTNSQ

SEQ ID NO: 2275298 - protein, 19 aa, Cryptosporidium parvum
PNNSTNKESKGEVRGNGES

SEQ ID NO: 2275299 - protein, 7 aa, Cryptosporidium parvum
PNPEEVS

SEQ ID NO: 2275300 - protein, 9 aa, Cryptosporidium parvum
PNPFSYGNN

SEQ ID NO: 2275301 - protein, 7 aa, Cryptosporidium parvum
PNPIDKD

SEQ ID NO: 2275302 - protein, 11 aa, Cryptosporidium parvum
PNPKCDNDNLL

SEQ ID NO: 2275303 - protein, 15 aa, Cryptosporidium parvum
PNPNANLEENELSDK

SEQ ID NO: 2275304 - protein, 5 aa, Cryptosporidium parvum
PNPNP

SEQ ID NO: 2275305 - protein, 20 aa, Cryptosporidium parvum
PNPNRFSNKPKNSNSKVQIQ

SEQ ID NO: 2275306 - protein, 9 aa, Cryptosporidium parvum
PNPNSPLNC

SEQ ID NO: 2275307 - protein, 16 aa, Cryptosporidium parvum
PNPNTSTSNNIPSTTA

SEQ ID NO: 2275308 - protein, 6 aa, Cryptosporidium parvum
PNPQEW

SEQ ID NO: 2275309 - protein, 53 aa, Cryptosporidium parvum
PNPQFYSEKKNKAKSNKEELGTRKKRKSRIKKLASDNDLDSNSDIDSENSDNI

SEQ ID NO: 2275310 - protein, 18 aa, Cryptosporidium parvum
PNPQGVNTIRSTTNTGLG

SEQ ID NO: 2275311 - protein, 7 aa, Cryptosporidium parvum
PNPSASI

SEQ ID NO: 2275312 - protein, 5 aa, Cryptosporidium parvum
PNPSP

SEQ ID NO: 2275313 - protein, 9 aa, Cryptosporidium parvum
PNPVESEGI

SEQ ID NO: 2275314 - protein, 11 aa, Cryptosporidium parvum
PNPVNRPNTDD

SEQ ID NO: 2275315 - protein, 13 aa, Cryptosporidium parvum
PNPVSTQNEAIGG

SEQ ID NO: 2275316 - protein, 9 aa, Cryptosporidium parvum
PNQDEATSI

SEQ ID NO: 2275317 - protein, 23 aa, Cryptosporidium parvum
PNQGEASGQHIDSGNYNTESNMP

SEQ ID NO: 2275318 - protein, 9 aa, Cryptosporidium parvum
PNQPNLSSK

SEQ ID NO: 2275319 - protein, 8 aa, Cryptosporidium parvum
PNQQNPNY

SEQ ID NO: 2275320 - protein, 7 aa, Cryptosporidium parvum
PNQYGER

SEQ ID NO: 2275321 - protein, 7 aa, Cryptosporidium parvum
PNRASYS

SEQ ID NO: 2275322 - protein, 7 aa, Cryptosporidium parvum
PNREISK

SEQ ID NO: 2275323 - protein, 20 aa, Cryptosporidium parvum
PNRRDHGKEARNRDINGENL

SEQ ID NO: 2275324 - protein, 11 aa, Cryptosporidium parvum
PNRRPHKPYQG

SEQ ID NO: 2275325 - protein, 8 aa, Cryptosporidium parvum
PNRSCDSK

SEQ ID NO: 2275326 - protein, 6 aa, Cryptosporidium parvum
PNRSNL

SEQ ID NO: 2275327 - protein, 24 aa, Cryptosporidium parvum
PNRVTSGSSCSNTPISRETRPELT

SEQ ID NO: 2275328 - protein, 9 aa, Cryptosporidium parvum
PNSDEESIS

SEQ ID NO: 2275329 - protein, 8 aa, Cryptosporidium parvum
PNSDSNKD

SEQ ID NO: 2275330 - protein, 9 aa, Cryptosporidium parvum
PNSEKYSTA

SEQ ID NO: 2275331 - protein, 27 aa, Cryptosporidium parvum
PNSESSNSLLGKNTSNLKYSNNPELSN

SEQ ID NO: 2275332 - protein, 9 aa, Cryptosporidium parvum
PNSGGDVNC

SEQ ID NO: 2275333 - protein, 6 aa, Cryptosporidium parvum
PNSHHN

SEQ ID NO: 2275334 - protein, 12 aa, Cryptosporidium parvum
PNSISGRSNESH

SEQ ID NO: 2275335 - protein, 25 aa, Cryptosporidium parvum
PNSITNNNNNNNNSNNIKKSPVPPL

SEQ ID NO: 2275336 - protein, 8 aa, Cryptosporidium parvum
PNSKRARP

SEQ ID NO: 2275337 - protein, 6 aa, Cryptosporidium parvum
PNSKSD

SEQ ID NO: 2275338 - protein, 10 aa, Cryptosporidium parvum
PNSLSQEDEN

SEQ ID NO: 2275339 - protein, 5 aa, Cryptosporidium parvum
PNSNA

SEQ ID NO: 2275340 - protein, 24 aa, Cryptosporidium parvum
PNSNDIPKKTSSSNILKKPQNDLK

SEQ ID NO: 2275341 - protein, 9 aa, Cryptosporidium parvum
PNSNEKERI

SEQ ID NO: 2275342 - protein, 7 aa, Cryptosporidium parvum
PNSNGKL

SEQ ID NO: 2275343 - protein, 10 aa, Cryptosporidium parvum
PNSNNSPDEF

SEQ ID NO: 2275344 - protein, 7 aa, Cryptosporidium parvum
PNSPKNI

SEQ ID NO: 2275345 - protein, 10 aa, Cryptosporidium parvum
PNSPPEETDP

SEQ ID NO: 2275346 - protein, 7 aa, Cryptosporidium parvum
PNSQDRK

SEQ ID NO: 2275347 - protein, 9 aa, Cryptosporidium parvum
PNSQERNLE

SEQ ID NO: 2275348 - protein, 6 aa, Cryptosporidium parvum
PNSRKA

SEQ ID NO: 2275349 - protein, 9 aa, Cryptosporidium parvum
PNSRSQNPS

SEQ ID NO: 2275350 - protein, 4 aa, Cryptosporidium parvum
PNSS

SEQ ID NO: 2275351 - protein, 8 aa, Cryptosporidium parvum
PNSSDKNG

SEQ ID NO: 2275352 - protein, 8 aa, Cryptosporidium parvum
PNSSKAKK

SEQ ID NO: 2275353 - protein, 15 aa, Cryptosporidium parvum
PNSSKENKDDENEDE

SEQ ID NO: 2275354 - protein, 9 aa, Cryptosporidium parvum
PNSSPTNIS

SEQ ID NO: 2275355 - protein, 21 aa, Cryptosporidium parvum
PNSSSNTNHTGNTNNSTNNSY

SEQ ID NO: 2275356 - protein, 6 aa, Cryptosporidium parvum
PNSSVI

SEQ ID NO: 2275357 - protein, 11 aa, Cryptosporidium parvum
PNSTESKYSVS

SEQ ID NO: 2275358 - protein, 5 aa, Cryptosporidium parvum
PNSTS

SEQ ID NO: 2275359 - protein, 5 aa, Cryptosporidium parvum
PNSWP

SEQ ID NO: 2275360 - protein, 6 aa, Cryptosporidium parvum
PNTEQQ

SEQ ID NO: 2275361 - protein, 7 aa, Cryptosporidium parvum
PNTITNP

SEQ ID NO: 2275362 - protein, 8 aa, Cryptosporidium parvum
PNTLNGKK

SEQ ID NO: 2275363 - protein, 5 aa, Cryptosporidium parvum
PNTLP

SEQ ID NO: 2275364 - protein, 13 aa, Cryptosporidium parvum
PNTLREGGSNPNI

SEQ ID NO: 2275365 - protein, 5 aa, Cryptosporidium parvum
PNTMN

SEQ ID NO: 2275366 - protein, 7 aa, Cryptosporidium parvum
PNTNTIS

SEQ ID NO: 2275367 - protein, 8 aa, Cryptosporidium parvum
PNTNTNNN

SEQ ID NO: 2275368 - protein, 5 aa, Cryptosporidium parvum
PNTPF

SEQ ID NO: 2275369 - protein, 14 aa, Cryptosporidium parvum
PNTPIDDEASRRSN

SEQ ID NO: 2275370 - protein, 9 aa, Cryptosporidium parvum
PNTRPFSNS

SEQ ID NO: 2275371 - protein, 7 aa, Cryptosporidium parvum
PNTSNES

SEQ ID NO: 2275372 - protein, 10 aa, Cryptosporidium parvum
PNTYYDDEKK

SEQ ID NO: 2275373 - protein, 4 aa, Cryptosporidium parvum
PNWP

SEQ ID NO: 2275374 - protein, 6 aa, Cryptosporidium parvum
PNYEEN

SEQ ID NO: 2275375 - protein, 7 aa, Cryptosporidium parvum
PNYKDRR

SEQ ID NO: 2275376 - protein, 5 aa, Cryptosporidium parvum
PNYKG

SEQ ID NO: 2275377 - protein, 6 aa, Cryptosporidium parvum
PNYLRN

SEQ ID NO: 2275378 - protein, 7 aa, Cryptosporidium parvum
PNYNEKR

SEQ ID NO: 2275379 - protein, 8 aa, Cryptosporidium parvum
PNYNGDDD

SEQ ID NO: 2275380 - protein, 5 aa, Cryptosporidium parvum
PNYPD

SEQ ID NO: 2275381 - protein, 10 aa, Cryptosporidium parvum
PNYPIERSSG

SEQ ID NO: 2275382 - protein, 7 aa, Cryptosporidium parvum
PNYPRKQ

SEQ ID NO: 2275383 - protein, 6 aa, Cryptosporidium parvum
PNYPTL

SEQ ID NO: 2275384 - protein, 15 aa, Cryptosporidium parvum
PNYTTNSKNTNVRSA

SEQ ID NO: 2275385 - protein, 4 aa, Cryptosporidium parvum
PPAF

SEQ ID NO: 2275386 - protein, 1131 aa, Cryptosporidium parvum
PPAKKEAPAAPLKKDAPAAPAAPPAKKDAPAAPLKKDAPAAPAAPPAKKDAPAAPAAPPAKKDAPAAPLKKDAPVAPTAPPAKKDAPAAPLKKDVPAAPLKKDAPTTPAAPPAKKDAPAAPLKKDAPAAPLKKDAPAAPAAPPAKKDAPAAPAAPAAPPAKKDAPAAPLKKDAPAAPAAPPAKKDAPAAPAAPPAKKDAPAAPAAPPAKKDAPAAPLKKDAPAAPAAPPAKKDAPAAPAAPLKKDAPAAPAAPPAKKDAPAAPLKKDAPAAPAAPPAKKDAPAAPAAPPAKKDAPAAPLKKDAPAAPVAPPAKKDAPAAPPAKKDAPAAPLKKDAPTPPAKDAPAAPPMKKDAPAAPPMKKGAPPAPESPAKDAPAAPPAKKDAPTAPLKKDAPAVPTAPPAKKDAPAAPPMKKDAPAVPATPPAKKDAPATPATPAAPPAKKDAPAAPPMKKDAPAVPATPPAKKDAPAAPAAPPAKKDAPAAPAAPPAKKDAPAAPAAPLKKDAPAAPAAPPAKKDAPAVPTAPPAKKDAPAAPPAKKDAPAAPPMKKDAPAVPTAPPAKKDAPAAPPMKKDVPAAPPMKKDAPAAPPAKDAPPAPESPAKKDAPVPPPAKKDAPAAPPMKKDAPAALPAKKDAPAVPAAPPVKKDAPASPPMKKDAPPAPESPAKDAPAAPPAKKDAPTAPLKKDAPAVPTAPPAKKDAPAAPPMKKDAPAVPAAPPAKKDAPAAPAAPPAKKDAPAAPPAKKDAPAAPPAKKDAPAAPPAKKDAPAAPPVKKDAPPAPESPAKDAPASPLAKKDAPAAPPMKKDAPAAPAAPPAKKDAPAAPPAKKDAPAAPPAKKDTPAAPPAKKDAPAAPPAKKDAPAAPPAKKDAPAAPPAKKDAPAPESPAKDAPAAPPMKKDAPAAPPAKKDAPAPPAKDAPVAPPAKKDAPAPPAKDAPASPPAKKDAPAPPPMKKDAPAAPPMKKDAPVPPESPAKDIPAAPPAKKDAPAAPPMKKDAPAAPPMKKDAPAAPPMKKDAPPAPESPAKDAPAPPPAKKDAPAVPPMKKDAPAAPPMKKDAPAAPDSPAKDAPAIPPAKKDAPLSPTMKKGAPTSPPMKKDLPSAPPMKKDAPTAPAPIKKSPPIPIKKEAP

SEQ ID NO: 2275387 - protein, 7 aa, Cryptosporidium parvum
PPAKNKV

SEQ ID NO: 2275388 - protein, 5 aa, Cryptosporidium parvum
PPAND

SEQ ID NO: 2275389 - protein, 6 aa, Cryptosporidium parvum
PPAPET

SEQ ID NO: 2275390 - protein, 8 aa, Cryptosporidium parvum
PPAPRGVP

SEQ ID NO: 2275391 - protein, 19 aa, Cryptosporidium parvum
PPAPSSQTDLANSTSAESL

SEQ ID NO: 2275392 - protein, 5 aa, Cryptosporidium parvum
PPDED

SEQ ID NO: 2275393 - protein, 7 aa, Cryptosporidium parvum
PPDFPKD

SEQ ID NO: 2275394 - protein, 4 aa, Cryptosporidium parvum
PPDL

SEQ ID NO: 2275395 - protein, 10 aa, Cryptosporidium parvum
PPDPMRGQSE

SEQ ID NO: 2275396 - protein, 5 aa, Cryptosporidium parvum
PPDSG

SEQ ID NO: 2275397 - protein, 7 aa, Cryptosporidium parvum
PPDSPNF

SEQ ID NO: 2275398 - protein, 7 aa, Cryptosporidium parvum
PPEADSS

SEQ ID NO: 2275399 - protein, 10 aa, Cryptosporidium parvum
PPEDPKIKES

SEQ ID NO: 2275400 - protein, 8 aa, Cryptosporidium parvum
PPEEGPVN

SEQ ID NO: 2275401 - protein, 4 aa, Cryptosporidium parvum
PPEH

SEQ ID NO: 2275402 - protein, 5 aa, Cryptosporidium parvum
PPEIQ

SEQ ID NO: 2275403 - protein, 5 aa, Cryptosporidium parvum
PPEKA

SEQ ID NO: 2275404 - protein, 10 aa, Cryptosporidium parvum
PPEKSTLPEY

SEQ ID NO: 2275405 - protein, 19 aa, Cryptosporidium parvum
PPELPERVNPDPGTGGAMT

SEQ ID NO: 2275406 - protein, 6 aa, Cryptosporidium parvum
PPENFE

SEQ ID NO: 2275407 - protein, 11 aa, Cryptosporidium parvum
PPESKSTKPTS

SEQ ID NO: 2275408 - protein, 6 aa, Cryptosporidium parvum
PPEYEN

SEQ ID NO: 2275409 - protein, 5 aa, Cryptosporidium parvum
PPFFG

SEQ ID NO: 2275410 - protein, 16 aa, Cryptosporidium parvum
PPFKSHNDLSASQDSF

SEQ ID NO: 2275411 - protein, 6 aa, Cryptosporidium parvum
PPFSGD

SEQ ID NO: 2275412 - protein, 12 aa, Cryptosporidium parvum
PPGGPVLENSKT

SEQ ID NO: 2275413 - protein, 5 aa, Cryptosporidium parvum
PPGNN

SEQ ID NO: 2275414 - protein, 14 aa, Cryptosporidium parvum
PPGNNNSNYMFNFR

SEQ ID NO: 2275415 - protein, 4 aa, Cryptosporidium parvum
PPGT

SEQ ID NO: 2275416 - protein, 6 aa, Cryptosporidium parvum
PPGTGD

SEQ ID NO: 2275417 - protein, 7 aa, Cryptosporidium parvum
PPGTGKT

SEQ ID NO: 2275418 - protein, 7 aa, Cryptosporidium parvum
PPGTTDV

SEQ ID NO: 2275419 - protein, 7 aa, Cryptosporidium parvum
PPGYAEQ

SEQ ID NO: 2275420 - protein, 12 aa, Cryptosporidium parvum
PPHLNDKEEDQD

SEQ ID NO: 2275421 - protein, 4 aa, Cryptosporidium parvum
PPHN

SEQ ID NO: 2275422 - protein, 10 aa, Cryptosporidium parvum
PPHSTRPKET

SEQ ID NO: 2275423 - protein, 47 aa, Cryptosporidium parvum
PPIPPVPPIPPVPPIPPVPPIPPVPPIPPVPPIPPVPPIPPIPPIPA

SEQ ID NO: 2275424 - protein, 6 aa, Cryptosporidium parvum
PPIPSL

SEQ ID NO: 2275425 - protein, 28 aa, Cryptosporidium parvum
PPIQSGPARASRNSSNIRRSSTSPPPHM

SEQ ID NO: 2275426 - protein, 7 aa, Cryptosporidium parvum
PPIQTRT

SEQ ID NO: 2275427 - protein, 8 aa, Cryptosporidium parvum
PPISANDD

SEQ ID NO: 2275428 - protein, 23 aa, Cryptosporidium parvum
PPKGKKNKRRQNSSSNNSSSAHK

SEQ ID NO: 2275429 - protein, 10 aa, Cryptosporidium parvum
PPKGLNASSE

SEQ ID NO: 2275430 - protein, 55 aa, Cryptosporidium parvum
PPKHPGKDETMDTQNGRSGENHKGEKTKKDDDYDSDEDDFDNDYSGNTIESDDEN

SEQ ID NO: 2275431 - protein, 5 aa, Cryptosporidium parvum
PPKID

SEQ ID NO: 2275432 - protein, 8 aa, Cryptosporidium parvum
PPKIEGTS

SEQ ID NO: 2275433 - protein, 4 aa, Cryptosporidium parvum
PPKK

SEQ ID NO: 2275434 - protein, 6 aa, Cryptosporidium parvum
PPKKSW

SEQ ID NO: 2275435 - protein, 5 aa, Cryptosporidium parvum
PPKLT

SEQ ID NO: 2275436 - protein, 4 aa, Cryptosporidium parvum
PPKP

SEQ ID NO: 2275437 - protein, 7 aa, Cryptosporidium parvum
PPKRGSQ

SEQ ID NO: 2275438 - protein, 17 aa, Cryptosporidium parvum
PPKRYSNSDHPWNIELL

SEQ ID NO: 2275439 - protein, 6 aa, Cryptosporidium parvum
PPKSGK

SEQ ID NO: 2275440 - protein, 11 aa, Cryptosporidium parvum
PPKTSSSSHDQ

SEQ ID NO: 2275441 - protein, 11 aa, Cryptosporidium parvum
PPKVPGISSNN

SEQ ID NO: 2275442 - protein, 4 aa, Cryptosporidium parvum
PPKY

SEQ ID NO: 2275443 - protein, 5 aa, Cryptosporidium parvum
PPLEP

SEQ ID NO: 2275444 - protein, 7 aa, Cryptosporidium parvum
PPLPPQN

SEQ ID NO: 2275445 - protein, 11 aa, Cryptosporidium parvum
PPLSDPGQNSL

SEQ ID NO: 2275446 - protein, 5 aa, Cryptosporidium parvum
PPLSP

SEQ ID NO: 2275447 - protein, 10 aa, Cryptosporidium parvum
PPLSSKQKYE

SEQ ID NO: 2275448 - protein, 5 aa, Cryptosporidium parvum
PPMED

SEQ ID NO: 2275449 - protein, 4 aa, Cryptosporidium parvum
PPND

SEQ ID NO: 2275450 - protein, 13 aa, Cryptosporidium parvum
PPNDGSINSPYNG

SEQ ID NO: 2275451 - protein, 8 aa, Cryptosporidium parvum
PPNDQENK

SEQ ID NO: 2275452 - protein, 6 aa, Cryptosporidium parvum
PPNEVN

SEQ ID NO: 2275453 - protein, 11 aa, Cryptosporidium parvum
PPNGSAPMSMG

SEQ ID NO: 2275454 - protein, 5 aa, Cryptosporidium parvum
PPNHT

SEQ ID NO: 2275455 - protein, 5 aa, Cryptosporidium parvum
PPNIH

SEQ ID NO: 2275456 - protein, 5 aa, Cryptosporidium parvum
PPNIS

SEQ ID NO: 2275457 - protein, 5 aa, Cryptosporidium parvum
PPNKN

SEQ ID NO: 2275458 - protein, 12 aa, Cryptosporidium parvum
PPNLSNQASNRT

SEQ ID NO: 2275459 - protein, 5 aa, Cryptosporidium parvum
PPNPV

SEQ ID NO: 2275460 - protein, 7 aa, Cryptosporidium parvum
PPNSLAE

SEQ ID NO: 2275461 - protein, 8 aa, Cryptosporidium parvum
PPNSNISI

SEQ ID NO: 2275462 - protein, 11 aa, Cryptosporidium parvum
PPNSRVGSSGA

SEQ ID NO: 2275463 - protein, 6 aa, Cryptosporidium parvum
PPNTTF

SEQ ID NO: 2275464 - protein, 5 aa, Cryptosporidium parvum
PPPEY

SEQ ID NO: 2275465 - protein, 12 aa, Cryptosporidium parvum
PPPIQPPEKIPG

SEQ ID NO: 2275466 - protein, 7 aa, Cryptosporidium parvum
PPPLTSR

SEQ ID NO: 2275467 - protein, 6 aa, Cryptosporidium parvum
PPPNVT

SEQ ID NO: 2275468 - protein, 8 aa, Cryptosporidium parvum
PPPPDYFP

SEQ ID NO: 2275469 - protein, 6 aa, Cryptosporidium parvum
PPPPET

SEQ ID NO: 2275470 - protein, 8 aa, Cryptosporidium parvum
PPPPKNIN

SEQ ID NO: 2275471 - protein, 14 aa, Cryptosporidium parvum
PPPPPHLNPPIPGH

SEQ ID NO: 2275472 - protein, 6 aa, Cryptosporidium parvum
PPPPPL

SEQ ID NO: 2275473 - protein, 7 aa, Cryptosporidium parvum
PPPPPLL

SEQ ID NO: 2275474 - protein, 22 aa, Cryptosporidium parvum
PPPPPNHRAGSNRLYGASKAKN

SEQ ID NO: 2275475 - protein, 13 aa, Cryptosporidium parvum
PPPPPPPSKTSGA

SEQ ID NO: 2275476 - protein, 7 aa, Cryptosporidium parvum
PPPQSRN

SEQ ID NO: 2275477 - protein, 8 aa, Cryptosporidium parvum
PPPQSSSE

SEQ ID NO: 2275478 - protein, 4 aa, Cryptosporidium parvum
PPPS

SEQ ID NO: 2275479 - protein, 4 aa, Cryptosporidium parvum
PPPT

SEQ ID NO: 2275480 - protein, 5 aa, Cryptosporidium parvum
PPPVL

SEQ ID NO: 2275481 - protein, 14 aa, Cryptosporidium parvum
PPQDHSHQNQLEKE

SEQ ID NO: 2275482 - protein, 5 aa, Cryptosporidium parvum
PPQGP

SEQ ID NO: 2275483 - protein, 4 aa, Cryptosporidium parvum
PPQI

SEQ ID NO: 2275484 - protein, 4 aa, Cryptosporidium parvum
PPQL

SEQ ID NO: 2275485 - protein, 7 aa, Cryptosporidium parvum
PPQMNGD

SEQ ID NO: 2275486 - protein, 25 aa, Cryptosporidium parvum
PPQPISGSESIELDENSSINIRETS

SEQ ID NO: 2275487 - protein, 15 aa, Cryptosporidium parvum
PPQPPASHSEDNSQI

SEQ ID NO: 2275488 - protein, 7 aa, Cryptosporidium parvum
PPQQDSK

SEQ ID NO: 2275489 - protein, 10 aa, Cryptosporidium parvum
PPQQSVEHSN

SEQ ID NO: 2275490 - protein, 11 aa, Cryptosporidium parvum
PPQTSRPDSTH

SEQ ID NO: 2275491 - protein, 15 aa, Cryptosporidium parvum
PPRAGASSSENAQKT

SEQ ID NO: 2275492 - protein, 5 aa, Cryptosporidium parvum
PPRDI

SEQ ID NO: 2275493 - protein, 6 aa, Cryptosporidium parvum
PPRSRP

SEQ ID NO: 2275494 - protein, 8 aa, Cryptosporidium parvum
PPSEASMT

SEQ ID NO: 2275495 - protein, 10 aa, Cryptosporidium parvum
PPSEDQPQGM

SEQ ID NO: 2275496 - protein, 6 aa, Cryptosporidium parvum
PPSGAI

SEQ ID NO: 2275497 - protein, 4 aa, Cryptosporidium parvum
PPSI

SEQ ID NO: 2275498 - protein, 6 aa, Cryptosporidium parvum
PPSIND

SEQ ID NO: 2275499 - protein, 10 aa, Cryptosporidium parvum
PPSKKLTQEE

SEQ ID NO: 2275500 - protein, 7 aa, Cryptosporidium parvum
PPSLSSI

SEQ ID NO: 2275501 - protein, 5 aa, Cryptosporidium parvum
PPSNE

SEQ ID NO: 2275502 - protein, 4 aa, Cryptosporidium parvum
PPSP

SEQ ID NO: 2275503 - protein, 28 aa, Cryptosporidium parvum
PPSRLQNRPAATASTKHPSSKARSNFNN

SEQ ID NO: 2275504 - protein, 9 aa, Cryptosporidium parvum
PPSSSSIST

SEQ ID NO: 2275505 - protein, 15 aa, Cryptosporidium parvum
PPSTPSSGSRSTSAS

SEQ ID NO: 2275506 - protein, 11 aa, Cryptosporidium parvum
PPSTSVSPSNY

SEQ ID NO: 2275507 - protein, 18 aa, Cryptosporidium parvum
PPTAPESQNNSPTRENDN

SEQ ID NO: 2275508 - protein, 8 aa, Cryptosporidium parvum
PPTDDSNV

SEQ ID NO: 2275509 - protein, 4 aa, Cryptosporidium parvum
PPTF

SEQ ID NO: 2275510 - protein, 9 aa, Cryptosporidium parvum
PPTIEEDEE

SEQ ID NO: 2275511 - protein, 19 aa, Cryptosporidium parvum
PPTIPTSELGTNPQNYASG

SEQ ID NO: 2275512 - protein, 6 aa, Cryptosporidium parvum
PPTISE

SEQ ID NO: 2275513 - protein, 4 aa, Cryptosporidium parvum
PPTL

SEQ ID NO: 2275514 - protein, 5 aa, Cryptosporidium parvum
PPTQR

SEQ ID NO: 2275515 - protein, 6 aa, Cryptosporidium parvum
PPTRAF

SEQ ID NO: 2275516 - protein, 8 aa, Cryptosporidium parvum
PPTRQGYP

SEQ ID NO: 2275517 - protein, 13 aa, Cryptosporidium parvum
PPTTTSASISAHP

SEQ ID NO: 2275518 - protein, 4 aa, Cryptosporidium parvum
PPVP

SEQ ID NO: 2275519 - protein, 5 aa, Cryptosporidium parvum
PPVPS

SEQ ID NO: 2275520 - protein, 4 aa, Cryptosporidium parvum
PPVS

SEQ ID NO: 2275521 - protein, 4 aa, Cryptosporidium parvum
PPVT

SEQ ID NO: 2275522 - protein, 13 aa, Cryptosporidium parvum
PPVTNKAEKGEVI

SEQ ID NO: 2275523 - protein, 4 aa, Cryptosporidium parvum
PPVV

SEQ ID NO: 2275524 - protein, 7 aa, Cryptosporidium parvum
PPWGGYS

SEQ ID NO: 2275525 - protein, 6 aa, Cryptosporidium parvum
PPWGKI

SEQ ID NO: 2275526 - protein, 4 aa, Cryptosporidium parvum
PPWN

SEQ ID NO: 2275527 - protein, 5 aa, Cryptosporidium parvum
PPYGT

SEQ ID NO: 2275528 - protein, 5 aa, Cryptosporidium parvum
PPYLP

SEQ ID NO: 2275529 - protein, 8 aa, Cryptosporidium parvum
PPYNDDGM

SEQ ID NO: 2275530 - protein, 16 aa, Cryptosporidium parvum
PQAPNVDSTYRNEGNL

SEQ ID NO: 2275531 - protein, 5 aa, Cryptosporidium parvum
PQAPP

SEQ ID NO: 2275532 - protein, 5 aa, Cryptosporidium parvum
PQDEY

SEQ ID NO: 2275533 - protein, 15 aa, Cryptosporidium parvum
PQDRLDKRRKFNKSD

SEQ ID NO: 2275534 - protein, 8 aa, Cryptosporidium parvum
PQEHENGE

SEQ ID NO: 2275535 - protein, 4 aa, Cryptosporidium parvum
PQEN

SEQ ID NO: 2275536 - protein, 11 aa, Cryptosporidium parvum
PQESVDERNEI

SEQ ID NO: 2275537 - protein, 5 aa, Cryptosporidium parvum
PQETW

SEQ ID NO: 2275538 - protein, 4 aa, Cryptosporidium parvum
PQEV

SEQ ID NO: 2275539 - protein, 6 aa, Cryptosporidium parvum
PQFQPQ

SEQ ID NO: 2275540 - protein, 9 aa, Cryptosporidium parvum
PQGDKERIS

SEQ ID NO: 2275541 - protein, 6 aa, Cryptosporidium parvum
PQGLER

SEQ ID NO: 2275542 - protein, 30 aa, Cryptosporidium parvum
PQGQTNHSPAVSPIGQNANPASSAPSQPDS

SEQ ID NO: 2275543 - protein, 8 aa, Cryptosporidium parvum
PQGSDSSF

SEQ ID NO: 2275544 - protein, 11 aa, Cryptosporidium parvum
PQGSERIENAD

SEQ ID NO: 2275545 - protein, 6 aa, Cryptosporidium parvum
PQINEE

SEQ ID NO: 2275546 - protein, 4 aa, Cryptosporidium parvum
PQIP

SEQ ID NO: 2275547 - protein, 4 aa, Cryptosporidium parvum
PQIT

SEQ ID NO: 2275548 - protein, 6 aa, Cryptosporidium parvum
PQITPG

SEQ ID NO: 2275549 - protein, 68 aa, Cryptosporidium parvum
  misc_feature (27)..(27): Xaa can be any naturally occurring amino acid
  misc_feature (49)..(49): Xaa can be any naturally occurring amino acid
PQITPGAGISPQVVSGTGVNPQIASGXGVNPQITTGIGVNPQVVSGVGXNPQISPRIGVNSPTVAPGI

SEQ ID NO: 2275550 - protein, 16 aa, Cryptosporidium parvum
PQITTGIGTNPQIAPG

SEQ ID NO: 2275551 - protein, 10 aa, Cryptosporidium parvum
PQKDQPQEKS

SEQ ID NO: 2275552 - protein, 10 aa, Cryptosporidium parvum
PQKHPARDSH

SEQ ID NO: 2275553 - protein, 4 aa, Cryptosporidium parvum
PQKL

SEQ ID NO: 2275554 - protein, 28 aa, Cryptosporidium parvum
PQKNQKDDENLDSNLNSNTLSSSDSSSC

SEQ ID NO: 2275555 - protein, 8 aa, Cryptosporidium parvum
PQKPSDVS

SEQ ID NO: 2275556 - protein, 10 aa, Cryptosporidium parvum
PQLETNSSQA

SEQ ID NO: 2275557 - protein, 24 aa, Cryptosporidium parvum
PQLIEGKSRTVESKTSIEKNKDFN

SEQ ID NO: 2275558 - protein, 4 aa, Cryptosporidium parvum
PQLN

SEQ ID NO: 2275559 - protein, 9 aa, Cryptosporidium parvum
PQLNPPNHS

SEQ ID NO: 2275560 - protein, 7 aa, Cryptosporidium parvum
PQLPREG

SEQ ID NO: 2275561 - protein, 4 aa, Cryptosporidium parvum
PQND

SEQ ID NO: 2275562 - protein, 19 aa, Cryptosporidium parvum
PQNDNSSIEHNASTFTDKS

SEQ ID NO: 2275563 - protein, 8 aa, Cryptosporidium parvum
PQNESYYG

SEQ ID NO: 2275564 - protein, 34 aa, Cryptosporidium parvum; identical to SEQ ID NO: 2156549

SEQ ID NO: 2275565 - protein, 5 aa, Cryptosporidium parvum
PQNLT

SEQ ID NO: 2275566 - protein, 7 aa, Cryptosporidium parvum
PQNPKEK

SEQ ID NO: 2275567 - protein, 7 aa, Cryptosporidium parvum
PQNSSRV

SEQ ID NO: 2275568 - protein, 10 aa, Cryptosporidium parvum
PQNYPKKEVY

SEQ ID NO: 2275569 - protein, 5 aa, Cryptosporidium parvum
PQPDV

SEQ ID NO: 2275570 - protein, 6 aa, Cryptosporidium parvum
PQPGEK

SEQ ID NO: 2275571 - protein, 9 aa, Cryptosporidium parvum
PQPKEKPIT

SEQ ID NO: 2275572 - protein, 5 aa, Cryptosporidium parvum
PQPPF

SEQ ID NO: 2275573 - protein, 6 aa, Cryptosporidium parvum
PQPPRI

SEQ ID NO: 2275574 - protein, 7 aa, Cryptosporidium parvum
PQPSKRG

SEQ ID NO: 2275575 - protein, 7 aa, Cryptosporidium parvum
PQRDKFG

SEQ ID NO: 2275576 - protein, 4 aa, Cryptosporidium parvum
PQRK

SEQ ID NO: 2275577 - protein, 8 aa, Cryptosporidium parvum
PQRKYTTL

SEQ ID NO: 2275578 - protein, 5 aa, Cryptosporidium parvum
PQRTG

SEQ ID NO: 2275579 - protein, 6 aa, Cryptosporidium parvum
PQSAQN

SEQ ID NO: 2275580 - protein, 8 aa, Cryptosporidium parvum
PQSCQNKK

SEQ ID NO: 2275581 - protein, 9 aa, Cryptosporidium parvum
PQSGNSVSV

SEQ ID NO: 2275582 - protein, 10 aa, Cryptosporidium parvum
PQSKKFKSSN

SEQ ID NO: 2275583 - protein, 17 aa, Cryptosporidium parvum
PQSTSSLRGPQDTPQGN

SEQ ID NO: 2275584 - protein, 5 aa, Cryptosporidium parvum
PQTGH

SEQ ID NO: 2275585 - protein, 7 aa, Cryptosporidium parvum
PQTNQVR

SEQ ID NO: 2275586 - protein, 4 aa, Cryptosporidium parvum
PQVS

SEQ ID NO: 2275587 - protein, 5 aa, Cryptosporidium parvum
PQVTR

SEQ ID NO: 2275588 - protein, 16 aa, Cryptosporidium parvum
PRAGQKGYGQRTETNK

SEQ ID NO: 2275589 - protein, 7 aa, Cryptosporidium parvum
PRAISPS

SEQ ID NO: 2275590 - protein, 9 aa, Cryptosporidium parvum
PRAKKKVSM

SEQ ID NO: 2275591 - protein, 7 aa, Cryptosporidium parvum
PRANAHS

SEQ ID NO: 2275592 - protein, 10 aa, Cryptosporidium parvum
PRARSSNPQR

SEQ ID NO: 2275593 - protein, 10 aa, Cryptosporidium parvum
PRDAQDAVNR

SEQ ID NO: 2275594 - protein, 6 aa, Cryptosporidium parvum
PRDIEK

SEQ ID NO: 2275595 - protein, 5 aa, Cryptosporidium parvum
PRDSA

SEQ ID NO: 2275596 - protein, 5 aa, Cryptosporidium parvum
PRDSG

SEQ ID NO: 2275597 - protein, 6 aa, Cryptosporidium parvum
PRDSTY

SEQ ID NO: 2275598 - protein, 4 aa, Cryptosporidium parvum
PRED

SEQ ID NO: 2275599 - protein, 8 aa, Cryptosporidium parvum
PREGNRSK

SEQ ID NO: 2275600 - protein, 9 aa, Cryptosporidium parvum
PRENCNNSS

SEQ ID NO: 2275601 - protein, 12 aa, Cryptosporidium parvum
PREQEKKNEELY

SEQ ID NO: 2275602 - protein, 6 aa, Cryptosporidium parvum
PREQTT

SEQ ID NO: 2275603 - protein, 7 aa, Cryptosporidium parvum
PRETVTE

SEQ ID NO: 2275604 - protein, 6 aa, Cryptosporidium parvum
PRGNAS

SEQ ID NO: 2275605 - protein, 5 aa, Cryptosporidium parvum
PRGNN

SEQ ID NO: 2275606 - protein, 5 aa, Cryptosporidium parvum
PRGRR

SEQ ID NO: 2275607 - protein, 11 aa, Cryptosporidium parvum
PRGSTDKENMQ

SEQ ID NO: 2275608 - protein, 6 aa, Cryptosporidium parvum
PRHQSA

SEQ ID NO: 2275609 - protein, 22 aa, Cryptosporidium parvum
PRHRDSSKSVQLSSVNSNSNMM

SEQ ID NO: 2275610 - protein, 4 aa, Cryptosporidium parvum
PRIE

SEQ ID NO: 2275611 - protein, 4 aa, Cryptosporidium parvum
PRIN

SEQ ID NO: 2275612 - protein, 10 aa, Cryptosporidium parvum
PRINKTDSEN

SEQ ID NO: 2275613 - protein, 5 aa, Cryptosporidium parvum
PRISQ

SEQ ID NO: 2275614 - protein, 27 aa, Cryptosporidium parvum
PRKCSRSNANSQTPANERENSSIRRSN

SEQ ID NO: 2275615 - protein, 25 aa, Cryptosporidium parvum
PRKEDREPNDPQTPNAHTRCPQKQF

SEQ ID NO: 2275616 - protein, 14 aa, Cryptosporidium parvum
PRKGCKDDGSHPPI

SEQ ID NO: 2275617 - protein, 23 aa, Cryptosporidium parvum
PRKGKKTKKGFAGIPNDSAREEF

SEQ ID NO: 2275618 - protein, 4 aa, Cryptosporidium parvum
PRKI

SEQ ID NO: 2275619 - protein, 21 aa, Cryptosporidium parvum
PRKKTQRSHSQKLKQDKKQTS

SEQ ID NO: 2275620 - protein, 8 aa, Cryptosporidium parvum
PRKPNMTR

SEQ ID NO: 2275621 - protein, 4 aa, Cryptosporidium parvum
PRLH

SEQ ID NO: 2275622 - protein, 7 aa, Cryptosporidium parvum
PRNGKES

SEQ ID NO: 2275623 - protein, 4 aa, Cryptosporidium parvum
PRNH

SEQ ID NO: 2275624 - protein, 7 aa, Cryptosporidium parvum
PRNKTSL

SEQ ID NO: 2275625 - protein, 4 aa, Cryptosporidium parvum
PRNL

SEQ ID NO: 2275626 - protein, 6 aa, Cryptosporidium parvum
PRNPSQ

SEQ ID NO: 2275627 - protein, 9 aa, Cryptosporidium parvum
PRNSPDVTK

SEQ ID NO: 2275628 - protein, 4 aa, Cryptosporidium parvum
PRNT

SEQ ID NO: 2275629 - protein, 4 aa, Cryptosporidium parvum
PRNY

SEQ ID NO: 2275630 - protein, 4 aa, Cryptosporidium parvum
PRPI

SEQ ID NO: 2275631 - protein, 5 aa, Cryptosporidium parvum
PRPSF

SEQ ID NO: 2275632 - protein, 5 aa, Cryptosporidium parvum
PRPVP

SEQ ID NO: 2275633 - protein, 21 aa, Cryptosporidium parvum
PRPWKGGDNSSNGPKDSTGDD

SEQ ID NO: 2275634 - protein, 11 aa, Cryptosporidium parvum
PRQDMSSNAQN

SEQ ID NO: 2275635 - protein, 21 aa, Cryptosporidium parvum
PRQKNTTNIQDSNVKPPPSDI

SEQ ID NO: 2275636 - protein, 7 aa, Cryptosporidium parvum
PRQPTLS

SEQ ID NO: 2275637 - protein, 22 aa, Cryptosporidium parvum
PRRCEPKKFGGPGARARIQKSY

SEQ ID NO: 2275638 - protein, 11 aa, Cryptosporidium parvum
PRRRDKSEDLT

SEQ ID NO: 2275639 - protein, 8 aa, Cryptosporidium parvum
PRRRGVKE

SEQ ID NO: 2275640 - protein, 4 aa, Cryptosporidium parvum
PRSA

SEQ ID NO: 2275641 - protein, 5 aa, Cryptosporidium parvum
PRSER

SEQ ID NO: 2275642 - protein, 10 aa, Cryptosporidium parvum
PRSKTRSTYI

SEQ ID NO: 2275643 - protein, 13 aa, Cryptosporidium parvum
PRSNPNMLQRYPG

SEQ ID NO: 2275644 - protein, 5 aa, Cryptosporidium parvum
PRSPL

SEQ ID NO: 2275645 - protein, 8 aa, Cryptosporidium parvum
PRSRSEKK

SEQ ID NO: 2275646 - protein, 12 aa, Cryptosporidium parvum
PRSRYSKKKTKL

SEQ ID NO: 2275647 - protein, 5 aa, Cryptosporidium parvum
PRSVG

SEQ ID NO: 2275648 - protein, 10 aa, Cryptosporidium parvum
PRTGANPPIV

SEQ ID NO: 2275649 - protein, 6 aa, Cryptosporidium parvum
PRTGGA

SEQ ID NO: 2275650 - protein, 13 aa, Cryptosporidium parvum
PRTKSKQKLPSGR

SEQ ID NO: 2275651 - protein, 7 aa, Cryptosporidium parvum
PRTNTDF

SEQ ID NO: 2275652 - protein, 4 aa, Cryptosporidium parvum
PRTP

SEQ ID NO: 2275653 - protein, 9 aa, Cryptosporidium parvum
PRTPDEAKV

SEQ ID NO: 2275654 - protein, 5 aa, Cryptosporidium parvum
PRTRD

SEQ ID NO: 2275655 - protein, 6 aa, Cryptosporidium parvum
PRVDSQ

SEQ ID NO: 2275656 - protein, 6 aa, Cryptosporidium parvum
PRVSTT

SEQ ID NO: 2275657 - protein, 4 aa, Cryptosporidium parvum
PRYG

SEQ ID NO: 2275658 - protein, 7 aa, Cryptosporidium parvum
PRYGRHR

SEQ ID NO: 2275659 - protein, 10 aa, Cryptosporidium parvum
PRYHPKSKPF

SEQ ID NO: 2275660 - protein, 9 aa, Cryptosporidium parvum
PRYSDTGKM

SEQ ID NO: 2275661 - protein, 5 aa, Cryptosporidium parvum
PSAEN

SEQ ID NO: 2275662 - protein, 7 aa, Cryptosporidium parvum
PSAGQDS

SEQ ID NO: 2275663 - protein, 4 aa, Cryptosporidium parvum
PSAK

SEQ ID NO: 2275664 - protein, 6 aa, Cryptosporidium parvum
PSAKNS

SEQ ID NO: 2275665 - protein, 4 aa, Cryptosporidium parvum
PSAP

SEQ ID NO: 2275666 - protein, 5 aa, Cryptosporidium parvum
PSASI

SEQ ID NO: 2275667 - protein, 9 aa, Cryptosporidium parvum
PSATESTSM

SEQ ID NO: 2275668 - protein, 6 aa, Cryptosporidium parvum
PSCGKS

SEQ ID NO: 2275669 - protein, 5 aa, Cryptosporidium parvum
PSCGN

SEQ ID NO: 2275670 - protein, 97 aa, Cryptosporidium parvum
PSDDPLAQKPPSYPPSKPQMPPPYQKPPSYPQPKPQIPPPYQKPPSYPQPKPQIPPPYQKPPSYPPSKPQIPPPYQKPPSYPQPKPQISTSSGGQQV

SEQ ID NO: 2275671 - protein, 12 aa, Cryptosporidium parvum
PSDENSAQGEST

SEQ ID NO: 2275672 - protein, 6 aa, Cryptosporidium parvum
PSDGTK

SEQ ID NO: 2275673 - protein, 10 aa, Cryptosporidium parvum
PSDIFGSEKS

SEQ ID NO: 2275674 - protein, 7 aa, Cryptosporidium parvum
PSDKECR

SEQ ID NO: 2275675 - protein, 13 aa, Cryptosporidium parvum
PSDKIDEKANELK

SEQ ID NO: 2275676 - protein, 7 aa, Cryptosporidium parvum
PSDLEEE

SEQ ID NO: 2275677 - protein, 7 aa, Cryptosporidium parvum
PSDLTNN

SEQ ID NO: 2275678 - protein, 8 aa, Cryptosporidium parvum
PSDNEPPP

SEQ ID NO: 2275679 - protein, 11 aa, Cryptosporidium parvum
PSDNSKGEVDS

SEQ ID NO: 2275680 - protein, 13 aa, Cryptosporidium parvum
PSDSESGNDANLN

SEQ ID NO: 2275681 - protein, 7 aa, Cryptosporidium parvum
PSDTEHS

SEQ ID NO: 2275682 - protein, 6 aa, Cryptosporidium parvum
PSEAED

SEQ ID NO: 2275683 - protein, 8 aa, Cryptosporidium parvum
PSEEEDLS

SEQ ID NO: 2275684 - protein, 11 aa, Cryptosporidium parvum
PSEEKDRESYL

SEQ ID NO: 2275685 - protein, 20 aa, Cryptosporidium parvum
PSEGDSNQKISDSKNTIETG

SEQ ID NO: 2275686 - protein, 16 aa, Cryptosporidium parvum
PSEKRPKNRNNHASAV

SEQ ID NO: 2275687 - protein, 9 aa, Cryptosporidium parvum
PSENDKDLT

SEQ ID NO: 2275688 - protein, 6 aa, Cryptosporidium parvum
PSENLT

SEQ ID NO: 2275689 - protein, 13 aa, Cryptosporidium parvum
PSENSEDGNIPIT

SEQ ID NO: 2275690 - protein, 7 aa, Cryptosporidium parvum
PSEPIGS

SEQ ID NO: 2275691 - protein, 10 aa, Cryptosporidium parvum
PSESAASSNV

SEQ ID NO: 2275692 - protein, 8 aa, Cryptosporidium parvum
PSESSTPV

SEQ ID NO: 2275693 - protein, 14 aa, Cryptosporidium parvum
PSETAGRYVTYRLV

SEQ ID NO: 2275694 - protein, 11 aa, Cryptosporidium parvum
PSETIDPNIHP

SEQ ID NO: 2275695 - protein, 5 aa, Cryptosporidium parvum
PSETP

SEQ ID NO: 2275696 - protein, 4 aa, Cryptosporidium parvum
PSEV

SEQ ID NO: 2275697 - protein, 6 aa, Cryptosporidium parvum
PSEVNG

SEQ ID NO: 2275698 - protein, 6 aa, Cryptosporidium parvum
PSEYSG

SEQ ID NO: 2275699 - protein, 13 aa, Cryptosporidium parvum
PSFENDSLESENN

SEQ ID NO: 2275700 - protein, 14 aa, Cryptosporidium parvum
PSFQTSSTVPNSPL

SEQ ID NO: 2275701 - protein, 12 aa, Cryptosporidium parvum
PSFRDEQPRGSI

SEQ ID NO: 2275702 - protein, 6 aa, Cryptosporidium parvum
PSFSSD

SEQ ID NO: 2275703 - protein, 4 aa, Cryptosporidium parvum
PSFT

SEQ ID NO: 2275704 - protein, 5 aa, Cryptosporidium parvum
PSGAY

SEQ ID NO: 2275705 - protein, 4 aa, Cryptosporidium parvum
PSGE

SEQ ID NO: 2275706 - protein, 4 aa, Cryptosporidium parvum
PSGF

SEQ ID NO: 2275707 - protein, 7 aa, Cryptosporidium parvum
PSGGESL

SEQ ID NO: 2275708 - protein, 8 aa, Cryptosporidium parvum
PSGGGKKV

SEQ ID NO: 2275709 - protein, 5 aa, Cryptosporidium parvum
PSGGI

SEQ ID NO: 2275710 - protein, 16 aa, Cryptosporidium parvum
PSGNDQGESVLKDSSE

SEQ ID NO: 2275711 - protein, 7 aa, Cryptosporidium parvum
PSGPSFS

SEQ ID NO: 2275712 - protein, 33 aa, Cryptosporidium parvum; identical to SEQ ID NO: 2156690

SEQ ID NO: 2275713 - protein, 7 aa, Cryptosporidium parvum
PSGTEEV

SEQ ID NO: 2275714 - protein, 8 aa, Cryptosporidium parvum
PSGVGSPG

SEQ ID NO: 2275715 - protein, 5 aa, Cryptosporidium parvum
PSGYN

SEQ ID NO: 2275716 - protein, 5 aa, Cryptosporidium parvum
PSHGQ

SEQ ID NO: 2275717 - protein, 4 aa, Cryptosporidium parvum
PSHT

SEQ ID NO: 2275718 - protein, 4 aa, Cryptosporidium parvum
PSHY

SEQ ID NO: 2275719 - protein, 6 aa, Cryptosporidium parvum
PSHYQG

SEQ ID NO: 2275720 - protein, 5 aa, Cryptosporidium parvum
PSIAT

SEQ ID NO: 2275721 - protein, 4 aa, Cryptosporidium parvum
PSID

SEQ ID NO: 2275722 - protein, 4 aa, Cryptosporidium parvum
PSIE

SEQ ID NO: 2275723 - protein, 6 aa, Cryptosporidium parvum
PSINKG

SEQ ID NO: 2275724 - protein, 5 aa, Cryptosporidium parvum
PSINN

SEQ ID NO: 2275725 - protein, 16 aa, Cryptosporidium parvum
PSIPEAKASSTIGEGT

SEQ ID NO: 2275726 - protein, 11 aa, Cryptosporidium parvum
PSIPEKTLNSA

SEQ ID NO: 2275727 - protein, 11 aa, Cryptosporidium parvum
PSIPNKEPERA

SEQ ID NO: 2275728 - protein, 4 aa, Cryptosporidium parvum
PSIS

SEQ ID NO: 2275729 - protein, 5 aa, Cryptosporidium parvum
PSISE

SEQ ID NO: 2275730 - protein, 6 aa, Cryptosporidium parvum
PSISEG

SEQ ID NO: 2275731 - protein, 4 aa, Cryptosporidium parvum
PSIY

SEQ ID NO: 2275732 - protein, 14 aa, Cryptosporidium parvum
PSKDKPYDAAKDSV

SEQ ID NO: 2275733 - protein, 6 aa, Cryptosporidium parvum
PSKDKS

SEQ ID NO: 2275734 - protein, 7 aa, Cryptosporidium parvum
PSKEHGA

SEQ ID NO: 2275735 - protein, 17 aa, Cryptosporidium parvum
PSKELNGATVQDSPTYQ

SEQ ID NO: 2275736 - protein, 7 aa, Cryptosporidium parvum
PSKFGKG

SEQ ID NO: 2275737 - protein, 10 aa, Cryptosporidium parvum
PSKFQDESTT

SEQ ID NO: 2275738 - protein, 7 aa, Cryptosporidium parvum
PSKGDKV

SEQ ID NO: 2275739 - protein, 12 aa, Cryptosporidium parvum
PSKGESSKASTN

SEQ ID NO: 2275740 - protein, 10 aa, Cryptosporidium parvum
PSKHNRQIRE

SEQ ID NO: 2275741 - protein, 16 aa, Cryptosporidium parvum
PSKISTGSEIKTQEAT

SEQ ID NO: 2275742 - protein, 11 aa, Cryptosporidium parvum
PSKKNNLETDI

SEQ ID NO: 2275743 - protein, 10 aa, Cryptosporidium parvum
PSKNEPKNLP

SEQ ID NO: 2275744 - protein, 9 aa, Cryptosporidium parvum
PSKNKKNNN

SEQ ID NO: 2275745 - protein, 75 aa, Cryptosporidium parvum
PSKPTIPNEPTFPNKPTVPNKPIVPNEPTVPNEPTVPNKPTVPNKPTIPNKPTVSNEPTVPSGSGGGDGDEGNYP

SEQ ID NO: 2275746 - protein, 4 aa, Cryptosporidium parvum
PSKR

SEQ ID NO: 2275747 - protein, 9 aa, Cryptosporidium parvum
PSKSNCDLR

SEQ ID NO: 2275748 - protein, 5 aa, Cryptosporidium parvum
PSKST

SEQ ID NO: 2275749 - protein, 8 aa, Cryptosporidium parvum
PSKSYALQ

SEQ ID NO: 2275750 - protein, 10 aa, Cryptosporidium parvum
PSKYGKERME

SEQ ID NO: 2275751 - protein, 5 aa, Cryptosporidium parvum
PSLDS

SEQ ID NO: 2275752 - protein, 8 aa, Cryptosporidium parvum
PSLPNYTQ

SEQ ID NO: 2275753 - protein, 7 aa, Cryptosporidium parvum
PSLPPNE

SEQ ID NO: 2275754 - protein, 5 aa, Cryptosporidium parvum
PSLPS

SEQ ID NO: 2275755 - protein, 20 aa, Cryptosporidium parvum
PSMGGEGGNHGGLGGNPVNT

SEQ ID NO: 2275756 - protein, 11 aa, Cryptosporidium parvum
PSNDNTQTVTT

SEQ ID NO: 2275757 - protein, 13 aa, Cryptosporidium parvum
PSNDSTKATSSIP

SEQ ID NO: 2275758 - protein, 14 aa, Cryptosporidium parvum
PSNEASKSNLTGYA

SEQ ID NO: 2275759 - protein, 12 aa, Cryptosporidium parvum
PSNEDVESIQSP

SEQ ID NO: 2275760 - protein, 10 aa, Cryptosporidium parvum
PSNEGSSIDL

SEQ ID NO: 2275761 - protein, 6 aa, Cryptosporidium parvum
PSNEKA

SEQ ID NO: 2275762 - protein, 10 aa, Cryptosporidium parvum
PSNESSTPIS

SEQ ID NO: 2275763 - protein, 6 aa, Cryptosporidium parvum
PSNETN

SEQ ID NO: 2275764 - protein, 7 aa, Cryptosporidium parvum
PSNFEGY

SEQ ID NO: 2275765 - protein, 7 aa, Cryptosporidium parvum
PSNGGYN

SEQ ID NO: 2275766 - protein, 8 aa, Cryptosporidium parvum
PSNGKDAK

SEQ ID NO: 2275767 - protein, 8 aa, Cryptosporidium parvum
PSNIPTSS

SEQ ID NO: 2275768 - protein, 8 aa, Cryptosporidium parvum
PSNITNDS

SEQ ID NO: 2275769 - protein, 4 aa, Cryptosporidium parvum
PSNL

SEQ ID NO: 2275770 - protein, 25 aa, Cryptosporidium parvum
PSNLSPKKSRAKRKVADAIKRVEIT

SEQ ID NO: 2275771 - protein, 9 aa, Cryptosporidium parvum
PSNNMTDSD

SEQ ID NO: 2275772 - protein, 7 aa, Cryptosporidium parvum
PSNNSEV

SEQ ID NO: 2275773 - protein, 9 aa, Cryptosporidium parvum
PSNNSGKRN

SEQ ID NO: 2275774 - protein, 76 aa, Cryptosporidium parvum
PSNNTGNQKFKANGRKNNNSSGNRTGNKSSLNPSNPKKNNNQKSSFVNGTNPEGTYSEPKVGSKTASISKSPVNDA

SEQ ID NO: 2275775 - protein, 7 aa, Cryptosporidium parvum
PSNPVQR

SEQ ID NO: 2275776 - protein, 5 aa, Cryptosporidium parvum
PSNQQ

SEQ ID NO: 2275777 - protein, 8 aa, Cryptosporidium parvum
PSNSDPFN

SEQ ID NO: 2275778 - protein, 13 aa, Cryptosporidium parvum
PSNSDQSRKSWTT

SEQ ID NO: 2275779 - protein, 7 aa, Cryptosporidium parvum
PSNSEIE

SEQ ID NO: 2275780 - protein, 9 aa, Cryptosporidium parvum
PSNSETSDC

SEQ ID NO: 2275781 - protein, 60 aa, Cryptosporidium parvum
PSNSGGSSPISKTENESNIKRRKSFSRSPSVSSIEGNNTQNPGKEKARKTSIYSSKNELS

SEQ ID NO: 2275782 - protein, 10 aa, Cryptosporidium parvum
PSNSKDLLPK

SEQ ID NO: 2275783 - protein, 6 aa, Cryptosporidium parvum
PSNSMN

SEQ ID NO: 2275784 - protein, 18 aa, Cryptosporidium parvum
PSNSTSMVGANSTGVLPS

SEQ ID NO: 2275785 - protein, 17 aa, Cryptosporidium parvum
PSNTTFEASDQDGDHIR

SEQ ID NO: 2275786 - protein, 6 aa, Cryptosporidium parvum
PSNVSS

SEQ ID NO: 2275787 - protein, 15 aa, Cryptosporidium parvum
PSNWGDSQADAESAA

SEQ ID NO: 2275788 - protein, 24 aa, Cryptosporidium parvum
PSNYTSSLQSDHPTSTDPNQTYAN

SEQ ID NO: 2275789 - protein, 9 aa, Cryptosporidium parvum
PSPAAAQKY

SEQ ID NO: 2275790 - protein, 8 aa, Cryptosporidium parvum
PSPALERT

SEQ ID NO: 2275791 - protein, 12 aa, Cryptosporidium parvum
PSPDFTKIPPED

SEQ ID NO: 2275792 - protein, 10 aa, Cryptosporidium parvum
PSPDGTTSSI

SEQ ID NO: 2275793 - protein, 5 aa, Cryptosporidium parvum
PSPEE

SEQ ID NO: 2275794 - protein, 4 aa, Cryptosporidium parvum
PSPF

SEQ ID NO: 2275795 - protein, 13 aa, Cryptosporidium parvum
PSPIGGNCEPKRI

SEQ ID NO: 2275796 - protein, 8 aa, Cryptosporidium parvum
PSPKVSDT

SEQ ID NO: 2275797 - protein, 15 aa, Cryptosporidium parvum
PSPNPKSGKWTTDST

SEQ ID NO: 2275798 - protein, 7 aa, Cryptosporidium parvum
PSPPKEK

SEQ ID NO: 2275799 - protein, 5 aa, Cryptosporidium parvum
PSPRN

SEQ ID NO: 2275800 - protein, 4 aa, Cryptosporidium parvum
PSQA

SEQ ID NO: 2275801 - protein, 6 aa, Cryptosporidium parvum
PSQEFD

SEQ ID NO: 2275802 - protein, 7 aa, Cryptosporidium parvum
PSQGDLD

SEQ ID NO: 2275803 - protein, 5 aa, Cryptosporidium parvum
PSQNW

SEQ ID NO: 2275804 - protein, 4 aa, Cryptosporidium parvum
PSQR

SEQ ID NO: 2275805 - protein, 4 aa, Cryptosporidium parvum
PSQS

SEQ ID NO: 2275806 - protein, 6 aa, Cryptosporidium parvum
PSRELD

SEQ ID NO: 2275807 - protein, 4 aa, Cryptosporidium parvum
PSRI

SEQ ID NO: 2275808 - protein, 4 aa, Cryptosporidium parvum
PSRK

SEQ ID NO: 2275809 - protein, 13 aa, Cryptosporidium parvum
PSRTPYVPQRDKS

SEQ ID NO: 2275810 - protein, 6 aa, Cryptosporidium parvum
PSRVGG

SEQ ID NO: 2275811 - protein, 12 aa, Cryptosporidium parvum
PSSASASSNIDS

SEQ ID NO: 2275812 - protein, 12 aa, Cryptosporidium parvum
PSSATRGQKPVH

SEQ ID NO: 2275813 - protein, 10 aa, Cryptosporidium parvum
PSSEEIERQK

SEQ ID NO: 2275814 - protein, 19 aa, Cryptosporidium parvum
PSSFGVSTKKNGMPDPAVR

SEQ ID NO: 2275815 - protein, 11 aa, Cryptosporidium parvum
PSSGAGNGNFT

SEQ ID NO: 2275816 - protein, 12 aa, Cryptosporidium parvum
PSSHNASTSQAA

SEQ ID NO: 2275817 - protein, 11 aa, Cryptosporidium parvum
PSSISANSRKV

SEQ ID NO: 2275818 - protein, 8 aa, Cryptosporidium parvum
PSSKSPIT

SEQ ID NO: 2275819 - protein, 4 aa, Cryptosporidium parvum
PSSL

SEQ ID NO: 2275820 - protein, 5 aa, Cryptosporidium parvum
PSSLD

SEQ ID NO: 2275821 - protein, 9 aa, Cryptosporidium parvum
PSSLNNNQN

SEQ ID NO: 2275822 - protein, 8 aa, Cryptosporidium parvum
PSSMNNQQ

SEQ ID NO: 2275823 - protein, 6 aa, Cryptosporidium parvum
PSSNEL

SEQ ID NO: 2275824 - protein, 7 aa, Cryptosporidium parvum
PSSNGRF

SEQ ID NO: 2275825 - protein, 8 aa, Cryptosporidium parvum
PSSNQGVY

SEQ ID NO: 2275826 - protein, 5 aa, Cryptosporidium parvum
PSSNT

SEQ ID NO: 2275827 - protein, 20 aa, Cryptosporidium parvum
PSSSDTTNADESNMTEKQRK

SEQ ID NO: 2275828 - protein, 38 aa, Cryptosporidium parvum
PSSSGKPTQNHGNISNNTNNFSGPKTISSNASQRPINP

SEQ ID NO: 2275829 - protein, 8 aa, Cryptosporidium parvum
PSSSKEGI

SEQ ID NO: 2275830 - protein, 15 aa, Cryptosporidium parvum
PSSSTPIRKSRSIRS

SEQ ID NO: 2275831 - protein, 13 aa, Cryptosporidium parvum
PSSTTTSYNIPPV

SEQ ID NO: 2275832 - protein, 4 aa, Cryptosporidium parvum
PSSY

SEQ ID NO: 2275833 - protein, 12 aa, Cryptosporidium parvum
PSTEGSSDKNIA

SEQ ID NO: 2275834 - protein, 10 aa, Cryptosporidium parvum
PSTFNSPSQY

SEQ ID NO: 2275835 - protein, 7 aa, Cryptosporidium parvum
PSTFPSE

SEQ ID NO: 2275836 - protein, 7 aa, Cryptosporidium parvum
PSTFRNK

SEQ ID NO: 2275837 - protein, 5 aa, Cryptosporidium parvum
PSTGQ

SEQ ID NO: 2275838 - protein, 5 aa, Cryptosporidium parvum
PSTKV

SEQ ID NO: 2275839 - protein, 6 aa, Cryptosporidium parvum
PSTLSS

SEQ ID NO: 2275840 - protein, 4 aa, Cryptosporidium parvum
PSTN

SEQ ID NO: 2275841 - protein, 24 aa, Cryptosporidium parvum
PSTNELNNEESDKQIASGSPKEEL

SEQ ID NO: 2275842 - protein, 17 aa, Cryptosporidium parvum
PSTNNQEEVKDGQTSGS

SEQ ID NO: 2275843 - protein, 15 aa, Cryptosporidium parvum
PSTPDPYSNTSKSCF

SEQ ID NO: 2275844 - protein, 4 aa, Cryptosporidium parvum
PSTS

SEQ ID NO: 2275845 - protein, 8 aa, Cryptosporidium parvum
PSVLNDPD

SEQ ID NO: 2275846 - protein, 21 aa, Cryptosporidium parvum
PSVLQTNSESLNEIDHPQNED

SEQ ID NO: 2275847 - protein, 4 aa, Cryptosporidium parvum
PSVN

SEQ ID NO: 2275848 - protein, 8 aa, Cryptosporidium parvum
PSVNNRQE

SEQ ID NO: 2275849 - protein, 4 aa, Cryptosporidium parvum
PSVP

SEQ ID NO: 2275850 - protein, 6 aa, Cryptosporidium parvum
PSVPTE

SEQ ID NO: 2275851 - protein, 16 aa, Cryptosporidium parvum
PSVPYTKNQKGYGPAW

SEQ ID NO: 2275852 - protein, 13 aa, Cryptosporidium parvum
PSVQGENSPLSPF

SEQ ID NO: 2275853 - protein, 23 aa, Cryptosporidium parvum
PSVSPKSWKGTPVTNEKKKSLSS

SEQ ID NO: 2275854 - protein, 5 aa, Cryptosporidium parvum
PSVSS

SEQ ID NO: 2275855 - protein, 6 aa, Cryptosporidium parvum
PSWEGY

SEQ ID NO: 2275856 - protein, 7 aa, Cryptosporidium parvum
PSYDSDI

SEQ ID NO: 2275857 - protein, 13 aa, Cryptosporidium parvum
PSYINSGNQSLSW

SEQ ID NO: 2275858 - protein, 4 aa, Cryptosporidium parvum
PSYK

SEQ ID NO: 2275859 - protein, 5 aa, Cryptosporidium parvum
PSYPL

SEQ ID NO: 2275860 - protein, 33 aa, Cryptosporidium parvum
PSYPRNGLSSALNNSKGTQFSQSFTTNNNLKQY

SEQ ID NO: 2275861 - protein, 22 aa, Cryptosporidium parvum
PSYSSENDQNNDLIKWSNLFGV

SEQ ID NO: 2275862 - protein, 5 aa, Cryptosporidium parvum
PTAAS

SEQ ID NO: 2275863 - protein, 67 aa, Cryptosporidium parvum
PTAASNSEESKSISSDSVSIKGTAGGASSSAISSSAASVSGSSQRLKPSKSNLNANSPGASGDPSLK

SEQ ID NO: 2275864 - protein, 9 aa, Cryptosporidium parvum
PTANNNGKL

SEQ ID NO: 2275865 - protein, 50 aa, Cryptosporidium parvum
PTAPKTQKQKKSKTKSENDSEDKGVNKSALSTSNKRQKTGSLSGKGTSGS

SEQ ID NO: 2275866 - protein, 6 aa, Cryptosporidium parvum
PTARTP

SEQ ID NO: 2275867 - protein, 6 aa, Cryptosporidium parvum
PTASGK

SEQ ID NO: 2275868 - protein, 8 aa, Cryptosporidium parvum
PTATSPDS

SEQ ID NO: 2275869 - protein, 6 aa, Cryptosporidium parvum
PTCESD

SEQ ID NO: 2275870 - protein, 5 aa, Cryptosporidium parvum
PTDIQ

SEQ ID NO: 2275871 - protein, 10 aa, Cryptosporidium parvum
PTDNKNSGKK

SEQ ID NO: 2275872 - protein, 7 aa, Cryptosporidium parvum
PTDPESP

SEQ ID NO: 2275873 - protein, 34 aa, Cryptosporidium parvum; identical to SEQ ID NO: 2156837

SEQ ID NO: 2275874 - protein, 6 aa, Cryptosporidium parvum
PTEDTI

SEQ ID NO: 2275875 - protein, 7 aa, Cryptosporidium parvum
PTEEDDR

SEQ ID NO: 2275876 - protein, 4 aa, Cryptosporidium parvum
PTEP

SEQ ID NO: 2275877 - protein, 10 aa, Cryptosporidium parvum
PTEQLTPSSF

SEQ ID NO: 2275878 - protein, 5 aa, Cryptosporidium parvum
PTERE

SEQ ID NO: 2275879 - protein, 8 aa, Cryptosporidium parvum
PTESAANA

SEQ ID NO: 2275880 - protein, 7 aa, Cryptosporidium parvum
PTESEIT

SEQ ID NO: 2275881 - protein, 17 aa, Cryptosporidium parvum
PTESSINKLSSTELENM

SEQ ID NO: 2275882 - protein, 11 aa, Cryptosporidium parvum
PTFPDQQPSGC

SEQ ID NO: 2275883 - protein, 7 aa, Cryptosporidium parvum
PTFSGNV

SEQ ID NO: 2275884 - protein, 7 aa, Cryptosporidium parvum
PTGEETF

SEQ ID NO: 2275885 - protein, 4 aa, Cryptosporidium parvum
PTGI

SEQ ID NO: 2275886 - protein, 8 aa, Cryptosporidium parvum
PTGNKPFS

SEQ ID NO: 2275887 - protein, 8 aa, Cryptosporidium parvum
PTGSGKTN

SEQ ID NO: 2275888 - protein, 7 aa, Cryptosporidium parvum
PTGTGKT

SEQ ID NO: 2275889 - protein, 7 aa, Cryptosporidium parvum
PTGTSSP

SEQ ID NO: 2275890 - protein, 8 aa, Cryptosporidium parvum
PTGTSVEE

SEQ ID NO: 2275891 - protein, 15 aa, Cryptosporidium parvum
PTGTVPLGTTAYEKR

SEQ ID NO: 2275892 - protein, 11 aa, Cryptosporidium parvum
PTGVSKTNSID

SEQ ID NO: 2275893 - protein, 5 aa, Cryptosporidium parvum
PTHSS

SEQ ID NO: 2275894 - protein, 5 aa, Cryptosporidium parvum
PTIAN

SEQ ID NO: 2275895 - protein, 14 aa, Cryptosporidium parvum
PTIESKDKKEVSSK

SEQ ID NO: 2275896 - protein, 22 aa, Cryptosporidium parvum
PTINASSRTSSLRSISKNNDIE

SEQ ID NO: 2275897 - protein, 7 aa, Cryptosporidium parvum
PTIPREN

SEQ ID NO: 2275898 - protein, 4 aa, Cryptosporidium parvum
PTIS

SEQ ID NO: 2275899 - protein, 5 aa, Cryptosporidium parvum
PTISE

SEQ ID NO: 2275900 - protein, 4 aa, Cryptosporidium parvum
PTIY

SEQ ID NO: 2275901 - protein, 10 aa, Cryptosporidium parvum
PTKDRRTDIK

SEQ ID NO: 2275902 - protein, 9 aa, Cryptosporidium parvum
PTKGCGNRT

SEQ ID NO: 2275903 - protein, 5 aa, Cryptosporidium parvum
PTKGI

SEQ ID NO: 2275904 - protein, 5 aa, Cryptosporidium parvum
PTKIN

SEQ ID NO: 2275905 - protein, 5 aa, Cryptosporidium parvum
PTKKN

SEQ ID NO: 2275906 - protein, 6 aa, Cryptosporidium parvum
PTKNQA

SEQ ID NO: 2275907 - protein, 5 aa, Cryptosporidium parvum
PTKNS

SEQ ID NO: 2275908 - protein, 5 aa, Cryptosporidium parvum
PTKQQ

SEQ ID NO: 2275909 - protein, 5 aa, Cryptosporidium parvum
PTKSE

SEQ ID NO: 2275910 - protein, 13 aa, Cryptosporidium parvum
PTKTETTTTMTET

SEQ ID NO: 2275911 - protein, 5 aa, Cryptosporidium parvum
PTLNY

SEQ ID NO: 2275912 - protein, 10 aa, Cryptosporidium parvum
PTLPSITSSM

SEQ ID NO: 2275913 - protein, 8 aa, Cryptosporidium parvum
PTLSPTEY

SEQ ID NO: 2275914 - protein, 4 aa, Cryptosporidium parvum
PTNE

SEQ ID NO: 2275915 - protein, 13 aa, Cryptosporidium parvum
PTNHESSDNRSTF

SEQ ID NO: 2275916 - protein, 11 aa, Cryptosporidium parvum
PTNISKADVSY

SEQ ID NO: 2275917 - protein, 14 aa, Cryptosporidium parvum
PTNKKRKLSSNRNI

SEQ ID NO: 2275918 - protein, 14 aa, Cryptosporidium parvum
PTNMKDDEECMMCS

SEQ ID NO: 2275919 - protein, 5 aa, Cryptosporidium parvum
PTNNE

SEQ ID NO: 2275920 - protein, 5 aa, Cryptosporidium parvum
PTNNF

SEQ ID NO: 2275921 - protein, 7 aa, Cryptosporidium parvum
PTNNGQI

SEQ ID NO: 2275922 - protein, 7 aa, Cryptosporidium parvum
PTNPQES

SEQ ID NO: 2275923 - protein, 10 aa, Cryptosporidium parvum
PTNSGQNETL

SEQ ID NO: 2275924 - protein, 17 aa, Cryptosporidium parvum
PTNSSEFGKAPDTTGGA

SEQ ID NO: 2275925 - protein, 11 aa, Cryptosporidium parvum
PTNSSSTSTTR

SEQ ID NO: 2275926 - protein, 5 aa, Cryptosporidium parvum
PTNSV

SEQ ID NO: 2275927 - protein, 4 aa, Cryptosporidium parvum
PTPD

SEQ ID NO: 2275928 - protein, 5 aa, Cryptosporidium parvum
PTPDE

SEQ ID NO: 2275929 - protein, 7 aa, Cryptosporidium parvum
PTPGTVE

SEQ ID NO: 2275930 - protein, 6 aa, Cryptosporidium parvum
PTPQYN

SEQ ID NO: 2275931 - protein, 17 aa, Cryptosporidium parvum
PTPRKASEKEKLRPETQ

SEQ ID NO: 2275932 - protein, 10 aa, Cryptosporidium parvum
PTPSQRISSI

SEQ ID NO: 2275933 - protein, 5 aa, Cryptosporidium parvum
PTQAI

SEQ ID NO: 2275934 - protein, 15 aa, Cryptosporidium parvum
PTQDNNTGRKLSPAE

SEQ ID NO: 2275935 - protein, 18 aa, Cryptosporidium parvum
PTRDEKEEGGGEKAELPS

SEQ ID NO: 2275936 - protein, 18 aa, Cryptosporidium parvum
PTRDLEKGDWNNDTVNSS

SEQ ID NO: 2275937 - protein, 4 aa, Cryptosporidium parvum
PTRE

SEQ ID NO: 2275938 - protein, 12 aa, Cryptosporidium parvum
PTREGKRVSIEK

SEQ ID NO: 2275939 - protein, 14 aa, Cryptosporidium parvum
PTRPYGPGEKLPPH

SEQ ID NO: 2275940 - protein, 4 aa, Cryptosporidium parvum
PTRR

SEQ ID NO: 2275941 - protein, 4 aa, Cryptosporidium parvum
PTRV

SEQ ID NO: 2275942 - protein, 11 aa, Cryptosporidium parvum
PTSARLNPTVG

SEQ ID NO: 2275943 - protein, 7 aa, Cryptosporidium parvum
PTSDKGR

SEQ ID NO: 2275944 - protein, 11 aa, Cryptosporidium parvum
PTSETKIEAER

SEQ ID NO: 2275945 - protein, 13 aa, Cryptosporidium parvum
PTSGGNKASVFTK

SEQ ID NO: 2275946 - protein, 4 aa, Cryptosporidium parvum
PTSI

SEQ ID NO: 2275947 - protein, 11 aa, Cryptosporidium parvum
PTSIENQKKMT

SEQ ID NO: 2275948 - protein, 12 aa, Cryptosporidium parvum
PTSKRNHKAWMI

SEQ ID NO: 2275949 - protein, 25 aa, Cryptosporidium parvum
PTSPKNYSKNNLGSGAISNNDYNHA

SEQ ID NO: 2275950 - protein, 6 aa, Cryptosporidium parvum
PTSRDP

SEQ ID NO: 2275951 - protein, 6 aa, Cryptosporidium parvum
PTSRIS

SEQ ID NO: 2275952 - protein, 6 aa, Cryptosporidium parvum
PTSSKD

SEQ ID NO: 2275953 - protein, 15 aa, Cryptosporidium parvum
PTSSLLPETSEATNP

SEQ ID NO: 2275954 - protein, 5 aa, Cryptosporidium parvum
PTSSV

SEQ ID NO: 2275955 - protein, 12 aa, Cryptosporidium parvum
PTSTNDQNSKGN

SEQ ID NO: 2275956 - protein, 12 aa, Cryptosporidium parvum
PTSVEQNSKYCS

SEQ ID NO: 2275957 - protein, 5 aa, Cryptosporidium parvum
PTTDM

SEQ ID NO: 2275958 - protein, 7 aa, Cryptosporidium parvum
PTTEKQQ

SEQ ID NO: 2275959 - protein, 7 aa, Cryptosporidium parvum
PTTESDF

SEQ ID NO: 2275960 - protein, 5 aa, Cryptosporidium parvum
PTTGL

SEQ ID NO: 2275961 - protein, 12 aa, Cryptosporidium parvum
PTTKSPTSFTNT

SEQ ID NO: 2275962 - protein, 6 aa, Cryptosporidium parvum
PTTLSP

SEQ ID NO: 2275963 - protein, 4 aa, Cryptosporidium parvum
PTTN

SEQ ID NO: 2275964 - protein, 7 aa, Cryptosporidium parvum
PTTNPIR

SEQ ID NO: 2275965 - protein, 5 aa, Cryptosporidium parvum
PTTQK

SEQ ID NO: 2275966 - protein, 8 aa, Cryptosporidium parvum
PTTSDDEI

SEQ ID NO: 2275967 - protein, 5 aa, Cryptosporidium parvum
PTVEE

SEQ ID NO: 2275968 - protein, 4 aa, Cryptosporidium parvum
PTYK

SEQ ID NO: 2275969 - protein, 7 aa, Cryptosporidium parvum
PTYPNAG

SEQ ID NO: 2275970 - protein, 14 aa, Cryptosporidium parvum
PTYQDSKKTTKIKP

SEQ ID NO: 2275971 - protein, 6 aa, Cryptosporidium parvum
PTYQNG

SEQ ID NO: 2275972 - protein, 5 aa, Cryptosporidium parvum
PVAPG

SEQ ID NO: 2275973 - protein, 4 aa, Cryptosporidium parvum
PVEI

SEQ ID NO: 2275974 - protein, 13 aa, Cryptosporidium parvum
PVENKDEDECELT

SEQ ID NO: 2275975 - protein, 13 aa, Cryptosporidium parvum
PVEYSWPTSGGNV

SEQ ID NO: 2275976 - protein, 4 aa, Cryptosporidium parvum
PVGE

SEQ ID NO: 2275977 - protein, 14 aa, Cryptosporidium parvum
PVGEQTHGQMIYTK

SEQ ID NO: 2275978 - protein, 15 aa, Cryptosporidium parvum
PVGGRYNPSKTLSQN

SEQ ID NO: 2275979 - protein, 17 aa, Cryptosporidium parvum
PVIPRKRGAKKRLFKFC

SEQ ID NO: 2275980 - protein, 4 aa, Cryptosporidium parvum
PVIQ

SEQ ID NO: 2275981 - protein, 12 aa, Cryptosporidium parvum
PVKDGNSGPKWP

SEQ ID NO: 2275982 - protein, 8 aa, Cryptosporidium parvum
PVKDNDKE

SEQ ID NO: 2275983 - protein, 5 aa, Cryptosporidium parvum
PVKKG

SEQ ID NO: 2275984 - protein, 40 aa, Cryptosporidium parvum
PVKPFNDEQSNESKNTSKSTRIKQRNEDQSEKKVDLSPKN

SEQ ID NO: 2275985 - protein, 29 aa, Cryptosporidium parvum
PVKSQQSSRSHSVPPSSSPSPSSSPTLQA

SEQ ID NO: 2275986 - protein, 10 aa, Cryptosporidium parvum
PVNGEDLPEN

SEQ ID NO: 2275987 - protein, 12 aa, Cryptosporidium parvum
PVNKSANPNKMS

SEQ ID NO: 2275988 - protein, 4 aa, Cryptosporidium parvum
PVNP

SEQ ID NO: 2275989 - protein, 18 aa, Cryptosporidium parvum
PVNTGDSLSANNVGSTGY

SEQ ID NO: 2275990 - protein, 13 aa, Cryptosporidium parvum
PVPGNESNREIQD

SEQ ID NO: 2275991 - protein, 8 aa, Cryptosporidium parvum
PVPGSEPD

SEQ ID NO: 2275992 - protein, 4 aa, Cryptosporidium parvum
PVPL

SEQ ID NO: 2275993 - protein, 19 aa, Cryptosporidium parvum
PVPPSYKGLGARKNPIGGV

SEQ ID NO: 2275994 - protein, 12 aa, Cryptosporidium parvum
PVPSHSNINSSV

SEQ ID NO: 2275995 - protein, 7 aa, Cryptosporidium parvum
PVSENDE

SEQ ID NO: 2275996 - protein, 4 aa, Cryptosporidium parvum
PVSG

SEQ ID NO: 2275997 - protein, 22 aa, Cryptosporidium parvum
PVSGETSNSNTELKKQNSDFKS

SEQ ID NO: 2275998 - protein, 17 aa, Cryptosporidium parvum
PVSGSGGNTISSSSTNN

SEQ ID NO: 2275999 - protein, 8 aa, Cryptosporidium parvum
PVSGSSMY

SEQ ID NO: 2276000 - protein, 7 aa, Cryptosporidium parvum
PVSKIPS

SEQ ID NO: 2276001 - protein, 28 aa, Cryptosporidium parvum
PVSKNLSSQAEKDLAENSSEAPNQSSEI

SEQ ID NO: 2276002 - protein, 10 aa, Cryptosporidium parvum
PVSKRQKQEI

SEQ ID NO: 2276003 - protein, 4 aa, Cryptosporidium parvum
PVSM

SEQ ID NO: 2276004 - protein, 4 aa, Cryptosporidium parvum
PVSN

SEQ ID NO: 2276005 - protein, 6 aa, Cryptosporidium parvum
PVSNSP

SEQ ID NO: 2276006 - protein, 12 aa, Cryptosporidium parvum
PVSRRKLDRSSL

SEQ ID NO: 2276007 - protein, 11 aa, Cryptosporidium parvum
PVTAPTRLNGH

SEQ ID NO: 2276008 - protein, 4 aa, Cryptosporidium parvum
PVTP

SEQ ID NO: 2276009 - protein, 6 aa, Cryptosporidium parvum
PVTQDD

SEQ ID NO: 2276010 - protein, 14 aa, Cryptosporidium parvum
PWDRSKYTIKTQEK

SEQ ID NO: 2276011 - protein, 8 aa, Cryptosporidium parvum
PWGKGRPG

SEQ ID NO: 2276012 - protein, 13 aa, Cryptosporidium parvum
PWNKDNGKSDEER

SEQ ID NO: 2276013 - protein, 7 aa, Cryptosporidium parvum
PWNTKDE

SEQ ID NO: 2276014 - protein, 16 aa, Cryptosporidium parvum
PYASKTPVHRQKPRHV

SEQ ID NO: 2276015 - protein, 63 aa, Cryptosporidium parvum
PYEANKETYETEVRDQSSSLTGGGSSSMNLDRNKEGLYDSRARSDFDSSSMDISSNGFNTNES

SEQ ID NO: 2276016 - protein, 14 aa, Cryptosporidium parvum
PYFSPKKKSNADTN

SEQ ID NO: 2276017 - protein, 4 aa, Cryptosporidium parvum
PYGA

SEQ ID NO: 2276018 - protein, 10 aa, Cryptosporidium parvum
PYHTEGRTSL

SEQ ID NO: 2276019 - protein, 5 aa, Cryptosporidium parvum
PYIPD

SEQ ID NO: 2276020 - protein, 7 aa, Cryptosporidium parvum
PYKEKPS

SEQ ID NO: 2276021 - protein, 15 aa, Cryptosporidium parvum
PYKEQSHGDASGKSI

SEQ ID NO: 2276022 - protein, 9 aa, Cryptosporidium parvum
PYKFSSSQG

SEQ ID NO: 2276023 - protein, 4 aa, Cryptosporidium parvum
PYKG

SEQ ID NO: 2276024 - protein, 7 aa, Cryptosporidium parvum
PYKGGEY

SEQ ID NO: 2276025 - protein, 4 aa, Cryptosporidium parvum
PYKK

SEQ ID NO: 2276026 - protein, 7 aa, Cryptosporidium parvum
PYKNGED

SEQ ID NO: 2276027 - protein, 11 aa, Cryptosporidium parvum
PYKVQKDDDLR

SEQ ID NO: 2276028 - protein, 6 aa, Cryptosporidium parvum
PYNESK

SEQ ID NO: 2276029 - protein, 5 aa, Cryptosporidium parvum
PYNGT

SEQ ID NO: 2276030 - protein, 6 aa, Cryptosporidium parvum
PYNQKS

SEQ ID NO: 2276031 - protein, 5 aa, Cryptosporidium parvum
PYNRP

SEQ ID NO: 2276032 - protein, 4 aa, Cryptosporidium parvum
PYPG

SEQ ID NO: 2276033 - protein, 15 aa, Cryptosporidium parvum
PYPNGVQDLPKETKD

SEQ ID NO: 2276034 - protein, 31 aa, Cryptosporidium parvum
PYPPKAPLSDCNNSDSESSFSKKMQDNKERL

SEQ ID NO: 2276035 - protein, 4 aa, Cryptosporidium parvum
PYPT

SEQ ID NO: 2276036 - protein, 11 aa, Cryptosporidium parvum
PYQNGNPNQMT

SEQ ID NO: 2276037 - protein, 15 aa, Cryptosporidium parvum
PYQTTPEVQTNNPNL

SEQ ID NO: 2276038 - protein, 12 aa, Cryptosporidium parvum
PYRDNEYKNVQS

SEQ ID NO: 2276039 - protein, 5 aa, Cryptosporidium parvum
PYRTD

SEQ ID NO: 2276040 - protein, 4 aa, Cryptosporidium parvum
PYRV

SEQ ID NO: 2276041 - protein, 14 aa, Cryptosporidium parvum
PYSDKRVSVDSTSL

SEQ ID NO: 2276042 - protein, 12 aa, Cryptosporidium parvum
PYSDQNKPESLS

SEQ ID NO: 2276043 - protein, 10 aa, Cryptosporidium parvum
PYSEATSQAI

SEQ ID NO: 2276044 - protein, 12 aa, Cryptosporidium parvum
PYSENSNNNNLN

SEQ ID NO: 2276045 - protein, 19 aa, Cryptosporidium parvum
PYSGAKDTLGGKSSELHAP

SEQ ID NO: 2276046 - protein, 13 aa, Cryptosporidium parvum
PYSGESDESTTEI

SEQ ID NO: 2276047 - protein, 6 aa, Cryptosporidium parvum
PYSIGS

SEQ ID NO: 2276048 - protein, 5 aa, Cryptosporidium parvum
PYSPE

SEQ ID NO: 2276049 - protein, 8 aa, Cryptosporidium parvum
PYSPTDSR

SEQ ID NO: 2276050 - protein, 15 aa, Cryptosporidium parvum
PYSQSKISSRSTGID

SEQ ID NO: 2276051 - protein, 52 aa, Cryptosporidium parvum
PYSSSISTITSSNQSLDDGLSNSGGNLSASTSNSNMNSNPSFSSFSASNNSV

SEQ ID NO: 2276052 - protein, 5 aa, Cryptosporidium parvum
PYSST

SEQ ID NO: 2276053 - protein, 4 aa, Cryptosporidium parvum
PYTA

SEQ ID NO: 2276054 - protein, 6 aa, Cryptosporidium parvum
PYVGDD

SEQ ID NO: 2276055 - protein, 4 aa, Cryptosporidium parvum
PYYS

SEQ ID NO: 2276056 - protein, 18 aa, Cryptosporidium parvum
QAAENSRSDSEQFSENTE

SEQ ID NO: 2276057 - protein, 8 aa, Cryptosporidium parvum
QAAKTDSK

SEQ ID NO: 2276058 - protein, 8 aa, Cryptosporidium parvum
QADGEEAI

SEQ ID NO: 2276059 - protein, 9 aa, Cryptosporidium parvum
QADKTLSSC

SEQ ID NO: 2276060 - protein, 11 aa, Cryptosporidium parvum
QADPAPANDPL

SEQ ID NO: 2276061 - protein, 7 aa, Cryptosporidium parvum
QAEEAAI

SEQ ID NO: 2276062 - protein, 9 aa, Cryptosporidium parvum
QAEEEQINS

SEQ ID NO: 2276063 - protein, 5 aa, Cryptosporidium parvum
QAEEL

SEQ ID NO: 2276064 - protein, 10 aa, Cryptosporidium parvum
QAEEYGDASN

SEQ ID NO: 2276065 - protein, 9 aa, Cryptosporidium parvum
QAEFDTDQR

SEQ ID NO: 2276066 - protein, 7 aa, Cryptosporidium parvum
QAEGQTS

SEQ ID NO: 2276067 - protein, 9 aa, Cryptosporidium parvum
QAEKHNTDF

SEQ ID NO: 2276068 - protein, 9 aa, Cryptosporidium parvum
QAEKSGERI

SEQ ID NO: 2276069 - protein, 18 aa, Cryptosporidium parvum
QAEKSNSRTFKGDDSGLS

SEQ ID NO: 2276070 - protein, 5 aa, Cryptosporidium parvum
QAEKT

SEQ ID NO: 2276071 - protein, 4 aa, Cryptosporidium parvum
QAEM

SEQ ID NO: 2276072 - protein, 10 aa, Cryptosporidium parvum
QAENNKTNEL

SEQ ID NO: 2276073 - protein, 6 aa, Cryptosporidium parvum
QAENRN

SEQ ID NO: 2276074 - protein, 14 aa, Cryptosporidium parvum
QAENYAASNALPNK

SEQ ID NO: 2276075 - protein, 9 aa, Cryptosporidium parvum
QAESSYNTE

SEQ ID NO: 2276076 - protein, 6 aa, Cryptosporidium parvum
QAGKKV

SEQ ID NO: 2276077 - protein, 6 aa, Cryptosporidium parvum
QAGKTV

SEQ ID NO: 2276078 - protein, 5 aa, Cryptosporidium parvum
QAGLR

SEQ ID NO: 2276079 - protein, 7 aa, Cryptosporidium parvum
QAGRGGR

SEQ ID NO: 2276080 - protein, 5 aa, Cryptosporidium parvum
QAGSD

SEQ ID NO: 2276081 - protein, 6 aa, Cryptosporidium parvum
QAGSND

SEQ ID NO: 2276082 - protein, 8 aa, Cryptosporidium parvum
QAGSPKIE

SEQ ID NO: 2276083 - protein, 7 aa, Cryptosporidium parvum
QAGTPEV

SEQ ID NO: 2276084 - protein, 27 aa, Cryptosporidium parvum
QAIKEDRKRGREQDEDRRVDSGYSRKR

SEQ ID NO: 2276085 - protein, 39 aa, Cryptosporidium parvum
QAIKGTQNSNLNSISSKGGGQDSTGINTKSEQGGISIGS

SEQ ID NO: 2276086 - protein, 13 aa, Cryptosporidium parvum
QAIPSSNINSKSV

SEQ ID NO: 2276087 - protein, 13 aa, Cryptosporidium parvum
QAITDSKEKIQKS

SEQ ID NO: 2276088 - protein, 11 aa, Cryptosporidium parvum
QAITGPPESLR

SEQ ID NO: 2276089 - protein, 10 aa, Cryptosporidium parvum
QAITNPENTV

SEQ ID NO: 2276090 - protein, 8 aa, Cryptosporidium parvum
QAKGKPSC

SEQ ID NO: 2276091 - protein, 25 aa, Cryptosporidium parvum
QAKKYQKSLNSSLSSSSFSPNYSSS

SEQ ID NO: 2276092 - protein, 8 aa, Cryptosporidium parvum
QAKKYRSE

SEQ ID NO: 2276093 - protein, 8 aa, Cryptosporidium parvum
QAKNNPNV

SEQ ID NO: 2276094 - protein, 9 aa, Cryptosporidium parvum
QAKNTDSSS

SEQ ID NO: 2276095 - protein, 5 aa, Cryptosporidium parvum
QAKPP

SEQ ID NO: 2276096 - protein, 11 aa, Cryptosporidium parvum
QAKPTKQEQKI

SEQ ID NO: 2276097 - protein, 15 aa, Cryptosporidium parvum
QAKSNIRVTPADDRN

SEQ ID NO: 2276098 - protein, 7 aa, Cryptosporidium parvum
QAKSSSS

SEQ ID NO: 2276099 - protein, 6 aa, Cryptosporidium parvum
QALEST

SEQ ID NO: 2276100 - protein, 4 aa, Cryptosporidium parvum
QALG

SEQ ID NO: 2276101 - protein, 18 aa, Cryptosporidium parvum
QANTTGMNYKNSSSKSSL

SEQ ID NO: 2276102 - protein, 40 aa, Cryptosporidium parvum; identical to SEQ ID NO: 2157031

SEQ ID NO: 2276103 - protein, 11 aa, Cryptosporidium parvum
QAPGDIAEEYD

SEQ ID NO: 2276104 - protein, 5 aa, Cryptosporidium parvum
QAPGI

SEQ ID NO: 2276105 - protein, 49 aa, Cryptosporidium parvum
QAPRPSSSYMSGGDAISGSGFPKTVSSTLPPPPLPPSSSSYSAPTSIPP

SEQ ID NO: 2276106 - protein, 10 aa, Cryptosporidium parvum
QAPSDSEREK

SEQ ID NO: 2276107 - protein, 8 aa, Cryptosporidium parvum
QAPSLNPK

SEQ ID NO: 2276108 - protein, 8 aa, Cryptosporidium parvum
QAPSQEVE

SEQ ID NO: 2276109 - protein, 16 aa, Cryptosporidium parvum
QAPVSGSSSPPELKTE

SEQ ID NO: 2276110 - protein, 4 aa, Cryptosporidium parvum
QAQA

SEQ ID NO: 2276111 - protein, 8 aa, Cryptosporidium parvum
QAQQISTA

SEQ ID NO: 2276112 - protein, 21 aa, Cryptosporidium parvum
QAQRGANQAFKGLTNTNNNIG

SEQ ID NO: 2276113 - protein, 15 aa, Cryptosporidium parvum
QAQSANIGSSSESQF

SEQ ID NO: 2276114 - protein, 31 aa, Cryptosporidium parvum; identical to SEQ ID NO: 2157039

SEQ ID NO: 2276115 - protein, 19 aa, Cryptosporidium parvum
QAQTQSQAQVQSSQALPEL

SEQ ID NO: 2276116 - protein, 4 aa, Cryptosporidium parvum
QAQV

SEQ ID NO: 2276117 - protein, 9 aa, Cryptosporidium parvum
QARNNRGTR

SEQ ID NO: 2276118 - protein, 12 aa, Cryptosporidium parvum
QARSSYGTGVEV

SEQ ID NO: 2276119 - protein, 9 aa, Cryptosporidium parvum
QARTGSGKT

SEQ ID NO: 2276120 - protein, 7 aa, Cryptosporidium parvum
QASETNI

SEQ ID NO: 2276121 - protein, 18 aa, Cryptosporidium parvum
QASGANGTINNTFNSGNN

SEQ ID NO: 2276122 - protein, 8 aa, Cryptosporidium parvum
QASKDHQS

SEQ ID NO: 2276123 - protein, 7 aa, Cryptosporidium parvum
QASKIQN

SEQ ID NO: 2276124 - protein, 15 aa, Cryptosporidium parvum
QASKKSESSIADPDL

SEQ ID NO: 2276125 - protein, 7 aa, Cryptosporidium parvum
QASKSHF

SEQ ID NO: 2276126 - protein, 7 aa, Cryptosporidium parvum
QASLAEK

SEQ ID NO: 2276127 - protein, 10 aa, Cryptosporidium parvum
QASNEGNPEM

SEQ ID NO: 2276128 - protein, 6 aa, Cryptosporidium parvum
QASPIS

SEQ ID NO: 2276129 - protein, 12 aa, Cryptosporidium parvum
QASQAEKNRAAK

SEQ ID NO: 2276130 - protein, 5 aa, Cryptosporidium parvum
QASQT

SEQ ID NO: 2276131 - protein, 13 aa, Cryptosporidium parvum
QASSNTEKNINTI

SEQ ID NO: 2276132 - protein, 9 aa, Cryptosporidium parvum
QASSPSVEI

SEQ ID NO: 2276133 - protein, 9 aa, Cryptosporidium parvum
QASSQGYSS

SEQ ID NO: 2276134 - protein, 4 aa, Cryptosporidium parvum
QAST

SEQ ID NO: 2276135 - protein, 8 aa, Cryptosporidium parvum
QASTATSR

SEQ ID NO: 2276136 - protein, 6 aa, Cryptosporidium parvum
QASYQT

SEQ ID NO: 2276137 - protein, 9 aa, Cryptosporidium parvum
QATESREKN

SEQ ID NO: 2276138 - protein, 4 aa, Cryptosporidium parvum
QATK

SEQ ID NO: 2276139 - protein, 19 aa, Cryptosporidium parvum
QATSTISASNETRENISPP

SEQ ID NO: 2276140 - protein, 25 aa, Cryptosporidium parvum
QAVENKVKTDTNTEADSSSSSSKTQ

SEQ ID NO: 2276141 - protein, 8 aa, Cryptosporidium parvum
QAVTGEYP

SEQ ID NO: 2276142 - protein, 9 aa, Cryptosporidium parvum
QAYTTDCTT

SEQ ID NO: 2276143 - protein, 5 aa, Cryptosporidium parvum
QCDSQ

SEQ ID NO: 2276144 - protein, 34 aa, Cryptosporidium parvum
QCESSNNEIDHTQTLNSTKYEQNNISESQKNTFQ

SEQ ID NO: 2276145 - protein, 5 aa, Cryptosporidium parvum
QCGNQ

SEQ ID NO: 2276146 - protein, 30 aa, Cryptosporidium parvum
QCNDEHNKEVNKHATGPKEDDDNKSQSVAT

SEQ ID NO: 2276147 - protein, 7 aa, Cryptosporidium parvum
QCNREKN

SEQ ID NO: 2276148 - protein, 6 aa, Cryptosporidium parvum
QCPFPD

SEQ ID NO: 2276149 - protein, 7 aa, Cryptosporidium parvum
QCQGPEG

SEQ ID NO: 2276150 - protein, 7 aa, Cryptosporidium parvum
QCRDENG

SEQ ID NO: 2276151 - protein, 6 aa, Cryptosporidium parvum
QDAEEV

SEQ ID NO: 2276152 - protein, 6 aa, Cryptosporidium parvum
QDAHSL

SEQ ID NO: 2276153 - protein, 6 aa, Cryptosporidium parvum
QDALGG

SEQ ID NO: 2276154 - protein, 9 aa, Cryptosporidium parvum
QDAPRTPQF

SEQ ID NO: 2276155 - protein, 8 aa, Cryptosporidium parvum
QDAQNYRE

SEQ ID NO: 2276156 - protein, 9 aa, Cryptosporidium parvum
QDCDTKQAI

SEQ ID NO: 2276157 - protein, 19 aa, Cryptosporidium parvum
QDCSSSSIFEDQSKETINE

SEQ ID NO: 2276158 - protein, 5 aa, Cryptosporidium parvum
QDDEA

SEQ ID NO: 2276159 - protein, 4 aa, Cryptosporidium parvum
QDDI

SEQ ID NO: 2276160 - protein, 9 aa, Cryptosporidium parvum
QDDKENNGG

SEQ ID NO: 2276161 - protein, 7 aa, Cryptosporidium parvum
QDDPVTA

SEQ ID NO: 2276162 - protein, 15 aa, Cryptosporidium parvum
QDDSKNRKANQGELS

SEQ ID NO: 2276163 - protein, 9 aa, Cryptosporidium parvum
QDDSLSNRI

SEQ ID NO: 2276164 - protein, 9 aa, Cryptosporidium parvum
QDEDGLIST

SEQ ID NO: 2276165 - protein, 5 aa, Cryptosporidium parvum
QDEEF

SEQ ID NO: 2276166 - protein, 5 aa, Cryptosporidium parvum
QDEEN

SEQ ID NO: 2276167 - protein, 7 aa, Cryptosporidium parvum
QDEENDE

SEQ ID NO: 2276168 - protein, 13 aa, Cryptosporidium parvum
QDEFSSNEASNNE

SEQ ID NO: 2276169 - protein, 12 aa, Cryptosporidium parvum
QDEGKSEEENLS

SEQ ID NO: 2276170 - protein, 11 aa, Cryptosporidium parvum
QDEGQEERRNQ

SEQ ID NO: 2276171 - protein, 9 aa, Cryptosporidium parvum
QDEKERENA

SEQ ID NO: 2276172 - protein, 4 aa, Cryptosporidium parvum
QDEN

SEQ ID NO: 2276173 - protein, 5 aa, Cryptosporidium parvum
QDENN

SEQ ID NO: 2276174 - protein, 4 aa, Cryptosporidium parvum
QDER

SEQ ID NO: 2276175 - protein, 6 aa, Cryptosporidium parvum
QDERGE

SEQ ID NO: 2276176 - protein, 5 aa, Cryptosporidium parvum
QDETD

SEQ ID NO: 2276177 - protein, 8 aa, Cryptosporidium parvum
QDEVKGKQ

SEQ ID NO: 2276178 - protein, 6 aa, Cryptosporidium parvum
QDFEDT

SEQ ID NO: 2276179 - protein, 4 aa, Cryptosporidium parvum
QDFQ

SEQ ID NO: 2276180 - protein, 11 aa, Cryptosporidium parvum
QDFTKNKELNE

SEQ ID NO: 2276181 - protein, 14 aa, Cryptosporidium parvum
QDFTLNDDQDLDDD

SEQ ID NO: 2276182 - protein, 6 aa, Cryptosporidium parvum
QDGFNT

SEQ ID NO: 2276183 - protein, 5 aa, Cryptosporidium parvum
QDGHP

SEQ ID NO: 2276184 - protein, 9 aa, Cryptosporidium parvum
QDGNPETRK

SEQ ID NO: 2276185 - protein, 4 aa, Cryptosporidium parvum
QDGS

SEQ ID NO: 2276186 - protein, 5 aa, Cryptosporidium parvum
QDGSI

SEQ ID NO: 2276187 - protein, 11 aa, Cryptosporidium parvum
QDGSNDERNED

SEQ ID NO: 2276188 - protein, 7 aa, Cryptosporidium parvum
QDHDGSH

SEQ ID NO: 2276189 - protein, 14 aa, Cryptosporidium parvum
QDHDSDGENAAGGR

SEQ ID NO: 2276190 - protein, 9 aa, Cryptosporidium parvum
QDHNTNDQA

SEQ ID NO: 2276191 - protein, 10 aa, Cryptosporidium parvum
QDIANSPELE

SEQ ID NO: 2276192 - protein, 12 aa, Cryptosporidium parvum
QDIEKSKDYDQE

SEQ ID NO: 2276193 - protein, 7 aa, Cryptosporidium parvum
QDINNVS

SEQ ID NO: 2276194 - protein, 7 aa, Cryptosporidium parvum
QDIQPGE

SEQ ID NO: 2276195 - protein, 9 aa, Cryptosporidium parvum
QDKATISKK

SEQ ID NO: 2276196 - protein, 15 aa, Cryptosporidium parvum
QDKETTDTNTSSEES

SEQ ID NO: 2276197 - protein, 10 aa, Cryptosporidium parvum
QDKEVGDGTT

SEQ ID NO: 2276198 - protein, 5 aa, Cryptosporidium parvum
QDKPD

SEQ ID NO: 2276199 - protein, 10 aa, Cryptosporidium parvum
QDKTKYNSPK

SEQ ID NO: 2276200 - protein, 10 aa, Cryptosporidium parvum
QDLDDNDDDI

SEQ ID NO: 2276201 - protein, 7 aa, Cryptosporidium parvum
QDLEEDN

SEQ ID NO: 2276202 - protein, 7 aa, Cryptosporidium parvum
QDLKEKT

SEQ ID NO: 2276203 - protein, 7 aa, Cryptosporidium parvum
QDLNNNT

SEQ ID NO: 2276204 - protein, 6 aa, Cryptosporidium parvum
QDLPNA

SEQ ID NO: 2276205 - protein, 7 aa, Cryptosporidium parvum
QDLPNAM

SEQ ID NO: 2276206 - protein, 18 aa, Cryptosporidium parvum
QDLSESQQRYTESTQKLK

SEQ ID NO: 2276207 - protein, 12 aa, Cryptosporidium parvum
QDLSNALKPEEV

SEQ ID NO: 2276208 - protein, 7 aa, Cryptosporidium parvum
QDMEADE

SEQ ID NO: 2276209 - protein, 14 aa, Cryptosporidium parvum
QDMKGSAFSTTHNP

SEQ ID NO: 2276210 - protein, 5 aa, Cryptosporidium parvum
QDMKN

SEQ ID NO: 2276211 - protein, 5 aa, Cryptosporidium parvum
QDMRS

SEQ ID NO: 2276212 - protein, 84 aa, Cryptosporidium parvum
QDNDEDDDEDGDEDSDEDDEDDLDDLDDDEEEEEEEEEPVKAPSTKNKNKQSSTSQKTKSSDSQPPSKKSRLESKSQSKPDQLY

SEQ ID NO: 2276213 - protein, 8 aa, Cryptosporidium parvum
QDNEEDSF

SEQ ID NO: 2276214 - protein, 7 aa, Cryptosporidium parvum
QDNESAK

SEQ ID NO: 2276215 - protein, 6 aa, Cryptosporidium parvum
QDNGYR

SEQ ID NO: 2276216 - protein, 10 aa, Cryptosporidium parvum
QDNKDSGSNS

SEQ ID NO: 2276217 - protein, 11 aa, Cryptosporidium parvum
QDNNINNSGLR

SEQ ID NO: 2276218 - protein, 7 aa, Cryptosporidium parvum
QDNNNLK

SEQ ID NO: 2276219 - protein, 6 aa, Cryptosporidium parvum
QDNNTN

SEQ ID NO: 2276220 - protein, 12 aa, Cryptosporidium parvum
QDPDAPIPDTSE

SEQ ID NO: 2276221 - protein, 4 aa, Cryptosporidium parvum
QDPE

SEQ ID NO: 2276222 - protein, 7 aa, Cryptosporidium parvum
QDPEECR

SEQ ID NO: 2276223 - protein, 6 aa, Cryptosporidium parvum
QDPEEL

SEQ ID NO: 2276224 - protein, 5 aa, Cryptosporidium parvum
QDPIK

SEQ ID NO: 2276225 - protein, 6 aa, Cryptosporidium parvum
QDPLNN

SEQ ID NO: 2276226 - protein, 11 aa, Cryptosporidium parvum
QDPQNNNQGYK

SEQ ID NO: 2276227 - protein, 12 aa, Cryptosporidium parvum
QDPQTKELSEMN

SEQ ID NO: 2276228 - protein, 8 aa, Cryptosporidium parvum
QDPRYKNR

SEQ ID NO: 2276229 - protein, 12 aa, Cryptosporidium parvum
QDPSDYSEAEEV

SEQ ID NO: 2276230 - protein, 5 aa, Cryptosporidium parvum
QDPSI

SEQ ID NO: 2276231 - protein, 12 aa, Cryptosporidium parvum
QDPTIQYGPDLT

SEQ ID NO: 2276232 - protein, 5 aa, Cryptosporidium parvum
QDPTL

SEQ ID NO: 2276233 - protein, 6 aa, Cryptosporidium parvum
QDPTLG

SEQ ID NO: 2276234 - protein, 8 aa, Cryptosporidium parvum
QDQDESNS

SEQ ID NO: 2276235 - protein, 5 aa, Cryptosporidium parvum
QDQDH

SEQ ID NO: 2276236 - protein, 28 aa, Cryptosporidium parvum
QDQEDEQTKESNGEKPMEVDKENYNKDN

SEQ ID NO: 2276237 - protein, 6 aa, Cryptosporidium parvum
QDQEDF

SEQ ID NO: 2276238 - protein, 34 aa, Cryptosporidium parvum
QDQGRTKSKSGQATPAGNLDQTPLNKNRKESDVM

SEQ ID NO: 2276239 - protein, 9 aa, Cryptosporidium parvum
QDQKESTFS

SEQ ID NO: 2276240 - protein, 7 aa, Cryptosporidium parvum
QDQSEEK

SEQ ID NO: 2276241 - protein, 8 aa, Cryptosporidium parvum
QDQSGSWE

SEQ ID NO: 2276242 - protein, 6 aa, Cryptosporidium parvum
QDQSKA

SEQ ID NO: 2276243 - protein, 8 aa, Cryptosporidium parvum
QDQSNSKL

SEQ ID NO: 2276244 - protein, 26 aa, Cryptosporidium parvum
QDQTGLENLDSSSEISDDSSYNEIES

SEQ ID NO: 2276245 - protein, 6 aa, Cryptosporidium parvum
QDQTSY

SEQ ID NO: 2276246 - protein, 6 aa, Cryptosporidium parvum
QDRPSF

SEQ ID NO: 2276247 - protein, 8 aa, Cryptosporidium parvum
QDSAENNV

SEQ ID NO: 2276248 - protein, 5 aa, Cryptosporidium parvum
QDSDL

SEQ ID NO: 2276249 - protein, 29 aa, Cryptosporidium parvum
QDSDNHTSQDSNQCDLNPEPTSKINEGQA

SEQ ID NO: 2276250 - protein, 8 aa, Cryptosporidium parvum
QDSDSEVV

SEQ ID NO: 2276251 - protein, 4 aa, Cryptosporidium parvum
QDSE

SEQ ID NO: 2276252 - protein, 8 aa, Cryptosporidium parvum
QDSGLKEY

SEQ ID NO: 2276253 - protein, 8 aa, Cryptosporidium parvum
QDSKFQSK

SEQ ID NO: 2276254 - protein, 5 aa, Cryptosporidium parvum
QDSKV

SEQ ID NO: 2276255 - protein, 26 aa, Cryptosporidium parvum
QDSLPKSQTNNSKNPYKTFQPNNITE

SEQ ID NO: 2276256 - protein, 8 aa, Cryptosporidium parvum
QDSNKSNN

SEQ ID NO: 2276257 - protein, 35 aa, Cryptosporidium parvum
QDSQNEEEKSNIIKKENKENVSKINNNSKEKNIEI

SEQ ID NO: 2276258 - protein, 15 aa, Cryptosporidium parvum
QDSSEIQKSQIGTLE

SEQ ID NO: 2276259 - protein, 10 aa, Cryptosporidium parvum
QDSSPRESKF

SEQ ID NO: 2276260 - protein, 7 aa, Cryptosporidium parvum
QDSSVEN

SEQ ID NO: 2276261 - protein, 4 aa, Cryptosporidium parvum
QDST

SEQ ID NO: 2276262 - protein, 8 aa, Cryptosporidium parvum
QDTATSKL

SEQ ID NO: 2276263 - protein, 6 aa, Cryptosporidium parvum
QDTDEK

SEQ ID NO: 2276264 - protein, 9 aa, Cryptosporidium parvum
QDTENDDSM

SEQ ID NO: 2276265 - protein, 16 aa, Cryptosporidium parvum
QDTHNTLSQNNEQIEH

SEQ ID NO: 2276266 - protein, 17 aa, Cryptosporidium parvum
QDTKEEATETDLNSSRM

SEQ ID NO: 2276267 - protein, 8 aa, Cryptosporidium parvum
QDTNQHQQ

SEQ ID NO: 2276268 - protein, 9 aa, Cryptosporidium parvum
QDVDGSTKG

SEQ ID NO: 2276269 - protein, 19 aa, Cryptosporidium parvum
QDVGRKSAPLSKNKKGEKG

SEQ ID NO: 2276270 - protein, 10 aa, Cryptosporidium parvum
QDVSGRRQPP

SEQ ID NO: 2276271 - protein, 11 aa, Cryptosporidium parvum
QDVSTQKNNLE

SEQ ID NO: 2276272 - protein, 9 aa, Cryptosporidium parvum
QDYEDAYPE

SEQ ID NO: 2276273 - protein, 6 aa, Cryptosporidium parvum
QDYRAN

SEQ ID NO: 2276274 - protein, 7 aa, Cryptosporidium parvum
QDYRNEA

SEQ ID NO: 2276275 - protein, 10 aa, Cryptosporidium parvum
QEADGKKQAL

SEQ ID NO: 2276276 - protein, 4 aa, Cryptosporidium parvum
QEAE

SEQ ID NO: 2276277 - protein, 11 aa, Cryptosporidium parvum
QEAETTKDAVS

SEQ ID NO: 2276278 - protein, 11 aa, Cryptosporidium parvum
QEAPTTWNSHR

SEQ ID NO: 2276279 - protein, 9 aa, Cryptosporidium parvum
QEAQQTGGI

SEQ ID NO: 2276280 - protein, 6 aa, Cryptosporidium parvum
QEARDI

SEQ ID NO: 2276281 - protein, 7 aa, Cryptosporidium parvum
QEASESN

SEQ ID NO: 2276282 - protein, 10 aa, Cryptosporidium parvum
QEASKHEKAM

SEQ ID NO: 2276283 - protein, 20 aa, Cryptosporidium parvum
QEASPIQETPPIQETSPIQE

SEQ ID NO: 2276284 - protein, 8 aa, Cryptosporidium parvum
QEDAEKKF

SEQ ID NO: 2276285 - protein, 18 aa, Cryptosporidium parvum
QEDAKTSGSSTSSQSGTF

SEQ ID NO: 2276286 - protein, 13 aa, Cryptosporidium parvum
QEDDDKSRDKADQ

SEQ ID NO: 2276287 - protein, 9 aa, Cryptosporidium parvum
QEDDPEKYK

SEQ ID NO: 2276288 - protein, 9 aa, Cryptosporidium parvum
QEDDPPIST

SEQ ID NO: 2276289 - protein, 6 aa, Cryptosporidium parvum
QEDGTK

SEQ ID NO: 2276290 - protein, 5 aa, Cryptosporidium parvum
QEDHQ

SEQ ID NO: 2276291 - protein, 7 aa, Cryptosporidium parvum
QEDLQNK

SEQ ID NO: 2276292 - protein, 11 aa, Cryptosporidium parvum
QEDNYSKAFQD

SEQ ID NO: 2276293 - protein, 8 aa, Cryptosporidium parvum
QEDPESKG

SEQ ID NO: 2276294 - protein, 13 aa, Cryptosporidium parvum
QEDRFGSQNDQNA

SEQ ID NO: 2276295 - protein, 10 aa, Cryptosporidium parvum
QEDSGPLAHP

SEQ ID NO: 2276296 - protein, 6 aa, Cryptosporidium parvum
QEDSSK

SEQ ID NO: 2276297 - protein, 10 aa, Cryptosporidium parvum
QEDSVCPKNT

SEQ ID NO: 2276298 - protein, 18 aa, Cryptosporidium parvum
QEEAKRLSEKLGDKKLSE

SEQ ID NO: 2276299 - protein, 6 aa, Cryptosporidium parvum
QEEAND

SEQ ID NO: 2276300 - protein, 17 aa, Cryptosporidium parvum
QEEARRKHTGGKILGFF

SEQ ID NO: 2276301 - protein, 6 aa, Cryptosporidium parvum
QEEDES

SEQ ID NO: 2276302 - protein, 6 aa, Cryptosporidium parvum
QEEEEV

SEQ ID NO: 2276303 - protein, 6 aa, Cryptosporidium parvum
QEEELS

SEQ ID NO: 2276304 - protein, 13 aa, Cryptosporidium parvum
QEEENENNENYSE

SEQ ID NO: 2276305 - protein, 9 aa, Cryptosporidium parvum
QEEERERRM

SEQ ID NO: 2276306 - protein, 7 aa, Cryptosporidium parvum
QEEERKR

SEQ ID NO: 2276307 - protein, 7 aa, Cryptosporidium parvum
QEEERNP

SEQ ID NO: 2276308 - protein, 8 aa, Cryptosporidium parvum
QEEGAKSA

SEQ ID NO: 2276309 - protein, 8 aa, Cryptosporidium parvum
QEEIEQAR

SEQ ID NO: 2276310 - protein, 10 aa, Cryptosporidium parvum
QEEKRKQIES

SEQ ID NO: 2276311 - protein, 6 aa, Cryptosporidium parvum
QEELTR

SEQ ID NO: 2276312 - protein, 7 aa, Cryptosporidium parvum
QEEMKQK

SEQ ID NO: 2276313 - protein, 20 aa, Cryptosporidium parvum
QEEMQQEESNKDTNSGDSTI

SEQ ID NO: 2276314 - protein, 7 aa, Cryptosporidium parvum
QEENKRR

SEQ ID NO: 2276315 - protein, 4 aa, Cryptosporidium parvum
QEEP

SEQ ID NO: 2276316 - protein, 5 aa, Cryptosporidium parvum
QEEPF

SEQ ID NO: 2276317 - protein, 6 aa, Cryptosporidium parvum
QEEPFS

SEQ ID NO: 2276318 - protein, 12 aa, Cryptosporidium parvum
QEERRRKEEEFK

SEQ ID NO: 2276319 - protein, 19 aa, Cryptosporidium parvum
QEESENDSEYNAYPSGLFI

SEQ ID NO: 2276320 - protein, 9 aa, Cryptosporidium parvum
QEESHNPTI

SEQ ID NO: 2276321 - protein, 6 aa, Cryptosporidium parvum
QEETTM

SEQ ID NO: 2276322 - protein, 26 aa, Cryptosporidium parvum
QEFNSQSEEYGGWDGSYTSPKKGQIK

SEQ ID NO: 2276323 - protein, 7 aa, Cryptosporidium parvum
QEFSEDY

SEQ ID NO: 2276324 - protein, 9 aa, Cryptosporidium parvum
QEGEGDHRM

SEQ ID NO: 2276325 - protein, 6 aa, Cryptosporidium parvum
QEGHSR

SEQ ID NO: 2276326 - protein, 9 aa, Cryptosporidium parvum
QEGKRQGSL

SEQ ID NO: 2276327 - protein, 10 aa, Cryptosporidium parvum
QEGKTSQNCL

SEQ ID NO: 2276328 - protein, 9 aa, Cryptosporidium parvum
QEGNTIPID

SEQ ID NO: 2276329 - protein, 11 aa, Cryptosporidium parvum
QEGRKSPESMR

SEQ ID NO: 2276330 - protein, 7 aa, Cryptosporidium parvum
QEGTTEH

SEQ ID NO: 2276331 - protein, 13 aa, Cryptosporidium parvum
QEHDPSRGDIIFD

SEQ ID NO: 2276332 - protein, 11 aa, Cryptosporidium parvum
QEIDSQQPPGD

SEQ ID NO: 2276333 - protein, 4 aa, Cryptosporidium parvum
QEIE

SEQ ID NO: 2276334 - protein, 5 aa, Cryptosporidium parvum
QEIEE

SEQ ID NO: 2276335 - protein, 5 aa, Cryptosporidium parvum
QEIES

SEQ ID NO: 2276336 - protein, 19 aa, Cryptosporidium parvum
QEIKSENNSSLASVSESRF

SEQ ID NO: 2276337 - protein, 4 aa, Cryptosporidium parvum
QEIN

SEQ ID NO: 2276338 - protein, 4 aa, Cryptosporidium parvum
QEIQ

SEQ ID NO: 2276339 - protein, 9 aa, Cryptosporidium parvum
QEISEKENN

SEQ ID NO: 2276340 - protein, 10 aa, Cryptosporidium parvum
QEKAGSKSNK

SEQ ID NO: 2276341 - protein, 9 aa, Cryptosporidium parvum
QEKDKQEKY

SEQ ID NO: 2276342 - protein, 14 aa, Cryptosporidium parvum
QEKDSNQECQKTQV

SEQ ID NO: 2276343 - protein, 10 aa, Cryptosporidium parvum
QEKESQFESE

SEQ ID NO: 2276344 - protein, 5 aa, Cryptosporidium parvum
QEKGE

SEQ ID NO: 2276345 - protein, 11 aa, Cryptosporidium parvum
QEKKKEWAEAE

SEQ ID NO: 2276346 - protein, 8 aa, Cryptosporidium parvum
QEKKNNEY

SEQ ID NO: 2276347 - protein, 9 aa, Cryptosporidium parvum
QEKKTLQNC

SEQ ID NO: 2276348 - protein, 25 aa, Cryptosporidium parvum
QEKNHEKTEDKAEYSYNDEGNSYID

SEQ ID NO: 2276349 - protein, 10 aa, Cryptosporidium parvum
QEKQSKKSTK

SEQ ID NO: 2276350 - protein, 9 aa, Cryptosporidium parvum
QEKRPENKM

SEQ ID NO: 2276351 - protein, 4 aa, Cryptosporidium parvum
QEKS

SEQ ID NO: 2276352 - protein, 11 aa, Cryptosporidium parvum
QEKSDNSNRIS

SEQ ID NO: 2276353 - protein, 21 aa, Cryptosporidium parvum
QEKTEKSNISWENSKKLQKDY

SEQ ID NO: 2276354 - protein, 11 aa, Cryptosporidium parvum
QELASSTQSLT

SEQ ID NO: 2276355 - protein, 6 aa, Cryptosporidium parvum
QELGEK

SEQ ID NO: 2276356 - protein, 5 aa, Cryptosporidium parvum
QELGS

SEQ ID NO: 2276357 - protein, 9 aa, Cryptosporidium parvum
QELGTKEPI

SEQ ID NO: 2276358 - protein, 47 aa, Cryptosporidium parvum
QELKQNNVNSRRNKQNSKKSTTKTAQKAIDKKNIKPESDEIQQSESS

SEQ ID NO: 2276359 - protein, 5 aa, Cryptosporidium parvum
QELNF

SEQ ID NO: 2276360 - protein, 11 aa, Cryptosporidium parvum
QELRSKASGNI

SEQ ID NO: 2276361 - protein, 13 aa, Cryptosporidium parvum
QEMDNTQDSTTNI

SEQ ID NO: 2276362 - protein, 30 aa, Cryptosporidium parvum; identical to SEQ ID NO: 2157270

SEQ ID NO: 2276363 - protein, 8 aa, Cryptosporidium parvum
QENAEASR

SEQ ID NO: 2276364 - protein, 8 aa, Cryptosporidium parvum
QENDEQPC

SEQ ID NO: 2276365 - protein, 5 aa, Cryptosporidium parvum
QENDS

SEQ ID NO: 2276366 - protein, 9 aa, Cryptosporidium parvum
QENGDTLQT

SEQ ID NO: 2276367 - protein, 16 aa, Cryptosporidium parvum
QENHKFSKNSKADSKA

SEQ ID NO: 2276368 - protein, 9 aa, Cryptosporidium parvum
QENKKEGIY

SEQ ID NO: 2276369 - protein, 9 aa, Cryptosporidium parvum
QENNEDDEF

SEQ ID NO: 2276370 - protein, 7 aa, Cryptosporidium parvum
QENNKEK

SEQ ID NO: 2276371 - protein, 5 aa, Cryptosporidium parvum
QENNL

SEQ ID NO: 2276372 - protein, 37 aa, Cryptosporidium parvum
QENNYSESDQNSGRPCKEKKMSNRKKRKLKQLEEKKR

SEQ ID NO: 2276373 - protein, 16 aa, Cryptosporidium parvum
QENPKAPLPNNSPVEE

SEQ ID NO: 2276374 - protein, 9 aa, Cryptosporidium parvum
QENPNSHNN

SEQ ID NO: 2276375 - protein, 8 aa, Cryptosporidium parvum
QENRERRL

SEQ ID NO: 2276376 - protein, 5 aa, Cryptosporidium parvum
QENSA

SEQ ID NO: 2276377 - protein, 17 aa, Cryptosporidium parvum
QENSLDGNSLSSAEKLR

SEQ ID NO: 2276378 - protein, 9 aa, Cryptosporidium parvum
QENSTLSQQ

SEQ ID NO: 2276379 - protein, 18 aa, Cryptosporidium parvum
QENTDMPSYDSNCNANTG

SEQ ID NO: 2276380 - protein, 8 aa, Cryptosporidium parvum
QENTNKKA

SEQ ID NO: 2276381 - protein, 61 aa, Cryptosporidium parvum
QEPCGNKSISQINGDKPKKYDGKSETSNNNKYSRKNSESKNLASSSSKSQDNSRNVESEAA

SEQ ID NO: 2276382 - protein, 5 aa, Cryptosporidium parvum
QEPIQ

SEQ ID NO: 2276383 - protein, 5 aa, Cryptosporidium parvum
QEPKE

SEQ ID NO: 2276384 - protein, 12 aa, Cryptosporidium parvum
QEPLNDKEALDI

SEQ ID NO: 2276385 - protein, 14 aa, Cryptosporidium parvum
QEPNSNKNTSRSNL

SEQ ID NO: 2276386 - protein, 7 aa, Cryptosporidium parvum
QEPPRSG

SEQ ID NO: 2276387 - protein, 6 aa, Cryptosporidium parvum
QEPQGR

SEQ ID NO: 2276388 - protein, 7 aa, Cryptosporidium parvum
QEPRGSV

SEQ ID NO: 2276389 - protein, 4 aa, Cryptosporidium parvum
QEPT

SEQ ID NO: 2276390 - protein, 11 aa, Cryptosporidium parvum
QEPVPDPSISK

SEQ ID NO: 2276391 - protein, 46 aa, Cryptosporidium parvum
QEQEQEQEQEQEQEQEQEQELEQPEQELKQELEQENELDQDQDQKQ

SEQ ID NO: 2276392 - protein, 7 aa, Cryptosporidium parvum
QEQHNSH

SEQ ID NO: 2276393 - protein, 9 aa, Cryptosporidium parvum
QEQKQRLKG

SEQ ID NO: 2276394 - protein, 16 aa, Cryptosporidium parvum
QEQNLNDKAKDLDQRS

SEQ ID NO: 2276395 - protein, 16 aa, Cryptosporidium parvum
QEQNQYQTTYSNTNHS

SEQ ID NO: 2276396 - protein, 29 aa, Cryptosporidium parvum
QEQQNQQLNTNRGNITEYSSSSSSNIPEN

SEQ ID NO: 2276397 - protein, 9 aa, Cryptosporidium parvum
QEQRNRGYD

SEQ ID NO: 2276398 - protein, 10 aa, Cryptosporidium parvum
QEQTKQLNND

SEQ ID NO: 2276399 - protein, 6 aa, Cryptosporidium parvum
QEQYNQ

SEQ ID NO: 2276400 - protein, 9 aa, Cryptosporidium parvum
QEREDQKSM

SEQ ID NO: 2276401 - protein, 5 aa, Cryptosporidium parvum
QEREK

SEQ ID NO: 2276402 - protein, 10 aa, Cryptosporidium parvum
QERGGTDLKK

SEQ ID NO: 2276403 - protein, 10 aa, Cryptosporidium parvum
QERKEEQKQY

SEQ ID NO: 2276404 - protein, 16 aa, Cryptosporidium parvum
QERKEKMDEFNSPDSE

SEQ ID NO: 2276405 - protein, 8 aa, Cryptosporidium parvum
QERKEYSE

SEQ ID NO: 2276406 - protein, 5 aa, Cryptosporidium parvum
QERRN

SEQ ID NO: 2276407 - protein, 6 aa, Cryptosporidium parvum
QERSIA

SEQ ID NO: 2276408 - protein, 19 aa, Cryptosporidium parvum
QERSQEIKSRTKSGPLEKE

SEQ ID NO: 2276409 - protein, 8 aa, Cryptosporidium parvum
QERTNEMN

SEQ ID NO: 2276410 - protein, 14 aa, Cryptosporidium parvum
QESDEYDSEEIDNE

SEQ ID NO: 2276411 - protein, 8 aa, Cryptosporidium parvum
QESDSAIQ

SEQ ID NO: 2276412 - protein, 14 aa, Cryptosporidium parvum
QESEDESVSSGNEA

SEQ ID NO: 2276413 - protein, 4 aa, Cryptosporidium parvum
QESF

SEQ ID NO: 2276414 - protein, 14 aa, Cryptosporidium parvum
QESFNQNGSDDEDV

SEQ ID NO: 2276415 - protein, 4 aa, Cryptosporidium parvum
QESG

SEQ ID NO: 2276416 - protein, 4 aa, Cryptosporidium parvum
QESI

SEQ ID NO: 2276417 - protein, 5 aa, Cryptosporidium parvum
QESKH

SEQ ID NO: 2276418 - protein, 11 aa, Cryptosporidium parvum
QESKNPPFQPS

SEQ ID NO: 2276419 - protein, 6 aa, Cryptosporidium parvum
QESNAE

SEQ ID NO: 2276420 - protein, 5 aa, Cryptosporidium parvum
QESRQ

SEQ ID NO: 2276421 - protein, 5 aa, Cryptosporidium parvum
QESSE

SEQ ID NO: 2276422 - protein, 9 aa, Cryptosporidium parvum
QESSNTTKQ

SEQ ID NO: 2276423 - protein, 7 aa, Cryptosporidium parvum
QESSRDI

SEQ ID NO: 2276424 - protein, 4 aa, Cryptosporidium parvum
QEST

SEQ ID NO: 2276425 - protein, 13 aa, Cryptosporidium parvum
QESTQSSDYESAI

SEQ ID NO: 2276426 - protein, 7 aa, Cryptosporidium parvum
QESVNRR

SEQ ID NO: 2276427 - protein, 7 aa, Cryptosporidium parvum
QESYTDP

SEQ ID NO: 2276428 - protein, 13 aa, Cryptosporidium parvum
QETDSDNGDNKNN

SEQ ID NO: 2276429 - protein, 14 aa, Cryptosporidium parvum
QETFNKESKASDQL

SEQ ID NO: 2276430 - protein, 11 aa, Cryptosporidium parvum
QETHSEPPAKR

SEQ ID NO: 2276431 - protein, 20 aa, Cryptosporidium parvum
QETKAINKEKSNLATRPEPI

SEQ ID NO: 2276432 - protein, 4 aa, Cryptosporidium parvum
QETL

SEQ ID NO: 2276433 - protein, 6 aa, Cryptosporidium parvum
QETNTT

SEQ ID NO: 2276434 - protein, 33 aa, Cryptosporidium parvum
QETRLQSSNEAAASSMSHPRNGTVGSVGSAGSV

SEQ ID NO: 2276435 - protein, 6 aa, Cryptosporidium parvum
QETSEF

SEQ ID NO: 2276436 - protein, 6 aa, Cryptosporidium parvum
QETSRR

SEQ ID NO: 2276437 - protein, 10 aa, Cryptosporidium parvum
QETTNEKIDE

SEQ ID NO: 2276438 - protein, 6 aa, Cryptosporidium parvum
QETTNI

SEQ ID NO: 2276439 - protein, 8 aa, Cryptosporidium parvum
QETVTKDD

SEQ ID NO: 2276440 - protein, 18 aa, Cryptosporidium parvum
QEVKTSSKDKNIPASSPR

SEQ ID NO: 2276441 - protein, 4 aa, Cryptosporidium parvum
QEVR

SEQ ID NO: 2276442 - protein, 5 aa, Cryptosporidium parvum
QEVRE

SEQ ID NO: 2276443 - protein, 8 aa, Cryptosporidium parvum
QEYAQANS

SEQ ID NO: 2276444 - protein, 5 aa, Cryptosporidium parvum
QEYDE

SEQ ID NO: 2276445 - protein, 16 aa, Cryptosporidium parvum
QEYEKEERKEKGSKKV

SEQ ID NO: 2276446 - protein, 7 aa, Cryptosporidium parvum
QEYPKGL

SEQ ID NO: 2276447 - protein, 6 aa, Cryptosporidium parvum
QEYQES

SEQ ID NO: 2276448 - protein, 14 aa, Cryptosporidium parvum
QEYSYGSNTRRERV

SEQ ID NO: 2276449 - protein, 33 aa, Cryptosporidium parvum
QEYVGGRKGRGKSSKYGSGAVGGGSSSGEDEHG

SEQ ID NO: 2276450 - protein, 34 aa, Cryptosporidium parvum
QFASPASQSSIDNSSHISSINNKEDFSNSPMKET

SEQ ID NO: 2276451 - protein, 6 aa, Cryptosporidium parvum
QFDDSG

SEQ ID NO: 2276452 - protein, 5 aa, Cryptosporidium parvum
QFDKE

SEQ ID NO: 2276453 - protein, 5 aa, Cryptosporidium parvum
QFDSA

SEQ ID NO: 2276454 - protein, 10 aa, Cryptosporidium parvum
QFEDSSSSYA

SEQ ID NO: 2276455 - protein, 13 aa, Cryptosporidium parvum
QFEGNEKNFSENI

SEQ ID NO: 2276456 - protein, 17 aa, Cryptosporidium parvum
QFEKARKVSGPRALQPS

SEQ ID NO: 2276457 - protein, 20 aa, Cryptosporidium parvum
QFEKSNPEAPTVIEGGSEHA

SEQ ID NO: 2276458 - protein, 13 aa, Cryptosporidium parvum
QFEQEEKKNSLYN

SEQ ID NO: 2276459 - protein, 14 aa, Cryptosporidium parvum
QFESPSSKETTTIS

SEQ ID NO: 2276460 - protein, 13 aa, Cryptosporidium parvum
QFGRSNNKDKNIN

SEQ ID NO: 2276461 - protein, 32 aa, Cryptosporidium parvum
QFGSNNNNNTNNKNEGNFNNYGGNNNFGNEQN

SEQ ID NO: 2276462 - protein, 7 aa, Cryptosporidium parvum
QFKDSKI

SEQ ID NO: 2276463 - protein, 7 aa, Cryptosporidium parvum
QFNPKEH

SEQ ID NO: 2276464 - protein, 10 aa, Cryptosporidium parvum
QFPDDEDIST

SEQ ID NO: 2276465 - protein, 5 aa, Cryptosporidium parvum
QFPRE

SEQ ID NO: 2276466 - protein, 17 aa, Cryptosporidium parvum
QFPSQNLGNSSSSSNMA

SEQ ID NO: 2276467 - protein, 7 aa, Cryptosporidium parvum
QFQDQSG

SEQ ID NO: 2276468 - protein, 5 aa, Cryptosporidium parvum
QFQGQ

SEQ ID NO: 2276469 - protein, 13 aa, Cryptosporidium parvum
QFSDSNSNQNPNN

SEQ ID NO: 2276470 - protein, 6 aa, Cryptosporidium parvum
QFSSSN

SEQ ID NO: 2276471 - protein, 5 aa, Cryptosporidium parvum
QFTGE

SEQ ID NO: 2276472 - protein, 10 aa, Cryptosporidium parvum
QFTNSSEVTH

SEQ ID NO: 2276473 - protein, 9 aa, Cryptosporidium parvum
QGAKSSDPN

SEQ ID NO: 2276474 - protein, 8 aa, Cryptosporidium parvum
QGASKNPC

SEQ ID NO: 2276475 - protein, 20 aa, Cryptosporidium parvum
QGDDIPDQIPDKEDRSETIS

SEQ ID NO: 2276476 - protein, 4 aa, Cryptosporidium parvum
QGDE

SEQ ID NO: 2276477 - protein, 5 aa, Cryptosporidium parvum
QGDKG

SEQ ID NO: 2276478 - protein, 5 aa, Cryptosporidium parvum
QGDLR

SEQ ID NO: 2276479 - protein, 5 aa, Cryptosporidium parvum
QGDNI

SEQ ID NO: 2276480 - protein, 6 aa, Cryptosporidium parvum
QGDPLE

SEQ ID NO: 2276481 - protein, 14 aa, Cryptosporidium parvum
QGEDGKKFKTRSGD

SEQ ID NO: 2276482 - protein, 12 aa, Cryptosporidium parvum
QGEGLGKNNQGI

SEQ ID NO: 2276483 - protein, 6 aa, Cryptosporidium parvum
QGEGRT

SEQ ID NO: 2276484 - protein, 5 aa, Cryptosporidium parvum
QGEIE

SEQ ID NO: 2276485 - protein, 10 aa, Cryptosporidium parvum
QGEKNIDDNY

SEQ ID NO: 2276486 - protein, 11 aa, Cryptosporidium parvum
QGEKNVSISEP

SEQ ID NO: 2276487 - protein, 10 aa, Cryptosporidium parvum
QGENSKGSKG

SEQ ID NO: 2276488 - protein, 9 aa, Cryptosporidium parvum
QGEQHQDGC

SEQ ID NO: 2276489 - protein, 6 aa, Cryptosporidium parvum
QGESRG

SEQ ID NO: 2276490 - protein, 9 aa, Cryptosporidium parvum
QGETGKKEG

SEQ ID NO: 2276491 - protein, 14 aa, Cryptosporidium parvum
QGEYYDSNNQYYEE

SEQ ID NO: 2276492 - protein, 12 aa, Cryptosporidium parvum
QGFDGKPASDES

SEQ ID NO: 2276493 - protein, 7 aa, Cryptosporidium parvum
QGFSTPN

SEQ ID NO: 2276494 - protein, 5 aa, Cryptosporidium parvum
QGGGA

SEQ ID NO: 2276495 - protein, 28 aa, Cryptosporidium parvum
QGGGGFNSLEGSEDGNRYNTGGWDEETI

SEQ ID NO: 2276496 - protein, 4 aa, Cryptosporidium parvum
QGGR

SEQ ID NO: 2276497 - protein, 6 aa, Cryptosporidium parvum
QGGRMG

SEQ ID NO: 2276498 - protein, 7 aa, Cryptosporidium parvum
QGGSIPK

SEQ ID NO: 2276499 - protein, 9 aa, Cryptosporidium parvum
QGGSSEESI

SEQ ID NO: 2276500 - protein, 14 aa, Cryptosporidium parvum
QGGVSKSVSTSTSV

SEQ ID NO: 2276501 - protein, 7 aa, Cryptosporidium parvum
QGIENTQ

SEQ ID NO: 2276502 - protein, 8 aa, Cryptosporidium parvum
QGISENET

SEQ ID NO: 2276503 - protein, 8 aa, Cryptosporidium parvum
QGKDKSKE

SEQ ID NO: 2276504 - protein, 8 aa, Cryptosporidium parvum
QGKDSSLK

SEQ ID NO: 2276505 - protein, 10 aa, Cryptosporidium parvum
QGKDTNFDDA

SEQ ID NO: 2276506 - protein, 8 aa, Cryptosporidium parvum
QGKNAENL

SEQ ID NO: 2276507 - protein, 5 aa, Cryptosporidium parvum
QGKNE

SEQ ID NO: 2276508 - protein, 8 aa, Cryptosporidium parvum
QGKNENNL

SEQ ID NO: 2276509 - protein, 9 aa, Cryptosporidium parvum
QGKPGGRLE

SEQ ID NO: 2276510 - protein, 4 aa, Cryptosporidium parvum
QGKR

SEQ ID NO: 2276511 - protein, 9 aa, Cryptosporidium parvum
QGKSISALD

SEQ ID NO: 2276512 - protein, 5 aa, Cryptosporidium parvum
QGKSL

SEQ ID NO: 2276513 - protein, 9 aa, Cryptosporidium parvum
QGKSNKSQH

SEQ ID NO: 2276514 - protein, 8 aa, Cryptosporidium parvum
QGKTDRTL

SEQ ID NO: 2276515 - protein, 6 aa, Cryptosporidium parvum
QGKTKL

SEQ ID NO: 2276516 - protein, 15 aa, Cryptosporidium parvum
QGKVSGVVTSQGKAE

SEQ ID NO: 2276517 - protein, 13 aa, Cryptosporidium parvum
QGKWNGKASHDDY

SEQ ID NO: 2276518 - protein, 12 aa, Cryptosporidium parvum
QGLENSDDYTSK

SEQ ID NO: 2276519 - protein, 23 aa, Cryptosporidium parvum
QGLKTNSGDESTHADGASGSDFA

SEQ ID NO: 2276520 - protein, 6 aa, Cryptosporidium parvum
QGMPTS

SEQ ID NO: 2276521 - protein, 10 aa, Cryptosporidium parvum
QGNDEYSSKI

SEQ ID NO: 2276522 - protein, 5 aa, Cryptosporidium parvum
QGNDR

SEQ ID NO: 2276523 - protein, 10 aa, Cryptosporidium parvum
QGNDSHNHAD

SEQ ID NO: 2276524 - protein, 4 aa, Cryptosporidium parvum
QGNE

SEQ ID NO: 2276525 - protein, 9 aa, Cryptosporidium parvum
QGNEKDSFF

SEQ ID NO: 2276526 - protein, 4 aa, Cryptosporidium parvum
QGNG

SEQ ID NO: 2276527 - protein, 10 aa, Cryptosporidium parvum
QGNHENHENN

SEQ ID NO: 2276528 - protein, 11 aa, Cryptosporidium parvum
QGNIPAGQSTN

SEQ ID NO: 2276529 - protein, 10 aa, Cryptosporidium parvum
QGNKKYNEKL

SEQ ID NO: 2276530 - protein, 8 aa, Cryptosporidium parvum
QGNKQSQI

SEQ ID NO: 2276531 - protein, 5 aa, Cryptosporidium parvum
QGNKY

SEQ ID NO: 2276532 - protein, 14 aa, Cryptosporidium parvum
QGNMGESNRSKSSF

SEQ ID NO: 2276533 - protein, 7 aa, Cryptosporidium parvum
QGNPNKA

SEQ ID NO: 2276534 - protein, 13 aa, Cryptosporidium parvum
QGNPSNNENENTL

SEQ ID NO: 2276535 - protein, 14 aa, Cryptosporidium parvum
QGNSAYKSSKVEAL

SEQ ID NO: 2276536 - protein, 6 aa, Cryptosporidium parvum
QGNSRD

SEQ ID NO: 2276537 - protein, 16 aa, Cryptosporidium parvum
QGNSRKENGGNINNNL

SEQ ID NO: 2276538 - protein, 6 aa, Cryptosporidium parvum
QGNTPL

SEQ ID NO: 2276539 - protein, 18 aa, Cryptosporidium parvum
QGPDPDCNQSNKVGSSGF

SEQ ID NO: 2276540 - protein, 7 aa, Cryptosporidium parvum
QGPGMGA

SEQ ID NO: 2276541 - protein, 10 aa, Cryptosporidium parvum
QGPPGTGKTT

SEQ ID NO: 2276542 - protein, 13 aa, Cryptosporidium parvum
QGPRYVPGGKEDL

SEQ ID NO: 2276543 - protein, 4 aa, Cryptosporidium parvum
QGQD

SEQ ID NO: 2276544 - protein, 6 aa, Cryptosporidium parvum
QGQDDS

SEQ ID NO: 2276545 - protein, 15 aa, Cryptosporidium parvum
QGQGVGGNSSSGNSS

SEQ ID NO: 2276546 - protein, 24 aa, Cryptosporidium parvum
QGQIQDQGQTQDQGQTQDHGQIQD

SEQ ID NO: 2276547 - protein, 8 aa, Cryptosporidium parvum
QGQKGGMM

SEQ ID NO: 2276548 - protein, 4 aa, Cryptosporidium parvum
QGQL

SEQ ID NO: 2276549 - protein, 10 aa, Cryptosporidium parvum
QGQSAMSGHY

SEQ ID NO: 2276550 - protein, 32 aa, Cryptosporidium parvum
QGQTSGTGITADNTQVGKPGSGVTATNIPTSQ

SEQ ID NO: 2276551 - protein, 6 aa, Cryptosporidium parvum
QGQYIP

SEQ ID NO: 2276552 - protein, 8 aa, Cryptosporidium parvum
QGRDPTQE

SEQ ID NO: 2276553 - protein, 9 aa, Cryptosporidium parvum
QGRESLPPL

SEQ ID NO: 2276554 - protein, 8 aa, Cryptosporidium parvum
QGRPRNEL

SEQ ID NO: 2276555 - protein, 9 aa, Cryptosporidium parvum
QGRTADSGH

SEQ ID NO: 2276556 - protein, 15 aa, Cryptosporidium parvum
QGRTDNSESNDDEVE

SEQ ID NO: 2276557 - protein, 7 aa, Cryptosporidium parvum
QGSDNNM

SEQ ID NO: 2276558 - protein, 5 aa, Cryptosporidium parvum
QGSEM

SEQ ID NO: 2276559 - protein, 7 aa, Cryptosporidium parvum
QGSESLE

SEQ ID NO: 2276560 - protein, 8 aa, Cryptosporidium parvum
QGSKSPAQ

SEQ ID NO: 2276561 - protein, 9 aa, Cryptosporidium parvum
QGSNGDQNH

SEQ ID NO: 2276562 - protein, 5 aa, Cryptosporidium parvum
QGSNH

SEQ ID NO: 2276563 - protein, 9 aa, Cryptosporidium parvum
QGSNSNGRV

SEQ ID NO: 2276564 - protein, 4 aa, Cryptosporidium parvum
QGSQ

SEQ ID NO: 2276565 - protein, 9 aa, Cryptosporidium parvum
QGSQSSPYN

SEQ ID NO: 2276566 - protein, 9 aa, Cryptosporidium parvum
QGSRYSEAC

SEQ ID NO: 2276567 - protein, 9 aa, Cryptosporidium parvum
QGSSETYLE

SEQ ID NO: 2276568 - protein, 5 aa, Cryptosporidium parvum
QGSSI

SEQ ID NO: 2276569 - protein, 9 aa, Cryptosporidium parvum
QGSSQEFND

SEQ ID NO: 2276570 - protein, 7 aa, Cryptosporidium parvum
QGSTGAV

SEQ ID NO: 2276571 - protein, 8 aa, Cryptosporidium parvum
QGSYSAAK

SEQ ID NO: 2276572 - protein, 21 aa, Cryptosporidium parvum
QGTEKDISPPQIQESSSSFDT

SEQ ID NO: 2276573 - protein, 11 aa, Cryptosporidium parvum
QGTEKEKIGNL

SEQ ID NO: 2276574 - protein, 5 aa, Cryptosporidium parvum
QGTPF

SEQ ID NO: 2276575 - protein, 5 aa, Cryptosporidium parvum
QGTTC

SEQ ID NO: 2276576 - protein, 9 aa, Cryptosporidium parvum
QGTVSTTGQ

SEQ ID NO: 2276577 - protein, 5 aa, Cryptosporidium parvum
QGVGN

SEQ ID NO: 2276578 - protein, 8 aa, Cryptosporidium parvum
QGVGTGIG

SEQ ID NO: 2276579 - protein, 7 aa, Cryptosporidium parvum
QGVGTSK

SEQ ID NO: 2276580 - protein, 8 aa, Cryptosporidium parvum
QGVSDYNT

SEQ ID NO: 2276581 - protein, 19 aa, Cryptosporidium parvum
QGVSEYSQSGNEEHTSKSS

SEQ ID NO: 2276582 - protein, 50 aa, Cryptosporidium parvum
QGYDHAPEVEEKKGEEKEEEGEEEVEEEEEQEEEEEKDEKDVRGADDMDQ

SEQ ID NO: 2276583 - protein, 7 aa, Cryptosporidium parvum
QGYHPAP

SEQ ID NO: 2276584 - protein, 26 aa, Cryptosporidium parvum
QHAPSSGSLDNGNKTIDSSENNRGIE

SEQ ID NO: 2276585 - protein, 7 aa, Cryptosporidium parvum
QHDKKSD

SEQ ID NO: 2276586 - protein, 4 aa, Cryptosporidium parvum
QHDV

SEQ ID NO: 2276587 - protein, 9 aa, Cryptosporidium parvum
QHERGLQEN

SEQ ID NO: 2276588 - protein, 10 aa, Cryptosporidium parvum
QHESEEANTY

SEQ ID NO: 2276589 - protein, 7 aa, Cryptosporidium parvum
QHESGGA

SEQ ID NO: 2276590 - protein, 8 aa, Cryptosporidium parvum
QHGNQNSI

SEQ ID NO: 2276591 - protein, 4 aa, Cryptosporidium parvum
QHGQ

SEQ ID NO: 2276592 - protein, 47 aa, Cryptosporidium parvum
QHHQQQQHQHQQQHQHQQQQQHQQQHQGQNTTQHPKQVSQRQISSNF

SEQ ID NO: 2276593 - protein, 9 aa, Cryptosporidium parvum
QHKASKARN

SEQ ID NO: 2276594 - protein, 4 aa, Cryptosporidium parvum
QHNE

SEQ ID NO: 2276595 - protein, 12 aa, Cryptosporidium parvum
QHNEDTTPKPVF

SEQ ID NO: 2276596 - protein, 10 aa, Cryptosporidium parvum
QHNKEEDLNH

SEQ ID NO: 2276597 - protein, 6 aa, Cryptosporidium parvum
QHNQGV

SEQ ID NO: 2276598 - protein, 48 aa, Cryptosporidium parvum
QHPLSTQSNGASANISQGPFPNSSGVSVNGVSAGAGAGLGGGVGSGTA

SEQ ID NO: 2276599 - protein, 5 aa, Cryptosporidium parvum
QHQKA

SEQ ID NO: 2276600 - protein, 8 aa, Cryptosporidium parvum
QHSAHPAT

SEQ ID NO: 2276601 - protein, 12 aa, Cryptosporidium parvum
QHSNPVTPQQAQ

SEQ ID NO: 2276602 - protein, 24 aa, Cryptosporidium parvum
QHSSHRHGNQPKVTSNGTSNTNTA

SEQ ID NO: 2276603 - protein, 6 aa, Cryptosporidium parvum
QHSYSE

SEQ ID NO: 2276604 - protein, 10 aa, Cryptosporidium parvum
QHTDYPPKYY

SEQ ID NO: 2276605 - protein, 5 aa, Cryptosporidium parvum
QHTGG

SEQ ID NO: 2276606 - protein, 6 aa, Cryptosporidium parvum
QHVPGS

SEQ ID NO: 2276607 - protein, 13 aa, Cryptosporidium parvum
QHYSAQKEEKRSL

SEQ ID NO: 2276608 - protein, 10 aa, Cryptosporidium parvum
QIATPRTKAT

SEQ ID NO: 2276609 - protein, 6 aa, Cryptosporidium parvum
QIDANN

SEQ ID NO: 2276610 - protein, 22 aa, Cryptosporidium parvum
QIDDTKNSGVGSEYKDPSIPEG

SEQ ID NO: 2276611 - protein, 5 aa, Cryptosporidium parvum
QIDNN

SEQ ID NO: 2276612 - protein, 6 aa, Cryptosporidium parvum
QIDSSD

SEQ ID NO: 2276613 - protein, 6 aa, Cryptosporidium parvum
QIEEER

SEQ ID NO: 2276614 - protein, 18 aa, Cryptosporidium parvum
QIEENQKLTDYDKEKLRE

SEQ ID NO: 2276615 - protein, 4 aa, Cryptosporidium parvum
QIEI

SEQ ID NO: 2276616 - protein, 7 aa, Cryptosporidium parvum
QIENRES

SEQ ID NO: 2276617 - protein, 6 aa, Cryptosporidium parvum
QIEPGK

SEQ ID NO: 2276618 - protein, 16 aa, Cryptosporidium parvum
QIESEEDNKVKSNVTV

SEQ ID NO: 2276619 - protein, 24 aa, Cryptosporidium parvum
QIESSKKNKCLEENVSNKDFTENK

SEQ ID NO: 2276620 - protein, 7 aa, Cryptosporidium parvum
QIESSND

SEQ ID NO: 2276621 - protein, 23 aa, Cryptosporidium parvum
QIETNNRHTDRYNNQISSTENHP

SEQ ID NO: 2276622 - protein, 6 aa, Cryptosporidium parvum
QIGNDS

SEQ ID NO: 2276623 - protein, 8 aa, Cryptosporidium parvum
QIGNSGNN

SEQ ID NO: 2276624 - protein, 4 aa, Cryptosporidium parvum
QIGS

SEQ ID NO: 2276625 - protein, 8 aa, Cryptosporidium parvum
QIGSTGRR

SEQ ID NO: 2276626 - protein, 5 aa, Cryptosporidium parvum
QIKEG

SEQ ID NO: 2276627 - protein, 13 aa, Cryptosporidium parvum
QIKPPGKIPELTP

SEQ ID NO: 2276628 - protein, 6 aa, Cryptosporidium parvum
QIKQKE

SEQ ID NO: 2276629 - protein, 6 aa, Cryptosporidium parvum
QIKQPI

SEQ ID NO: 2276630 - protein, 5 aa, Cryptosporidium parvum
QINAN

SEQ ID NO: 2276631 - protein, 4 aa, Cryptosporidium parvum
QIND

SEQ ID NO: 2276632 - protein, 9 aa, Cryptosporidium parvum
QINDDDDEF

SEQ ID NO: 2276633 - protein, 21 aa, Cryptosporidium parvum
QINDNVSDELNNTNNDDAFEE

SEQ ID NO: 2276634 - protein, 10 aa, Cryptosporidium parvum
QINDSNTRTI

SEQ ID NO: 2276635 - protein, 10 aa, Cryptosporidium parvum
QINKNESQLL

SEQ ID NO: 2276636 - protein, 7 aa, Cryptosporidium parvum
QINPPSM

SEQ ID NO: 2276637 - protein, 9 aa, Cryptosporidium parvum
QINQEREQK

SEQ ID NO: 2276638 - protein, 23 aa, Cryptosporidium parvum
QINRPNQENDHSTKDTGNEPQIG

SEQ ID NO: 2276639 - protein, 23 aa, Cryptosporidium parvum
QINSKKDKQKNKNKGGDENESLK

SEQ ID NO: 2276640 - protein, 7 aa, Cryptosporidium parvum
QINSKNK

SEQ ID NO: 2276641 - protein, 12 aa, Cryptosporidium parvum
QIPANKRDDLGD

SEQ ID NO: 2276642 - protein, 7 aa, Cryptosporidium parvum
QIPEPGD

SEQ ID NO: 2276643 - protein, 8 aa, Cryptosporidium parvum
QIPGDQSS

SEQ ID NO: 2276644 - protein, 11 aa, Cryptosporidium parvum
QIPNAESENSG

SEQ ID NO: 2276645 - protein, 10 aa, Cryptosporidium parvum
QIPNESPNSY

SEQ ID NO: 2276646 - protein, 11 aa, Cryptosporidium parvum
QIPNSKKRCTE

SEQ ID NO: 2276647 - protein, 8 aa, Cryptosporidium parvum
QIPNTKNS

SEQ ID NO: 2276648 - protein, 17 aa, Cryptosporidium parvum
QIPPAKIKRENTEQMNP

SEQ ID NO: 2276649 - protein, 10 aa, Cryptosporidium parvum
QIPTENSKQF

SEQ ID NO: 2276650 - protein, 26 aa, Cryptosporidium parvum
QIQAKTNDQIPKKNVTENSNLNDSEL

SEQ ID NO: 2276651 - protein, 7 aa, Cryptosporidium parvum
QIQKDGS

SEQ ID NO: 2276652 - protein, 20 aa, Cryptosporidium parvum
QIQKQENEENSKREKENTVK

SEQ ID NO: 2276653 - protein, 36 aa, Cryptosporidium parvum
QIQPQQKQAESTEHSSQLENKQPDAITGSESELKPE

SEQ ID NO: 2276654 - protein, 6 aa, Cryptosporidium parvum
QIQPRN

SEQ ID NO: 2276655 - protein, 10 aa, Cryptosporidium parvum
QIQSPESREQ

SEQ ID NO: 2276656 - protein, 14 aa, Cryptosporidium parvum
QIQSQREEKEVANG

SEQ ID NO: 2276657 - protein, 11 aa, Cryptosporidium parvum
QIQTGNQAKPI

SEQ ID NO: 2276658 - protein, 19 aa, Cryptosporidium parvum
QIQTRNNNMNIDGDKENNP

SEQ ID NO: 2276659 - protein, 5 aa, Cryptosporidium parvum
QIRPD

SEQ ID NO: 2276660 - protein, 6 aa, Cryptosporidium parvum
QIRSNE

SEQ ID NO: 2276661 - protein, 7 aa, Cryptosporidium parvum
QISAEEE

SEQ ID NO: 2276662 - protein, 11 aa, Cryptosporidium parvum
QISEARKATME

SEQ ID NO: 2276663 - protein, 5 aa, Cryptosporidium parvum
QISEE

SEQ ID NO: 2276664 - protein, 10 aa, Cryptosporidium parvum
QISEKYSKLR

SEQ ID NO: 2276665 - protein, 15 aa, Cryptosporidium parvum
QISESLEGKIGKPEI

SEQ ID NO: 2276666 - protein, 8 aa, Cryptosporidium parvum
QISETERS

SEQ ID NO: 2276667 - protein, 12 aa, Cryptosporidium parvum
QISGNNQTSFES

SEQ ID NO: 2276668 - protein, 11 aa, Cryptosporidium parvum
QISKSDDCRTS

SEQ ID NO: 2276669 - protein, 5 aa, Cryptosporidium parvum
QISND

SEQ ID NO: 2276670 - protein, 9 aa, Cryptosporidium parvum
QISNKGRNL

SEQ ID NO: 2276671 - protein, 5 aa, Cryptosporidium parvum
QISNT

SEQ ID NO: 2276672 - protein, 19 aa, Cryptosporidium parvum
QISRNKNTPMISLEDKLKN

SEQ ID NO: 2276673 - protein, 35 aa, Cryptosporidium parvum; identical to SEQ ID NO: 2157526

SEQ ID NO: 2276674 - protein, 9 aa, Cryptosporidium parvum
QISSNGNSI

SEQ ID NO: 2276675 - protein, 11 aa, Cryptosporidium parvum
QISSQNEQNPY

SEQ ID NO: 2276676 - protein, 10 aa, Cryptosporidium parvum
QISTTSKDNF

SEQ ID NO: 2276677 - protein, 16 aa, Cryptosporidium parvum
QITNGNNGKQDKNVKN

SEQ ID NO: 2276678 - protein, 5 aa, Cryptosporidium parvum
QITSS

SEQ ID NO: 2276679 - protein, 16 aa, Cryptosporidium parvum
QITVKEPSKASEGDTN

SEQ ID NO: 2276680 - protein, 14 aa, Cryptosporidium parvum
QIYESEDDEDPLNV

SEQ ID NO: 2276681 - protein, 20 aa, Cryptosporidium parvum
QKAELKSELNRNKVKSSDFE

SEQ ID NO: 2276682 - protein, 13 aa, Cryptosporidium parvum
QKAKRRRTTGTGR

SEQ ID NO: 2276683 - protein, 10 aa, Cryptosporidium parvum
QKALSSSKRE

SEQ ID NO: 2276684 - protein, 9 aa, Cryptosporidium parvum
QKANIQSRI

SEQ ID NO: 2276685 - protein, 8 aa, Cryptosporidium parvum
QKATDEHN

SEQ ID NO: 2276686 - protein, 5 aa, Cryptosporidium parvum
QKAVE

SEQ ID NO: 2276687 - protein, 13 aa, Cryptosporidium parvum
QKCEEEPVQEQKK

SEQ ID NO: 2276688 - protein, 5 aa, Cryptosporidium parvum
QKCKY

SEQ ID NO: 2276689 - protein, 7 aa, Cryptosporidium parvum
QKCPRCR

SEQ ID NO: 2276690 - protein, 15 aa, Cryptosporidium parvum
QKDDNGKIMENNEDI

SEQ ID NO: 2276691 - protein, 10 aa, Cryptosporidium parvum
QKDDNRSQYN

SEQ ID NO: 2276692 - protein, 5 aa, Cryptosporidium parvum
QKDDQ

SEQ ID NO: 2276693 - protein, 9 aa, Cryptosporidium parvum
QKDDSEPID

SEQ ID NO: 2276694 - protein, 6 aa, Cryptosporidium parvum
QKDEEW

SEQ ID NO: 2276695 - protein, 4 aa, Cryptosporidium parvum
QKDF

SEQ ID NO: 2276696 - protein, 5 aa, Cryptosporidium parvum
QKDFP

SEQ ID NO: 2276697 - protein, 7 aa, Cryptosporidium parvum
QKDGTVQ

SEQ ID NO: 2276698 - protein, 5 aa, Cryptosporidium parvum
QKDKL

SEQ ID NO: 2276699 - protein, 6 aa, Cryptosporidium parvum
QKDKNR

SEQ ID NO: 2276700 - protein, 8 aa, Cryptosporidium parvum
QKDPTESS

SEQ ID NO: 2276701 - protein, 8 aa, Cryptosporidium parvum
QKDRELSE

SEQ ID NO: 2276702 - protein, 6 aa, Cryptosporidium parvum
QKDSNF

SEQ ID NO: 2276703 - protein, 6 aa, Cryptosporidium parvum
QKDSSE

SEQ ID NO: 2276704 - protein, 21 aa, Cryptosporidium parvum
QKDTSNANKKSDTPATELQGS

SEQ ID NO: 2276705 - protein, 7 aa, Cryptosporidium parvum
QKEEESK

SEQ ID NO: 2276706 - protein, 5 aa, Cryptosporidium parvum
QKEEL

SEQ ID NO: 2276707 - protein, 13 aa, Cryptosporidium parvum
QKEESEDSGSDIF

SEQ ID NO: 2276708 - protein, 11 aa, Cryptosporidium parvum
QKEFNNDEQKL

SEQ ID NO: 2276709 - protein, 8 aa, Cryptosporidium parvum
QKEGDVES

SEQ ID NO: 2276710 - protein, 9 aa, Cryptosporidium parvum
QKEHDGLRN

SEQ ID NO: 2276711 - protein, 13 aa, Cryptosporidium parvum
QKEHEEDLARDAA

SEQ ID NO: 2276712 - protein, 99 aa, Cryptosporidium parvum
QKEKDQDNNPDDDDDDDNEREREREREREREREREREREREKEREREREREKEREREREREKEREREREREKERERERDMNKNKYGPTRKTGDGSSSAA

SEQ ID NO: 2276713 - protein, 9 aa, Cryptosporidium parvum
QKEKDSGAE

SEQ ID NO: 2276714 - protein, 28 aa, Cryptosporidium parvum
QKEKNPSQNSSNSKNKLKTKNQTNINES

SEQ ID NO: 2276715 - protein, 8 aa, Cryptosporidium parvum
QKELEAKK

SEQ ID NO: 2276716 - protein, 4 aa, Cryptosporidium parvum
QKEM

SEQ ID NO: 2276717 - protein, 14 aa, Cryptosporidium parvum
QKEPDSKVKDQEPV

SEQ ID NO: 2276718 - protein, 22 aa, Cryptosporidium parvum
QKEQLISTDNKMGNISKSLQDS

SEQ ID NO: 2276719 - protein, 4 aa, Cryptosporidium parvum
QKER

SEQ ID NO: 2276720 - protein, 8 aa, Cryptosporidium parvum
QKERSNSP

SEQ ID NO: 2276721 - protein, 6 aa, Cryptosporidium parvum
QKESES

SEQ ID NO: 2276722 - protein, 5 aa, Cryptosporidium parvum
QKESI

SEQ ID NO: 2276723 - protein, 18 aa, Cryptosporidium parvum
QKETAQAYHQKQQQQEKA

SEQ ID NO: 2276724 - protein, 10 aa, Cryptosporidium parvum
QKEWKESNDF

SEQ ID NO: 2276725 - protein, 14 aa, Cryptosporidium parvum
QKEYKKRKYSDKFQ

SEQ ID NO: 2276726 - protein, 75 aa, Cryptosporidium parvum
QKEYNSEETNETTISSIRNDDTKNGQNSNSSDEEVDSGKKDDDEEEEDDFDDEESDENEEFKEDEDFEENENIPN

SEQ ID NO: 2276727 - protein, 6 aa, Cryptosporidium parvum
QKGATF

SEQ ID NO: 2276728 - protein, 8 aa, Cryptosporidium parvum
QKGGSSQV

SEQ ID NO: 2276729 - protein, 5 aa, Cryptosporidium parvum
QKGKG

SEQ ID NO: 2276730 - protein, 15 aa, Cryptosporidium parvum
QKGNTENQEHDDISE

SEQ ID NO: 2276731 - protein, 16 aa, Cryptosporidium parvum
QKGRPNRSKVVLVERR

SEQ ID NO: 2276732 - protein, 5 aa, Cryptosporidium parvum
QKGSS

SEQ ID NO: 2276733 - protein, 9 aa, Cryptosporidium parvum
QKGTLEEEM

SEQ ID NO: 2276734 - protein, 5 aa, Cryptosporidium parvum
QKGTN

SEQ ID NO: 2276735 - protein, 5 aa, Cryptosporidium parvum
QKHKG

SEQ ID NO: 2276736 - protein, 8 aa, Cryptosporidium parvum
QKHNSRHW

SEQ ID NO: 2276737 - protein, 48 aa, Cryptosporidium parvum
QKHQTYSSSSHNSHHEGRYNQDRRGRGYGYSGNRQHNHGSSSGGGYDL

SEQ ID NO: 2276738 - protein, 12 aa, Cryptosporidium parvum
QKHSQNTEDCSN

SEQ ID NO: 2276739 - protein, 4 aa, Cryptosporidium parvum
QKHY

SEQ ID NO: 2276740 - protein, 12 aa, Cryptosporidium parvum
QKIDAEKESQKS

SEQ ID NO: 2276741 - protein, 12 aa, Cryptosporidium parvum
QKIESSLTSRGY

SEQ ID NO: 2276742 - protein, 6 aa, Cryptosporidium parvum
QKINRN

SEQ ID NO: 2276743 - protein, 8 aa, Cryptosporidium parvum
QKIPTEKS

SEQ ID NO: 2276744 - protein, 9 aa, Cryptosporidium parvum
QKISDPESE

SEQ ID NO: 2276745 - protein, 16 aa, Cryptosporidium parvum
QKISDQQNLQSCENPN

SEQ ID NO: 2276746 - protein, 12 aa, Cryptosporidium parvum
QKITQGQESSRY

SEQ ID NO: 2276747 - protein, 5 aa, Cryptosporidium parvum
QKIVS

SEQ ID NO: 2276748 - protein, 9 aa, Cryptosporidium parvum
QKKDGKMEE

SEQ ID NO: 2276749 - protein, 7 aa, Cryptosporidium parvum
QKKDLDE

SEQ ID NO: 2276750 - protein, 8 aa, Cryptosporidium parvum
QKKENNEL

SEQ ID NO: 2276751 - protein, 7 aa, Cryptosporidium parvum
QKKINID

SEQ ID NO: 2276752 - protein, 11 aa, Cryptosporidium parvum
QKKKNQRNKKL

SEQ ID NO: 2276753 - protein, 8 aa, Cryptosporidium parvum
QKKNKNIQ

SEQ ID NO: 2276754 - protein, 10 aa, Cryptosporidium parvum
QKKQEDARKI

SEQ ID NO: 2276755 - protein, 24 aa, Cryptosporidium parvum
QKKQQNTQSQNNNGVSSTQDDDEY

SEQ ID NO: 2276756 - protein, 23 aa, Cryptosporidium parvum
QKKRDEEDSSNTDCNSSEEKPVI

SEQ ID NO: 2276757 - protein, 6 aa, Cryptosporidium parvum
QKKRGI

SEQ ID NO: 2276758 - protein, 26 aa, Cryptosporidium parvum
QKKRLSNAEEGSGITDNLKSEGVNQG

SEQ ID NO: 2276759 - protein, 17 aa, Cryptosporidium parvum
QKKSEDLIQDFEKLSIN

SEQ ID NO: 2276760 - protein, 10 aa, Cryptosporidium parvum
QKKSNEIDSK

SEQ ID NO: 2276761 - protein, 8 aa, Cryptosporidium parvum
QKKSQKMP

SEQ ID NO: 2276762 - protein, 51 aa, Cryptosporidium parvum; identical to SEQ ID NO: 2157600

SEQ ID NO: 2276763 - protein, 7 aa, Cryptosporidium parvum
QKKVNER

SEQ ID NO: 2276764 - protein, 17 aa, Cryptosporidium parvum
QKLDQSSSFQSGSEVMS

SEQ ID NO: 2276765 - protein, 23 aa, Cryptosporidium parvum
QKLDTSEMEEINPGRRNQENHSS

SEQ ID NO: 2276766 - protein, 9 aa, Cryptosporidium parvum
QKLENSKEY

SEQ ID NO: 2276767 - protein, 13 aa, Cryptosporidium parvum
QKLKEERNKCTRL

SEQ ID NO: 2276768 - protein, 5 aa, Cryptosporidium parvum
QKLSF

SEQ ID NO: 2276769 - protein, 4 aa, Cryptosporidium parvum
QKLV

SEQ ID NO: 2276770 - protein, 4 aa, Cryptosporidium parvum
QKME

SEQ ID NO: 2276771 - protein, 12 aa, Cryptosporidium parvum
QKNASQNTQYKQ

SEQ ID NO: 2276772 - protein, 8 aa, Cryptosporidium parvum
QKNDGSDV

SEQ ID NO: 2276773 - protein, 4 aa, Cryptosporidium parvum
QKNE

SEQ ID NO: 2276774 - protein, 9 aa, Cryptosporidium parvum
QKNEDYDEN

SEQ ID NO: 2276775 - protein, 8 aa, Cryptosporidium parvum
QKNEEPYL

SEQ ID NO: 2276776 - protein, 4 aa, Cryptosporidium parvum
QKNG

SEQ ID NO: 2276777 - protein, 5 aa, Cryptosporidium parvum
QKNHD

SEQ ID NO: 2276778 - protein, 11 aa, Cryptosporidium parvum
QKNHEQKQNAK

SEQ ID NO: 2276779 - protein, 13 aa, Cryptosporidium parvum
QKNIGSAANRIDP

SEQ ID NO: 2276780 - protein, 16 aa, Cryptosporidium parvum
QKNKINSNISLSSSNN

SEQ ID NO: 2276781 - protein, 5 aa, Cryptosporidium parvum
QKNKK

SEQ ID NO: 2276782 - protein, 9 aa, Cryptosporidium parvum
QKNNKDQSI

SEQ ID NO: 2276783 - protein, 4 aa, Cryptosporidium parvum
QKNQ

SEQ ID NO: 2276784 - protein, 9 aa, Cryptosporidium parvum
QKNQTSVRL

SEQ ID NO: 2276785 - protein, 10 aa, Cryptosporidium parvum
QKNSNQINDF

SEQ ID NO: 2276786 - protein, 10 aa, Cryptosporidium parvum
QKNSNSARHV

SEQ ID NO: 2276787 - protein, 7 aa, Cryptosporidium parvum
QKNSPFP

SEQ ID NO: 2276788 - protein, 9 aa, Cryptosporidium parvum
QKNYTDEQE

SEQ ID NO: 2276789 - protein, 4 aa, Cryptosporidium parvum
QKPD

SEQ ID NO: 2276790 - protein, 10 aa, Cryptosporidium parvum
QKPGTSGLRK

SEQ ID NO: 2276791 - protein, 5 aa, Cryptosporidium parvum
QKPLT

SEQ ID NO: 2276792 - protein, 6 aa, Cryptosporidium parvum
QKPPIV

SEQ ID NO: 2276793 - protein, 5 aa, Cryptosporidium parvum
QKPVF

SEQ ID NO: 2276794 - protein, 4 aa, Cryptosporidium parvum
QKQK

SEQ ID NO: 2276795 - protein, 4 aa, Cryptosporidium parvum
QKQN

SEQ ID NO: 2276796 - protein, 8 aa, Cryptosporidium parvum
QKQPPKLV

SEQ ID NO: 2276797 - protein, 6 aa, Cryptosporidium parvum
QKRDDL

SEQ ID NO: 2276798 - protein, 8 aa, Cryptosporidium parvum
QKRESAPE

SEQ ID NO: 2276799 - protein, 9 aa, Cryptosporidium parvum
QKRKEKSAK

SEQ ID NO: 2276800 - protein, 13 aa, Cryptosporidium parvum
QKRKLANKDPVSE

SEQ ID NO: 2276801 - protein, 11 aa, Cryptosporidium parvum
QKRMNQRESTA

SEQ ID NO: 2276802 - protein, 4 aa, Cryptosporidium parvum
QKRN

SEQ ID NO: 2276803 - protein, 6 aa, Cryptosporidium parvum
QKRNRL

SEQ ID NO: 2276804 - protein, 14 aa, Cryptosporidium parvum
QKRQQISNSNQTQI

SEQ ID NO: 2276805 - protein, 4 aa, Cryptosporidium parvum
QKRR

SEQ ID NO: 2276806 - protein, 6 aa, Cryptosporidium parvum
QKRSGF

SEQ ID NO: 2276807 - protein, 6 aa, Cryptosporidium parvum
QKRSSV

SEQ ID NO: 2276808 - protein, 16 aa, Cryptosporidium parvum
QKRVTGKKKTYEERIR

SEQ ID NO: 2276809 - protein, 7 aa, Cryptosporidium parvum
QKRYQAA

SEQ ID NO: 2276810 - protein, 10 aa, Cryptosporidium parvum
QKSAEGLASP

SEQ ID NO: 2276811 - protein, 12 aa, Cryptosporidium parvum
QKSAQKSSGKPL

SEQ ID NO: 2276812 - protein, 8 aa, Cryptosporidium parvum
QKSDPENI

SEQ ID NO: 2276813 - protein, 10 aa, Cryptosporidium parvum
QKSDPSQSMN

SEQ ID NO: 2276814 - protein, 7 aa, Cryptosporidium parvum
QKSEIES

SEQ ID NO: 2276815 - protein, 7 aa, Cryptosporidium parvum
QKSEIGE

SEQ ID NO: 2276816 - protein, 8 aa, Cryptosporidium parvum
QKSEQKRI

SEQ ID NO: 2276817 - protein, 21 aa, Cryptosporidium parvum
QKSGDDSSSQFENQEERLESD

SEQ ID NO: 2276818 - protein, 8 aa, Cryptosporidium parvum
QKSGKKSV

SEQ ID NO: 2276819 - protein, 7 aa, Cryptosporidium parvum
QKSHSDW

SEQ ID NO: 2276820 - protein, 7 aa, Cryptosporidium parvum
QKSIDRS

SEQ ID NO: 2276821 - protein, 12 aa, Cryptosporidium parvum
QKSINEKNHANN

SEQ ID NO: 2276822 - protein, 8 aa, Cryptosporidium parvum
QKSKDNSI

SEQ ID NO: 2276823 - protein, 32 aa, Cryptosporidium parvum
QKSKKNSASNGGGNNNRKKTAINSFNNGSNSS

SEQ ID NO: 2276824 - protein, 5 aa, Cryptosporidium parvum
QKSKL

SEQ ID NO: 2276825 - protein, 15 aa, Cryptosporidium parvum
QKSKLSKISQNDQDS

SEQ ID NO: 2276826 - protein, 7 aa, Cryptosporidium parvum
QKSKNQI

SEQ ID NO: 2276827 - protein, 6 aa, Cryptosporidium parvum
QKSKVN

SEQ ID NO: 2276828 - protein, 9 aa, Cryptosporidium parvum
QKSLQNTNS

SEQ ID NO: 2276829 - protein, 7 aa, Cryptosporidium parvum
QKSNSRI

SEQ ID NO: 2276830 - protein, 7 aa, Cryptosporidium parvum
QKSQSVL

SEQ ID NO: 2276831 - protein, 8 aa, Cryptosporidium parvum
QKSREKSY

SEQ ID NO: 2276832 - protein, 8 aa, Cryptosporidium parvum
QKSSFGDR

SEQ ID NO: 2276833 - protein, 9 aa, Cryptosporidium parvum
QKSSNNNPF

SEQ ID NO: 2276834 - protein, 6 aa, Cryptosporidium parvum
QKSSSL

SEQ ID NO: 2276835 - protein, 8 aa, Cryptosporidium parvum
QKSTQVDA

SEQ ID NO: 2276836 - protein, 20 aa, Cryptosporidium parvum
QKSTSSFDFTGGRPNSALSP

SEQ ID NO: 2276837 - protein, 4 aa, Cryptosporidium parvum
QKSY

SEQ ID NO: 2276838 - protein, 12 aa, Cryptosporidium parvum
QKTIETDAEQTV

SEQ ID NO: 2276839 - protein, 9 aa, Cryptosporidium parvum
QKTLGKNPQ

SEQ ID NO: 2276840 - protein, 6 aa, Cryptosporidium parvum
QKTNSR

SEQ ID NO: 2276841 - protein, 9 aa, Cryptosporidium parvum
QKTQKTKTW

SEQ ID NO: 2276842 - protein, 9 aa, Cryptosporidium parvum
QKTSEIDSL

SEQ ID NO: 2276843 - protein, 5 aa, Cryptosporidium parvum
QKTTK

SEQ ID NO: 2276844 - protein, 7 aa, Cryptosporidium parvum
QKTTPSL

SEQ ID NO: 2276845 - protein, 18 aa, Cryptosporidium parvum
QKVKSKKKSQIESSSQTI

SEQ ID NO: 2276846 - protein, 25 aa, Cryptosporidium parvum
QKVQDTSINNNKSQLSKVDKNSSKI

SEQ ID NO: 2276847 - protein, 4 aa, Cryptosporidium parvum
QKVR

SEQ ID NO: 2276848 - protein, 9 aa, Cryptosporidium parvum
QKVSQYTKV

SEQ ID NO: 2276849 - protein, 8 aa, Cryptosporidium parvum
QKYADHES

SEQ ID NO: 2276850 - protein, 9 aa, Cryptosporidium parvum
QKYDNGPVN

SEQ ID NO: 2276851 - protein, 6 aa, Cryptosporidium parvum
QKYVEK

SEQ ID NO: 2276852 - protein, 13 aa, Cryptosporidium parvum
QLCGTGKKDETDL

SEQ ID NO: 2276853 - protein, 9 aa, Cryptosporidium parvum
QLCPSSSSS

SEQ ID NO: 2276854 - protein, 15 aa, Cryptosporidium parvum
QLDDSNDKSEKNVDS

SEQ ID NO: 2276855 - protein, 11 aa, Cryptosporidium parvum
QLDDSNKTPFV

SEQ ID NO: 2276856 - protein, 6 aa, Cryptosporidium parvum
QLDNED

SEQ ID NO: 2276857 - protein, 13 aa, Cryptosporidium parvum
QLDNNNNNNNNNK

SEQ ID NO: 2276858 - protein, 18 aa, Cryptosporidium parvum
QLDNNSLEKQFQQNSTIS

SEQ ID NO: 2276859 - protein, 6 aa, Cryptosporidium parvum
QLDSNS

SEQ ID NO: 2276860 - protein, 9 aa, Cryptosporidium parvum
QLDSNTENV

SEQ ID NO: 2276861 - protein, 20 aa, Cryptosporidium parvum
QLDSSGRALSTDTSAIEDSG

SEQ ID NO: 2276862 - protein, 10 aa, Cryptosporidium parvum
QLDSSNERND

SEQ ID NO: 2276863 - protein, 8 aa, Cryptosporidium parvum
QLEEENRI

SEQ ID NO: 2276864 - protein, 9 aa, Cryptosporidium parvum
QLEEGEDLN

SEQ ID NO: 2276865 - protein, 5 aa, Cryptosporidium parvum
QLEER

SEQ ID NO: 2276866 - protein, 10 aa, Cryptosporidium parvum
QLEESKNEHL

SEQ ID NO: 2276867 - protein, 10 aa, Cryptosporidium parvum
QLEKNEASEY

SEQ ID NO: 2276868 - protein, 8 aa, Cryptosporidium parvum
QLENAKNI

SEQ ID NO: 2276869 - protein, 4 aa, Cryptosporidium parvum
QLEP

SEQ ID NO: 2276870 - protein, 5 aa, Cryptosporidium parvum
QLERT

SEQ ID NO: 2276871 - protein, 5 aa, Cryptosporidium parvum
QLGDD

SEQ ID NO: 2276872 - protein, 11 aa, Cryptosporidium parvum
QLGDQVSKSMP

SEQ ID NO: 2276873 - protein, 10 aa, Cryptosporidium parvum
QLGEEGRKID

SEQ ID NO: 2276874 - protein, 9 aa, Cryptosporidium parvum
QLGESIKEK

SEQ ID NO: 2276875 - protein, 10 aa, Cryptosporidium parvum
QLGGSNKEVA

SEQ ID NO: 2276876 - protein, 10 aa, Cryptosporidium parvum
QLGKAGKSNF

SEQ ID NO: 2276877 - protein, 5 aa, Cryptosporidium parvum
QLGKS

SEQ ID NO: 2276878 - protein, 13 aa, Cryptosporidium parvum
QLGSKSSLNNESK

SEQ ID NO: 2276879 - protein, 10 aa, Cryptosporidium parvum
QLKDENKELR

SEQ ID NO: 2276880 - protein, 7 aa, Cryptosporidium parvum
QLKDGSE

SEQ ID NO: 2276881 - protein, 9 aa, Cryptosporidium parvum
QLKKGGKMT

SEQ ID NO: 2276882 - protein, 16 aa, Cryptosporidium parvum
QLKKNKNKKNKCEETN

SEQ ID NO: 2276883 - protein, 10 aa, Cryptosporidium parvum
QLKNRDSKRF

SEQ ID NO: 2276884 - protein, 10 aa, Cryptosporidium parvum
QLKPENKDNT

SEQ ID NO: 2276885 - protein, 8 aa, Cryptosporidium parvum
QLKSNDAG

SEQ ID NO: 2276886 - protein, 4 aa, Cryptosporidium parvum
QLKT

SEQ ID NO: 2276887 - protein, 17 aa, Cryptosporidium parvum
QLNDESEIKPPSTYEDD

SEQ ID NO: 2276888 - protein, 12 aa, Cryptosporidium parvum
QLNDNDSKNCND

SEQ ID NO: 2276889 - protein, 11 aa, Cryptosporidium parvum
QLNDSGSNKRV

SEQ ID NO: 2276890 - protein, 25 aa, Cryptosporidium parvum
QLNEESGVTGAEGSYNDHNSPQGSH

SEQ ID NO: 2276891 - protein, 9 aa, Cryptosporidium parvum
QLNKANEIR

SEQ ID NO: 2276892 - protein, 10 aa, Cryptosporidium parvum
QLNKLSSNKD

SEQ ID NO: 2276893 - protein, 17 aa, Cryptosporidium parvum
QLNNQNISKSSKSRNRI

SEQ ID NO: 2276894 - protein, 12 aa, Cryptosporidium parvum
QLNQSNDYDEFE

SEQ ID NO: 2276895 - protein, 6 aa, Cryptosporidium parvum
QLNRDN

SEQ ID NO: 2276896 - protein, 8 aa, Cryptosporidium parvum
QLPKGDYD

SEQ ID NO: 2276897 - protein, 7 aa, Cryptosporidium parvum
QLPNSSN

SEQ ID NO: 2276898 - protein, 6 aa, Cryptosporidium parvum
QLPPDD

SEQ ID NO: 2276899 - protein, 8 aa, Cryptosporidium parvum
QLPPEAEE

SEQ ID NO: 2276900 - protein, 5 aa, Cryptosporidium parvum
QLPTT

SEQ ID NO: 2276901 - protein, 13 aa, Cryptosporidium parvum
QLQGTSEQENKQV

SEQ ID NO: 2276902 - protein, 7 aa, Cryptosporidium parvum
QLQKSNQ

SEQ ID NO: 2276903 - protein, 4 aa, Cryptosporidium parvum
QLRD

SEQ ID NO: 2276904 - protein, 16 aa, Cryptosporidium parvum
QLRKTNQAVIADKIQR

SEQ ID NO: 2276905 - protein, 19 aa, Cryptosporidium parvum
QLSDENSKLNTNYKENKTC

SEQ ID NO: 2276906 - protein, 10 aa, Cryptosporidium parvum
QLSDPSGGQY

SEQ ID NO: 2276907 - protein, 11 aa, Cryptosporidium parvum
QLSEENADKNN

SEQ ID NO: 2276908 - protein, 5 aa, Cryptosporidium parvum
QLSEH

SEQ ID NO: 2276909 - protein, 9 aa, Cryptosporidium parvum
QLSEKERVE

SEQ ID NO: 2276910 - protein, 5 aa, Cryptosporidium parvum
QLSKE

SEQ ID NO: 2276911 - protein, 11 aa, Cryptosporidium parvum
QLSKKQTRRQD

SEQ ID NO: 2276912 - protein, 8 aa, Cryptosporidium parvum
QLSPPNIT

SEQ ID NO: 2276913 - protein, 7 aa, Cryptosporidium parvum
QLSQTHR

SEQ ID NO: 2276914 - protein, 10 aa, Cryptosporidium parvum
QLSRTPRPFP

SEQ ID NO: 2276915 - protein, 12 aa, Cryptosporidium parvum
QLSSNSGSFTNG

SEQ ID NO: 2276916 - protein, 12 aa, Cryptosporidium parvum
QLSSSGQNEGAQ

SEQ ID NO: 2276917 - protein, 7 aa, Cryptosporidium parvum
QLTPTSA

SEQ ID NO: 2276918 - protein, 14 aa, Cryptosporidium parvum
QMASPTSRPEQRAI

SEQ ID NO: 2276919 - protein, 13 aa, Cryptosporidium parvum
QMDEDDKKRSLQE

SEQ ID NO: 2276920 - protein, 5 aa, Cryptosporidium parvum
QMDEN

SEQ ID NO: 2276921 - protein, 24 aa, Cryptosporidium parvum
QMDSNSVKTSPSLVPNSGGNQLTT

SEQ ID NO: 2276922 - protein, 8 aa, Cryptosporidium parvum
QMDSSNGA

SEQ ID NO: 2276923 - protein, 25 aa, Cryptosporidium parvum
QMEEQESQEEVLGESKNENSKSQEV

SEQ ID NO: 2276924 - protein, 10 aa, Cryptosporidium parvum
QMGKLNPGGK

SEQ ID NO: 2276925 - protein, 11 aa, Cryptosporidium parvum
QMGTRRKRRDS

SEQ ID NO: 2276926 - protein, 6 aa, Cryptosporidium parvum
QMQESR

SEQ ID NO: 2276927 - protein, 12 aa, Cryptosporidium parvum
QMQGSKALENTA

SEQ ID NO: 2276928 - protein, 10 aa, Cryptosporidium parvum
QMRESSRLAN

SEQ ID NO: 2276929 - protein, 12 aa, Cryptosporidium parvum
QMRSESKKAQLR

SEQ ID NO: 2276930 - protein, 7 aa, Cryptosporidium parvum
QMSASSD

SEQ ID NO: 2276931 - protein, 8 aa, Cryptosporidium parvum
QMSSNSCS

SEQ ID NO: 2276932 - protein, 5 aa, Cryptosporidium parvum
QMTEG

SEQ ID NO: 2276933 - protein, 4 aa, Cryptosporidium parvum
QMTR

SEQ ID NO: 2276934 - protein, 7 aa, Cryptosporidium parvum
QNAIEEE

SEQ ID NO: 2276935 - protein, 25 aa, Cryptosporidium parvum
QNANNQQLNNNHQIQSNTNFTSNIN

SEQ ID NO: 2276936 - protein, 18 aa, Cryptosporidium parvum
QNANNSYALNSNPPNNAA

SEQ ID NO: 2276937 - protein, 9 aa, Cryptosporidium parvum
QNANNYTEN

SEQ ID NO: 2276938 - protein, 13 aa, Cryptosporidium parvum
QNASFNSNNQNNQ

SEQ ID NO: 2276939 - protein, 21 aa, Cryptosporidium parvum
QNAYSSGLDSFEDDDDQDNES

SEQ ID NO: 2276940 - protein, 13 aa, Cryptosporidium parvum
QNCASNNRKTFSD

SEQ ID NO: 2276941 - protein, 9 aa, Cryptosporidium parvum
QNDDDDLES

SEQ ID NO: 2276942 - protein, 8 aa, Cryptosporidium parvum
QNDEEIKE

SEQ ID NO: 2276943 - protein, 9 aa, Cryptosporidium parvum
QNDENELNR

SEQ ID NO: 2276944 - protein, 7 aa, Cryptosporidium parvum
QNDEQGY

SEQ ID NO: 2276945 - protein, 6 aa, Cryptosporidium parvum
QNDERV

SEQ ID NO: 2276946 - protein, 4 aa, Cryptosporidium parvum
QNDF

SEQ ID NO: 2276947 - protein, 12 aa, Cryptosporidium parvum
QNDGFPRDDGNF

SEQ ID NO: 2276948 - protein, 7 aa, Cryptosporidium parvum
QNDGTRK

SEQ ID NO: 2276949 - protein, 5 aa, Cryptosporidium parvum
QNDKK

SEQ ID NO: 2276950 - protein, 22 aa, Cryptosporidium parvum
QNDLEKRDKELKAQKEQNKQLK

SEQ ID NO: 2276951 - protein, 6 aa, Cryptosporidium parvum
QNDPIE

SEQ ID NO: 2276952 - protein, 6 aa, Cryptosporidium parvum
QNDPNI

SEQ ID NO: 2276953 - protein, 9 aa, Cryptosporidium parvum
QNDRDAQSK

SEQ ID NO: 2276954 - protein, 20 aa, Cryptosporidium parvum
QNDSCEQGSHSLPNDICDLG

SEQ ID NO: 2276955 - protein, 10 aa, Cryptosporidium parvum
QNDSPGPNNG

SEQ ID NO: 2276956 - protein, 10 aa, Cryptosporidium parvum
QNDVEDIQSS

SEQ ID NO: 2276957 - protein, 11 aa, Cryptosporidium parvum
QNDVQGDSDDW

SEQ ID NO: 2276958 - protein, 6 aa, Cryptosporidium parvum
QNEDIP

SEQ ID NO: 2276959 - protein, 9 aa, Cryptosporidium parvum
QNEEKQTAE

SEQ ID NO: 2276960 - protein, 6 aa, Cryptosporidium parvum
QNEENL

SEQ ID NO: 2276961 - protein, 17 aa, Cryptosporidium parvum
QNEGEDNKSFYSSEEEI

SEQ ID NO: 2276962 - protein, 9 aa, Cryptosporidium parvum
QNEKATLEE

SEQ ID NO: 2276963 - protein, 8 aa, Cryptosporidium parvum
QNEKTDYQ

SEQ ID NO: 2276964 - protein, 10 aa, Cryptosporidium parvum
QNEKTSESKL

SEQ ID NO: 2276965 - protein, 7 aa, Cryptosporidium parvum
QNELKTI

SEQ ID NO: 2276966 - protein, 7 aa, Cryptosporidium parvum
QNELNSA

SEQ ID NO: 2276967 - protein, 11 aa, Cryptosporidium parvum
QNENETDQTHN

SEQ ID NO: 2276968 - protein, 7 aa, Cryptosporidium parvum
QNEPTHI

SEQ ID NO: 2276969 - protein, 4 aa, Cryptosporidium parvum
QNEQ

SEQ ID NO: 2276970 - protein, 12 aa, Cryptosporidium parvum
QNESDSNESQLS

SEQ ID NO: 2276971 - protein, 5 aa, Cryptosporidium parvum
QNESF

SEQ ID NO: 2276972 - protein, 9 aa, Cryptosporidium parvum
QNESNRNKE

SEQ ID NO: 2276973 - protein, 12 aa, Cryptosporidium parvum
QNESRNHKKEIH

SEQ ID NO: 2276974 - protein, 16 aa, Cryptosporidium parvum
QNETDSHSIPLPDPDP

SEQ ID NO: 2276975 - protein, 6 aa, Cryptosporidium parvum
QNEVQD

SEQ ID NO: 2276976 - protein, 7 aa, Cryptosporidium parvum
QNFNQVD

SEQ ID NO: 2276977 - protein, 20 aa, Cryptosporidium parvum
QNFQKTSSNRYSPEESFTSR

SEQ ID NO: 2276978 - protein, 23 aa, Cryptosporidium parvum
QNFSSDPLQSQDQNQNELSSSNK

SEQ ID NO: 2276979 - protein, 7 aa, Cryptosporidium parvum
QNGDLNN

SEQ ID NO: 2276980 - protein, 10 aa, Cryptosporidium parvum
QNGDQRDGVK

SEQ ID NO: 2276981 - protein, 5 aa, Cryptosporidium parvum
QNGEK

SEQ ID NO: 2276982 - protein, 9 aa, Cryptosporidium parvum
QNGEKYEGY

SEQ ID NO: 2276983 - protein, 10 aa, Cryptosporidium parvum
QNGGAESNEE

SEQ ID NO: 2276984 - protein, 6 aa, Cryptosporidium parvum
QNGNDD

SEQ ID NO: 2276985 - protein, 22 aa, Cryptosporidium parvum
QNGPSIADSEVTSSKMENRRQR

SEQ ID NO: 2276986 - protein, 8 aa, Cryptosporidium parvum
QNGQNNPL

SEQ ID NO: 2276987 - protein, 4 aa, Cryptosporidium parvum
QNGS

SEQ ID NO: 2276988 - protein, 8 aa, Cryptosporidium parvum
QNGSGKTT

SEQ ID NO: 2276989 - protein, 4 aa, Cryptosporidium parvum
QNGT

SEQ ID NO: 2276990 - protein, 6 aa, Cryptosporidium parvum
QNGTSR

SEQ ID NO: 2276991 - protein, 43 aa, Cryptosporidium parvum
QNGVSPNGAANATGSVQNGVTGNAVTGVQGAQNNRTGGNNQRI

SEQ ID NO: 2276992 - protein, 10 aa, Cryptosporidium parvum
QNHGGKEEQI

SEQ ID NO: 2276993 - protein, 9 aa, Cryptosporidium parvum
QNHLPEKSA

SEQ ID NO: 2276994 - protein, 10 aa, Cryptosporidium parvum
QNIDNSGELS

SEQ ID NO: 2276995 - protein, 4 aa, Cryptosporidium parvum
QNIE

SEQ ID NO: 2276996 - protein, 6 aa, Cryptosporidium parvum
QNIEDK

SEQ ID NO: 2276997 - protein, 19 aa, Cryptosporidium parvum
QNIEKDQKSGSSGNTGDNC

SEQ ID NO: 2276998 - protein, 8 aa, Cryptosporidium parvum
QNIETSDD

SEQ ID NO: 2276999 - protein, 24 aa, Cryptosporidium parvum
QNINNNSSTPTPSSTSTASTNYSE

SEQ ID NO: 2277000 - protein, 19 aa, Cryptosporidium parvum
QNINSNDQDLKTQSSPPKH

SEQ ID NO: 2277001 - protein, 4 aa, Cryptosporidium parvum
QNIQ

SEQ ID NO: 2277002 - protein, 19 aa, Cryptosporidium parvum
QNISKSPLRPKKPGRRQKS

SEQ ID NO: 2277003 - protein, 19 aa, Cryptosporidium parvum
QNISNTNEYPPLSSASNMV

SEQ ID NO: 2277004 - protein, 9 aa, Cryptosporidium parvum
QNISSGNTL

SEQ ID NO: 2277005 - protein, 6 aa, Cryptosporidium parvum
QNITKK

SEQ ID NO: 2277006 - protein, 6 aa, Cryptosporidium parvum
QNKARE

SEQ ID NO: 2277007 - protein, 11 aa, Cryptosporidium parvum
QNKDDNFTKGM

SEQ ID NO: 2277008 - protein, 7 aa, Cryptosporidium parvum
QNKDGSF

SEQ ID NO: 2277009 - protein, 14 aa, Cryptosporidium parvum
QNKDIEIEKKSGEF

SEQ ID NO: 2277010 - protein, 5 aa, Cryptosporidium parvum
QNKEK

SEQ ID NO: 2277011 - protein, 12 aa, Cryptosporidium parvum
QNKENEEKERRR

SEQ ID NO: 2277012 - protein, 8 aa, Cryptosporidium parvum
QNKEQQYR

SEQ ID NO: 2277013 - protein, 12 aa, Cryptosporidium parvum
QNKGENKMNSGE

SEQ ID NO: 2277014 - protein, 10 aa, Cryptosporidium parvum
QNKGKSIGQV

SEQ ID NO: 2277015 - protein, 6 aa, Cryptosporidium parvum
QNKGLN

SEQ ID NO: 2277016 - protein, 4 aa, Cryptosporidium parvum
QNKH

SEQ ID NO: 2277017 - protein, 10 aa, Cryptosporidium parvum
QNKKKNSERV

SEQ ID NO: 2277018 - protein, 12 aa, Cryptosporidium parvum
QNKLDPASEASL

SEQ ID NO: 2277019 - protein, 5 aa, Cryptosporidium parvum
QNKNE

SEQ ID NO: 2277020 - protein, 7 aa, Cryptosporidium parvum
QNKNNIE

SEQ ID NO: 2277021 - protein, 14 aa, Cryptosporidium parvum
QNKNSKKDLILSLK

SEQ ID NO: 2277022 - protein, 4 aa, Cryptosporidium parvum
QNKR

SEQ ID NO: 2277023 - protein, 17 aa, Cryptosporidium parvum
QNKSESPPAENKISVEK

SEQ ID NO: 2277024 - protein, 18 aa, Cryptosporidium parvum
QNKSFKDCRDKEMDDNTT

SEQ ID NO: 2277025 - protein, 18 aa, Cryptosporidium parvum
QNKSKQEKEENLTKETKI

SEQ ID NO: 2277026 - protein, 9 aa, Cryptosporidium parvum
QNKSPFQHD

SEQ ID NO: 2277027 - protein, 10 aa, Cryptosporidium parvum
QNKSRDKTEV

SEQ ID NO: 2277028 - protein, 12 aa, Cryptosporidium parvum
QNLHSSERKGVS

SEQ ID NO: 2277029 - protein, 8 aa, Cryptosporidium parvum
QNLKTTNK

SEQ ID NO: 2277030 - protein, 5 aa, Cryptosporidium parvum
QNLPM

SEQ ID NO: 2277031 - protein, 23 aa, Cryptosporidium parvum
QNLPPPPPKRPTTTDSGTRTESM

SEQ ID NO: 2277032 - protein, 12 aa, Cryptosporidium parvum
QNLQSKSAYNTG

SEQ ID NO: 2277033 - protein, 17 aa, Cryptosporidium parvum
QNLTETPRLGNNMHDSS

SEQ ID NO: 2277034 - protein, 13 aa, Cryptosporidium parvum
QNMDDSNHLSPSP

SEQ ID NO: 2277035 - protein, 9 aa, Cryptosporidium parvum
QNMDKKELS

SEQ ID NO: 2277036 - protein, 6 aa, Cryptosporidium parvum
QNMGSG

SEQ ID NO: 2277037 - protein, 31 aa, Cryptosporidium parvum
QNMPPPTYTPKKNKLDRSNEKGGIQRQSSIT

SEQ ID NO: 2277038 - protein, 5 aa, Cryptosporidium parvum
QNNEN

SEQ ID NO: 2277039 - protein, 13 aa, Cryptosporidium parvum
QNNFDRNDNNMSS

SEQ ID NO: 2277040 - protein, 5 aa, Cryptosporidium parvum
QNNGH

SEQ ID NO: 2277041 - protein, 15 aa, Cryptosporidium parvum
QNNGKELGTKTEQKT

SEQ ID NO: 2277042 - protein, 16 aa, Cryptosporidium parvum
QNNGNVGGTGTGTNNG

SEQ ID NO: 2277043 - protein, 7 aa, Cryptosporidium parvum
QNNHNSA

SEQ ID NO: 2277044 - protein, 4 aa, Cryptosporidium parvum
QNNI

SEQ ID NO: 2277045 - protein, 6 aa, Cryptosporidium parvum
QNNISN

SEQ ID NO: 2277046 - protein, 11 aa, Cryptosporidium parvum
QNNKDKSETLP

SEQ ID NO: 2277047 - protein, 12 aa, Cryptosporidium parvum
QNNKRRSKRGYA

SEQ ID NO: 2277048 - protein, 4 aa, Cryptosporidium parvum
QNNL

SEQ ID NO: 2277049 - protein, 6 aa, Cryptosporidium parvum
QNNNEH

SEQ ID NO: 2277050 - protein, 8 aa, Cryptosporidium parvum
QNNNGDDF

SEQ ID NO: 2277051 - protein, 14 aa, Cryptosporidium parvum
QNNNNLDNNESQES

SEQ ID NO: 2277052 - protein, 8 aa, Cryptosporidium parvum
QNNNNNNN

SEQ ID NO: 2277053 - protein, 12 aa, Cryptosporidium parvum
QNNNNNNNSELN

SEQ ID NO: 2277054 - protein, 8 aa, Cryptosporidium parvum
QNNNQEYQ

SEQ ID NO: 2277055 - protein, 4 aa, Cryptosporidium parvum
QNNP

SEQ ID NO: 2277056 - protein, 8 aa, Cryptosporidium parvum
QNNPYQSK

SEQ ID NO: 2277057 - protein, 37 aa, Cryptosporidium parvum
QNNRKQNSIENTKNDSNDINNNHSNHIQDDNSESNRI

SEQ ID NO: 2277058 - protein, 14 aa, Cryptosporidium parvum
QNNSDLKGETNEKL

SEQ ID NO: 2277059 - protein, 10 aa, Cryptosporidium parvum
QNNSLNKQKQ

SEQ ID NO: 2277060 - protein, 9 aa, Cryptosporidium parvum
QNNSSDPIE

SEQ ID NO: 2277061 - protein, 8 aa, Cryptosporidium parvum
QNNSSISV

SEQ ID NO: 2277062 - protein, 6 aa, Cryptosporidium parvum
QNNSSP

SEQ ID NO: 2277063 - protein, 18 aa, Cryptosporidium parvum
QNNSVGYSGRRSNGARGY

SEQ ID NO: 2277064 - protein, 5 aa, Cryptosporidium parvum
QNNTM

SEQ ID NO: 2277065 - protein, 13 aa, Cryptosporidium parvum
QNNTQNHPPLLPS

SEQ ID NO: 2277066 - protein, 41 aa, Cryptosporidium parvum
QNNTQTASNTNSAESKQSPSSASASVAPQNLGQATNAGHSL

SEQ ID NO: 2277067 - protein, 18 aa, Cryptosporidium parvum
QNNYEKKNKMRSSSTSLP

SEQ ID NO: 2277068 - protein, 11 aa, Cryptosporidium parvum
QNPENEADNSL

SEQ ID NO: 2277069 - protein, 7 aa, Cryptosporidium parvum
QNPETAR

SEQ ID NO: 2277070 - protein, 7 aa, Cryptosporidium parvum
QNPIEDG

SEQ ID NO: 2277071 - protein, 6 aa, Cryptosporidium parvum
QNPNYG

SEQ ID NO: 2277072 - protein, 7 aa, Cryptosporidium parvum
QNPPYTS

SEQ ID NO: 2277073 - protein, 6 aa, Cryptosporidium parvum
QNPRNW

SEQ ID NO: 2277074 - protein, 9 aa, Cryptosporidium parvum
QNPSAGRMG

SEQ ID NO: 2277075 - protein, 10 aa, Cryptosporidium parvum
QNQAPKYEGI

SEQ ID NO: 2277076 - protein, 5 aa, Cryptosporidium parvum
QNQCT

SEQ ID NO: 2277077 - protein, 13 aa, Cryptosporidium parvum
QNQDAPEKSLNNE

SEQ ID NO: 2277078 - protein, 8 aa, Cryptosporidium parvum
QNQDENRI

SEQ ID NO: 2277079 - protein, 9 aa, Cryptosporidium parvum
QNQDEYSNT

SEQ ID NO: 2277080 - protein, 15 aa, Cryptosporidium parvum
QNQFKTENQYVESSQ

SEQ ID NO: 2277081 - protein, 22 aa, Cryptosporidium parvum
QNQHNQHNQNQYQHQQQRYSQN

SEQ ID NO: 2277082 - protein, 4 aa, Cryptosporidium parvum
QNQN

SEQ ID NO: 2277083 - protein, 8 aa, Cryptosporidium parvum
QNQNETRI

SEQ ID NO: 2277084 - protein, 9 aa, Cryptosporidium parvum
QNQNHPQQQ

SEQ ID NO: 2277085 - protein, 6 aa, Cryptosporidium parvum
QNQNKN

SEQ ID NO: 2277086 - protein, 9 aa, Cryptosporidium parvum
QNQNQNQNN

SEQ ID NO: 2277087 - protein, 23 aa, Cryptosporidium parvum
QNQNQSQPQSQQQPVSTQSQPVA

SEQ ID NO: 2277088 - protein, 4 aa, Cryptosporidium parvum
QNQQ

SEQ ID NO: 2277089 - protein, 20 aa, Cryptosporidium parvum
QNQQNTIITGPRKSAMRDGS

SEQ ID NO: 2277090 - protein, 10 aa, Cryptosporidium parvum
QNQSANGNAE

SEQ ID NO: 2277091 - protein, 4 aa, Cryptosporidium parvum
QNQY

SEQ ID NO: 2277092 - protein, 11 aa, Cryptosporidium parvum
QNRGENRKRSR

SEQ ID NO: 2277093 - protein, 7 aa, Cryptosporidium parvum
QNRKRHS

SEQ ID NO: 2277094 - protein, 6 aa, Cryptosporidium parvum
QNRPYS

SEQ ID NO: 2277095 - protein, 4 aa, Cryptosporidium parvum
QNRQ

SEQ ID NO: 2277096 - protein, 9 aa, Cryptosporidium parvum
QNRSNTSKI

SEQ ID NO: 2277097 - protein, 16 aa, Cryptosporidium parvum
QNSDKRISSSSLTPNI

SEQ ID NO: 2277098 - protein, 15 aa, Cryptosporidium parvum
QNSENNSKSYKKLGN

SEQ ID NO: 2277099 - protein, 5 aa, Cryptosporidium parvum
QNSFS

SEQ ID NO: 2277100 - protein, 15 aa, Cryptosporidium parvum
QNSGKTVTANENMNR

SEQ ID NO: 2277101 - protein, 19 aa, Cryptosporidium parvum
QNSGNCPNSNGKGKQTESC

SEQ ID NO: 2277102 - protein, 14 aa, Cryptosporidium parvum
QNSGNSYNQNEGVL

SEQ ID NO: 2277103 - protein, 42 aa, Cryptosporidium parvum
QNSINNMNGNCNNSLKNNNLGNSGINPNIGPKPKNKNNKKGM

SEQ ID NO: 2277104 - protein, 26 aa, Cryptosporidium parvum
QNSISEHNRQSTGHYQNSVENPSPTL

SEQ ID NO: 2277105 - protein, 7 aa, Cryptosporidium parvum
QNSKGEN

SEQ ID NO: 2277106 - protein, 15 aa, Cryptosporidium parvum
QNSKKNINMTKSKKK

SEQ ID NO: 2277107 - protein, 16 aa, Cryptosporidium parvum
QNSKNENSIVQNETDK

SEQ ID NO: 2277108 - protein, 8 aa, Cryptosporidium parvum
QNSLTPNY

SEQ ID NO: 2277109 - protein, 13 aa, Cryptosporidium parvum
QNSNLKSQSQLNE

SEQ ID NO: 2277110 - protein, 6 aa, Cryptosporidium parvum
QNSNNL

SEQ ID NO: 2277111 - protein, 5 aa, Cryptosporidium parvum
QNSPI

SEQ ID NO: 2277112 - protein, 14 aa, Cryptosporidium parvum
QNSPPRELRSRRGH

SEQ ID NO: 2277113 - protein, 4 aa, Cryptosporidium parvum
QNSQ

SEQ ID NO: 2277114 - protein, 9 aa, Cryptosporidium parvum
QNSQDSHGI

SEQ ID NO: 2277115 - protein, 9 aa, Cryptosporidium parvum
QNSQEQGLN

SEQ ID NO: 2277116 - protein, 6 aa, Cryptosporidium parvum
QNSQRN

SEQ ID NO: 2277117 - protein, 9 aa, Cryptosporidium parvum
QNSQYSTEI

SEQ ID NO: 2277118 - protein, 4 aa, Cryptosporidium parvum
QNSR

SEQ ID NO: 2277119 - protein, 7 aa, Cryptosporidium parvum
QNSRANY

SEQ ID NO: 2277120 - protein, 110 aa, Cryptosporidium parvum
QNSRLEKKSSSSCSKSKSRSRSRSRSRSRSRSRSRSRSRSRSRSYSKSRSYSKSRSRSKPRSKSKSKSHSRSRSKSEPRSKSCSSQSSISSPSSSFYSENDSNSDSSSIS

SEQ ID NO: 2277121 - protein, 7 aa, Cryptosporidium parvum
QNSRPEF

SEQ ID NO: 2277122 - protein, 6 aa, Cryptosporidium parvum
QNSRSN

SEQ ID NO: 2277123 - protein, 16 aa, Cryptosporidium parvum
QNSRYNSLSTLSDSQA

SEQ ID NO: 2277124 - protein, 8 aa, Cryptosporidium parvum
QNSSESCG

SEQ ID NO: 2277125 - protein, 9 aa, Cryptosporidium parvum
QNSSLKQMG

SEQ ID NO: 2277126 - protein, 13 aa, Cryptosporidium parvum
QNSSNINEQKESL

SEQ ID NO: 2277127 - protein, 5 aa, Cryptosporidium parvum
QNSSS

SEQ ID NO: 2277128 - protein, 9 aa, Cryptosporidium parvum
QNSTDAQRT

SEQ ID NO: 2277129 - protein, 11 aa, Cryptosporidium parvum
QNSTETNGELA

SEQ ID NO: 2277130 - protein, 5 aa, Cryptosporidium parvum
QNSTQ

SEQ ID NO: 2277131 - protein, 4 aa, Cryptosporidium parvum
QNSV

SEQ ID NO: 2277132 - protein, 13 aa, Cryptosporidium parvum
QNSVGEENDDLDK

SEQ ID NO: 2277133 - protein, 10 aa, Cryptosporidium parvum
QNTDKIDSLS

SEQ ID NO: 2277134 - protein, 4 aa, Cryptosporidium parvum
QNTE

SEQ ID NO: 2277135 - protein, 13 aa, Cryptosporidium parvum
QNTELKASEEPLT

SEQ ID NO: 2277136 - protein, 15 aa, Cryptosporidium parvum
QNTINNIPDPNFSSS

SEQ ID NO: 2277137 - protein, 18 aa, Cryptosporidium parvum
QNTMEESLNGNKYTEERN

SEQ ID NO: 2277138 - protein, 6 aa, Cryptosporidium parvum
QNTNDE

SEQ ID NO: 2277139 - protein, 9 aa, Cryptosporidium parvum
QNTNTNPNF

SEQ ID NO: 2277140 - protein, 5 aa, Cryptosporidium parvum
QNTPN

SEQ ID NO: 2277141 - protein, 9 aa, Cryptosporidium parvum
QNTPPNRYV

SEQ ID NO: 2277142 - protein, 7 aa, Cryptosporidium parvum
QNTPQTL

SEQ ID NO: 2277143 - protein, 14 aa, Cryptosporidium parvum
QNTRINVSKSSQEW

SEQ ID NO: 2277144 - protein, 14 aa, Cryptosporidium parvum
QNTSADSSLNTAIN

SEQ ID NO: 2277145 - protein, 9 aa, Cryptosporidium parvum
QNVAGQRIQ

SEQ ID NO: 2277146 - protein, 4 aa, Cryptosporidium parvum
QNVE

SEQ ID NO: 2277147 - protein, 6 aa, Cryptosporidium parvum
QNVEGK

SEQ ID NO: 2277148 - protein, 63 aa, Cryptosporidium parvum
QNVERRKDGAYIPPHRRQQGLREDPNSNLASFTGNQANSYNSQRNNSSRNNIDGKRNDQASNL

SEQ ID NO: 2277149 - protein, 31 aa, Cryptosporidium parvum
QNVGNKEFEEEDGIEVEDEEENNSDNNNEYG

SEQ ID NO: 2277150 - protein, 5 aa, Cryptosporidium parvum
QNVGQ

SEQ ID NO: 2277151 - protein, 9 aa, Cryptosporidium parvum
QNVKGSEMQ

SEQ ID NO: 2277152 - protein, 9 aa, Cryptosporidium parvum
QNVSEDKST

SEQ ID NO: 2277153 - protein, 12 aa, Cryptosporidium parvum
QNYENSASGIRN

SEQ ID NO: 2277154 - protein, 12 aa, Cryptosporidium parvum
QNYSSGKVKRQI

SEQ ID NO: 2277155 - protein, 6 aa, Cryptosporidium parvum
QNYTKE

SEQ ID NO: 2277156 - protein, 12 aa, Cryptosporidium parvum
QPALDSKSSFSE

SEQ ID NO: 2277157 - protein, 8 aa, Cryptosporidium parvum
QPDFTSPG

SEQ ID NO: 2277158 - protein, 8 aa, Cryptosporidium parvum
QPDGPDGK

SEQ ID NO: 2277159 - protein, 19 aa, Cryptosporidium parvum
QPEDEGYEEAKLKGETHRG

SEQ ID NO: 2277160 - protein, 7 aa, Cryptosporidium parvum
QPEDHEN

SEQ ID NO: 2277161 - protein, 7 aa, Cryptosporidium parvum
QPENEDI

SEQ ID NO: 2277162 - protein, 8 aa, Cryptosporidium parvum
QPESSRES

SEQ ID NO: 2277163 - protein, 8 aa, Cryptosporidium parvum
QPETEDAT

SEQ ID NO: 2277164 - protein, 4 aa, Cryptosporidium parvum
QPFK

SEQ ID NO: 2277165 - protein, 13 aa, Cryptosporidium parvum
QPFSGKDTAGYIQ

SEQ ID NO: 2277166 - protein, 4 aa, Cryptosporidium parvum
QPGA

SEQ ID NO: 2277167 - protein, 23 aa, Cryptosporidium parvum
QPGFKLPPKADDSSPKGEPEPQV

SEQ ID NO: 2277168 - protein, 13 aa, Cryptosporidium parvum
QPGISGLGAPNMG

SEQ ID NO: 2277169 - protein, 8 aa, Cryptosporidium parvum
QPGSSIEN

SEQ ID NO: 2277170 - protein, 12 aa, Cryptosporidium parvum
QPGTSRLATAGA

SEQ ID NO: 2277171 - protein, 41 aa, Cryptosporidium parvum
QPGVPGVPGVPGVPGVPGVPGVPGVPGVPGVPGVPGSQGGL

SEQ ID NO: 2277172 - protein, 7 aa, Cryptosporidium parvum
QPIEAPP

SEQ ID NO: 2277173 - protein, 19 aa, Cryptosporidium parvum
QPIEDDNCSESSIISFLSE

SEQ ID NO: 2277174 - protein, 6 aa, Cryptosporidium parvum
QPIETA

SEQ ID NO: 2277175 - protein, 28 aa, Cryptosporidium parvum
QPIKYSNNQYTNNPISLSNTQKSQGTIS

SEQ ID NO: 2277176 - protein, 4 aa, Cryptosporidium parvum
QPIR

SEQ ID NO: 2277177 - protein, 7 aa, Cryptosporidium parvum
QPKEEKK

SEQ ID NO: 2277178 - protein, 7 aa, Cryptosporidium parvum
QPKERRH

SEQ ID NO: 2277179 - protein, 4 aa, Cryptosporidium parvum
QPKY

SEQ ID NO: 2277180 - protein, 4 aa, Cryptosporidium parvum
QPLK

SEQ ID NO: 2277181 - protein, 5 aa, Cryptosporidium parvum
QPLKN

SEQ ID NO: 2277182 - protein, 4 aa, Cryptosporidium parvum
QPMN

SEQ ID NO: 2277183 - protein, 19 aa, Cryptosporidium parvum
QPMQPPNINNPTSIVDNFL

SEQ ID NO: 2277184 - protein, 8 aa, Cryptosporidium parvum
QPNDQQDL

SEQ ID NO: 2277185 - protein, 4 aa, Cryptosporidium parvum
QPNE

SEQ ID NO: 2277186 - protein, 5 aa, Cryptosporidium parvum
QPNMA

SEQ ID NO: 2277187 - protein, 10 aa, Cryptosporidium parvum
QPNNGGGKRG

SEQ ID NO: 2277188 - protein, 9 aa, Cryptosporidium parvum
QPNSPGNYN

SEQ ID NO: 2277189 - protein, 4 aa, Cryptosporidium parvum
QPNY

SEQ ID NO: 2277190 - protein, 7 aa, Cryptosporidium parvum
QPNYSSN

SEQ ID NO: 2277191 - protein, 6 aa, Cryptosporidium parvum
QPPFGG

SEQ ID NO: 2277192 - protein, 16 aa, Cryptosporidium parvum
QPPGYPLSNGPAPYQI

SEQ ID NO: 2277193 - protein, 6 aa, Cryptosporidium parvum
QPPHMK

SEQ ID NO: 2277194 - protein, 15 aa, Cryptosporidium parvum
QPPLDGSSSTGDYSE

SEQ ID NO: 2277195 - protein, 6 aa, Cryptosporidium parvum
QPPNTI

SEQ ID NO: 2277196 - protein, 19 aa, Cryptosporidium parvum
QPPPPQKVDQKDSDNSRLQ

SEQ ID NO: 2277197 - protein, 8 aa, Cryptosporidium parvum
QPPPQLAN

SEQ ID NO: 2277198 - protein, 13 aa, Cryptosporidium parvum
QPPQSTETTDSKS

SEQ ID NO: 2277199 - protein, 9 aa, Cryptosporidium parvum
QPPTVVPGG

SEQ ID NO: 2277200 - protein, 13 aa, Cryptosporidium parvum
QPQERLPERQPNF

SEQ ID NO: 2277201 - protein, 5 aa, Cryptosporidium parvum
QPQNI

SEQ ID NO: 2277202 - protein, 6 aa, Cryptosporidium parvum
QPQPGV

SEQ ID NO: 2277203 - protein, 8 aa, Cryptosporidium parvum
QPQSTHSL

SEQ ID NO: 2277204 - protein, 4 aa, Cryptosporidium parvum
QPRA

SEQ ID NO: 2277205 - protein, 8 aa, Cryptosporidium parvum
QPRETKVN

SEQ ID NO: 2277206 - protein, 8 aa, Cryptosporidium parvum
QPRPPPND

SEQ ID NO: 2277207 - protein, 4 aa, Cryptosporidium parvum
QPRR

SEQ ID NO: 2277208 - protein, 6 aa, Cryptosporidium parvum
QPRRVA

SEQ ID NO: 2277209 - protein, 5 aa, Cryptosporidium parvum
QPSEL

SEQ ID NO: 2277210 - protein, 6 aa, Cryptosporidium parvum
QPSESV

SEQ ID NO: 2277211 - protein, 5 aa, Cryptosporidium parvum
QPSGA

SEQ ID NO: 2277212 - protein, 7 aa, Cryptosporidium parvum
QPSINND

SEQ ID NO: 2277213 - protein, 10 aa, Cryptosporidium parvum
QPSKESEKWN

SEQ ID NO: 2277214 - protein, 7 aa, Cryptosporidium parvum
QPSPFNP

SEQ ID NO: 2277215 - protein, 12 aa, Cryptosporidium parvum
QPSQRDQGRKAQ

SEQ ID NO: 2277216 - protein, 11 aa, Cryptosporidium parvum
QPSSAKVPWGG

SEQ ID NO: 2277217 - protein, 5 aa, Cryptosporidium parvum
QPSSF

SEQ ID NO: 2277218 - protein, 8 aa, Cryptosporidium parvum
QPSTASYN

SEQ ID NO: 2277219 - protein, 17 aa, Cryptosporidium parvum
QPSTTNNNKLDNIGAHP

SEQ ID NO: 2277220 - protein, 7 aa, Cryptosporidium parvum
QPTANDY

SEQ ID NO: 2277221 - protein, 4 aa, Cryptosporidium parvum
QPTI

SEQ ID NO: 2277222 - protein, 6 aa, Cryptosporidium parvum
QPTYEE

SEQ ID NO: 2277223 - protein, 4 aa, Cryptosporidium parvum
QPVD

SEQ ID NO: 2277224 - protein, 8 aa, Cryptosporidium parvum
QPVGQKDS

SEQ ID NO: 2277225 - protein, 6 aa, Cryptosporidium parvum
QPVKSH

SEQ ID NO: 2277226 - protein, 6 aa, Cryptosporidium parvum
QPVPDA

SEQ ID NO: 2277227 - protein, 5 aa, Cryptosporidium parvum
QPYPT

SEQ ID NO: 2277228 - protein, 9 aa, Cryptosporidium parvum
QQAISYNRT

SEQ ID NO: 2277229 - protein, 4 aa, Cryptosporidium parvum
QQDA

SEQ ID NO: 2277230 - protein, 10 aa, Cryptosporidium parvum
QQDHTQIPNP

SEQ ID NO: 2277231 - protein, 5 aa, Cryptosporidium parvum
QQDQR

SEQ ID NO: 2277232 - protein, 6 aa, Cryptosporidium parvum
QQDSER

SEQ ID NO: 2277233 - protein, 10 aa, Cryptosporidium parvum
QQEDDPQEEY

SEQ ID NO: 2277234 - protein, 10 aa, Cryptosporidium parvum
QQEETEVKDL

SEQ ID NO: 2277235 - protein, 13 aa, Cryptosporidium parvum
QQEKRRKEQEKME

SEQ ID NO: 2277236 - protein, 6 aa, Cryptosporidium parvum
QQELEE

SEQ ID NO: 2277237 - protein, 15 aa, Cryptosporidium parvum
QQEQEHSESNSNNQF

SEQ ID NO: 2277238 - protein, 5 aa, Cryptosporidium parvum
QQERI

SEQ ID NO: 2277239 - protein, 6 aa, Cryptosporidium parvum
QQESNY

SEQ ID NO: 2277240 - protein, 7 aa, Cryptosporidium parvum
QQEYGPE

SEQ ID NO: 2277241 - protein, 7 aa, Cryptosporidium parvum
QQEYNKN

SEQ ID NO: 2277242 - protein, 10 aa, Cryptosporidium parvum
QQFDSVDAGA

SEQ ID NO: 2277243 - protein, 5 aa, Cryptosporidium parvum
QQGIQ

SEQ ID NO: 2277244 - protein, 5 aa, Cryptosporidium parvum
QQGNR

SEQ ID NO: 2277245 - protein, 9 aa, Cryptosporidium parvum
QQGNSLSKV

SEQ ID NO: 2277246 - protein, 4 aa, Cryptosporidium parvum
QQGQ

SEQ ID NO: 2277247 - protein, 12 aa, Cryptosporidium parvum
QQGSNPMSHYYY

SEQ ID NO: 2277248 - protein, 9 aa, Cryptosporidium parvum
QQGSQPHKG

SEQ ID NO: 2277249 - protein, 8 aa, Cryptosporidium parvum
QQGVSQNI

SEQ ID NO: 2277250 - protein, 9 aa, Cryptosporidium parvum
QQGYDTNNY

SEQ ID NO: 2277251 - protein, 5 aa, Cryptosporidium parvum
QQHQH

SEQ ID NO: 2277252 - protein, 9 aa, Cryptosporidium parvum
QQHQHQQQQ

SEQ ID NO: 2277253 - protein, 11 aa, Cryptosporidium parvum
QQHQHSTHQQN

SEQ ID NO: 2277254 - protein, 8 aa, Cryptosporidium parvum
QQHQQQQQ

SEQ ID NO: 2277255 - protein, 5 aa, Cryptosporidium parvum
QQHQS

SEQ ID NO: 2277256 - protein, 12 aa, Cryptosporidium parvum
QQIESKNRNFEE

SEQ ID NO: 2277257 - protein, 32 aa, Cryptosporidium parvum
QQIKTSGMTTTSTSTTYSSTDTFDSENNQING

SEQ ID NO: 2277258 - protein, 4 aa, Cryptosporidium parvum
QQIN

SEQ ID NO: 2277259 - protein, 23 aa, Cryptosporidium parvum
QQISKTNKNKKSIEGKNKEKMNI

SEQ ID NO: 2277260 - protein, 8 aa, Cryptosporidium parvum
QQKDLREK

SEQ ID NO: 2277261 - protein, 6 aa, Cryptosporidium parvum
QQKGER

SEQ ID NO: 2277262 - protein, 30 aa, Cryptosporidium parvum
QQKKGNKKNKKNNISGYDNKISDSNIGADS

SEQ ID NO: 2277263 - protein, 9 aa, Cryptosporidium parvum
QQKNSFKQK

SEQ ID NO: 2277264 - protein, 8 aa, Cryptosporidium parvum
QQKPKNEY

SEQ ID NO: 2277265 - protein, 9 aa, Cryptosporidium parvum
QQKSASERW

SEQ ID NO: 2277266 - protein, 7 aa, Cryptosporidium parvum
QQKYGKR

SEQ ID NO: 2277267 - protein, 40 aa, Cryptosporidium parvum
QQLDTSPAKLDESVENEHFESQDPLPTYTQTDKDELQEVS

SEQ ID NO: 2277268 - protein, 17 aa, Cryptosporidium parvum
QQLEETKKALEVSQNKY

SEQ ID NO: 2277269 - protein, 5 aa, Cryptosporidium parvum
QQLEQ

SEQ ID NO: 2277270 - protein, 7 aa, Cryptosporidium parvum
QQLNDSE

SEQ ID NO: 2277271 - protein, 10 aa, Cryptosporidium parvum
QQLNRNSIGG

SEQ ID NO: 2277272 - protein, 11 aa, Cryptosporidium parvum
QQLRNANNNVQ

SEQ ID NO: 2277273 - protein, 14 aa, Cryptosporidium parvum
QQMQGASGAESKAV

SEQ ID NO: 2277274 - protein, 6 aa, Cryptosporidium parvum
QQNEAL

SEQ ID NO: 2277275 - protein, 23 aa, Cryptosporidium parvum
QQNGSFTNDNEKLAEDKKIKNEL

SEQ ID NO: 2277276 - protein, 14 aa, Cryptosporidium parvum
QQNGTDSHSNQRGY

SEQ ID NO: 2277277 - protein, 9 aa, Cryptosporidium parvum
QQNGTGKNI

SEQ ID NO: 2277278 - protein, 12 aa, Cryptosporidium parvum
QQNNNITNYPPP

SEQ ID NO: 2277279 - protein, 8 aa, Cryptosporidium parvum
QQNPRFND

SEQ ID NO: 2277280 - protein, 7 aa, Cryptosporidium parvum
QQNSFED

SEQ ID NO: 2277281 - protein, 26 aa, Cryptosporidium parvum
QQNSFGGSTTGTGGKRKRDSSELSSD

SEQ ID NO: 2277282 - protein, 28 aa, Cryptosporidium parvum
QQNSMGNSKNNNNNNNNNNNNINNSNNS

SEQ ID NO: 2277283 - protein, 9 aa, Cryptosporidium parvum
QQNVRKTTT

SEQ ID NO: 2277284 - protein, 5 aa, Cryptosporidium parvum
QQNYS

SEQ ID NO: 2277285 - protein, 31 aa, Cryptosporidium parvum
QQPATSDSFNTSRADEDTSLISETTSKQTEN

SEQ ID NO: 2277286 - protein, 6 aa, Cryptosporidium parvum
QQPIDF

SEQ ID NO: 2277287 - protein, 18 aa, Cryptosporidium parvum
QQPNGIDRSEKRKERENI

SEQ ID NO: 2277288 - protein, 8 aa, Cryptosporidium parvum
QQPNSQYR

SEQ ID NO: 2277289 - protein, 4 aa, Cryptosporidium parvum
QQPS

SEQ ID NO: 2277290 - protein, 16 aa, Cryptosporidium parvum
QQPSQVRRNHYISQNH

SEQ ID NO: 2277291 - protein, 23 aa, Cryptosporidium parvum
QQQENGGASVGNSNHKVLHVPYG

SEQ ID NO: 2277292 - protein, 8 aa, Cryptosporidium parvum
QQQETDQS

SEQ ID NO: 2277293 - protein, 14 aa, Cryptosporidium parvum
QQQKEKKRTKDERD

SEQ ID NO: 2277294 - protein, 10 aa, Cryptosporidium parvum
QQQKKNNHPL

SEQ ID NO: 2277295 - protein, 7 aa, Cryptosporidium parvum
QQQKPIK

SEQ ID NO: 2277296 - protein, 14 aa, Cryptosporidium parvum
QQQLNSKKKASEWR

SEQ ID NO: 2277297 - protein, 7 aa, Cryptosporidium parvum
QQQQHQQ

SEQ ID NO: 2277298 - protein, 8 aa, Cryptosporidium parvum
QQQQQLQQ

SEQ ID NO: 2277299 - protein, 19 aa, Cryptosporidium parvum
QQQQQQHQQQQQLQQQHNQ

SEQ ID NO: 2277300 - protein, 8 aa, Cryptosporidium parvum
QQQQQQQI

SEQ ID NO: 2277301 - protein, 16 aa, Cryptosporidium parvum
QQQQQQQKQKHENNIN

SEQ ID NO: 2277302 - protein, 10 aa, Cryptosporidium parvum
QQQQQQQQQL

SEQ ID NO: 2277303 - protein, 23 aa, Cryptosporidium parvum
QQQQQQQQQQQQQQQQQQQQQQL

SEQ ID NO: 2277304 - protein, 102 aa, Cryptosporidium parvum
QQQQQQQQQQQQQQQQQQQQQQQQQQQQQQLQQQQFEQQRQLQQQQQLQQQQQQQQHLQQQQQQQQQQQQQQRHQQQQQQQQQQQLQQQQQLQQQQQLQQQQ

SEQ ID NO: 2277305 - protein, 41 aa, Cryptosporidium parvum
QQQQQQQQQQQQQQQQQQQQQQQQQQQQQQQQQQQQQQQQQ

SEQ ID NO: 2277306 - protein, 8 aa, Cryptosporidium parvum
QQQQQQRM

SEQ ID NO: 2277307 - protein, 5 aa, Cryptosporidium parvum
QQQRT

SEQ ID NO: 2277308 - protein, 9 aa, Cryptosporidium parvum
QQQSSTEKQ

SEQ ID NO: 2277309 - protein, 7 aa, Cryptosporidium parvum
QQQTQRT

SEQ ID NO: 2277310 - protein, 5 aa, Cryptosporidium parvum
QQRAR

SEQ ID NO: 2277311 - protein, 17 aa, Cryptosporidium parvum
QQRKMDSGRDNNYSPGL

SEQ ID NO: 2277312 - protein, 4 aa, Cryptosporidium parvum
QQSE

SEQ ID NO: 2277313 - protein, 9 aa, Cryptosporidium parvum
QQSHSNISS

SEQ ID NO: 2277314 - protein, 9 aa, Cryptosporidium parvum
QQSKKFNTF

SEQ ID NO: 2277315 - protein, 4 aa, Cryptosporidium parvum
QQSN

SEQ ID NO: 2277316 - protein, 5 aa, Cryptosporidium parvum
QQSNQ

SEQ ID NO: 2277317 - protein, 9 aa, Cryptosporidium parvum
QQSQFGAAN

SEQ ID NO: 2277318 - protein, 14 aa, Cryptosporidium parvum
QQSQHTRNARSDSL

SEQ ID NO: 2277319 - protein, 19 aa, Cryptosporidium parvum
QQSQQSNSFAHERRSRNRK

SEQ ID NO: 2277320 - protein, 9 aa, Cryptosporidium parvum
QQSQRLEQA

SEQ ID NO: 2277321 - protein, 6 aa, Cryptosporidium parvum
QQSWNK

SEQ ID NO: 2277322 - protein, 6 aa, Cryptosporidium parvum
QQTAGR

SEQ ID NO: 2277323 - protein, 12 aa, Cryptosporidium parvum
QQTDQLPETPES

SEQ ID NO: 2277324 - protein, 8 aa, Cryptosporidium parvum
QQTEGIPF

SEQ ID NO: 2277325 - protein, 5 aa, Cryptosporidium parvum
QQTMT

SEQ ID NO: 2277326 - protein, 10 aa, Cryptosporidium parvum
QQTRITKSEI

SEQ ID NO: 2277327 - protein, 7 aa, Cryptosporidium parvum
QQTSTTR

SEQ ID NO: 2277328 - protein, 5 aa, Cryptosporidium parvum
QQVED

SEQ ID NO: 2277329 - protein, 6 aa, Cryptosporidium parvum
QQVEEE

SEQ ID NO: 2277330 - protein, 13 aa, Cryptosporidium parvum
QQVQGQNQTQTGF

SEQ ID NO: 2277331 - protein, 12 aa, Cryptosporidium parvum
QQVSGDKGGSLT

SEQ ID NO: 2277332 - protein, 4 aa, Cryptosporidium parvum
QQVT

SEQ ID NO: 2277333 - protein, 8 aa, Cryptosporidium parvum
QQYEQNER

SEQ ID NO: 2277334 - protein, 8 aa, Cryptosporidium parvum
QQYGASDQ

SEQ ID NO: 2277335 - protein, 12 aa, Cryptosporidium parvum
QQYPIDQNPRIN

SEQ ID NO: 2277336 - protein, 9 aa, Cryptosporidium parvum
QQYRNSGVA

SEQ ID NO: 2277337 - protein, 4 aa, Cryptosporidium parvum
QRAG

SEQ ID NO: 2277338 - protein, 16 aa, Cryptosporidium parvum
QRAQQESALTASSNIE

SEQ ID NO: 2277339 - protein, 4 aa, Cryptosporidium parvum
QRAS

SEQ ID NO: 2277340 - protein, 8 aa, Cryptosporidium parvum
QRDIRKKS

SEQ ID NO: 2277341 - protein, 5 aa, Cryptosporidium parvum
QRDKD

SEQ ID NO: 2277342 - protein, 6 aa, Cryptosporidium parvum
QRDPEL

SEQ ID NO: 2277343 - protein, 7 aa, Cryptosporidium parvum
QRDPKEE

SEQ ID NO: 2277344 - protein, 5 aa, Cryptosporidium parvum
QRDSL

SEQ ID NO: 2277345 - protein, 4 aa, Cryptosporidium parvum
QRDY

SEQ ID NO: 2277346 - protein, 8 aa, Cryptosporidium parvum
QRDYNNNT

SEQ ID NO: 2277347 - protein, 8 aa, Cryptosporidium parvum
QREATQSV

SEQ ID NO: 2277348 - protein, 9 aa, Cryptosporidium parvum
QREKVSREI

SEQ ID NO: 2277349 - protein, 11 aa, Cryptosporidium parvum
QRELSNTEDQI

SEQ ID NO: 2277350 - protein, 14 aa, Cryptosporidium parvum
QREPSTRRKGAGLG

SEQ ID NO: 2277351 - protein, 7 aa, Cryptosporidium parvum
QRERDLK

SEQ ID NO: 2277352 - protein, 21 aa, Cryptosporidium parvum
QRESEASTKTIDPHPQAQGSV

SEQ ID NO: 2277353 - protein, 5 aa, Cryptosporidium parvum
QRESI

SEQ ID NO: 2277354 - protein, 11 aa, Cryptosporidium parvum
QRFRNSSNISL

SEQ ID NO: 2277355 - protein, 7 aa, Cryptosporidium parvum
QRGANSV

SEQ ID NO: 2277356 - protein, 7 aa, Cryptosporidium parvum
QRGDRQS

SEQ ID NO: 2277357 - protein, 78 aa, Cryptosporidium parvum
QRGPDGKRITNETPKVDGSSLLTSGGEGNGGLQASQTLTAPPPPPPPPPPSSQGITSNKGANANGGIRSRYVDIFQSK

SEQ ID NO: 2277358 - protein, 8 aa, Cryptosporidium parvum
QRGVTPDE

SEQ ID NO: 2277359 - protein, 36 aa, Cryptosporidium parvum
QRGYPKSVTATGSRYGAGNTTGTNFSASSQFRSEPY

SEQ ID NO: 2277360 - protein, 8 aa, Cryptosporidium parvum
QRHKQSKE

SEQ ID NO: 2277361 - protein, 7 aa, Cryptosporidium parvum
QRIQQSS

SEQ ID NO: 2277362 - protein, 5 aa, Cryptosporidium parvum
QRKGY

SEQ ID NO: 2277363 - protein, 9 aa, Cryptosporidium parvum
QRKLAERNN

SEQ ID NO: 2277364 - protein, 16 aa, Cryptosporidium parvum
QRKSTSKLPGNNSTHA

SEQ ID NO: 2277365 - protein, 24 aa, Cryptosporidium parvum
QRKTDKQEIKKTKRVRDKKKNQIK

SEQ ID NO: 2277366 - protein, 12 aa, Cryptosporidium parvum
QRLTEQKRNIER

SEQ ID NO: 2277367 - protein, 17 aa, Cryptosporidium parvum
QRNGFDAKNCKQEIRQQ

SEQ ID NO: 2277368 - protein, 16 aa, Cryptosporidium parvum
QRNPKYERKSIKTQKS

SEQ ID NO: 2277369 - protein, 5 aa, Cryptosporidium parvum
QRNQS

SEQ ID NO: 2277370 - protein, 14 aa, Cryptosporidium parvum
QRNQSENDQEEESE

SEQ ID NO: 2277371 - protein, 14 aa, Cryptosporidium parvum
QRPSDDSTRTGNIA

SEQ ID NO: 2277372 - protein, 15 aa, Cryptosporidium parvum
QRPSSLGSYTNETIS

SEQ ID NO: 2277373 - protein, 10 aa, Cryptosporidium parvum
QRQKAANRAL

SEQ ID NO: 2277374 - protein, 6 aa, Cryptosporidium parvum
QRQKAE

SEQ ID NO: 2277375 - protein, 5 aa, Cryptosporidium parvum
QRQKE

SEQ ID NO: 2277376 - protein, 5 aa, Cryptosporidium parvum
QRQKI

SEQ ID NO: 2277377 - protein, 66 aa, Cryptosporidium parvum
QRQNGNSIPNRRSLGSVSSTAGNNPANSRSKKSINEMNASNSGIPRRSSSVTTAQRSNQSNSDIER

SEQ ID NO: 2277378 - protein, 9 aa, Cryptosporidium parvum
QRRASLQDS

SEQ ID NO: 2277379 - protein, 4 aa, Cryptosporidium parvum
QRRD

SEQ ID NO: 2277380 - protein, 6 aa, Cryptosporidium parvum
QRREKE

SEQ ID NO: 2277381 - protein, 10 aa, Cryptosporidium parvum
QRREQSSKDY

SEQ ID NO: 2277382 - protein, 5 aa, Cryptosporidium parvum
QRRIE

SEQ ID NO: 2277383 - protein, 8 aa, Cryptosporidium parvum
QRRNSSEL

SEQ ID NO: 2277384 - protein, 35 aa, Cryptosporidium parvum
QRRRTSRQINTGSGGFGGRENGKFTHGKYNNGYEN

SEQ ID NO: 2277385 - protein, 6 aa, Cryptosporidium parvum
QRSDAS

SEQ ID NO: 2277386 - protein, 39 aa, Cryptosporidium parvum
QRSGHYGGSTRGYYRDDDRDRERDRERDRRSANDQYSNS

SEQ ID NO: 2277387 - protein, 8 aa, Cryptosporidium parvum
QRSKKDWK

SEQ ID NO: 2277388 - protein, 5 aa, Cryptosporidium parvum
QRSLG

SEQ ID NO: 2277389 - protein, 11 aa, Cryptosporidium parvum
QRSNEDYNPNT

SEQ ID NO: 2277390 - protein, 21 aa, Cryptosporidium parvum
QRSPTNGAQKSSIGKEKDKIH

SEQ ID NO: 2277391 - protein, 9 aa, Cryptosporidium parvum
QRSRTIRTE

SEQ ID NO: 2277392 - protein, 9 aa, Cryptosporidium parvum
QRSTLGRSA

SEQ ID NO: 2277393 - protein, 12 aa, Cryptosporidium parvum
QRSTSTSITRNN

SEQ ID NO: 2277394 - protein, 4 aa, Cryptosporidium parvum
QRTA

SEQ ID NO: 2277395 - protein, 7 aa, Cryptosporidium parvum
QRTGTQW

SEQ ID NO: 2277396 - protein, 7 aa, Cryptosporidium parvum
QRTRCSE

SEQ ID NO: 2277397 - protein, 4 aa, Cryptosporidium parvum
QRVS

SEQ ID NO: 2277398 - protein, 6 aa, Cryptosporidium parvum
QRWSRR

SEQ ID NO: 2277399 - protein, 4 aa, Cryptosporidium parvum
QRYS

SEQ ID NO: 2277400 - protein, 6 aa, Cryptosporidium parvum
QRYTKE

SEQ ID NO: 2277401 - protein, 7 aa, Cryptosporidium parvum
QSAETAS

SEQ ID NO: 2277402 - protein, 9 aa, Cryptosporidium parvum
QSAGSLTKE

SEQ ID NO: 2277403 - protein, 14 aa, Cryptosporidium parvum
QSAQLDEKKTASDI

SEQ ID NO: 2277404 - protein, 6 aa, Cryptosporidium parvum
QSATAS

SEQ ID NO: 2277405 - protein, 7 aa, Cryptosporidium parvum
QSATRPI

SEQ ID NO: 2277406 - protein, 7 aa, Cryptosporidium parvum
QSAYRGR

SEQ ID NO: 2277407 - protein, 4 aa, Cryptosporidium parvum
QSCN

SEQ ID NO: 2277408 - protein, 6 aa, Cryptosporidium parvum
QSCTDE

SEQ ID NO: 2277409 - protein, 10 aa, Cryptosporidium parvum
QSDAAAPSTS

SEQ ID NO: 2277410 - protein, 10 aa, Cryptosporidium parvum
QSDAGSPSLK

SEQ ID NO: 2277411 - protein, 4 aa, Cryptosporidium parvum
QSDD

SEQ ID NO: 2277412 - protein, 10 aa, Cryptosporidium parvum
QSDDDSDSNI

SEQ ID NO: 2277413 - protein, 9 aa, Cryptosporidium parvum
QSDGQSPHT

SEQ ID NO: 2277414 - protein, 28 aa, Cryptosporidium parvum
QSDKDDDEDRANEDRKNMNSKEIGEQSQ

SEQ ID NO: 2277415 - protein, 8 aa, Cryptosporidium parvum
QSDKDLSA

SEQ ID NO: 2277416 - protein, 20 aa, Cryptosporidium parvum
QSDKQEFENPFENDENIEVP

SEQ ID NO: 2277417 - protein, 4 aa, Cryptosporidium parvum
QSDN

SEQ ID NO: 2277418 - protein, 7 aa, Cryptosporidium parvum
QSDPEKG

SEQ ID NO: 2277419 - protein, 10 aa, Cryptosporidium parvum
QSDPSGNFSG

SEQ ID NO: 2277420 - protein, 22 aa, Cryptosporidium parvum
QSDQEIQISSTKSQNDSFHPYS

SEQ ID NO: 2277421 - protein, 9 aa, Cryptosporidium parvum
QSDSEERKM

SEQ ID NO: 2277422 - protein, 12 aa, Cryptosporidium parvum
QSDTKNESKSIG

SEQ ID NO: 2277423 - protein, 15 aa, Cryptosporidium parvum
QSDYSEDDDYKNNDE

SEQ ID NO: 2277424 - protein, 9 aa, Cryptosporidium parvum
QSEDGTKTR

SEQ ID NO: 2277425 - protein, 8 aa, Cryptosporidium parvum
QSEDRNQI

SEQ ID NO: 2277426 - protein, 9 aa, Cryptosporidium parvum
QSEESDKRL

SEQ ID NO: 2277427 - protein, 12 aa, Cryptosporidium parvum
QSEESSFDEKQG

SEQ ID NO: 2277428 - protein, 4 aa, Cryptosporidium parvum
QSEI

SEQ ID NO: 2277429 - protein, 19 aa, Cryptosporidium parvum
QSEKGKAPKDLIFLRKPLR

SEQ ID NO: 2277430 - protein, 10 aa, Cryptosporidium parvum
QSEKPEKGSA

SEQ ID NO: 2277431 - protein, 5 aa, Cryptosporidium parvum
QSELD

SEQ ID NO: 2277432 - protein, 15 aa, Cryptosporidium parvum
QSENTNYMTNTSSGM

SEQ ID NO: 2277433 - protein, 11 aa, Cryptosporidium parvum
QSEQKKQNTPI

SEQ ID NO: 2277434 - protein, 5 aa, Cryptosporidium parvum
QSEQL

SEQ ID NO: 2277435 - protein, 8 aa, Cryptosporidium parvum
QSESSGRV

SEQ ID NO: 2277436 - protein, 20 aa, Cryptosporidium parvum
QSETKSDQNHSSNKKTAKIK

SEQ ID NO: 2277437 - protein, 10 aa, Cryptosporidium parvum
QSEVQEHERQ

SEQ ID NO: 2277438 - protein, 11 aa, Cryptosporidium parvum
QSFSGGKEDDI

SEQ ID NO: 2277439 - protein, 24 aa, Cryptosporidium parvum
QSFSSSNINQRQIGDNLKNPNHGI

SEQ ID NO: 2277440 - protein, 4 aa, Cryptosporidium parvum
QSGE

SEQ ID NO: 2277441 - protein, 15 aa, Cryptosporidium parvum
QSGEENSRFNYKKCS

SEQ ID NO: 2277442 - protein, 11 aa, Cryptosporidium parvum
QSGGTNPMGVP

SEQ ID NO: 2277443 - protein, 6 aa, Cryptosporidium parvum
QSGHPG

SEQ ID NO: 2277444 - protein, 6 aa, Cryptosporidium parvum
QSGISG

SEQ ID NO: 2277445 - protein, 6 aa, Cryptosporidium parvum
QSGKGR

SEQ ID NO: 2277446 - protein, 13 aa, Cryptosporidium parvum
QSGMASTTREERP

SEQ ID NO: 2277447 - protein, 5 aa, Cryptosporidium parvum
QSGPK

SEQ ID NO: 2277448 - protein, 10 aa, Cryptosporidium parvum
QSGSSAVSFE

SEQ ID NO: 2277449 - protein, 7 aa, Cryptosporidium parvum
QSGSTKH

SEQ ID NO: 2277450 - protein, 10 aa, Cryptosporidium parvum
QSGVRGGAEQ

SEQ ID NO: 2277451 - protein, 7 aa, Cryptosporidium parvum
QSHDNSV

SEQ ID NO: 2277452 - protein, 9 aa, Cryptosporidium parvum
QSHESTTSN

SEQ ID NO: 2277453 - protein, 24 aa, Cryptosporidium parvum
QSHNPELETNTDQQSQISPPSSPT

SEQ ID NO: 2277454 - protein, 9 aa, Cryptosporidium parvum
QSHSSIPRY

SEQ ID NO: 2277455 - protein, 16 aa, Cryptosporidium parvum
QSHYPTHSGASHAFPS

SEQ ID NO: 2277456 - protein, 9 aa, Cryptosporidium parvum
QSIGEPATQ

SEQ ID NO: 2277457 - protein, 9 aa, Cryptosporidium parvum
QSIGEPGTQ

SEQ ID NO: 2277458 - protein, 7 aa, Cryptosporidium parvum
QSIGMGK

SEQ ID NO: 2277459 - protein, 19 aa, Cryptosporidium parvum
QSIKDEDHEMTQETDDDNK

SEQ ID NO: 2277460 - protein, 8 aa, Cryptosporidium parvum
QSIPKSRY

SEQ ID NO: 2277461 - protein, 20 aa, Cryptosporidium parvum
QSIPTESKITDEKLQKASSY

SEQ ID NO: 2277462 - protein, 8 aa, Cryptosporidium parvum
QSIQAKTL

SEQ ID NO: 2277463 - protein, 5 aa, Cryptosporidium parvum
QSISG

SEQ ID NO: 2277464 - protein, 14 aa, Cryptosporidium parvum
QSISNSPAESKENL

SEQ ID NO: 2277465 - protein, 8 aa, Cryptosporidium parvum
QSITPAGR

SEQ ID NO: 2277466 - protein, 22 aa, Cryptosporidium parvum
QSITPNKPVPGENSISVSPQTG

SEQ ID NO: 2277467 - protein, 13 aa, Cryptosporidium parvum
QSKGINRKPMKAE

SEQ ID NO: 2277468 - protein, 22 aa, Cryptosporidium parvum
QSKIPTNDTFDNSQMSTDKDQK

SEQ ID NO: 2277469 - protein, 6 aa, Cryptosporidium parvum
QSKISF

SEQ ID NO: 2277470 - protein, 9 aa, Cryptosporidium parvum
QSKKELNSI

SEQ ID NO: 2277471 - protein, 58 aa, Cryptosporidium parvum
QSKKNNKSEDSDELSRKGGEDRDDGGEDEFDENDDDIDQDEDSSKSSKSKSKASNDLG

SEQ ID NO: 2277472 - protein, 7 aa, Cryptosporidium parvum
QSKLPAT

SEQ ID NO: 2277473 - protein, 14 aa, Cryptosporidium parvum
QSKQKRSDYKDDLD

SEQ ID NO: 2277474 - protein, 7 aa, Cryptosporidium parvum
QSKSDCS

SEQ ID NO: 2277475 - protein, 8 aa, Cryptosporidium parvum
QSKSGALK

SEQ ID NO: 2277476 - protein, 13 aa, Cryptosporidium parvum
QSKSGNGSSKKNK

SEQ ID NO: 2277477 - protein, 5 aa, Cryptosporidium parvum
QSKTY

SEQ ID NO: 2277478 - protein, 8 aa, Cryptosporidium parvum
QSKYDKKS

SEQ ID NO: 2277479 - protein, 5 aa, Cryptosporidium parvum
QSLAG

SEQ ID NO: 2277480 - protein, 97 aa, Cryptosporidium parvum
QSLAGGGAEGGASGGAGVGGGAGVGGGAGASGGAGGGATGGAEGGVVGGAEGGAVGGAGGGAVGGAEGGAVGGAEGGATGGAEGGAVGGAEGGWGVG

SEQ ID NO: 2277481 - protein, 55 aa, Cryptosporidium parvum
QSLATSNKSSRSEKDLSRDSKITTFESSNKPKSSIKTQKTISKTKTNNKTSSKSS

SEQ ID NO: 2277482 - protein, 6 aa, Cryptosporidium parvum
QSLDNI

SEQ ID NO: 2277483 - protein, 4 aa, Cryptosporidium parvum
QSLE

SEQ ID NO: 2277484 - protein, 26 aa, Cryptosporidium parvum
QSLEEEKKNMEDTDSVHQEDLKQESD

SEQ ID NO: 2277485 - protein, 10 aa, Cryptosporidium parvum
QSLKSPNIQG

SEQ ID NO: 2277486 - protein, 11 aa, Cryptosporidium parvum
QSLNDSNKCGH

SEQ ID NO: 2277487 - protein, 7 aa, Cryptosporidium parvum
QSLNNPE

SEQ ID NO: 2277488 - protein, 9 aa, Cryptosporidium parvum
QSLNPTTTL

SEQ ID NO: 2277489 - protein, 10 aa, Cryptosporidium parvum
QSLNSLSSNL

SEQ ID NO: 2277490 - protein, 5 aa, Cryptosporidium parvum
QSLQK

SEQ ID NO: 2277491 - protein, 9 aa, Cryptosporidium parvum
QSNDNFNTP

SEQ ID NO: 2277492 - protein, 6 aa, Cryptosporidium parvum
QSNEEV

SEQ ID NO: 2277493 - protein, 9 aa, Cryptosporidium parvum
QSNERGEIS

SEQ ID NO: 2277494 - protein, 5 aa, Cryptosporidium parvum
QSNFT

SEQ ID NO: 2277495 - protein, 4 aa, Cryptosporidium parvum
QSNH

SEQ ID NO: 2277496 - protein, 8 aa, Cryptosporidium parvum
QSNHSSNA

SEQ ID NO: 2277497 - protein, 4 aa, Cryptosporidium parvum
QSNI

SEQ ID NO: 2277498 - protein, 9 aa, Cryptosporidium parvum
QSNIQSNGT

SEQ ID NO: 2277499 - protein, 6 aa, Cryptosporidium parvum
QSNITK

SEQ ID NO: 2277500 - protein, 9 aa, Cryptosporidium parvum
QSNKDSEIS

SEQ ID NO: 2277501 - protein, 14 aa, Cryptosporidium parvum
QSNKQSNRSEKKEQ

SEQ ID NO: 2277502 - protein, 6 aa, Cryptosporidium parvum
QSNKSF

SEQ ID NO: 2277503 - protein, 14 aa, Cryptosporidium parvum
QSNLNNSSNDFNSK

SEQ ID NO: 2277504 - protein, 11 aa, Cryptosporidium parvum
QSNLQESHSRN

SEQ ID NO: 2277505 - protein, 5 aa, Cryptosporidium parvum
QSNLT

SEQ ID NO: 2277506 - protein, 41 aa, Cryptosporidium parvum
QSNNASGNSSIQSSNSNNNGSSLNGSVGNSLSDSKDDEQLL

SEQ ID NO: 2277507 - protein, 6 aa, Cryptosporidium parvum
QSNNDY

SEQ ID NO: 2277508 - protein, 8 aa, Cryptosporidium parvum
QSNNGNKI

SEQ ID NO: 2277509 - protein, 7 aa, Cryptosporidium parvum
QSNNSEY

SEQ ID NO: 2277510 - protein, 5 aa, Cryptosporidium parvum
QSNPE

SEQ ID NO: 2277511 - protein, 6 aa, Cryptosporidium parvum
QSNPEY

SEQ ID NO: 2277512 - protein, 7 aa, Cryptosporidium parvum
QSNRGNS

SEQ ID NO: 2277513 - protein, 7 aa, Cryptosporidium parvum
QSNSFQD

SEQ ID NO: 2277514 - protein, 8 aa, Cryptosporidium parvum
QSNSPQIE

SEQ ID NO: 2277515 - protein, 5 aa, Cryptosporidium parvum
QSNSV

SEQ ID NO: 2277516 - protein, 4 aa, Cryptosporidium parvum
QSNT

SEQ ID NO: 2277517 - protein, 6 aa, Cryptosporidium parvum
QSNVNN

SEQ ID NO: 2277518 - protein, 16 aa, Cryptosporidium parvum
QSPEQNGNSPTNSKTR

SEQ ID NO: 2277519 - protein, 5 aa, Cryptosporidium parvum
QSPEV

SEQ ID NO: 2277520 - protein, 13 aa, Cryptosporidium parvum
QSPNKLKSKSKTN

SEQ ID NO: 2277521 - protein, 6 aa, Cryptosporidium parvum
QSPPGV

SEQ ID NO: 2277522 - protein, 5 aa, Cryptosporidium parvum
QSPQL

SEQ ID NO: 2277523 - protein, 7 aa, Cryptosporidium parvum
QSPSISA

SEQ ID NO: 2277524 - protein, 7 aa, Cryptosporidium parvum
QSPTGIG

SEQ ID NO: 2277525 - protein, 9 aa, Cryptosporidium parvum
QSPTGNEST

SEQ ID NO: 2277526 - protein, 8 aa, Cryptosporidium parvum
QSPTGSGK

SEQ ID NO: 2277527 - protein, 19 aa, Cryptosporidium parvum
QSQDQYKRKINSPIKNIHK

SEQ ID NO: 2277528 - protein, 10 aa, Cryptosporidium parvum
QSQDSSNSQV

SEQ ID NO: 2277529 - protein, 4 aa, Cryptosporidium parvum
QSQE

SEQ ID NO: 2277530 - protein, 7 aa, Cryptosporidium parvum
QSQEPHT

SEQ ID NO: 2277531 - protein, 8 aa, Cryptosporidium parvum
QSQGQEVR

SEQ ID NO: 2277532 - protein, 7 aa, Cryptosporidium parvum
QSQHDNL

SEQ ID NO: 2277533 - protein, 4 aa, Cryptosporidium parvum
QSQK

SEQ ID NO: 2277534 - protein, 6 aa, Cryptosporidium parvum
QSQLND

SEQ ID NO: 2277535 - protein, 21 aa, Cryptosporidium parvum
QSQMNSKSYFESSPKPRSHSY

SEQ ID NO: 2277536 - protein, 16 aa, Cryptosporidium parvum
QSQNDSAKLKQAKEEV

SEQ ID NO: 2277537 - protein, 6 aa, Cryptosporidium parvum
QSQNPI

SEQ ID NO: 2277538 - protein, 8 aa, Cryptosporidium parvum
QSQNQGFN

SEQ ID NO: 2277539 - protein, 20 aa, Cryptosporidium parvum
QSQNSEKQQAIQTLSTEKSK

SEQ ID NO: 2277540 - protein, 33 aa, Cryptosporidium parvum; identical to SEQ ID NO: 2158311

SEQ ID NO: 2277541 - protein, 8 aa, Cryptosporidium parvum
QSQQQAQH

SEQ ID NO: 2277542 - protein, 5 aa, Cryptosporidium parvum
QSQRN

SEQ ID NO: 2277543 - protein, 6 aa, Cryptosporidium parvum
QSQSEL

SEQ ID NO: 2277544 - protein, 9 aa, Cryptosporidium parvum
QSQSGTGKT

SEQ ID NO: 2277545 - protein, 24 aa, Cryptosporidium parvum
QSQSKSTNLNQSWSSTASSSSPTL

SEQ ID NO: 2277546 - protein, 11 aa, Cryptosporidium parvum
QSQTKLEKTTF

SEQ ID NO: 2277547 - protein, 11 aa, Cryptosporidium parvum
QSQVSTQQNSE

SEQ ID NO: 2277548 - protein, 11 aa, Cryptosporidium parvum
QSQYRPDEQID

SEQ ID NO: 2277549 - protein, 15 aa, Cryptosporidium parvum
QSQYTSGIGSNSQIY

SEQ ID NO: 2277550 - protein, 10 aa, Cryptosporidium parvum
QSRDISSRPK

SEQ ID NO: 2277551 - protein, 4 aa, Cryptosporidium parvum
QSRG

SEQ ID NO: 2277552 - protein, 26 aa, Cryptosporidium parvum
QSRNGKNMSVQNNRQEKSKSLSQRKN

SEQ ID NO: 2277553 - protein, 7 aa, Cryptosporidium parvum
QSRNIKS

SEQ ID NO: 2277554 - protein, 12 aa, Cryptosporidium parvum
QSRNKPDTSKMV

SEQ ID NO: 2277555 - protein, 14 aa, Cryptosporidium parvum
QSSDLTQRRIEGSE

SEQ ID NO: 2277556 - protein, 7 aa, Cryptosporidium parvum
QSSEPYE

SEQ ID NO: 2277557 - protein, 8 aa, Cryptosporidium parvum
QSSFPPHY

SEQ ID NO: 2277558 - protein, 10 aa, Cryptosporidium parvum
QSSGGLSGAE

SEQ ID NO: 2277559 - protein, 6 aa, Cryptosporidium parvum
QSSIRS

SEQ ID NO: 2277560 - protein, 4 aa, Cryptosporidium parvum
QSSK

SEQ ID NO: 2277561 - protein, 13 aa, Cryptosporidium parvum
QSSKDDQKKRDEL

SEQ ID NO: 2277562 - protein, 27 aa, Cryptosporidium parvum
QSSKSSESSFSRHSNSTIVSNSPSLYD

SEQ ID NO: 2277563 - protein, 7 aa, Cryptosporidium parvum
QSSNKQE

SEQ ID NO: 2277564 - protein, 6 aa, Cryptosporidium parvum
QSSNSR

SEQ ID NO: 2277565 - protein, 7 aa, Cryptosporidium parvum
QSSPESN

SEQ ID NO: 2277566 - protein, 7 aa, Cryptosporidium parvum
QSSPQAY

SEQ ID NO: 2277567 - protein, 8 aa, Cryptosporidium parvum
QSSQDGSL

SEQ ID NO: 2277568 - protein, 6 aa, Cryptosporidium parvum
QSSQNT

SEQ ID NO: 2277569 - protein, 9 aa, Cryptosporidium parvum
QSSSAFTRE

SEQ ID NO: 2277570 - protein, 6 aa, Cryptosporidium parvum
QSSSCQ

SEQ ID NO: 2277571 - protein, 9 aa, Cryptosporidium parvum
QSSSEEEIL

SEQ ID NO: 2277572 - protein, 6 aa, Cryptosporidium parvum
QSSSGM

SEQ ID NO: 2277573 - protein, 13 aa, Cryptosporidium parvum
QSSSLDNLKEKKT

SEQ ID NO: 2277574 - protein, 7 aa, Cryptosporidium parvum
QSSSNLG

SEQ ID NO: 2277575 - protein, 9 aa, Cryptosporidium parvum
QSSSSGRKE

SEQ ID NO: 2277576 - protein, 7 aa, Cryptosporidium parvum
QSSTLEN

SEQ ID NO: 2277577 - protein, 5 aa, Cryptosporidium parvum
QSSTT

SEQ ID NO: 2277578 - protein, 9 aa, Cryptosporidium parvum
QSSVSKSGV

SEQ ID NO: 2277579 - protein, 4 aa, Cryptosporidium parvum
QSTD

SEQ ID NO: 2277580 - protein, 6 aa, Cryptosporidium parvum
QSTEKK

SEQ ID NO: 2277581 - protein, 4 aa, Cryptosporidium parvum
QSTK

SEQ ID NO: 2277582 - protein, 7 aa, Cryptosporidium parvum
QSTLKSQ

SEQ ID NO: 2277583 - protein, 4 aa, Cryptosporidium parvum
QSTR

SEQ ID NO: 2277584 - protein, 5 aa, Cryptosporidium parvum
QSTRD

SEQ ID NO: 2277585 - protein, 6 aa, Cryptosporidium parvum
QSTSDN

SEQ ID NO: 2277586 - protein, 8 aa, Cryptosporidium parvum
QSTVERPN

SEQ ID NO: 2277587 - protein, 17 aa, Cryptosporidium parvum
QSTVQNPQKKVANSQIG

SEQ ID NO: 2277588 - protein, 7 aa, Cryptosporidium parvum
QSTYGNI

SEQ ID NO: 2277589 - protein, 4 aa, Cryptosporidium parvum
QSVF

SEQ ID NO: 2277590 - protein, 43 aa, Cryptosporidium parvum
QSVQNTAKIANNDSGVAKNSGKKSHDSGFETNKSQKEQHHSSK

SEQ ID NO: 2277591 - protein, 4 aa, Cryptosporidium parvum
QSVS

SEQ ID NO: 2277592 - protein, 9 aa, Cryptosporidium parvum
QSVSLGEQQ

SEQ ID NO: 2277593 - protein, 7 aa, Cryptosporidium parvum
QSWDQPN

SEQ ID NO: 2277594 - protein, 26 aa, Cryptosporidium parvum
QSWNNTESNVRDKNSIDAIRDSGSPT

SEQ ID NO: 2277595 - protein, 5 aa, Cryptosporidium parvum
QSWTS

SEQ ID NO: 2277596 - protein, 6 aa, Cryptosporidium parvum
QSYEPE

SEQ ID NO: 2277597 - protein, 4 aa, Cryptosporidium parvum
QSYN

SEQ ID NO: 2277598 - protein, 6 aa, Cryptosporidium parvum
QSYNAP

SEQ ID NO: 2277599 - protein, 7 aa, Cryptosporidium parvum
QSYNATN

SEQ ID NO: 2277600 - protein, 6 aa, Cryptosporidium parvum
QSYPLN

SEQ ID NO: 2277601 - protein, 26 aa, Cryptosporidium parvum
QSYRANKQNKKKNQKMAGNKTANGLV

SEQ ID NO: 2277602 - protein, 13 aa, Cryptosporidium parvum
QSYSTENEELQQT

SEQ ID NO: 2277603 - protein, 8 aa, Cryptosporidium parvum
QTAEETIK

SEQ ID NO: 2277604 - protein, 6 aa, Cryptosporidium parvum
QTASGA

SEQ ID NO: 2277605 - protein, 6 aa, Cryptosporidium parvum
QTCDNE

SEQ ID NO: 2277606 - protein, 7 aa, Cryptosporidium parvum
QTCEEDD

SEQ ID NO: 2277607 - protein, 10 aa, Cryptosporidium parvum
QTCPSNSDVT

SEQ ID NO: 2277608 - protein, 11 aa, Cryptosporidium parvum
QTCSSSLPKSL

SEQ ID NO: 2277609 - protein, 7 aa, Cryptosporidium parvum
QTDEQSF

SEQ ID NO: 2277610 - protein, 10 aa, Cryptosporidium parvum
QTDGGHQSDL

SEQ ID NO: 2277611 - protein, 10 aa, Cryptosporidium parvum
QTDINRSNSA

SEQ ID NO: 2277612 - protein, 5 aa, Cryptosporidium parvum
QTDKA

SEQ ID NO: 2277613 - protein, 13 aa, Cryptosporidium parvum
QTDKNSSISNIEN

SEQ ID NO: 2277614 - protein, 5 aa, Cryptosporidium parvum
QTDPI

SEQ ID NO: 2277615 - protein, 7 aa, Cryptosporidium parvum
QTDPNPA

SEQ ID NO: 2277616 - protein, 4 aa, Cryptosporidium parvum
QTDS

SEQ ID NO: 2277617 - protein, 6 aa, Cryptosporidium parvum
QTDSGQ

SEQ ID NO: 2277618 - protein, 15 aa, Cryptosporidium parvum
QTDSSGEISNTKEYD

SEQ ID NO: 2277619 - protein, 9 aa, Cryptosporidium parvum
QTEASNDKF

SEQ ID NO: 2277620 - protein, 8 aa, Cryptosporidium parvum
QTEEEQEK

SEQ ID NO: 2277621 - protein, 7 aa, Cryptosporidium parvum
QTEIQSK

SEQ ID NO: 2277622 - protein, 5 aa, Cryptosporidium parvum
QTENL

SEQ ID NO: 2277623 - protein, 6 aa, Cryptosporidium parvum
QTENNK

SEQ ID NO: 2277624 - protein, 5 aa, Cryptosporidium parvum
QTEYK

SEQ ID NO: 2277625 - protein, 8 aa, Cryptosporidium parvum
QTGEEEQS

SEQ ID NO: 2277626 - protein, 5 aa, Cryptosporidium parvum
QTGKD

SEQ ID NO: 2277627 - protein, 7 aa, Cryptosporidium parvum
QTGNEAK

SEQ ID NO: 2277628 - protein, 7 aa, Cryptosporidium parvum
QTGPNNL

SEQ ID NO: 2277629 - protein, 6 aa, Cryptosporidium parvum
QTGQPL

SEQ ID NO: 2277630 - protein, 8 aa, Cryptosporidium parvum
QTGSGKTA

SEQ ID NO: 2277631 - protein, 25 aa, Cryptosporidium parvum
QTGTDEHGQKIAATAEKKGISPKEL

SEQ ID NO: 2277632 - protein, 7 aa, Cryptosporidium parvum
QTGTESK

SEQ ID NO: 2277633 - protein, 11 aa, Cryptosporidium parvum
QTGTGKTYTME

SEQ ID NO: 2277634 - protein, 6 aa, Cryptosporidium parvum
QTHNKK

SEQ ID NO: 2277635 - protein, 25 aa, Cryptosporidium parvum
QTHTNTRSSSLSPSNQFSQSNNTQA

SEQ ID NO: 2277636 - protein, 6 aa, Cryptosporidium parvum
QTIETP

SEQ ID NO: 2277637 - protein, 13 aa, Cryptosporidium parvum
QTIGESEPTQQVP

SEQ ID NO: 2277638 - protein, 12 aa, Cryptosporidium parvum
QTKDEESGQVTS

SEQ ID NO: 2277639 - protein, 5 aa, Cryptosporidium parvum
QTKEA

SEQ ID NO: 2277640 - protein, 5 aa, Cryptosporidium parvum
QTKES

SEQ ID NO: 2277641 - protein, 8 aa, Cryptosporidium parvum
QTKESCDT

SEQ ID NO: 2277642 - protein, 5 aa, Cryptosporidium parvum
QTKRI

SEQ ID NO: 2277643 - protein, 5 aa, Cryptosporidium parvum
QTKRK

SEQ ID NO: 2277644 - protein, 14 aa, Cryptosporidium parvum
QTKSEAEEDKNEVI

SEQ ID NO: 2277645 - protein, 8 aa, Cryptosporidium parvum
QTKSWENS

SEQ ID NO: 2277646 - protein, 4 aa, Cryptosporidium parvum
QTKY

SEQ ID NO: 2277647 - protein, 13 aa, Cryptosporidium parvum
QTKYQQQDQAETV

SEQ ID NO: 2277648 - protein, 4 aa, Cryptosporidium parvum
QTLE

SEQ ID NO: 2277649 - protein, 26 aa, Cryptosporidium parvum
QTLPQGLTDENDEEMTSASNLGRSGC

SEQ ID NO: 2277650 - protein, 5 aa, Cryptosporidium parvum
QTLTN

SEQ ID NO: 2277651 - protein, 4 aa, Cryptosporidium parvum
QTMD

SEQ ID NO: 2277652 - protein, 4 aa, Cryptosporidium parvum
QTNK

SEQ ID NO: 2277653 - protein, 27 aa, Cryptosporidium parvum
QTNLQTQQQQYQQQQQQQQHLAENSTN

SEQ ID NO: 2277654 - protein, 14 aa, Cryptosporidium parvum
QTNNSAISKKRSKI

SEQ ID NO: 2277655 - protein, 6 aa, Cryptosporidium parvum
QTNPNI

SEQ ID NO: 2277656 - protein, 6 aa, Cryptosporidium parvum
QTNQGR

SEQ ID NO: 2277657 - protein, 28 aa, Cryptosporidium parvum
QTNSDKTRQDLEQNKEVVERKDEEIANS

SEQ ID NO: 2277658 - protein, 8 aa, Cryptosporidium parvum
QTNTPGRY

SEQ ID NO: 2277659 - protein, 5 aa, Cryptosporidium parvum
QTNTQ

SEQ ID NO: 2277660 - protein, 6 aa, Cryptosporidium parvum
QTPDGL

SEQ ID NO: 2277661 - protein, 4 aa, Cryptosporidium parvum
QTPE

SEQ ID NO: 2277662 - protein, 5 aa, Cryptosporidium parvum
QTPEE

SEQ ID NO: 2277663 - protein, 12 aa, Cryptosporidium parvum
QTPGEGNNGDNK

SEQ ID NO: 2277664 - protein, 12 aa, Cryptosporidium parvum
QTPGHSNIEPAK

SEQ ID NO: 2277665 - protein, 5 aa, Cryptosporidium parvum
QTPMG

SEQ ID NO: 2277666 - protein, 13 aa, Cryptosporidium parvum
QTPQQSQANSINN

SEQ ID NO: 2277667 - protein, 18 aa, Cryptosporidium parvum
QTPRKPSPASNNISSQSI

SEQ ID NO: 2277668 - protein, 4 aa, Cryptosporidium parvum
QTPS

SEQ ID NO: 2277669 - protein, 10 aa, Cryptosporidium parvum
QTPSQTTYGK

SEQ ID NO: 2277670 - protein, 11 aa, Cryptosporidium parvum
QTPSRKVVGGS

SEQ ID NO: 2277671 - protein, 10 aa, Cryptosporidium parvum
QTQENSYKKN

SEQ ID NO: 2277672 - protein, 12 aa, Cryptosporidium parvum
QTQNQSQNQSQF

SEQ ID NO: 2277673 - protein, 7 aa, Cryptosporidium parvum
QTQSGNL

SEQ ID NO: 2277674 - protein, 18 aa, Cryptosporidium parvum
QTQSPCNPCKGTGKTIPV

SEQ ID NO: 2277675 - protein, 32 aa, Cryptosporidium parvum; identical to SEQ ID NO: 2158447

SEQ ID NO: 2277676 - protein, 4 aa, Cryptosporidium parvum
QTQT

SEQ ID NO: 2277677 - protein, 16 aa, Cryptosporidium parvum
QTQYEQKTFSSKTDWR

SEQ ID NO: 2277678 - protein, 5 aa, Cryptosporidium parvum
QTRDS

SEQ ID NO: 2277679 - protein, 4 aa, Cryptosporidium parvum
QTRK

SEQ ID NO: 2277680 - protein, 13 aa, Cryptosporidium parvum
QTRKDQNSAQRSF

SEQ ID NO: 2277681 - protein, 12 aa, Cryptosporidium parvum
QTRNSSKDHSIT

SEQ ID NO: 2277682 - protein, 6 aa, Cryptosporidium parvum
QTRNVS

SEQ ID NO: 2277683 - protein, 10 aa, Cryptosporidium parvum
QTRRPELGDK

SEQ ID NO: 2277684 - protein, 9 aa, Cryptosporidium parvum
QTSEETLQS

SEQ ID NO: 2277685 - protein, 26 aa, Cryptosporidium parvum
QTSETKPELPPSQRPAMAGNEIKGQD

SEQ ID NO: 2277686 - protein, 14 aa, Cryptosporidium parvum
QTSFTGNNEHESKE

SEQ ID NO: 2277687 - protein, 8 aa, Cryptosporidium parvum
QTSKNSNI

SEQ ID NO: 2277688 - protein, 9 aa, Cryptosporidium parvum
QTSKSGEEL

SEQ ID NO: 2277689 - protein, 5 aa, Cryptosporidium parvum
QTSLG

SEQ ID NO: 2277690 - protein, 9 aa, Cryptosporidium parvum
QTSNGISSI

SEQ ID NO: 2277691 - protein, 4 aa, Cryptosporidium parvum
QTSP

SEQ ID NO: 2277692 - protein, 10 aa, Cryptosporidium parvum
QTSQYDDKNQ

SEQ ID NO: 2277693 - protein, 9 aa, Cryptosporidium parvum
QTSSGKTHT

SEQ ID NO: 2277694 - protein, 7 aa, Cryptosporidium parvum
QTSSSIS

SEQ ID NO: 2277695 - protein, 4 aa, Cryptosporidium parvum
QTST

SEQ ID NO: 2277696 - protein, 7 aa, Cryptosporidium parvum
QTTGLED

SEQ ID NO: 2277697 - protein, 11 aa, Cryptosporidium parvum
QTTNTHLNQPD

SEQ ID NO: 2277698 - protein, 32 aa, Cryptosporidium parvum
QTTPCSSSGASIKATNLKRTRSSGEATEVPSL

SEQ ID NO: 2277699 - protein, 6 aa, Cryptosporidium parvum
QTTQDG

SEQ ID NO: 2277700 - protein, 41 aa, Cryptosporidium parvum
QTTRRCSKNGQRIAKGRRSIPNISKTNNSAENFDPNRQGSL

SEQ ID NO: 2277701 - protein, 16 aa, Cryptosporidium parvum
QTTSDSHPKVSDAARE

SEQ ID NO: 2277702 - protein, 5 aa, Cryptosporidium parvum
QTTST

SEQ ID NO: 2277703 - protein, 5 aa, Cryptosporidium parvum
QTTTE

SEQ ID NO: 2277704 - protein, 21 aa, Cryptosporidium parvum
QTTTMSDISRQKALKKSEKKM

SEQ ID NO: 2277705 - protein, 9 aa, Cryptosporidium parvum
QTVDPKAQL

SEQ ID NO: 2277706 - protein, 13 aa, Cryptosporidium parvum
QTVDSQRAKIEDE

SEQ ID NO: 2277707 - protein, 12 aa, Cryptosporidium parvum
QTVKEGQSLQKD

SEQ ID NO: 2277708 - protein, 15 aa, Cryptosporidium parvum
QTWEDPNKKGDENVD

SEQ ID NO: 2277709 - protein, 4 aa, Cryptosporidium parvum
QTYE

SEQ ID NO: 2277710 - protein, 7 aa, Cryptosporidium parvum
QTYEGNS

SEQ ID NO: 2277711 - protein, 5 aa, Cryptosporidium parvum
QTYTP

SEQ ID NO: 2277712 - protein, 6 aa, Cryptosporidium parvum
QVAPSN

SEQ ID NO: 2277713 - protein, 11 aa, Cryptosporidium parvum
QVDEKKAKYQS

SEQ ID NO: 2277714 - protein, 11 aa, Cryptosporidium parvum
QVEEDNNEGTN

SEQ ID NO: 2277715 - protein, 20 aa, Cryptosporidium parvum
QVEESKMNSTISNSESDQTE

SEQ ID NO: 2277716 - protein, 8 aa, Cryptosporidium parvum
QVESSNSE

SEQ ID NO: 2277717 - protein, 5 aa, Cryptosporidium parvum
QVETE

SEQ ID NO: 2277718 - protein, 5 aa, Cryptosporidium parvum
QVFTS

SEQ ID NO: 2277719 - protein, 16 aa, Cryptosporidium parvum
QVGENTNMEDGGEASF

SEQ ID NO: 2277720 - protein, 7 aa, Cryptosporidium parvum
QVGQTHA

SEQ ID NO: 2277721 - protein, 13 aa, Cryptosporidium parvum
QVINPTDQERNRN

SEQ ID NO: 2277722 - protein, 10 aa, Cryptosporidium parvum
QVKDSTSIEE

SEQ ID NO: 2277723 - protein, 9 aa, Cryptosporidium parvum
QVKNESVEL

SEQ ID NO: 2277724 - protein, 6 aa, Cryptosporidium parvum
QVKNQH

SEQ ID NO: 2277725 - protein, 5 aa, Cryptosporidium parvum
QVKRI

SEQ ID NO: 2277726 - protein, 7 aa, Cryptosporidium parvum
QVKSESA

SEQ ID NO: 2277727 - protein, 11 aa, Cryptosporidium parvum
QVNEKDQDWER

SEQ ID NO: 2277728 - protein, 5 aa, Cryptosporidium parvum
QVNGP

SEQ ID NO: 2277729 - protein, 19 aa, Cryptosporidium parvum
QVNRKAHRNGIKKAKSYRK

SEQ ID NO: 2277730 - protein, 8 aa, Cryptosporidium parvum
QVNSNSLR

SEQ ID NO: 2277731 - protein, 29 aa, Cryptosporidium parvum
QVNSQNTRGSAQQGPKLAGAQPIRQGGCC

SEQ ID NO: 2277732 - protein, 5 aa, Cryptosporidium parvum
QVQDS

SEQ ID NO: 2277733 - protein, 7 aa, Cryptosporidium parvum
QVQHESD

SEQ ID NO: 2277734 - protein, 5 aa, Cryptosporidium parvum
QVQNG

SEQ ID NO: 2277735 - protein, 8 aa, Cryptosporidium parvum
QVRATGPI

SEQ ID NO: 2277736 - protein, 5 aa, Cryptosporidium parvum
QVSDA

SEQ ID NO: 2277737 - protein, 12 aa, Cryptosporidium parvum
QVSDEKTNEQID

SEQ ID NO: 2277738 - protein, 42 aa, Cryptosporidium parvum; identical to SEQ ID NO: 2158503

SEQ ID NO: 2277739 - protein, 14 aa, Cryptosporidium parvum
QVSITNSNSTPNAD

SEQ ID NO: 2277740 - protein, 8 aa, Cryptosporidium parvum
QVSKNQSI

SEQ ID NO: 2277741 - protein, 16 aa, Cryptosporidium parvum
QVSKRKKRFQEQPSSK

SEQ ID NO: 2277742 - protein, 8 aa, Cryptosporidium parvum
QVSRYDSV

SEQ ID NO: 2277743 - protein, 12 aa, Cryptosporidium parvum
QVSSSDQIDEEQ

SEQ ID NO: 2277744 - protein, 5 aa, Cryptosporidium parvum
QVSTG

SEQ ID NO: 2277745 - protein, 14 aa, Cryptosporidium parvum
QVTEYSNVNNIPSK

SEQ ID NO: 2277746 - protein, 6 aa, Cryptosporidium parvum
QVYEGE

SEQ ID NO: 2277747 - protein, 10 aa, Cryptosporidium parvum
QVYNSNPNVT

SEQ ID NO: 2277748 - protein, 5 aa, Cryptosporidium parvum
QWGDY

SEQ ID NO: 2277749 - protein, 11 aa, Cryptosporidium parvum
QWNSEAKRKLT

SEQ ID NO: 2277750 - protein, 7 aa, Cryptosporidium parvum
QWREQQQ

SEQ ID NO: 2277751 - protein, 8 aa, Cryptosporidium parvum
QWTEEEKS

SEQ ID NO: 2277752 - protein, 14 aa, Cryptosporidium parvum
QYAEQARKKTNSLI

SEQ ID NO: 2277753 - protein, 13 aa, Cryptosporidium parvum
QYAPYSRLGTPDD

SEQ ID NO: 2277754 - protein, 7 aa, Cryptosporidium parvum
QYDGIDS

SEQ ID NO: 2277755 - protein, 5 aa, Cryptosporidium parvum
QYDPQ

SEQ ID NO: 2277756 - protein, 16 aa, Cryptosporidium parvum
QYEDTSHKDYSQNNPR

SEQ ID NO: 2277757 - protein, 11 aa, Cryptosporidium parvum
QYEENNINNNL

SEQ ID NO: 2277758 - protein, 11 aa, Cryptosporidium parvum
QYENSLTNRPC

SEQ ID NO: 2277759 - protein, 13 aa, Cryptosporidium parvum
QYESKQRKNDKDF

SEQ ID NO: 2277760 - protein, 6 aa, Cryptosporidium parvum
QYFPPG

SEQ ID NO: 2277761 - protein, 6 aa, Cryptosporidium parvum
QYGDNI

SEQ ID NO: 2277762 - protein, 5 aa, Cryptosporidium parvum
QYGEY

SEQ ID NO: 2277763 - protein, 6 aa, Cryptosporidium parvum
QYGGSG

SEQ ID NO: 2277764 - protein, 14 aa, Cryptosporidium parvum
QYGQGQNASRNVND

SEQ ID NO: 2277765 - protein, 22 aa, Cryptosporidium parvum
QYGSEGLQAGFGGPTSDQGGMG

SEQ ID NO: 2277766 - protein, 20 aa, Cryptosporidium parvum
QYGTETSDDLHTTDVRGANQ

SEQ ID NO: 2277767 - protein, 4 aa, Cryptosporidium parvum
QYHK

SEQ ID NO: 2277768 - protein, 13 aa, Cryptosporidium parvum
QYISKSKKIVSCT

SEQ ID NO: 2277769 - protein, 31 aa, Cryptosporidium parvum
QYKATTGGNRISGSGIQTKSSNIPEEKNQHY

SEQ ID NO: 2277770 - protein, 4 aa, Cryptosporidium parvum
QYKE

SEQ ID NO: 2277771 - protein, 8 aa, Cryptosporidium parvum
QYKEPDRN

SEQ ID NO: 2277772 - protein, 10 aa, Cryptosporidium parvum
QYKPKNIQDR

SEQ ID NO: 2277773 - protein, 14 aa, Cryptosporidium parvum
QYKSDSSLTPEEQK

SEQ ID NO: 2277774 - protein, 9 aa, Cryptosporidium parvum
QYNSEGRRI

SEQ ID NO: 2277775 - protein, 20 aa, Cryptosporidium parvum
QYNYRRDEDFRREDYPRSHN

SEQ ID NO: 2277776 - protein, 4 aa, Cryptosporidium parvum
QYPI

SEQ ID NO: 2277777 - protein, 6 aa, Cryptosporidium parvum
QYPKIP

SEQ ID NO: 2277778 - protein, 6 aa, Cryptosporidium parvum
QYPSDE

SEQ ID NO: 2277779 - protein, 7 aa, Cryptosporidium parvum
QYPYPDK

SEQ ID NO: 2277780 - protein, 7 aa, Cryptosporidium parvum
QYQKECR

SEQ ID NO: 2277781 - protein, 6 aa, Cryptosporidium parvum
QYRRRE

SEQ ID NO: 2277782 - protein, 4 aa, Cryptosporidium parvum
QYSN

SEQ ID NO: 2277783 - protein, 18 aa, Cryptosporidium parvum
QYSRGRDGRPSRDTNTGT

SEQ ID NO: 2277784 - protein, 11 aa, Cryptosporidium parvum
QYSSASGHGTG

SEQ ID NO: 2277785 - protein, 5 aa, Cryptosporidium parvum
QYSSK

SEQ ID NO: 2277786 - protein, 8 aa, Cryptosporidium parvum
QYSTTTGG

SEQ ID NO: 2277787 - protein, 4 aa, Cryptosporidium parvum
QYTE

SEQ ID NO: 2277788 - protein, 11 aa, Cryptosporidium parvum
QYTGNKATRVE

SEQ ID NO: 2277789 - protein, 5 aa, Cryptosporidium parvum
QYTPL

SEQ ID NO: 2277790 - protein, 7 aa, Cryptosporidium parvum
QYTPPLA

SEQ ID NO: 2277791 - protein, 14 aa, Cryptosporidium parvum
QYYNSDSNSLTPRC

SEQ ID NO: 2277792 - protein, 33 aa, Cryptosporidium parvum
RAALSESERRSLEEREGQLYEKESRLKDREGKF

SEQ ID NO: 2277793 - protein, 7 aa, Cryptosporidium parvum
RADFPSR

SEQ ID NO: 2277794 - protein, 10 aa, Cryptosporidium parvum
RADGEETIEY

SEQ ID NO: 2277795 - protein, 4 aa, Cryptosporidium parvum
RADQ

SEQ ID NO: 2277796 - protein, 6 aa, Cryptosporidium parvum
RADTLD

SEQ ID NO: 2277797 - protein, 65 aa, Cryptosporidium parvum
RAEEKEKSSQRQSTGNDSSVSSSTSKDKDNSNTNTHAGSATSSGGSSCAGGLGGSSGSLSGATAS

SEQ ID NO: 2277798 - protein, 8 aa, Cryptosporidium parvum
RAEEQLQS

SEQ ID NO: 2277799 - protein, 6 aa, Cryptosporidium parvum
RAEKRN

SEQ ID NO: 2277800 - protein, 20 aa, Cryptosporidium parvum
RAEKSPAQKNLRGRARRSNL

SEQ ID NO: 2277801 - protein, 20 aa, Cryptosporidium parvum
RAFSSPSSSSASEDEDDISL

SEQ ID NO: 2277802 - protein, 5 aa, Cryptosporidium parvum
RAGAA

SEQ ID NO: 2277803 - protein, 6 aa, Cryptosporidium parvum
RAGENE

SEQ ID NO: 2277804 - protein, 13 aa, Cryptosporidium parvum
RAGGKHNDLDDVG

SEQ ID NO: 2277805 - protein, 5 aa, Cryptosporidium parvum
RAGGL

SEQ ID NO: 2277806 - protein, 8 aa, Cryptosporidium parvum
RAGKDTKI

SEQ ID NO: 2277807 - protein, 4 aa, Cryptosporidium parvum
RAGP

SEQ ID NO: 2277808 - protein, 4 aa, Cryptosporidium parvum
RAGR

SEQ ID NO: 2277809 - protein, 5 aa, Cryptosporidium parvum
RAGRT

SEQ ID NO: 2277810 - protein, 11 aa, Cryptosporidium parvum
RAGSFGDEEGS

SEQ ID NO: 2277811 - protein, 4 aa, Cryptosporidium parvum
RAGV

SEQ ID NO: 2277812 - protein, 4 aa, Cryptosporidium parvum
RAID

SEQ ID NO: 2277813 - protein, 37 aa, Cryptosporidium parvum
RAIKKQQKSQISISNPNLPLNTNSSNSSSLPLTNQQS

SEQ ID NO: 2277814 - protein, 4 aa, Cryptosporidium parvum
RAIP

SEQ ID NO: 2277815 - protein, 11 aa, Cryptosporidium parvum
RAKDTNSPIET

SEQ ID NO: 2277816 - protein, 10 aa, Cryptosporidium parvum
RAKNGTGKTA

SEQ ID NO: 2277817 - protein, 7 aa, Cryptosporidium parvum
RAKNLEP

SEQ ID NO: 2277818 - protein, 9 aa, Cryptosporidium parvum
RAKSCTESI

SEQ ID NO: 2277819 - protein, 9 aa, Cryptosporidium parvum
RAKSGSKKK

SEQ ID NO: 2277820 - protein, 10 aa, Cryptosporidium parvum
RAKSSGKLKG

SEQ ID NO: 2277821 - protein, 36 aa, Cryptosporidium parvum
RALGESNGQSSKRSRPKVDANPKLNQKSKSPKNVIK

SEQ ID NO: 2277822 - protein, 8 aa, Cryptosporidium parvum
RANALSSE

SEQ ID NO: 2277823 - protein, 9 aa, Cryptosporidium parvum
RANDVKQRM

SEQ ID NO: 2277824 - protein, 7 aa, Cryptosporidium parvum
RANKTQI

SEQ ID NO: 2277825 - protein, 7 aa, Cryptosporidium parvum
RANNGNF

SEQ ID NO: 2277826 - protein, 8 aa, Cryptosporidium parvum
RANNHELS

SEQ ID NO: 2277827 - protein, 10 aa, Cryptosporidium parvum
RANNKSNNLE

SEQ ID NO: 2277828 - protein, 11 aa, Cryptosporidium parvum
RANNQKNGEFE

SEQ ID NO: 2277829 - protein, 11 aa, Cryptosporidium parvum
RANNSNKLEES

SEQ ID NO: 2277830 - protein, 9 aa, Cryptosporidium parvum
RANSNKESK

SEQ ID NO: 2277831 - protein, 32 aa, Cryptosporidium parvum
RANSNSNTSPTLDTNSSSKSSSPRKLSKATRS

SEQ ID NO: 2277832 - protein, 9 aa, Cryptosporidium parvum
RAPEKVRES

SEQ ID NO: 2277833 - protein, 34 aa, Cryptosporidium parvum; identical to SEQ ID NO: 2158584

SEQ ID NO: 2277834 - protein, 6 aa, Cryptosporidium parvum
RAPKGR

SEQ ID NO: 2277835 - protein, 7 aa, Cryptosporidium parvum
RAPKGSN

SEQ ID NO: 2277836 - protein, 12 aa, Cryptosporidium parvum
RAPPSEVESLPQ

SEQ ID NO: 2277837 - protein, 8 aa, Cryptosporidium parvum
RAQDAQDV

SEQ ID NO: 2277838 - protein, 25 aa, Cryptosporidium parvum
RAQETFESKAEEVIGNDSGNSELQR

SEQ ID NO: 2277839 - protein, 14 aa, Cryptosporidium parvum
RAQGKEEDSKIVEN

SEQ ID NO: 2277840 - protein, 15 aa, Cryptosporidium parvum
RAQHSSENKEFDANS

SEQ ID NO: 2277841 - protein, 23 aa, Cryptosporidium parvum
RAQNTAGQAGQVGSAQSKQTSVN

SEQ ID NO: 2277842 - protein, 7 aa, Cryptosporidium parvum
RAQRAKS

SEQ ID NO: 2277843 - protein, 6 aa, Cryptosporidium parvum
RAQRIN

SEQ ID NO: 2277844 - protein, 24 aa, Cryptosporidium parvum
RAQSQIDNPPPIQETSNDTSSSTI

SEQ ID NO: 2277845 - protein, 12 aa, Cryptosporidium parvum
RAQYEPSDGEIE

SEQ ID NO: 2277846 - protein, 9 aa, Cryptosporidium parvum
RARPTPLDE

SEQ ID NO: 2277847 - protein, 12 aa, Cryptosporidium parvum
RARSQEKKLQSR

SEQ ID NO: 2277848 - protein, 7 aa, Cryptosporidium parvum
RASDLTG

SEQ ID NO: 2277849 - protein, 30 aa, Cryptosporidium parvum; identical to SEQ ID NO: 2158600

SEQ ID NO: 2277850 - protein, 9 aa, Cryptosporidium parvum
RASGRKPET

SEQ ID NO: 2277851 - protein, 4 aa, Cryptosporidium parvum
RASL

SEQ ID NO: 2277852 - protein, 13 aa, Cryptosporidium parvum
RASPENALRGGNM

SEQ ID NO: 2277853 - protein, 7 aa, Cryptosporidium parvum
RASPYVN

SEQ ID NO: 2277854 - protein, 82 aa, Cryptosporidium parvum
RASSKKNISADNSEDSKLKKSESKKDIIKDEAKDESKTNKDGKDLKKTLKEGEGSISKVKGKGKVKTKAKAKEAPPPAEESS

SEQ ID NO: 2277855 - protein, 5 aa, Cryptosporidium parvum
RASSL

SEQ ID NO: 2277856 - protein, 9 aa, Cryptosporidium parvum
RASSSGNIS

SEQ ID NO: 2277857 - protein, 48 aa, Cryptosporidium parvum
RASTTQKKQDLQESIKRRDEEAQDRTNRKRLKKSSTSKEQAKTVMTQE

SEQ ID NO: 2277858 - protein, 13 aa, Cryptosporidium parvum
RATFKRSPSPRKD

SEQ ID NO: 2277859 - protein, 14 aa, Cryptosporidium parvum
RATFKRSPSPRKDW

SEQ ID NO: 2277860 - protein, 6 aa, Cryptosporidium parvum
RATGGR

SEQ ID NO: 2277861 - protein, 12 aa, Cryptosporidium parvum
RATGQKIPKELD

SEQ ID NO: 2277862 - protein, 4 aa, Cryptosporidium parvum
RATI

SEQ ID NO: 2277863 - protein, 9 aa, Cryptosporidium parvum
RATLKNSKK

SEQ ID NO: 2277864 - protein, 9 aa, Cryptosporidium parvum
RATNGNTEL

SEQ ID NO: 2277865 - protein, 14 aa, Cryptosporidium parvum
RATTRSKNSQNSDS

SEQ ID NO: 2277866 - protein, 6 aa, Cryptosporidium parvum
RAVQNG

SEQ ID NO: 2277867 - protein, 21 aa, Cryptosporidium parvum
RAVSKSRNGVEIPENATTAEI

SEQ ID NO: 2277868 - protein, 12 aa, Cryptosporidium parvum
RAYSPEEVKSNG

SEQ ID NO: 2277869 - protein, 8 aa, Cryptosporidium parvum
RCERTGRD

SEQ ID NO: 2277870 - protein, 7 aa, Cryptosporidium parvum
RCGGEQS

SEQ ID NO: 2277871 - protein, 4 aa, Cryptosporidium parvum
RCGK

SEQ ID NO: 2277872 - protein, 9 aa, Cryptosporidium parvum
RCKKPPQRI

SEQ ID NO: 2277873 - protein, 4 aa, Cryptosporidium parvum
RCKP

SEQ ID NO: 2277874 - protein, 10 aa, Cryptosporidium parvum
RCKPKNCRQE

SEQ ID NO: 2277875 - protein, 5 aa, Cryptosporidium parvum
RCPSK

SEQ ID NO: 2277876 - protein, 6 aa, Cryptosporidium parvum
RCSAGQ

SEQ ID NO: 2277877 - protein, 14 aa, Cryptosporidium parvum
RCSNPNRVEGKSLE

SEQ ID NO: 2277878 - protein, 4 aa, Cryptosporidium parvum
RCSQ

SEQ ID NO: 2277879 - protein, 7 aa, Cryptosporidium parvum
RCSRYSQ

SEQ ID NO: 2277880 - protein, 7 aa, Cryptosporidium parvum
RDANGFT

SEQ ID NO: 2277881 - protein, 8 aa, Cryptosporidium parvum
RDARKNKA

SEQ ID NO: 2277882 - protein, 7 aa, Cryptosporidium parvum
RDASERD

SEQ ID NO: 2277883 - protein, 18 aa, Cryptosporidium parvum
RDASKAGTGRDDSNSTYP

SEQ ID NO: 2277884 - protein, 7 aa, Cryptosporidium parvum
RDAYNKS

SEQ ID NO: 2277885 - protein, 9 aa, Cryptosporidium parvum
RDCDERTKS

SEQ ID NO: 2277886 - protein, 16 aa, Cryptosporidium parvum
RDDAGRSTEKPKPELD

SEQ ID NO: 2277887 - protein, 7 aa, Cryptosporidium parvum
RDDAYSN

SEQ ID NO: 2277888 - protein, 5 aa, Cryptosporidium parvum
RDDDI

SEQ ID NO: 2277889 - protein, 9 aa, Cryptosporidium parvum
RDDFDDDNI

SEQ ID NO: 2277890 - protein, 27 aa, Cryptosporidium parvum
RDDGSNTTTNKNNKNKANKNNTKSDKG

SEQ ID NO: 2277891 - protein, 9 aa, Cryptosporidium parvum
RDDGTSTAN

SEQ ID NO: 2277892 - protein, 5 aa, Cryptosporidium parvum
RDDQL

SEQ ID NO: 2277893 - protein, 6 aa, Cryptosporidium parvum
RDDREQ

SEQ ID NO: 2277894 - protein, 11 aa, Cryptosporidium parvum
RDDTSNSWRTP

SEQ ID NO: 2277895 - protein, 36 aa, Cryptosporidium parvum
RDEDDSDDNDESDNYEDDITGSSFRYDPDSKSSLEE

SEQ ID NO: 2277896 - protein, 11 aa, Cryptosporidium parvum
RDEDGNKSCIG

SEQ ID NO: 2277897 - protein, 6 aa, Cryptosporidium parvum
RDEGIE

SEQ ID NO: 2277898 - protein, 10 aa, Cryptosporidium parvum
RDEIPPTKHH

SEQ ID NO: 2277899 - protein, 7 aa, Cryptosporidium parvum
RDELEGG

SEQ ID NO: 2277900 - protein, 8 aa, Cryptosporidium parvum
RDELSGEV

SEQ ID NO: 2277901 - protein, 4 aa, Cryptosporidium parvum
RDEM

SEQ ID NO: 2277902 - protein, 6 aa, Cryptosporidium parvum
RDEREY

SEQ ID NO: 2277903 - protein, 4 aa, Cryptosporidium parvum
RDES

SEQ ID NO: 2277904 - protein, 5 aa, Cryptosporidium parvum
RDESF

SEQ ID NO: 2277905 - protein, 12 aa, Cryptosporidium parvum
RDESKNSENSDH

SEQ ID NO: 2277906 - protein, 8 aa, Cryptosporidium parvum
RDESRESL

SEQ ID NO: 2277907 - protein, 5 aa, Cryptosporidium parvum
RDEVL

SEQ ID NO: 2277908 - protein, 7 aa, Cryptosporidium parvum
RDEYERR

SEQ ID NO: 2277909 - protein, 5 aa, Cryptosporidium parvum
RDGDG

SEQ ID NO: 2277910 - protein, 7 aa, Cryptosporidium parvum
RDGPGGA

SEQ ID NO: 2277911 - protein, 6 aa, Cryptosporidium parvum
RDGRSQ

SEQ ID NO: 2277912 - protein, 7 aa, Cryptosporidium parvum
RDGYDTK

SEQ ID NO: 2277913 - protein, 5 aa, Cryptosporidium parvum
RDHYK

SEQ ID NO: 2277914 - protein, 5 aa, Cryptosporidium parvum
RDIDN

SEQ ID NO: 2277915 - protein, 26 aa, Cryptosporidium parvum
RDIDRQRAQKRQDRTAPKTGKSIIEQ

SEQ ID NO: 2277916 - protein, 5 aa, Cryptosporidium parvum
RDINQ

SEQ ID NO: 2277917 - protein, 10 aa, Cryptosporidium parvum
RDIQKDGETL

SEQ ID NO: 2277918 - protein, 4 aa, Cryptosporidium parvum
RDIT

SEQ ID NO: 2277919 - protein, 5 aa, Cryptosporidium parvum
RDKEA

SEQ ID NO: 2277920 - protein, 10 aa, Cryptosporidium parvum
RDKESDETIN

SEQ ID NO: 2277921 - protein, 8 aa, Cryptosporidium parvum
RDKESGTL

SEQ ID NO: 2277922 - protein, 9 aa, Cryptosporidium parvum
RDKFTDNSI

SEQ ID NO: 2277923 - protein, 5 aa, Cryptosporidium parvum
RDKLN

SEQ ID NO: 2277924 - protein, 15 aa, Cryptosporidium parvum
RDKNQDSNKEVSKGI

SEQ ID NO: 2277925 - protein, 7 aa, Cryptosporidium parvum
RDKNTMK

SEQ ID NO: 2277926 - protein, 28 aa, Cryptosporidium parvum
RDKRRNRRNFTESDYDTSSECSSESNSI

SEQ ID NO: 2277927 - protein, 20 aa, Cryptosporidium parvum
RDKSKEADYAKSSFVDPDGD

SEQ ID NO: 2277928 - protein, 6 aa, Cryptosporidium parvum
RDKTGS

SEQ ID NO: 2277929 - protein, 15 aa, Cryptosporidium parvum
RDLNSGNKVENESDT

SEQ ID NO: 2277930 - protein, 9 aa, Cryptosporidium parvum
RDNDSAYTK

SEQ ID NO: 2277931 - protein, 6 aa, Cryptosporidium parvum
RDNKTT

SEQ ID NO: 2277932 - protein, 12 aa, Cryptosporidium parvum
RDNNETKKNESV

SEQ ID NO: 2277933 - protein, 14 aa, Cryptosporidium parvum
RDNSFENEQNVNSV

SEQ ID NO: 2277934 - protein, 10 aa, Cryptosporidium parvum
RDPEKGSIAN

SEQ ID NO: 2277935 - protein, 12 aa, Cryptosporidium parvum
RDPKGYKTSNCE

SEQ ID NO: 2277936 - protein, 9 aa, Cryptosporidium parvum
RDPKYANSE

SEQ ID NO: 2277937 - protein, 12 aa, Cryptosporidium parvum
RDPYNRDPKSHH

SEQ ID NO: 2277938 - protein, 7 aa, Cryptosporidium parvum
RDQERGL

SEQ ID NO: 2277939 - protein, 22 aa, Cryptosporidium parvum
RDQKQNSGSKKAPLSQEPTSFS

SEQ ID NO: 2277940 - protein, 6 aa, Cryptosporidium parvum
RDQLHS

SEQ ID NO: 2277941 - protein, 13 aa, Cryptosporidium parvum
RDQNRKCENCDND

SEQ ID NO: 2277942 - protein, 11 aa, Cryptosporidium parvum
RDQNTSEVTLE

SEQ ID NO: 2277943 - protein, 10 aa, Cryptosporidium parvum
RDQQNVENST

SEQ ID NO: 2277944 - protein, 7 aa, Cryptosporidium parvum
RDQSQSY

SEQ ID NO: 2277945 - protein, 5 aa, Cryptosporidium parvum
RDSDA

SEQ ID NO: 2277946 - protein, 10 aa, Cryptosporidium parvum
RDSDTPQEKE

SEQ ID NO: 2277947 - protein, 5 aa, Cryptosporidium parvum
RDSEN

SEQ ID NO: 2277948 - protein, 17 aa, Cryptosporidium parvum
RDSERPRDLNKEKSNEL

SEQ ID NO: 2277949 - protein, 7 aa, Cryptosporidium parvum
RDSESGK

SEQ ID NO: 2277950 - protein, 9 aa, Cryptosporidium parvum
RDSGIPKEK

SEQ ID NO: 2277951 - protein, 92 aa, Cryptosporidium parvum; identical to SEQ ID NO: 2158693

SEQ ID NO: 2277952 - protein, 8 aa, Cryptosporidium parvum
RDSIPQEQ

SEQ ID NO: 2277953 - protein, 11 aa, Cryptosporidium parvum
RDSKGTRPLDP

SEQ ID NO: 2277954 - protein, 72 aa, Cryptosporidium parvum
RDSKMTGVKSSENLETSEKSDKKSEKKSEKKSEKKSENKSESKSDNKSEKNKNNLRPEKESNESQKEKSGSR

SEQ ID NO: 2277955 - protein, 8 aa, Cryptosporidium parvum
RDSNSSSI

SEQ ID NO: 2277956 - protein, 8 aa, Cryptosporidium parvum
RDSPAGRK

SEQ ID NO: 2277957 - protein, 6 aa, Cryptosporidium parvum
RDSPVA

SEQ ID NO: 2277958 - protein, 18 aa, Cryptosporidium parvum
RDSQPELKDEIRKKGGIQ

SEQ ID NO: 2277959 - protein, 4 aa, Cryptosporidium parvum
RDSS

SEQ ID NO: 2277960 - protein, 17 aa, Cryptosporidium parvum
RDSSEINEKKRNNSFDG

SEQ ID NO: 2277961 - protein, 7 aa, Cryptosporidium parvum
RDSSGCT

SEQ ID NO: 2277962 - protein, 8 aa, Cryptosporidium parvum
RDSSNSEL

SEQ ID NO: 2277963 - protein, 16 aa, Cryptosporidium parvum
RDSSSPIIDNADVTEF

SEQ ID NO: 2277964 - protein, 4 aa, Cryptosporidium parvum
RDSY

SEQ ID NO: 2277965 - protein, 8 aa, Cryptosporidium parvum
RDTASSNI

SEQ ID NO: 2277966 - protein, 8 aa, Cryptosporidium parvum
RDTATENG

SEQ ID NO: 2277967 - protein, 10 aa, Cryptosporidium parvum
RDTEKPEYNP

SEQ ID NO: 2277968 - protein, 14 aa, Cryptosporidium parvum
RDTSRNMSYTNNRR

SEQ ID NO: 2277969 - protein, 5 aa, Cryptosporidium parvum
RDVNS

SEQ ID NO: 2277970 - protein, 5 aa, Cryptosporidium parvum
RDVPD

SEQ ID NO: 2277971 - protein, 5 aa, Cryptosporidium parvum
RDVPS

SEQ ID NO: 2277972 - protein, 10 aa, Cryptosporidium parvum
RDYEKELEGA

SEQ ID NO: 2277973 - protein, 9 aa, Cryptosporidium parvum
RDYNKAQDK

SEQ ID NO: 2277974 - protein, 35 aa, Cryptosporidium parvum
RDYPFGNPSRGNNISTEPDETNLVGTNSESTLRRR

SEQ ID NO: 2277975 - protein, 9 aa, Cryptosporidium parvum
REAEELTET

SEQ ID NO: 2277976 - protein, 5 aa, Cryptosporidium parvum
REAEG

SEQ ID NO: 2277977 - protein, 8 aa, Cryptosporidium parvum
REAEKDLS

SEQ ID NO: 2277978 - protein, 11 aa, Cryptosporidium parvum
REAENKMKAED

SEQ ID NO: 2277979 - protein, 4 aa, Cryptosporidium parvum
REAK

SEQ ID NO: 2277980 - protein, 10 aa, Cryptosporidium parvum
REANETLENT

SEQ ID NO: 2277981 - protein, 10 aa, Cryptosporidium parvum
REANMNQTAE

SEQ ID NO: 2277982 - protein, 6 aa, Cryptosporidium parvum
REAQAY

SEQ ID NO: 2277983 - protein, 5 aa, Cryptosporidium parvum
RECSS

SEQ ID NO: 2277984 - protein, 4 aa, Cryptosporidium parvum
REDD

SEQ ID NO: 2277985 - protein, 4 aa, Cryptosporidium parvum
REDE

SEQ ID NO: 2277986 - protein, 9 aa, Cryptosporidium parvum
REDLKPPAS

SEQ ID NO: 2277987 - protein, 4 aa, Cryptosporidium parvum
REDR

SEQ ID NO: 2277988 - protein, 5 aa, Cryptosporidium parvum
REDSL

SEQ ID NO: 2277989 - protein, 11 aa, Cryptosporidium parvum
REDSPTRDNTI

SEQ ID NO: 2277990 - protein, 9 aa, Cryptosporidium parvum
REDTDDPDS

SEQ ID NO: 2277991 - protein, 6 aa, Cryptosporidium parvum
REDYTK

SEQ ID NO: 2277992 - protein, 12 aa, Cryptosporidium parvum
REEAESKIRDHE

SEQ ID NO: 2277993 - protein, 14 aa, Cryptosporidium parvum
REEENESTKIGKNL

SEQ ID NO: 2277994 - protein, 30 aa, Cryptosporidium parvum; identical to SEQ ID NO: 2158734

SEQ ID NO: 2277995 - protein, 6 aa, Cryptosporidium parvum
REEGSL

SEQ ID NO: 2277996 - protein, 16 aa, Cryptosporidium parvum
REEKNNYHKEAGAPGN

SEQ ID NO: 2277997 - protein, 11 aa, Cryptosporidium parvum
REEKPYSPMSA

SEQ ID NO: 2277998 - protein, 12 aa, Cryptosporidium parvum
REEQEKSTKQLN

SEQ ID NO: 2277999 - protein, 5 aa, Cryptosporidium parvum
REERA

SEQ ID NO: 2278000 - protein, 5 aa, Cryptosporidium parvum
REERI

SEQ ID NO: 2278001 - protein, 7 aa, Cryptosporidium parvum
REERIGD

SEQ ID NO: 2278002 - protein, 13 aa, Cryptosporidium parvum
REERRQLNPTGVP

SEQ ID NO: 2278003 - protein, 4 aa, Cryptosporidium parvum
REES

SEQ ID NO: 2278004 - protein, 21 aa, Cryptosporidium parvum
REESNFRKNGDNLKESSKSIS

SEQ ID NO: 2278005 - protein, 20 aa, Cryptosporidium parvum
REESRSKKKFKAKNTEDKIK

SEQ ID NO: 2278006 - protein, 19 aa, Cryptosporidium parvum
REETEDGSEIVEGADEDVE

SEQ ID NO: 2278007 - protein, 5 aa, Cryptosporidium parvum
REETN

SEQ ID NO: 2278008 - protein, 8 aa, Cryptosporidium parvum
REEYPLPE

SEQ ID NO: 2278009 - protein, 5 aa, Cryptosporidium parvum
REFAA

SEQ ID NO: 2278010 - protein, 4 aa, Cryptosporidium parvum
REFD

SEQ ID NO: 2278011 - protein, 11 aa, Cryptosporidium parvum
REFEKHDRRRT

SEQ ID NO: 2278012 - protein, 6 aa, Cryptosporidium parvum
REFSSQ

SEQ ID NO: 2278013 - protein, 4 aa, Cryptosporidium parvum
REFT

SEQ ID NO: 2278014 - protein, 11 aa, Cryptosporidium parvum
REFTHDEKQGI

SEQ ID NO: 2278015 - protein, 4 aa, Cryptosporidium parvum
REGC

SEQ ID NO: 2278016 - protein, 10 aa, Cryptosporidium parvum
REGDALRSSF

SEQ ID NO: 2278017 - protein, 4 aa, Cryptosporidium parvum
REGE

SEQ ID NO: 2278018 - protein, 5 aa, Cryptosporidium parvum
REGEN

SEQ ID NO: 2278019 - protein, 66 aa, Cryptosporidium parvum
REGEQEGAGEREDGGEGEGGEGEGGEGDEYEEREGEEKKEKVRNMENTKLRKSTVGKESTGGQTIS

SEQ ID NO: 2278020 - protein, 5 aa, Cryptosporidium parvum
REGGI

SEQ ID NO: 2278021 - protein, 5 aa, Cryptosporidium parvum
REGKQ

SEQ ID NO: 2278022 - protein, 4 aa, Cryptosporidium parvum
REGL

SEQ ID NO: 2278023 - protein, 7 aa, Cryptosporidium parvum
REGLEEL

SEQ ID NO: 2278024 - protein, 5 aa, Cryptosporidium parvum
REGNS

SEQ ID NO: 2278025 - protein, 17 aa, Cryptosporidium parvum
REGSAPDPLIESGIERV

SEQ ID NO: 2278026 - protein, 10 aa, Cryptosporidium parvum
REGSNTDHGD

SEQ ID NO: 2278027 - protein, 9 aa, Cryptosporidium parvum
REGSPGSTI

SEQ ID NO: 2278028 - protein, 8 aa, Cryptosporidium parvum
REGTNLSQ

SEQ ID NO: 2278029 - protein, 9 aa, Cryptosporidium parvum
REGVEEETF

SEQ ID NO: 2278030 - protein, 10 aa, Cryptosporidium parvum
REHQERTQEA

SEQ ID NO: 2278031 - protein, 4 aa, Cryptosporidium parvum
REIE

SEQ ID NO: 2278032 - protein, 21 aa, Cryptosporidium parvum
REIQGQARNNYGNSSPSSTRE

SEQ ID NO: 2278033 - protein, 16 aa, Cryptosporidium parvum
REKDEEQQKQQSSGPI

SEQ ID NO: 2278034 - protein, 16 aa, Cryptosporidium parvum
REKDNDEVSATAEEIA

SEQ ID NO: 2278035 - protein, 27 aa, Cryptosporidium parvum
REKDTQKMDDSEFESVSEKDEQFKTSK

SEQ ID NO: 2278036 - protein, 10 aa, Cryptosporidium parvum
REKEEAQFES

SEQ ID NO: 2278037 - protein, 17 aa, Cryptosporidium parvum
REKEEEIEKEKRRIAST

SEQ ID NO: 2278038 - protein, 17 aa, Cryptosporidium parvum
REKELYEGKSFSNKDKE

SEQ ID NO: 2278039 - protein, 13 aa, Cryptosporidium parvum
REKENQTKELSSP

SEQ ID NO: 2278040 - protein, 8 aa, Cryptosporidium parvum
REKGGSGN

SEQ ID NO: 2278041 - protein, 7 aa, Cryptosporidium parvum
REKHAGS

SEQ ID NO: 2278042 - protein, 4 aa, Cryptosporidium parvum
REKK

SEQ ID NO: 2278043 - protein, 15 aa, Cryptosporidium parvum
REKKEDLRISDKEEP

SEQ ID NO: 2278044 - protein, 12 aa, Cryptosporidium parvum
REKKKVSVKTPL

SEQ ID NO: 2278045 - protein, 9 aa, Cryptosporidium parvum
REKKRKKAL

SEQ ID NO: 2278046 - protein, 4 aa, Cryptosporidium parvum
REKL

SEQ ID NO: 2278047 - protein, 6 aa, Cryptosporidium parvum
REKLEE

SEQ ID NO: 2278048 - protein, 6 aa, Cryptosporidium parvum
REKLRQ

SEQ ID NO: 2278049 - protein, 19 aa, Cryptosporidium parvum
REKLTSRSIYNPKPSNASE

SEQ ID NO: 2278050 - protein, 11 aa, Cryptosporidium parvum
REKNANDSSLG

SEQ ID NO: 2278051 - protein, 10 aa, Cryptosporidium parvum
REKNGRSRGY

SEQ ID NO: 2278052 - protein, 7 aa, Cryptosporidium parvum
REKPSRF

SEQ ID NO: 2278053 - protein, 27 aa, Cryptosporidium parvum
REKQNISSRGDNDNGNNNSYSDMGESD

SEQ ID NO: 2278054 - protein, 13 aa, Cryptosporidium parvum
REKQRKEENERKR

SEQ ID NO: 2278055 - protein, 6 aa, Cryptosporidium parvum
REKRAS

SEQ ID NO: 2278056 - protein, 6 aa, Cryptosporidium parvum
REKSGP

SEQ ID NO: 2278057 - protein, 12 aa, Cryptosporidium parvum
REKSSDRKPLEI

SEQ ID NO: 2278058 - protein, 15 aa, Cryptosporidium parvum
REKSSTSESVKNLFE

SEQ ID NO: 2278059 - protein, 10 aa, Cryptosporidium parvum
RELAEQSEKV

SEQ ID NO: 2278060 - protein, 13 aa, Cryptosporidium parvum
RELNSGDASGAPL

SEQ ID NO: 2278061 - protein, 22 aa, Cryptosporidium parvum
REMASDAKQKEREKHKQESLEA

SEQ ID NO: 2278062 - protein, 8 aa, Cryptosporidium parvum
REMQTSST

SEQ ID NO: 2278063 - protein, 8 aa, Cryptosporidium parvum
REMSNSNY

SEQ ID NO: 2278064 - protein, 5 aa, Cryptosporidium parvum
RENDI

SEQ ID NO: 2278065 - protein, 11 aa, Cryptosporidium parvum
RENEHQKQNIS

SEQ ID NO: 2278066 - protein, 9 aa, Cryptosporidium parvum
RENGKENNY

SEQ ID NO: 2278067 - protein, 7 aa, Cryptosporidium parvum
RENGKRK

SEQ ID NO: 2278068 - protein, 7 aa, Cryptosporidium parvum
RENKRLK

SEQ ID NO: 2278069 - protein, 4 aa, Cryptosporidium parvum
RENL

SEQ ID NO: 2278070 - protein, 14 aa, Cryptosporidium parvum
RENNQDNKATNPSD

SEQ ID NO: 2278071 - protein, 4 aa, Cryptosporidium parvum
RENP

SEQ ID NO: 2278072 - protein, 6 aa, Cryptosporidium parvum
RENPGF

SEQ ID NO: 2278073 - protein, 6 aa, Cryptosporidium parvum
RENQRS

SEQ ID NO: 2278074 - protein, 6 aa, Cryptosporidium parvum
RENQSL

SEQ ID NO: 2278075 - protein, 5 aa, Cryptosporidium parvum
RENSP

SEQ ID NO: 2278076 - protein, 17 aa, Cryptosporidium parvum
RENYRRRSIDGGPTPRG

SEQ ID NO: 2278077 - protein, 13 aa, Cryptosporidium parvum
REPDKNEIAHDFV

SEQ ID NO: 2278078 - protein, 4 aa, Cryptosporidium parvum
REPG

SEQ ID NO: 2278079 - protein, 7 aa, Cryptosporidium parvum
REPGGTI

SEQ ID NO: 2278080 - protein, 10 aa, Cryptosporidium parvum
REPKSIDSNT

SEQ ID NO: 2278081 - protein, 7 aa, Cryptosporidium parvum
REPLSGD

SEQ ID NO: 2278082 - protein, 18 aa, Cryptosporidium parvum
REPNDNEKRHSSMDKGGG

SEQ ID NO: 2278083 - protein, 16 aa, Cryptosporidium parvum
REPTDLGPDATETFES

SEQ ID NO: 2278084 - protein, 5 aa, Cryptosporidium parvum
REQGQ

SEQ ID NO: 2278085 - protein, 6 aa, Cryptosporidium parvum
REQNPE

SEQ ID NO: 2278086 - protein, 8 aa, Cryptosporidium parvum
REQQQRKE

SEQ ID NO: 2278087 - protein, 38 aa, Cryptosporidium parvum
REQSLSTSNEIDSIDNEHKDSSNFTTESELTNTKDKVN

SEQ ID NO: 2278088 - protein, 4 aa, Cryptosporidium parvum
RERE

SEQ ID NO: 2278089 - protein, 8 aa, Cryptosporidium parvum
RERENSGL

SEQ ID NO: 2278090 - protein, 9 aa, Cryptosporidium parvum
RERGPFPTI

SEQ ID NO: 2278091 - protein, 28 aa, Cryptosporidium parvum
RERKNQQQNNTREHNTDSNNSDDETYEL

SEQ ID NO: 2278092 - protein, 4 aa, Cryptosporidium parvum
RERN

SEQ ID NO: 2278093 - protein, 5 aa, Cryptosporidium parvum
RERND

SEQ ID NO: 2278094 - protein, 8 aa, Cryptosporidium parvum
RERRGEYL

SEQ ID NO: 2278095 - protein, 4 aa, Cryptosporidium parvum
RERS

SEQ ID NO: 2278096 - protein, 4 aa, Cryptosporidium parvum
RESC

SEQ ID NO: 2278097 - protein, 6 aa, Cryptosporidium parvum
RESENS

SEQ ID NO: 2278098 - protein, 8 aa, Cryptosporidium parvum
RESGKINK

SEQ ID NO: 2278099 - protein, 10 aa, Cryptosporidium parvum
RESGSLPTVR

SEQ ID NO: 2278100 - protein, 5 aa, Cryptosporidium parvum
RESKP

SEQ ID NO: 2278101 - protein, 5 aa, Cryptosporidium parvum
RESLE

SEQ ID NO: 2278102 - protein, 12 aa, Cryptosporidium parvum
RESMSNTSDVST

SEQ ID NO: 2278103 - protein, 24 aa, Cryptosporidium parvum
RESNEDFNSDISNGFSDTSVKNGI

SEQ ID NO: 2278104 - protein, 6 aa, Cryptosporidium parvum
RESRES

SEQ ID NO: 2278105 - protein, 10 aa, Cryptosporidium parvum
RESSDGSKSV

SEQ ID NO: 2278106 - protein, 14 aa, Cryptosporidium parvum
RESSIGSSTERRSI

SEQ ID NO: 2278107 - protein, 25 aa, Cryptosporidium parvum
RESTGGQIKDESDELGMESQTDSVH

SEQ ID NO: 2278108 - protein, 23 aa, Cryptosporidium parvum
RESTSTNSIRNNANEPRKANRRG

SEQ ID NO: 2278109 - protein, 5 aa, Cryptosporidium parvum
RESVN

SEQ ID NO: 2278110 - protein, 5 aa, Cryptosporidium parvum
RETEY

SEQ ID NO: 2278111 - protein, 7 aa, Cryptosporidium parvum
RETKTYN

SEQ ID NO: 2278112 - protein, 7 aa, Cryptosporidium parvum
RETNGRI

SEQ ID NO: 2278113 - protein, 11 aa, Cryptosporidium parvum
RETRSSRENEI

SEQ ID NO: 2278114 - protein, 4 aa, Cryptosporidium parvum
RETS

SEQ ID NO: 2278115 - protein, 12 aa, Cryptosporidium parvum
RETSSKSSKSRG

SEQ ID NO: 2278116 - protein, 9 aa, Cryptosporidium parvum
REVKDKDRF

SEQ ID NO: 2278117 - protein, 9 aa, Cryptosporidium parvum
REVNARKNK

SEQ ID NO: 2278118 - protein, 6 aa, Cryptosporidium parvum
REVNKG

SEQ ID NO: 2278119 - protein, 9 aa, Cryptosporidium parvum
REVPKESEM

SEQ ID NO: 2278120 - protein, 5 aa, Cryptosporidium parvum
REYHE

SEQ ID NO: 2278121 - protein, 6 aa, Cryptosporidium parvum
REYKQA

SEQ ID NO: 2278122 - protein, 12 aa, Cryptosporidium parvum
REYNNLGKSSRE

SEQ ID NO: 2278123 - protein, 4 aa, Cryptosporidium parvum
REYS

SEQ ID NO: 2278124 - protein, 5 aa, Cryptosporidium parvum
RFDQD

SEQ ID NO: 2278125 - protein, 10 aa, Cryptosporidium parvum
RFEQNNHDSY

SEQ ID NO: 2278126 - protein, 11 aa, Cryptosporidium parvum
RFESKSSFGSS

SEQ ID NO: 2278127 - protein, 10 aa, Cryptosporidium parvum
RFGESTVPEV

SEQ ID NO: 2278128 - protein, 13 aa, Cryptosporidium parvum
RFKEENSDIDNYE

SEQ ID NO: 2278129 - protein, 16 aa, Cryptosporidium parvum
RFKSNSKIINNLRNSS

SEQ ID NO: 2278130 - protein, 12 aa, Cryptosporidium parvum
RFNSDTDVPKLG

SEQ ID NO: 2278131 - protein, 5 aa, Cryptosporidium parvum
RFPSE

SEQ ID NO: 2278132 - protein, 6 aa, Cryptosporidium parvum
RFPYND

SEQ ID NO: 2278133 - protein, 10 aa, Cryptosporidium parvum
RFQGGKSSKV

SEQ ID NO: 2278134 - protein, 5 aa, Cryptosporidium parvum
RFRPD

SEQ ID NO: 2278135 - protein, 4 aa, Cryptosporidium parvum
RFSE

SEQ ID NO: 2278136 - protein, 8 aa, Cryptosporidium parvum
RGAAGGAK

SEQ ID NO: 2278137 - protein, 4 aa, Cryptosporidium parvum
RGAD

SEQ ID NO: 2278138 - protein, 27 aa, Cryptosporidium parvum
RGADPNVGGGTNNSTTNKNNNSGNSGN

SEQ ID NO: 2278139 - protein, 9 aa, Cryptosporidium parvum
RGAEDSPLE

SEQ ID NO: 2278140 - protein, 8 aa, Cryptosporidium parvum
RGAGQITP

SEQ ID NO: 2278141 - protein, 11 aa, Cryptosporidium parvum
RGANVDPTGEW

SEQ ID NO: 2278142 - protein, 4 aa, Cryptosporidium parvum
RGAR

SEQ ID NO: 2278143 - protein, 11 aa, Cryptosporidium parvum
RGASEFGTPNA

SEQ ID NO: 2278144 - protein, 6 aa, Cryptosporidium parvum
RGDATN

SEQ ID NO: 2278145 - protein, 22 aa, Cryptosporidium parvum
RGDDPRNASTSADLTEKTITPM

SEQ ID NO: 2278146 - protein, 8 aa, Cryptosporidium parvum
RGDGCSEA

SEQ ID NO: 2278147 - protein, 6 aa, Cryptosporidium parvum
RGDIEN

SEQ ID NO: 2278148 - protein, 11 aa, Cryptosporidium parvum
RGDKESKGLDK

SEQ ID NO: 2278149 - protein, 10 aa, Cryptosporidium parvum
RGDTEYSRKD

SEQ ID NO: 2278150 - protein, 7 aa, Cryptosporidium parvum
RGDTPGR

SEQ ID NO: 2278151 - protein, 15 aa, Cryptosporidium parvum
RGDVKEANTRFNTTG

SEQ ID NO: 2278152 - protein, 4 aa, Cryptosporidium parvum
RGDY

SEQ ID NO: 2278153 - protein, 5 aa, Cryptosporidium parvum
RGDYD

SEQ ID NO: 2278154 - protein, 29 aa, Cryptosporidium parvum
RGEAREKTNASIENSSSDHTAQNANGSLA

SEQ ID NO: 2278155 - protein, 6 aa, Cryptosporidium parvum
RGECKK

SEQ ID NO: 2278156 - protein, 5 aa, Cryptosporidium parvum
RGEEL

SEQ ID NO: 2278157 - protein, 5 aa, Cryptosporidium parvum
RGEES

SEQ ID NO: 2278158 - protein, 4 aa, Cryptosporidium parvum
RGEF

SEQ ID NO: 2278159 - protein, 12 aa, Cryptosporidium parvum
RGEIEVTNKNRK

SEQ ID NO: 2278160 - protein, 14 aa, Cryptosporidium parvum
RGEIGNYQEQKKIE

SEQ ID NO: 2278161 - protein, 20 aa, Cryptosporidium parvum
RGEKKGSLSHRSNLKPAPSM

SEQ ID NO: 2278162 - protein, 5 aa, Cryptosporidium parvum
RGEKL

SEQ ID NO: 2278163 - protein, 4 aa, Cryptosporidium parvum
RGEP

SEQ ID NO: 2278164 - protein, 9 aa, Cryptosporidium parvum
RGERYSPSQ

SEQ ID NO: 2278165 - protein, 10 aa, Cryptosporidium parvum
RGESIPSGMP

SEQ ID NO: 2278166 - protein, 6 aa, Cryptosporidium parvum
RGEVDI

SEQ ID NO: 2278167 - protein, 6 aa, Cryptosporidium parvum
RGGAVP

SEQ ID NO: 2278168 - protein, 5 aa, Cryptosporidium parvum
RGGDC

SEQ ID NO: 2278169 - protein, 5 aa, Cryptosporidium parvum
RGGEL

SEQ ID NO: 2278170 - protein, 7 aa, Cryptosporidium parvum
RGGETVA

SEQ ID NO: 2278171 - protein, 15 aa, Cryptosporidium parvum
RGGFSTVNKTNNDVE

SEQ ID NO: 2278172 - protein, 8 aa, Cryptosporidium parvum
RGGGDYSF

SEQ ID NO: 2278173 - protein, 15 aa, Cryptosporidium parvum
RGGKEGGSNQLSDER

SEQ ID NO: 2278174 - protein, 5 aa, Cryptosporidium parvum
RGGNI

SEQ ID NO: 2278175 - protein, 6 aa, Cryptosporidium parvum
RGGNKK

SEQ ID NO: 2278176 - protein, 7 aa, Cryptosporidium parvum
RGGPISS

SEQ ID NO: 2278177 - protein, 14 aa, Cryptosporidium parvum
RGGRKTAKDKVEKG

SEQ ID NO: 2278178 - protein, 5 aa, Cryptosporidium parvum
RGGRR

SEQ ID NO: 2278179 - protein, 10 aa, Cryptosporidium parvum
RGGSKKEWGI

SEQ ID NO: 2278180 - protein, 7 aa, Cryptosporidium parvum
RGGSNTV

SEQ ID NO: 2278181 - protein, 8 aa, Cryptosporidium parvum
RGGSPYRG

SEQ ID NO: 2278182 - protein, 10 aa, Cryptosporidium parvum
RGGSRGQEVR

SEQ ID NO: 2278183 - protein, 18 aa, Cryptosporidium parvum
RGGTTTTSSSSGNSIENL

SEQ ID NO: 2278184 - protein, 4 aa, Cryptosporidium parvum
RGGV

SEQ ID NO: 2278185 - protein, 11 aa, Cryptosporidium parvum
RGIDRGSNTIA

SEQ ID NO: 2278186 - protein, 11 aa, Cryptosporidium parvum
RGIEEDEEETC

SEQ ID NO: 2278187 - protein, 11 aa, Cryptosporidium parvum
RGISSTESLEY

SEQ ID NO: 2278188 - protein, 5 aa, Cryptosporidium parvum
RGITK

SEQ ID NO: 2278189 - protein, 8 aa, Cryptosporidium parvum
RGKKDIPP

SEQ ID NO: 2278190 - protein, 11 aa, Cryptosporidium parvum
RGKKGTDRQEQ

SEQ ID NO: 2278191 - protein, 12 aa, Cryptosporidium parvum
RGKLSEHGSNGD

SEQ ID NO: 2278192 - protein, 13 aa, Cryptosporidium parvum
RGKLSNNDRPSGT

SEQ ID NO: 2278193 - protein, 8 aa, Cryptosporidium parvum
RGKNSPDF

SEQ ID NO: 2278194 - protein, 15 aa, Cryptosporidium parvum
RGKYTSNIENSKDNF

SEQ ID NO: 2278195 - protein, 15 aa, Cryptosporidium parvum
RGLNRSTPFSNNQTQ

SEQ ID NO: 2278196 - protein, 8 aa, Cryptosporidium parvum
RGLPSRKN

SEQ ID NO: 2278197 - protein, 9 aa, Cryptosporidium parvum
RGLSERAHP

SEQ ID NO: 2278198 - protein, 33 aa, Cryptosporidium parvum
RGNENVDPRKKTKPRPKAERPEARQRNQNIGGH

SEQ ID NO: 2278199 - protein, 9 aa, Cryptosporidium parvum
RGNEWPGLT

SEQ ID NO: 2278200 - protein, 8 aa, Cryptosporidium parvum
RGNGKISR

SEQ ID NO: 2278201 - protein, 38 aa, Cryptosporidium parvum
RGNISSSNKKDPITSNNNEFGQKNENYSTDSALNSESD

SEQ ID NO: 2278202 - protein, 8 aa, Cryptosporidium parvum
RGNSPPGK

SEQ ID NO: 2278203 - protein, 7 aa, Cryptosporidium parvum
RGNSQGI

SEQ ID NO: 2278204 - protein, 4 aa, Cryptosporidium parvum
RGNV

SEQ ID NO: 2278205 - protein, 8 aa, Cryptosporidium parvum
RGPAGSGK

SEQ ID NO: 2278206 - protein, 12 aa, Cryptosporidium parvum
RGPCNESSDSWS

SEQ ID NO: 2278207 - protein, 8 aa, Cryptosporidium parvum
RGPHEWPG

SEQ ID NO: 2278208 - protein, 8 aa, Cryptosporidium parvum
RGPKDKPI

SEQ ID NO: 2278209 - protein, 7 aa, Cryptosporidium parvum
RGPNTNI

SEQ ID NO: 2278210 - protein, 6 aa, Cryptosporidium parvum
RGPPLI

SEQ ID NO: 2278211 - protein, 9 aa, Cryptosporidium parvum
RGPQAYSSD

SEQ ID NO: 2278212 - protein, 13 aa, Cryptosporidium parvum
RGPRTSVSAEAYG

SEQ ID NO: 2278213 - protein, 7 aa, Cryptosporidium parvum
RGPSNVV

SEQ ID NO: 2278214 - protein, 5 aa, Cryptosporidium parvum
RGPSR

SEQ ID NO: 2278215 - protein, 13 aa, Cryptosporidium parvum
RGPTVGAAREKRI

SEQ ID NO: 2278216 - protein, 4 aa, Cryptosporidium parvum
RGPV

SEQ ID NO: 2278217 - protein, 8 aa, Cryptosporidium parvum
RGPYSPYS

SEQ ID NO: 2278218 - protein, 8 aa, Cryptosporidium parvum
RGQGQTIT

SEQ ID NO: 2278219 - protein, 9 aa, Cryptosporidium parvum
RGRAASANA

SEQ ID NO: 2278220 - protein, 13 aa, Cryptosporidium parvum
RGRARQASAGELT

SEQ ID NO: 2278221 - protein, 19 aa, Cryptosporidium parvum
RGRGRPPRNANRADIGPSG

SEQ ID NO: 2278222 - protein, 7 aa, Cryptosporidium parvum
RGRGSRN

SEQ ID NO: 2278223 - protein, 12 aa, Cryptosporidium parvum
RGRPKKNQPKPS

SEQ ID NO: 2278224 - protein, 8 aa, Cryptosporidium parvum
RGRPPPPF

SEQ ID NO: 2278225 - protein, 14 aa, Cryptosporidium parvum
RGRSPVKHTSPRKI

SEQ ID NO: 2278226 - protein, 16 aa, Cryptosporidium parvum
RGRSYSNGNEGGNYRS

SEQ ID NO: 2278227 - protein, 5 aa, Cryptosporidium parvum
RGRTV

SEQ ID NO: 2278228 - protein, 4 aa, Cryptosporidium parvum
RGRV

SEQ ID NO: 2278229 - protein, 8 aa, Cryptosporidium parvum
RGSDENGI

SEQ ID NO: 2278230 - protein, 9 aa, Cryptosporidium parvum
RGSDGNQGQ

SEQ ID NO: 2278231 - protein, 4 aa, Cryptosporidium parvum
RGSG

SEQ ID NO: 2278232 - protein, 9 aa, Cryptosporidium parvum
RGSGQAKNL

SEQ ID NO: 2278233 - protein, 9 aa, Cryptosporidium parvum
RGSKGGIQV

SEQ ID NO: 2278234 - protein, 12 aa, Cryptosporidium parvum
RGSKSITRSRRK

SEQ ID NO: 2278235 - protein, 10 aa, Cryptosporidium parvum
RGSNSNNNEE

SEQ ID NO: 2278236 - protein, 5 aa, Cryptosporidium parvum
RGSQL

SEQ ID NO: 2278237 - protein, 21 aa, Cryptosporidium parvum
RGSRGDSLSMPHSTSSTFSKF

SEQ ID NO: 2278238 - protein, 12 aa, Cryptosporidium parvum
RGSRPGKPVQLT

SEQ ID NO: 2278239 - protein, 18 aa, Cryptosporidium parvum
RGSRTSKNRSSSVDSGSC

SEQ ID NO: 2278240 - protein, 12 aa, Cryptosporidium parvum
RGSTGSSSISSI

SEQ ID NO: 2278241 - protein, 9 aa, Cryptosporidium parvum
RGSVPNKSL

SEQ ID NO: 2278242 - protein, 5 aa, Cryptosporidium parvum
RGSVS

SEQ ID NO: 2278243 - protein, 5 aa, Cryptosporidium parvum
RGTAN

SEQ ID NO: 2278244 - protein, 20 aa, Cryptosporidium parvum
RGTKDGTQLKLSSEGNFVSG

SEQ ID NO: 2278245 - protein, 18 aa, Cryptosporidium parvum
RGTKSSESLPAMKTSDHN

SEQ ID NO: 2278246 - protein, 8 aa, Cryptosporidium parvum
RGTPAYEL

SEQ ID NO: 2278247 - protein, 16 aa, Cryptosporidium parvum
RGTSKNYDNSSEPSSI

SEQ ID NO: 2278248 - protein, 4 aa, Cryptosporidium parvum
RGTT

SEQ ID NO: 2278249 - protein, 5 aa, Cryptosporidium parvum
RGVEG

SEQ ID NO: 2278250 - protein, 13 aa, Cryptosporidium parvum
RGVNNNDDPILGD

SEQ ID NO: 2278251 - protein, 4 aa, Cryptosporidium parvum
RGVT

SEQ ID NO: 2278252 - protein, 8 aa, Cryptosporidium parvum
RGYGYNAN

SEQ ID NO: 2278253 - protein, 26 aa, Cryptosporidium parvum
RGYNNNNSNNSTDSAKNNDKENHDSF

SEQ ID NO: 2278254 - protein, 17 aa, Cryptosporidium parvum
RGYPNQINPKTLNSPTR

SEQ ID NO: 2278255 - protein, 16 aa, Cryptosporidium parvum
RHAQHKDDMTGTGSFN

SEQ ID NO: 2278256 - protein, 15 aa, Cryptosporidium parvum
RHCKGNYPLAKEDNI

SEQ ID NO: 2278257 - protein, 6 aa, Cryptosporidium parvum
RHDESI

SEQ ID NO: 2278258 - protein, 28 aa, Cryptosporidium parvum
RHDNKGGNSQSSVGQRGNVEDSQKRLPD

SEQ ID NO: 2278259 - protein, 7 aa, Cryptosporidium parvum
RHDNSSN

SEQ ID NO: 2278260 - protein, 20 aa, Cryptosporidium parvum
RHEAKTSVGRNQLSQEDKSR

SEQ ID NO: 2278261 - protein, 4 aa, Cryptosporidium parvum
RHED

SEQ ID NO: 2278262 - protein, 9 aa, Cryptosporidium parvum
RHENLGKGN

SEQ ID NO: 2278263 - protein, 14 aa, Cryptosporidium parvum
RHESPSEEKKENFS

SEQ ID NO: 2278264 - protein, 18 aa, Cryptosporidium parvum
RHGKPGVGSTSSSRFIPL

SEQ ID NO: 2278265 - protein, 4 aa, Cryptosporidium parvum
RHKF

SEQ ID NO: 2278266 - protein, 7 aa, Cryptosporidium parvum
RHKPESL

SEQ ID NO: 2278267 - protein, 4 aa, Cryptosporidium parvum
RHNG

SEQ ID NO: 2278268 - protein, 8 aa, Cryptosporidium parvum
RHNKPHPC

SEQ ID NO: 2278269 - protein, 8 aa, Cryptosporidium parvum
RHNPQRVG

SEQ ID NO: 2278270 - protein, 4 aa, Cryptosporidium parvum
RHNQ

SEQ ID NO: 2278271 - protein, 17 aa, Cryptosporidium parvum
RHNSQYRLTDRGRAQAR

SEQ ID NO: 2278272 - protein, 4 aa, Cryptosporidium parvum
RHPG

SEQ ID NO: 2278273 - protein, 8 aa, Cryptosporidium parvum
RHPGIPSS

SEQ ID NO: 2278274 - protein, 8 aa, Cryptosporidium parvum
RHPNPSDF

SEQ ID NO: 2278275 - protein, 5 aa, Cryptosporidium parvum
RHPNT

SEQ ID NO: 2278276 - protein, 8 aa, Cryptosporidium parvum
RHPPGNEI

SEQ ID NO: 2278277 - protein, 8 aa, Cryptosporidium parvum
RHPRDSGF

SEQ ID NO: 2278278 - protein, 6 aa, Cryptosporidium parvum
RHRGLP

SEQ ID NO: 2278279 - protein, 4 aa, Cryptosporidium parvum
RHRP

SEQ ID NO: 2278280 - protein, 18 aa, Cryptosporidium parvum
RHSCDSDKLTKNSPVSHS

SEQ ID NO: 2278281 - protein, 9 aa, Cryptosporidium parvum
RHSGNQNLD

SEQ ID NO: 2278282 - protein, 8 aa, Cryptosporidium parvum
RHSKEEQG

SEQ ID NO: 2278283 - protein, 20 aa, Cryptosporidium parvum
RHSKENKRARSLSRSLSPDL

SEQ ID NO: 2278284 - protein, 5 aa, Cryptosporidium parvum
RIDES

SEQ ID NO: 2278285 - protein, 10 aa, Cryptosporidium parvum
RIEEQEKERS

SEQ ID NO: 2278286 - protein, 14 aa, Cryptosporidium parvum
RIEKSVKNDNISSQ

SEQ ID NO: 2278287 - protein, 49 aa, Cryptosporidium parvum
RIEREEKEKIERERIERKEKERIEREERERIEREERERIEKEENERIER

SEQ ID NO: 2278288 - protein, 64 aa, Cryptosporidium parvum
RIEREEKEKIERERIERKEKERIEREERERVEREEKEKSKNEIISKNSSERKAKRSRNEFTEDI

SEQ ID NO: 2278289 - protein, 19 aa, Cryptosporidium parvum
RIEREEKERIEREERERIE

SEQ ID NO: 2278290 - protein, 20 aa, Cryptosporidium parvum
RIEREERERIEKEENERIER

SEQ ID NO: 2278291 - protein, 11 aa, Cryptosporidium parvum
RIERNENKISN

SEQ ID NO: 2278292 - protein, 6 aa, Cryptosporidium parvum
RIGNNI

SEQ ID NO: 2278293 - protein, 8 aa, Cryptosporidium parvum
RIGQKKPV

SEQ ID NO: 2278294 - protein, 4 aa, Cryptosporidium parvum
RIGS

SEQ ID NO: 2278295 - protein, 13 aa, Cryptosporidium parvum
RIHDQEKSSKFDN

SEQ ID NO: 2278296 - protein, 9 aa, Cryptosporidium parvum
RIKDTQELS

SEQ ID NO: 2278297 - protein, 11 aa, Cryptosporidium parvum
RIKQRKQEAKR

SEQ ID NO: 2278298 - protein, 14 aa, Cryptosporidium parvum
RIKTDNHKYKNNDE

SEQ ID NO: 2278299 - protein, 9 aa, Cryptosporidium parvum
RINSGGTTV

SEQ ID NO: 2278300 - protein, 6 aa, Cryptosporidium parvum
RIPEDH

SEQ ID NO: 2278301 - protein, 6 aa, Cryptosporidium parvum
RIPGNG

SEQ ID NO: 2278302 - protein, 5 aa, Cryptosporidium parvum
RIPPN

SEQ ID NO: 2278303 - protein, 11 aa, Cryptosporidium parvum
RIPQDSNFEEK

SEQ ID NO: 2278304 - protein, 10 aa, Cryptosporidium parvum
RIQESGEFSN

SEQ ID NO: 2278305 - protein, 9 aa, Cryptosporidium parvum
RIQGEIEGK

SEQ ID NO: 2278306 - protein, 6 aa, Cryptosporidium parvum
RIRPNT

SEQ ID NO: 2278307 - protein, 6 aa, Cryptosporidium parvum
RISDVE

SEQ ID NO: 2278308 - protein, 8 aa, Cryptosporidium parvum
RISEDESR

SEQ ID NO: 2278309 - protein, 13 aa, Cryptosporidium parvum
RISKGPKDGSGGL

SEQ ID NO: 2278310 - protein, 12 aa, Cryptosporidium parvum
RISNKGGAYYSS

SEQ ID NO: 2278311 - protein, 6 aa, Cryptosporidium parvum
RISPQE

SEQ ID NO: 2278312 - protein, 9 aa, Cryptosporidium parvum
RISPSQSTK

SEQ ID NO: 2278313 - protein, 4 aa, Cryptosporidium parvum
RISR

SEQ ID NO: 2278314 - protein, 18 aa, Cryptosporidium parvum
RISTSNLHKNTSSDIGDV

SEQ ID NO: 2278315 - protein, 6 aa, Cryptosporidium parvum
RITDSD

SEQ ID NO: 2278316 - protein, 17 aa, Cryptosporidium parvum
RITNNESNKLQNDNHDT

SEQ ID NO: 2278317 - protein, 10 aa, Cryptosporidium parvum
RITNQDYDKD

SEQ ID NO: 2278318 - protein, 7 aa, Cryptosporidium parvum
RITNSSE

SEQ ID NO: 2278319 - protein, 6 aa, Cryptosporidium parvum
RITQQE

SEQ ID NO: 2278320 - protein, 12 aa, Cryptosporidium parvum
RITSSTGSSNHY

SEQ ID NO: 2278321 - protein, 16 aa, Cryptosporidium parvum
RIYTNSSDISQFSSKT

SEQ ID NO: 2278322 - protein, 18 aa, Cryptosporidium parvum
RKAELEEEYNGKKSEYLE

SEQ ID NO: 2278323 - protein, 10 aa, Cryptosporidium parvum
RKAKNKEYKT

SEQ ID NO: 2278324 - protein, 23 aa, Cryptosporidium parvum
RKAKQIKERISEQKEKKNEKHME

SEQ ID NO: 2278325 - protein, 18 aa, Cryptosporidium parvum
RKALSSNSFNNRENRSAF

SEQ ID NO: 2278326 - protein, 8 aa, Cryptosporidium parvum
RKASDEIQ

SEQ ID NO: 2278327 - protein, 13 aa, Cryptosporidium parvum
RKASSAYKNVPQT

SEQ ID NO: 2278328 - protein, 6 aa, Cryptosporidium parvum
RKCSSS

SEQ ID NO: 2278329 - protein, 9 aa, Cryptosporidium parvum
RKCSTKDEK

SEQ ID NO: 2278330 - protein, 4 aa, Cryptosporidium parvum
RKDE

SEQ ID NO: 2278331 - protein, 10 aa, Cryptosporidium parvum
RKDEETLNKE

SEQ ID NO: 2278332 - protein, 12 aa, Cryptosporidium parvum
RKDEVERVAKAN

SEQ ID NO: 2278333 - protein, 4 aa, Cryptosporidium parvum
RKDF

SEQ ID NO: 2278334 - protein, 8 aa, Cryptosporidium parvum
RKDGKRKH

SEQ ID NO: 2278335 - protein, 8 aa, Cryptosporidium parvum
RKDGSKEI

SEQ ID NO: 2278336 - protein, 4 aa, Cryptosporidium parvum
RKDL

SEQ ID NO: 2278337 - protein, 8 aa, Cryptosporidium parvum
RKDQKEKV

SEQ ID NO: 2278338 - protein, 8 aa, Cryptosporidium parvum
RKDRGGIT

SEQ ID NO: 2278339 - protein, 6 aa, Cryptosporidium parvum
RKDTAA

SEQ ID NO: 2278340 - protein, 7 aa, Cryptosporidium parvum
RKDTGEV

SEQ ID NO: 2278341 - protein, 17 aa, Cryptosporidium parvum
RKDVNSIGEQIKRLDLN

SEQ ID NO: 2278342 - protein, 5 aa, Cryptosporidium parvum
RKDYG

SEQ ID NO: 2278343 - protein, 7 aa, Cryptosporidium parvum
RKDYYNQ

SEQ ID NO: 2278344 - protein, 20 aa, Cryptosporidium parvum
RKEETKYEDIPSQISKRDPL

SEQ ID NO: 2278345 - protein, 5 aa, Cryptosporidium parvum
RKEIL

SEQ ID NO: 2278346 - protein, 10 aa, Cryptosporidium parvum
RKEKSNDEEI

SEQ ID NO: 2278347 - protein, 6 aa, Cryptosporidium parvum
RKELTS

SEQ ID NO: 2278348 - protein, 5 aa, Cryptosporidium parvum
RKENF

SEQ ID NO: 2278349 - protein, 11 aa, Cryptosporidium parvum
RKEQEKERKKV

SEQ ID NO: 2278350 - protein, 6 aa, Cryptosporidium parvum
RKEQRA

SEQ ID NO: 2278351 - protein, 8 aa, Cryptosporidium parvum
RKEREQLK

SEQ ID NO: 2278352 - protein, 10 aa, Cryptosporidium parvum
RKERKKQLSL

SEQ ID NO: 2278353 - protein, 9 aa, Cryptosporidium parvum
RKERPSSKL

SEQ ID NO: 2278354 - protein, 7 aa, Cryptosporidium parvum
RKESQST

SEQ ID NO: 2278355 - protein, 7 aa, Cryptosporidium parvum
RKESTSG

SEQ ID NO: 2278356 - protein, 4 aa, Cryptosporidium parvum
RKET

SEQ ID NO: 2278357 - protein, 9 aa, Cryptosporidium parvum
RKETDTGPV

SEQ ID NO: 2278358 - protein, 17 aa, Cryptosporidium parvum
RKEVDRARGASPNTRSA

SEQ ID NO: 2278359 - protein, 17 aa, Cryptosporidium parvum
RKFEAEKFTRDQNLRRG

SEQ ID NO: 2278360 - protein, 18 aa, Cryptosporidium parvum
RKFESRKVHKDSQHAQKL

SEQ ID NO: 2278361 - protein, 6 aa, Cryptosporidium parvum
RKFSSD

SEQ ID NO: 2278362 - protein, 7 aa, Cryptosporidium parvum
RKFSTPI

SEQ ID NO: 2278363 - protein, 13 aa, Cryptosporidium parvum
RKGANEATKALNR

SEQ ID NO: 2278364 - protein, 10 aa, Cryptosporidium parvum
RKGDNNQAES

SEQ ID NO: 2278365 - protein, 4 aa, Cryptosporidium parvum
RKGF

SEQ ID NO: 2278366 - protein, 9 aa, Cryptosporidium parvum
RKGGPPAQR

SEQ ID NO: 2278367 - protein, 7 aa, Cryptosporidium parvum
RKGLPTQ

SEQ ID NO: 2278368 - protein, 9 aa, Cryptosporidium parvum
RKGLTPSQI

SEQ ID NO: 2278369 - protein, 17 aa, Cryptosporidium parvum
RKGNHEGKEDKAPTKNM

SEQ ID NO: 2278370 - protein, 7 aa, Cryptosporidium parvum
RKGPISI

SEQ ID NO: 2278371 - protein, 13 aa, Cryptosporidium parvum
RKGPMSAPDKSFE

SEQ ID NO: 2278372 - protein, 5 aa, Cryptosporidium parvum
RKGQR

SEQ ID NO: 2278373 - protein, 25 aa, Cryptosporidium parvum
RKGRDGGDLQRTNSKSGRDRFNRPD

SEQ ID NO: 2278374 - protein, 6 aa, Cryptosporidium parvum
RKGSGT

SEQ ID NO: 2278375 - protein, 12 aa, Cryptosporidium parvum
RKGSLPKRFETK

SEQ ID NO: 2278376 - protein, 8 aa, Cryptosporidium parvum
RKGYPPQS

SEQ ID NO: 2278377 - protein, 7 aa, Cryptosporidium parvum
RKIPKGP

SEQ ID NO: 2278378 - protein, 6 aa, Cryptosporidium parvum
RKIQSE

SEQ ID NO: 2278379 - protein, 4 aa, Cryptosporidium parvum
RKIR

SEQ ID NO: 2278380 - protein, 6 aa, Cryptosporidium parvum
RKITGP

SEQ ID NO: 2278381 - protein, 7 aa, Cryptosporidium parvum
RKKAECD

SEQ ID NO: 2278382 - protein, 15 aa, Cryptosporidium parvum
RKKAKKEMEEATDPT

SEQ ID NO: 2278383 - protein, 24 aa, Cryptosporidium parvum
RKKAKTGIGPSTRESLRKELKKQG

SEQ ID NO: 2278384 - protein, 38 aa, Cryptosporidium parvum
RKKAQAELAQKSKYKPEYDSKSADYDDSVDESYAEAEK

SEQ ID NO: 2278385 - protein, 26 aa, Cryptosporidium parvum
RKKDETPEDRRNRKQAVKQAKREMRD

SEQ ID NO: 2278386 - protein, 23 aa, Cryptosporidium parvum
RKKDTHKQKKNLSKTKNEMGCML

SEQ ID NO: 2278387 - protein, 11 aa, Cryptosporidium parvum
RKKEEENNQKI

SEQ ID NO: 2278388 - protein, 26 aa, Cryptosporidium parvum
RKKFERKTTERKKGRFELGGSSNIDK

SEQ ID NO: 2278389 - protein, 11 aa, Cryptosporidium parvum
RKKGEKSNSVF

SEQ ID NO: 2278390 - protein, 17 aa, Cryptosporidium parvum
RKKGNFGGTLSKDSIPE

SEQ ID NO: 2278391 - protein, 10 aa, Cryptosporidium parvum
RKKGQRSTKL

SEQ ID NO: 2278392 - protein, 7 aa, Cryptosporidium parvum
RKKIQKS

SEQ ID NO: 2278393 - protein, 4 aa, Cryptosporidium parvum
RKKK

SEQ ID NO: 2278394 - protein, 7 aa, Cryptosporidium parvum
RKKKDGK

SEQ ID NO: 2278395 - protein, 15 aa, Cryptosporidium parvum
RKKMTSGDITQRQLG

SEQ ID NO: 2278396 - protein, 5 aa, Cryptosporidium parvum
RKKNA

SEQ ID NO: 2278397 - protein, 7 aa, Cryptosporidium parvum
RKKNDLK

SEQ ID NO: 2278398 - protein, 5 aa, Cryptosporidium parvum
RKKPI

SEQ ID NO: 2278399 - protein, 7 aa, Cryptosporidium parvum
RKKRDGK

SEQ ID NO: 2278400 - protein, 6 aa, Cryptosporidium parvum
RKKRNN

SEQ ID NO: 2278401 - protein, 4 aa, Cryptosporidium parvum
RKKS

SEQ ID NO: 2278402 - protein, 5 aa, Cryptosporidium parvum
RKKSN

SEQ ID NO: 2278403 - protein, 10 aa, Cryptosporidium parvum
RKKSYKNTAI

SEQ ID NO: 2278404 - protein, 24 aa, Cryptosporidium parvum
RKKVAEKKSPSKKRLQKQNSGIHE

SEQ ID NO: 2278405 - protein, 5 aa, Cryptosporidium parvum
RKKYG

SEQ ID NO: 2278406 - protein, 6 aa, Cryptosporidium parvum
RKLNKE

SEQ ID NO: 2278407 - protein, 11 aa, Cryptosporidium parvum
RKLRKKKKFDE

SEQ ID NO: 2278408 - protein, 4 aa, Cryptosporidium parvum
RKLS

SEQ ID NO: 2278409 - protein, 10 aa, Cryptosporidium parvum
RKMEDNGTNH

SEQ ID NO: 2278410 - protein, 7 aa, Cryptosporidium parvum
RKMKQND

SEQ ID NO: 2278411 - protein, 7 aa, Cryptosporidium parvum
RKNANLQ

SEQ ID NO: 2278412 - protein, 12 aa, Cryptosporidium parvum
RKNDSKNTNNEL

SEQ ID NO: 2278413 - protein, 6 aa, Cryptosporidium parvum
RKNDSR

SEQ ID NO: 2278414 - protein, 4 aa, Cryptosporidium parvum
RKNE

SEQ ID NO: 2278415 - protein, 11 aa, Cryptosporidium parvum
RKNEELNDEEF

SEQ ID NO: 2278416 - protein, 8 aa, Cryptosporidium parvum
RKNELTSS

SEQ ID NO: 2278417 - protein, 9 aa, Cryptosporidium parvum
RKNGTAGRL

SEQ ID NO: 2278418 - protein, 13 aa, Cryptosporidium parvum
RKNINELRNSSNS

SEQ ID NO: 2278419 - protein, 7 aa, Cryptosporidium parvum
RKNKDAD

SEQ ID NO: 2278420 - protein, 9 aa, Cryptosporidium parvum
RKNKDSEDF

SEQ ID NO: 2278421 - protein, 13 aa, Cryptosporidium parvum
RKNKGQSETISTG

SEQ ID NO: 2278422 - protein, 8 aa, Cryptosporidium parvum
RKNKLGDE

SEQ ID NO: 2278423 - protein, 8 aa, Cryptosporidium parvum
RKNKPEQT

SEQ ID NO: 2278424 - protein, 9 aa, Cryptosporidium parvum
RKNNSSNLN

SEQ ID NO: 2278425 - protein, 9 aa, Cryptosporidium parvum
RKNRGMDLT

SEQ ID NO: 2278426 - protein, 19 aa, Cryptosporidium parvum
RKNRSTKKGKYTNADAADL

SEQ ID NO: 2278427 - protein, 5 aa, Cryptosporidium parvum
RKNSM

SEQ ID NO: 2278428 - protein, 7 aa, Cryptosporidium parvum
RKNSNKQ

SEQ ID NO: 2278429 - protein, 29 aa, Cryptosporidium parvum
RKNSYENSNIENSNISSDFTDSKVNKNNS

SEQ ID NO: 2278430 - protein, 9 aa, Cryptosporidium parvum
RKNSYKNIE

SEQ ID NO: 2278431 - protein, 6 aa, Cryptosporidium parvum
RKNTGL

SEQ ID NO: 2278432 - protein, 7 aa, Cryptosporidium parvum
RKNYSPK

SEQ ID NO: 2278433 - protein, 5 aa, Cryptosporidium parvum
RKPDQ

SEQ ID NO: 2278434 - protein, 10 aa, Cryptosporidium parvum
RKPETGRPTD

SEQ ID NO: 2278435 - protein, 22 aa, Cryptosporidium parvum
RKPGKHMASETNREHKGINDNS

SEQ ID NO: 2278436 - protein, 14 aa, Cryptosporidium parvum
RKPITGDPRRRLPS

SEQ ID NO: 2278437 - protein, 5 aa, Cryptosporidium parvum
RKPPI

SEQ ID NO: 2278438 - protein, 6 aa, Cryptosporidium parvum
RKPPYI

SEQ ID NO: 2278439 - protein, 7 aa, Cryptosporidium parvum
RKPSNSI

SEQ ID NO: 2278440 - protein, 9 aa, Cryptosporidium parvum
RKPVSPTLT

SEQ ID NO: 2278441 - protein, 8 aa, Cryptosporidium parvum
RKQAPIQS

SEQ ID NO: 2278442 - protein, 4 aa, Cryptosporidium parvum
RKQC

SEQ ID NO: 2278443 - protein, 5 aa, Cryptosporidium parvum
RKQDL

SEQ ID NO: 2278444 - protein, 4 aa, Cryptosporidium parvum
RKQE

SEQ ID NO: 2278445 - protein, 9 aa, Cryptosporidium parvum
RKQEVPHDG

SEQ ID NO: 2278446 - protein, 8 aa, Cryptosporidium parvum
RKQEYGPE

SEQ ID NO: 2278447 - protein, 7 aa, Cryptosporidium parvum
RKQFTDK

SEQ ID NO: 2278448 - protein, 9 aa, Cryptosporidium parvum
RKQGNAPPR

SEQ ID NO: 2278449 - protein, 7 aa, Cryptosporidium parvum
RKQKKEV

SEQ ID NO: 2278450 - protein, 5 aa, Cryptosporidium parvum
RKQNI

SEQ ID NO: 2278451 - protein, 27 aa, Cryptosporidium parvum
RKQNSEKQIENKSNDVEKKETEQSDYS

SEQ ID NO: 2278452 - protein, 6 aa, Cryptosporidium parvum
RKQNVE

SEQ ID NO: 2278453 - protein, 4 aa, Cryptosporidium parvum
RKQP

SEQ ID NO: 2278454 - protein, 53 aa, Cryptosporidium parvum
RKQPPPSSNSGGGAGGTLHNSQSKLNQHNKSQQQFQNGPSNNTAIENTTSISS

SEQ ID NO: 2278455 - protein, 4 aa, Cryptosporidium parvum
RKQS

SEQ ID NO: 2278456 - protein, 7 aa, Cryptosporidium parvum
RKQSDGV

SEQ ID NO: 2278457 - protein, 6 aa, Cryptosporidium parvum
RKQSEY

SEQ ID NO: 2278458 - protein, 6 aa, Cryptosporidium parvum
RKQSSN

SEQ ID NO: 2278459 - protein, 4 aa, Cryptosporidium parvum
RKQV

SEQ ID NO: 2278460 - protein, 5 aa, Cryptosporidium parvum
RKRDA

SEQ ID NO: 2278461 - protein, 7 aa, Cryptosporidium parvum
RKRDDKR

SEQ ID NO: 2278462 - protein, 9 aa, Cryptosporidium parvum
RKRDRETIR

SEQ ID NO: 2278463 - protein, 9 aa, Cryptosporidium parvum
RKREELRKS

SEQ ID NO: 2278464 - protein, 9 aa, Cryptosporidium parvum
RKRKDKEKI

SEQ ID NO: 2278465 - protein, 6 aa, Cryptosporidium parvum
RKRKNV

SEQ ID NO: 2278466 - protein, 10 aa, Cryptosporidium parvum
RKRKTDSEQA

SEQ ID NO: 2278467 - protein, 6 aa, Cryptosporidium parvum
RKRRKI

SEQ ID NO: 2278468 - protein, 8 aa, Cryptosporidium parvum
RKRRTAET

SEQ ID NO: 2278469 - protein, 13 aa, Cryptosporidium parvum
RKRSESEDSKDSL

SEQ ID NO: 2278470 - protein, 5 aa, Cryptosporidium parvum
RKRSP

SEQ ID NO: 2278471 - protein, 9 aa, Cryptosporidium parvum
RKRTQRLET

SEQ ID NO: 2278472 - protein, 4 aa, Cryptosporidium parvum
RKRY

SEQ ID NO: 2278473 - protein, 31 aa, Cryptosporidium parvum
RKSAYTQRKIEEKGKIQVDEEGSIKDGEGAF

SEQ ID NO: 2278474 - protein, 9 aa, Cryptosporidium parvum
RKSDNNRIA

SEQ ID NO: 2278475 - protein, 6 aa, Cryptosporidium parvum
RKSEEL

SEQ ID NO: 2278476 - protein, 13 aa, Cryptosporidium parvum
RKSERQRIDQSGV

SEQ ID NO: 2278477 - protein, 7 aa, Cryptosporidium parvum
RKSESHA

SEQ ID NO: 2278478 - protein, 9 aa, Cryptosporidium parvum
RKSGENNVG

SEQ ID NO: 2278479 - protein, 14 aa, Cryptosporidium parvum
RKSGRFGGTLSPPY

SEQ ID NO: 2278480 - protein, 7 aa, Cryptosporidium parvum
RKSGSAY

SEQ ID NO: 2278481 - protein, 8 aa, Cryptosporidium parvum
RKSGSGVI

SEQ ID NO: 2278482 - protein, 19 aa, Cryptosporidium parvum
RKSIDAKSSEKASDKIQGD

SEQ ID NO: 2278483 - protein, 6 aa, Cryptosporidium parvum
RKSIEA

SEQ ID NO: 2278484 - protein, 7 aa, Cryptosporidium parvum
RKSISEK

SEQ ID NO: 2278485 - protein, 9 aa, Cryptosporidium parvum
RKSKKNAAN

SEQ ID NO: 2278486 - protein, 16 aa, Cryptosporidium parvum
RKSKMAELQSETEELG

SEQ ID NO: 2278487 - protein, 9 aa, Cryptosporidium parvum
RKSKTSDIS

SEQ ID NO: 2278488 - protein, 7 aa, Cryptosporidium parvum
RKSLGSP

SEQ ID NO: 2278489 - protein, 7 aa, Cryptosporidium parvum
RKSNGDI

SEQ ID NO: 2278490 - protein, 5 aa, Cryptosporidium parvum
RKSNK

SEQ ID NO: 2278491 - protein, 15 aa, Cryptosporidium parvum
RKSNQNNGLSDSNSK

SEQ ID NO: 2278492 - protein, 12 aa, Cryptosporidium parvum
RKSNSVSDLNSK

SEQ ID NO: 2278493 - protein, 8 aa, Cryptosporidium parvum
RKSPKSKF

SEQ ID NO: 2278494 - protein, 7 aa, Cryptosporidium parvum
RKSPQCA

SEQ ID NO: 2278495 - protein, 41 aa, Cryptosporidium parvum
RKSQADNKSKGAKAPKTTTSHANNMNARSHANSNTGNNLST

SEQ ID NO: 2278496 - protein, 6 aa, Cryptosporidium parvum
RKSQDA

SEQ ID NO: 2278497 - protein, 28 aa, Cryptosporidium parvum
RKSQQLVKKEDSSNSLKENDTEEKIQKT

SEQ ID NO: 2278498 - protein, 10 aa, Cryptosporidium parvum
RKSRENSCEQ

SEQ ID NO: 2278499 - protein, 9 aa, Cryptosporidium parvum
RKSRQDEIN

SEQ ID NO: 2278500 - protein, 14 aa, Cryptosporidium parvum
RKSRRDGRKNPATI

SEQ ID NO: 2278501 - protein, 7 aa, Cryptosporidium parvum
RKSSEHI

SEQ ID NO: 2278502 - protein, 16 aa, Cryptosporidium parvum
RKSSGSTSNLSNPTSI

SEQ ID NO: 2278503 - protein, 8 aa, Cryptosporidium parvum
RKSSQMSH

SEQ ID NO: 2278504 - protein, 6 aa, Cryptosporidium parvum
RKSSQS

SEQ ID NO: 2278505 - protein, 10 aa, Cryptosporidium parvum
RKSSQVITES

SEQ ID NO: 2278506 - protein, 9 aa, Cryptosporidium parvum
RKSTDGLSE

SEQ ID NO: 2278507 - protein, 9 aa, Cryptosporidium parvum
RKTEERTVS

SEQ ID NO: 2278508 - protein, 15 aa, Cryptosporidium parvum
RKTFKKDNSGCNYKP

SEQ ID NO: 2278509 - protein, 9 aa, Cryptosporidium parvum
RKTNNISSN

SEQ ID NO: 2278510 - protein, 5 aa, Cryptosporidium parvum
RKTNT

SEQ ID NO: 2278511 - protein, 8 aa, Cryptosporidium parvum
RKTPEPMK

SEQ ID NO: 2278512 - protein, 7 aa, Cryptosporidium parvum
RKTPGFV

SEQ ID NO: 2278513 - protein, 17 aa, Cryptosporidium parvum
RKTQFTKNQSFIIDLPN

SEQ ID NO: 2278514 - protein, 12 aa, Cryptosporidium parvum
RKTQSGAPKDAL

SEQ ID NO: 2278515 - protein, 8 aa, Cryptosporidium parvum
RKTQYDLT

SEQ ID NO: 2278516 - protein, 7 aa, Cryptosporidium parvum
RKTSNSL

SEQ ID NO: 2278517 - protein, 5 aa, Cryptosporidium parvum
RKTTF

SEQ ID NO: 2278518 - protein, 4 aa, Cryptosporidium parvum
RKTV

SEQ ID NO: 2278519 - protein, 6 aa, Cryptosporidium parvum
RKVSRH

SEQ ID NO: 2278520 - protein, 9 aa, Cryptosporidium parvum
RKYNTNERA

SEQ ID NO: 2278521 - protein, 7 aa, Cryptosporidium parvum
RKYQKKG

SEQ ID NO: 2278522 - protein, 13 aa, Cryptosporidium parvum
RKYRSKAEDSKNF

SEQ ID NO: 2278523 - protein, 11 aa, Cryptosporidium parvum
RKYSSDSRSDK

SEQ ID NO: 2278524 - protein, 13 aa, Cryptosporidium parvum
RLAKTGKKFDSGN

SEQ ID NO: 2278525 - protein, 18 aa, Cryptosporidium parvum
RLANTNGRKAKRKARERY

SEQ ID NO: 2278526 - protein, 9 aa, Cryptosporidium parvum
RLDDYSTKL

SEQ ID NO: 2278527 - protein, 17 aa, Cryptosporidium parvum
RLDNTNLKNKDENQKMD

SEQ ID NO: 2278528 - protein, 11 aa, Cryptosporidium parvum
RLEDEEKMSED

SEQ ID NO: 2278529 - protein, 10 aa, Cryptosporidium parvum
RLEEQKANNR

SEQ ID NO: 2278530 - protein, 12 aa, Cryptosporidium parvum
RLEKERKERMNL

SEQ ID NO: 2278531 - protein, 10 aa, Cryptosporidium parvum
RLETGRKVSP

SEQ ID NO: 2278532 - protein, 7 aa, Cryptosporidium parvum
RLGDQGR

SEQ ID NO: 2278533 - protein, 6 aa, Cryptosporidium parvum
RLGKSM

SEQ ID NO: 2278534 - protein, 8 aa, Cryptosporidium parvum
RLGSNEDF

SEQ ID NO: 2278535 - protein, 4 aa, Cryptosporidium parvum
RLKD

SEQ ID NO: 2278536 - protein, 10 aa, Cryptosporidium parvum
RLKGKDGRIR

SEQ ID NO: 2278537 - protein, 20 aa, Cryptosporidium parvum
RLKGQSSAQSSGLENSALSK

SEQ ID NO: 2278538 - protein, 33 aa, Cryptosporidium parvum
RLKGTQRSMRDYESSYSGESTGLKDNVKRSTNL

SEQ ID NO: 2278539 - protein, 19 aa, Cryptosporidium parvum
RLKNKDKKPYLTPKKTNGR

SEQ ID NO: 2278540 - protein, 11 aa, Cryptosporidium parvum
RLKNKDSDTIS

SEQ ID NO: 2278541 - protein, 8 aa, Cryptosporidium parvum
RLKNPKSK

SEQ ID NO: 2278542 - protein, 7 aa, Cryptosporidium parvum
RLKNSKS

SEQ ID NO: 2278543 - protein, 4 aa, Cryptosporidium parvum
RLKQ

SEQ ID NO: 2278544 - protein, 10 aa, Cryptosporidium parvum
RLKTNRRGGY

SEQ ID NO: 2278545 - protein, 5 aa, Cryptosporidium parvum
RLNEN

SEQ ID NO: 2278546 - protein, 11 aa, Cryptosporidium parvum
RLNPNRREKMK

SEQ ID NO: 2278547 - protein, 15 aa, Cryptosporidium parvum
RLNPSSQIQNYQRNY

SEQ ID NO: 2278548 - protein, 12 aa, Cryptosporidium parvum
RLNQEEKERLEK

SEQ ID NO: 2278549 - protein, 9 aa, Cryptosporidium parvum
RLNRSQREE

SEQ ID NO: 2278550 - protein, 6 aa, Cryptosporidium parvum
RLPISS

SEQ ID NO: 2278551 - protein, 52 aa, Cryptosporidium parvum
RLPKTSEEATSTKNNINSTNNKQKNSALPRGKKSKLKKVADKYGEQDDEERK

SEQ ID NO: 2278552 - protein, 18 aa, Cryptosporidium parvum
RLPPPPPPPISPSPPTSK

SEQ ID NO: 2278553 - protein, 14 aa, Cryptosporidium parvum
RLPRGHSPAPNRID

SEQ ID NO: 2278554 - protein, 15 aa, Cryptosporidium parvum
RLPSGARKTISSQSR

SEQ ID NO: 2278555 - protein, 8 aa, Cryptosporidium parvum
RLPSPTQS

SEQ ID NO: 2278556 - protein, 9 aa, Cryptosporidium parvum
RLQGKSYSF

SEQ ID NO: 2278557 - protein, 36 aa, Cryptosporidium parvum; identical to SEQ ID NO: 2159226

SEQ ID NO: 2278558 - protein, 15 aa, Cryptosporidium parvum
RLQQNQQLSSTNGIY

SEQ ID NO: 2278559 - protein, 17 aa, Cryptosporidium parvum
RLRETKKNLEGNKSENC

SEQ ID NO: 2278560 - protein, 6 aa, Cryptosporidium parvum
RLRGTS

SEQ ID NO: 2278561 - protein, 21 aa, Cryptosporidium parvum
RLRKKEEDGNVFENKQDSHIY

SEQ ID NO: 2278562 - protein, 24 aa, Cryptosporidium parvum
RLRRPQNEDSSESKKSISKDTEPI

SEQ ID NO: 2278563 - protein, 8 aa, Cryptosporidium parvum
RLRTDTAE

SEQ ID NO: 2278564 - protein, 5 aa, Cryptosporidium parvum
RLSEN

SEQ ID NO: 2278565 - protein, 9 aa, Cryptosporidium parvum
RLSKDKNNM

SEQ ID NO: 2278566 - protein, 4 aa, Cryptosporidium parvum
RLSN

SEQ ID NO: 2278567 - protein, 12 aa, Cryptosporidium parvum
RLSNEKKIKDLQ

SEQ ID NO: 2278568 - protein, 8 aa, Cryptosporidium parvum
RLSPKPES

SEQ ID NO: 2278569 - protein, 8 aa, Cryptosporidium parvum
RLSTGSNV

SEQ ID NO: 2278570 - protein, 6 aa, Cryptosporidium parvum
RLTEQG

SEQ ID NO: 2278571 - protein, 7 aa, Cryptosporidium parvum
RLTKGSP

SEQ ID NO: 2278572 - protein, 5 aa, Cryptosporidium parvum
RMEDK

SEQ ID NO: 2278573 - protein, 36 aa, Cryptosporidium parvum
RMNDSETEKMNQDSDIDLGQDIDDDDDDDEDLDCNN

SEQ ID NO: 2278574 - protein, 4 aa, Cryptosporidium parvum
RMNG

SEQ ID NO: 2278575 - protein, 7 aa, Cryptosporidium parvum
RMNNRQK

SEQ ID NO: 2278576 - protein, 12 aa, Cryptosporidium parvum
RMNTGKENKVDM

SEQ ID NO: 2278577 - protein, 6 aa, Cryptosporidium parvum
RMRPGA

SEQ ID NO: 2278578 - protein, 9 aa, Cryptosporidium parvum
RNADNGEST

SEQ ID NO: 2278579 - protein, 10 aa, Cryptosporidium parvum
RNADYKRSTP

SEQ ID NO: 2278580 - protein, 10 aa, Cryptosporidium parvum
RNAETYSQNH

SEQ ID NO: 2278581 - protein, 9 aa, Cryptosporidium parvum
RNAEYNPKK

SEQ ID NO: 2278582 - protein, 6 aa, Cryptosporidium parvum
RNANQH

SEQ ID NO: 2278583 - protein, 16 aa, Cryptosporidium parvum
RNAPGQMGTKSFGGSR

SEQ ID NO: 2278584 - protein, 10 aa, Cryptosporidium parvum
RNARKMEPIS

SEQ ID NO: 2278585 - protein, 5 aa, Cryptosporidium parvum
RNCSE

SEQ ID NO: 2278586 - protein, 6 aa, Cryptosporidium parvum
RNDAGH

SEQ ID NO: 2278587 - protein, 7 aa, Cryptosporidium parvum
RNDDGRQ

SEQ ID NO: 2278588 - protein, 7 aa, Cryptosporidium parvum
RNDEKKW

SEQ ID NO: 2278589 - protein, 8 aa, Cryptosporidium parvum
RNDKKQPY

SEQ ID NO: 2278590 - protein, 11 aa, Cryptosporidium parvum
RNDKRARGGED

SEQ ID NO: 2278591 - protein, 10 aa, Cryptosporidium parvum
RNDNKEKRSV

SEQ ID NO: 2278592 - protein, 7 aa, Cryptosporidium parvum
RNDQDQI

SEQ ID NO: 2278593 - protein, 8 aa, Cryptosporidium parvum
RNDQEKMN

SEQ ID NO: 2278594 - protein, 7 aa, Cryptosporidium parvum
RNDQGQI

SEQ ID NO: 2278595 - protein, 14 aa, Cryptosporidium parvum
RNDQLKSDGGMGQK

SEQ ID NO: 2278596 - protein, 11 aa, Cryptosporidium parvum
RNDRQTSNGFK

SEQ ID NO: 2278597 - protein, 6 aa, Cryptosporidium parvum
RNDSYN

SEQ ID NO: 2278598 - protein, 5 aa, Cryptosporidium parvum
RNDTG

SEQ ID NO: 2278599 - protein, 17 aa, Cryptosporidium parvum
RNEAGKASHISLPPSNK

SEQ ID NO: 2278600 - protein, 6 aa, Cryptosporidium parvum
RNEDAQ

SEQ ID NO: 2278601 - protein, 21 aa, Cryptosporidium parvum
RNEDEVSDDEIEEINQEKKAV

SEQ ID NO: 2278602 - protein, 11 aa, Cryptosporidium parvum
RNEELQEEKTR

SEQ ID NO: 2278603 - protein, 7 aa, Cryptosporidium parvum
RNEESKN

SEQ ID NO: 2278604 - protein, 10 aa, Cryptosporidium parvum
RNEKEKIKEW

SEQ ID NO: 2278605 - protein, 4 aa, Cryptosporidium parvum
RNEL

SEQ ID NO: 2278606 - protein, 11 aa, Cryptosporidium parvum
RNELNNKNNYE

SEQ ID NO: 2278607 - protein, 12 aa, Cryptosporidium parvum
RNELNSKVKELK

SEQ ID NO: 2278608 - protein, 5 aa, Cryptosporidium parvum
RNELS

SEQ ID NO: 2278609 - protein, 10 aa, Cryptosporidium parvum
RNEMKGGRIN

SEQ ID NO: 2278610 - protein, 11 aa, Cryptosporidium parvum
RNEMSGTVGYN

SEQ ID NO: 2278611 - protein, 7 aa, Cryptosporidium parvum
RNENIPV

SEQ ID NO: 2278612 - protein, 6 aa, Cryptosporidium parvum
RNERGK

SEQ ID NO: 2278613 - protein, 29 aa, Cryptosporidium parvum
RNERYGDYQDEEEYDNIAEEEYSELDIKD

SEQ ID NO: 2278614 - protein, 8 aa, Cryptosporidium parvum
RNESKNPV

SEQ ID NO: 2278615 - protein, 7 aa, Cryptosporidium parvum
RNESNAY

SEQ ID NO: 2278616 - protein, 7 aa, Cryptosporidium parvum
RNESPQI

SEQ ID NO: 2278617 - protein, 7 aa, Cryptosporidium parvum
RNESYGE

SEQ ID NO: 2278618 - protein, 15 aa, Cryptosporidium parvum
RNETPDLIPKDKGNM

SEQ ID NO: 2278619 - protein, 9 aa, Cryptosporidium parvum
RNFAGNEQT

SEQ ID NO: 2278620 - protein, 14 aa, Cryptosporidium parvum
RNFEEEKYSESSFD

SEQ ID NO: 2278621 - protein, 15 aa, Cryptosporidium parvum
RNFSGSSKKIEQNKV

SEQ ID NO: 2278622 - protein, 5 aa, Cryptosporidium parvum
RNGAE

SEQ ID NO: 2278623 - protein, 5 aa, Cryptosporidium parvum
RNGEA

SEQ ID NO: 2278624 - protein, 6 aa, Cryptosporidium parvum
RNGEIS

SEQ ID NO: 2278625 - protein, 20 aa, Cryptosporidium parvum
RNGGFQQKPGENPGLTNSGH

SEQ ID NO: 2278626 - protein, 5 aa, Cryptosporidium parvum
RNGGR

SEQ ID NO: 2278627 - protein, 5 aa, Cryptosporidium parvum
RNGHP

SEQ ID NO: 2278628 - protein, 14 aa, Cryptosporidium parvum
RNGKVGPDTSINKN

SEQ ID NO: 2278629 - protein, 11 aa, Cryptosporidium parvum
RNGLDPEDPEE

SEQ ID NO: 2278630 - protein, 6 aa, Cryptosporidium parvum
RNGLES

SEQ ID NO: 2278631 - protein, 4 aa, Cryptosporidium parvum
RNGN

SEQ ID NO: 2278632 - protein, 7 aa, Cryptosporidium parvum
RNGNNEG

SEQ ID NO: 2278633 - protein, 6 aa, Cryptosporidium parvum
RNGNTS

SEQ ID NO: 2278634 - protein, 6 aa, Cryptosporidium parvum
RNGRNE

SEQ ID NO: 2278635 - protein, 6 aa, Cryptosporidium parvum
RNHSNY

SEQ ID NO: 2278636 - protein, 4 aa, Cryptosporidium parvum
RNID

SEQ ID NO: 2278637 - protein, 10 aa, Cryptosporidium parvum
RNIDESDPAF

SEQ ID NO: 2278638 - protein, 7 aa, Cryptosporidium parvum
RNIEEDD

SEQ ID NO: 2278639 - protein, 6 aa, Cryptosporidium parvum
RNIENK

SEQ ID NO: 2278640 - protein, 13 aa, Cryptosporidium parvum
RNINQDKSFNEEI

SEQ ID NO: 2278641 - protein, 8 aa, Cryptosporidium parvum
RNIQDNEL

SEQ ID NO: 2278642 - protein, 11 aa, Cryptosporidium parvum
RNIRKGDQVIS

SEQ ID NO: 2278643 - protein, 13 aa, Cryptosporidium parvum
RNISNSNEKNRDI

SEQ ID NO: 2278644 - protein, 8 aa, Cryptosporidium parvum
RNKASHNE

SEQ ID NO: 2278645 - protein, 14 aa, Cryptosporidium parvum
RNKDKEEAKQVKVT

SEQ ID NO: 2278646 - protein, 19 aa, Cryptosporidium parvum
RNKDRNNDPISIGEAIKMC

SEQ ID NO: 2278647 - protein, 6 aa, Cryptosporidium parvum
RNKEKM

SEQ ID NO: 2278648 - protein, 6 aa, Cryptosporidium parvum
RNKEND

SEQ ID NO: 2278649 - protein, 8 aa, Cryptosporidium parvum
RNKGSDEC

SEQ ID NO: 2278650 - protein, 6 aa, Cryptosporidium parvum
RNKGST

SEQ ID NO: 2278651 - protein, 7 aa, Cryptosporidium parvum
RNKKELA

SEQ ID NO: 2278652 - protein, 9 aa, Cryptosporidium parvum
RNKKHSNMR

SEQ ID NO: 2278653 - protein, 5 aa, Cryptosporidium parvum
RNKKK

SEQ ID NO: 2278654 - protein, 10 aa, Cryptosporidium parvum
RNKKQQPSLS

SEQ ID NO: 2278655 - protein, 29 aa, Cryptosporidium parvum
RNKKVDPKKGISNAKEGVRSEFNKNGRGN

SEQ ID NO: 2278656 - protein, 5 aa, Cryptosporidium parvum
RNKNA

SEQ ID NO: 2278657 - protein, 9 aa, Cryptosporidium parvum
RNKPPSRKL

SEQ ID NO: 2278658 - protein, 5 aa, Cryptosporidium parvum
RNKQI

SEQ ID NO: 2278659 - protein, 8 aa, Cryptosporidium parvum
RNKSGQTT

SEQ ID NO: 2278660 - protein, 10 aa, Cryptosporidium parvum
RNKSKWEKGF

SEQ ID NO: 2278661 - protein, 28 aa, Cryptosporidium parvum
RNKSQPPQQNLTSSTRKMPSKTGLGSNE

SEQ ID NO: 2278662 - protein, 6 aa, Cryptosporidium parvum
RNKTPI

SEQ ID NO: 2278663 - protein, 6 aa, Cryptosporidium parvum
RNKYNS

SEQ ID NO: 2278664 - protein, 10 aa, Cryptosporidium parvum
RNKYYESTPD

SEQ ID NO: 2278665 - protein, 11 aa, Cryptosporidium parvum
RNLPNNKQISL

SEQ ID NO: 2278666 - protein, 6 aa, Cryptosporidium parvum
RNLPPI

SEQ ID NO: 2278667 - protein, 11 aa, Cryptosporidium parvum
RNLQAKSNMES

SEQ ID NO: 2278668 - protein, 16 aa, Cryptosporidium parvum
RNMTPTDEEREKYDSE

SEQ ID NO: 2278669 - protein, 10 aa, Cryptosporidium parvum
RNNAKNTELN

SEQ ID NO: 2278670 - protein, 19 aa, Cryptosporidium parvum
RNNCHNSSKLNKDVSNYYS

SEQ ID NO: 2278671 - protein, 5 aa, Cryptosporidium parvum
RNNDE

SEQ ID NO: 2278672 - protein, 7 aa, Cryptosporidium parvum
RNNERPR

SEQ ID NO: 2278673 - protein, 9 aa, Cryptosporidium parvum
RNNGKKNQA

SEQ ID NO: 2278674 - protein, 13 aa, Cryptosporidium parvum
RNNHTSSSETQNS

SEQ ID NO: 2278675 - protein, 7 aa, Cryptosporidium parvum
RNNKSIE

SEQ ID NO: 2278676 - protein, 4 aa, Cryptosporidium parvum
RNNL

SEQ ID NO: 2278677 - protein, 8 aa, Cryptosporidium parvum
RNNLNGSK

SEQ ID NO: 2278678 - protein, 20 aa, Cryptosporidium parvum
RNNLSKNTLNKDYDPGLEPN

SEQ ID NO: 2278679 - protein, 6 aa, Cryptosporidium parvum
RNNMTN

SEQ ID NO: 2278680 - protein, 10 aa, Cryptosporidium parvum
RNNNENTNNF

SEQ ID NO: 2278681 - protein, 6 aa, Cryptosporidium parvum
RNNNNT

SEQ ID NO: 2278682 - protein, 10 aa, Cryptosporidium parvum
RNNQGKITRE

SEQ ID NO: 2278683 - protein, 8 aa, Cryptosporidium parvum
RNNSKKKR

SEQ ID NO: 2278684 - protein, 5 aa, Cryptosporidium parvum
RNNSP

SEQ ID NO: 2278685 - protein, 19 aa, Cryptosporidium parvum
RNNSVPPPRPKNELNSEKV

SEQ ID NO: 2278686 - protein, 4 aa, Cryptosporidium parvum
RNNT

SEQ ID NO: 2278687 - protein, 4 aa, Cryptosporidium parvum
RNNV

SEQ ID NO: 2278688 - protein, 10 aa, Cryptosporidium parvum
RNPNDKDKIC

SEQ ID NO: 2278689 - protein, 5 aa, Cryptosporidium parvum
RNPQL

SEQ ID NO: 2278690 - protein, 7 aa, Cryptosporidium parvum
RNPTNRV

SEQ ID NO: 2278691 - protein, 4 aa, Cryptosporidium parvum
RNPV

SEQ ID NO: 2278692 - protein, 4 aa, Cryptosporidium parvum
RNQE

SEQ ID NO: 2278693 - protein, 4 aa, Cryptosporidium parvum
RNQI

SEQ ID NO: 2278694 - protein, 5 aa, Cryptosporidium parvum
RNQKR

SEQ ID NO: 2278695 - protein, 7 aa, Cryptosporidium parvum
RNQLEDD

SEQ ID NO: 2278696 - protein, 7 aa, Cryptosporidium parvum
RNQNGIK

SEQ ID NO: 2278697 - protein, 6 aa, Cryptosporidium parvum
RNQNKH

SEQ ID NO: 2278698 - protein, 19 aa, Cryptosporidium parvum
RNQNQNQAQTSSCSRSGRV

SEQ ID NO: 2278699 - protein, 20 aa, Cryptosporidium parvum
RNQQQVNTSSAATLSYTNNG

SEQ ID NO: 2278700 - protein, 21 aa, Cryptosporidium parvum
RNQRENMTGEANIPNQGNDPH

SEQ ID NO: 2278701 - protein, 23 aa, Cryptosporidium parvum
RNRISGSSNSQQVVNDSAQGKLE

SEQ ID NO: 2278702 - protein, 6 aa, Cryptosporidium parvum
RNRKTS

SEQ ID NO: 2278703 - protein, 17 aa, Cryptosporidium parvum
RNRPRYRNGKKVPPPLP

SEQ ID NO: 2278704 - protein, 4 aa, Cryptosporidium parvum
RNRR

SEQ ID NO: 2278705 - protein, 15 aa, Cryptosporidium parvum
RNRRGKSSKGRKVSG

SEQ ID NO: 2278706 - protein, 13 aa, Cryptosporidium parvum
RNRRSDDNSDENS

SEQ ID NO: 2278707 - protein, 5 aa, Cryptosporidium parvum
RNRSK

SEQ ID NO: 2278708 - protein, 7 aa, Cryptosporidium parvum
RNRSSST

SEQ ID NO: 2278709 - protein, 14 aa, Cryptosporidium parvum
RNSAKSKPEKSYGE

SEQ ID NO: 2278710 - protein, 13 aa, Cryptosporidium parvum
RNSDNSSGSSRNR

SEQ ID NO: 2278711 - protein, 13 aa, Cryptosporidium parvum
RNSDRLNGENAIS

SEQ ID NO: 2278712 - protein, 5 aa, Cryptosporidium parvum
RNSGF

SEQ ID NO: 2278713 - protein, 9 aa, Cryptosporidium parvum
RNSGRNRGL

SEQ ID NO: 2278714 - protein, 6 aa, Cryptosporidium parvum
RNSHPD

SEQ ID NO: 2278715 - protein, 21 aa, Cryptosporidium parvum
RNSKDVDKSRLGSSYNEKNAS

SEQ ID NO: 2278716 - protein, 8 aa, Cryptosporidium parvum
RNSLNNNS

SEQ ID NO: 2278717 - protein, 7 aa, Cryptosporidium parvum
RNSLNYP

SEQ ID NO: 2278718 - protein, 10 aa, Cryptosporidium parvum
RNSNGSENIG

SEQ ID NO: 2278719 - protein, 15 aa, Cryptosporidium parvum
RNSRSKGATEEINPN

SEQ ID NO: 2278720 - protein, 4 aa, Cryptosporidium parvum
RNSS

SEQ ID NO: 2278721 - protein, 60 aa, Cryptosporidium parvum
RNSSERKHSKEHDKRCASNTHDRKEREREREREKECERERERERERERERERERERERER

SEQ ID NO: 2278722 - protein, 6 aa, Cryptosporidium parvum
RNSSST

SEQ ID NO: 2278723 - protein, 6 aa, Cryptosporidium parvum
RNSTGS

SEQ ID NO: 2278724 - protein, 5 aa, Cryptosporidium parvum
RNSTV

SEQ ID NO: 2278725 - protein, 6 aa, Cryptosporidium parvum
RNSVNS

SEQ ID NO: 2278726 - protein, 10 aa, Cryptosporidium parvum
RNTAENSLNE

SEQ ID NO: 2278727 - protein, 16 aa, Cryptosporidium parvum
RNTDKYKTVIKKITTK

SEQ ID NO: 2278728 - protein, 4 aa, Cryptosporidium parvum
RNTE

SEQ ID NO: 2278729 - protein, 16 aa, Cryptosporidium parvum
RNTENGESHASPSHYQ

SEQ ID NO: 2278730 - protein, 4 aa, Cryptosporidium parvum
RNTF

SEQ ID NO: 2278731 - protein, 9 aa, Cryptosporidium parvum
RNTGTVSQT

SEQ ID NO: 2278732 - protein, 5 aa, Cryptosporidium parvum
RNTIS

SEQ ID NO: 2278733 - protein, 4 aa, Cryptosporidium parvum
RNTL

SEQ ID NO: 2278734 - protein, 5 aa, Cryptosporidium parvum
RNTND

SEQ ID NO: 2278735 - protein, 4 aa, Cryptosporidium parvum
RNVA

SEQ ID NO: 2278736 - protein, 39 aa, Cryptosporidium parvum
RNVPDDHSNYPSFNQKRDADETDGVGSIRTNTPESKKGH

SEQ ID NO: 2278737 - protein, 6 aa, Cryptosporidium parvum
RNVPNK

SEQ ID NO: 2278738 - protein, 21 aa, Cryptosporidium parvum
RNVSTNKDESEQNKGCSERKD

SEQ ID NO: 2278739 - protein, 11 aa, Cryptosporidium parvum
RNVTENGRQLE

SEQ ID NO: 2278740 - protein, 6 aa, Cryptosporidium parvum
RNYEEN

SEQ ID NO: 2278741 - protein, 4 aa, Cryptosporidium parvum
RNYH

SEQ ID NO: 2278742 - protein, 50 aa, Cryptosporidium parvum
RNYPQRDSARSYSRGRSRSRSGSIGRSRSRSRSRDRIRSRSRSMSEFGSR

SEQ ID NO: 2278743 - protein, 5 aa, Cryptosporidium parvum
RNYQS

SEQ ID NO: 2278744 - protein, 5 aa, Cryptosporidium parvum
RPAMT

SEQ ID NO: 2278745 - protein, 6 aa, Cryptosporidium parvum
RPANSL

SEQ ID NO: 2278746 - protein, 5 aa, Cryptosporidium parvum
RPDET

SEQ ID NO: 2278747 - protein, 6 aa, Cryptosporidium parvum
RPDGGS

SEQ ID NO: 2278748 - protein, 4 aa, Cryptosporidium parvum
RPDV

SEQ ID NO: 2278749 - protein, 4 aa, Cryptosporidium parvum
RPDY

SEQ ID NO: 2278750 - protein, 5 aa, Cryptosporidium parvum
RPEDY

SEQ ID NO: 2278751 - protein, 4 aa, Cryptosporidium parvum
RPEE

SEQ ID NO: 2278752 - protein, 5 aa, Cryptosporidium parvum
RPEKL

SEQ ID NO: 2278753 - protein, 14 aa, Cryptosporidium parvum
RPEMTAEDAGLQEG

SEQ ID NO: 2278754 - protein, 5 aa, Cryptosporidium parvum
RPENR

SEQ ID NO: 2278755 - protein, 5 aa, Cryptosporidium parvum
RPEVD

SEQ ID NO: 2278756 - protein, 6 aa, Cryptosporidium parvum
RPFPKT

SEQ ID NO: 2278757 - protein, 4 aa, Cryptosporidium parvum
RPGF

SEQ ID NO: 2278758 - protein, 12 aa, Cryptosporidium parvum
RPGGFNRPLSPT

SEQ ID NO: 2278759 - protein, 8 aa, Cryptosporidium parvum
RPGKLSQR

SEQ ID NO: 2278760 - protein, 4 aa, Cryptosporidium parvum
RPGN

SEQ ID NO: 2278761 - protein, 6 aa, Cryptosporidium parvum
RPGNRV

SEQ ID NO: 2278762 - protein, 5 aa, Cryptosporidium parvum
RPGQS

SEQ ID NO: 2278763 - protein, 9 aa, Cryptosporidium parvum
RPGSVLGPQ

SEQ ID NO: 2278764 - protein, 5 aa, Cryptosporidium parvum
RPGTS

SEQ ID NO: 2278765 - protein, 14 aa, Cryptosporidium parvum
RPGTSPPANYGANR

SEQ ID NO: 2278766 - protein, 61 aa, Cryptosporidium parvum
RPHTNGGITSSSSIQPNTSSNTNISTSNTKLEQQQITGSGISGGGVGGGMGSSSAYNHQNH

SEQ ID NO: 2278767 - protein, 5 aa, Cryptosporidium parvum
RPIAN

SEQ ID NO: 2278768 - protein, 8 aa, Cryptosporidium parvum
RPISTSRE

SEQ ID NO: 2278769 - protein, 20 aa, Cryptosporidium parvum
RPITRQPLEDPNKPKRPHNA

SEQ ID NO: 2278770 - protein, 7 aa, Cryptosporidium parvum
RPKDGRS

SEQ ID NO: 2278771 - protein, 9 aa, Cryptosporidium parvum
RPKDNKELP

SEQ ID NO: 2278772 - protein, 8 aa, Cryptosporidium parvum
RPKDPLEL

SEQ ID NO: 2278773 - protein, 5 aa, Cryptosporidium parvum
RPKDV

SEQ ID NO: 2278774 - protein, 10 aa, Cryptosporidium parvum
RPKEKSPEEV

SEQ ID NO: 2278775 - protein, 7 aa, Cryptosporidium parvum
RPKKDGA

SEQ ID NO: 2278776 - protein, 4 aa, Cryptosporidium parvum
RPKM

SEQ ID NO: 2278777 - protein, 21 aa, Cryptosporidium parvum
RPKRSSIGDFDNDNDDLDSDL

SEQ ID NO: 2278778 - protein, 5 aa, Cryptosporidium parvum
RPLEG

SEQ ID NO: 2278779 - protein, 8 aa, Cryptosporidium parvum
RPLENRDK

SEQ ID NO: 2278780 - protein, 14 aa, Cryptosporidium parvum
RPLRPSQTPQTEYE

SEQ ID NO: 2278781 - protein, 12 aa, Cryptosporidium parvum
RPLTDNEISRND

SEQ ID NO: 2278782 - protein, 6 aa, Cryptosporidium parvum
RPLTEN

SEQ ID NO: 2278783 - protein, 10 aa, Cryptosporidium parvum
RPNLASRRPL

SEQ ID NO: 2278784 - protein, 7 aa, Cryptosporidium parvum
RPNLGDY

SEQ ID NO: 2278785 - protein, 5 aa, Cryptosporidium parvum
RPNQC

SEQ ID NO: 2278786 - protein, 17 aa, Cryptosporidium parvum
RPNSGSVTSNSVVPNKD

SEQ ID NO: 2278787 - protein, 6 aa, Cryptosporidium parvum
RPNYKN

SEQ ID NO: 2278788 - protein, 14 aa, Cryptosporidium parvum
RPPEQFSESPENRD

SEQ ID NO: 2278789 - protein, 9 aa, Cryptosporidium parvum
RPPGQVEER

SEQ ID NO: 2278790 - protein, 10 aa, Cryptosporidium parvum
RPPGRESYPG

SEQ ID NO: 2278791 - protein, 4 aa, Cryptosporidium parvum
RPPH

SEQ ID NO: 2278792 - protein, 7 aa, Cryptosporidium parvum
RPPKEEL

SEQ ID NO: 2278793 - protein, 12 aa, Cryptosporidium parvum
RPPNEAEKTHGN

SEQ ID NO: 2278794 - protein, 8 aa, Cryptosporidium parvum
RPPPPPPL

SEQ ID NO: 2278795 - protein, 5 aa, Cryptosporidium parvum
RPPQP

SEQ ID NO: 2278796 - protein, 7 aa, Cryptosporidium parvum
RPPRDRY

SEQ ID NO: 2278797 - protein, 4 aa, Cryptosporidium parvum
RPQA

SEQ ID NO: 2278798 - protein, 12 aa, Cryptosporidium parvum
RPQFANSSTLGG

SEQ ID NO: 2278799 - protein, 43 aa, Cryptosporidium parvum
RPQMKHKEKEGAEHDKAKNAHSTGDTVVAGGAEERDSASPSIK

SEQ ID NO: 2278800 - protein, 22 aa, Cryptosporidium parvum
RPQPPTSSSSTSSSTSSNPGVY

SEQ ID NO: 2278801 - protein, 18 aa, Cryptosporidium parvum
RPQRPRPSSRKGKLSARN

SEQ ID NO: 2278802 - protein, 5 aa, Cryptosporidium parvum
RPRGN

SEQ ID NO: 2278803 - protein, 6 aa, Cryptosporidium parvum
RPRRRC

SEQ ID NO: 2278804 - protein, 12 aa, Cryptosporidium parvum
RPRRTGEMKRKS

SEQ ID NO: 2278805 - protein, 6 aa, Cryptosporidium parvum
RPSENS

SEQ ID NO: 2278806 - protein, 7 aa, Cryptosporidium parvum
RPSEQVP

SEQ ID NO: 2278807 - protein, 32 aa, Cryptosporidium parvum
RPSFSYSNENSSTERNFEHDDNDEDRTYLDEG

SEQ ID NO: 2278808 - protein, 5 aa, Cryptosporidium parvum
RPSGL

SEQ ID NO: 2278809 - protein, 11 aa, Cryptosporidium parvum
RPSIYKSNNHV

SEQ ID NO: 2278810 - protein, 7 aa, Cryptosporidium parvum
RPSPSHS

SEQ ID NO: 2278811 - protein, 18 aa, Cryptosporidium parvum
RPSPVDEEKKQAENSEKK

SEQ ID NO: 2278812 - protein, 4 aa, Cryptosporidium parvum
RPSR

SEQ ID NO: 2278813 - protein, 6 aa, Cryptosporidium parvum
RPSSVQ

SEQ ID NO: 2278814 - protein, 5 aa, Cryptosporidium parvum
RPSVE

SEQ ID NO: 2278815 - protein, 4 aa, Cryptosporidium parvum
RPTI

SEQ ID NO: 2278816 - protein, 10 aa, Cryptosporidium parvum
RPTIGQGRRQ

SEQ ID NO: 2278817 - protein, 5 aa, Cryptosporidium parvum
RPTPD

SEQ ID NO: 2278818 - protein, 5 aa, Cryptosporidium parvum
RPTPL

SEQ ID NO: 2278819 - protein, 5 aa, Cryptosporidium parvum
RPTSE

SEQ ID NO: 2278820 - protein, 7 aa, Cryptosporidium parvum
RPTSSNI

SEQ ID NO: 2278821 - protein, 8 aa, Cryptosporidium parvum
RPTTQNAL

SEQ ID NO: 2278822 - protein, 4 aa, Cryptosporidium parvum
RPTV

SEQ ID NO: 2278823 - protein, 4 aa, Cryptosporidium parvum
RPTY

SEQ ID NO: 2278824 - protein, 5 aa, Cryptosporidium parvum
RPVDP

SEQ ID NO: 2278825 - protein, 10 aa, Cryptosporidium parvum
RPVSKKTTVS

SEQ ID NO: 2278826 - protein, 15 aa, Cryptosporidium parvum
RPWEDPNPEAGERTI

SEQ ID NO: 2278827 - protein, 5 aa, Cryptosporidium parvum
RPWER

SEQ ID NO: 2278828 - protein, 8 aa, Cryptosporidium parvum
RPYGSRPA

SEQ ID NO: 2278829 - protein, 6 aa, Cryptosporidium parvum
RPYTPL

SEQ ID NO: 2278830 - protein, 14 aa, Cryptosporidium parvum
RQAKQNGGLYRPAE

SEQ ID NO: 2278831 - protein, 12 aa, Cryptosporidium parvum
RQAQTEEPEQSC

SEQ ID NO: 2278832 - protein, 14 aa, Cryptosporidium parvum
RQDDKEDPITGEKR

SEQ ID NO: 2278833 - protein, 8 aa, Cryptosporidium parvum
RQDPNINS

SEQ ID NO: 2278834 - protein, 6 aa, Cryptosporidium parvum
RQDQTK

SEQ ID NO: 2278835 - protein, 7 aa, Cryptosporidium parvum
RQDSHPV

SEQ ID NO: 2278836 - protein, 10 aa, Cryptosporidium parvum
RQEDPTTKKL

SEQ ID NO: 2278837 - protein, 8 aa, Cryptosporidium parvum
RQEDSRKA

SEQ ID NO: 2278838 - protein, 9 aa, Cryptosporidium parvum
RQEKEMERQ

SEQ ID NO: 2278839 - protein, 20 aa, Cryptosporidium parvum
RQERAGKKSKTLRDSDRDIS

SEQ ID NO: 2278840 - protein, 27 aa, Cryptosporidium parvum
RQESRKAEKPRKSIKSNIGGRRKIDKS

SEQ ID NO: 2278841 - protein, 5 aa, Cryptosporidium parvum
RQGEA

SEQ ID NO: 2278842 - protein, 31 aa, Cryptosporidium parvum
RQGKDESETKNNGLSQINNEGSQRVTPSYYP

SEQ ID NO: 2278843 - protein, 4 aa, Cryptosporidium parvum
RQGS

SEQ ID NO: 2278844 - protein, 16 aa, Cryptosporidium parvum
RQGSKLSRTSFNTAKT

SEQ ID NO: 2278845 - protein, 21 aa, Cryptosporidium parvum
RQGSTGGSLQRQKTITATPRQ

SEQ ID NO: 2278846 - protein, 7 aa, Cryptosporidium parvum
RQHDPSV

SEQ ID NO: 2278847 - protein, 13 aa, Cryptosporidium parvum
RQHGAREHSNYHQ

SEQ ID NO: 2278848 - protein, 11 aa, Cryptosporidium parvum
RQINPKDVERI

SEQ ID NO: 2278849 - protein, 39 aa, Cryptosporidium parvum
RQKADPRSYSSSKKKKNKADNGQNIEGTNISDDDDLNDS

SEQ ID NO: 2278850 - protein, 10 aa, Cryptosporidium parvum
RQKATKRHID

SEQ ID NO: 2278851 - protein, 22 aa, Cryptosporidium parvum
RQKKKKEDSKEKQTNTNQNQID

SEQ ID NO: 2278852 - protein, 20 aa, Cryptosporidium parvum
RQKLKSKDEDMSSVNTDKRP

SEQ ID NO: 2278853 - protein, 15 aa, Cryptosporidium parvum
RQKNISTREKELDGR

SEQ ID NO: 2278854 - protein, 9 aa, Cryptosporidium parvum
RQKNSTEVI

SEQ ID NO: 2278855 - protein, 10 aa, Cryptosporidium parvum
RQKSRNKSKA

SEQ ID NO: 2278856 - protein, 5 aa, Cryptosporidium parvum
RQLEL

SEQ ID NO: 2278857 - protein, 4 aa, Cryptosporidium parvum
RQLR

SEQ ID NO: 2278858 - protein, 14 aa, Cryptosporidium parvum
RQNAFEASKSELEE

SEQ ID NO: 2278859 - protein, 5 aa, Cryptosporidium parvum
RQNEK

SEQ ID NO: 2278860 - protein, 4 aa, Cryptosporidium parvum
RQNG

SEQ ID NO: 2278861 - protein, 10 aa, Cryptosporidium parvum
RQNHSTQSKN

SEQ ID NO: 2278862 - protein, 10 aa, Cryptosporidium parvum
RQNKNGEIDS

SEQ ID NO: 2278863 - protein, 6 aa, Cryptosporidium parvum
RQNNDS

SEQ ID NO: 2278864 - protein, 9 aa, Cryptosporidium parvum
RQNNQKEFE

SEQ ID NO: 2278865 - protein, 6 aa, Cryptosporidium parvum
RQNQEV

SEQ ID NO: 2278866 - protein, 4 aa, Cryptosporidium parvum
RQNS

SEQ ID NO: 2278867 - protein, 8 aa, Cryptosporidium parvum
RQNSARGI

SEQ ID NO: 2278868 - protein, 5 aa, Cryptosporidium parvum
RQNSS

SEQ ID NO: 2278869 - protein, 15 aa, Cryptosporidium parvum
RQNSSLSKRSIQNNN

SEQ ID NO: 2278870 - protein, 9 aa, Cryptosporidium parvum
RQNTKTDRL

SEQ ID NO: 2278871 - protein, 29 aa, Cryptosporidium parvum
RQNTSASIDECKGNSEANEITPDTEPACK

SEQ ID NO: 2278872 - protein, 8 aa, Cryptosporidium parvum
RQNYSSAN

SEQ ID NO: 2278873 - protein, 4 aa, Cryptosporidium parvum
RQPD

SEQ ID NO: 2278874 - protein, 5 aa, Cryptosporidium parvum
RQPEK

SEQ ID NO: 2278875 - protein, 19 aa, Cryptosporidium parvum
RQPGNDSSLLDKGQQTQTR

SEQ ID NO: 2278876 - protein, 4 aa, Cryptosporidium parvum
RQPN

SEQ ID NO: 2278877 - protein, 12 aa, Cryptosporidium parvum
RQPREGRAREGG

SEQ ID NO: 2278878 - protein, 6 aa, Cryptosporidium parvum
RQPSNE

SEQ ID NO: 2278879 - protein, 14 aa, Cryptosporidium parvum
RQPTEGRSKDGGLR

SEQ ID NO: 2278880 - protein, 12 aa, Cryptosporidium parvum
RQPVKGRKRHGG

SEQ ID NO: 2278881 - protein, 7 aa, Cryptosporidium parvum
RQQAQLQ

SEQ ID NO: 2278882 - protein, 4 aa, Cryptosporidium parvum
RQQE

SEQ ID NO: 2278883 - protein, 8 aa, Cryptosporidium parvum
RQQEKVRQ

SEQ ID NO: 2278884 - protein, 6 aa, Cryptosporidium parvum
RQQNSD

SEQ ID NO: 2278885 - protein, 30 aa, Cryptosporidium parvum; identical to SEQ ID NO: 2159519

SEQ ID NO: 2278886 - protein, 8 aa, Cryptosporidium parvum
RQQYDNAR

SEQ ID NO: 2278887 - protein, 12 aa, Cryptosporidium parvum
RQRAMGSASDEY

SEQ ID NO: 2278888 - protein, 5 aa, Cryptosporidium parvum
RQRIE

SEQ ID NO: 2278889 - protein, 6 aa, Cryptosporidium parvum
RQRLGS

SEQ ID NO: 2278890 - protein, 11 aa, Cryptosporidium parvum
RQRMKNATNNI

SEQ ID NO: 2278891 - protein, 21 aa, Cryptosporidium parvum
RQRNKKKNNKEKNLENSQTPT

SEQ ID NO: 2278892 - protein, 15 aa, Cryptosporidium parvum
RQSAQKHRDKQKIER

SEQ ID NO: 2278893 - protein, 12 aa, Cryptosporidium parvum
RQSEYENKLQQE

SEQ ID NO: 2278894 - protein, 18 aa, Cryptosporidium parvum
RQSHSHSNLHSNSRTGLG

SEQ ID NO: 2278895 - protein, 8 aa, Cryptosporidium parvum
RQSHWDNN

SEQ ID NO: 2278896 - protein, 4 aa, Cryptosporidium parvum
RQSK

SEQ ID NO: 2278897 - protein, 4 aa, Cryptosporidium parvum
RQSS

SEQ ID NO: 2278898 - protein, 9 aa, Cryptosporidium parvum
RQSSEKGAS

SEQ ID NO: 2278899 - protein, 13 aa, Cryptosporidium parvum
RQSTGSKLQSSKL

SEQ ID NO: 2278900 - protein, 12 aa, Cryptosporidium parvum
RQSTTIYESSNE

SEQ ID NO: 2278901 - protein, 51 aa, Cryptosporidium parvum
RQTEDKDSKEEVQQLSGSSGISGGKGSGYFQSQSGGQQISQGSLSSGTGHH

SEQ ID NO: 2278902 - protein, 5 aa, Cryptosporidium parvum
RQTEI

SEQ ID NO: 2278903 - protein, 6 aa, Cryptosporidium parvum
RQTPTI

SEQ ID NO: 2278904 - protein, 7 aa, Cryptosporidium parvum
RQTQEDL

SEQ ID NO: 2278905 - protein, 5 aa, Cryptosporidium parvum
RQTRI

SEQ ID NO: 2278906 - protein, 6 aa, Cryptosporidium parvum
RQTSNL

SEQ ID NO: 2278907 - protein, 4 aa, Cryptosporidium parvum
RQYR

SEQ ID NO: 2278908 - protein, 11 aa, Cryptosporidium parvum
RRAEEKNLSNK

SEQ ID NO: 2278909 - protein, 18 aa, Cryptosporidium parvum
RRAKIKNKDEETSKEDDW

SEQ ID NO: 2278910 - protein, 14 aa, Cryptosporidium parvum
RRAKLKGSNTNPAM

SEQ ID NO: 2278911 - protein, 10 aa, Cryptosporidium parvum
RRANNPTDKL

SEQ ID NO: 2278912 - protein, 22 aa, Cryptosporidium parvum
RRDASGKAHRVSKQNDSAGIED

SEQ ID NO: 2278913 - protein, 6 aa, Cryptosporidium parvum
RRDDPN

SEQ ID NO: 2278914 - protein, 9 aa, Cryptosporidium parvum
RRDEPQMAR

SEQ ID NO: 2278915 - protein, 5 aa, Cryptosporidium parvum
RRDEQ

SEQ ID NO: 2278916 - protein, 4 aa, Cryptosporidium parvum
RRDG

SEQ ID NO: 2278917 - protein, 5 aa, Cryptosporidium parvum
RRDHK

SEQ ID NO: 2278918 - protein, 10 aa, Cryptosporidium parvum
RRDIENSRNN

SEQ ID NO: 2278919 - protein, 4 aa, Cryptosporidium parvum
RRDN

SEQ ID NO: 2278920 - protein, 7 aa, Cryptosporidium parvum
RRDPISG

SEQ ID NO: 2278921 - protein, 14 aa, Cryptosporidium parvum
RREAIKKQRENETL

SEQ ID NO: 2278922 - protein, 17 aa, Cryptosporidium parvum
RREAPDVSDTRAFPVLG

SEQ ID NO: 2278923 - protein, 17 aa, Cryptosporidium parvum
RREKKTDISTGKTETNV

SEQ ID NO: 2278924 - protein, 7 aa, Cryptosporidium parvum
RREKVEK

SEQ ID NO: 2278925 - protein, 6 aa, Cryptosporidium parvum
RRENFE

SEQ ID NO: 2278926 - protein, 15 aa, Cryptosporidium parvum
RRENMDNKARNAPIL

SEQ ID NO: 2278927 - protein, 7 aa, Cryptosporidium parvum
RRERETV

SEQ ID NO: 2278928 - protein, 4 aa, Cryptosporidium parvum
RRES

SEQ ID NO: 2278929 - protein, 5 aa, Cryptosporidium parvum
RRETI

SEQ ID NO: 2278930 - protein, 6 aa, Cryptosporidium parvum
RRFTPG

SEQ ID NO: 2278931 - protein, 8 aa, Cryptosporidium parvum
RRGATVDK

SEQ ID NO: 2278932 - protein, 10 aa, Cryptosporidium parvum
RRGDRKKRVA

SEQ ID NO: 2278933 - protein, 9 aa, Cryptosporidium parvum
RRGITEKGG

SEQ ID NO: 2278934 - protein, 6 aa, Cryptosporidium parvum
RRGPPI

SEQ ID NO: 2278935 - protein, 6 aa, Cryptosporidium parvum
RRGPTQ

SEQ ID NO: 2278936 - protein, 6 aa, Cryptosporidium parvum
RRGRGG

SEQ ID NO: 2278937 - protein, 9 aa, Cryptosporidium parvum
RRGRSPSLS

SEQ ID NO: 2278938 - protein, 6 aa, Cryptosporidium parvum
RRGSSL

SEQ ID NO: 2278939 - protein, 4 aa, Cryptosporidium parvum
RRGY

SEQ ID NO: 2278940 - protein, 8 aa, Cryptosporidium parvum
RRGYTESN

SEQ ID NO: 2278941 - protein, 14 aa, Cryptosporidium parvum
RRHPGGRGRNSRGT

SEQ ID NO: 2278942 - protein, 11 aa, Cryptosporidium parvum
RRHSERDGYNN

SEQ ID NO: 2278943 - protein, 6 aa, Cryptosporidium parvum
RRHSNE

SEQ ID NO: 2278944 - protein, 21 aa, Cryptosporidium parvum
RRIENEQRKLKGETPLPIDTE

SEQ ID NO: 2278945 - protein, 4 aa, Cryptosporidium parvum
RRIR

SEQ ID NO: 2278946 - protein, 8 aa, Cryptosporidium parvum
RRKEENSL

SEQ ID NO: 2278947 - protein, 13 aa, Cryptosporidium parvum
RRKGKAVDNSTQA

SEQ ID NO: 2278948 - protein, 8 aa, Cryptosporidium parvum
RRKGLSDD

SEQ ID NO: 2278949 - protein, 26 aa, Cryptosporidium parvum
RRKKELEEDFEERKKSLESTFNERAS

SEQ ID NO: 2278950 - protein, 5 aa, Cryptosporidium parvum
RRKKV

SEQ ID NO: 2278951 - protein, 22 aa, Cryptosporidium parvum
RRKNAKNQKKKQNDDDDDDEYK

SEQ ID NO: 2278952 - protein, 10 aa, Cryptosporidium parvum
RRKNKSSKKI

SEQ ID NO: 2278953 - protein, 9 aa, Cryptosporidium parvum
RRKPSLKEN

SEQ ID NO: 2278954 - protein, 6 aa, Cryptosporidium parvum
RRKSDG

SEQ ID NO: 2278955 - protein, 8 aa, Cryptosporidium parvum
RRKSPETM

SEQ ID NO: 2278956 - protein, 7 aa, Cryptosporidium parvum
RRKTACE

SEQ ID NO: 2278957 - protein, 5 aa, Cryptosporidium parvum
RRKTI

SEQ ID NO: 2278958 - protein, 9 aa, Cryptosporidium parvum
RRKVEEGGA

SEQ ID NO: 2278959 - protein, 6 aa, Cryptosporidium parvum
RRNEAI

SEQ ID NO: 2278960 - protein, 6 aa, Cryptosporidium parvum
RRNGYI

SEQ ID NO: 2278961 - protein, 7 aa, Cryptosporidium parvum
RRNHPEN

SEQ ID NO: 2278962 - protein, 5 aa, Cryptosporidium parvum
RRNKN

SEQ ID NO: 2278963 - protein, 29 aa, Cryptosporidium parvum
RRNKNEEKEEEEDEEEEEEEEDEEGKEIE

SEQ ID NO: 2278964 - protein, 18 aa, Cryptosporidium parvum
RRNKNNHHLSKSDREEKL

SEQ ID NO: 2278965 - protein, 8 aa, Cryptosporidium parvum
RRNKSKGL

SEQ ID NO: 2278966 - protein, 7 aa, Cryptosporidium parvum
RRNNTQY

SEQ ID NO: 2278967 - protein, 6 aa, Cryptosporidium parvum
RRNPGI

SEQ ID NO: 2278968 - protein, 8 aa, Cryptosporidium parvum
RRNPNDHY

SEQ ID NO: 2278969 - protein, 10 aa, Cryptosporidium parvum
RRNPTKYKYS

SEQ ID NO: 2278970 - protein, 18 aa, Cryptosporidium parvum
RRNRYIPSDEEYQEEESS

SEQ ID NO: 2278971 - protein, 4 aa, Cryptosporidium parvum
RRNT

SEQ ID NO: 2278972 - protein, 6 aa, Cryptosporidium parvum
RRPGDL

SEQ ID NO: 2278973 - protein, 9 aa, Cryptosporidium parvum
RRPGSESSF

SEQ ID NO: 2278974 - protein, 4 aa, Cryptosporidium parvum
RRPR

SEQ ID NO: 2278975 - protein, 10 aa, Cryptosporidium parvum
RRPREPRVTQ

SEQ ID NO: 2278976 - protein, 12 aa, Cryptosporidium parvum
RRPRRNNKETLE

SEQ ID NO: 2278977 - protein, 10 aa, Cryptosporidium parvum
RRPSKTYSDV

SEQ ID NO: 2278978 - protein, 9 aa, Cryptosporidium parvum
RRPSPSPQL

SEQ ID NO: 2278979 - protein, 9 aa, Cryptosporidium parvum
RRQLPSKNI

SEQ ID NO: 2278980 - protein, 4 aa, Cryptosporidium parvum
RRQN

SEQ ID NO: 2278981 - protein, 10 aa, Cryptosporidium parvum
RRQQDSKDFQ

SEQ ID NO: 2278982 - protein, 6 aa, Cryptosporidium parvum
RRQSGH

SEQ ID NO: 2278983 - protein, 13 aa, Cryptosporidium parvum
RRRAGNASKGGFR

SEQ ID NO: 2278984 - protein, 13 aa, Cryptosporidium parvum
RRRALGNSPDPSI

SEQ ID NO: 2278985 - protein, 6 aa, Cryptosporidium parvum
RRRDDP

SEQ ID NO: 2278986 - protein, 5 aa, Cryptosporidium parvum
RRRDI

SEQ ID NO: 2278987 - protein, 5 aa, Cryptosporidium parvum
RRRDL

SEQ ID NO: 2278988 - protein, 6 aa, Cryptosporidium parvum
RRRDSI

SEQ ID NO: 2278989 - protein, 7 aa, Cryptosporidium parvum
RRREEEI

SEQ ID NO: 2278990 - protein, 21 aa, Cryptosporidium parvum
RRREKLEQKSLKEYDDGFEEP

SEQ ID NO: 2278991 - protein, 13 aa, Cryptosporidium parvum
RRRGKNDSEGDKR

SEQ ID NO: 2278992 - protein, 12 aa, Cryptosporidium parvum
RRRGRRRRPGKL

SEQ ID NO: 2278993 - protein, 10 aa, Cryptosporidium parvum
RRRGTSQRDR

SEQ ID NO: 2278994 - protein, 4 aa, Cryptosporidium parvum
RRRL

SEQ ID NO: 2278995 - protein, 23 aa, Cryptosporidium parvum
RRRLTPTSINSSLSSNNIIDDNN

SEQ ID NO: 2278996 - protein, 8 aa, Cryptosporidium parvum
RRRQREMN

SEQ ID NO: 2278997 - protein, 6 aa, Cryptosporidium parvum
RRRQSE

SEQ ID NO: 2278998 - protein, 18 aa, Cryptosporidium parvum
RRRRAKTTSVDAKNNTFK

SEQ ID NO: 2278999 - protein, 21 aa, Cryptosporidium parvum
RRRRTNNRRNNTSRANNSNLD

SEQ ID NO: 2279000 - protein, 8 aa, Cryptosporidium parvum
RRRSIKGG

SEQ ID NO: 2279001 - protein, 6 aa, Cryptosporidium parvum
RRSENQ

SEQ ID NO: 2279002 - protein, 17 aa, Cryptosporidium parvum
RRSGFGQDQRIQSHPNQ

SEQ ID NO: 2279003 - protein, 21 aa, Cryptosporidium parvum
RRSGSDQKTSGSQKPKGLQSE

SEQ ID NO: 2279004 - protein, 11 aa, Cryptosporidium parvum
RRSKNKIKNGM

SEQ ID NO: 2279005 - protein, 7 aa, Cryptosporidium parvum
RRSSDGC

SEQ ID NO: 2279006 - protein, 9 aa, Cryptosporidium parvum
RRSSQQSFE

SEQ ID NO: 2279007 - protein, 23 aa, Cryptosporidium parvum
RRSSRNSNKVQSSERNNAESEFS

SEQ ID NO: 2279008 - protein, 14 aa, Cryptosporidium parvum
RRSSSISSNCNSNG

SEQ ID NO: 2279009 - protein, 7 aa, Cryptosporidium parvum
RRSVNSD

SEQ ID NO: 2279010 - protein, 9 aa, Cryptosporidium parvum
RRTDLSEET

SEQ ID NO: 2279011 - protein, 4 aa, Cryptosporidium parvum
RRTG

SEQ ID NO: 2279012 - protein, 25 aa, Cryptosporidium parvum
RRTGSIASSTAGAFGNKYRAPSISG

SEQ ID NO: 2279013 - protein, 7 aa, Cryptosporidium parvum
RRTGTGM

SEQ ID NO: 2279014 - protein, 7 aa, Cryptosporidium parvum
RRTNATY

SEQ ID NO: 2279015 - protein, 5 aa, Cryptosporidium parvum
RRTVE

SEQ ID NO: 2279016 - protein, 5 aa, Cryptosporidium parvum
RRVHS

SEQ ID NO: 2279017 - protein, 16 aa, Cryptosporidium parvum
RRVNPEDVERCEEKYS

SEQ ID NO: 2279018 - protein, 29 aa, Cryptosporidium parvum
RRYEQKEGGEVSEAERETEFGSSEVTSSV

SEQ ID NO: 2279019 - protein, 8 aa, Cryptosporidium parvum
RRYSGGEM

SEQ ID NO: 2279020 - protein, 8 aa, Cryptosporidium parvum
RSADEGTT

SEQ ID NO: 2279021 - protein, 6 aa, Cryptosporidium parvum
RSAENI

SEQ ID NO: 2279022 - protein, 21 aa, Cryptosporidium parvum
RSAGKLKKSAISENKEALDDP

SEQ ID NO: 2279023 - protein, 7 aa, Cryptosporidium parvum
RSAMPSQ

SEQ ID NO: 2279024 - protein, 5 aa, Cryptosporidium parvum
RSAQQ

SEQ ID NO: 2279025 - protein, 13 aa, Cryptosporidium parvum
RSASLTAPNGPAQ

SEQ ID NO: 2279026 - protein, 21 aa, Cryptosporidium parvum
RSASNKSISPSKSKKSPIKSI

SEQ ID NO: 2279027 - protein, 11 aa, Cryptosporidium parvum
RSATSEFSTTT

SEQ ID NO: 2279028 - protein, 10 aa, Cryptosporidium parvum
RSCSSSNNIK

SEQ ID NO: 2279029 - protein, 9 aa, Cryptosporidium parvum
RSDEDGSVS

SEQ ID NO: 2279030 - protein, 9 aa, Cryptosporidium parvum
RSDEGEDLE

SEQ ID NO: 2279031 - protein, 9 aa, Cryptosporidium parvum
RSDFPSRPL

SEQ ID NO: 2279032 - protein, 5 aa, Cryptosporidium parvum
RSDIP

SEQ ID NO: 2279033 - protein, 9 aa, Cryptosporidium parvum
RSDIPGDTI

SEQ ID NO: 2279034 - protein, 7 aa, Cryptosporidium parvum
RSDITGR

SEQ ID NO: 2279035 - protein, 11 aa, Cryptosporidium parvum
RSDKNSPNDIN

SEQ ID NO: 2279036 - protein, 12 aa, Cryptosporidium parvum
RSDKPRNLNYDL

SEQ ID NO: 2279037 - protein, 9 aa, Cryptosporidium parvum
RSDKSGWSK

SEQ ID NO: 2279038 - protein, 6 aa, Cryptosporidium parvum
RSDRPS

SEQ ID NO: 2279039 - protein, 6 aa, Cryptosporidium parvum
RSDSFT

SEQ ID NO: 2279040 - protein, 6 aa, Cryptosporidium parvum
RSDTSS

SEQ ID NO: 2279041 - protein, 6 aa, Cryptosporidium parvum
RSEAPK

SEQ ID NO: 2279042 - protein, 8 aa, Cryptosporidium parvum
RSEASSET

SEQ ID NO: 2279043 - protein, 7 aa, Cryptosporidium parvum
RSEAVSL

SEQ ID NO: 2279044 - protein, 35 aa, Cryptosporidium parvum
RSEDFESDNYTDSREEDNSDNYFNSQDDLEDDYDN

SEQ ID NO: 2279045 - protein, 5 aa, Cryptosporidium parvum
RSEDQ

SEQ ID NO: 2279046 - protein, 18 aa, Cryptosporidium parvum
RSEDTNKNHEKKQDSFQK

SEQ ID NO: 2279047 - protein, 6 aa, Cryptosporidium parvum
RSEEVR

SEQ ID NO: 2279048 - protein, 5 aa, Cryptosporidium parvum
RSEGG

SEQ ID NO: 2279049 - protein, 12 aa, Cryptosporidium parvum
RSEGTSEPKDIS

SEQ ID NO: 2279050 - protein, 11 aa, Cryptosporidium parvum
RSEHEKYQSME

SEQ ID NO: 2279051 - protein, 8 aa, Cryptosporidium parvum
RSEIGGKK

SEQ ID NO: 2279052 - protein, 6 aa, Cryptosporidium parvum
RSEIKH

SEQ ID NO: 2279053 - protein, 22 aa, Cryptosporidium parvum
RSEKRKLRKERRSTRKVVETSA

SEQ ID NO: 2279054 - protein, 7 aa, Cryptosporidium parvum
RSENIDN

SEQ ID NO: 2279055 - protein, 23 aa, Cryptosporidium parvum
RSEPPTQATYSYSSSTQPGINNG

SEQ ID NO: 2279056 - protein, 20 aa, Cryptosporidium parvum
RSEQEKRQKQTQLTEKEAEC

SEQ ID NO: 2279057 - protein, 7 aa, Cryptosporidium parvum
RSERSQL

SEQ ID NO: 2279058 - protein, 8 aa, Cryptosporidium parvum
RSERVKEE

SEQ ID NO: 2279059 - protein, 4 aa, Cryptosporidium parvum
RSES

SEQ ID NO: 2279060 - protein, 8 aa, Cryptosporidium parvum
RSESKKEY

SEQ ID NO: 2279061 - protein, 15 aa, Cryptosporidium parvum
RSESNADASYNKAGD

SEQ ID NO: 2279062 - protein, 6 aa, Cryptosporidium parvum
RSFDPS

SEQ ID NO: 2279063 - protein, 7 aa, Cryptosporidium parvum
RSFEENK

SEQ ID NO: 2279064 - protein, 31 aa, Cryptosporidium parvum
RSFENSPEDEADNAGEEDDNSENVETLGENR

SEQ ID NO: 2279065 - protein, 14 aa, Cryptosporidium parvum
RSFKNSSGINLEKS

SEQ ID NO: 2279066 - protein, 26 aa, Cryptosporidium parvum
RSFQDNIEKGQKTNKKQLSIKSSQKY

SEQ ID NO: 2279067 - protein, 6 aa, Cryptosporidium parvum
RSFSEN

SEQ ID NO: 2279068 - protein, 6 aa, Cryptosporidium parvum
RSFSNN

SEQ ID NO: 2279069 - protein, 12 aa, Cryptosporidium parvum
RSFTRSKDYDAV

SEQ ID NO: 2279070 - protein, 16 aa, Cryptosporidium parvum
RSGCGKASKNQTEEEI

SEQ ID NO: 2279071 - protein, 10 aa, Cryptosporidium parvum
RSGDKERGRM

SEQ ID NO: 2279072 - protein, 5 aa, Cryptosporidium parvum
RSGDM

SEQ ID NO: 2279073 - protein, 13 aa, Cryptosporidium parvum
RSGEKIKSKRRKE

SEQ ID NO: 2279074 - protein, 21 aa, Cryptosporidium parvum
RSGGGGNNTNNNMSISGRNAN

SEQ ID NO: 2279075 - protein, 70 aa, Cryptosporidium parvum
RSGNDSKKIRSKVNNLSNNKEFSNSLNKRETSSRFNSSSSLTQSTRTESKQKPSLLKKSTSNNEASRNLS

SEQ ID NO: 2279076 - protein, 7 aa, Cryptosporidium parvum
RSGNLTP

SEQ ID NO: 2279077 - protein, 8 aa, Cryptosporidium parvum
RSGNTQEG

SEQ ID NO: 2279078 - protein, 9 aa, Cryptosporidium parvum
RSGRFGKKG

SEQ ID NO: 2279079 - protein, 11 aa, Cryptosporidium parvum
RSGRGYKNEIE

SEQ ID NO: 2279080 - protein, 7 aa, Cryptosporidium parvum
RSGRPGI

SEQ ID NO: 2279081 - protein, 9 aa, Cryptosporidium parvum
RSGRPQYDS

SEQ ID NO: 2279082 - protein, 9 aa, Cryptosporidium parvum
RSGSPSFQG

SEQ ID NO: 2279083 - protein, 5 aa, Cryptosporidium parvum
RSGSS

SEQ ID NO: 2279084 - protein, 4 aa, Cryptosporidium parvum
RSGT

SEQ ID NO: 2279085 - protein, 6 aa, Cryptosporidium parvum
RSGTYH

SEQ ID NO: 2279086 - protein, 12 aa, Cryptosporidium parvum
RSGVIGGRGGLD

SEQ ID NO: 2279087 - protein, 16 aa, Cryptosporidium parvum
RSHGGEGLPEDFESPD

SEQ ID NO: 2279088 - protein, 4 aa, Cryptosporidium parvum
RSIA

SEQ ID NO: 2279089 - protein, 12 aa, Cryptosporidium parvum
RSIAEGEETEVV

SEQ ID NO: 2279090 - protein, 13 aa, Cryptosporidium parvum
RSIEKAEKLQNST

SEQ ID NO: 2279091 - protein, 4 aa, Cryptosporidium parvum
RSIG

SEQ ID NO: 2279092 - protein, 19 aa, Cryptosporidium parvum
RSIHSTKSPSELDDEQNED

SEQ ID NO: 2279093 - protein, 5 aa, Cryptosporidium parvum
RSIKS

SEQ ID NO: 2279094 - protein, 26 aa, Cryptosporidium parvum
RSINKEKSLANKKDQKQTETTGSESR

SEQ ID NO: 2279095 - protein, 6 aa, Cryptosporidium parvum
RSINNE

SEQ ID NO: 2279096 - protein, 9 aa, Cryptosporidium parvum
RSIPNSAEF

SEQ ID NO: 2279097 - protein, 9 aa, Cryptosporidium parvum
RSISNGSNP

SEQ ID NO: 2279098 - protein, 5 aa, Cryptosporidium parvum
RSITN

SEQ ID NO: 2279099 - protein, 7 aa, Cryptosporidium parvum
RSKAAQD

SEQ ID NO: 2279100 - protein, 9 aa, Cryptosporidium parvum
RSKDEHSSI

SEQ ID NO: 2279101 - protein, 6 aa, Cryptosporidium parvum
RSKEEL

SEQ ID NO: 2279102 - protein, 15 aa, Cryptosporidium parvum
RSKFQKSYTECSDYT

SEQ ID NO: 2279103 - protein, 11 aa, Cryptosporidium parvum
RSKFSKGFRQK

SEQ ID NO: 2279104 - protein, 5 aa, Cryptosporidium parvum
RSKGI

SEQ ID NO: 2279105 - protein, 9 aa, Cryptosporidium parvum
RSKGNGFSE

SEQ ID NO: 2279106 - protein, 10 aa, Cryptosporidium parvum
RSKKNGHSRG

SEQ ID NO: 2279107 - protein, 23 aa, Cryptosporidium parvum
RSKKNNNQRNSSSSYSSKNSTTI

SEQ ID NO: 2279108 - protein, 10 aa, Cryptosporidium parvum
RSKKNSNNDY

SEQ ID NO: 2279109 - protein, 4 aa, Cryptosporidium parvum
RSKM

SEQ ID NO: 2279110 - protein, 8 aa, Cryptosporidium parvum
RSKRKAFT

SEQ ID NO: 2279111 - protein, 6 aa, Cryptosporidium parvum
RSKSDG

SEQ ID NO: 2279112 - protein, 7 aa, Cryptosporidium parvum
RSKSRRN

SEQ ID NO: 2279113 - protein, 5 aa, Cryptosporidium parvum
RSKSV

SEQ ID NO: 2279114 - protein, 7 aa, Cryptosporidium parvum
RSKTGSN

SEQ ID NO: 2279115 - protein, 13 aa, Cryptosporidium parvum
RSKVGKHGRVTKD

SEQ ID NO: 2279116 - protein, 5 aa, Cryptosporidium parvum
RSKYK

SEQ ID NO: 2279117 - protein, 14 aa, Cryptosporidium parvum
RSKYNSGNQGVQRK

SEQ ID NO: 2279118 - protein, 10 aa, Cryptosporidium parvum
RSLEEGSREV

SEQ ID NO: 2279119 - protein, 6 aa, Cryptosporidium parvum
RSLEKN

SEQ ID NO: 2279120 - protein, 6 aa, Cryptosporidium parvum
RSLGAC

SEQ ID NO: 2279121 - protein, 6 aa, Cryptosporidium parvum
RSLHRP

SEQ ID NO: 2279122 - protein, 9 aa, Cryptosporidium parvum
RSLRGRKKN

SEQ ID NO: 2279123 - protein, 6 aa, Cryptosporidium parvum
RSLRND

SEQ ID NO: 2279124 - protein, 7 aa, Cryptosporidium parvum
RSLSDSH

SEQ ID NO: 2279125 - protein, 20 aa, Cryptosporidium parvum
RSLSTYNSQLKSNNVGGVNG

SEQ ID NO: 2279126 - protein, 6 aa, Cryptosporidium parvum
RSLTPD

SEQ ID NO: 2279127 - protein, 14 aa, Cryptosporidium parvum
RSMDRREADLKERD

SEQ ID NO: 2279128 - protein, 8 aa, Cryptosporidium parvum
RSNDNSVK

SEQ ID NO: 2279129 - protein, 12 aa, Cryptosporidium parvum
RSNEANRKNGGS

SEQ ID NO: 2279130 - protein, 6 aa, Cryptosporidium parvum
RSNEIH

SEQ ID NO: 2279131 - protein, 8 aa, Cryptosporidium parvum
RSNENMSS

SEQ ID NO: 2279132 - protein, 6 aa, Cryptosporidium parvum
RSNGAT

SEQ ID NO: 2279133 - protein, 11 aa, Cryptosporidium parvum
RSNGTSKEDIE

SEQ ID NO: 2279134 - protein, 13 aa, Cryptosporidium parvum
RSNHKDPITTSSV

SEQ ID NO: 2279135 - protein, 9 aa, Cryptosporidium parvum
RSNNEKSID

SEQ ID NO: 2279136 - protein, 12 aa, Cryptosporidium parvum
RSNNPSQLVSDK

SEQ ID NO: 2279137 - protein, 8 aa, Cryptosporidium parvum
RSNPDNQG

SEQ ID NO: 2279138 - protein, 7 aa, Cryptosporidium parvum
RSNPENL

SEQ ID NO: 2279139 - protein, 6 aa, Cryptosporidium parvum
RSNREY

SEQ ID NO: 2279140 - protein, 21 aa, Cryptosporidium parvum
RSNRKTNNGEDERYEEEEEKK

SEQ ID NO: 2279141 - protein, 8 aa, Cryptosporidium parvum
RSNRNHGD

SEQ ID NO: 2279142 - protein, 4 aa, Cryptosporidium parvum
RSNS

SEQ ID NO: 2279143 - protein, 6 aa, Cryptosporidium parvum
RSNSES

SEQ ID NO: 2279144 - protein, 6 aa, Cryptosporidium parvum
RSNSME

SEQ ID NO: 2279145 - protein, 7 aa, Cryptosporidium parvum
RSNSNIG

SEQ ID NO: 2279146 - protein, 8 aa, Cryptosporidium parvum
RSNSNSGF

SEQ ID NO: 2279147 - protein, 11 aa, Cryptosporidium parvum
RSNTNSKGFAG

SEQ ID NO: 2279148 - protein, 5 aa, Cryptosporidium parvum
RSNYN

SEQ ID NO: 2279149 - protein, 7 aa, Cryptosporidium parvum
RSPDGEQ

SEQ ID NO: 2279150 - protein, 10 aa, Cryptosporidium parvum
RSPESGVSKG

SEQ ID NO: 2279151 - protein, 4 aa, Cryptosporidium parvum
RSPL

SEQ ID NO: 2279152 - protein, 7 aa, Cryptosporidium parvum
RSPNENN

SEQ ID NO: 2279153 - protein, 38 aa, Cryptosporidium parvum
RSPRNSYSKYKSLSSELRDAGYSQDNELDENEQSPLIE

SEQ ID NO: 2279154 - protein, 33 aa, Cryptosporidium parvum; identical to SEQ ID NO: 2159755

SEQ ID NO: 2279155 - protein, 4 aa, Cryptosporidium parvum
RSPY

SEQ ID NO: 2279156 - protein, 6 aa, Cryptosporidium parvum
RSQENN

SEQ ID NO: 2279157 - protein, 8 aa, Cryptosporidium parvum
RSQETSQI

SEQ ID NO: 2279158 - protein, 7 aa, Cryptosporidium parvum
RSQGKQA

SEQ ID NO: 2279159 - protein, 6 aa, Cryptosporidium parvum
RSQKPV

SEQ ID NO: 2279160 - protein, 15 aa, Cryptosporidium parvum
RSQNEGKLKDTGTVI

SEQ ID NO: 2279161 - protein, 8 aa, Cryptosporidium parvum
RSQNGNDQ

SEQ ID NO: 2279162 - protein, 10 aa, Cryptosporidium parvum
RSQNNAVTGS

SEQ ID NO: 2279163 - protein, 6 aa, Cryptosporidium parvum
RSQNSV

SEQ ID NO: 2279164 - protein, 7 aa, Cryptosporidium parvum
RSQPDRE

SEQ ID NO: 2279165 - protein, 6 aa, Cryptosporidium parvum
RSQVSN

SEQ ID NO: 2279166 - protein, 12 aa, Cryptosporidium parvum
RSRNNGNNSNSN

SEQ ID NO: 2279167 - protein, 14 aa, Cryptosporidium parvum
RSRRGSINSDHNSK

SEQ ID NO: 2279168 - protein, 21 aa, Cryptosporidium parvum
RSRSSFPETIPKGISNGSFPT

SEQ ID NO: 2279169 - protein, 5 aa, Cryptosporidium parvum
RSRTQ

SEQ ID NO: 2279170 - protein, 7 aa, Cryptosporidium parvum
RSRTTGF

SEQ ID NO: 2279171 - protein, 6 aa, Cryptosporidium parvum
RSSCHR

SEQ ID NO: 2279172 - protein, 7 aa, Cryptosporidium parvum
RSSDSNS

SEQ ID NO: 2279173 - protein, 7 aa, Cryptosporidium parvum
RSSDVPN

SEQ ID NO: 2279174 - protein, 8 aa, Cryptosporidium parvum
RSSELEER

SEQ ID NO: 2279175 - protein, 11 aa, Cryptosporidium parvum
RSSELNKTSND

SEQ ID NO: 2279176 - protein, 5 aa, Cryptosporidium parvum
RSSFE

SEQ ID NO: 2279177 - protein, 7 aa, Cryptosporidium parvum
RSSKARP

SEQ ID NO: 2279178 - protein, 6 aa, Cryptosporidium parvum
RSSKLE

SEQ ID NO: 2279179 - protein, 15 aa, Cryptosporidium parvum
RSSKLSDEKGGGSLT

SEQ ID NO: 2279180 - protein, 4 aa, Cryptosporidium parvum
RSSL

SEQ ID NO: 2279181 - protein, 27 aa, Cryptosporidium parvum
RSSLGSANDDLELPKSACNSNKTVNQA

SEQ ID NO: 2279182 - protein, 7 aa, Cryptosporidium parvum
RSSLNAD

SEQ ID NO: 2279183 - protein, 18 aa, Cryptosporidium parvum
RSSLTKKSNKNHQKLKEN

SEQ ID NO: 2279184 - protein, 6 aa, Cryptosporidium parvum
RSSNDI

SEQ ID NO: 2279185 - protein, 5 aa, Cryptosporidium parvum
RSSNN

SEQ ID NO: 2279186 - protein, 6 aa, Cryptosporidium parvum
RSSNVT

SEQ ID NO: 2279187 - protein, 7 aa, Cryptosporidium parvum
RSSSFPK

SEQ ID NO: 2279188 - protein, 24 aa, Cryptosporidium parvum
RSSSNESFNDQSQGKGIQMRPPDV

SEQ ID NO: 2279189 - protein, 5 aa, Cryptosporidium parvum
RSSSS

SEQ ID NO: 2279190 - protein, 15 aa, Cryptosporidium parvum
RSSSSSECNDSAAEM

SEQ ID NO: 2279191 - protein, 5 aa, Cryptosporidium parvum
RSSTI

SEQ ID NO: 2279192 - protein, 7 aa, Cryptosporidium parvum
RSSTKPI

SEQ ID NO: 2279193 - protein, 14 aa, Cryptosporidium parvum
RSSTLEGNSEVQTT

SEQ ID NO: 2279194 - protein, 7 aa, Cryptosporidium parvum
RSSTLSH

SEQ ID NO: 2279195 - protein, 7 aa, Cryptosporidium parvum
RSSTNSN

SEQ ID NO: 2279196 - protein, 10 aa, Cryptosporidium parvum
RSSTSIGRSN

SEQ ID NO: 2279197 - protein, 4 aa, Cryptosporidium parvum
RSSV

SEQ ID NO: 2279198 - protein, 16 aa, Cryptosporidium parvum
RSSVGDGIQNPDSSHL

SEQ ID NO: 2279199 - protein, 7 aa, Cryptosporidium parvum
RSTAINK

SEQ ID NO: 2279200 - protein, 8 aa, Cryptosporidium parvum
RSTGEKEY

SEQ ID NO: 2279201 - protein, 14 aa, Cryptosporidium parvum
RSTIDQPKSDIPLS

SEQ ID NO: 2279202 - protein, 5 aa, Cryptosporidium parvum
RSTPD

SEQ ID NO: 2279203 - protein, 5 aa, Cryptosporidium parvum
RSTPL

SEQ ID NO: 2279204 - protein, 11 aa, Cryptosporidium parvum
RSTRLSNDTMD

SEQ ID NO: 2279205 - protein, 7 aa, Cryptosporidium parvum
RSTSQTM

SEQ ID NO: 2279206 - protein, 4 aa, Cryptosporidium parvum
RSVE

SEQ ID NO: 2279207 - protein, 138 aa, Cryptosporidium parvum
RSVENSRGGRHRDDENMDKGKNDDQNNSQWEREREKERDRDRERDRERDRDRDRDRDRDRDRDRERDRERDRERDRERDRDRERDRDRERDRERDRDRYKEKIKDRGYMEKKRSKGYRSKRRSSSVSSDDSDLPPRRY

SEQ ID NO: 2279208 - protein, 17 aa, Cryptosporidium parvum
RSVGREAFDRKKSEFQA

SEQ ID NO: 2279209 - protein, 11 aa, Cryptosporidium parvum
RSVPKQHESSM

SEQ ID NO: 2279210 - protein, 8 aa, Cryptosporidium parvum
RSVSKTCQ

SEQ ID NO: 2279211 - protein, 19 aa, Cryptosporidium parvum
RSVSPGREFNSKPQPEKQI

SEQ ID NO: 2279212 - protein, 17 aa, Cryptosporidium parvum
RSWTNKRIGKENNSSHA

SEQ ID NO: 2279213 - protein, 11 aa, Cryptosporidium parvum
RSYDSRGSSIT

SEQ ID NO: 2279214 - protein, 9 aa, Cryptosporidium parvum
RSYKQNNSK

SEQ ID NO: 2279215 - protein, 14 aa, Cryptosporidium parvum
RSYSISSSSLASPS

SEQ ID NO: 2279216 - protein, 7 aa, Cryptosporidium parvum
RSYSSVA

SEQ ID NO: 2279217 - protein, 8 aa, Cryptosporidium parvum
RSYYKDND

SEQ ID NO: 2279218 - protein, 4 aa, Cryptosporidium parvum
RTAL

SEQ ID NO: 2279219 - protein, 5 aa, Cryptosporidium parvum
RTANA

SEQ ID NO: 2279220 - protein, 9 aa, Cryptosporidium parvum
RTARAGKLG

SEQ ID NO: 2279221 - protein, 11 aa, Cryptosporidium parvum
RTARAGRSGRA

SEQ ID NO: 2279222 - protein, 11 aa, Cryptosporidium parvum
RTARGAGGTGK

SEQ ID NO: 2279223 - protein, 10 aa, Cryptosporidium parvum
RTARGGSSGV

SEQ ID NO: 2279224 - protein, 16 aa, Cryptosporidium parvum
RTARRVNNSEHSEELK

SEQ ID NO: 2279225 - protein, 4 aa, Cryptosporidium parvum
RTDH

SEQ ID NO: 2279226 - protein, 5 aa, Cryptosporidium parvum
RTDNE

SEQ ID NO: 2279227 - protein, 5 aa, Cryptosporidium parvum
RTDNR

SEQ ID NO: 2279228 - protein, 10 aa, Cryptosporidium parvum
RTDRGVHSAG

SEQ ID NO: 2279229 - protein, 7 aa, Cryptosporidium parvum
RTDSSFN

SEQ ID NO: 2279230 - protein, 4 aa, Cryptosporidium parvum
RTDY

SEQ ID NO: 2279231 - protein, 18 aa, Cryptosporidium parvum
RTEDKEYFKPKGKSEKVH

SEQ ID NO: 2279232 - protein, 11 aa, Cryptosporidium parvum
RTEEDIGNESK

SEQ ID NO: 2279233 - protein, 4 aa, Cryptosporidium parvum
RTEL

SEQ ID NO: 2279234 - protein, 13 aa, Cryptosporidium parvum
RTENSYNTNLQSE

SEQ ID NO: 2279235 - protein, 5 aa, Cryptosporidium parvum
RTERR

SEQ ID NO: 2279236 - protein, 10 aa, Cryptosporidium parvum
RTESKCPETL

SEQ ID NO: 2279237 - protein, 19 aa, Cryptosporidium parvum
RTETGKFESLTETGELKKE

SEQ ID NO: 2279238 - protein, 5 aa, Cryptosporidium parvum
RTGDG

SEQ ID NO: 2279239 - protein, 35 aa, Cryptosporidium parvum
RTGLPKSPKIKTRTLSNTKKAMDSEKEQKKTPIRA

SEQ ID NO: 2279240 - protein, 8 aa, Cryptosporidium parvum
RTGQNEQS

SEQ ID NO: 2279241 - protein, 9 aa, Cryptosporidium parvum
RTGRAGATG

SEQ ID NO: 2279242 - protein, 9 aa, Cryptosporidium parvum
RTGRAGNFG

SEQ ID NO: 2279243 - protein, 7 aa, Cryptosporidium parvum
RTGSGKR

SEQ ID NO: 2279244 - protein, 9 aa, Cryptosporidium parvum
RTGSGKTAG

SEQ ID NO: 2279245 - protein, 17 aa, Cryptosporidium parvum
RTHAPRPPLKEENKGKQ

SEQ ID NO: 2279246 - protein, 6 aa, Cryptosporidium parvum
RTHNNI

SEQ ID NO: 2279247 - protein, 6 aa, Cryptosporidium parvum
RTHPTM

SEQ ID NO: 2279248 - protein, 6 aa, Cryptosporidium parvum
RTHSQL

SEQ ID NO: 2279249 - protein, 4 aa, Cryptosporidium parvum
RTID

SEQ ID NO: 2279250 - protein, 9 aa, Cryptosporidium parvum
RTIDPNAND

SEQ ID NO: 2279251 - protein, 9 aa, Cryptosporidium parvum
RTIENTREI

SEQ ID NO: 2279252 - protein, 6 aa, Cryptosporidium parvum
RTIGTE

SEQ ID NO: 2279253 - protein, 4 aa, Cryptosporidium parvum
RTIK

SEQ ID NO: 2279254 - protein, 7 aa, Cryptosporidium parvum
RTIPQAE

SEQ ID NO: 2279255 - protein, 8 aa, Cryptosporidium parvum
RTIQSTKA

SEQ ID NO: 2279256 - protein, 7 aa, Cryptosporidium parvum
RTISETP

SEQ ID NO: 2279257 - protein, 7 aa, Cryptosporidium parvum
RTKINGS

SEQ ID NO: 2279258 - protein, 7 aa, Cryptosporidium parvum
RTKLEPA

SEQ ID NO: 2279259 - protein, 12 aa, Cryptosporidium parvum
RTKRGNRADSMG

SEQ ID NO: 2279260 - protein, 16 aa, Cryptosporidium parvum
RTKTTERLADGTVRET

SEQ ID NO: 2279261 - protein, 20 aa, Cryptosporidium parvum
RTLSRRNTFEDGSNDNSIIP

SEQ ID NO: 2279262 - protein, 5 aa, Cryptosporidium parvum
RTMNE

SEQ ID NO: 2279263 - protein, 7 aa, Cryptosporidium parvum
RTNDDEA

SEQ ID NO: 2279264 - protein, 6 aa, Cryptosporidium parvum
RTNDRN

SEQ ID NO: 2279265 - protein, 4 aa, Cryptosporidium parvum
RTNE

SEQ ID NO: 2279266 - protein, 5 aa, Cryptosporidium parvum
RTNGT

SEQ ID NO: 2279267 - protein, 11 aa, Cryptosporidium parvum
RTNKNESPREV

SEQ ID NO: 2279268 - protein, 4 aa, Cryptosporidium parvum
RTNL

SEQ ID NO: 2279269 - protein, 5 aa, Cryptosporidium parvum
RTNND

SEQ ID NO: 2279270 - protein, 74 aa, Cryptosporidium parvum
RTNQTSTTSVSDVNTALSSSNMNNSNDKADSKKKFNINNNQSSSYNNNNNNNNNNNSNNNGSNNNNSGTARQNK

SEQ ID NO: 2279271 - protein, 6 aa, Cryptosporidium parvum
RTNRHN

SEQ ID NO: 2279272 - protein, 8 aa, Cryptosporidium parvum
RTPGPREL

SEQ ID NO: 2279273 - protein, 9 aa, Cryptosporidium parvum
RTPGYQPNS

SEQ ID NO: 2279274 - protein, 9 aa, Cryptosporidium parvum
RTPNDRESH

SEQ ID NO: 2279275 - protein, 4 aa, Cryptosporidium parvum
RTPR

SEQ ID NO: 2279276 - protein, 4 aa, Cryptosporidium parvum
RTPS

SEQ ID NO: 2279277 - protein, 29 aa, Cryptosporidium parvum
RTPSHSVPGGQSPTVSQTHNISQQSSSSI

SEQ ID NO: 2279278 - protein, 5 aa, Cryptosporidium parvum
RTPSI

SEQ ID NO: 2279279 - protein, 13 aa, Cryptosporidium parvum
RTPSSKESLKRSR

SEQ ID NO: 2279280 - protein, 4 aa, Cryptosporidium parvum
RTQA

SEQ ID NO: 2279281 - protein, 7 aa, Cryptosporidium parvum
RTQGTLS

SEQ ID NO: 2279282 - protein, 5 aa, Cryptosporidium parvum
RTQKL

SEQ ID NO: 2279283 - protein, 37 aa, Cryptosporidium parvum
RTQQQSNSGENQISDNTKNSSYSDYISTESKENSEKS

SEQ ID NO: 2279284 - protein, 5 aa, Cryptosporidium parvum
RTRNS

SEQ ID NO: 2279285 - protein, 4 aa, Cryptosporidium parvum
RTRR

SEQ ID NO: 2279286 - protein, 21 aa, Cryptosporidium parvum
RTSDSKNNSKIQSKGSASKKK

SEQ ID NO: 2279287 - protein, 5 aa, Cryptosporidium parvum
RTSLE

SEQ ID NO: 2279288 - protein, 7 aa, Cryptosporidium parvum
RTSVSGK

SEQ ID NO: 2279289 - protein, 8 aa, Cryptosporidium parvum
RTTENEQS

SEQ ID NO: 2279290 - protein, 11 aa, Cryptosporidium parvum
RTTGKALESHE

SEQ ID NO: 2279291 - protein, 7 aa, Cryptosporidium parvum
RTTKPQR

SEQ ID NO: 2279292 - protein, 4 aa, Cryptosporidium parvum
RTTN

SEQ ID NO: 2279293 - protein, 23 aa, Cryptosporidium parvum
RTTSGSPGHPQASSGTPPPNSMQ

SEQ ID NO: 2279294 - protein, 47 aa, Cryptosporidium parvum
RTTTTTRTTTTTRTTTTTRTTASTKTTTSTKTTSEYFSSNEKEIDLK

SEQ ID NO: 2279295 - protein, 4 aa, Cryptosporidium parvum
RTTY

SEQ ID NO: 2279296 - protein, 9 aa, Cryptosporidium parvum
RTVASPQNY

SEQ ID NO: 2279297 - protein, 12 aa, Cryptosporidium parvum
RTVQTLQERTET

SEQ ID NO: 2279298 - protein, 11 aa, Cryptosporidium parvum
RTVRNYNSSRF

SEQ ID NO: 2279299 - protein, 9 aa, Cryptosporidium parvum
RTVTSNPNL

SEQ ID NO: 2279300 - protein, 14 aa, Cryptosporidium parvum
RTYDKVDSKTKTTM

SEQ ID NO: 2279301 - protein, 10 aa, Cryptosporidium parvum
RTYKVSPKKK

SEQ ID NO: 2279302 - protein, 11 aa, Cryptosporidium parvum
RTYPSGSDEAH

SEQ ID NO: 2279303 - protein, 4 aa, Cryptosporidium parvum
RVDS

SEQ ID NO: 2279304 - protein, 7 aa, Cryptosporidium parvum
RVDTKEI

SEQ ID NO: 2279305 - protein, 50 aa, Cryptosporidium parvum
RVEEQSSECEKNTETELDKDEKQVEREKQNKTENRDDKLKDERKRDKEDA

SEQ ID NO: 2279306 - protein, 7 aa, Cryptosporidium parvum
RVEESIG

SEQ ID NO: 2279307 - protein, 30 aa, Cryptosporidium parvum
RVGRPTNAASSNGNQSGSGGIGGGGSGNVI

SEQ ID NO: 2279308 - protein, 9 aa, Cryptosporidium parvum
RVGRTDKGV

SEQ ID NO: 2279309 - protein, 8 aa, Cryptosporidium parvum
RVGTDTED

SEQ ID NO: 2279310 - protein, 31 aa, Cryptosporidium parvum
RVGTNSSNNFVKSTSSLKKNDEPLKSSSNHF

SEQ ID NO: 2279311 - protein, 8 aa, Cryptosporidium parvum
RVKPSKKV

SEQ ID NO: 2279312 - protein, 27 aa, Cryptosporidium parvum
RVNGNGNSQGVYRSRNNKHLRSNPFEK

SEQ ID NO: 2279313 - protein, 4 aa, Cryptosporidium parvum
RVNK

SEQ ID NO: 2279314 - protein, 10 aa, Cryptosporidium parvum
RVNNNDDEGK

SEQ ID NO: 2279315 - protein, 7 aa, Cryptosporidium parvum
RVNNRNV

SEQ ID NO: 2279316 - protein, 6 aa, Cryptosporidium parvum
RVNPPD

SEQ ID NO: 2279317 - protein, 11 aa, Cryptosporidium parvum
RVNTMSEGTAF

SEQ ID NO: 2279318 - protein, 14 aa, Cryptosporidium parvum
RVNTRKKKKTPEQI

SEQ ID NO: 2279319 - protein, 47 aa, Cryptosporidium parvum
RVNTTSKEGSACKLSEDTDNKVECTSISNKQQFDQNLTQKKNLEEKN

SEQ ID NO: 2279320 - protein, 7 aa, Cryptosporidium parvum
RVPDDGK

SEQ ID NO: 2279321 - protein, 11 aa, Cryptosporidium parvum
RVPEDDRDHFG

SEQ ID NO: 2279322 - protein, 7 aa, Cryptosporidium parvum
RVPEPDY

SEQ ID NO: 2279323 - protein, 4 aa, Cryptosporidium parvum
RVPP

SEQ ID NO: 2279324 - protein, 9 aa, Cryptosporidium parvum
RVPVSQSPY

SEQ ID NO: 2279325 - protein, 8 aa, Cryptosporidium parvum
RVQKNGKN

SEQ ID NO: 2279326 - protein, 9 aa, Cryptosporidium parvum
RVREGSNSR

SEQ ID NO: 2279327 - protein, 6 aa, Cryptosporidium parvum
RVRNEA

SEQ ID NO: 2279328 - protein, 11 aa, Cryptosporidium parvum
RVRSVNESNDF

SEQ ID NO: 2279329 - protein, 4 aa, Cryptosporidium parvum
RVSE

SEQ ID NO: 2279330 - protein, 8 aa, Cryptosporidium parvum
RVSPSTIP

SEQ ID NO: 2279331 - protein, 19 aa, Cryptosporidium parvum
RVSRPKVKGNEQHGNSSHP

SEQ ID NO: 2279332 - protein, 92 aa, Cryptosporidium parvum
RVSSSEASNTQNSTDCSTDNCNNSQGTKNKSDSKNTKNISKSSNSCNTSSKPSSDSNSVNDDPSLSKNNEIQSTISSGTDPPSNNDNSSSNL

SEQ ID NO: 2279333 - protein, 6 aa, Cryptosporidium parvum
RVSTDG

SEQ ID NO: 2279334 - protein, 8 aa, Cryptosporidium parvum
RVSTPDLK

SEQ ID NO: 2279335 - protein, 31 aa, Cryptosporidium parvum
RVSVEKDPNSQDCSSDEEENTAYVPRRDRDH

SEQ ID NO: 2279336 - protein, 4 aa, Cryptosporidium parvum
RWEE

SEQ ID NO: 2279337 - protein, 4 aa, Cryptosporidium parvum
RWTQ

SEQ ID NO: 2279338 - protein, 5 aa, Cryptosporidium parvum
RYAGK

SEQ ID NO: 2279339 - protein, 6 aa, Cryptosporidium parvum
RYDSGE

SEQ ID NO: 2279340 - protein, 25 aa, Cryptosporidium parvum
RYDSNSGGSSQSQGGQTNNTDSSSI

SEQ ID NO: 2279341 - protein, 11 aa, Cryptosporidium parvum
RYEEEKKRRED

SEQ ID NO: 2279342 - protein, 4 aa, Cryptosporidium parvum
RYEK

SEQ ID NO: 2279343 - protein, 27 aa, Cryptosporidium parvum
RYEKDSIEINKNKEVRRKQSNKRGNFP

SEQ ID NO: 2279344 - protein, 7 aa, Cryptosporidium parvum
RYENDQS

SEQ ID NO: 2279345 - protein, 20 aa, Cryptosporidium parvum
RYENSPENEDSDLKEKYSQW

SEQ ID NO: 2279346 - protein, 18 aa, Cryptosporidium parvum
RYETDLKEKYDGLTDVED

SEQ ID NO: 2279347 - protein, 6 aa, Cryptosporidium parvum
RYGITR

SEQ ID NO: 2279348 - protein, 9 aa, Cryptosporidium parvum
RYGLSEDQT

SEQ ID NO: 2279349 - protein, 7 aa, Cryptosporidium parvum
RYGPHNH

SEQ ID NO: 2279350 - protein, 5 aa, Cryptosporidium parvum
RYISK

SEQ ID NO: 2279351 - protein, 9 aa, Cryptosporidium parvum
RYKGEEKEL

SEQ ID NO: 2279352 - protein, 4 aa, Cryptosporidium parvum
RYKN

SEQ ID NO: 2279353 - protein, 5 aa, Cryptosporidium parvum
RYLPG

SEQ ID NO: 2279354 - protein, 14 aa, Cryptosporidium parvum
RYLQGKKGLERPPY

SEQ ID NO: 2279355 - protein, 11 aa, Cryptosporidium parvum
RYLSSQSTHEK

SEQ ID NO: 2279356 - protein, 4 aa, Cryptosporidium parvum
RYNN

SEQ ID NO: 2279357 - protein, 23 aa, Cryptosporidium parvum
RYNNNNNNNNNNNSNNNNNINSI

SEQ ID NO: 2279358 - protein, 7 aa, Cryptosporidium parvum
RYPATEL

SEQ ID NO: 2279359 - protein, 5 aa, Cryptosporidium parvum
RYPEE

SEQ ID NO: 2279360 - protein, 10 aa, Cryptosporidium parvum
RYRKESPYSK

SEQ ID NO: 2279361 - protein, 9 aa, Cryptosporidium parvum
RYSGSDIKR

SEQ ID NO: 2279362 - protein, 8 aa, Cryptosporidium parvum
RYSKGREK

SEQ ID NO: 2279363 - protein, 5 aa, Cryptosporidium parvum
RYSKS

SEQ ID NO: 2279364 - protein, 6 aa, Cryptosporidium parvum
RYSNNF

SEQ ID NO: 2279365 - protein, 5 aa, Cryptosporidium parvum
RYSQG

SEQ ID NO: 2279366 - protein, 7 aa, Cryptosporidium parvum
RYSVEGN

SEQ ID NO: 2279367 - protein, 11 aa, Cryptosporidium parvum
RYTKNEKTGKT

SEQ ID NO: 2279368 - protein, 6 aa, Cryptosporidium parvum
RYTSAA

SEQ ID NO: 2279369 - protein, 6 aa, Cryptosporidium parvum
RYTTDS

SEQ ID NO: 2279370 - protein, 6 aa, Cryptosporidium parvum
SAAKGL

SEQ ID NO: 2279371 - protein, 7 aa, Cryptosporidium parvum
SAAKSAL

SEQ ID NO: 2279372 - protein, 18 aa, Cryptosporidium parvum
SAANDGYSQLDGSSIGQS

SEQ ID NO: 2279373 - protein, 15 aa, Cryptosporidium parvum
SAAPPSATKKSDAES

SEQ ID NO: 2279374 - protein, 7 aa, Cryptosporidium parvum
SAAPQRL

SEQ ID NO: 2279375 - protein, 14 aa, Cryptosporidium parvum
SAAREEVPGRRGYP

SEQ ID NO: 2279376 - protein, 14 aa, Cryptosporidium parvum
SAASNDSKIPTFDE

SEQ ID NO: 2279377 - protein, 11 aa, Cryptosporidium parvum
SAASTSVSNSQ

SEQ ID NO: 2279378 - protein, 57 aa, Cryptosporidium parvum
SAATAATNAQLSSAAQTQPDAENHASKPVAKASGSGRASHGSGSRALNASSSVTAAA

SEQ ID NO: 2279379 - protein, 6 aa, Cryptosporidium parvum
SAATSI

SEQ ID NO: 2279380 - protein, 4 aa, Cryptosporidium parvum
SADE

SEQ ID NO: 2279381 - protein, 16 aa, Cryptosporidium parvum
SADEDTNKENSFRVDT

SEQ ID NO: 2279382 - protein, 7 aa, Cryptosporidium parvum
SADEPMT

SEQ ID NO: 2279383 - protein, 8 aa, Cryptosporidium parvum
SADNKNVN

SEQ ID NO: 2279384 - protein, 8 aa, Cryptosporidium parvum
SADNTVRK

SEQ ID NO: 2279385 - protein, 12 aa, Cryptosporidium parvum
SADSNNSRGINN

SEQ ID NO: 2279386 - protein, 4 aa, Cryptosporidium parvum
SAED

SEQ ID NO: 2279387 - protein, 4 aa, Cryptosporidium parvum
SAEE

SEQ ID NO: 2279388 - protein, 4 aa, Cryptosporidium parvum
SAEI

SEQ ID NO: 2279389 - protein, 8 aa, Cryptosporidium parvum
SAEKRLKQ

SEQ ID NO: 2279390 - protein, 8 aa, Cryptosporidium parvum
SAENKNNN

SEQ ID NO: 2279391 - protein, 18 aa, Cryptosporidium parvum
SAEPEFKYNPDSNVDFKF

SEQ ID NO: 2279392 - protein, 9 aa, Cryptosporidium parvum
SAESCSDSN

SEQ ID NO: 2279393 - protein, 15 aa, Cryptosporidium parvum
SAESESGTKSTSLVT

SEQ ID NO: 2279394 - protein, 15 aa, Cryptosporidium parvum
SAESLEKAESSIKTA

SEQ ID NO: 2279395 - protein, 7 aa, Cryptosporidium parvum
SAETIEN

SEQ ID NO: 2279396 - protein, 17 aa, Cryptosporidium parvum
SAETQNKDKRGSLADEL

SEQ ID NO: 2279397 - protein, 8 aa, Cryptosporidium parvum
SAFDNDQS

SEQ ID NO: 2279398 - protein, 6 aa, Cryptosporidium parvum
SAFGSR

SEQ ID NO: 2279399 - protein, 7 aa, Cryptosporidium parvum
SAFKNKE

SEQ ID NO: 2279400 - protein, 27 aa, Cryptosporidium parvum
SAFNNGYARTQIDNSERAYNANLNSSN

SEQ ID NO: 2279401 - protein, 8 aa, Cryptosporidium parvum
SAGDEVSD

SEQ ID NO: 2279402 - protein, 11 aa, Cryptosporidium parvum
SAGGLKEKNLN

SEQ ID NO: 2279403 - protein, 20 aa, Cryptosporidium parvum
SAGGSFTITNDTSDNKLQRG

SEQ ID NO: 2279404 - protein, 23 aa, Cryptosporidium parvum
SAGGSTLTPWRNGKRSLSTNYGY

SEQ ID NO: 2279405 - protein, 4 aa, Cryptosporidium parvum
SAGI

SEQ ID NO: 2279406 - protein, 8 aa, Cryptosporidium parvum
SAGKSDTY

SEQ ID NO: 2279407 - protein, 62 aa, Cryptosporidium parvum
SAGKSRGHRNSKNSSNGGGNSEGKGNLEYSEHRSNLANDKSKVPDGTKGNNGPNNQAAETGL

SEQ ID NO: 2279408 - protein, 11 aa, Cryptosporidium parvum
SAGNSYTPTTM

SEQ ID NO: 2279409 - protein, 13 aa, Cryptosporidium parvum
SAGSDGRVIVGEF

SEQ ID NO: 2279410 - protein, 18 aa, Cryptosporidium parvum
SAGSGKKVSITEESLSRA

SEQ ID NO: 2279411 - protein, 8 aa, Cryptosporidium parvum
SAGSSDFK

SEQ ID NO: 2279412 - protein, 4 aa, Cryptosporidium parvum
SAHP

SEQ ID NO: 2279413 - protein, 9 aa, Cryptosporidium parvum
SAIEDSGES

SEQ ID NO: 2279414 - protein, 6 aa, Cryptosporidium parvum
SAIESS

SEQ ID NO: 2279415 - protein, 6 aa, Cryptosporidium parvum
SAIKNS

SEQ ID NO: 2279416 - protein, 10 aa, Cryptosporidium parvum
SAINEGLKHS

SEQ ID NO: 2279417 - protein, 4 aa, Cryptosporidium parvum
SAIP

SEQ ID NO: 2279418 - protein, 8 aa, Cryptosporidium parvum
SAKDGNIE

SEQ ID NO: 2279419 - protein, 8 aa, Cryptosporidium parvum
SAKDSRSK

SEQ ID NO: 2279420 - protein, 32 aa, Cryptosporidium parvum; identical to SEQ ID NO: 2159995

SEQ ID NO: 2279421 - protein, 7 aa, Cryptosporidium parvum
SAKEYSG

SEQ ID NO: 2279422 - protein, 15 aa, Cryptosporidium parvum
SAKGLKESEKENQSK

SEQ ID NO: 2279423 - protein, 8 aa, Cryptosporidium parvum
SAKGTKTL

SEQ ID NO: 2279424 - protein, 8 aa, Cryptosporidium parvum
SAKIGKPI

SEQ ID NO: 2279425 - protein, 8 aa, Cryptosporidium parvum
SAKNAYNV

SEQ ID NO: 2279426 - protein, 13 aa, Cryptosporidium parvum
SAKPIASQSPALK

SEQ ID NO: 2279427 - protein, 15 aa, Cryptosporidium parvum
SAKPKKATEATKKPK

SEQ ID NO: 2279428 - protein, 10 aa, Cryptosporidium parvum
SAKQENEVSE

SEQ ID NO: 2279429 - protein, 12 aa, Cryptosporidium parvum
SAKQKDLKVTGP

SEQ ID NO: 2279430 - protein, 11 aa, Cryptosporidium parvum
SAKSQLKESQK

SEQ ID NO: 2279431 - protein, 48 aa, Cryptosporidium parvum
SAKSTSSIIGTSNSHYSKLSGNNNAIKQENSSIISSSNLSNNFTNSSN

SEQ ID NO: 2279432 - protein, 9 aa, Cryptosporidium parvum
SAKTSNNVE

SEQ ID NO: 2279433 - protein, 7 aa, Cryptosporidium parvum
SAKWPSS

SEQ ID NO: 2279434 - protein, 7 aa, Cryptosporidium parvum
SAKYGKL

SEQ ID NO: 2279435 - protein, 7 aa, Cryptosporidium parvum
SALENVS

SEQ ID NO: 2279436 - protein, 10 aa, Cryptosporidium parvum
SALGKSEGEF

SEQ ID NO: 2279437 - protein, 19 aa, Cryptosporidium parvum
SALNSNSEQAYSVGIRNQR

SEQ ID NO: 2279438 - protein, 8 aa, Cryptosporidium parvum
SALPSQSP

SEQ ID NO: 2279439 - protein, 9 aa, Cryptosporidium parvum
SALPTNHGN

SEQ ID NO: 2279440 - protein, 7 aa, Cryptosporidium parvum
SALSELG

SEQ ID NO: 2279441 - protein, 27 aa, Cryptosporidium parvum
SAMESNNKPRNCNTSSDLNTPNNNGNY

SEQ ID NO: 2279442 - protein, 7 aa, Cryptosporidium parvum
SANEVED

SEQ ID NO: 2279443 - protein, 4 aa, Cryptosporidium parvum
SANF

SEQ ID NO: 2279444 - protein, 7 aa, Cryptosporidium parvum
SANGDSI

SEQ ID NO: 2279445 - protein, 5 aa, Cryptosporidium parvum
SANGI

SEQ ID NO: 2279446 - protein, 6 aa, Cryptosporidium parvum
SANGTY

SEQ ID NO: 2279447 - protein, 15 aa, Cryptosporidium parvum
SANNTDKLSDQPTYF

SEQ ID NO: 2279448 - protein, 5 aa, Cryptosporidium parvum
SANPR

SEQ ID NO: 2279449 - protein, 5 aa, Cryptosporidium parvum
SANQE

SEQ ID NO: 2279450 - protein, 4 aa, Cryptosporidium parvum
SANR

SEQ ID NO: 2279451 - protein, 14 aa, Cryptosporidium parvum
SANRIKNSRNSINE

SEQ ID NO: 2279452 - protein, 10 aa, Cryptosporidium parvum
SANSGLSDKD

SEQ ID NO: 2279453 - protein, 22 aa, Cryptosporidium parvum
SANSRISSVSSSSAKAATSSVK

SEQ ID NO: 2279454 - protein, 5 aa, Cryptosporidium parvum
SANTE

SEQ ID NO: 2279455 - protein, 8 aa, Cryptosporidium parvum
SANYSNQY

SEQ ID NO: 2279456 - protein, 7 aa, Cryptosporidium parvum
SAPDKRN

SEQ ID NO: 2279457 - protein, 27 aa, Cryptosporidium parvum
SAPEEPPKEEEKKEEKKEDAPPAEESS

SEQ ID NO: 2279458 - protein, 12 aa, Cryptosporidium parvum
SAPFQETNNLGE

SEQ ID NO: 2279459 - protein, 6 aa, Cryptosporidium parvum
SAPGGK

SEQ ID NO: 2279460 - protein, 7 aa, Cryptosporidium parvum
SAPGSKS

SEQ ID NO: 2279461 - protein, 9 aa, Cryptosporidium parvum
SAPGSKSTQ

SEQ ID NO: 2279462 - protein, 8 aa, Cryptosporidium parvum
SAPIQPKP

SEQ ID NO: 2279463 - protein, 23 aa, Cryptosporidium parvum
SAPNYGRSSSAGRPTFTNSTTLN

SEQ ID NO: 2279464 - protein, 8 aa, Cryptosporidium parvum
SAPPKDNV

SEQ ID NO: 2279465 - protein, 10 aa, Cryptosporidium parvum
SAPQPSIDSL

SEQ ID NO: 2279466 - protein, 5 aa, Cryptosporidium parvum
SAPSI

SEQ ID NO: 2279467 - protein, 8 aa, Cryptosporidium parvum
SAPSMSTP

SEQ ID NO: 2279468 - protein, 7 aa, Cryptosporidium parvum
SAPTDAT

SEQ ID NO: 2279469 - protein, 25 aa, Cryptosporidium parvum
SAPTNSLNSQKDANFSNSFSISSND

SEQ ID NO: 2279470 - protein, 39 aa, Cryptosporidium parvum
SAPTPTPASGNPEDSNSNDAQSNESKPEEQPAAPQPTMK

SEQ ID NO: 2279471 - protein, 9 aa, Cryptosporidium parvum
SAPTSGGKT

SEQ ID NO: 2279472 - protein, 9 aa, Cryptosporidium parvum
SAPYSSTSL

SEQ ID NO: 2279473 - protein, 7 aa, Cryptosporidium parvum
SAQANTQ

SEQ ID NO: 2279474 - protein, 11 aa, Cryptosporidium parvum
SAQDQDQKIGS

SEQ ID NO: 2279475 - protein, 8 aa, Cryptosporidium parvum
SAQGSSLA

SEQ ID NO: 2279476 - protein, 7 aa, Cryptosporidium parvum
SAQISEA

SEQ ID NO: 2279477 - protein, 8 aa, Cryptosporidium parvum
SAQKGQKM

SEQ ID NO: 2279478 - protein, 19 aa, Cryptosporidium parvum
SAQPASSVISKERADTLRK

SEQ ID NO: 2279479 - protein, 7 aa, Cryptosporidium parvum
SAQPSVG

SEQ ID NO: 2279480 - protein, 6 aa, Cryptosporidium parvum
SARKGH

SEQ ID NO: 2279481 - protein, 7 aa, Cryptosporidium parvum
SARKNIP

SEQ ID NO: 2279482 - protein, 6 aa, Cryptosporidium parvum
SARKNV

SEQ ID NO: 2279483 - protein, 14 aa, Cryptosporidium parvum
SARNNTSFKSISNE

SEQ ID NO: 2279484 - protein, 4 aa, Cryptosporidium parvum
SARS

SEQ ID NO: 2279485 - protein, 7 aa, Cryptosporidium parvum
SASDDRT

SEQ ID NO: 2279486 - protein, 7 aa, Cryptosporidium parvum
SASEDNT

SEQ ID NO: 2279487 - protein, 9 aa, Cryptosporidium parvum
SASEEESTI

SEQ ID NO: 2279488 - protein, 18 aa, Cryptosporidium parvum
SASESSENGKIQGIDSPA

SEQ ID NO: 2279489 - protein, 13 aa, Cryptosporidium parvum
SASGGVDKSVNNS

SEQ ID NO: 2279490 - protein, 8 aa, Cryptosporidium parvum
SASGSDGY

SEQ ID NO: 2279491 - protein, 6 aa, Cryptosporidium parvum
SASINP

SEQ ID NO: 2279492 - protein, 7 aa, Cryptosporidium parvum
SASKDPR

SEQ ID NO: 2279493 - protein, 43 aa, Cryptosporidium parvum
SASNHIEKNEINDGRSNGDPTINNSIDNSTSNTGNTSNTEGGV

SEQ ID NO: 2279494 - protein, 9 aa, Cryptosporidium parvum
SASNNKQIS

SEQ ID NO: 2279495 - protein, 13 aa, Cryptosporidium parvum
SASNSGESYGTEA

SEQ ID NO: 2279496 - protein, 4 aa, Cryptosporidium parvum
SASP

SEQ ID NO: 2279497 - protein, 6 aa, Cryptosporidium parvum
SASPNL

SEQ ID NO: 2279498 - protein, 9 aa, Cryptosporidium parvum
SASQGEGDL

SEQ ID NO: 2279499 - protein, 6 aa, Cryptosporidium parvum
SASRDK

SEQ ID NO: 2279500 - protein, 4 aa, Cryptosporidium parvum
SASS

SEQ ID NO: 2279501 - protein, 8 aa, Cryptosporidium parvum
SASSDSTI

SEQ ID NO: 2279502 - protein, 8 aa, Cryptosporidium parvum
SASSDSTV

SEQ ID NO: 2279503 - protein, 7 aa, Cryptosporidium parvum
SASSFEE

SEQ ID NO: 2279504 - protein, 5 aa, Cryptosporidium parvum
SASSI

SEQ ID NO: 2279505 - protein, 15 aa, Cryptosporidium parvum
SASSPTATTSTSNAH

SEQ ID NO: 2279506 - protein, 18 aa, Cryptosporidium parvum
SASSTASTTPSSTPGGLA

SEQ ID NO: 2279507 - protein, 12 aa, Cryptosporidium parvum
SASSTATSSSTS

SEQ ID NO: 2279508 - protein, 7 aa, Cryptosporidium parvum
SASTLGN

SEQ ID NO: 2279509 - protein, 6 aa, Cryptosporidium parvum
SASTNI

SEQ ID NO: 2279510 - protein, 14 aa, Cryptosporidium parvum
SASTTNAGEKNLKI

SEQ ID NO: 2279511 - protein, 13 aa, Cryptosporidium parvum
SASVTDQKPCPGK

SEQ ID NO: 2279512 - protein, 4 aa, Cryptosporidium parvum
SATE

SEQ ID NO: 2279513 - protein, 9 aa, Cryptosporidium parvum
SATESYSPL

SEQ ID NO: 2279514 - protein, 7 aa, Cryptosporidium parvum
SATHEEK

SEQ ID NO: 2279515 - protein, 10 aa, Cryptosporidium parvum
SATKAIKNIN

SEQ ID NO: 2279516 - protein, 11 aa, Cryptosporidium parvum
SATLDGSRSAQ

SEQ ID NO: 2279517 - protein, 8 aa, Cryptosporidium parvum
SATNNQTN

SEQ ID NO: 2279518 - protein, 10 aa, Cryptosporidium parvum
SATNNSCGQF

SEQ ID NO: 2279519 - protein, 28 aa, Cryptosporidium parvum
SATNTSNSNSATPTESEKGSGPKLSLTE

SEQ ID NO: 2279520 - protein, 38 aa, Cryptosporidium parvum
SATPSDGSAFEGAQTSTTASTASPSEASTYPSIGQQND

SEQ ID NO: 2279521 - protein, 4 aa, Cryptosporidium parvum
SATS

SEQ ID NO: 2279522 - protein, 7 aa, Cryptosporidium parvum
SATTGIN

SEQ ID NO: 2279523 - protein, 9 aa, Cryptosporidium parvum
SATTGKPKG

SEQ ID NO: 2279524 - protein, 6 aa, Cryptosporidium parvum
SATTNI

SEQ ID NO: 2279525 - protein, 6 aa, Cryptosporidium parvum
SATTPE

SEQ ID NO: 2279526 - protein, 20 aa, Cryptosporidium parvum
SATVSNNNIQSTNSESQEPL

SEQ ID NO: 2279527 - protein, 19 aa, Cryptosporidium parvum
SAVGGREGYSTSYVPAPKV

SEQ ID NO: 2279528 - protein, 14 aa, Cryptosporidium parvum
SAVKTGMDELGGEA

SEQ ID NO: 2279529 - protein, 22 aa, Cryptosporidium parvum
SAVNSNSSPKAKQANSPPPPLA

SEQ ID NO: 2279530 - protein, 6 aa, Cryptosporidium parvum
SAVPRY

SEQ ID NO: 2279531 - protein, 16 aa, Cryptosporidium parvum
SAVQTNRTTGTSNAKR

SEQ ID NO: 2279532 - protein, 7 aa, Cryptosporidium parvum
SAVSSGT

SEQ ID NO: 2279533 - protein, 29 aa, Cryptosporidium parvum
SAWKGNKGGNNDLENGNKNGSDGFKPSEK

SEQ ID NO: 2279534 - protein, 12 aa, Cryptosporidium parvum
SAYLDSEQRITA

SEQ ID NO: 2279535 - protein, 4 aa, Cryptosporidium parvum
SAYN

SEQ ID NO: 2279536 - protein, 6 aa, Cryptosporidium parvum
SAYSKS

SEQ ID NO: 2279537 - protein, 6 aa, Cryptosporidium parvum
SAYSNI

SEQ ID NO: 2279538 - protein, 25 aa, Cryptosporidium parvum
SAYSSALKKRASGKTAVNSNSSRSH

SEQ ID NO: 2279539 - protein, 9 aa, Cryptosporidium parvum
SAYSSATEA

SEQ ID NO: 2279540 - protein, 15 aa, Cryptosporidium parvum
SCADESNHLKTEIKS

SEQ ID NO: 2279541 - protein, 24 aa, Cryptosporidium parvum
SCCNTNPNKSTSDKEVVNQNQNDH

SEQ ID NO: 2279542 - protein, 6 aa, Cryptosporidium parvum
SCDDTI

SEQ ID NO: 2279543 - protein, 9 aa, Cryptosporidium parvum
SCEKAEDNP

SEQ ID NO: 2279544 - protein, 10 aa, Cryptosporidium parvum
SCEKSSISKV

SEQ ID NO: 2279545 - protein, 4 aa, Cryptosporidium parvum
SCEN

SEQ ID NO: 2279546 - protein, 9 aa, Cryptosporidium parvum
SCESYKNEI

SEQ ID NO: 2279547 - protein, 6 aa, Cryptosporidium parvum
SCGASA

SEQ ID NO: 2279548 - protein, 4 aa, Cryptosporidium parvum
SCGD

SEQ ID NO: 2279549 - protein, 7 aa, Cryptosporidium parvum
SCGSNYS

SEQ ID NO: 2279550 - protein, 12 aa, Cryptosporidium parvum
SCGSPNYAAPEV

SEQ ID NO: 2279551 - protein, 8 aa, Cryptosporidium parvum
SCGYPSAK

SEQ ID NO: 2279552 - protein, 13 aa, Cryptosporidium parvum
SCINDEYDNNNVS

SEQ ID NO: 2279553 - protein, 4 aa, Cryptosporidium parvum
SCIT

SEQ ID NO: 2279554 - protein, 8 aa, Cryptosporidium parvum
SCKEIRQS

SEQ ID NO: 2279555 - protein, 9 aa, Cryptosporidium parvum
SCKENPKTH

SEQ ID NO: 2279556 - protein, 17 aa, Cryptosporidium parvum
SCKGSEYLDGNNKSADF

SEQ ID NO: 2279557 - protein, 7 aa, Cryptosporidium parvum
SCKKEKE

SEQ ID NO: 2279558 - protein, 8 aa, Cryptosporidium parvum
SCKNKNDY

SEQ ID NO: 2279559 - protein, 4 aa, Cryptosporidium parvum
SCLS

SEQ ID NO: 2279560 - protein, 8 aa, Cryptosporidium parvum
SCNDENKI

SEQ ID NO: 2279561 - protein, 7 aa, Cryptosporidium parvum
SCNDGNN

SEQ ID NO: 2279562 - protein, 5 aa, Cryptosporidium parvum
SCNEI

SEQ ID NO: 2279563 - protein, 18 aa, Cryptosporidium parvum
SCNKKGSKKELDKEYQSK

SEQ ID NO: 2279564 - protein, 7 aa, Cryptosporidium parvum
SCNNYPK

SEQ ID NO: 2279565 - protein, 8 aa, Cryptosporidium parvum
SCNTNTNN

SEQ ID NO: 2279566 - protein, 7 aa, Cryptosporidium parvum
SCQKTPQ

SEQ ID NO: 2279567 - protein, 19 aa, Cryptosporidium parvum
SCQPKIRSDKLSPNSVGPR

SEQ ID NO: 2279568 - protein, 9 aa, Cryptosporidium parvum
SCSDPDPYV

SEQ ID NO: 2279569 - protein, 7 aa, Cryptosporidium parvum
SCSEAAP

SEQ ID NO: 2279570 - protein, 31 aa, Cryptosporidium parvum; identical to SEQ ID NO: 2160129

SEQ ID NO: 2279571 - protein, 12 aa, Cryptosporidium parvum
SCSGSGLPQHGK

SEQ ID NO: 2279572 - protein, 6 aa, Cryptosporidium parvum
SCSKRV

SEQ ID NO: 2279573 - protein, 9 aa, Cryptosporidium parvum
SCSPATGAQ

SEQ ID NO: 2279574 - protein, 8 aa, Cryptosporidium parvum
SCSSAAGS

SEQ ID NO: 2279575 - protein, 9 aa, Cryptosporidium parvum
SCSSGDLRE

SEQ ID NO: 2279576 - protein, 6 aa, Cryptosporidium parvum
SCSSPS

SEQ ID NO: 2279577 - protein, 12 aa, Cryptosporidium parvum
SCSSSESLSSQL

SEQ ID NO: 2279578 - protein, 15 aa, Cryptosporidium parvum
SCSTTTNSIPNTSDI

SEQ ID NO: 2279579 - protein, 5 aa, Cryptosporidium parvum
SCTGR

SEQ ID NO: 2279580 - protein, 15 aa, Cryptosporidium parvum
SCTSDDWRKGVSNPP

SEQ ID NO: 2279581 - protein, 23 aa, Cryptosporidium parvum
SCTSNSPIAASPITPNSLTSSTL

SEQ ID NO: 2279582 - protein, 6 aa, Cryptosporidium parvum
SCVNSK

SEQ ID NO: 2279583 - protein, 8 aa, Cryptosporidium parvum
SDAAVPKE

SEQ ID NO: 2279584 - protein, 26 aa, Cryptosporidium parvum
SDADPNVTYASSTSGSSSGSASTGLA

SEQ ID NO: 2279585 - protein, 12 aa, Cryptosporidium parvum
SDAEDNEENFTV

SEQ ID NO: 2279586 - protein, 5 aa, Cryptosporidium parvum
SDAEF

SEQ ID NO: 2279587 - protein, 6 aa, Cryptosporidium parvum
SDAEID

SEQ ID NO: 2279588 - protein, 13 aa, Cryptosporidium parvum
SDAISQNKQKNGA

SEQ ID NO: 2279589 - protein, 13 aa, Cryptosporidium parvum
SDAKNDPAKGCED

SEQ ID NO: 2279590 - protein, 5 aa, Cryptosporidium parvum
SDANA

SEQ ID NO: 2279591 - protein, 5 aa, Cryptosporidium parvum
SDAQE

SEQ ID NO: 2279592 - protein, 8 aa, Cryptosporidium parvum
SDATSSNI

SEQ ID NO: 2279593 - protein, 5 aa, Cryptosporidium parvum
SDCDT

SEQ ID NO: 2279594 - protein, 15 aa, Cryptosporidium parvum
SDDAHDNQNNESSLN

SEQ ID NO: 2279595 - protein, 6 aa, Cryptosporidium parvum
SDDAKD

SEQ ID NO: 2279596 - protein, 9 aa, Cryptosporidium parvum
SDDDCTAFE

SEQ ID NO: 2279597 - protein, 9 aa, Cryptosporidium parvum
SDDDDENEM

SEQ ID NO: 2279598 - protein, 8 aa, Cryptosporidium parvum
SDDDVSKQ

SEQ ID NO: 2279599 - protein, 39 aa, Cryptosporidium parvum
SDDEKGQPATKTNEKLGDEEESDTEAPPPGNGGSTDKYT

SEQ ID NO: 2279600 - protein, 7 aa, Cryptosporidium parvum
SDDENVE

SEQ ID NO: 2279601 - protein, 9 aa, Cryptosporidium parvum
SDDETEDEF

SEQ ID NO: 2279602 - protein, 7 aa, Cryptosporidium parvum
SDDGDIT

SEQ ID NO: 2279603 - protein, 8 aa, Cryptosporidium parvum
SDDGHLRD

SEQ ID NO: 2279604 - protein, 6 aa, Cryptosporidium parvum
SDDHTQ

SEQ ID NO: 2279605 - protein, 5 aa, Cryptosporidium parvum
SDDIG

SEQ ID NO: 2279606 - protein, 6 aa, Cryptosporidium parvum
SDDLRQ

SEQ ID NO: 2279607 - protein, 9 aa, Cryptosporidium parvum
SDDNESDIE

SEQ ID NO: 2279608 - protein, 5 aa, Cryptosporidium parvum
SDDNK

SEQ ID NO: 2279609 - protein, 9 aa, Cryptosporidium parvum
SDDQLGSQK

SEQ ID NO: 2279610 - protein, 7 aa, Cryptosporidium parvum
SDDQNDL

SEQ ID NO: 2279611 - protein, 8 aa, Cryptosporidium parvum
SDDSEEFD

SEQ ID NO: 2279612 - protein, 10 aa, Cryptosporidium parvum
SDDSNKPYKY

SEQ ID NO: 2279613 - protein, 7 aa, Cryptosporidium parvum
SDDSNSL

SEQ ID NO: 2279614 - protein, 13 aa, Cryptosporidium parvum
SDDTLDDDEFGNN

SEQ ID NO: 2279615 - protein, 9 aa, Cryptosporidium parvum
SDDVDKLGA

SEQ ID NO: 2279616 - protein, 6 aa, Cryptosporidium parvum
SDDVST

SEQ ID NO: 2279617 - protein, 14 aa, Cryptosporidium parvum
SDDYNPEKGANIPI

SEQ ID NO: 2279618 - protein, 4 aa, Cryptosporidium parvum
SDEA

SEQ ID NO: 2279619 - protein, 5 aa, Cryptosporidium parvum
SDEAK

SEQ ID NO: 2279620 - protein, 57 aa, Cryptosporidium parvum
SDEEEDEEEEEEEEPELESSKIDNKKSLKRKLPSKSDESTEEEIDDEEIDSDEADDL

SEQ ID NO: 2279621 - protein, 5 aa, Cryptosporidium parvum
SDEEL

SEQ ID NO: 2279622 - protein, 24 aa, Cryptosporidium parvum
SDEELNNNIDSGKISDVEQEYFKV

SEQ ID NO: 2279623 - protein, 11 aa, Cryptosporidium parvum
SDEELNSDSEV

SEQ ID NO: 2279624 - protein, 9 aa, Cryptosporidium parvum
SDEETHRLK

SEQ ID NO: 2279625 - protein, 7 aa, Cryptosporidium parvum
SDEEVKP

SEQ ID NO: 2279626 - protein, 6 aa, Cryptosporidium parvum
SDEFGP

SEQ ID NO: 2279627 - protein, 7 aa, Cryptosporidium parvum
SDEFRGN

SEQ ID NO: 2279628 - protein, 10 aa, Cryptosporidium parvum
SDEGINETSK

SEQ ID NO: 2279629 - protein, 5 aa, Cryptosporidium parvum
SDEIE

SEQ ID NO: 2279630 - protein, 5 aa, Cryptosporidium parvum
SDELP

SEQ ID NO: 2279631 - protein, 4 aa, Cryptosporidium parvum
SDEM

SEQ ID NO: 2279632 - protein, 9 aa, Cryptosporidium parvum
SDENNESID

SEQ ID NO: 2279633 - protein, 13 aa, Cryptosporidium parvum
SDENTSVKNSATA

SEQ ID NO: 2279634 - protein, 13 aa, Cryptosporidium parvum
SDENYTSSTDEFE

SEQ ID NO: 2279635 - protein, 13 aa, Cryptosporidium parvum
SDEPESRKVLSSQ

SEQ ID NO: 2279636 - protein, 26 aa, Cryptosporidium parvum
SDERSKKTPYQLSEGDSVYDTQSYGS

SEQ ID NO: 2279637 - protein, 22 aa, Cryptosporidium parvum
SDESDGNNDKGYIEDESELRKS

SEQ ID NO: 2279638 - protein, 17 aa, Cryptosporidium parvum
SDESRNGSFGASKDQID

SEQ ID NO: 2279639 - protein, 9 aa, Cryptosporidium parvum
SDESRQSLK

SEQ ID NO: 2279640 - protein, 10 aa, Cryptosporidium parvum
SDFDSRTQFN

SEQ ID NO: 2279641 - protein, 4 aa, Cryptosporidium parvum
SDFN

SEQ ID NO: 2279642 - protein, 8 aa, Cryptosporidium parvum
SDFNDTDN

SEQ ID NO: 2279643 - protein, 8 aa, Cryptosporidium parvum
SDFNSDSD

SEQ ID NO: 2279644 - protein, 9 aa, Cryptosporidium parvum
SDFQEPPNY

SEQ ID NO: 2279645 - protein, 5 aa, Cryptosporidium parvum
SDFSN

SEQ ID NO: 2279646 - protein, 24 aa, Cryptosporidium parvum
SDFSTVKTKSRKNTTKKSSSNEKK

SEQ ID NO: 2279647 - protein, 6 aa, Cryptosporidium parvum
SDFTQT

SEQ ID NO: 2279648 - protein, 12 aa, Cryptosporidium parvum
SDGDKENNPNTF

SEQ ID NO: 2279649 - protein, 4 aa, Cryptosporidium parvum
SDGE

SEQ ID NO: 2279650 - protein, 12 aa, Cryptosporidium parvum
SDGEDPDEHEGM

SEQ ID NO: 2279651 - protein, 12 aa, Cryptosporidium parvum
SDGESLLLDYGL

SEQ ID NO: 2279652 - protein, 7 aa, Cryptosporidium parvum
SDGFSGK

SEQ ID NO: 2279653 - protein, 9 aa, Cryptosporidium parvum
SDGGKKDII

SEQ ID NO: 2279654 - protein, 10 aa, Cryptosporidium parvum
SDGGYGYDST

SEQ ID NO: 2279655 - protein, 5 aa, Cryptosporidium parvum
SDGKI

SEQ ID NO: 2279656 - protein, 9 aa, Cryptosporidium parvum
SDGKKMSKR

SEQ ID NO: 2279657 - protein, 46 aa, Cryptosporidium parvum
SDGKSETFSNNSNGVAADLTNDSDKITEKDAISGKSKTKVETSNSI

SEQ ID NO: 2279658 - protein, 14 aa, Cryptosporidium parvum
SDGKSLTANKQRSN

SEQ ID NO: 2279659 - protein, 7 aa, Cryptosporidium parvum
SDGNGTI

SEQ ID NO: 2279660 - protein, 7 aa, Cryptosporidium parvum
SDGNKGE

SEQ ID NO: 2279661 - protein, 5 aa, Cryptosporidium parvum
SDGNN

SEQ ID NO: 2279662 - protein, 6 aa, Cryptosporidium parvum
SDGNSL

SEQ ID NO: 2279663 - protein, 8 aa, Cryptosporidium parvum
SDGPNDRV

SEQ ID NO: 2279664 - protein, 9 aa, Cryptosporidium parvum
SDGQAKADY

SEQ ID NO: 2279665 - protein, 15 aa, Cryptosporidium parvum
SDGQPIQKEQTKTSQ

SEQ ID NO: 2279666 - protein, 4 aa, Cryptosporidium parvum
SDGS

SEQ ID NO: 2279667 - protein, 15 aa, Cryptosporidium parvum
SDGSATSHTGSNSNV

SEQ ID NO: 2279668 - protein, 6 aa, Cryptosporidium parvum
SDGSGC

SEQ ID NO: 2279669 - protein, 5 aa, Cryptosporidium parvum
SDGSH

SEQ ID NO: 2279670 - protein, 5 aa, Cryptosporidium parvum
SDGSI

SEQ ID NO: 2279671 - protein, 12 aa, Cryptosporidium parvum
SDGSNSKNVGQK

SEQ ID NO: 2279672 - protein, 6 aa, Cryptosporidium parvum
SDGSSN

SEQ ID NO: 2279673 - protein, 9 aa, Cryptosporidium parvum
SDGSSSWKK

SEQ ID NO: 2279674 - protein, 10 aa, Cryptosporidium parvum
SDGTVSANKN

SEQ ID NO: 2279675 - protein, 8 aa, Cryptosporidium parvum
SDGVSEAA

SEQ ID NO: 2279676 - protein, 18 aa, Cryptosporidium parvum
SDHDNDYKSSQNNNKNSH

SEQ ID NO: 2279677 - protein, 8 aa, Cryptosporidium parvum
SDHETQNR

SEQ ID NO: 2279678 - protein, 27 aa, Cryptosporidium parvum
SDHNNGNKSVSSNPNIIESDNSRVKSN

SEQ ID NO: 2279679 - protein, 49 aa, Cryptosporidium parvum
SDHPTLSDHTNSQEKSSRVDVADNKSSAANQEHSPTDSFDGSKYSSKMT

SEQ ID NO: 2279680 - protein, 9 aa, Cryptosporidium parvum
SDHQNVPDT

SEQ ID NO: 2279681 - protein, 5 aa, Cryptosporidium parvum
SDHRK

SEQ ID NO: 2279682 - protein, 44 aa, Cryptosporidium parvum
SDHSSIPESSVDITSTNNTYNSSSCNKNNKEVGITKRQTPSKSI

SEQ ID NO: 2279683 - protein, 16 aa, Cryptosporidium parvum
SDIDSRIKSNDQISSQ

SEQ ID NO: 2279684 - protein, 5 aa, Cryptosporidium parvum
SDIGQ

SEQ ID NO: 2279685 - protein, 4 aa, Cryptosporidium parvum
SDIN

SEQ ID NO: 2279686 - protein, 10 aa, Cryptosporidium parvum
SDINDDKDSH

SEQ ID NO: 2279687 - protein, 10 aa, Cryptosporidium parvum
SDINKNDNIK

SEQ ID NO: 2279688 - protein, 11 aa, Cryptosporidium parvum
SDINNDGSEDE

SEQ ID NO: 2279689 - protein, 29 aa, Cryptosporidium parvum
SDINRLNEEQNDQDIDSLKEDQLNNTAKD

SEQ ID NO: 2279690 - protein, 4 aa, Cryptosporidium parvum
SDIQ

SEQ ID NO: 2279691 - protein, 4 aa, Cryptosporidium parvum
SDIS

SEQ ID NO: 2279692 - protein, 6 aa, Cryptosporidium parvum
SDISPI

SEQ ID NO: 2279693 - protein, 9 aa, Cryptosporidium parvum
SDKDQSCQK

SEQ ID NO: 2279694 - protein, 7 aa, Cryptosporidium parvum
SDKEEDM

SEQ ID NO: 2279695 - protein, 7 aa, Cryptosporidium parvum
SDKEHKE

SEQ ID NO: 2279696 - protein, 10 aa, Cryptosporidium parvum
SDKKNNDDIE

SEQ ID NO: 2279697 - protein, 6 aa, Cryptosporidium parvum
SDKNDG

SEQ ID NO: 2279698 - protein, 12 aa, Cryptosporidium parvum
SDKNGGFSPRST

SEQ ID NO: 2279699 - protein, 7 aa, Cryptosporidium parvum
SDKNIGF

SEQ ID NO: 2279700 - protein, 9 aa, Cryptosporidium parvum
SDKNTNKID

SEQ ID NO: 2279701 - protein, 7 aa, Cryptosporidium parvum
SDKPSFT

SEQ ID NO: 2279702 - protein, 6 aa, Cryptosporidium parvum
SDKPYK

SEQ ID NO: 2279703 - protein, 7 aa, Cryptosporidium parvum
SDKQNKL

SEQ ID NO: 2279704 - protein, 19 aa, Cryptosporidium parvum
SDKQQDVEKKKKEERERRI

SEQ ID NO: 2279705 - protein, 8 aa, Cryptosporidium parvum
SDKQREKV

SEQ ID NO: 2279706 - protein, 8 aa, Cryptosporidium parvum
SDKRPTII

SEQ ID NO: 2279707 - protein, 8 aa, Cryptosporidium parvum
SDKRQSTI

SEQ ID NO: 2279708 - protein, 8 aa, Cryptosporidium parvum
SDKSDSEE

SEQ ID NO: 2279709 - protein, 8 aa, Cryptosporidium parvum
SDKSEDKH

SEQ ID NO: 2279710 - protein, 10 aa, Cryptosporidium parvum
SDKSHSIEEN

SEQ ID NO: 2279711 - protein, 8 aa, Cryptosporidium parvum
SDKTKLSS

SEQ ID NO: 2279712 - protein, 17 aa, Cryptosporidium parvum
SDKTKSLSESGPSRSSK

SEQ ID NO: 2279713 - protein, 12 aa, Cryptosporidium parvum
SDKVSRGTGQIV

SEQ ID NO: 2279714 - protein, 10 aa, Cryptosporidium parvum
SDLDDEEPEC

SEQ ID NO: 2279715 - protein, 16 aa, Cryptosporidium parvum
SDLHDKSKSNNSPISE

SEQ ID NO: 2279716 - protein, 13 aa, Cryptosporidium parvum
SDLKSDDELTTDQ

SEQ ID NO: 2279717 - protein, 7 aa, Cryptosporidium parvum
SDLKSGD

SEQ ID NO: 2279718 - protein, 6 aa, Cryptosporidium parvum
SDLKSP

SEQ ID NO: 2279719 - protein, 10 aa, Cryptosporidium parvum
SDLNEGEGEE

SEQ ID NO: 2279720 - protein, 9 aa, Cryptosporidium parvum
SDLNNTKDL

SEQ ID NO: 2279721 - protein, 5 aa, Cryptosporidium parvum
SDLNS

SEQ ID NO: 2279722 - protein, 4 aa, Cryptosporidium parvum
SDLP

SEQ ID NO: 2279723 - protein, 6 aa, Cryptosporidium parvum
SDLPKF

SEQ ID NO: 2279724 - protein, 6 aa, Cryptosporidium parvum
SDLPPL

SEQ ID NO: 2279725 - protein, 14 aa, Cryptosporidium parvum
SDLPSNEASLELSE

SEQ ID NO: 2279726 - protein, 7 aa, Cryptosporidium parvum
SDLQDRK

SEQ ID NO: 2279727 - protein, 8 aa, Cryptosporidium parvum
SDLSNEAS

SEQ ID NO: 2279728 - protein, 7 aa, Cryptosporidium parvum
SDLSSTH

SEQ ID NO: 2279729 - protein, 26 aa, Cryptosporidium parvum
SDMKKQKNKELDYQSDYSNLSSPLKS

SEQ ID NO: 2279730 - protein, 7 aa, Cryptosporidium parvum
SDNADTL

SEQ ID NO: 2279731 - protein, 15 aa, Cryptosporidium parvum
SDNAISSSPSASSSI

SEQ ID NO: 2279732 - protein, 6 aa, Cryptosporidium parvum
SDNEDH

SEQ ID NO: 2279733 - protein, 7 aa, Cryptosporidium parvum
SDNEGKC

SEQ ID NO: 2279734 - protein, 12 aa, Cryptosporidium parvum
SDNENDSNVNKK

SEQ ID NO: 2279735 - protein, 25 aa, Cryptosporidium parvum
SDNIETELGEKKQEEESLGGRKRSM

SEQ ID NO: 2279736 - protein, 20 aa, Cryptosporidium parvum
SDNISKEGVNRNSNTLMNNF

SEQ ID NO: 2279737 - protein, 9 aa, Cryptosporidium parvum
SDNKEKLNS

SEQ ID NO: 2279738 - protein, 9 aa, Cryptosporidium parvum
SDNKENSEK

SEQ ID NO: 2279739 - protein, 7 aa, Cryptosporidium parvum
SDNKNEE

SEQ ID NO: 2279740 - protein, 13 aa, Cryptosporidium parvum
SDNNGSIKNNFGQ

SEQ ID NO: 2279741 - protein, 12 aa, Cryptosporidium parvum
SDNPFNNNDRNY

SEQ ID NO: 2279742 - protein, 7 aa, Cryptosporidium parvum
SDNPIQN

SEQ ID NO: 2279743 - protein, 7 aa, Cryptosporidium parvum
SDNPQKI

SEQ ID NO: 2279744 - protein, 11 aa, Cryptosporidium parvum
SDNQKKARDEV

SEQ ID NO: 2279745 - protein, 9 aa, Cryptosporidium parvum
SDNQKNKEF

SEQ ID NO: 2279746 - protein, 10 aa, Cryptosporidium parvum
SDNQSGSKMQ

SEQ ID NO: 2279747 - protein, 8 aa, Cryptosporidium parvum
SDNRKKGK

SEQ ID NO: 2279748 - protein, 4 aa, Cryptosporidium parvum
SDNS

SEQ ID NO: 2279749 - protein, 21 aa, Cryptosporidium parvum
SDNSQISDSESEFSSDNSTIK

SEQ ID NO: 2279750 - protein, 8 aa, Cryptosporidium parvum
SDNSREQC

SEQ ID NO: 2279751 - protein, 4 aa, Cryptosporidium parvum
SDNY

SEQ ID NO: 2279752 - protein, 8 aa, Cryptosporidium parvum
SDPEKRKI

SEQ ID NO: 2279753 - protein, 21 aa, Cryptosporidium parvum
SDPEKRNRYDTYGADGVSADF

SEQ ID NO: 2279754 - protein, 5 aa, Cryptosporidium parvum
SDPEN

SEQ ID NO: 2279755 - protein, 4 aa, Cryptosporidium parvum
SDPG

SEQ ID NO: 2279756 - protein, 17 aa, Cryptosporidium parvum
SDPGNKSNSTFGNPQAT

SEQ ID NO: 2279757 - protein, 6 aa, Cryptosporidium parvum
SDPGNW

SEQ ID NO: 2279758 - protein, 10 aa, Cryptosporidium parvum
SDPGSDLENV

SEQ ID NO: 2279759 - protein, 4 aa, Cryptosporidium parvum
SDPH

SEQ ID NO: 2279760 - protein, 13 aa, Cryptosporidium parvum
SDPKDSESDNIKG

SEQ ID NO: 2279761 - protein, 12 aa, Cryptosporidium parvum
SDPKKRPTAENA

SEQ ID NO: 2279762 - protein, 4 aa, Cryptosporidium parvum
SDPL

SEQ ID NO: 2279763 - protein, 7 aa, Cryptosporidium parvum
SDPLDSK

SEQ ID NO: 2279764 - protein, 6 aa, Cryptosporidium parvum
SDPNAI

SEQ ID NO: 2279765 - protein, 6 aa, Cryptosporidium parvum
SDPNAL

SEQ ID NO: 2279766 - protein, 7 aa, Cryptosporidium parvum
SDPNERA

SEQ ID NO: 2279767 - protein, 12 aa, Cryptosporidium parvum
SDPNPNSPANTI

SEQ ID NO: 2279768 - protein, 8 aa, Cryptosporidium parvum
SDPNQVNM

SEQ ID NO: 2279769 - protein, 5 aa, Cryptosporidium parvum
SDPNS

SEQ ID NO: 2279770 - protein, 10 aa, Cryptosporidium parvum
SDPNSTARLS

SEQ ID NO: 2279771 - protein, 6 aa, Cryptosporidium parvum
SDPQEA

SEQ ID NO: 2279772 - protein, 4 aa, Cryptosporidium parvum
SDPR

SEQ ID NO: 2279773 - protein, 7 aa, Cryptosporidium parvum
SDPRHGR

SEQ ID NO: 2279774 - protein, 7 aa, Cryptosporidium parvum
SDPSINE

SEQ ID NO: 2279775 - protein, 5 aa, Cryptosporidium parvum
SDPSK

SEQ ID NO: 2279776 - protein, 6 aa, Cryptosporidium parvum
SDPSNA

SEQ ID NO: 2279777 - protein, 5 aa, Cryptosporidium parvum
SDPTD

SEQ ID NO: 2279778 - protein, 5 aa, Cryptosporidium parvum
SDPVP

SEQ ID NO: 2279779 - protein, 9 aa, Cryptosporidium parvum
SDPYTRDYY

SEQ ID NO: 2279780 - protein, 4 aa, Cryptosporidium parvum
SDQE

SEQ ID NO: 2279781 - protein, 13 aa, Cryptosporidium parvum
SDQEEFSLSPDQM

SEQ ID NO: 2279782 - protein, 8 aa, Cryptosporidium parvum
SDQEFDEE

SEQ ID NO: 2279783 - protein, 6 aa, Cryptosporidium parvum
SDQEGF

SEQ ID NO: 2279784 - protein, 6 aa, Cryptosporidium parvum
SDQEMG

SEQ ID NO: 2279785 - protein, 7 aa, Cryptosporidium parvum
SDQEPVQ

SEQ ID NO: 2279786 - protein, 10 aa, Cryptosporidium parvum
SDQERRERAS

SEQ ID NO: 2279787 - protein, 7 aa, Cryptosporidium parvum
SDQESET

SEQ ID NO: 2279788 - protein, 8 aa, Cryptosporidium parvum
SDQKESQN

SEQ ID NO: 2279789 - protein, 15 aa, Cryptosporidium parvum
SDQMSDEPRNSSLSS

SEQ ID NO: 2279790 - protein, 7 aa, Cryptosporidium parvum
SDQNIKE

SEQ ID NO: 2279791 - protein, 14 aa, Cryptosporidium parvum
SDQPGSNSFTPKGS

SEQ ID NO: 2279792 - protein, 10 aa, Cryptosporidium parvum
SDQQEEGVTE

SEQ ID NO: 2279793 - protein, 19 aa, Cryptosporidium parvum
SDQSKSKESEVVPSNETEI

SEQ ID NO: 2279794 - protein, 8 aa, Cryptosporidium parvum
SDQSNPKY

SEQ ID NO: 2279795 - protein, 24 aa, Cryptosporidium parvum
SDQTLKNDKDSTKASESSDNTNLS

SEQ ID NO: 2279796 - protein, 6 aa, Cryptosporidium parvum
SDQTLT

SEQ ID NO: 2279797 - protein, 8 aa, Cryptosporidium parvum
SDQTTVSN

SEQ ID NO: 2279798 - protein, 4 aa, Cryptosporidium parvum
SDQV

SEQ ID NO: 2279799 - protein, 4 aa, Cryptosporidium parvum
SDQY

SEQ ID NO: 2279800 - protein, 6 aa, Cryptosporidium parvum
SDQYSS

SEQ ID NO: 2279801 - protein, 5 aa, Cryptosporidium parvum
SDRAI

SEQ ID NO: 2279802 - protein, 27 aa, Cryptosporidium parvum
SDRALKKEKKKLAMDSQKISSALSNEI

SEQ ID NO: 2279803 - protein, 6 aa, Cryptosporidium parvum
SDREEK

SEQ ID NO: 2279804 - protein, 8 aa, Cryptosporidium parvum
SDRESNDD

SEQ ID NO: 2279805 - protein, 16 aa, Cryptosporidium parvum
SDRGVGTGGIGSNQLN

SEQ ID NO: 2279806 - protein, 4 aa, Cryptosporidium parvum
SDRI

SEQ ID NO: 2279807 - protein, 11 aa, Cryptosporidium parvum
SDRNTRKNAKK

SEQ ID NO: 2279808 - protein, 5 aa, Cryptosporidium parvum
SDRQV

SEQ ID NO: 2279809 - protein, 8 aa, Cryptosporidium parvum
SDRTTSSL

SEQ ID NO: 2279810 - protein, 11 aa, Cryptosporidium parvum
SDRYSDKNSNY

SEQ ID NO: 2279811 - protein, 6 aa, Cryptosporidium parvum
SDSAKD

SEQ ID NO: 2279812 - protein, 10 aa, Cryptosporidium parvum
SDSAPKALQG

SEQ ID NO: 2279813 - protein, 11 aa, Cryptosporidium parvum
SDSASAPSGYQ

SEQ ID NO: 2279814 - protein, 7 aa, Cryptosporidium parvum
SDSDEKT

SEQ ID NO: 2279815 - protein, 10 aa, Cryptosporidium parvum
SDSDFSKMSN

SEQ ID NO: 2279816 - protein, 22 aa, Cryptosporidium parvum
SDSDVSSDKSDNEYLDPSNAEE

SEQ ID NO: 2279817 - protein, 17 aa, Cryptosporidium parvum
SDSEDELSNNAASKRSS

SEQ ID NO: 2279818 - protein, 8 aa, Cryptosporidium parvum
SDSEESYD

SEQ ID NO: 2279819 - protein, 8 aa, Cryptosporidium parvum
SDSEIPQI

SEQ ID NO: 2279820 - protein, 6 aa, Cryptosporidium parvum
SDSELK

SEQ ID NO: 2279821 - protein, 5 aa, Cryptosporidium parvum
SDSEM

SEQ ID NO: 2279822 - protein, 5 aa, Cryptosporidium parvum
SDSES

SEQ ID NO: 2279823 - protein, 7 aa, Cryptosporidium parvum
SDSETDY

SEQ ID NO: 2279824 - protein, 7 aa, Cryptosporidium parvum
SDSFQKN

SEQ ID NO: 2279825 - protein, 48 aa, Cryptosporidium parvum
SDSFSEGEISDSSDHIKQSKRSRENKNITNQRKSVKNKKMGEISDSEW

SEQ ID NO: 2279826 - protein, 11 aa, Cryptosporidium parvum
SDSGACGPEHC

SEQ ID NO: 2279827 - protein, 5 aa, Cryptosporidium parvum
SDSGD

SEQ ID NO: 2279828 - protein, 8 aa, Cryptosporidium parvum
SDSGMETL

SEQ ID NO: 2279829 - protein, 8 aa, Cryptosporidium parvum
SDSHQSVT

SEQ ID NO: 2279830 - protein, 9 aa, Cryptosporidium parvum
SDSIDNTPL

SEQ ID NO: 2279831 - protein, 5 aa, Cryptosporidium parvum
SDSIL

SEQ ID NO: 2279832 - protein, 4 aa, Cryptosporidium parvum
SDSK

SEQ ID NO: 2279833 - protein, 7 aa, Cryptosporidium parvum
SDSKEHL

SEQ ID NO: 2279834 - protein, 8 aa, Cryptosporidium parvum
SDSKGRPF

SEQ ID NO: 2279835 - protein, 9 aa, Cryptosporidium parvum
SDSKKSSLE

SEQ ID NO: 2279836 - protein, 7 aa, Cryptosporidium parvum
SDSKTFH

SEQ ID NO: 2279837 - protein, 24 aa, Cryptosporidium parvum
SDSLGNKEFGQDTSNALSQSSSQA

SEQ ID NO: 2279838 - protein, 6 aa, Cryptosporidium parvum
SDSNAK

SEQ ID NO: 2279839 - protein, 8 aa, Cryptosporidium parvum
SDSNPLKP

SEQ ID NO: 2279840 - protein, 16 aa, Cryptosporidium parvum
SDSNSEISNKSQNLKD

SEQ ID NO: 2279841 - protein, 7 aa, Cryptosporidium parvum
SDSNTRQ

SEQ ID NO: 2279842 - protein, 8 aa, Cryptosporidium parvum
SDSPDLKD

SEQ ID NO: 2279843 - protein, 7 aa, Cryptosporidium parvum
SDSPEKL

SEQ ID NO: 2279844 - protein, 10 aa, Cryptosporidium parvum
SDSPINQRPL

SEQ ID NO: 2279845 - protein, 7 aa, Cryptosporidium parvum
SDSPNTD

SEQ ID NO: 2279846 - protein, 25 aa, Cryptosporidium parvum
SDSPSSRNSSSKVSRIPKYTGTISR

SEQ ID NO: 2279847 - protein, 5 aa, Cryptosporidium parvum
SDSQE

SEQ ID NO: 2279848 - protein, 5 aa, Cryptosporidium parvum
SDSQI

SEQ ID NO: 2279849 - protein, 10 aa, Cryptosporidium parvum
SDSREELSDL

SEQ ID NO: 2279850 - protein, 11 aa, Cryptosporidium parvum
SDSSKDGGRLT

SEQ ID NO: 2279851 - protein, 4 aa, Cryptosporidium parvum
SDST

SEQ ID NO: 2279852 - protein, 9 aa, Cryptosporidium parvum
SDSTGGPGV

SEQ ID NO: 2279853 - protein, 7 aa, Cryptosporidium parvum
SDSTGLT

SEQ ID NO: 2279854 - protein, 35 aa, Cryptosporidium parvum
SDSTGNNSTVPTQGNSGNNPSKFKSQLRADAQEFK

SEQ ID NO: 2279855 - protein, 10 aa, Cryptosporidium parvum
SDSTHPNDVS

SEQ ID NO: 2279856 - protein, 11 aa, Cryptosporidium parvum
SDSTKKKLFES

SEQ ID NO: 2279857 - protein, 10 aa, Cryptosporidium parvum
SDSVSQGEGV

SEQ ID NO: 2279858 - protein, 6 aa, Cryptosporidium parvum
SDSWGA

SEQ ID NO: 2279859 - protein, 5 aa, Cryptosporidium parvum
SDSYR

SEQ ID NO: 2279860 - protein, 27 aa, Cryptosporidium parvum
SDTCKNKMEQTKMNSNYDKQSKEYSSS

SEQ ID NO: 2279861 - protein, 21 aa, Cryptosporidium parvum
SDTDIQEDATIEGEGNSGGQI

SEQ ID NO: 2279862 - protein, 16 aa, Cryptosporidium parvum
SDTDKDDNTSLTSLDP

SEQ ID NO: 2279863 - protein, 6 aa, Cryptosporidium parvum
SDTDPE

SEQ ID NO: 2279864 - protein, 26 aa, Cryptosporidium parvum
SDTDTNFGKKDNETHSNGNDEQTDSY

SEQ ID NO: 2279865 - protein, 21 aa, Cryptosporidium parvum
SDTEESKSKYIKPSGNPGYNK

SEQ ID NO: 2279866 - protein, 16 aa, Cryptosporidium parvum
SDTEIEDENNNINTPV

SEQ ID NO: 2279867 - protein, 10 aa, Cryptosporidium parvum
SDTENNEESF

SEQ ID NO: 2279868 - protein, 12 aa, Cryptosporidium parvum
SDTESEEQLKND

SEQ ID NO: 2279869 - protein, 10 aa, Cryptosporidium parvum
SDTESLENPI

SEQ ID NO: 2279870 - protein, 6 aa, Cryptosporidium parvum
SDTETP

SEQ ID NO: 2279871 - protein, 25 aa, Cryptosporidium parvum
SDTGHSGSKNKQKKEKNIKNNQNLK

SEQ ID NO: 2279872 - protein, 12 aa, Cryptosporidium parvum
SDTGYTNKTDYA

SEQ ID NO: 2279873 - protein, 9 aa, Cryptosporidium parvum
SDTIERRDH

SEQ ID NO: 2279874 - protein, 6 aa, Cryptosporidium parvum
SDTITS

SEQ ID NO: 2279875 - protein, 9 aa, Cryptosporidium parvum
SDTKDPKYY

SEQ ID NO: 2279876 - protein, 19 aa, Cryptosporidium parvum
SDTKYQSKSDTSEHNINNN

SEQ ID NO: 2279877 - protein, 4 aa, Cryptosporidium parvum
SDTN

SEQ ID NO: 2279878 - protein, 16 aa, Cryptosporidium parvum
SDTNNSYIPQYTTNAR

SEQ ID NO: 2279879 - protein, 6 aa, Cryptosporidium parvum
SDTPTM

SEQ ID NO: 2279880 - protein, 153 aa, Cryptosporidium parvum
SDTSNSGTTNSNTANSSTSNSNISNSNTANSNTSNSITANFGTANSNTANFNTANSNTANFNTANSNTANFNTTNSNTANSNTANSNTANFNTANSNTANSNTANSNTSNSNTANSNTSNSNTANSNTANSNTSNSNTANSITTTSSNCSRSK

SEQ ID NO: 2279881 - protein, 6 aa, Cryptosporidium parvum
SDTTNN

SEQ ID NO: 2279882 - protein, 15 aa, Cryptosporidium parvum
SDTVRNDSLLIQQFI

SEQ ID NO: 2279883 - protein, 25 aa, Cryptosporidium parvum
SDTWETDGLNQHGYKKGIDRKHDNN

SEQ ID NO: 2279884 - protein, 7 aa, Cryptosporidium parvum
SDVPPPI

SEQ ID NO: 2279885 - protein, 7 aa, Cryptosporidium parvum
SDVRDRY

SEQ ID NO: 2279886 - protein, 6 aa, Cryptosporidium parvum
SDVSDA

SEQ ID NO: 2279887 - protein, 13 aa, Cryptosporidium parvum
SDVSISKGTFSKI

SEQ ID NO: 2279888 - protein, 6 aa, Cryptosporidium parvum
SDVTNS

SEQ ID NO: 2279889 - protein, 9 aa, Cryptosporidium parvum
SDWGASPND

SEQ ID NO: 2279890 - protein, 5 aa, Cryptosporidium parvum
SDYDE

SEQ ID NO: 2279891 - protein, 10 aa, Cryptosporidium parvum
SDYDESANIQ

SEQ ID NO: 2279892 - protein, 7 aa, Cryptosporidium parvum
SDYGNDT

SEQ ID NO: 2279893 - protein, 4 aa, Cryptosporidium parvum
SDYN

SEQ ID NO: 2279894 - protein, 4 aa, Cryptosporidium parvum
SDYR

SEQ ID NO: 2279895 - protein, 10 aa, Cryptosporidium parvum
SDYSGKIRGH

SEQ ID NO: 2279896 - protein, 45 aa, Cryptosporidium parvum
SDYYSDDDDNVAYERETITKTVKTKPTVQTDKKHVAKQNQDKGVK

SEQ ID NO: 2279897 - protein, 9 aa, Cryptosporidium parvum
SEAATFGAS

SEQ ID NO: 2279898 - protein, 7 aa, Cryptosporidium parvum
SEADLTN

SEQ ID NO: 2279899 - protein, 6 aa, Cryptosporidium parvum
SEADQR

SEQ ID NO: 2279900 - protein, 5 aa, Cryptosporidium parvum
SEAET

SEQ ID NO: 2279901 - protein, 14 aa, Cryptosporidium parvum
SEAHMRKSKENNLN

SEQ ID NO: 2279902 - protein, 22 aa, Cryptosporidium parvum
SEAIIEEDTNKTLADSKQETNL

SEQ ID NO: 2279903 - protein, 4 aa, Cryptosporidium parvum
SEAK

SEQ ID NO: 2279904 - protein, 9 aa, Cryptosporidium parvum
SEAKGNDSS

SEQ ID NO: 2279905 - protein, 11 aa, Cryptosporidium parvum
SEALDSPNKTL

SEQ ID NO: 2279906 - protein, 9 aa, Cryptosporidium parvum
SEANSHASK

SEQ ID NO: 2279907 - protein, 16 aa, Cryptosporidium parvum
SEANSNIGTYAATSHA

SEQ ID NO: 2279908 - protein, 8 aa, Cryptosporidium parvum
SEANVPKN

SEQ ID NO: 2279909 - protein, 8 aa, Cryptosporidium parvum
SEAPEEPL

SEQ ID NO: 2279910 - protein, 7 aa, Cryptosporidium parvum
SEAPELQ

SEQ ID NO: 2279911 - protein, 6 aa, Cryptosporidium parvum
SEAPNY

SEQ ID NO: 2279912 - protein, 15 aa, Cryptosporidium parvum
SEAQVTVDKNKPTTN

SEQ ID NO: 2279913 - protein, 7 aa, Cryptosporidium parvum
SEARRTI

SEQ ID NO: 2279914 - protein, 12 aa, Cryptosporidium parvum
SEARSFSETYSQ

SEQ ID NO: 2279915 - protein, 7 aa, Cryptosporidium parvum
SEASDKF

SEQ ID NO: 2279916 - protein, 25 aa, Cryptosporidium parvum
SEASIYSSGGGNYDNNNNNSNNSNI

SEQ ID NO: 2279917 - protein, 6 aa, Cryptosporidium parvum
SEASKI

SEQ ID NO: 2279918 - protein, 5 aa, Cryptosporidium parvum
SEASN

SEQ ID NO: 2279919 - protein, 13 aa, Cryptosporidium parvum
SEASPSLEDILQV

SEQ ID NO: 2279920 - protein, 5 aa, Cryptosporidium parvum
SEATI

SEQ ID NO: 2279921 - protein, 6 aa, Cryptosporidium parvum
SEATQN

SEQ ID NO: 2279922 - protein, 6 aa, Cryptosporidium parvum
SECLNQ

SEQ ID NO: 2279923 - protein, 6 aa, Cryptosporidium parvum
SECQET

SEQ ID NO: 2279924 - protein, 11 aa, Cryptosporidium parvum
SECSDSSYSSF

SEQ ID NO: 2279925 - protein, 8 aa, Cryptosporidium parvum
SEDAGPEE

SEQ ID NO: 2279926 - protein, 8 aa, Cryptosporidium parvum
SEDASTIT

SEQ ID NO: 2279927 - protein, 9 aa, Cryptosporidium parvum
SEDATEEDL

SEQ ID NO: 2279928 - protein, 15 aa, Cryptosporidium parvum
SEDATNNEAFNSKAE

SEQ ID NO: 2279929 - protein, 5 aa, Cryptosporidium parvum
SEDCR

SEQ ID NO: 2279930 - protein, 47 aa, Cryptosporidium parvum
SEDDEDDYEDEDEGDEEENEEKEEEQVDKNEDKKDCSGKKHKKNGAV

SEQ ID NO: 2279931 - protein, 8 aa, Cryptosporidium parvum
SEDDEISR

SEQ ID NO: 2279932 - protein, 5 aa, Cryptosporidium parvum
SEDDH

SEQ ID NO: 2279933 - protein, 4 aa, Cryptosporidium parvum
SEDE

SEQ ID NO: 2279934 - protein, 33 aa, Cryptosporidium parvum
SEDEARDLKATELKNKRSSTTKSAIERRKKELS

SEQ ID NO: 2279935 - protein, 6 aa, Cryptosporidium parvum
SEDELR

SEQ ID NO: 2279936 - protein, 6 aa, Cryptosporidium parvum
SEDEMN

SEQ ID NO: 2279937 - protein, 9 aa, Cryptosporidium parvum
SEDESDSEN

SEQ ID NO: 2279938 - protein, 4 aa, Cryptosporidium parvum
SEDG

SEQ ID NO: 2279939 - protein, 15 aa, Cryptosporidium parvum
SEDGGVRGNDTGFGA

SEQ ID NO: 2279940 - protein, 7 aa, Cryptosporidium parvum
SEDGKTL

SEQ ID NO: 2279941 - protein, 6 aa, Cryptosporidium parvum
SEDGSL

SEQ ID NO: 2279942 - protein, 6 aa, Cryptosporidium parvum
SEDKQM

SEQ ID NO: 2279943 - protein, 17 aa, Cryptosporidium parvum
SEDKQVSNYQTQHGNDF

SEQ ID NO: 2279944 - protein, 8 aa, Cryptosporidium parvum
SEDLRTPV

SEQ ID NO: 2279945 - protein, 10 aa, Cryptosporidium parvum
SEDLSRGEEK

SEQ ID NO: 2279946 - protein, 7 aa, Cryptosporidium parvum
SEDLSSV

SEQ ID NO: 2279947 - protein, 13 aa, Cryptosporidium parvum
SEDMKSAKVHFLS

SEQ ID NO: 2279948 - protein, 4 aa, Cryptosporidium parvum
SEDN

SEQ ID NO: 2279949 - protein, 14 aa, Cryptosporidium parvum
SEDNGITSDSQSIN

SEQ ID NO: 2279950 - protein, 20 aa, Cryptosporidium parvum
SEDQESDNLTNSEQLDSTNM

SEQ ID NO: 2279951 - protein, 14 aa, Cryptosporidium parvum
SEDREKNIKNQSLN

SEQ ID NO: 2279952 - protein, 15 aa, Cryptosporidium parvum
SEDRIKKSNHENSSS

SEQ ID NO: 2279953 - protein, 6 aa, Cryptosporidium parvum
SEDRKR

SEQ ID NO: 2279954 - protein, 8 aa, Cryptosporidium parvum
SEDSSFQR

SEQ ID NO: 2279955 - protein, 18 aa, Cryptosporidium parvum
SEDTKHPIQNKENIKPKI

SEQ ID NO: 2279956 - protein, 6 aa, Cryptosporidium parvum
SEDTKV

SEQ ID NO: 2279957 - protein, 12 aa, Cryptosporidium parvum
SEEAEDSQLDEE

SEQ ID NO: 2279958 - protein, 16 aa, Cryptosporidium parvum
SEEASDENNSKESTHK

SEQ ID NO: 2279959 - protein, 8 aa, Cryptosporidium parvum
SEEDIEKT

SEQ ID NO: 2279960 - protein, 9 aa, Cryptosporidium parvum
SEEDKISTE

SEQ ID NO: 2279961 - protein, 13 aa, Cryptosporidium parvum
SEEDLELSKSDDA

SEQ ID NO: 2279962 - protein, 6 aa, Cryptosporidium parvum
SEEDQK

SEQ ID NO: 2279963 - protein, 7 aa, Cryptosporidium parvum
SEEEEIN

SEQ ID NO: 2279964 - protein, 5 aa, Cryptosporidium parvum
SEEEI

SEQ ID NO: 2279965 - protein, 10 aa, Cryptosporidium parvum
SEEEQGKSIS

SEQ ID NO: 2279966 - protein, 5 aa, Cryptosporidium parvum
SEEEV

SEQ ID NO: 2279967 - protein, 4 aa, Cryptosporidium parvum
SEEF

SEQ ID NO: 2279968 - protein, 14 aa, Cryptosporidium parvum
SEEGIKDENGSNSI

SEQ ID NO: 2279969 - protein, 8 aa, Cryptosporidium parvum
SEEHRMGP

SEQ ID NO: 2279970 - protein, 8 aa, Cryptosporidium parvum
SEEINSKI

SEQ ID NO: 2279971 - protein, 5 aa, Cryptosporidium parvum
SEEIQ

SEQ ID NO: 2279972 - protein, 14 aa, Cryptosporidium parvum
SEEISGDNSNKELI

SEQ ID NO: 2279973 - protein, 4 aa, Cryptosporidium parvum
SEEK

SEQ ID NO: 2279974 - protein, 6 aa, Cryptosporidium parvum
SEEKEL

SEQ ID NO: 2279975 - protein, 7 aa, Cryptosporidium parvum
SEEKHNT

SEQ ID NO: 2279976 - protein, 10 aa, Cryptosporidium parvum
SEEKKSLGIN

SEQ ID NO: 2279977 - protein, 20 aa, Cryptosporidium parvum
SEELERASEFASKAEANEST

SEQ ID NO: 2279978 - protein, 16 aa, Cryptosporidium parvum
SEELPQSKNISLTSNT

SEQ ID NO: 2279979 - protein, 5 aa, Cryptosporidium parvum
SEEMR

SEQ ID NO: 2279980 - protein, 27 aa, Cryptosporidium parvum
SEENKSSSNNFNSSIGGGNSISTNSHE

SEQ ID NO: 2279981 - protein, 10 aa, Cryptosporidium parvum
SEENQDTNIE

SEQ ID NO: 2279982 - protein, 6 aa, Cryptosporidium parvum
SEEPGY

SEQ ID NO: 2279983 - protein, 16 aa, Cryptosporidium parvum
SEEPINVNSENPNATS

SEQ ID NO: 2279984 - protein, 6 aa, Cryptosporidium parvum
SEEQEV

SEQ ID NO: 2279985 - protein, 9 aa, Cryptosporidium parvum
SEEQGFEDF

SEQ ID NO: 2279986 - protein, 5 aa, Cryptosporidium parvum
SEEQK

SEQ ID NO: 2279987 - protein, 26 aa, Cryptosporidium parvum
SEERGEGEEEGGTRRRKGRSGEEEEE

SEQ ID NO: 2279988 - protein, 12 aa, Cryptosporidium parvum
SEESKDLNNEKN

SEQ ID NO: 2279989 - protein, 7 aa, Cryptosporidium parvum
SEESTIE

SEQ ID NO: 2279990 - protein, 5 aa, Cryptosporidium parvum
SEETG

SEQ ID NO: 2279991 - protein, 8 aa, Cryptosporidium parvum
SEETKRSY

SEQ ID NO: 2279992 - protein, 6 aa, Cryptosporidium parvum
SEETNE

SEQ ID NO: 2279993 - protein, 9 aa, Cryptosporidium parvum
SEETPEKRR

SEQ ID NO: 2279994 - protein, 13 aa, Cryptosporidium parvum
SEETTESSNHNHS

SEQ ID NO: 2279995 - protein, 5 aa, Cryptosporidium parvum
SEETV

SEQ ID NO: 2279996 - protein, 6 aa, Cryptosporidium parvum
SEFDKE

SEQ ID NO: 2279997 - protein, 10 aa, Cryptosporidium parvum
SEFESDNNSY

SEQ ID NO: 2279998 - protein, 8 aa, Cryptosporidium parvum
SEFGNPDS

SEQ ID NO: 2279999 - protein, 25 aa, Cryptosporidium parvum
SEFNDETQESDTDDSLTDEKYAEST

SEQ ID NO: 2280000 - protein, 6 aa, Cryptosporidium parvum
SEFNNQ

SEQ ID NO: 2280001 - protein, 5 aa, Cryptosporidium parvum
SEFNQ

SEQ ID NO: 2280002 - protein, 24 aa, Cryptosporidium parvum
SEFNQEQKQQKQEQEQEQEQEQEN

SEQ ID NO: 2280003 - protein, 5 aa, Cryptosporidium parvum
SEFNS

SEQ ID NO: 2280004 - protein, 6 aa, Cryptosporidium parvum
SEFPAN

SEQ ID NO: 2280005 - protein, 26 aa, Cryptosporidium parvum
SEFPDEKGVAAQDDLNESSEGKSKIN

SEQ ID NO: 2280006 - protein, 20 aa, Cryptosporidium parvum
SEFQANSDSSKDQKSGNKED

SEQ ID NO: 2280007 - protein, 12 aa, Cryptosporidium parvum
SEFQNKENEINQ

SEQ ID NO: 2280008 - protein, 6 aa, Cryptosporidium parvum
SEFQNS

SEQ ID NO: 2280009 - protein, 14 aa, Cryptosporidium parvum
SEFSASSHNKQEEA

SEQ ID NO: 2280010 - protein, 9 aa, Cryptosporidium parvum
SEFSEEEKQ

SEQ ID NO: 2280011 - protein, 24 aa, Cryptosporidium parvum
SEFSNNNKSIKRVKAGNNNNEIAE

SEQ ID NO: 2280012 - protein, 10 aa, Cryptosporidium parvum
SEFSNTTNRM

SEQ ID NO: 2280013 - protein, 8 aa, Cryptosporidium parvum
SEGAETNR

SEQ ID NO: 2280014 - protein, 7 aa, Cryptosporidium parvum
SEGFPRS

SEQ ID NO: 2280015 - protein, 51 aa, Cryptosporidium parvum
SEGGGTGAGGGTEEGGGSSSSLAATSSVNSINPSESVGTEGNSAGVTGDNA

SEQ ID NO: 2280016 - protein, 9 aa, Cryptosporidium parvum
SEGGKGSDI

SEQ ID NO: 2280017 - protein, 6 aa, Cryptosporidium parvum
SEGGLS

SEQ ID NO: 2280018 - protein, 9 aa, Cryptosporidium parvum
SEGIGPDSN

SEQ ID NO: 2280019 - protein, 9 aa, Cryptosporidium parvum
SEGKAPNGV

SEQ ID NO: 2280020 - protein, 19 aa, Cryptosporidium parvum
SEGKDGNSIDSKDLDNSEG

SEQ ID NO: 2280021 - protein, 6 aa, Cryptosporidium parvum
SEGKNI

SEQ ID NO: 2280022 - protein, 19 aa, Cryptosporidium parvum
SEGNNGDPEGNISNLPTKK

SEQ ID NO: 2280023 - protein, 13 aa, Cryptosporidium parvum
SEGRKSEFNDERE

SEQ ID NO: 2280024 - protein, 8 aa, Cryptosporidium parvum
SEGSIKNK

SEQ ID NO: 2280025 - protein, 6 aa, Cryptosporidium parvum
SEGSYS

SEQ ID NO: 2280026 - protein, 4 aa, Cryptosporidium parvum
SEGT

SEQ ID NO: 2280027 - protein, 12 aa, Cryptosporidium parvum
SEGYKSIQENPQ

SEQ ID NO: 2280028 - protein, 5 aa, Cryptosporidium parvum
SEHEK

SEQ ID NO: 2280029 - protein, 7 aa, Cryptosporidium parvum
SEHENKE

SEQ ID NO: 2280030 - protein, 7 aa, Cryptosporidium parvum
SEHYQTS

SEQ ID NO: 2280031 - protein, 7 aa, Cryptosporidium parvum
SEIDDCE

SEQ ID NO: 2280032 - protein, 5 aa, Cryptosporidium parvum
SEIEN

SEQ ID NO: 2280033 - protein, 12 aa, Cryptosporidium parvum
SEIENGTKKPIR

SEQ ID NO: 2280034 - protein, 4 aa, Cryptosporidium parvum
SEIG

SEQ ID NO: 2280035 - protein, 5 aa, Cryptosporidium parvum
SEIGD

SEQ ID NO: 2280036 - protein, 9 aa, Cryptosporidium parvum
SEIGENGGI

SEQ ID NO: 2280037 - protein, 13 aa, Cryptosporidium parvum
SEIGSGDDISSRY

SEQ ID NO: 2280038 - protein, 6 aa, Cryptosporidium parvum
SEIGSR

SEQ ID NO: 2280039 - protein, 4 aa, Cryptosporidium parvum
SEIN

SEQ ID NO: 2280040 - protein, 12 aa, Cryptosporidium parvum
SEINKENYQGNT

SEQ ID NO: 2280041 - protein, 26 aa, Cryptosporidium parvum
SEINSDNLSSKDSFEFKNDNNNNNNI

SEQ ID NO: 2280042 - protein, 8 aa, Cryptosporidium parvum
SEINSNGK

SEQ ID NO: 2280043 - protein, 4 aa, Cryptosporidium parvum
SEIP

SEQ ID NO: 2280044 - protein, 5 aa, Cryptosporidium parvum
SEIPK

SEQ ID NO: 2280045 - protein, 5 aa, Cryptosporidium parvum
SEIPQ

SEQ ID NO: 2280046 - protein, 6 aa, Cryptosporidium parvum
SEIPSD

SEQ ID NO: 2280047 - protein, 15 aa, Cryptosporidium parvum
SEIQDEAESKRKRKS

SEQ ID NO: 2280048 - protein, 9 aa, Cryptosporidium parvum
SEIQSEKEI

SEQ ID NO: 2280049 - protein, 9 aa, Cryptosporidium parvum
SEISPASTF

SEQ ID NO: 2280050 - protein, 58 aa, Cryptosporidium parvum
SEISPSDVEGRHGLSTEEGLGNEHMSEKDINSDNENGSSSNNLECNNSNGETNAETDF

SEQ ID NO: 2280051 - protein, 8 aa, Cryptosporidium parvum
SEITANES

SEQ ID NO: 2280052 - protein, 6 aa, Cryptosporidium parvum
SEITGK

SEQ ID NO: 2280053 - protein, 16 aa, Cryptosporidium parvum
SEITPEAQEIVDNYIN

SEQ ID NO: 2280054 - protein, 4 aa, Cryptosporidium parvum
SEIY

SEQ ID NO: 2280055 - protein, 4 aa, Cryptosporidium parvum
SEKA

SEQ ID NO: 2280056 - protein, 11 aa, Cryptosporidium parvum
SEKARTRNPDE

SEQ ID NO: 2280057 - protein, 7 aa, Cryptosporidium parvum
SEKDHRK

SEQ ID NO: 2280058 - protein, 10 aa, Cryptosporidium parvum
SEKDPNPEEI

SEQ ID NO: 2280059 - protein, 5 aa, Cryptosporidium parvum
SEKEE

SEQ ID NO: 2280060 - protein, 13 aa, Cryptosporidium parvum
SEKEEEKSDDDFF

SEQ ID NO: 2280061 - protein, 12 aa, Cryptosporidium parvum
SEKEKAQKGIYD

SEQ ID NO: 2280062 - protein, 5 aa, Cryptosporidium parvum
SEKER

SEQ ID NO: 2280063 - protein, 16 aa, Cryptosporidium parvum
SEKESETLKPKLDKEL

SEQ ID NO: 2280064 - protein, 4 aa, Cryptosporidium parvum
SEKF

SEQ ID NO: 2280065 - protein, 7 aa, Cryptosporidium parvum
SEKFPSK

SEQ ID NO: 2280066 - protein, 5 aa, Cryptosporidium parvum
SEKGE

SEQ ID NO: 2280067 - protein, 4 aa, Cryptosporidium parvum
SEKI

SEQ ID NO: 2280068 - protein, 16 aa, Cryptosporidium parvum
SEKISKRENIRSNSSE

SEQ ID NO: 2280069 - protein, 18 aa, Cryptosporidium parvum
SEKKGNLSIKADPKYDTG

SEQ ID NO: 2280070 - protein, 22 aa, Cryptosporidium parvum
SEKKKEKRSKEVEKNSKKKVSE

SEQ ID NO: 2280071 - protein, 20 aa, Cryptosporidium parvum
SEKKSSNTTLKANDNQEFTN

SEQ ID NO: 2280072 - protein, 22 aa, Cryptosporidium parvum
SEKKSVSQPKRGTTESRPTLQK

SEQ ID NO: 2280073 - protein, 9 aa, Cryptosporidium parvum
SEKKSYSSY

SEQ ID NO: 2280074 - protein, 19 aa, Cryptosporidium parvum
SEKNIENLTETSNENKTFA

SEQ ID NO: 2280075 - protein, 10 aa, Cryptosporidium parvum
SEKNNKSQLS

SEQ ID NO: 2280076 - protein, 10 aa, Cryptosporidium parvum
SEKNNSDEIL

SEQ ID NO: 2280077 - protein, 10 aa, Cryptosporidium parvum
SEKNSSNSLA

SEQ ID NO: 2280078 - protein, 8 aa, Cryptosporidium parvum
SEKRKDFE

SEQ ID NO: 2280079 - protein, 13 aa, Cryptosporidium parvum
SEKRNDTNKFPDS

SEQ ID NO: 2280080 - protein, 8 aa, Cryptosporidium parvum
SEKSYQEL

SEQ ID NO: 2280081 - protein, 8 aa, Cryptosporidium parvum
SEKTENES

SEQ ID NO: 2280082 - protein, 5 aa, Cryptosporidium parvum
SEKTI

SEQ ID NO: 2280083 - protein, 8 aa, Cryptosporidium parvum
SEKTTDKE

SEQ ID NO: 2280084 - protein, 8 aa, Cryptosporidium parvum
SEKTTSKI

SEQ ID NO: 2280085 - protein, 7 aa, Cryptosporidium parvum
SEKVDYN

SEQ ID NO: 2280086 - protein, 7 aa, Cryptosporidium parvum
SEKYTET

SEQ ID NO: 2280087 - protein, 13 aa, Cryptosporidium parvum
SELAEKKVEYENS

SEQ ID NO: 2280088 - protein, 10 aa, Cryptosporidium parvum
SELEAREEEI

SEQ ID NO: 2280089 - protein, 12 aa, Cryptosporidium parvum
SELEDYKKTNCE

SEQ ID NO: 2280090 - protein, 6 aa, Cryptosporidium parvum
SELISD

SEQ ID NO: 2280091 - protein, 15 aa, Cryptosporidium parvum
SELISNSKKVSQEDI

SEQ ID NO: 2280092 - protein, 32 aa, Cryptosporidium parvum
SELKKAEKKRKSLNKNKNKSEEEKSTTLTEND

SEQ ID NO: 2280093 - protein, 18 aa, Cryptosporidium parvum
SELNNSNNLKSKSALDNI

SEQ ID NO: 2280094 - protein, 13 aa, Cryptosporidium parvum
SELNTSNKISSTN

SEQ ID NO: 2280095 - protein, 11 aa, Cryptosporidium parvum
SELPTGNPGAT

SEQ ID NO: 2280096 - protein, 25 aa, Cryptosporidium parvum
SELQSNKRSSINKNPPADNSKKGGI

SEQ ID NO: 2280097 - protein, 20 aa, Cryptosporidium parvum
SELRTENNEFDKRTSKDSLT

SEQ ID NO: 2280098 - protein, 14 aa, Cryptosporidium parvum
SELSEKEQKKMEQK

SEQ ID NO: 2280099 - protein, 20 aa, Cryptosporidium parvum
SELSKENIPSTRSLQPNDEI

SEQ ID NO: 2280100 - protein, 10 aa, Cryptosporidium parvum
SELSKPQKIE

SEQ ID NO: 2280101 - protein, 10 aa, Cryptosporidium parvum
SELSQDSKEH

SEQ ID NO: 2280102 - protein, 13 aa, Cryptosporidium parvum
SELTDPEKITGGW

SEQ ID NO: 2280103 - protein, 9 aa, Cryptosporidium parvum
SEMGSAGAL

SEQ ID NO: 2280104 - protein, 4 aa, Cryptosporidium parvum
SEMH

SEQ ID NO: 2280105 - protein, 13 aa, Cryptosporidium parvum
SEMNEAKRNQLAS

SEQ ID NO: 2280106 - protein, 8 aa, Cryptosporidium parvum
SEMPHSLD

SEQ ID NO: 2280107 - protein, 5 aa, Cryptosporidium parvum
SENAI

SEQ ID NO: 2280108 - protein, 14 aa, Cryptosporidium parvum
SENAKEVIKAVERA

SEQ ID NO: 2280109 - protein, 23 aa, Cryptosporidium parvum
SENCRSKSASPTSSENREKNNCG

SEQ ID NO: 2280110 - protein, 12 aa, Cryptosporidium parvum
SENDDNNHNNRN

SEQ ID NO: 2280111 - protein, 12 aa, Cryptosporidium parvum
SENDENNNINSQ

SEQ ID NO: 2280112 - protein, 13 aa, Cryptosporidium parvum
SENDNTNFSKESN

SEQ ID NO: 2280113 - protein, 12 aa, Cryptosporidium parvum
SENDQLKRILES

SEQ ID NO: 2280114 - protein, 7 aa, Cryptosporidium parvum
SENDTTY

SEQ ID NO: 2280115 - protein, 8 aa, Cryptosporidium parvum
SENEASQL

SEQ ID NO: 2280116 - protein, 6 aa, Cryptosporidium parvum
SENEKD

SEQ ID NO: 2280117 - protein, 17 aa, Cryptosporidium parvum
SENEKLKNEGDEGHEDY

SEQ ID NO: 2280118 - protein, 5 aa, Cryptosporidium parvum
SENEM

SEQ ID NO: 2280119 - protein, 15 aa, Cryptosporidium parvum
SENENNSKKLSSRTC

SEQ ID NO: 2280120 - protein, 13 aa, Cryptosporidium parvum
SENESENSDPDLG

SEQ ID NO: 2280121 - protein, 15 aa, Cryptosporidium parvum
SENGACASDSEVDDE

SEQ ID NO: 2280122 - protein, 5 aa, Cryptosporidium parvum
SENGE

SEQ ID NO: 2280123 - protein, 13 aa, Cryptosporidium parvum
SENGNFKNQSLSG

SEQ ID NO: 2280124 - protein, 9 aa, Cryptosporidium parvum
SENIENRNR

SEQ ID NO: 2280125 - protein, 5 aa, Cryptosporidium parvum
SENIN

SEQ ID NO: 2280126 - protein, 13 aa, Cryptosporidium parvum
SENINDKNNSHTN

SEQ ID NO: 2280127 - protein, 13 aa, Cryptosporidium parvum
SENKANERNQEIS

SEQ ID NO: 2280128 - protein, 22 aa, Cryptosporidium parvum
SENKGEILENSGADSSDSKLDN

SEQ ID NO: 2280129 - protein, 6 aa, Cryptosporidium parvum
SENKTE

SEQ ID NO: 2280130 - protein, 4 aa, Cryptosporidium parvum
SENL

SEQ ID NO: 2280131 - protein, 12 aa, Cryptosporidium parvum
SENLNKKSNQET

SEQ ID NO: 2280132 - protein, 4 aa, Cryptosporidium parvum
SENN

SEQ ID NO: 2280133 - protein, 5 aa, Cryptosporidium parvum
SENNI

SEQ ID NO: 2280134 - protein, 5 aa, Cryptosporidium parvum
SENNK

SEQ ID NO: 2280135 - protein, 14 aa, Cryptosporidium parvum
SENNKLKKENQKLK

SEQ ID NO: 2280136 - protein, 7 aa, Cryptosporidium parvum
SENNPKE

SEQ ID NO: 2280137 - protein, 8 aa, Cryptosporidium parvum
SENNRQLN

SEQ ID NO: 2280138 - protein, 5 aa, Cryptosporidium parvum
SENNS

SEQ ID NO: 2280139 - protein, 13 aa, Cryptosporidium parvum
SENNSDESKENME

SEQ ID NO: 2280140 - protein, 5 aa, Cryptosporidium parvum
SENPK

SEQ ID NO: 2280141 - protein, 5 aa, Cryptosporidium parvum
SENQD

SEQ ID NO: 2280142 - protein, 6 aa, Cryptosporidium parvum
SENQDM

SEQ ID NO: 2280143 - protein, 9 aa, Cryptosporidium parvum
SENQNSDSS

SEQ ID NO: 2280144 - protein, 6 aa, Cryptosporidium parvum
SENQQW

SEQ ID NO: 2280145 - protein, 7 aa, Cryptosporidium parvum
SENQSNE

SEQ ID NO: 2280146 - protein, 4 aa, Cryptosporidium parvum
SENR

SEQ ID NO: 2280147 - protein, 6 aa, Cryptosporidium parvum
SENRDS

SEQ ID NO: 2280148 - protein, 6 aa, Cryptosporidium parvum
SENREI

SEQ ID NO: 2280149 - protein, 5 aa, Cryptosporidium parvum
SENRM

SEQ ID NO: 2280150 - protein, 4 aa, Cryptosporidium parvum
SENS

SEQ ID NO: 2280151 - protein, 9 aa, Cryptosporidium parvum
SENSENNQH

SEQ ID NO: 2280152 - protein, 8 aa, Cryptosporidium parvum
SENSGERI

SEQ ID NO: 2280153 - protein, 12 aa, Cryptosporidium parvum
SENSISCNNSNN

SEQ ID NO: 2280154 - protein, 9 aa, Cryptosporidium parvum
SENSNHDDN

SEQ ID NO: 2280155 - protein, 7 aa, Cryptosporidium parvum
SENSSFA

SEQ ID NO: 2280156 - protein, 7 aa, Cryptosporidium parvum
SENSSNS

SEQ ID NO: 2280157 - protein, 8 aa, Cryptosporidium parvum
SENTKNGC

SEQ ID NO: 2280158 - protein, 5 aa, Cryptosporidium parvum
SENTL

SEQ ID NO: 2280159 - protein, 15 aa, Cryptosporidium parvum
SENVSQYQTEQINET

SEQ ID NO: 2280160 - protein, 10 aa, Cryptosporidium parvum
SENYGKNSSL

SEQ ID NO: 2280161 - protein, 25 aa, Cryptosporidium parvum
SENYNNTKFPKVSEELDSEKTIVGG

SEQ ID NO: 2280162 - protein, 17 aa, Cryptosporidium parvum
SENYRELQKKKDEEEVR

SEQ ID NO: 2280163 - protein, 5 aa, Cryptosporidium parvum
SEPAH

SEQ ID NO: 2280164 - protein, 6 aa, Cryptosporidium parvum
SEPAQL

SEQ ID NO: 2280165 - protein, 8 aa, Cryptosporidium parvum
SEPDRGYD

SEQ ID NO: 2280166 - protein, 6 aa, Cryptosporidium parvum
SEPENG

SEQ ID NO: 2280167 - protein, 8 aa, Cryptosporidium parvum
SEPHKESA

SEQ ID NO: 2280168 - protein, 4 aa, Cryptosporidium parvum
SEPI

SEQ ID NO: 2280169 - protein, 7 aa, Cryptosporidium parvum
SEPIPDN

SEQ ID NO: 2280170 - protein, 17 aa, Cryptosporidium parvum
SEPKGDDSTNNISNPEE

SEQ ID NO: 2280171 - protein, 6 aa, Cryptosporidium parvum
SEPLID

SEQ ID NO: 2280172 - protein, 5 aa, Cryptosporidium parvum
SEPNA

SEQ ID NO: 2280173 - protein, 7 aa, Cryptosporidium parvum
SEPNRDV

SEQ ID NO: 2280174 - protein, 7 aa, Cryptosporidium parvum
SEPNSDI

SEQ ID NO: 2280175 - protein, 15 aa, Cryptosporidium parvum
SEPNSKSSSRSPSIS

SEQ ID NO: 2280176 - protein, 7 aa, Cryptosporidium parvum
SEPQRCN

SEQ ID NO: 2280177 - protein, 18 aa, Cryptosporidium parvum
SEPRNYTPVSSKNISDIK

SEQ ID NO: 2280178 - protein, 8 aa, Cryptosporidium parvum
SEPRTSSI

SEQ ID NO: 2280179 - protein, 7 aa, Cryptosporidium parvum
SEPSKQF

SEQ ID NO: 2280180 - protein, 10 aa, Cryptosporidium parvum
SEPSNATEMV

SEQ ID NO: 2280181 - protein, 22 aa, Cryptosporidium parvum
SEPTGVTNLPSYSANNDRKKEI

SEQ ID NO: 2280182 - protein, 4 aa, Cryptosporidium parvum
SEPV

SEQ ID NO: 2280183 - protein, 9 aa, Cryptosporidium parvum
SEPYGKSGC

SEQ ID NO: 2280184 - protein, 10 aa, Cryptosporidium parvum
SEQAKAKAET

SEQ ID NO: 2280185 - protein, 6 aa, Cryptosporidium parvum
SEQDFD

SEQ ID NO: 2280186 - protein, 6 aa, Cryptosporidium parvum
SEQDGT

SEQ ID NO: 2280187 - protein, 7 aa, Cryptosporidium parvum
SEQDKKL

SEQ ID NO: 2280188 - protein, 21 aa, Cryptosporidium parvum
SEQDVTSPSGSKKDNETITSN

SEQ ID NO: 2280189 - protein, 30 aa, Cryptosporidium parvum; identical to SEQ ID NO: 2160677

SEQ ID NO: 2280190 - protein, 6 aa, Cryptosporidium parvum
SEQEEP

SEQ ID NO: 2280191 - protein, 6 aa, Cryptosporidium parvum
SEQEIK

SEQ ID NO: 2280192 - protein, 6 aa, Cryptosporidium parvum
SEQELL

SEQ ID NO: 2280193 - protein, 9 aa, Cryptosporidium parvum
SEQEQKSLE

SEQ ID NO: 2280194 - protein, 43 aa, Cryptosporidium parvum
SEQEQTSTEHGDNKSSNNDDQERNNKRISYSNLDDSGISSQMH

SEQ ID NO: 2280195 - protein, 18 aa, Cryptosporidium parvum
SEQGTNSPHTSLSQVPAQ

SEQ ID NO: 2280196 - protein, 14 aa, Cryptosporidium parvum
SEQKFNDKGNKDYY

SEQ ID NO: 2280197 - protein, 5 aa, Cryptosporidium parvum
SEQKL

SEQ ID NO: 2280198 - protein, 8 aa, Cryptosporidium parvum
SEQLNSKM

SEQ ID NO: 2280199 - protein, 5 aa, Cryptosporidium parvum
SEQNK

SEQ ID NO: 2280200 - protein, 7 aa, Cryptosporidium parvum
SEQPEGQ

SEQ ID NO: 2280201 - protein, 14 aa, Cryptosporidium parvum
SEQSNPNNSLPSKI

SEQ ID NO: 2280202 - protein, 10 aa, Cryptosporidium parvum
SEQSRADIGY

SEQ ID NO: 2280203 - protein, 11 aa, Cryptosporidium parvum
SEQVNGGGGDF

SEQ ID NO: 2280204 - protein, 14 aa, Cryptosporidium parvum
SEQYDTEKQISDEQ

SEQ ID NO: 2280205 - protein, 4 aa, Cryptosporidium parvum
SERD

SEQ ID NO: 2280206 - protein, 8 aa, Cryptosporidium parvum
SERDALER

SEQ ID NO: 2280207 - protein, 9 aa, Cryptosporidium parvum
SERDSGSGE

SEQ ID NO: 2280208 - protein, 6 aa, Cryptosporidium parvum
SERERK

SEQ ID NO: 2280209 - protein, 14 aa, Cryptosporidium parvum
SERESKGNTRIKYE

SEQ ID NO: 2280210 - protein, 9 aa, Cryptosporidium parvum
SERGDVNTK

SEQ ID NO: 2280211 - protein, 4 aa, Cryptosporidium parvum
SERI

SEQ ID NO: 2280212 - protein, 8 aa, Cryptosporidium parvum
SERKEVKE

SEQ ID NO: 2280213 - protein, 7 aa, Cryptosporidium parvum
SERKRAK

SEQ ID NO: 2280214 - protein, 14 aa, Cryptosporidium parvum
SERNSLKDEREQLN

SEQ ID NO: 2280215 - protein, 12 aa, Cryptosporidium parvum
SERPPTPPRSAT

SEQ ID NO: 2280216 - protein, 6 aa, Cryptosporidium parvum
SERPRT

SEQ ID NO: 2280217 - protein, 10 aa, Cryptosporidium parvum
SERPSPRISS

SEQ ID NO: 2280218 - protein, 10 aa, Cryptosporidium parvum
SERRAKEKNI

SEQ ID NO: 2280219 - protein, 5 aa, Cryptosporidium parvum
SERRD

SEQ ID NO: 2280220 - protein, 11 aa, Cryptosporidium parvum
SERRQYYSETD

SEQ ID NO: 2280221 - protein, 4 aa, Cryptosporidium parvum
SERS

SEQ ID NO: 2280222 - protein, 14 aa, Cryptosporidium parvum
SERSEVSENEIDTY

SEQ ID NO: 2280223 - protein, 7 aa, Cryptosporidium parvum
SERVGES

SEQ ID NO: 2280224 - protein, 13 aa, Cryptosporidium parvum
SERVIDKDNKQKH

SEQ ID NO: 2280225 - protein, 13 aa, Cryptosporidium parvum
SESADKDERNQSL

SEQ ID NO: 2280226 - protein, 6 aa, Cryptosporidium parvum
SESALT

SEQ ID NO: 2280227 - protein, 4 aa, Cryptosporidium parvum
SESD

SEQ ID NO: 2280228 - protein, 11 aa, Cryptosporidium parvum
SESDGGDGSAI

SEQ ID NO: 2280229 - protein, 5 aa, Cryptosporidium parvum
SESDI

SEQ ID NO: 2280230 - protein, 7 aa, Cryptosporidium parvum
SESDQLT

SEQ ID NO: 2280231 - protein, 11 aa, Cryptosporidium parvum
SESDTSKLETN

SEQ ID NO: 2280232 - protein, 12 aa, Cryptosporidium parvum
SESEESDYDESD

SEQ ID NO: 2280233 - protein, 7 aa, Cryptosporidium parvum
SESELPT

SEQ ID NO: 2280234 - protein, 8 aa, Cryptosporidium parvum
SESERESH

SEQ ID NO: 2280235 - protein, 26 aa, Cryptosporidium parvum
SESESEPESDSDPDPDQNSDQDSELK

SEQ ID NO: 2280236 - protein, 5 aa, Cryptosporidium parvum
SESFD

SEQ ID NO: 2280237 - protein, 5 aa, Cryptosporidium parvum
SESFS

SEQ ID NO: 2280238 - protein, 4 aa, Cryptosporidium parvum
SESG

SEQ ID NO: 2280239 - protein, 11 aa, Cryptosporidium parvum
SESGKLQGKIV

SEQ ID NO: 2280240 - protein, 4 aa, Cryptosporidium parvum
SESH

SEQ ID NO: 2280241 - protein, 9 aa, Cryptosporidium parvum
SESHENTKY

SEQ ID NO: 2280242 - protein, 4 aa, Cryptosporidium parvum
SESI

SEQ ID NO: 2280243 - protein, 8 aa, Cryptosporidium parvum
SESISDKP

SEQ ID NO: 2280244 - protein, 12 aa, Cryptosporidium parvum
SESISKNNNISE

SEQ ID NO: 2280245 - protein, 8 aa, Cryptosporidium parvum
SESISNQK

SEQ ID NO: 2280246 - protein, 7 aa, Cryptosporidium parvum
SESITSP

SEQ ID NO: 2280247 - protein, 15 aa, Cryptosporidium parvum
SESKIDSIPRLPSNI

SEQ ID NO: 2280248 - protein, 5 aa, Cryptosporidium parvum
SESKK

SEQ ID NO: 2280249 - protein, 6 aa, Cryptosporidium parvum
SESKNI

SEQ ID NO: 2280250 - protein, 10 aa, Cryptosporidium parvum
SESLATNSPE

SEQ ID NO: 2280251 - protein, 8 aa, Cryptosporidium parvum
SESLSGVV

SEQ ID NO: 2280252 - protein, 4 aa, Cryptosporidium parvum
SESN

SEQ ID NO: 2280253 - protein, 6 aa, Cryptosporidium parvum
SESNDL

SEQ ID NO: 2280254 - protein, 6 aa, Cryptosporidium parvum
SESNEK

SEQ ID NO: 2280255 - protein, 5 aa, Cryptosporidium parvum
SESNM

SEQ ID NO: 2280256 - protein, 15 aa, Cryptosporidium parvum
SESNNKKDSDTSMND

SEQ ID NO: 2280257 - protein, 8 aa, Cryptosporidium parvum
SESNSYDI

SEQ ID NO: 2280258 - protein, 12 aa, Cryptosporidium parvum
SESNTDLCTSDS

SEQ ID NO: 2280259 - protein, 7 aa, Cryptosporidium parvum
SESNTEW

SEQ ID NO: 2280260 - protein, 4 aa, Cryptosporidium parvum
SESP

SEQ ID NO: 2280261 - protein, 8 aa, Cryptosporidium parvum
SESPFRRD

SEQ ID NO: 2280262 - protein, 7 aa, Cryptosporidium parvum
SESPNLA

SEQ ID NO: 2280263 - protein, 7 aa, Cryptosporidium parvum
SESRKTD

SEQ ID NO: 2280264 - protein, 4 aa, Cryptosporidium parvum
SESS

SEQ ID NO: 2280265 - protein, 5 aa, Cryptosporidium parvum
SESSE

SEQ ID NO: 2280266 - protein, 9 aa, Cryptosporidium parvum
SESSETLNS

SEQ ID NO: 2280267 - protein, 11 aa, Cryptosporidium parvum
SESSISNTKKI

SEQ ID NO: 2280268 - protein, 8 aa, Cryptosporidium parvum
SESSKSQL

SEQ ID NO: 2280269 - protein, 8 aa, Cryptosporidium parvum
SESSLTPN

SEQ ID NO: 2280270 - protein, 12 aa, Cryptosporidium parvum
SESSNKGSEAPE

SEQ ID NO: 2280271 - protein, 9 aa, Cryptosporidium parvum
SESSNKYGI

SEQ ID NO: 2280272 - protein, 9 aa, Cryptosporidium parvum
SESSVQDKP

SEQ ID NO: 2280273 - protein, 7 aa, Cryptosporidium parvum
SESTSIP

SEQ ID NO: 2280274 - protein, 9 aa, Cryptosporidium parvum
SESTTNESL

SEQ ID NO: 2280275 - protein, 12 aa, Cryptosporidium parvum
SESVRGRTSRIP

SEQ ID NO: 2280276 - protein, 4 aa, Cryptosporidium parvum
SESY

SEQ ID NO: 2280277 - protein, 6 aa, Cryptosporidium parvum
SESYDS

SEQ ID NO: 2280278 - protein, 17 aa, Cryptosporidium parvum
SETCCSKNKKKKRSAPL

SEQ ID NO: 2280279 - protein, 20 aa, Cryptosporidium parvum
SETCSSVNPSIKDEEYSNFT

SEQ ID NO: 2280280 - protein, 8 aa, Cryptosporidium parvum
SETDSSEI

SEQ ID NO: 2280281 - protein, 4 aa, Cryptosporidium parvum
SETE

SEQ ID NO: 2280282 - protein, 12 aa, Cryptosporidium parvum
SETEKKSYNGKI

SEQ ID NO: 2280283 - protein, 14 aa, Cryptosporidium parvum
SETITGTKDNNNIT

SEQ ID NO: 2280284 - protein, 7 aa, Cryptosporidium parvum
SETLGDE

SEQ ID NO: 2280285 - protein, 18 aa, Cryptosporidium parvum
SETLSKESSNLKKPPKHL

SEQ ID NO: 2280286 - protein, 7 aa, Cryptosporidium parvum
SETMEPE

SEQ ID NO: 2280287 - protein, 16 aa, Cryptosporidium parvum
SETNLDSEKTETEKNE

SEQ ID NO: 2280288 - protein, 15 aa, Cryptosporidium parvum
SETPTVVSSSETQLE

SEQ ID NO: 2280289 - protein, 12 aa, Cryptosporidium parvum
SETQPSRPLGCM

SEQ ID NO: 2280290 - protein, 4 aa, Cryptosporidium parvum
SETS

SEQ ID NO: 2280291 - protein, 7 aa, Cryptosporidium parvum
SETSPIS

SEQ ID NO: 2280292 - protein, 8 aa, Cryptosporidium parvum
SETSVNTD

SEQ ID NO: 2280293 - protein, 6 aa, Cryptosporidium parvum
SETTIP

SEQ ID NO: 2280294 - protein, 62 aa, Cryptosporidium parvum
SETTPAPPPTPTATANPKPRKNPKEAPKKDSTPSSPPIPQSSQIQPTSQPQPQPQPPAEESS

SEQ ID NO: 2280295 - protein, 47 aa, Cryptosporidium parvum
SETTPAPPPTPTATINPEPTKVPTDAKENLASSPPPPSPPPPAEESS

SEQ ID NO: 2280296 - protein, 48 aa, Cryptosporidium parvum
SETTPAPPPTPTITENPTQNNPSTNNLQIPNPSNPTPSPTPQTAEDSS

SEQ ID NO: 2280297 - protein, 10 aa, Cryptosporidium parvum
SETTSQDTNF

SEQ ID NO: 2280298 - protein, 7 aa, Cryptosporidium parvum
SETVPES

SEQ ID NO: 2280299 - protein, 8 aa, Cryptosporidium parvum
SEVDSSPY

SEQ ID NO: 2280300 - protein, 9 aa, Cryptosporidium parvum
SEVESQNIK

SEQ ID NO: 2280301 - protein, 7 aa, Cryptosporidium parvum
SEVETDK

SEQ ID NO: 2280302 - protein, 21 aa, Cryptosporidium parvum
SEVNKNSSSISQEKNKSSNEI

SEQ ID NO: 2280303 - protein, 6 aa, Cryptosporidium parvum
SEVPST

SEQ ID NO: 2280304 - protein, 4 aa, Cryptosporidium parvum
SEVR

SEQ ID NO: 2280305 - protein, 7 aa, Cryptosporidium parvum
SEVTGEH

SEQ ID NO: 2280306 - protein, 6 aa, Cryptosporidium parvum
SEVYTK

SEQ ID NO: 2280307 - protein, 10 aa, Cryptosporidium parvum
SEWSRSGLND

SEQ ID NO: 2280308 - protein, 9 aa, Cryptosporidium parvum
SEWTSEQQS

SEQ ID NO: 2280309 - protein, 6 aa, Cryptosporidium parvum
SEYARS

SEQ ID NO: 2280310 - protein, 13 aa, Cryptosporidium parvum
SEYASKLKDDEDN

SEQ ID NO: 2280311 - protein, 28 aa, Cryptosporidium parvum
SEYDPDKTYETEYTSSLEPIQPPINAPY

SEQ ID NO: 2280312 - protein, 10 aa, Cryptosporidium parvum
SEYKDSPHLE

SEQ ID NO: 2280313 - protein, 8 aa, Cryptosporidium parvum
SEYKGTDY

SEQ ID NO: 2280314 - protein, 5 aa, Cryptosporidium parvum
SEYKK

SEQ ID NO: 2280315 - protein, 10 aa, Cryptosporidium parvum
SEYKSDKQKL

SEQ ID NO: 2280316 - protein, 13 aa, Cryptosporidium parvum
SEYKSRKSASFRS

SEQ ID NO: 2280317 - protein, 17 aa, Cryptosporidium parvum
SEYNDRQGIKDRNKKIP

SEQ ID NO: 2280318 - protein, 15 aa, Cryptosporidium parvum
SEYNEQESPNYPNDD

SEQ ID NO: 2280319 - protein, 14 aa, Cryptosporidium parvum
SEYNGRGELATRQS

SEQ ID NO: 2280320 - protein, 12 aa, Cryptosporidium parvum
SEYQQHPISESE

SEQ ID NO: 2280321 - protein, 13 aa, Cryptosporidium parvum
SEYSDKNNAGTYY

SEQ ID NO: 2280322 - protein, 15 aa, Cryptosporidium parvum
SFAEKSSSEANSVPS

SEQ ID NO: 2280323 - protein, 6 aa, Cryptosporidium parvum
SFAKNN

SEQ ID NO: 2280324 - protein, 17 aa, Cryptosporidium parvum
SFDCDSDSNIEDNSNVF

SEQ ID NO: 2280325 - protein, 6 aa, Cryptosporidium parvum
SFDEDS

SEQ ID NO: 2280326 - protein, 11 aa, Cryptosporidium parvum
SFDNSKATCET

SEQ ID NO: 2280327 - protein, 7 aa, Cryptosporidium parvum
SFDPSKR

SEQ ID NO: 2280328 - protein, 13 aa, Cryptosporidium parvum
SFDSQTKETLTTK

SEQ ID NO: 2280329 - protein, 14 aa, Cryptosporidium parvum
SFEDKISKGENKER

SEQ ID NO: 2280330 - protein, 6 aa, Cryptosporidium parvum
SFEEEN

SEQ ID NO: 2280331 - protein, 23 aa, Cryptosporidium parvum
SFEFGGNTKESTRQKQKQEIEDF

SEQ ID NO: 2280332 - protein, 17 aa, Cryptosporidium parvum
SFEGKEFQEKESENKSS

SEQ ID NO: 2280333 - protein, 8 aa, Cryptosporidium parvum
SFEKNTNQ

SEQ ID NO: 2280334 - protein, 5 aa, Cryptosporidium parvum
SFEKS

SEQ ID NO: 2280335 - protein, 10 aa, Cryptosporidium parvum
SFENQVGNSL

SEQ ID NO: 2280336 - protein, 5 aa, Cryptosporidium parvum
SFENS

SEQ ID NO: 2280337 - protein, 6 aa, Cryptosporidium parvum
SFERPS

SEQ ID NO: 2280338 - protein, 5 aa, Cryptosporidium parvum
SFESL

SEQ ID NO: 2280339 - protein, 9 aa, Cryptosporidium parvum
SFESTEDDA

SEQ ID NO: 2280340 - protein, 4 aa, Cryptosporidium parvum
SFET

SEQ ID NO: 2280341 - protein, 5 aa, Cryptosporidium parvum
SFETT

SEQ ID NO: 2280342 - protein, 6 aa, Cryptosporidium parvum
SFGDNR

SEQ ID NO: 2280343 - protein, 15 aa, Cryptosporidium parvum
SFGGRSKDDSLQNNR

SEQ ID NO: 2280344 - protein, 4 aa, Cryptosporidium parvum
SFGK

SEQ ID NO: 2280345 - protein, 21 aa, Cryptosporidium parvum
SFGPSHSDYNYGDDEYREETV

SEQ ID NO: 2280346 - protein, 23 aa, Cryptosporidium parvum
SFGQQSKPDDNNHISYTSQDIPE

SEQ ID NO: 2280347 - protein, 10 aa, Cryptosporidium parvum
SFGSSGTTTL

SEQ ID NO: 2280348 - protein, 9 aa, Cryptosporidium parvum
SFGSSPGMY

SEQ ID NO: 2280349 - protein, 37 aa, Cryptosporidium parvum
SFGSSSSLESSPYSQYKPKSQTNYNLDSNSNSEENIS

SEQ ID NO: 2280350 - protein, 13 aa, Cryptosporidium parvum
SFGSSTFGKHKRV

SEQ ID NO: 2280351 - protein, 21 aa, Cryptosporidium parvum
SFGTSGGFGSQSSQSNPSSFF

SEQ ID NO: 2280352 - protein, 5 aa, Cryptosporidium parvum
SFHNS

SEQ ID NO: 2280353 - protein, 8 aa, Cryptosporidium parvum
SFHSPPPP

SEQ ID NO: 2280354 - protein, 10 aa, Cryptosporidium parvum
SFKDNEKTFE

SEQ ID NO: 2280355 - protein, 4 aa, Cryptosporidium parvum
SFKE

SEQ ID NO: 2280356 - protein, 6 aa, Cryptosporidium parvum
SFKGQS

SEQ ID NO: 2280357 - protein, 6 aa, Cryptosporidium parvum
SFKNHP

SEQ ID NO: 2280358 - protein, 5 aa, Cryptosporidium parvum
SFKSQ

SEQ ID NO: 2280359 - protein, 21 aa, Cryptosporidium parvum
SFNDASEYVRERRGTSSPNIG

SEQ ID NO: 2280360 - protein, 12 aa, Cryptosporidium parvum
SFNGDNSKVSKG

SEQ ID NO: 2280361 - protein, 10 aa, Cryptosporidium parvum
SFNGKQRKYP

SEQ ID NO: 2280362 - protein, 12 aa, Cryptosporidium parvum
SFNKRFKSHHFI

SEQ ID NO: 2280363 - protein, 44 aa, Cryptosporidium parvum
SFNNGNTGGNSGSSSTGNNNNSNSTCTNTNSQSTLGSGSGRNGM

SEQ ID NO: 2280364 - protein, 17 aa, Cryptosporidium parvum
SFNPQSAIRAETKEKIR

SEQ ID NO: 2280365 - protein, 17 aa, Cryptosporidium parvum
SFNRGTSCSDNNQEFDG

SEQ ID NO: 2280366 - protein, 10 aa, Cryptosporidium parvum
SFNSNADIPS

SEQ ID NO: 2280367 - protein, 6 aa, Cryptosporidium parvum
SFPNEQ

SEQ ID NO: 2280368 - protein, 12 aa, Cryptosporidium parvum
SFPNNDNNRISS

SEQ ID NO: 2280369 - protein, 21 aa, Cryptosporidium parvum
SFPNNDNNRISSIPNHNNNRV

SEQ ID NO: 2280370 - protein, 9 aa, Cryptosporidium parvum
SFPSNLGND

SEQ ID NO: 2280371 - protein, 4 aa, Cryptosporidium parvum
SFPT

SEQ ID NO: 2280372 - protein, 30 aa, Cryptosporidium parvum
SFQDDGDYDGRDRDHDRDRDRDHDHDHDRN

SEQ ID NO: 2280373 - protein, 18 aa, Cryptosporidium parvum
SFQKEDQDHELRQNDEVY

SEQ ID NO: 2280374 - protein, 9 aa, Cryptosporidium parvum
SFQSKPKEK

SEQ ID NO: 2280375 - protein, 5 aa, Cryptosporidium parvum
SFRDT

SEQ ID NO: 2280376 - protein, 13 aa, Cryptosporidium parvum
SFRSESRDSALNK

SEQ ID NO: 2280377 - protein, 6 aa, Cryptosporidium parvum
SFSDNG

SEQ ID NO: 2280378 - protein, 5 aa, Cryptosporidium parvum
SFSEG

SEQ ID NO: 2280379 - protein, 10 aa, Cryptosporidium parvum
SFSEKENNSL

SEQ ID NO: 2280380 - protein, 11 aa, Cryptosporidium parvum
SFSENSSASTS

SEQ ID NO: 2280381 - protein, 21 aa, Cryptosporidium parvum
SFSESASTTLNHSGGTNSNIE

SEQ ID NO: 2280382 - protein, 6 aa, Cryptosporidium parvum
SFSGPS

SEQ ID NO: 2280383 - protein, 4 aa, Cryptosporidium parvum
SFSK

SEQ ID NO: 2280384 - protein, 11 aa, Cryptosporidium parvum
SFSKDDPEDFT

SEQ ID NO: 2280385 - protein, 7 aa, Cryptosporidium parvum
SFSKENS

SEQ ID NO: 2280386 - protein, 5 aa, Cryptosporidium parvum
SFSKL

SEQ ID NO: 2280387 - protein, 18 aa, Cryptosporidium parvum
SFSNEDNSPKKELKKTSI

SEQ ID NO: 2280388 - protein, 6 aa, Cryptosporidium parvum
SFSNGK

SEQ ID NO: 2280389 - protein, 5 aa, Cryptosporidium parvum
SFSNN

SEQ ID NO: 2280390 - protein, 7 aa, Cryptosporidium parvum
SFSNTSI

SEQ ID NO: 2280391 - protein, 41 aa, Cryptosporidium parvum
SFSPAGARVNGTLSPKFNKARRGSRSQIRGPTRQQYEKGVR

SEQ ID NO: 2280392 - protein, 6 aa, Cryptosporidium parvum
SFSPGP

SEQ ID NO: 2280393 - protein, 9 aa, Cryptosporidium parvum
SFSQNNTIN

SEQ ID NO: 2280394 - protein, 5 aa, Cryptosporidium parvum
SFSSG

SEQ ID NO: 2280395 - protein, 12 aa, Cryptosporidium parvum
SFSSGSQSTGIR

SEQ ID NO: 2280396 - protein, 11 aa, Cryptosporidium parvum
SFSSSSSSISS

SEQ ID NO: 2280397 - protein, 19 aa, Cryptosporidium parvum
SFSTTKSDVSKEDKELKSQ

SEQ ID NO: 2280398 - protein, 10 aa, Cryptosporidium parvum
SFTANATGHF

SEQ ID NO: 2280399 - protein, 6 aa, Cryptosporidium parvum
SFTGKE

SEQ ID NO: 2280400 - protein, 10 aa, Cryptosporidium parvum
SFTSNEQRYD

SEQ ID NO: 2280401 - protein, 5 aa, Cryptosporidium parvum
SFTSQ

SEQ ID NO: 2280402 - protein, 8 aa, Cryptosporidium parvum
SGAIPSGT

SEQ ID NO: 2280403 - protein, 5 aa, Cryptosporidium parvum
SGAKG

SEQ ID NO: 2280404 - protein, 5 aa, Cryptosporidium parvum
SGALD

SEQ ID NO: 2280405 - protein, 19 aa, Cryptosporidium parvum
SGANEDYDELEDNTNDNDI

SEQ ID NO: 2280406 - protein, 44 aa, Cryptosporidium parvum
SGANLGSSSGLNATNNNSNINNSCSSSTKDLKAINTKKKKTHRR

SEQ ID NO: 2280407 - protein, 8 aa, Cryptosporidium parvum
SGAPSIPT

SEQ ID NO: 2280408 - protein, 5 aa, Cryptosporidium parvum
SGARM

SEQ ID NO: 2280409 - protein, 8 aa, Cryptosporidium parvum
SGARTTKF

SEQ ID NO: 2280410 - protein, 8 aa, Cryptosporidium parvum
SGASTGIY

SEQ ID NO: 2280411 - protein, 4 aa, Cryptosporidium parvum
SGAT

SEQ ID NO: 2280412 - protein, 9 aa, Cryptosporidium parvum
SGATESNNT

SEQ ID NO: 2280413 - protein, 9 aa, Cryptosporidium parvum
SGATKNNSI

SEQ ID NO: 2280414 - protein, 5 aa, Cryptosporidium parvum
SGATP

SEQ ID NO: 2280415 - protein, 6 aa, Cryptosporidium parvum
SGCGPG

SEQ ID NO: 2280416 - protein, 17 aa, Cryptosporidium parvum
SGCKNTTVEKKSESKME

SEQ ID NO: 2280417 - protein, 8 aa, Cryptosporidium parvum
SGCKSTDC

SEQ ID NO: 2280418 - protein, 4 aa, Cryptosporidium parvum
SGDA

SEQ ID NO: 2280419 - protein, 9 aa, Cryptosporidium parvum
SGDEELRSK

SEQ ID NO: 2280420 - protein, 10 aa, Cryptosporidium parvum
SGDGTLRKNP

SEQ ID NO: 2280421 - protein, 7 aa, Cryptosporidium parvum
SGDGVSH

SEQ ID NO: 2280422 - protein, 6 aa, Cryptosporidium parvum
SGDGVT

SEQ ID NO: 2280423 - protein, 9 aa, Cryptosporidium parvum
SGDKNNELK

SEQ ID NO: 2280424 - protein, 15 aa, Cryptosporidium parvum
SGDLDDDENEDYQNK

SEQ ID NO: 2280425 - protein, 8 aa, Cryptosporidium parvum
SGDNPPYS

SEQ ID NO: 2280426 - protein, 7 aa, Cryptosporidium parvum
SGDQKVS

SEQ ID NO: 2280427 - protein, 7 aa, Cryptosporidium parvum
SGDSEVS

SEQ ID NO: 2280428 - protein, 7 aa, Cryptosporidium parvum
SGDSGGA

SEQ ID NO: 2280429 - protein, 11 aa, Cryptosporidium parvum
SGDSNKTHNSN

SEQ ID NO: 2280430 - protein, 6 aa, Cryptosporidium parvum
SGDTDS

SEQ ID NO: 2280431 - protein, 7 aa, Cryptosporidium parvum
SGDTKNL

SEQ ID NO: 2280432 - protein, 10 aa, Cryptosporidium parvum
SGDVKSYGSE

SEQ ID NO: 2280433 - protein, 5 aa, Cryptosporidium parvum
SGDWN

SEQ ID NO: 2280434 - protein, 9 aa, Cryptosporidium parvum
SGDYSAATI

SEQ ID NO: 2280435 - protein, 5 aa, Cryptosporidium parvum
SGEAM

SEQ ID NO: 2280436 - protein, 7 aa, Cryptosporidium parvum
SGEAMDQ

SEQ ID NO: 2280437 - protein, 8 aa, Cryptosporidium parvum
SGEDGEQV

SEQ ID NO: 2280438 - protein, 18 aa, Cryptosporidium parvum
SGEDISGSRRYGRGNSGF

SEQ ID NO: 2280439 - protein, 5 aa, Cryptosporidium parvum
SGEEL

SEQ ID NO: 2280440 - protein, 14 aa, Cryptosporidium parvum
SGEFPNDSNLKNAT

SEQ ID NO: 2280441 - protein, 5 aa, Cryptosporidium parvum
SGEGI

SEQ ID NO: 2280442 - protein, 10 aa, Cryptosporidium parvum
SGEGKTLYSD

SEQ ID NO: 2280443 - protein, 5 aa, Cryptosporidium parvum
SGEGL

SEQ ID NO: 2280444 - protein, 13 aa, Cryptosporidium parvum
SGEGVPRESDYRS

SEQ ID NO: 2280445 - protein, 4 aa, Cryptosporidium parvum
SGEI

SEQ ID NO: 2280446 - protein, 16 aa, Cryptosporidium parvum
SGEISKKEAHEQESGY

SEQ ID NO: 2280447 - protein, 6 aa, Cryptosporidium parvum
SGEKIE

SEQ ID NO: 2280448 - protein, 8 aa, Cryptosporidium parvum
SGEKNLKA

SEQ ID NO: 2280449 - protein, 8 aa, Cryptosporidium parvum
SGENEDVT

SEQ ID NO: 2280450 - protein, 6 aa, Cryptosporidium parvum
SGENGR

SEQ ID NO: 2280451 - protein, 34 aa, Cryptosporidium parvum
SGENSEVNNAASTEEASDQSIPRQGSSEKTENID

SEQ ID NO: 2280452 - protein, 13 aa, Cryptosporidium parvum
SGEPRSRRSDNRL

SEQ ID NO: 2280453 - protein, 8 aa, Cryptosporidium parvum
SGERDRIS

SEQ ID NO: 2280454 - protein, 13 aa, Cryptosporidium parvum
SGESGAGKTETAR

SEQ ID NO: 2280455 - protein, 8 aa, Cryptosporidium parvum
SGETFKTK

SEQ ID NO: 2280456 - protein, 7 aa, Cryptosporidium parvum
SGETPIN

SEQ ID NO: 2280457 - protein, 6 aa, Cryptosporidium parvum
SGETRL

SEQ ID NO: 2280458 - protein, 5 aa, Cryptosporidium parvum
SGETS

SEQ ID NO: 2280459 - protein, 5 aa, Cryptosporidium parvum
SGEVD

SEQ ID NO: 2280460 - protein, 15 aa, Cryptosporidium parvum
SGEWRDDKRHGKGTV

SEQ ID NO: 2280461 - protein, 12 aa, Cryptosporidium parvum
SGFDSGFQKGQT

SEQ ID NO: 2280462 - protein, 6 aa, Cryptosporidium parvum
SGFDST

SEQ ID NO: 2280463 - protein, 6 aa, Cryptosporidium parvum
SGFEES

SEQ ID NO: 2280464 - protein, 13 aa, Cryptosporidium parvum
SGFESGSETASQS

SEQ ID NO: 2280465 - protein, 18 aa, Cryptosporidium parvum
SGFKGMSDYNKYEKARKL

SEQ ID NO: 2280466 - protein, 28 aa, Cryptosporidium parvum
SGFNQDSYQPRSPTPSPSPPLSDTKVPL

SEQ ID NO: 2280467 - protein, 4 aa, Cryptosporidium parvum
SGFP

SEQ ID NO: 2280468 - protein, 6 aa, Cryptosporidium parvum
SGFSEN

SEQ ID NO: 2280469 - protein, 7 aa, Cryptosporidium parvum
SGFSPVG

SEQ ID NO: 2280470 - protein, 13 aa, Cryptosporidium parvum
SGGADPLKETTCT

SEQ ID NO: 2280471 - protein, 7 aa, Cryptosporidium parvum
SGGAGTV

SEQ ID NO: 2280472 - protein, 11 aa, Cryptosporidium parvum
SGGAMKRTNKD

SEQ ID NO: 2280473 - protein, 6 aa, Cryptosporidium parvum
SGGDDG

SEQ ID NO: 2280474 - protein, 25 aa, Cryptosporidium parvum
SGGDGRGGGGGGNEGWDVSKTGEAR

SEQ ID NO: 2280475 - protein, 5 aa, Cryptosporidium parvum
SGGED

SEQ ID NO: 2280476 - protein, 10 aa, Cryptosporidium parvum
SGGEKKTESL

SEQ ID NO: 2280477 - protein, 8 aa, Cryptosporidium parvum
SGGEKTLS

SEQ ID NO: 2280478 - protein, 12 aa, Cryptosporidium parvum
SGGGAENSEYSI

SEQ ID NO: 2280479 - protein, 11 aa, Cryptosporidium parvum
SGGGGSDTNSP

SEQ ID NO: 2280480 - protein, 5 aa, Cryptosporidium parvum
SGGGH

SEQ ID NO: 2280481 - protein, 8 aa, Cryptosporidium parvum
SGGHGPNM

SEQ ID NO: 2280482 - protein, 22 aa, Cryptosporidium parvum
SGGHHEESSPSITKSDNGAGSF

SEQ ID NO: 2280483 - protein, 6 aa, Cryptosporidium parvum
SGGIPE

SEQ ID NO: 2280484 - protein, 7 aa, Cryptosporidium parvum
SGGKDSL

SEQ ID NO: 2280485 - protein, 7 aa, Cryptosporidium parvum
SGGKDSS

SEQ ID NO: 2280486 - protein, 9 aa, Cryptosporidium parvum
SGGKVEYDN

SEQ ID NO: 2280487 - protein, 5 aa, Cryptosporidium parvum
SGGNI

SEQ ID NO: 2280488 - protein, 13 aa, Cryptosporidium parvum
SGGNIGSSPDKRF

SEQ ID NO: 2280489 - protein, 12 aa, Cryptosporidium parvum
SGGNNELKDSIS

SEQ ID NO: 2280490 - protein, 10 aa, Cryptosporidium parvum
SGGNNNNNKK

SEQ ID NO: 2280491 - protein, 6 aa, Cryptosporidium parvum
SGGNTQ

SEQ ID NO: 2280492 - protein, 7 aa, Cryptosporidium parvum
SGGNWPK

SEQ ID NO: 2280493 - protein, 8 aa, Cryptosporidium parvum
SGGPDYDE

SEQ ID NO: 2280494 - protein, 11 aa, Cryptosporidium parvum
SGGPNSPDNKN

SEQ ID NO: 2280495 - protein, 7 aa, Cryptosporidium parvum
SGGRNAK

SEQ ID NO: 2280496 - protein, 5 aa, Cryptosporidium parvum
SGGSD

SEQ ID NO: 2280497 - protein, 9 aa, Cryptosporidium parvum
SGGSEKTIK

SEQ ID NO: 2280498 - protein, 5 aa, Cryptosporidium parvum
SGGSL

SEQ ID NO: 2280499 - protein, 17 aa, Cryptosporidium parvum
SGGSSNNNNKGGVNTSI

SEQ ID NO: 2280500 - protein, 7 aa, Cryptosporidium parvum
SGGYIDP

SEQ ID NO: 2280501 - protein, 5 aa, Cryptosporidium parvum
SGGYN

SEQ ID NO: 2280502 - protein, 6 aa, Cryptosporidium parvum
SGHDQK

SEQ ID NO: 2280503 - protein, 6 aa, Cryptosporidium parvum
SGHEDG

SEQ ID NO: 2280504 - protein, 98 aa, Cryptosporidium parvum
SGHESGQWTKVGKNRTNGGLKQNNTNSTNVNNNNVNRNKNSNNTNSIKSGKQTHSQNNQSQIQNQSQSQNQNQSQNQSQNHVEGTNTNYNKSNNKSIK

SEQ ID NO: 2280505 - protein, 4 aa, Cryptosporidium parvum
SGHN

SEQ ID NO: 2280506 - protein, 4 aa, Cryptosporidium parvum
SGHS

SEQ ID NO: 2280507 - protein, 39 aa, Cryptosporidium parvum; identical to SEQ ID NO: 2160972

SEQ ID NO: 2280508 - protein, 18 aa, Cryptosporidium parvum
SGIDGSPKVSFGKSRRNT

SEQ ID NO: 2280509 - protein, 12 aa, Cryptosporidium parvum
SGIDSESSISYN

SEQ ID NO: 2280510 - protein, 6 aa, Cryptosporidium parvum
SGIDSY

SEQ ID NO: 2280511 - protein, 12 aa, Cryptosporidium parvum
SGIEGGFQGRTN

SEQ ID NO: 2280512 - protein, 12 aa, Cryptosporidium parvum
SGIESQSDSIKA

SEQ ID NO: 2280513 - protein, 5 aa, Cryptosporidium parvum
SGIGM

SEQ ID NO: 2280514 - protein, 9 aa, Cryptosporidium parvum
SGIGTADDM

SEQ ID NO: 2280515 - protein, 7 aa, Cryptosporidium parvum
SGIKTKS

SEQ ID NO: 2280516 - protein, 6 aa, Cryptosporidium parvum
SGILSS

SEQ ID NO: 2280517 - protein, 4 aa, Cryptosporidium parvum
SGIN

SEQ ID NO: 2280518 - protein, 5 aa, Cryptosporidium parvum
SGINQ

SEQ ID NO: 2280519 - protein, 4 aa, Cryptosporidium parvum
SGIP

SEQ ID NO: 2280520 - protein, 8 aa, Cryptosporidium parvum
SGIPAQTL

SEQ ID NO: 2280521 - protein, 14 aa, Cryptosporidium parvum
SGIPGNLGAPTGVT

SEQ ID NO: 2280522 - protein, 5 aa, Cryptosporidium parvum
SGIPK

SEQ ID NO: 2280523 - protein, 13 aa, Cryptosporidium parvum
SGIRARTPNSVTT

SEQ ID NO: 2280524 - protein, 6 aa, Cryptosporidium parvum
SGIRGQ

SEQ ID NO: 2280525 - protein, 5 aa, Cryptosporidium parvum
SGISK

SEQ ID NO: 2280526 - protein, 8 aa, Cryptosporidium parvum
SGISNQKA

SEQ ID NO: 2280527 - protein, 5 aa, Cryptosporidium parvum
SGISS

SEQ ID NO: 2280528 - protein, 8 aa, Cryptosporidium parvum
SGISSGLS

SEQ ID NO: 2280529 - protein, 6 aa, Cryptosporidium parvum
SGITEL

SEQ ID NO: 2280530 - protein, 8 aa, Cryptosporidium parvum
SGITNTGM

SEQ ID NO: 2280531 - protein, 4 aa, Cryptosporidium parvum
SGIY

SEQ ID NO: 2280532 - protein, 9 aa, Cryptosporidium parvum
SGKEAESAV

SEQ ID NO: 2280533 - protein, 5 aa, Cryptosporidium parvum
SGKEL

SEQ ID NO: 2280534 - protein, 7 aa, Cryptosporidium parvum
SGKESKD

SEQ ID NO: 2280535 - protein, 6 aa, Cryptosporidium parvum
SGKEYT

SEQ ID NO: 2280536 - protein, 7 aa, Cryptosporidium parvum
SGKGKHG

SEQ ID NO: 2280537 - protein, 10 aa, Cryptosporidium parvum
SGKGSSAAGL

SEQ ID NO: 2280538 - protein, 9 aa, Cryptosporidium parvum
SGKGSSAVG

SEQ ID NO: 2280539 - protein, 8 aa, Cryptosporidium parvum
SGKGTDLE

SEQ ID NO: 2280540 - protein, 16 aa, Cryptosporidium parvum
SGKHEDGFKKTEVGQF

SEQ ID NO: 2280541 - protein, 24 aa, Cryptosporidium parvum
SGKIPCQKSNSINISDSEGNNIGG

SEQ ID NO: 2280542 - protein, 6 aa, Cryptosporidium parvum
SGKIQY

SEQ ID NO: 2280543 - protein, 7 aa, Cryptosporidium parvum
SGKMGNM

SEQ ID NO: 2280544 - protein, 4 aa, Cryptosporidium parvum
SGKN

SEQ ID NO: 2280545 - protein, 10 aa, Cryptosporidium parvum
SGKNDHPNIS

SEQ ID NO: 2280546 - protein, 5 aa, Cryptosporidium parvum
SGKNI

SEQ ID NO: 2280547 - protein, 21 aa, Cryptosporidium parvum
SGKNSSFSKTSFRSDNALPDL

SEQ ID NO: 2280548 - protein, 7 aa, Cryptosporidium parvum
SGKQDEV

SEQ ID NO: 2280549 - protein, 8 aa, Cryptosporidium parvum
SGKQEIAE

SEQ ID NO: 2280550 - protein, 6 aa, Cryptosporidium parvum
SGKRKE

SEQ ID NO: 2280551 - protein, 6 aa, Cryptosporidium parvum
SGKRNI

SEQ ID NO: 2280552 - protein, 16 aa, Cryptosporidium parvum
SGKSLSNNNNFTPTRD

SEQ ID NO: 2280553 - protein, 4 aa, Cryptosporidium parvum
SGKT

SEQ ID NO: 2280554 - protein, 28 aa, Cryptosporidium parvum
SGKTESLISSNKQSTEKNLSDSQNDYLD

SEQ ID NO: 2280555 - protein, 15 aa, Cryptosporidium parvum
SGKVNKSLKKDEQLH

SEQ ID NO: 2280556 - protein, 7 aa, Cryptosporidium parvum
SGKYDPG

SEQ ID NO: 2280557 - protein, 7 aa, Cryptosporidium parvum
SGLAYSG

SEQ ID NO: 2280558 - protein, 5 aa, Cryptosporidium parvum
SGLEN

SEQ ID NO: 2280559 - protein, 19 aa, Cryptosporidium parvum
SGLGGGSGSNLGGNGIGNS

SEQ ID NO: 2280560 - protein, 18 aa, Cryptosporidium parvum
SGLGGSSSIEAALGSSGL

SEQ ID NO: 2280561 - protein, 11 aa, Cryptosporidium parvum
SGLGQKSFKNL

SEQ ID NO: 2280562 - protein, 47 aa, Cryptosporidium parvum
SGLGVEDGERGGRRGRGVGGEGRVGGRGRGGMGGEMERGGMGGEMER

SEQ ID NO: 2280563 - protein, 7 aa, Cryptosporidium parvum
SGLKSAE

SEQ ID NO: 2280564 - protein, 16 aa, Cryptosporidium parvum
SGLNGPNTPFVGFLTI

SEQ ID NO: 2280565 - protein, 9 aa, Cryptosporidium parvum
SGLPRDTNR

SEQ ID NO: 2280566 - protein, 17 aa, Cryptosporidium parvum
SGLPSETVKRSREKAEE

SEQ ID NO: 2280567 - protein, 5 aa, Cryptosporidium parvum
SGLRE

SEQ ID NO: 2280568 - protein, 6 aa, Cryptosporidium parvum
SGLSPK

SEQ ID NO: 2280569 - protein, 9 aa, Cryptosporidium parvum
SGLSPSTGL

SEQ ID NO: 2280570 - protein, 9 aa, Cryptosporidium parvum
SGLSSKRGF

SEQ ID NO: 2280571 - protein, 9 aa, Cryptosporidium parvum
SGLSSRTDS

SEQ ID NO: 2280572 - protein, 30 aa, Cryptosporidium parvum; identical to SEQ ID NO: 2161025

SEQ ID NO: 2280573 - protein, 14 aa, Cryptosporidium parvum
SGLTNSGNNIRDNS

SEQ ID NO: 2280574 - protein, 5 aa, Cryptosporidium parvum
SGLTP

SEQ ID NO: 2280575 - protein, 9 aa, Cryptosporidium parvum
SGMGSDNKV

SEQ ID NO: 2280576 - protein, 4 aa, Cryptosporidium parvum
SGMH

SEQ ID NO: 2280577 - protein, 14 aa, Cryptosporidium parvum
SGNAIEEETLNSKL

SEQ ID NO: 2280578 - protein, 8 aa, Cryptosporidium parvum
SGNDDLDK

SEQ ID NO: 2280579 - protein, 4 aa, Cryptosporidium parvum
SGNE

SEQ ID NO: 2280580 - protein, 13 aa, Cryptosporidium parvum
SGNEGRERRRNQG

SEQ ID NO: 2280581 - protein, 5 aa, Cryptosporidium parvum
SGNEI

SEQ ID NO: 2280582 - protein, 8 aa, Cryptosporidium parvum
SGNEIEEE

SEQ ID NO: 2280583 - protein, 17 aa, Cryptosporidium parvum
SGNEQHQQQQQHIGSEL

SEQ ID NO: 2280584 - protein, 10 aa, Cryptosporidium parvum
SGNERINQGL

SEQ ID NO: 2280585 - protein, 4 aa, Cryptosporidium parvum
SGNG

SEQ ID NO: 2280586 - protein, 8 aa, Cryptosporidium parvum
SGNGNNIG

SEQ ID NO: 2280587 - protein, 7 aa, Cryptosporidium parvum
SGNHRAN

SEQ ID NO: 2280588 - protein, 11 aa, Cryptosporidium parvum
SGNIAQASGQQ

SEQ ID NO: 2280589 - protein, 9 aa, Cryptosporidium parvum
SGNIYGQNS

SEQ ID NO: 2280590 - protein, 9 aa, Cryptosporidium parvum
SGNKELQDD

SEQ ID NO: 2280591 - protein, 8 aa, Cryptosporidium parvum
SGNKLKKD

SEQ ID NO: 2280592 - protein, 4 aa, Cryptosporidium parvum
SGNL

SEQ ID NO: 2280593 - protein, 26 aa, Cryptosporidium parvum
SGNNNNNNNNNNMNVNNNNNNISNNM

SEQ ID NO: 2280594 - protein, 9 aa, Cryptosporidium parvum
SGNNQGSVN

SEQ ID NO: 2280595 - protein, 74 aa, Cryptosporidium parvum
SGNNSGLNTTSSGTSSLFGSSGTGGLTGATSTLGGGGGGGLFGSSSSATGNNTSFSFGSTNSSSTSNPSNNSGL

SEQ ID NO: 2280596 - protein, 9 aa, Cryptosporidium parvum
SGNNSISAK

SEQ ID NO: 2280597 - protein, 8 aa, Cryptosporidium parvum
SGNNSVDI

SEQ ID NO: 2280598 - protein, 10 aa, Cryptosporidium parvum
SGNNYNRSNY

SEQ ID NO: 2280599 - protein, 18 aa, Cryptosporidium parvum
SGNPIKIKSSKNHISPRN

SEQ ID NO: 2280600 - protein, 9 aa, Cryptosporidium parvum
SGNQESDLE

SEQ ID NO: 2280601 - protein, 10 aa, Cryptosporidium parvum
SGNRPRYNAR

SEQ ID NO: 2280602 - protein, 6 aa, Cryptosporidium parvum
SGNRTF

SEQ ID NO: 2280603 - protein, 6 aa, Cryptosporidium parvum
SGNRVY

SEQ ID NO: 2280604 - protein, 9 aa, Cryptosporidium parvum
SGNSGISSG

SEQ ID NO: 2280605 - protein, 12 aa, Cryptosporidium parvum
SGNSNNSRSSSS

SEQ ID NO: 2280606 - protein, 9 aa, Cryptosporidium parvum
SGNSNQGYP

SEQ ID NO: 2280607 - protein, 7 aa, Cryptosporidium parvum
SGNSNSI

SEQ ID NO: 2280608 - protein, 15 aa, Cryptosporidium parvum
SGNSPDDVTITNDGA

SEQ ID NO: 2280609 - protein, 19 aa, Cryptosporidium parvum
SGNSSQQPQNQLNQSQSQL

SEQ ID NO: 2280610 - protein, 9 aa, Cryptosporidium parvum
SGNSSTKNA

SEQ ID NO: 2280611 - protein, 5 aa, Cryptosporidium parvum
SGNTD

SEQ ID NO: 2280612 - protein, 29 aa, Cryptosporidium parvum
SGNVSGPGSTIGGNCSASDAGNDQTKISS

SEQ ID NO: 2280613 - protein, 16 aa, Cryptosporidium parvum
SGNYKSPKKVQQQSNS

SEQ ID NO: 2280614 - protein, 14 aa, Cryptosporidium parvum
SGNYSWGSQGISRK

SEQ ID NO: 2280615 - protein, 4 aa, Cryptosporidium parvum
SGPA

SEQ ID NO: 2280616 - protein, 7 aa, Cryptosporidium parvum
SGPEETY

SEQ ID NO: 2280617 - protein, 12 aa, Cryptosporidium parvum
SGPFSGFPDSPL

SEQ ID NO: 2280618 - protein, 7 aa, Cryptosporidium parvum
SGPIYNN

SEQ ID NO: 2280619 - protein, 6 aa, Cryptosporidium parvum
SGPNGQ

SEQ ID NO: 2280620 - protein, 6 aa, Cryptosporidium parvum
SGPNNH

SEQ ID NO: 2280621 - protein, 7 aa, Cryptosporidium parvum
SGPNRKT

SEQ ID NO: 2280622 - protein, 10 aa, Cryptosporidium parvum
SGPPGIGKST

SEQ ID NO: 2280623 - protein, 11 aa, Cryptosporidium parvum
SGPPGTGKTTS

SEQ ID NO: 2280624 - protein, 6 aa, Cryptosporidium parvum
SGPQIS

SEQ ID NO: 2280625 - protein, 14 aa, Cryptosporidium parvum
SGPQYSQSSDDENS

SEQ ID NO: 2280626 - protein, 10 aa, Cryptosporidium parvum
SGPRGSESKI

SEQ ID NO: 2280627 - protein, 12 aa, Cryptosporidium parvum
SGPSGTSVDEDG

SEQ ID NO: 2280628 - protein, 8 aa, Cryptosporidium parvum
SGPSSEDN

SEQ ID NO: 2280629 - protein, 6 aa, Cryptosporidium parvum
SGPTAT

SEQ ID NO: 2280630 - protein, 15 aa, Cryptosporidium parvum
SGPVKSDSINDDTRI

SEQ ID NO: 2280631 - protein, 9 aa, Cryptosporidium parvum
SGQAGISKA

SEQ ID NO: 2280632 - protein, 7 aa, Cryptosporidium parvum
SGQAYEA

SEQ ID NO: 2280633 - protein, 6 aa, Cryptosporidium parvum
SGQDSR

SEQ ID NO: 2280634 - protein, 14 aa, Cryptosporidium parvum
SGQEVSEGNVQSES

SEQ ID NO: 2280635 - protein, 11 aa, Cryptosporidium parvum
SGQGKSTDIPV

SEQ ID NO: 2280636 - protein, 5 aa, Cryptosporidium parvum
SGQKE

SEQ ID NO: 2280637 - protein, 8 aa, Cryptosporidium parvum
SGQKKPIK

SEQ ID NO: 2280638 - protein, 19 aa, Cryptosporidium parvum
SGQKSLESQITDSASVNGT

SEQ ID NO: 2280639 - protein, 14 aa, Cryptosporidium parvum
SGQNSSTKQTKDDY

SEQ ID NO: 2280640 - protein, 5 aa, Cryptosporidium parvum
SGQNV

SEQ ID NO: 2280641 - protein, 11 aa, Cryptosporidium parvum
SGQPNSSVRNN

SEQ ID NO: 2280642 - protein, 8 aa, Cryptosporidium parvum
SGQTPESL

SEQ ID NO: 2280643 - protein, 5 aa, Cryptosporidium parvum
SGRAF

SEQ ID NO: 2280644 - protein, 7 aa, Cryptosporidium parvum
SGRDRAT

SEQ ID NO: 2280645 - protein, 4 aa, Cryptosporidium parvum
SGRE

SEQ ID NO: 2280646 - protein, 7 aa, Cryptosporidium parvum
SGRFGRS

SEQ ID NO: 2280647 - protein, 8 aa, Cryptosporidium parvum
SGRGEDPR

SEQ ID NO: 2280648 - protein, 9 aa, Cryptosporidium parvum
SGRGELAER

SEQ ID NO: 2280649 - protein, 6 aa, Cryptosporidium parvum
SGRGGL

SEQ ID NO: 2280650 - protein, 6 aa, Cryptosporidium parvum
SGRGVP

SEQ ID NO: 2280651 - protein, 8 aa, Cryptosporidium parvum
SGRHKQES

SEQ ID NO: 2280652 - protein, 40 aa, Cryptosporidium parvum
SGRHNEERGSGSEKTTSLSSGGKPCISNNSPSKGGNEVGV

SEQ ID NO: 2280653 - protein, 7 aa, Cryptosporidium parvum
SGRKTPK

SEQ ID NO: 2280654 - protein, 34 aa, Cryptosporidium parvum
SGRKTRRYNQNDYSESRPEHSSYNRYDNTYYQNN

SEQ ID NO: 2280655 - protein, 19 aa, Cryptosporidium parvum
SGRLPSSNTGSVNGGTGSF

SEQ ID NO: 2280656 - protein, 4 aa, Cryptosporidium parvum
SGRM

SEQ ID NO: 2280657 - protein, 4 aa, Cryptosporidium parvum
SGRN

SEQ ID NO: 2280658 - protein, 7 aa, Cryptosporidium parvum
SGRQNIP

SEQ ID NO: 2280659 - protein, 6 aa, Cryptosporidium parvum
SGRSRG

SEQ ID NO: 2280660 - protein, 10 aa, Cryptosporidium parvum
SGRTGRAGKF

SEQ ID NO: 2280661 - protein, 6 aa, Cryptosporidium parvum
SGRTTG

SEQ ID NO: 2280662 - protein, 9 aa, Cryptosporidium parvum
SGSAFDDKN

SEQ ID NO: 2280663 - protein, 9 aa, Cryptosporidium parvum
SGSAGYNGQ

SEQ ID NO: 2280664 - protein, 7 aa, Cryptosporidium parvum
SGSAINN

SEQ ID NO: 2280665 - protein, 21 aa, Cryptosporidium parvum
SGSASVPSSVSLSGPISGSAS

SEQ ID NO: 2280666 - protein, 4 aa, Cryptosporidium parvum
SGSD

SEQ ID NO: 2280667 - protein, 7 aa, Cryptosporidium parvum
SGSDDAT

SEQ ID NO: 2280668 - protein, 6 aa, Cryptosporidium parvum
SGSDDN

SEQ ID NO: 2280669 - protein, 6 aa, Cryptosporidium parvum
SGSDEL

SEQ ID NO: 2280670 - protein, 6 aa, Cryptosporidium parvum
SGSDWN

SEQ ID NO: 2280671 - protein, 6 aa, Cryptosporidium parvum
SGSDYS

SEQ ID NO: 2280672 - protein, 13 aa, Cryptosporidium parvum
SGSEASNGNMSRE

SEQ ID NO: 2280673 - protein, 13 aa, Cryptosporidium parvum
SGSEASYERSSEV

SEQ ID NO: 2280674 - protein, 5 aa, Cryptosporidium parvum
SGSEN

SEQ ID NO: 2280675 - protein, 6 aa, Cryptosporidium parvum
SGSGFG

SEQ ID NO: 2280676 - protein, 11 aa, Cryptosporidium parvum
SGSGGKDSNIS

SEQ ID NO: 2280677 - protein, 9 aa, Cryptosporidium parvum
SGSGLSDGD

SEQ ID NO: 2280678 - protein, 7 aa, Cryptosporidium parvum
SGSGTFA

SEQ ID NO: 2280679 - protein, 7 aa, Cryptosporidium parvum
SGSHSTN

SEQ ID NO: 2280680 - protein, 7 aa, Cryptosporidium parvum
SGSHTRS

SEQ ID NO: 2280681 - protein, 14 aa, Cryptosporidium parvum
SGSIAASTSLSSNS

SEQ ID NO: 2280682 - protein, 15 aa, Cryptosporidium parvum
SGSIRDPKSTVDAPE

SEQ ID NO: 2280683 - protein, 6 aa, Cryptosporidium parvum
SGSLGV

SEQ ID NO: 2280684 - protein, 9 aa, Cryptosporidium parvum
SGSLSESNS

SEQ ID NO: 2280685 - protein, 12 aa, Cryptosporidium parvum
SGSLTVNGPFST

SEQ ID NO: 2280686 - protein, 5 aa, Cryptosporidium parvum
SGSNF

SEQ ID NO: 2280687 - protein, 6 aa, Cryptosporidium parvum
SGSNNC

SEQ ID NO: 2280688 - protein, 8 aa, Cryptosporidium parvum
SGSNNDQN

SEQ ID NO: 2280689 - protein, 16 aa, Cryptosporidium parvum
SGSQKISTIEYPEDGI

SEQ ID NO: 2280690 - protein, 12 aa, Cryptosporidium parvum
SGSRNEDPGKNG

SEQ ID NO: 2280691 - protein, 10 aa, Cryptosporidium parvum
SGSRNISGED

SEQ ID NO: 2280692 - protein, 4 aa, Cryptosporidium parvum
SGSS

SEQ ID NO: 2280693 - protein, 11 aa, Cryptosporidium parvum
SGSSASKESIV

SEQ ID NO: 2280694 - protein, 11 aa, Cryptosporidium parvum
SGSSDNNSVYN

SEQ ID NO: 2280695 - protein, 7 aa, Cryptosporidium parvum
SGSSIQE

SEQ ID NO: 2280696 - protein, 7 aa, Cryptosporidium parvum
SGSSIST

SEQ ID NO: 2280697 - protein, 8 aa, Cryptosporidium parvum
SGSSQLEE

SEQ ID NO: 2280698 - protein, 18 aa, Cryptosporidium parvum
SGSSSFGTFSSGGNSNKV

SEQ ID NO: 2280699 - protein, 12 aa, Cryptosporidium parvum
SGSTGRPKGAKL

SEQ ID NO: 2280700 - protein, 15 aa, Cryptosporidium parvum
SGSTGTPKGVQHSTA

SEQ ID NO: 2280701 - protein, 13 aa, Cryptosporidium parvum
SGSTITGKSDDTY

SEQ ID NO: 2280702 - protein, 9 aa, Cryptosporidium parvum
SGSTSQPKG

SEQ ID NO: 2280703 - protein, 4 aa, Cryptosporidium parvum
SGSV

SEQ ID NO: 2280704 - protein, 9 aa, Cryptosporidium parvum
SGSVKTREA

SEQ ID NO: 2280705 - protein, 15 aa, Cryptosporidium parvum
SGSYSSKNNTSSKRS

SEQ ID NO: 2280706 - protein, 6 aa, Cryptosporidium parvum
SGTADN

SEQ ID NO: 2280707 - protein, 5 aa, Cryptosporidium parvum
SGTAG

SEQ ID NO: 2280708 - protein, 45 aa, Cryptosporidium parvum
SGTDNDDEECIDQENEKDSLSKDKVIPDQSPDNNSETNTNLESSH

SEQ ID NO: 2280709 - protein, 14 aa, Cryptosporidium parvum
SGTDTSFQNITETE

SEQ ID NO: 2280710 - protein, 4 aa, Cryptosporidium parvum
SGTE

SEQ ID NO: 2280711 - protein, 6 aa, Cryptosporidium parvum
SGTENC

SEQ ID NO: 2280712 - protein, 7 aa, Cryptosporidium parvum
SGTGSKF

SEQ ID NO: 2280713 - protein, 7 aa, Cryptosporidium parvum
SGTISSG

SEQ ID NO: 2280714 - protein, 6 aa, Cryptosporidium parvum
SGTITS

SEQ ID NO: 2280715 - protein, 9 aa, Cryptosporidium parvum
SGTKAPQAA

SEQ ID NO: 2280716 - protein, 4 aa, Cryptosporidium parvum
SGTL

SEQ ID NO: 2280717 - protein, 55 aa, Cryptosporidium parvum; identical to SEQ ID NO: 2161150

SEQ ID NO: 2280718 - protein, 13 aa, Cryptosporidium parvum
SGTLTKDQNLEKS

SEQ ID NO: 2280719 - protein, 6 aa, Cryptosporidium parvum
SGTNES

SEQ ID NO: 2280720 - protein, 19 aa, Cryptosporidium parvum
SGTNESNSSIEFNESQKEF

SEQ ID NO: 2280721 - protein, 9 aa, Cryptosporidium parvum
SGTNSGISS

SEQ ID NO: 2280722 - protein, 10 aa, Cryptosporidium parvum
SGTPAQSNSR

SEQ ID NO: 2280723 - protein, 6 aa, Cryptosporidium parvum
SGTPGR

SEQ ID NO: 2280724 - protein, 6 aa, Cryptosporidium parvum
SGTPIS

SEQ ID NO: 2280725 - protein, 8 aa, Cryptosporidium parvum
SGTPRPQM

SEQ ID NO: 2280726 - protein, 11 aa, Cryptosporidium parvum
SGTRISSSNYN

SEQ ID NO: 2280727 - protein, 8 aa, Cryptosporidium parvum
SGTSMNGR

SEQ ID NO: 2280728 - protein, 5 aa, Cryptosporidium parvum
SGTSP

SEQ ID NO: 2280729 - protein, 5 aa, Cryptosporidium parvum
SGTTA

SEQ ID NO: 2280730 - protein, 9 aa, Cryptosporidium parvum
SGTTGYPKG

SEQ ID NO: 2280731 - protein, 10 aa, Cryptosporidium parvum
SGTVNRGSDV

SEQ ID NO: 2280732 - protein, 8 aa, Cryptosporidium parvum
SGTVTDTK

SEQ ID NO: 2280733 - protein, 4 aa, Cryptosporidium parvum
SGTW

SEQ ID NO: 2280734 - protein, 21 aa, Cryptosporidium parvum
SGVATPGSASLKSANSTDALS

SEQ ID NO: 2280735 - protein, 12 aa, Cryptosporidium parvum
SGVESTTNITTD

SEQ ID NO: 2280736 - protein, 4 aa, Cryptosporidium parvum
SGVG

SEQ ID NO: 2280737 - protein, 5 aa, Cryptosporidium parvum
SGVGK

SEQ ID NO: 2280738 - protein, 6 aa, Cryptosporidium parvum
SGVGKS

SEQ ID NO: 2280739 - protein, 15 aa, Cryptosporidium parvum
SGVGKTCNKTISRKE

SEQ ID NO: 2280740 - protein, 6 aa, Cryptosporidium parvum
SGVGLG

SEQ ID NO: 2280741 - protein, 9 aa, Cryptosporidium parvum
SGVKRNSPL

SEQ ID NO: 2280742 - protein, 13 aa, Cryptosporidium parvum
SGVPSEDGQGNKM

SEQ ID NO: 2280743 - protein, 57 aa, Cryptosporidium parvum
SGVPVTDDNNGDNNINMSNTSVGNNNNSNNNNSTQSNTQSNTQNNTQNNNQNNNNNH

SEQ ID NO: 2280744 - protein, 4 aa, Cryptosporidium parvum
SGVQ

SEQ ID NO: 2280745 - protein, 9 aa, Cryptosporidium parvum
SGVQNKSKF

SEQ ID NO: 2280746 - protein, 15 aa, Cryptosporidium parvum
SGVRPGDLDPKTSSH

SEQ ID NO: 2280747 - protein, 6 aa, Cryptosporidium parvum
SGVRQG

SEQ ID NO: 2280748 - protein, 8 aa, Cryptosporidium parvum
SGVSIESL

SEQ ID NO: 2280749 - protein, 14 aa, Cryptosporidium parvum
SGVYENETSTNGKN

SEQ ID NO: 2280750 - protein, 4 aa, Cryptosporidium parvum
SGYA

SEQ ID NO: 2280751 - protein, 7 aa, Cryptosporidium parvum
SGYDPIS

SEQ ID NO: 2280752 - protein, 8 aa, Cryptosporidium parvum
SGYGNEEG

SEQ ID NO: 2280753 - protein, 16 aa, Cryptosporidium parvum
SGYNGGLSEELNPTDF

SEQ ID NO: 2280754 - protein, 4 aa, Cryptosporidium parvum
SGYP

SEQ ID NO: 2280755 - protein, 7 aa, Cryptosporidium parvum
SGYPKEN

SEQ ID NO: 2280756 - protein, 6 aa, Cryptosporidium parvum
SGYQDD

SEQ ID NO: 2280757 - protein, 5 aa, Cryptosporidium parvum
SGYQY

SEQ ID NO: 2280758 - protein, 9 aa, Cryptosporidium parvum
SGYSDQAKQ

SEQ ID NO: 2280759 - protein, 8 aa, Cryptosporidium parvum
SGYSKDPR

SEQ ID NO: 2280760 - protein, 10 aa, Cryptosporidium parvum
SGYSPSPQVV

SEQ ID NO: 2280761 - protein, 5 aa, Cryptosporidium parvum
SGYSV

SEQ ID NO: 2280762 - protein, 4 aa, Cryptosporidium parvum
SGYY

SEQ ID NO: 2280763 - protein, 4 aa, Cryptosporidium parvum
SHAN

SEQ ID NO: 2280764 - protein, 8 aa, Cryptosporidium parvum
SHCKSKKS

SEQ ID NO: 2280765 - protein, 7 aa, Cryptosporidium parvum
SHCNSPS

SEQ ID NO: 2280766 - protein, 6 aa, Cryptosporidium parvum
SHDDGK

SEQ ID NO: 2280767 - protein, 5 aa, Cryptosporidium parvum
SHDER

SEQ ID NO: 2280768 - protein, 8 aa, Cryptosporidium parvum
SHDQESPI

SEQ ID NO: 2280769 - protein, 5 aa, Cryptosporidium parvum
SHDTP

SEQ ID NO: 2280770 - protein, 28 aa, Cryptosporidium parvum
SHEEEESSLTIKSSTHRSDLSYDENNQK

SEQ ID NO: 2280771 - protein, 8 aa, Cryptosporidium parvum
SHENQSNI

SEQ ID NO: 2280772 - protein, 10 aa, Cryptosporidium parvum
SHENSSSEII

SEQ ID NO: 2280773 - protein, 5 aa, Cryptosporidium parvum
SHESN

SEQ ID NO: 2280774 - protein, 6 aa, Cryptosporidium parvum
SHESSK

SEQ ID NO: 2280775 - protein, 46 aa, Cryptosporidium parvum
SHETKSNESLEKKKLSGTPTRNIKSELDENVHTSNKSRKKNRKLNI

SEQ ID NO: 2280776 - protein, 7 aa, Cryptosporidium parvum
SHETRSE

SEQ ID NO: 2280777 - protein, 7 aa, Cryptosporidium parvum
SHEYRGS

SEQ ID NO: 2280778 - protein, 55 aa, Cryptosporidium parvum
SHFGDSASAENEKESEDDNLNSNDLKTGLQDYDQDQEQAEQVKSREGGKHHYDPK

SEQ ID NO: 2280779 - protein, 9 aa, Cryptosporidium parvum
SHGDNDPLD

SEQ ID NO: 2280780 - protein, 15 aa, Cryptosporidium parvum
SHGGSPINKNLSEKD

SEQ ID NO: 2280781 - protein, 6 aa, Cryptosporidium parvum
SHGHGA

SEQ ID NO: 2280782 - protein, 5 aa, Cryptosporidium parvum
SHGKR

SEQ ID NO: 2280783 - protein, 18 aa, Cryptosporidium parvum
SHGNKKGRKYGDKDNTEL

SEQ ID NO: 2280784 - protein, 21 aa, Cryptosporidium parvum
SHGNTKQDQPVCPNGKTGQGI

SEQ ID NO: 2280785 - protein, 11 aa, Cryptosporidium parvum
SHGTGTPLGDP

SEQ ID NO: 2280786 - protein, 5 aa, Cryptosporidium parvum
SHIES

SEQ ID NO: 2280787 - protein, 22 aa, Cryptosporidium parvum
SHKGGSNNASIETRNRFAALDE

SEQ ID NO: 2280788 - protein, 5 aa, Cryptosporidium parvum
SHKGR

SEQ ID NO: 2280789 - protein, 19 aa, Cryptosporidium parvum
SHKGRSGSGFGSSSSYENR

SEQ ID NO: 2280790 - protein, 10 aa, Cryptosporidium parvum
SHKKGLDSDM

SEQ ID NO: 2280791 - protein, 5 aa, Cryptosporidium parvum
SHKKT

SEQ ID NO: 2280792 - protein, 9 aa, Cryptosporidium parvum
SHKRSSEEI

SEQ ID NO: 2280793 - protein, 20 aa, Cryptosporidium parvum
SHLEDSDNLEGDIKQSQNFR

SEQ ID NO: 2280794 - protein, 4 aa, Cryptosporidium parvum
SHLN

SEQ ID NO: 2280795 - protein, 7 aa, Cryptosporidium parvum
SHLPSNS

SEQ ID NO: 2280796 - protein, 16 aa, Cryptosporidium parvum
SHNARIGNENLKNSRN

SEQ ID NO: 2280797 - protein, 21 aa, Cryptosporidium parvum
SHNDSNISRDGLVDDNGESLI

SEQ ID NO: 2280798 - protein, 5 aa, Cryptosporidium parvum
SHNER

SEQ ID NO: 2280799 - protein, 19 aa, Cryptosporidium parvum
SHNKHYPRHRNNPNSDFAN

SEQ ID NO: 2280800 - protein, 6 aa, Cryptosporidium parvum
SHNKNN

SEQ ID NO: 2280801 - protein, 11 aa, Cryptosporidium parvum
SHNNHSSGNLN

SEQ ID NO: 2280802 - protein, 9 aa, Cryptosporidium parvum
SHNNRRKKR

SEQ ID NO: 2280803 - protein, 10 aa, Cryptosporidium parvum
SHNNSEVQNS

SEQ ID NO: 2280804 - protein, 21 aa, Cryptosporidium parvum
SHNNTNSHQNSTTNEADNSVT

SEQ ID NO: 2280805 - protein, 9 aa, Cryptosporidium parvum
SHNPGGIDE

SEQ ID NO: 2280806 - protein, 6 aa, Cryptosporidium parvum
SHNSNQ

SEQ ID NO: 2280807 - protein, 7 aa, Cryptosporidium parvum
SHNSQNI

SEQ ID NO: 2280808 - protein, 9 aa, Cryptosporidium parvum
SHNSSISYK

SEQ ID NO: 2280809 - protein, 6 aa, Cryptosporidium parvum
SHNTSS

SEQ ID NO: 2280810 - protein, 4 aa, Cryptosporidium parvum
SHPE

SEQ ID NO: 2280811 - protein, 6 aa, Cryptosporidium parvum
SHPEFQ

SEQ ID NO: 2280812 - protein, 6 aa, Cryptosporidium parvum
SHPESF

SEQ ID NO: 2280813 - protein, 6 aa, Cryptosporidium parvum
SHPHPS

SEQ ID NO: 2280814 - protein, 6 aa, Cryptosporidium parvum
SHPHTG

SEQ ID NO: 2280815 - protein, 5 aa, Cryptosporidium parvum
SHPKD

SEQ ID NO: 2280816 - protein, 4 aa, Cryptosporidium parvum
SHPN

SEQ ID NO: 2280817 - protein, 9 aa, Cryptosporidium parvum
SHPNDQRPC

SEQ ID NO: 2280818 - protein, 7 aa, Cryptosporidium parvum
SHPNIKK

SEQ ID NO: 2280819 - protein, 5 aa, Cryptosporidium parvum
SHPQM

SEQ ID NO: 2280820 - protein, 15 aa, Cryptosporidium parvum
SHQKTGSGNSPRSDI

SEQ ID NO: 2280821 - protein, 7 aa, Cryptosporidium parvum
SHQNNNF

SEQ ID NO: 2280822 - protein, 14 aa, Cryptosporidium parvum
SHQSRQYQQNNTNE

SEQ ID NO: 2280823 - protein, 4 aa, Cryptosporidium parvum
SHQT

SEQ ID NO: 2280824 - protein, 25 aa, Cryptosporidium parvum
SHRIPSTKSSHASNDFQHIFKEGSF

SEQ ID NO: 2280825 - protein, 12 aa, Cryptosporidium parvum
SHRQSYSGEGRA

SEQ ID NO: 2280826 - protein, 8 aa, Cryptosporidium parvum
SHRSKKGD

SEQ ID NO: 2280827 - protein, 4 aa, Cryptosporidium parvum
SHSA

SEQ ID NO: 2280828 - protein, 6 aa, Cryptosporidium parvum
SHSGID

SEQ ID NO: 2280829 - protein, 6 aa, Cryptosporidium parvum
SHSKPK

SEQ ID NO: 2280830 - protein, 6 aa, Cryptosporidium parvum
SHSKSG

SEQ ID NO: 2280831 - protein, 5 aa, Cryptosporidium parvum
SHSSK

SEQ ID NO: 2280832 - protein, 6 aa, Cryptosporidium parvum
SHTDSP

SEQ ID NO: 2280833 - protein, 4 aa, Cryptosporidium parvum
SHTG

SEQ ID NO: 2280834 - protein, 6 aa, Cryptosporidium parvum
SHTTIN

SEQ ID NO: 2280835 - protein, 13 aa, Cryptosporidium parvum
SHTVNPQSEHNLY

SEQ ID NO: 2280836 - protein, 4 aa, Cryptosporidium parvum
SHVG

SEQ ID NO: 2280837 - protein, 4 aa, Cryptosporidium parvum
SIAA

SEQ ID NO: 2280838 - protein, 12 aa, Cryptosporidium parvum
SIADPFLHSFPE

SEQ ID NO: 2280839 - protein, 13 aa, Cryptosporidium parvum
SIAGDTAGTPSAL

SEQ ID NO: 2280840 - protein, 8 aa, Cryptosporidium parvum
SIAGNAQS

SEQ ID NO: 2280841 - protein, 11 aa, Cryptosporidium parvum
SIANSGSPKEI

SEQ ID NO: 2280842 - protein, 10 aa, Cryptosporidium parvum
SIAPKASKSV

SEQ ID NO: 2280843 - protein, 14 aa, Cryptosporidium parvum
SIARPISKDLSRES

SEQ ID NO: 2280844 - protein, 6 aa, Cryptosporidium parvum
SIASKG

SEQ ID NO: 2280845 - protein, 10 aa, Cryptosporidium parvum
SIASNNARQS

SEQ ID NO: 2280846 - protein, 23 aa, Cryptosporidium parvum
SIASSGSKNEKQRSKQTFKSRNE

SEQ ID NO: 2280847 - protein, 4 aa, Cryptosporidium parvum
SIDD

SEQ ID NO: 2280848 - protein, 10 aa, Cryptosporidium parvum
SIDESKQKQY

SEQ ID NO: 2280849 - protein, 7 aa, Cryptosporidium parvum
SIDKKTK

SEQ ID NO: 2280850 - protein, 5 aa, Cryptosporidium parvum
SIDKN

SEQ ID NO: 2280851 - protein, 10 aa, Cryptosporidium parvum
SIDKPNEQNN

SEQ ID NO: 2280852 - protein, 9 aa, Cryptosporidium parvum
SIDPNSGIK

SEQ ID NO: 2280853 - protein, 8 aa, Cryptosporidium parvum
SIDQAKSS

SEQ ID NO: 2280854 - protein, 28 aa, Cryptosporidium parvum
SIDQESNRHTPTTASSSSKSPAKIEEPT

SEQ ID NO: 2280855 - protein, 10 aa, Cryptosporidium parvum
SIDQKRSASM

SEQ ID NO: 2280856 - protein, 16 aa, Cryptosporidium parvum
SIDQSTNQNIRQKNGD

SEQ ID NO: 2280857 - protein, 6 aa, Cryptosporidium parvum
SIDSKF

SEQ ID NO: 2280858 - protein, 4 aa, Cryptosporidium parvum
SIDT

SEQ ID NO: 2280859 - protein, 4 aa, Cryptosporidium parvum
SIEA

SEQ ID NO: 2280860 - protein, 10 aa, Cryptosporidium parvum
SIEASNETIK

SEQ ID NO: 2280861 - protein, 9 aa, Cryptosporidium parvum
SIEATDTTI

SEQ ID NO: 2280862 - protein, 8 aa, Cryptosporidium parvum
SIEDESSS

SEQ ID NO: 2280863 - protein, 14 aa, Cryptosporidium parvum
SIEDQGELGSNEDR

SEQ ID NO: 2280864 - protein, 9 aa, Cryptosporidium parvum
SIEEGLDDE

SEQ ID NO: 2280865 - protein, 15 aa, Cryptosporidium parvum
SIEEPNSKVEDGFRR

SEQ ID NO: 2280866 - protein, 4 aa, Cryptosporidium parvum
SIEG

SEQ ID NO: 2280867 - protein, 20 aa, Cryptosporidium parvum
SIEGESPCDKEIAAGDDEEV

SEQ ID NO: 2280868 - protein, 4 aa, Cryptosporidium parvum
SIEN

SEQ ID NO: 2280869 - protein, 10 aa, Cryptosporidium parvum
SIENNDNNHH

SEQ ID NO: 2280870 - protein, 5 aa, Cryptosporidium parvum
SIENP

SEQ ID NO: 2280871 - protein, 13 aa, Cryptosporidium parvum
SIEPEPPKEIDED

SEQ ID NO: 2280872 - protein, 9 aa, Cryptosporidium parvum
SIERDSTEC

SEQ ID NO: 2280873 - protein, 22 aa, Cryptosporidium parvum
SIESSEYSSLNDEKKSSEPDIS

SEQ ID NO: 2280874 - protein, 12 aa, Cryptosporidium parvum
SIESSKRYNHTS

SEQ ID NO: 2280875 - protein, 7 aa, Cryptosporidium parvum
SIESTSL

SEQ ID NO: 2280876 - protein, 8 aa, Cryptosporidium parvum
SIETEKAD

SEQ ID NO: 2280877 - protein, 6 aa, Cryptosporidium parvum
SIETPR

SEQ ID NO: 2280878 - protein, 8 aa, Cryptosporidium parvum
SIETTEDG

SEQ ID NO: 2280879 - protein, 35 aa, Cryptosporidium parvum
SIETTKEKDSQDLTTEPASSSASLSSPTEKPSIPG

SEQ ID NO: 2280880 - protein, 12 aa, Cryptosporidium parvum
SIFGSSNSSNPF

SEQ ID NO: 2280881 - protein, 11 aa, Cryptosporidium parvum
SIGDNNSFEVG

SEQ ID NO: 2280882 - protein, 4 aa, Cryptosporidium parvum
SIGE

SEQ ID NO: 2280883 - protein, 12 aa, Cryptosporidium parvum
SIGESNSNINNN

SEQ ID NO: 2280884 - protein, 6 aa, Cryptosporidium parvum
SIGGKG

SEQ ID NO: 2280885 - protein, 8 aa, Cryptosporidium parvum
SIGNPPRG

SEQ ID NO: 2280886 - protein, 7 aa, Cryptosporidium parvum
SIGQDET

SEQ ID NO: 2280887 - protein, 9 aa, Cryptosporidium parvum
SIGRANNKS

SEQ ID NO: 2280888 - protein, 4 aa, Cryptosporidium parvum
SIGS

SEQ ID NO: 2280889 - protein, 16 aa, Cryptosporidium parvum
SIGSGKSIRNNNGSDL

SEQ ID NO: 2280890 - protein, 17 aa, Cryptosporidium parvum
SIGSQRTEGESGDSEVQ

SEQ ID NO: 2280891 - protein, 11 aa, Cryptosporidium parvum
SIGSRTEEGLL

SEQ ID NO: 2280892 - protein, 32 aa, Cryptosporidium parvum
SIGSSLGCGSSDGAGPHDSRDIRQNTASVQTP

SEQ ID NO: 2280893 - protein, 38 aa, Cryptosporidium parvum
SIGSSQYNRRNNIKENTEVDEKEPITLSKEDDSKKENF

SEQ ID NO: 2280894 - protein, 6 aa, Cryptosporidium parvum
SIGTGL

SEQ ID NO: 2280895 - protein, 19 aa, Cryptosporidium parvum
SIGTQRGSSMGDAGGAGDR

SEQ ID NO: 2280896 - protein, 5 aa, Cryptosporidium parvum
SIHSE

SEQ ID NO: 2280897 - protein, 6 aa, Cryptosporidium parvum
SIHSKN

SEQ ID NO: 2280898 - protein, 11 aa, Cryptosporidium parvum
SIHSNTPLPPS

SEQ ID NO: 2280899 - protein, 14 aa, Cryptosporidium parvum
SIKDDKQDQGMTED

SEQ ID NO: 2280900 - protein, 5 aa, Cryptosporidium parvum
SIKDG

SEQ ID NO: 2280901 - protein, 5 aa, Cryptosporidium parvum
SIKDS

SEQ ID NO: 2280902 - protein, 8 aa, Cryptosporidium parvum
SIKDSTRK

SEQ ID NO: 2280903 - protein, 10 aa, Cryptosporidium parvum
SIKEDHSKSI

SEQ ID NO: 2280904 - protein, 6 aa, Cryptosporidium parvum
SIKEQN

SEQ ID NO: 2280905 - protein, 12 aa, Cryptosporidium parvum
SIKESNINNRQG

SEQ ID NO: 2280906 - protein, 17 aa, Cryptosporidium parvum
SIKGRSENEIMANDKPL

SEQ ID NO: 2280907 - protein, 4 aa, Cryptosporidium parvum
SIKK

SEQ ID NO: 2280908 - protein, 8 aa, Cryptosporidium parvum
SIKNNDRI

SEQ ID NO: 2280909 - protein, 8 aa, Cryptosporidium parvum
SIKNQVNS

SEQ ID NO: 2280910 - protein, 5 aa, Cryptosporidium parvum
SIKPD

SEQ ID NO: 2280911 - protein, 10 aa, Cryptosporidium parvum
SIKPKKGRKR

SEQ ID NO: 2280912 - protein, 31 aa, Cryptosporidium parvum
SIKPNGGEENSKEEVKLSEKDHQKLQNGDNE

SEQ ID NO: 2280913 - protein, 9 aa, Cryptosporidium parvum
SIKQDDEGI

SEQ ID NO: 2280914 - protein, 8 aa, Cryptosporidium parvum
SIKQEDNN

SEQ ID NO: 2280915 - protein, 5 aa, Cryptosporidium parvum
SIKRN

SEQ ID NO: 2280916 - protein, 7 aa, Cryptosporidium parvum
SIKSEQG

SEQ ID NO: 2280917 - protein, 16 aa, Cryptosporidium parvum
SIKSQEEKLRKEKSLN

SEQ ID NO: 2280918 - protein, 16 aa, Cryptosporidium parvum
SIKSSDKKDYSDVTPD

SEQ ID NO: 2280919 - protein, 10 aa, Cryptosporidium parvum
SILGGSGNHH

SEQ ID NO: 2280920 - protein, 37 aa, Cryptosporidium parvum
SILGSGKSSSLLNPKQSEGKSSVKDGGKVSKSPAKLG

SEQ ID NO: 2280921 - protein, 4 aa, Cryptosporidium parvum
SILQ

SEQ ID NO: 2280922 - protein, 13 aa, Cryptosporidium parvum
SILSEKKNSSYSK

SEQ ID NO: 2280923 - protein, 9 aa, Cryptosporidium parvum
SILSKPEKF

SEQ ID NO: 2280924 - protein, 7 aa, Cryptosporidium parvum
SINEGFP

SEQ ID NO: 2280925 - protein, 15 aa, Cryptosporidium parvum
SINEQENKGKIESNI

SEQ ID NO: 2280926 - protein, 6 aa, Cryptosporidium parvum
SINGGT

SEQ ID NO: 2280927 - protein, 12 aa, Cryptosporidium parvum
SINGNGDSKNEW

SEQ ID NO: 2280928 - protein, 5 aa, Cryptosporidium parvum
SINGR

SEQ ID NO: 2280929 - protein, 4 aa, Cryptosporidium parvum
SINK

SEQ ID NO: 2280930 - protein, 11 aa, Cryptosporidium parvum
SINKEKTSIDQ

SEQ ID NO: 2280931 - protein, 8 aa, Cryptosporidium parvum
SINKGGKG

SEQ ID NO: 2280932 - protein, 18 aa, Cryptosporidium parvum
SINKSTNNNIRKNDKDHY

SEQ ID NO: 2280933 - protein, 16 aa, Cryptosporidium parvum
SINNEQNQENKKNESI

SEQ ID NO: 2280934 - protein, 12 aa, Cryptosporidium parvum
SINNKEVANTIK

SEQ ID NO: 2280935 - protein, 51 aa, Cryptosporidium parvum
SINNNKELNEQSTIKNKDLESESNTKNSSSSTTSSVTKPKVSTPTNVTTTS

SEQ ID NO: 2280936 - protein, 5 aa, Cryptosporidium parvum
SINNS

SEQ ID NO: 2280937 - protein, 16 aa, Cryptosporidium parvum
SINNSGNNSSFSKQNI

SEQ ID NO: 2280938 - protein, 9 aa, Cryptosporidium parvum
SINNSNNSF

SEQ ID NO: 2280939 - protein, 19 aa, Cryptosporidium parvum
SINNTTDDLSNQELEDSKF

SEQ ID NO: 2280940 - protein, 5 aa, Cryptosporidium parvum
SINPD

SEQ ID NO: 2280941 - protein, 11 aa, Cryptosporidium parvum
SINPGQSNSKL

SEQ ID NO: 2280942 - protein, 6 aa, Cryptosporidium parvum
SINPTS

SEQ ID NO: 2280943 - protein, 6 aa, Cryptosporidium parvum
SINPTT

SEQ ID NO: 2280944 - protein, 6 aa, Cryptosporidium parvum
SINSEP

SEQ ID NO: 2280945 - protein, 10 aa, Cryptosporidium parvum
SINSEQKSLR

SEQ ID NO: 2280946 - protein, 18 aa, Cryptosporidium parvum
SINSNQNTEQIPDCKSSK

SEQ ID NO: 2280947 - protein, 33 aa, Cryptosporidium parvum
SINSNTNNSGSNNGNNNSSTNNNNINNACSDNA

SEQ ID NO: 2280948 - protein, 5 aa, Cryptosporidium parvum
SINSQ

SEQ ID NO: 2280949 - protein, 14 aa, Cryptosporidium parvum
SINSQTKNIKRPEI

SEQ ID NO: 2280950 - protein, 13 aa, Cryptosporidium parvum
SINSSRPNTFTNN

SEQ ID NO: 2280951 - protein, 7 aa, Cryptosporidium parvum
SINSSRS

SEQ ID NO: 2280952 - protein, 4 aa, Cryptosporidium parvum
SINT

SEQ ID NO: 2280953 - protein, 16 aa, Cryptosporidium parvum
SINTKQKNSNETGKFT

SEQ ID NO: 2280954 - protein, 5 aa, Cryptosporidium parvum
SINWT

SEQ ID NO: 2280955 - protein, 8 aa, Cryptosporidium parvum
SINYNSYD

SEQ ID NO: 2280956 - protein, 5 aa, Cryptosporidium parvum
SIPDE

SEQ ID NO: 2280957 - protein, 52 aa, Cryptosporidium parvum
SIPESESDTDSDSDSESLGSSIEKPSVEGNLRKESGLSGSETNTGEESTKAL

SEQ ID NO: 2280958 - protein, 4 aa, Cryptosporidium parvum
SIPG

SEQ ID NO: 2280959 - protein, 5 aa, Cryptosporidium parvum
SIPGG

SEQ ID NO: 2280960 - protein, 13 aa, Cryptosporidium parvum
SIPKLSGPTKSDI

SEQ ID NO: 2280961 - protein, 5 aa, Cryptosporidium parvum
SIPNK

SEQ ID NO: 2280962 - protein, 9 aa, Cryptosporidium parvum
SIPNSLTTS

SEQ ID NO: 2280963 - protein, 6 aa, Cryptosporidium parvum
SIPPEN

SEQ ID NO: 2280964 - protein, 5 aa, Cryptosporidium parvum
SIPQN

SEQ ID NO: 2280965 - protein, 7 aa, Cryptosporidium parvum
SIPQTSP

SEQ ID NO: 2280966 - protein, 9 aa, Cryptosporidium parvum
SIPRKEREH

SEQ ID NO: 2280967 - protein, 4 aa, Cryptosporidium parvum
SIPS

SEQ ID NO: 2280968 - protein, 7 aa, Cryptosporidium parvum
SIPSGST

SEQ ID NO: 2280969 - protein, 5 aa, Cryptosporidium parvum
SIPSH

SEQ ID NO: 2280970 - protein, 19 aa, Cryptosporidium parvum
SIPSPPSVNTLNTTYRKGD

SEQ ID NO: 2280971 - protein, 8 aa, Cryptosporidium parvum
SIPSTADY

SEQ ID NO: 2280972 - protein, 8 aa, Cryptosporidium parvum
SIPSTRKT

SEQ ID NO: 2280973 - protein, 13 aa, Cryptosporidium parvum
SIPSTVSTSTDSI

SEQ ID NO: 2280974 - protein, 4 aa, Cryptosporidium parvum
SIPT

SEQ ID NO: 2280975 - protein, 5 aa, Cryptosporidium parvum
SIPTD

SEQ ID NO: 2280976 - protein, 7 aa, Cryptosporidium parvum
SIPTKDI

SEQ ID NO: 2280977 - protein, 6 aa, Cryptosporidium parvum
SIPTKR

SEQ ID NO: 2280978 - protein, 13 aa, Cryptosporidium parvum
SIPTPTAQQKAGL

SEQ ID NO: 2280979 - protein, 8 aa, Cryptosporidium parvum
SIQADSKA

SEQ ID NO: 2280980 - protein, 10 aa, Cryptosporidium parvum
SIQARSKQKY

SEQ ID NO: 2280981 - protein, 11 aa, Cryptosporidium parvum
SIQDSDNENIS

SEQ ID NO: 2280982 - protein, 12 aa, Cryptosporidium parvum
SIQEKSKRYTSV

SEQ ID NO: 2280983 - protein, 10 aa, Cryptosporidium parvum
SIQGGDPIPN

SEQ ID NO: 2280984 - protein, 20 aa, Cryptosporidium parvum
SIQMPHSGQSINPSEPDRQD

SEQ ID NO: 2280985 - protein, 7 aa, Cryptosporidium parvum
SIQNENE

SEQ ID NO: 2280986 - protein, 9 aa, Cryptosporidium parvum
SIQNHENKN

SEQ ID NO: 2280987 - protein, 6 aa, Cryptosporidium parvum
SIQNNE

SEQ ID NO: 2280988 - protein, 12 aa, Cryptosporidium parvum
SIQNQGQQITTQ

SEQ ID NO: 2280989 - protein, 5 aa, Cryptosporidium parvum
SIQPC

SEQ ID NO: 2280990 - protein, 18 aa, Cryptosporidium parvum
SIQPPAKKTRKSRSINSN

SEQ ID NO: 2280991 - protein, 5 aa, Cryptosporidium parvum
SIQRK

SEQ ID NO: 2280992 - protein, 8 aa, Cryptosporidium parvum
SIQRPGMG

SEQ ID NO: 2280993 - protein, 14 aa, Cryptosporidium parvum
SIRAGYGGDDLPRS

SEQ ID NO: 2280994 - protein, 6 aa, Cryptosporidium parvum
SIRDPE

SEQ ID NO: 2280995 - protein, 5 aa, Cryptosporidium parvum
SIREN

SEQ ID NO: 2280996 - protein, 15 aa, Cryptosporidium parvum
SIRESDTGLAPPSQW

SEQ ID NO: 2280997 - protein, 7 aa, Cryptosporidium parvum
SIRKGQT

SEQ ID NO: 2280998 - protein, 10 aa, Cryptosporidium parvum
SIRPTITTEN

SEQ ID NO: 2280999 - protein, 13 aa, Cryptosporidium parvum
SIRRQDANGQKPE

SEQ ID NO: 2281000 - protein, 61 aa, Cryptosporidium parvum
SISARRTKAEPESKAAKKRQRKDTIKVGSEHSPNKNFNSVENPVKPKKPRKSNSSSSGEKQ

SEQ ID NO: 2281001 - protein, 5 aa, Cryptosporidium parvum
SISDE

SEQ ID NO: 2281002 - protein, 8 aa, Cryptosporidium parvum
SISDEREN

SEQ ID NO: 2281003 - protein, 4 aa, Cryptosporidium parvum
SISE

SEQ ID NO: 2281004 - protein, 6 aa, Cryptosporidium parvum
SISEDP

SEQ ID NO: 2281005 - protein, 7 aa, Cryptosporidium parvum
SISEDYG

SEQ ID NO: 2281006 - protein, 5 aa, Cryptosporidium parvum
SISEI

SEQ ID NO: 2281007 - protein, 8 aa, Cryptosporidium parvum
SISEKKEK

SEQ ID NO: 2281008 - protein, 5 aa, Cryptosporidium parvum
SISEL

SEQ ID NO: 2281009 - protein, 11 aa, Cryptosporidium parvum
SISEREAKSRA

SEQ ID NO: 2281010 - protein, 13 aa, Cryptosporidium parvum
SISESRPESELEP

SEQ ID NO: 2281011 - protein, 39 aa, Cryptosporidium parvum
SISETNGNIQEEEKKKREEKKKREEEEKIKKEKEEEEKA

SEQ ID NO: 2281012 - protein, 6 aa, Cryptosporidium parvum
SISGRR

SEQ ID NO: 2281013 - protein, 19 aa, Cryptosporidium parvum
SISGSQGLYRNQSNGGTSN

SEQ ID NO: 2281014 - protein, 5 aa, Cryptosporidium parvum
SISGT

SEQ ID NO: 2281015 - protein, 27 aa, Cryptosporidium parvum
SISKDKSSIGDGNLSSNSTNNNKLPKK

SEQ ID NO: 2281016 - protein, 5 aa, Cryptosporidium parvum
SISKK

SEQ ID NO: 2281017 - protein, 9 aa, Cryptosporidium parvum
SISKSNARE

SEQ ID NO: 2281018 - protein, 6 aa, Cryptosporidium parvum
SISKSP

SEQ ID NO: 2281019 - protein, 13 aa, Cryptosporidium parvum
SISNGKDTISSAE

SEQ ID NO: 2281020 - protein, 11 aa, Cryptosporidium parvum
SISNKDNDNLK

SEQ ID NO: 2281021 - protein, 30 aa, Cryptosporidium parvum
SISNKPNSSIPSSHLAPPSSSVSSSKLGEA

SEQ ID NO: 2281022 - protein, 8 aa, Cryptosporidium parvum
SISNKQTN

SEQ ID NO: 2281023 - protein, 17 aa, Cryptosporidium parvum
SISNNNNNNNNNNNNDI

SEQ ID NO: 2281024 - protein, 6 aa, Cryptosporidium parvum
SISNRE

SEQ ID NO: 2281025 - protein, 4 aa, Cryptosporidium parvum
SISP

SEQ ID NO: 2281026 - protein, 9 aa, Cryptosporidium parvum
SISPEDSQS

SEQ ID NO: 2281027 - protein, 14 aa, Cryptosporidium parvum
SISPLTKGTSTSLI

SEQ ID NO: 2281028 - protein, 5 aa, Cryptosporidium parvum
SISPN

SEQ ID NO: 2281029 - protein, 15 aa, Cryptosporidium parvum
SISPTNKSKKNKEVK

SEQ ID NO: 2281030 - protein, 8 aa, Cryptosporidium parvum
SISQATEN

SEQ ID NO: 2281031 - protein, 13 aa, Cryptosporidium parvum
SISRDPYQGKRYR

SEQ ID NO: 2281032 - protein, 11 aa, Cryptosporidium parvum
SISSDFEKNTG

SEQ ID NO: 2281033 - protein, 7 aa, Cryptosporidium parvum
SISSENA

SEQ ID NO: 2281034 - protein, 17 aa, Cryptosporidium parvum
SISSPNSNESSKPETFR

SEQ ID NO: 2281035 - protein, 13 aa, Cryptosporidium parvum
SISSQKARRNRVF

SEQ ID NO: 2281036 - protein, 7 aa, Cryptosporidium parvum
SISSSPN

SEQ ID NO: 2281037 - protein, 12 aa, Cryptosporidium parvum
SISSSSNSSSNL

SEQ ID NO: 2281038 - protein, 14 aa, Cryptosporidium parvum
SISSSSSSSFPSQS

SEQ ID NO: 2281039 - protein, 13 aa, Cryptosporidium parvum
SISSSSTTDVPNM

SEQ ID NO: 2281040 - protein, 10 aa, Cryptosporidium parvum
SISTAENEQQ

SEQ ID NO: 2281041 - protein, 7 aa, Cryptosporidium parvum
SISTETG

SEQ ID NO: 2281042 - protein, 6 aa, Cryptosporidium parvum
SISTNY

SEQ ID NO: 2281043 - protein, 18 aa, Cryptosporidium parvum
SISTQDDQQMEDPEKKGS

SEQ ID NO: 2281044 - protein, 27 aa, Cryptosporidium parvum
SISTTQAPQDTLSSQDSLQSQSNTQVQ

SEQ ID NO: 2281045 - protein, 7 aa, Cryptosporidium parvum
SITGSSS

SEQ ID NO: 2281046 - protein, 5 aa, Cryptosporidium parvum
SITGT

SEQ ID NO: 2281047 - protein, 11 aa, Cryptosporidium parvum
SITNQTSSNPK

SEQ ID NO: 2281048 - protein, 7 aa, Cryptosporidium parvum
SITNYNT

SEQ ID NO: 2281049 - protein, 6 aa, Cryptosporidium parvum
SITQEE

SEQ ID NO: 2281050 - protein, 17 aa, Cryptosporidium parvum
SITQTGQSITPPAIPGN

SEQ ID NO: 2281051 - protein, 16 aa, Cryptosporidium parvum
SITSASERDVHTGDSA

SEQ ID NO: 2281052 - protein, 17 aa, Cryptosporidium parvum
SITSQARKSYYKPKNED

SEQ ID NO: 2281053 - protein, 4 aa, Cryptosporidium parvum
SITT

SEQ ID NO: 2281054 - protein, 5 aa, Cryptosporidium parvum
SITTY

SEQ ID NO: 2281055 - protein, 4 aa, Cryptosporidium parvum
SITY

SEQ ID NO: 2281056 - protein, 16 aa, Cryptosporidium parvum
SITYDEASSSSEEYPE

SEQ ID NO: 2281057 - protein, 11 aa, Cryptosporidium parvum
SIVSPKSNDLE

SEQ ID NO: 2281058 - protein, 6 aa, Cryptosporidium parvum
SIYEPS

SEQ ID NO: 2281059 - protein, 9 aa, Cryptosporidium parvum
SIYETNKTQ

SEQ ID NO: 2281060 - protein, 5 aa, Cryptosporidium parvum
SIYPP

SEQ ID NO: 2281061 - protein, 19 aa, Cryptosporidium parvum
SKAAGDARFTDTRADEQER

SEQ ID NO: 2281062 - protein, 8 aa, Cryptosporidium parvum
SKADGNRS

SEQ ID NO: 2281063 - protein, 8 aa, Cryptosporidium parvum
SKAKRNSY

SEQ ID NO: 2281064 - protein, 11 aa, Cryptosporidium parvum
SKANKKNGEGQ

SEQ ID NO: 2281065 - protein, 9 aa, Cryptosporidium parvum
SKANSQSSM

SEQ ID NO: 2281066 - protein, 17 aa, Cryptosporidium parvum
SKANTENVKNNQEQAQI

SEQ ID NO: 2281067 - protein, 9 aa, Cryptosporidium parvum
SKAQNDNNL

SEQ ID NO: 2281068 - protein, 32 aa, Cryptosporidium parvum
SKASSSKIDRTEYQNKADYSQVNSDGNKRTKL

SEQ ID NO: 2281069 - protein, 8 aa, Cryptosporidium parvum
SKATETHK

SEQ ID NO: 2281070 - protein, 11 aa, Cryptosporidium parvum
SKAVGSDKRIG

SEQ ID NO: 2281071 - protein, 8 aa, Cryptosporidium parvum
SKAVGSPQ

SEQ ID NO: 2281072 - protein, 12 aa, Cryptosporidium parvum
SKCDRKAKNCKA

SEQ ID NO: 2281073 - protein, 15 aa, Cryptosporidium parvum
SKCENASQDLTNKEV

SEQ ID NO: 2281074 - protein, 8 aa, Cryptosporidium parvum
SKCGEDTE

SEQ ID NO: 2281075 - protein, 17 aa, Cryptosporidium parvum
SKCKSTKPIKQIGGGQY

SEQ ID NO: 2281076 - protein, 12 aa, Cryptosporidium parvum
SKCLPDGNRIRG

SEQ ID NO: 2281077 - protein, 9 aa, Cryptosporidium parvum
SKDALTSKH

SEQ ID NO: 2281078 - protein, 7 aa, Cryptosporidium parvum
SKDDNNE

SEQ ID NO: 2281079 - protein, 8 aa, Cryptosporidium parvum
SKDEEEKV

SEQ ID NO: 2281080 - protein, 9 aa, Cryptosporidium parvum
SKDEEGYDE

SEQ ID NO: 2281081 - protein, 6 aa, Cryptosporidium parvum
SKDEET

SEQ ID NO: 2281082 - protein, 14 aa, Cryptosporidium parvum
SKDEISQSIKSNSR

SEQ ID NO: 2281083 - protein, 8 aa, Cryptosporidium parvum
SKDEKISK

SEQ ID NO: 2281084 - protein, 7 aa, Cryptosporidium parvum
SKDEKLV

SEQ ID NO: 2281085 - protein, 24 aa, Cryptosporidium parvum
SKDEKTVFESNPNVDSKADVSYNS

SEQ ID NO: 2281086 - protein, 8 aa, Cryptosporidium parvum
SKDELKEL

SEQ ID NO: 2281087 - protein, 6 aa, Cryptosporidium parvum
SKDEVD

SEQ ID NO: 2281088 - protein, 8 aa, Cryptosporidium parvum
SKDGEFGG

SEQ ID NO: 2281089 - protein, 5 aa, Cryptosporidium parvum
SKDGF

SEQ ID NO: 2281090 - protein, 8 aa, Cryptosporidium parvum
SKDGQNEL

SEQ ID NO: 2281091 - protein, 5 aa, Cryptosporidium parvum
SKDIN

SEQ ID NO: 2281092 - protein, 11 aa, Cryptosporidium parvum
SKDISENDSRQ

SEQ ID NO: 2281093 - protein, 14 aa, Cryptosporidium parvum
SKDLRDSEEKERME

SEQ ID NO: 2281094 - protein, 5 aa, Cryptosporidium parvum
SKDME

SEQ ID NO: 2281095 - protein, 6 aa, Cryptosporidium parvum
SKDNKI

SEQ ID NO: 2281096 - protein, 13 aa, Cryptosporidium parvum
SKDNNEEDEDPKI

SEQ ID NO: 2281097 - protein, 11 aa, Cryptosporidium parvum
SKDNPKSNSSM

SEQ ID NO: 2281098 - protein, 5 aa, Cryptosporidium parvum
SKDNT

SEQ ID NO: 2281099 - protein, 5 aa, Cryptosporidium parvum
SKDPF

SEQ ID NO: 2281100 - protein, 10 aa, Cryptosporidium parvum
SKDPKNKSVK

SEQ ID NO: 2281101 - protein, 8 aa, Cryptosporidium parvum
SKDPSHRQ

SEQ ID NO: 2281102 - protein, 11 aa, Cryptosporidium parvum
SKDPSSPFNPN

SEQ ID NO: 2281103 - protein, 5 aa, Cryptosporidium parvum
SKDQD

SEQ ID NO: 2281104 - protein, 14 aa, Cryptosporidium parvum
SKDQDKSDELREKR

SEQ ID NO: 2281105 - protein, 16 aa, Cryptosporidium parvum
SKDQIPPGIANTPSLG

SEQ ID NO: 2281106 - protein, 29 aa, Cryptosporidium parvum
SKDSEDIESRTAKSGSQKKQNSQNSENEI

SEQ ID NO: 2281107 - protein, 8 aa, Cryptosporidium parvum
SKDSGALQ

SEQ ID NO: 2281108 - protein, 7 aa, Cryptosporidium parvum
SKDSKEY

SEQ ID NO: 2281109 - protein, 6 aa, Cryptosporidium parvum
SKDSKS

SEQ ID NO: 2281110 - protein, 6 aa, Cryptosporidium parvum
SKDSNI

SEQ ID NO: 2281111 - protein, 11 aa, Cryptosporidium parvum
SKDSSSNNSCN

SEQ ID NO: 2281112 - protein, 8 aa, Cryptosporidium parvum
SKDTIEKT

SEQ ID NO: 2281113 - protein, 13 aa, Cryptosporidium parvum
SKDTTGDGSQIGK

SEQ ID NO: 2281114 - protein, 16 aa, Cryptosporidium parvum
SKDYSEQCNKKSTSRG

SEQ ID NO: 2281115 - protein, 6 aa, Cryptosporidium parvum
SKDYTN

SEQ ID NO: 2281116 - protein, 5 aa, Cryptosporidium parvum
SKEAG

SEQ ID NO: 2281117 - protein, 5 aa, Cryptosporidium parvum
SKEAR

SEQ ID NO: 2281118 - protein, 7 aa, Cryptosporidium parvum
SKEDEYN

SEQ ID NO: 2281119 - protein, 8 aa, Cryptosporidium parvum
SKEDQDRI

SEQ ID NO: 2281120 - protein, 8 aa, Cryptosporidium parvum
SKEEDRID

SEQ ID NO: 2281121 - protein, 5 aa, Cryptosporidium parvum
SKEEI

SEQ ID NO: 2281122 - protein, 7 aa, Cryptosporidium parvum
SKEEKDV

SEQ ID NO: 2281123 - protein, 8 aa, Cryptosporidium parvum
SKEEKEKC

SEQ ID NO: 2281124 - protein, 7 aa, Cryptosporidium parvum
SKEEKYE

SEQ ID NO: 2281125 - protein, 14 aa, Cryptosporidium parvum
SKEEKYEISGYNRE

SEQ ID NO: 2281126 - protein, 9 aa, Cryptosporidium parvum
SKEENQSIN

SEQ ID NO: 2281127 - protein, 7 aa, Cryptosporidium parvum
SKEFKFS

SEQ ID NO: 2281128 - protein, 5 aa, Cryptosporidium parvum
SKEGE

SEQ ID NO: 2281129 - protein, 6 aa, Cryptosporidium parvum
SKEGIQ

SEQ ID NO: 2281130 - protein, 6 aa, Cryptosporidium parvum
SKEGIS

SEQ ID NO: 2281131 - protein, 9 aa, Cryptosporidium parvum
SKEGLNPTI

SEQ ID NO: 2281132 - protein, 8 aa, Cryptosporidium parvum
SKEGSGDW

SEQ ID NO: 2281133 - protein, 8 aa, Cryptosporidium parvum
SKEGVDKS

SEQ ID NO: 2281134 - protein, 8 aa, Cryptosporidium parvum
SKEIESKL

SEQ ID NO: 2281135 - protein, 7 aa, Cryptosporidium parvum
SKEIHPK

SEQ ID NO: 2281136 - protein, 6 aa, Cryptosporidium parvum
SKEIPP

SEQ ID NO: 2281137 - protein, 15 aa, Cryptosporidium parvum
SKEIYSSNDELGGTE

SEQ ID NO: 2281138 - protein, 4 aa, Cryptosporidium parvum
SKEK

SEQ ID NO: 2281139 - protein, 9 aa, Cryptosporidium parvum
SKEKEEKIE

SEQ ID NO: 2281140 - protein, 7 aa, Cryptosporidium parvum
SKEKLKG

SEQ ID NO: 2281141 - protein, 12 aa, Cryptosporidium parvum
SKEKLKKKSTIK

SEQ ID NO: 2281142 - protein, 5 aa, Cryptosporidium parvum
SKEKN

SEQ ID NO: 2281143 - protein, 8 aa, Cryptosporidium parvum
SKEKQKLE

SEQ ID NO: 2281144 - protein, 5 aa, Cryptosporidium parvum
SKELE

SEQ ID NO: 2281145 - protein, 7 aa, Cryptosporidium parvum
SKELGTW

SEQ ID NO: 2281146 - protein, 6 aa, Cryptosporidium parvum
SKELRQ

SEQ ID NO: 2281147 - protein, 9 aa, Cryptosporidium parvum
SKELSDDKK

SEQ ID NO: 2281148 - protein, 4 aa, Cryptosporidium parvum
SKEN

SEQ ID NO: 2281149 - protein, 25 aa, Cryptosporidium parvum
SKENDESSVSSQDEYEGQTSEETSL

SEQ ID NO: 2281150 - protein, 7 aa, Cryptosporidium parvum
SKENEEL

SEQ ID NO: 2281151 - protein, 14 aa, Cryptosporidium parvum
SKENKEKMKNKPPI

SEQ ID NO: 2281152 - protein, 10 aa, Cryptosporidium parvum
SKENKRDSCY

SEQ ID NO: 2281153 - protein, 8 aa, Cryptosporidium parvum
SKENNSQC

SEQ ID NO: 2281154 - protein, 9 aa, Cryptosporidium parvum
SKENREASL

SEQ ID NO: 2281155 - protein, 7 aa, Cryptosporidium parvum
SKENSQN

SEQ ID NO: 2281156 - protein, 10 aa, Cryptosporidium parvum
SKENTKDGTV

SEQ ID NO: 2281157 - protein, 10 aa, Cryptosporidium parvum
SKENTSNTGF

SEQ ID NO: 2281158 - protein, 8 aa, Cryptosporidium parvum
SKEPIESN

SEQ ID NO: 2281159 - protein, 6 aa, Cryptosporidium parvum
SKEQIG

SEQ ID NO: 2281160 - protein, 15 aa, Cryptosporidium parvum
SKEQSSQGEVNNCGN

SEQ ID NO: 2281161 - protein, 7 aa, Cryptosporidium parvum
SKERMRP

SEQ ID NO: 2281162 - protein, 27 aa, Cryptosporidium parvum
SKESFQDSDESISYSRSSGSSINPSIN

SEQ ID NO: 2281163 - protein, 7 aa, Cryptosporidium parvum
SKESGSI

SEQ ID NO: 2281164 - protein, 6 aa, Cryptosporidium parvum
SKESID

SEQ ID NO: 2281165 - protein, 8 aa, Cryptosporidium parvum
SKESKSAL

SEQ ID NO: 2281166 - protein, 6 aa, Cryptosporidium parvum
SKESPN

SEQ ID NO: 2281167 - protein, 11 aa, Cryptosporidium parvum
SKESRDGFSKT

SEQ ID NO: 2281168 - protein, 11 aa, Cryptosporidium parvum
SKETDGKEEYD

SEQ ID NO: 2281169 - protein, 8 aa, Cryptosporidium parvum
SKETEISD

SEQ ID NO: 2281170 - protein, 8 aa, Cryptosporidium parvum
SKETENSS

SEQ ID NO: 2281171 - protein, 5 aa, Cryptosporidium parvum
SKETF

SEQ ID NO: 2281172 - protein, 6 aa, Cryptosporidium parvum
SKETGD

SEQ ID NO: 2281173 - protein, 66 aa, Cryptosporidium parvum
SKETTDTSVANNGYSGVNSKQTKCQETMRGAGYETSIQGQDQARKQLQKQKQTEQNNQQADQDFNG

SEQ ID NO: 2281174 - protein, 8 aa, Cryptosporidium parvum
SKETTSNL

SEQ ID NO: 2281175 - protein, 21 aa, Cryptosporidium parvum
SKFDHSSDDVSSSIETSNSEI

SEQ ID NO: 2281176 - protein, 5 aa, Cryptosporidium parvum
SKFDI

SEQ ID NO: 2281177 - protein, 10 aa, Cryptosporidium parvum
SKFESEMSNN

SEQ ID NO: 2281178 - protein, 4 aa, Cryptosporidium parvum
SKFG

SEQ ID NO: 2281179 - protein, 9 aa, Cryptosporidium parvum
SKFGGKPAW

SEQ ID NO: 2281180 - protein, 11 aa, Cryptosporidium parvum
SKFGKDPNMKQ

SEQ ID NO: 2281181 - protein, 8 aa, Cryptosporidium parvum
SKFKSENN

SEQ ID NO: 2281182 - protein, 4 aa, Cryptosporidium parvum
SKFQ

SEQ ID NO: 2281183 - protein, 8 aa, Cryptosporidium parvum
SKFQPRKD

SEQ ID NO: 2281184 - protein, 6 aa, Cryptosporidium parvum
SKFQYK

SEQ ID NO: 2281185 - protein, 13 aa, Cryptosporidium parvum
SKFSQSGNETNLK

SEQ ID NO: 2281186 - protein, 13 aa, Cryptosporidium parvum
SKFSSEISNSSDA

SEQ ID NO: 2281187 - protein, 18 aa, Cryptosporidium parvum
SKFSSGASTRVNTPEDDL

SEQ ID NO: 2281188 - protein, 6 aa, Cryptosporidium parvum
SKFTEN

SEQ ID NO: 2281189 - protein, 9 aa, Cryptosporidium parvum
SKGAECPKC

SEQ ID NO: 2281190 - protein, 6 aa, Cryptosporidium parvum
SKGAFN

SEQ ID NO: 2281191 - protein, 13 aa, Cryptosporidium parvum
SKGASKKPNTNGS

SEQ ID NO: 2281192 - protein, 9 aa, Cryptosporidium parvum
SKGDEPLVQ

SEQ ID NO: 2281193 - protein, 5 aa, Cryptosporidium parvum
SKGDK

SEQ ID NO: 2281194 - protein, 9 aa, Cryptosporidium parvum
SKGDPSNIG

SEQ ID NO: 2281195 - protein, 6 aa, Cryptosporidium parvum
SKGDRV

SEQ ID NO: 2281196 - protein, 5 aa, Cryptosporidium parvum
SKGEL

SEQ ID NO: 2281197 - protein, 6 aa, Cryptosporidium parvum
SKGFEK

SEQ ID NO: 2281198 - protein, 9 aa, Cryptosporidium parvum
SKGGKEDVE

SEQ ID NO: 2281199 - protein, 7 aa, Cryptosporidium parvum
SKGGSGE

SEQ ID NO: 2281200 - protein, 6 aa, Cryptosporidium parvum
SKGHED

SEQ ID NO: 2281201 - protein, 15 aa, Cryptosporidium parvum
SKGIKNKNNKEDTLN

SEQ ID NO: 2281202 - protein, 11 aa, Cryptosporidium parvum
SKGISKPSQIQ

SEQ ID NO: 2281203 - protein, 8 aa, Cryptosporidium parvum
SKGKDYSQ

SEQ ID NO: 2281204 - protein, 13 aa, Cryptosporidium parvum
SKGKQKGNTQLKQ

SEQ ID NO: 2281205 - protein, 7 aa, Cryptosporidium parvum
SKGKTSL

SEQ ID NO: 2281206 - protein, 7 aa, Cryptosporidium parvum
SKGNAAE

SEQ ID NO: 2281207 - protein, 6 aa, Cryptosporidium parvum
SKGNEG

SEQ ID NO: 2281208 - protein, 8 aa, Cryptosporidium parvum
SKGNQYKN

SEQ ID NO: 2281209 - protein, 9 aa, Cryptosporidium parvum
SKGNSTEKV

SEQ ID NO: 2281210 - protein, 5 aa, Cryptosporidium parvum
SKGPI

SEQ ID NO: 2281211 - protein, 5 aa, Cryptosporidium parvum
SKGPN

SEQ ID NO: 2281212 - protein, 13 aa, Cryptosporidium parvum
SKGRNNHNEMSGN

SEQ ID NO: 2281213 - protein, 7 aa, Cryptosporidium parvum
SKGRYES

SEQ ID NO: 2281214 - protein, 32 aa, Cryptosporidium parvum
SKGSGGPGAIGGSSGAGSGIPGERDSSTGPDF

SEQ ID NO: 2281215 - protein, 5 aa, Cryptosporidium parvum
SKGSK

SEQ ID NO: 2281216 - protein, 6 aa, Cryptosporidium parvum
SKGSQS

SEQ ID NO: 2281217 - protein, 7 aa, Cryptosporidium parvum
SKGSRSM

SEQ ID NO: 2281218 - protein, 7 aa, Cryptosporidium parvum
SKGTKFN

SEQ ID NO: 2281219 - protein, 28 aa, Cryptosporidium parvum
SKGTNNVPAQSQSGSDSTCGRCTDGQCG

SEQ ID NO: 2281220 - protein, 6 aa, Cryptosporidium parvum
SKGTVA

SEQ ID NO: 2281221 - protein, 4 aa, Cryptosporidium parvum
SKHG

SEQ ID NO: 2281222 - protein, 9 aa, Cryptosporidium parvum
SKHKDKYKH

SEQ ID NO: 2281223 - protein, 14 aa, Cryptosporidium parvum
SKHLSEKEDISVGS

SEQ ID NO: 2281224 - protein, 15 aa, Cryptosporidium parvum
SKHNSKTSRKSKLKK

SEQ ID NO: 2281225 - protein, 9 aa, Cryptosporidium parvum
SKHPGDKNV

SEQ ID NO: 2281226 - protein, 4 aa, Cryptosporidium parvum
SKHR

SEQ ID NO: 2281227 - protein, 7 aa, Cryptosporidium parvum
SKHSKEF

SEQ ID NO: 2281228 - protein, 6 aa, Cryptosporidium parvum
SKIDES

SEQ ID NO: 2281229 - protein, 4 aa, Cryptosporidium parvum
SKIE

SEQ ID NO: 2281230 - protein, 16 aa, Cryptosporidium parvum
SKIEPGSTSFDESTSS

SEQ ID NO: 2281231 - protein, 7 aa, Cryptosporidium parvum
SKIESEK

SEQ ID NO: 2281232 - protein, 7 aa, Cryptosporidium parvum
SKIGTKI

SEQ ID NO: 2281233 - protein, 6 aa, Cryptosporidium parvum
SKIKSR

SEQ ID NO: 2281234 - protein, 8 aa, Cryptosporidium parvum
SKINGDEN

SEQ ID NO: 2281235 - protein, 6 aa, Cryptosporidium parvum
SKINSE

SEQ ID NO: 2281236 - protein, 12 aa, Cryptosporidium parvum
SKINSQSKSNKL

SEQ ID NO: 2281237 - protein, 17 aa, Cryptosporidium parvum
SKIPTKINYDGTETQIS

SEQ ID NO: 2281238 - protein, 7 aa, Cryptosporidium parvum
SKISKES

SEQ ID NO: 2281239 - protein, 11 aa, Cryptosporidium parvum
SKISNNQQGSI

SEQ ID NO: 2281240 - protein, 6 aa, Cryptosporidium parvum
SKISQS

SEQ ID NO: 2281241 - protein, 4 aa, Cryptosporidium parvum
SKIT

SEQ ID NO: 2281242 - protein, 7 aa, Cryptosporidium parvum
SKITDND

SEQ ID NO: 2281243 - protein, 7 aa, Cryptosporidium parvum
SKITPKD

SEQ ID NO: 2281244 - protein, 8 aa, Cryptosporidium parvum
SKKADFSG

SEQ ID NO: 2281245 - protein, 8 aa, Cryptosporidium parvum
SKKAEEKV

SEQ ID NO: 2281246 - protein, 18 aa, Cryptosporidium parvum
SKKAEKKIKEAGGICVLS

SEQ ID NO: 2281247 - protein, 7 aa, Cryptosporidium parvum
SKKAFNK

SEQ ID NO: 2281248 - protein, 11 aa, Cryptosporidium parvum
SKKAPNTQPQI

SEQ ID NO: 2281249 - protein, 10 aa, Cryptosporidium parvum
SKKAVQNNNL

SEQ ID NO: 2281250 - protein, 7 aa, Cryptosporidium parvum
SKKCLGS

SEQ ID NO: 2281251 - protein, 10 aa, Cryptosporidium parvum
SKKDEQEKLN

SEQ ID NO: 2281252 - protein, 11 aa, Cryptosporidium parvum
SKKDGKKSKAN

SEQ ID NO: 2281253 - protein, 8 aa, Cryptosporidium parvum
SKKDGSTL

SEQ ID NO: 2281254 - protein, 28 aa, Cryptosporidium parvum
SKKEDFRNNYDQGVSNKSKENNSLTPTI

SEQ ID NO: 2281255 - protein, 8 aa, Cryptosporidium parvum
SKKEGSNE

SEQ ID NO: 2281256 - protein, 15 aa, Cryptosporidium parvum
SKKEKEEEEERERER

SEQ ID NO: 2281257 - protein, 11 aa, Cryptosporidium parvum
SKKEKPSQKDK

SEQ ID NO: 2281258 - protein, 11 aa, Cryptosporidium parvum
SKKELDSLQTE

SEQ ID NO: 2281259 - protein, 7 aa, Cryptosporidium parvum
SKKETIS

SEQ ID NO: 2281260 - protein, 8 aa, Cryptosporidium parvum
SKKFQSKD

SEQ ID NO: 2281261 - protein, 9 aa, Cryptosporidium parvum
SKKGEQERE

SEQ ID NO: 2281262 - protein, 16 aa, Cryptosporidium parvum
SKKGKEDFLNFALRMI

SEQ ID NO: 2281263 - protein, 13 aa, Cryptosporidium parvum
SKKGLLMKKLSQL

SEQ ID NO: 2281264 - protein, 4 aa, Cryptosporidium parvum
SKKH

SEQ ID NO: 2281265 - protein, 9 aa, Cryptosporidium parvum
SKKIARNEL

SEQ ID NO: 2281266 - protein, 6 aa, Cryptosporidium parvum
SKKIHQ

SEQ ID NO: 2281267 - protein, 6 aa, Cryptosporidium parvum
SKKKDG

SEQ ID NO: 2281268 - protein, 8 aa, Cryptosporidium parvum
SKKKERKH

SEQ ID NO: 2281269 - protein, 8 aa, Cryptosporidium parvum
SKKKESEY

SEQ ID NO: 2281270 - protein, 9 aa, Cryptosporidium parvum
SKKKFDEKS

SEQ ID NO: 2281271 - protein, 7 aa, Cryptosporidium parvum
SKKKRLK

SEQ ID NO: 2281272 - protein, 8 aa, Cryptosporidium parvum
SKKKSEEF

SEQ ID NO: 2281273 - protein, 7 aa, Cryptosporidium parvum
SKKKVGA

SEQ ID NO: 2281274 - protein, 13 aa, Cryptosporidium parvum
SKKLGYDKEQDEL

SEQ ID NO: 2281275 - protein, 26 aa, Cryptosporidium parvum
SKKNAGEDEDGKNMNDEEKEKPKETL

SEQ ID NO: 2281276 - protein, 7 aa, Cryptosporidium parvum
SKKNDSN

SEQ ID NO: 2281277 - protein, 11 aa, Cryptosporidium parvum
SKKNKSIDNMK

SEQ ID NO: 2281278 - protein, 6 aa, Cryptosporidium parvum
SKKNNV

SEQ ID NO: 2281279 - protein, 6 aa, Cryptosporidium parvum
SKKNRS

SEQ ID NO: 2281280 - protein, 4 aa, Cryptosporidium parvum
SKKP

SEQ ID NO: 2281281 - protein, 7 aa, Cryptosporidium parvum
SKKPCPF

SEQ ID NO: 2281282 - protein, 7 aa, Cryptosporidium parvum
SKKPFDF

SEQ ID NO: 2281283 - protein, 20 aa, Cryptosporidium parvum
SKKPVEETKYCSNNESSVAS

SEQ ID NO: 2281284 - protein, 5 aa, Cryptosporidium parvum
SKKQE

SEQ ID NO: 2281285 - protein, 12 aa, Cryptosporidium parvum
SKKQIDKLQKLC

SEQ ID NO: 2281286 - protein, 10 aa, Cryptosporidium parvum
SKKRFDTDPQ

SEQ ID NO: 2281287 - protein, 8 aa, Cryptosporidium parvum
SKKRFRKA

SEQ ID NO: 2281288 - protein, 4 aa, Cryptosporidium parvum
SKKS

SEQ ID NO: 2281289 - protein, 14 aa, Cryptosporidium parvum
SKKSCGDSTDEVKE

SEQ ID NO: 2281290 - protein, 16 aa, Cryptosporidium parvum
SKKSEENIKENYSGKS

SEQ ID NO: 2281291 - protein, 9 aa, Cryptosporidium parvum
SKKSFGPGY

SEQ ID NO: 2281292 - protein, 5 aa, Cryptosporidium parvum
SKKSI

SEQ ID NO: 2281293 - protein, 19 aa, Cryptosporidium parvum
SKKSKTSQVDEKTSLPYGS

SEQ ID NO: 2281294 - protein, 10 aa, Cryptosporidium parvum
SKKSQKGDNF

SEQ ID NO: 2281295 - protein, 17 aa, Cryptosporidium parvum
SKKTQDYQGNTSPDKEM

SEQ ID NO: 2281296 - protein, 7 aa, Cryptosporidium parvum
SKKYNQT

SEQ ID NO: 2281297 - protein, 7 aa, Cryptosporidium parvum
SKKYPEA

SEQ ID NO: 2281298 - protein, 10 aa, Cryptosporidium parvum
SKKYSTYKDR

SEQ ID NO: 2281299 - protein, 5 aa, Cryptosporidium parvum
SKLAD

SEQ ID NO: 2281300 - protein, 6 aa, Cryptosporidium parvum
SKLDET

SEQ ID NO: 2281301 - protein, 13 aa, Cryptosporidium parvum
SKLDNSKKKDNLK

SEQ ID NO: 2281302 - protein, 16 aa, Cryptosporidium parvum
SKLEEDDESAENEAAS

SEQ ID NO: 2281303 - protein, 26 aa, Cryptosporidium parvum
SKLEEKETNCYDSSNIHNNSEFEDND

SEQ ID NO: 2281304 - protein, 6 aa, Cryptosporidium parvum
SKLEES

SEQ ID NO: 2281305 - protein, 10 aa, Cryptosporidium parvum
SKLEKEGELE

SEQ ID NO: 2281306 - protein, 12 aa, Cryptosporidium parvum
SKLEQDDFDNEG

SEQ ID NO: 2281307 - protein, 7 aa, Cryptosporidium parvum
SKLEREK

SEQ ID NO: 2281308 - protein, 10 aa, Cryptosporidium parvum
SKLGANATTA

SEQ ID NO: 2281309 - protein, 12 aa, Cryptosporidium parvum
SKLGDKDSREGI

SEQ ID NO: 2281310 - protein, 31 aa, Cryptosporidium parvum
SKLGSSSITVSSSTRPLTFPKSTNSDVGLTD

SEQ ID NO: 2281311 - protein, 4 aa, Cryptosporidium parvum
SKLK

SEQ ID NO: 2281312 - protein, 19 aa, Cryptosporidium parvum
SKLKKSKDTFMDQGEETKV

SEQ ID NO: 2281313 - protein, 18 aa, Cryptosporidium parvum
SKLKQTNERRAGRPPLDR

SEQ ID NO: 2281314 - protein, 7 aa, Cryptosporidium parvum
SKLNSSD

SEQ ID NO: 2281315 - protein, 9 aa, Cryptosporidium parvum
SKLPDEDNN

SEQ ID NO: 2281316 - protein, 11 aa, Cryptosporidium parvum
SKLPDENKSSK

SEQ ID NO: 2281317 - protein, 7 aa, Cryptosporidium parvum
SKLPDSS

SEQ ID NO: 2281318 - protein, 46 aa, Cryptosporidium parvum
SKLPKANDSDSSSSSGSNSNSNSDSDSDSDSDSNSGSKPYSNYKPK

SEQ ID NO: 2281319 - protein, 6 aa, Cryptosporidium parvum
SKLPNS

SEQ ID NO: 2281320 - protein, 5 aa, Cryptosporidium parvum
SKLPQ

SEQ ID NO: 2281321 - protein, 8 aa, Cryptosporidium parvum
SKLPRHSP

SEQ ID NO: 2281322 - protein, 6 aa, Cryptosporidium parvum
SKLPTS

SEQ ID NO: 2281323 - protein, 7 aa, Cryptosporidium parvum
SKLQEAI

SEQ ID NO: 2281324 - protein, 24 aa, Cryptosporidium parvum
SKLSSEVKLDEKTQESEVANTNSL

SEQ ID NO: 2281325 - protein, 27 aa, Cryptosporidium parvum
SKMADNSYEEAATKNCQYENRNSCGRG

SEQ ID NO: 2281326 - protein, 7 aa, Cryptosporidium parvum
SKMEGTN

SEQ ID NO: 2281327 - protein, 20 aa, Cryptosporidium parvum
SKMGNSSQSILDPKQEREYN

SEQ ID NO: 2281328 - protein, 7 aa, Cryptosporidium parvum
SKMSNSS

SEQ ID NO: 2281329 - protein, 15 aa, Cryptosporidium parvum
SKMTMKQKQRRKIRP

SEQ ID NO: 2281330 - protein, 14 aa, Cryptosporidium parvum
SKMTPKKNQLYNQQ

SEQ ID NO: 2281331 - protein, 15 aa, Cryptosporidium parvum
SKNDEIQSLEISRFS

SEQ ID NO: 2281332 - protein, 6 aa, Cryptosporidium parvum
SKNEAQ

SEQ ID NO: 2281333 - protein, 7 aa, Cryptosporidium parvum
SKNEIPD

SEQ ID NO: 2281334 - protein, 8 aa, Cryptosporidium parvum
SKNEQTEK

SEQ ID NO: 2281335 - protein, 5 aa, Cryptosporidium parvum
SKNEY

SEQ ID NO: 2281336 - protein, 4 aa, Cryptosporidium parvum
SKNF

SEQ ID NO: 2281337 - protein, 7 aa, Cryptosporidium parvum
SKNFDGQ

SEQ ID NO: 2281338 - protein, 16 aa, Cryptosporidium parvum
SKNGDDNNSSNSSTFD

SEQ ID NO: 2281339 - protein, 5 aa, Cryptosporidium parvum
SKNGI

SEQ ID NO: 2281340 - protein, 7 aa, Cryptosporidium parvum
SKNGNEI

SEQ ID NO: 2281341 - protein, 35 aa, Cryptosporidium parvum
SKNGNSRPIGTTSKKIRTDTRKFDSDSTLSDLDGE

SEQ ID NO: 2281342 - protein, 6 aa, Cryptosporidium parvum
SKNGTI

SEQ ID NO: 2281343 - protein, 7 aa, Cryptosporidium parvum
SKNHPFS

SEQ ID NO: 2281344 - protein, 39 aa, Cryptosporidium parvum
SKNIHPDDFNPNPKPPSNIETSKDQKDNFENSKKRKELK

SEQ ID NO: 2281345 - protein, 7 aa, Cryptosporidium parvum
SKNIQSE

SEQ ID NO: 2281346 - protein, 8 aa, Cryptosporidium parvum
SKNIRSAS

SEQ ID NO: 2281347 - protein, 28 aa, Cryptosporidium parvum
SKNITKKSLTNNKNIKEIEKDNEDTDSN

SEQ ID NO: 2281348 - protein, 7 aa, Cryptosporidium parvum
SKNKLES

SEQ ID NO: 2281349 - protein, 8 aa, Cryptosporidium parvum
SKNKNQPE

SEQ ID NO: 2281350 - protein, 8 aa, Cryptosporidium parvum
SKNKNSIT

SEQ ID NO: 2281351 - protein, 6 aa, Cryptosporidium parvum
SKNKRL

SEQ ID NO: 2281352 - protein, 10 aa, Cryptosporidium parvum
SKNKSSRYQE

SEQ ID NO: 2281353 - protein, 9 aa, Cryptosporidium parvum
SKNKSTDSF

SEQ ID NO: 2281354 - protein, 6 aa, Cryptosporidium parvum
SKNKTY

SEQ ID NO: 2281355 - protein, 8 aa, Cryptosporidium parvum
SKNLDKGI

SEQ ID NO: 2281356 - protein, 5 aa, Cryptosporidium parvum
SKNLR

SEQ ID NO: 2281357 - protein, 14 aa, Cryptosporidium parvum
SKNMSKSVQQMGNA

SEQ ID NO: 2281358 - protein, 21 aa, Cryptosporidium parvum
SKNNDNIDKTTTTKDVQRLGG

SEQ ID NO: 2281359 - protein, 7 aa, Cryptosporidium parvum
SKNNESL

SEQ ID NO: 2281360 - protein, 5 aa, Cryptosporidium parvum
SKNNK

SEQ ID NO: 2281361 - protein, 6 aa, Cryptosporidium parvum
SKNNQI

SEQ ID NO: 2281362 - protein, 6 aa, Cryptosporidium parvum
SKNPGL

SEQ ID NO: 2281363 - protein, 12 aa, Cryptosporidium parvum
SKNPRKPGEKSS

SEQ ID NO: 2281364 - protein, 6 aa, Cryptosporidium parvum
SKNPSE

SEQ ID NO: 2281365 - protein, 47 aa, Cryptosporidium parvum
SKNPSIISSKSEQKQGSLDSLKSSNFYQSSPIDENHISSNENTAAQE

SEQ ID NO: 2281366 - protein, 14 aa, Cryptosporidium parvum
SKNPSLPTNLSGET

SEQ ID NO: 2281367 - protein, 4 aa, Cryptosporidium parvum
SKNQ

SEQ ID NO: 2281368 - protein, 7 aa, Cryptosporidium parvum
SKNQDNI

SEQ ID NO: 2281369 - protein, 5 aa, Cryptosporidium parvum
SKNQF

SEQ ID NO: 2281370 - protein, 6 aa, Cryptosporidium parvum
SKNQPR

SEQ ID NO: 2281371 - protein, 4 aa, Cryptosporidium parvum
SKNR

SEQ ID NO: 2281372 - protein, 5 aa, Cryptosporidium parvum
SKNRD

SEQ ID NO: 2281373 - protein, 10 aa, Cryptosporidium parvum
SKNRYSDYKP

SEQ ID NO: 2281374 - protein, 4 aa, Cryptosporidium parvum
SKNS

SEQ ID NO: 2281375 - protein, 5 aa, Cryptosporidium parvum
SKNSE

SEQ ID NO: 2281376 - protein, 5 aa, Cryptosporidium parvum
SKNSF

SEQ ID NO: 2281377 - protein, 10 aa, Cryptosporidium parvum
SKNSKSAITI

SEQ ID NO: 2281378 - protein, 6 aa, Cryptosporidium parvum
SKNSLD

SEQ ID NO: 2281379 - protein, 13 aa, Cryptosporidium parvum
SKNSLGSIPKAPC

SEQ ID NO: 2281380 - protein, 9 aa, Cryptosporidium parvum
SKNSLSKND

SEQ ID NO: 2281381 - protein, 8 aa, Cryptosporidium parvum
SKNSNPLG

SEQ ID NO: 2281382 - protein, 11 aa, Cryptosporidium parvum
SKNSPKPPLES

SEQ ID NO: 2281383 - protein, 5 aa, Cryptosporidium parvum
SKNSQ

SEQ ID NO: 2281384 - protein, 7 aa, Cryptosporidium parvum
SKNSSGK

SEQ ID NO: 2281385 - protein, 9 aa, Cryptosporidium parvum
SKNSSNSNI

SEQ ID NO: 2281386 - protein, 4 aa, Cryptosporidium parvum
SKNT

SEQ ID NO: 2281387 - protein, 8 aa, Cryptosporidium parvum
SKNTGNEY

SEQ ID NO: 2281388 - protein, 17 aa, Cryptosporidium parvum
SKNTLDNFSGNTWKDNN

SEQ ID NO: 2281389 - protein, 13 aa, Cryptosporidium parvum
SKNTQISKKYTQN

SEQ ID NO: 2281390 - protein, 9 aa, Cryptosporidium parvum
SKNTSSIAT

SEQ ID NO: 2281391 - protein, 6 aa, Cryptosporidium parvum
SKNVPK

SEQ ID NO: 2281392 - protein, 7 aa, Cryptosporidium parvum
SKNVQAK

SEQ ID NO: 2281393 - protein, 18 aa, Cryptosporidium parvum
SKNVQENSQNNTNTNTQI

SEQ ID NO: 2281394 - protein, 5 aa, Cryptosporidium parvum
SKNVT

SEQ ID NO: 2281395 - protein, 5 aa, Cryptosporidium parvum
SKPAL

SEQ ID NO: 2281396 - protein, 7 aa, Cryptosporidium parvum
SKPDDEI

SEQ ID NO: 2281397 - protein, 9 aa, Cryptosporidium parvum
SKPDFGGLH

SEQ ID NO: 2281398 - protein, 8 aa, Cryptosporidium parvum
SKPDSSFQ

SEQ ID NO: 2281399 - protein, 5 aa, Cryptosporidium parvum
SKPEN

SEQ ID NO: 2281400 - protein, 9 aa, Cryptosporidium parvum
SKPFTEESK

SEQ ID NO: 2281401 - protein, 9 aa, Cryptosporidium parvum
SKPGKKNTY

SEQ ID NO: 2281402 - protein, 5 aa, Cryptosporidium parvum
SKPIG

SEQ ID NO: 2281403 - protein, 5 aa, Cryptosporidium parvum
SKPKL

SEQ ID NO: 2281404 - protein, 13 aa, Cryptosporidium parvum
SKPLENNEGLNKD

SEQ ID NO: 2281405 - protein, 5 aa, Cryptosporidium parvum
SKPNE

SEQ ID NO: 2281406 - protein, 8 aa, Cryptosporidium parvum
SKPNNYER

SEQ ID NO: 2281407 - protein, 6 aa, Cryptosporidium parvum
SKPPKI

SEQ ID NO: 2281408 - protein, 6 aa, Cryptosporidium parvum
SKPPPV

SEQ ID NO: 2281409 - protein, 8 aa, Cryptosporidium parvum
SKPPSQHH

SEQ ID NO: 2281410 - protein, 12 aa, Cryptosporidium parvum
SKPSDKRKLSSF

SEQ ID NO: 2281411 - protein, 10 aa, Cryptosporidium parvum
SKPSDSCNSH

SEQ ID NO: 2281412 - protein, 5 aa, Cryptosporidium parvum
SKPSF

SEQ ID NO: 2281413 - protein, 13 aa, Cryptosporidium parvum
SKPSILGSKGQMV

SEQ ID NO: 2281414 - protein, 18 aa, Cryptosporidium parvum
SKPSSTSSSSVSNGNSNT

SEQ ID NO: 2281415 - protein, 14 aa, Cryptosporidium parvum
SKPSYASKGLYSAP

SEQ ID NO: 2281416 - protein, 7 aa, Cryptosporidium parvum
SKPTGLL

SEQ ID NO: 2281417 - protein, 5 aa, Cryptosporidium parvum
SKPVE

SEQ ID NO: 2281418 - protein, 11 aa, Cryptosporidium parvum
SKPVNGQTGNS

SEQ ID NO: 2281419 - protein, 10 aa, Cryptosporidium parvum
SKPYSSSSPC

SEQ ID NO: 2281420 - protein, 4 aa, Cryptosporidium parvum
SKQA

SEQ ID NO: 2281421 - protein, 7 aa, Cryptosporidium parvum
SKQANAY

SEQ ID NO: 2281422 - protein, 5 aa, Cryptosporidium parvum
SKQDI

SEQ ID NO: 2281423 - protein, 7 aa, Cryptosporidium parvum
SKQDKVY

SEQ ID NO: 2281424 - protein, 10 aa, Cryptosporidium parvum
SKQDNSNGIA

SEQ ID NO: 2281425 - protein, 6 aa, Cryptosporidium parvum
SKQEEE

SEQ ID NO: 2281426 - protein, 7 aa, Cryptosporidium parvum
SKQEQYK

SEQ ID NO: 2281427 - protein, 5 aa, Cryptosporidium parvum
SKQFT

SEQ ID NO: 2281428 - protein, 17 aa, Cryptosporidium parvum
SKQGCGNDYSENSNTNS

SEQ ID NO: 2281429 - protein, 5 aa, Cryptosporidium parvum
SKQGR

SEQ ID NO: 2281430 - protein, 7 aa, Cryptosporidium parvum
SKQGSIN

SEQ ID NO: 2281431 - protein, 4 aa, Cryptosporidium parvum
SKQH

SEQ ID NO: 2281432 - protein, 9 aa, Cryptosporidium parvum
SKQIEEDER

SEQ ID NO: 2281433 - protein, 13 aa, Cryptosporidium parvum
SKQIKNDLRNEKG

SEQ ID NO: 2281434 - protein, 11 aa, Cryptosporidium parvum
SKQKSTSGSIN

SEQ ID NO: 2281435 - protein, 6 aa, Cryptosporidium parvum
SKQLSI

SEQ ID NO: 2281436 - protein, 4 aa, Cryptosporidium parvum
SKQN

SEQ ID NO: 2281437 - protein, 6 aa, Cryptosporidium parvum
SKQNKG

SEQ ID NO: 2281438 - protein, 7 aa, Cryptosporidium parvum
SKQNSDW

SEQ ID NO: 2281439 - protein, 13 aa, Cryptosporidium parvum
SKQQDNEANTYVE

SEQ ID NO: 2281440 - protein, 19 aa, Cryptosporidium parvum
SKQQTPEELASSRRGSESL

SEQ ID NO: 2281441 - protein, 18 aa, Cryptosporidium parvum
SKQRESKLEERLQTENVN

SEQ ID NO: 2281442 - protein, 29 aa, Cryptosporidium parvum
SKQRRLPQIKKKNSSNEFKIDNKKKKTDV

SEQ ID NO: 2281443 - protein, 8 aa, Cryptosporidium parvum
SKQRRNRE

SEQ ID NO: 2281444 - protein, 5 aa, Cryptosporidium parvum
SKQRY

SEQ ID NO: 2281445 - protein, 23 aa, Cryptosporidium parvum
SKQSADYIQSSEKRLKKNRKYRI

SEQ ID NO: 2281446 - protein, 10 aa, Cryptosporidium parvum
SKQSDQESGN

SEQ ID NO: 2281447 - protein, 6 aa, Cryptosporidium parvum
SKQSEY

SEQ ID NO: 2281448 - protein, 6 aa, Cryptosporidium parvum
SKQSSV

SEQ ID NO: 2281449 - protein, 7 aa, Cryptosporidium parvum
SKQSTAY

SEQ ID NO: 2281450 - protein, 9 aa, Cryptosporidium parvum
SKQTKNMTY

SEQ ID NO: 2281451 - protein, 9 aa, Cryptosporidium parvum
SKQYHESTK

SEQ ID NO: 2281452 - protein, 13 aa, Cryptosporidium parvum
SKRADEIRACLLG

SEQ ID NO: 2281453 - protein, 6 aa, Cryptosporidium parvum
SKRCSS

SEQ ID NO: 2281454 - protein, 7 aa, Cryptosporidium parvum
SKRDSQN

SEQ ID NO: 2281455 - protein, 4 aa, Cryptosporidium parvum
SKRE

SEQ ID NO: 2281456 - protein, 9 aa, Cryptosporidium parvum
SKREETSWR

SEQ ID NO: 2281457 - protein, 6 aa, Cryptosporidium parvum
SKREVS

SEQ ID NO: 2281458 - protein, 7 aa, Cryptosporidium parvum
SKRHEGR

SEQ ID NO: 2281459 - protein, 9 aa, Cryptosporidium parvum
SKRINSQTS

SEQ ID NO: 2281460 - protein, 22 aa, Cryptosporidium parvum
SKRKNPDCSSKEGSGSRKYDRI

SEQ ID NO: 2281461 - protein, 20 aa, Cryptosporidium parvum
SKRKPSGDSREEGSPDKRSK

SEQ ID NO: 2281462 - protein, 5 aa, Cryptosporidium parvum
SKRKR

SEQ ID NO: 2281463 - protein, 7 aa, Cryptosporidium parvum
SKRLDTL

SEQ ID NO: 2281464 - protein, 7 aa, Cryptosporidium parvum
SKRLSNG

SEQ ID NO: 2281465 - protein, 6 aa, Cryptosporidium parvum
SKRMPL

SEQ ID NO: 2281466 - protein, 5 aa, Cryptosporidium parvum
SKRNE

SEQ ID NO: 2281467 - protein, 20 aa, Cryptosporidium parvum
SKRNKNQGNKGTKQDYGGVD

SEQ ID NO: 2281468 - protein, 6 aa, Cryptosporidium parvum
SKRNSS

SEQ ID NO: 2281469 - protein, 8 aa, Cryptosporidium parvum
SKRNTKIN

SEQ ID NO: 2281470 - protein, 5 aa, Cryptosporidium parvum
SKRPA

SEQ ID NO: 2281471 - protein, 6 aa, Cryptosporidium parvum
SKRPIE

SEQ ID NO: 2281472 - protein, 6 aa, Cryptosporidium parvum
SKRQEK

SEQ ID NO: 2281473 - protein, 11 aa, Cryptosporidium parvum
SKRQKKNTLIS

SEQ ID NO: 2281474 - protein, 7 aa, Cryptosporidium parvum
SKRQRRV

SEQ ID NO: 2281475 - protein, 7 aa, Cryptosporidium parvum
SKRSGNI

SEQ ID NO: 2281476 - protein, 9 aa, Cryptosporidium parvum
SKRSGSSIS

SEQ ID NO: 2281477 - protein, 5 aa, Cryptosporidium parvum
SKRSK

SEQ ID NO: 2281478 - protein, 16 aa, Cryptosporidium parvum
SKRSLGRKTIGSSNNI

SEQ ID NO: 2281479 - protein, 9 aa, Cryptosporidium parvum
SKRSSINSM

SEQ ID NO: 2281480 - protein, 8 aa, Cryptosporidium parvum
SKRTDSEL

SEQ ID NO: 2281481 - protein, 7 aa, Cryptosporidium parvum
SKRTKID

SEQ ID NO: 2281482 - protein, 12 aa, Cryptosporidium parvum
SKRTRKPPPPVY

SEQ ID NO: 2281483 - protein, 9 aa, Cryptosporidium parvum
SKRVEGKKS

SEQ ID NO: 2281484 - protein, 9 aa, Cryptosporidium parvum
SKRYSKDCR

SEQ ID NO: 2281485 - protein, 4 aa, Cryptosporidium parvum
SKSD

SEQ ID NO: 2281486 - protein, 6 aa, Cryptosporidium parvum
SKSDGV

SEQ ID NO: 2281487 - protein, 23 aa, Cryptosporidium parvum
SKSDQLNNKRNSINCTSSTKKVN

SEQ ID NO: 2281488 - protein, 6 aa, Cryptosporidium parvum
SKSDRV

SEQ ID NO: 2281489 - protein, 5 aa, Cryptosporidium parvum
SKSEC

SEQ ID NO: 2281490 - protein, 7 aa, Cryptosporidium parvum
SKSELEA

SEQ ID NO: 2281491 - protein, 7 aa, Cryptosporidium parvum
SKSFNDK

SEQ ID NO: 2281492 - protein, 10 aa, Cryptosporidium parvum
SKSGDNTSEN

SEQ ID NO: 2281493 - protein, 14 aa, Cryptosporidium parvum
SKSGEKNKESKNGV

SEQ ID NO: 2281494 - protein, 6 aa, Cryptosporidium parvum
SKSGIQ

SEQ ID NO: 2281495 - protein, 8 aa, Cryptosporidium parvum
SKSGKEKV

SEQ ID NO: 2281496 - protein, 8 aa, Cryptosporidium parvum
SKSGKRVE

SEQ ID NO: 2281497 - protein, 35 aa, Cryptosporidium parvum; identical to SEQ ID NO: 2161783

SEQ ID NO: 2281498 - protein, 7 aa, Cryptosporidium parvum
SKSGSEI

SEQ ID NO: 2281499 - protein, 7 aa, Cryptosporidium parvum
SKSGTMD

SEQ ID NO: 2281500 - protein, 7 aa, Cryptosporidium parvum
SKSGTRI

SEQ ID NO: 2281501 - protein, 18 aa, Cryptosporidium parvum
SKSHSELDDAASELQGTP

SEQ ID NO: 2281502 - protein, 14 aa, Cryptosporidium parvum
SKSIQRSESGSSIN

SEQ ID NO: 2281503 - protein, 13 aa, Cryptosporidium parvum
SKSITDPNLNSVS

SEQ ID NO: 2281504 - protein, 15 aa, Cryptosporidium parvum
SKSKDGQFISFITDF

SEQ ID NO: 2281505 - protein, 8 aa, Cryptosporidium parvum
SKSKDLSV

SEQ ID NO: 2281506 - protein, 11 aa, Cryptosporidium parvum
SKSKDVLEGGP

SEQ ID NO: 2281507 - protein, 10 aa, Cryptosporidium parvum
SKSKEERDRI

SEQ ID NO: 2281508 - protein, 9 aa, Cryptosporidium parvum
SKSKEKGNN

SEQ ID NO: 2281509 - protein, 6 aa, Cryptosporidium parvum
SKSKIK

SEQ ID NO: 2281510 - protein, 7 aa, Cryptosporidium parvum
SKSKKDV

SEQ ID NO: 2281511 - protein, 8 aa, Cryptosporidium parvum
SKSKQKMP

SEQ ID NO: 2281512 - protein, 11 aa, Cryptosporidium parvum
SKSKQQDKNNS

SEQ ID NO: 2281513 - protein, 11 aa, Cryptosporidium parvum
SKSKSNENNSS

SEQ ID NO: 2281514 - protein, 16 aa, Cryptosporidium parvum
SKSLAEDDKLSGGGPK

SEQ ID NO: 2281515 - protein, 14 aa, Cryptosporidium parvum
SKSLEDTKEETPII

SEQ ID NO: 2281516 - protein, 15 aa, Cryptosporidium parvum
SKSLRGQKGTNADLS

SEQ ID NO: 2281517 - protein, 7 aa, Cryptosporidium parvum
SKSLSSS

SEQ ID NO: 2281518 - protein, 7 aa, Cryptosporidium parvum
SKSLTER

SEQ ID NO: 2281519 - protein, 19 aa, Cryptosporidium parvum
SKSMASNTENIQNEINNNS

SEQ ID NO: 2281520 - protein, 15 aa, Cryptosporidium parvum
SKSMKNKIDNNDKQK

SEQ ID NO: 2281521 - protein, 13 aa, Cryptosporidium parvum
SKSMKRSSSQITD

SEQ ID NO: 2281522 - protein, 4 aa, Cryptosporidium parvum
SKSN

SEQ ID NO: 2281523 - protein, 11 aa, Cryptosporidium parvum
SKSNDSENSGK

SEQ ID NO: 2281524 - protein, 7 aa, Cryptosporidium parvum
SKSNFSK

SEQ ID NO: 2281525 - protein, 7 aa, Cryptosporidium parvum
SKSNGIE

SEQ ID NO: 2281526 - protein, 12 aa, Cryptosporidium parvum
SKSNIDSEENRR

SEQ ID NO: 2281527 - protein, 6 aa, Cryptosporidium parvum
SKSNIP

SEQ ID NO: 2281528 - protein, 7 aa, Cryptosporidium parvum
SKSNISM

SEQ ID NO: 2281529 - protein, 20 aa, Cryptosporidium parvum
SKSNNLSLNESTYEHASDLI

SEQ ID NO: 2281530 - protein, 7 aa, Cryptosporidium parvum
SKSNNYV

SEQ ID NO: 2281531 - protein, 6 aa, Cryptosporidium parvum
SKSNPN

SEQ ID NO: 2281532 - protein, 7 aa, Cryptosporidium parvum
SKSNTEV

SEQ ID NO: 2281533 - protein, 6 aa, Cryptosporidium parvum
SKSNVR

SEQ ID NO: 2281534 - protein, 9 aa, Cryptosporidium parvum
SKSNVSATI

SEQ ID NO: 2281535 - protein, 7 aa, Cryptosporidium parvum
SKSNYLE

SEQ ID NO: 2281536 - protein, 8 aa, Cryptosporidium parvum
SKSPKQGT

SEQ ID NO: 2281537 - protein, 5 aa, Cryptosporidium parvum
SKSPL

SEQ ID NO: 2281538 - protein, 17 aa, Cryptosporidium parvum
SKSPLEIAGKPNLEVTN

SEQ ID NO: 2281539 - protein, 8 aa, Cryptosporidium parvum
SKSQDEIP

SEQ ID NO: 2281540 - protein, 10 aa, Cryptosporidium parvum
SKSQDTASSA

SEQ ID NO: 2281541 - protein, 8 aa, Cryptosporidium parvum
SKSQLKNI

SEQ ID NO: 2281542 - protein, 8 aa, Cryptosporidium parvum
SKSQTLRI

SEQ ID NO: 2281543 - protein, 47 aa, Cryptosporidium parvum
SKSQVPNDHKNTSNELDSLSDSELEPNSGESKNKNSKNSVTEEEKSV

SEQ ID NO: 2281544 - protein, 8 aa, Cryptosporidium parvum
SKSRDEYG

SEQ ID NO: 2281545 - protein, 8 aa, Cryptosporidium parvum
SKSRNKEF

SEQ ID NO: 2281546 - protein, 11 aa, Cryptosporidium parvum
SKSSIQSNNNN

SEQ ID NO: 2281547 - protein, 16 aa, Cryptosporidium parvum
SKSSKYRDSIDKDDIK

SEQ ID NO: 2281548 - protein, 6 aa, Cryptosporidium parvum
SKSSPY

SEQ ID NO: 2281549 - protein, 12 aa, Cryptosporidium parvum
SKSSSGIVSSQD

SEQ ID NO: 2281550 - protein, 10 aa, Cryptosporidium parvum
SKSSYEDSTS

SEQ ID NO: 2281551 - protein, 9 aa, Cryptosporidium parvum
SKSTEYTKD

SEQ ID NO: 2281552 - protein, 6 aa, Cryptosporidium parvum
SKSTGN

SEQ ID NO: 2281553 - protein, 12 aa, Cryptosporidium parvum
SKSTKNLKNPLP

SEQ ID NO: 2281554 - protein, 13 aa, Cryptosporidium parvum
SKSTSSKSNSRLP

SEQ ID NO: 2281555 - protein, 35 aa, Cryptosporidium parvum
SKSTTKIENKTAINSNSSPSLNETFSDNSSTSLFS

SEQ ID NO: 2281556 - protein, 12 aa, Cryptosporidium parvum
SKSVRSESGFEP

SEQ ID NO: 2281557 - protein, 8 aa, Cryptosporidium parvum
SKTDYDEI

SEQ ID NO: 2281558 - protein, 4 aa, Cryptosporidium parvum
SKTE

SEQ ID NO: 2281559 - protein, 8 aa, Cryptosporidium parvum
SKTESEDG

SEQ ID NO: 2281560 - protein, 10 aa, Cryptosporidium parvum
SKTGLNKKKA

SEQ ID NO: 2281561 - protein, 9 aa, Cryptosporidium parvum
SKTGSQSFY

SEQ ID NO: 2281562 - protein, 7 aa, Cryptosporidium parvum
SKTITDK

SEQ ID NO: 2281563 - protein, 6 aa, Cryptosporidium parvum
SKTITQ

SEQ ID NO: 2281564 - protein, 9 aa, Cryptosporidium parvum
SKTKGKSFN

SEQ ID NO: 2281565 - protein, 18 aa, Cryptosporidium parvum
SKTKKVSNTGTKKDQPTM

SEQ ID NO: 2281566 - protein, 5 aa, Cryptosporidium parvum
SKTLN

SEQ ID NO: 2281567 - protein, 8 aa, Cryptosporidium parvum
SKTNPDIQ

SEQ ID NO: 2281568 - protein, 8 aa, Cryptosporidium parvum
SKTNSESN

SEQ ID NO: 2281569 - protein, 20 aa, Cryptosporidium parvum
SKTNTMEEQTTSRSSNMASN

SEQ ID NO: 2281570 - protein, 16 aa, Cryptosporidium parvum
SKTNYLSAQNERDMSE

SEQ ID NO: 2281571 - protein, 4 aa, Cryptosporidium parvum
SKTP

SEQ ID NO: 2281572 - protein, 6 aa, Cryptosporidium parvum
SKTPKA

SEQ ID NO: 2281573 - protein, 15 aa, Cryptosporidium parvum
SKTQSYQAPTINSNM

SEQ ID NO: 2281574 - protein, 7 aa, Cryptosporidium parvum
SKTQTVS

SEQ ID NO: 2281575 - protein, 15 aa, Cryptosporidium parvum
SKTREGSFTSDANLS

SEQ ID NO: 2281576 - protein, 19 aa, Cryptosporidium parvum
SKTRKGSTNHSSNNNLSGI

SEQ ID NO: 2281577 - protein, 31 aa, Cryptosporidium parvum
SKTSKTKKKNKSITNSNSNINDTKISPKEDV

SEQ ID NO: 2281578 - protein, 9 aa, Cryptosporidium parvum
SKTTIENAK

SEQ ID NO: 2281579 - protein, 11 aa, Cryptosporidium parvum
SKTTQNTIAGG

SEQ ID NO: 2281580 - protein, 14 aa, Cryptosporidium parvum
SKTTSDEIKNPHLG

SEQ ID NO: 2281581 - protein, 6 aa, Cryptosporidium parvum
SKTYES

SEQ ID NO: 2281582 - protein, 18 aa, Cryptosporidium parvum
SKTYSESKVSSSKSESSY

SEQ ID NO: 2281583 - protein, 6 aa, Cryptosporidium parvum
SKVEAE

SEQ ID NO: 2281584 - protein, 7 aa, Cryptosporidium parvum
SKVENSI

SEQ ID NO: 2281585 - protein, 5 aa, Cryptosporidium parvum
SKVEQ

SEQ ID NO: 2281586 - protein, 19 aa, Cryptosporidium parvum
SKVESNIDSNSNSNMGTES

SEQ ID NO: 2281587 - protein, 4 aa, Cryptosporidium parvum
SKVG

SEQ ID NO: 2281588 - protein, 7 aa, Cryptosporidium parvum
SKVGQPI

SEQ ID NO: 2281589 - protein, 8 aa, Cryptosporidium parvum
SKVGRKGK

SEQ ID NO: 2281590 - protein, 11 aa, Cryptosporidium parvum
SKVKDGSNTNL

SEQ ID NO: 2281591 - protein, 11 aa, Cryptosporidium parvum
SKVKDSEKSSN

SEQ ID NO: 2281592 - protein, 8 aa, Cryptosporidium parvum
SKVNGNQI

SEQ ID NO: 2281593 - protein, 8 aa, Cryptosporidium parvum
SKVNQTPN

SEQ ID NO: 2281594 - protein, 13 aa, Cryptosporidium parvum
SKVPSSASLKQKA

SEQ ID NO: 2281595 - protein, 6 aa, Cryptosporidium parvum
SKVSAG

SEQ ID NO: 2281596 - protein, 21 aa, Cryptosporidium parvum
SKVSERSNFEEQAKAEKTPNN

SEQ ID NO: 2281597 - protein, 6 aa, Cryptosporidium parvum
SKVSGK

SEQ ID NO: 2281598 - protein, 10 aa, Cryptosporidium parvum
SKVSKKDDKT

SEQ ID NO: 2281599 - protein, 28 aa, Cryptosporidium parvum
SKVSKTDEDSQVCNRQGTEEDDQASRDH

SEQ ID NO: 2281600 - protein, 13 aa, Cryptosporidium parvum
SKVSPEKVTSAYR

SEQ ID NO: 2281601 - protein, 6 aa, Cryptosporidium parvum
SKWTKD

SEQ ID NO: 2281602 - protein, 9 aa, Cryptosporidium parvum
SKYDSNGQV

SEQ ID NO: 2281603 - protein, 10 aa, Cryptosporidium parvum
SKYEHKYPGA

SEQ ID NO: 2281604 - protein, 12 aa, Cryptosporidium parvum
SKYESCPSPRSG

SEQ ID NO: 2281605 - protein, 5 aa, Cryptosporidium parvum
SKYFN

SEQ ID NO: 2281606 - protein, 6 aa, Cryptosporidium parvum
SKYGGA

SEQ ID NO: 2281607 - protein, 6 aa, Cryptosporidium parvum
SKYGTL

SEQ ID NO: 2281608 - protein, 53 aa, Cryptosporidium parvum
SKYHSVQQTSSNSNVSTCASSSSNLNNNNGGNSNGNINSSNNNNNASNIGSRQ

SEQ ID NO: 2281609 - protein, 23 aa, Cryptosporidium parvum
SKYNKLEQDHEKLTDKYNEVDQN

SEQ ID NO: 2281610 - protein, 6 aa, Cryptosporidium parvum
SKYPSI

SEQ ID NO: 2281611 - protein, 18 aa, Cryptosporidium parvum
SKYQGTGHINTKRSSEWG

SEQ ID NO: 2281612 - protein, 6 aa, Cryptosporidium parvum
SKYSAS

SEQ ID NO: 2281613 - protein, 6 aa, Cryptosporidium parvum
SKYSNS

SEQ ID NO: 2281614 - protein, 20 aa, Cryptosporidium parvum
SKYSSSNSNSTNSTNRHYRG

SEQ ID NO: 2281615 - protein, 4 aa, Cryptosporidium parvum
SKYV

SEQ ID NO: 2281616 - protein, 11 aa, Cryptosporidium parvum
SLAKEESSKAP

SEQ ID NO: 2281617 - protein, 6 aa, Cryptosporidium parvum
SLAPST

SEQ ID NO: 2281618 - protein, 23 aa, Cryptosporidium parvum
SLAQSKGKVGLRGTKRKPSTNIN

SEQ ID NO: 2281619 - protein, 10 aa, Cryptosporidium parvum
SLASNSSSDP

SEQ ID NO: 2281620 - protein, 8 aa, Cryptosporidium parvum
SLATNSGF

SEQ ID NO: 2281621 - protein, 56 aa, Cryptosporidium parvum
SLATNTQQAPNNNEKLNDQNVSSTAKKLKQSAENKTKDIQESQNQVKNETKEEIKE

SEQ ID NO: 2281622 - protein, 7 aa, Cryptosporidium parvum
SLDAGSR

SEQ ID NO: 2281623 - protein, 11 aa, Cryptosporidium parvum
SLDDAKSTVSK

SEQ ID NO: 2281624 - protein, 12 aa, Cryptosporidium parvum
SLDEDEEDEDEL

SEQ ID NO: 2281625 - protein, 66 aa, Cryptosporidium parvum
SLDEKQNKEEEKNENKDKDEEEKNENEDKEEANEKKNEEEANDKKGEGEIETQKEVENKEEENHKE

SEQ ID NO: 2281626 - protein, 10 aa, Cryptosporidium parvum
SLDEQRLQDE

SEQ ID NO: 2281627 - protein, 13 aa, Cryptosporidium parvum
SLDGSTTTRGSEL

SEQ ID NO: 2281628 - protein, 13 aa, Cryptosporidium parvum
SLDKDSTTNSCEP

SEQ ID NO: 2281629 - protein, 11 aa, Cryptosporidium parvum
SLDNDKEFGNN

SEQ ID NO: 2281630 - protein, 9 aa, Cryptosporidium parvum
SLDPENPEI

SEQ ID NO: 2281631 - protein, 25 aa, Cryptosporidium parvum
SLDQKSYNSYDGSLDHDQDLDPGMD

SEQ ID NO: 2281632 - protein, 20 aa, Cryptosporidium parvum
SLDSEMQSISSESESESSVL

SEQ ID NO: 2281633 - protein, 16 aa, Cryptosporidium parvum
SLDSQTNNQNSKYQSN

SEQ ID NO: 2281634 - protein, 6 aa, Cryptosporidium parvum
SLDSSY

SEQ ID NO: 2281635 - protein, 6 aa, Cryptosporidium parvum
SLEATS

SEQ ID NO: 2281636 - protein, 23 aa, Cryptosporidium parvum
SLEDGRSIEEGSKYRNAKSKGVN

SEQ ID NO: 2281637 - protein, 10 aa, Cryptosporidium parvum
SLEEGTQESM

SEQ ID NO: 2281638 - protein, 6 aa, Cryptosporidium parvum
SLEEYQ

SEQ ID NO: 2281639 - protein, 5 aa, Cryptosporidium parvum
SLEGE

SEQ ID NO: 2281640 - protein, 5 aa, Cryptosporidium parvum
SLEGS

SEQ ID NO: 2281641 - protein, 7 aa, Cryptosporidium parvum
SLEKKDS

SEQ ID NO: 2281642 - protein, 9 aa, Cryptosporidium parvum
SLENDSKDF

SEQ ID NO: 2281643 - protein, 6 aa, Cryptosporidium parvum
SLENSS

SEQ ID NO: 2281644 - protein, 5 aa, Cryptosporidium parvum
SLEQN

SEQ ID NO: 2281645 - protein, 24 aa, Cryptosporidium parvum
SLERKKKHRYRKPRRSRSPSTVSR

SEQ ID NO: 2281646 - protein, 13 aa, Cryptosporidium parvum
SLERKMSSEAIRN

SEQ ID NO: 2281647 - protein, 26 aa, Cryptosporidium parvum
SLESKEKSNLEHRHSSKAKKNSNNLK

SEQ ID NO: 2281648 - protein, 7 aa, Cryptosporidium parvum
SLETERD

SEQ ID NO: 2281649 - protein, 39 aa, Cryptosporidium parvum; identical to SEQ ID NO: 2161922

SEQ ID NO: 2281650 - protein, 17 aa, Cryptosporidium parvum
SLFPTQSTLNSSNNALS

SEQ ID NO: 2281651 - protein, 12 aa, Cryptosporidium parvum
SLGATGNTTPIK

SEQ ID NO: 2281652 - protein, 7 aa, Cryptosporidium parvum
SLGDNSQ

SEQ ID NO: 2281653 - protein, 9 aa, Cryptosporidium parvum
SLGDSDGRV

SEQ ID NO: 2281654 - protein, 8 aa, Cryptosporidium parvum
SLGENSKI

SEQ ID NO: 2281655 - protein, 20 aa, Cryptosporidium parvum
SLGESFQNRENEKSNNSNFL

SEQ ID NO: 2281656 - protein, 8 aa, Cryptosporidium parvum
SLGGNSKA

SEQ ID NO: 2281657 - protein, 7 aa, Cryptosporidium parvum
SLGGNSL

SEQ ID NO: 2281658 - protein, 7 aa, Cryptosporidium parvum
SLGGNSR

SEQ ID NO: 2281659 - protein, 11 aa, Cryptosporidium parvum
SLGGRSPSQLT

SEQ ID NO: 2281660 - protein, 7 aa, Cryptosporidium parvum
SLGGRTK

SEQ ID NO: 2281661 - protein, 9 aa, Cryptosporidium parvum
SLGKDDYTA

SEQ ID NO: 2281662 - protein, 9 aa, Cryptosporidium parvum
SLGKGGNGE

SEQ ID NO: 2281663 - protein, 10 aa, Cryptosporidium parvum
SLGPPPNSNN

SEQ ID NO: 2281664 - protein, 7 aa, Cryptosporidium parvum
SLGPQGL

SEQ ID NO: 2281665 - protein, 6 aa, Cryptosporidium parvum
SLGRGN

SEQ ID NO: 2281666 - protein, 10 aa, Cryptosporidium parvum
SLGRSKELSE

SEQ ID NO: 2281667 - protein, 12 aa, Cryptosporidium parvum
SLGSKEPEYSYE

SEQ ID NO: 2281668 - protein, 6 aa, Cryptosporidium parvum
SLGSPA

SEQ ID NO: 2281669 - protein, 7 aa, Cryptosporidium parvum
SLGTRNL

SEQ ID NO: 2281670 - protein, 16 aa, Cryptosporidium parvum
SLGTRPNGQTSSPNMH

SEQ ID NO: 2281671 - protein, 7 aa, Cryptosporidium parvum
SLHEGQS

SEQ ID NO: 2281672 - protein, 15 aa, Cryptosporidium parvum
SLHTNTDDRRHTEKE

SEQ ID NO: 2281673 - protein, 14 aa, Cryptosporidium parvum
SLIGDSGTQNRGGA

SEQ ID NO: 2281674 - protein, 5 aa, Cryptosporidium parvum
SLKDE

SEQ ID NO: 2281675 - protein, 7 aa, Cryptosporidium parvum
SLKEGSC

SEQ ID NO: 2281676 - protein, 5 aa, Cryptosporidium parvum
SLKEK

SEQ ID NO: 2281677 - protein, 8 aa, Cryptosporidium parvum
SLKENGED

SEQ ID NO: 2281678 - protein, 9 aa, Cryptosporidium parvum
SLKGNNGKN

SEQ ID NO: 2281679 - protein, 34 aa, Cryptosporidium parvum
SLKKSKNTVSISKSSASTNPDRKLGENKKNGFYR

SEQ ID NO: 2281680 - protein, 6 aa, Cryptosporidium parvum
SLKNLP

SEQ ID NO: 2281681 - protein, 8 aa, Cryptosporidium parvum
SLKNTDNF

SEQ ID NO: 2281682 - protein, 37 aa, Cryptosporidium parvum; identical to SEQ ID NO: 2161953

SEQ ID NO: 2281683 - protein, 7 aa, Cryptosporidium parvum
SLKPLKT

SEQ ID NO: 2281684 - protein, 13 aa, Cryptosporidium parvum
SLKPTFAKIIESA

SEQ ID NO: 2281685 - protein, 9 aa, Cryptosporidium parvum
SLKREDNLS

SEQ ID NO: 2281686 - protein, 9 aa, Cryptosporidium parvum
SLKTGRKSD

SEQ ID NO: 2281687 - protein, 12 aa, Cryptosporidium parvum
SLKTGTNAPDIK

SEQ ID NO: 2281688 - protein, 5 aa, Cryptosporidium parvum
SLKTS

SEQ ID NO: 2281689 - protein, 4 aa, Cryptosporidium parvum
SLKV

SEQ ID NO: 2281690 - protein, 48 aa, Cryptosporidium parvum
SLMDAKNQVQKSSSSSCDQEDTSPQNNTINSQNQCDQQTSTQNNVDKD

SEQ ID NO: 2281691 - protein, 15 aa, Cryptosporidium parvum
SLMEGGSNHQDNVGG

SEQ ID NO: 2281692 - protein, 4 aa, Cryptosporidium parvum
SLND

SEQ ID NO: 2281693 - protein, 10 aa, Cryptosporidium parvum
SLNDKNPLSA

SEQ ID NO: 2281694 - protein, 6 aa, Cryptosporidium parvum
SLNDKT

SEQ ID NO: 2281695 - protein, 4 aa, Cryptosporidium parvum
SLNE

SEQ ID NO: 2281696 - protein, 10 aa, Cryptosporidium parvum
SLNENSEKIY

SEQ ID NO: 2281697 - protein, 6 aa, Cryptosporidium parvum
SLNESE

SEQ ID NO: 2281698 - protein, 22 aa, Cryptosporidium parvum
SLNGDGTTFSISSNGSSYGSPQ

SEQ ID NO: 2281699 - protein, 7 aa, Cryptosporidium parvum
SLNGDRN

SEQ ID NO: 2281700 - protein, 13 aa, Cryptosporidium parvum
SLNGEQDKDISSV

SEQ ID NO: 2281701 - protein, 6 aa, Cryptosporidium parvum
SLNGSL

SEQ ID NO: 2281702 - protein, 8 aa, Cryptosporidium parvum
SLNKSNLN

SEQ ID NO: 2281703 - protein, 8 aa, Cryptosporidium parvum
SLNNNDGI

SEQ ID NO: 2281704 - protein, 7 aa, Cryptosporidium parvum
SLNNSHE

SEQ ID NO: 2281705 - protein, 8 aa, Cryptosporidium parvum
SLNRTNVK

SEQ ID NO: 2281706 - protein, 5 aa, Cryptosporidium parvum
SLNSI

SEQ ID NO: 2281707 - protein, 12 aa, Cryptosporidium parvum
SLNSPKCNTDFN

SEQ ID NO: 2281708 - protein, 7 aa, Cryptosporidium parvum
SLNSQDQ

SEQ ID NO: 2281709 - protein, 10 aa, Cryptosporidium parvum
SLNSSANNLK

SEQ ID NO: 2281710 - protein, 7 aa, Cryptosporidium parvum
SLNSTSY

SEQ ID NO: 2281711 - protein, 10 aa, Cryptosporidium parvum
SLNTENTNIS

SEQ ID NO: 2281712 - protein, 6 aa, Cryptosporidium parvum
SLNTQK

SEQ ID NO: 2281713 - protein, 4 aa, Cryptosporidium parvum
SLPA

SEQ ID NO: 2281714 - protein, 15 aa, Cryptosporidium parvum
SLPADSSEDSLSETE

SEQ ID NO: 2281715 - protein, 11 aa, Cryptosporidium parvum
SLPAPPGSDPF

SEQ ID NO: 2281716 - protein, 5 aa, Cryptosporidium parvum
SLPDN

SEQ ID NO: 2281717 - protein, 6 aa, Cryptosporidium parvum
SLPDRQ

SEQ ID NO: 2281718 - protein, 5 aa, Cryptosporidium parvum
SLPDS

SEQ ID NO: 2281719 - protein, 5 aa, Cryptosporidium parvum
SLPEG

SEQ ID NO: 2281720 - protein, 10 aa, Cryptosporidium parvum
SLPENSSTAL

SEQ ID NO: 2281721 - protein, 5 aa, Cryptosporidium parvum
SLPEY

SEQ ID NO: 2281722 - protein, 11 aa, Cryptosporidium parvum
SLPGKCNNEEK

SEQ ID NO: 2281723 - protein, 5 aa, Cryptosporidium parvum
SLPGT

SEQ ID NO: 2281724 - protein, 13 aa, Cryptosporidium parvum
SLPHRSPSNASLD

SEQ ID NO: 2281725 - protein, 7 aa, Cryptosporidium parvum
SLPIDPR

SEQ ID NO: 2281726 - protein, 13 aa, Cryptosporidium parvum
SLPLSTKQKLGQI

SEQ ID NO: 2281727 - protein, 7 aa, Cryptosporidium parvum
SLPNMQK

SEQ ID NO: 2281728 - protein, 9 aa, Cryptosporidium parvum
SLPNQAGPS

SEQ ID NO: 2281729 - protein, 7 aa, Cryptosporidium parvum
SLPNSNN

SEQ ID NO: 2281730 - protein, 12 aa, Cryptosporidium parvum
SLPNTPEAIVIN

SEQ ID NO: 2281731 - protein, 9 aa, Cryptosporidium parvum
SLPNYSPDW

SEQ ID NO: 2281732 - protein, 4 aa, Cryptosporidium parvum
SLPP

SEQ ID NO: 2281733 - protein, 6 aa, Cryptosporidium parvum
SLPPKT

SEQ ID NO: 2281734 - protein, 5 aa, Cryptosporidium parvum
SLPPN

SEQ ID NO: 2281735 - protein, 13 aa, Cryptosporidium parvum
SLPPNYSSSQPLY

SEQ ID NO: 2281736 - protein, 9 aa, Cryptosporidium parvum
SLPQDEADP

SEQ ID NO: 2281737 - protein, 8 aa, Cryptosporidium parvum
SLPQEQPN

SEQ ID NO: 2281738 - protein, 15 aa, Cryptosporidium parvum
SLPQQQSNPSSPSLP

SEQ ID NO: 2281739 - protein, 10 aa, Cryptosporidium parvum
SLPREEESSI

SEQ ID NO: 2281740 - protein, 5 aa, Cryptosporidium parvum
SLPRF

SEQ ID NO: 2281741 - protein, 4 aa, Cryptosporidium parvum
SLPS

SEQ ID NO: 2281742 - protein, 7 aa, Cryptosporidium parvum
SLPSGAQ

SEQ ID NO: 2281743 - protein, 10 aa, Cryptosporidium parvum
SLPSIADAES

SEQ ID NO: 2281744 - protein, 12 aa, Cryptosporidium parvum
SLPSPSSSIPSL

SEQ ID NO: 2281745 - protein, 20 aa, Cryptosporidium parvum
SLPSRKDSTISKQPTRSGTV

SEQ ID NO: 2281746 - protein, 7 aa, Cryptosporidium parvum
SLPSSTI

SEQ ID NO: 2281747 - protein, 10 aa, Cryptosporidium parvum
SLPTPPKDYN

SEQ ID NO: 2281748 - protein, 17 aa, Cryptosporidium parvum
SLQANNNNYSASTYEDD

SEQ ID NO: 2281749 - protein, 7 aa, Cryptosporidium parvum
SLQNQEK

SEQ ID NO: 2281750 - protein, 6 aa, Cryptosporidium parvum
SLQPGI

SEQ ID NO: 2281751 - protein, 11 aa, Cryptosporidium parvum
SLQPPTAYPST

SEQ ID NO: 2281752 - protein, 7 aa, Cryptosporidium parvum
SLQRKSE

SEQ ID NO: 2281753 - protein, 38 aa, Cryptosporidium parvum
SLQSSIKKKSSGTAENERTYESNLEQDAEESARTQQQF

SEQ ID NO: 2281754 - protein, 7 aa, Cryptosporidium parvum
SLQTKRR

SEQ ID NO: 2281755 - protein, 11 aa, Cryptosporidium parvum
SLQTNGSEKVN

SEQ ID NO: 2281756 - protein, 7 aa, Cryptosporidium parvum
SLREENE

SEQ ID NO: 2281757 - protein, 6 aa, Cryptosporidium parvum
SLRGKS

SEQ ID NO: 2281758 - protein, 4 aa, Cryptosporidium parvum
SLRK

SEQ ID NO: 2281759 - protein, 6 aa, Cryptosporidium parvum
SLRPND

SEQ ID NO: 2281760 - protein, 25 aa, Cryptosporidium parvum
SLRRPDERRKLKRKEKKERKAEEKL

SEQ ID NO: 2281761 - protein, 12 aa, Cryptosporidium parvum
SLRRSEKNSEPL

SEQ ID NO: 2281762 - protein, 10 aa, Cryptosporidium parvum
SLSDDDENKT

SEQ ID NO: 2281763 - protein, 5 aa, Cryptosporidium parvum
SLSDY

SEQ ID NO: 2281764 - protein, 5 aa, Cryptosporidium parvum
SLSEK

SEQ ID NO: 2281765 - protein, 7 aa, Cryptosporidium parvum
SLSEKYK

SEQ ID NO: 2281766 - protein, 10 aa, Cryptosporidium parvum
SLSGGESSSI

SEQ ID NO: 2281767 - protein, 7 aa, Cryptosporidium parvum
SLSGNPD

SEQ ID NO: 2281768 - protein, 12 aa, Cryptosporidium parvum
SLSKSPGSFERE

SEQ ID NO: 2281769 - protein, 13 aa, Cryptosporidium parvum
SLSNASGGNSIAD

SEQ ID NO: 2281770 - protein, 26 aa, Cryptosporidium parvum
SLSNGNNVSFQSNNGNQYSQFNDRNN

SEQ ID NO: 2281771 - protein, 5 aa, Cryptosporidium parvum
SLSNI

SEQ ID NO: 2281772 - protein, 7 aa, Cryptosporidium parvum
SLSNIEK

SEQ ID NO: 2281773 - protein, 22 aa, Cryptosporidium parvum
SLSNLSKSNENSITQNKRNNIY

SEQ ID NO: 2281774 - protein, 10 aa, Cryptosporidium parvum
SLSNSGAVKR

SEQ ID NO: 2281775 - protein, 8 aa, Cryptosporidium parvum
SLSNSKKD

SEQ ID NO: 2281776 - protein, 17 aa, Cryptosporidium parvum
SLSNSNTSTNNNNNNNN

SEQ ID NO: 2281777 - protein, 27 aa, Cryptosporidium parvum
SLSNSNTTTCSEQSGPHSNKISAPESL

SEQ ID NO: 2281778 - protein, 15 aa, Cryptosporidium parvum
SLSNSSGGNSSKKEC

SEQ ID NO: 2281779 - protein, 7 aa, Cryptosporidium parvum
SLSPGLE

SEQ ID NO: 2281780 - protein, 5 aa, Cryptosporidium parvum
SLSPR

SEQ ID NO: 2281781 - protein, 9 aa, Cryptosporidium parvum
SLSQESNEQ

SEQ ID NO: 2281782 - protein, 11 aa, Cryptosporidium parvum
SLSQVSSAPIP

SEQ ID NO: 2281783 - protein, 4 aa, Cryptosporidium parvum
SLSR

SEQ ID NO: 2281784 - protein, 18 aa, Cryptosporidium parvum
SLSRRSSSLRKGSKSSGF

SEQ ID NO: 2281785 - protein, 9 aa, Cryptosporidium parvum
SLSRTGAPI

SEQ ID NO: 2281786 - protein, 6 aa, Cryptosporidium parvum
SLSRYE

SEQ ID NO: 2281787 - protein, 6 aa, Cryptosporidium parvum
SLSSDE

SEQ ID NO: 2281788 - protein, 10 aa, Cryptosporidium parvum
SLSSDQNHST

SEQ ID NO: 2281789 - protein, 7 aa, Cryptosporidium parvum
SLSSEKK

SEQ ID NO: 2281790 - protein, 10 aa, Cryptosporidium parvum
SLSSGNLSKS

SEQ ID NO: 2281791 - protein, 6 aa, Cryptosporidium parvum
SLSSNK

SEQ ID NO: 2281792 - protein, 5 aa, Cryptosporidium parvum
SLSSS

SEQ ID NO: 2281793 - protein, 21 aa, Cryptosporidium parvum
SLSSSSQISSNMNSNITTTSR

SEQ ID NO: 2281794 - protein, 54 aa, Cryptosporidium parvum
SLSSSSSSSSSSSSSSSSFSSTSSSSSSFNDSSNGFGRVNNKNNNNNNGNGDGH

SEQ ID NO: 2281795 - protein, 40 aa, Cryptosporidium parvum
SLSSSSSSSSSSSSSSSSSTSPASNSILPGTSGIPTPSTV

SEQ ID NO: 2281796 - protein, 10 aa, Cryptosporidium parvum
SLSSVPKSPM

SEQ ID NO: 2281797 - protein, 46 aa, Cryptosporidium parvum
SLSSYGSRKHFSEEPNSADSNSTSISSDENNNAVENKSKKTKERRK

SEQ ID NO: 2281798 - protein, 17 aa, Cryptosporidium parvum
SLSTNKEFTDEYETTDI

SEQ ID NO: 2281799 - protein, 7 aa, Cryptosporidium parvum
SLSTTTS

SEQ ID NO: 2281800 - protein, 9 aa, Cryptosporidium parvum
SLTAGGGSI

SEQ ID NO: 2281801 - protein, 4 aa, Cryptosporidium parvum
SLTD

SEQ ID NO: 2281802 - protein, 6 aa, Cryptosporidium parvum
SLTGNE

SEQ ID NO: 2281803 - protein, 6 aa, Cryptosporidium parvum
SLTIST

SEQ ID NO: 2281804 - protein, 7 aa, Cryptosporidium parvum
SLTKNDR

SEQ ID NO: 2281805 - protein, 4 aa, Cryptosporidium parvum
SLTN

SEQ ID NO: 2281806 - protein, 7 aa, Cryptosporidium parvum
SLTNIPS

SEQ ID NO: 2281807 - protein, 17 aa, Cryptosporidium parvum
SLTNKGGMSDVKTTVGS

SEQ ID NO: 2281808 - protein, 6 aa, Cryptosporidium parvum
SLTNSS

SEQ ID NO: 2281809 - protein, 9 aa, Cryptosporidium parvum
SLTSKYSGD

SEQ ID NO: 2281810 - protein, 5 aa, Cryptosporidium parvum
SLTSN

SEQ ID NO: 2281811 - protein, 5 aa, Cryptosporidium parvum
SLTTK

SEQ ID NO: 2281812 - protein, 14 aa, Cryptosporidium parvum
SLTTSGIKDSTENA

SEQ ID NO: 2281813 - protein, 6 aa, Cryptosporidium parvum
SLTYET

SEQ ID NO: 2281814 - protein, 4 aa, Cryptosporidium parvum
SLVG

SEQ ID NO: 2281815 - protein, 10 aa, Cryptosporidium parvum
SLVSKKNQRA

SEQ ID NO: 2281816 - protein, 8 aa, Cryptosporidium parvum
SLYDSKNN

SEQ ID NO: 2281817 - protein, 14 aa, Cryptosporidium parvum
SLYEGEDKQKRSEV

SEQ ID NO: 2281818 - protein, 6 aa, Cryptosporidium parvum
SLYQDK

SEQ ID NO: 2281819 - protein, 11 aa, Cryptosporidium parvum
SLYTKQSISDK

SEQ ID NO: 2281820 - protein, 7 aa, Cryptosporidium parvum
SMDGPKK

SEQ ID NO: 2281821 - protein, 7 aa, Cryptosporidium parvum
SMDSNGE

SEQ ID NO: 2281822 - protein, 4 aa, Cryptosporidium parvum
SMGG

SEQ ID NO: 2281823 - protein, 8 aa, Cryptosporidium parvum
SMGGSPAW

SEQ ID NO: 2281824 - protein, 5 aa, Cryptosporidium parvum
SMGKT

SEQ ID NO: 2281825 - protein, 25 aa, Cryptosporidium parvum
SMHPESKDDELKSGDDSKTKDLPTI

SEQ ID NO: 2281826 - protein, 21 aa, Cryptosporidium parvum
SMIEEKSSSVYNKKEGGRKLD

SEQ ID NO: 2281827 - protein, 4 aa, Cryptosporidium parvum
SMKE

SEQ ID NO: 2281828 - protein, 27 aa, Cryptosporidium parvum
SMKNKKKREKRSLKNLEKSQAKNTNLN

SEQ ID NO: 2281829 - protein, 12 aa, Cryptosporidium parvum
SMNEEEALSAGG

SEQ ID NO: 2281830 - protein, 7 aa, Cryptosporidium parvum
SMNPTSS

SEQ ID NO: 2281831 - protein, 12 aa, Cryptosporidium parvum
SMNRENKELNDA

SEQ ID NO: 2281832 - protein, 10 aa, Cryptosporidium parvum
SMNRRSSDTF

SEQ ID NO: 2281833 - protein, 23 aa, Cryptosporidium parvum
SMNSNALSSYRSTGSGSMPTNRS

SEQ ID NO: 2281834 - protein, 13 aa, Cryptosporidium parvum
SMNSSNKSSYLPY

SEQ ID NO: 2281835 - protein, 5 aa, Cryptosporidium parvum
SMNST

SEQ ID NO: 2281836 - protein, 9 aa, Cryptosporidium parvum
SMNTKTTKK

SEQ ID NO: 2281837 - protein, 12 aa, Cryptosporidium parvum
SMPNHPDPISVS

SEQ ID NO: 2281838 - protein, 5 aa, Cryptosporidium parvum
SMPNS

SEQ ID NO: 2281839 - protein, 5 aa, Cryptosporidium parvum
SMPNV

SEQ ID NO: 2281840 - protein, 9 aa, Cryptosporidium parvum
SMPNVSTST

SEQ ID NO: 2281841 - protein, 11 aa, Cryptosporidium parvum
SMPREKGHQNS

SEQ ID NO: 2281842 - protein, 13 aa, Cryptosporidium parvum
SMPRNPPSKESTL

SEQ ID NO: 2281843 - protein, 6 aa, Cryptosporidium parvum
SMQDDG

SEQ ID NO: 2281844 - protein, 20 aa, Cryptosporidium parvum
SMRRTTGFRDNSENGDLNSQ

SEQ ID NO: 2281845 - protein, 10 aa, Cryptosporidium parvum
SMSGGRSSVG

SEQ ID NO: 2281846 - protein, 5 aa, Cryptosporidium parvum
SMSIT

SEQ ID NO: 2281847 - protein, 9 aa, Cryptosporidium parvum
SMSNDSLNS

SEQ ID NO: 2281848 - protein, 11 aa, Cryptosporidium parvum
SMSNRIDSTPN

SEQ ID NO: 2281849 - protein, 5 aa, Cryptosporidium parvum
SMSSS

SEQ ID NO: 2281850 - protein, 9 aa, Cryptosporidium parvum
SMTDSAQQA

SEQ ID NO: 2281851 - protein, 5 aa, Cryptosporidium parvum
SMTNN

SEQ ID NO: 2281852 - protein, 12 aa, Cryptosporidium parvum
SMTSQSDNVTSI

SEQ ID NO: 2281853 - protein, 44 aa, Cryptosporidium parvum
SNAAATTTNASVSANSISTAQTAPINSTANIASANTANNTVNTP

SEQ ID NO: 2281854 - protein, 9 aa, Cryptosporidium parvum
SNADNDPIE

SEQ ID NO: 2281855 - protein, 26 aa, Cryptosporidium parvum
SNADTKSQLQTEDKTGSSQSINNEEG

SEQ ID NO: 2281856 - protein, 6 aa, Cryptosporidium parvum
SNADVP

SEQ ID NO: 2281857 - protein, 7 aa, Cryptosporidium parvum
SNAKSQW

SEQ ID NO: 2281858 - protein, 8 aa, Cryptosporidium parvum
SNAKTYNG

SEQ ID NO: 2281859 - protein, 5 aa, Cryptosporidium parvum
SNANE

SEQ ID NO: 2281860 - protein, 10 aa, Cryptosporidium parvum
SNAPSSSELQ

SEQ ID NO: 2281861 - protein, 8 aa, Cryptosporidium parvum
SNASKEMI

SEQ ID NO: 2281862 - protein, 24 aa, Cryptosporidium parvum
SNASNVIRPKRAAAIKAEESIQKK

SEQ ID NO: 2281863 - protein, 7 aa, Cryptosporidium parvum
SNASPGS

SEQ ID NO: 2281864 - protein, 17 aa, Cryptosporidium parvum
SNAVPPQESHSGCNNCN

SEQ ID NO: 2281865 - protein, 7 aa, Cryptosporidium parvum
SNCGGSG

SEQ ID NO: 2281866 - protein, 7 aa, Cryptosporidium parvum
SNCGGSN

SEQ ID NO: 2281867 - protein, 4 aa, Cryptosporidium parvum
SNCP

SEQ ID NO: 2281868 - protein, 5 aa, Cryptosporidium parvum
SNCQT

SEQ ID NO: 2281869 - protein, 11 aa, Cryptosporidium parvum
SNCSSAGTTPI

SEQ ID NO: 2281870 - protein, 4 aa, Cryptosporidium parvum
SNDA

SEQ ID NO: 2281871 - protein, 8 aa, Cryptosporidium parvum
SNDATSPS

SEQ ID NO: 2281872 - protein, 5 aa, Cryptosporidium parvum
SNDDD

SEQ ID NO: 2281873 - protein, 6 aa, Cryptosporidium parvum
SNDDLS

SEQ ID NO: 2281874 - protein, 10 aa, Cryptosporidium parvum
SNDENYSAKT

SEQ ID NO: 2281875 - protein, 10 aa, Cryptosporidium parvum
SNDETHPELP

SEQ ID NO: 2281876 - protein, 5 aa, Cryptosporidium parvum
SNDFQ

SEQ ID NO: 2281877 - protein, 6 aa, Cryptosporidium parvum
SNDFSN

SEQ ID NO: 2281878 - protein, 5 aa, Cryptosporidium parvum
SNDGK

SEQ ID NO: 2281879 - protein, 9 aa, Cryptosporidium parvum
SNDHGSTIE

SEQ ID NO: 2281880 - protein, 5 aa, Cryptosporidium parvum
SNDID

SEQ ID NO: 2281881 - protein, 10 aa, Cryptosporidium parvum
SNDKDNDEAC

SEQ ID NO: 2281882 - protein, 11 aa, Cryptosporidium parvum
SNDKGKTGRKI

SEQ ID NO: 2281883 - protein, 10 aa, Cryptosporidium parvum
SNDKKYSSSF

SEQ ID NO: 2281884 - protein, 14 aa, Cryptosporidium parvum
SNDLDNDKELESDK

SEQ ID NO: 2281885 - protein, 8 aa, Cryptosporidium parvum
SNDMRSTN

SEQ ID NO: 2281886 - protein, 18 aa, Cryptosporidium parvum
SNDNENSSPSERKHSQNI

SEQ ID NO: 2281887 - protein, 23 aa, Cryptosporidium parvum
SNDNISKRESRWSKVSDGSTSRW

SEQ ID NO: 2281888 - protein, 9 aa, Cryptosporidium parvum
SNDNNKPQV

SEQ ID NO: 2281889 - protein, 6 aa, Cryptosporidium parvum
SNDNPM

SEQ ID NO: 2281890 - protein, 6 aa, Cryptosporidium parvum
SNDNTL

SEQ ID NO: 2281891 - protein, 4 aa, Cryptosporidium parvum
SNDP

SEQ ID NO: 2281892 - protein, 7 aa, Cryptosporidium parvum
SNDPIST

SEQ ID NO: 2281893 - protein, 9 aa, Cryptosporidium parvum
SNDQNSFTD

SEQ ID NO: 2281894 - protein, 9 aa, Cryptosporidium parvum
SNDRDRNFH

SEQ ID NO: 2281895 - protein, 23 aa, Cryptosporidium parvum
SNDRIDDEEGKKKENKDEDFESQ

SEQ ID NO: 2281896 - protein, 5 aa, Cryptosporidium parvum
SNDTN

SEQ ID NO: 2281897 - protein, 8 aa, Cryptosporidium parvum
SNDTYSRK

SEQ ID NO: 2281898 - protein, 6 aa, Cryptosporidium parvum
SNDYAA

SEQ ID NO: 2281899 - protein, 7 aa, Cryptosporidium parvum
SNDYPGY

SEQ ID NO: 2281900 - protein, 6 aa, Cryptosporidium parvum
SNDYRG

SEQ ID NO: 2281901 - protein, 55 aa, Cryptosporidium parvum
SNEANGKRDDCNLSSNSNVESQTRRNKTNRSGVGKRKNKKIRFNSGTKDSFQENS

SEQ ID NO: 2281902 - protein, 10 aa, Cryptosporidium parvum
SNEDKSKIYN

SEQ ID NO: 2281903 - protein, 5 aa, Cryptosporidium parvum
SNEDV

SEQ ID NO: 2281904 - protein, 4 aa, Cryptosporidium parvum
SNEE

SEQ ID NO: 2281905 - protein, 6 aa, Cryptosporidium parvum
SNEEEC

SEQ ID NO: 2281906 - protein, 14 aa, Cryptosporidium parvum
SNEEQFSSEVPKNI

SEQ ID NO: 2281907 - protein, 7 aa, Cryptosporidium parvum
SNEIESK

SEQ ID NO: 2281908 - protein, 9 aa, Cryptosporidium parvum
SNEIGDDEQ

SEQ ID NO: 2281909 - protein, 23 aa, Cryptosporidium parvum
SNEINDDVDDESDSSIENSASVN

SEQ ID NO: 2281910 - protein, 12 aa, Cryptosporidium parvum
SNEISKSKQNEI

SEQ ID NO: 2281911 - protein, 6 aa, Cryptosporidium parvum
SNEISN

SEQ ID NO: 2281912 - protein, 7 aa, Cryptosporidium parvum
SNEKDPV

SEQ ID NO: 2281913 - protein, 17 aa, Cryptosporidium parvum
SNEKGYSTQKAAPQSYY

SEQ ID NO: 2281914 - protein, 7 aa, Cryptosporidium parvum
SNEKRSF

SEQ ID NO: 2281915 - protein, 5 aa, Cryptosporidium parvum
SNEKV

SEQ ID NO: 2281916 - protein, 4 aa, Cryptosporidium parvum
SNEL

SEQ ID NO: 2281917 - protein, 13 aa, Cryptosporidium parvum
SNELGEELDDETL

SEQ ID NO: 2281918 - protein, 9 aa, Cryptosporidium parvum
SNENAGSYN

SEQ ID NO: 2281919 - protein, 5 aa, Cryptosporidium parvum
SNENF

SEQ ID NO: 2281920 - protein, 6 aa, Cryptosporidium parvum
SNENFN

SEQ ID NO: 2281921 - protein, 5 aa, Cryptosporidium parvum
SNENG

SEQ ID NO: 2281922 - protein, 9 aa, Cryptosporidium parvum
SNENKNSIQ

SEQ ID NO: 2281923 - protein, 10 aa, Cryptosporidium parvum
SNENSGSPIQ

SEQ ID NO: 2281924 - protein, 7 aa, Cryptosporidium parvum
SNENSLN

SEQ ID NO: 2281925 - protein, 4 aa, Cryptosporidium parvum
SNEP

SEQ ID NO: 2281926 - protein, 15 aa, Cryptosporidium parvum
SNEPDDPAQPNDQDV

SEQ ID NO: 2281927 - protein, 6 aa, Cryptosporidium parvum
SNEPET

SEQ ID NO: 2281928 - protein, 9 aa, Cryptosporidium parvum
SNEPKNNGE

SEQ ID NO: 2281929 - protein, 5 aa, Cryptosporidium parvum
SNERN

SEQ ID NO: 2281930 - protein, 5 aa, Cryptosporidium parvum
SNERQ

SEQ ID NO: 2281931 - protein, 6 aa, Cryptosporidium parvum
SNERYF

SEQ ID NO: 2281932 - protein, 4 aa, Cryptosporidium parvum
SNES

SEQ ID NO: 2281933 - protein, 5 aa, Cryptosporidium parvum
SNESA

SEQ ID NO: 2281934 - protein, 10 aa, Cryptosporidium parvum
SNESKGKSEK

SEQ ID NO: 2281935 - protein, 5 aa, Cryptosporidium parvum
SNESL

SEQ ID NO: 2281936 - protein, 7 aa, Cryptosporidium parvum
SNESNKN

SEQ ID NO: 2281937 - protein, 24 aa, Cryptosporidium parvum
SNESSSSISNIDSPSSSISKKRRV

SEQ ID NO: 2281938 - protein, 8 aa, Cryptosporidium parvum
SNETDKRS

SEQ ID NO: 2281939 - protein, 6 aa, Cryptosporidium parvum
SNETDL

SEQ ID NO: 2281940 - protein, 7 aa, Cryptosporidium parvum
SNETKEN

SEQ ID NO: 2281941 - protein, 4 aa, Cryptosporidium parvum
SNEY

SEQ ID NO: 2281942 - protein, 8 aa, Cryptosporidium parvum
SNEYKETV

SEQ ID NO: 2281943 - protein, 6 aa, Cryptosporidium parvum
SNFAKD

SEQ ID NO: 2281944 - protein, 20 aa, Cryptosporidium parvum
SNFANKTSINASSNINPNNT

SEQ ID NO: 2281945 - protein, 75 aa, Cryptosporidium parvum
SNFDQNNNSQYTSAIETSASVVPGSIESTNQQNISTVDASSSLAVSSNSGVDSTQTQEAPPEPPKKRGRGRPRIN

SEQ ID NO: 2281946 - protein, 7 aa, Cryptosporidium parvum
SNFEGSY

SEQ ID NO: 2281947 - protein, 12 aa, Cryptosporidium parvum
SNFENSEDLEET

SEQ ID NO: 2281948 - protein, 7 aa, Cryptosporidium parvum
SNFGEKA

SEQ ID NO: 2281949 - protein, 6 aa, Cryptosporidium parvum
SNFGNN

SEQ ID NO: 2281950 - protein, 35 aa, Cryptosporidium parvum
SNFGQGSSSEPISSQESSSSSSSSTSKNSTENNGY

SEQ ID NO: 2281951 - protein, 11 aa, Cryptosporidium parvum
SNFKNSLESAL

SEQ ID NO: 2281952 - protein, 7 aa, Cryptosporidium parvum
SNFSTKY

SEQ ID NO: 2281953 - protein, 31 aa, Cryptosporidium parvum
SNFTQSSINNNNQKSNQSILNDTGSSSSLQK

SEQ ID NO: 2281954 - protein, 5 aa, Cryptosporidium parvum
SNGCY

SEQ ID NO: 2281955 - protein, 4 aa, Cryptosporidium parvum
SNGD

SEQ ID NO: 2281956 - protein, 6 aa, Cryptosporidium parvum
SNGDIK

SEQ ID NO: 2281957 - protein, 16 aa, Cryptosporidium parvum
SNGDRKKNAVARATGE

SEQ ID NO: 2281958 - protein, 9 aa, Cryptosporidium parvum
SNGEENKFV

SEQ ID NO: 2281959 - protein, 7 aa, Cryptosporidium parvum
SNGEGQI

SEQ ID NO: 2281960 - protein, 18 aa, Cryptosporidium parvum
SNGEKENYSQEENSQNKV

SEQ ID NO: 2281961 - protein, 25 aa, Cryptosporidium parvum
SNGEKITRRDPYARYTDYDTDSSYI

SEQ ID NO: 2281962 - protein, 7 aa, Cryptosporidium parvum
SNGEPVF

SEQ ID NO: 2281963 - protein, 17 aa, Cryptosporidium parvum
SNGEVEDPKTSSNTPLN

SEQ ID NO: 2281964 - protein, 25 aa, Cryptosporidium parvum
SNGFEDSNLNTETKEGTLQGSSKTV

SEQ ID NO: 2281965 - protein, 8 aa, Cryptosporidium parvum
SNGFGTNT

SEQ ID NO: 2281966 - protein, 17 aa, Cryptosporidium parvum
SNGFKNEDKEKGGEAYN

SEQ ID NO: 2281967 - protein, 5 aa, Cryptosporidium parvum
SNGFT

SEQ ID NO: 2281968 - protein, 8 aa, Cryptosporidium parvum
SNGGECPS

SEQ ID NO: 2281969 - protein, 10 aa, Cryptosporidium parvum
SNGGGPDISR

SEQ ID NO: 2281970 - protein, 7 aa, Cryptosporidium parvum
SNGGIGD

SEQ ID NO: 2281971 - protein, 6 aa, Cryptosporidium parvum
SNGGKI

SEQ ID NO: 2281972 - protein, 11 aa, Cryptosporidium parvum
SNGGPTSSTGL

SEQ ID NO: 2281973 - protein, 12 aa, Cryptosporidium parvum
SNGISAVPPDKY

SEQ ID NO: 2281974 - protein, 41 aa, Cryptosporidium parvum
SNGIYEDNRGSGGGARCRTGRKRRSSRVDMEREANGATTAG

SEQ ID NO: 2281975 - protein, 20 aa, Cryptosporidium parvum
SNGKPGSGAAATTTTTTTTI

SEQ ID NO: 2281976 - protein, 10 aa, Cryptosporidium parvum
SNGKSSSIDG

SEQ ID NO: 2281977 - protein, 17 aa, Cryptosporidium parvum
SNGKTIEVGNTDAEGRL

SEQ ID NO: 2281978 - protein, 14 aa, Cryptosporidium parvum
SNGLESKNEYNGDN

SEQ ID NO: 2281979 - protein, 20 aa, Cryptosporidium parvum
SNGMPEAGNESSEDDDDDEI

SEQ ID NO: 2281980 - protein, 14 aa, Cryptosporidium parvum
SNGRNNSHKLTPIG

SEQ ID NO: 2281981 - protein, 8 aa, Cryptosporidium parvum
SNGSDLDE

SEQ ID NO: 2281982 - protein, 9 aa, Cryptosporidium parvum
SNGSKSFDN

SEQ ID NO: 2281983 - protein, 6 aa, Cryptosporidium parvum
SNGSLS

SEQ ID NO: 2281984 - protein, 10 aa, Cryptosporidium parvum
SNGSTYSRES

SEQ ID NO: 2281985 - protein, 9 aa, Cryptosporidium parvum
SNGTLDTKN

SEQ ID NO: 2281986 - protein, 7 aa, Cryptosporidium parvum
SNGTNHS

SEQ ID NO: 2281987 - protein, 9 aa, Cryptosporidium parvum
SNGVRGSLV

SEQ ID NO: 2281988 - protein, 11 aa, Cryptosporidium parvum
SNGVSSKIEEK

SEQ ID NO: 2281989 - protein, 11 aa, Cryptosporidium parvum
SNGYVAGGGAV

SEQ ID NO: 2281990 - protein, 23 aa, Cryptosporidium parvum
SNHEYGKKRNDELNHDKDDNRSL

SEQ ID NO: 2281991 - protein, 147 aa, Cryptosporidium parvum
SNHNGNKEHMSNNEPRLNSNKHVNNVSSSNKNFSVNNGGVKDQYYSTHRDNSDKGQHSNVTNNNSTYITGNDDNSKPSHAKNNKPEKIQPSHHQQQNHQQQRQQQQHHQQQHQQQQQQHQQHQQQQHHQHQQQQHHQQHHQQQHHQQ

SEQ ID NO: 2281992 - protein, 8 aa, Cryptosporidium parvum
SNHNHNNK

SEQ ID NO: 2281993 - protein, 14 aa, Cryptosporidium parvum
SNHNNNNNNNNNKR

SEQ ID NO: 2281994 - protein, 12 aa, Cryptosporidium parvum
SNHNQGDSESEY

SEQ ID NO: 2281995 - protein, 23 aa, Cryptosporidium parvum
SNHQPQQNRSNYGQRQQNYGGHQ

SEQ ID NO: 2281996 - protein, 9 aa, Cryptosporidium parvum
SNHSYGSRR

SEQ ID NO: 2281997 - protein, 8 aa, Cryptosporidium parvum
SNHTDSGK

SEQ ID NO: 2281998 - protein, 20 aa, Cryptosporidium parvum
SNHTGNNQIENPNNYDQPQI

SEQ ID NO: 2281999 - protein, 22 aa, Cryptosporidium parvum
SNHYNEKEEDSSEAETEKRSNA

SEQ ID NO: 2282000 - protein, 9 aa, Cryptosporidium parvum
SNIDEIPPI

SEQ ID NO: 2282001 - protein, 22 aa, Cryptosporidium parvum
SNIDESDSDLFGESDSTPDQVH

SEQ ID NO: 2282002 - protein, 8 aa, Cryptosporidium parvum
SNIDGSSG

SEQ ID NO: 2282003 - protein, 16 aa, Cryptosporidium parvum
SNIDKADSNAITGPVQ

SEQ ID NO: 2282004 - protein, 15 aa, Cryptosporidium parvum
SNIDRSDDPITSGEE

SEQ ID NO: 2282005 - protein, 18 aa, Cryptosporidium parvum
SNIDSKVSKNNSFKSDQA

SEQ ID NO: 2282006 - protein, 4 aa, Cryptosporidium parvum
SNIE

SEQ ID NO: 2282007 - protein, 12 aa, Cryptosporidium parvum
SNIEGDQRETGD

SEQ ID NO: 2282008 - protein, 5 aa, Cryptosporidium parvum
SNIEI

SEQ ID NO: 2282009 - protein, 19 aa, Cryptosporidium parvum
SNIEQTHNNYSQEQPNSFE

SEQ ID NO: 2282010 - protein, 10 aa, Cryptosporidium parvum
SNIESETNTV

SEQ ID NO: 2282011 - protein, 15 aa, Cryptosporidium parvum
SNIGNNRGGMAGGDI

SEQ ID NO: 2282012 - protein, 5 aa, Cryptosporidium parvum
SNIGS

SEQ ID NO: 2282013 - protein, 6 aa, Cryptosporidium parvum
SNIHTS

SEQ ID NO: 2282014 - protein, 4 aa, Cryptosporidium parvum
SNIK

SEQ ID NO: 2282015 - protein, 4 aa, Cryptosporidium parvum
SNIN

SEQ ID NO: 2282016 - protein, 5 aa, Cryptosporidium parvum
SNINM

SEQ ID NO: 2282017 - protein, 8 aa, Cryptosporidium parvum
SNINNNNN

SEQ ID NO: 2282018 - protein, 19 aa, Cryptosporidium parvum
SNINNNNNNNNNNNNIQEK

SEQ ID NO: 2282019 - protein, 43 aa, Cryptosporidium parvum; identical to SEQ ID NO: 2162240

SEQ ID NO: 2282020 - protein, 8 aa, Cryptosporidium parvum
SNINPTNK

SEQ ID NO: 2282021 - protein, 9 aa, Cryptosporidium parvum
SNINQDDKL

SEQ ID NO: 2282022 - protein, 6 aa, Cryptosporidium parvum
SNINSE

SEQ ID NO: 2282023 - protein, 21 aa, Cryptosporidium parvum
SNINSKSKEIGIDSNATPGMT

SEQ ID NO: 2282024 - protein, 6 aa, Cryptosporidium parvum
SNINTN

SEQ ID NO: 2282025 - protein, 4 aa, Cryptosporidium parvum
SNIP

SEQ ID NO: 2282026 - protein, 8 aa, Cryptosporidium parvum
SNIPGEGE

SEQ ID NO: 2282027 - protein, 19 aa, Cryptosporidium parvum
SNIPRNKNIRSEACSSDEA

SEQ ID NO: 2282028 - protein, 13 aa, Cryptosporidium parvum
SNIPSNNHNQYSH

SEQ ID NO: 2282029 - protein, 13 aa, Cryptosporidium parvum
SNIPTIPSSEVDL

SEQ ID NO: 2282030 - protein, 7 aa, Cryptosporidium parvum
SNIRSPG

SEQ ID NO: 2282031 - protein, 8 aa, Cryptosporidium parvum
SNISENKN

SEQ ID NO: 2282032 - protein, 8 aa, Cryptosporidium parvum
SNISGNVE

SEQ ID NO: 2282033 - protein, 32 aa, Cryptosporidium parvum
SNISGQISENVKGKSQSGDYANDSEDQNASKI

SEQ ID NO: 2282034 - protein, 7 aa, Cryptosporidium parvum
SNISGRL

SEQ ID NO: 2282035 - protein, 12 aa, Cryptosporidium parvum
SNISNNTDDEDN

SEQ ID NO: 2282036 - protein, 5 aa, Cryptosporidium parvum
SNISQ

SEQ ID NO: 2282037 - protein, 6 aa, Cryptosporidium parvum
SNISRG

SEQ ID NO: 2282038 - protein, 16 aa, Cryptosporidium parvum
SNISRSIKEEDCEENH

SEQ ID NO: 2282039 - protein, 5 aa, Cryptosporidium parvum
SNIST

SEQ ID NO: 2282040 - protein, 4 aa, Cryptosporidium parvum
SNIT

SEQ ID NO: 2282041 - protein, 13 aa, Cryptosporidium parvum
SNITDKKVDSENL

SEQ ID NO: 2282042 - protein, 6 aa, Cryptosporidium parvum
SNITGL

SEQ ID NO: 2282043 - protein, 7 aa, Cryptosporidium parvum
SNKANFD

SEQ ID NO: 2282044 - protein, 7 aa, Cryptosporidium parvum
SNKASKY

SEQ ID NO: 2282045 - protein, 6 aa, Cryptosporidium parvum
SNKDEN

SEQ ID NO: 2282046 - protein, 7 aa, Cryptosporidium parvum
SNKDEYI

SEQ ID NO: 2282047 - protein, 9 aa, Cryptosporidium parvum
SNKDQFNDP

SEQ ID NO: 2282048 - protein, 5 aa, Cryptosporidium parvum
SNKDR

SEQ ID NO: 2282049 - protein, 6 aa, Cryptosporidium parvum
SNKDRE

SEQ ID NO: 2282050 - protein, 8 aa, Cryptosporidium parvum
SNKEENEG

SEQ ID NO: 2282051 - protein, 5 aa, Cryptosporidium parvum
SNKER

SEQ ID NO: 2282052 - protein, 23 aa, Cryptosporidium parvum
SNKFKENRFESKKDEAVSNTNLG

SEQ ID NO: 2282053 - protein, 6 aa, Cryptosporidium parvum
SNKFSG

SEQ ID NO: 2282054 - protein, 72 aa, Cryptosporidium parvum
SNKGNTEFQGGSEDQAEVRAEDQVEDQVEDQSQEQAEDQSQDRAEDQDYSQSRPQNQPKDPNHMNENEKELL

SEQ ID NO: 2282055 - protein, 6 aa, Cryptosporidium parvum
SNKGPS

SEQ ID NO: 2282056 - protein, 4 aa, Cryptosporidium parvum
SNKI

SEQ ID NO: 2282057 - protein, 9 aa, Cryptosporidium parvum
SNKIEKTKL

SEQ ID NO: 2282058 - protein, 8 aa, Cryptosporidium parvum
SNKIPNSV

SEQ ID NO: 2282059 - protein, 6 aa, Cryptosporidium parvum
SNKISN

SEQ ID NO: 2282060 - protein, 9 aa, Cryptosporidium parvum
SNKKDGIKI

SEQ ID NO: 2282061 - protein, 5 aa, Cryptosporidium parvum
SNKKN

SEQ ID NO: 2282062 - protein, 5 aa, Cryptosporidium parvum
SNKKP

SEQ ID NO: 2282063 - protein, 8 aa, Cryptosporidium parvum
SNKKQVSN

SEQ ID NO: 2282064 - protein, 8 aa, Cryptosporidium parvum
SNKLDTSK

SEQ ID NO: 2282065 - protein, 5 aa, Cryptosporidium parvum
SNKND

SEQ ID NO: 2282066 - protein, 15 aa, Cryptosporidium parvum
SNKNETSSTKDIGNY

SEQ ID NO: 2282067 - protein, 6 aa, Cryptosporidium parvum
SNKNFS

SEQ ID NO: 2282068 - protein, 7 aa, Cryptosporidium parvum
SNKNKKL

SEQ ID NO: 2282069 - protein, 8 aa, Cryptosporidium parvum
SNKPDSQW

SEQ ID NO: 2282070 - protein, 8 aa, Cryptosporidium parvum
SNKPFPNN

SEQ ID NO: 2282071 - protein, 5 aa, Cryptosporidium parvum
SNKPI

SEQ ID NO: 2282072 - protein, 10 aa, Cryptosporidium parvum
SNKPKNIKEE

SEQ ID NO: 2282073 - protein, 4 aa, Cryptosporidium parvum
SNKR

SEQ ID NO: 2282074 - protein, 7 aa, Cryptosporidium parvum
SNKRANI

SEQ ID NO: 2282075 - protein, 10 aa, Cryptosporidium parvum
SNKSDAMEQG

SEQ ID NO: 2282076 - protein, 86 aa, Cryptosporidium parvum
SNKSDSKNETSMNGVNSSISSNMQEEKNLNKTSNQSLEYTTKKSSKRSQETKENNSNEIKETLKDQTRSDENKSIRKLSQNEEFER

SEQ ID NO: 2282077 - protein, 6 aa, Cryptosporidium parvum
SNKSHP

SEQ ID NO: 2282078 - protein, 5 aa, Cryptosporidium parvum
SNKSI

SEQ ID NO: 2282079 - protein, 9 aa, Cryptosporidium parvum
SNKSKETLV

SEQ ID NO: 2282080 - protein, 13 aa, Cryptosporidium parvum
SNKSNQDASEAFT

SEQ ID NO: 2282081 - protein, 9 aa, Cryptosporidium parvum
SNKSPNFNA

SEQ ID NO: 2282082 - protein, 15 aa, Cryptosporidium parvum
SNKSSKASKNDEDSE

SEQ ID NO: 2282083 - protein, 15 aa, Cryptosporidium parvum
SNKSVPTSSNNNFGS

SEQ ID NO: 2282084 - protein, 9 aa, Cryptosporidium parvum
SNKTDGDAT

SEQ ID NO: 2282085 - protein, 9 aa, Cryptosporidium parvum
SNKTNDQNK

SEQ ID NO: 2282086 - protein, 24 aa, Cryptosporidium parvum
SNKTTQGFNTKKQINKKEKKKTYN

SEQ ID NO: 2282087 - protein, 9 aa, Cryptosporidium parvum
SNKVSKNKD

SEQ ID NO: 2282088 - protein, 12 aa, Cryptosporidium parvum
SNKWPKTKESIE

SEQ ID NO: 2282089 - protein, 19 aa, Cryptosporidium parvum
SNKYCNKSDSKNKLEKTNK

SEQ ID NO: 2282090 - protein, 7 aa, Cryptosporidium parvum
SNKYEPQ

SEQ ID NO: 2282091 - protein, 8 aa, Cryptosporidium parvum
SNKYRRTE

SEQ ID NO: 2282092 - protein, 6 aa, Cryptosporidium parvum
SNLDQN

SEQ ID NO: 2282093 - protein, 13 aa, Cryptosporidium parvum
SNLDRKKKNCDTI

SEQ ID NO: 2282094 - protein, 4 aa, Cryptosporidium parvum
SNLE

SEQ ID NO: 2282095 - protein, 5 aa, Cryptosporidium parvum
SNLER

SEQ ID NO: 2282096 - protein, 12 aa, Cryptosporidium parvum
SNLETKSLEKIS

SEQ ID NO: 2282097 - protein, 9 aa, Cryptosporidium parvum
SNLETNSNL

SEQ ID NO: 2282098 - protein, 6 aa, Cryptosporidium parvum
SNLGQH

SEQ ID NO: 2282099 - protein, 29 aa, Cryptosporidium parvum
SNLKGKDKIGNAAFNKGNAQKLPHYKSNK

SEQ ID NO: 2282100 - protein, 4 aa, Cryptosporidium parvum
SNLN

SEQ ID NO: 2282101 - protein, 36 aa, Cryptosporidium parvum
SNLNKKNKKIKSGYDEMNDEENDTNDNMESEQMQEQ

SEQ ID NO: 2282102 - protein, 6 aa, Cryptosporidium parvum
SNLNKN

SEQ ID NO: 2282103 - protein, 8 aa, Cryptosporidium parvum
SNLNPSDI

SEQ ID NO: 2282104 - protein, 13 aa, Cryptosporidium parvum
SNLNSETRGLDGI

SEQ ID NO: 2282105 - protein, 13 aa, Cryptosporidium parvum
SNLNSTDGKKYYQ

SEQ ID NO: 2282106 - protein, 21 aa, Cryptosporidium parvum
SNLNYNDSNGGHLNNSKQLNN

SEQ ID NO: 2282107 - protein, 17 aa, Cryptosporidium parvum
SNLPENPVYSSEQGTER

SEQ ID NO: 2282108 - protein, 6 aa, Cryptosporidium parvum
SNLPKE

SEQ ID NO: 2282109 - protein, 9 aa, Cryptosporidium parvum
SNLQDKEED

SEQ ID NO: 2282110 - protein, 16 aa, Cryptosporidium parvum
SNLQDKSKKSNDENTN

SEQ ID NO: 2282111 - protein, 6 aa, Cryptosporidium parvum
SNLRSY

SEQ ID NO: 2282112 - protein, 8 aa, Cryptosporidium parvum
SNLSEDSE

SEQ ID NO: 2282113 - protein, 6 aa, Cryptosporidium parvum
SNLSIQ

SEQ ID NO: 2282114 - protein, 8 aa, Cryptosporidium parvum
SNLSPGEY

SEQ ID NO: 2282115 - protein, 6 aa, Cryptosporidium parvum
SNLSQR

SEQ ID NO: 2282116 - protein, 17 aa, Cryptosporidium parvum
SNLSSSERTSSSSGNSI

SEQ ID NO: 2282117 - protein, 8 aa, Cryptosporidium parvum
SNLSTQNE

SEQ ID NO: 2282118 - protein, 9 aa, Cryptosporidium parvum
SNLTTESGV

SEQ ID NO: 2282119 - protein, 5 aa, Cryptosporidium parvum
SNMAG

SEQ ID NO: 2282120 - protein, 13 aa, Cryptosporidium parvum
SNMAREADHRDSE

SEQ ID NO: 2282121 - protein, 8 aa, Cryptosporidium parvum
SNMDEKPE

SEQ ID NO: 2282122 - protein, 13 aa, Cryptosporidium parvum
SNMENLNSRQDCE

SEQ ID NO: 2282123 - protein, 4 aa, Cryptosporidium parvum
SNMG

SEQ ID NO: 2282124 - protein, 8 aa, Cryptosporidium parvum
SNMNENSA

SEQ ID NO: 2282125 - protein, 5 aa, Cryptosporidium parvum
SNMNG

SEQ ID NO: 2282126 - protein, 14 aa, Cryptosporidium parvum
SNMNNRRNNNNNNY

SEQ ID NO: 2282127 - protein, 5 aa, Cryptosporidium parvum
SNMNQ

SEQ ID NO: 2282128 - protein, 26 aa, Cryptosporidium parvum
SNMNQQHQQHQQQKQQQQQQQQQQQL

SEQ ID NO: 2282129 - protein, 5 aa, Cryptosporidium parvum
SNMPV

SEQ ID NO: 2282130 - protein, 22 aa, Cryptosporidium parvum
SNMSNKQQKQLKQRNGVSPNLG

SEQ ID NO: 2282131 - protein, 11 aa, Cryptosporidium parvum
SNMSSNSNSNL

SEQ ID NO: 2282132 - protein, 18 aa, Cryptosporidium parvum
SNMTKNEIKKKSHQNTEQ

SEQ ID NO: 2282133 - protein, 9 aa, Cryptosporidium parvum
SNNAGITNS

SEQ ID NO: 2282134 - protein, 10 aa, Cryptosporidium parvum
SNNCDSNKKN

SEQ ID NO: 2282135 - protein, 5 aa, Cryptosporidium parvum
SNNDF

SEQ ID NO: 2282136 - protein, 31 aa, Cryptosporidium parvum
SNNDGQSYYQNGYDQQNYEYQTEMNNDSTNF

SEQ ID NO: 2282137 - protein, 24 aa, Cryptosporidium parvum
SNNDIERESISSKNTNHSSISNND

SEQ ID NO: 2282138 - protein, 24 aa, Cryptosporidium parvum
SNNEAEPTNENRPASLIGSLGELL

SEQ ID NO: 2282139 - protein, 7 aa, Cryptosporidium parvum
SNNEDAN

SEQ ID NO: 2282140 - protein, 5 aa, Cryptosporidium parvum
SNNEE

SEQ ID NO: 2282141 - protein, 16 aa, Cryptosporidium parvum
SNNEEDKKDENRSLKN

SEQ ID NO: 2282142 - protein, 12 aa, Cryptosporidium parvum
SNNEKDHYSEAG

SEQ ID NO: 2282143 - protein, 5 aa, Cryptosporidium parvum
SNNEL

SEQ ID NO: 2282144 - protein, 23 aa, Cryptosporidium parvum
SNNENIQANSTRSSISGDKQELL

SEQ ID NO: 2282145 - protein, 5 aa, Cryptosporidium parvum
SNNFE

SEQ ID NO: 2282146 - protein, 17 aa, Cryptosporidium parvum
SNNFGTSIERNKKHVRS

SEQ ID NO: 2282147 - protein, 10 aa, Cryptosporidium parvum
SNNGKTDQNF

SEQ ID NO: 2282148 - protein, 31 aa, Cryptosporidium parvum
SNNHGEHIPETETASEQGFGGRDDTYGPNNK

SEQ ID NO: 2282149 - protein, 15 aa, Cryptosporidium parvum
SNNHQTKISQETEQF

SEQ ID NO: 2282150 - protein, 8 aa, Cryptosporidium parvum
SNNHSTSC

SEQ ID NO: 2282151 - protein, 5 aa, Cryptosporidium parvum
SNNIS

SEQ ID NO: 2282152 - protein, 25 aa, Cryptosporidium parvum
SNNKKDLTSNRPKSTSISTSTENTK

SEQ ID NO: 2282153 - protein, 6 aa, Cryptosporidium parvum
SNNKMN

SEQ ID NO: 2282154 - protein, 29 aa, Cryptosporidium parvum
SNNKPNDQTVTQTPGQNLEQSSGSNIFGS

SEQ ID NO: 2282155 - protein, 8 aa, Cryptosporidium parvum
SNNKQYNS

SEQ ID NO: 2282156 - protein, 12 aa, Cryptosporidium parvum
SNNKSNSSKDKR

SEQ ID NO: 2282157 - protein, 6 aa, Cryptosporidium parvum
SNNLER

SEQ ID NO: 2282158 - protein, 12 aa, Cryptosporidium parvum
SNNLQKAGNGCP

SEQ ID NO: 2282159 - protein, 25 aa, Cryptosporidium parvum
SNNMNSSAANSNPFSSLNGGGPNVA

SEQ ID NO: 2282160 - protein, 10 aa, Cryptosporidium parvum
SNNNASNRHI

SEQ ID NO: 2282161 - protein, 14 aa, Cryptosporidium parvum
SNNNDIKSGVRYFR

SEQ ID NO: 2282162 - protein, 10 aa, Cryptosporidium parvum
SNNNDKKQNN

SEQ ID NO: 2282163 - protein, 5 aa, Cryptosporidium parvum
SNNNF

SEQ ID NO: 2282164 - protein, 17 aa, Cryptosporidium parvum
SNNNITGNKNQYSDHSS

SEQ ID NO: 2282165 - protein, 12 aa, Cryptosporidium parvum
SNNNKESTELND

SEQ ID NO: 2282166 - protein, 18 aa, Cryptosporidium parvum
SNNNNNNDLSKNIESPID

SEQ ID NO: 2282167 - protein, 8 aa, Cryptosporidium parvum
SNNNNNNG

SEQ ID NO: 2282168 - protein, 9 aa, Cryptosporidium parvum
SNNNNNNIH

SEQ ID NO: 2282169 - protein, 9 aa, Cryptosporidium parvum
SNNNNNNIL

SEQ ID NO: 2282170 - protein, 21 aa, Cryptosporidium parvum
SNNNNSDNCVKNDDMSNINNN

SEQ ID NO: 2282171 - protein, 21 aa, Cryptosporidium parvum
SNNNRGNKSHNMSNRDSSPDF

SEQ ID NO: 2282172 - protein, 19 aa, Cryptosporidium parvum
SNNNSIKELQDQNSNNKKY

SEQ ID NO: 2282173 - protein, 7 aa, Cryptosporidium parvum
SNNNSLK

SEQ ID NO: 2282174 - protein, 5 aa, Cryptosporidium parvum
SNNNT

SEQ ID NO: 2282175 - protein, 4 aa, Cryptosporidium parvum
SNNP

SEQ ID NO: 2282176 - protein, 8 aa, Cryptosporidium parvum
SNNPDEVI

SEQ ID NO: 2282177 - protein, 9 aa, Cryptosporidium parvum
SNNPDSAKR

SEQ ID NO: 2282178 - protein, 7 aa, Cryptosporidium parvum
SNNPPHG

SEQ ID NO: 2282179 - protein, 5 aa, Cryptosporidium parvum
SNNQD

SEQ ID NO: 2282180 - protein, 13 aa, Cryptosporidium parvum
SNNRDKNKEHERI

SEQ ID NO: 2282181 - protein, 7 aa, Cryptosporidium parvum
SNNRKSR

SEQ ID NO: 2282182 - protein, 14 aa, Cryptosporidium parvum
SNNRNTSYYNSHEN

SEQ ID NO: 2282183 - protein, 7 aa, Cryptosporidium parvum
SNNRSRN

SEQ ID NO: 2282184 - protein, 9 aa, Cryptosporidium parvum
SNNRTNRIG

SEQ ID NO: 2282185 - protein, 64 aa, Cryptosporidium parvum
SNNSGSGSQNHHYKGGEGGGLQGNQQEGGSISQGLRSRRVKSSNADCNNENNNNNKGEDGSMQQ

SEQ ID NO: 2282186 - protein, 5 aa, Cryptosporidium parvum
SNNSH

SEQ ID NO: 2282187 - protein, 7 aa, Cryptosporidium parvum
SNNSIEP

SEQ ID NO: 2282188 - protein, 6 aa, Cryptosporidium parvum
SNNSKM

SEQ ID NO: 2282189 - protein, 6 aa, Cryptosporidium parvum
SNNSLT

SEQ ID NO: 2282190 - protein, 9 aa, Cryptosporidium parvum
SNNSNGSVI

SEQ ID NO: 2282191 - protein, 12 aa, Cryptosporidium parvum
SNNSNNATSSTY

SEQ ID NO: 2282192 - protein, 8 aa, Cryptosporidium parvum
SNNSRMDD

SEQ ID NO: 2282193 - protein, 7 aa, Cryptosporidium parvum
SNNSSNY

SEQ ID NO: 2282194 - protein, 10 aa, Cryptosporidium parvum
SNNSSSIKDS

SEQ ID NO: 2282195 - protein, 8 aa, Cryptosporidium parvum
SNNSTGNY

SEQ ID NO: 2282196 - protein, 4 aa, Cryptosporidium parvum
SNNT

SEQ ID NO: 2282197 - protein, 6 aa, Cryptosporidium parvum
SNNTAF

SEQ ID NO: 2282198 - protein, 8 aa, Cryptosporidium parvum
SNNTENRH

SEQ ID NO: 2282199 - protein, 14 aa, Cryptosporidium parvum
SNNTGINNSNNQTI

SEQ ID NO: 2282200 - protein, 13 aa, Cryptosporidium parvum
SNNTGKIGSNGCA

SEQ ID NO: 2282201 - protein, 23 aa, Cryptosporidium parvum
SNNTRIENEKQASSYNQNQTKRR

SEQ ID NO: 2282202 - protein, 11 aa, Cryptosporidium parvum
SNNTSKNMSSK

SEQ ID NO: 2282203 - protein, 31 aa, Cryptosporidium parvum
SNNTSNSNSNSNSTTTTTTTSGSLSGTVSRI

SEQ ID NO: 2282204 - protein, 23 aa, Cryptosporidium parvum
SNNVLTSKQDQDEYGNSSNQGFN

SEQ ID NO: 2282205 - protein, 5 aa, Cryptosporidium parvum
SNNVS

SEQ ID NO: 2282206 - protein, 4 aa, Cryptosporidium parvum
SNNY

SEQ ID NO: 2282207 - protein, 12 aa, Cryptosporidium parvum
SNNYTDKTKTQT

SEQ ID NO: 2282208 - protein, 9 aa, Cryptosporidium parvum
SNPADVAPF

SEQ ID NO: 2282209 - protein, 27 aa, Cryptosporidium parvum
SNPCQNPNMNSSTYVSNQYQNSQQQHS

SEQ ID NO: 2282210 - protein, 6 aa, Cryptosporidium parvum
SNPCSP

SEQ ID NO: 2282211 - protein, 4 aa, Cryptosporidium parvum
SNPD

SEQ ID NO: 2282212 - protein, 8 aa, Cryptosporidium parvum
SNPDKTQM

SEQ ID NO: 2282213 - protein, 6 aa, Cryptosporidium parvum
SNPDPH

SEQ ID NO: 2282214 - protein, 7 aa, Cryptosporidium parvum
SNPFSGN

SEQ ID NO: 2282215 - protein, 6 aa, Cryptosporidium parvum
SNPGMQ

SEQ ID NO: 2282216 - protein, 7 aa, Cryptosporidium parvum
SNPIDSQ

SEQ ID NO: 2282217 - protein, 5 aa, Cryptosporidium parvum
SNPIT

SEQ ID NO: 2282218 - protein, 4 aa, Cryptosporidium parvum
SNPK

SEQ ID NO: 2282219 - protein, 7 aa, Cryptosporidium parvum
SNPKVNG

SEQ ID NO: 2282220 - protein, 13 aa, Cryptosporidium parvum
SNPMEGATQTTKH

SEQ ID NO: 2282221 - protein, 5 aa, Cryptosporidium parvum
SNPNK

SEQ ID NO: 2282222 - protein, 13 aa, Cryptosporidium parvum
SNPNKKEVYDEYG

SEQ ID NO: 2282223 - protein, 11 aa, Cryptosporidium parvum
SNPNSGSSFER

SEQ ID NO: 2282224 - protein, 14 aa, Cryptosporidium parvum
SNPNWTTSLTPRSI

SEQ ID NO: 2282225 - protein, 6 aa, Cryptosporidium parvum
SNPNYE

SEQ ID NO: 2282226 - protein, 5 aa, Cryptosporidium parvum
SNPQI

SEQ ID NO: 2282227 - protein, 6 aa, Cryptosporidium parvum
SNPRHN

SEQ ID NO: 2282228 - protein, 8 aa, Cryptosporidium parvum
SNPRRRSY

SEQ ID NO: 2282229 - protein, 4 aa, Cryptosporidium parvum
SNPS

SEQ ID NO: 2282230 - protein, 7 aa, Cryptosporidium parvum
SNPSDYD

SEQ ID NO: 2282231 - protein, 5 aa, Cryptosporidium parvum
SNPSL

SEQ ID NO: 2282232 - protein, 72 aa, Cryptosporidium parvum
SNPSSKSKKNQKNATTLQPVKKKGKSNSKAQKNKGNTSNRKIQENNSNIKLEEESKDNSKEINDSDNDFPLS

SEQ ID NO: 2282233 - protein, 7 aa, Cryptosporidium parvum
SNPSTFT

SEQ ID NO: 2282234 - protein, 31 aa, Cryptosporidium parvum; identical to SEQ ID NO: 2162414

SEQ ID NO: 2282235 - protein, 6 aa, Cryptosporidium parvum
SNPTNQ

SEQ ID NO: 2282236 - protein, 5 aa, Cryptosporidium parvum
SNPVN

SEQ ID NO: 2282237 - protein, 8 aa, Cryptosporidium parvum
SNPVTKPI

SEQ ID NO: 2282238 - protein, 9 aa, Cryptosporidium parvum
SNQADDTNV

SEQ ID NO: 2282239 - protein, 9 aa, Cryptosporidium parvum
SNQARSGDI

SEQ ID NO: 2282240 - protein, 7 aa, Cryptosporidium parvum
SNQGRGV

SEQ ID NO: 2282241 - protein, 9 aa, Cryptosporidium parvum
SNQIGNRKS

SEQ ID NO: 2282242 - protein, 7 aa, Cryptosporidium parvum
SNQKRIS

SEQ ID NO: 2282243 - protein, 9 aa, Cryptosporidium parvum
SNQKTFTPI

SEQ ID NO: 2282244 - protein, 56 aa, Cryptosporidium parvum
SNQLDSDKKKKKKRKSHESIQNEQDEDDQQEQMRDNDESSEKKKKKKRKSSGKGDD

SEQ ID NO: 2282245 - protein, 4 aa, Cryptosporidium parvum
SNQN

SEQ ID NO: 2282246 - protein, 6 aa, Cryptosporidium parvum
SNQNDH

SEQ ID NO: 2282247 - protein, 9 aa, Cryptosporidium parvum
SNQNDYIED

SEQ ID NO: 2282248 - protein, 9 aa, Cryptosporidium parvum
SNQNEGSSQ

SEQ ID NO: 2282249 - protein, 13 aa, Cryptosporidium parvum
SNQNNKEKDDNEN

SEQ ID NO: 2282250 - protein, 6 aa, Cryptosporidium parvum
SNQNNN

SEQ ID NO: 2282251 - protein, 9 aa, Cryptosporidium parvum
SNQNPGNKL

SEQ ID NO: 2282252 - protein, 5 aa, Cryptosporidium parvum
SNQNS

SEQ ID NO: 2282253 - protein, 6 aa, Cryptosporidium parvum
SNQNTN

SEQ ID NO: 2282254 - protein, 7 aa, Cryptosporidium parvum
SNQPNQI

SEQ ID NO: 2282255 - protein, 4 aa, Cryptosporidium parvum
SNQQ

SEQ ID NO: 2282256 - protein, 17 aa, Cryptosporidium parvum
SNQRKSLSDQYDQQIDN

SEQ ID NO: 2282257 - protein, 8 aa, Cryptosporidium parvum
SNQSEESM

SEQ ID NO: 2282258 - protein, 6 aa, Cryptosporidium parvum
SNQSKF

SEQ ID NO: 2282259 - protein, 12 aa, Cryptosporidium parvum
SNQSKLKKVQNS

SEQ ID NO: 2282260 - protein, 30 aa, Cryptosporidium parvum
SNQSPTSTSSSSSSVSSPSAISTSCQNSSN

SEQ ID NO: 2282261 - protein, 24 aa, Cryptosporidium parvum
SNQTLSGSNLGAGSGSTSGANLST

SEQ ID NO: 2282262 - protein, 11 aa, Cryptosporidium parvum
SNQTPKPPIKR

SEQ ID NO: 2282263 - protein, 35 aa, Cryptosporidium parvum
SNQTQETEISNQSGIVTTTGSLENLEKTQETKDIT

SEQ ID NO: 2282264 - protein, 13 aa, Cryptosporidium parvum
SNRANKSNLQPEI

SEQ ID NO: 2282265 - protein, 5 aa, Cryptosporidium parvum
SNRDD

SEQ ID NO: 2282266 - protein, 8 aa, Cryptosporidium parvum
SNRDGRNL

SEQ ID NO: 2282267 - protein, 12 aa, Cryptosporidium parvum
SNRDRSLEKPSI

SEQ ID NO: 2282268 - protein, 17 aa, Cryptosporidium parvum
SNRDSRKRKLISRQLKK

SEQ ID NO: 2282269 - protein, 9 aa, Cryptosporidium parvum
SNREDSNKV

SEQ ID NO: 2282270 - protein, 11 aa, Cryptosporidium parvum
SNREGMQATSG

SEQ ID NO: 2282271 - protein, 11 aa, Cryptosporidium parvum
SNREMENTTIG

SEQ ID NO: 2282272 - protein, 4 aa, Cryptosporidium parvum
SNRG

SEQ ID NO: 2282273 - protein, 9 aa, Cryptosporidium parvum
SNRINGNYN

SEQ ID NO: 2282274 - protein, 20 aa, Cryptosporidium parvum
SNRISEDPDKISERNKRIKN

SEQ ID NO: 2282275 - protein, 9 aa, Cryptosporidium parvum
SNRKISSDE

SEQ ID NO: 2282276 - protein, 6 aa, Cryptosporidium parvum
SNRKTM

SEQ ID NO: 2282277 - protein, 7 aa, Cryptosporidium parvum
SNRLSEK

SEQ ID NO: 2282278 - protein, 11 aa, Cryptosporidium parvum
SNRNATTALNT

SEQ ID NO: 2282279 - protein, 9 aa, Cryptosporidium parvum
SNRNKDLSY

SEQ ID NO: 2282280 - protein, 16 aa, Cryptosporidium parvum
SNRNLGSSSVQNTPPY

SEQ ID NO: 2282281 - protein, 12 aa, Cryptosporidium parvum
SNRNSNRRRGRS

SEQ ID NO: 2282282 - protein, 10 aa, Cryptosporidium parvum
SNRPKKEDNL

SEQ ID NO: 2282283 - protein, 4 aa, Cryptosporidium parvum
SNRQ

SEQ ID NO: 2282284 - protein, 4 aa, Cryptosporidium parvum
SNRS

SEQ ID NO: 2282285 - protein, 10 aa, Cryptosporidium parvum
SNRSELSQGA

SEQ ID NO: 2282286 - protein, 14 aa, Cryptosporidium parvum
SNRSGWDRKNKSKN

SEQ ID NO: 2282287 - protein, 7 aa, Cryptosporidium parvum
SNRTNSS

SEQ ID NO: 2282288 - protein, 5 aa, Cryptosporidium parvum
SNRYD

SEQ ID NO: 2282289 - protein, 4 aa, Cryptosporidium parvum
SNSA

SEQ ID NO: 2282290 - protein, 22 aa, Cryptosporidium parvum
SNSAMSSNTNFSRNVNNQSQNV

SEQ ID NO: 2282291 - protein, 13 aa, Cryptosporidium parvum
SNSAQSNEDKTIS

SEQ ID NO: 2282292 - protein, 10 aa, Cryptosporidium parvum
SNSDDRSYVS

SEQ ID NO: 2282293 - protein, 5 aa, Cryptosporidium parvum
SNSDI

SEQ ID NO: 2282294 - protein, 20 aa, Cryptosporidium parvum
SNSDKNSNKQSGSEYNPAAE

SEQ ID NO: 2282295 - protein, 7 aa, Cryptosporidium parvum
SNSDLGF

SEQ ID NO: 2282296 - protein, 7 aa, Cryptosporidium parvum
SNSDPEV

SEQ ID NO: 2282297 - protein, 13 aa, Cryptosporidium parvum
SNSDRPKSEIETN

SEQ ID NO: 2282298 - protein, 12 aa, Cryptosporidium parvum
SNSDSGNRRSHQ

SEQ ID NO: 2282299 - protein, 8 aa, Cryptosporidium parvum
SNSEDNIS

SEQ ID NO: 2282300 - protein, 31 aa, Cryptosporidium parvum
SNSEICKKNRDKEVGERHESYDQETNNGELS

SEQ ID NO: 2282301 - protein, 10 aa, Cryptosporidium parvum
SNSEKISEEA

SEQ ID NO: 2282302 - protein, 10 aa, Cryptosporidium parvum
SNSEKQVKDA

SEQ ID NO: 2282303 - protein, 6 aa, Cryptosporidium parvum
SNSEKV

SEQ ID NO: 2282304 - protein, 7 aa, Cryptosporidium parvum
SNSELEY

SEQ ID NO: 2282305 - protein, 11 aa, Cryptosporidium parvum
SNSENTRLDDS

SEQ ID NO: 2282306 - protein, 8 aa, Cryptosporidium parvum
SNSESMQK

SEQ ID NO: 2282307 - protein, 5 aa, Cryptosporidium parvum
SNSEV

SEQ ID NO: 2282308 - protein, 5 aa, Cryptosporidium parvum
SNSFP

SEQ ID NO: 2282309 - protein, 8 aa, Cryptosporidium parvum
SNSFQSNN

SEQ ID NO: 2282310 - protein, 11 aa, Cryptosporidium parvum
SNSGDSNNKFQ

SEQ ID NO: 2282311 - protein, 5 aa, Cryptosporidium parvum
SNSGG

SEQ ID NO: 2282312 - protein, 9 aa, Cryptosporidium parvum
SNSGGLKGA

SEQ ID NO: 2282313 - protein, 8 aa, Cryptosporidium parvum
SNSGKKFE

SEQ ID NO: 2282314 - protein, 10 aa, Cryptosporidium parvum
SNSGNENETI

SEQ ID NO: 2282315 - protein, 8 aa, Cryptosporidium parvum
SNSGPLVP

SEQ ID NO: 2282316 - protein, 6 aa, Cryptosporidium parvum
SNSGSR

SEQ ID NO: 2282317 - protein, 25 aa, Cryptosporidium parvum
SNSGSTPSTNCNAISSSPSSIITTS

SEQ ID NO: 2282318 - protein, 11 aa, Cryptosporidium parvum
SNSHNGGEQAL

SEQ ID NO: 2282319 - protein, 4 aa, Cryptosporidium parvum
SNSI

SEQ ID NO: 2282320 - protein, 5 aa, Cryptosporidium parvum
SNSIG

SEQ ID NO: 2282321 - protein, 14 aa, Cryptosporidium parvum
SNSIGNKKKRQKEF

SEQ ID NO: 2282322 - protein, 33 aa, Cryptosporidium parvum
SNSIKRANTNTSRRNNRISTRTNPYSTSSSSRG

SEQ ID NO: 2282323 - protein, 10 aa, Cryptosporidium parvum
SNSILSSERH

SEQ ID NO: 2282324 - protein, 12 aa, Cryptosporidium parvum
SNSINQHDLIDF

SEQ ID NO: 2282325 - protein, 17 aa, Cryptosporidium parvum
SNSISDSRQINPNFPDN

SEQ ID NO: 2282326 - protein, 9 aa, Cryptosporidium parvum
SNSITNNTC

SEQ ID NO: 2282327 - protein, 13 aa, Cryptosporidium parvum
SNSKEKESSNYKP

SEQ ID NO: 2282328 - protein, 7 aa, Cryptosporidium parvum
SNSKGSV

SEQ ID NO: 2282329 - protein, 19 aa, Cryptosporidium parvum
SNSKKDQKEENSKIRDSNN

SEQ ID NO: 2282330 - protein, 6 aa, Cryptosporidium parvum
SNSKPL

SEQ ID NO: 2282331 - protein, 9 aa, Cryptosporidium parvum
SNSKQPEEL

SEQ ID NO: 2282332 - protein, 7 aa, Cryptosporidium parvum
SNSKSDV

SEQ ID NO: 2282333 - protein, 20 aa, Cryptosporidium parvum
SNSKTKYKDTTEKKLQEDMG

SEQ ID NO: 2282334 - protein, 9 aa, Cryptosporidium parvum
SNSKYKTPR

SEQ ID NO: 2282335 - protein, 5 aa, Cryptosporidium parvum
SNSLN

SEQ ID NO: 2282336 - protein, 29 aa, Cryptosporidium parvum
SNSLNDSNQQSKGSFSQGIAQNNTISEVQ

SEQ ID NO: 2282337 - protein, 22 aa, Cryptosporidium parvum
SNSLRYNSSSSSSSNNNNNNIG

SEQ ID NO: 2282338 - protein, 12 aa, Cryptosporidium parvum
SNSLSPNKQKEV

SEQ ID NO: 2282339 - protein, 42 aa, Cryptosporidium parvum
SNSMAASVPSSNSASSSNSVPSNSLSASISGKVQQRISQGEL

SEQ ID NO: 2282340 - protein, 4 aa, Cryptosporidium parvum
SNSN

SEQ ID NO: 2282341 - protein, 9 aa, Cryptosporidium parvum
SNSNDSKMS

SEQ ID NO: 2282342 - protein, 14 aa, Cryptosporidium parvum
SNSNKSNAPQHSAA

SEQ ID NO: 2282343 - protein, 13 aa, Cryptosporidium parvum
SNSNLEKLDQSME

SEQ ID NO: 2282344 - protein, 6 aa, Cryptosporidium parvum
SNSNLS

SEQ ID NO: 2282345 - protein, 26 aa, Cryptosporidium parvum
SNSNNPSSATSPYEHPLSTPDGKKTK

SEQ ID NO: 2282346 - protein, 7 aa, Cryptosporidium parvum
SNSNSHL

SEQ ID NO: 2282347 - protein, 8 aa, Cryptosporidium parvum
SNSNSLGG

SEQ ID NO: 2282348 - protein, 13 aa, Cryptosporidium parvum
SNSNSPTSNNYSN

SEQ ID NO: 2282349 - protein, 10 aa, Cryptosporidium parvum
SNSNTQPQIS

SEQ ID NO: 2282350 - protein, 8 aa, Cryptosporidium parvum
SNSNTTTL

SEQ ID NO: 2282351 - protein, 10 aa, Cryptosporidium parvum
SNSPNPGNDA

SEQ ID NO: 2282352 - protein, 4 aa, Cryptosporidium parvum
SNSQ

SEQ ID NO: 2282353 - protein, 15 aa, Cryptosporidium parvum
SNSQGESANTIQKKD

SEQ ID NO: 2282354 - protein, 13 aa, Cryptosporidium parvum
SNSQIAQMISFNF

SEQ ID NO: 2282355 - protein, 5 aa, Cryptosporidium parvum
SNSQY

SEQ ID NO: 2282356 - protein, 4 aa, Cryptosporidium parvum
SNSR

SEQ ID NO: 2282357 - protein, 23 aa, Cryptosporidium parvum
SNSRENHFKNSQNNFNTTRKGFE

SEQ ID NO: 2282358 - protein, 10 aa, Cryptosporidium parvum
SNSSENHNRQ

SEQ ID NO: 2282359 - protein, 5 aa, Cryptosporidium parvum
SNSSL

SEQ ID NO: 2282360 - protein, 7 aa, Cryptosporidium parvum
SNSSNHY

SEQ ID NO: 2282361 - protein, 5 aa, Cryptosporidium parvum
SNSSS

SEQ ID NO: 2282362 - protein, 9 aa, Cryptosporidium parvum
SNSSSNQRA

SEQ ID NO: 2282363 - protein, 6 aa, Cryptosporidium parvum
SNSSSV

SEQ ID NO: 2282364 - protein, 6 aa, Cryptosporidium parvum
SNSSTY

SEQ ID NO: 2282365 - protein, 4 aa, Cryptosporidium parvum
SNST

SEQ ID NO: 2282366 - protein, 7 aa, Cryptosporidium parvum
SNSTKFA

SEQ ID NO: 2282367 - protein, 6 aa, Cryptosporidium parvum
SNSTNK

SEQ ID NO: 2282368 - protein, 5 aa, Cryptosporidium parvum
SNSTP

SEQ ID NO: 2282369 - protein, 6 aa, Cryptosporidium parvum
SNSTQD

SEQ ID NO: 2282370 - protein, 8 aa, Cryptosporidium parvum
SNSTSRPL

SEQ ID NO: 2282371 - protein, 6 aa, Cryptosporidium parvum
SNSVNN

SEQ ID NO: 2282372 - protein, 23 aa, Cryptosporidium parvum
SNSVSNNNINNNNNNNNNSNNIH

SEQ ID NO: 2282373 - protein, 10 aa, Cryptosporidium parvum
SNSVSRRPSW

SEQ ID NO: 2282374 - protein, 6 aa, Cryptosporidium parvum
SNSYES

SEQ ID NO: 2282375 - protein, 5 aa, Cryptosporidium parvum
SNSYN

SEQ ID NO: 2282376 - protein, 7 aa, Cryptosporidium parvum
SNTCRER

SEQ ID NO: 2282377 - protein, 6 aa, Cryptosporidium parvum
SNTDKT

SEQ ID NO: 2282378 - protein, 14 aa, Cryptosporidium parvum
SNTDPKEDAAWSSE

SEQ ID NO: 2282379 - protein, 13 aa, Cryptosporidium parvum
SNTEGISDTNTNI

SEQ ID NO: 2282380 - protein, 6 aa, Cryptosporidium parvum
SNTELK

SEQ ID NO: 2282381 - protein, 20 aa, Cryptosporidium parvum
SNTESSKSSSSSNYQHRSLT

SEQ ID NO: 2282382 - protein, 18 aa, Cryptosporidium parvum
SNTGDQNSKDSSIRENSN

SEQ ID NO: 2282383 - protein, 13 aa, Cryptosporidium parvum
SNTGDTIYSTPRH

SEQ ID NO: 2282384 - protein, 7 aa, Cryptosporidium parvum
SNTGQEV

SEQ ID NO: 2282385 - protein, 6 aa, Cryptosporidium parvum
SNTIDS

SEQ ID NO: 2282386 - protein, 17 aa, Cryptosporidium parvum
SNTIEEASKVSSDSENI

SEQ ID NO: 2282387 - protein, 15 aa, Cryptosporidium parvum
SNTIPPNSNPTPLNK

SEQ ID NO: 2282388 - protein, 8 aa, Cryptosporidium parvum
SNTKDISE

SEQ ID NO: 2282389 - protein, 7 aa, Cryptosporidium parvum
SNTKDLK

SEQ ID NO: 2282390 - protein, 6 aa, Cryptosporidium parvum
SNTKEE

SEQ ID NO: 2282391 - protein, 7 aa, Cryptosporidium parvum
SNTKGSI

SEQ ID NO: 2282392 - protein, 7 aa, Cryptosporidium parvum
SNTKKSD

SEQ ID NO: 2282393 - protein, 5 aa, Cryptosporidium parvum
SNTKN

SEQ ID NO: 2282394 - protein, 6 aa, Cryptosporidium parvum
SNTKNI

SEQ ID NO: 2282395 - protein, 36 aa, Cryptosporidium parvum
SNTKPSEVKDRIQKEAYQEDDEDGHHGGAERVSCRQ

SEQ ID NO: 2282396 - protein, 17 aa, Cryptosporidium parvum
SNTKSNFNDEVSNENNM

SEQ ID NO: 2282397 - protein, 9 aa, Cryptosporidium parvum
SNTLSSNSF

SEQ ID NO: 2282398 - protein, 9 aa, Cryptosporidium parvum
SNTLSSPYR

SEQ ID NO: 2282399 - protein, 14 aa, Cryptosporidium parvum
SNTNLSQKTTLTNN

SEQ ID NO: 2282400 - protein, 16 aa, Cryptosporidium parvum
SNTNNSSHGGSLTEKV

SEQ ID NO: 2282401 - protein, 18 aa, Cryptosporidium parvum
SNTNQQQYQPLESTNIQN

SEQ ID NO: 2282402 - protein, 10 aa, Cryptosporidium parvum
SNTNSGNQNI

SEQ ID NO: 2282403 - protein, 7 aa, Cryptosporidium parvum
SNTPKME

SEQ ID NO: 2282404 - protein, 6 aa, Cryptosporidium parvum
SNTPNV

SEQ ID NO: 2282405 - protein, 15 aa, Cryptosporidium parvum
SNTPRRSSKTGICGN

SEQ ID NO: 2282406 - protein, 4 aa, Cryptosporidium parvum
SNTQ

SEQ ID NO: 2282407 - protein, 30 aa, Cryptosporidium parvum; identical to SEQ ID NO: 2162556

SEQ ID NO: 2282408 - protein, 13 aa, Cryptosporidium parvum
SNTQKKKSPSIVN

SEQ ID NO: 2282409 - protein, 16 aa, Cryptosporidium parvum
SNTQSEIEQQSGDEHD

SEQ ID NO: 2282410 - protein, 7 aa, Cryptosporidium parvum
SNTRSNH

SEQ ID NO: 2282411 - protein, 12 aa, Cryptosporidium parvum
SNTSDEKNTDPP

SEQ ID NO: 2282412 - protein, 18 aa, Cryptosporidium parvum
SNTSKLVNSQGGERPTIS

SEQ ID NO: 2282413 - protein, 26 aa, Cryptosporidium parvum
SNTSKNDFNLNPNNNSNSNALQSPSI

SEQ ID NO: 2282414 - protein, 19 aa, Cryptosporidium parvum
SNTSKPSKVSSIDEDLQND

SEQ ID NO: 2282415 - protein, 13 aa, Cryptosporidium parvum
SNTSKTREQDTSH

SEQ ID NO: 2282416 - protein, 9 aa, Cryptosporidium parvum
SNTSNNSNN

SEQ ID NO: 2282417 - protein, 19 aa, Cryptosporidium parvum
SNTTPLLNNTSNNNNNQYY

SEQ ID NO: 2282418 - protein, 4 aa, Cryptosporidium parvum
SNTV

SEQ ID NO: 2282419 - protein, 4 aa, Cryptosporidium parvum
SNTY

SEQ ID NO: 2282420 - protein, 10 aa, Cryptosporidium parvum
SNTYSYREKD

SEQ ID NO: 2282421 - protein, 6 aa, Cryptosporidium parvum
SNVANG

SEQ ID NO: 2282422 - protein, 5 aa, Cryptosporidium parvum
SNVAQ

SEQ ID NO: 2282423 - protein, 6 aa, Cryptosporidium parvum
SNVDEN

SEQ ID NO: 2282424 - protein, 20 aa, Cryptosporidium parvum
SNVDYKDEETNANNDEEHND

SEQ ID NO: 2282425 - protein, 6 aa, Cryptosporidium parvum
SNVKSS

SEQ ID NO: 2282426 - protein, 11 aa, Cryptosporidium parvum
SNVNEKGRSKS

SEQ ID NO: 2282427 - protein, 12 aa, Cryptosporidium parvum
SNVNNQEEMREK

SEQ ID NO: 2282428 - protein, 7 aa, Cryptosporidium parvum
SNVPYNS

SEQ ID NO: 2282429 - protein, 6 aa, Cryptosporidium parvum
SNVRSE

SEQ ID NO: 2282430 - protein, 22 aa, Cryptosporidium parvum
SNVSDTNSTISNSSISNSNLND

SEQ ID NO: 2282431 - protein, 4 aa, Cryptosporidium parvum
SNWP

SEQ ID NO: 2282432 - protein, 6 aa, Cryptosporidium parvum
SNYDEI

SEQ ID NO: 2282433 - protein, 10 aa, Cryptosporidium parvum
SNYDKDSKIL

SEQ ID NO: 2282434 - protein, 7 aa, Cryptosporidium parvum
SNYIPSK

SEQ ID NO: 2282435 - protein, 4 aa, Cryptosporidium parvum
SNYN

SEQ ID NO: 2282436 - protein, 18 aa, Cryptosporidium parvum
SNYNQQLGDSNEYSAESV

SEQ ID NO: 2282437 - protein, 36 aa, Cryptosporidium parvum
SNYQSREKYISSGTGTGTGIGEAAAPIKLGTGTATI

SEQ ID NO: 2282438 - protein, 4 aa, Cryptosporidium parvum
SNYS

SEQ ID NO: 2282439 - protein, 11 aa, Cryptosporidium parvum
SNYSLQSGDVS

SEQ ID NO: 2282440 - protein, 9 aa, Cryptosporidium parvum
SNYSNSQIE

SEQ ID NO: 2282441 - protein, 19 aa, Cryptosporidium parvum
SNYSPTSNKQTLAADSNDE

SEQ ID NO: 2282442 - protein, 12 aa, Cryptosporidium parvum
SNYSRNGDYGTS

SEQ ID NO: 2282443 - protein, 9 aa, Cryptosporidium parvum
SNYSRSFNK

SEQ ID NO: 2282444 - protein, 15 aa, Cryptosporidium parvum
SNYSSKYGMKPDGNF

SEQ ID NO: 2282445 - protein, 10 aa, Cryptosporidium parvum
SNYSSSTSSV

SEQ ID NO: 2282446 - protein, 5 aa, Cryptosporidium parvum
SNYST

SEQ ID NO: 2282447 - protein, 16 aa, Cryptosporidium parvum
SNYTFRGSKSSSPIHR

SEQ ID NO: 2282448 - protein, 7 aa, Cryptosporidium parvum
SNYTGNK

SEQ ID NO: 2282449 - protein, 21 aa, Cryptosporidium parvum
SNYTGNSKDLTSNVNIVNNTN

SEQ ID NO: 2282450 - protein, 7 aa, Cryptosporidium parvum
SPAEQSA

SEQ ID NO: 2282451 - protein, 4 aa, Cryptosporidium parvum
SPAI

SEQ ID NO: 2282452 - protein, 6 aa, Cryptosporidium parvum
SPAQQH

SEQ ID NO: 2282453 - protein, 8 aa, Cryptosporidium parvum
SPASIRGP

SEQ ID NO: 2282454 - protein, 4 aa, Cryptosporidium parvum
SPDD

SEQ ID NO: 2282455 - protein, 5 aa, Cryptosporidium parvum
SPDDQ

SEQ ID NO: 2282456 - protein, 8 aa, Cryptosporidium parvum
SPDDTNCH

SEQ ID NO: 2282457 - protein, 4 aa, Cryptosporidium parvum
SPDF

SEQ ID NO: 2282458 - protein, 6 aa, Cryptosporidium parvum
SPDGIE

SEQ ID NO: 2282459 - protein, 15 aa, Cryptosporidium parvum
SPDGQTIVTGAGDET

SEQ ID NO: 2282460 - protein, 5 aa, Cryptosporidium parvum
SPDGR

SEQ ID NO: 2282461 - protein, 7 aa, Cryptosporidium parvum
SPDHIPN

SEQ ID NO: 2282462 - protein, 5 aa, Cryptosporidium parvum
SPDIN

SEQ ID NO: 2282463 - protein, 11 aa, Cryptosporidium parvum
SPDISTHSETS

SEQ ID NO: 2282464 - protein, 28 aa, Cryptosporidium parvum
SPDLSKIKGSGKQTSNSNNQAQANPIGG

SEQ ID NO: 2282465 - protein, 6 aa, Cryptosporidium parvum
SPDMNT

SEQ ID NO: 2282466 - protein, 7 aa, Cryptosporidium parvum
SPDNEDI

SEQ ID NO: 2282467 - protein, 14 aa, Cryptosporidium parvum
SPDNRQIISGSRDH

SEQ ID NO: 2282468 - protein, 9 aa, Cryptosporidium parvum
SPDQSKHTL

SEQ ID NO: 2282469 - protein, 9 aa, Cryptosporidium parvum
SPDSPPTDL

SEQ ID NO: 2282470 - protein, 8 aa, Cryptosporidium parvum
SPDTNFDD

SEQ ID NO: 2282471 - protein, 7 aa, Cryptosporidium parvum
SPEDGAL

SEQ ID NO: 2282472 - protein, 5 aa, Cryptosporidium parvum
SPEDK

SEQ ID NO: 2282473 - protein, 7 aa, Cryptosporidium parvum
SPEDRNE

SEQ ID NO: 2282474 - protein, 5 aa, Cryptosporidium parvum
SPEEH

SEQ ID NO: 2282475 - protein, 9 aa, Cryptosporidium parvum
SPEFDPQNG

SEQ ID NO: 2282476 - protein, 4 aa, Cryptosporidium parvum
SPEG

SEQ ID NO: 2282477 - protein, 4 aa, Cryptosporidium parvum
SPEI

SEQ ID NO: 2282478 - protein, 6 aa, Cryptosporidium parvum
SPEIKN

SEQ ID NO: 2282479 - protein, 4 aa, Cryptosporidium parvum
SPEK

SEQ ID NO: 2282480 - protein, 5 aa, Cryptosporidium parvum
SPEKC

SEQ ID NO: 2282481 - protein, 19 aa, Cryptosporidium parvum
SPEKLESLKENTDKNTEDC

SEQ ID NO: 2282482 - protein, 5 aa, Cryptosporidium parvum
SPELR

SEQ ID NO: 2282483 - protein, 5 aa, Cryptosporidium parvum
SPENC

SEQ ID NO: 2282484 - protein, 9 aa, Cryptosporidium parvum
SPEPNNYYN

SEQ ID NO: 2282485 - protein, 4 aa, Cryptosporidium parvum
SPER

SEQ ID NO: 2282486 - protein, 16 aa, Cryptosporidium parvum
SPESKEPIKQITQSQG

SEQ ID NO: 2282487 - protein, 8 aa, Cryptosporidium parvum
SPESRLTA

SEQ ID NO: 2282488 - protein, 28 aa, Cryptosporidium parvum
SPEVTTPNGERETSTDSNIKNTESTKVS

SEQ ID NO: 2282489 - protein, 13 aa, Cryptosporidium parvum
SPFGGGRAGRVRR

SEQ ID NO: 2282490 - protein, 6 aa, Cryptosporidium parvum
SPFGPE

SEQ ID NO: 2282491 - protein, 8 aa, Cryptosporidium parvum
SPFKQSSS

SEQ ID NO: 2282492 - protein, 5 aa, Cryptosporidium parvum
SPFNK

SEQ ID NO: 2282493 - protein, 13 aa, Cryptosporidium parvum
SPFPNKESSIEVE

SEQ ID NO: 2282494 - protein, 7 aa, Cryptosporidium parvum
SPFSSKE

SEQ ID NO: 2282495 - protein, 8 aa, Cryptosporidium parvum
SPFTKTST

SEQ ID NO: 2282496 - protein, 4 aa, Cryptosporidium parvum
SPGC

SEQ ID NO: 2282497 - protein, 9 aa, Cryptosporidium parvum
SPGEAEAQA

SEQ ID NO: 2282498 - protein, 4 aa, Cryptosporidium parvum
SPGI

SEQ ID NO: 2282499 - protein, 11 aa, Cryptosporidium parvum
SPGIDGAESFE

SEQ ID NO: 2282500 - protein, 69 aa, Cryptosporidium parvum
SPGKVSGTAMNSATSVSTSSSNQVQSTPNLRQTGNTSMGTINSQKMDSSETLTRPASTSTLKKSDSGCF

SEQ ID NO: 2282501 - protein, 5 aa, Cryptosporidium parvum
SPGLQ

SEQ ID NO: 2282502 - protein, 4 aa, Cryptosporidium parvum
SPGN

SEQ ID NO: 2282503 - protein, 39 aa, Cryptosporidium parvum
SPGNPNSNTNSIGMSGKTDQSNRQGATLSEPINDCSSEV

SEQ ID NO: 2282504 - protein, 4 aa, Cryptosporidium parvum
SPGS

SEQ ID NO: 2282505 - protein, 7 aa, Cryptosporidium parvum
SPGSSSI

SEQ ID NO: 2282506 - protein, 12 aa, Cryptosporidium parvum
SPGTGKTSISRA

SEQ ID NO: 2282507 - protein, 6 aa, Cryptosporidium parvum
SPGTTL

SEQ ID NO: 2282508 - protein, 5 aa, Cryptosporidium parvum
SPGVQ

SEQ ID NO: 2282509 - protein, 8 aa, Cryptosporidium parvum
SPHDSSPY

SEQ ID NO: 2282510 - protein, 21 aa, Cryptosporidium parvum
SPHFSDSDEFYSDSSSNSSES

SEQ ID NO: 2282511 - protein, 6 aa, Cryptosporidium parvum
SPHLPE

SEQ ID NO: 2282512 - protein, 46 aa, Cryptosporidium parvum
SPHSPQNNAYLPSNYSENQYRKRNSPPRSLREHSSKYSTSRGASSS

SEQ ID NO: 2282513 - protein, 7 aa, Cryptosporidium parvum
SPHSTNN

SEQ ID NO: 2282514 - protein, 11 aa, Cryptosporidium parvum
SPIDSQDSNYA

SEQ ID NO: 2282515 - protein, 18 aa, Cryptosporidium parvum
SPIEDHDPDQDQDRDQDY

SEQ ID NO: 2282516 - protein, 5 aa, Cryptosporidium parvum
SPIGI

SEQ ID NO: 2282517 - protein, 8 aa, Cryptosporidium parvum
SPIGPVQR

SEQ ID NO: 2282518 - protein, 8 aa, Cryptosporidium parvum
SPIGSSNQ

SEQ ID NO: 2282519 - protein, 5 aa, Cryptosporidium parvum
SPIKS

SEQ ID NO: 2282520 - protein, 6 aa, Cryptosporidium parvum
SPIKTK

SEQ ID NO: 2282521 - protein, 4 aa, Cryptosporidium parvum
SPIN

SEQ ID NO: 2282522 - protein, 8 aa, Cryptosporidium parvum
SPINSPNF

SEQ ID NO: 2282523 - protein, 4 aa, Cryptosporidium parvum
SPIP

SEQ ID NO: 2282524 - protein, 8 aa, Cryptosporidium parvum
SPIPEESK

SEQ ID NO: 2282525 - protein, 7 aa, Cryptosporidium parvum
SPIPNSL

SEQ ID NO: 2282526 - protein, 6 aa, Cryptosporidium parvum
SPIQND

SEQ ID NO: 2282527 - protein, 8 aa, Cryptosporidium parvum
SPIQRESS

SEQ ID NO: 2282528 - protein, 4 aa, Cryptosporidium parvum
SPIS

SEQ ID NO: 2282529 - protein, 13 aa, Cryptosporidium parvum
SPISEKKYTQDIV

SEQ ID NO: 2282530 - protein, 7 aa, Cryptosporidium parvum
SPKANSI

SEQ ID NO: 2282531 - protein, 4 aa, Cryptosporidium parvum
SPKD

SEQ ID NO: 2282532 - protein, 13 aa, Cryptosporidium parvum
SPKDNDERRKTIE

SEQ ID NO: 2282533 - protein, 4 aa, Cryptosporidium parvum
SPKG

SEQ ID NO: 2282534 - protein, 8 aa, Cryptosporidium parvum
SPKGNQIA

SEQ ID NO: 2282535 - protein, 7 aa, Cryptosporidium parvum
SPKKEYE

SEQ ID NO: 2282536 - protein, 11 aa, Cryptosporidium parvum
SPKKMRKTGIN

SEQ ID NO: 2282537 - protein, 9 aa, Cryptosporidium parvum
SPKKPTDVL

SEQ ID NO: 2282538 - protein, 9 aa, Cryptosporidium parvum
SPKNIKEGS

SEQ ID NO: 2282539 - protein, 32 aa, Cryptosporidium parvum; identical to SEQ ID NO: 2162686

SEQ ID NO: 2282540 - protein, 12 aa, Cryptosporidium parvum
SPKNQKDKPTEA

SEQ ID NO: 2282541 - protein, 9 aa, Cryptosporidium parvum
SPKQAETPC

SEQ ID NO: 2282542 - protein, 9 aa, Cryptosporidium parvum
SPKQISPKG

SEQ ID NO: 2282543 - protein, 4 aa, Cryptosporidium parvum
SPKS

SEQ ID NO: 2282544 - protein, 8 aa, Cryptosporidium parvum
SPKSEVPA

SEQ ID NO: 2282545 - protein, 13 aa, Cryptosporidium parvum
SPKSLEPINNTKN

SEQ ID NO: 2282546 - protein, 10 aa, Cryptosporidium parvum
SPKTADYRRS

SEQ ID NO: 2282547 - protein, 9 aa, Cryptosporidium parvum
SPKTDDSSI

SEQ ID NO: 2282548 - protein, 9 aa, Cryptosporidium parvum
SPKTKEYAS

SEQ ID NO: 2282549 - protein, 5 aa, Cryptosporidium parvum
SPLFP

SEQ ID NO: 2282550 - protein, 7 aa, Cryptosporidium parvum
SPLPESR

SEQ ID NO: 2282551 - protein, 13 aa, Cryptosporidium parvum
SPLPSSASIKGSR

SEQ ID NO: 2282552 - protein, 6 aa, Cryptosporidium parvum
SPLPTG

SEQ ID NO: 2282553 - protein, 18 aa, Cryptosporidium parvum
SPLPTGQIPSTNDPPYVS

SEQ ID NO: 2282554 - protein, 6 aa, Cryptosporidium parvum
SPLSKN

SEQ ID NO: 2282555 - protein, 13 aa, Cryptosporidium parvum
SPLSNPSTASSWK

SEQ ID NO: 2282556 - protein, 4 aa, Cryptosporidium parvum
SPLV

SEQ ID NO: 2282557 - protein, 7 aa, Cryptosporidium parvum
SPLYGED

SEQ ID NO: 2282558 - protein, 9 aa, Cryptosporidium parvum
SPMDEAKKE

SEQ ID NO: 2282559 - protein, 5 aa, Cryptosporidium parvum
SPMEA

SEQ ID NO: 2282560 - protein, 5 aa, Cryptosporidium parvum
SPMET

SEQ ID NO: 2282561 - protein, 9 aa, Cryptosporidium parvum
SPNADADEI

SEQ ID NO: 2282562 - protein, 9 aa, Cryptosporidium parvum
SPNAGAAEI

SEQ ID NO: 2282563 - protein, 4 aa, Cryptosporidium parvum
SPND

SEQ ID NO: 2282564 - protein, 4 aa, Cryptosporidium parvum
SPNE

SEQ ID NO: 2282565 - protein, 5 aa, Cryptosporidium parvum
SPNEF

SEQ ID NO: 2282566 - protein, 5 aa, Cryptosporidium parvum
SPNFE

SEQ ID NO: 2282567 - protein, 12 aa, Cryptosporidium parvum
SPNFNKEKDPKR

SEQ ID NO: 2282568 - protein, 8 aa, Cryptosporidium parvum
SPNFTSPN

SEQ ID NO: 2282569 - protein, 4 aa, Cryptosporidium parvum
SPNG

SEQ ID NO: 2282570 - protein, 5 aa, Cryptosporidium parvum
SPNGA

SEQ ID NO: 2282571 - protein, 12 aa, Cryptosporidium parvum
SPNGPDVPRPTY

SEQ ID NO: 2282572 - protein, 22 aa, Cryptosporidium parvum
SPNHEGNNSSVKKNTTAETSEE

SEQ ID NO: 2282573 - protein, 8 aa, Cryptosporidium parvum
SPNHEPEH

SEQ ID NO: 2282574 - protein, 4 aa, Cryptosporidium parvum
SPNI

SEQ ID NO: 2282575 - protein, 12 aa, Cryptosporidium parvum
SPNIDSKEEKKM

SEQ ID NO: 2282576 - protein, 5 aa, Cryptosporidium parvum
SPNIG

SEQ ID NO: 2282577 - protein, 5 aa, Cryptosporidium parvum
SPNIS

SEQ ID NO: 2282578 - protein, 9 aa, Cryptosporidium parvum
SPNLPEGDA

SEQ ID NO: 2282579 - protein, 20 aa, Cryptosporidium parvum
SPNNDNNVEVKEKESYETES

SEQ ID NO: 2282580 - protein, 5 aa, Cryptosporidium parvum
SPNNK

SEQ ID NO: 2282581 - protein, 41 aa, Cryptosporidium parvum
SPNPDSGSGDKDSGGKYTGGNGGGSINGNFDPTALERGAKA

SEQ ID NO: 2282582 - protein, 15 aa, Cryptosporidium parvum
SPNPESIPMPCGFPI

SEQ ID NO: 2282583 - protein, 22 aa, Cryptosporidium parvum
SPNSDIQNDPELCSSDSCKNYN

SEQ ID NO: 2282584 - protein, 13 aa, Cryptosporidium parvum
SPNSDITQKDDSL

SEQ ID NO: 2282585 - protein, 10 aa, Cryptosporidium parvum
SPNSEPSNIN

SEQ ID NO: 2282586 - protein, 9 aa, Cryptosporidium parvum
SPNSMQSGQ

SEQ ID NO: 2282587 - protein, 8 aa, Cryptosporidium parvum
SPNSSMPD

SEQ ID NO: 2282588 - protein, 8 aa, Cryptosporidium parvum
SPNSTVER

SEQ ID NO: 2282589 - protein, 9 aa, Cryptosporidium parvum
SPNTDIELS

SEQ ID NO: 2282590 - protein, 12 aa, Cryptosporidium parvum
SPNTRLERDNRT

SEQ ID NO: 2282591 - protein, 6 aa, Cryptosporidium parvum
SPNVKI

SEQ ID NO: 2282592 - protein, 8 aa, Cryptosporidium parvum
SPNYTDSS

SEQ ID NO: 2282593 - protein, 13 aa, Cryptosporidium parvum
SPPEKNVPESEYE

SEQ ID NO: 2282594 - protein, 16 aa, Cryptosporidium parvum
SPPGKYSSDDSNARIS

SEQ ID NO: 2282595 - protein, 4 aa, Cryptosporidium parvum
SPPK

SEQ ID NO: 2282596 - protein, 5 aa, Cryptosporidium parvum
SPPLI

SEQ ID NO: 2282597 - protein, 21 aa, Cryptosporidium parvum
SPPPGMKHANNNNSDNQQQYF

SEQ ID NO: 2282598 - protein, 6 aa, Cryptosporidium parvum
SPPSHS

SEQ ID NO: 2282599 - protein, 6 aa, Cryptosporidium parvum
SPPSSW

SEQ ID NO: 2282600 - protein, 7 aa, Cryptosporidium parvum
SPPVTGG

SEQ ID NO: 2282601 - protein, 21 aa, Cryptosporidium parvum
SPPYTSDESSHSNHQSNDRLN

SEQ ID NO: 2282602 - protein, 5 aa, Cryptosporidium parvum
SPQAE

SEQ ID NO: 2282603 - protein, 8 aa, Cryptosporidium parvum
SPQFRKGT

SEQ ID NO: 2282604 - protein, 24 aa, Cryptosporidium parvum
SPQGEGISSGNRISDSQRGGAGGM

SEQ ID NO: 2282605 - protein, 7 aa, Cryptosporidium parvum
SPQGNKP

SEQ ID NO: 2282606 - protein, 10 aa, Cryptosporidium parvum
SPQGRGAEAE

SEQ ID NO: 2282607 - protein, 5 aa, Cryptosporidium parvum
SPQIV

SEQ ID NO: 2282608 - protein, 11 aa, Cryptosporidium parvum
SPQKDEDAQRG

SEQ ID NO: 2282609 - protein, 5 aa, Cryptosporidium parvum
SPQLS

SEQ ID NO: 2282610 - protein, 9 aa, Cryptosporidium parvum
SPQNNQKPK

SEQ ID NO: 2282611 - protein, 8 aa, Cryptosporidium parvum
SPQPVSAV

SEQ ID NO: 2282612 - protein, 4 aa, Cryptosporidium parvum
SPQQ

SEQ ID NO: 2282613 - protein, 6 aa, Cryptosporidium parvum
SPQQTD

SEQ ID NO: 2282614 - protein, 14 aa, Cryptosporidium parvum
SPRGCRKENVKKDQ

SEQ ID NO: 2282615 - protein, 4 aa, Cryptosporidium parvum
SPRI

SEQ ID NO: 2282616 - protein, 6 aa, Cryptosporidium parvum
SPRIDS

SEQ ID NO: 2282617 - protein, 19 aa, Cryptosporidium parvum
SPRITPNFGDENDSLLPNR

SEQ ID NO: 2282618 - protein, 5 aa, Cryptosporidium parvum
SPRKI

SEQ ID NO: 2282619 - protein, 4 aa, Cryptosporidium parvum
SPRL

SEQ ID NO: 2282620 - protein, 12 aa, Cryptosporidium parvum
SPRLSSTPNPRK

SEQ ID NO: 2282621 - protein, 4 aa, Cryptosporidium parvum
SPRM

SEQ ID NO: 2282622 - protein, 4 aa, Cryptosporidium parvum
SPRN

SEQ ID NO: 2282623 - protein, 8 aa, Cryptosporidium parvum
SPRPTITD

SEQ ID NO: 2282624 - protein, 8 aa, Cryptosporidium parvum
SPRQFSTG

SEQ ID NO: 2282625 - protein, 10 aa, Cryptosporidium parvum
SPRSDASPNT

SEQ ID NO: 2282626 - protein, 8 aa, Cryptosporidium parvum
SPRSSPDV

SEQ ID NO: 2282627 - protein, 6 aa, Cryptosporidium parvum
SPRSTP

SEQ ID NO: 2282628 - protein, 5 aa, Cryptosporidium parvum
SPRYK

SEQ ID NO: 2282629 - protein, 18 aa, Cryptosporidium parvum
SPSAEKPYIATGSDDKTV

SEQ ID NO: 2282630 - protein, 22 aa, Cryptosporidium parvum
SPSAVSNSQNEPSKGNSSAHNL

SEQ ID NO: 2282631 - protein, 6 aa, Cryptosporidium parvum
SPSDDV

SEQ ID NO: 2282632 - protein, 13 aa, Cryptosporidium parvum
SPSDTYQSKKGKI

SEQ ID NO: 2282633 - protein, 7 aa, Cryptosporidium parvum
SPSEAIH

SEQ ID NO: 2282634 - protein, 5 aa, Cryptosporidium parvum
SPSEN

SEQ ID NO: 2282635 - protein, 13 aa, Cryptosporidium parvum
SPSETNKPTSKVS

SEQ ID NO: 2282636 - protein, 8 aa, Cryptosporidium parvum
SPSEWPGT

SEQ ID NO: 2282637 - protein, 6 aa, Cryptosporidium parvum
SPSFEA

SEQ ID NO: 2282638 - protein, 5 aa, Cryptosporidium parvum
SPSHV

SEQ ID NO: 2282639 - protein, 4 aa, Cryptosporidium parvum
SPSI

SEQ ID NO: 2282640 - protein, 5 aa, Cryptosporidium parvum
SPSIA

SEQ ID NO: 2282641 - protein, 10 aa, Cryptosporidium parvum
SPSISFPSDE

SEQ ID NO: 2282642 - protein, 35 aa, Cryptosporidium parvum
SPSISSPSSTPTSIPSPHSPTVSKSSSKSSISTSS

SEQ ID NO: 2282643 - protein, 9 aa, Cryptosporidium parvum
SPSKNETNI

SEQ ID NO: 2282644 - protein, 8 aa, Cryptosporidium parvum
SPSLPSLD

SEQ ID NO: 2282645 - protein, 6 aa, Cryptosporidium parvum
SPSLYS

SEQ ID NO: 2282646 - protein, 6 aa, Cryptosporidium parvum
SPSNAA

SEQ ID NO: 2282647 - protein, 7 aa, Cryptosporidium parvum
SPSNIQK

SEQ ID NO: 2282648 - protein, 10 aa, Cryptosporidium parvum
SPSNNGIQQK

SEQ ID NO: 2282649 - protein, 6 aa, Cryptosporidium parvum
SPSPFD

SEQ ID NO: 2282650 - protein, 9 aa, Cryptosporidium parvum
SPSPTPEDI

SEQ ID NO: 2282651 - protein, 4 aa, Cryptosporidium parvum
SPSR

SEQ ID NO: 2282652 - protein, 13 aa, Cryptosporidium parvum
SPSRSISSPIKSS

SEQ ID NO: 2282653 - protein, 39 aa, Cryptosporidium parvum; identical to SEQ ID NO: 2162781

SEQ ID NO: 2282654 - protein, 5 aa, Cryptosporidium parvum
SPSSG

SEQ ID NO: 2282655 - protein, 12 aa, Cryptosporidium parvum
SPSSKAFEESHN

SEQ ID NO: 2282656 - protein, 6 aa, Cryptosporidium parvum
SPSSLN

SEQ ID NO: 2282657 - protein, 7 aa, Cryptosporidium parvum
SPSSSEI

SEQ ID NO: 2282658 - protein, 7 aa, Cryptosporidium parvum
SPSTSPY

SEQ ID NO: 2282659 - protein, 7 aa, Cryptosporidium parvum
SPSTSQP

SEQ ID NO: 2282660 - protein, 15 aa, Cryptosporidium parvum
SPSTVGGKVSGKTSI

SEQ ID NO: 2282661 - protein, 6 aa, Cryptosporidium parvum
SPSYNF

SEQ ID NO: 2282662 - protein, 5 aa, Cryptosporidium parvum
SPSYT

SEQ ID NO: 2282663 - protein, 6 aa, Cryptosporidium parvum
SPTAFK

SEQ ID NO: 2282664 - protein, 8 aa, Cryptosporidium parvum
SPTEDQCN

SEQ ID NO: 2282665 - protein, 19 aa, Cryptosporidium parvum
SPTEQHDESKFKDPETGAE

SEQ ID NO: 2282666 - protein, 4 aa, Cryptosporidium parvum
SPTG

SEQ ID NO: 2282667 - protein, 8 aa, Cryptosporidium parvum
SPTGTGKT

SEQ ID NO: 2282668 - protein, 9 aa, Cryptosporidium parvum
SPTKSGINV

SEQ ID NO: 2282669 - protein, 6 aa, Cryptosporidium parvum
SPTLER

SEQ ID NO: 2282670 - protein, 16 aa, Cryptosporidium parvum
SPTLSMESSENSQDSE

SEQ ID NO: 2282671 - protein, 7 aa, Cryptosporidium parvum
SPTLTPN

SEQ ID NO: 2282672 - protein, 5 aa, Cryptosporidium parvum
SPTNL

SEQ ID NO: 2282673 - protein, 7 aa, Cryptosporidium parvum
SPTQDPI

SEQ ID NO: 2282674 - protein, 13 aa, Cryptosporidium parvum
SPTQKKNLNGRNS

SEQ ID NO: 2282675 - protein, 24 aa, Cryptosporidium parvum
SPVEQKSNMENKGEKNPNETANSN

SEQ ID NO: 2282676 - protein, 6 aa, Cryptosporidium parvum
SPVGRN

SEQ ID NO: 2282677 - protein, 10 aa, Cryptosporidium parvum
SPVKEPNIKN

SEQ ID NO: 2282678 - protein, 20 aa, Cryptosporidium parvum
SPVNRTLDTTTSEVSTIPSA

SEQ ID NO: 2282679 - protein, 6 aa, Cryptosporidium parvum
SPVNSN

SEQ ID NO: 2282680 - protein, 14 aa, Cryptosporidium parvum
SPVSEYSSEIESKS

SEQ ID NO: 2282681 - protein, 17 aa, Cryptosporidium parvum
SPWSSSKPAQPESETNE

SEQ ID NO: 2282682 - protein, 4 aa, Cryptosporidium parvum
SPYN

SEQ ID NO: 2282683 - protein, 7 aa, Cryptosporidium parvum
SPYSSSI

SEQ ID NO: 2282684 - protein, 27 aa, Cryptosporidium parvum
SQADSGKRNKIPSEKASIKPTSTKSDE

SEQ ID NO: 2282685 - protein, 6 aa, Cryptosporidium parvum
SQADYQ

SEQ ID NO: 2282686 - protein, 13 aa, Cryptosporidium parvum
SQAKSINKSLPKE

SEQ ID NO: 2282687 - protein, 5 aa, Cryptosporidium parvum
SQALG

SEQ ID NO: 2282688 - protein, 10 aa, Cryptosporidium parvum
SQALNDGENR

SEQ ID NO: 2282689 - protein, 8 aa, Cryptosporidium parvum
SQANKITK

SEQ ID NO: 2282690 - protein, 5 aa, Cryptosporidium parvum
SQARK

SEQ ID NO: 2282691 - protein, 14 aa, Cryptosporidium parvum
SQASKSDKIKNANF

SEQ ID NO: 2282692 - protein, 10 aa, Cryptosporidium parvum
SQATSSNPME

SEQ ID NO: 2282693 - protein, 4 aa, Cryptosporidium parvum
SQAV

SEQ ID NO: 2282694 - protein, 25 aa, Cryptosporidium parvum
SQCQSQLQSQSQSQIYNQSQTNMSD

SEQ ID NO: 2282695 - protein, 9 aa, Cryptosporidium parvum
SQDCNEGYQ

SEQ ID NO: 2282696 - protein, 9 aa, Cryptosporidium parvum
SQDDNLAPN

SEQ ID NO: 2282697 - protein, 7 aa, Cryptosporidium parvum
SQDKERF

SEQ ID NO: 2282698 - protein, 6 aa, Cryptosporidium parvum
SQDKPY

SEQ ID NO: 2282699 - protein, 8 aa, Cryptosporidium parvum
SQDKSMQE

SEQ ID NO: 2282700 - protein, 5 aa, Cryptosporidium parvum
SQDKT

SEQ ID NO: 2282701 - protein, 7 aa, Cryptosporidium parvum
SQDLESN

SEQ ID NO: 2282702 - protein, 9 aa, Cryptosporidium parvum
SQDNVPGSA

SEQ ID NO: 2282703 - protein, 11 aa, Cryptosporidium parvum
SQDSELKDNPF

SEQ ID NO: 2282704 - protein, 20 aa, Cryptosporidium parvum
SQDSSPNRDLDDSGSDLDED

SEQ ID NO: 2282705 - protein, 23 aa, Cryptosporidium parvum
SQDTTASTSGSLSIQEEQSRTLS

SEQ ID NO: 2282706 - protein, 6 aa, Cryptosporidium parvum
SQEAGM

SEQ ID NO: 2282707 - protein, 10 aa, Cryptosporidium parvum
SQEASKEVEK

SEQ ID NO: 2282708 - protein, 15 aa, Cryptosporidium parvum
SQEEDIVKKESQPKF

SEQ ID NO: 2282709 - protein, 9 aa, Cryptosporidium parvum
SQEEEQTNF

SEQ ID NO: 2282710 - protein, 8 aa, Cryptosporidium parvum
SQEEGESL

SEQ ID NO: 2282711 - protein, 6 aa, Cryptosporidium parvum
SQEEGM

SEQ ID NO: 2282712 - protein, 7 aa, Cryptosporidium parvum
SQEIRNK

SEQ ID NO: 2282713 - protein, 4 aa, Cryptosporidium parvum
SQEK

SEQ ID NO: 2282714 - protein, 9 aa, Cryptosporidium parvum
SQEKKNEDI

SEQ ID NO: 2282715 - protein, 11 aa, Cryptosporidium parvum
SQEMEEDNESS

SEQ ID NO: 2282716 - protein, 26 aa, Cryptosporidium parvum
SQEMEYRNNKVGDNLSDNDSNDEDLD

SEQ ID NO: 2282717 - protein, 9 aa, Cryptosporidium parvum
SQENAYKSS

SEQ ID NO: 2282718 - protein, 14 aa, Cryptosporidium parvum
SQENISKTNSSSSI

SEQ ID NO: 2282719 - protein, 8 aa, Cryptosporidium parvum
SQENRSSL

SEQ ID NO: 2282720 - protein, 4 aa, Cryptosporidium parvum
SQES

SEQ ID NO: 2282721 - protein, 6 aa, Cryptosporidium parvum
SQESAE

SEQ ID NO: 2282722 - protein, 8 aa, Cryptosporidium parvum
SQESKRIE

SEQ ID NO: 2282723 - protein, 11 aa, Cryptosporidium parvum
SQESPNNPYDR

SEQ ID NO: 2282724 - protein, 4 aa, Cryptosporidium parvum
SQET

SEQ ID NO: 2282725 - protein, 13 aa, Cryptosporidium parvum
SQETENKEANQEA

SEQ ID NO: 2282726 - protein, 5 aa, Cryptosporidium parvum
SQETL

SEQ ID NO: 2282727 - protein, 13 aa, Cryptosporidium parvum
SQFEEQESKEKDE

SEQ ID NO: 2282728 - protein, 18 aa, Cryptosporidium parvum
SQFENNAEVDDTTPTTTI

SEQ ID NO: 2282729 - protein, 10 aa, Cryptosporidium parvum
SQFGSQSPQE

SEQ ID NO: 2282730 - protein, 11 aa, Cryptosporidium parvum
SQFNKDETSNS

SEQ ID NO: 2282731 - protein, 13 aa, Cryptosporidium parvum
SQFNNNSSLYNPN

SEQ ID NO: 2282732 - protein, 7 aa, Cryptosporidium parvum
SQFPPLP

SEQ ID NO: 2282733 - protein, 11 aa, Cryptosporidium parvum
SQFQSGPMDNI

SEQ ID NO: 2282734 - protein, 9 aa, Cryptosporidium parvum
SQGAGQKDK

SEQ ID NO: 2282735 - protein, 10 aa, Cryptosporidium parvum
SQGGCKENQD

SEQ ID NO: 2282736 - protein, 13 aa, Cryptosporidium parvum
SQGHKVKTDGDHI

SEQ ID NO: 2282737 - protein, 8 aa, Cryptosporidium parvum
SQGIGNAN

SEQ ID NO: 2282738 - protein, 21 aa, Cryptosporidium parvum
SQGISGSGSGTNHEQLPNTEY

SEQ ID NO: 2282739 - protein, 12 aa, Cryptosporidium parvum
SQGKQGDRAARA

SEQ ID NO: 2282740 - protein, 6 aa, Cryptosporidium parvum
SQGNPM

SEQ ID NO: 2282741 - protein, 15 aa, Cryptosporidium parvum
SQGPDKSNPKSTAPL

SEQ ID NO: 2282742 - protein, 8 aa, Cryptosporidium parvum
SQGPYEKR

SEQ ID NO: 2282743 - protein, 13 aa, Cryptosporidium parvum
SQGSPNKKKVNED

SEQ ID NO: 2282744 - protein, 8 aa, Cryptosporidium parvum
SQGSSHEE

SEQ ID NO: 2282745 - protein, 8 aa, Cryptosporidium parvum
SQGSSHEW

SEQ ID NO: 2282746 - protein, 10 aa, Cryptosporidium parvum
SQGSVDSKEE

SEQ ID NO: 2282747 - protein, 10 aa, Cryptosporidium parvum
SQGTGSNISN

SEQ ID NO: 2282748 - protein, 5 aa, Cryptosporidium parvum
SQHDA

SEQ ID NO: 2282749 - protein, 14 aa, Cryptosporidium parvum
SQHELKQQKSSINA

SEQ ID NO: 2282750 - protein, 9 aa, Cryptosporidium parvum
SQHGDEKNS

SEQ ID NO: 2282751 - protein, 10 aa, Cryptosporidium parvum
SQHKKPNKLK

SEQ ID NO: 2282752 - protein, 5 aa, Cryptosporidium parvum
SQIDT

SEQ ID NO: 2282753 - protein, 24 aa, Cryptosporidium parvum
SQIGSSSNNINGTGNVNTLNTGIG

SEQ ID NO: 2282754 - protein, 9 aa, Cryptosporidium parvum
SQIKDDQTN

SEQ ID NO: 2282755 - protein, 14 aa, Cryptosporidium parvum
SQINQSKKNNKVTT

SEQ ID NO: 2282756 - protein, 8 aa, Cryptosporidium parvum
SQINSGEI

SEQ ID NO: 2282757 - protein, 34 aa, Cryptosporidium parvum
SQIQDHGQTQDQGQTQDQGQIQDQGQIQDHGQTQ

SEQ ID NO: 2282758 - protein, 20 aa, Cryptosporidium parvum
SQIQKEKTASDESEDGNSIQ

SEQ ID NO: 2282759 - protein, 6 aa, Cryptosporidium parvum
SQISDG

SEQ ID NO: 2282760 - protein, 8 aa, Cryptosporidium parvum
SQISEENP

SEQ ID NO: 2282761 - protein, 6 aa, Cryptosporidium parvum
SQISND

SEQ ID NO: 2282762 - protein, 13 aa, Cryptosporidium parvum
SQKDSSSSKMRQE

SEQ ID NO: 2282763 - protein, 10 aa, Cryptosporidium parvum
SQKEGTVNSG

SEQ ID NO: 2282764 - protein, 11 aa, Cryptosporidium parvum
SQKENPTPKIN

SEQ ID NO: 2282765 - protein, 27 aa, Cryptosporidium parvum
SQKFENVTENNRIRTKNRKKGLISSTN

SEQ ID NO: 2282766 - protein, 4 aa, Cryptosporidium parvum
SQKG

SEQ ID NO: 2282767 - protein, 7 aa, Cryptosporidium parvum
SQKISKS

SEQ ID NO: 2282768 - protein, 11 aa, Cryptosporidium parvum
SQKNASEKTKL

SEQ ID NO: 2282769 - protein, 10 aa, Cryptosporidium parvum
SQKNSNKSWL

SEQ ID NO: 2282770 - protein, 8 aa, Cryptosporidium parvum
SQKNSNYA

SEQ ID NO: 2282771 - protein, 8 aa, Cryptosporidium parvum
SQKNTDEK

SEQ ID NO: 2282772 - protein, 20 aa, Cryptosporidium parvum
SQKSNNTDSTAKSNKSKTPF

SEQ ID NO: 2282773 - protein, 9 aa, Cryptosporidium parvum
SQKSSANSL

SEQ ID NO: 2282774 - protein, 15 aa, Cryptosporidium parvum
SQKSSISRTPGKTKH

SEQ ID NO: 2282775 - protein, 11 aa, Cryptosporidium parvum
SQLERQRKHGY

SEQ ID NO: 2282776 - protein, 7 aa, Cryptosporidium parvum
SQLFQDE

SEQ ID NO: 2282777 - protein, 20 aa, Cryptosporidium parvum
SQLGNSTDGLTGGPIRSSDK

SEQ ID NO: 2282778 - protein, 22 aa, Cryptosporidium parvum
SQLKKEPKSYEGTVPDELPAIS

SEQ ID NO: 2282779 - protein, 4 aa, Cryptosporidium parvum
SQLN

SEQ ID NO: 2282780 - protein, 9 aa, Cryptosporidium parvum
SQLNESKSS

SEQ ID NO: 2282781 - protein, 22 aa, Cryptosporidium parvum
SQLQTNKDQANIPQEEDEEELD

SEQ ID NO: 2282782 - protein, 6 aa, Cryptosporidium parvum
SQLRGV

SEQ ID NO: 2282783 - protein, 36 aa, Cryptosporidium parvum
SQLSKKQKTKSQSSTHSSVTSTSTSTPRSRPTRPKA

SEQ ID NO: 2282784 - protein, 8 aa, Cryptosporidium parvum
SQLSNESN

SEQ ID NO: 2282785 - protein, 6 aa, Cryptosporidium parvum
SQLTSN

SEQ ID NO: 2282786 - protein, 5 aa, Cryptosporidium parvum
SQMAE

SEQ ID NO: 2282787 - protein, 11 aa, Cryptosporidium parvum
SQMDISNSQSS

SEQ ID NO: 2282788 - protein, 7 aa, Cryptosporidium parvum
SQNCGSS

SEQ ID NO: 2282789 - protein, 10 aa, Cryptosporidium parvum
SQNDEEDNEI

SEQ ID NO: 2282790 - protein, 8 aa, Cryptosporidium parvum
SQNDGKWG

SEQ ID NO: 2282791 - protein, 8 aa, Cryptosporidium parvum
SQNDSSRL

SEQ ID NO: 2282792 - protein, 6 aa, Cryptosporidium parvum
SQNEDE

SEQ ID NO: 2282793 - protein, 7 aa, Cryptosporidium parvum
SQNEIKG

SEQ ID NO: 2282794 - protein, 8 aa, Cryptosporidium parvum
SQNEKNEY

SEQ ID NO: 2282795 - protein, 8 aa, Cryptosporidium parvum
SQNESSTI

SEQ ID NO: 2282796 - protein, 14 aa, Cryptosporidium parvum
SQNFDSASGNPRRI

SEQ ID NO: 2282797 - protein, 7 aa, Cryptosporidium parvum
SQNGLEK

SEQ ID NO: 2282798 - protein, 5 aa, Cryptosporidium parvum
SQNID

SEQ ID NO: 2282799 - protein, 13 aa, Cryptosporidium parvum
SQNIQDTNSQASG

SEQ ID NO: 2282800 - protein, 8 aa, Cryptosporidium parvum
SQNKESNL

SEQ ID NO: 2282801 - protein, 5 aa, Cryptosporidium parvum
SQNKI

SEQ ID NO: 2282802 - protein, 6 aa, Cryptosporidium parvum
SQNKNN

SEQ ID NO: 2282803 - protein, 11 aa, Cryptosporidium parvum
SQNLRKRSLPK

SEQ ID NO: 2282804 - protein, 8 aa, Cryptosporidium parvum
SQNLSQAD

SEQ ID NO: 2282805 - protein, 12 aa, Cryptosporidium parvum
SQNNDKSINSKK

SEQ ID NO: 2282806 - protein, 79 aa, Cryptosporidium parvum
SQNNGKNNLDGSELHDNSEISHEEDDSTQEEEEEEEEEEEEEEEEEEEEDDDDDDDEYNCRNQDQDNSDNEHQEEEEYD

SEQ ID NO: 2282807 - protein, 6 aa, Cryptosporidium parvum
SQNNGY

SEQ ID NO: 2282808 - protein, 13 aa, Cryptosporidium parvum
SQNNHETQSIHEQ

SEQ ID NO: 2282809 - protein, 8 aa, Cryptosporidium parvum
SQNNLSGN

SEQ ID NO: 2282810 - protein, 26 aa, Cryptosporidium parvum
SQNNNTNGETPGRNDNEGEEGTSASS

SEQ ID NO: 2282811 - protein, 6 aa, Cryptosporidium parvum
SQNNQI

SEQ ID NO: 2282812 - protein, 6 aa, Cryptosporidium parvum
SQNNRS

SEQ ID NO: 2282813 - protein, 15 aa, Cryptosporidium parvum
SQNQNNSNSNSTIGI

SEQ ID NO: 2282814 - protein, 12 aa, Cryptosporidium parvum
SQNQVKSSVQRS

SEQ ID NO: 2282815 - protein, 10 aa, Cryptosporidium parvum
SQNSGGNDIK

SEQ ID NO: 2282816 - protein, 26 aa, Cryptosporidium parvum
SQNSNDNVNGNNESNTDDNSNNNNDV

SEQ ID NO: 2282817 - protein, 15 aa, Cryptosporidium parvum
SQNSRLTGNNTSENL

SEQ ID NO: 2282818 - protein, 9 aa, Cryptosporidium parvum
SQNSSKRKV

SEQ ID NO: 2282819 - protein, 20 aa, Cryptosporidium parvum
SQNSYNGFGGIPNNNNFGNI

SEQ ID NO: 2282820 - protein, 15 aa, Cryptosporidium parvum
SQNVSKDSESEEEPI

SEQ ID NO: 2282821 - protein, 5 aa, Cryptosporidium parvum
SQNYD

SEQ ID NO: 2282822 - protein, 8 aa, Cryptosporidium parvum
SQPAQNNQ

SEQ ID NO: 2282823 - protein, 10 aa, Cryptosporidium parvum
SQPENPEDAL

SEQ ID NO: 2282824 - protein, 32 aa, Cryptosporidium parvum
SQPIDQRSINTGTSETLVSKDTTKQSSGSNIR

SEQ ID NO: 2282825 - protein, 5 aa, Cryptosporidium parvum
SQPIQ

SEQ ID NO: 2282826 - protein, 9 aa, Cryptosporidium parvum
SQPLPETET

SEQ ID NO: 2282827 - protein, 5 aa, Cryptosporidium parvum
SQPNE

SEQ ID NO: 2282828 - protein, 4 aa, Cryptosporidium parvum
SQPP

SEQ ID NO: 2282829 - protein, 7 aa, Cryptosporidium parvum
SQPSNID

SEQ ID NO: 2282830 - protein, 10 aa, Cryptosporidium parvum
SQPYPQPHQN

SEQ ID NO: 2282831 - protein, 4 aa, Cryptosporidium parvum
SQQE

SEQ ID NO: 2282832 - protein, 6 aa, Cryptosporidium parvum
SQQENE

SEQ ID NO: 2282833 - protein, 20 aa, Cryptosporidium parvum
SQQERPESGNEQRNSINSSN

SEQ ID NO: 2282834 - protein, 4 aa, Cryptosporidium parvum
SQQL

SEQ ID NO: 2282835 - protein, 7 aa, Cryptosporidium parvum
SQQNLRD

SEQ ID NO: 2282836 - protein, 7 aa, Cryptosporidium parvum
SQQNSIS

SEQ ID NO: 2282837 - protein, 10 aa, Cryptosporidium parvum
SQQNTALQTN

SEQ ID NO: 2282838 - protein, 6 aa, Cryptosporidium parvum
SQQNVQ

SEQ ID NO: 2282839 - protein, 10 aa, Cryptosporidium parvum
SQQQQQHQHQ

SEQ ID NO: 2282840 - protein, 7 aa, Cryptosporidium parvum
SQQSQGV

SEQ ID NO: 2282841 - protein, 7 aa, Cryptosporidium parvum
SQQSSSM

SEQ ID NO: 2282842 - protein, 6 aa, Cryptosporidium parvum
SQQTNN

SEQ ID NO: 2282843 - protein, 14 aa, Cryptosporidium parvum
SQQTQIPQQRPGTV

SEQ ID NO: 2282844 - protein, 10 aa, Cryptosporidium parvum
SQQYNKPGSC

SEQ ID NO: 2282845 - protein, 6 aa, Cryptosporidium parvum
SQRAAQ

SEQ ID NO: 2282846 - protein, 18 aa, Cryptosporidium parvum
SQRARKSDLIQSIISFQG

SEQ ID NO: 2282847 - protein, 9 aa, Cryptosporidium parvum
SQRATGGTS

SEQ ID NO: 2282848 - protein, 5 aa, Cryptosporidium parvum
SQRDI

SEQ ID NO: 2282849 - protein, 5 aa, Cryptosporidium parvum
SQRGR

SEQ ID NO: 2282850 - protein, 10 aa, Cryptosporidium parvum
SQRIKSAKEA

SEQ ID NO: 2282851 - protein, 7 aa, Cryptosporidium parvum
SQRISDS

SEQ ID NO: 2282852 - protein, 25 aa, Cryptosporidium parvum
SQRKEGRSGAGTLESEEGNAVSNSG

SEQ ID NO: 2282853 - protein, 5 aa, Cryptosporidium parvum
SQRKL

SEQ ID NO: 2282854 - protein, 18 aa, Cryptosporidium parvum
SQRKSIDELSSELSTPST

SEQ ID NO: 2282855 - protein, 8 aa, Cryptosporidium parvum
SQRNSSLP

SEQ ID NO: 2282856 - protein, 5 aa, Cryptosporidium parvum
SQRPT

SEQ ID NO: 2282857 - protein, 9 aa, Cryptosporidium parvum
SQRSDQNLY

SEQ ID NO: 2282858 - protein, 6 aa, Cryptosporidium parvum
SQRTQR

SEQ ID NO: 2282859 - protein, 5 aa, Cryptosporidium parvum
SQSDG

SEQ ID NO: 2282860 - protein, 12 aa, Cryptosporidium parvum
SQSGVANYDQSK

SEQ ID NO: 2282861 - protein, 9 aa, Cryptosporidium parvum
SQSHNQKMG

SEQ ID NO: 2282862 - protein, 8 aa, Cryptosporidium parvum
SQSHSKSV

SEQ ID NO: 2282863 - protein, 21 aa, Cryptosporidium parvum
SQSHSNNFNPNSSQSSSKQNL

SEQ ID NO: 2282864 - protein, 4 aa, Cryptosporidium parvum
SQSI

SEQ ID NO: 2282865 - protein, 9 aa, Cryptosporidium parvum
SQSKHEFND

SEQ ID NO: 2282866 - protein, 5 aa, Cryptosporidium parvum
SQSLG

SEQ ID NO: 2282867 - protein, 6 aa, Cryptosporidium parvum
SQSLSS

SEQ ID NO: 2282868 - protein, 4 aa, Cryptosporidium parvum
SQSN

SEQ ID NO: 2282869 - protein, 14 aa, Cryptosporidium parvum
SQSNEEKKLNEEES

SEQ ID NO: 2282870 - protein, 10 aa, Cryptosporidium parvum
SQSNEKPISE

SEQ ID NO: 2282871 - protein, 9 aa, Cryptosporidium parvum
SQSNVDTSH

SEQ ID NO: 2282872 - protein, 20 aa, Cryptosporidium parvum
SQSPLVSPAVSSKKNRKEVE

SEQ ID NO: 2282873 - protein, 24 aa, Cryptosporidium parvum
SQSPPPGKTLTPSQSSSNESNPIR

SEQ ID NO: 2282874 - protein, 5 aa, Cryptosporidium parvum
SQSQK

SEQ ID NO: 2282875 - protein, 10 aa, Cryptosporidium parvum
SQSQKKSQSK

SEQ ID NO: 2282876 - protein, 13 aa, Cryptosporidium parvum
SQSQNSISSQNSM

SEQ ID NO: 2282877 - protein, 23 aa, Cryptosporidium parvum
SQSQPQSRSHLQSQSLPGPQSQT

SEQ ID NO: 2282878 - protein, 19 aa, Cryptosporidium parvum
SQSQSQSQSQSQSQNQSQC

SEQ ID NO: 2282879 - protein, 41 aa, Cryptosporidium parvum
SQSQTQNQTQTKTQAQIHSQSHSQSHVKAPNQTQTQTQVHS

SEQ ID NO: 2282880 - protein, 4 aa, Cryptosporidium parvum
SQSR

SEQ ID NO: 2282881 - protein, 20 aa, Cryptosporidium parvum
SQSRKKKLTQTSHENGTEIA

SEQ ID NO: 2282882 - protein, 4 aa, Cryptosporidium parvum
SQSS

SEQ ID NO: 2282883 - protein, 9 aa, Cryptosporidium parvum
SQSSDHRMG

SEQ ID NO: 2282884 - protein, 21 aa, Cryptosporidium parvum
SQSSGRLENTSNGDKTSISLR

SEQ ID NO: 2282885 - protein, 7 aa, Cryptosporidium parvum
SQSSNIE

SEQ ID NO: 2282886 - protein, 7 aa, Cryptosporidium parvum
SQSSPFN

SEQ ID NO: 2282887 - protein, 5 aa, Cryptosporidium parvum
SQSSQ

SEQ ID NO: 2282888 - protein, 7 aa, Cryptosporidium parvum
SQSSTFS

SEQ ID NO: 2282889 - protein, 7 aa, Cryptosporidium parvum
SQSVGKT

SEQ ID NO: 2282890 - protein, 4 aa, Cryptosporidium parvum
SQTD

SEQ ID NO: 2282891 - protein, 7 aa, Cryptosporidium parvum
SQTDSQV

SEQ ID NO: 2282892 - protein, 17 aa, Cryptosporidium parvum
SQTDSVKQNSSITPREY

SEQ ID NO: 2282893 - protein, 5 aa, Cryptosporidium parvum
SQTND

SEQ ID NO: 2282894 - protein, 5 aa, Cryptosporidium parvum
SQTNN

SEQ ID NO: 2282895 - protein, 6 aa, Cryptosporidium parvum
SQTNNC

SEQ ID NO: 2282896 - protein, 38 aa, Cryptosporidium parvum
SQTNNDETSSVEAQSYSSDFSNDEDFDINNSSTTNTNR

SEQ ID NO: 2282897 - protein, 27 aa, Cryptosporidium parvum
SQTNQTNTIPHSDIGTETSLPQPEDSA

SEQ ID NO: 2282898 - protein, 11 aa, Cryptosporidium parvum
SQTPSNTQEPI

SEQ ID NO: 2282899 - protein, 17 aa, Cryptosporidium parvum
SQTQAQQMYPNSSQNSH

SEQ ID NO: 2282900 - protein, 7 aa, Cryptosporidium parvum
SQTSGVN

SEQ ID NO: 2282901 - protein, 4 aa, Cryptosporidium parvum
SQTV

SEQ ID NO: 2282902 - protein, 10 aa, Cryptosporidium parvum
SQTYANPDFD

SEQ ID NO: 2282903 - protein, 11 aa, Cryptosporidium parvum
SQVEEDLTHPS

SEQ ID NO: 2282904 - protein, 6 aa, Cryptosporidium parvum
SQVESG

SEQ ID NO: 2282905 - protein, 7 aa, Cryptosporidium parvum
SQVGPQM

SEQ ID NO: 2282906 - protein, 10 aa, Cryptosporidium parvum
SQVNQKNISN

SEQ ID NO: 2282907 - protein, 9 aa, Cryptosporidium parvum
SQVQGRKNF

SEQ ID NO: 2282908 - protein, 49 aa, Cryptosporidium parvum
SQVTAEGRHLPNGAVGSSSKRARMAERKAAAAAAAAAAAAASAAPDAPR

SEQ ID NO: 2282909 - protein, 5 aa, Cryptosporidium parvum
SQVTE

SEQ ID NO: 2282910 - protein, 6 aa, Cryptosporidium parvum
SQVTPN

SEQ ID NO: 2282911 - protein, 11 aa, Cryptosporidium parvum
SQVTQNAENSN

SEQ ID NO: 2282912 - protein, 14 aa, Cryptosporidium parvum
SQVVAKSDMDSGQI

SEQ ID NO: 2282913 - protein, 12 aa, Cryptosporidium parvum
SQWPNKDGRFSQ

SEQ ID NO: 2282914 - protein, 4 aa, Cryptosporidium parvum
SQYK

SEQ ID NO: 2282915 - protein, 10 aa, Cryptosporidium parvum
SQYKPRINPK

SEQ ID NO: 2282916 - protein, 4 aa, Cryptosporidium parvum
SQYN

SEQ ID NO: 2282917 - protein, 6 aa, Cryptosporidium parvum
SQYPSP

SEQ ID NO: 2282918 - protein, 12 aa, Cryptosporidium parvum
SQYQDGYTKDST

SEQ ID NO: 2282919 - protein, 8 aa, Cryptosporidium parvum
SQYQEQDL

SEQ ID NO: 2282920 - protein, 4 aa, Cryptosporidium parvum
SQYS

SEQ ID NO: 2282921 - protein, 6 aa, Cryptosporidium parvum
SRAEST

SEQ ID NO: 2282922 - protein, 4 aa, Cryptosporidium parvum
SRAP

SEQ ID NO: 2282923 - protein, 19 aa, Cryptosporidium parvum
SRARENETNDAHQEKDKKD

SEQ ID NO: 2282924 - protein, 7 aa, Cryptosporidium parvum
SRARKKV

SEQ ID NO: 2282925 - protein, 7 aa, Cryptosporidium parvum
SRARRKN

SEQ ID NO: 2282926 - protein, 12 aa, Cryptosporidium parvum
SRASQGSYIASQ

SEQ ID NO: 2282927 - protein, 28 aa, Cryptosporidium parvum
SRCPQSYTSQEPPVENETEKGDTNSNTL

SEQ ID NO: 2282928 - protein, 6 aa, Cryptosporidium parvum
SRDELE

SEQ ID NO: 2282929 - protein, 6 aa, Cryptosporidium parvum
SRDGNG

SEQ ID NO: 2282930 - protein, 4 aa, Cryptosporidium parvum
SRDH

SEQ ID NO: 2282931 - protein, 14 aa, Cryptosporidium parvum
SRDKLRRSSGVSKE

SEQ ID NO: 2282932 - protein, 10 aa, Cryptosporidium parvum
SRDLDPDSIS

SEQ ID NO: 2282933 - protein, 12 aa, Cryptosporidium parvum
SRDLDSGTGLFG

SEQ ID NO: 2282934 - protein, 8 aa, Cryptosporidium parvum
SRDNFTTT

SEQ ID NO: 2282935 - protein, 10 aa, Cryptosporidium parvum
SRDNNIDKKI

SEQ ID NO: 2282936 - protein, 8 aa, Cryptosporidium parvum
SRDPEGTR

SEQ ID NO: 2282937 - protein, 16 aa, Cryptosporidium parvum
SRDQLVENQTKPVISE

SEQ ID NO: 2282938 - protein, 9 aa, Cryptosporidium parvum
SRDRPTKDS

SEQ ID NO: 2282939 - protein, 5 aa, Cryptosporidium parvum
SRDRR

SEQ ID NO: 2282940 - protein, 7 aa, Cryptosporidium parvum
SRDSKTL

SEQ ID NO: 2282941 - protein, 6 aa, Cryptosporidium parvum
SRDSLE

SEQ ID NO: 2282942 - protein, 7 aa, Cryptosporidium parvum
SREATED

SEQ ID NO: 2282943 - protein, 6 aa, Cryptosporidium parvum
SREDEQ

SEQ ID NO: 2282944 - protein, 9 aa, Cryptosporidium parvum
SREEEESRI

SEQ ID NO: 2282945 - protein, 10 aa, Cryptosporidium parvum
SREEGASKNL

SEQ ID NO: 2282946 - protein, 15 aa, Cryptosporidium parvum
SREEKIKYKNEELDT

SEQ ID NO: 2282947 - protein, 6 aa, Cryptosporidium parvum
SREEYL

SEQ ID NO: 2282948 - protein, 8 aa, Cryptosporidium parvum
SREKNETV

SEQ ID NO: 2282949 - protein, 7 aa, Cryptosporidium parvum
SREKTGN

SEQ ID NO: 2282950 - protein, 4 aa, Cryptosporidium parvum
SREP

SEQ ID NO: 2282951 - protein, 8 aa, Cryptosporidium parvum
SREPGNNT

SEQ ID NO: 2282952 - protein, 7 aa, Cryptosporidium parvum
SREQDEH

SEQ ID NO: 2282953 - protein, 4 aa, Cryptosporidium parvum
SRER

SEQ ID NO: 2282954 - protein, 6 aa, Cryptosporidium parvum
SRESKI

SEQ ID NO: 2282955 - protein, 7 aa, Cryptosporidium parvum
SRFESES

SEQ ID NO: 2282956 - protein, 12 aa, Cryptosporidium parvum
SRFNDESDNQQI

SEQ ID NO: 2282957 - protein, 15 aa, Cryptosporidium parvum
SRGAGSSGSTGVGDS

SEQ ID NO: 2282958 - protein, 5 aa, Cryptosporidium parvum
SRGAI

SEQ ID NO: 2282959 - protein, 8 aa, Cryptosporidium parvum
SRGASESI

SEQ ID NO: 2282960 - protein, 6 aa, Cryptosporidium parvum
SRGAST

SEQ ID NO: 2282961 - protein, 8 aa, Cryptosporidium parvum
SRGEAWDS

SEQ ID NO: 2282962 - protein, 7 aa, Cryptosporidium parvum
SRGEHTV

SEQ ID NO: 2282963 - protein, 6 aa, Cryptosporidium parvum
SRGELG

SEQ ID NO: 2282964 - protein, 11 aa, Cryptosporidium parvum
SRGGAPISSHS

SEQ ID NO: 2282965 - protein, 12 aa, Cryptosporidium parvum
SRGGCSCAGPYS

SEQ ID NO: 2282966 - protein, 8 aa, Cryptosporidium parvum
SRGGDQQL

SEQ ID NO: 2282967 - protein, 20 aa, Cryptosporidium parvum
SRGGYESQRSESDTSEESVR

SEQ ID NO: 2282968 - protein, 9 aa, Cryptosporidium parvum
SRGKETTSI

SEQ ID NO: 2282969 - protein, 13 aa, Cryptosporidium parvum
SRGKLNKGGIPDI

SEQ ID NO: 2282970 - protein, 14 aa, Cryptosporidium parvum
SRGKPDEKFSNNVN

SEQ ID NO: 2282971 - protein, 8 aa, Cryptosporidium parvum
SRGLRPSG

SEQ ID NO: 2282972 - protein, 4 aa, Cryptosporidium parvum
SRGT

SEQ ID NO: 2282973 - protein, 11 aa, Cryptosporidium parvum
SRGWNAPPLKQ

SEQ ID NO: 2282974 - protein, 10 aa, Cryptosporidium parvum
SRGYSSSSLN

SEQ ID NO: 2282975 - protein, 4 aa, Cryptosporidium parvum
SRHP

SEQ ID NO: 2282976 - protein, 10 aa, Cryptosporidium parvum
SRHQGKEKHI

SEQ ID NO: 2282977 - protein, 15 aa, Cryptosporidium parvum
SRHSGNRSFGRPEES

SEQ ID NO: 2282978 - protein, 14 aa, Cryptosporidium parvum
SRHTSRHISRKTTE

SEQ ID NO: 2282979 - protein, 7 aa, Cryptosporidium parvum
SRIEKQR

SEQ ID NO: 2282980 - protein, 26 aa, Cryptosporidium parvum
SRIEYNGGTPNASTTYEFNSNIYSSL

SEQ ID NO: 2282981 - protein, 6 aa, Cryptosporidium parvum
SRIPSP

SEQ ID NO: 2282982 - protein, 8 aa, Cryptosporidium parvum
SRIRNQGT

SEQ ID NO: 2282983 - protein, 7 aa, Cryptosporidium parvum
SRIRPPA

SEQ ID NO: 2282984 - protein, 20 aa, Cryptosporidium parvum
SRISQSHNTETLSGVNNSEK

SEQ ID NO: 2282985 - protein, 5 aa, Cryptosporidium parvum
SRIYP

SEQ ID NO: 2282986 - protein, 13 aa, Cryptosporidium parvum
SRKAGKKAKKEYT

SEQ ID NO: 2282987 - protein, 7 aa, Cryptosporidium parvum
SRKDPKE

SEQ ID NO: 2282988 - protein, 7 aa, Cryptosporidium parvum
SRKEKQI

SEQ ID NO: 2282989 - protein, 7 aa, Cryptosporidium parvum
SRKFQNE

SEQ ID NO: 2282990 - protein, 8 aa, Cryptosporidium parvum
SRKGGDRL

SEQ ID NO: 2282991 - protein, 9 aa, Cryptosporidium parvum
SRKGTKGRM

SEQ ID NO: 2282992 - protein, 17 aa, Cryptosporidium parvum
SRKGTKSEAEDQSKESL

SEQ ID NO: 2282993 - protein, 9 aa, Cryptosporidium parvum
SRKKDGKNS

SEQ ID NO: 2282994 - protein, 9 aa, Cryptosporidium parvum
SRKKDSEIE

SEQ ID NO: 2282995 - protein, 15 aa, Cryptosporidium parvum
SRKKVVSKKDATKNL

SEQ ID NO: 2282996 - protein, 13 aa, Cryptosporidium parvum
SRKNNENSQENIN

SEQ ID NO: 2282997 - protein, 15 aa, Cryptosporidium parvum
SRKNNWKSKNAKEGP

SEQ ID NO: 2282998 - protein, 7 aa, Cryptosporidium parvum
SRKNPNI

SEQ ID NO: 2282999 - protein, 10 aa, Cryptosporidium parvum
SRKNQDNSVS

SEQ ID NO: 2283000 - protein, 6 aa, Cryptosporidium parvum
SRKNQV

SEQ ID NO: 2283001 - protein, 9 aa, Cryptosporidium parvum
SRKPDGSYK

SEQ ID NO: 2283002 - protein, 7 aa, Cryptosporidium parvum
SRKPPRS

SEQ ID NO: 2283003 - protein, 9 aa, Cryptosporidium parvum
SRKRANNYI

SEQ ID NO: 2283004 - protein, 5 aa, Cryptosporidium parvum
SRKRI

SEQ ID NO: 2283005 - protein, 7 aa, Cryptosporidium parvum
SRKRKNI

SEQ ID NO: 2283006 - protein, 19 aa, Cryptosporidium parvum
SRKRKQKSSQSQKSDIHSC

SEQ ID NO: 2283007 - protein, 17 aa, Cryptosporidium parvum
SRKSSLSGNNYSSFSDD

SEQ ID NO: 2283008 - protein, 8 aa, Cryptosporidium parvum
SRKTSQQA

SEQ ID NO: 2283009 - protein, 4 aa, Cryptosporidium parvum
SRKV

SEQ ID NO: 2283010 - protein, 4 aa, Cryptosporidium parvum
SRLE

SEQ ID NO: 2283011 - protein, 4 aa, Cryptosporidium parvum
SRLK

SEQ ID NO: 2283012 - protein, 17 aa, Cryptosporidium parvum
SRLNGTNKKGGPMPETL

SEQ ID NO: 2283013 - protein, 12 aa, Cryptosporidium parvum
SRLPQVNNNSSD

SEQ ID NO: 2283014 - protein, 12 aa, Cryptosporidium parvum
SRLSNSNCKVNS

SEQ ID NO: 2283015 - protein, 12 aa, Cryptosporidium parvum
SRLSSPKDSKTQ

SEQ ID NO: 2283016 - protein, 6 aa, Cryptosporidium parvum
SRMGTR

SEQ ID NO: 2283017 - protein, 11 aa, Cryptosporidium parvum
SRNADDDEEIQ

SEQ ID NO: 2283018 - protein, 25 aa, Cryptosporidium parvum
SRNADRGNHTADQGDDNVTTTSIQT

SEQ ID NO: 2283019 - protein, 9 aa, Cryptosporidium parvum
SRNASDEEI

SEQ ID NO: 2283020 - protein, 5 aa, Cryptosporidium parvum
SRNCK

SEQ ID NO: 2283021 - protein, 7 aa, Cryptosporidium parvum
SRNDIQK

SEQ ID NO: 2283022 - protein, 7 aa, Cryptosporidium parvum
SRNDVSL

SEQ ID NO: 2283023 - protein, 5 aa, Cryptosporidium parvum
SRNEG

SEQ ID NO: 2283024 - protein, 5 aa, Cryptosporidium parvum
SRNEP

SEQ ID NO: 2283025 - protein, 14 aa, Cryptosporidium parvum
SRNERKFSKYKYET

SEQ ID NO: 2283026 - protein, 4 aa, Cryptosporidium parvum
SRNF

SEQ ID NO: 2283027 - protein, 22 aa, Cryptosporidium parvum
SRNIKQNQTNLKNSLGRKNGSL

SEQ ID NO: 2283028 - protein, 5 aa, Cryptosporidium parvum
SRNIS

SEQ ID NO: 2283029 - protein, 8 aa, Cryptosporidium parvum
SRNKKEIG

SEQ ID NO: 2283030 - protein, 10 aa, Cryptosporidium parvum
SRNKSKNTSF

SEQ ID NO: 2283031 - protein, 8 aa, Cryptosporidium parvum
SRNLGSDG

SEQ ID NO: 2283032 - protein, 6 aa, Cryptosporidium parvum
SRNLPK

SEQ ID NO: 2283033 - protein, 7 aa, Cryptosporidium parvum
SRNLRDN

SEQ ID NO: 2283034 - protein, 7 aa, Cryptosporidium parvum
SRNNNAI

SEQ ID NO: 2283035 - protein, 16 aa, Cryptosporidium parvum
SRNNVNKYNDQEDPIG

SEQ ID NO: 2283036 - protein, 5 aa, Cryptosporidium parvum
SRNNW

SEQ ID NO: 2283037 - protein, 8 aa, Cryptosporidium parvum
SRNPESLQ

SEQ ID NO: 2283038 - protein, 6 aa, Cryptosporidium parvum
SRNPKS

SEQ ID NO: 2283039 - protein, 9 aa, Cryptosporidium parvum
SRNPPLSSK

SEQ ID NO: 2283040 - protein, 5 aa, Cryptosporidium parvum
SRNPT

SEQ ID NO: 2283041 - protein, 6 aa, Cryptosporidium parvum
SRNQEI

SEQ ID NO: 2283042 - protein, 9 aa, Cryptosporidium parvum
SRNQENVDD

SEQ ID NO: 2283043 - protein, 13 aa, Cryptosporidium parvum
SRNQNMLNSDNNS

SEQ ID NO: 2283044 - protein, 5 aa, Cryptosporidium parvum
SRNQP

SEQ ID NO: 2283045 - protein, 21 aa, Cryptosporidium parvum
SRNRETVCSSDSESSDDEDFD

SEQ ID NO: 2283046 - protein, 6 aa, Cryptosporidium parvum
SRNRNP

SEQ ID NO: 2283047 - protein, 15 aa, Cryptosporidium parvum
SRNRVLKDSDEKNIV

SEQ ID NO: 2283048 - protein, 5 aa, Cryptosporidium parvum
SRNSA

SEQ ID NO: 2283049 - protein, 11 aa, Cryptosporidium parvum
SRNSNYSNNNT

SEQ ID NO: 2283050 - protein, 10 aa, Cryptosporidium parvum
SRNSQQDRKI

SEQ ID NO: 2283051 - protein, 13 aa, Cryptosporidium parvum
SRNSSNEAIENNS

SEQ ID NO: 2283052 - protein, 14 aa, Cryptosporidium parvum
SRNSSSSIKPPSAL

SEQ ID NO: 2283053 - protein, 6 aa, Cryptosporidium parvum
SRNTRS

SEQ ID NO: 2283054 - protein, 10 aa, Cryptosporidium parvum
SRNVRNRPNF

SEQ ID NO: 2283055 - protein, 8 aa, Cryptosporidium parvum
SRPEEASK

SEQ ID NO: 2283056 - protein, 6 aa, Cryptosporidium parvum
SRPEEL

SEQ ID NO: 2283057 - protein, 8 aa, Cryptosporidium parvum
SRPEKISA

SEQ ID NO: 2283058 - protein, 4 aa, Cryptosporidium parvum
SRPF

SEQ ID NO: 2283059 - protein, 8 aa, Cryptosporidium parvum
SRPGQCGR

SEQ ID NO: 2283060 - protein, 14 aa, Cryptosporidium parvum
SRPKCGDCKKPLAG

SEQ ID NO: 2283061 - protein, 57 aa, Cryptosporidium parvum
SRPKRGKRKTIIESEEEEEDGEEEEEEDDDDEIEDQESVSNISSDSLKESDFSEYSD

SEQ ID NO: 2283062 - protein, 14 aa, Cryptosporidium parvum
SRPLSPEDHPSSRN

SEQ ID NO: 2283063 - protein, 7 aa, Cryptosporidium parvum
SRPMSPN

SEQ ID NO: 2283064 - protein, 6 aa, Cryptosporidium parvum
SRPNKN

SEQ ID NO: 2283065 - protein, 6 aa, Cryptosporidium parvum
SRPQSE

SEQ ID NO: 2283066 - protein, 13 aa, Cryptosporidium parvum
SRPQVSSSSTQQV

SEQ ID NO: 2283067 - protein, 70 aa, Cryptosporidium parvum
SRPRSVSRSRSRSRPRSGSATNESPINERTRNNLRNRPKTPPSDKRVSFSPQRTSRNVKYEPGNDEEFIS

SEQ ID NO: 2283068 - protein, 17 aa, Cryptosporidium parvum
SRPSDLALDTDKNDVSK

SEQ ID NO: 2283069 - protein, 18 aa, Cryptosporidium parvum
SRPSIKYQSSVRRKNNSR

SEQ ID NO: 2283070 - protein, 11 aa, Cryptosporidium parvum
SRPSVEEREGV

SEQ ID NO: 2283071 - protein, 8 aa, Cryptosporidium parvum
SRPTDGSP

SEQ ID NO: 2283072 - protein, 15 aa, Cryptosporidium parvum
SRPTRKTFESLKSTE

SEQ ID NO: 2283073 - protein, 4 aa, Cryptosporidium parvum
SRPY

SEQ ID NO: 2283074 - protein, 14 aa, Cryptosporidium parvum
SRQFRSEKSNNAND

SEQ ID NO: 2283075 - protein, 18 aa, Cryptosporidium parvum
SRQKAGGPRSLRASLNDE

SEQ ID NO: 2283076 - protein, 10 aa, Cryptosporidium parvum
SRQKNIKGRY

SEQ ID NO: 2283077 - protein, 15 aa, Cryptosporidium parvum
SRQKTKELKNNSPNA

SEQ ID NO: 2283078 - protein, 11 aa, Cryptosporidium parvum
SRQNPEDPNIT

SEQ ID NO: 2283079 - protein, 39 aa, Cryptosporidium parvum; identical to SEQ ID NO: 2163155

SEQ ID NO: 2283080 - protein, 7 aa, Cryptosporidium parvum
SRRDEEI

SEQ ID NO: 2283081 - protein, 17 aa, Cryptosporidium parvum
SRRDETANQRSHPYSPT

SEQ ID NO: 2283082 - protein, 6 aa, Cryptosporidium parvum
SRRDSI

SEQ ID NO: 2283083 - protein, 9 aa, Cryptosporidium parvum
SRRFPSDNR

SEQ ID NO: 2283084 - protein, 20 aa, Cryptosporidium parvum
SRRGCEPEVDGDNKENDSKL

SEQ ID NO: 2283085 - protein, 9 aa, Cryptosporidium parvum
SRRGSNDGV

SEQ ID NO: 2283086 - protein, 21 aa, Cryptosporidium parvum
SRRNTKSMHQNSSSMEINLNK

SEQ ID NO: 2283087 - protein, 6 aa, Cryptosporidium parvum
SRRPRG

SEQ ID NO: 2283088 - protein, 8 aa, Cryptosporidium parvum
SRRQEAQR

SEQ ID NO: 2283089 - protein, 8 aa, Cryptosporidium parvum
SRRRSQSI

SEQ ID NO: 2283090 - protein, 4 aa, Cryptosporidium parvum
SRRS

SEQ ID NO: 2283091 - protein, 9 aa, Cryptosporidium parvum
SRRSAQNLG

SEQ ID NO: 2283092 - protein, 6 aa, Cryptosporidium parvum
SRRSEV

SEQ ID NO: 2283093 - protein, 19 aa, Cryptosporidium parvum
SRRSRNSRWRGASEDNFNT

SEQ ID NO: 2283094 - protein, 41 aa, Cryptosporidium parvum
SRRSSLSSESSLTSHTSSTKPKNSYIQKNSSVSGGNGTSHN

SEQ ID NO: 2283095 - protein, 13 aa, Cryptosporidium parvum
SRSCESTELENES

SEQ ID NO: 2283096 - protein, 11 aa, Cryptosporidium parvum
SRSENNSYRQE

SEQ ID NO: 2283097 - protein, 8 aa, Cryptosporidium parvum
SRSENSLK

SEQ ID NO: 2283098 - protein, 9 aa, Cryptosporidium parvum
SRSGFGGNY

SEQ ID NO: 2283099 - protein, 7 aa, Cryptosporidium parvum
SRSIDTL

SEQ ID NO: 2283100 - protein, 5 aa, Cryptosporidium parvum
SRSKE

SEQ ID NO: 2283101 - protein, 9 aa, Cryptosporidium parvum
SRSKEDKIG

SEQ ID NO: 2283102 - protein, 7 aa, Cryptosporidium parvum
SRSKKIT

SEQ ID NO: 2283103 - protein, 10 aa, Cryptosporidium parvum
SRSKLSSSTL

SEQ ID NO: 2283104 - protein, 8 aa, Cryptosporidium parvum
SRSLASSR

SEQ ID NO: 2283105 - protein, 13 aa, Cryptosporidium parvum
SRSNEDKKPTLKH

SEQ ID NO: 2283106 - protein, 8 aa, Cryptosporidium parvum
SRSNITEQ

SEQ ID NO: 2283107 - protein, 8 aa, Cryptosporidium parvum
SRSNSATM

SEQ ID NO: 2283108 - protein, 8 aa, Cryptosporidium parvum
SRSNSFGP

SEQ ID NO: 2283109 - protein, 5 aa, Cryptosporidium parvum
SRSNV

SEQ ID NO: 2283110 - protein, 11 aa, Cryptosporidium parvum
SRSPGNSPDNL

SEQ ID NO: 2283111 - protein, 27 aa, Cryptosporidium parvum
SRSPRRDPYDRRERSHHYPDDRYRRGY

SEQ ID NO: 2283112 - protein, 18 aa, Cryptosporidium parvum
SRSPRVVSQNGEGEGRAG

SEQ ID NO: 2283113 - protein, 9 aa, Cryptosporidium parvum
SRSQNLDDD

SEQ ID NO: 2283114 - protein, 7 aa, Cryptosporidium parvum
SRSRKIE

SEQ ID NO: 2283115 - protein, 4 aa, Cryptosporidium parvum
SRSS

SEQ ID NO: 2283116 - protein, 10 aa, Cryptosporidium parvum
SRSSKQTRKR

SEQ ID NO: 2283117 - protein, 5 aa, Cryptosporidium parvum
SRSSQ

SEQ ID NO: 2283118 - protein, 11 aa, Cryptosporidium parvum
SRSSSGRSGRK

SEQ ID NO: 2283119 - protein, 23 aa, Cryptosporidium parvum
SRSYTDSNNNNYLQETETFRSGI

SEQ ID NO: 2283120 - protein, 24 aa, Cryptosporidium parvum
SRTDTAKSLQEKQKNQCKRHKNKE

SEQ ID NO: 2283121 - protein, 10 aa, Cryptosporidium parvum
SRTGSSEPTL

SEQ ID NO: 2283122 - protein, 5 aa, Cryptosporidium parvum
SRTGY

SEQ ID NO: 2283123 - protein, 7 aa, Cryptosporidium parvum
SRTIGTR

SEQ ID NO: 2283124 - protein, 13 aa, Cryptosporidium parvum
SRTIRNDNSSRFG

SEQ ID NO: 2283125 - protein, 5 aa, Cryptosporidium parvum
SRTKD

SEQ ID NO: 2283126 - protein, 9 aa, Cryptosporidium parvum
SRTRDSGKP

SEQ ID NO: 2283127 - protein, 21 aa, Cryptosporidium parvum
SRTRGNQNQTENSSDKTSTGV

SEQ ID NO: 2283128 - protein, 23 aa, Cryptosporidium parvum
SRTRSISRSKSWDVTSPNMTKKS

SEQ ID NO: 2283129 - protein, 4 aa, Cryptosporidium parvum
SRTS

SEQ ID NO: 2283130 - protein, 4 aa, Cryptosporidium parvum
SRTT

SEQ ID NO: 2283131 - protein, 6 aa, Cryptosporidium parvum
SRTVTV

SEQ ID NO: 2283132 - protein, 8 aa, Cryptosporidium parvum
SRVPEPIN

SEQ ID NO: 2283133 - protein, 20 aa, Cryptosporidium parvum
SRVSNSSPHYPLTATSSPNY

SEQ ID NO: 2283134 - protein, 13 aa, Cryptosporidium parvum
SRVSSLGRVGGAV

SEQ ID NO: 2283135 - protein, 5 aa, Cryptosporidium parvum
SRVTS

SEQ ID NO: 2283136 - protein, 5 aa, Cryptosporidium parvum
SRYER

SEQ ID NO: 2283137 - protein, 5 aa, Cryptosporidium parvum
SRYES

SEQ ID NO: 2283138 - protein, 8 aa, Cryptosporidium parvum
SRYGGPSL

SEQ ID NO: 2283139 - protein, 12 aa, Cryptosporidium parvum
SRYGNKNDEKIK

SEQ ID NO: 2283140 - protein, 4 aa, Cryptosporidium parvum
SRYK

SEQ ID NO: 2283141 - protein, 11 aa, Cryptosporidium parvum
SRYNKNSKKSI

SEQ ID NO: 2283142 - protein, 32 aa, Cryptosporidium parvum; identical to SEQ ID NO: 2163219

SEQ ID NO: 2283143 - protein, 7 aa, Cryptosporidium parvum
SRYSQSG

SEQ ID NO: 2283144 - protein, 39 aa, Cryptosporidium parvum
SRYSVNEQTWNREGSSLTDYRRESKFHEKEQQSQPPQEY

SEQ ID NO: 2283145 - protein, 4 aa, Cryptosporidium parvum
SSAA

SEQ ID NO: 2283146 - protein, 7 aa, Cryptosporidium parvum
SSAAQLR

SEQ ID NO: 2283147 - protein, 19 aa, Cryptosporidium parvum
SSADNIDISSSKKSFNRNN

SEQ ID NO: 2283148 - protein, 7 aa, Cryptosporidium parvum
SSAEEKF

SEQ ID NO: 2283149 - protein, 18 aa, Cryptosporidium parvum
SSAENKAKKFDQHSRESD

SEQ ID NO: 2283150 - protein, 17 aa, Cryptosporidium parvum
SSAESKKKTNYAHTSNR

SEQ ID NO: 2283151 - protein, 4 aa, Cryptosporidium parvum
SSAF

SEQ ID NO: 2283152 - protein, 12 aa, Cryptosporidium parvum
SSAFNSSPVPVS

SEQ ID NO: 2283153 - protein, 14 aa, Cryptosporidium parvum
SSAIESPEKGAFNH

SEQ ID NO: 2283154 - protein, 4 aa, Cryptosporidium parvum
SSAK

SEQ ID NO: 2283155 - protein, 9 aa, Cryptosporidium parvum
SSAKHATKQ

SEQ ID NO: 2283156 - protein, 21 aa, Cryptosporidium parvum
SSAKHGGKNYDCEDNDGVNKF

SEQ ID NO: 2283157 - protein, 9 aa, Cryptosporidium parvum
SSAKNSTNV

SEQ ID NO: 2283158 - protein, 9 aa, Cryptosporidium parvum
SSALPGYPN

SEQ ID NO: 2283159 - protein, 7 aa, Cryptosporidium parvum
SSANRNY

SEQ ID NO: 2283160 - protein, 7 aa, Cryptosporidium parvum
SSAPRPD

SEQ ID NO: 2283161 - protein, 13 aa, Cryptosporidium parvum
SSARFTTPSISGY

SEQ ID NO: 2283162 - protein, 14 aa, Cryptosporidium parvum
SSASATHGSAGQIP

SEQ ID NO: 2283163 - protein, 7 aa, Cryptosporidium parvum
SSASLGF

SEQ ID NO: 2283164 - protein, 27 aa, Cryptosporidium parvum
SSASPNENESKNISNKAQSGVTQHPSN

SEQ ID NO: 2283165 - protein, 5 aa, Cryptosporidium parvum
SSATP

SEQ ID NO: 2283166 - protein, 8 aa, Cryptosporidium parvum
SSATQEKN

SEQ ID NO: 2283167 - protein, 5 aa, Cryptosporidium parvum
SSATS

SEQ ID NO: 2283168 - protein, 10 aa, Cryptosporidium parvum
SSAYNQRSIQ

SEQ ID NO: 2283169 - protein, 6 aa, Cryptosporidium parvum
SSAYSE

SEQ ID NO: 2283170 - protein, 7 aa, Cryptosporidium parvum
SSCKSAS

SEQ ID NO: 2283171 - protein, 5 aa, Cryptosporidium parvum
SSCSR

SEQ ID NO: 2283172 - protein, 5 aa, Cryptosporidium parvum
SSCTD

SEQ ID NO: 2283173 - protein, 5 aa, Cryptosporidium parvum
SSDAD

SEQ ID NO: 2283174 - protein, 4 aa, Cryptosporidium parvum
SSDD

SEQ ID NO: 2283175 - protein, 6 aa, Cryptosporidium parvum
SSDDEG

SEQ ID NO: 2283176 - protein, 8 aa, Cryptosporidium parvum
SSDDESVK

SEQ ID NO: 2283177 - protein, 7 aa, Cryptosporidium parvum
SSDDSNM

SEQ ID NO: 2283178 - protein, 60 aa, Cryptosporidium parvum
SSDEDEEEDLKSPVSRRKKDVKVKAEKESSPKRNKSSSSKSNLNTKTDKISSNSQSDEEL

SEQ ID NO: 2283179 - protein, 28 aa, Cryptosporidium parvum
SSDEDLIQDDEDSSKIIQSNEEIEIPIG

SEQ ID NO: 2283180 - protein, 8 aa, Cryptosporidium parvum
SSDEGRCQ

SEQ ID NO: 2283181 - protein, 10 aa, Cryptosporidium parvum
SSDESNSEKI

SEQ ID NO: 2283182 - protein, 12 aa, Cryptosporidium parvum
SSDFDSDEVNAE

SEQ ID NO: 2283183 - protein, 9 aa, Cryptosporidium parvum
SSDFKDTTL

SEQ ID NO: 2283184 - protein, 11 aa, Cryptosporidium parvum
SSDGSEDFGPG

SEQ ID NO: 2283185 - protein, 6 aa, Cryptosporidium parvum
SSDGTI

SEQ ID NO: 2283186 - protein, 10 aa, Cryptosporidium parvum
SSDGTLRKNP

SEQ ID NO: 2283187 - protein, 9 aa, Cryptosporidium parvum
SSDGTMNKN

SEQ ID NO: 2283188 - protein, 7 aa, Cryptosporidium parvum
SSDIDTN

SEQ ID NO: 2283189 - protein, 5 aa, Cryptosporidium parvum
SSDIK

SEQ ID NO: 2283190 - protein, 7 aa, Cryptosporidium parvum
SSDKDKL

SEQ ID NO: 2283191 - protein, 15 aa, Cryptosporidium parvum
SSDKIYSSNRDEALK

SEQ ID NO: 2283192 - protein, 5 aa, Cryptosporidium parvum
SSDKQ

SEQ ID NO: 2283193 - protein, 31 aa, Cryptosporidium parvum
SSDLSANGEYSNESRNETSSSIQEIQNNEEF

SEQ ID NO: 2283194 - protein, 14 aa, Cryptosporidium parvum
SSDMESKNPASDVS

SEQ ID NO: 2283195 - protein, 9 aa, Cryptosporidium parvum
SSDNLENEI

SEQ ID NO: 2283196 - protein, 9 aa, Cryptosporidium parvum
SSDNNSGIF

SEQ ID NO: 2283197 - protein, 23 aa, Cryptosporidium parvum
  misc_feature (16)..(19): Xaa can be any naturally occurring amino acid
  misc_feature (21)..(22): Xaa can be any naturally occurring amino acid
SSDNSVGLFDIRSSTXXXXVXXS

SEQ ID NO: 2283198 - protein, 16 aa, Cryptosporidium parvum
SSDPHMSEYTPDKYKR

SEQ ID NO: 2283199 - protein, 7 aa, Cryptosporidium parvum
SSDPTFK

SEQ ID NO: 2283200 - protein, 16 aa, Cryptosporidium parvum
SSDRDSNKNNQQTSIL

SEQ ID NO: 2283201 - protein, 4 aa, Cryptosporidium parvum
SSDS

SEQ ID NO: 2283202 - protein, 9 aa, Cryptosporidium parvum
SSDSATNPI

SEQ ID NO: 2283203 - protein, 7 aa, Cryptosporidium parvum
SSDSIQS

SEQ ID NO: 2283204 - protein, 8 aa, Cryptosporidium parvum
SSDSKIEK

SEQ ID NO: 2283205 - protein, 16 aa, Cryptosporidium parvum
SSDSSIESKLGDISSN

SEQ ID NO: 2283206 - protein, 7 aa, Cryptosporidium parvum
SSDTENI

SEQ ID NO: 2283207 - protein, 38 aa, Cryptosporidium parvum
SSDTQDTSKISQIPRQTPSVVRPPTAPNSISKSSSLPK

SEQ ID NO: 2283208 - protein, 37 aa, Cryptosporidium parvum
SSDTRQTKKPKHAFGEDGEDLATPKSNHLKEQDMNDD

SEQ ID NO: 2283209 - protein, 6 aa, Cryptosporidium parvum
SSDYKF

SEQ ID NO: 2283210 - protein, 20 aa, Cryptosporidium parvum
SSDYSNVRKTHANSAIGAGF

SEQ ID NO: 2283211 - protein, 7 aa, Cryptosporidium parvum
SSEADEN

SEQ ID NO: 2283212 - protein, 11 aa, Cryptosporidium parvum
SSEDEENEDYD

SEQ ID NO: 2283213 - protein, 22 aa, Cryptosporidium parvum
SSEDENNITDDDEDVYNRPNRK

SEQ ID NO: 2283214 - protein, 5 aa, Cryptosporidium parvum
SSEDF

SEQ ID NO: 2283215 - protein, 5 aa, Cryptosporidium parvum
SSEDK

SEQ ID NO: 2283216 - protein, 9 aa, Cryptosporidium parvum
SSEDYKIRN

SEQ ID NO: 2283217 - protein, 4 aa, Cryptosporidium parvum
SSEE

SEQ ID NO: 2283218 - protein, 19 aa, Cryptosporidium parvum
SSEEENSKKQNDSNSKKLE

SEQ ID NO: 2283219 - protein, 10 aa, Cryptosporidium parvum
SSEEKKENKC

SEQ ID NO: 2283220 - protein, 6 aa, Cryptosporidium parvum
SSEEQA

SEQ ID NO: 2283221 - protein, 4 aa, Cryptosporidium parvum
SSEF

SEQ ID NO: 2283222 - protein, 18 aa, Cryptosporidium parvum
SSEFDNVEDYTKSYPLSY

SEQ ID NO: 2283223 - protein, 31 aa, Cryptosporidium parvum
SSEFSENGSLSPNSTLDSETKTISKGDSSGI

SEQ ID NO: 2283224 - protein, 6 aa, Cryptosporidium parvum
SSEFSP

SEQ ID NO: 2283225 - protein, 4 aa, Cryptosporidium parvum
SSEG

SEQ ID NO: 2283226 - protein, 7 aa, Cryptosporidium parvum
SSEGPAI

SEQ ID NO: 2283227 - protein, 12 aa, Cryptosporidium parvum
SSEIARTEATRA

SEQ ID NO: 2283228 - protein, 7 aa, Cryptosporidium parvum
SSEIGKN

SEQ ID NO: 2283229 - protein, 11 aa, Cryptosporidium parvum
SSEIKYQSNQI

SEQ ID NO: 2283230 - protein, 10 aa, Cryptosporidium parvum
SSEISKRKHE

SEQ ID NO: 2283231 - protein, 4 aa, Cryptosporidium parvum
SSEK

SEQ ID NO: 2283232 - protein, 10 aa, Cryptosporidium parvum
SSEKNDGFPV

SEQ ID NO: 2283233 - protein, 7 aa, Cryptosporidium parvum
SSEKQEI

SEQ ID NO: 2283234 - protein, 15 aa, Cryptosporidium parvum
SSEKSKKISQKREEM

SEQ ID NO: 2283235 - protein, 4 aa, Cryptosporidium parvum
SSEL

SEQ ID NO: 2283236 - protein, 4 aa, Cryptosporidium parvum
SSEN

SEQ ID NO: 2283237 - protein, 10 aa, Cryptosporidium parvum
SSENESSESR

SEQ ID NO: 2283238 - protein, 7 aa, Cryptosporidium parvum
SSENFNR

SEQ ID NO: 2283239 - protein, 19 aa, Cryptosporidium parvum
SSENIERNSVSNTPNNNRI

SEQ ID NO: 2283240 - protein, 44 aa, Cryptosporidium parvum
SSENIRASDQNDFKSVGGKSLSQIDASSINGGTGFGSSSQPEWD

SEQ ID NO: 2283241 - protein, 5 aa, Cryptosporidium parvum
SSENM

SEQ ID NO: 2283242 - protein, 9 aa, Cryptosporidium parvum
SSENSSNLA

SEQ ID NO: 2283243 - protein, 8 aa, Cryptosporidium parvum
SSEPNSHG

SEQ ID NO: 2283244 - protein, 8 aa, Cryptosporidium parvum
SSEPSPIE

SEQ ID NO: 2283245 - protein, 6 aa, Cryptosporidium parvum
SSEQDE

SEQ ID NO: 2283246 - protein, 9 aa, Cryptosporidium parvum
SSEQESKTI

SEQ ID NO: 2283247 - protein, 12 aa, Cryptosporidium parvum
SSERKRRREEHY

SEQ ID NO: 2283248 - protein, 20 aa, Cryptosporidium parvum
SSERQLKTHSNSDRRESESV

SEQ ID NO: 2283249 - protein, 40 aa, Cryptosporidium parvum
SSERSDKELDQERVSNGDVENEKNTVYPPLKKNNNKNDEN

SEQ ID NO: 2283250 - protein, 7 aa, Cryptosporidium parvum
SSERTSN

SEQ ID NO: 2283251 - protein, 12 aa, Cryptosporidium parvum
SSESKDNKNYLN

SEQ ID NO: 2283252 - protein, 26 aa, Cryptosporidium parvum
SSETENDNHLDESTNNYGEISKSCDQ

SEQ ID NO: 2283253 - protein, 9 aa, Cryptosporidium parvum
SSETPTISD

SEQ ID NO: 2283254 - protein, 7 aa, Cryptosporidium parvum
SSETSVQ

SEQ ID NO: 2283255 - protein, 6 aa, Cryptosporidium parvum
SSETTI

SEQ ID NO: 2283256 - protein, 5 aa, Cryptosporidium parvum
SSEVS

SEQ ID NO: 2283257 - protein, 11 aa, Cryptosporidium parvum
SSEWTSQSRTR

SEQ ID NO: 2283258 - protein, 50 aa, Cryptosporidium parvum
SSEYSEVSKNPSLSQIENSSFNGEYNNYSSHQDIPQTPTIGGGRSEHGSK

SEQ ID NO: 2283259 - protein, 6 aa, Cryptosporidium parvum
SSEYTN

SEQ ID NO: 2283260 - protein, 19 aa, Cryptosporidium parvum
SSFDDDVSLDDDDDNETIA

SEQ ID NO: 2283261 - protein, 6 aa, Cryptosporidium parvum
SSFDPM

SEQ ID NO: 2283262 - protein, 6 aa, Cryptosporidium parvum
SSFDTI

SEQ ID NO: 2283263 - protein, 6 aa, Cryptosporidium parvum
SSFDTS

SEQ ID NO: 2283264 - protein, 11 aa, Cryptosporidium parvum
SSFGKNSNAFA

SEQ ID NO: 2283265 - protein, 6 aa, Cryptosporidium parvum
SSFGPT

SEQ ID NO: 2283266 - protein, 6 aa, Cryptosporidium parvum
SSFGYK

SEQ ID NO: 2283267 - protein, 32 aa, Cryptosporidium parvum
SSFKEKGGTSVVSSRNSNKSQTVSSNTPGPAL

SEQ ID NO: 2283268 - protein, 106 aa, Cryptosporidium parvum
SSFKGGGFNSSKASRSSSNSSYDRRRYSSAKTNTRQKFKSSSRSMSKSSSENRYRSESMSLSNSRSNSRSCPRAGSRQVQRKSIERGRSKERVKRNYESSPEEFND

SEQ ID NO: 2283269 - protein, 27 aa, Cryptosporidium parvum
SSFKSNNKADLKTRVSDKSDKSMNDNT

SEQ ID NO: 2283270 - protein, 11 aa, Cryptosporidium parvum
SSFNDKEQYND

SEQ ID NO: 2283271 - protein, 5 aa, Cryptosporidium parvum
SSFNE

SEQ ID NO: 2283272 - protein, 5 aa, Cryptosporidium parvum
SSFPS

SEQ ID NO: 2283273 - protein, 6 aa, Cryptosporidium parvum
SSFRTS

SEQ ID NO: 2283274 - protein, 5 aa, Cryptosporidium parvum
SSFSA

SEQ ID NO: 2283275 - protein, 26 aa, Cryptosporidium parvum
SSFSAYSKDEKIKKFEEKHANSLDSY

SEQ ID NO: 2283276 - protein, 5 aa, Cryptosporidium parvum
SSFSE

SEQ ID NO: 2283277 - protein, 6 aa, Cryptosporidium parvum
SSFSNE

SEQ ID NO: 2283278 - protein, 17 aa, Cryptosporidium parvum
SSFTGGFGSNASSSNGL

SEQ ID NO: 2283279 - protein, 13 aa, Cryptosporidium parvum
SSFTSGGGTGMGP

SEQ ID NO: 2283280 - protein, 4 aa, Cryptosporidium parvum
SSGA

SEQ ID NO: 2283281 - protein, 6 aa, Cryptosporidium parvum
SSGADN

SEQ ID NO: 2283282 - protein, 5 aa, Cryptosporidium parvum
SSGAS

SEQ ID NO: 2283283 - protein, 9 aa, Cryptosporidium parvum
SSGDSSKDF

SEQ ID NO: 2283284 - protein, 4 aa, Cryptosporidium parvum
SSGE

SEQ ID NO: 2283285 - protein, 7 aa, Cryptosporidium parvum
SSGEKGM

SEQ ID NO: 2283286 - protein, 10 aa, Cryptosporidium parvum
SSGFQKNGNE

SEQ ID NO: 2283287 - protein, 4 aa, Cryptosporidium parvum
SSGG

SEQ ID NO: 2283288 - protein, 11 aa, Cryptosporidium parvum
SSGGATGEGGK

SEQ ID NO: 2283289 - protein, 7 aa, Cryptosporidium parvum
SSGGDGI

SEQ ID NO: 2283290 - protein, 15 aa, Cryptosporidium parvum
SSGGDVKAEEISQKL

SEQ ID NO: 2283291 - protein, 8 aa, Cryptosporidium parvum
SSGGQNCS

SEQ ID NO: 2283292 - protein, 5 aa, Cryptosporidium parvum
SSGHS

SEQ ID NO: 2283293 - protein, 9 aa, Cryptosporidium parvum
SSGHSSSNL

SEQ ID NO: 2283294 - protein, 4 aa, Cryptosporidium parvum
SSGI

SEQ ID NO: 2283295 - protein, 12 aa, Cryptosporidium parvum
SSGIEATTPTEV

SEQ ID NO: 2283296 - protein, 15 aa, Cryptosporidium parvum
SSGISRNKSEESGYD

SEQ ID NO: 2283297 - protein, 8 aa, Cryptosporidium parvum
SSGKQIQT

SEQ ID NO: 2283298 - protein, 4 aa, Cryptosporidium parvum
SSGL

SEQ ID NO: 2283299 - protein, 8 aa, Cryptosporidium parvum
SSGLRSSC

SEQ ID NO: 2283300 - protein, 5 aa, Cryptosporidium parvum
SSGNI

SEQ ID NO: 2283301 - protein, 34 aa, Cryptosporidium parvum
SSGNKSNPSSKTTSKSNGGAASKLAYEKNGDNSQ

SEQ ID NO: 2283302 - protein, 29 aa, Cryptosporidium parvum
SSGNNSNNNDNNNSNINNYNSNNNGPKYG

SEQ ID NO: 2283303 - protein, 7 aa, Cryptosporidium parvum
SSGNSSL

SEQ ID NO: 2283304 - protein, 15 aa, Cryptosporidium parvum
SSGNTIGNSGGSSHY

SEQ ID NO: 2283305 - protein, 6 aa, Cryptosporidium parvum
SSGPMS

SEQ ID NO: 2283306 - protein, 15 aa, Cryptosporidium parvum
SSGPPFGSANAKDLN

SEQ ID NO: 2283307 - protein, 7 aa, Cryptosporidium parvum
SSGPPNW

SEQ ID NO: 2283308 - protein, 7 aa, Cryptosporidium parvum
SSGPYSI

SEQ ID NO: 2283309 - protein, 5 aa, Cryptosporidium parvum
SSGQH

SEQ ID NO: 2283310 - protein, 5 aa, Cryptosporidium parvum
SSGQM

SEQ ID NO: 2283311 - protein, 9 aa, Cryptosporidium parvum
SSGQPVSSL

SEQ ID NO: 2283312 - protein, 6 aa, Cryptosporidium parvum
SSGQTN

SEQ ID NO: 2283313 - protein, 9 aa, Cryptosporidium parvum
SSGRSRVTI

SEQ ID NO: 2283314 - protein, 7 aa, Cryptosporidium parvum
SSGRTTG

SEQ ID NO: 2283315 - protein, 14 aa, Cryptosporidium parvum
SSGSACTSASLEPS

SEQ ID NO: 2283316 - protein, 9 aa, Cryptosporidium parvum
SSGSGKSTL

SEQ ID NO: 2283317 - protein, 34 aa, Cryptosporidium parvum
SSGSGNGGAGGNIGGGSSQMQNPNMNNPSSAKAA

SEQ ID NO: 2283318 - protein, 9 aa, Cryptosporidium parvum
SSGSIGSGS

SEQ ID NO: 2283319 - protein, 28 aa, Cryptosporidium parvum
SSGSSSTGSSRTSHHSRSSGSSDSISEF

SEQ ID NO: 2283320 - protein, 16 aa, Cryptosporidium parvum
SSGSVSDSYSSVGSSG

SEQ ID NO: 2283321 - protein, 4 aa, Cryptosporidium parvum
SSGT

SEQ ID NO: 2283322 - protein, 8 aa, Cryptosporidium parvum
SSGTGKTF

SEQ ID NO: 2283323 - protein, 8 aa, Cryptosporidium parvum
SSGTKQVF

SEQ ID NO: 2283324 - protein, 9 aa, Cryptosporidium parvum
SSGYTHRDF

SEQ ID NO: 2283325 - protein, 16 aa, Cryptosporidium parvum
SSGYYSSNNNQKSSST

SEQ ID NO: 2283326 - protein, 6 aa, Cryptosporidium parvum
SSHEHK

SEQ ID NO: 2283327 - protein, 6 aa, Cryptosporidium parvum
SSHENN

SEQ ID NO: 2283328 - protein, 4 aa, Cryptosporidium parvum
SSHF

SEQ ID NO: 2283329 - protein, 6 aa, Cryptosporidium parvum
SSHGGF

SEQ ID NO: 2283330 - protein, 10 aa, Cryptosporidium parvum
SSHGTKGGCE

SEQ ID NO: 2283331 - protein, 4 aa, Cryptosporidium parvum
SSHI

SEQ ID NO: 2283332 - protein, 8 aa, Cryptosporidium parvum
SSHNGKNN

SEQ ID NO: 2283333 - protein, 5 aa, Cryptosporidium parvum
SSHPD

SEQ ID NO: 2283334 - protein, 13 aa, Cryptosporidium parvum
SSHPQQSVNSTGI

SEQ ID NO: 2283335 - protein, 24 aa, Cryptosporidium parvum
SSHPQSPPVSPSDSSNLSSPLTSS

SEQ ID NO: 2283336 - protein, 6 aa, Cryptosporidium parvum
SSHQKE

SEQ ID NO: 2283337 - protein, 8 aa, Cryptosporidium parvum
SSHSINET

SEQ ID NO: 2283338 - protein, 7 aa, Cryptosporidium parvum
SSHSISK

SEQ ID NO: 2283339 - protein, 10 aa, Cryptosporidium parvum
SSHSKSSNQS

SEQ ID NO: 2283340 - protein, 12 aa, Cryptosporidium parvum
SSHSTNNKSSIS

SEQ ID NO: 2283341 - protein, 6 aa, Cryptosporidium parvum
SSIDLE

SEQ ID NO: 2283342 - protein, 28 aa, Cryptosporidium parvum
SSIDQAKISKSPKSSNPKNVSHELNSNQ

SEQ ID NO: 2283343 - protein, 7 aa, Cryptosporidium parvum
SSIDQED

SEQ ID NO: 2283344 - protein, 10 aa, Cryptosporidium parvum
SSIEHNSDKG

SEQ ID NO: 2283345 - protein, 13 aa, Cryptosporidium parvum
SSIEQNDQSYRKF

SEQ ID NO: 2283346 - protein, 6 aa, Cryptosporidium parvum
SSIGEN

SEQ ID NO: 2283347 - protein, 5 aa, Cryptosporidium parvum
SSIGS

SEQ ID NO: 2283348 - protein, 7 aa, Cryptosporidium parvum
SSIGSEE

SEQ ID NO: 2283349 - protein, 5 aa, Cryptosporidium parvum
SSIGV

SEQ ID NO: 2283350 - protein, 10 aa, Cryptosporidium parvum
SSIIESNDSY

SEQ ID NO: 2283351 - protein, 6 aa, Cryptosporidium parvum
SSIKNQ

SEQ ID NO: 2283352 - protein, 17 aa, Cryptosporidium parvum
SSIKSSGKTGGGSDNGI

SEQ ID NO: 2283353 - protein, 29 aa, Cryptosporidium parvum
SSINNSNNNNNNNNNNDNNNINNGNNGNN

SEQ ID NO: 2283354 - protein, 18 aa, Cryptosporidium parvum
SSINSNNSITSKSPLSKV

SEQ ID NO: 2283355 - protein, 15 aa, Cryptosporidium parvum
SSIPAQKKRPLMGEN

SEQ ID NO: 2283356 - protein, 6 aa, Cryptosporidium parvum
SSIPQS

SEQ ID NO: 2283357 - protein, 8 aa, Cryptosporidium parvum
SSIQDSQE

SEQ ID NO: 2283358 - protein, 7 aa, Cryptosporidium parvum
SSIQGGF

SEQ ID NO: 2283359 - protein, 12 aa, Cryptosporidium parvum
SSIQNNKRAEEL

SEQ ID NO: 2283360 - protein, 6 aa, Cryptosporidium parvum
SSIQQE

SEQ ID NO: 2283361 - protein, 4 aa, Cryptosporidium parvum
SSIR

SEQ ID NO: 2283362 - protein, 12 aa, Cryptosporidium parvum
SSIRDSSRRSTY

SEQ ID NO: 2283363 - protein, 4 aa, Cryptosporidium parvum
SSIS

SEQ ID NO: 2283364 - protein, 14 aa, Cryptosporidium parvum
SSISDSGLATNPGF

SEQ ID NO: 2283365 - protein, 46 aa, Cryptosporidium parvum
SSISESGNNNVTNNNNNINNNNGNNNNNNNNNNNGNNNNDSINNNN

SEQ ID NO: 2283366 - protein, 5 aa, Cryptosporidium parvum
SSISK

SEQ ID NO: 2283367 - protein, 7 aa, Cryptosporidium parvum
SSISKSP

SEQ ID NO: 2283368 - protein, 8 aa, Cryptosporidium parvum
SSISNQYN

SEQ ID NO: 2283369 - protein, 32 aa, Cryptosporidium parvum
SSISNYGCSTSSITNSTSIQNQAINSTNTGSG

SEQ ID NO: 2283370 - protein, 6 aa, Cryptosporidium parvum
SSISQA

SEQ ID NO: 2283371 - protein, 13 aa, Cryptosporidium parvum
SSISSPSLYSNRE

SEQ ID NO: 2283372 - protein, 4 aa, Cryptosporidium parvum
SSIT

SEQ ID NO: 2283373 - protein, 48 aa, Cryptosporidium parvum
SSKAAGGGPGDQKQPAVQNQMGASSGTPNSSHSTEPSSVSMQQQQQQH

SEQ ID NO: 2283374 - protein, 13 aa, Cryptosporidium parvum
SSKAKKSDDELAQ

SEQ ID NO: 2283375 - protein, 10 aa, Cryptosporidium parvum
SSKDEEDKAV

SEQ ID NO: 2283376 - protein, 9 aa, Cryptosporidium parvum
SSKDKECTS

SEQ ID NO: 2283377 - protein, 43 aa, Cryptosporidium parvum
SSKDKKKKASGDSSGAGANSGMDAHGNSLDGENANTDENSSLG

SEQ ID NO: 2283378 - protein, 8 aa, Cryptosporidium parvum
SSKDKSNN

SEQ ID NO: 2283379 - protein, 16 aa, Cryptosporidium parvum
SSKDPGKLLSSFPIII

SEQ ID NO: 2283380 - protein, 11 aa, Cryptosporidium parvum
SSKDSQSTPVP

SEQ ID NO: 2283381 - protein, 6 aa, Cryptosporidium parvum
SSKDYN

SEQ ID NO: 2283382 - protein, 4 aa, Cryptosporidium parvum
SSKE

SEQ ID NO: 2283383 - protein, 10 aa, Cryptosporidium parvum
SSKEHTDQRN

SEQ ID NO: 2283384 - protein, 7 aa, Cryptosporidium parvum
SSKEKMD

SEQ ID NO: 2283385 - protein, 13 aa, Cryptosporidium parvum
SSKESDFNSERKY

SEQ ID NO: 2283386 - protein, 11 aa, Cryptosporidium parvum
SSKESKDSKLE

SEQ ID NO: 2283387 - protein, 7 aa, Cryptosporidium parvum
SSKEVNR

SEQ ID NO: 2283388 - protein, 9 aa, Cryptosporidium parvum
SSKFDKDSR

SEQ ID NO: 2283389 - protein, 14 aa, Cryptosporidium parvum
SSKFEENNDISQAN

SEQ ID NO: 2283390 - protein, 7 aa, Cryptosporidium parvum
SSKFGHG

SEQ ID NO: 2283391 - protein, 7 aa, Cryptosporidium parvum
SSKFPKR

SEQ ID NO: 2283392 - protein, 8 aa, Cryptosporidium parvum
SSKFQQQN

SEQ ID NO: 2283393 - protein, 8 aa, Cryptosporidium parvum
SSKGEFGT

SEQ ID NO: 2283394 - protein, 6 aa, Cryptosporidium parvum
SSKGIN

SEQ ID NO: 2283395 - protein, 8 aa, Cryptosporidium parvum
SSKGRIRE

SEQ ID NO: 2283396 - protein, 7 aa, Cryptosporidium parvum
SSKIDDN

SEQ ID NO: 2283397 - protein, 17 aa, Cryptosporidium parvum
SSKIENSLDKRKDKLGF

SEQ ID NO: 2283398 - protein, 10 aa, Cryptosporidium parvum
SSKINSSEHG

SEQ ID NO: 2283399 - protein, 6 aa, Cryptosporidium parvum
SSKISD

SEQ ID NO: 2283400 - protein, 33 aa, Cryptosporidium parvum
SSKKATTTSKTSASSKNDKNKLHDDRDPGAPLR

SEQ ID NO: 2283401 - protein, 9 aa, Cryptosporidium parvum
SSKKESDSE

SEQ ID NO: 2283402 - protein, 11 aa, Cryptosporidium parvum
SSKKESQGKKV

SEQ ID NO: 2283403 - protein, 9 aa, Cryptosporidium parvum
SSKKFPTKG

SEQ ID NO: 2283404 - protein, 4 aa, Cryptosporidium parvum
SSKL

SEQ ID NO: 2283405 - protein, 5 aa, Cryptosporidium parvum
SSKLE

SEQ ID NO: 2283406 - protein, 7 aa, Cryptosporidium parvum
SSKLRSN

SEQ ID NO: 2283407 - protein, 14 aa, Cryptosporidium parvum
SSKLSESSDKLSKN

SEQ ID NO: 2283408 - protein, 4 aa, Cryptosporidium parvum
SSKN

SEQ ID NO: 2283409 - protein, 14 aa, Cryptosporidium parvum
SSKNDYSTNNNMPN

SEQ ID NO: 2283410 - protein, 8 aa, Cryptosporidium parvum
SSKNISSN

SEQ ID NO: 2283411 - protein, 14 aa, Cryptosporidium parvum
SSKNNSNLSTIQIP

SEQ ID NO: 2283412 - protein, 15 aa, Cryptosporidium parvum
SSKNNTRRNSNTPIT

SEQ ID NO: 2283413 - protein, 10 aa, Cryptosporidium parvum
SSKNSKSNSK

SEQ ID NO: 2283414 - protein, 5 aa, Cryptosporidium parvum
SSKNY

SEQ ID NO: 2283415 - protein, 8 aa, Cryptosporidium parvum
SSKPDEEI

SEQ ID NO: 2283416 - protein, 5 aa, Cryptosporidium parvum
SSKPF

SEQ ID NO: 2283417 - protein, 16 aa, Cryptosporidium parvum
SSKPGEPAQLKPPPGL

SEQ ID NO: 2283418 - protein, 5 aa, Cryptosporidium parvum
SSKPI

SEQ ID NO: 2283419 - protein, 10 aa, Cryptosporidium parvum
SSKPLQVKSH

SEQ ID NO: 2283420 - protein, 18 aa, Cryptosporidium parvum
SSKPPSPSTLNNSNNQPI

SEQ ID NO: 2283421 - protein, 10 aa, Cryptosporidium parvum
SSKPQKKASK

SEQ ID NO: 2283422 - protein, 11 aa, Cryptosporidium parvum
SSKPSGETNLS

SEQ ID NO: 2283423 - protein, 10 aa, Cryptosporidium parvum
SSKPTSNSEH

SEQ ID NO: 2283424 - protein, 8 aa, Cryptosporidium parvum
SSKRDERF

SEQ ID NO: 2283425 - protein, 15 aa, Cryptosporidium parvum
SSKRGTYGLASPSKK

SEQ ID NO: 2283426 - protein, 23 aa, Cryptosporidium parvum
SSKRPHTKRGRSTANTSNSSNQS

SEQ ID NO: 2283427 - protein, 17 aa, Cryptosporidium parvum
SSKRTLDTRDKEQKKKI

SEQ ID NO: 2283428 - protein, 6 aa, Cryptosporidium parvum
SSKSKR

SEQ ID NO: 2283429 - protein, 6 aa, Cryptosporidium parvum
SSKSLH

SEQ ID NO: 2283430 - protein, 22 aa, Cryptosporidium parvum
SSKSRNSLKNINQTQEENNREP

SEQ ID NO: 2283431 - protein, 14 aa, Cryptosporidium parvum
SSKTEINELLEEKL

SEQ ID NO: 2283432 - protein, 10 aa, Cryptosporidium parvum
SSKTENCQEC

SEQ ID NO: 2283433 - protein, 7 aa, Cryptosporidium parvum
SSKTGTY

SEQ ID NO: 2283434 - protein, 9 aa, Cryptosporidium parvum
SSKTQITPS

SEQ ID NO: 2283435 - protein, 23 aa, Cryptosporidium parvum
SSKTSSNDSCSDYLSSESSDDEI

SEQ ID NO: 2283436 - protein, 8 aa, Cryptosporidium parvum
SSKYETGP

SEQ ID NO: 2283437 - protein, 5 aa, Cryptosporidium parvum
SSKYP

SEQ ID NO: 2283438 - protein, 15 aa, Cryptosporidium parvum
SSKYSKSNNYHSSRN

SEQ ID NO: 2283439 - protein, 8 aa, Cryptosporidium parvum
SSLAPPIE

SEQ ID NO: 2283440 - protein, 9 aa, Cryptosporidium parvum
SSLDANEYG

SEQ ID NO: 2283441 - protein, 7 aa, Cryptosporidium parvum
SSLDGNI

SEQ ID NO: 2283442 - protein, 9 aa, Cryptosporidium parvum
SSLDPNNYI

SEQ ID NO: 2283443 - protein, 9 aa, Cryptosporidium parvum
SSLEPFESH

SEQ ID NO: 2283444 - protein, 7 aa, Cryptosporidium parvum
SSLGQRT

SEQ ID NO: 2283445 - protein, 12 aa, Cryptosporidium parvum
SSLGSGSFSDSS

SEQ ID NO: 2283446 - protein, 34 aa, Cryptosporidium parvum; identical to SEQ ID NO: 2163488

SEQ ID NO: 2283447 - protein, 6 aa, Cryptosporidium parvum
SSLISK

SEQ ID NO: 2283448 - protein, 16 aa, Cryptosporidium parvum
SSLKGLKDKKLKSKLS

SEQ ID NO: 2283449 - protein, 7 aa, Cryptosporidium parvum
SSLKRKS

SEQ ID NO: 2283450 - protein, 40 aa, Cryptosporidium parvum
SSLKSAEINEQDDSNNKPASIEEPDSANEKTSDSKPEISP

SEQ ID NO: 2283451 - protein, 10 aa, Cryptosporidium parvum
SSLKSKKSLE

SEQ ID NO: 2283452 - protein, 11 aa, Cryptosporidium parvum
SSLKTRRSEIQ

SEQ ID NO: 2283453 - protein, 23 aa, Cryptosporidium parvum
SSLLSKGKKTVNNVDRRASKGRK

SEQ ID NO: 2283454 - protein, 8 aa, Cryptosporidium parvum
SSLNDEKI

SEQ ID NO: 2283455 - protein, 9 aa, Cryptosporidium parvum
SSLNDSKRI

SEQ ID NO: 2283456 - protein, 13 aa, Cryptosporidium parvum
SSLNESVSAPQEE

SEQ ID NO: 2283457 - protein, 14 aa, Cryptosporidium parvum
SSLNKSESKEENVK

SEQ ID NO: 2283458 - protein, 15 aa, Cryptosporidium parvum
SSLNNAYSECTNSPI

SEQ ID NO: 2283459 - protein, 33 aa, Cryptosporidium parvum
SSLNNNNNNNNNNRQSVSSINSNLPENSSNKGL

SEQ ID NO: 2283460 - protein, 10 aa, Cryptosporidium parvum
SSLNSGEEKN

SEQ ID NO: 2283461 - protein, 5 aa, Cryptosporidium parvum
SSLNT

SEQ ID NO: 2283462 - protein, 6 aa, Cryptosporidium parvum
SSLPEP

SEQ ID NO: 2283463 - protein, 19 aa, Cryptosporidium parvum
SSLPQEDTRINSSIKDERS

SEQ ID NO: 2283464 - protein, 7 aa, Cryptosporidium parvum
SSLPSTV

SEQ ID NO: 2283465 - protein, 4 aa, Cryptosporidium parvum
SSLQ

SEQ ID NO: 2283466 - protein, 10 aa, Cryptosporidium parvum
SSLQGRKTVS

SEQ ID NO: 2283467 - protein, 6 aa, Cryptosporidium parvum
SSLREK

SEQ ID NO: 2283468 - protein, 13 aa, Cryptosporidium parvum
SSLRTNGKNSALR

SEQ ID NO: 2283469 - protein, 9 aa, Cryptosporidium parvum
SSLSATENT

SEQ ID NO: 2283470 - protein, 12 aa, Cryptosporidium parvum
SSLSDENKNMSE

SEQ ID NO: 2283471 - protein, 7 aa, Cryptosporidium parvum
SSLSDEY

SEQ ID NO: 2283472 - protein, 16 aa, Cryptosporidium parvum
SSLSEENRSRTSKDMK

SEQ ID NO: 2283473 - protein, 10 aa, Cryptosporidium parvum
SSLSFKGDKI

SEQ ID NO: 2283474 - protein, 11 aa, Cryptosporidium parvum
SSLSHNNDHLT

SEQ ID NO: 2283475 - protein, 15 aa, Cryptosporidium parvum
SSLSNQNIKSERDNV

SEQ ID NO: 2283476 - protein, 6 aa, Cryptosporidium parvum
SSLSNR

SEQ ID NO: 2283477 - protein, 6 aa, Cryptosporidium parvum
SSLSPK

SEQ ID NO: 2283478 - protein, 15 aa, Cryptosporidium parvum
SSLSRSPERPSEPYF

SEQ ID NO: 2283479 - protein, 5 aa, Cryptosporidium parvum
SSLSS

SEQ ID NO: 2283480 - protein, 6 aa, Cryptosporidium parvum
SSLSTS

SEQ ID NO: 2283481 - protein, 5 aa, Cryptosporidium parvum
SSLTG

SEQ ID NO: 2283482 - protein, 17 aa, Cryptosporidium parvum
SSLTNPEAGNSDCSSNN

SEQ ID NO: 2283483 - protein, 14 aa, Cryptosporidium parvum
SSLTPFSASSNFDT

SEQ ID NO: 2283484 - protein, 4 aa, Cryptosporidium parvum
SSLY

SEQ ID NO: 2283485 - protein, 13 aa, Cryptosporidium parvum
SSMARKGNTYGDI

SEQ ID NO: 2283486 - protein, 19 aa, Cryptosporidium parvum
SSMEMGSENHSKEENEAKK

SEQ ID NO: 2283487 - protein, 5 aa, Cryptosporidium parvum
SSMER

SEQ ID NO: 2283488 - protein, 12 aa, Cryptosporidium parvum
SSMFPRDPKRLS

SEQ ID NO: 2283489 - protein, 6 aa, Cryptosporidium parvum
SSMTER

SEQ ID NO: 2283490 - protein, 11 aa, Cryptosporidium parvum
SSMTVTTKSSL

SEQ ID NO: 2283491 - protein, 23 aa, Cryptosporidium parvum
SSNCNPSNSCSASSSSSSSISNY

SEQ ID NO: 2283492 - protein, 10 aa, Cryptosporidium parvum
SSNDDDGFSE

SEQ ID NO: 2283493 - protein, 6 aa, Cryptosporidium parvum
SSNDSL

SEQ ID NO: 2283494 - protein, 4 aa, Cryptosporidium parvum
SSNE

SEQ ID NO: 2283495 - protein, 7 aa, Cryptosporidium parvum
SSNEHIS

SEQ ID NO: 2283496 - protein, 16 aa, Cryptosporidium parvum
SSNEINLSPDKSKLPN

SEQ ID NO: 2283497 - protein, 9 aa, Cryptosporidium parvum
SSNENISNN

SEQ ID NO: 2283498 - protein, 7 aa, Cryptosporidium parvum
SSNEQTL

SEQ ID NO: 2283499 - protein, 12 aa, Cryptosporidium parvum
SSNESDEDHKER

SEQ ID NO: 2283500 - protein, 23 aa, Cryptosporidium parvum
SSNESQGTHQSSNYLNKDSSIPT

SEQ ID NO: 2283501 - protein, 4 aa, Cryptosporidium parvum
SSNG

SEQ ID NO: 2283502 - protein, 16 aa, Cryptosporidium parvum
SSNGSNVQNDSTDGQT

SEQ ID NO: 2283503 - protein, 8 aa, Cryptosporidium parvum
SSNGVTKS

SEQ ID NO: 2283504 - protein, 7 aa, Cryptosporidium parvum
SSNHEKY

SEQ ID NO: 2283505 - protein, 12 aa, Cryptosporidium parvum
SSNHENKSKEET

SEQ ID NO: 2283506 - protein, 9 aa, Cryptosporidium parvum
SSNIDSDEE

SEQ ID NO: 2283507 - protein, 9 aa, Cryptosporidium parvum
SSNIDSETA

SEQ ID NO: 2283508 - protein, 28 aa, Cryptosporidium parvum
SSNIGVSPNLQGSINADGSVKGNLRHPT

SEQ ID NO: 2283509 - protein, 12 aa, Cryptosporidium parvum
SSNINRNRVPKG

SEQ ID NO: 2283510 - protein, 16 aa, Cryptosporidium parvum
SSNKDELNKSESFSNP

SEQ ID NO: 2283511 - protein, 12 aa, Cryptosporidium parvum
SSNKEPLGPTSE

SEQ ID NO: 2283512 - protein, 17 aa, Cryptosporidium parvum
SSNKGPKDSDSLNTENI

SEQ ID NO: 2283513 - protein, 9 aa, Cryptosporidium parvum
SSNKGSKYK

SEQ ID NO: 2283514 - protein, 7 aa, Cryptosporidium parvum
SSNKKTF

SEQ ID NO: 2283515 - protein, 8 aa, Cryptosporidium parvum
SSNKLPNE

SEQ ID NO: 2283516 - protein, 16 aa, Cryptosporidium parvum
SSNKNESSIHENQKRT

SEQ ID NO: 2283517 - protein, 7 aa, Cryptosporidium parvum
SSNKNTL

SEQ ID NO: 2283518 - protein, 6 aa, Cryptosporidium parvum
SSNKRI

SEQ ID NO: 2283519 - protein, 14 aa, Cryptosporidium parvum
SSNLKGNKSDYEYN

SEQ ID NO: 2283520 - protein, 24 aa, Cryptosporidium parvum
SSNLNSNKSESSKNSNGKIENTSF

SEQ ID NO: 2283521 - protein, 9 aa, Cryptosporidium parvum
SSNLPKEYT

SEQ ID NO: 2283522 - protein, 16 aa, Cryptosporidium parvum
SSNLPKSTIQTSNSNI

SEQ ID NO: 2283523 - protein, 6 aa, Cryptosporidium parvum
SSNLTE

SEQ ID NO: 2283524 - protein, 14 aa, Cryptosporidium parvum
SSNNENGDNENVQM

SEQ ID NO: 2283525 - protein, 7 aa, Cryptosporidium parvum
SSNNIDS

SEQ ID NO: 2283526 - protein, 8 aa, Cryptosporidium parvum
SSNNLNDQ

SEQ ID NO: 2283527 - protein, 31 aa, Cryptosporidium parvum; identical to SEQ ID NO: 2163558

SEQ ID NO: 2283528 - protein, 43 aa, Cryptosporidium parvum
SSNNPKDKVYGSLQENHSDQVGPTKKKPRFTHNSSSRNDQSYK

SEQ ID NO: 2283529 - protein, 19 aa, Cryptosporidium parvum
SSNNQIQSDPKKSMNSSTP

SEQ ID NO: 2283530 - protein, 33 aa, Cryptosporidium parvum; identical to SEQ ID NO: 2163561

SEQ ID NO: 2283531 - protein, 7 aa, Cryptosporidium parvum
SSNNSDV

SEQ ID NO: 2283532 - protein, 8 aa, Cryptosporidium parvum
SSNNSEDY

SEQ ID NO: 2283533 - protein, 21 aa, Cryptosporidium parvum
SSNNSVSSGIGDSGTGNEKRY

SEQ ID NO: 2283534 - protein, 5 aa, Cryptosporidium parvum
SSNNV

SEQ ID NO: 2283535 - protein, 20 aa, Cryptosporidium parvum
SSNPAGGTSHRRRIARAKRS

SEQ ID NO: 2283536 - protein, 8 aa, Cryptosporidium parvum
SSNPEQFR

SEQ ID NO: 2283537 - protein, 23 aa, Cryptosporidium parvum
SSNPRIVEDSNQDSVSSPGGNAQ

SEQ ID NO: 2283538 - protein, 18 aa, Cryptosporidium parvum
SSNQSGLGISDTKNNGSD

SEQ ID NO: 2283539 - protein, 8 aa, Cryptosporidium parvum
SSNQSSSI

SEQ ID NO: 2283540 - protein, 7 aa, Cryptosporidium parvum
SSNQTDF

SEQ ID NO: 2283541 - protein, 10 aa, Cryptosporidium parvum
SSNQVTNFSD

SEQ ID NO: 2283542 - protein, 6 aa, Cryptosporidium parvum
SSNRNN

SEQ ID NO: 2283543 - protein, 40 aa, Cryptosporidium parvum
SSNSDESNRDNSETVSGNKAIRSQDNDKELSSREKHEGSD

SEQ ID NO: 2283544 - protein, 7 aa, Cryptosporidium parvum
SSNSDLN

SEQ ID NO: 2283545 - protein, 10 aa, Cryptosporidium parvum
SSNSDTESLN

SEQ ID NO: 2283546 - protein, 17 aa, Cryptosporidium parvum
SSNSGNDECFSKSSRNR

SEQ ID NO: 2283547 - protein, 9 aa, Cryptosporidium parvum
SSNSGTSKI

SEQ ID NO: 2283548 - protein, 17 aa, Cryptosporidium parvum
SSNSIDDQQKVQDKDPF

SEQ ID NO: 2283549 - protein, 17 aa, Cryptosporidium parvum
SSNSIDGSKANNELSSG

SEQ ID NO: 2283550 - protein, 9 aa, Cryptosporidium parvum
SSNSISKHS

SEQ ID NO: 2283551 - protein, 9 aa, Cryptosporidium parvum
SSNSNNISD

SEQ ID NO: 2283552 - protein, 27 aa, Cryptosporidium parvum
SSNSNNNNNNNNINQSTPLNIAKKYEI

SEQ ID NO: 2283553 - protein, 5 aa, Cryptosporidium parvum
SSNSQ

SEQ ID NO: 2283554 - protein, 5 aa, Cryptosporidium parvum
SSNSR

SEQ ID NO: 2283555 - protein, 10 aa, Cryptosporidium parvum
SSNSREAKEE

SEQ ID NO: 2283556 - protein, 8 aa, Cryptosporidium parvum
SSNSRSDL

SEQ ID NO: 2283557 - protein, 7 aa, Cryptosporidium parvum
SSNSSDW

SEQ ID NO: 2283558 - protein, 8 aa, Cryptosporidium parvum
SSNSSEYV

SEQ ID NO: 2283559 - protein, 11 aa, Cryptosporidium parvum
SSNSSSSISNT

SEQ ID NO: 2283560 - protein, 18 aa, Cryptosporidium parvum
SSNTENDSQENGMGNNEL

SEQ ID NO: 2283561 - protein, 5 aa, Cryptosporidium parvum
SSNTI

SEQ ID NO: 2283562 - protein, 9 aa, Cryptosporidium parvum
SSNTPEGNE

SEQ ID NO: 2283563 - protein, 7 aa, Cryptosporidium parvum
SSNTSQN

SEQ ID NO: 2283564 - protein, 19 aa, Cryptosporidium parvum
SSNTVSKAAELNNGLSGRG

SEQ ID NO: 2283565 - protein, 6 aa, Cryptosporidium parvum
SSNVPE

SEQ ID NO: 2283566 - protein, 12 aa, Cryptosporidium parvum
SSNVTEDSQGYP

SEQ ID NO: 2283567 - protein, 17 aa, Cryptosporidium parvum
SSNWSKSGITTSSGTYN

SEQ ID NO: 2283568 - protein, 4 aa, Cryptosporidium parvum
SSNY

SEQ ID NO: 2283569 - protein, 8 aa, Cryptosporidium parvum
SSNYDGIH

SEQ ID NO: 2283570 - protein, 7 aa, Cryptosporidium parvum
SSNYRSG

SEQ ID NO: 2283571 - protein, 8 aa, Cryptosporidium parvum
SSPCGSTI

SEQ ID NO: 2283572 - protein, 15 aa, Cryptosporidium parvum
SSPDGSIRQESETQF

SEQ ID NO: 2283573 - protein, 10 aa, Cryptosporidium parvum
SSPDTEKQTK

SEQ ID NO: 2283574 - protein, 25 aa, Cryptosporidium parvum
SSPELKNKIQEGSRINKDLDKPEQK

SEQ ID NO: 2283575 - protein, 10 aa, Cryptosporidium parvum
SSPEPNDPLD

SEQ ID NO: 2283576 - protein, 11 aa, Cryptosporidium parvum
SSPEPNDPQDA

SEQ ID NO: 2283577 - protein, 62 aa, Cryptosporidium parvum
SSPFGGSISGSGSTSAIGSSPFGSAVGGSGSISSSSSSSSSSSSSSSSTGNVKPSKSDNPTL

SEQ ID NO: 2283578 - protein, 26 aa, Cryptosporidium parvum
SSPFGSSVSGSGSSTISTTGPTTGSI

SEQ ID NO: 2283579 - protein, 5 aa, Cryptosporidium parvum
SSPFL

SEQ ID NO: 2283580 - protein, 16 aa, Cryptosporidium parvum
SSPFPLPEGSQPVEPR

SEQ ID NO: 2283581 - protein, 14 aa, Cryptosporidium parvum
SSPFSSGTENSQEV

SEQ ID NO: 2283582 - protein, 5 aa, Cryptosporidium parvum
SSPGI

SEQ ID NO: 2283583 - protein, 7 aa, Cryptosporidium parvum
SSPHEEY

SEQ ID NO: 2283584 - protein, 13 aa, Cryptosporidium parvum
SSPIGNPQYYPGK

SEQ ID NO: 2283585 - protein, 5 aa, Cryptosporidium parvum
SSPIN

SEQ ID NO: 2283586 - protein, 6 aa, Cryptosporidium parvum
SSPIRD

SEQ ID NO: 2283587 - protein, 4 aa, Cryptosporidium parvum
SSPK

SEQ ID NO: 2283588 - protein, 7 aa, Cryptosporidium parvum
SSPKQHL

SEQ ID NO: 2283589 - protein, 15 aa, Cryptosporidium parvum
SSPLEGSSDISTPQS

SEQ ID NO: 2283590 - protein, 6 aa, Cryptosporidium parvum
SSPLFS

SEQ ID NO: 2283591 - protein, 14 aa, Cryptosporidium parvum
SSPNGELKLPDEEN

SEQ ID NO: 2283592 - protein, 7 aa, Cryptosporidium parvum
SSPNGGF

SEQ ID NO: 2283593 - protein, 16 aa, Cryptosporidium parvum
SSPNNANSNNSNAISN

SEQ ID NO: 2283594 - protein, 6 aa, Cryptosporidium parvum
SSPNVS

SEQ ID NO: 2283595 - protein, 7 aa, Cryptosporidium parvum
SSPPELK

SEQ ID NO: 2283596 - protein, 8 aa, Cryptosporidium parvum
SSPPGNGQ

SEQ ID NO: 2283597 - protein, 12 aa, Cryptosporidium parvum
SSPPSIKSAKSL

SEQ ID NO: 2283598 - protein, 6 aa, Cryptosporidium parvum
SSPQAQ

SEQ ID NO: 2283599 - protein, 5 aa, Cryptosporidium parvum
SSPRI

SEQ ID NO: 2283600 - protein, 13 aa, Cryptosporidium parvum
SSPSLQNQNTLET

SEQ ID NO: 2283601 - protein, 24 aa, Cryptosporidium parvum
SSPSSIPVSPHSSLGSVSGSPGAF

SEQ ID NO: 2283602 - protein, 12 aa, Cryptosporidium parvum
SSPSSSSSSSPH

SEQ ID NO: 2283603 - protein, 9 aa, Cryptosporidium parvum
SSPSVSTPV

SEQ ID NO: 2283604 - protein, 12 aa, Cryptosporidium parvum
SSPSYPSNDHHT

SEQ ID NO: 2283605 - protein, 8 aa, Cryptosporidium parvum
SSPSYSVK

SEQ ID NO: 2283606 - protein, 6 aa, Cryptosporidium parvum
SSPSYT

SEQ ID NO: 2283607 - protein, 5 aa, Cryptosporidium parvum
SSPTM

SEQ ID NO: 2283608 - protein, 6 aa, Cryptosporidium parvum
SSPTNY

SEQ ID NO: 2283609 - protein, 6 aa, Cryptosporidium parvum
SSPYGN

SEQ ID NO: 2283610 - protein, 11 aa, Cryptosporidium parvum
SSPYNNESQEY

SEQ ID NO: 2283611 - protein, 10 aa, Cryptosporidium parvum
SSPYSASSNL

SEQ ID NO: 2283612 - protein, 8 aa, Cryptosporidium parvum
SSQCDTNS

SEQ ID NO: 2283613 - protein, 10 aa, Cryptosporidium parvum
SSQDKEEDFS

SEQ ID NO: 2283614 - protein, 37 aa, Cryptosporidium parvum
SSQDSIKLSTGGSKEKLADSITGLQNNSSSSSSTNSS

SEQ ID NO: 2283615 - protein, 17 aa, Cryptosporidium parvum
SSQDSVGYPAPQRGQSS

SEQ ID NO: 2283616 - protein, 7 aa, Cryptosporidium parvum
SSQDTRQ

SEQ ID NO: 2283617 - protein, 24 aa, Cryptosporidium parvum
SSQEDLKKNQGVQTRSMARSNINK

SEQ ID NO: 2283618 - protein, 12 aa, Cryptosporidium parvum
SSQENLPSEERQ

SEQ ID NO: 2283619 - protein, 5 aa, Cryptosporidium parvum
SSQES

SEQ ID NO: 2283620 - protein, 6 aa, Cryptosporidium parvum
SSQETI

SEQ ID NO: 2283621 - protein, 13 aa, Cryptosporidium parvum
SSQGSERSSINSQ

SEQ ID NO: 2283622 - protein, 13 aa, Cryptosporidium parvum
SSQKIASKKMTKI

SEQ ID NO: 2283623 - protein, 14 aa, Cryptosporidium parvum
SSQKKFESASNDKE

SEQ ID NO: 2283624 - protein, 12 aa, Cryptosporidium parvum
SSQKRPRSCSSD

SEQ ID NO: 2283625 - protein, 4 aa, Cryptosporidium parvum
SSQL

SEQ ID NO: 2283626 - protein, 6 aa, Cryptosporidium parvum
SSQLSE

SEQ ID NO: 2283627 - protein, 5 aa, Cryptosporidium parvum
SSQMG

SEQ ID NO: 2283628 - protein, 7 aa, Cryptosporidium parvum
SSQMSDR

SEQ ID NO: 2283629 - protein, 10 aa, Cryptosporidium parvum
SSQNPSSYQN

SEQ ID NO: 2283630 - protein, 10 aa, Cryptosporidium parvum
SSQNQDKSSR

SEQ ID NO: 2283631 - protein, 5 aa, Cryptosporidium parvum
SSQNT

SEQ ID NO: 2283632 - protein, 9 aa, Cryptosporidium parvum
SSQNTTSIQ

SEQ ID NO: 2283633 - protein, 7 aa, Cryptosporidium parvum
SSQPKSA

SEQ ID NO: 2283634 - protein, 7 aa, Cryptosporidium parvum
SSQPKTV

SEQ ID NO: 2283635 - protein, 16 aa, Cryptosporidium parvum
SSQPLDYNGENKGGYN

SEQ ID NO: 2283636 - protein, 7 aa, Cryptosporidium parvum
SSQPSEI

SEQ ID NO: 2283637 - protein, 23 aa, Cryptosporidium parvum
SSQQSTSSSNKRARNEDELNNTI

SEQ ID NO: 2283638 - protein, 16 aa, Cryptosporidium parvum
SSQSDTNITAQKGEVI

SEQ ID NO: 2283639 - protein, 9 aa, Cryptosporidium parvum
SSQSPKNKS

SEQ ID NO: 2283640 - protein, 19 aa, Cryptosporidium parvum
SSQVQAQNQNQSQPQTQPQ

SEQ ID NO: 2283641 - protein, 9 aa, Cryptosporidium parvum
SSQYVEGGQ

SEQ ID NO: 2283642 - protein, 6 aa, Cryptosporidium parvum
SSRADC

SEQ ID NO: 2283643 - protein, 12 aa, Cryptosporidium parvum
SSRDLTKDCDQS

SEQ ID NO: 2283644 - protein, 7 aa, Cryptosporidium parvum
SSRDPDT

SEQ ID NO: 2283645 - protein, 7 aa, Cryptosporidium parvum
SSREGEL

SEQ ID NO: 2283646 - protein, 6 aa, Cryptosporidium parvum
SSRENC

SEQ ID NO: 2283647 - protein, 4 aa, Cryptosporidium parvum
SSRG

SEQ ID NO: 2283648 - protein, 6 aa, Cryptosporidium parvum
SSRGAI

SEQ ID NO: 2283649 - protein, 70 aa, Cryptosporidium parvum
SSRGRGSGRGGSVRGRASSGAIRTNGGSSGIGASSGGNGMGRLTGRGGLGSGTAGSSSRGRGLARGGLSS

SEQ ID NO: 2283650 - protein, 9 aa, Cryptosporidium parvum
SSRKNSNWE

SEQ ID NO: 2283651 - protein, 14 aa, Cryptosporidium parvum
SSRLSPNNRRSTES

SEQ ID NO: 2283652 - protein, 14 aa, Cryptosporidium parvum
SSRNEQENEATRRI

SEQ ID NO: 2283653 - protein, 7 aa, Cryptosporidium parvum
SSRNKLD

SEQ ID NO: 2283654 - protein, 17 aa, Cryptosporidium parvum
SSRNYPTNHSINNNSKN

SEQ ID NO: 2283655 - protein, 17 aa, Cryptosporidium parvum
SSRQNCQGRRQRPRNID

SEQ ID NO: 2283656 - protein, 14 aa, Cryptosporidium parvum
SSRQSQTIGRHDAP

SEQ ID NO: 2283657 - protein, 6 aa, Cryptosporidium parvum
SSRRPK

SEQ ID NO: 2283658 - protein, 9 aa, Cryptosporidium parvum
SSRSDLPEI

SEQ ID NO: 2283659 - protein, 9 aa, Cryptosporidium parvum
SSRSQHESK

SEQ ID NO: 2283660 - protein, 9 aa, Cryptosporidium parvum
SSRTGSNSG

SEQ ID NO: 2283661 - protein, 6 aa, Cryptosporidium parvum
SSRTIN

SEQ ID NO: 2283662 - protein, 6 aa, Cryptosporidium parvum
SSRTRQ

SEQ ID NO: 2283663 - protein, 19 aa, Cryptosporidium parvum
SSSANNEAMTSSSMNTNSN

SEQ ID NO: 2283664 - protein, 7 aa, Cryptosporidium parvum
SSSASPF

SEQ ID NO: 2283665 - protein, 10 aa, Cryptosporidium parvum
SSSASSSSIM

SEQ ID NO: 2283666 - protein, 12 aa, Cryptosporidium parvum
SSSCRPKSQGLH

SEQ ID NO: 2283667 - protein, 10 aa, Cryptosporidium parvum
SSSDGASIKH

SEQ ID NO: 2283668 - protein, 9 aa, Cryptosporidium parvum
SSSDSNIDT

SEQ ID NO: 2283669 - protein, 9 aa, Cryptosporidium parvum
SSSDTIGYD

SEQ ID NO: 2283670 - protein, 7 aa, Cryptosporidium parvum
SSSDVNE

SEQ ID NO: 2283671 - protein, 5 aa, Cryptosporidium parvum
SSSDY

SEQ ID NO: 2283672 - protein, 4 aa, Cryptosporidium parvum
SSSE

SEQ ID NO: 2283673 - protein, 9 aa, Cryptosporidium parvum
SSSEESKIN

SEQ ID NO: 2283674 - protein, 14 aa, Cryptosporidium parvum
SSSEINSSNDSPLF

SEQ ID NO: 2283675 - protein, 6 aa, Cryptosporidium parvum
SSSEKF

SEQ ID NO: 2283676 - protein, 7 aa, Cryptosporidium parvum
SSSEKGL

SEQ ID NO: 2283677 - protein, 10 aa, Cryptosporidium parvum
SSSEKNFGMT

SEQ ID NO: 2283678 - protein, 8 aa, Cryptosporidium parvum
SSSENSID

SEQ ID NO: 2283679 - protein, 9 aa, Cryptosporidium parvum
SSSENSPSL

SEQ ID NO: 2283680 - protein, 15 aa, Cryptosporidium parvum
SSSESKSDSETKERT

SEQ ID NO: 2283681 - protein, 7 aa, Cryptosporidium parvum
SSSESYS

SEQ ID NO: 2283682 - protein, 5 aa, Cryptosporidium parvum
SSSET

SEQ ID NO: 2283683 - protein, 16 aa, Cryptosporidium parvum
SSSEYNEISEDSTEID

SEQ ID NO: 2283684 - protein, 45 aa, Cryptosporidium parvum
SSSEYPERRISTRNSIHSSSDNKIDLNDSDEGFKDHSGIDNDEVS

SEQ ID NO: 2283685 - protein, 14 aa, Cryptosporidium parvum
SSSFKNNSSGKSRE

SEQ ID NO: 2283686 - protein, 7 aa, Cryptosporidium parvum
SSSGDPE

SEQ ID NO: 2283687 - protein, 34 aa, Cryptosporidium parvum
SSSGEDEFENNSDYDNGFYSDADSNQSDDYSNEE

SEQ ID NO: 2283688 - protein, 9 aa, Cryptosporidium parvum
SSSGEECHD

SEQ ID NO: 2283689 - protein, 42 aa, Cryptosporidium parvum
SSSGQPSHSGANNSGGIASNYEELGGGIGNTSGFGVTSNGAG

SEQ ID NO: 2283690 - protein, 8 aa, Cryptosporidium parvum
SSSGREDV

SEQ ID NO: 2283691 - protein, 19 aa, Cryptosporidium parvum
SSSGVSTKINDTEKREVSA

SEQ ID NO: 2283692 - protein, 13 aa, Cryptosporidium parvum
SSSHPKSRNESRV

SEQ ID NO: 2283693 - protein, 13 aa, Cryptosporidium parvum
SSSHTNKNTSITE

SEQ ID NO: 2283694 - protein, 10 aa, Cryptosporidium parvum
SSSIENTSTY

SEQ ID NO: 2283695 - protein, 7 aa, Cryptosporidium parvum
SSSIEPK

SEQ ID NO: 2283696 - protein, 9 aa, Cryptosporidium parvum
SSSIKNKTQ

SEQ ID NO: 2283697 - protein, 6 aa, Cryptosporidium parvum
SSSIKS

SEQ ID NO: 2283698 - protein, 11 aa, Cryptosporidium parvum
SSSINKGNDDV

SEQ ID NO: 2283699 - protein, 8 aa, Cryptosporidium parvum
SSSINTNY

SEQ ID NO: 2283700 - protein, 8 aa, Cryptosporidium parvum
SSSKGETI

SEQ ID NO: 2283701 - protein, 16 aa, Cryptosporidium parvum
SSSKKCLPSAISNSSL

SEQ ID NO: 2283702 - protein, 41 aa, Cryptosporidium parvum
SSSKNDEQNTTMTTESEIRENNAERPNDISSASSKISKSEK

SEQ ID NO: 2283703 - protein, 20 aa, Cryptosporidium parvum
SSSKRKRMRRIPSSSRNISS

SEQ ID NO: 2283704 - protein, 28 aa, Cryptosporidium parvum
SSSLEDENEGGDEDEGIQEFEDQTNGLA

SEQ ID NO: 2283705 - protein, 7 aa, Cryptosporidium parvum
SSSLGVN

SEQ ID NO: 2283706 - protein, 16 aa, Cryptosporidium parvum
SSSLSDDLTPISKTST

SEQ ID NO: 2283707 - protein, 20 aa, Cryptosporidium parvum
SSSMDSSNSESESSSDSEME

SEQ ID NO: 2283708 - protein, 6 aa, Cryptosporidium parvum
SSSNEH

SEQ ID NO: 2283709 - protein, 24 aa, Cryptosporidium parvum
SSSNFYSNSGFGPEVGTGAGYGAG

SEQ ID NO: 2283710 - protein, 16 aa, Cryptosporidium parvum
SSSNGPISSGKIAPKQ

SEQ ID NO: 2283711 - protein, 10 aa, Cryptosporidium parvum
SSSNMNAPNY

SEQ ID NO: 2283712 - protein, 7 aa, Cryptosporidium parvum
SSSNNYC

SEQ ID NO: 2283713 - protein, 7 aa, Cryptosporidium parvum
SSSNNYE

SEQ ID NO: 2283714 - protein, 9 aa, Cryptosporidium parvum
SSSNPTVKV

SEQ ID NO: 2283715 - protein, 7 aa, Cryptosporidium parvum
SSSNSMT

SEQ ID NO: 2283716 - protein, 6 aa, Cryptosporidium parvum
SSSNSS

SEQ ID NO: 2283717 - protein, 17 aa, Cryptosporidium parvum
SSSNTRNLHKNKSKKIP

SEQ ID NO: 2283718 - protein, 10 aa, Cryptosporidium parvum
SSSNTSRDLY

SEQ ID NO: 2283719 - protein, 21 aa, Cryptosporidium parvum
SSSNVNDSNNNDNNNNINSSS

SEQ ID NO: 2283720 - protein, 44 aa, Cryptosporidium parvum
SSSNYKNKQCHPKQTSNDNFQSASSRSSSLPPLSNSPNNQPSFE

SEQ ID NO: 2283721 - protein, 7 aa, Cryptosporidium parvum
SSSPEKA

SEQ ID NO: 2283722 - protein, 5 aa, Cryptosporidium parvum
SSSPI

SEQ ID NO: 2283723 - protein, 8 aa, Cryptosporidium parvum
SSSPRLSD

SEQ ID NO: 2283724 - protein, 17 aa, Cryptosporidium parvum
SSSPRNNSTTKIENSNR

SEQ ID NO: 2283725 - protein, 18 aa, Cryptosporidium parvum
SSSPSSPSSQVEESKEFE

SEQ ID NO: 2283726 - protein, 7 aa, Cryptosporidium parvum
SSSPSSQ

SEQ ID NO: 2283727 - protein, 6 aa, Cryptosporidium parvum
SSSPSV

SEQ ID NO: 2283728 - protein, 5 aa, Cryptosporidium parvum
SSSQS

SEQ ID NO: 2283729 - protein, 12 aa, Cryptosporidium parvum
SSSQSPGGVLSR

SEQ ID NO: 2283730 - protein, 6 aa, Cryptosporidium parvum
SSSRDS

SEQ ID NO: 2283731 - protein, 9 aa, Cryptosporidium parvum
SSSREQFGE

SEQ ID NO: 2283732 - protein, 10 aa, Cryptosporidium parvum
SSSRNYESRT

SEQ ID NO: 2283733 - protein, 13 aa, Cryptosporidium parvum
SSSRYVKKSQADI

SEQ ID NO: 2283734 - protein, 8 aa, Cryptosporidium parvum
SSSSEPLK

SEQ ID NO: 2283735 - protein, 15 aa, Cryptosporidium parvum
SSSSFKNKTNFSKEK

SEQ ID NO: 2283736 - protein, 8 aa, Cryptosporidium parvum
SSSSFSSG

SEQ ID NO: 2283737 - protein, 6 aa, Cryptosporidium parvum
SSSSFY

SEQ ID NO: 2283738 - protein, 26 aa, Cryptosporidium parvum
SSSSGSGSITGTNLSSNSSKSMSKEQ

SEQ ID NO: 2283739 - protein, 9 aa, Cryptosporidium parvum
SSSSIDGQS

SEQ ID NO: 2283740 - protein, 9 aa, Cryptosporidium parvum
SSSSINSKY

SEQ ID NO: 2283741 - protein, 6 aa, Cryptosporidium parvum
SSSSKR

SEQ ID NO: 2283742 - protein, 11 aa, Cryptosporidium parvum
SSSSNESQIKE

SEQ ID NO: 2283743 - protein, 10 aa, Cryptosporidium parvum
SSSSQLPRTG

SEQ ID NO: 2283744 - protein, 13 aa, Cryptosporidium parvum
SSSSQPNESNHNI

SEQ ID NO: 2283745 - protein, 78 aa, Cryptosporidium parvum
SSSSQSEDDEKYISKRHNKSNKDISDESNSQNLKDSRINESIEQSLSRGKLKTRSKDESDNDNNINNNNNDDEEDGIN

SEQ ID NO: 2283746 - protein, 20 aa, Cryptosporidium parvum
SSSSRYNRDYPNGSRSSLSQ

SEQ ID NO: 2283747 - protein, 9 aa, Cryptosporidium parvum
SSSSSEEVL

SEQ ID NO: 2283748 - protein, 17 aa, Cryptosporidium parvum
SSSSSESEGEQKRTGKI

SEQ ID NO: 2283749 - protein, 8 aa, Cryptosporidium parvum
SSSSSFIG

SEQ ID NO: 2283750 - protein, 21 aa, Cryptosporidium parvum
SSSSSGAGAVTGSGGAQTNAM

SEQ ID NO: 2283751 - protein, 16 aa, Cryptosporidium parvum
SSSSSRIANASEDNEI

SEQ ID NO: 2283752 - protein, 17 aa, Cryptosporidium parvum
SSSSSSSEESENEYRDQ

SEQ ID NO: 2283753 - protein, 15 aa, Cryptosporidium parvum
SSSSSSSSLSALSDI

SEQ ID NO: 2283754 - protein, 18 aa, Cryptosporidium parvum
SSSSSSSSNTNTTQEENS

SEQ ID NO: 2283755 - protein, 16 aa, Cryptosporidium parvum
SSSSSSSSPSQEQKLT

SEQ ID NO: 2283756 - protein, 21 aa, Cryptosporidium parvum
SSSSTGIPRPGRPKRTVTAKK

SEQ ID NO: 2283757 - protein, 17 aa, Cryptosporidium parvum
SSSSTKLEKSEENRNEM

SEQ ID NO: 2283758 - protein, 9 aa, Cryptosporidium parvum
SSSSTNATK

SEQ ID NO: 2283759 - protein, 8 aa, Cryptosporidium parvum
SSSSVENQ

SEQ ID NO: 2283760 - protein, 7 aa, Cryptosporidium parvum
SSSSYNL

SEQ ID NO: 2283761 - protein, 8 aa, Cryptosporidium parvum
SSSTGNQG

SEQ ID NO: 2283762 - protein, 41 aa, Cryptosporidium parvum
SSSTIETNSPNRRLTQSSIDNSDHSGNRTENSNNSNNDNNI

SEQ ID NO: 2283763 - protein, 8 aa, Cryptosporidium parvum
SSSTLDYT

SEQ ID NO: 2283764 - protein, 31 aa, Cryptosporidium parvum
SSSTPNMSKENKNEKINTTFDADQDNSTKPI

SEQ ID NO: 2283765 - protein, 7 aa, Cryptosporidium parvum
SSSTPQF

SEQ ID NO: 2283766 - protein, 12 aa, Cryptosporidium parvum
SSSTSTTTSSAA

SEQ ID NO: 2283767 - protein, 8 aa, Cryptosporidium parvum
SSSTTFSD

SEQ ID NO: 2283768 - protein, 29 aa, Cryptosporidium parvum
SSSTTTTTTTTTTTTTTTTTTTTTTTTTR

SEQ ID NO: 2283769 - protein, 19 aa, Cryptosporidium parvum
SSSVFSEENYNNENDNDSL

SEQ ID NO: 2283770 - protein, 8 aa, Cryptosporidium parvum
SSSVNISK

SEQ ID NO: 2283771 - protein, 20 aa, Cryptosporidium parvum
SSSVPSNIEGRAIDSNSHEK

SEQ ID NO: 2283772 - protein, 10 aa, Cryptosporidium parvum
SSSVSSYKDH

SEQ ID NO: 2283773 - protein, 6 aa, Cryptosporidium parvum
SSSVTA

SEQ ID NO: 2283774 - protein, 9 aa, Cryptosporidium parvum
SSSYDGSLG

SEQ ID NO: 2283775 - protein, 7 aa, Cryptosporidium parvum
SSTAGSN

SEQ ID NO: 2283776 - protein, 9 aa, Cryptosporidium parvum
SSTAIEDNF

SEQ ID NO: 2283777 - protein, 8 aa, Cryptosporidium parvum
SSTAPLTP

SEQ ID NO: 2283778 - protein, 4 aa, Cryptosporidium parvum
SSTD

SEQ ID NO: 2283779 - protein, 20 aa, Cryptosporidium parvum
SSTDKESSKAHSSSRNGSLR

SEQ ID NO: 2283780 - protein, 8 aa, Cryptosporidium parvum
SSTDKNRH

SEQ ID NO: 2283781 - protein, 7 aa, Cryptosporidium parvum
SSTDSSC

SEQ ID NO: 2283782 - protein, 5 aa, Cryptosporidium parvum
SSTDV

SEQ ID NO: 2283783 - protein, 4 aa, Cryptosporidium parvum
SSTE

SEQ ID NO: 2283784 - protein, 21 aa, Cryptosporidium parvum
SSTFEENKIPEKIPPRYLRMY

SEQ ID NO: 2283785 - protein, 11 aa, Cryptosporidium parvum
SSTFYGDSGPL

SEQ ID NO: 2283786 - protein, 5 aa, Cryptosporidium parvum
SSTGA

SEQ ID NO: 2283787 - protein, 5 aa, Cryptosporidium parvum
SSTGK

SEQ ID NO: 2283788 - protein, 13 aa, Cryptosporidium parvum
SSTGNSNGTQGNI

SEQ ID NO: 2283789 - protein, 22 aa, Cryptosporidium parvum
SSTGNTNTVESENDSKNLENSV

SEQ ID NO: 2283790 - protein, 7 aa, Cryptosporidium parvum
SSTIADE

SEQ ID NO: 2283791 - protein, 6 aa, Cryptosporidium parvum
SSTILS

SEQ ID NO: 2283792 - protein, 6 aa, Cryptosporidium parvum
SSTINN

SEQ ID NO: 2283793 - protein, 14 aa, Cryptosporidium parvum
SSTIQKKQKGAMDT

SEQ ID NO: 2283794 - protein, 23 aa, Cryptosporidium parvum
SSTISKGGMSSNISNSSRFSNAS

SEQ ID NO: 2283795 - protein, 4 aa, Cryptosporidium parvum
SSTK

SEQ ID NO: 2283796 - protein, 7 aa, Cryptosporidium parvum
SSTKNPN

SEQ ID NO: 2283797 - protein, 4 aa, Cryptosporidium parvum
SSTL

SEQ ID NO: 2283798 - protein, 7 aa, Cryptosporidium parvum
SSTLNRD

SEQ ID NO: 2283799 - protein, 6 aa, Cryptosporidium parvum
SSTLPE

SEQ ID NO: 2283800 - protein, 26 aa, Cryptosporidium parvum
SSTLPNNLNSKNTKKVENTTKKFSSS

SEQ ID NO: 2283801 - protein, 11 aa, Cryptosporidium parvum
SSTNENTGNGS

SEQ ID NO: 2283802 - protein, 14 aa, Cryptosporidium parvum
SSTNERIESSESDV

SEQ ID NO: 2283803 - protein, 12 aa, Cryptosporidium parvum
SSTNGRKQHNLG

SEQ ID NO: 2283804 - protein, 12 aa, Cryptosporidium parvum
SSTNNTNNREEI

SEQ ID NO: 2283805 - protein, 22 aa, Cryptosporidium parvum
SSTNTDKLEKISDTIKEQQSIH

SEQ ID NO: 2283806 - protein, 5 aa, Cryptosporidium parvum
SSTNW

SEQ ID NO: 2283807 - protein, 8 aa, Cryptosporidium parvum
SSTPEIDK

SEQ ID NO: 2283808 - protein, 8 aa, Cryptosporidium parvum
SSTPRESQ

SEQ ID NO: 2283809 - protein, 8 aa, Cryptosporidium parvum
SSTPTTKD

SEQ ID NO: 2283810 - protein, 8 aa, Cryptosporidium parvum
SSTREELK

SEQ ID NO: 2283811 - protein, 7 aa, Cryptosporidium parvum
SSTRSGF

SEQ ID NO: 2283812 - protein, 9 aa, Cryptosporidium parvum
SSTSEHMNN

SEQ ID NO: 2283813 - protein, 7 aa, Cryptosporidium parvum
SSTSGNS

SEQ ID NO: 2283814 - protein, 10 aa, Cryptosporidium parvum
SSTSIGNSNG

SEQ ID NO: 2283815 - protein, 14 aa, Cryptosporidium parvum
SSTSLTEKQSQAIS

SEQ ID NO: 2283816 - protein, 17 aa, Cryptosporidium parvum
SSTSSLSIESDDGSTIT

SEQ ID NO: 2283817 - protein, 19 aa, Cryptosporidium parvum
SSTSSNNSTCSTVSNRQRI

SEQ ID NO: 2283818 - protein, 4 aa, Cryptosporidium parvum
SSTT

SEQ ID NO: 2283819 - protein, 15 aa, Cryptosporidium parvum
SSTTEQVTSEEDANS

SEQ ID NO: 2283820 - protein, 11 aa, Cryptosporidium parvum
SSTTNTSNITN

SEQ ID NO: 2283821 - protein, 46 aa, Cryptosporidium parvum
SSTTSSTMAATPAVNKINDSTQYGGYSSSNVGNSQLNVTGSNDNIY

SEQ ID NO: 2283822 - protein, 6 aa, Cryptosporidium parvum
SSTYTA

SEQ ID NO: 2283823 - protein, 8 aa, Cryptosporidium parvum
SSVDDSSF

SEQ ID NO: 2283824 - protein, 9 aa, Cryptosporidium parvum
SSVDQDSGF

SEQ ID NO: 2283825 - protein, 6 aa, Cryptosporidium parvum
SSVENP

SEQ ID NO: 2283826 - protein, 44 aa, Cryptosporidium parvum
SSVGKSNNNTNIGGTISTSATSNSNNNATIGTRSVNNGSTVNNN

SEQ ID NO: 2283827 - protein, 6 aa, Cryptosporidium parvum
SSVGSE

SEQ ID NO: 2283828 - protein, 4 aa, Cryptosporidium parvum
SSVI

SEQ ID NO: 2283829 - protein, 7 aa, Cryptosporidium parvum
SSVNDES

SEQ ID NO: 2283830 - protein, 21 aa, Cryptosporidium parvum
SSVNHNGRSASLTAPNGISQQ

SEQ ID NO: 2283831 - protein, 10 aa, Cryptosporidium parvum
SSVNPPPQIA

SEQ ID NO: 2283832 - protein, 15 aa, Cryptosporidium parvum
SSVNSKMDSLRNQTT

SEQ ID NO: 2283833 - protein, 8 aa, Cryptosporidium parvum
SSVPNYNP

SEQ ID NO: 2283834 - protein, 7 aa, Cryptosporidium parvum
SSVPPLD

SEQ ID NO: 2283835 - protein, 12 aa, Cryptosporidium parvum
SSVPSDSPDDYA

SEQ ID NO: 2283836 - protein, 5 aa, Cryptosporidium parvum
SSVQT

SEQ ID NO: 2283837 - protein, 6 aa, Cryptosporidium parvum
SSVRTE

SEQ ID NO: 2283838 - protein, 4 aa, Cryptosporidium parvum
SSVS

SEQ ID NO: 2283839 - protein, 6 aa, Cryptosporidium parvum
SSVSGD

SEQ ID NO: 2283840 - protein, 11 aa, Cryptosporidium parvum
SSVSGSGNPVG

SEQ ID NO: 2283841 - protein, 5 aa, Cryptosporidium parvum
SSVSP

SEQ ID NO: 2283842 - protein, 5 aa, Cryptosporidium parvum
SSVSS

SEQ ID NO: 2283843 - protein, 21 aa, Cryptosporidium parvum
SSVSSETVNTNRNGAENMSSP

SEQ ID NO: 2283844 - protein, 14 aa, Cryptosporidium parvum
SSVSSNSSHSSFGA

SEQ ID NO: 2283845 - protein, 44 aa, Cryptosporidium parvum
SSVSSVKSKSVQSSAPSSSSSSSSSSSKKNSKNVSSIPSKENLS

SEQ ID NO: 2283846 - protein, 5 aa, Cryptosporidium parvum
SSVST

SEQ ID NO: 2283847 - protein, 9 aa, Cryptosporidium parvum
SSVSTSNDD

SEQ ID NO: 2283848 - protein, 5 aa, Cryptosporidium parvum
SSVTA

SEQ ID NO: 2283849 - protein, 4 aa, Cryptosporidium parvum
SSVW

SEQ ID NO: 2283850 - protein, 5 aa, Cryptosporidium parvum
SSWGG

SEQ ID NO: 2283851 - protein, 11 aa, Cryptosporidium parvum
SSWSNKNTNTL

SEQ ID NO: 2283852 - protein, 5 aa, Cryptosporidium parvum
SSYDR

SEQ ID NO: 2283853 - protein, 7 aa, Cryptosporidium parvum
SSYDYSK

SEQ ID NO: 2283854 - protein, 13 aa, Cryptosporidium parvum
SSYEDDDYDNDGK

SEQ ID NO: 2283855 - protein, 4 aa, Cryptosporidium parvum
SSYF

SEQ ID NO: 2283856 - protein, 17 aa, Cryptosporidium parvum
SSYGGGLGGGDSGMVSG

SEQ ID NO: 2283857 - protein, 17 aa, Cryptosporidium parvum
SSYKSVKEYPKERSSSR

SEQ ID NO: 2283858 - protein, 11 aa, Cryptosporidium parvum
SSYNINSKERE

SEQ ID NO: 2283859 - protein, 5 aa, Cryptosporidium parvum
SSYNP

SEQ ID NO: 2283860 - protein, 5 aa, Cryptosporidium parvum
SSYQE

SEQ ID NO: 2283861 - protein, 12 aa, Cryptosporidium parvum
SSYQQNSKEDGR

SEQ ID NO: 2283862 - protein, 8 aa, Cryptosporidium parvum
SSYQSNPN

SEQ ID NO: 2283863 - protein, 5 aa, Cryptosporidium parvum
SSYSK

SEQ ID NO: 2283864 - protein, 14 aa, Cryptosporidium parvum
SSYSKRSSISQENL

SEQ ID NO: 2283865 - protein, 13 aa, Cryptosporidium parvum
SSYSNDSGYYNSV

SEQ ID NO: 2283866 - protein, 10 aa, Cryptosporidium parvum
SSYTSGSNEK

SEQ ID NO: 2283867 - protein, 85 aa, Cryptosporidium parvum
SSYTSTTTANTGATTATTTTTGANTGTTTTKTATNTSTTTTTNNSAQGVTTDSQRTVTQSDSKSKVQDQLKAQTTTQFQDQNVSG

SEQ ID NO: 2283868 - protein, 31 aa, Cryptosporidium parvum
STAADNTTAVGASAPVEEEEEEEGDLGFSLF

SEQ ID NO: 2283869 - protein, 7 aa, Cryptosporidium parvum
STAGESK

SEQ ID NO: 2283870 - protein, 10 aa, Cryptosporidium parvum
STAGVTSEKE

SEQ ID NO: 2283871 - protein, 5 aa, Cryptosporidium parvum
STAKN

SEQ ID NO: 2283872 - protein, 13 aa, Cryptosporidium parvum
STAPSSKPSPQFS

SEQ ID NO: 2283873 - protein, 14 aa, Cryptosporidium parvum
STAQDSFNVFIPSN

SEQ ID NO: 2283874 - protein, 26 aa, Cryptosporidium parvum
STARALGEIKSRNKKQKKKSSANNHY

SEQ ID NO: 2283875 - protein, 14 aa, Cryptosporidium parvum
STARDGPAQNQGYI

SEQ ID NO: 2283876 - protein, 10 aa, Cryptosporidium parvum
STASATPIAE

SEQ ID NO: 2283877 - protein, 6 aa, Cryptosporidium parvum
STASDG

SEQ ID NO: 2283878 - protein, 9 aa, Cryptosporidium parvum
STASGEKMT

SEQ ID NO: 2283879 - protein, 9 aa, Cryptosporidium parvum
STASPNKSK

SEQ ID NO: 2283880 - protein, 7 aa, Cryptosporidium parvum
STASTET

SEQ ID NO: 2283881 - protein, 12 aa, Cryptosporidium parvum
STATNSPLLGGP

SEQ ID NO: 2283882 - protein, 9 aa, Cryptosporidium parvum
STAVGIKTK

SEQ ID NO: 2283883 - protein, 6 aa, Cryptosporidium parvum
STCDNA

SEQ ID NO: 2283884 - protein, 9 aa, Cryptosporidium parvum
STDDSNNTN

SEQ ID NO: 2283885 - protein, 5 aa, Cryptosporidium parvum
STDET

SEQ ID NO: 2283886 - protein, 15 aa, Cryptosporidium parvum
STDFPSKRKVPLDTN

SEQ ID NO: 2283887 - protein, 22 aa, Cryptosporidium parvum
STDHDKELKSENVNFDSESKLE

SEQ ID NO: 2283888 - protein, 7 aa, Cryptosporidium parvum
STDHDPK

SEQ ID NO: 2283889 - protein, 9 aa, Cryptosporidium parvum
STDKDNDKK

SEQ ID NO: 2283890 - protein, 6 aa, Cryptosporidium parvum
STDKTY

SEQ ID NO: 2283891 - protein, 17 aa, Cryptosporidium parvum
STDNGTLNNIENTNSLN

SEQ ID NO: 2283892 - protein, 16 aa, Cryptosporidium parvum
STDNHHRELPTGFKNS

SEQ ID NO: 2283893 - protein, 14 aa, Cryptosporidium parvum
STDNPGSLFSSTNN

SEQ ID NO: 2283894 - protein, 17 aa, Cryptosporidium parvum
STDNPNSRPGKPSNRFS

SEQ ID NO: 2283895 - protein, 5 aa, Cryptosporidium parvum
STDRS

SEQ ID NO: 2283896 - protein, 10 aa, Cryptosporidium parvum
STDSIKKHNS

SEQ ID NO: 2283897 - protein, 7 aa, Cryptosporidium parvum
STDSSIP

SEQ ID NO: 2283898 - protein, 11 aa, Cryptosporidium parvum
STEATNVDPQQ

SEQ ID NO: 2283899 - protein, 4 aa, Cryptosporidium parvum
STEC

SEQ ID NO: 2283900 - protein, 16 aa, Cryptosporidium parvum
STECEQSKNETESSNM

SEQ ID NO: 2283901 - protein, 4 aa, Cryptosporidium parvum
STED

SEQ ID NO: 2283902 - protein, 10 aa, Cryptosporidium parvum
STEDEEQFRS

SEQ ID NO: 2283903 - protein, 18 aa, Cryptosporidium parvum
STEDPNNRFGSPPASTQV

SEQ ID NO: 2283904 - protein, 5 aa, Cryptosporidium parvum
STEDS

SEQ ID NO: 2283905 - protein, 7 aa, Cryptosporidium parvum
STEDSSK

SEQ ID NO: 2283906 - protein, 7 aa, Cryptosporidium parvum
STEEQKS

SEQ ID NO: 2283907 - protein, 7 aa, Cryptosporidium parvum
STEESEE

SEQ ID NO: 2283908 - protein, 9 aa, Cryptosporidium parvum
STEGGTKNR

SEQ ID NO: 2283909 - protein, 13 aa, Cryptosporidium parvum
STEHPDAPERPGY

SEQ ID NO: 2283910 - protein, 6 aa, Cryptosporidium parvum
STEIGS

SEQ ID NO: 2283911 - protein, 10 aa, Cryptosporidium parvum
STEINTRSSI

SEQ ID NO: 2283912 - protein, 10 aa, Cryptosporidium parvum
STEKIDSDAR

SEQ ID NO: 2283913 - protein, 14 aa, Cryptosporidium parvum
STEKNKSEDIEAAD

SEQ ID NO: 2283914 - protein, 7 aa, Cryptosporidium parvum
STEKQLD

SEQ ID NO: 2283915 - protein, 9 aa, Cryptosporidium parvum
STENALENN

SEQ ID NO: 2283916 - protein, 21 aa, Cryptosporidium parvum
STENGNVYDTSMKKRRKECSI

SEQ ID NO: 2283917 - protein, 9 aa, Cryptosporidium parvum
STENNQINT

SEQ ID NO: 2283918 - protein, 6 aa, Cryptosporidium parvum
STEPIP

SEQ ID NO: 2283919 - protein, 13 aa, Cryptosporidium parvum
STEQNNNKTLENQ

SEQ ID NO: 2283920 - protein, 9 aa, Cryptosporidium parvum
STEQVKGYG

SEQ ID NO: 2283921 - protein, 8 aa, Cryptosporidium parvum
STESENEY

SEQ ID NO: 2283922 - protein, 8 aa, Cryptosporidium parvum
STESHDQN

SEQ ID NO: 2283923 - protein, 18 aa, Cryptosporidium parvum
STESTDFKADKELNSVTD

SEQ ID NO: 2283924 - protein, 6 aa, Cryptosporidium parvum
STESTV

SEQ ID NO: 2283925 - protein, 8 aa, Cryptosporidium parvum
STETASLT

SEQ ID NO: 2283926 - protein, 5 aa, Cryptosporidium parvum
STETR

SEQ ID NO: 2283927 - protein, 21 aa, Cryptosporidium parvum
STFEGTDDKLGQEIKSKEESI

SEQ ID NO: 2283928 - protein, 4 aa, Cryptosporidium parvum
STFG

SEQ ID NO: 2283929 - protein, 8 aa, Cryptosporidium parvum
STFSKTEP

SEQ ID NO: 2283930 - protein, 21 aa, Cryptosporidium parvum
STFSSSSSSSSSSSPMDNSNM

SEQ ID NO: 2283931 - protein, 12 aa, Cryptosporidium parvum
STFTASRPTTFQ

SEQ ID NO: 2283932 - protein, 6 aa, Cryptosporidium parvum
STFTQN

SEQ ID NO: 2283933 - protein, 14 aa, Cryptosporidium parvum
STGDDGRCLLWDVR

SEQ ID NO: 2283934 - protein, 7 aa, Cryptosporidium parvum
STGDPRI

SEQ ID NO: 2283935 - protein, 21 aa, Cryptosporidium parvum
STGDSKQSSAEDALKAYKDAT

SEQ ID NO: 2283936 - protein, 6 aa, Cryptosporidium parvum
STGEKR

SEQ ID NO: 2283937 - protein, 27 aa, Cryptosporidium parvum
STGEQLNQKAQNLSQSIKEKNKKLQEM

SEQ ID NO: 2283938 - protein, 7 aa, Cryptosporidium parvum
STGESIT

SEQ ID NO: 2283939 - protein, 5 aa, Cryptosporidium parvum
STGIR

SEQ ID NO: 2283940 - protein, 5 aa, Cryptosporidium parvum
STGKC

SEQ ID NO: 2283941 - protein, 15 aa, Cryptosporidium parvum
STGKFPSQNPSPEFY

SEQ ID NO: 2283942 - protein, 11 aa, Cryptosporidium parvum
STGKYGPTRSQ

SEQ ID NO: 2283943 - protein, 13 aa, Cryptosporidium parvum
STGLPSNRIGPSS

SEQ ID NO: 2283944 - protein, 7 aa, Cryptosporidium parvum
STGLSVP

SEQ ID NO: 2283945 - protein, 4 aa, Cryptosporidium parvum
STGN

SEQ ID NO: 2283946 - protein, 6 aa, Cryptosporidium parvum
STGNLQ

SEQ ID NO: 2283947 - protein, 7 aa, Cryptosporidium parvum
STGQKKK

SEQ ID NO: 2283948 - protein, 15 aa, Cryptosporidium parvum
STGQYVSTGGTDGTI

SEQ ID NO: 2283949 - protein, 4 aa, Cryptosporidium parvum
STGR

SEQ ID NO: 2283950 - protein, 14 aa, Cryptosporidium parvum
STGSEGSSEDNDKY

SEQ ID NO: 2283951 - protein, 17 aa, Cryptosporidium parvum
STGSGKKVSIDEENFNR

SEQ ID NO: 2283952 - protein, 18 aa, Cryptosporidium parvum
STGSGKQVSIDEESLSRA

SEQ ID NO: 2283953 - protein, 9 aa, Cryptosporidium parvum
STGTAPNKL

SEQ ID NO: 2283954 - protein, 7 aa, Cryptosporidium parvum
STGTGKI

SEQ ID NO: 2283955 - protein, 10 aa, Cryptosporidium parvum
STGTGKTTVR

SEQ ID NO: 2283956 - protein, 5 aa, Cryptosporidium parvum
STGTI

SEQ ID NO: 2283957 - protein, 11 aa, Cryptosporidium parvum
STGTPRGKTSQ

SEQ ID NO: 2283958 - protein, 10 aa, Cryptosporidium parvum
STGTRGAQSA

SEQ ID NO: 2283959 - protein, 10 aa, Cryptosporidium parvum
STHEKTPLKD

SEQ ID NO: 2283960 - protein, 23 aa, Cryptosporidium parvum
STHKKDEARNINNTKDIDSSDKH

SEQ ID NO: 2283961 - protein, 16 aa, Cryptosporidium parvum
STHNGRSSTRHAPRSH

SEQ ID NO: 2283962 - protein, 7 aa, Cryptosporidium parvum
STHNPAS

SEQ ID NO: 2283963 - protein, 12 aa, Cryptosporidium parvum
STHSNKAWPSNV

SEQ ID NO: 2283964 - protein, 7 aa, Cryptosporidium parvum
STHYGRP

SEQ ID NO: 2283965 - protein, 5 aa, Cryptosporidium parvum
STIEH

SEQ ID NO: 2283966 - protein, 5 aa, Cryptosporidium parvum
STIEN

SEQ ID NO: 2283967 - protein, 11 aa, Cryptosporidium parvum
STIENSVSDEN

SEQ ID NO: 2283968 - protein, 16 aa, Cryptosporidium parvum
STIGNSNNNNKGNHEK

SEQ ID NO: 2283969 - protein, 8 aa, Cryptosporidium parvum
STIGNTDL

SEQ ID NO: 2283970 - protein, 11 aa, Cryptosporidium parvum
STIGTTTSGTI

SEQ ID NO: 2283971 - protein, 6 aa, Cryptosporidium parvum
STIKQD

SEQ ID NO: 2283972 - protein, 4 aa, Cryptosporidium parvum
STIL

SEQ ID NO: 2283973 - protein, 4 aa, Cryptosporidium parvum
STIN

SEQ ID NO: 2283974 - protein, 11 aa, Cryptosporidium parvum
STINSDSNHFE

SEQ ID NO: 2283975 - protein, 18 aa, Cryptosporidium parvum
STINSNNNQNEKLTDNQE

SEQ ID NO: 2283976 - protein, 7 aa, Cryptosporidium parvum
STIPDED

SEQ ID NO: 2283977 - protein, 6 aa, Cryptosporidium parvum
STIQGT

SEQ ID NO: 2283978 - protein, 5 aa, Cryptosporidium parvum
STIQN

SEQ ID NO: 2283979 - protein, 13 aa, Cryptosporidium parvum
STIQTLSSNPKSI

SEQ ID NO: 2283980 - protein, 5 aa, Cryptosporidium parvum
STISN

SEQ ID NO: 2283981 - protein, 6 aa, Cryptosporidium parvum
STISSK

SEQ ID NO: 2283982 - protein, 12 aa, Cryptosporidium parvum
STISSRNKSVSR

SEQ ID NO: 2283983 - protein, 5 aa, Cryptosporidium parvum
STITQ

SEQ ID NO: 2283984 - protein, 15 aa, Cryptosporidium parvum
STKANNNKKSTSILR

SEQ ID NO: 2283985 - protein, 6 aa, Cryptosporidium parvum
STKDPL

SEQ ID NO: 2283986 - protein, 6 aa, Cryptosporidium parvum
STKDST

SEQ ID NO: 2283987 - protein, 7 aa, Cryptosporidium parvum
STKEGVD

SEQ ID NO: 2283988 - protein, 9 aa, Cryptosporidium parvum
STKEKYRWG

SEQ ID NO: 2283989 - protein, 7 aa, Cryptosporidium parvum
STKESYN

SEQ ID NO: 2283990 - protein, 6 aa, Cryptosporidium parvum
STKEVD

SEQ ID NO: 2283991 - protein, 17 aa, Cryptosporidium parvum
STKKSRGRGRPKSKPKQ

SEQ ID NO: 2283992 - protein, 5 aa, Cryptosporidium parvum
STKNQ

SEQ ID NO: 2283993 - protein, 7 aa, Cryptosporidium parvum
STKNSNL

SEQ ID NO: 2283994 - protein, 10 aa, Cryptosporidium parvum
STKNTPEKNL

SEQ ID NO: 2283995 - protein, 20 aa, Cryptosporidium parvum
STKSGFETSSTIHNSPSLSP

SEQ ID NO: 2283996 - protein, 9 aa, Cryptosporidium parvum
STKSKSKLE

SEQ ID NO: 2283997 - protein, 20 aa, Cryptosporidium parvum
STKSNNKLENSVKNKSKIEV

SEQ ID NO: 2283998 - protein, 10 aa, Cryptosporidium parvum
STKTTVSSVE

SEQ ID NO: 2283999 - protein, 4 aa, Cryptosporidium parvum
STKY

SEQ ID NO: 2284000 - protein, 5 aa, Cryptosporidium parvum
STLDI

SEQ ID NO: 2284001 - protein, 12 aa, Cryptosporidium parvum
STLDPEKNDQNE

SEQ ID NO: 2284002 - protein, 6 aa, Cryptosporidium parvum
STLDSG

SEQ ID NO: 2284003 - protein, 21 aa, Cryptosporidium parvum
STLDSGNIRSNLNGSQNNTLN

SEQ ID NO: 2284004 - protein, 5 aa, Cryptosporidium parvum
STLDT

SEQ ID NO: 2284005 - protein, 5 aa, Cryptosporidium parvum
STLGS

SEQ ID NO: 2284006 - protein, 12 aa, Cryptosporidium parvum
STLGTGNELEDL

SEQ ID NO: 2284007 - protein, 9 aa, Cryptosporidium parvum
STLKSYNKS

SEQ ID NO: 2284008 - protein, 4 aa, Cryptosporidium parvum
STLP

SEQ ID NO: 2284009 - protein, 16 aa, Cryptosporidium parvum
STLPDTDLIEFSKYKT

SEQ ID NO: 2284010 - protein, 7 aa, Cryptosporidium parvum
STLPEIK

SEQ ID NO: 2284011 - protein, 22 aa, Cryptosporidium parvum
STLPKDNWSKNEKEKKNKDNIE

SEQ ID NO: 2284012 - protein, 49 aa, Cryptosporidium parvum
STLPSSSGLFSNSPNSLFSSTQPQNTLNNNNANASSSSLFGQSTSLSQS

SEQ ID NO: 2284013 - protein, 7 aa, Cryptosporidium parvum
STLPTPA

SEQ ID NO: 2284014 - protein, 8 aa, Cryptosporidium parvum
STLSNNKI

SEQ ID NO: 2284015 - protein, 14 aa, Cryptosporidium parvum
STLSTKNSAPSPSY

SEQ ID NO: 2284016 - protein, 6 aa, Cryptosporidium parvum
STLTPL

SEQ ID NO: 2284017 - protein, 5 aa, Cryptosporidium parvum
STLTT

SEQ ID NO: 2284018 - protein, 4 aa, Cryptosporidium parvum
STLY

SEQ ID NO: 2284019 - protein, 26 aa, Cryptosporidium parvum
STMASKDVSSVKPGIGEDVKNSPDLP

SEQ ID NO: 2284020 - protein, 18 aa, Cryptosporidium parvum
STNAGRKGTGKKRTRGMP

SEQ ID NO: 2284021 - protein, 22 aa, Cryptosporidium parvum
STNARKRMSNNARTDESSGGNV

SEQ ID NO: 2284022 - protein, 11 aa, Cryptosporidium parvum
STNASTGGGLH

SEQ ID NO: 2284023 - protein, 11 aa, Cryptosporidium parvum
STNDEKSRKKL

SEQ ID NO: 2284024 - protein, 11 aa, Cryptosporidium parvum
STNDLEGSSEF

SEQ ID NO: 2284025 - protein, 14 aa, Cryptosporidium parvum
STNEEAGDGTTTAT

SEQ ID NO: 2284026 - protein, 28 aa, Cryptosporidium parvum
STNIEGSGNISSVSGSLNSSSRGDDGGL

SEQ ID NO: 2284027 - protein, 7 aa, Cryptosporidium parvum
STNISDN

SEQ ID NO: 2284028 - protein, 21 aa, Cryptosporidium parvum
STNISRRDHKTGNYHENDRNE

SEQ ID NO: 2284029 - protein, 4 aa, Cryptosporidium parvum
STNK

SEQ ID NO: 2284030 - protein, 14 aa, Cryptosporidium parvum
STNKERRDQNLEQQ

SEQ ID NO: 2284031 - protein, 8 aa, Cryptosporidium parvum
STNKGNLS

SEQ ID NO: 2284032 - protein, 5 aa, Cryptosporidium parvum
STNKS

SEQ ID NO: 2284033 - protein, 11 aa, Cryptosporidium parvum
STNKSDSGNSD

SEQ ID NO: 2284034 - protein, 25 aa, Cryptosporidium parvum
STNKTLKDCEKNNPKPNCKKAQNFD

SEQ ID NO: 2284035 - protein, 10 aa, Cryptosporidium parvum
STNLSRSQNN

SEQ ID NO: 2284036 - protein, 12 aa, Cryptosporidium parvum
STNMERESQYKQ

SEQ ID NO: 2284037 - protein, 7 aa, Cryptosporidium parvum
STNNERH

SEQ ID NO: 2284038 - protein, 14 aa, Cryptosporidium parvum
STNNGQNGAGNSIE

SEQ ID NO: 2284039 - protein, 13 aa, Cryptosporidium parvum
STNNNNNNNINNN

SEQ ID NO: 2284040 - protein, 20 aa, Cryptosporidium parvum
STNNSSENSNNDNITKNPTT

SEQ ID NO: 2284041 - protein, 7 aa, Cryptosporidium parvum
STNPGGA

SEQ ID NO: 2284042 - protein, 12 aa, Cryptosporidium parvum
STNQENNKECKD

SEQ ID NO: 2284043 - protein, 10 aa, Cryptosporidium parvum
STNRTSESQL

SEQ ID NO: 2284044 - protein, 4 aa, Cryptosporidium parvum
STNS

SEQ ID NO: 2284045 - protein, 8 aa, Cryptosporidium parvum
STNSEQYI

SEQ ID NO: 2284046 - protein, 14 aa, Cryptosporidium parvum
STNSNSTSHEATNS

SEQ ID NO: 2284047 - protein, 8 aa, Cryptosporidium parvum
STNSSSMI

SEQ ID NO: 2284048 - protein, 19 aa, Cryptosporidium parvum
STNTNFNSKSNSNSNSNSY

SEQ ID NO: 2284049 - protein, 19 aa, Cryptosporidium parvum
STNTTNGVSSIGTSTSSGQ

SEQ ID NO: 2284050 - protein, 5 aa, Cryptosporidium parvum
STPAL

SEQ ID NO: 2284051 - protein, 4 aa, Cryptosporidium parvum
STPD

SEQ ID NO: 2284052 - protein, 100 aa, Cryptosporidium parvum
STPEEPPKEDPAKRPTPKVHPAKKSSSVKKDNDEKKEEKEEKKEEKKEEKKEEKKEEKEEKKEDDEKEKKVVKAKTKTKAKAKAKAKEEPPPAPPAEESS

SEQ ID NO: 2284053 - protein, 4 aa, Cryptosporidium parvum
STPF

SEQ ID NO: 2284054 - protein, 6 aa, Cryptosporidium parvum
STPFTK

SEQ ID NO: 2284055 - protein, 6 aa, Cryptosporidium parvum
STPGTQ

SEQ ID NO: 2284056 - protein, 13 aa, Cryptosporidium parvum
STPHTTTSPAGIS

SEQ ID NO: 2284057 - protein, 8 aa, Cryptosporidium parvum
STPIRKSK

SEQ ID NO: 2284058 - protein, 5 aa, Cryptosporidium parvum
STPIS

SEQ ID NO: 2284059 - protein, 9 aa, Cryptosporidium parvum
STPKDESNI

SEQ ID NO: 2284060 - protein, 9 aa, Cryptosporidium parvum
STPKNPENT

SEQ ID NO: 2284061 - protein, 4 aa, Cryptosporidium parvum
STPM

SEQ ID NO: 2284062 - protein, 7 aa, Cryptosporidium parvum
STPNEEY

SEQ ID NO: 2284063 - protein, 6 aa, Cryptosporidium parvum
STPNEH

SEQ ID NO: 2284064 - protein, 5 aa, Cryptosporidium parvum
STPNS

SEQ ID NO: 2284065 - protein, 6 aa, Cryptosporidium parvum
STPPKV

SEQ ID NO: 2284066 - protein, 16 aa, Cryptosporidium parvum
STPQSNGKEGSKSIQN

SEQ ID NO: 2284067 - protein, 25 aa, Cryptosporidium parvum
STPRKRVRGTENGFNSSNNNNNINT

SEQ ID NO: 2284068 - protein, 16 aa, Cryptosporidium parvum
STPRSTSCQTPRTKNH

SEQ ID NO: 2284069 - protein, 11 aa, Cryptosporidium parvum
STPSGTIPGLP

SEQ ID NO: 2284070 - protein, 34 aa, Cryptosporidium parvum
STPSNGGKNGNKSKCCNDGNGCCGENNSNNNSKQ

SEQ ID NO: 2284071 - protein, 9 aa, Cryptosporidium parvum
STPSTKLPN

SEQ ID NO: 2284072 - protein, 4 aa, Cryptosporidium parvum
STPT

SEQ ID NO: 2284073 - protein, 8 aa, Cryptosporidium parvum
STPTGPAI

SEQ ID NO: 2284074 - protein, 5 aa, Cryptosporidium parvum
STPTI

SEQ ID NO: 2284075 - protein, 5 aa, Cryptosporidium parvum
STPTT

SEQ ID NO: 2284076 - protein, 27 aa, Cryptosporidium parvum
STPVSNINSNKISSSQDMNSSNQVQSS

SEQ ID NO: 2284077 - protein, 8 aa, Cryptosporidium parvum
STPYSNID

SEQ ID NO: 2284078 - protein, 8 aa, Cryptosporidium parvum
STQCESDG

SEQ ID NO: 2284079 - protein, 7 aa, Cryptosporidium parvum
STQDHFP

SEQ ID NO: 2284080 - protein, 6 aa, Cryptosporidium parvum
STQDRE

SEQ ID NO: 2284081 - protein, 14 aa, Cryptosporidium parvum
STQDTFEKAKKSCE

SEQ ID NO: 2284082 - protein, 4 aa, Cryptosporidium parvum
STQE

SEQ ID NO: 2284083 - protein, 17 aa, Cryptosporidium parvum
STQEESPFTGTKATEDI

SEQ ID NO: 2284084 - protein, 11 aa, Cryptosporidium parvum
STQGEKMSEAK

SEQ ID NO: 2284085 - protein, 18 aa, Cryptosporidium parvum
STQIGKDNMGYSNRKQRR

SEQ ID NO: 2284086 - protein, 9 aa, Cryptosporidium parvum
STQIGNGPF

SEQ ID NO: 2284087 - protein, 7 aa, Cryptosporidium parvum
STQPIDK

SEQ ID NO: 2284088 - protein, 6 aa, Cryptosporidium parvum
STQPLN

SEQ ID NO: 2284089 - protein, 5 aa, Cryptosporidium parvum
STQPS

SEQ ID NO: 2284090 - protein, 8 aa, Cryptosporidium parvum
STQSEVTR

SEQ ID NO: 2284091 - protein, 9 aa, Cryptosporidium parvum
STQSNDEIN

SEQ ID NO: 2284092 - protein, 9 aa, Cryptosporidium parvum
STQSQLSVS

SEQ ID NO: 2284093 - protein, 23 aa, Cryptosporidium parvum
STQSTSKSGRRSAANHEAGSRQL

SEQ ID NO: 2284094 - protein, 8 aa, Cryptosporidium parvum
STRDPTTA

SEQ ID NO: 2284095 - protein, 10 aa, Cryptosporidium parvum
STRGGKKDRH

SEQ ID NO: 2284096 - protein, 5 aa, Cryptosporidium parvum
STRIP

SEQ ID NO: 2284097 - protein, 11 aa, Cryptosporidium parvum
STRKGTGTRLR

SEQ ID NO: 2284098 - protein, 14 aa, Cryptosporidium parvum
STRKKFGYNRSEKD

SEQ ID NO: 2284099 - protein, 4 aa, Cryptosporidium parvum
STRN

SEQ ID NO: 2284100 - protein, 5 aa, Cryptosporidium parvum
STRNL

SEQ ID NO: 2284101 - protein, 12 aa, Cryptosporidium parvum
STRSTSAPYTPT

SEQ ID NO: 2284102 - protein, 4 aa, Cryptosporidium parvum
STRT

SEQ ID NO: 2284103 - protein, 7 aa, Cryptosporidium parvum
STRTISN

SEQ ID NO: 2284104 - protein, 6 aa, Cryptosporidium parvum
STRVDN

SEQ ID NO: 2284105 - protein, 7 aa, Cryptosporidium parvum
STRVTNS

SEQ ID NO: 2284106 - protein, 4 aa, Cryptosporidium parvum
STRY

SEQ ID NO: 2284107 - protein, 14 aa, Cryptosporidium parvum
STSASTSASTSSSL

SEQ ID NO: 2284108 - protein, 4 aa, Cryptosporidium parvum
STSC

SEQ ID NO: 2284109 - protein, 5 aa, Cryptosporidium parvum
STSCD

SEQ ID NO: 2284110 - protein, 10 aa, Cryptosporidium parvum
STSDGSSGIT

SEQ ID NO: 2284111 - protein, 7 aa, Cryptosporidium parvum
STSDKSE

SEQ ID NO: 2284112 - protein, 6 aa, Cryptosporidium parvum
STSDNK

SEQ ID NO: 2284113 - protein, 11 aa, Cryptosporidium parvum
STSDPSGNQKL

SEQ ID NO: 2284114 - protein, 4 aa, Cryptosporidium parvum
STSE

SEQ ID NO: 2284115 - protein, 7 aa, Cryptosporidium parvum
STSEKAD

SEQ ID NO: 2284116 - protein, 8 aa, Cryptosporidium parvum
STSESNID

SEQ ID NO: 2284117 - protein, 7 aa, Cryptosporidium parvum
STSESRR

SEQ ID NO: 2284118 - protein, 9 aa, Cryptosporidium parvum
STSFDRRTQ

SEQ ID NO: 2284119 - protein, 8 aa, Cryptosporidium parvum
STSFTSKP

SEQ ID NO: 2284120 - protein, 11 aa, Cryptosporidium parvum
STSGGYSPSNG

SEQ ID NO: 2284121 - protein, 5 aa, Cryptosporidium parvum
STSGK

SEQ ID NO: 2284122 - protein, 12 aa, Cryptosporidium parvum
STSGQGEFPGSS

SEQ ID NO: 2284123 - protein, 5 aa, Cryptosporidium parvum
STSGT

SEQ ID NO: 2284124 - protein, 55 aa, Cryptosporidium parvum
STSHGNRKSTVFTSSTSKSPFSNKEFKKDPKTKVSSATNSNMKDGSSLKPEIENG

SEQ ID NO: 2284125 - protein, 6 aa, Cryptosporidium parvum
STSIGQ

SEQ ID NO: 2284126 - protein, 5 aa, Cryptosporidium parvum
STSKI

SEQ ID NO: 2284127 - protein, 16 aa, Cryptosporidium parvum
STSKKSEKRKKKKMQK

SEQ ID NO: 2284128 - protein, 8 aa, Cryptosporidium parvum
STSKLNEL

SEQ ID NO: 2284129 - protein, 5 aa, Cryptosporidium parvum
STSKN

SEQ ID NO: 2284130 - protein, 8 aa, Cryptosporidium parvum
STSKRNRK

SEQ ID NO: 2284131 - protein, 11 aa, Cryptosporidium parvum
STSKTGKHGHA

SEQ ID NO: 2284132 - protein, 14 aa, Cryptosporidium parvum
STSNDDHKNFSNTN

SEQ ID NO: 2284133 - protein, 7 aa, Cryptosporidium parvum
STSNEHE

SEQ ID NO: 2284134 - protein, 9 aa, Cryptosporidium parvum
STSNFNRDS

SEQ ID NO: 2284135 - protein, 21 aa, Cryptosporidium parvum
STSNISKSRNIPKSINSQQRS

SEQ ID NO: 2284136 - protein, 9 aa, Cryptosporidium parvum
STSNPNNSI

SEQ ID NO: 2284137 - protein, 6 aa, Cryptosporidium parvum
STSPGA

SEQ ID NO: 2284138 - protein, 10 aa, Cryptosporidium parvum
STSQENSESI

SEQ ID NO: 2284139 - protein, 5 aa, Cryptosporidium parvum
STSQN

SEQ ID NO: 2284140 - protein, 6 aa, Cryptosporidium parvum
STSQNG

SEQ ID NO: 2284141 - protein, 12 aa, Cryptosporidium parvum
STSRSSLPCDGR

SEQ ID NO: 2284142 - protein, 5 aa, Cryptosporidium parvum
STSRW

SEQ ID NO: 2284143 - protein, 21 aa, Cryptosporidium parvum
STSSGLNLNSGLGKNGIGSGD

SEQ ID NO: 2284144 - protein, 8 aa, Cryptosporidium parvum
STSSNHVN

SEQ ID NO: 2284145 - protein, 57 aa, Cryptosporidium parvum
STSSNIGNTNNNLNTSSPFGSNINNSISSSTGIGNSNSNSLFGGNSTLTSSSSGGLG

SEQ ID NO: 2284146 - protein, 20 aa, Cryptosporidium parvum
STSSNNNNEKNTNSKFQAKK

SEQ ID NO: 2284147 - protein, 6 aa, Cryptosporidium parvum
STSSPS

SEQ ID NO: 2284148 - protein, 7 aa, Cryptosporidium parvum
STSSSGN

SEQ ID NO: 2284149 - protein, 10 aa, Cryptosporidium parvum
STSSSNTNYT

SEQ ID NO: 2284150 - protein, 15 aa, Cryptosporidium parvum
STSSSRCQTEENELE

SEQ ID NO: 2284151 - protein, 14 aa, Cryptosporidium parvum
STSSSTNNSSSIIG

SEQ ID NO: 2284152 - protein, 13 aa, Cryptosporidium parvum
STSSSTSITPSNS

SEQ ID NO: 2284153 - protein, 14 aa, Cryptosporidium parvum
STSTANNPDKITEV

SEQ ID NO: 2284154 - protein, 5 aa, Cryptosporidium parvum
STSTG

SEQ ID NO: 2284155 - protein, 9 aa, Cryptosporidium parvum
STTAPPSNY

SEQ ID NO: 2284156 - protein, 6 aa, Cryptosporidium parvum
STTEED

SEQ ID NO: 2284157 - protein, 5 aa, Cryptosporidium parvum
STTEG

SEQ ID NO: 2284158 - protein, 16 aa, Cryptosporidium parvum
STTFSQNNTTLGGPEN

SEQ ID NO: 2284159 - protein, 6 aa, Cryptosporidium parvum
STTGED

SEQ ID NO: 2284160 - protein, 9 aa, Cryptosporidium parvum
STTGRGCSG

SEQ ID NO: 2284161 - protein, 5 aa, Cryptosporidium parvum
STTKK

SEQ ID NO: 2284162 - protein, 7 aa, Cryptosporidium parvum
STTKLID

SEQ ID NO: 2284163 - protein, 7 aa, Cryptosporidium parvum
STTKSIH

SEQ ID NO: 2284164 - protein, 12 aa, Cryptosporidium parvum
STTKSSNCSNNI

SEQ ID NO: 2284165 - protein, 4 aa, Cryptosporidium parvum
STTL

SEQ ID NO: 2284166 - protein, 8 aa, Cryptosporidium parvum
STTLGNDE

SEQ ID NO: 2284167 - protein, 5 aa, Cryptosporidium parvum
STTLK

SEQ ID NO: 2284168 - protein, 7 aa, Cryptosporidium parvum
STTLKPK

SEQ ID NO: 2284169 - protein, 11 aa, Cryptosporidium parvum
STTNTNGIPTR

SEQ ID NO: 2284170 - protein, 5 aa, Cryptosporidium parvum
STTNV

SEQ ID NO: 2284171 - protein, 65 aa, Cryptosporidium parvum
STTPENPKAKIKTAKTTQKNITKNNQQKLKRKASNKLPPKANNEGNREHENSPQTSSSAVPAQET

SEQ ID NO: 2284172 - protein, 6 aa, Cryptosporidium parvum
STTRIR

SEQ ID NO: 2284173 - protein, 5 aa, Cryptosporidium parvum
STTSG

SEQ ID NO: 2284174 - protein, 10 aa, Cryptosporidium parvum
STTSSGESHG

SEQ ID NO: 2284175 - protein, 9 aa, Cryptosporidium parvum
STTSSSSIN

SEQ ID NO: 2284176 - protein, 8 aa, Cryptosporidium parvum
STTTFTAS

SEQ ID NO: 2284177 - protein, 9 aa, Cryptosporidium parvum
STTTGGRVT

SEQ ID NO: 2284178 - protein, 5 aa, Cryptosporidium parvum
STTTL

SEQ ID NO: 2284179 - protein, 4 aa, Cryptosporidium parvum
STTV

SEQ ID NO: 2284180 - protein, 4 aa, Cryptosporidium parvum
STVE

SEQ ID NO: 2284181 - protein, 8 aa, Cryptosporidium parvum
STVKENNR

SEQ ID NO: 2284182 - protein, 13 aa, Cryptosporidium parvum
STVNSLTDQLNEK

SEQ ID NO: 2284183 - protein, 7 aa, Cryptosporidium parvum
STVPNTG

SEQ ID NO: 2284184 - protein, 50 aa, Cryptosporidium parvum
STVRSKASKIATQGREMKQNSQKAGFNSPTRTAKASKKTVTRNALERFKS

SEQ ID NO: 2284185 - protein, 6 aa, Cryptosporidium parvum
STVSDS

SEQ ID NO: 2284186 - protein, 7 aa, Cryptosporidium parvum
STVTTND

SEQ ID NO: 2284187 - protein, 9 aa, Cryptosporidium parvum
STYEKVENG

SEQ ID NO: 2284188 - protein, 16 aa, Cryptosporidium parvum
STYESNFDSSTSNTTP

SEQ ID NO: 2284189 - protein, 4 aa, Cryptosporidium parvum
STYG

SEQ ID NO: 2284190 - protein, 5 aa, Cryptosporidium parvum
STYGQ

SEQ ID NO: 2284191 - protein, 7 aa, Cryptosporidium parvum
STYPPFP

SEQ ID NO: 2284192 - protein, 9 aa, Cryptosporidium parvum
SVAEATDEE

SEQ ID NO: 2284193 - protein, 18 aa, Cryptosporidium parvum
SVAESETSERKINNSTVS

SEQ ID NO: 2284194 - protein, 17 aa, Cryptosporidium parvum
SVAPEELRKRSKNNQTI

SEQ ID NO: 2284195 - protein, 8 aa, Cryptosporidium parvum
SVAPNSYY

SEQ ID NO: 2284196 - protein, 31 aa, Cryptosporidium parvum
SVASETNTNNVDNQNDVQTSAISTPVCKPKE

SEQ ID NO: 2284197 - protein, 9 aa, Cryptosporidium parvum
SVCKEGANE

SEQ ID NO: 2284198 - protein, 41 aa, Cryptosporidium parvum
SVCSSGSSSCSTGVGGSTCSLAGNNSSGAYGMKRSSKSNSL

SEQ ID NO: 2284199 - protein, 7 aa, Cryptosporidium parvum
SVDGNSR

SEQ ID NO: 2284200 - protein, 11 aa, Cryptosporidium parvum
SVDPKSKWKQI

SEQ ID NO: 2284201 - protein, 9 aa, Cryptosporidium parvum
SVDQSSDIL

SEQ ID NO: 2284202 - protein, 4 aa, Cryptosporidium parvum
SVDR

SEQ ID NO: 2284203 - protein, 9 aa, Cryptosporidium parvum
SVDSNAERN

SEQ ID NO: 2284204 - protein, 18 aa, Cryptosporidium parvum
SVDTNGNTSFGRTNMSRR

SEQ ID NO: 2284205 - protein, 7 aa, Cryptosporidium parvum
SVEDSEI

SEQ ID NO: 2284206 - protein, 23 aa, Cryptosporidium parvum
SVEHGQVNQVDSESLSNINNDSC

SEQ ID NO: 2284207 - protein, 4 aa, Cryptosporidium parvum
SVEN

SEQ ID NO: 2284208 - protein, 4 aa, Cryptosporidium parvum
SVES

SEQ ID NO: 2284209 - protein, 8 aa, Cryptosporidium parvum
SVESQDVP

SEQ ID NO: 2284210 - protein, 6 aa, Cryptosporidium parvum
SVETEI

SEQ ID NO: 2284211 - protein, 4 aa, Cryptosporidium parvum
SVFQ

SEQ ID NO: 2284212 - protein, 4 aa, Cryptosporidium parvum
SVGG

SEQ ID NO: 2284213 - protein, 8 aa, Cryptosporidium parvum
SVGGKSAV

SEQ ID NO: 2284214 - protein, 7 aa, Cryptosporidium parvum
SVGGNKM

SEQ ID NO: 2284215 - protein, 5 aa, Cryptosporidium parvum
SVGKT

SEQ ID NO: 2284216 - protein, 7 aa, Cryptosporidium parvum
SVGKTSM

SEQ ID NO: 2284217 - protein, 7 aa, Cryptosporidium parvum
SVGPDLS

SEQ ID NO: 2284218 - protein, 4 aa, Cryptosporidium parvum
SVGS

SEQ ID NO: 2284219 - protein, 13 aa, Cryptosporidium parvum
SVGSNDPRCSENL

SEQ ID NO: 2284220 - protein, 10 aa, Cryptosporidium parvum
SVGTEKDNEM

SEQ ID NO: 2284221 - protein, 5 aa, Cryptosporidium parvum
SVIDD

SEQ ID NO: 2284222 - protein, 16 aa, Cryptosporidium parvum
SVIGDQGSISSMDPIG

SEQ ID NO: 2284223 - protein, 10 aa, Cryptosporidium parvum
SVKAGGTYIE

SEQ ID NO: 2284224 - protein, 33 aa, Cryptosporidium parvum
SVKAISSPSNEVKSSNINSREANNSEAINYTTD

SEQ ID NO: 2284225 - protein, 5 aa, Cryptosporidium parvum
SVKGE

SEQ ID NO: 2284226 - protein, 17 aa, Cryptosporidium parvum
SVKKDTEIITQGDNGDK

SEQ ID NO: 2284227 - protein, 24 aa, Cryptosporidium parvum
SVKKNSSIRKTSSSELDECSDNES

SEQ ID NO: 2284228 - protein, 39 aa, Cryptosporidium parvum
SVKMEGSEGGENGTAEFDPKSYEEKSRDQKTKNTQSEDD

SEQ ID NO: 2284229 - protein, 16 aa, Cryptosporidium parvum
SVKPSSTITHHRTFTS

SEQ ID NO: 2284230 - protein, 12 aa, Cryptosporidium parvum
SVKQSEQQKRAE

SEQ ID NO: 2284231 - protein, 25 aa, Cryptosporidium parvum
SVLAPTASLGTGNEITEAGVGSENV

SEQ ID NO: 2284232 - protein, 9 aa, Cryptosporidium parvum
SVLPPSPGK

SEQ ID NO: 2284233 - protein, 4 aa, Cryptosporidium parvum
SVLS

SEQ ID NO: 2284234 - protein, 17 aa, Cryptosporidium parvum
SVNNKEKIPDKGSHTGS

SEQ ID NO: 2284235 - protein, 14 aa, Cryptosporidium parvum
SVNNTNNSNIKEEK

SEQ ID NO: 2284236 - protein, 22 aa, Cryptosporidium parvum
SVNSMNSSQKSDENKSDQYSGL

SEQ ID NO: 2284237 - protein, 15 aa, Cryptosporidium parvum
SVNSSEETNCTTSSE

SEQ ID NO: 2284238 - protein, 8 aa, Cryptosporidium parvum
SVNSSFQK

SEQ ID NO: 2284239 - protein, 26 aa, Cryptosporidium parvum
SVPDPNLNGHPTGDVSEDDVSSYEND

SEQ ID NO: 2284240 - protein, 8 aa, Cryptosporidium parvum
SVPEIQRT

SEQ ID NO: 2284241 - protein, 16 aa, Cryptosporidium parvum
SVPGQKQAQRDPLFAN

SEQ ID NO: 2284242 - protein, 12 aa, Cryptosporidium parvum
SVPKKSDISEIS

SEQ ID NO: 2284243 - protein, 11 aa, Cryptosporidium parvum
SVPNDSESQFS

SEQ ID NO: 2284244 - protein, 7 aa, Cryptosporidium parvum
SVPPIKK

SEQ ID NO: 2284245 - protein, 4 aa, Cryptosporidium parvum
SVPQ

SEQ ID NO: 2284246 - protein, 20 aa, Cryptosporidium parvum
SVPQPPGSMPSGVGSSTNSD

SEQ ID NO: 2284247 - protein, 7 aa, Cryptosporidium parvum
SVPSGQG

SEQ ID NO: 2284248 - protein, 6 aa, Cryptosporidium parvum
SVPSLN

SEQ ID NO: 2284249 - protein, 9 aa, Cryptosporidium parvum
SVPSQNNSN

SEQ ID NO: 2284250 - protein, 7 aa, Cryptosporidium parvum
SVPTNTS

SEQ ID NO: 2284251 - protein, 10 aa, Cryptosporidium parvum
SVPTQSKLNS

SEQ ID NO: 2284252 - protein, 6 aa, Cryptosporidium parvum
SVPYDT

SEQ ID NO: 2284253 - protein, 5 aa, Cryptosporidium parvum
SVQEK

SEQ ID NO: 2284254 - protein, 17 aa, Cryptosporidium parvum
SVQGEDSETNKSKGITA

SEQ ID NO: 2284255 - protein, 17 aa, Cryptosporidium parvum
SVQGHNHGQNRNSSSQI

SEQ ID NO: 2284256 - protein, 15 aa, Cryptosporidium parvum
SVQKEQENIPVNGSR

SEQ ID NO: 2284257 - protein, 5 aa, Cryptosporidium parvum
SVQNG

SEQ ID NO: 2284258 - protein, 9 aa, Cryptosporidium parvum
SVQNPTEWG

SEQ ID NO: 2284259 - protein, 32 aa, Cryptosporidium parvum; identical to SEQ ID NO: 2164225

SEQ ID NO: 2284260 - protein, 19 aa, Cryptosporidium parvum
SVQSSENNPGNSNKVQGAQ

SEQ ID NO: 2284261 - protein, 8 aa, Cryptosporidium parvum
SVRDESDL

SEQ ID NO: 2284262 - protein, 54 aa, Cryptosporidium parvum
SVRKPRKFSQDGGFREKKQSWNGSERNIEEKNQRFPAKYKGQKKDTPSSYSPKT

SEQ ID NO: 2284263 - protein, 11 aa, Cryptosporidium parvum
SVRSKKNLTIS

SEQ ID NO: 2284264 - protein, 6 aa, Cryptosporidium parvum
SVRSVT

SEQ ID NO: 2284265 - protein, 8 aa, Cryptosporidium parvum
SVRTGSYQ

SEQ ID NO: 2284266 - protein, 5 aa, Cryptosporidium parvum
SVRTS

SEQ ID NO: 2284267 - protein, 12 aa, Cryptosporidium parvum
SVSDSENNNPHY

SEQ ID NO: 2284268 - protein, 17 aa, Cryptosporidium parvum
SVSDTKNLTESEEEIPV

SEQ ID NO: 2284269 - protein, 12 aa, Cryptosporidium parvum
SVSENIHKDNSR

SEQ ID NO: 2284270 - protein, 22 aa, Cryptosporidium parvum
SVSEQYKIKGNESFKSGKYNEA

SEQ ID NO: 2284271 - protein, 8 aa, Cryptosporidium parvum
SVSETDLN

SEQ ID NO: 2284272 - protein, 25 aa, Cryptosporidium parvum
SVSEYNNSSFDTDSSESSSSSDNDE

SEQ ID NO: 2284273 - protein, 4 aa, Cryptosporidium parvum
SVSG

SEQ ID NO: 2284274 - protein, 12 aa, Cryptosporidium parvum
SVSGESGGEYKK

SEQ ID NO: 2284275 - protein, 11 aa, Cryptosporidium parvum
SVSGTEVASGS

SEQ ID NO: 2284276 - protein, 27 aa, Cryptosporidium parvum
SVSKKKDPVQNNIEQNPNMESFGDSRD

SEQ ID NO: 2284277 - protein, 25 aa, Cryptosporidium parvum
SVSKPIKSINENSPVFPTNRSTTSS

SEQ ID NO: 2284278 - protein, 14 aa, Cryptosporidium parvum
SVSNDNLSKNPTII

SEQ ID NO: 2284279 - protein, 7 aa, Cryptosporidium parvum
SVSNKGN

SEQ ID NO: 2284280 - protein, 10 aa, Cryptosporidium parvum
SVSNTEYSDI

SEQ ID NO: 2284281 - protein, 20 aa, Cryptosporidium parvum
SVSPRKGCNSCNYSDPDEKK

SEQ ID NO: 2284282 - protein, 12 aa, Cryptosporidium parvum
SVSQSGPPSNHF

SEQ ID NO: 2284283 - protein, 12 aa, Cryptosporidium parvum
SVSQSHTCSNEN

SEQ ID NO: 2284284 - protein, 12 aa, Cryptosporidium parvum
SVSRGKDLSSST

SEQ ID NO: 2284285 - protein, 18 aa, Cryptosporidium parvum
SVSSSSSRGIRSSKFGDR

SEQ ID NO: 2284286 - protein, 15 aa, Cryptosporidium parvum
SVSTSKSVNSGMNYP

SEQ ID NO: 2284287 - protein, 4 aa, Cryptosporidium parvum
SVTP

SEQ ID NO: 2284288 - protein, 7 aa, Cryptosporidium parvum
SVTPDNC

SEQ ID NO: 2284289 - protein, 8 aa, Cryptosporidium parvum
SVTPEAED

SEQ ID NO: 2284290 - protein, 12 aa, Cryptosporidium parvum
SVTRYDPNVRGR

SEQ ID NO: 2284291 - protein, 13 aa, Cryptosporidium parvum
SVTSIDNTSNNID

SEQ ID NO: 2284292 - protein, 4 aa, Cryptosporidium parvum
SVVP

SEQ ID NO: 2284293 - protein, 12 aa, Cryptosporidium parvum
SVVPEAGRNSKL

SEQ ID NO: 2284294 - protein, 24 aa, Cryptosporidium parvum
SVVSPNQLPRQHQGKDSSGSSIGE

SEQ ID NO: 2284295 - protein, 20 aa, Cryptosporidium parvum
SWAPATNSVGNSPSNPSSQT

SEQ ID NO: 2284296 - protein, 4 aa, Cryptosporidium parvum
SWDG

SEQ ID NO: 2284297 - protein, 5 aa, Cryptosporidium parvum
SWGTP

SEQ ID NO: 2284298 - protein, 21 aa, Cryptosporidium parvum
SWNSKGTTFEDKDVSETARST

SEQ ID NO: 2284299 - protein, 13 aa, Cryptosporidium parvum
SWSTGTSDYRSNY

SEQ ID NO: 2284300 - protein, 7 aa, Cryptosporidium parvum
SWSYSSR

SEQ ID NO: 2284301 - protein, 9 aa, Cryptosporidium parvum
SWTKQEDEK

SEQ ID NO: 2284302 - protein, 23 aa, Cryptosporidium parvum
SYAPYIPGAKNGIPVTENTSTPQ

SEQ ID NO: 2284303 - protein, 8 aa, Cryptosporidium parvum
SYASLKQS

SEQ ID NO: 2284304 - protein, 8 aa, Cryptosporidium parvum
SYCSNNRK

SEQ ID NO: 2284305 - protein, 7 aa, Cryptosporidium parvum
SYDDELK

SEQ ID NO: 2284306 - protein, 5 aa, Cryptosporidium parvum
SYDRT

SEQ ID NO: 2284307 - protein, 38 aa, Cryptosporidium parvum; identical to SEQ ID NO: 2164269

SEQ ID NO: 2284308 - protein, 15 aa, Cryptosporidium parvum
SYEEEFKEAEKAVKE

SEQ ID NO: 2284309 - protein, 13 aa, Cryptosporidium parvum
SYENESLGQNKKP

SEQ ID NO: 2284310 - protein, 6 aa, Cryptosporidium parvum
SYENGD

SEQ ID NO: 2284311 - protein, 7 aa, Cryptosporidium parvum
SYEPNEA

SEQ ID NO: 2284312 - protein, 17 aa, Cryptosporidium parvum
SYERKNGQNLGESTHSS

SEQ ID NO: 2284313 - protein, 4 aa, Cryptosporidium parvum
SYES

SEQ ID NO: 2284314 - protein, 15 aa, Cryptosporidium parvum
SYESEVKNNSNFPHG

SEQ ID NO: 2284315 - protein, 5 aa, Cryptosporidium parvum
SYETQ

SEQ ID NO: 2284316 - protein, 5 aa, Cryptosporidium parvum
SYFGS

SEQ ID NO: 2284317 - protein, 7 aa, Cryptosporidium parvum
SYGNSGA

SEQ ID NO: 2284318 - protein, 11 aa, Cryptosporidium parvum
SYGQPRREYTP

SEQ ID NO: 2284319 - protein, 11 aa, Cryptosporidium parvum
SYGSNKEDEPM

SEQ ID NO: 2284320 - protein, 8 aa, Cryptosporidium parvum
SYGTNNPK

SEQ ID NO: 2284321 - protein, 12 aa, Cryptosporidium parvum
SYHGNGESLNSD

SEQ ID NO: 2284322 - protein, 12 aa, Cryptosporidium parvum
SYIENKEDELDE

SEQ ID NO: 2284323 - protein, 4 aa, Cryptosporidium parvum
SYIP

SEQ ID NO: 2284324 - protein, 4 aa, Cryptosporidium parvum
SYKA

SEQ ID NO: 2284325 - protein, 16 aa, Cryptosporidium parvum
SYKAEFERNKDEALKR

SEQ ID NO: 2284326 - protein, 10 aa, Cryptosporidium parvum
SYKDSGSSGI

SEQ ID NO: 2284327 - protein, 10 aa, Cryptosporidium parvum
SYKDSPQFKP

SEQ ID NO: 2284328 - protein, 20 aa, Cryptosporidium parvum
SYKPDIKKGVRKTDKSRIPK

SEQ ID NO: 2284329 - protein, 10 aa, Cryptosporidium parvum
SYKSADGSYS

SEQ ID NO: 2284330 - protein, 5 aa, Cryptosporidium parvum
SYKSG

SEQ ID NO: 2284331 - protein, 11 aa, Cryptosporidium parvum
SYKSLRKRRTE

SEQ ID NO: 2284332 - protein, 17 aa, Cryptosporidium parvum
SYLDSESKAKSNDNEQI

SEQ ID NO: 2284333 - protein, 11 aa, Cryptosporidium parvum
SYLTPSKEPNF

SEQ ID NO: 2284334 - protein, 5 aa, Cryptosporidium parvum
SYLTS

SEQ ID NO: 2284335 - protein, 7 aa, Cryptosporidium parvum
SYNANGL

SEQ ID NO: 2284336 - protein, 9 aa, Cryptosporidium parvum
SYNDKIESN

SEQ ID NO: 2284337 - protein, 4 aa, Cryptosporidium parvum
SYNE

SEQ ID NO: 2284338 - protein, 13 aa, Cryptosporidium parvum
SYNEDNNSCKDTC

SEQ ID NO: 2284339 - protein, 10 aa, Cryptosporidium parvum
SYNIDNPDQY

SEQ ID NO: 2284340 - protein, 11 aa, Cryptosporidium parvum
SYNNLSDSNSI

SEQ ID NO: 2284341 - protein, 13 aa, Cryptosporidium parvum
SYNNNSPQSLSPF

SEQ ID NO: 2284342 - protein, 8 aa, Cryptosporidium parvum
SYNPENTN

SEQ ID NO: 2284343 - protein, 7 aa, Cryptosporidium parvum
SYNPPEE

SEQ ID NO: 2284344 - protein, 5 aa, Cryptosporidium parvum
SYNSE

SEQ ID NO: 2284345 - protein, 4 aa, Cryptosporidium parvum
SYNT

SEQ ID NO: 2284346 - protein, 8 aa, Cryptosporidium parvum
SYNTPGIK

SEQ ID NO: 2284347 - protein, 13 aa, Cryptosporidium parvum
SYNTTNNNSTSEI

SEQ ID NO: 2284348 - protein, 5 aa, Cryptosporidium parvum
SYPAP

SEQ ID NO: 2284349 - protein, 8 aa, Cryptosporidium parvum
SYPDPPAC

SEQ ID NO: 2284350 - protein, 6 aa, Cryptosporidium parvum
SYPESI

SEQ ID NO: 2284351 - protein, 4 aa, Cryptosporidium parvum
SYPG

SEQ ID NO: 2284352 - protein, 4 aa, Cryptosporidium parvum
SYPL

SEQ ID NO: 2284353 - protein, 5 aa, Cryptosporidium parvum
SYPNI

SEQ ID NO: 2284354 - protein, 8 aa, Cryptosporidium parvum
SYPSPTVS

SEQ ID NO: 2284355 - protein, 6 aa, Cryptosporidium parvum
SYQETV

SEQ ID NO: 2284356 - protein, 6 aa, Cryptosporidium parvum
SYQNKV

SEQ ID NO: 2284357 - protein, 4 aa, Cryptosporidium parvum
SYRE

SEQ ID NO: 2284358 - protein, 6 aa, Cryptosporidium parvum
SYRKNN

SEQ ID NO: 2284359 - protein, 4 aa, Cryptosporidium parvum
SYRN

SEQ ID NO: 2284360 - protein, 8 aa, Cryptosporidium parvum
SYRSDVNQ

SEQ ID NO: 2284361 - protein, 8 aa, Cryptosporidium parvum
SYSAPNNA

SEQ ID NO: 2284362 - protein, 18 aa, Cryptosporidium parvum
SYSASKKLEQNENYNEDQ

SEQ ID NO: 2284363 - protein, 5 aa, Cryptosporidium parvum
SYSEG

SEQ ID NO: 2284364 - protein, 11 aa, Cryptosporidium parvum
SYSGGGNRGQL

SEQ ID NO: 2284365 - protein, 6 aa, Cryptosporidium parvum
SYSGNS

SEQ ID NO: 2284366 - protein, 10 aa, Cryptosporidium parvum
SYSGSTTTTM

SEQ ID NO: 2284367 - protein, 8 aa, Cryptosporidium parvum
SYSKAAQD

SEQ ID NO: 2284368 - protein, 8 aa, Cryptosporidium parvum
SYSKNSGT

SEQ ID NO: 2284369 - protein, 4 aa, Cryptosporidium parvum
SYSN

SEQ ID NO: 2284370 - protein, 6 aa, Cryptosporidium parvum
SYSNTN

SEQ ID NO: 2284371 - protein, 11 aa, Cryptosporidium parvum
SYSNWEKTDPV

SEQ ID NO: 2284372 - protein, 17 aa, Cryptosporidium parvum
SYSRGRDAKSSQADNQD

SEQ ID NO: 2284373 - protein, 24 aa, Cryptosporidium parvum
SYSRKKKVVNKQGRANARQSNHEF

SEQ ID NO: 2284374 - protein, 6 aa, Cryptosporidium parvum
SYSSEH

SEQ ID NO: 2284375 - protein, 9 aa, Cryptosporidium parvum
SYSTTTRTS

SEQ ID NO: 2284376 - protein, 4 aa, Cryptosporidium parvum
SYSY

SEQ ID NO: 2284377 - protein, 12 aa, Cryptosporidium parvum
SYTDQDSQSQLS

SEQ ID NO: 2284378 - protein, 12 aa, Cryptosporidium parvum
SYTGSGGASSLV

SEQ ID NO: 2284379 - protein, 8 aa, Cryptosporidium parvum
SYTKDSME

SEQ ID NO: 2284380 - protein, 11 aa, Cryptosporidium parvum
SYTKNKNHLTR

SEQ ID NO: 2284381 - protein, 5 aa, Cryptosporidium parvum
SYTKQ

SEQ ID NO: 2284382 - protein, 24 aa, Cryptosporidium parvum
SYTSGSGSIPCENSSDSSKQQRIQ

SEQ ID NO: 2284383 - protein, 10 aa, Cryptosporidium parvum
SYTSSPCQSF

SEQ ID NO: 2284384 - protein, 4 aa, Cryptosporidium parvum
SYTT

SEQ ID NO: 2284385 - protein, 15 aa, Cryptosporidium parvum
SYVSSEGEDFDPKDK

SEQ ID NO: 2284386 - protein, 8 aa, Cryptosporidium parvum
SYYGGEAA

SEQ ID NO: 2284387 - protein, 4 aa, Cryptosporidium parvum
SYYN

SEQ ID NO: 2284388 - protein, 11 aa, Cryptosporidium parvum
SYYNQNNQAGY

SEQ ID NO: 2284389 - protein, 8 aa, Cryptosporidium parvum
TAAAAAAA

SEQ ID NO: 2284390 - protein, 6 aa, Cryptosporidium parvum
TAAAQS

SEQ ID NO: 2284391 - protein, 8 aa, Cryptosporidium parvum
TADEDTGV

SEQ ID NO: 2284392 - protein, 10 aa, Cryptosporidium parvum
TADGEEEYSW

SEQ ID NO: 2284393 - protein, 7 aa, Cryptosporidium parvum
TADPNDV

SEQ ID NO: 2284394 - protein, 5 aa, Cryptosporidium parvum
TADRF

SEQ ID NO: 2284395 - protein, 9 aa, Cryptosporidium parvum
TADRQKALE

SEQ ID NO: 2284396 - protein, 7 aa, Cryptosporidium parvum
TADSIGK

SEQ ID NO: 2284397 - protein, 5 aa, Cryptosporidium parvum
TAEDL

SEQ ID NO: 2284398 - protein, 5 aa, Cryptosporidium parvum
TAEDP

SEQ ID NO: 2284399 - protein, 13 aa, Cryptosporidium parvum
TAEGGELKAPSEK

SEQ ID NO: 2284400 - protein, 9 aa, Cryptosporidium parvum
TAENGKGFS

SEQ ID NO: 2284401 - protein, 6 aa, Cryptosporidium parvum
TAEQNY

SEQ ID NO: 2284402 - protein, 5 aa, Cryptosporidium parvum
TAERE

SEQ ID NO: 2284403 - protein, 7 aa, Cryptosporidium parvum
TAESGLP

SEQ ID NO: 2284404 - protein, 11 aa, Cryptosporidium parvum
TAESKEKTEKE

SEQ ID NO: 2284405 - protein, 32 aa, Cryptosporidium parvum
TAESSRMDAATKPTNGPKKGNSGGGNSGGGYG

SEQ ID NO: 2284406 - protein, 6 aa, Cryptosporidium parvum
TAETKA

SEQ ID NO: 2284407 - protein, 4 aa, Cryptosporidium parvum
TAGG

SEQ ID NO: 2284408 - protein, 5 aa, Cryptosporidium parvum
TAGGK

SEQ ID NO: 2284409 - protein, 9 aa, Cryptosporidium parvum
TAGGPTPDL

SEQ ID NO: 2284410 - protein, 11 aa, Cryptosporidium parvum
TAGKNSNSNTI

SEQ ID NO: 2284411 - protein, 7 aa, Cryptosporidium parvum
TAGKPYS

SEQ ID NO: 2284412 - protein, 7 aa, Cryptosporidium parvum
TAGNDNS

SEQ ID NO: 2284413 - protein, 8 aa, Cryptosporidium parvum
TAGNKEQI

SEQ ID NO: 2284414 - protein, 6 aa, Cryptosporidium parvum
TAGNYT

SEQ ID NO: 2284415 - protein, 8 aa, Cryptosporidium parvum
TAGQERYR

SEQ ID NO: 2284416 - protein, 9 aa, Cryptosporidium parvum
TAHSTRKEA

SEQ ID NO: 2284417 - protein, 8 aa, Cryptosporidium parvum
TAIEESEE

SEQ ID NO: 2284418 - protein, 19 aa, Cryptosporidium parvum
TAIGKSKTISNCEYKSSEE

SEQ ID NO: 2284419 - protein, 12 aa, Cryptosporidium parvum
TAIQSMNAPGKG

SEQ ID NO: 2284420 - protein, 7 aa, Cryptosporidium parvum
TAISENN

SEQ ID NO: 2284421 - protein, 4 aa, Cryptosporidium parvum
TAIT

SEQ ID NO: 2284422 - protein, 5 aa, Cryptosporidium parvum
TAKCD

SEQ ID NO: 2284423 - protein, 8 aa, Cryptosporidium parvum
TAKDGYND

SEQ ID NO: 2284424 - protein, 5 aa, Cryptosporidium parvum
TAKER

SEQ ID NO: 2284425 - protein, 14 aa, Cryptosporidium parvum
TAKPKLDSEDGEII

SEQ ID NO: 2284426 - protein, 9 aa, Cryptosporidium parvum
TAKSTDYQR

SEQ ID NO: 2284427 - protein, 7 aa, Cryptosporidium parvum
TAKTQQM

SEQ ID NO: 2284428 - protein, 10 aa, Cryptosporidium parvum
TALNGGSQTC

SEQ ID NO: 2284429 - protein, 10 aa, Cryptosporidium parvum
TANENQSNEN

SEQ ID NO: 2284430 - protein, 11 aa, Cryptosporidium parvum
TANETLCKEKK

SEQ ID NO: 2284431 - protein, 5 aa, Cryptosporidium parvum
TANKN

SEQ ID NO: 2284432 - protein, 8 aa, Cryptosporidium parvum
TANNSNIV

SEQ ID NO: 2284433 - protein, 5 aa, Cryptosporidium parvum
TANPH

SEQ ID NO: 2284434 - protein, 14 aa, Cryptosporidium parvum
TANQESSLKDENNT

SEQ ID NO: 2284435 - protein, 12 aa, Cryptosporidium parvum
TANQLTELSSSE

SEQ ID NO: 2284436 - protein, 15 aa, Cryptosporidium parvum
TANSVEKNDDLKREE

SEQ ID NO: 2284437 - protein, 11 aa, Cryptosporidium parvum
TANTNSNTTNI

SEQ ID NO: 2284438 - protein, 94 aa, Cryptosporidium parvum
TAPETTTTGAAGVTGSTNTTGTTTRTTTGATGATGATGTTGTTTTTTTTTTGATGTTTDTNTTTTTTTTGTTGTTGTTDTSGFTTGATTTTTTF

SEQ ID NO: 2284439 - protein, 12 aa, Cryptosporidium parvum
TAPGPQSSASVS

SEQ ID NO: 2284440 - protein, 17 aa, Cryptosporidium parvum
TAPHTRPNMSPPLNPQG

SEQ ID NO: 2284441 - protein, 6 aa, Cryptosporidium parvum
TAPSNG

SEQ ID NO: 2284442 - protein, 6 aa, Cryptosporidium parvum
TAPTHP

SEQ ID NO: 2284443 - protein, 4 aa, Cryptosporidium parvum
TAQK

SEQ ID NO: 2284444 - protein, 9 aa, Cryptosporidium parvum
TAQNLESEM

SEQ ID NO: 2284445 - protein, 6 aa, Cryptosporidium parvum
TARDGS

SEQ ID NO: 2284446 - protein, 5 aa, Cryptosporidium parvum
TAREK

SEQ ID NO: 2284447 - protein, 9 aa, Cryptosporidium parvum
TARESNNPQ

SEQ ID NO: 2284448 - protein, 8 aa, Cryptosporidium parvum
TARIGSKG

SEQ ID NO: 2284449 - protein, 48 aa, Cryptosporidium parvum
TARKKRKFIPSSDQEYNDFNKNENSSSKRGKKVAKKCEDQNKNGTDLS

SEQ ID NO: 2284450 - protein, 9 aa, Cryptosporidium parvum
TARMGDKGT

SEQ ID NO: 2284451 - protein, 5 aa, Cryptosporidium parvum
TARQK

SEQ ID NO: 2284452 - protein, 7 aa, Cryptosporidium parvum
TARQSGY

SEQ ID NO: 2284453 - protein, 5 aa, Cryptosporidium parvum
TARSE

SEQ ID NO: 2284454 - protein, 6 aa, Cryptosporidium parvum
TASDDG

SEQ ID NO: 2284455 - protein, 7 aa, Cryptosporidium parvum
TASDSDN

SEQ ID NO: 2284456 - protein, 15 aa, Cryptosporidium parvum
TASGGGGGGGEGAEV

SEQ ID NO: 2284457 - protein, 5 aa, Cryptosporidium parvum
TASGR

SEQ ID NO: 2284458 - protein, 23 aa, Cryptosporidium parvum
TASKPKVADNHSKYKQEASYTQS

SEQ ID NO: 2284459 - protein, 4 aa, Cryptosporidium parvum
TASN

SEQ ID NO: 2284460 - protein, 7 aa, Cryptosporidium parvum
TASNAAS

SEQ ID NO: 2284461 - protein, 5 aa, Cryptosporidium parvum
TASPV

SEQ ID NO: 2284462 - protein, 9 aa, Cryptosporidium parvum
TASQNSNIA

SEQ ID NO: 2284463 - protein, 9 aa, Cryptosporidium parvum
TASSNYLPS

SEQ ID NO: 2284464 - protein, 37 aa, Cryptosporidium parvum
TASSSLSSSSSSSSSSSSSSSSSSSSSSSSSSSSFQN

SEQ ID NO: 2284465 - protein, 16 aa, Cryptosporidium parvum
TASTSKALSLSKQGSG

SEQ ID NO: 2284466 - protein, 22 aa, Cryptosporidium parvum
TASYGRRDKALPDEDRTTNKVK

SEQ ID NO: 2284467 - protein, 7 aa, Cryptosporidium parvum
TATKRTA

SEQ ID NO: 2284468 - protein, 12 aa, Cryptosporidium parvum
TATSGSSSSDML

SEQ ID NO: 2284469 - protein, 13 aa, Cryptosporidium parvum
TATSTGQNDPSLI

SEQ ID NO: 2284470 - protein, 8 aa, Cryptosporidium parvum
TATTMQNS

SEQ ID NO: 2284471 - protein, 26 aa, Cryptosporidium parvum
TATVKKPKQTESHLSSERNSTSCKDQ

SEQ ID NO: 2284472 - protein, 5 aa, Cryptosporidium parvum
TAVDA

SEQ ID NO: 2284473 - protein, 7 aa, Cryptosporidium parvum
TAYPKPQ

SEQ ID NO: 2284474 - protein, 11 aa, Cryptosporidium parvum
TCDQRGSVVDP

SEQ ID NO: 2284475 - protein, 7 aa, Cryptosporidium parvum
TCEKTHK

SEQ ID NO: 2284476 - protein, 5 aa, Cryptosporidium parvum
TCENG

SEQ ID NO: 2284477 - protein, 9 aa, Cryptosporidium parvum
TCESESVDA

SEQ ID NO: 2284478 - protein, 6 aa, Cryptosporidium parvum
TCGDYG

SEQ ID NO: 2284479 - protein, 5 aa, Cryptosporidium parvum
TCGGP

SEQ ID NO: 2284480 - protein, 6 aa, Cryptosporidium parvum
TCIEGG

SEQ ID NO: 2284481 - protein, 8 aa, Cryptosporidium parvum
TCNGNGKN

SEQ ID NO: 2284482 - protein, 18 aa, Cryptosporidium parvum
TCNKKSESRRSSAYNSTV

SEQ ID NO: 2284483 - protein, 12 aa, Cryptosporidium parvum
TCNNNPEMQNQI

SEQ ID NO: 2284484 - protein, 16 aa, Cryptosporidium parvum
TCNSDNASNSISSQSI

SEQ ID NO: 2284485 - protein, 6 aa, Cryptosporidium parvum
TCSEDK

SEQ ID NO: 2284486 - protein, 14 aa, Cryptosporidium parvum
TCTGTDDNSSSSTT

SEQ ID NO: 2284487 - protein, 11 aa, Cryptosporidium parvum
TCTTSSDISTP

SEQ ID NO: 2284488 - protein, 10 aa, Cryptosporidium parvum
TDAAKNGSIS

SEQ ID NO: 2284489 - protein, 22 aa, Cryptosporidium parvum
TDAENKAKIEKSTSKKRPVIKG

SEQ ID NO: 2284490 - protein, 9 aa, Cryptosporidium parvum
TDANPDDPL

SEQ ID NO: 2284491 - protein, 4 aa, Cryptosporidium parvum
TDAQ

SEQ ID NO: 2284492 - protein, 6 aa, Cryptosporidium parvum
TDARMT

SEQ ID NO: 2284493 - protein, 7 aa, Cryptosporidium parvum
TDASLGR

SEQ ID NO: 2284494 - protein, 5 aa, Cryptosporidium parvum
TDASP

SEQ ID NO: 2284495 - protein, 9 aa, Cryptosporidium parvum
TDASTLSSF

SEQ ID NO: 2284496 - protein, 4 aa, Cryptosporidium parvum
TDCL

SEQ ID NO: 2284497 - protein, 7 aa, Cryptosporidium parvum
TDCQSKG

SEQ ID NO: 2284498 - protein, 8 aa, Cryptosporidium parvum
TDDDGAVT

SEQ ID NO: 2284499 - protein, 54 aa, Cryptosporidium parvum
TDDEVEGQKDDQKETNQSTLEGGLENVGGGGVGDSEEFMSQDDEKEEESHEGHK

SEQ ID NO: 2284500 - protein, 9 aa, Cryptosporidium parvum
TDDKESSLV

SEQ ID NO: 2284501 - protein, 4 aa, Cryptosporidium parvum
TDDL

SEQ ID NO: 2284502 - protein, 6 aa, Cryptosporidium parvum
TDDLPK

SEQ ID NO: 2284503 - protein, 28 aa, Cryptosporidium parvum
TDDNIKNNVNNNNNNNNNNGNNTNIPDK

SEQ ID NO: 2284504 - protein, 5 aa, Cryptosporidium parvum
TDDPF

SEQ ID NO: 2284505 - protein, 7 aa, Cryptosporidium parvum
TDDQSVP

SEQ ID NO: 2284506 - protein, 4 aa, Cryptosporidium parvum
TDDS

SEQ ID NO: 2284507 - protein, 18 aa, Cryptosporidium parvum
TDDSERKFPTINICDLGK

SEQ ID NO: 2284508 - protein, 6 aa, Cryptosporidium parvum
TDDVTY

SEQ ID NO: 2284509 - protein, 4 aa, Cryptosporidium parvum
TDEE

SEQ ID NO: 2284510 - protein, 34 aa, Cryptosporidium parvum
TDEEDEDDDQEETQDDNFENDPDEEMTPITGEND

SEQ ID NO: 2284511 - protein, 10 aa, Cryptosporidium parvum
TDEEENPSSK

SEQ ID NO: 2284512 - protein, 14 aa, Cryptosporidium parvum
TDEELNSKDPGDAR

SEQ ID NO: 2284513 - protein, 8 aa, Cryptosporidium parvum
TDEESFND

SEQ ID NO: 2284514 - protein, 6 aa, Cryptosporidium parvum
TDEGKD

SEQ ID NO: 2284515 - protein, 4 aa, Cryptosporidium parvum
TDEI

SEQ ID NO: 2284516 - protein, 15 aa, Cryptosporidium parvum
TDEKEYVDRSNSKIQ

SEQ ID NO: 2284517 - protein, 8 aa, Cryptosporidium parvum
TDEKNTRE

SEQ ID NO: 2284518 - protein, 6 aa, Cryptosporidium parvum
TDEMNK

SEQ ID NO: 2284519 - protein, 4 aa, Cryptosporidium parvum
TDEN

SEQ ID NO: 2284520 - protein, 7 aa, Cryptosporidium parvum
TDENESF

SEQ ID NO: 2284521 - protein, 9 aa, Cryptosporidium parvum
TDENGYKGD

SEQ ID NO: 2284522 - protein, 34 aa, Cryptosporidium parvum
TDENISEESTNQEQPPSHQNADQNPDNSLKQGYR

SEQ ID NO: 2284523 - protein, 8 aa, Cryptosporidium parvum
TDENQNQV

SEQ ID NO: 2284524 - protein, 8 aa, Cryptosporidium parvum
TDESTAEL

SEQ ID NO: 2284525 - protein, 10 aa, Cryptosporidium parvum
TDEVNTEDPK

SEQ ID NO: 2284526 - protein, 8 aa, Cryptosporidium parvum
TDFGENSS

SEQ ID NO: 2284527 - protein, 11 aa, Cryptosporidium parvum
TDFQNNEPDLE

SEQ ID NO: 2284528 - protein, 6 aa, Cryptosporidium parvum
TDFSNG

SEQ ID NO: 2284529 - protein, 11 aa, Cryptosporidium parvum
TDFTKDENNPI

SEQ ID NO: 2284530 - protein, 9 aa, Cryptosporidium parvum
TDGIGTGWS

SEQ ID NO: 2284531 - protein, 7 aa, Cryptosporidium parvum
TDGNGRI

SEQ ID NO: 2284532 - protein, 14 aa, Cryptosporidium parvum
TDGNLNQNNSDKSF

SEQ ID NO: 2284533 - protein, 7 aa, Cryptosporidium parvum
TDGNQKI

SEQ ID NO: 2284534 - protein, 12 aa, Cryptosporidium parvum
TDGSGTIDPKEM

SEQ ID NO: 2284535 - protein, 10 aa, Cryptosporidium parvum
TDGTAEIREE

SEQ ID NO: 2284536 - protein, 9 aa, Cryptosporidium parvum
TDGTSTCSE

SEQ ID NO: 2284537 - protein, 18 aa, Cryptosporidium parvum
TDGYDPNIKDKSDEVYTS

SEQ ID NO: 2284538 - protein, 12 aa, Cryptosporidium parvum
TDHHDGNGCDSM

SEQ ID NO: 2284539 - protein, 7 aa, Cryptosporidium parvum
TDHLNSD

SEQ ID NO: 2284540 - protein, 7 aa, Cryptosporidium parvum
TDHSNSV

SEQ ID NO: 2284541 - protein, 5 aa, Cryptosporidium parvum
TDIDE

SEQ ID NO: 2284542 - protein, 6 aa, Cryptosporidium parvum
TDIENN

SEQ ID NO: 2284543 - protein, 4 aa, Cryptosporidium parvum
TDIN

SEQ ID NO: 2284544 - protein, 6 aa, Cryptosporidium parvum
TDINEE

SEQ ID NO: 2284545 - protein, 13 aa, Cryptosporidium parvum
TDIPKEIEANTNK

SEQ ID NO: 2284546 - protein, 6 aa, Cryptosporidium parvum
TDIQNQ

SEQ ID NO: 2284547 - protein, 4 aa, Cryptosporidium parvum
TDIR

SEQ ID NO: 2284548 - protein, 5 aa, Cryptosporidium parvum
TDISS

SEQ ID NO: 2284549 - protein, 15 aa, Cryptosporidium parvum
TDITAKSEMHASSNT

SEQ ID NO: 2284550 - protein, 8 aa, Cryptosporidium parvum
TDKDGNEI

SEQ ID NO: 2284551 - protein, 16 aa, Cryptosporidium parvum
TDKDRELSSYSETSNS

SEQ ID NO: 2284552 - protein, 22 aa, Cryptosporidium parvum
TDKEEKQSLSSCKSKMSDEANQ

SEQ ID NO: 2284553 - protein, 10 aa, Cryptosporidium parvum
TDKEEQKEIR

SEQ ID NO: 2284554 - protein, 15 aa, Cryptosporidium parvum
TDKFKKNKLNNIKSN

SEQ ID NO: 2284555 - protein, 4 aa, Cryptosporidium parvum
TDKG

SEQ ID NO: 2284556 - protein, 24 aa, Cryptosporidium parvum
TDKLKEEKEEDKIYKQNDSDEEIM

SEQ ID NO: 2284557 - protein, 7 aa, Cryptosporidium parvum
TDKQKSL

SEQ ID NO: 2284558 - protein, 5 aa, Cryptosporidium parvum
TDKRG

SEQ ID NO: 2284559 - protein, 8 aa, Cryptosporidium parvum
TDLASKSV

SEQ ID NO: 2284560 - protein, 14 aa, Cryptosporidium parvum
TDLSQKNKLKDSMS

SEQ ID NO: 2284561 - protein, 9 aa, Cryptosporidium parvum
TDNEISHDD

SEQ ID NO: 2284562 - protein, 14 aa, Cryptosporidium parvum
TDNEQSLCQSPRDE

SEQ ID NO: 2284563 - protein, 18 aa, Cryptosporidium parvum
TDNHSGSATGHNCPPSSI

SEQ ID NO: 2284564 - protein, 6 aa, Cryptosporidium parvum
TDNISS

SEQ ID NO: 2284565 - protein, 4 aa, Cryptosporidium parvum
TDNK

SEQ ID NO: 2284566 - protein, 7 aa, Cryptosporidium parvum
TDNKPRI

SEQ ID NO: 2284567 - protein, 5 aa, Cryptosporidium parvum
TDNMH

SEQ ID NO: 2284568 - protein, 4 aa, Cryptosporidium parvum
TDNN

SEQ ID NO: 2284569 - protein, 17 aa, Cryptosporidium parvum
TDNNADFGHNGRMNSQH

SEQ ID NO: 2284570 - protein, 10 aa, Cryptosporidium parvum
TDNNNSQSSA

SEQ ID NO: 2284571 - protein, 9 aa, Cryptosporidium parvum
TDNPAKIGN

SEQ ID NO: 2284572 - protein, 5 aa, Cryptosporidium parvum
TDNPD

SEQ ID NO: 2284573 - protein, 6 aa, Cryptosporidium parvum
TDNPEI

SEQ ID NO: 2284574 - protein, 5 aa, Cryptosporidium parvum
TDNSF

SEQ ID NO: 2284575 - protein, 10 aa, Cryptosporidium parvum
TDNSSTDHSS

SEQ ID NO: 2284576 - protein, 17 aa, Cryptosporidium parvum
TDNYSKYSNGKKRKVEK

SEQ ID NO: 2284577 - protein, 13 aa, Cryptosporidium parvum
TDPAGVKARIGDN

SEQ ID NO: 2284578 - protein, 5 aa, Cryptosporidium parvum
TDPGQ

SEQ ID NO: 2284579 - protein, 4 aa, Cryptosporidium parvum
TDPI

SEQ ID NO: 2284580 - protein, 4 aa, Cryptosporidium parvum
TDPK

SEQ ID NO: 2284581 - protein, 30 aa, Cryptosporidium parvum
TDPKLYPESGYERGSVKKENEQVNKINQEE

SEQ ID NO: 2284582 - protein, 8 aa, Cryptosporidium parvum
TDPKSGDY

SEQ ID NO: 2284583 - protein, 13 aa, Cryptosporidium parvum
TDPLGASNPYGQT

SEQ ID NO: 2284584 - protein, 6 aa, Cryptosporidium parvum
TDPLTG

SEQ ID NO: 2284585 - protein, 12 aa, Cryptosporidium parvum
TDPNSDEGKRRI

SEQ ID NO: 2284586 - protein, 5 aa, Cryptosporidium parvum
TDPNY

SEQ ID NO: 2284587 - protein, 8 aa, Cryptosporidium parvum
TDPSPNSE

SEQ ID NO: 2284588 - protein, 5 aa, Cryptosporidium parvum
TDPTY

SEQ ID NO: 2284589 - protein, 8 aa, Cryptosporidium parvum
TDQEDSSF

SEQ ID NO: 2284590 - protein, 8 aa, Cryptosporidium parvum
TDQGYPQD

SEQ ID NO: 2284591 - protein, 5 aa, Cryptosporidium parvum
TDQPT

SEQ ID NO: 2284592 - protein, 31 aa, Cryptosporidium parvum
TDQSLTEHTEINSANGQIHEGKSSRKANKKS

SEQ ID NO: 2284593 - protein, 50 aa, Cryptosporidium parvum
TDRHRGNYEWEDNDRRRVADNEGRRDRDFDSERGRRREHYGGRDRRRDFR

SEQ ID NO: 2284594 - protein, 6 aa, Cryptosporidium parvum
TDRNGL

SEQ ID NO: 2284595 - protein, 6 aa, Cryptosporidium parvum
TDRSEL

SEQ ID NO: 2284596 - protein, 18 aa, Cryptosporidium parvum
TDRSKYEQTAREWTQKYA

SEQ ID NO: 2284597 - protein, 6 aa, Cryptosporidium parvum
TDRSLT

SEQ ID NO: 2284598 - protein, 5 aa, Cryptosporidium parvum
TDRTD

SEQ ID NO: 2284599 - protein, 12 aa, Cryptosporidium parvum
TDSDEVGETSQF

SEQ ID NO: 2284600 - protein, 10 aa, Cryptosporidium parvum
TDSENSKNYQ

SEQ ID NO: 2284601 - protein, 10 aa, Cryptosporidium parvum
TDSKADVSYN

SEQ ID NO: 2284602 - protein, 9 aa, Cryptosporidium parvum
TDSKNSSPL

SEQ ID NO: 2284603 - protein, 4 aa, Cryptosporidium parvum
TDSL

SEQ ID NO: 2284604 - protein, 11 aa, Cryptosporidium parvum
TDSMENKSFEE

SEQ ID NO: 2284605 - protein, 4 aa, Cryptosporidium parvum
TDSN

SEQ ID NO: 2284606 - protein, 10 aa, Cryptosporidium parvum
TDSNDPNKSV

SEQ ID NO: 2284607 - protein, 10 aa, Cryptosporidium parvum
TDSNTKDKSN

SEQ ID NO: 2284608 - protein, 16 aa, Cryptosporidium parvum
TDSPNINELGRNKTIS

SEQ ID NO: 2284609 - protein, 5 aa, Cryptosporidium parvum
TDSPP

SEQ ID NO: 2284610 - protein, 4 aa, Cryptosporidium parvum
TDSS

SEQ ID NO: 2284611 - protein, 7 aa, Cryptosporidium parvum
TDSSRGL

SEQ ID NO: 2284612 - protein, 8 aa, Cryptosporidium parvum
TDSSSKSL

SEQ ID NO: 2284613 - protein, 6 aa, Cryptosporidium parvum
TDSSYK

SEQ ID NO: 2284614 - protein, 19 aa, Cryptosporidium parvum
TDSTSNMNTNSSNKRRSIT

SEQ ID NO: 2284615 - protein, 12 aa, Cryptosporidium parvum
TDSYHSENHNTT

SEQ ID NO: 2284616 - protein, 5 aa, Cryptosporidium parvum
TDTGG

SEQ ID NO: 2284617 - protein, 6 aa, Cryptosporidium parvum
TDTNIG

SEQ ID NO: 2284618 - protein, 17 aa, Cryptosporidium parvum
TDTNQTIKDLPQDPYHI

SEQ ID NO: 2284619 - protein, 10 aa, Cryptosporidium parvum
TDTRNHENSI

SEQ ID NO: 2284620 - protein, 4 aa, Cryptosporidium parvum
TDVE

SEQ ID NO: 2284621 - protein, 8 aa, Cryptosporidium parvum
TDVEGKSL

SEQ ID NO: 2284622 - protein, 7 aa, Cryptosporidium parvum
TDVKDTS

SEQ ID NO: 2284623 - protein, 7 aa, Cryptosporidium parvum
TDYNGDN

SEQ ID NO: 2284624 - protein, 15 aa, Cryptosporidium parvum
TDYNNNTVSYQPLNS

SEQ ID NO: 2284625 - protein, 5 aa, Cryptosporidium parvum
TDYSR

SEQ ID NO: 2284626 - protein, 9 aa, Cryptosporidium parvum
TDYTKNDNI

SEQ ID NO: 2284627 - protein, 9 aa, Cryptosporidium parvum
TEAERKRRM

SEQ ID NO: 2284628 - protein, 8 aa, Cryptosporidium parvum
TEAESQSL

SEQ ID NO: 2284629 - protein, 10 aa, Cryptosporidium parvum
TEAGKVEGLE

SEQ ID NO: 2284630 - protein, 10 aa, Cryptosporidium parvum
TEAGNNIKNP

SEQ ID NO: 2284631 - protein, 4 aa, Cryptosporidium parvum
TEAL

SEQ ID NO: 2284632 - protein, 18 aa, Cryptosporidium parvum
TEANNEYSTSSSSSEINK

SEQ ID NO: 2284633 - protein, 5 aa, Cryptosporidium parvum
TEASD

SEQ ID NO: 2284634 - protein, 6 aa, Cryptosporidium parvum
TEASPY

SEQ ID NO: 2284635 - protein, 8 aa, Cryptosporidium parvum
TECEENKS

SEQ ID NO: 2284636 - protein, 12 aa, Cryptosporidium parvum
TEDDEGSNMTDT

SEQ ID NO: 2284637 - protein, 6 aa, Cryptosporidium parvum
TEDERR

SEQ ID NO: 2284638 - protein, 10 aa, Cryptosporidium parvum
TEDESKDYSL

SEQ ID NO: 2284639 - protein, 9 aa, Cryptosporidium parvum
TEDGKEKKV

SEQ ID NO: 2284640 - protein, 5 aa, Cryptosporidium parvum
TEDIS

SEQ ID NO: 2284641 - protein, 15 aa, Cryptosporidium parvum
TEDLGSQKPKMADQS

SEQ ID NO: 2284642 - protein, 4 aa, Cryptosporidium parvum
TEDN

SEQ ID NO: 2284643 - protein, 20 aa, Cryptosporidium parvum
TEDNEDLENEDNDITDHRDS

SEQ ID NO: 2284644 - protein, 4 aa, Cryptosporidium parvum
TEDS

SEQ ID NO: 2284645 - protein, 9 aa, Cryptosporidium parvum
TEDSERDLE

SEQ ID NO: 2284646 - protein, 8 aa, Cryptosporidium parvum
TEDTDAQI

SEQ ID NO: 2284647 - protein, 6 aa, Cryptosporidium parvum
TEEATK

SEQ ID NO: 2284648 - protein, 4 aa, Cryptosporidium parvum
TEED

SEQ ID NO: 2284649 - protein, 5 aa, Cryptosporidium parvum
TEEDR

SEQ ID NO: 2284650 - protein, 5 aa, Cryptosporidium parvum
TEEEE

SEQ ID NO: 2284651 - protein, 12 aa, Cryptosporidium parvum
TEEEEDNKEEKN

SEQ ID NO: 2284652 - protein, 14 aa, Cryptosporidium parvum
TEEERSKRRSDAKR

SEQ ID NO: 2284653 - protein, 9 aa, Cryptosporidium parvum
TEEETRKST

SEQ ID NO: 2284654 - protein, 14 aa, Cryptosporidium parvum
TEEGKDKGAGIREK

SEQ ID NO: 2284655 - protein, 16 aa, Cryptosporidium parvum
TEEHEEEEDYDDQDND

SEQ ID NO: 2284656 - protein, 8 aa, Cryptosporidium parvum
TEEHNKEI

SEQ ID NO: 2284657 - protein, 6 aa, Cryptosporidium parvum
TEEIED

SEQ ID NO: 2284658 - protein, 31 aa, Cryptosporidium parvum
TEEINKKIKKSDEKQKESGEERTLSSSMNSM

SEQ ID NO: 2284659 - protein, 17 aa, Cryptosporidium parvum
TEEINNSNSYSQSCNTI

SEQ ID NO: 2284660 - protein, 32 aa, Cryptosporidium parvum
TEEKEQVGFTSKGSSDSETDPTNLGKTQHPLS

SEQ ID NO: 2284661 - protein, 13 aa, Cryptosporidium parvum
TEEKKINNEENKS

SEQ ID NO: 2284662 - protein, 18 aa, Cryptosporidium parvum
TEEKSFKTYNTGESYNYN

SEQ ID NO: 2284663 - protein, 5 aa, Cryptosporidium parvum
TEELK

SEQ ID NO: 2284664 - protein, 4 aa, Cryptosporidium parvum
TEEM

SEQ ID NO: 2284665 - protein, 9 aa, Cryptosporidium parvum
TEEPTISES

SEQ ID NO: 2284666 - protein, 4 aa, Cryptosporidium parvum
TEEQ

SEQ ID NO: 2284667 - protein, 5 aa, Cryptosporidium parvum
TEEQC

SEQ ID NO: 2284668 - protein, 14 aa, Cryptosporidium parvum
TEEQSLKANEVSNK

SEQ ID NO: 2284669 - protein, 16 aa, Cryptosporidium parvum
TEFDGSDSGASPDEAV

SEQ ID NO: 2284670 - protein, 7 aa, Cryptosporidium parvum
TEFENET

SEQ ID NO: 2284671 - protein, 4 aa, Cryptosporidium parvum
TEFS

SEQ ID NO: 2284672 - protein, 5 aa, Cryptosporidium parvum
TEFSS

SEQ ID NO: 2284673 - protein, 6 aa, Cryptosporidium parvum
TEGEFD

SEQ ID NO: 2284674 - protein, 4 aa, Cryptosporidium parvum
TEGI

SEQ ID NO: 2284675 - protein, 9 aa, Cryptosporidium parvum
TEGKAKGSL

SEQ ID NO: 2284676 - protein, 11 aa, Cryptosporidium parvum
TEGKGLGKEEV

SEQ ID NO: 2284677 - protein, 6 aa, Cryptosporidium parvum
TEGKQF

SEQ ID NO: 2284678 - protein, 7 aa, Cryptosporidium parvum
TEGLHPE

SEQ ID NO: 2284679 - protein, 7 aa, Cryptosporidium parvum
TEGPAAG

SEQ ID NO: 2284680 - protein, 8 aa, Cryptosporidium parvum
TEGVSTTS

SEQ ID NO: 2284681 - protein, 4 aa, Cryptosporidium parvum
TEGY

SEQ ID NO: 2284682 - protein, 5 aa, Cryptosporidium parvum
TEHSP

SEQ ID NO: 2284683 - protein, 7 aa, Cryptosporidium parvum
TEHYQRS

SEQ ID NO: 2284684 - protein, 11 aa, Cryptosporidium parvum
TEIDQKNDESL

SEQ ID NO: 2284685 - protein, 5 aa, Cryptosporidium parvum
TEIDS

SEQ ID NO: 2284686 - protein, 6 aa, Cryptosporidium parvum
TEIGGI

SEQ ID NO: 2284687 - protein, 22 aa, Cryptosporidium parvum
TEIKSSKEAEEENQEYYPSESE

SEQ ID NO: 2284688 - protein, 7 aa, Cryptosporidium parvum
TEINETI

SEQ ID NO: 2284689 - protein, 11 aa, Cryptosporidium parvum
TEINSDDELPL

SEQ ID NO: 2284690 - protein, 9 aa, Cryptosporidium parvum
TEIPPGSMP

SEQ ID NO: 2284691 - protein, 8 aa, Cryptosporidium parvum
TEIPPTPL

SEQ ID NO: 2284692 - protein, 5 aa, Cryptosporidium parvum
TEIRP

SEQ ID NO: 2284693 - protein, 5 aa, Cryptosporidium parvum
TEISG

SEQ ID NO: 2284694 - protein, 14 aa, Cryptosporidium parvum
TEISKSEKKDENEN

SEQ ID NO: 2284695 - protein, 6 aa, Cryptosporidium parvum
TEISPS

SEQ ID NO: 2284696 - protein, 8 aa, Cryptosporidium parvum
TEITNNGY

SEQ ID NO: 2284697 - protein, 5 aa, Cryptosporidium parvum
TEKAQ

SEQ ID NO: 2284698 - protein, 28 aa, Cryptosporidium parvum
TEKDKSNEKQNDNDERNVTSPQLTTEGN

SEQ ID NO: 2284699 - protein, 9 aa, Cryptosporidium parvum
TEKDYEAED

SEQ ID NO: 2284700 - protein, 6 aa, Cryptosporidium parvum
TEKESP

SEQ ID NO: 2284701 - protein, 8 aa, Cryptosporidium parvum
TEKETTLV

SEQ ID NO: 2284702 - protein, 4 aa, Cryptosporidium parvum
TEKF

SEQ ID NO: 2284703 - protein, 6 aa, Cryptosporidium parvum
TEKING

SEQ ID NO: 2284704 - protein, 5 aa, Cryptosporidium parvum
TEKKG

SEQ ID NO: 2284705 - protein, 7 aa, Cryptosporidium parvum
TEKKTRE

SEQ ID NO: 2284706 - protein, 5 aa, Cryptosporidium parvum
TEKLY

SEQ ID NO: 2284707 - protein, 7 aa, Cryptosporidium parvum
TEKNERF

SEQ ID NO: 2284708 - protein, 5 aa, Cryptosporidium parvum
TEKNM

SEQ ID NO: 2284709 - protein, 8 aa, Cryptosporidium parvum
TEKPDDYK

SEQ ID NO: 2284710 - protein, 24 aa, Cryptosporidium parvum
TEKPINPLGKKTISDTLESIFNIN

SEQ ID NO: 2284711 - protein, 5 aa, Cryptosporidium parvum
TEKPV

SEQ ID NO: 2284712 - protein, 4 aa, Cryptosporidium parvum
TEKR

SEQ ID NO: 2284713 - protein, 8 aa, Cryptosporidium parvum
TEKRNSEL

SEQ ID NO: 2284714 - protein, 19 aa, Cryptosporidium parvum
TEKSENNSNAEVDLTNNQS

SEQ ID NO: 2284715 - protein, 5 aa, Cryptosporidium parvum
TEKSH

SEQ ID NO: 2284716 - protein, 11 aa, Cryptosporidium parvum
TEKSSSNGSCS

SEQ ID NO: 2284717 - protein, 7 aa, Cryptosporidium parvum
TEKYKHN

SEQ ID NO: 2284718 - protein, 12 aa, Cryptosporidium parvum
TEKYNSKEDSDF

SEQ ID NO: 2284719 - protein, 10 aa, Cryptosporidium parvum
TELDQPKDNL

SEQ ID NO: 2284720 - protein, 25 aa, Cryptosporidium parvum
TELENPYQIKTNRKKQLDQTKYENN

SEQ ID NO: 2284721 - protein, 14 aa, Cryptosporidium parvum
TELKKDEANSSTYI

SEQ ID NO: 2284722 - protein, 12 aa, Cryptosporidium parvum
TELNSENIAREN

SEQ ID NO: 2284723 - protein, 9 aa, Cryptosporidium parvum
TELSGGQRS

SEQ ID NO: 2284724 - protein, 5 aa, Cryptosporidium parvum
TENFK

SEQ ID NO: 2284725 - protein, 5 aa, Cryptosporidium parvum
TENGH

SEQ ID NO: 2284726 - protein, 23 aa, Cryptosporidium parvum
TENGSTKDDLALPTDAEGNPDEV

SEQ ID NO: 2284727 - protein, 17 aa, Cryptosporidium parvum
TENIKERKKGRKEYNET

SEQ ID NO: 2284728 - protein, 7 aa, Cryptosporidium parvum
TENINNE

SEQ ID NO: 2284729 - protein, 9 aa, Cryptosporidium parvum
TENKNEENL

SEQ ID NO: 2284730 - protein, 9 aa, Cryptosporidium parvum
TENKRNSLP

SEQ ID NO: 2284731 - protein, 4 aa, Cryptosporidium parvum
TENN

SEQ ID NO: 2284732 - protein, 21 aa, Cryptosporidium parvum
TENNERESSQSNKKRLHNNME

SEQ ID NO: 2284733 - protein, 7 aa, Cryptosporidium parvum
TENNKHS

SEQ ID NO: 2284734 - protein, 18 aa, Cryptosporidium parvum
TENNNGNNNEDNIQQIED

SEQ ID NO: 2284735 - protein, 18 aa, Cryptosporidium parvum
TENPNKDKDNYESSGNSL

SEQ ID NO: 2284736 - protein, 11 aa, Cryptosporidium parvum
TENSKDSIKDE

SEQ ID NO: 2284737 - protein, 28 aa, Cryptosporidium parvum
TENSNNSNSNVESTLKGEKQDENKENIE

SEQ ID NO: 2284738 - protein, 8 aa, Cryptosporidium parvum
TENSRDTI

SEQ ID NO: 2284739 - protein, 10 aa, Cryptosporidium parvum
TENSTDKKLA

SEQ ID NO: 2284740 - protein, 10 aa, Cryptosporidium parvum
TENVNEEEVT

SEQ ID NO: 2284741 - protein, 4 aa, Cryptosporidium parvum
TENY

SEQ ID NO: 2284742 - protein, 7 aa, Cryptosporidium parvum
TEPGEAV

SEQ ID NO: 2284743 - protein, 6 aa, Cryptosporidium parvum
TEPGSV

SEQ ID NO: 2284744 - protein, 6 aa, Cryptosporidium parvum
TEPIPA

SEQ ID NO: 2284745 - protein, 6 aa, Cryptosporidium parvum
TEPKNF

SEQ ID NO: 2284746 - protein, 6 aa, Cryptosporidium parvum
TEPNDQ

SEQ ID NO: 2284747 - protein, 6 aa, Cryptosporidium parvum
TEPNIN

SEQ ID NO: 2284748 - protein, 19 aa, Cryptosporidium parvum
TEPTNKDSSDGKPKTGINE

SEQ ID NO: 2284749 - protein, 4 aa, Cryptosporidium parvum
TEPY

SEQ ID NO: 2284750 - protein, 12 aa, Cryptosporidium parvum
TEQEKKDPSNSN

SEQ ID NO: 2284751 - protein, 15 aa, Cryptosporidium parvum
TEQELDKNNLNHGTP

SEQ ID NO: 2284752 - protein, 8 aa, Cryptosporidium parvum
TEQFQQES

SEQ ID NO: 2284753 - protein, 6 aa, Cryptosporidium parvum
TEQGKP

SEQ ID NO: 2284754 - protein, 6 aa, Cryptosporidium parvum
TEQILG

SEQ ID NO: 2284755 - protein, 8 aa, Cryptosporidium parvum
TEQKDSFG

SEQ ID NO: 2284756 - protein, 15 aa, Cryptosporidium parvum
TEQRKNKQSKKRRTS

SEQ ID NO: 2284757 - protein, 11 aa, Cryptosporidium parvum
TEQSKISNPQL

SEQ ID NO: 2284758 - protein, 10 aa, Cryptosporidium parvum
TERENTEKEN

SEQ ID NO: 2284759 - protein, 26 aa, Cryptosporidium parvum
TERGVVQENSTEKMDAAENPNEISVD

SEQ ID NO: 2284760 - protein, 8 aa, Cryptosporidium parvum
TERHSNLE

SEQ ID NO: 2284761 - protein, 7 aa, Cryptosporidium parvum
TERKNYS

SEQ ID NO: 2284762 - protein, 34 aa, Cryptosporidium parvum
TERNSNAIPNRNSISASRSIQNDQISPATSSQNC

SEQ ID NO: 2284763 - protein, 4 aa, Cryptosporidium parvum
TERP

SEQ ID NO: 2284764 - protein, 9 aa, Cryptosporidium parvum
TERPTTVGD

SEQ ID NO: 2284765 - protein, 27 aa, Cryptosporidium parvum
TERTLKEKLDSKTNQFSQKKEYNEELA

SEQ ID NO: 2284766 - protein, 19 aa, Cryptosporidium parvum
TERTQPFPVDTSNVSEDMP

SEQ ID NO: 2284767 - protein, 20 aa, Cryptosporidium parvum
TESATKIKGLKEGKRSSINQ

SEQ ID NO: 2284768 - protein, 17 aa, Cryptosporidium parvum
TESDGSINRAIDKLLNQ

SEQ ID NO: 2284769 - protein, 14 aa, Cryptosporidium parvum
TESDNDENGNIQDK

SEQ ID NO: 2284770 - protein, 10 aa, Cryptosporidium parvum
TESDPSNKDY

SEQ ID NO: 2284771 - protein, 11 aa, Cryptosporidium parvum
TESEESEIEDT

SEQ ID NO: 2284772 - protein, 5 aa, Cryptosporidium parvum
TESEV

SEQ ID NO: 2284773 - protein, 11 aa, Cryptosporidium parvum
TESGAKAEIDN

SEQ ID NO: 2284774 - protein, 6 aa, Cryptosporidium parvum
TESGRA

SEQ ID NO: 2284775 - protein, 44 aa, Cryptosporidium parvum; identical to SEQ ID NO: 2164672

SEQ ID NO: 2284776 - protein, 10 aa, Cryptosporidium parvum
TESLATEDIR

SEQ ID NO: 2284777 - protein, 5 aa, Cryptosporidium parvum
TESLE

SEQ ID NO: 2284778 - protein, 38 aa, Cryptosporidium parvum; identical to SEQ ID NO: 2164675

SEQ ID NO: 2284779 - protein, 24 aa, Cryptosporidium parvum
TESPSYGKKAKRTDSDSSDNESVI

SEQ ID NO: 2284780 - protein, 6 aa, Cryptosporidium parvum
TESQIS

SEQ ID NO: 2284781 - protein, 6 aa, Cryptosporidium parvum
TESQSN

SEQ ID NO: 2284782 - protein, 12 aa, Cryptosporidium parvum
TESQVSTGTKNS

SEQ ID NO: 2284783 - protein, 4 aa, Cryptosporidium parvum
TESR

SEQ ID NO: 2284784 - protein, 7 aa, Cryptosporidium parvum
TESRCKG

SEQ ID NO: 2284785 - protein, 9 aa, Cryptosporidium parvum
TESSKKGAK

SEQ ID NO: 2284786 - protein, 6 aa, Cryptosporidium parvum
TESTAV

SEQ ID NO: 2284787 - protein, 9 aa, Cryptosporidium parvum
TESTLGNAG

SEQ ID NO: 2284788 - protein, 11 aa, Cryptosporidium parvum
TESTNSDFSKG

SEQ ID NO: 2284789 - protein, 9 aa, Cryptosporidium parvum
TETALDNDT

SEQ ID NO: 2284790 - protein, 17 aa, Cryptosporidium parvum
TETAQNSSNCSSEQYES

SEQ ID NO: 2284791 - protein, 8 aa, Cryptosporidium parvum
TETDYSSS

SEQ ID NO: 2284792 - protein, 12 aa, Cryptosporidium parvum
TETESPDEYKSP

SEQ ID NO: 2284793 - protein, 17 aa, Cryptosporidium parvum
TETETKGEFGSINSGDY

SEQ ID NO: 2284794 - protein, 5 aa, Cryptosporidium parvum
TETEV

SEQ ID NO: 2284795 - protein, 8 aa, Cryptosporidium parvum
TETEYNQP

SEQ ID NO: 2284796 - protein, 4 aa, Cryptosporidium parvum
TETG

SEQ ID NO: 2284797 - protein, 9 aa, Cryptosporidium parvum
TETGNSEEV

SEQ ID NO: 2284798 - protein, 9 aa, Cryptosporidium parvum
TETGNSRKI

SEQ ID NO: 2284799 - protein, 9 aa, Cryptosporidium parvum
TETGSKSSL

SEQ ID NO: 2284800 - protein, 7 aa, Cryptosporidium parvum
TETNEEV

SEQ ID NO: 2284801 - protein, 5 aa, Cryptosporidium parvum
TETNN

SEQ ID NO: 2284802 - protein, 6 aa, Cryptosporidium parvum
TETPQI

SEQ ID NO: 2284803 - protein, 9 aa, Cryptosporidium parvum
TETQKNEKS

SEQ ID NO: 2284804 - protein, 13 aa, Cryptosporidium parvum
TETSNINKEISSI

SEQ ID NO: 2284805 - protein, 4 aa, Cryptosporidium parvum
TETT

SEQ ID NO: 2284806 - protein, 5 aa, Cryptosporidium parvum
TETTT

SEQ ID NO: 2284807 - protein, 6 aa, Cryptosporidium parvum
TETTYR

SEQ ID NO: 2284808 - protein, 7 aa, Cryptosporidium parvum
TETVGNF

SEQ ID NO: 2284809 - protein, 6 aa, Cryptosporidium parvum
TEVDGN

SEQ ID NO: 2284810 - protein, 15 aa, Cryptosporidium parvum
TEVESSQTHVSNTNQ

SEQ ID NO: 2284811 - protein, 14 aa, Cryptosporidium parvum
TEVLDSTKKSIGTT

SEQ ID NO: 2284812 - protein, 12 aa, Cryptosporidium parvum
TEWAQKEKFSNN

SEQ ID NO: 2284813 - protein, 4 aa, Cryptosporidium parvum
TEYG

SEQ ID NO: 2284814 - protein, 7 aa, Cryptosporidium parvum
TEYGGKT

SEQ ID NO: 2284815 - protein, 6 aa, Cryptosporidium parvum
TEYGPG

SEQ ID NO: 2284816 - protein, 13 aa, Cryptosporidium parvum
TEYKETNNQSYYS

SEQ ID NO: 2284817 - protein, 4 aa, Cryptosporidium parvum
TFDE

SEQ ID NO: 2284818 - protein, 6 aa, Cryptosporidium parvum
TFEASN

SEQ ID NO: 2284819 - protein, 6 aa, Cryptosporidium parvum
TFEGGG

SEQ ID NO: 2284820 - protein, 5 aa, Cryptosporidium parvum
TFENE

SEQ ID NO: 2284821 - protein, 5 aa, Cryptosporidium parvum
TFGDQ

SEQ ID NO: 2284822 - protein, 31 aa, Cryptosporidium parvum
TFGGNQQISSTQPTMFGSSSSSTIGSSSGFF

SEQ ID NO: 2284823 - protein, 4 aa, Cryptosporidium parvum
TFGK

SEQ ID NO: 2284824 - protein, 24 aa, Cryptosporidium parvum
TFGNIDNSDPHRQENPFNNPEEYS

SEQ ID NO: 2284825 - protein, 6 aa, Cryptosporidium parvum
TFGPKG

SEQ ID NO: 2284826 - protein, 11 aa, Cryptosporidium parvum
TFGTKNKKKFI

SEQ ID NO: 2284827 - protein, 7 aa, Cryptosporidium parvum
TFHDGDS

SEQ ID NO: 2284828 - protein, 4 aa, Cryptosporidium parvum
TFNS

SEQ ID NO: 2284829 - protein, 6 aa, Cryptosporidium parvum
TFNTKK

SEQ ID NO: 2284830 - protein, 25 aa, Cryptosporidium parvum
TFPDGTQMDAQQARARRRRHVFGVC

SEQ ID NO: 2284831 - protein, 11 aa, Cryptosporidium parvum
TFPGSQPVSLN

SEQ ID NO: 2284832 - protein, 6 aa, Cryptosporidium parvum
TFPNKG

SEQ ID NO: 2284833 - protein, 6 aa, Cryptosporidium parvum
TFQDRE

SEQ ID NO: 2284834 - protein, 5 aa, Cryptosporidium parvum
TFQGN

SEQ ID NO: 2284835 - protein, 12 aa, Cryptosporidium parvum
TFQGRKSRTGYN

SEQ ID NO: 2284836 - protein, 16 aa, Cryptosporidium parvum
TFQNSISPKKKDIELS

SEQ ID NO: 2284837 - protein, 10 aa, Cryptosporidium parvum
TFQRNSNIRK

SEQ ID NO: 2284838 - protein, 8 aa, Cryptosporidium parvum
TFQSTSLA

SEQ ID NO: 2284839 - protein, 21 aa, Cryptosporidium parvum
TFSESNSKMNPKNNESNFQDQ

SEQ ID NO: 2284840 - protein, 20 aa, Cryptosporidium parvum
TFSGQRQQVGLTGKRSSDKL

SEQ ID NO: 2284841 - protein, 28 aa, Cryptosporidium parvum
TFSQAGNNQTINSNNYSNFRSSNRHNSS

SEQ ID NO: 2284842 - protein, 6 aa, Cryptosporidium parvum
TFSSNE

SEQ ID NO: 2284843 - protein, 4 aa, Cryptosporidium parvum
TFST

SEQ ID NO: 2284844 - protein, 5 aa, Cryptosporidium parvum
TFTGG

SEQ ID NO: 2284845 - protein, 5 aa, Cryptosporidium parvum
TFTPQ

SEQ ID NO: 2284846 - protein, 33 aa, Cryptosporidium parvum
TFTTTSSSLVDSSTTTNNNNNNNNTAASSNNFP

SEQ ID NO: 2284847 - protein, 7 aa, Cryptosporidium parvum
TGADISQ

SEQ ID NO: 2284848 - protein, 4 aa, Cryptosporidium parvum
TGAE

SEQ ID NO: 2284849 - protein, 14 aa, Cryptosporidium parvum
TGAGIGTGAGIGAG

SEQ ID NO: 2284850 - protein, 4 aa, Cryptosporidium parvum
TGAI

SEQ ID NO: 2284851 - protein, 5 aa, Cryptosporidium parvum
TGAID

SEQ ID NO: 2284852 - protein, 4 aa, Cryptosporidium parvum
TGAS

SEQ ID NO: 2284853 - protein, 13 aa, Cryptosporidium parvum
TGASGANRSREDY

SEQ ID NO: 2284854 - protein, 7 aa, Cryptosporidium parvum
TGCSPTI

SEQ ID NO: 2284855 - protein, 8 aa, Cryptosporidium parvum
TGCSRAKA

SEQ ID NO: 2284856 - protein, 5 aa, Cryptosporidium parvum
TGDDE

SEQ ID NO: 2284857 - protein, 7 aa, Cryptosporidium parvum
TGDDRQT

SEQ ID NO: 2284858 - protein, 28 aa, Cryptosporidium parvum
TGDEEPKPPQPPDDHNKLGGKNNGVNNH

SEQ ID NO: 2284859 - protein, 8 aa, Cryptosporidium parvum
TGDGYSGP

SEQ ID NO: 2284860 - protein, 114 aa, Cryptosporidium parvum
TGDHDDQNDEGKDITGSGLESESNSNIESSSSKKRKEKKETNDEESSSSFSSKNKKEKNKRKSTEPLSENGSSSSSSDSSSSNSSSDDEKSKSKGKKSSKDKSKKKKKHSRISE

SEQ ID NO: 2284861 - protein, 5 aa, Cryptosporidium parvum
TGDMS

SEQ ID NO: 2284862 - protein, 17 aa, Cryptosporidium parvum
TGDMSNINSKKTSNKKY

SEQ ID NO: 2284863 - protein, 39 aa, Cryptosporidium parvum
TGDPNKTRSDLTNEDLGSSTTNEQNNVQEYNSPKSNDIP

SEQ ID NO: 2284864 - protein, 6 aa, Cryptosporidium parvum
TGDPNL

SEQ ID NO: 2284865 - protein, 10 aa, Cryptosporidium parvum
TGDPTGQGIG

SEQ ID NO: 2284866 - protein, 6 aa, Cryptosporidium parvum
TGDTRI

SEQ ID NO: 2284867 - protein, 16 aa, Cryptosporidium parvum
TGDVYEGEYSNGLKNG

SEQ ID NO: 2284868 - protein, 5 aa, Cryptosporidium parvum
TGDYH

SEQ ID NO: 2284869 - protein, 5 aa, Cryptosporidium parvum
TGDYT

SEQ ID NO: 2284870 - protein, 7 aa, Cryptosporidium parvum
TGEAPLS

SEQ ID NO: 2284871 - protein, 4 aa, Cryptosporidium parvum
TGED

SEQ ID NO: 2284872 - protein, 13 aa, Cryptosporidium parvum
TGEDYGDDNDDDL

SEQ ID NO: 2284873 - protein, 8 aa, Cryptosporidium parvum
TGEEDEEE

SEQ ID NO: 2284874 - protein, 13 aa, Cryptosporidium parvum
TGEELKSPSIPRA

SEQ ID NO: 2284875 - protein, 8 aa, Cryptosporidium parvum
TGEFKSNE

SEQ ID NO: 2284876 - protein, 9 aa, Cryptosporidium parvum
TGEIANSQC

SEQ ID NO: 2284877 - protein, 13 aa, Cryptosporidium parvum
TGEKNSAKSQNIQ

SEQ ID NO: 2284878 - protein, 10 aa, Cryptosporidium parvum
TGENKNEYGE

SEQ ID NO: 2284879 - protein, 10 aa, Cryptosporidium parvum
TGESNIPSRM

SEQ ID NO: 2284880 - protein, 15 aa, Cryptosporidium parvum
TGFGSRGGRGGQRGR

SEQ ID NO: 2284881 - protein, 12 aa, Cryptosporidium parvum
TGFQRPSWSSQQ

SEQ ID NO: 2284882 - protein, 6 aa, Cryptosporidium parvum
TGGCDG

SEQ ID NO: 2284883 - protein, 35 aa, Cryptosporidium parvum; identical to SEQ ID NO: 2164762

SEQ ID NO: 2284884 - protein, 37 aa, Cryptosporidium parvum
TGGEASYSPSLKRYKSQEKSETDENPPSNNDSSSAVF

SEQ ID NO: 2284885 - protein, 10 aa, Cryptosporidium parvum
TGGESDTDFP

SEQ ID NO: 2284886 - protein, 10 aa, Cryptosporidium parvum
TGGGAGGGGM

SEQ ID NO: 2284887 - protein, 5 aa, Cryptosporidium parvum
TGGGK

SEQ ID NO: 2284888 - protein, 8 aa, Cryptosporidium parvum
TGGGKSLT

SEQ ID NO: 2284889 - protein, 9 aa, Cryptosporidium parvum
TGGGTSDKP

SEQ ID NO: 2284890 - protein, 35 aa, Cryptosporidium parvum
TGGKAPRKQLASKGARKSAPVTGGVKKPRRYRPGT

SEQ ID NO: 2284891 - protein, 6 aa, Cryptosporidium parvum
TGGKLD

SEQ ID NO: 2284892 - protein, 9 aa, Cryptosporidium parvum
TGGNDKQGF

SEQ ID NO: 2284893 - protein, 11 aa, Cryptosporidium parvum
TGGNGSGKSSL

SEQ ID NO: 2284894 - protein, 5 aa, Cryptosporidium parvum
TGGNN

SEQ ID NO: 2284895 - protein, 5 aa, Cryptosporidium parvum
TGGRD

SEQ ID NO: 2284896 - protein, 8 aa, Cryptosporidium parvum
TGGRTRRK

SEQ ID NO: 2284897 - protein, 4 aa, Cryptosporidium parvum
TGGT

SEQ ID NO: 2284898 - protein, 7 aa, Cryptosporidium parvum
TGGTSLR

SEQ ID NO: 2284899 - protein, 6 aa, Cryptosporidium parvum
TGGVDG

SEQ ID NO: 2284900 - protein, 9 aa, Cryptosporidium parvum
TGGVGGGHG

SEQ ID NO: 2284901 - protein, 13 aa, Cryptosporidium parvum
TGGVPGSTNYSNE

SEQ ID NO: 2284902 - protein, 22 aa, Cryptosporidium parvum
TGGVSSSSISVNSSPIHSSQTI

SEQ ID NO: 2284903 - protein, 4 aa, Cryptosporidium parvum
TGHG

SEQ ID NO: 2284904 - protein, 13 aa, Cryptosporidium parvum
TGHGNTTTNGNHH

SEQ ID NO: 2284905 - protein, 4 aa, Cryptosporidium parvum
TGHP

SEQ ID NO: 2284906 - protein, 24 aa, Cryptosporidium parvum
TGIGGSSSQSSIQVGGGGGSGGGG

SEQ ID NO: 2284907 - protein, 10 aa, Cryptosporidium parvum
TGIGNTNQIN

SEQ ID NO: 2284908 - protein, 4 aa, Cryptosporidium parvum
TGIK

SEQ ID NO: 2284909 - protein, 13 aa, Cryptosporidium parvum
TGIKGPKEFETKQ

SEQ ID NO: 2284910 - protein, 5 aa, Cryptosporidium parvum
TGIPP

SEQ ID NO: 2284911 - protein, 5 aa, Cryptosporidium parvum
TGIRL

SEQ ID NO: 2284912 - protein, 5 aa, Cryptosporidium parvum
TGISG

SEQ ID NO: 2284913 - protein, 12 aa, Cryptosporidium parvum
TGISTGKENEKI

SEQ ID NO: 2284914 - protein, 14 aa, Cryptosporidium parvum
TGITTNGKSSSKKI

SEQ ID NO: 2284915 - protein, 36 aa, Cryptosporidium parvum; identical to SEQ ID NO: 2164785

SEQ ID NO: 2284916 - protein, 7 aa, Cryptosporidium parvum
TGKDLKE

SEQ ID NO: 2284917 - protein, 5 aa, Cryptosporidium parvum
TGKDS

SEQ ID NO: 2284918 - protein, 8 aa, Cryptosporidium parvum
TGKDSQSA

SEQ ID NO: 2284919 - protein, 17 aa, Cryptosporidium parvum
TGKEKRREYTKGSDSSH

SEQ ID NO: 2284920 - protein, 5 aa, Cryptosporidium parvum
TGKEY

SEQ ID NO: 2284921 - protein, 4 aa, Cryptosporidium parvum
TGKG

SEQ ID NO: 2284922 - protein, 8 aa, Cryptosporidium parvum
TGKGDEQL

SEQ ID NO: 2284923 - protein, 10 aa, Cryptosporidium parvum
TGKKEIESIS

SEQ ID NO: 2284924 - protein, 20 aa, Cryptosporidium parvum
TGKKHDRKLAKDEKKLESEL

SEQ ID NO: 2284925 - protein, 13 aa, Cryptosporidium parvum
TGKKSTDKRNSKN

SEQ ID NO: 2284926 - protein, 13 aa, Cryptosporidium parvum
TGKPMGSYANTDF

SEQ ID NO: 2284927 - protein, 7 aa, Cryptosporidium parvum
TGKRVGQ

SEQ ID NO: 2284928 - protein, 6 aa, Cryptosporidium parvum
TGLKQS

SEQ ID NO: 2284929 - protein, 4 aa, Cryptosporidium parvum
TGND

SEQ ID NO: 2284930 - protein, 5 aa, Cryptosporidium parvum
TGNDF

SEQ ID NO: 2284931 - protein, 8 aa, Cryptosporidium parvum
TGNDSKEA

SEQ ID NO: 2284932 - protein, 4 aa, Cryptosporidium parvum
TGNE

SEQ ID NO: 2284933 - protein, 8 aa, Cryptosporidium parvum
TGNEEQFN

SEQ ID NO: 2284934 - protein, 7 aa, Cryptosporidium parvum
TGNGKLR

SEQ ID NO: 2284935 - protein, 9 aa, Cryptosporidium parvum
TGNKETLEF

SEQ ID NO: 2284936 - protein, 15 aa, Cryptosporidium parvum
TGNKPHEDETTDPNV

SEQ ID NO: 2284937 - protein, 22 aa, Cryptosporidium parvum
TGNNGSSSTNLQETLQQFRGIK

SEQ ID NO: 2284938 - protein, 14 aa, Cryptosporidium parvum
TGNNLEDSSKSNIN

SEQ ID NO: 2284939 - protein, 6 aa, Cryptosporidium parvum
TGNNNK

SEQ ID NO: 2284940 - protein, 40 aa, Cryptosporidium parvum
TGNNNNHDINDDFEKNGISESESESDSDLKSSLKNSNCST

SEQ ID NO: 2284941 - protein, 4 aa, Cryptosporidium parvum
TGNP

SEQ ID NO: 2284942 - protein, 5 aa, Cryptosporidium parvum
TGNPD

SEQ ID NO: 2284943 - protein, 8 aa, Cryptosporidium parvum
TGNPNHSN

SEQ ID NO: 2284944 - protein, 8 aa, Cryptosporidium parvum
TGNQDIQD

SEQ ID NO: 2284945 - protein, 5 aa, Cryptosporidium parvum
TGPAN

SEQ ID NO: 2284946 - protein, 6 aa, Cryptosporidium parvum
TGPCGP

SEQ ID NO: 2284947 - protein, 12 aa, Cryptosporidium parvum
TGPDVSKAKDTV

SEQ ID NO: 2284948 - protein, 6 aa, Cryptosporidium parvum
TGPKTK

SEQ ID NO: 2284949 - protein, 5 aa, Cryptosporidium parvum
TGPPF

SEQ ID NO: 2284950 - protein, 6 aa, Cryptosporidium parvum
TGPSSY

SEQ ID NO: 2284951 - protein, 17 aa, Cryptosporidium parvum
TGQDGKINQYSVKDEAT

SEQ ID NO: 2284952 - protein, 6 aa, Cryptosporidium parvum
TGQDGV

SEQ ID NO: 2284953 - protein, 8 aa, Cryptosporidium parvum
TGQEKASS

SEQ ID NO: 2284954 - protein, 9 aa, Cryptosporidium parvum
TGQKKAQEL

SEQ ID NO: 2284955 - protein, 19 aa, Cryptosporidium parvum
TGQNQFNASTLNTANLSQA

SEQ ID NO: 2284956 - protein, 6 aa, Cryptosporidium parvum
TGQQDG

SEQ ID NO: 2284957 - protein, 8 aa, Cryptosporidium parvum
TGQQSFSN

SEQ ID NO: 2284958 - protein, 4 aa, Cryptosporidium parvum
TGQS

SEQ ID NO: 2284959 - protein, 15 aa, Cryptosporidium parvum
TGQVQTNKKTDSDGS

SEQ ID NO: 2284960 - protein, 9 aa, Cryptosporidium parvum
TGREADLTK

SEQ ID NO: 2284961 - protein, 10 aa, Cryptosporidium parvum
TGRPKGPKNL

SEQ ID NO: 2284962 - protein, 11 aa, Cryptosporidium parvum
TGRQGNQKNKP

SEQ ID NO: 2284963 - protein, 8 aa, Cryptosporidium parvum
TGRRPTGL

SEQ ID NO: 2284964 - protein, 5 aa, Cryptosporidium parvum
TGRTH

SEQ ID NO: 2284965 - protein, 4 aa, Cryptosporidium parvum
TGSC

SEQ ID NO: 2284966 - protein, 5 aa, Cryptosporidium parvum
TGSDF

SEQ ID NO: 2284967 - protein, 10 aa, Cryptosporidium parvum
TGSDTNKIKP

SEQ ID NO: 2284968 - protein, 12 aa, Cryptosporidium parvum
TGSEDTEGGGAC

SEQ ID NO: 2284969 - protein, 7 aa, Cryptosporidium parvum
TGSELSK

SEQ ID NO: 2284970 - protein, 5 aa, Cryptosporidium parvum
TGSEQ

SEQ ID NO: 2284971 - protein, 36 aa, Cryptosporidium parvum
TGSGGTQKGRKGKSRPHSNQVRQTGKSESEGGSMND

SEQ ID NO: 2284972 - protein, 7 aa, Cryptosporidium parvum
TGSGKTT

SEQ ID NO: 2284973 - protein, 6 aa, Cryptosporidium parvum
TGSGTV

SEQ ID NO: 2284974 - protein, 9 aa, Cryptosporidium parvum
TGSIDTPYN

SEQ ID NO: 2284975 - protein, 7 aa, Cryptosporidium parvum
TGSKIKP

SEQ ID NO: 2284976 - protein, 5 aa, Cryptosporidium parvum
TGSPI

SEQ ID NO: 2284977 - protein, 8 aa, Cryptosporidium parvum
TGSPYHSV

SEQ ID NO: 2284978 - protein, 4 aa, Cryptosporidium parvum
TGSQ

SEQ ID NO: 2284979 - protein, 5 aa, Cryptosporidium parvum
TGSQT

SEQ ID NO: 2284980 - protein, 7 aa, Cryptosporidium parvum
TGSRDGS

SEQ ID NO: 2284981 - protein, 16 aa, Cryptosporidium parvum
TGSRDKYDQENIGNSI

SEQ ID NO: 2284982 - protein, 12 aa, Cryptosporidium parvum
TGSRTSSAQTSD

SEQ ID NO: 2284983 - protein, 24 aa, Cryptosporidium parvum
TGSSIAPVDSPSTCGEESITPSKE

SEQ ID NO: 2284984 - protein, 26 aa, Cryptosporidium parvum
TGSSNLQGSEHDSKVESDSEASNDLE

SEQ ID NO: 2284985 - protein, 6 aa, Cryptosporidium parvum
TGSSQL

SEQ ID NO: 2284986 - protein, 27 aa, Cryptosporidium parvum
TGSTNSSTAAASSSLFGGSNPSNNTLG

SEQ ID NO: 2284987 - protein, 12 aa, Cryptosporidium parvum
TGSVTKDSINNL

SEQ ID NO: 2284988 - protein, 4 aa, Cryptosporidium parvum
TGTE

SEQ ID NO: 2284989 - protein, 8 aa, Cryptosporidium parvum
TGTEAKGT

SEQ ID NO: 2284990 - protein, 12 aa, Cryptosporidium parvum
TGTMKKNATDEK

SEQ ID NO: 2284991 - protein, 6 aa, Cryptosporidium parvum
TGTNEY

SEQ ID NO: 2284992 - protein, 8 aa, Cryptosporidium parvum
TGTNNVET

SEQ ID NO: 2284993 - protein, 25 aa, Cryptosporidium parvum
TGTREENRKYKGNNEYQDNSTGSNL

SEQ ID NO: 2284994 - protein, 9 aa, Cryptosporidium parvum
TGTRFGPSI

SEQ ID NO: 2284995 - protein, 19 aa, Cryptosporidium parvum
TGTSIKSDNSQENGGFQQG

SEQ ID NO: 2284996 - protein, 6 aa, Cryptosporidium parvum
TGTSQA

SEQ ID NO: 2284997 - protein, 4 aa, Cryptosporidium parvum
TGTY

SEQ ID NO: 2284998 - protein, 10 aa, Cryptosporidium parvum
TGTYSVPGRQ

SEQ ID NO: 2284999 - protein, 8 aa, Cryptosporidium parvum
TGVDNSSK

SEQ ID NO: 2285000 - protein, 10 aa, Cryptosporidium parvum
TGVPASKQKL

SEQ ID NO: 2285001 - protein, 4 aa, Cryptosporidium parvum
TGVS

SEQ ID NO: 2285002 - protein, 20 aa, Cryptosporidium parvum
TGYETPTKLSYGAGDRSSSI

SEQ ID NO: 2285003 - protein, 4 aa, Cryptosporidium parvum
TGYI

SEQ ID NO: 2285004 - protein, 5 aa, Cryptosporidium parvum
TGYKE

SEQ ID NO: 2285005 - protein, 25 aa, Cryptosporidium parvum
TGYQSEEIEYEDKTGEYQNTPRMDE

SEQ ID NO: 2285006 - protein, 5 aa, Cryptosporidium parvum
TGYSE

SEQ ID NO: 2285007 - protein, 11 aa, Cryptosporidium parvum
THDGDNPEKLG

SEQ ID NO: 2285008 - protein, 18 aa, Cryptosporidium parvum
THDLEDSINKQLKDKERV

SEQ ID NO: 2285009 - protein, 13 aa, Cryptosporidium parvum
THDPDTKERRLEA

SEQ ID NO: 2285010 - protein, 5 aa, Cryptosporidium parvum
THEIT

SEQ ID NO: 2285011 - protein, 22 aa, Cryptosporidium parvum
THEKELPGPKKRKKCSKACNEK

SEQ ID NO: 2285012 - protein, 4 aa, Cryptosporidium parvum
THEN

SEQ ID NO: 2285013 - protein, 9 aa, Cryptosporidium parvum
THENEELNN

SEQ ID NO: 2285014 - protein, 9 aa, Cryptosporidium parvum
THESYQSPI

SEQ ID NO: 2285015 - protein, 11 aa, Cryptosporidium parvum
THGTGTALGDP

SEQ ID NO: 2285016 - protein, 8 aa, Cryptosporidium parvum
THKDGGLG

SEQ ID NO: 2285017 - protein, 47 aa, Cryptosporidium parvum
THKKAYKKTFDDPRRKREEQQAQIRKQQRDEQLSKRRQGNDGENNDI

SEQ ID NO: 2285018 - protein, 4 aa, Cryptosporidium parvum
THLR

SEQ ID NO: 2285019 - protein, 16 aa, Cryptosporidium parvum
THLSPTKDELLESEGE

SEQ ID NO: 2285020 - protein, 7 aa, Cryptosporidium parvum
THNEDDL

SEQ ID NO: 2285021 - protein, 10 aa, Cryptosporidium parvum
THNHSSKGSF

SEQ ID NO: 2285022 - protein, 33 aa, Cryptosporidium parvum
THNQAQPQAQIQGHTHNTSLSSISNQNRASEEG

SEQ ID NO: 2285023 - protein, 5 aa, Cryptosporidium parvum
THNRE

SEQ ID NO: 2285024 - protein, 5 aa, Cryptosporidium parvum
THNSE

SEQ ID NO: 2285025 - protein, 11 aa, Cryptosporidium parvum
THNSGKTLENM

SEQ ID NO: 2285026 - protein, 6 aa, Cryptosporidium parvum
THNSGV

SEQ ID NO: 2285027 - protein, 4 aa, Cryptosporidium parvum
THPH

SEQ ID NO: 2285028 - protein, 6 aa, Cryptosporidium parvum
THPSQT

SEQ ID NO: 2285029 - protein, 9 aa, Cryptosporidium parvum
THRQPVEDY

SEQ ID NO: 2285030 - protein, 15 aa, Cryptosporidium parvum
THRTLPAEVKNNPAA

SEQ ID NO: 2285031 - protein, 9 aa, Cryptosporidium parvum
THSDSDGNI

SEQ ID NO: 2285032 - protein, 19 aa, Cryptosporidium parvum
THSKGDLNDEKSQNKKKRV

SEQ ID NO: 2285033 - protein, 7 aa, Cryptosporidium parvum
THSSSND

SEQ ID NO: 2285034 - protein, 4 aa, Cryptosporidium parvum
THST

SEQ ID NO: 2285035 - protein, 14 aa, Cryptosporidium parvum
THSYKGDKKNIPLP

SEQ ID NO: 2285036 - protein, 8 aa, Cryptosporidium parvum
THYGSKTA

SEQ ID NO: 2285037 - protein, 5 aa, Cryptosporidium parvum
TIAPN

SEQ ID NO: 2285038 - protein, 14 aa, Cryptosporidium parvum
TIASRTEELTPNDV

SEQ ID NO: 2285039 - protein, 4 aa, Cryptosporidium parvum
TIDD

SEQ ID NO: 2285040 - protein, 7 aa, Cryptosporidium parvum
TIDENED

SEQ ID NO: 2285041 - protein, 7 aa, Cryptosporidium parvum
TIDENRG

SEQ ID NO: 2285042 - protein, 7 aa, Cryptosporidium parvum
TIDEQHP

SEQ ID NO: 2285043 - protein, 17 aa, Cryptosporidium parvum
TIDESENDHPVNSTNHY

SEQ ID NO: 2285044 - protein, 7 aa, Cryptosporidium parvum
TIDESSR

SEQ ID NO: 2285045 - protein, 6 aa, Cryptosporidium parvum
TIDGDL

SEQ ID NO: 2285046 - protein, 25 aa, Cryptosporidium parvum
TIDNQFESSKSNNIDKMSSNNEKKV

SEQ ID NO: 2285047 - protein, 11 aa, Cryptosporidium parvum
TIDSRVGGDFS

SEQ ID NO: 2285048 - protein, 6 aa, Cryptosporidium parvum
TIDSSD

SEQ ID NO: 2285049 - protein, 12 aa, Cryptosporidium parvum
TIDTKNPTEKTE

SEQ ID NO: 2285050 - protein, 7 aa, Cryptosporidium parvum
TIEAATP

SEQ ID NO: 2285051 - protein, 12 aa, Cryptosporidium parvum
TIEEESINKQNF

SEQ ID NO: 2285052 - protein, 36 aa, Cryptosporidium parvum
TIEGSGRGGYSRGGLGSGTTGSSSRGRGLARGGLSS

SEQ ID NO: 2285053 - protein, 31 aa, Cryptosporidium parvum
TIENDDDISELKSHSELRKKYSDHSSKGGIS

SEQ ID NO: 2285054 - protein, 5 aa, Cryptosporidium parvum
TIENG

SEQ ID NO: 2285055 - protein, 5 aa, Cryptosporidium parvum
TIEPQ

SEQ ID NO: 2285056 - protein, 7 aa, Cryptosporidium parvum
TIERGRQ

SEQ ID NO: 2285057 - protein, 7 aa, Cryptosporidium parvum
TIESEEK

SEQ ID NO: 2285058 - protein, 9 aa, Cryptosporidium parvum
TIESSSNNN

SEQ ID NO: 2285059 - protein, 7 aa, Cryptosporidium parvum
TIESTES

SEQ ID NO: 2285060 - protein, 6 aa, Cryptosporidium parvum
TIETDD

SEQ ID NO: 2285061 - protein, 11 aa, Cryptosporidium parvum
TIGENKDSDID

SEQ ID NO: 2285062 - protein, 6 aa, Cryptosporidium parvum
TIGETR

SEQ ID NO: 2285063 - protein, 13 aa, Cryptosporidium parvum
TIGGPAADAGLTG

SEQ ID NO: 2285064 - protein, 5 aa, Cryptosporidium parvum
TIGNA

SEQ ID NO: 2285065 - protein, 4 aa, Cryptosporidium parvum
TIGP

SEQ ID NO: 2285066 - protein, 13 aa, Cryptosporidium parvum
TIGQAQSGTGKTA

SEQ ID NO: 2285067 - protein, 37 aa, Cryptosporidium parvum
TIGSAGKLSRTDLGDTARIRGERYASSCNASSLNESE

SEQ ID NO: 2285068 - protein, 12 aa, Cryptosporidium parvum
TIGTKRHRSDEV

SEQ ID NO: 2285069 - protein, 5 aa, Cryptosporidium parvum
TIHPD

SEQ ID NO: 2285070 - protein, 6 aa, Cryptosporidium parvum
TIIEDS

SEQ ID NO: 2285071 - protein, 12 aa, Cryptosporidium parvum
TIKENKEKMPNR

SEQ ID NO: 2285072 - protein, 12 aa, Cryptosporidium parvum
TIKGGNNNEKNL

SEQ ID NO: 2285073 - protein, 6 aa, Cryptosporidium parvum
TIKNGT

SEQ ID NO: 2285074 - protein, 6 aa, Cryptosporidium parvum
TIKNNS

SEQ ID NO: 2285075 - protein, 7 aa, Cryptosporidium parvum
TIKPGDR

SEQ ID NO: 2285076 - protein, 9 aa, Cryptosporidium parvum
TIKSSVTTN

SEQ ID NO: 2285077 - protein, 20 aa, Cryptosporidium parvum
TIKTQENKGELNPPGNSAHS

SEQ ID NO: 2285078 - protein, 10 aa, Cryptosporidium parvum
TINDEDNSNI

SEQ ID NO: 2285079 - protein, 10 aa, Cryptosporidium parvum
TINEENKKSM

SEQ ID NO: 2285080 - protein, 9 aa, Cryptosporidium parvum
TINKDEEIT

SEQ ID NO: 2285081 - protein, 11 aa, Cryptosporidium parvum
TINKENSLVQT

SEQ ID NO: 2285082 - protein, 9 aa, Cryptosporidium parvum
TINKSNNNN

SEQ ID NO: 2285083 - protein, 4 aa, Cryptosporidium parvum
TINN

SEQ ID NO: 2285084 - protein, 12 aa, Cryptosporidium parvum
TINNNSEKVSHD

SEQ ID NO: 2285085 - protein, 14 aa, Cryptosporidium parvum
TINSDSDDQSESSM

SEQ ID NO: 2285086 - protein, 6 aa, Cryptosporidium parvum
TINSEL

SEQ ID NO: 2285087 - protein, 16 aa, Cryptosporidium parvum
TINSNGLTSTTSGVEE

SEQ ID NO: 2285088 - protein, 6 aa, Cryptosporidium parvum
TINTNY

SEQ ID NO: 2285089 - protein, 5 aa, Cryptosporidium parvum
TINTQ

SEQ ID NO: 2285090 - protein, 23 aa, Cryptosporidium parvum
TIPENDHEFTENLSNSSVNNTSE

SEQ ID NO: 2285091 - protein, 38 aa, Cryptosporidium parvum
TIPETGSSSNHPSATIPETGSSSDHTPATSPEEGLDSE

SEQ ID NO: 2285092 - protein, 68 aa, Cryptosporidium parvum
TIPETGSSSNHPSVTIPETGSSSNHPSVTKPETDSGSDHPATIPETGSSSNHPSVTVPETGSGSDHAP

SEQ ID NO: 2285093 - protein, 84 aa, Cryptosporidium parvum
TIPETGSSSNHPSVTVPETESSSNHPSVTIPETGSSSNHPSVTVPETGSSSNHPSVTVPETESSSNHPSVTIPETGSDSDHAPV

SEQ ID NO: 2285094 - protein, 82 aa, Cryptosporidium parvum
TIPGGMATSPLPSPTPEVGSPNASKTGDTEVTKSPKNNHKRRGSKSSYISDSDTKSLSPNISNRRSSPDATNNVKPASEVEN

SEQ ID NO: 2285095 - protein, 5 aa, Cryptosporidium parvum
TIPKE

SEQ ID NO: 2285096 - protein, 22 aa, Cryptosporidium parvum
TIPKLSSTNIGAEDKNLERTGS

SEQ ID NO: 2285097 - protein, 5 aa, Cryptosporidium parvum
TIPNQ

SEQ ID NO: 2285098 - protein, 10 aa, Cryptosporidium parvum
TIPRQTDSSL

SEQ ID NO: 2285099 - protein, 4 aa, Cryptosporidium parvum
TIPS

SEQ ID NO: 2285100 - protein, 13 aa, Cryptosporidium parvum
TIQATNELKENFG

SEQ ID NO: 2285101 - protein, 27 aa, Cryptosporidium parvum
TIQESYYSNYDKNGMNKNNDEYELNDN

SEQ ID NO: 2285102 - protein, 4 aa, Cryptosporidium parvum
TIQG

SEQ ID NO: 2285103 - protein, 5 aa, Cryptosporidium parvum
TIQTE

SEQ ID NO: 2285104 - protein, 12 aa, Cryptosporidium parvum
TISDNEGEEEEE

SEQ ID NO: 2285105 - protein, 11 aa, Cryptosporidium parvum
TISDSQSQYSL

SEQ ID NO: 2285106 - protein, 51 aa, Cryptosporidium parvum; identical to SEQ ID NO: 2164937

SEQ ID NO: 2285107 - protein, 7 aa, Cryptosporidium parvum
TISGRSE

SEQ ID NO: 2285108 - protein, 7 aa, Cryptosporidium parvum
TISKNRP

SEQ ID NO: 2285109 - protein, 14 aa, Cryptosporidium parvum
TISKSGSYVEDDDS

SEQ ID NO: 2285110 - protein, 12 aa, Cryptosporidium parvum
TISKTSKKGGEI

SEQ ID NO: 2285111 - protein, 11 aa, Cryptosporidium parvum
TISMSESKARE

SEQ ID NO: 2285112 - protein, 7 aa, Cryptosporidium parvum
TISNPVR

SEQ ID NO: 2285113 - protein, 9 aa, Cryptosporidium parvum
TISPEECSH

SEQ ID NO: 2285114 - protein, 11 aa, Cryptosporidium parvum
TISPEHKNKGS

SEQ ID NO: 2285115 - protein, 7 aa, Cryptosporidium parvum
TISPSEK

SEQ ID NO: 2285116 - protein, 9 aa, Cryptosporidium parvum
TISPTPIPS

SEQ ID NO: 2285117 - protein, 18 aa, Cryptosporidium parvum
TISQHRKQEQTKIESGKK

SEQ ID NO: 2285118 - protein, 6 aa, Cryptosporidium parvum
TISSDD

SEQ ID NO: 2285119 - protein, 12 aa, Cryptosporidium parvum
TISSGSDLKQQC

SEQ ID NO: 2285120 - protein, 5 aa, Cryptosporidium parvum
TISSN

SEQ ID NO: 2285121 - protein, 5 aa, Cryptosporidium parvum
TISSP

SEQ ID NO: 2285122 - protein, 11 aa, Cryptosporidium parvum
TISTANSRQSI

SEQ ID NO: 2285123 - protein, 13 aa, Cryptosporidium parvum
TISTNDSRDNEDS

SEQ ID NO: 2285124 - protein, 9 aa, Cryptosporidium parvum
TISTNTQKY

SEQ ID NO: 2285125 - protein, 32 aa, Cryptosporidium parvum
TISYSSSSSFSSSSSSSSSSSSSISNLNNSSH

SEQ ID NO: 2285126 - protein, 6 aa, Cryptosporidium parvum
TITEPK

SEQ ID NO: 2285127 - protein, 7 aa, Cryptosporidium parvum
TITGGNI

SEQ ID NO: 2285128 - protein, 6 aa, Cryptosporidium parvum
TITKGT

SEQ ID NO: 2285129 - protein, 4 aa, Cryptosporidium parvum
TITN

SEQ ID NO: 2285130 - protein, 23 aa, Cryptosporidium parvum
TITNISGNKELEIEENSLGQRSG

SEQ ID NO: 2285131 - protein, 7 aa, Cryptosporidium parvum
TKADQEN

SEQ ID NO: 2285132 - protein, 7 aa, Cryptosporidium parvum
TKAGSRS

SEQ ID NO: 2285133 - protein, 7 aa, Cryptosporidium parvum
TKAGTPY

SEQ ID NO: 2285134 - protein, 7 aa, Cryptosporidium parvum
TKAHPNP

SEQ ID NO: 2285135 - protein, 8 aa, Cryptosporidium parvum
TKANHESS

SEQ ID NO: 2285136 - protein, 17 aa, Cryptosporidium parvum
TKANSIENQNYLNPKSD

SEQ ID NO: 2285137 - protein, 5 aa, Cryptosporidium parvum
TKANV

SEQ ID NO: 2285138 - protein, 6 aa, Cryptosporidium parvum
TKAQKK

SEQ ID NO: 2285139 - protein, 6 aa, Cryptosporidium parvum
TKARIQ

SEQ ID NO: 2285140 - protein, 15 aa, Cryptosporidium parvum
TKASISNNPVDNTTT

SEQ ID NO: 2285141 - protein, 6 aa, Cryptosporidium parvum
TKCNDK

SEQ ID NO: 2285142 - protein, 16 aa, Cryptosporidium parvum
TKDDINHEKGITSKAI

SEQ ID NO: 2285143 - protein, 9 aa, Cryptosporidium parvum
TKDDQVKTL

SEQ ID NO: 2285144 - protein, 9 aa, Cryptosporidium parvum
TKDDSQRRK

SEQ ID NO: 2285145 - protein, 8 aa, Cryptosporidium parvum
TKDENGNF

SEQ ID NO: 2285146 - protein, 7 aa, Cryptosporidium parvum
TKDEVSR

SEQ ID NO: 2285147 - protein, 4 aa, Cryptosporidium parvum
TKDG

SEQ ID NO: 2285148 - protein, 9 aa, Cryptosporidium parvum
TKDGNLKGL

SEQ ID NO: 2285149 - protein, 7 aa, Cryptosporidium parvum
TKDIDSE

SEQ ID NO: 2285150 - protein, 15 aa, Cryptosporidium parvum
TKDKEEEEEEEEEEE

SEQ ID NO: 2285151 - protein, 4 aa, Cryptosporidium parvum
TKDL

SEQ ID NO: 2285152 - protein, 6 aa, Cryptosporidium parvum
TKDNSM

SEQ ID NO: 2285153 - protein, 8 aa, Cryptosporidium parvum
TKDPETKE

SEQ ID NO: 2285154 - protein, 10 aa, Cryptosporidium parvum
TKDQNESIPE

SEQ ID NO: 2285155 - protein, 5 aa, Cryptosporidium parvum
TKDSI

SEQ ID NO: 2285156 - protein, 13 aa, Cryptosporidium parvum
TKDSITEEDLGGK

SEQ ID NO: 2285157 - protein, 6 aa, Cryptosporidium parvum
TKDSQL

SEQ ID NO: 2285158 - protein, 8 aa, Cryptosporidium parvum
TKDTFDKG

SEQ ID NO: 2285159 - protein, 6 aa, Cryptosporidium parvum
TKDTII

SEQ ID NO: 2285160 - protein, 8 aa, Cryptosporidium parvum
TKDVTSQQ

SEQ ID NO: 2285161 - protein, 11 aa, Cryptosporidium parvum
TKDWNKESVES

SEQ ID NO: 2285162 - protein, 9 aa, Cryptosporidium parvum
TKEALRQEK

SEQ ID NO: 2285163 - protein, 25 aa, Cryptosporidium parvum
TKEDSELNQNKIGNNNKGNANSDSR

SEQ ID NO: 2285164 - protein, 21 aa, Cryptosporidium parvum
TKEEKKDGQLSSFSPDTGLDD

SEQ ID NO: 2285165 - protein, 6 aa, Cryptosporidium parvum
TKEEKS

SEQ ID NO: 2285166 - protein, 5 aa, Cryptosporidium parvum
TKEEL

SEQ ID NO: 2285167 - protein, 15 aa, Cryptosporidium parvum
TKEEQAIERANYENR

SEQ ID NO: 2285168 - protein, 6 aa, Cryptosporidium parvum
TKEFSG

SEQ ID NO: 2285169 - protein, 4 aa, Cryptosporidium parvum
TKEG

SEQ ID NO: 2285170 - protein, 9 aa, Cryptosporidium parvum
TKEGSGLVT

SEQ ID NO: 2285171 - protein, 27 aa, Cryptosporidium parvum
TKEINNSNVKLEENKTFENNNESLDEK

SEQ ID NO: 2285172 - protein, 5 aa, Cryptosporidium parvum
TKEKD

SEQ ID NO: 2285173 - protein, 9 aa, Cryptosporidium parvum
TKENANKEI

SEQ ID NO: 2285174 - protein, 5 aa, Cryptosporidium parvum
TKENE

SEQ ID NO: 2285175 - protein, 31 aa, Cryptosporidium parvum
TKENEAISNKTDNLGNSEYFEDSNNKNPTIS

SEQ ID NO: 2285176 - protein, 7 aa, Cryptosporidium parvum
TKENEVM

SEQ ID NO: 2285177 - protein, 8 aa, Cryptosporidium parvum
TKEQNSSF

SEQ ID NO: 2285178 - protein, 7 aa, Cryptosporidium parvum
TKESESI

SEQ ID NO: 2285179 - protein, 8 aa, Cryptosporidium parvum
TKESNSSI

SEQ ID NO: 2285180 - protein, 11 aa, Cryptosporidium parvum
TKETDDSKGKY

SEQ ID NO: 2285181 - protein, 14 aa, Cryptosporidium parvum
TKETDNTCNEIERT

SEQ ID NO: 2285182 - protein, 22 aa, Cryptosporidium parvum
TKETNVAPKSPPRKTSKGMKPS

SEQ ID NO: 2285183 - protein, 11 aa, Cryptosporidium parvum
TKFEGNKTERG

SEQ ID NO: 2285184 - protein, 11 aa, Cryptosporidium parvum
TKFEKSKGENC

SEQ ID NO: 2285185 - protein, 6 aa, Cryptosporidium parvum
TKFGRG

SEQ ID NO: 2285186 - protein, 10 aa, Cryptosporidium parvum
TKFKPGTTNL

SEQ ID NO: 2285187 - protein, 11 aa, Cryptosporidium parvum
TKFNDTSNPYE

SEQ ID NO: 2285188 - protein, 15 aa, Cryptosporidium parvum
TKGACQKCKTKLLRL

SEQ ID NO: 2285189 - protein, 8 aa, Cryptosporidium parvum
TKGEAITS

SEQ ID NO: 2285190 - protein, 19 aa, Cryptosporidium parvum
TKGEEYCNNNNNNNNSNYE

SEQ ID NO: 2285191 - protein, 5 aa, Cryptosporidium parvum
TKGFN

SEQ ID NO: 2285192 - protein, 8 aa, Cryptosporidium parvum
TKGQNKCR

SEQ ID NO: 2285193 - protein, 7 aa, Cryptosporidium parvum
TKGRSHE

SEQ ID NO: 2285194 - protein, 4 aa, Cryptosporidium parvum
TKGT

SEQ ID NO: 2285195 - protein, 5 aa, Cryptosporidium parvum
TKGYG

SEQ ID NO: 2285196 - protein, 19 aa, Cryptosporidium parvum
TKIDSYRSSLQQSKKELVS

SEQ ID NO: 2285197 - protein, 9 aa, Cryptosporidium parvum
TKIEDISEE

SEQ ID NO: 2285198 - protein, 9 aa, Cryptosporidium parvum
TKIEIKDKK

SEQ ID NO: 2285199 - protein, 22 aa, Cryptosporidium parvum
TKIEQSETKYTDVNSEYPSETF

SEQ ID NO: 2285200 - protein, 17 aa, Cryptosporidium parvum
TKIGQEYSQQLSSNNEF

SEQ ID NO: 2285201 - protein, 6 aa, Cryptosporidium parvum
TKIGSK

SEQ ID NO: 2285202 - protein, 4 aa, Cryptosporidium parvum
TKIK

SEQ ID NO: 2285203 - protein, 8 aa, Cryptosporidium parvum
TKIKGETI

SEQ ID NO: 2285204 - protein, 21 aa, Cryptosporidium parvum
TKIKRKKRSAVEDLTNDKEVY

SEQ ID NO: 2285205 - protein, 7 aa, Cryptosporidium parvum
TKINDET

SEQ ID NO: 2285206 - protein, 9 aa, Cryptosporidium parvum
TKINPKSQD

SEQ ID NO: 2285207 - protein, 4 aa, Cryptosporidium parvum
TKIS

SEQ ID NO: 2285208 - protein, 6 aa, Cryptosporidium parvum
TKISND

SEQ ID NO: 2285209 - protein, 17 aa, Cryptosporidium parvum
TKISSVKESRNSDDNNK

SEQ ID NO: 2285210 - protein, 12 aa, Cryptosporidium parvum
TKITSKDTRFSS

SEQ ID NO: 2285211 - protein, 8 aa, Cryptosporidium parvum
TKKASNIP

SEQ ID NO: 2285212 - protein, 11 aa, Cryptosporidium parvum
TKKDNPSEGPL

SEQ ID NO: 2285213 - protein, 220 aa, Cryptosporidium parvum
TKKDRDETLNEKESSIDKINKETKPLNTTTFTTTKKPTVTTTTTTTRKPVGTNTTTTKKPIGTATTTKKPTVTSNTTTTKKPIGTTTTTKKPTVATNTTTTKKPIGTTTTTKKPTVATYTATTKKPIGTTTTTKKTTMTTNTTTTKKPIGTTNTTKKPTATTTTRKPTATTTTKKPTVATTTTKKPIVATTTTKKPTATTTTRKPIVTTTTRKPTVTTTK

SEQ ID NO: 2285214 - protein, 10 aa, Cryptosporidium parvum
TKKENKRSFS

SEQ ID NO: 2285215 - protein, 10 aa, Cryptosporidium parvum
TKKFSKKAYN

SEQ ID NO: 2285216 - protein, 6 aa, Cryptosporidium parvum
TKKGTL

SEQ ID NO: 2285217 - protein, 9 aa, Cryptosporidium parvum
TKKKDRLSD

SEQ ID NO: 2285218 - protein, 8 aa, Cryptosporidium parvum
TKKLDTSL

SEQ ID NO: 2285219 - protein, 8 aa, Cryptosporidium parvum
TKKMGKKE

SEQ ID NO: 2285220 - protein, 26 aa, Cryptosporidium parvum
TKKRPSKSHKSVEKKNVNSKRNSKMD

SEQ ID NO: 2285221 - protein, 8 aa, Cryptosporidium parvum
TKKSEKKL

SEQ ID NO: 2285222 - protein, 6 aa, Cryptosporidium parvum
TKKSEY

SEQ ID NO: 2285223 - protein, 9 aa, Cryptosporidium parvum
TKKSHQVNS

SEQ ID NO: 2285224 - protein, 24 aa, Cryptosporidium parvum
TKKSNALDDNSSQWVNEPPSPRKI

SEQ ID NO: 2285225 - protein, 8 aa, Cryptosporidium parvum
TKKSTPKY

SEQ ID NO: 2285226 - protein, 12 aa, Cryptosporidium parvum
TKKTENTSTQKV

SEQ ID NO: 2285227 - protein, 9 aa, Cryptosporidium parvum
TKKTSENKR

SEQ ID NO: 2285228 - protein, 13 aa, Cryptosporidium parvum
TKKVASDVYEESP

SEQ ID NO: 2285229 - protein, 26 aa, Cryptosporidium parvum
TKLDEERRLKQKQENLAKREKSASTV

SEQ ID NO: 2285230 - protein, 11 aa, Cryptosporidium parvum
TKLDGSSPIPA

SEQ ID NO: 2285231 - protein, 13 aa, Cryptosporidium parvum
TKLEENRNSLEKQ

SEQ ID NO: 2285232 - protein, 6 aa, Cryptosporidium parvum
TKLELE

SEQ ID NO: 2285233 - protein, 6 aa, Cryptosporidium parvum
TKLGGR

SEQ ID NO: 2285234 - protein, 11 aa, Cryptosporidium parvum
TKLKNSSRETI

SEQ ID NO: 2285235 - protein, 22 aa, Cryptosporidium parvum
TKLNKELGNACREGAVSAPELK

SEQ ID NO: 2285236 - protein, 8 aa, Cryptosporidium parvum
TKLNPNNQ

SEQ ID NO: 2285237 - protein, 11 aa, Cryptosporidium parvum
TKLNSHDPIKQ

SEQ ID NO: 2285238 - protein, 7 aa, Cryptosporidium parvum
TKLPTES

SEQ ID NO: 2285239 - protein, 11 aa, Cryptosporidium parvum
TKLSNSHNGSL

SEQ ID NO: 2285240 - protein, 26 aa, Cryptosporidium parvum
TKMKSSQSKNKSNSQVSGKEGQNKKH

SEQ ID NO: 2285241 - protein, 8 aa, Cryptosporidium parvum
TKMPATST

SEQ ID NO: 2285242 - protein, 14 aa, Cryptosporidium parvum
TKNDSISEHAHDSN

SEQ ID NO: 2285243 - protein, 9 aa, Cryptosporidium parvum
TKNELSKDL

SEQ ID NO: 2285244 - protein, 19 aa, Cryptosporidium parvum
TKNENTPENYNNAVTKGIK

SEQ ID NO: 2285245 - protein, 25 aa, Cryptosporidium parvum
TKNFNDNEKNLESEYHSKQKYEGEV

SEQ ID NO: 2285246 - protein, 13 aa, Cryptosporidium parvum
TKNGTDRTKKEQV

SEQ ID NO: 2285247 - protein, 11 aa, Cryptosporidium parvum
TKNHASGEEWR

SEQ ID NO: 2285248 - protein, 6 aa, Cryptosporidium parvum
TKNLSS

SEQ ID NO: 2285249 - protein, 10 aa, Cryptosporidium parvum
TKNNNEISSF

SEQ ID NO: 2285250 - protein, 5 aa, Cryptosporidium parvum
TKNNS

SEQ ID NO: 2285251 - protein, 6 aa, Cryptosporidium parvum
TKNNYI

SEQ ID NO: 2285252 - protein, 8 aa, Cryptosporidium parvum
TKNQQDYN

SEQ ID NO: 2285253 - protein, 9 aa, Cryptosporidium parvum
TKNQRHDNH

SEQ ID NO: 2285254 - protein, 5 aa, Cryptosporidium parvum
TKNRD

SEQ ID NO: 2285255 - protein, 9 aa, Cryptosporidium parvum
TKNREPDNN

SEQ ID NO: 2285256 - protein, 4 aa, Cryptosporidium parvum
TKNS

SEQ ID NO: 2285257 - protein, 5 aa, Cryptosporidium parvum
TKNSG

SEQ ID NO: 2285258 - protein, 9 aa, Cryptosporidium parvum
TKNSHTESG

SEQ ID NO: 2285259 - protein, 6 aa, Cryptosporidium parvum
TKNSNS

SEQ ID NO: 2285260 - protein, 8 aa, Cryptosporidium parvum
TKNSPSSV

SEQ ID NO: 2285261 - protein, 25 aa, Cryptosporidium parvum
TKNSQNDGLGGGIGSGAVSSSSSQL

SEQ ID NO: 2285262 - protein, 4 aa, Cryptosporidium parvum
TKNT

SEQ ID NO: 2285263 - protein, 21 aa, Cryptosporidium parvum
TKNTNKPSKQGGGKGRKGGKR

SEQ ID NO: 2285264 - protein, 6 aa, Cryptosporidium parvum
TKNWEK

SEQ ID NO: 2285265 - protein, 6 aa, Cryptosporidium parvum
TKNYAG

SEQ ID NO: 2285266 - protein, 4 aa, Cryptosporidium parvum
TKPD

SEQ ID NO: 2285267 - protein, 8 aa, Cryptosporidium parvum
TKPENDLN

SEQ ID NO: 2285268 - protein, 5 aa, Cryptosporidium parvum
TKPGL

SEQ ID NO: 2285269 - protein, 9 aa, Cryptosporidium parvum
TKPGVDKNK

SEQ ID NO: 2285270 - protein, 6 aa, Cryptosporidium parvum
TKPIEN

SEQ ID NO: 2285271 - protein, 6 aa, Cryptosporidium parvum
TKPKSI

SEQ ID NO: 2285272 - protein, 6 aa, Cryptosporidium parvum
TKPMDA

SEQ ID NO: 2285273 - protein, 6 aa, Cryptosporidium parvum
TKPNNA

SEQ ID NO: 2285274 - protein, 8 aa, Cryptosporidium parvum
TKPQENNF

SEQ ID NO: 2285275 - protein, 5 aa, Cryptosporidium parvum
TKPQV

SEQ ID NO: 2285276 - protein, 17 aa, Cryptosporidium parvum
TKPSDSESKNVTSSTLP

SEQ ID NO: 2285277 - protein, 5 aa, Cryptosporidium parvum
TKPSN

SEQ ID NO: 2285278 - protein, 5 aa, Cryptosporidium parvum
TKPSR

SEQ ID NO: 2285279 - protein, 10 aa, Cryptosporidium parvum
TKPSTKNETL

SEQ ID NO: 2285280 - protein, 9 aa, Cryptosporidium parvum
TKQEDQNLS

SEQ ID NO: 2285281 - protein, 13 aa, Cryptosporidium parvum
TKQHPSNANSNSQ

SEQ ID NO: 2285282 - protein, 13 aa, Cryptosporidium parvum
TKQNGKATKRKQI

SEQ ID NO: 2285283 - protein, 23 aa, Cryptosporidium parvum
TKQSEKLSNEDLKNESSGKNNVK

SEQ ID NO: 2285284 - protein, 7 aa, Cryptosporidium parvum
TKQTANE

SEQ ID NO: 2285285 - protein, 43 aa, Cryptosporidium parvum
TKQTARKSTGGKAPRKQLASKGARKSAPVTGGVKKPRRYRPGT

SEQ ID NO: 2285286 - protein, 6 aa, Cryptosporidium parvum
TKQTDI

SEQ ID NO: 2285287 - protein, 6 aa, Cryptosporidium parvum
TKRRIG

SEQ ID NO: 2285288 - protein, 8 aa, Cryptosporidium parvum
TKRRRDMR

SEQ ID NO: 2285289 - protein, 11 aa, Cryptosporidium parvum
TKRSEPPKSLK

SEQ ID NO: 2285290 - protein, 9 aa, Cryptosporidium parvum
TKRSIGNDI

SEQ ID NO: 2285291 - protein, 6 aa, Cryptosporidium parvum
TKRVNS

SEQ ID NO: 2285292 - protein, 28 aa, Cryptosporidium parvum
TKSANSSNSSSSGGNGNHGSDDDESIDD

SEQ ID NO: 2285293 - protein, 9 aa, Cryptosporidium parvum
TKSDNESAA

SEQ ID NO: 2285294 - protein, 12 aa, Cryptosporidium parvum
TKSDSNSSSKVS

SEQ ID NO: 2285295 - protein, 16 aa, Cryptosporidium parvum
TKSEKRKKKRQKELEQ

SEQ ID NO: 2285296 - protein, 9 aa, Cryptosporidium parvum
TKSGESKGY

SEQ ID NO: 2285297 - protein, 6 aa, Cryptosporidium parvum
TKSGKT

SEQ ID NO: 2285298 - protein, 8 aa, Cryptosporidium parvum
TKSKGPEI

SEQ ID NO: 2285299 - protein, 22 aa, Cryptosporidium parvum
TKSKYKSSRSHEGEVASTPVRS

SEQ ID NO: 2285300 - protein, 8 aa, Cryptosporidium parvum
TKSLTNSI

SEQ ID NO: 2285301 - protein, 5 aa, Cryptosporidium parvum
TKSMG

SEQ ID NO: 2285302 - protein, 4 aa, Cryptosporidium parvum
TKSN

SEQ ID NO: 2285303 - protein, 9 aa, Cryptosporidium parvum
TKSNDESVI

SEQ ID NO: 2285304 - protein, 5 aa, Cryptosporidium parvum
TKSPK

SEQ ID NO: 2285305 - protein, 9 aa, Cryptosporidium parvum
TKSQGGSLT

SEQ ID NO: 2285306 - protein, 7 aa, Cryptosporidium parvum
TKSQPNA

SEQ ID NO: 2285307 - protein, 7 aa, Cryptosporidium parvum
TKSQQNH

SEQ ID NO: 2285308 - protein, 11 aa, Cryptosporidium parvum
TKSRASSGISS

SEQ ID NO: 2285309 - protein, 7 aa, Cryptosporidium parvum
TKSSITN

SEQ ID NO: 2285310 - protein, 20 aa, Cryptosporidium parvum
TKSSSMPKSFTVNEDDGLFS

SEQ ID NO: 2285311 - protein, 9 aa, Cryptosporidium parvum
TKSTPEKLR

SEQ ID NO: 2285312 - protein, 5 aa, Cryptosporidium parvum
TKSVE

SEQ ID NO: 2285313 - protein, 13 aa, Cryptosporidium parvum
TKTAKSNKKISTM

SEQ ID NO: 2285314 - protein, 13 aa, Cryptosporidium parvum
TKTGMKNLRSSRS

SEQ ID NO: 2285315 - protein, 5 aa, Cryptosporidium parvum
TKTIN

SEQ ID NO: 2285316 - protein, 9 aa, Cryptosporidium parvum
TKTLSENQN

SEQ ID NO: 2285317 - protein, 4 aa, Cryptosporidium parvum
TKTP

SEQ ID NO: 2285318 - protein, 6 aa, Cryptosporidium parvum
TKTPNF

SEQ ID NO: 2285319 - protein, 5 aa, Cryptosporidium parvum
TKTPQ

SEQ ID NO: 2285320 - protein, 17 aa, Cryptosporidium parvum
TKTRRNTTLPSNVQQKT

SEQ ID NO: 2285321 - protein, 8 aa, Cryptosporidium parvum
TKTSPPGV

SEQ ID NO: 2285322 - protein, 6 aa, Cryptosporidium parvum
TKTSSI

SEQ ID NO: 2285323 - protein, 5 aa, Cryptosporidium parvum
TKTST

SEQ ID NO: 2285324 - protein, 17 aa, Cryptosporidium parvum
TKTSVDPENNTHLQVIS

SEQ ID NO: 2285325 - protein, 5 aa, Cryptosporidium parvum
TKTTF

SEQ ID NO: 2285326 - protein, 6 aa, Cryptosporidium parvum
TKTTKE

SEQ ID NO: 2285327 - protein, 13 aa, Cryptosporidium parvum
TKVDVSKADVSKF

SEQ ID NO: 2285328 - protein, 16 aa, Cryptosporidium parvum
TKVEGDLGSSKGVSEM

SEQ ID NO: 2285329 - protein, 5 aa, Cryptosporidium parvum
TKVPD

SEQ ID NO: 2285330 - protein, 15 aa, Cryptosporidium parvum
TKVSEDIDRAKEGNI

SEQ ID NO: 2285331 - protein, 6 aa, Cryptosporidium parvum
TKYCGN

SEQ ID NO: 2285332 - protein, 5 aa, Cryptosporidium parvum
TKYCQ

SEQ ID NO: 2285333 - protein, 8 aa, Cryptosporidium parvum
TKYGPEEE

SEQ ID NO: 2285334 - protein, 4 aa, Cryptosporidium parvum
TKYQ

SEQ ID NO: 2285335 - protein, 34 aa, Cryptosporidium parvum
TKYQDTSSKKHNMKTHNTQKPSKLKRGFCSCTKV

SEQ ID NO: 2285336 - protein, 26 aa, Cryptosporidium parvum
TKYSSEEYQKSDKQLSNKLPDEKTIS

SEQ ID NO: 2285337 - protein, 6 aa, Cryptosporidium parvum
TKYTKG

SEQ ID NO: 2285338 - protein, 7 aa, Cryptosporidium parvum
TLAGYGS

SEQ ID NO: 2285339 - protein, 64 aa, Cryptosporidium parvum
TLATEEKKGGDDNDATSQGIGISSAPSQVANDSNGIVENSQPAKTKEESKETTGLSSQENTQLT

SEQ ID NO: 2285340 - protein, 5 aa, Cryptosporidium parvum
TLATN

SEQ ID NO: 2285341 - protein, 4 aa, Cryptosporidium parvum
TLDE

SEQ ID NO: 2285342 - protein, 5 aa, Cryptosporidium parvum
TLDEK

SEQ ID NO: 2285343 - protein, 14 aa, Cryptosporidium parvum
TLDKQNSNSKFSGS

SEQ ID NO: 2285344 - protein, 72 aa, Cryptosporidium parvum; identical to SEQ ID NO: 2165139

SEQ ID NO: 2285345 - protein, 9 aa, Cryptosporidium parvum
TLDSKDKCL

SEQ ID NO: 2285346 - protein, 5 aa, Cryptosporidium parvum
TLDTL

SEQ ID NO: 2285347 - protein, 8 aa, Cryptosporidium parvum
TLDTSNAR

SEQ ID NO: 2285348 - protein, 11 aa, Cryptosporidium parvum
TLEDENDEKNK

SEQ ID NO: 2285349 - protein, 9 aa, Cryptosporidium parvum
TLEGKSQEK

SEQ ID NO: 2285350 - protein, 6 aa, Cryptosporidium parvum
TLEGMT

SEQ ID NO: 2285351 - protein, 11 aa, Cryptosporidium parvum
TLESSSNETKE

SEQ ID NO: 2285352 - protein, 12 aa, Cryptosporidium parvum
TLGDPTKALSKL

SEQ ID NO: 2285353 - protein, 5 aa, Cryptosporidium parvum
TLGEN

SEQ ID NO: 2285354 - protein, 17 aa, Cryptosporidium parvum
TLGGTKKTNDETDINSD

SEQ ID NO: 2285355 - protein, 8 aa, Cryptosporidium parvum
TLGKSSKL

SEQ ID NO: 2285356 - protein, 8 aa, Cryptosporidium parvum
TLGKSSQP

SEQ ID NO: 2285357 - protein, 4 aa, Cryptosporidium parvum
TLGP

SEQ ID NO: 2285358 - protein, 5 aa, Cryptosporidium parvum
TLGSE

SEQ ID NO: 2285359 - protein, 6 aa, Cryptosporidium parvum
TLGSRE

SEQ ID NO: 2285360 - protein, 5 aa, Cryptosporidium parvum
TLHDK

SEQ ID NO: 2285361 - protein, 14 aa, Cryptosporidium parvum
TLKDKDREKPINET

SEQ ID NO: 2285362 - protein, 8 aa, Cryptosporidium parvum
TLKDRTES

SEQ ID NO: 2285363 - protein, 11 aa, Cryptosporidium parvum
TLKENQSIENS

SEQ ID NO: 2285364 - protein, 5 aa, Cryptosporidium parvum
TLKGP

SEQ ID NO: 2285365 - protein, 11 aa, Cryptosporidium parvum
TLKKGSDPLDK

SEQ ID NO: 2285366 - protein, 11 aa, Cryptosporidium parvum
TLKKRDSEGYS

SEQ ID NO: 2285367 - protein, 12 aa, Cryptosporidium parvum
TLKNQSGGGEDE

SEQ ID NO: 2285368 - protein, 5 aa, Cryptosporidium parvum
TLKPP

SEQ ID NO: 2285369 - protein, 9 aa, Cryptosporidium parvum
TLKSGVSAS

SEQ ID NO: 2285370 - protein, 13 aa, Cryptosporidium parvum
TLKSQKINSSKSL

SEQ ID NO: 2285371 - protein, 5 aa, Cryptosporidium parvum
TLLPE

SEQ ID NO: 2285372 - protein, 11 aa, Cryptosporidium parvum
TLNGEVPSDFR

SEQ ID NO: 2285373 - protein, 9 aa, Cryptosporidium parvum
TLNKKDEDS

SEQ ID NO: 2285374 - protein, 16 aa, Cryptosporidium parvum
TLNKTINKSDNNNINY

SEQ ID NO: 2285375 - protein, 5 aa, Cryptosporidium parvum
TLNNG

SEQ ID NO: 2285376 - protein, 8 aa, Cryptosporidium parvum
TLNNNVDD

SEQ ID NO: 2285377 - protein, 9 aa, Cryptosporidium parvum
TLNNPNSSI

SEQ ID NO: 2285378 - protein, 7 aa, Cryptosporidium parvum
TLNNSSP

SEQ ID NO: 2285379 - protein, 13 aa, Cryptosporidium parvum
TLNSPGSTPSEKL

SEQ ID NO: 2285380 - protein, 9 aa, Cryptosporidium parvum
TLPEPHRTR

SEQ ID NO: 2285381 - protein, 5 aa, Cryptosporidium parvum
TLPPK

SEQ ID NO: 2285382 - protein, 5 aa, Cryptosporidium parvum
TLPRK

SEQ ID NO: 2285383 - protein, 16 aa, Cryptosporidium parvum
TLPSISDNQSKFTKKN

SEQ ID NO: 2285384 - protein, 10 aa, Cryptosporidium parvum
TLPSPQYPSD

SEQ ID NO: 2285385 - protein, 9 aa, Cryptosporidium parvum
TLPSSSDKY

SEQ ID NO: 2285386 - protein, 6 aa, Cryptosporidium parvum
TLPTPD

SEQ ID NO: 2285387 - protein, 9 aa, Cryptosporidium parvum
TLQDDPDHI

SEQ ID NO: 2285388 - protein, 19 aa, Cryptosporidium parvum
TLQNDNKPSCDGEIESKRT

SEQ ID NO: 2285389 - protein, 8 aa, Cryptosporidium parvum
TLQNETYR

SEQ ID NO: 2285390 - protein, 9 aa, Cryptosporidium parvum
TLQSNEYSS

SEQ ID NO: 2285391 - protein, 8 aa, Cryptosporidium parvum
TLRNEEEI

SEQ ID NO: 2285392 - protein, 11 aa, Cryptosporidium parvum
TLRPENNKHHY

SEQ ID NO: 2285393 - protein, 11 aa, Cryptosporidium parvum
TLRPKRRSFES

SEQ ID NO: 2285394 - protein, 10 aa, Cryptosporidium parvum
TLRSTEQEVA

SEQ ID NO: 2285395 - protein, 4 aa, Cryptosporidium parvum
TLSD

SEQ ID NO: 2285396 - protein, 22 aa, Cryptosporidium parvum
TLSDSKKRKQFSNSGIGQAGQK

SEQ ID NO: 2285397 - protein, 10 aa, Cryptosporidium parvum
TLSDTEKEKI

SEQ ID NO: 2285398 - protein, 20 aa, Cryptosporidium parvum
TLSDTNYDTNSSNADPGFSE

SEQ ID NO: 2285399 - protein, 11 aa, Cryptosporidium parvum
TLSESTASDIG

SEQ ID NO: 2285400 - protein, 13 aa, Cryptosporidium parvum
TLSGLEEETSISK

SEQ ID NO: 2285401 - protein, 9 aa, Cryptosporidium parvum
TLSNSRKEF

SEQ ID NO: 2285402 - protein, 6 aa, Cryptosporidium parvum
TLSPLD

SEQ ID NO: 2285403 - protein, 7 aa, Cryptosporidium parvum
TLSPTGG

SEQ ID NO: 2285404 - protein, 30 aa, Cryptosporidium parvum
TLSQTTRSYSDSGAFESDSFESPMSPLSPM

SEQ ID NO: 2285405 - protein, 5 aa, Cryptosporidium parvum
TLSRG

SEQ ID NO: 2285406 - protein, 31 aa, Cryptosporidium parvum
TLSSLNSNSITSSSKSLPKKDLTAKSSELKK

SEQ ID NO: 2285407 - protein, 16 aa, Cryptosporidium parvum
TLSSMKDSSKKEKSTW

SEQ ID NO: 2285408 - protein, 19 aa, Cryptosporidium parvum
TLSSSSPSRANSPSSNFHN

SEQ ID NO: 2285409 - protein, 5 aa, Cryptosporidium parvum
TLSTS

SEQ ID NO: 2285410 - protein, 11 aa, Cryptosporidium parvum
TLSYSNSFDGD

SEQ ID NO: 2285411 - protein, 5 aa, Cryptosporidium parvum
TLTPS

SEQ ID NO: 2285412 - protein, 6 aa, Cryptosporidium parvum
TLTPVK

SEQ ID NO: 2285413 - protein, 22 aa, Cryptosporidium parvum
TLTQERDSLLESSNSLQEYNKE

SEQ ID NO: 2285414 - protein, 25 aa, Cryptosporidium parvum
TLTSSTSPMSQQAPGSSKSSVGIGG

SEQ ID NO: 2285415 - protein, 13 aa, Cryptosporidium parvum
TLTTKERKKSRFG

SEQ ID NO: 2285416 - protein, 6 aa, Cryptosporidium parvum
TLTTPS

SEQ ID NO: 2285417 - protein, 15 aa, Cryptosporidium parvum
TLTTTASSSARTSHG

SEQ ID NO: 2285418 - protein, 16 aa, Cryptosporidium parvum
TMAPDTGARRARACPG

SEQ ID NO: 2285419 - protein, 8 aa, Cryptosporidium parvum
TMDPQTPA

SEQ ID NO: 2285420 - protein, 6 aa, Cryptosporidium parvum
TMDSEK

SEQ ID NO: 2285421 - protein, 13 aa, Cryptosporidium parvum
TMDSTQEDTPTCG

SEQ ID NO: 2285422 - protein, 7 aa, Cryptosporidium parvum
TMDTGGY

SEQ ID NO: 2285423 - protein, 11 aa, Cryptosporidium parvum
TMDTTSPTADK

SEQ ID NO: 2285424 - protein, 6 aa, Cryptosporidium parvum
TMGDED

SEQ ID NO: 2285425 - protein, 11 aa, Cryptosporidium parvum
TMNKDGEFKKA

SEQ ID NO: 2285426 - protein, 5 aa, Cryptosporidium parvum
TMNNN

SEQ ID NO: 2285427 - protein, 7 aa, Cryptosporidium parvum
TMNPASQ

SEQ ID NO: 2285428 - protein, 17 aa, Cryptosporidium parvum
TMPTPRAHGSSTNLDKS

SEQ ID NO: 2285429 - protein, 5 aa, Cryptosporidium parvum
TMQGK

SEQ ID NO: 2285430 - protein, 9 aa, Cryptosporidium parvum
TMRDGKPVS

SEQ ID NO: 2285431 - protein, 4 aa, Cryptosporidium parvum
TMSP

SEQ ID NO: 2285432 - protein, 4 aa, Cryptosporidium parvum
TMSS

SEQ ID NO: 2285433 - protein, 7 aa, Cryptosporidium parvum
TMSTDKR

SEQ ID NO: 2285434 - protein, 5 aa, Cryptosporidium parvum
TMTSS

SEQ ID NO: 2285435 - protein, 9 aa, Cryptosporidium parvum
TNAENPDVR

SEQ ID NO: 2285436 - protein, 4 aa, Cryptosporidium parvum
TNAI

SEQ ID NO: 2285437 - protein, 4 aa, Cryptosporidium parvum
TNAN

SEQ ID NO: 2285438 - protein, 8 aa, Cryptosporidium parvum
TNCEEEGR

SEQ ID NO: 2285439 - protein, 7 aa, Cryptosporidium parvum
TNCGGNS

SEQ ID NO: 2285440 - protein, 5 aa, Cryptosporidium parvum
TNCPR

SEQ ID NO: 2285441 - protein, 6 aa, Cryptosporidium parvum
TNCRNT

SEQ ID NO: 2285442 - protein, 13 aa, Cryptosporidium parvum
TNCSESEKVVEKK

SEQ ID NO: 2285443 - protein, 19 aa, Cryptosporidium parvum
TNDDRNYKYPEFKRSDKDL

SEQ ID NO: 2285444 - protein, 4 aa, Cryptosporidium parvum
TNDE

SEQ ID NO: 2285445 - protein, 8 aa, Cryptosporidium parvum
TNDEKNKK

SEQ ID NO: 2285446 - protein, 5 aa, Cryptosporidium parvum
TNDEY

SEQ ID NO: 2285447 - protein, 11 aa, Cryptosporidium parvum
TNDFSKKATEI

SEQ ID NO: 2285448 - protein, 17 aa, Cryptosporidium parvum
TNDIPEGSGKLVSGSSE

SEQ ID NO: 2285449 - protein, 8 aa, Cryptosporidium parvum
TNDLRSKI

SEQ ID NO: 2285450 - protein, 4 aa, Cryptosporidium parvum
TNDM

SEQ ID NO: 2285451 - protein, 11 aa, Cryptosporidium parvum
TNDNNSNNQPF

SEQ ID NO: 2285452 - protein, 9 aa, Cryptosporidium parvum
TNDNYNNMN

SEQ ID NO: 2285453 - protein, 4 aa, Cryptosporidium parvum
TNDR

SEQ ID NO: 2285454 - protein, 5 aa, Cryptosporidium parvum
TNDRD

SEQ ID NO: 2285455 - protein, 7 aa, Cryptosporidium parvum
TNDSIDG

SEQ ID NO: 2285456 - protein, 10 aa, Cryptosporidium parvum
TNDSKESKLN

SEQ ID NO: 2285457 - protein, 27 aa, Cryptosporidium parvum
TNDSRNYVNNQYNKGNNTNEWGYEGYD

SEQ ID NO: 2285458 - protein, 8 aa, Cryptosporidium parvum
TNDTNNDI

SEQ ID NO: 2285459 - protein, 4 aa, Cryptosporidium parvum
TNED

SEQ ID NO: 2285460 - protein, 14 aa, Cryptosporidium parvum
TNEDSGKKTQPNDK

SEQ ID NO: 2285461 - protein, 27 aa, Cryptosporidium parvum
TNEDWENEQERERNERREGVSSKKGDI

SEQ ID NO: 2285462 - protein, 21 aa, Cryptosporidium parvum
TNEEKYSPSGGTISVENNNEI

SEQ ID NO: 2285463 - protein, 6 aa, Cryptosporidium parvum
TNEESK

SEQ ID NO: 2285464 - protein, 6 aa, Cryptosporidium parvum
TNEGDT

SEQ ID NO: 2285465 - protein, 5 aa, Cryptosporidium parvum
TNEGK

SEQ ID NO: 2285466 - protein, 10 aa, Cryptosporidium parvum
TNEGKDQTGI

SEQ ID NO: 2285467 - protein, 6 aa, Cryptosporidium parvum
TNEGMQ

SEQ ID NO: 2285468 - protein, 10 aa, Cryptosporidium parvum
TNEGNQVQGK

SEQ ID NO: 2285469 - protein, 6 aa, Cryptosporidium parvum
TNEGSY

SEQ ID NO: 2285470 - protein, 19 aa, Cryptosporidium parvum
TNEISPSKCPKTSPPYPCR

SEQ ID NO: 2285471 - protein, 9 aa, Cryptosporidium parvum
TNEKSNRIN

SEQ ID NO: 2285472 - protein, 6 aa, Cryptosporidium parvum
TNENDS

SEQ ID NO: 2285473 - protein, 6 aa, Cryptosporidium parvum
TNENEI

SEQ ID NO: 2285474 - protein, 5 aa, Cryptosporidium parvum
TNENN

SEQ ID NO: 2285475 - protein, 11 aa, Cryptosporidium parvum
TNENSNSALKQ

SEQ ID NO: 2285476 - protein, 5 aa, Cryptosporidium parvum
TNEPK

SEQ ID NO: 2285477 - protein, 11 aa, Cryptosporidium parvum
TNEQKRPRPTV

SEQ ID NO: 2285478 - protein, 5 aa, Cryptosporidium parvum
TNEQW

SEQ ID NO: 2285479 - protein, 5 aa, Cryptosporidium parvum
TNESF

SEQ ID NO: 2285480 - protein, 14 aa, Cryptosporidium parvum
TNESQVSENEISPQ

SEQ ID NO: 2285481 - protein, 10 aa, Cryptosporidium parvum
TNESTGSISV

SEQ ID NO: 2285482 - protein, 6 aa, Cryptosporidium parvum
TNETKE

SEQ ID NO: 2285483 - protein, 6 aa, Cryptosporidium parvum
TNETSS

SEQ ID NO: 2285484 - protein, 4 aa, Cryptosporidium parvum
TNEV

SEQ ID NO: 2285485 - protein, 19 aa, Cryptosporidium parvum
TNEVANNSNEYQNDNYHYS

SEQ ID NO: 2285486 - protein, 8 aa, Cryptosporidium parvum
TNEYSDRI

SEQ ID NO: 2285487 - protein, 8 aa, Cryptosporidium parvum
TNFDKKDE

SEQ ID NO: 2285488 - protein, 15 aa, Cryptosporidium parvum
TNFKQREHTIEEKQP

SEQ ID NO: 2285489 - protein, 12 aa, Cryptosporidium parvum
TNFRPSNPQPSV

SEQ ID NO: 2285490 - protein, 4 aa, Cryptosporidium parvum
TNFS

SEQ ID NO: 2285491 - protein, 31 aa, Cryptosporidium parvum
TNFTTSTNSFGNSSFSNAGGFASNSQGPSIS

SEQ ID NO: 2285492 - protein, 6 aa, Cryptosporidium parvum
TNGDIS

SEQ ID NO: 2285493 - protein, 4 aa, Cryptosporidium parvum
TNGE

SEQ ID NO: 2285494 - protein, 9 aa, Cryptosporidium parvum
TNGERSPFE

SEQ ID NO: 2285495 - protein, 8 aa, Cryptosporidium parvum
TNGESNFD

SEQ ID NO: 2285496 - protein, 5 aa, Cryptosporidium parvum
TNGGM

SEQ ID NO: 2285497 - protein, 8 aa, Cryptosporidium parvum
TNGIGKST

SEQ ID NO: 2285498 - protein, 10 aa, Cryptosporidium parvum
TNGKEDTGEF

SEQ ID NO: 2285499 - protein, 4 aa, Cryptosporidium parvum
TNGL

SEQ ID NO: 2285500 - protein, 13 aa, Cryptosporidium parvum
TNGRESDKKTSFS

SEQ ID NO: 2285501 - protein, 6 aa, Cryptosporidium parvum
TNGTDS

SEQ ID NO: 2285502 - protein, 6 aa, Cryptosporidium parvum
TNGTTV

SEQ ID NO: 2285503 - protein, 10 aa, Cryptosporidium parvum
TNHDNKASYI

SEQ ID NO: 2285504 - protein, 6 aa, Cryptosporidium parvum
TNHFKS

SEQ ID NO: 2285505 - protein, 4 aa, Cryptosporidium parvum
TNHK

SEQ ID NO: 2285506 - protein, 4 aa, Cryptosporidium parvum
TNHN

SEQ ID NO: 2285507 - protein, 25 aa, Cryptosporidium parvum
TNHSPTKNPQVFEEGGANGINNGYS

SEQ ID NO: 2285508 - protein, 11 aa, Cryptosporidium parvum
TNIDESKSELK

SEQ ID NO: 2285509 - protein, 5 aa, Cryptosporidium parvum
TNIED

SEQ ID NO: 2285510 - protein, 9 aa, Cryptosporidium parvum
TNIKATSDF

SEQ ID NO: 2285511 - protein, 6 aa, Cryptosporidium parvum
TNIKGR

SEQ ID NO: 2285512 - protein, 10 aa, Cryptosporidium parvum
TNIKTTNTDY

SEQ ID NO: 2285513 - protein, 8 aa, Cryptosporidium parvum
TNINNTEK

SEQ ID NO: 2285514 - protein, 22 aa, Cryptosporidium parvum
TNINSNNSRMKDQRTKLEKFIG

SEQ ID NO: 2285515 - protein, 14 aa, Cryptosporidium parvum
TNINSSRHKGFQDN

SEQ ID NO: 2285516 - protein, 43 aa, Cryptosporidium parvum
TNINTNTNTNNESGITLETQEKVQEEEDCDSSGKNQRKKRRFD

SEQ ID NO: 2285517 - protein, 8 aa, Cryptosporidium parvum
TNIRRNPT

SEQ ID NO: 2285518 - protein, 4 aa, Cryptosporidium parvum
TNIS

SEQ ID NO: 2285519 - protein, 8 aa, Cryptosporidium parvum
TNISDDQI

SEQ ID NO: 2285520 - protein, 5 aa, Cryptosporidium parvum
TNIYG

SEQ ID NO: 2285521 - protein, 8 aa, Cryptosporidium parvum
TNKATSLT

SEQ ID NO: 2285522 - protein, 7 aa, Cryptosporidium parvum
TNKDGKV

SEQ ID NO: 2285523 - protein, 9 aa, Cryptosporidium parvum
TNKDHSRVN

SEQ ID NO: 2285524 - protein, 21 aa, Cryptosporidium parvum
TNKDNEAQTLQTNNNDKVPTS

SEQ ID NO: 2285525 - protein, 7 aa, Cryptosporidium parvum
TNKEAEF

SEQ ID NO: 2285526 - protein, 5 aa, Cryptosporidium parvum
TNKEV

SEQ ID NO: 2285527 - protein, 12 aa, Cryptosporidium parvum
TNKGFDNEGKFE

SEQ ID NO: 2285528 - protein, 9 aa, Cryptosporidium parvum
TNKGKTKDE

SEQ ID NO: 2285529 - protein, 4 aa, Cryptosporidium parvum
TNKI

SEQ ID NO: 2285530 - protein, 10 aa, Cryptosporidium parvum
TNKKNTSRSI

SEQ ID NO: 2285531 - protein, 5 aa, Cryptosporidium parvum
TNKKQ

SEQ ID NO: 2285532 - protein, 9 aa, Cryptosporidium parvum
TNKKRKKDL

SEQ ID NO: 2285533 - protein, 5 aa, Cryptosporidium parvum
TNKLF

SEQ ID NO: 2285534 - protein, 6 aa, Cryptosporidium parvum
TNKNQG

SEQ ID NO: 2285535 - protein, 10 aa, Cryptosporidium parvum
TNKPNEIDPA

SEQ ID NO: 2285536 - protein, 6 aa, Cryptosporidium parvum
TNKRAG

SEQ ID NO: 2285537 - protein, 20 aa, Cryptosporidium parvum
TNKRQISEEFTEKRDHEYDT

SEQ ID NO: 2285538 - protein, 5 aa, Cryptosporidium parvum
TNKRV

SEQ ID NO: 2285539 - protein, 5 aa, Cryptosporidium parvum
TNKSF

SEQ ID NO: 2285540 - protein, 11 aa, Cryptosporidium parvum
TNKSSAREENA

SEQ ID NO: 2285541 - protein, 22 aa, Cryptosporidium parvum
TNKSSNYNNNTQSKWERGKNGI

SEQ ID NO: 2285542 - protein, 9 aa, Cryptosporidium parvum
TNKYTENRK

SEQ ID NO: 2285543 - protein, 6 aa, Cryptosporidium parvum
TNKYTG

SEQ ID NO: 2285544 - protein, 10 aa, Cryptosporidium parvum
TNLEDDDGKI

SEQ ID NO: 2285545 - protein, 6 aa, Cryptosporidium parvum
TNLEEP

SEQ ID NO: 2285546 - protein, 38 aa, Cryptosporidium parvum
TNLGNHDEDENELENNEGQINNEDYNERDHDEAEENVV

SEQ ID NO: 2285547 - protein, 8 aa, Cryptosporidium parvum
TNLNNSSS

SEQ ID NO: 2285548 - protein, 7 aa, Cryptosporidium parvum
TNLPNPK

SEQ ID NO: 2285549 - protein, 9 aa, Cryptosporidium parvum
TNLSSEAQD

SEQ ID NO: 2285550 - protein, 25 aa, Cryptosporidium parvum
TNLSTSTTTTSLFGSSSKPENNNTS

SEQ ID NO: 2285551 - protein, 5 aa, Cryptosporidium parvum
TNLTH

SEQ ID NO: 2285552 - protein, 13 aa, Cryptosporidium parvum
TNMEGGNKGFSNY

SEQ ID NO: 2285553 - protein, 9 aa, Cryptosporidium parvum
TNMSSTNIG

SEQ ID NO: 2285554 - protein, 8 aa, Cryptosporidium parvum
TNNDEKSF

SEQ ID NO: 2285555 - protein, 8 aa, Cryptosporidium parvum
TNNDFDDI

SEQ ID NO: 2285556 - protein, 5 aa, Cryptosporidium parvum
TNNEF

SEQ ID NO: 2285557 - protein, 17 aa, Cryptosporidium parvum
TNNEFEKKQIASDNSIT

SEQ ID NO: 2285558 - protein, 7 aa, Cryptosporidium parvum
TNNETKS

SEQ ID NO: 2285559 - protein, 6 aa, Cryptosporidium parvum
TNNFST

SEQ ID NO: 2285560 - protein, 12 aa, Cryptosporidium parvum
TNNGVDNDNNIS

SEQ ID NO: 2285561 - protein, 19 aa, Cryptosporidium parvum
TNNHSKSYKFSHGSNSSFH

SEQ ID NO: 2285562 - protein, 8 aa, Cryptosporidium parvum
TNNKASKH

SEQ ID NO: 2285563 - protein, 10 aa, Cryptosporidium parvum
TNNKRESTDH

SEQ ID NO: 2285564 - protein, 34 aa, Cryptosporidium parvum
TNNLPISAGGSRRATSPDLLSPTKSTGRGPPPKI

SEQ ID NO: 2285565 - protein, 4 aa, Cryptosporidium parvum
TNNN

SEQ ID NO: 2285566 - protein, 13 aa, Cryptosporidium parvum
TNNNKYATTHGHP

SEQ ID NO: 2285567 - protein, 20 aa, Cryptosporidium parvum
TNNNNNNNNNNNNNNNTIQR

SEQ ID NO: 2285568 - protein, 5 aa, Cryptosporidium parvum
TNNQS

SEQ ID NO: 2285569 - protein, 10 aa, Cryptosporidium parvum
TNNQTKCEKQ

SEQ ID NO: 2285570 - protein, 9 aa, Cryptosporidium parvum
TNNSDIGDE

SEQ ID NO: 2285571 - protein, 33 aa, Cryptosporidium parvum
TNNSHSNNNSNGNNNNVDNSHKTSAKDEVGYNE

SEQ ID NO: 2285572 - protein, 11 aa, Cryptosporidium parvum
TNNSKDVKEGG

SEQ ID NO: 2285573 - protein, 9 aa, Cryptosporidium parvum
TNNSNAANA

SEQ ID NO: 2285574 - protein, 34 aa, Cryptosporidium parvum
TNNSNDDGIISTEGVGGGVVSTSSATVTSSTSLE

SEQ ID NO: 2285575 - protein, 6 aa, Cryptosporidium parvum
TNNSNS

SEQ ID NO: 2285576 - protein, 18 aa, Cryptosporidium parvum
TNNTKNETNFSDDQFQED

SEQ ID NO: 2285577 - protein, 17 aa, Cryptosporidium parvum
TNNTSVDDITVISCNIS

SEQ ID NO: 2285578 - protein, 4 aa, Cryptosporidium parvum
TNNV

SEQ ID NO: 2285579 - protein, 6 aa, Cryptosporidium parvum
TNNVQD

SEQ ID NO: 2285580 - protein, 30 aa, Cryptosporidium parvum
TNNVSSSASSLSNSSISSSSPVSKTYSRSD

SEQ ID NO: 2285581 - protein, 4 aa, Cryptosporidium parvum
TNNY

SEQ ID NO: 2285582 - protein, 7 aa, Cryptosporidium parvum
TNPEETR

SEQ ID NO: 2285583 - protein, 10 aa, Cryptosporidium parvum
TNPEKGLDES

SEQ ID NO: 2285584 - protein, 8 aa, Cryptosporidium parvum
TNPHYDAK

SEQ ID NO: 2285585 - protein, 5 aa, Cryptosporidium parvum
TNPKG

SEQ ID NO: 2285586 - protein, 6 aa, Cryptosporidium parvum
TNPKLD

SEQ ID NO: 2285587 - protein, 4 aa, Cryptosporidium parvum
TNPN

SEQ ID NO: 2285588 - protein, 16 aa, Cryptosporidium parvum
TNPNIGQKYPGLSANS

SEQ ID NO: 2285589 - protein, 7 aa, Cryptosporidium parvum
TNPNLKQ

SEQ ID NO: 2285590 - protein, 7 aa, Cryptosporidium parvum
TNPNNNI

SEQ ID NO: 2285591 - protein, 6 aa, Cryptosporidium parvum
TNPPAI

SEQ ID NO: 2285592 - protein, 5 aa, Cryptosporidium parvum
TNPPL

SEQ ID NO: 2285593 - protein, 4 aa, Cryptosporidium parvum
TNPS

SEQ ID NO: 2285594 - protein, 7 aa, Cryptosporidium parvum
TNPSYGD

SEQ ID NO: 2285595 - protein, 10 aa, Cryptosporidium parvum
TNPTSLSASS

SEQ ID NO: 2285596 - protein, 5 aa, Cryptosporidium parvum
TNPTV

SEQ ID NO: 2285597 - protein, 31 aa, Cryptosporidium parvum
TNPVTTTTTPFTTTTTKSTSSGSWMDSFLSW

SEQ ID NO: 2285598 - protein, 5 aa, Cryptosporidium parvum
TNQDK

SEQ ID NO: 2285599 - protein, 8 aa, Cryptosporidium parvum
TNQDLSET

SEQ ID NO: 2285600 - protein, 9 aa, Cryptosporidium parvum
TNQEKDSNI

SEQ ID NO: 2285601 - protein, 5 aa, Cryptosporidium parvum
TNQES

SEQ ID NO: 2285602 - protein, 13 aa, Cryptosporidium parvum
TNQKNNKSNSLED

SEQ ID NO: 2285603 - protein, 10 aa, Cryptosporidium parvum
TNQNLPGKNK

SEQ ID NO: 2285604 - protein, 13 aa, Cryptosporidium parvum
TNQNQESNTTAQR

SEQ ID NO: 2285605 - protein, 13 aa, Cryptosporidium parvum
TNQNSRAASSEII

SEQ ID NO: 2285606 - protein, 9 aa, Cryptosporidium parvum
TNQNTKKSL

SEQ ID NO: 2285607 - protein, 4 aa, Cryptosporidium parvum
TNQP

SEQ ID NO: 2285608 - protein, 7 aa, Cryptosporidium parvum
TNQPFDG

SEQ ID NO: 2285609 - protein, 6 aa, Cryptosporidium parvum
TNQPIT

SEQ ID NO: 2285610 - protein, 17 aa, Cryptosporidium parvum
TNQPYAPISQAPRPLPQ

SEQ ID NO: 2285611 - protein, 9 aa, Cryptosporidium parvum
TNQQEGERN

SEQ ID NO: 2285612 - protein, 15 aa, Cryptosporidium parvum
TNQQNQTSKSAGTNI

SEQ ID NO: 2285613 - protein, 11 aa, Cryptosporidium parvum
TNQQRKERVQK

SEQ ID NO: 2285614 - protein, 6 aa, Cryptosporidium parvum
TNQRQD

SEQ ID NO: 2285615 - protein, 8 aa, Cryptosporidium parvum
TNQSQLSS

SEQ ID NO: 2285616 - protein, 6 aa, Cryptosporidium parvum
TNQTCT

SEQ ID NO: 2285617 - protein, 17 aa, Cryptosporidium parvum
TNQTNQVTQIGEGTDPS

SEQ ID NO: 2285618 - protein, 7 aa, Cryptosporidium parvum
TNRPALG

SEQ ID NO: 2285619 - protein, 6 aa, Cryptosporidium parvum
TNRPDL

SEQ ID NO: 2285620 - protein, 6 aa, Cryptosporidium parvum
TNRPDM

SEQ ID NO: 2285621 - protein, 9 aa, Cryptosporidium parvum
TNRPNSIDP

SEQ ID NO: 2285622 - protein, 6 aa, Cryptosporidium parvum
TNRSDV

SEQ ID NO: 2285623 - protein, 31 aa, Cryptosporidium parvum; identical to SEQ ID NO: 2165375

SEQ ID NO: 2285624 - protein, 22 aa, Cryptosporidium parvum
TNRTRHLGEDEEVNVNTGNNNE

SEQ ID NO: 2285625 - protein, 4 aa, Cryptosporidium parvum
TNSA

SEQ ID NO: 2285626 - protein, 32 aa, Cryptosporidium parvum; identical to SEQ ID NO: 2165378

SEQ ID NO: 2285627 - protein, 8 aa, Cryptosporidium parvum
TNSDGERR

SEQ ID NO: 2285628 - protein, 7 aa, Cryptosporidium parvum
TNSDPIG

SEQ ID NO: 2285629 - protein, 7 aa, Cryptosporidium parvum
TNSEEFN

SEQ ID NO: 2285630 - protein, 5 aa, Cryptosporidium parvum
TNSEF

SEQ ID NO: 2285631 - protein, 15 aa, Cryptosporidium parvum
TNSESINSNFQGSTF

SEQ ID NO: 2285632 - protein, 8 aa, Cryptosporidium parvum
TNSFNEDI

SEQ ID NO: 2285633 - protein, 8 aa, Cryptosporidium parvum
TNSGNNAV

SEQ ID NO: 2285634 - protein, 13 aa, Cryptosporidium parvum
TNSHESNQIDSNI

SEQ ID NO: 2285635 - protein, 4 aa, Cryptosporidium parvum
TNSI

SEQ ID NO: 2285636 - protein, 13 aa, Cryptosporidium parvum
TNSIEQDYKTGAS

SEQ ID NO: 2285637 - protein, 7 aa, Cryptosporidium parvum
TNSKGVK

SEQ ID NO: 2285638 - protein, 35 aa, Cryptosporidium parvum
TNSKNEKKKNSCKKERKRSKSVDGYPKKKQSRGSF

SEQ ID NO: 2285639 - protein, 6 aa, Cryptosporidium parvum
TNSKNV

SEQ ID NO: 2285640 - protein, 12 aa, Cryptosporidium parvum
TNSKSNKKIGVS

SEQ ID NO: 2285641 - protein, 12 aa, Cryptosporidium parvum
TNSNENTPTNNL

SEQ ID NO: 2285642 - protein, 8 aa, Cryptosporidium parvum
TNSNNKGN

SEQ ID NO: 2285643 - protein, 5 aa, Cryptosporidium parvum
TNSNS

SEQ ID NO: 2285644 - protein, 15 aa, Cryptosporidium parvum
TNSNYKAQSNHSVSR

SEQ ID NO: 2285645 - protein, 13 aa, Cryptosporidium parvum
TNSPSSPRSPVIE

SEQ ID NO: 2285646 - protein, 4 aa, Cryptosporidium parvum
TNSQ

SEQ ID NO: 2285647 - protein, 5 aa, Cryptosporidium parvum
TNSQD

SEQ ID NO: 2285648 - protein, 8 aa, Cryptosporidium parvum
TNSRRNSQ

SEQ ID NO: 2285649 - protein, 12 aa, Cryptosporidium parvum
TNSRSNADSNNS

SEQ ID NO: 2285650 - protein, 4 aa, Cryptosporidium parvum
TNSS

SEQ ID NO: 2285651 - protein, 5 aa, Cryptosporidium parvum
TNSSL

SEQ ID NO: 2285652 - protein, 16 aa, Cryptosporidium parvum
TNSSLSSQQKTFTESK

SEQ ID NO: 2285653 - protein, 7 aa, Cryptosporidium parvum
TNSSSKA

SEQ ID NO: 2285654 - protein, 19 aa, Cryptosporidium parvum
TNSTATVSSNDIGGLSVND

SEQ ID NO: 2285655 - protein, 13 aa, Cryptosporidium parvum
TNSVSNDHDHDNN

SEQ ID NO: 2285656 - protein, 8 aa, Cryptosporidium parvum
TNSVSRET

SEQ ID NO: 2285657 - protein, 6 aa, Cryptosporidium parvum
TNTAKF

SEQ ID NO: 2285658 - protein, 18 aa, Cryptosporidium parvum
TNTASSTSSSTKSKPNTN

SEQ ID NO: 2285659 - protein, 4 aa, Cryptosporidium parvum
TNTE

SEQ ID NO: 2285660 - protein, 4 aa, Cryptosporidium parvum
TNTG

SEQ ID NO: 2285661 - protein, 6 aa, Cryptosporidium parvum
TNTGLE

SEQ ID NO: 2285662 - protein, 12 aa, Cryptosporidium parvum
TNTGNKSNQEIM

SEQ ID NO: 2285663 - protein, 21 aa, Cryptosporidium parvum
TNTKGNEYNSEITVNNRRKYG

SEQ ID NO: 2285664 - protein, 4 aa, Cryptosporidium parvum
TNTL

SEQ ID NO: 2285665 - protein, 14 aa, Cryptosporidium parvum
TNTNHQNNKLSGFT

SEQ ID NO: 2285666 - protein, 29 aa, Cryptosporidium parvum
TNTNINTINNNNNNNTNSNNAVNTNTNNA

SEQ ID NO: 2285667 - protein, 10 aa, Cryptosporidium parvum
TNTNPDSSIS

SEQ ID NO: 2285668 - protein, 7 aa, Cryptosporidium parvum
TNTQGGC

SEQ ID NO: 2285669 - protein, 8 aa, Cryptosporidium parvum
TNTSESLK

SEQ ID NO: 2285670 - protein, 9 aa, Cryptosporidium parvum
TNTSNPNQM

SEQ ID NO: 2285671 - protein, 11 aa, Cryptosporidium parvum
TNTSQRRIPRG

SEQ ID NO: 2285672 - protein, 5 aa, Cryptosporidium parvum
TNTVK

SEQ ID NO: 2285673 - protein, 5 aa, Cryptosporidium parvum
TNVGE

SEQ ID NO: 2285674 - protein, 6 aa, Cryptosporidium parvum
TNVKVS

SEQ ID NO: 2285675 - protein, 4 aa, Cryptosporidium parvum
TNVN

SEQ ID NO: 2285676 - protein, 8 aa, Cryptosporidium parvum
TNVSKDIA

SEQ ID NO: 2285677 - protein, 5 aa, Cryptosporidium parvum
TNYEY

SEQ ID NO: 2285678 - protein, 14 aa, Cryptosporidium parvum
TNYGRGYSQSDNEE

SEQ ID NO: 2285679 - protein, 12 aa, Cryptosporidium parvum
TNYNFSNTSDHS

SEQ ID NO: 2285680 - protein, 5 aa, Cryptosporidium parvum
TNYPT

SEQ ID NO: 2285681 - protein, 6 aa, Cryptosporidium parvum
TNYTRK

SEQ ID NO: 2285682 - protein, 8 aa, Cryptosporidium parvum
TPAHDKND

SEQ ID NO: 2285683 - protein, 5 aa, Cryptosporidium parvum
TPAIR

SEQ ID NO: 2285684 - protein, 42 aa, Cryptosporidium parvum
TPAKSTSKMQTTPKKGDSPGKSMIKGETPKSGIKKEPSLGKK

SEQ ID NO: 2285685 - protein, 4 aa, Cryptosporidium parvum
TPAL

SEQ ID NO: 2285686 - protein, 9 aa, Cryptosporidium parvum
TPALNNPTE

SEQ ID NO: 2285687 - protein, 4 aa, Cryptosporidium parvum
TPAN

SEQ ID NO: 2285688 - protein, 5 aa, Cryptosporidium parvum
TPARK

SEQ ID NO: 2285689 - protein, 12 aa, Cryptosporidium parvum
TPARPTSAYKTA

SEQ ID NO: 2285690 - protein, 12 aa, Cryptosporidium parvum
TPASKGNQFSTF

SEQ ID NO: 2285691 - protein, 23 aa, Cryptosporidium parvum
TPDEARALKSKGEIPETTKINES

SEQ ID NO: 2285692 - protein, 6 aa, Cryptosporidium parvum
TPDFDG

SEQ ID NO: 2285693 - protein, 6 aa, Cryptosporidium parvum
TPDGEP

SEQ ID NO: 2285694 - protein, 13 aa, Cryptosporidium parvum
TPDNSITNKSAQN

SEQ ID NO: 2285695 - protein, 11 aa, Cryptosporidium parvum
TPDPNNDDKVY

SEQ ID NO: 2285696 - protein, 5 aa, Cryptosporidium parvum
TPDSG

SEQ ID NO: 2285697 - protein, 7 aa, Cryptosporidium parvum
TPDTRSE

SEQ ID NO: 2285698 - protein, 12 aa, Cryptosporidium parvum
TPEAINNKPSQF

SEQ ID NO: 2285699 - protein, 5 aa, Cryptosporidium parvum
TPEAV

SEQ ID NO: 2285700 - protein, 19 aa, Cryptosporidium parvum
TPECNPDNITSNKSNEPIY

SEQ ID NO: 2285701 - protein, 13 aa, Cryptosporidium parvum
TPEGSQLPEEKTG

SEQ ID NO: 2285702 - protein, 4 aa, Cryptosporidium parvum
TPEH

SEQ ID NO: 2285703 - protein, 6 aa, Cryptosporidium parvum
TPEIQP

SEQ ID NO: 2285704 - protein, 4 aa, Cryptosporidium parvum
TPEK

SEQ ID NO: 2285705 - protein, 7 aa, Cryptosporidium parvum
TPEKEIS

SEQ ID NO: 2285706 - protein, 5 aa, Cryptosporidium parvum
TPENP

SEQ ID NO: 2285707 - protein, 39 aa, Cryptosporidium parvum; identical to SEQ ID NO: 2165441

SEQ ID NO: 2285708 - protein, 8 aa, Cryptosporidium parvum
TPEQWEPA

SEQ ID NO: 2285709 - protein, 7 aa, Cryptosporidium parvum
TPERKRE

SEQ ID NO: 2285710 - protein, 6 aa, Cryptosporidium parvum
TPERRI

SEQ ID NO: 2285711 - protein, 11 aa, Cryptosporidium parvum
TPERTKQENII

SEQ ID NO: 2285712 - protein, 6 aa, Cryptosporidium parvum
TPETPM

SEQ ID NO: 2285713 - protein, 10 aa, Cryptosporidium parvum
TPEVQSKITS

SEQ ID NO: 2285714 - protein, 11 aa, Cryptosporidium parvum
TPFNPRYATDD

SEQ ID NO: 2285715 - protein, 5 aa, Cryptosporidium parvum
TPFSK

SEQ ID NO: 2285716 - protein, 5 aa, Cryptosporidium parvum
TPGGV

SEQ ID NO: 2285717 - protein, 7 aa, Cryptosporidium parvum
TPGSTTL

SEQ ID NO: 2285718 - protein, 19 aa, Cryptosporidium parvum
TPGTGKTSLSKKLEKKLEG

SEQ ID NO: 2285719 - protein, 8 aa, Cryptosporidium parvum
TPGTLTNQ

SEQ ID NO: 2285720 - protein, 4 aa, Cryptosporidium parvum
TPHK

SEQ ID NO: 2285721 - protein, 10 aa, Cryptosporidium parvum
TPHPNANVPG

SEQ ID NO: 2285722 - protein, 5 aa, Cryptosporidium parvum
TPHRD

SEQ ID NO: 2285723 - protein, 15 aa, Cryptosporidium parvum
TPHSPNRSSQIPPNV

SEQ ID NO: 2285724 - protein, 11 aa, Cryptosporidium parvum
TPHSPPENSEL

SEQ ID NO: 2285725 - protein, 11 aa, Cryptosporidium parvum
TPIDEKNSVKS

SEQ ID NO: 2285726 - protein, 21 aa, Cryptosporidium parvum
TPINNTNESPVTPSTGCETPL

SEQ ID NO: 2285727 - protein, 8 aa, Cryptosporidium parvum
TPIPESNN

SEQ ID NO: 2285728 - protein, 5 aa, Cryptosporidium parvum
TPIPG

SEQ ID NO: 2285729 - protein, 5 aa, Cryptosporidium parvum
TPIPI

SEQ ID NO: 2285730 - protein, 18 aa, Cryptosporidium parvum
TPIPTDSTRRKGGRRGRR

SEQ ID NO: 2285731 - protein, 4 aa, Cryptosporidium parvum
TPIQ

SEQ ID NO: 2285732 - protein, 21 aa, Cryptosporidium parvum
TPIRSSRRISSRKNYAKEEPN

SEQ ID NO: 2285733 - protein, 8 aa, Cryptosporidium parvum
TPISNSIS

SEQ ID NO: 2285734 - protein, 9 aa, Cryptosporidium parvum
TPISQGITN

SEQ ID NO: 2285735 - protein, 4 aa, Cryptosporidium parvum
TPKE

SEQ ID NO: 2285736 - protein, 14 aa, Cryptosporidium parvum
TPKERQKKRIGWND

SEQ ID NO: 2285737 - protein, 5 aa, Cryptosporidium parvum
TPKHI

SEQ ID NO: 2285738 - protein, 14 aa, Cryptosporidium parvum
TPKLPDSKYRQNLK

SEQ ID NO: 2285739 - protein, 4 aa, Cryptosporidium parvum
TPKQ

SEQ ID NO: 2285740 - protein, 6 aa, Cryptosporidium parvum
TPKQEY

SEQ ID NO: 2285741 - protein, 12 aa, Cryptosporidium parvum
TPKREGSNREME

SEQ ID NO: 2285742 - protein, 8 aa, Cryptosporidium parvum
TPKRKTPV

SEQ ID NO: 2285743 - protein, 10 aa, Cryptosporidium parvum
TPKYNPDTVD

SEQ ID NO: 2285744 - protein, 7 aa, Cryptosporidium parvum
TPKYNYE

SEQ ID NO: 2285745 - protein, 9 aa, Cryptosporidium parvum
TPLEQGGIG

SEQ ID NO: 2285746 - protein, 14 aa, Cryptosporidium parvum
TPLGREGKFAKPRQ

SEQ ID NO: 2285747 - protein, 4 aa, Cryptosporidium parvum
TPLL

SEQ ID NO: 2285748 - protein, 11 aa, Cryptosporidium parvum
TPLNKDRPPCI

SEQ ID NO: 2285749 - protein, 12 aa, Cryptosporidium parvum
TPLPAPPSPRYT

SEQ ID NO: 2285750 - protein, 6 aa, Cryptosporidium parvum
TPLQNR

SEQ ID NO: 2285751 - protein, 6 aa, Cryptosporidium parvum
TPLQNS

SEQ ID NO: 2285752 - protein, 5 aa, Cryptosporidium parvum
TPLTD

SEQ ID NO: 2285753 - protein, 5 aa, Cryptosporidium parvum
TPMDT

SEQ ID NO: 2285754 - protein, 4 aa, Cryptosporidium parvum
TPMG

SEQ ID NO: 2285755 - protein, 8 aa, Cryptosporidium parvum
TPMSPRTA

SEQ ID NO: 2285756 - protein, 9 aa, Cryptosporidium parvum
TPNASQQFS

SEQ ID NO: 2285757 - protein, 11 aa, Cryptosporidium parvum
TPNEDNWPQAK

SEQ ID NO: 2285758 - protein, 4 aa, Cryptosporidium parvum
TPNF

SEQ ID NO: 2285759 - protein, 4 aa, Cryptosporidium parvum
TPNG

SEQ ID NO: 2285760 - protein, 5 aa, Cryptosporidium parvum
TPNGL

SEQ ID NO: 2285761 - protein, 11 aa, Cryptosporidium parvum
TPNGTLDNRHV

SEQ ID NO: 2285762 - protein, 23 aa, Cryptosporidium parvum
TPNIETEARAETEDQSADTGGEI

SEQ ID NO: 2285763 - protein, 44 aa, Cryptosporidium parvum
TPNPATQEPKPSEDATAEGGNASGDERYYPEEELTEGNWNTPQV

SEQ ID NO: 2285764 - protein, 8 aa, Cryptosporidium parvum
TPNPREWP

SEQ ID NO: 2285765 - protein, 4 aa, Cryptosporidium parvum
TPNS

SEQ ID NO: 2285766 - protein, 7 aa, Cryptosporidium parvum
TPNSGSN

SEQ ID NO: 2285767 - protein, 8 aa, Cryptosporidium parvum
TPNSLNNN

SEQ ID NO: 2285768 - protein, 7 aa, Cryptosporidium parvum
TPNTKRL

SEQ ID NO: 2285769 - protein, 13 aa, Cryptosporidium parvum
TPNVQEDIKQGEG

SEQ ID NO: 2285770 - protein, 12 aa, Cryptosporidium parvum
TPPDNKSSKHNK

SEQ ID NO: 2285771 - protein, 7 aa, Cryptosporidium parvum
TPPDSPI

SEQ ID NO: 2285772 - protein, 6 aa, Cryptosporidium parvum
TPPEEY

SEQ ID NO: 2285773 - protein, 8 aa, Cryptosporidium parvum
TPPESEIR

SEQ ID NO: 2285774 - protein, 6 aa, Cryptosporidium parvum
TPPFYG

SEQ ID NO: 2285775 - protein, 5 aa, Cryptosporidium parvum
TPPGK

SEQ ID NO: 2285776 - protein, 9 aa, Cryptosporidium parvum
TPPGTPSYS

SEQ ID NO: 2285777 - protein, 7 aa, Cryptosporidium parvum
TPPIGDS

SEQ ID NO: 2285778 - protein, 9 aa, Cryptosporidium parvum
TPPLKPNTH

SEQ ID NO: 2285779 - protein, 8 aa, Cryptosporidium parvum
TPPPFTGL

SEQ ID NO: 2285780 - protein, 11 aa, Cryptosporidium parvum
TPPPLSPSKGI

SEQ ID NO: 2285781 - protein, 10 aa, Cryptosporidium parvum
TPPPNRKGRY

SEQ ID NO: 2285782 - protein, 6 aa, Cryptosporidium parvum
TPPQIP

SEQ ID NO: 2285783 - protein, 8 aa, Cryptosporidium parvum
TPPQTSNN

SEQ ID NO: 2285784 - protein, 7 aa, Cryptosporidium parvum
TPPSIQR

SEQ ID NO: 2285785 - protein, 5 aa, Cryptosporidium parvum
TPPSN

SEQ ID NO: 2285786 - protein, 14 aa, Cryptosporidium parvum
TPPSNTKNTIGSDP

SEQ ID NO: 2285787 - protein, 18 aa, Cryptosporidium parvum
TPPTASGVRATPPTAPGI

SEQ ID NO: 2285788 - protein, 9 aa, Cryptosporidium parvum
TPQEAESVE

SEQ ID NO: 2285789 - protein, 6 aa, Cryptosporidium parvum
TPQESI

SEQ ID NO: 2285790 - protein, 7 aa, Cryptosporidium parvum
TPQGGED

SEQ ID NO: 2285791 - protein, 55 aa, Cryptosporidium parvum
TPQIATQSIQRPKHMTTSDLPPLEKKPSNSNYPSSSSADSKDMNNSVEKSEGPHF

SEQ ID NO: 2285792 - protein, 4 aa, Cryptosporidium parvum
TPQL

SEQ ID NO: 2285793 - protein, 7 aa, Cryptosporidium parvum
TPQNPTK

SEQ ID NO: 2285794 - protein, 14 aa, Cryptosporidium parvum
TPQNTKISEESSDR

SEQ ID NO: 2285795 - protein, 12 aa, Cryptosporidium parvum
TPQNVSLETKQY

SEQ ID NO: 2285796 - protein, 5 aa, Cryptosporidium parvum
TPQYP

SEQ ID NO: 2285797 - protein, 8 aa, Cryptosporidium parvum
TPRASSNG

SEQ ID NO: 2285798 - protein, 9 aa, Cryptosporidium parvum
TPRGLTASN

SEQ ID NO: 2285799 - protein, 5 aa, Cryptosporidium parvum
TPRLE

SEQ ID NO: 2285800 - protein, 8 aa, Cryptosporidium parvum
TPRLENQN

SEQ ID NO: 2285801 - protein, 5 aa, Cryptosporidium parvum
TPRMG

SEQ ID NO: 2285802 - protein, 8 aa, Cryptosporidium parvum
TPRNGEPL

SEQ ID NO: 2285803 - protein, 7 aa, Cryptosporidium parvum
TPRSDEE

SEQ ID NO: 2285804 - protein, 13 aa, Cryptosporidium parvum
TPRSPMSPVSPGG

SEQ ID NO: 2285805 - protein, 6 aa, Cryptosporidium parvum
TPRTNN

SEQ ID NO: 2285806 - protein, 14 aa, Cryptosporidium parvum
TPSEMTDGGQTNTT

SEQ ID NO: 2285807 - protein, 4 aa, Cryptosporidium parvum
TPSF

SEQ ID NO: 2285808 - protein, 13 aa, Cryptosporidium parvum
TPSGSTAYSMSAG

SEQ ID NO: 2285809 - protein, 8 aa, Cryptosporidium parvum
TPSGTAYI

SEQ ID NO: 2285810 - protein, 5 aa, Cryptosporidium parvum
TPSHS

SEQ ID NO: 2285811 - protein, 5 aa, Cryptosporidium parvum
TPSKE

SEQ ID NO: 2285812 - protein, 9 aa, Cryptosporidium parvum
TPSPNPLAN

SEQ ID NO: 2285813 - protein, 5 aa, Cryptosporidium parvum
TPSRE

SEQ ID NO: 2285814 - protein, 5 aa, Cryptosporidium parvum
TPSRK

SEQ ID NO: 2285815 - protein, 6 aa, Cryptosporidium parvum
TPSSNL

SEQ ID NO: 2285816 - protein, 8 aa, Cryptosporidium parvum
TPSSTISE

SEQ ID NO: 2285817 - protein, 42 aa, Cryptosporidium parvum; identical to SEQ ID NO: 2165541

SEQ ID NO: 2285818 - protein, 5 aa, Cryptosporidium parvum
TPSTI

SEQ ID NO: 2285819 - protein, 5 aa, Cryptosporidium parvum
TPSVV

SEQ ID NO: 2285820 - protein, 4 aa, Cryptosporidium parvum
TPSY

SEQ ID NO: 2285821 - protein, 5 aa, Cryptosporidium parvum
TPTAE

SEQ ID NO: 2285822 - protein, 8 aa, Cryptosporidium parvum
TPTAIQSK

SEQ ID NO: 2285823 - protein, 6 aa, Cryptosporidium parvum
TPTDNK

SEQ ID NO: 2285824 - protein, 10 aa, Cryptosporidium parvum
TPTDQENEQV

SEQ ID NO: 2285825 - protein, 9 aa, Cryptosporidium parvum
TPTEESWPE

SEQ ID NO: 2285826 - protein, 5 aa, Cryptosporidium parvum
TPTIS

SEQ ID NO: 2285827 - protein, 5 aa, Cryptosporidium parvum
TPTKE

SEQ ID NO: 2285828 - protein, 6 aa, Cryptosporidium parvum
TPTKSS

SEQ ID NO: 2285829 - protein, 15 aa, Cryptosporidium parvum
TPTKTSSMDISRNRR

SEQ ID NO: 2285830 - protein, 16 aa, Cryptosporidium parvum
TPTKTYGRNKGEAPDL

SEQ ID NO: 2285831 - protein, 5 aa, Cryptosporidium parvum
TPTRE

SEQ ID NO: 2285832 - protein, 8 aa, Cryptosporidium parvum
TPTSDLSK

SEQ ID NO: 2285833 - protein, 6 aa, Cryptosporidium parvum
TPTSKD

SEQ ID NO: 2285834 - protein, 7 aa, Cryptosporidium parvum
TPTSPIY

SEQ ID NO: 2285835 - protein, 10 aa, Cryptosporidium parvum
TPVAERDREK

SEQ ID NO: 2285836 - protein, 8 aa, Cryptosporidium parvum
TPVQNNTE

SEQ ID NO: 2285837 - protein, 18 aa, Cryptosporidium parvum
TPVRGKKSQSQEDFDEKD

SEQ ID NO: 2285838 - protein, 9 aa, Cryptosporidium parvum
TPVSSGHRN

SEQ ID NO: 2285839 - protein, 5 aa, Cryptosporidium parvum
TPYGS

SEQ ID NO: 2285840 - protein, 8 aa, Cryptosporidium parvum
TQADRTRS

SEQ ID NO: 2285841 - protein, 4 aa, Cryptosporidium parvum
TQAE

SEQ ID NO: 2285842 - protein, 4 aa, Cryptosporidium parvum
TQAG

SEQ ID NO: 2285843 - protein, 4 aa, Cryptosporidium parvum
TQAK

SEQ ID NO: 2285844 - protein, 10 aa, Cryptosporidium parvum
TQAKQKQQSW

SEQ ID NO: 2285845 - protein, 7 aa, Cryptosporidium parvum
TQANMED

SEQ ID NO: 2285846 - protein, 12 aa, Cryptosporidium parvum
TQAPHSLPKPQT

SEQ ID NO: 2285847 - protein, 7 aa, Cryptosporidium parvum
TQASKNI

SEQ ID NO: 2285848 - protein, 27 aa, Cryptosporidium parvum
TQATVEDCKDENQTEESKEHPESTPSS

SEQ ID NO: 2285849 - protein, 22 aa, Cryptosporidium parvum
TQAYPETRKCTGGQDCMEESPG

SEQ ID NO: 2285850 - protein, 6 aa, Cryptosporidium parvum
TQCKRD

SEQ ID NO: 2285851 - protein, 6 aa, Cryptosporidium parvum
TQDHAA

SEQ ID NO: 2285852 - protein, 10 aa, Cryptosporidium parvum
TQDNKDLQND

SEQ ID NO: 2285853 - protein, 4 aa, Cryptosporidium parvum
TQEC

SEQ ID NO: 2285854 - protein, 5 aa, Cryptosporidium parvum
TQECG

SEQ ID NO: 2285855 - protein, 11 aa, Cryptosporidium parvum
TQEDRLEQNGQ

SEQ ID NO: 2285856 - protein, 18 aa, Cryptosporidium parvum
TQEEEIETGTVTRNSGGR

SEQ ID NO: 2285857 - protein, 7 aa, Cryptosporidium parvum
TQEEGRK

SEQ ID NO: 2285858 - protein, 20 aa, Cryptosporidium parvum
TQEENKKKGIQTNNENDNTI

SEQ ID NO: 2285859 - protein, 21 aa, Cryptosporidium parvum
TQEGDVSEPNENVQKRKQSCS

SEQ ID NO: 2285860 - protein, 5 aa, Cryptosporidium parvum
TQESL

SEQ ID NO: 2285861 - protein, 9 aa, Cryptosporidium parvum
TQESSNEKS

SEQ ID NO: 2285862 - protein, 11 aa, Cryptosporidium parvum
TQFSSQTQSAT

SEQ ID NO: 2285863 - protein, 9 aa, Cryptosporidium parvum
TQGFESSTK

SEQ ID NO: 2285864 - protein, 4 aa, Cryptosporidium parvum
TQGI

SEQ ID NO: 2285865 - protein, 4 aa, Cryptosporidium parvum
TQGN

SEQ ID NO: 2285866 - protein, 6 aa, Cryptosporidium parvum
TQHPTY

SEQ ID NO: 2285867 - protein, 14 aa, Cryptosporidium parvum
TQIESGLGATEGKN

SEQ ID NO: 2285868 - protein, 6 aa, Cryptosporidium parvum
TQINPG

SEQ ID NO: 2285869 - protein, 27 aa, Cryptosporidium parvum
TQISHETSKIRRKDPNEYSSSLESLSE

SEQ ID NO: 2285870 - protein, 8 aa, Cryptosporidium parvum
TQISPDNP

SEQ ID NO: 2285871 - protein, 9 aa, Cryptosporidium parvum
TQKAGSMLQ

SEQ ID NO: 2285872 - protein, 7 aa, Cryptosporidium parvum
TQKDKEE

SEQ ID NO: 2285873 - protein, 25 aa, Cryptosporidium parvum
TQKEGVANKSKKYIESMKTKKWHKK

SEQ ID NO: 2285874 - protein, 6 aa, Cryptosporidium parvum
TQKKSQ

SEQ ID NO: 2285875 - protein, 5 aa, Cryptosporidium parvum
TQKKY

SEQ ID NO: 2285876 - protein, 9 aa, Cryptosporidium parvum
TQKLSNKNQ

SEQ ID NO: 2285877 - protein, 16 aa, Cryptosporidium parvum
TQKPGFGSHTADECEK

SEQ ID NO: 2285878 - protein, 18 aa, Cryptosporidium parvum
TQKSDKEGPQNTQNLPEP

SEQ ID NO: 2285879 - protein, 16 aa, Cryptosporidium parvum
TQKSNYNSDLNQSEKS

SEQ ID NO: 2285880 - protein, 9 aa, Cryptosporidium parvum
TQLENELDS

SEQ ID NO: 2285881 - protein, 8 aa, Cryptosporidium parvum
TQLETQKG

SEQ ID NO: 2285882 - protein, 8 aa, Cryptosporidium parvum
TQLPEETR

SEQ ID NO: 2285883 - protein, 5 aa, Cryptosporidium parvum
TQLPY

SEQ ID NO: 2285884 - protein, 4 aa, Cryptosporidium parvum
TQLQ

SEQ ID NO: 2285885 - protein, 6 aa, Cryptosporidium parvum
TQLQPG

SEQ ID NO: 2285886 - protein, 9 aa, Cryptosporidium parvum
TQLSKSGHY

SEQ ID NO: 2285887 - protein, 9 aa, Cryptosporidium parvum
TQLTNSKEK

SEQ ID NO: 2285888 - protein, 4 aa, Cryptosporidium parvum
TQNE

SEQ ID NO: 2285889 - protein, 20 aa, Cryptosporidium parvum
TQNEKQDNIEIEKKENNYYT

SEQ ID NO: 2285890 - protein, 7 aa, Cryptosporidium parvum
TQNELGE

SEQ ID NO: 2285891 - protein, 5 aa, Cryptosporidium parvum
TQNER

SEQ ID NO: 2285892 - protein, 18 aa, Cryptosporidium parvum
TQNFEKDQQVYKRQKISD

SEQ ID NO: 2285893 - protein, 18 aa, Cryptosporidium parvum
TQNMSSSQANGISSVGNR

SEQ ID NO: 2285894 - protein, 11 aa, Cryptosporidium parvum
TQNNKESTANI

SEQ ID NO: 2285895 - protein, 11 aa, Cryptosporidium parvum
TQNNSPPANTD

SEQ ID NO: 2285896 - protein, 13 aa, Cryptosporidium parvum
TQNNSSHVSQGNN

SEQ ID NO: 2285897 - protein, 4 aa, Cryptosporidium parvum
TQNP

SEQ ID NO: 2285898 - protein, 9 aa, Cryptosporidium parvum
TQNPEADNS

SEQ ID NO: 2285899 - protein, 13 aa, Cryptosporidium parvum
TQNQEYDNDNSNW

SEQ ID NO: 2285900 - protein, 8 aa, Cryptosporidium parvum
TQNQKHTE

SEQ ID NO: 2285901 - protein, 4 aa, Cryptosporidium parvum
TQNR

SEQ ID NO: 2285902 - protein, 8 aa, Cryptosporidium parvum
TQNSGNEN

SEQ ID NO: 2285903 - protein, 9 aa, Cryptosporidium parvum
TQNSLGRPE

SEQ ID NO: 2285904 - protein, 7 aa, Cryptosporidium parvum
TQNSSNI

SEQ ID NO: 2285905 - protein, 9 aa, Cryptosporidium parvum
TQNTTNTTL

SEQ ID NO: 2285906 - protein, 7 aa, Cryptosporidium parvum
TQPDHHE

SEQ ID NO: 2285907 - protein, 17 aa, Cryptosporidium parvum
TQPNTKSSYKTSNECKD

SEQ ID NO: 2285908 - protein, 4 aa, Cryptosporidium parvum
TQPR

SEQ ID NO: 2285909 - protein, 5 aa, Cryptosporidium parvum
TQPSN

SEQ ID NO: 2285910 - protein, 30 aa, Cryptosporidium parvum
TQPSQPSQPSQPSQLTQPSQPSQPSQPTQF

SEQ ID NO: 2285911 - protein, 7 aa, Cryptosporidium parvum
TQQDENI

SEQ ID NO: 2285912 - protein, 11 aa, Cryptosporidium parvum
TQQENGPDCAR

SEQ ID NO: 2285913 - protein, 11 aa, Cryptosporidium parvum
TQQEREKQQLG

SEQ ID NO: 2285914 - protein, 4 aa, Cryptosporidium parvum
TQQG

SEQ ID NO: 2285915 - protein, 11 aa, Cryptosporidium parvum
TQQLANPFTET

SEQ ID NO: 2285916 - protein, 4 aa, Cryptosporidium parvum
TQQN

SEQ ID NO: 2285917 - protein, 5 aa, Cryptosporidium parvum
TQQSL

SEQ ID NO: 2285918 - protein, 9 aa, Cryptosporidium parvum
TQQSYGSSN

SEQ ID NO: 2285919 - protein, 9 aa, Cryptosporidium parvum
TQRKTPTQV

SEQ ID NO: 2285920 - protein, 4 aa, Cryptosporidium parvum
TQRL

SEQ ID NO: 2285921 - protein, 13 aa, Cryptosporidium parvum
TQRLNNKQDAYSI

SEQ ID NO: 2285922 - protein, 4 aa, Cryptosporidium parvum
TQRS

SEQ ID NO: 2285923 - protein, 7 aa, Cryptosporidium parvum
TQSAKCK

SEQ ID NO: 2285924 - protein, 10 aa, Cryptosporidium parvum
TQSDKNGRVS

SEQ ID NO: 2285925 - protein, 5 aa, Cryptosporidium parvum
TQSEF

SEQ ID NO: 2285926 - protein, 11 aa, Cryptosporidium parvum
TQSFSNPPSAL

SEQ ID NO: 2285927 - protein, 8 aa, Cryptosporidium parvum
TQSGGEGF

SEQ ID NO: 2285928 - protein, 7 aa, Cryptosporidium parvum
TQSGGVR

SEQ ID NO: 2285929 - protein, 7 aa, Cryptosporidium parvum
TQSINNE

SEQ ID NO: 2285930 - protein, 21 aa, Cryptosporidium parvum
TQSKGINLASEKSLSHSNNPL

SEQ ID NO: 2285931 - protein, 7 aa, Cryptosporidium parvum
TQSKINS

SEQ ID NO: 2285932 - protein, 20 aa, Cryptosporidium parvum
TQSKREKKSKNAARLQKEYS

SEQ ID NO: 2285933 - protein, 13 aa, Cryptosporidium parvum
TQSLKDKNDNHSL

SEQ ID NO: 2285934 - protein, 6 aa, Cryptosporidium parvum
TQSNKF

SEQ ID NO: 2285935 - protein, 8 aa, Cryptosporidium parvum
TQSPSNLT

SEQ ID NO: 2285936 - protein, 10 aa, Cryptosporidium parvum
TQSSLGGPKG

SEQ ID NO: 2285937 - protein, 11 aa, Cryptosporidium parvum
TQSSNNQNSGI

SEQ ID NO: 2285938 - protein, 6 aa, Cryptosporidium parvum
TQSSSC

SEQ ID NO: 2285939 - protein, 5 aa, Cryptosporidium parvum
TQSSV

SEQ ID NO: 2285940 - protein, 9 aa, Cryptosporidium parvum
TQSTPGGNI

SEQ ID NO: 2285941 - protein, 6 aa, Cryptosporidium parvum
TQSYEE

SEQ ID NO: 2285942 - protein, 5 aa, Cryptosporidium parvum
TQTDI

SEQ ID NO: 2285943 - protein, 7 aa, Cryptosporidium parvum
TQTGGVI

SEQ ID NO: 2285944 - protein, 10 aa, Cryptosporidium parvum
TQTNSGEKMD

SEQ ID NO: 2285945 - protein, 8 aa, Cryptosporidium parvum
TQTNSNEN

SEQ ID NO: 2285946 - protein, 4 aa, Cryptosporidium parvum
TQTS

SEQ ID NO: 2285947 - protein, 10 aa, Cryptosporidium parvum
TQTSYGPNSM

SEQ ID NO: 2285948 - protein, 5 aa, Cryptosporidium parvum
TQTYW

SEQ ID NO: 2285949 - protein, 11 aa, Cryptosporidium parvum
TQVEEEEREDR

SEQ ID NO: 2285950 - protein, 6 aa, Cryptosporidium parvum
TQYDTE

SEQ ID NO: 2285951 - protein, 11 aa, Cryptosporidium parvum
TQYNDGPVNSE

SEQ ID NO: 2285952 - protein, 26 aa, Cryptosporidium parvum
TQYTENSQYNSKINSGFQSSTNEDTT

SEQ ID NO: 2285953 - protein, 18 aa, Cryptosporidium parvum
TRAISSKSKPTSVCEEEE

SEQ ID NO: 2285954 - protein, 6 aa, Cryptosporidium parvum
TRCQPN

SEQ ID NO: 2285955 - protein, 6 aa, Cryptosporidium parvum
TRDEEY

SEQ ID NO: 2285956 - protein, 9 aa, Cryptosporidium parvum
TRDEQNPRS

SEQ ID NO: 2285957 - protein, 13 aa, Cryptosporidium parvum
TRDNTENEREDGE

SEQ ID NO: 2285958 - protein, 12 aa, Cryptosporidium parvum
TRDPTPPKSSCE

SEQ ID NO: 2285959 - protein, 17 aa, Cryptosporidium parvum
TREDDSIASQPSKQESK

SEQ ID NO: 2285960 - protein, 10 aa, Cryptosporidium parvum
TREIKNSCDN

SEQ ID NO: 2285961 - protein, 4 aa, Cryptosporidium parvum
TREL

SEQ ID NO: 2285962 - protein, 7 aa, Cryptosporidium parvum
TRENTTP

SEQ ID NO: 2285963 - protein, 5 aa, Cryptosporidium parvum
TREYA

SEQ ID NO: 2285964 - protein, 12 aa, Cryptosporidium parvum
TRFDSNNADESY

SEQ ID NO: 2285965 - protein, 9 aa, Cryptosporidium parvum
TRFPSSSNL

SEQ ID NO: 2285966 - protein, 25 aa, Cryptosporidium parvum
TRFTEARGGDCGNRENLINKLIDRM

SEQ ID NO: 2285967 - protein, 10 aa, Cryptosporidium parvum
TRGDEIDEEN

SEQ ID NO: 2285968 - protein, 30 aa, Cryptosporidium parvum
TRGETSGNNNSNRSFGNNSRSNNGNSSGKF

SEQ ID NO: 2285969 - protein, 6 aa, Cryptosporidium parvum
TRGRFS

SEQ ID NO: 2285970 - protein, 19 aa, Cryptosporidium parvum
TRGSGLSLSDNYDSLGGGI

SEQ ID NO: 2285971 - protein, 16 aa, Cryptosporidium parvum
TRGSTDQDSFSYNKNS

SEQ ID NO: 2285972 - protein, 6 aa, Cryptosporidium parvum
TRGTKE

SEQ ID NO: 2285973 - protein, 7 aa, Cryptosporidium parvum
TRGVGGG

SEQ ID NO: 2285974 - protein, 4 aa, Cryptosporidium parvum
TRGY

SEQ ID NO: 2285975 - protein, 6 aa, Cryptosporidium parvum
TRHANG

SEQ ID NO: 2285976 - protein, 5 aa, Cryptosporidium parvum
TRHRA

SEQ ID NO: 2285977 - protein, 14 aa, Cryptosporidium parvum
TRKADLKSTGDLKP

SEQ ID NO: 2285978 - protein, 10 aa, Cryptosporidium parvum
TRKDFKDTPC

SEQ ID NO: 2285979 - protein, 7 aa, Cryptosporidium parvum
TRKEPSI

SEQ ID NO: 2285980 - protein, 8 aa, Cryptosporidium parvum
TRKGYEPV

SEQ ID NO: 2285981 - protein, 7 aa, Cryptosporidium parvum
TRKGYQD

SEQ ID NO: 2285982 - protein, 10 aa, Cryptosporidium parvum
TRKKTNGESV

SEQ ID NO: 2285983 - protein, 7 aa, Cryptosporidium parvum
TRKPPKL

SEQ ID NO: 2285984 - protein, 23 aa, Cryptosporidium parvum
TRKSDVGNNNNNNNNNNSNTSEF

SEQ ID NO: 2285985 - protein, 9 aa, Cryptosporidium parvum
TRKSESLEN

SEQ ID NO: 2285986 - protein, 13 aa, Cryptosporidium parvum
TRKSPCGEGSKTW

SEQ ID NO: 2285987 - protein, 13 aa, Cryptosporidium parvum
TRLAPQEIKPQGR

SEQ ID NO: 2285988 - protein, 4 aa, Cryptosporidium parvum
TRLL

SEQ ID NO: 2285989 - protein, 5 aa, Cryptosporidium parvum
TRLPD

SEQ ID NO: 2285990 - protein, 6 aa, Cryptosporidium parvum
TRNDTI

SEQ ID NO: 2285991 - protein, 14 aa, Cryptosporidium parvum
TRNERSERQNSEDT

SEQ ID NO: 2285992 - protein, 18 aa, Cryptosporidium parvum
TRNNNSISKLNGKLTKKE

SEQ ID NO: 2285993 - protein, 14 aa, Cryptosporidium parvum
TRNNSNDRSNKQVQ

SEQ ID NO: 2285994 - protein, 7 aa, Cryptosporidium parvum
TRNPSPL

SEQ ID NO: 2285995 - protein, 15 aa, Cryptosporidium parvum
TRNQITTNNRVSSPI

SEQ ID NO: 2285996 - protein, 6 aa, Cryptosporidium parvum
TRNSRF

SEQ ID NO: 2285997 - protein, 26 aa, Cryptosporidium parvum
TRNSRKTKRRKQRKERMSNASKSIER

SEQ ID NO: 2285998 - protein, 10 aa, Cryptosporidium parvum
TRNTSNTANI

SEQ ID NO: 2285999 - protein, 5 aa, Cryptosporidium parvum
TRPKI

SEQ ID NO: 2286000 - protein, 5 aa, Cryptosporidium parvum
TRPRE

SEQ ID NO: 2286001 - protein, 22 aa, Cryptosporidium parvum
TRPSKRNLVETEEVKREGLTKP

SEQ ID NO: 2286002 - protein, 6 aa, Cryptosporidium parvum
TRPSSK

SEQ ID NO: 2286003 - protein, 7 aa, Cryptosporidium parvum
TRQRGNP

SEQ ID NO: 2286004 - protein, 6 aa, Cryptosporidium parvum
TRQYRS

SEQ ID NO: 2286005 - protein, 4 aa, Cryptosporidium parvum
TRRF

SEQ ID NO: 2286006 - protein, 4 aa, Cryptosporidium parvum
TRRN

SEQ ID NO: 2286007 - protein, 9 aa, Cryptosporidium parvum
TRRNESANA

SEQ ID NO: 2286008 - protein, 8 aa, Cryptosporidium parvum
TRRPRDAM

SEQ ID NO: 2286009 - protein, 7 aa, Cryptosporidium parvum
TRRQHRG

SEQ ID NO: 2286010 - protein, 11 aa, Cryptosporidium parvum
TRRRARGETPM

SEQ ID NO: 2286011 - protein, 18 aa, Cryptosporidium parvum
TRRSNGDLNKLPNEKDFE

SEQ ID NO: 2286012 - protein, 8 aa, Cryptosporidium parvum
TRSADEPM

SEQ ID NO: 2286013 - protein, 6 aa, Cryptosporidium parvum
TRSDWD

SEQ ID NO: 2286014 - protein, 10 aa, Cryptosporidium parvum
TRSEENNPTN

SEQ ID NO: 2286015 - protein, 9 aa, Cryptosporidium parvum
TRSEIAGRN

SEQ ID NO: 2286016 - protein, 13 aa, Cryptosporidium parvum
TRSESYDDKRNES

SEQ ID NO: 2286017 - protein, 7 aa, Cryptosporidium parvum
TRSGGVG

SEQ ID NO: 2286018 - protein, 7 aa, Cryptosporidium parvum
TRSIDKG

SEQ ID NO: 2286019 - protein, 17 aa, Cryptosporidium parvum
TRSNNNSETNNESQALE

SEQ ID NO: 2286020 - protein, 8 aa, Cryptosporidium parvum
TRSPHRPV

SEQ ID NO: 2286021 - protein, 27 aa, Cryptosporidium parvum
TRSPKSSKGSRSSKPSSILPGSRHRSS

SEQ ID NO: 2286022 - protein, 9 aa, Cryptosporidium parvum
TRSPTARDV

SEQ ID NO: 2286023 - protein, 4 aa, Cryptosporidium parvum
TRSQ

SEQ ID NO: 2286024 - protein, 45 aa, Cryptosporidium parvum
TRSSRTGRSTRSSGTNTRSTRSNSSLRSNRERRPSSHNTEPNLTT

SEQ ID NO: 2286025 - protein, 15 aa, Cryptosporidium parvum
TRTGVSDRIKTDEEI

SEQ ID NO: 2286026 - protein, 8 aa, Cryptosporidium parvum
TRTKVGAR

SEQ ID NO: 2286027 - protein, 9 aa, Cryptosporidium parvum
TRTLSGDSQ

SEQ ID NO: 2286028 - protein, 6 aa, Cryptosporidium parvum
TRTNDN

SEQ ID NO: 2286029 - protein, 5 aa, Cryptosporidium parvum
TRTSR

SEQ ID NO: 2286030 - protein, 8 aa, Cryptosporidium parvum
TRTTSGNR

SEQ ID NO: 2286031 - protein, 4 aa, Cryptosporidium parvum
TRTV

SEQ ID NO: 2286032 - protein, 13 aa, Cryptosporidium parvum
TRTVSGTEVEGRR

SEQ ID NO: 2286033 - protein, 6 aa, Cryptosporidium parvum
TRTYSE

SEQ ID NO: 2286034 - protein, 5 aa, Cryptosporidium parvum
TRYAQ

SEQ ID NO: 2286035 - protein, 9 aa, Cryptosporidium parvum
TRYNSSENC

SEQ ID NO: 2286036 - protein, 5 aa, Cryptosporidium parvum
TRYPE

SEQ ID NO: 2286037 - protein, 7 aa, Cryptosporidium parvum
TRYSPYQ

SEQ ID NO: 2286038 - protein, 6 aa, Cryptosporidium parvum
TSADKL

SEQ ID NO: 2286039 - protein, 7 aa, Cryptosporidium parvum
TSADKSQ

SEQ ID NO: 2286040 - protein, 8 aa, Cryptosporidium parvum
TSAGKTAV

SEQ ID NO: 2286041 - protein, 8 aa, Cryptosporidium parvum
TSAKTGYN

SEQ ID NO: 2286042 - protein, 20 aa, Cryptosporidium parvum
TSANSGKRISDIGDQAQDHS

SEQ ID NO: 2286043 - protein, 10 aa, Cryptosporidium parvum
TSAPDVVSGP

SEQ ID NO: 2286044 - protein, 20 aa, Cryptosporidium parvum
TSAPEEPPKEDPAKKPPKKH

SEQ ID NO: 2286045 - protein, 33 aa, Cryptosporidium parvum
TSAPEEPPKEEEKKEEKKEDETPPPPPPAEESS

SEQ ID NO: 2286046 - protein, 8 aa, Cryptosporidium parvum
TSAPPNYC

SEQ ID NO: 2286047 - protein, 4 aa, Cryptosporidium parvum
TSAS

SEQ ID NO: 2286048 - protein, 8 aa, Cryptosporidium parvum
TSASSLSK

SEQ ID NO: 2286049 - protein, 14 aa, Cryptosporidium parvum
TSASSNEQTDQNPL

SEQ ID NO: 2286050 - protein, 13 aa, Cryptosporidium parvum
TSASTTAPSCNTT

SEQ ID NO: 2286051 - protein, 8 aa, Cryptosporidium parvum
TSAVSGRT

SEQ ID NO: 2286052 - protein, 9 aa, Cryptosporidium parvum
TSCNSSSHI

SEQ ID NO: 2286053 - protein, 4 aa, Cryptosporidium parvum
TSCS

SEQ ID NO: 2286054 - protein, 6 aa, Cryptosporidium parvum
TSCTEG

SEQ ID NO: 2286055 - protein, 6 aa, Cryptosporidium parvum
TSDDPV

SEQ ID NO: 2286056 - protein, 14 aa, Cryptosporidium parvum
TSDDVQDVSPDDAS

SEQ ID NO: 2286057 - protein, 9 aa, Cryptosporidium parvum
TSDEGMNTN

SEQ ID NO: 2286058 - protein, 10 aa, Cryptosporidium parvum
TSDEIEPNFS

SEQ ID NO: 2286059 - protein, 36 aa, Cryptosporidium parvum
TSDEQKNKEKEEQKKKQEEQRKDKEKEKDKEQTNLP

SEQ ID NO: 2286060 - protein, 6 aa, Cryptosporidium parvum
TSDERA

SEQ ID NO: 2286061 - protein, 9 aa, Cryptosporidium parvum
TSDETGEEI

SEQ ID NO: 2286062 - protein, 7 aa, Cryptosporidium parvum
TSDGKNF

SEQ ID NO: 2286063 - protein, 8 aa, Cryptosporidium parvum
TSDGKPYY

SEQ ID NO: 2286064 - protein, 11 aa, Cryptosporidium parvum
TSDKDKKATIQ

SEQ ID NO: 2286065 - protein, 4 aa, Cryptosporidium parvum
TSDL

SEQ ID NO: 2286066 - protein, 6 aa, Cryptosporidium parvum
TSDLNS

SEQ ID NO: 2286067 - protein, 4 aa, Cryptosporidium parvum
TSDN

SEQ ID NO: 2286068 - protein, 9 aa, Cryptosporidium parvum
TSDPSSNTY

SEQ ID NO: 2286069 - protein, 30 aa, Cryptosporidium parvum
TSDQKNIESTISEPMNDGDPAKNFQNDPCA

SEQ ID NO: 2286070 - protein, 15 aa, Cryptosporidium parvum
TSDRSIQEKKLESKL

SEQ ID NO: 2286071 - protein, 41 aa, Cryptosporidium parvum
TSDSNQSSSIKENEVSSSETHLNDNQPHDTPAISGARRRSV

SEQ ID NO: 2286072 - protein, 6 aa, Cryptosporidium parvum
TSDSTF

SEQ ID NO: 2286073 - protein, 8 aa, Cryptosporidium parvum
TSDTDKSD

SEQ ID NO: 2286074 - protein, 12 aa, Cryptosporidium parvum
TSEASSKLSNNE

SEQ ID NO: 2286075 - protein, 7 aa, Cryptosporidium parvum
TSEERSS

SEQ ID NO: 2286076 - protein, 6 aa, Cryptosporidium parvum
TSEERY

SEQ ID NO: 2286077 - protein, 5 aa, Cryptosporidium parvum
TSEEY

SEQ ID NO: 2286078 - protein, 12 aa, Cryptosporidium parvum
TSEHAEKGFTPT

SEQ ID NO: 2286079 - protein, 18 aa, Cryptosporidium parvum
TSEHAEKHSVHKSSLSGI

SEQ ID NO: 2286080 - protein, 5 aa, Cryptosporidium parvum
TSEHG

SEQ ID NO: 2286081 - protein, 4 aa, Cryptosporidium parvum
TSEI

SEQ ID NO: 2286082 - protein, 6 aa, Cryptosporidium parvum
TSEIPT

SEQ ID NO: 2286083 - protein, 13 aa, Cryptosporidium parvum
TSEISQTKSYSDY

SEQ ID NO: 2286084 - protein, 8 aa, Cryptosporidium parvum
TSEKGKKQ

SEQ ID NO: 2286085 - protein, 6 aa, Cryptosporidium parvum
TSEKQG

SEQ ID NO: 2286086 - protein, 5 aa, Cryptosporidium parvum
TSEKV

SEQ ID NO: 2286087 - protein, 7 aa, Cryptosporidium parvum
TSENAKE

SEQ ID NO: 2286088 - protein, 5 aa, Cryptosporidium parvum
TSENN

SEQ ID NO: 2286089 - protein, 13 aa, Cryptosporidium parvum
TSENTQISKNNNM

SEQ ID NO: 2286090 - protein, 22 aa, Cryptosporidium parvum
TSERAEQRLKHNRSSSSGSNIY

SEQ ID NO: 2286091 - protein, 6 aa, Cryptosporidium parvum
TSESDQ

SEQ ID NO: 2286092 - protein, 46 aa, Cryptosporidium parvum
TSESGVDINNRTESNSTEVIPTSEASKSTTASASPLNQSQSCKDEL

SEQ ID NO: 2286093 - protein, 5 aa, Cryptosporidium parvum
TSESK

SEQ ID NO: 2286094 - protein, 5 aa, Cryptosporidium parvum
TSETA

SEQ ID NO: 2286095 - protein, 8 aa, Cryptosporidium parvum
TSETNAGN

SEQ ID NO: 2286096 - protein, 9 aa, Cryptosporidium parvum
TSEVETDRE

SEQ ID NO: 2286097 - protein, 5 aa, Cryptosporidium parvum
TSEYE

SEQ ID NO: 2286098 - protein, 4 aa, Cryptosporidium parvum
TSFD

SEQ ID NO: 2286099 - protein, 4 aa, Cryptosporidium parvum
TSFE

SEQ ID NO: 2286100 - protein, 4 aa, Cryptosporidium parvum
TSFI

SEQ ID NO: 2286101 - protein, 15 aa, Cryptosporidium parvum
TSFIGNEDSQYYTRE

SEQ ID NO: 2286102 - protein, 7 aa, Cryptosporidium parvum
TSFSPPE

SEQ ID NO: 2286103 - protein, 5 aa, Cryptosporidium parvum
TSGAD

SEQ ID NO: 2286104 - protein, 5 aa, Cryptosporidium parvum
TSGEH

SEQ ID NO: 2286105 - protein, 10 aa, Cryptosporidium parvum
TSGEQPTSIE

SEQ ID NO: 2286106 - protein, 7 aa, Cryptosporidium parvum
TSGETLT

SEQ ID NO: 2286107 - protein, 5 aa, Cryptosporidium parvum
TSGFS

SEQ ID NO: 2286108 - protein, 20 aa, Cryptosporidium parvum
TSGGNSNGKSGSGSSSNSML

SEQ ID NO: 2286109 - protein, 5 aa, Cryptosporidium parvum
TSGIG

SEQ ID NO: 2286110 - protein, 5 aa, Cryptosporidium parvum
TSGKF

SEQ ID NO: 2286111 - protein, 30 aa, Cryptosporidium parvum; identical to SEQ ID NO: 2165789

SEQ ID NO: 2286112 - protein, 8 aa, Cryptosporidium parvum
TSGKIGLS

SEQ ID NO: 2286113 - protein, 10 aa, Cryptosporidium parvum
TSGKSKSENH

SEQ ID NO: 2286114 - protein, 5 aa, Cryptosporidium parvum
TSGQA

SEQ ID NO: 2286115 - protein, 8 aa, Cryptosporidium parvum
TSGSESRK

SEQ ID NO: 2286116 - protein, 8 aa, Cryptosporidium parvum
TSGSGANV

SEQ ID NO: 2286117 - protein, 11 aa, Cryptosporidium parvum
TSGSGKSTISS

SEQ ID NO: 2286118 - protein, 14 aa, Cryptosporidium parvum
TSGSGRRKDGKYTM

SEQ ID NO: 2286119 - protein, 6 aa, Cryptosporidium parvum
TSGSIH

SEQ ID NO: 2286120 - protein, 11 aa, Cryptosporidium parvum
TSGTITPEEAS

SEQ ID NO: 2286121 - protein, 9 aa, Cryptosporidium parvum
TSGTSGTIK

SEQ ID NO: 2286122 - protein, 12 aa, Cryptosporidium parvum
TSGTTGNPKGAV

SEQ ID NO: 2286123 - protein, 8 aa, Cryptosporidium parvum
TSHNVPSE

SEQ ID NO: 2286124 - protein, 5 aa, Cryptosporidium parvum
TSHPM

SEQ ID NO: 2286125 - protein, 13 aa, Cryptosporidium parvum
TSIASNNANRYQP

SEQ ID NO: 2286126 - protein, 5 aa, Cryptosporidium parvum
TSIDS

SEQ ID NO: 2286127 - protein, 4 aa, Cryptosporidium parvum
TSIE

SEQ ID NO: 2286128 - protein, 5 aa, Cryptosporidium parvum
TSIGP

SEQ ID NO: 2286129 - protein, 5 aa, Cryptosporidium parvum
TSINP

SEQ ID NO: 2286130 - protein, 85 aa, Cryptosporidium parvum
TSIQDSAVNAASTTVKMPSSKSISSKSAISSLPKPKAKSAVKSAPATEENNGDQTISEPASISEVKSKAGSKSMPVSKSKSVIKA

SEQ ID NO: 2286131 - protein, 4 aa, Cryptosporidium parvum
TSIS

SEQ ID NO: 2286132 - protein, 22 aa, Cryptosporidium parvum
TSISESQNGISDEISSNNNISQ

SEQ ID NO: 2286133 - protein, 11 aa, Cryptosporidium parvum
TSISPASRKKG

SEQ ID NO: 2286134 - protein, 19 aa, Cryptosporidium parvum
TSISQITGSSSFKDKNRKI

SEQ ID NO: 2286135 - protein, 20 aa, Cryptosporidium parvum
TSISSKVSDKIDNSERVPSS

SEQ ID NO: 2286136 - protein, 9 aa, Cryptosporidium parvum
TSITDREKN

SEQ ID NO: 2286137 - protein, 4 aa, Cryptosporidium parvum
TSIV

SEQ ID NO: 2286138 - protein, 22 aa, Cryptosporidium parvum
TSKDEDNKNSKLNNSQNCNSNI

SEQ ID NO: 2286139 - protein, 11 aa, Cryptosporidium parvum
TSKDGSSLSSQ

SEQ ID NO: 2286140 - protein, 7 aa, Cryptosporidium parvum
TSKDIKS

SEQ ID NO: 2286141 - protein, 9 aa, Cryptosporidium parvum
TSKEAVQEI

SEQ ID NO: 2286142 - protein, 6 aa, Cryptosporidium parvum
TSKENE

SEQ ID NO: 2286143 - protein, 5 aa, Cryptosporidium parvum
TSKGN

SEQ ID NO: 2286144 - protein, 11 aa, Cryptosporidium parvum
TSKGSKRIKDT

SEQ ID NO: 2286145 - protein, 7 aa, Cryptosporidium parvum
TSKGSYE

SEQ ID NO: 2286146 - protein, 19 aa, Cryptosporidium parvum
TSKIISSKKRKYGENEVKS

SEQ ID NO: 2286147 - protein, 8 aa, Cryptosporidium parvum
TSKLSSNE

SEQ ID NO: 2286148 - protein, 11 aa, Cryptosporidium parvum
TSKNEKSDEKR

SEQ ID NO: 2286149 - protein, 5 aa, Cryptosporidium parvum
TSKNF

SEQ ID NO: 2286150 - protein, 16 aa, Cryptosporidium parvum
TSKNHQVTDDHHHDQQ

SEQ ID NO: 2286151 - protein, 16 aa, Cryptosporidium parvum
TSKNKEIDSVGEKSNG

SEQ ID NO: 2286152 - protein, 9 aa, Cryptosporidium parvum
TSKNKSPQY

SEQ ID NO: 2286153 - protein, 8 aa, Cryptosporidium parvum
TSKNLNDD

SEQ ID NO: 2286154 - protein, 7 aa, Cryptosporidium parvum
TSKNNNA

SEQ ID NO: 2286155 - protein, 9 aa, Cryptosporidium parvum
TSKNSRRIR

SEQ ID NO: 2286156 - protein, 8 aa, Cryptosporidium parvum
TSKPDFDS

SEQ ID NO: 2286157 - protein, 23 aa, Cryptosporidium parvum
TSKREKAPGIDKSNVEDESTPPY

SEQ ID NO: 2286158 - protein, 4 aa, Cryptosporidium parvum
TSKS

SEQ ID NO: 2286159 - protein, 96 aa, Cryptosporidium parvum
TSKSKKSISSLKSKVSKLSSSISKANSSQEIQSQEDPNQEDPSQEDPNQEDPSQEDPTQEVQSQEEPIQEDQSQETQSQETQSQEIQSQEAKVEDN

SEQ ID NO: 2286160 - protein, 12 aa, Cryptosporidium parvum
TSKSNTKNDQPV

SEQ ID NO: 2286161 - protein, 15 aa, Cryptosporidium parvum
TSKSRADKKDNSIHS

SEQ ID NO: 2286162 - protein, 20 aa, Cryptosporidium parvum
TSKSSKKNQIISKEKTHKNL

SEQ ID NO: 2286163 - protein, 5 aa, Cryptosporidium parvum
TSKST

SEQ ID NO: 2286164 - protein, 8 aa, Cryptosporidium parvum
TSKTEMSD

SEQ ID NO: 2286165 - protein, 12 aa, Cryptosporidium parvum
TSKTNLDSSENN

SEQ ID NO: 2286166 - protein, 4 aa, Cryptosporidium parvum
TSKV

SEQ ID NO: 2286167 - protein, 29 aa, Cryptosporidium parvum
TSKYSNERKRRRDLSHRKKTKSQQNVSTE

SEQ ID NO: 2286168 - protein, 4 aa, Cryptosporidium parvum
TSLD

SEQ ID NO: 2286169 - protein, 8 aa, Cryptosporidium parvum
TSLDDSDS

SEQ ID NO: 2286170 - protein, 10 aa, Cryptosporidium parvum
TSLDNEDKSQ

SEQ ID NO: 2286171 - protein, 15 aa, Cryptosporidium parvum
TSLEDGKLSEKGLEN

SEQ ID NO: 2286172 - protein, 18 aa, Cryptosporidium parvum
TSLEQSNDKRVLSSTSFD

SEQ ID NO: 2286173 - protein, 14 aa, Cryptosporidium parvum
TSLGNVDSKYKQQM

SEQ ID NO: 2286174 - protein, 7 aa, Cryptosporidium parvum
TSLHGGK

SEQ ID NO: 2286175 - protein, 14 aa, Cryptosporidium parvum
TSLKGLNSNQINSP

SEQ ID NO: 2286176 - protein, 9 aa, Cryptosporidium parvum
TSLQTQPQA

SEQ ID NO: 2286177 - protein, 6 aa, Cryptosporidium parvum
TSLRGA

SEQ ID NO: 2286178 - protein, 4 aa, Cryptosporidium parvum
TSLS

SEQ ID NO: 2286179 - protein, 9 aa, Cryptosporidium parvum
TSLSNAKEL

SEQ ID NO: 2286180 - protein, 14 aa, Cryptosporidium parvum
TSLSSTSVSLGETS

SEQ ID NO: 2286181 - protein, 6 aa, Cryptosporidium parvum
TSLTST

SEQ ID NO: 2286182 - protein, 20 aa, Cryptosporidium parvum
TSLTSTMSSSSSSSSSSSSL

SEQ ID NO: 2286183 - protein, 5 aa, Cryptosporidium parvum
TSLYS

SEQ ID NO: 2286184 - protein, 5 aa, Cryptosporidium parvum
TSNCS

SEQ ID NO: 2286185 - protein, 8 aa, Cryptosporidium parvum
TSNDIRTN

SEQ ID NO: 2286186 - protein, 13 aa, Cryptosporidium parvum
TSNDYYPQGDQVK

SEQ ID NO: 2286187 - protein, 5 aa, Cryptosporidium parvum
TSNEK

SEQ ID NO: 2286188 - protein, 13 aa, Cryptosporidium parvum
TSNEVNKSGAQIS

SEQ ID NO: 2286189 - protein, 4 aa, Cryptosporidium parvum
TSNG

SEQ ID NO: 2286190 - protein, 19 aa, Cryptosporidium parvum
TSNGESQSYNEQIEDETDE

SEQ ID NO: 2286191 - protein, 6 aa, Cryptosporidium parvum
TSNGIY

SEQ ID NO: 2286192 - protein, 12 aa, Cryptosporidium parvum
TSNGNSLDTREI

SEQ ID NO: 2286193 - protein, 7 aa, Cryptosporidium parvum
TSNINPA

SEQ ID NO: 2286194 - protein, 15 aa, Cryptosporidium parvum
TSNLESNNYLSESSE

SEQ ID NO: 2286195 - protein, 8 aa, Cryptosporidium parvum
TSNLNNSS

SEQ ID NO: 2286196 - protein, 5 aa, Cryptosporidium parvum
TSNLP

SEQ ID NO: 2286197 - protein, 20 aa, Cryptosporidium parvum
TSNLPGPQNSAIRSPPNVGD

SEQ ID NO: 2286198 - protein, 29 aa, Cryptosporidium parvum
TSNLSTPQLRRNNERKDESQINQNIPKNN

SEQ ID NO: 2286199 - protein, 9 aa, Cryptosporidium parvum
TSNNLGISS

SEQ ID NO: 2286200 - protein, 6 aa, Cryptosporidium parvum
TSNNNK

SEQ ID NO: 2286201 - protein, 18 aa, Cryptosporidium parvum
TSNNSDTEKQKSNINIEE

SEQ ID NO: 2286202 - protein, 12 aa, Cryptosporidium parvum
TSNNTNKNLNKD

SEQ ID NO: 2286203 - protein, 15 aa, Cryptosporidium parvum
TSNPINTTTILKNGD

SEQ ID NO: 2286204 - protein, 6 aa, Cryptosporidium parvum
TSNSDG

SEQ ID NO: 2286205 - protein, 7 aa, Cryptosporidium parvum
TSNSNKF

SEQ ID NO: 2286206 - protein, 8 aa, Cryptosporidium parvum
TSNSNNTE

SEQ ID NO: 2286207 - protein, 12 aa, Cryptosporidium parvum
TSNSTLESDSSS

SEQ ID NO: 2286208 - protein, 13 aa, Cryptosporidium parvum
TSNTGFGNNSSTK

SEQ ID NO: 2286209 - protein, 8 aa, Cryptosporidium parvum
TSNTNYGT

SEQ ID NO: 2286210 - protein, 5 aa, Cryptosporidium parvum
TSNTY

SEQ ID NO: 2286211 - protein, 5 aa, Cryptosporidium parvum
TSNWE

SEQ ID NO: 2286212 - protein, 5 aa, Cryptosporidium parvum
TSPAR

SEQ ID NO: 2286213 - protein, 7 aa, Cryptosporidium parvum
TSPDSLE

SEQ ID NO: 2286214 - protein, 14 aa, Cryptosporidium parvum
TSPDSSNNGNSVSL

SEQ ID NO: 2286215 - protein, 6 aa, Cryptosporidium parvum
TSPEDL

SEQ ID NO: 2286216 - protein, 11 aa, Cryptosporidium parvum
TSPGGRMEQVE

SEQ ID NO: 2286217 - protein, 9 aa, Cryptosporidium parvum
TSPKHINSE

SEQ ID NO: 2286218 - protein, 17 aa, Cryptosporidium parvum
TSPKSTIEDYEEKVESN

SEQ ID NO: 2286219 - protein, 6 aa, Cryptosporidium parvum
TSPNTV

SEQ ID NO: 2286220 - protein, 6 aa, Cryptosporidium parvum
TSPPEV

SEQ ID NO: 2286221 - protein, 12 aa, Cryptosporidium parvum
TSPPPPKPQQGL

SEQ ID NO: 2286222 - protein, 7 aa, Cryptosporidium parvum
TSPRKEM

SEQ ID NO: 2286223 - protein, 14 aa, Cryptosporidium parvum
TSPSGITSKTSSIN

SEQ ID NO: 2286224 - protein, 29 aa, Cryptosporidium parvum
TSPVAGLGSSVTRSSQNKRSSALRKAPQD

SEQ ID NO: 2286225 - protein, 9 aa, Cryptosporidium parvum
TSPYDKPTH

SEQ ID NO: 2286226 - protein, 11 aa, Cryptosporidium parvum
TSPYNADFDGD

SEQ ID NO: 2286227 - protein, 11 aa, Cryptosporidium parvum
TSQASNETQNK

SEQ ID NO: 2286228 - protein, 8 aa, Cryptosporidium parvum
TSQDASIT

SEQ ID NO: 2286229 - protein, 11 aa, Cryptosporidium parvum
TSQEDGSGHDG

SEQ ID NO: 2286230 - protein, 5 aa, Cryptosporidium parvum
TSQEF

SEQ ID NO: 2286231 - protein, 15 aa, Cryptosporidium parvum
TSQINNSKGGQVNQE

SEQ ID NO: 2286232 - protein, 5 aa, Cryptosporidium parvum
TSQKH

SEQ ID NO: 2286233 - protein, 13 aa, Cryptosporidium parvum
TSQNIDDNNNSID

SEQ ID NO: 2286234 - protein, 15 aa, Cryptosporidium parvum
TSQQNKNVNKNYLYK

SEQ ID NO: 2286235 - protein, 6 aa, Cryptosporidium parvum
TSQQRE

SEQ ID NO: 2286236 - protein, 19 aa, Cryptosporidium parvum
TSQRSRENVPTGEAESLAG

SEQ ID NO: 2286237 - protein, 5 aa, Cryptosporidium parvum
TSQVG

SEQ ID NO: 2286238 - protein, 8 aa, Cryptosporidium parvum
TSRDGTLS

SEQ ID NO: 2286239 - protein, 10 aa, Cryptosporidium parvum
TSRDLESKKE

SEQ ID NO: 2286240 - protein, 4 aa, Cryptosporidium parvum
TSRE

SEQ ID NO: 2286241 - protein, 5 aa, Cryptosporidium parvum
TSRES

SEQ ID NO: 2286242 - protein, 10 aa, Cryptosporidium parvum
TSRESNTKSN

SEQ ID NO: 2286243 - protein, 6 aa, Cryptosporidium parvum
TSREYP

SEQ ID NO: 2286244 - protein, 15 aa, Cryptosporidium parvum
TSRGDTRNQMAEGSS

SEQ ID NO: 2286245 - protein, 7 aa, Cryptosporidium parvum
TSRGEKE

SEQ ID NO: 2286246 - protein, 15 aa, Cryptosporidium parvum
TSRNPTKPPGYENED

SEQ ID NO: 2286247 - protein, 5 aa, Cryptosporidium parvum
TSRQE

SEQ ID NO: 2286248 - protein, 9 aa, Cryptosporidium parvum
TSRRADARS

SEQ ID NO: 2286249 - protein, 13 aa, Cryptosporidium parvum
TSRRDGLNAPPVS

SEQ ID NO: 2286250 - protein, 6 aa, Cryptosporidium parvum
TSRRRE

SEQ ID NO: 2286251 - protein, 9 aa, Cryptosporidium parvum
TSRSDKTFS

SEQ ID NO: 2286252 - protein, 17 aa, Cryptosporidium parvum
TSRSGKKNSSGSLTGSM

SEQ ID NO: 2286253 - protein, 13 aa, Cryptosporidium parvum
TSRSPRGKESNGV

SEQ ID NO: 2286254 - protein, 8 aa, Cryptosporidium parvum
TSRSPSSR

SEQ ID NO: 2286255 - protein, 13 aa, Cryptosporidium parvum
TSRSSKFSDRMKS

SEQ ID NO: 2286256 - protein, 9 aa, Cryptosporidium parvum
TSRTEKEYD

SEQ ID NO: 2286257 - protein, 6 aa, Cryptosporidium parvum
TSSDDD

SEQ ID NO: 2286258 - protein, 8 aa, Cryptosporidium parvum
TSSDDRSI

SEQ ID NO: 2286259 - protein, 11 aa, Cryptosporidium parvum
TSSDSKPHVGF

SEQ ID NO: 2286260 - protein, 4 aa, Cryptosporidium parvum
TSSE

SEQ ID NO: 2286261 - protein, 16 aa, Cryptosporidium parvum
TSSEDNEYEKSKNKYG

SEQ ID NO: 2286262 - protein, 10 aa, Cryptosporidium parvum
TSSEKEDHKV

SEQ ID NO: 2286263 - protein, 5 aa, Cryptosporidium parvum
TSSEL

SEQ ID NO: 2286264 - protein, 37 aa, Cryptosporidium parvum
TSSEQINGSCGNNGNSAKLPKDDQNNQSNNSSSQKQL

SEQ ID NO: 2286265 - protein, 15 aa, Cryptosporidium parvum
TSSFGKKASRSSNTS

SEQ ID NO: 2286266 - protein, 8 aa, Cryptosporidium parvum
TSSGDSIA

SEQ ID NO: 2286267 - protein, 4 aa, Cryptosporidium parvum
TSSI

SEQ ID NO: 2286268 - protein, 11 aa, Cryptosporidium parvum
TSSIGKDCSIG

SEQ ID NO: 2286269 - protein, 6 aa, Cryptosporidium parvum
TSSITV

SEQ ID NO: 2286270 - protein, 6 aa, Cryptosporidium parvum
TSSKDI

SEQ ID NO: 2286271 - protein, 18 aa, Cryptosporidium parvum
TSSKTGNKKLGNQNTGKA

SEQ ID NO: 2286272 - protein, 8 aa, Cryptosporidium parvum
TSSLQGHK

SEQ ID NO: 2286273 - protein, 6 aa, Cryptosporidium parvum
TSSLSG

SEQ ID NO: 2286274 - protein, 9 aa, Cryptosporidium parvum
TSSNSVNTS

SEQ ID NO: 2286275 - protein, 9 aa, Cryptosporidium parvum
TSSNTNVEL

SEQ ID NO: 2286276 - protein, 23 aa, Cryptosporidium parvum
TSSNYTNSSEESLNKESYSGNQR

SEQ ID NO: 2286277 - protein, 8 aa, Cryptosporidium parvum
TSSPAERV

SEQ ID NO: 2286278 - protein, 8 aa, Cryptosporidium parvum
TSSPDPNL

SEQ ID NO: 2286279 - protein, 5 aa, Cryptosporidium parvum
TSSPG

SEQ ID NO: 2286280 - protein, 6 aa, Cryptosporidium parvum
TSSPLL

SEQ ID NO: 2286281 - protein, 8 aa, Cryptosporidium parvum
TSSPQMSA

SEQ ID NO: 2286282 - protein, 4 aa, Cryptosporidium parvum
TSSQ

SEQ ID NO: 2286283 - protein, 6 aa, Cryptosporidium parvum
TSSQDN

SEQ ID NO: 2286284 - protein, 11 aa, Cryptosporidium parvum
TSSRGCTKTRG

SEQ ID NO: 2286285 - protein, 23 aa, Cryptosporidium parvum
TSSSNSDKEMIDNNGEIKYEEEE

SEQ ID NO: 2286286 - protein, 8 aa, Cryptosporidium parvum
TSSSPDIA

SEQ ID NO: 2286287 - protein, 8 aa, Cryptosporidium parvum
TSSTNSSQ

SEQ ID NO: 2286288 - protein, 15 aa, Cryptosporidium parvum
TSSTSTNSGNSGDIV

SEQ ID NO: 2286289 - protein, 8 aa, Cryptosporidium parvum
TSSVQVEN

SEQ ID NO: 2286290 - protein, 13 aa, Cryptosporidium parvum
TSSVREKTRRPVY

SEQ ID NO: 2286291 - protein, 4 aa, Cryptosporidium parvum
TSSY

SEQ ID NO: 2286292 - protein, 4 aa, Cryptosporidium parvum
TSTD

SEQ ID NO: 2286293 - protein, 8 aa, Cryptosporidium parvum
TSTETNKL

SEQ ID NO: 2286294 - protein, 7 aa, Cryptosporidium parvum
TSTEYTK

SEQ ID NO: 2286295 - protein, 12 aa, Cryptosporidium parvum
TSTFEDTQGLEK

SEQ ID NO: 2286296 - protein, 8 aa, Cryptosporidium parvum
TSTFGTDQ

SEQ ID NO: 2286297 - protein, 13 aa, Cryptosporidium parvum
TSTINEKDQVDQK

SEQ ID NO: 2286298 - protein, 4 aa, Cryptosporidium parvum
TSTK

SEQ ID NO: 2286299 - protein, 13 aa, Cryptosporidium parvum
TSTLTNSRTGKLS

SEQ ID NO: 2286300 - protein, 9 aa, Cryptosporidium parvum
TSTNEKLTS

SEQ ID NO: 2286301 - protein, 5 aa, Cryptosporidium parvum
TSTQQ

SEQ ID NO: 2286302 - protein, 5 aa, Cryptosporidium parvum
TSTSL

SEQ ID NO: 2286303 - protein, 13 aa, Cryptosporidium parvum
TSTSTNDQSITSE

SEQ ID NO: 2286304 - protein, 10 aa, Cryptosporidium parvum
TSTTAESKSR

SEQ ID NO: 2286305 - protein, 7 aa, Cryptosporidium parvum
TSTTESY

SEQ ID NO: 2286306 - protein, 8 aa, Cryptosporidium parvum
TSTTSEQI

SEQ ID NO: 2286307 - protein, 13 aa, Cryptosporidium parvum
TSTVSVDTRARED

SEQ ID NO: 2286308 - protein, 11 aa, Cryptosporidium parvum
TSVNQKSNHSK

SEQ ID NO: 2286309 - protein, 5 aa, Cryptosporidium parvum
TSVPA

SEQ ID NO: 2286310 - protein, 5 aa, Cryptosporidium parvum
TSVPE

SEQ ID NO: 2286311 - protein, 7 aa, Cryptosporidium parvum
TSVPKSG

SEQ ID NO: 2286312 - protein, 16 aa, Cryptosporidium parvum
TSVSSTLESEEEITTE

SEQ ID NO: 2286313 - protein, 12 aa, Cryptosporidium parvum
TSVTNQNIQNDS

SEQ ID NO: 2286314 - protein, 5 aa, Cryptosporidium parvum
TSYRG

SEQ ID NO: 2286315 - protein, 30 aa, Cryptosporidium parvum
TSYSGNSNNNNNSNSGHNNGNGSARGSQQL

SEQ ID NO: 2286316 - protein, 6 aa, Cryptosporidium parvum
TSYSIG

SEQ ID NO: 2286317 - protein, 19 aa, Cryptosporidium parvum
TSYSQISSSAKYTVTPNPS

SEQ ID NO: 2286318 - protein, 7 aa, Cryptosporidium parvum
TTANPFP

SEQ ID NO: 2286319 - protein, 11 aa, Cryptosporidium parvum
TTARSTYSLKQ

SEQ ID NO: 2286320 - protein, 8 aa, Cryptosporidium parvum
TTASSSDQ

SEQ ID NO: 2286321 - protein, 4 aa, Cryptosporidium parvum
TTCS

SEQ ID NO: 2286322 - protein, 7 aa, Cryptosporidium parvum
TTDDPNY

SEQ ID NO: 2286323 - protein, 6 aa, Cryptosporidium parvum
TTDDTK

SEQ ID NO: 2286324 - protein, 9 aa, Cryptosporidium parvum
TTDEGSVGG

SEQ ID NO: 2286325 - protein, 11 aa, Cryptosporidium parvum
TTDKDSKVTYK

SEQ ID NO: 2286326 - protein, 8 aa, Cryptosporidium parvum
TTDNFSEE

SEQ ID NO: 2286327 - protein, 7 aa, Cryptosporidium parvum
TTEDAQE

SEQ ID NO: 2286328 - protein, 15 aa, Cryptosporidium parvum
TTEEQEDDLNNDMPA

SEQ ID NO: 2286329 - protein, 11 aa, Cryptosporidium parvum
TTEGEKVKSRF

SEQ ID NO: 2286330 - protein, 10 aa, Cryptosporidium parvum
TTEGPRNVGG

SEQ ID NO: 2286331 - protein, 7 aa, Cryptosporidium parvum
TTEHPTG

SEQ ID NO: 2286332 - protein, 9 aa, Cryptosporidium parvum
TTEINQRAK

SEQ ID NO: 2286333 - protein, 8 aa, Cryptosporidium parvum
TTEKNSMD

SEQ ID NO: 2286334 - protein, 8 aa, Cryptosporidium parvum
TTENDNNR

SEQ ID NO: 2286335 - protein, 11 aa, Cryptosporidium parvum
TTENMNSENTI

SEQ ID NO: 2286336 - protein, 10 aa, Cryptosporidium parvum
TTENNSTKNM

SEQ ID NO: 2286337 - protein, 12 aa, Cryptosporidium parvum
TTENSNNQNTDI

SEQ ID NO: 2286338 - protein, 16 aa, Cryptosporidium parvum
TTEQDRWREAKEGFKT

SEQ ID NO: 2286339 - protein, 9 aa, Cryptosporidium parvum
TTEQEENKP

SEQ ID NO: 2286340 - protein, 9 aa, Cryptosporidium parvum
TTEQPESLS

SEQ ID NO: 2286341 - protein, 11 aa, Cryptosporidium parvum
TTESKGATPCE

SEQ ID NO: 2286342 - protein, 4 aa, Cryptosporidium parvum
TTET

SEQ ID NO: 2286343 - protein, 7 aa, Cryptosporidium parvum
TTFRRSD

SEQ ID NO: 2286344 - protein, 9 aa, Cryptosporidium parvum
TTGDEDIQS

SEQ ID NO: 2286345 - protein, 6 aa, Cryptosporidium parvum
TTGDTI

SEQ ID NO: 2286346 - protein, 10 aa, Cryptosporidium parvum
TTGEPVPAND

SEQ ID NO: 2286347 - protein, 7 aa, Cryptosporidium parvum
TTGFPNS

SEQ ID NO: 2286348 - protein, 12 aa, Cryptosporidium parvum
TTGKYTLSNLIK

SEQ ID NO: 2286349 - protein, 12 aa, Cryptosporidium parvum
TTGLSPTPRSGH

SEQ ID NO: 2286350 - protein, 8 aa, Cryptosporidium parvum
TTGNDPEG

SEQ ID NO: 2286351 - protein, 5 aa, Cryptosporidium parvum
TTGNI

SEQ ID NO: 2286352 - protein, 7 aa, Cryptosporidium parvum
TTGTDDD

SEQ ID NO: 2286353 - protein, 25 aa, Cryptosporidium parvum
TTGTSGESSNTNCLSTSGTENISTS

SEQ ID NO: 2286354 - protein, 6 aa, Cryptosporidium parvum
TTHMEE

SEQ ID NO: 2286355 - protein, 6 aa, Cryptosporidium parvum
TTHTQE

SEQ ID NO: 2286356 - protein, 10 aa, Cryptosporidium parvum
TTHTTSPNVT

SEQ ID NO: 2286357 - protein, 5 aa, Cryptosporidium parvum
TTIED

SEQ ID NO: 2286358 - protein, 12 aa, Cryptosporidium parvum
TTIHEDNNKRIG

SEQ ID NO: 2286359 - protein, 4 aa, Cryptosporidium parvum
TTIP

SEQ ID NO: 2286360 - protein, 4 aa, Cryptosporidium parvum
TTIQ

SEQ ID NO: 2286361 - protein, 8 aa, Cryptosporidium parvum
TTKARPQI

SEQ ID NO: 2286362 - protein, 10 aa, Cryptosporidium parvum
TTKDPLKFPN

SEQ ID NO: 2286363 - protein, 21 aa, Cryptosporidium parvum
TTKEIESEAHNETNISRNGTR

SEQ ID NO: 2286364 - protein, 11 aa, Cryptosporidium parvum
TTKEKKSPNTA

SEQ ID NO: 2286365 - protein, 12 aa, Cryptosporidium parvum
TTKESTLQSPLS

SEQ ID NO: 2286366 - protein, 6 aa, Cryptosporidium parvum
TTKGEM

SEQ ID NO: 2286367 - protein, 7 aa, Cryptosporidium parvum
TTKGQDM

SEQ ID NO: 2286368 - protein, 5 aa, Cryptosporidium parvum
TTKGR

SEQ ID NO: 2286369 - protein, 7 aa, Cryptosporidium parvum
TTKSEDD

SEQ ID NO: 2286370 - protein, 6 aa, Cryptosporidium parvum
TTKTRY

SEQ ID NO: 2286371 - protein, 6 aa, Cryptosporidium parvum
TTKYED

SEQ ID NO: 2286372 - protein, 6 aa, Cryptosporidium parvum
TTLASE

SEQ ID NO: 2286373 - protein, 8 aa, Cryptosporidium parvum
TTLDETKQ

SEQ ID NO: 2286374 - protein, 5 aa, Cryptosporidium parvum
TTLGT

SEQ ID NO: 2286375 - protein, 4 aa, Cryptosporidium parvum
TTLN

SEQ ID NO: 2286376 - protein, 13 aa, Cryptosporidium parvum
TTLPDPQTFGKAE

SEQ ID NO: 2286377 - protein, 4 aa, Cryptosporidium parvum
TTLS

SEQ ID NO: 2286378 - protein, 10 aa, Cryptosporidium parvum
TTLSEDRQES

SEQ ID NO: 2286379 - protein, 4 aa, Cryptosporidium parvum
TTLT

SEQ ID NO: 2286380 - protein, 14 aa, Cryptosporidium parvum
TTMGNTTNSNDPHV

SEQ ID NO: 2286381 - protein, 4 aa, Cryptosporidium parvum
TTMY

SEQ ID NO: 2286382 - protein, 17 aa, Cryptosporidium parvum
TTNATTTTTSATNAATV

SEQ ID NO: 2286383 - protein, 5 aa, Cryptosporidium parvum
TTNDS

SEQ ID NO: 2286384 - protein, 11 aa, Cryptosporidium parvum
TTNEKSPTNLQ

SEQ ID NO: 2286385 - protein, 10 aa, Cryptosporidium parvum
TTNESYGPKC

SEQ ID NO: 2286386 - protein, 13 aa, Cryptosporidium parvum
TTNGGDSKSKNRS

SEQ ID NO: 2286387 - protein, 5 aa, Cryptosporidium parvum
TTNHP

SEQ ID NO: 2286388 - protein, 5 aa, Cryptosporidium parvum
TTNIT

SEQ ID NO: 2286389 - protein, 5 aa, Cryptosporidium parvum
TTNKD

SEQ ID NO: 2286390 - protein, 6 aa, Cryptosporidium parvum
TTNKKK

SEQ ID NO: 2286391 - protein, 4 aa, Cryptosporidium parvum
TTNL

SEQ ID NO: 2286392 - protein, 10 aa, Cryptosporidium parvum
TTNLDEKRDR

SEQ ID NO: 2286393 - protein, 24 aa, Cryptosporidium parvum
TTNLEAGKSDVNKSIKPPNSQGSV

SEQ ID NO: 2286394 - protein, 25 aa, Cryptosporidium parvum
TTNNKNGKPKKKTQISSEKSKKLAS

SEQ ID NO: 2286395 - protein, 9 aa, Cryptosporidium parvum
TTNQDEVKQ

SEQ ID NO: 2286396 - protein, 5 aa, Cryptosporidium parvum
TTNSC

SEQ ID NO: 2286397 - protein, 14 aa, Cryptosporidium parvum
TTNSVRSKLNEPPI

SEQ ID NO: 2286398 - protein, 6 aa, Cryptosporidium parvum
TTNTEF

SEQ ID NO: 2286399 - protein, 24 aa, Cryptosporidium parvum
TTNYGEQQPKEEAGIESQNITSGT

SEQ ID NO: 2286400 - protein, 6 aa, Cryptosporidium parvum
TTPERE

SEQ ID NO: 2286401 - protein, 4 aa, Cryptosporidium parvum
TTPI

SEQ ID NO: 2286402 - protein, 11 aa, Cryptosporidium parvum
TTPIGDAPKCP

SEQ ID NO: 2286403 - protein, 9 aa, Cryptosporidium parvum
TTPISNSQI

SEQ ID NO: 2286404 - protein, 24 aa, Cryptosporidium parvum
TTPQNQSLRRPKIPKGTQDVTPQK

SEQ ID NO: 2286405 - protein, 5 aa, Cryptosporidium parvum
TTPRP

SEQ ID NO: 2286406 - protein, 12 aa, Cryptosporidium parvum
TTPTQLIRQVLH

SEQ ID NO: 2286407 - protein, 6 aa, Cryptosporidium parvum
TTQEDL

SEQ ID NO: 2286408 - protein, 9 aa, Cryptosporidium parvum
TTQEGFEAS

SEQ ID NO: 2286409 - protein, 4 aa, Cryptosporidium parvum
TTQR

SEQ ID NO: 2286410 - protein, 11 aa, Cryptosporidium parvum
TTQRKSNEIDS

SEQ ID NO: 2286411 - protein, 10 aa, Cryptosporidium parvum
TTQSEPQYNG

SEQ ID NO: 2286412 - protein, 5 aa, Cryptosporidium parvum
TTRES

SEQ ID NO: 2286413 - protein, 14 aa, Cryptosporidium parvum
TTRNNNEGIDNKGR

SEQ ID NO: 2286414 - protein, 4 aa, Cryptosporidium parvum
TTRS

SEQ ID NO: 2286415 - protein, 9 aa, Cryptosporidium parvum
TTSALYGSR

SEQ ID NO: 2286416 - protein, 13 aa, Cryptosporidium parvum
TTSCGTSAEPQLS

SEQ ID NO: 2286417 - protein, 42 aa, Cryptosporidium parvum
TTSDNHSSQSDSSEISDDSRSEKRSRKRKSSVSKSQKKNREK

SEQ ID NO: 2286418 - protein, 8 aa, Cryptosporidium parvum
TTSDWERK

SEQ ID NO: 2286419 - protein, 6 aa, Cryptosporidium parvum
TTSEKN

SEQ ID NO: 2286420 - protein, 48 aa, Cryptosporidium parvum
TTSGSPASQRKRRGSAKSSYNFSPPPIPVTNSPIQSGDPKDISSLNPE

SEQ ID NO: 2286421 - protein, 9 aa, Cryptosporidium parvum
TTSGTGAEM

SEQ ID NO: 2286422 - protein, 4 aa, Cryptosporidium parvum
TTSI

SEQ ID NO: 2286423 - protein, 8 aa, Cryptosporidium parvum
TTSNVSPS

SEQ ID NO: 2286424 - protein, 4 aa, Cryptosporidium parvum
TTSP

SEQ ID NO: 2286425 - protein, 15 aa, Cryptosporidium parvum
TTSPISPSNSPLHSN

SEQ ID NO: 2286426 - protein, 6 aa, Cryptosporidium parvum
TTSPRL

SEQ ID NO: 2286427 - protein, 9 aa, Cryptosporidium parvum
TTSRPDSID

SEQ ID NO: 2286428 - protein, 9 aa, Cryptosporidium parvum
TTSSAPNRA

SEQ ID NO: 2286429 - protein, 9 aa, Cryptosporidium parvum
TTSSRSERV

SEQ ID NO: 2286430 - protein, 21 aa, Cryptosporidium parvum
TTSSSAFERGSNLQSSHRDDC

SEQ ID NO: 2286431 - protein, 13 aa, Cryptosporidium parvum
TTSTEVSSEFSSR

SEQ ID NO: 2286432 - protein, 7 aa, Cryptosporidium parvum
TTSTSSF

SEQ ID NO: 2286433 - protein, 48 aa, Cryptosporidium parvum
TTSTTTTTTTTTTTTTTTTTTTTTTTTTTTTTTTTTTTATTASINSSL

SEQ ID NO: 2286434 - protein, 12 aa, Cryptosporidium parvum
TTTDDASNKLEE

SEQ ID NO: 2286435 - protein, 4 aa, Cryptosporidium parvum
TTTF

SEQ ID NO: 2286436 - protein, 4 aa, Cryptosporidium parvum
TTTK

SEQ ID NO: 2286437 - protein, 5 aa, Cryptosporidium parvum
TTTNN

SEQ ID NO: 2286438 - protein, 6 aa, Cryptosporidium parvum
TTTQEV

SEQ ID NO: 2286439 - protein, 12 aa, Cryptosporidium parvum
TTTTSSDTGSVT

SEQ ID NO: 2286440 - protein, 5 aa, Cryptosporidium parvum
TTTTT

SEQ ID NO: 2286441 - protein, 9 aa, Cryptosporidium parvum
TTTTTTPAN

SEQ ID NO: 2286442 - protein, 66 aa, Cryptosporidium parvum
TTTTTTTTTTTTTTTTTTTTTTTTTTTTTTTTTTTTTTTTTTTTTTTTTTTTTTTTTTTTTTTTTE

SEQ ID NO: 2286443 - protein, 5 aa, Cryptosporidium parvum
TTVDP

SEQ ID NO: 2286444 - protein, 5 aa, Cryptosporidium parvum
TTVGS

SEQ ID NO: 2286445 - protein, 22 aa, Cryptosporidium parvum
TTVNSKADVSYNSKSEPKMNEK

SEQ ID NO: 2286446 - protein, 20 aa, Cryptosporidium parvum
TTVSGTAGQFAHSNDTTVYE

SEQ ID NO: 2286447 - protein, 4 aa, Cryptosporidium parvum
TTYF

SEQ ID NO: 2286448 - protein, 5 aa, Cryptosporidium parvum
TTYSD

SEQ ID NO: 2286449 - protein, 5 aa, Cryptosporidium parvum
TVAND

SEQ ID NO: 2286450 - protein, 5 aa, Cryptosporidium parvum
TVANP

SEQ ID NO: 2286451 - protein, 7 aa, Cryptosporidium parvum
TVATGQK

SEQ ID NO: 2286452 - protein, 8 aa, Cryptosporidium parvum
TVATRSKN

SEQ ID NO: 2286453 - protein, 16 aa, Cryptosporidium parvum
TVDGPSKGGKDWRAGR

SEQ ID NO: 2286454 - protein, 4 aa, Cryptosporidium parvum
TVDK

SEQ ID NO: 2286455 - protein, 6 aa, Cryptosporidium parvum
TVDKTQ

SEQ ID NO: 2286456 - protein, 13 aa, Cryptosporidium parvum
TVDPNESIEMENS

SEQ ID NO: 2286457 - protein, 10 aa, Cryptosporidium parvum
TVDSSASESK

SEQ ID NO: 2286458 - protein, 15 aa, Cryptosporidium parvum
TVEKRDDIKETKEVV

SEQ ID NO: 2286459 - protein, 5 aa, Cryptosporidium parvum
TVENI

SEQ ID NO: 2286460 - protein, 9 aa, Cryptosporidium parvum
TVENKRREF

SEQ ID NO: 2286461 - protein, 17 aa, Cryptosporidium parvum
TVENSKQAGVKSEIEDE

SEQ ID NO: 2286462 - protein, 6 aa, Cryptosporidium parvum
TVENYS

SEQ ID NO: 2286463 - protein, 9 aa, Cryptosporidium parvum
TVESGGRHF

SEQ ID NO: 2286464 - protein, 5 aa, Cryptosporidium parvum
TVETD

SEQ ID NO: 2286465 - protein, 7 aa, Cryptosporidium parvum
TVETNQK

SEQ ID NO: 2286466 - protein, 5 aa, Cryptosporidium parvum
TVEVS

SEQ ID NO: 2286467 - protein, 4 aa, Cryptosporidium parvum
TVEY

SEQ ID NO: 2286468 - protein, 9 aa, Cryptosporidium parvum
TVGAQYTST

SEQ ID NO: 2286469 - protein, 11 aa, Cryptosporidium parvum
TVGDAPEKSGS

SEQ ID NO: 2286470 - protein, 5 aa, Cryptosporidium parvum
TVGDI

SEQ ID NO: 2286471 - protein, 8 aa, Cryptosporidium parvum
TVGDSGKR

SEQ ID NO: 2286472 - protein, 6 aa, Cryptosporidium parvum
TVGERS

SEQ ID NO: 2286473 - protein, 4 aa, Cryptosporidium parvum
TVGK

SEQ ID NO: 2286474 - protein, 4 aa, Cryptosporidium parvum
TVGN

SEQ ID NO: 2286475 - protein, 8 aa, Cryptosporidium parvum
TVGSMTNS

SEQ ID NO: 2286476 - protein, 14 aa, Cryptosporidium parvum
TVGTRSCYDEGKRI

SEQ ID NO: 2286477 - protein, 15 aa, Cryptosporidium parvum
TVHSSEDSQENSTCP

SEQ ID NO: 2286478 - protein, 10 aa, Cryptosporidium parvum
TVKDEQNEPK

SEQ ID NO: 2286479 - protein, 16 aa, Cryptosporidium parvum
TVKGQKGLEDQEQEEF

SEQ ID NO: 2286480 - protein, 16 aa, Cryptosporidium parvum
TVKGSSGGGRGNESMG

SEQ ID NO: 2286481 - protein, 19 aa, Cryptosporidium parvum
TVKNKSSEEDRMQGPLPGM

SEQ ID NO: 2286482 - protein, 15 aa, Cryptosporidium parvum
TVKSPTALSSSINGF

SEQ ID NO: 2286483 - protein, 5 aa, Cryptosporidium parvum
TVNDP

SEQ ID NO: 2286484 - protein, 21 aa, Cryptosporidium parvum
TVNESSNLNDHKSDFKNDLTS

SEQ ID NO: 2286485 - protein, 15 aa, Cryptosporidium parvum
TVNKTSTEDVTSTTM

SEQ ID NO: 2286486 - protein, 15 aa, Cryptosporidium parvum
TVNTPKYSLTGHEGG

SEQ ID NO: 2286487 - protein, 13 aa, Cryptosporidium parvum
TVPDSSLRRTDTE

SEQ ID NO: 2286488 - protein, 9 aa, Cryptosporidium parvum
TVPKSGIST

SEQ ID NO: 2286489 - protein, 10 aa, Cryptosporidium parvum
TVPNNNKGIP

SEQ ID NO: 2286490 - protein, 4 aa, Cryptosporidium parvum
TVPP

SEQ ID NO: 2286491 - protein, 8 aa, Cryptosporidium parvum
TVPPPRRF

SEQ ID NO: 2286492 - protein, 10 aa, Cryptosporidium parvum
TVPPQLSSND

SEQ ID NO: 2286493 - protein, 12 aa, Cryptosporidium parvum
TVPSRDSKENEL

SEQ ID NO: 2286494 - protein, 8 aa, Cryptosporidium parvum
TVPVKTSE

SEQ ID NO: 2286495 - protein, 8 aa, Cryptosporidium parvum
TVQEYEEY

SEQ ID NO: 2286496 - protein, 7 aa, Cryptosporidium parvum
TVQGSKT

SEQ ID NO: 2286497 - protein, 12 aa, Cryptosporidium parvum
TVQKENNKKFLF

SEQ ID NO: 2286498 - protein, 8 aa, Cryptosporidium parvum
TVQRGTEE

SEQ ID NO: 2286499 - protein, 10 aa, Cryptosporidium parvum
TVQSVNETNF

SEQ ID NO: 2286500 - protein, 7 aa, Cryptosporidium parvum
TVRNSNG

SEQ ID NO: 2286501 - protein, 14 aa, Cryptosporidium parvum
TVRPPTAPTSFPSN

SEQ ID NO: 2286502 - protein, 7 aa, Cryptosporidium parvum
TVRTSDG

SEQ ID NO: 2286503 - protein, 8 aa, Cryptosporidium parvum
TVSESGIV

SEQ ID NO: 2286504 - protein, 19 aa, Cryptosporidium parvum
TVSINNSNSATNTNANPIS

SEQ ID NO: 2286505 - protein, 14 aa, Cryptosporidium parvum
TVSRSRKSNAVENS

SEQ ID NO: 2286506 - protein, 9 aa, Cryptosporidium parvum
TVTQNISSQ

SEQ ID NO: 2286507 - protein, 4 aa, Cryptosporidium parvum
TWNQ

SEQ ID NO: 2286508 - protein, 4 aa, Cryptosporidium parvum
TWSE

SEQ ID NO: 2286509 - protein, 12 aa, Cryptosporidium parvum
TWSQNISKKSKI

SEQ ID NO: 2286510 - protein, 14 aa, Cryptosporidium parvum
TWTGKSGQAGAPSS

SEQ ID NO: 2286511 - protein, 5 aa, Cryptosporidium parvum
TYDCR

SEQ ID NO: 2286512 - protein, 8 aa, Cryptosporidium parvum
TYDEAGRR

SEQ ID NO: 2286513 - protein, 10 aa, Cryptosporidium parvum
TYDGSKTCAG

SEQ ID NO: 2286514 - protein, 4 aa, Cryptosporidium parvum
TYDS

SEQ ID NO: 2286515 - protein, 6 aa, Cryptosporidium parvum
TYEDNS

SEQ ID NO: 2286516 - protein, 4 aa, Cryptosporidium parvum
TYEE

SEQ ID NO: 2286517 - protein, 13 aa, Cryptosporidium parvum
TYEETINEENFEE

SEQ ID NO: 2286518 - protein, 5 aa, Cryptosporidium parvum
TYETG

SEQ ID NO: 2286519 - protein, 6 aa, Cryptosporidium parvum
TYGDGK

SEQ ID NO: 2286520 - protein, 9 aa, Cryptosporidium parvum
TYGGDRKAT

SEQ ID NO: 2286521 - protein, 4 aa, Cryptosporidium parvum
TYGL

SEQ ID NO: 2286522 - protein, 25 aa, Cryptosporidium parvum
TYGNELTEAAAKEATDCCENQDEAA

SEQ ID NO: 2286523 - protein, 16 aa, Cryptosporidium parvum
TYGNSCGVSSTGNSTF

SEQ ID NO: 2286524 - protein, 5 aa, Cryptosporidium parvum
TYGPC

SEQ ID NO: 2286525 - protein, 24 aa, Cryptosporidium parvum
TYHNNPKKGKNERNSKKKSNNMEK

SEQ ID NO: 2286526 - protein, 13 aa, Cryptosporidium parvum
TYKDDVKKTSTDH

SEQ ID NO: 2286527 - protein, 4 aa, Cryptosporidium parvum
TYKK

SEQ ID NO: 2286528 - protein, 19 aa, Cryptosporidium parvum
TYKSSNPPPKANDKGITQR

SEQ ID NO: 2286529 - protein, 24 aa, Cryptosporidium parvum
TYKSSNTNTSNNNNDNNNESDNSN

SEQ ID NO: 2286530 - protein, 6 aa, Cryptosporidium parvum
TYNENY

SEQ ID NO: 2286531 - protein, 5 aa, Cryptosporidium parvum
TYNIG

SEQ ID NO: 2286532 - protein, 13 aa, Cryptosporidium parvum
TYNRSRKEIESQI

SEQ ID NO: 2286533 - protein, 11 aa, Cryptosporidium parvum
TYNSDNNQLVS

SEQ ID NO: 2286534 - protein, 5 aa, Cryptosporidium parvum
TYNSH

SEQ ID NO: 2286535 - protein, 5 aa, Cryptosporidium parvum
TYNSK

SEQ ID NO: 2286536 - protein, 6 aa, Cryptosporidium parvum
TYNSSD

SEQ ID NO: 2286537 - protein, 5 aa, Cryptosporidium parvum
TYPDP

SEQ ID NO: 2286538 - protein, 5 aa, Cryptosporidium parvum
TYPER

SEQ ID NO: 2286539 - protein, 13 aa, Cryptosporidium parvum
TYPRTETSRYPKN

SEQ ID NO: 2286540 - protein, 5 aa, Cryptosporidium parvum
TYQDK

SEQ ID NO: 2286541 - protein, 9 aa, Cryptosporidium parvum
TYQVKQNSR

SEQ ID NO: 2286542 - protein, 6 aa, Cryptosporidium parvum
TYRGTF

SEQ ID NO: 2286543 - protein, 7 aa, Cryptosporidium parvum
TYRRDPG

SEQ ID NO: 2286544 - protein, 119 aa, Cryptosporidium parvum
TYSHSKSVPGPINSSRSTSRSRSPSIKTNKSENKNDGRNKIRDKVRQRDRDFDKECNRSKSRSVSRSRHSSRSKHISESQNKYKSKSNPRTRSYSCSDEEYISNSNTKTSRNRSQYYRN

SEQ ID NO: 2286545 - protein, 6 aa, Cryptosporidium parvum
TYSKEG

SEQ ID NO: 2286546 - protein, 8 aa, Cryptosporidium parvum
TYSNENYP

SEQ ID NO: 2286547 - protein, 5 aa, Cryptosporidium parvum
TYSNN

SEQ ID NO: 2286548 - protein, 5 aa, Cryptosporidium parvum
TYSNT

SEQ ID NO: 2286549 - protein, 5 aa, Cryptosporidium parvum
TYSRC

SEQ ID NO: 2286550 - protein, 9 aa, Cryptosporidium parvum
TYTDLQTTS

SEQ ID NO: 2286551 - protein, 16 aa, Cryptosporidium parvum
TYTQNLDQADSQRNDD

SEQ ID NO: 2286552 - protein, 21 aa, Cryptosporidium parvum
TYYEEESKSDTQNSEKKLKKR

SEQ ID NO: 2286553 - protein, 6 aa, Cryptosporidium parvum
VAARTG

SEQ ID NO: 2286554 - protein, 5 aa, Cryptosporidium parvum
VAATG

SEQ ID NO: 2286555 - protein, 7 aa, Cryptosporidium parvum
VADAERA

SEQ ID NO: 2286556 - protein, 18 aa, Cryptosporidium parvum
VADKRESLYKSNGNRDGS

SEQ ID NO: 2286557 - protein, 20 aa, Cryptosporidium parvum
VADSDYSKQEQIKNTSGDSK

SEQ ID NO: 2286558 - protein, 6 aa, Cryptosporidium parvum
VADSVP

SEQ ID NO: 2286559 - protein, 7 aa, Cryptosporidium parvum
VAEGEAV

SEQ ID NO: 2286560 - protein, 9 aa, Cryptosporidium parvum
VAEKETAAE

SEQ ID NO: 2286561 - protein, 99 aa, Cryptosporidium parvum
VAENKSAADANKQRELAEKKAQLAKAVKNPAPISNQAQQKPEEPKKSEPAPNNPPAADAPAAQAPAAPAEPAPQDKPADAPAAEAPAAEPAAQQDKPAD

SEQ ID NO: 2286562 - protein, 7 aa, Cryptosporidium parvum
VAEQPDC

SEQ ID NO: 2286563 - protein, 28 aa, Cryptosporidium parvum
VAESNLSSENDGSAKNPGNISFSSSNGL

SEQ ID NO: 2286564 - protein, 7 aa, Cryptosporidium parvum
VAGDDAP

SEQ ID NO: 2286565 - protein, 5 aa, Cryptosporidium parvum
VAGEA

SEQ ID NO: 2286566 - protein, 23 aa, Cryptosporidium parvum
VAGEGGQNVYHESQQDEQWGGVV

SEQ ID NO: 2286567 - protein, 40 aa, Cryptosporidium parvum
VAGGAGAGAAQDSGASAAADDKKKKEEEEEEEGDLGFSLF

SEQ ID NO: 2286568 - protein, 5 aa, Cryptosporidium parvum
VAGGQ

SEQ ID NO: 2286569 - protein, 28 aa, Cryptosporidium parvum
VAGGVGGTGIGESGSVSGAVGATENPIS

SEQ ID NO: 2286570 - protein, 6 aa, Cryptosporidium parvum
VAGRGI

SEQ ID NO: 2286571 - protein, 13 aa, Cryptosporidium parvum
VAKSQAKQQTSII

SEQ ID NO: 2286572 - protein, 9 aa, Cryptosporidium parvum
VAKTDPELD

SEQ ID NO: 2286573 - protein, 5 aa, Cryptosporidium parvum
VANET

SEQ ID NO: 2286574 - protein, 7 aa, Cryptosporidium parvum
VANETSA

SEQ ID NO: 2286575 - protein, 8 aa, Cryptosporidium parvum
VANGPPGV

SEQ ID NO: 2286576 - protein, 34 aa, Cryptosporidium parvum
VANNSKNKLNSAGNLSNEQNTIQPKKRPRRNGEI

SEQ ID NO: 2286577 - protein, 5 aa, Cryptosporidium parvum
VANRT

SEQ ID NO: 2286578 - protein, 14 aa, Cryptosporidium parvum
VANTKRADEPQRRD

SEQ ID NO: 2286579 - protein, 22 aa, Cryptosporidium parvum
VANTPEAITESNKGRKWDKKNR

SEQ ID NO: 2286580 - protein, 5 aa, Cryptosporidium parvum
VAPDE

SEQ ID NO: 2286581 - protein, 14 aa, Cryptosporidium parvum
VAPGSPKSDRVGRS

SEQ ID NO: 2286582 - protein, 7 aa, Cryptosporidium parvum
VAPNPKD

SEQ ID NO: 2286583 - protein, 10 aa, Cryptosporidium parvum
VAPPSKDSDH

SEQ ID NO: 2286584 - protein, 22 aa, Cryptosporidium parvum
VAPRAKMNQQRSRRFRSARDSE

SEQ ID NO: 2286585 - protein, 11 aa, Cryptosporidium parvum
VAPSQERSSEG

SEQ ID NO: 2286586 - protein, 10 aa, Cryptosporidium parvum
VAQSKGMAHT

SEQ ID NO: 2286587 - protein, 34 aa, Cryptosporidium parvum; identical to SEQ ID NO: 2166234

SEQ ID NO: 2286588 - protein, 8 aa, Cryptosporidium parvum
VASAKRGT

SEQ ID NO: 2286589 - protein, 31 aa, Cryptosporidium parvum
VASDQRSRSLSSYYSESASRKNFSPGYRSNS

SEQ ID NO: 2286590 - protein, 4 aa, Cryptosporidium parvum
VASG

SEQ ID NO: 2286591 - protein, 6 aa, Cryptosporidium parvum
VASKGL

SEQ ID NO: 2286592 - protein, 11 aa, Cryptosporidium parvum
VASTGEIESNY

SEQ ID NO: 2286593 - protein, 12 aa, Cryptosporidium parvum
VASTNMNSYSSR

SEQ ID NO: 2286594 - protein, 9 aa, Cryptosporidium parvum
VASTNTPVS

SEQ ID NO: 2286595 - protein, 10 aa, Cryptosporidium parvum
VATDPATERC

SEQ ID NO: 2286596 - protein, 5 aa, Cryptosporidium parvum
VATES

SEQ ID NO: 2286597 - protein, 11 aa, Cryptosporidium parvum
VATPTNSTQNE

SEQ ID NO: 2286598 - protein, 12 aa, Cryptosporidium parvum
VATVPESRLSST

SEQ ID NO: 2286599 - protein, 9 aa, Cryptosporidium parvum
VCGGNGGNL

SEQ ID NO: 2286600 - protein, 20 aa, Cryptosporidium parvum
VCQSNNANANLSKNNSQNSL

SEQ ID NO: 2286601 - protein, 7 aa, Cryptosporidium parvum
VCSGHPD

SEQ ID NO: 2286602 - protein, 35 aa, Cryptosporidium parvum
VCTNDQNQVPNKRRGSSSNRNSSSRKSSSSSKAIA

SEQ ID NO: 2286603 - protein, 19 aa, Cryptosporidium parvum
VDAEDDDLQQIQRTNNMGN

SEQ ID NO: 2286604 - protein, 6 aa, Cryptosporidium parvum
VDAESE

SEQ ID NO: 2286605 - protein, 4 aa, Cryptosporidium parvum
VDDD

SEQ ID NO: 2286606 - protein, 13 aa, Cryptosporidium parvum
VDDESQISKYSMD

SEQ ID NO: 2286607 - protein, 13 aa, Cryptosporidium parvum
VDDGRFDNIPEGR

SEQ ID NO: 2286608 - protein, 8 aa, Cryptosporidium parvum
VDDKENLS

SEQ ID NO: 2286609 - protein, 9 aa, Cryptosporidium parvum
VDDKNTEIN

SEQ ID NO: 2286610 - protein, 10 aa, Cryptosporidium parvum
VDDKTARSLN

SEQ ID NO: 2286611 - protein, 6 aa, Cryptosporidium parvum
VDDKVG

SEQ ID NO: 2286612 - protein, 10 aa, Cryptosporidium parvum
VDDSQSSSTI

SEQ ID NO: 2286613 - protein, 19 aa, Cryptosporidium parvum
VDEDSNSSLSPSSNSEITK

SEQ ID NO: 2286614 - protein, 10 aa, Cryptosporidium parvum
VDEGSAGGAH

SEQ ID NO: 2286615 - protein, 7 aa, Cryptosporidium parvum
VDEINSK

SEQ ID NO: 2286616 - protein, 5 aa, Cryptosporidium parvum
VDEKS

SEQ ID NO: 2286617 - protein, 4 aa, Cryptosporidium parvum
VDEP

SEQ ID NO: 2286618 - protein, 24 aa, Cryptosporidium parvum
VDEPNQAWETGDEGGGRDDGQDED

SEQ ID NO: 2286619 - protein, 8 aa, Cryptosporidium parvum
VDESGKHS

SEQ ID NO: 2286620 - protein, 32 aa, Cryptosporidium parvum
VDETNPNVNNQIENDENLTSTFNQNSSNCASI

SEQ ID NO: 2286621 - protein, 7 aa, Cryptosporidium parvum
VDGDGEI

SEQ ID NO: 2286622 - protein, 6 aa, Cryptosporidium parvum
VDGEKS

SEQ ID NO: 2286623 - protein, 4 aa, Cryptosporidium parvum
VDGL

SEQ ID NO: 2286624 - protein, 4 aa, Cryptosporidium parvum
VDGP

SEQ ID NO: 2286625 - protein, 8 aa, Cryptosporidium parvum
VDGTPGKL

SEQ ID NO: 2286626 - protein, 14 aa, Cryptosporidium parvum
VDITSGSGGGSGIL

SEQ ID NO: 2286627 - protein, 9 aa, Cryptosporidium parvum
VDKDTETKN

SEQ ID NO: 2286628 - protein, 21 aa, Cryptosporidium parvum
VDKENQSNLNISNTSQTTSLK

SEQ ID NO: 2286629 - protein, 14 aa, Cryptosporidium parvum
VDKENSRKSNQGLF

SEQ ID NO: 2286630 - protein, 38 aa, Cryptosporidium parvum
VDKKHTNKHETKDKESAKPTSYKNNKTPIGNNNNHSNN

SEQ ID NO: 2286631 - protein, 7 aa, Cryptosporidium parvum
VDKNSIK

SEQ ID NO: 2286632 - protein, 17 aa, Cryptosporidium parvum
VDKQGSGNELDESTATQ

SEQ ID NO: 2286633 - protein, 6 aa, Cryptosporidium parvum
VDKSDE

SEQ ID NO: 2286634 - protein, 21 aa, Cryptosporidium parvum
VDKSELENNISKNEKIANSTH

SEQ ID NO: 2286635 - protein, 16 aa, Cryptosporidium parvum
VDKSNEQIKQKKEDLN

SEQ ID NO: 2286636 - protein, 24 aa, Cryptosporidium parvum
VDKSTGKSSKITITNDKGRLSKDD

SEQ ID NO: 2286637 - protein, 9 aa, Cryptosporidium parvum
VDLENKQKE

SEQ ID NO: 2286638 - protein, 5 aa, Cryptosporidium parvum
VDLGN

SEQ ID NO: 2286639 - protein, 6 aa, Cryptosporidium parvum
VDNKNY

SEQ ID NO: 2286640 - protein, 14 aa, Cryptosporidium parvum
VDNNTNTNNNSNSK

SEQ ID NO: 2286641 - protein, 5 aa, Cryptosporidium parvum
VDNPY

SEQ ID NO: 2286642 - protein, 4 aa, Cryptosporidium parvum
VDPE

SEQ ID NO: 2286643 - protein, 6 aa, Cryptosporidium parvum
VDPEGI

SEQ ID NO: 2286644 - protein, 5 aa, Cryptosporidium parvum
VDPGL

SEQ ID NO: 2286645 - protein, 6 aa, Cryptosporidium parvum
VDPKGL

SEQ ID NO: 2286646 - protein, 8 aa, Cryptosporidium parvum
VDPPPNKG

SEQ ID NO: 2286647 - protein, 10 aa, Cryptosporidium parvum
VDPPSQLTNM

SEQ ID NO: 2286648 - protein, 5 aa, Cryptosporidium parvum
VDPPY

SEQ ID NO: 2286649 - protein, 4 aa, Cryptosporidium parvum
VDPS

SEQ ID NO: 2286650 - protein, 4 aa, Cryptosporidium parvum
VDPT

SEQ ID NO: 2286651 - protein, 7 aa, Cryptosporidium parvum
VDPTEAN

SEQ ID NO: 2286652 - protein, 9 aa, Cryptosporidium parvum
VDPTEEEIN

SEQ ID NO: 2286653 - protein, 15 aa, Cryptosporidium parvum
VDQNQSSQQQGSCDQ

SEQ ID NO: 2286654 - protein, 6 aa, Cryptosporidium parvum
VDQQTQ

SEQ ID NO: 2286655 - protein, 15 aa, Cryptosporidium parvum
VDQYNQNENNSKGRT

SEQ ID NO: 2286656 - protein, 6 aa, Cryptosporidium parvum
VDRDGR

SEQ ID NO: 2286657 - protein, 12 aa, Cryptosporidium parvum
VDRELTRSSWTR

SEQ ID NO: 2286658 - protein, 26 aa, Cryptosporidium parvum
VDRGAETSESAGTDSPEDHTKTTGVV

SEQ ID NO: 2286659 - protein, 8 aa, Cryptosporidium parvum
VDRNGKRS

SEQ ID NO: 2286660 - protein, 8 aa, Cryptosporidium parvum
VDRPSDLA

SEQ ID NO: 2286661 - protein, 7 aa, Cryptosporidium parvum
VDRSKNT

SEQ ID NO: 2286662 - protein, 8 aa, Cryptosporidium parvum
VDSAESYE

SEQ ID NO: 2286663 - protein, 8 aa, Cryptosporidium parvum
VDSATTEN

SEQ ID NO: 2286664 - protein, 6 aa, Cryptosporidium parvum
VDSDLS

SEQ ID NO: 2286665 - protein, 7 aa, Cryptosporidium parvum
VDSDSRQ

SEQ ID NO: 2286666 - protein, 8 aa, Cryptosporidium parvum
VDSGDQDT

SEQ ID NO: 2286667 - protein, 6 aa, Cryptosporidium parvum
VDSIQK

SEQ ID NO: 2286668 - protein, 15 aa, Cryptosporidium parvum
VDSNKDRGMTGGNSA

SEQ ID NO: 2286669 - protein, 23 aa, Cryptosporidium parvum
VDSSEETDDNHPESDPMDFGKGE

SEQ ID NO: 2286670 - protein, 4 aa, Cryptosporidium parvum
VDST

SEQ ID NO: 2286671 - protein, 9 aa, Cryptosporidium parvum
VDSTAKPEA

SEQ ID NO: 2286672 - protein, 4 aa, Cryptosporidium parvum
VDSY

SEQ ID NO: 2286673 - protein, 22 aa, Cryptosporidium parvum
VDSYNENYSNRKSRPANSSSSI

SEQ ID NO: 2286674 - protein, 8 aa, Cryptosporidium parvum
VDTENKSS

SEQ ID NO: 2286675 - protein, 7 aa, Cryptosporidium parvum
VDTSGHL

SEQ ID NO: 2286676 - protein, 7 aa, Cryptosporidium parvum
VDTSIQT

SEQ ID NO: 2286677 - protein, 11 aa, Cryptosporidium parvum
VDYNNESPGLG

SEQ ID NO: 2286678 - protein, 9 aa, Cryptosporidium parvum
VEAAKQYTR

SEQ ID NO: 2286679 - protein, 6 aa, Cryptosporidium parvum
VEAEQK

SEQ ID NO: 2286680 - protein, 16 aa, Cryptosporidium parvum
VEARGDDSDDQNISSL

SEQ ID NO: 2286681 - protein, 8 aa, Cryptosporidium parvum
VEAVPKKQ

SEQ ID NO: 2286682 - protein, 7 aa, Cryptosporidium parvum
VEDDDSQ

SEQ ID NO: 2286683 - protein, 9 aa, Cryptosporidium parvum
VEDEHTNTA

SEQ ID NO: 2286684 - protein, 7 aa, Cryptosporidium parvum
VEDKMEK

SEQ ID NO: 2286685 - protein, 5 aa, Cryptosporidium parvum
VEDKS

SEQ ID NO: 2286686 - protein, 9 aa, Cryptosporidium parvum
VEDQDSRLE

SEQ ID NO: 2286687 - protein, 11 aa, Cryptosporidium parvum
VEDRDSSPNKT

SEQ ID NO: 2286688 - protein, 16 aa, Cryptosporidium parvum
VEDYPNKKKSYEAEED

SEQ ID NO: 2286689 - protein, 77 aa, Cryptosporidium parvum
VEEDDFDGLPSEEEELDDIDDEEDDDEEEDDDDDDDDDDDEEGDEQEPTQGGDEDVEDDDDEEEDDEEEEEEDDDDE

SEQ ID NO: 2286690 - protein, 14 aa, Cryptosporidium parvum
VEEDEYPDDEHHIE

SEQ ID NO: 2286691 - protein, 7 aa, Cryptosporidium parvum
VEEDGID

SEQ ID NO: 2286692 - protein, 17 aa, Cryptosporidium parvum
VEEDKKRQEKEAKAQEE

SEQ ID NO: 2286693 - protein, 9 aa, Cryptosporidium parvum
VEEDSVHSN

SEQ ID NO: 2286694 - protein, 10 aa, Cryptosporidium parvum
VEEEAEDRRP

SEQ ID NO: 2286695 - protein, 8 aa, Cryptosporidium parvum
VEEECGKY

SEQ ID NO: 2286696 - protein, 12 aa, Cryptosporidium parvum
VEEEKKSGTKMP

SEQ ID NO: 2286697 - protein, 13 aa, Cryptosporidium parvum
VEEESNKSVGKTL

SEQ ID NO: 2286698 - protein, 9 aa, Cryptosporidium parvum
VEEESSESV

SEQ ID NO: 2286699 - protein, 5 aa, Cryptosporidium parvum
VEEGA

SEQ ID NO: 2286700 - protein, 5 aa, Cryptosporidium parvum
VEEIA

SEQ ID NO: 2286701 - protein, 7 aa, Cryptosporidium parvum
VEEPEKP

SEQ ID NO: 2286702 - protein, 4 aa, Cryptosporidium parvum
VEEQ

SEQ ID NO: 2286703 - protein, 9 aa, Cryptosporidium parvum
VEERDTDGS

SEQ ID NO: 2286704 - protein, 7 aa, Cryptosporidium parvum
VEETEKA

SEQ ID NO: 2286705 - protein, 6 aa, Cryptosporidium parvum
VEETND

SEQ ID NO: 2286706 - protein, 24 aa, Cryptosporidium parvum
VEEYEEKKKAGEIISDSEPESQPV

SEQ ID NO: 2286707 - protein, 7 aa, Cryptosporidium parvum
VEGEGDQ

SEQ ID NO: 2286708 - protein, 5 aa, Cryptosporidium parvum
VEGFS

SEQ ID NO: 2286709 - protein, 16 aa, Cryptosporidium parvum
VEGGKQGKHEEAEGSK

SEQ ID NO: 2286710 - protein, 5 aa, Cryptosporidium parvum
VEGNS

SEQ ID NO: 2286711 - protein, 9 aa, Cryptosporidium parvum
VEGQRAPPY

SEQ ID NO: 2286712 - protein, 6 aa, Cryptosporidium parvum
VEGSLR

SEQ ID NO: 2286713 - protein, 5 aa, Cryptosporidium parvum
VEGTI

SEQ ID NO: 2286714 - protein, 6 aa, Cryptosporidium parvum
VEGYNK

SEQ ID NO: 2286715 - protein, 4 aa, Cryptosporidium parvum
VEHD

SEQ ID NO: 2286716 - protein, 20 aa, Cryptosporidium parvum
VEHDEKNRSSLVNSSGRQYH

SEQ ID NO: 2286717 - protein, 6 aa, Cryptosporidium parvum
VEHTRD

SEQ ID NO: 2286718 - protein, 10 aa, Cryptosporidium parvum
VEKEEEKRQI

SEQ ID NO: 2286719 - protein, 10 aa, Cryptosporidium parvum
VEKGEDPNEV

SEQ ID NO: 2286720 - protein, 10 aa, Cryptosporidium parvum
VEKKNGPDNN

SEQ ID NO: 2286721 - protein, 8 aa, Cryptosporidium parvum
VEKNDYGL

SEQ ID NO: 2286722 - protein, 6 aa, Cryptosporidium parvum
VEKPDG

SEQ ID NO: 2286723 - protein, 8 aa, Cryptosporidium parvum
VEKPNPKY

SEQ ID NO: 2286724 - protein, 8 aa, Cryptosporidium parvum
VEKPRKDI

SEQ ID NO: 2286725 - protein, 12 aa, Cryptosporidium parvum
VEKRESDTGRRK

SEQ ID NO: 2286726 - protein, 17 aa, Cryptosporidium parvum
VEKSNQVSYNYQLFITF

SEQ ID NO: 2286727 - protein, 11 aa, Cryptosporidium parvum
VEKSQSRSKVS

SEQ ID NO: 2286728 - protein, 6 aa, Cryptosporidium parvum
VELKSK

SEQ ID NO: 2286729 - protein, 11 aa, Cryptosporidium parvum
VELNRDTQTPC

SEQ ID NO: 2286730 - protein, 11 aa, Cryptosporidium parvum
VENEDEYDNNF

SEQ ID NO: 2286731 - protein, 13 aa, Cryptosporidium parvum
VENEDIEKEETCN

SEQ ID NO: 2286732 - protein, 7 aa, Cryptosporidium parvum
VENETRK

SEQ ID NO: 2286733 - protein, 7 aa, Cryptosporidium parvum
VENGGEL

SEQ ID NO: 2286734 - protein, 6 aa, Cryptosporidium parvum
VENGGQ

SEQ ID NO: 2286735 - protein, 4 aa, Cryptosporidium parvum
VENK

SEQ ID NO: 2286736 - protein, 11 aa, Cryptosporidium parvum
VENKETNSRVN

SEQ ID NO: 2286737 - protein, 4 aa, Cryptosporidium parvum
VENL

SEQ ID NO: 2286738 - protein, 5 aa, Cryptosporidium parvum
VENNA

SEQ ID NO: 2286739 - protein, 6 aa, Cryptosporidium parvum
VENNQD

SEQ ID NO: 2286740 - protein, 7 aa, Cryptosporidium parvum
VENNQSS

SEQ ID NO: 2286741 - protein, 10 aa, Cryptosporidium parvum
VENQTQNPDI

SEQ ID NO: 2286742 - protein, 6 aa, Cryptosporidium parvum
VENSDE

SEQ ID NO: 2286743 - protein, 7 aa, Cryptosporidium parvum
VENSGGL

SEQ ID NO: 2286744 - protein, 5 aa, Cryptosporidium parvum
VEPGI

SEQ ID NO: 2286745 - protein, 6 aa, Cryptosporidium parvum
VEPGKA

SEQ ID NO: 2286746 - protein, 7 aa, Cryptosporidium parvum
VEPNNKK

SEQ ID NO: 2286747 - protein, 25 aa, Cryptosporidium parvum
VEQESAAFNKDNVGNLNQVPNNEYI

SEQ ID NO: 2286748 - protein, 7 aa, Cryptosporidium parvum
VEQPEER

SEQ ID NO: 2286749 - protein, 4 aa, Cryptosporidium parvum
VEQS

SEQ ID NO: 2286750 - protein, 11 aa, Cryptosporidium parvum
VEQTSNREKKR

SEQ ID NO: 2286751 - protein, 9 aa, Cryptosporidium parvum
VERDLPPKR

SEQ ID NO: 2286752 - protein, 15 aa, Cryptosporidium parvum
VERNNSNLQKTIENE

SEQ ID NO: 2286753 - protein, 10 aa, Cryptosporidium parvum
VERTTAPSSM

SEQ ID NO: 2286754 - protein, 9 aa, Cryptosporidium parvum
VESAKSYSN

SEQ ID NO: 2286755 - protein, 9 aa, Cryptosporidium parvum
VESDGLGNL

SEQ ID NO: 2286756 - protein, 13 aa, Cryptosporidium parvum
VESDKTALTTGNS

SEQ ID NO: 2286757 - protein, 16 aa, Cryptosporidium parvum
VESDSGDDADEESDFE

SEQ ID NO: 2286758 - protein, 10 aa, Cryptosporidium parvum
VESEKDGLGK

SEQ ID NO: 2286759 - protein, 12 aa, Cryptosporidium parvum
VESEKEDVTPDY

SEQ ID NO: 2286760 - protein, 8 aa, Cryptosporidium parvum
VESGGNEV

SEQ ID NO: 2286761 - protein, 5 aa, Cryptosporidium parvum
VESKT

SEQ ID NO: 2286762 - protein, 5 aa, Cryptosporidium parvum
VESLG

SEQ ID NO: 2286763 - protein, 15 aa, Cryptosporidium parvum
VESNTNDDDLLNEFN

SEQ ID NO: 2286764 - protein, 8 aa, Cryptosporidium parvum
VESPDKKK

SEQ ID NO: 2286765 - protein, 7 aa, Cryptosporidium parvum
VESPSSI

SEQ ID NO: 2286766 - protein, 7 aa, Cryptosporidium parvum
VESRKSK

SEQ ID NO: 2286767 - protein, 5 aa, Cryptosporidium parvum
VESRV

SEQ ID NO: 2286768 - protein, 10 aa, Cryptosporidium parvum
VESSDPNSLG

SEQ ID NO: 2286769 - protein, 7 aa, Cryptosporidium parvum
VESSPIS

SEQ ID NO: 2286770 - protein, 24 aa, Cryptosporidium parvum
VESSSPMKQKTAHNQNDLNHSKAE

SEQ ID NO: 2286771 - protein, 8 aa, Cryptosporidium parvum
VESVSEEA

SEQ ID NO: 2286772 - protein, 20 aa, Cryptosporidium parvum
VESYSNNDENVCKNSKINQQ

SEQ ID NO: 2286773 - protein, 23 aa, Cryptosporidium parvum
VETARRAKPYDPTPGEYKGPQYR

SEQ ID NO: 2286774 - protein, 14 aa, Cryptosporidium parvum
VETDYENNENEFTG

SEQ ID NO: 2286775 - protein, 4 aa, Cryptosporidium parvum
VETE

SEQ ID NO: 2286776 - protein, 5 aa, Cryptosporidium parvum
VETEN

SEQ ID NO: 2286777 - protein, 12 aa, Cryptosporidium parvum
VETNNENSNKVG

SEQ ID NO: 2286778 - protein, 11 aa, Cryptosporidium parvum
VETPDENSKNI

SEQ ID NO: 2286779 - protein, 10 aa, Cryptosporidium parvum
VETQANSNNQ

SEQ ID NO: 2286780 - protein, 7 aa, Cryptosporidium parvum
VETSEGL

SEQ ID NO: 2286781 - protein, 9 aa, Cryptosporidium parvum
VEVDPETEF

SEQ ID NO: 2286782 - protein, 5 aa, Cryptosporidium parvum
VFDGT

SEQ ID NO: 2286783 - protein, 7 aa, Cryptosporidium parvum
VFSPETK

SEQ ID NO: 2286784 - protein, 4 aa, Cryptosporidium parvum
VFSS

SEQ ID NO: 2286785 - protein, 21 aa, Cryptosporidium parvum
VGAEYQESSPGEGTEQKQERH

SEQ ID NO: 2286786 - protein, 38 aa, Cryptosporidium parvum
VGAPNNNNAIDNLDNQSGNLEPGKYDPKDLNEKQGIQE

SEQ ID NO: 2286787 - protein, 10 aa, Cryptosporidium parvum
VGARQGGGIG

SEQ ID NO: 2286788 - protein, 21 aa, Cryptosporidium parvum
VGASNNALNKLNSDDLKFLFQ

SEQ ID NO: 2286789 - protein, 8 aa, Cryptosporidium parvum
VGATSGSI

SEQ ID NO: 2286790 - protein, 10 aa, Cryptosporidium parvum
VGDGISSSKL

SEQ ID NO: 2286791 - protein, 40 aa, Cryptosporidium parvum
VGDKNDQDSDEGEDTEMSQESRVSKNIKSSSKSKKKANVT

SEQ ID NO: 2286792 - protein, 21 aa, Cryptosporidium parvum
VGDQNDDSKSINSNQNLDTSC

SEQ ID NO: 2286793 - protein, 8 aa, Cryptosporidium parvum
VGDSPIGD

SEQ ID NO: 2286794 - protein, 31 aa, Cryptosporidium parvum
VGDVGGSGGNDINNSSSSNSCSGSGNGIQDL

SEQ ID NO: 2286795 - protein, 20 aa, Cryptosporidium parvum
VGEDGGIKKTSTCNTNSQEH

SEQ ID NO: 2286796 - protein, 10 aa, Cryptosporidium parvum
VGEEEEGEVR

SEQ ID NO: 2286797 - protein, 12 aa, Cryptosporidium parvum
VGEERSRGGRGG

SEQ ID NO: 2286798 - protein, 14 aa, Cryptosporidium parvum
VGEKNMNDSDDSVQ

SEQ ID NO: 2286799 - protein, 33 aa, Cryptosporidium parvum
VGESASVDETNGGGNSSNSNGSENASSNEENDL

SEQ ID NO: 2286800 - protein, 7 aa, Cryptosporidium parvum
VGESEKA

SEQ ID NO: 2286801 - protein, 5 aa, Cryptosporidium parvum
VGESN

SEQ ID NO: 2286802 - protein, 10 aa, Cryptosporidium parvum
VGESNNFNDQ

SEQ ID NO: 2286803 - protein, 10 aa, Cryptosporidium parvum
VGETSAGTEI

SEQ ID NO: 2286804 - protein, 14 aa, Cryptosporidium parvum
VGGASSGAASRRRR

SEQ ID NO: 2286805 - protein, 23 aa, Cryptosporidium parvum
VGGGLQQQEDNISSTVKDSGDVS

SEQ ID NO: 2286806 - protein, 6 aa, Cryptosporidium parvum
VGGGSM

SEQ ID NO: 2286807 - protein, 5 aa, Cryptosporidium parvum
VGGGY

SEQ ID NO: 2286808 - protein, 14 aa, Cryptosporidium parvum
VGGNQQRTTFTKDD

SEQ ID NO: 2286809 - protein, 9 aa, Cryptosporidium parvum
VGGNTTQQS

SEQ ID NO: 2286810 - protein, 4 aa, Cryptosporidium parvum
VGGP

SEQ ID NO: 2286811 - protein, 6 aa, Cryptosporidium parvum
VGGPFS

SEQ ID NO: 2286812 - protein, 8 aa, Cryptosporidium parvum
VGGSDPMN

SEQ ID NO: 2286813 - protein, 9 aa, Cryptosporidium parvum
VGGSPIGGN

SEQ ID NO: 2286814 - protein, 9 aa, Cryptosporidium parvum
VGGSPLGGS

SEQ ID NO: 2286815 - protein, 14 aa, Cryptosporidium parvum
VGGSPSGGSPIGGN

SEQ ID NO: 2286816 - protein, 14 aa, Cryptosporidium parvum
VGGSPTGGSPIGGN

SEQ ID NO: 2286817 - protein, 23 aa, Cryptosporidium parvum
VGGSTGSNGGNSGSASNGNNSNM

SEQ ID NO: 2286818 - protein, 34 aa, Cryptosporidium parvum
VGGSVPNGAGNKSGSEGGNANSNVNTNRGISGAN

SEQ ID NO: 2286819 - protein, 26 aa, Cryptosporidium parvum
VGGTGGGTPVQGGITGNPGPQEPSMT

SEQ ID NO: 2286820 - protein, 6 aa, Cryptosporidium parvum
VGIEEE

SEQ ID NO: 2286821 - protein, 19 aa, Cryptosporidium parvum
VGIPSDQTIGNNGNNNGNN

SEQ ID NO: 2286822 - protein, 7 aa, Cryptosporidium parvum
VGKAGGE

SEQ ID NO: 2286823 - protein, 17 aa, Cryptosporidium parvum
VGKDTEKSVKEKETQEV

SEQ ID NO: 2286824 - protein, 10 aa, Cryptosporidium parvum
VGKEGNTRRR

SEQ ID NO: 2286825 - protein, 10 aa, Cryptosporidium parvum
VGKENGTITV

SEQ ID NO: 2286826 - protein, 8 aa, Cryptosporidium parvum
VGKGNDKI

SEQ ID NO: 2286827 - protein, 7 aa, Cryptosporidium parvum
VGKPSDS

SEQ ID NO: 2286828 - protein, 4 aa, Cryptosporidium parvum
VGKQ

SEQ ID NO: 2286829 - protein, 4 aa, Cryptosporidium parvum
VGKS

SEQ ID NO: 2286830 - protein, 5 aa, Cryptosporidium parvum
VGKSS

SEQ ID NO: 2286831 - protein, 7 aa, Cryptosporidium parvum
VGKSTNL

SEQ ID NO: 2286832 - protein, 17 aa, Cryptosporidium parvum
VGKSTSGEGVEDKEQEI

SEQ ID NO: 2286833 - protein, 9 aa, Cryptosporidium parvum
VGLPENKPR

SEQ ID NO: 2286834 - protein, 13 aa, Cryptosporidium parvum
VGLRQKKSQKSQM

SEQ ID NO: 2286835 - protein, 16 aa, Cryptosporidium parvum
VGLSKSHTSGDDVRKN

SEQ ID NO: 2286836 - protein, 8 aa, Cryptosporidium parvum
VGLTGEQI

SEQ ID NO: 2286837 - protein, 4 aa, Cryptosporidium parvum
VGMS

SEQ ID NO: 2286838 - protein, 7 aa, Cryptosporidium parvum
VGNDGSL

SEQ ID NO: 2286839 - protein, 7 aa, Cryptosporidium parvum
VGNEEEE

SEQ ID NO: 2286840 - protein, 17 aa, Cryptosporidium parvum
VGNEEKIDYKDNTKRES

SEQ ID NO: 2286841 - protein, 7 aa, Cryptosporidium parvum
VGNGKTV

SEQ ID NO: 2286842 - protein, 10 aa, Cryptosporidium parvum
VGNNEGGKAI

SEQ ID NO: 2286843 - protein, 16 aa, Cryptosporidium parvum
VGNNQTPVSISRTSHQ

SEQ ID NO: 2286844 - protein, 11 aa, Cryptosporidium parvum
VGNNRKKKIKS

SEQ ID NO: 2286845 - protein, 14 aa, Cryptosporidium parvum
VGNPGADNSGVGIS

SEQ ID NO: 2286846 - protein, 23 aa, Cryptosporidium parvum
VGNPPNVEENTVNPIEEENETVA

SEQ ID NO: 2286847 - protein, 11 aa, Cryptosporidium parvum
VGNSGNVTLPD

SEQ ID NO: 2286848 - protein, 7 aa, Cryptosporidium parvum
VGNSNNY

SEQ ID NO: 2286849 - protein, 17 aa, Cryptosporidium parvum
VGNSNSTENEEKAETLS

SEQ ID NO: 2286850 - protein, 8 aa, Cryptosporidium parvum
VGNSPDRY

SEQ ID NO: 2286851 - protein, 16 aa, Cryptosporidium parvum
VGNSYDKQYRTNSIAT

SEQ ID NO: 2286852 - protein, 10 aa, Cryptosporidium parvum
VGNTNINTNN

SEQ ID NO: 2286853 - protein, 5 aa, Cryptosporidium parvum
VGPDE

SEQ ID NO: 2286854 - protein, 9 aa, Cryptosporidium parvum
VGPDETPYE

SEQ ID NO: 2286855 - protein, 11 aa, Cryptosporidium parvum
VGPDGRETNMA

SEQ ID NO: 2286856 - protein, 6 aa, Cryptosporidium parvum
VGPEGS

SEQ ID NO: 2286857 - protein, 5 aa, Cryptosporidium parvum
VGPEQ

SEQ ID NO: 2286858 - protein, 14 aa, Cryptosporidium parvum
VGPETLSNSNKKKF

SEQ ID NO: 2286859 - protein, 4 aa, Cryptosporidium parvum
VGPG

SEQ ID NO: 2286860 - protein, 11 aa, Cryptosporidium parvum
VGPGGNVSSQL

SEQ ID NO: 2286861 - protein, 12 aa, Cryptosporidium parvum
VGPIGGNGSMNV

SEQ ID NO: 2286862 - protein, 8 aa, Cryptosporidium parvum
VGPNGSTL

SEQ ID NO: 2286863 - protein, 6 aa, Cryptosporidium parvum
VGPPGA

SEQ ID NO: 2286864 - protein, 10 aa, Cryptosporidium parvum
VGPPGSGFLP

SEQ ID NO: 2286865 - protein, 7 aa, Cryptosporidium parvum
VGPQHNN

SEQ ID NO: 2286866 - protein, 5 aa, Cryptosporidium parvum
VGPSQ

SEQ ID NO: 2286867 - protein, 9 aa, Cryptosporidium parvum
VGQPHSPHP

SEQ ID NO: 2286868 - protein, 8 aa, Cryptosporidium parvum
VGQSEENI

SEQ ID NO: 2286869 - protein, 6 aa, Cryptosporidium parvum
VGREIS

SEQ ID NO: 2286870 - protein, 10 aa, Cryptosporidium parvum
VGRKNSIPRF

SEQ ID NO: 2286871 - protein, 23 aa, Cryptosporidium parvum
VGRKRAKGGGFAASSNDERESTL

SEQ ID NO: 2286872 - protein, 10 aa, Cryptosporidium parvum
VGRSKTGTNL

SEQ ID NO: 2286873 - protein, 8 aa, Cryptosporidium parvum
VGSDPRSG

SEQ ID NO: 2286874 - protein, 12 aa, Cryptosporidium parvum
VGSEPKKPTKKI

SEQ ID NO: 2286875 - protein, 4 aa, Cryptosporidium parvum
VGSG

SEQ ID NO: 2286876 - protein, 8 aa, Cryptosporidium parvum
VGSGHLDS

SEQ ID NO: 2286877 - protein, 10 aa, Cryptosporidium parvum
VGSGNTGNRR

SEQ ID NO: 2286878 - protein, 13 aa, Cryptosporidium parvum
VGSIEKENVSKEP

SEQ ID NO: 2286879 - protein, 8 aa, Cryptosporidium parvum
VGSNPEEK

SEQ ID NO: 2286880 - protein, 8 aa, Cryptosporidium parvum
VGSPKSAI

SEQ ID NO: 2286881 - protein, 18 aa, Cryptosporidium parvum
VGSPSNRFRNGRDTIESS

SEQ ID NO: 2286882 - protein, 18 aa, Cryptosporidium parvum
VGSSGTAVSGRTNDRFDD

SEQ ID NO: 2286883 - protein, 6 aa, Cryptosporidium parvum
VGSTAS

SEQ ID NO: 2286884 - protein, 17 aa, Cryptosporidium parvum
VGTDVEDENPNSGESQI

SEQ ID NO: 2286885 - protein, 28 aa, Cryptosporidium parvum
VGTGAGTGGLGSGQGGGIGGDVGPGVGM

SEQ ID NO: 2286886 - protein, 16 aa, Cryptosporidium parvum
VGTKRHDSQSGGERDI

SEQ ID NO: 2286887 - protein, 18 aa, Cryptosporidium parvum
VGTPNVNIPNSQPSPFGG

SEQ ID NO: 2286888 - protein, 12 aa, Cryptosporidium parvum
VGTSLRPANPPI

SEQ ID NO: 2286889 - protein, 9 aa, Cryptosporidium parvum
VGYAPKDLN

SEQ ID NO: 2286890 - protein, 12 aa, Cryptosporidium parvum
VGYESGSSGNII

SEQ ID NO: 2286891 - protein, 16 aa, Cryptosporidium parvum
VGYNTKGVGMTQEKSV

SEQ ID NO: 2286892 - protein, 8 aa, Cryptosporidium parvum
VHASNSSL

SEQ ID NO: 2286893 - protein, 4 aa, Cryptosporidium parvum
VHDE

SEQ ID NO: 2286894 - protein, 13 aa, Cryptosporidium parvum
VHEQNQINAQASK

SEQ ID NO: 2286895 - protein, 20 aa, Cryptosporidium parvum
VHGNDDDNNSNANSNKFVDD

SEQ ID NO: 2286896 - protein, 26 aa, Cryptosporidium parvum
VHKEEASSQEKGKKNKLSRKKIQNIK

SEQ ID NO: 2286897 - protein, 9 aa, Cryptosporidium parvum
VHTSGSSEV

SEQ ID NO: 2286898 - protein, 6 aa, Cryptosporidium parvum
VHYGGE

SEQ ID NO: 2286899 - protein, 5 aa, Cryptosporidium parvum
VHYPG

SEQ ID NO: 2286900 - protein, 13 aa, Cryptosporidium parvum
VIEPGTGTATSGC

SEQ ID NO: 2286901 - protein, 10 aa, Cryptosporidium parvum
VINGNNSSII

SEQ ID NO: 2286902 - protein, 8 aa, Cryptosporidium parvum
VINPGQAF

SEQ ID NO: 2286903 - protein, 7 aa, Cryptosporidium parvum
VIPASNT

SEQ ID NO: 2286904 - protein, 12 aa, Cryptosporidium parvum
VIPPKKDSSVPV

SEQ ID NO: 2286905 - protein, 12 aa, Cryptosporidium parvum
VIPSKSRADSNE

SEQ ID NO: 2286906 - protein, 8 aa, Cryptosporidium parvum
VIPSPNSL

SEQ ID NO: 2286907 - protein, 8 aa, Cryptosporidium parvum
VIPSPTKN

SEQ ID NO: 2286908 - protein, 5 aa, Cryptosporidium parvum
VITET

SEQ ID NO: 2286909 - protein, 11 aa, Cryptosporidium parvum
VKADRDENSPY

SEQ ID NO: 2286910 - protein, 14 aa, Cryptosporidium parvum
VKAEDKKKASALTK

SEQ ID NO: 2286911 - protein, 8 aa, Cryptosporidium parvum
VKDDQSYS

SEQ ID NO: 2286912 - protein, 19 aa, Cryptosporidium parvum
VKDEDKSFDISSKNKQIAN

SEQ ID NO: 2286913 - protein, 5 aa, Cryptosporidium parvum
VKDEN

SEQ ID NO: 2286914 - protein, 8 aa, Cryptosporidium parvum
VKDEPEEN

SEQ ID NO: 2286915 - protein, 18 aa, Cryptosporidium parvum
VKDESGDFISEGNNEDEE

SEQ ID NO: 2286916 - protein, 71 aa, Cryptosporidium parvum
VKDKVRKRKDKKLSDEEYKNQIDNGESEEEKEEEQVQEQEESESEEINQSATINDKNKVEYKSKRKAHHSI

SEQ ID NO: 2286917 - protein, 10 aa, Cryptosporidium parvum
VKDNGENTDY

SEQ ID NO: 2286918 - protein, 9 aa, Cryptosporidium parvum
VKDNSKKDE

SEQ ID NO: 2286919 - protein, 12 aa, Cryptosporidium parvum
VKDSIEKSCRAY

SEQ ID NO: 2286920 - protein, 11 aa, Cryptosporidium parvum
VKDSSQQQQKI

SEQ ID NO: 2286921 - protein, 7 aa, Cryptosporidium parvum
VKDTEIG

SEQ ID NO: 2286922 - protein, 4 aa, Cryptosporidium parvum
VKEG

SEQ ID NO: 2286923 - protein, 7 aa, Cryptosporidium parvum
VKEKNSK

SEQ ID NO: 2286924 - protein, 7 aa, Cryptosporidium parvum
VKEKQKK

SEQ ID NO: 2286925 - protein, 8 aa, Cryptosporidium parvum
VKENGDKR

SEQ ID NO: 2286926 - protein, 18 aa, Cryptosporidium parvum
VKESEAKNLNSGSKYIQS

SEQ ID NO: 2286927 - protein, 9 aa, Cryptosporidium parvum
VKESQLTKQ

SEQ ID NO: 2286928 - protein, 7 aa, Cryptosporidium parvum
VKEVNQK

SEQ ID NO: 2286929 - protein, 8 aa, Cryptosporidium parvum
VKEYPSSP

SEQ ID NO: 2286930 - protein, 17 aa, Cryptosporidium parvum
VKGGEEVESSDFTSGDH

SEQ ID NO: 2286931 - protein, 80 aa, Cryptosporidium parvum
VKGKPPGPPPPLKSKSALSLKSSGNIGTESAAVSKVPGSSGKRAPPPKAPPPLKPPPKRGTTSQGFGGPSGASDPEISGG

SEQ ID NO: 2286932 - protein, 14 aa, Cryptosporidium parvum
VKGNTTAKDFEKEG

SEQ ID NO: 2286933 - protein, 9 aa, Cryptosporidium parvum
VKGQINKTI

SEQ ID NO: 2286934 - protein, 4 aa, Cryptosporidium parvum
VKGR

SEQ ID NO: 2286935 - protein, 18 aa, Cryptosporidium parvum
VKGTKSENEKFPGGDITK

SEQ ID NO: 2286936 - protein, 11 aa, Cryptosporidium parvum
VKGTSGKPDHI

SEQ ID NO: 2286937 - protein, 19 aa, Cryptosporidium parvum
VKHRKRSEATFDANSVNRK

SEQ ID NO: 2286938 - protein, 5 aa, Cryptosporidium parvum
VKIEE

SEQ ID NO: 2286939 - protein, 8 aa, Cryptosporidium parvum
VKKANGEI

SEQ ID NO: 2286940 - protein, 12 aa, Cryptosporidium parvum
VKKDEKRSKKIK

SEQ ID NO: 2286941 - protein, 7 aa, Cryptosporidium parvum
VKKENIK

SEQ ID NO: 2286942 - protein, 10 aa, Cryptosporidium parvum
VKKENKKNKL

SEQ ID NO: 2286943 - protein, 6 aa, Cryptosporidium parvum
VKKETI

SEQ ID NO: 2286944 - protein, 6 aa, Cryptosporidium parvum
VKKEYD

SEQ ID NO: 2286945 - protein, 12 aa, Cryptosporidium parvum
VKKGEESKELKR

SEQ ID NO: 2286946 - protein, 9 aa, Cryptosporidium parvum
VKKGLNSQD

SEQ ID NO: 2286947 - protein, 11 aa, Cryptosporidium parvum
VKKKSEDDFES

SEQ ID NO: 2286948 - protein, 4 aa, Cryptosporidium parvum
VKKN

SEQ ID NO: 2286949 - protein, 11 aa, Cryptosporidium parvum
VKKSPAALEPR

SEQ ID NO: 2286950 - protein, 7 aa, Cryptosporidium parvum
VKKSQLK

SEQ ID NO: 2286951 - protein, 8 aa, Cryptosporidium parvum
VKKSRTSL

SEQ ID NO: 2286952 - protein, 7 aa, Cryptosporidium parvum
VKKTEER

SEQ ID NO: 2286953 - protein, 4 aa, Cryptosporidium parvum
VKLP

SEQ ID NO: 2286954 - protein, 21 aa, Cryptosporidium parvum
VKLTSDKQAISESKEETFENN

SEQ ID NO: 2286955 - protein, 8 aa, Cryptosporidium parvum
VKNADPEI

SEQ ID NO: 2286956 - protein, 15 aa, Cryptosporidium parvum
VKNANNKFSSSNISE

SEQ ID NO: 2286957 - protein, 7 aa, Cryptosporidium parvum
VKNDDEL

SEQ ID NO: 2286958 - protein, 7 aa, Cryptosporidium parvum
VKNEVKS

SEQ ID NO: 2286959 - protein, 14 aa, Cryptosporidium parvum
VKNKNYTDKTARSS

SEQ ID NO: 2286960 - protein, 7 aa, Cryptosporidium parvum
VKNNPEK

SEQ ID NO: 2286961 - protein, 6 aa, Cryptosporidium parvum
VKNPSS

SEQ ID NO: 2286962 - protein, 7 aa, Cryptosporidium parvum
VKNSRQL

SEQ ID NO: 2286963 - protein, 15 aa, Cryptosporidium parvum
VKPALEKEKAALDSA

SEQ ID NO: 2286964 - protein, 7 aa, Cryptosporidium parvum
VKPDSKE

SEQ ID NO: 2286965 - protein, 9 aa, Cryptosporidium parvum
VKPGNTNTY

SEQ ID NO: 2286966 - protein, 5 aa, Cryptosporidium parvum
VKPLA

SEQ ID NO: 2286967 - protein, 5 aa, Cryptosporidium parvum
VKPPR

SEQ ID NO: 2286968 - protein, 24 aa, Cryptosporidium parvum
VKPQGEDSKRSKPESEAFSASPSL

SEQ ID NO: 2286969 - protein, 23 aa, Cryptosporidium parvum
VKPSAETAEEEHNKVDDLRGSPM

SEQ ID NO: 2286970 - protein, 6 aa, Cryptosporidium parvum
VKPSDV

SEQ ID NO: 2286971 - protein, 10 aa, Cryptosporidium parvum
VKPTKAGVSN

SEQ ID NO: 2286972 - protein, 10 aa, Cryptosporidium parvum
VKQEGSTIKE

SEQ ID NO: 2286973 - protein, 10 aa, Cryptosporidium parvum
VKQEGYSVDH

SEQ ID NO: 2286974 - protein, 6 aa, Cryptosporidium parvum
VKQNNR

SEQ ID NO: 2286975 - protein, 17 aa, Cryptosporidium parvum
VKRLSKKRKKKGADSID

SEQ ID NO: 2286976 - protein, 9 aa, Cryptosporidium parvum
VKRPKGPKD

SEQ ID NO: 2286977 - protein, 8 aa, Cryptosporidium parvum
VKRPKWTD

SEQ ID NO: 2286978 - protein, 9 aa, Cryptosporidium parvum
VKRPTDTIN

SEQ ID NO: 2286979 - protein, 11 aa, Cryptosporidium parvum
VKRTSNPSIEA

SEQ ID NO: 2286980 - protein, 20 aa, Cryptosporidium parvum
VKSESKVNDGFKGSSQIESE

SEQ ID NO: 2286981 - protein, 13 aa, Cryptosporidium parvum
VKSEVQEGIQNLL

SEQ ID NO: 2286982 - protein, 17 aa, Cryptosporidium parvum
VKSGGGFGSGSSNQQMT

SEQ ID NO: 2286983 - protein, 19 aa, Cryptosporidium parvum
VKSGKGTDFNNSKTSSKEH

SEQ ID NO: 2286984 - protein, 7 aa, Cryptosporidium parvum
VKSGRKL

SEQ ID NO: 2286985 - protein, 6 aa, Cryptosporidium parvum
VKSGVI

SEQ ID NO: 2286986 - protein, 4 aa, Cryptosporidium parvum
VKSK

SEQ ID NO: 2286987 - protein, 9 aa, Cryptosporidium parvum
VKSNNSKSN

SEQ ID NO: 2286988 - protein, 8 aa, Cryptosporidium parvum
VKSNPGHT

SEQ ID NO: 2286989 - protein, 43 aa, Cryptosporidium parvum
VKSPKKKTSQINGESKTNKKKENLSSVSKNPKKNDLKDSKKQK

SEQ ID NO: 2286990 - protein, 11 aa, Cryptosporidium parvum
VKSPSTEKIEH

SEQ ID NO: 2286991 - protein, 4 aa, Cryptosporidium parvum
VKSQ

SEQ ID NO: 2286992 - protein, 6 aa, Cryptosporidium parvum
VKSRHP

SEQ ID NO: 2286993 - protein, 10 aa, Cryptosporidium parvum
VKSSTKDNRF

SEQ ID NO: 2286994 - protein, 11 aa, Cryptosporidium parvum
VKSTKKTSENL

SEQ ID NO: 2286995 - protein, 12 aa, Cryptosporidium parvum
VKSTMGKSVRIY

SEQ ID NO: 2286996 - protein, 8 aa, Cryptosporidium parvum
VKSTTDNL

SEQ ID NO: 2286997 - protein, 7 aa, Cryptosporidium parvum
VKTKEDA

SEQ ID NO: 2286998 - protein, 4 aa, Cryptosporidium parvum
VKTL

SEQ ID NO: 2286999 - protein, 4 aa, Cryptosporidium parvum
VKTN

SEQ ID NO: 2287000 - protein, 5 aa, Cryptosporidium parvum
VKTPN

SEQ ID NO: 2287001 - protein, 7 aa, Cryptosporidium parvum
VKTTGKS

SEQ ID NO: 2287002 - protein, 8 aa, Cryptosporidium parvum
VKTVPGNV

SEQ ID NO: 2287003 - protein, 12 aa, Cryptosporidium parvum
VKYEEAEKLAQE

SEQ ID NO: 2287004 - protein, 7 aa, Cryptosporidium parvum
VKYGPNQ

SEQ ID NO: 2287005 - protein, 6 aa, Cryptosporidium parvum
VLDNGS

SEQ ID NO: 2287006 - protein, 8 aa, Cryptosporidium parvum
VLGGGSKE

SEQ ID NO: 2287007 - protein, 20 aa, Cryptosporidium parvum
VLGSSGGGLTSSSSSSSSVT

SEQ ID NO: 2287008 - protein, 10 aa, Cryptosporidium parvum
VLKSGQKNLD

SEQ ID NO: 2287009 - protein, 5 aa, Cryptosporidium parvum
VLNSN

SEQ ID NO: 2287010 - protein, 12 aa, Cryptosporidium parvum
VLPNKDKNEIKD

SEQ ID NO: 2287011 - protein, 26 aa, Cryptosporidium parvum
VLPNKRRSISIGQSRNDDSETTRLSR

SEQ ID NO: 2287012 - protein, 8 aa, Cryptosporidium parvum
VLPPNSKP

SEQ ID NO: 2287013 - protein, 4 aa, Cryptosporidium parvum
VLPQ

SEQ ID NO: 2287014 - protein, 13 aa, Cryptosporidium parvum
VLSEQDNKSNITT

SEQ ID NO: 2287015 - protein, 7 aa, Cryptosporidium parvum
VNAGEDC

SEQ ID NO: 2287016 - protein, 12 aa, Cryptosporidium parvum
VNAPDDLEDEDD

SEQ ID NO: 2287017 - protein, 7 aa, Cryptosporidium parvum
VNAPSRL

SEQ ID NO: 2287018 - protein, 8 aa, Cryptosporidium parvum
VNAPSRSI

SEQ ID NO: 2287019 - protein, 27 aa, Cryptosporidium parvum
VNASYSDKNNSEKSPKEGKISKTEKFK

SEQ ID NO: 2287020 - protein, 9 aa, Cryptosporidium parvum
VNDKSDEFI

SEQ ID NO: 2287021 - protein, 66 aa, Cryptosporidium parvum
VNDNNEQSGSQPEEIDEENNNKNENPVENESKSIEDEKVEEEQDKIAEEDDENKEIVENEKTLSRE

SEQ ID NO: 2287022 - protein, 23 aa, Cryptosporidium parvum
VNDNNNNISKEENSYQKRYSSLP

SEQ ID NO: 2287023 - protein, 5 aa, Cryptosporidium parvum
VNDNS

SEQ ID NO: 2287024 - protein, 19 aa, Cryptosporidium parvum
VNDPDHEKKIQARKLRFGL

SEQ ID NO: 2287025 - protein, 5 aa, Cryptosporidium parvum
VNDPE

SEQ ID NO: 2287026 - protein, 8 aa, Cryptosporidium parvum
VNDPSFLP

SEQ ID NO: 2287027 - protein, 14 aa, Cryptosporidium parvum
VNDPTMQRKDKDIQ

SEQ ID NO: 2287028 - protein, 7 aa, Cryptosporidium parvum
VNDTPVN

SEQ ID NO: 2287029 - protein, 13 aa, Cryptosporidium parvum
VNDTSKIDGEKGC

SEQ ID NO: 2287030 - protein, 12 aa, Cryptosporidium parvum
VNDYESGKAIPN

SEQ ID NO: 2287031 - protein, 9 aa, Cryptosporidium parvum
VNEATNKLS

SEQ ID NO: 2287032 - protein, 9 aa, Cryptosporidium parvum
VNEDNFSSL

SEQ ID NO: 2287033 - protein, 8 aa, Cryptosporidium parvum
VNEEENKQ

SEQ ID NO: 2287034 - protein, 9 aa, Cryptosporidium parvum
VNEEKNRRV

SEQ ID NO: 2287035 - protein, 9 aa, Cryptosporidium parvum
VNEENHPVS

SEQ ID NO: 2287036 - protein, 10 aa, Cryptosporidium parvum
VNEENNKSNL

SEQ ID NO: 2287037 - protein, 13 aa, Cryptosporidium parvum
VNEENSSKLTSFN

SEQ ID NO: 2287038 - protein, 8 aa, Cryptosporidium parvum
VNEGESGL

SEQ ID NO: 2287039 - protein, 6 aa, Cryptosporidium parvum
VNEGVR

SEQ ID NO: 2287040 - protein, 10 aa, Cryptosporidium parvum
VNEKGTENNY

SEQ ID NO: 2287041 - protein, 16 aa, Cryptosporidium parvum
VNEKSGKYEEVNSNEI

SEQ ID NO: 2287042 - protein, 5 aa, Cryptosporidium parvum
VNENQ

SEQ ID NO: 2287043 - protein, 4 aa, Cryptosporidium parvum
VNES

SEQ ID NO: 2287044 - protein, 8 aa, Cryptosporidium parvum
VNESESNK

SEQ ID NO: 2287045 - protein, 9 aa, Cryptosporidium parvum
VNESSKAEV

SEQ ID NO: 2287046 - protein, 8 aa, Cryptosporidium parvum
VNETKDNI

SEQ ID NO: 2287047 - protein, 20 aa, Cryptosporidium parvum
VNFRDNSNPVATSTSAGFNQ

SEQ ID NO: 2287048 - protein, 11 aa, Cryptosporidium parvum
VNGDGTGSTSI

SEQ ID NO: 2287049 - protein, 7 aa, Cryptosporidium parvum
VNGDSVS

SEQ ID NO: 2287050 - protein, 19 aa, Cryptosporidium parvum
VNGGSNGSSIGGNNGMNSN

SEQ ID NO: 2287051 - protein, 9 aa, Cryptosporidium parvum
VNGKSAYTD

SEQ ID NO: 2287052 - protein, 28 aa, Cryptosporidium parvum
VNGNFHNNSGQSNNQYGRHHNNHNNQLH

SEQ ID NO: 2287053 - protein, 5 aa, Cryptosporidium parvum
VNGNN

SEQ ID NO: 2287054 - protein, 12 aa, Cryptosporidium parvum
VNHDESAMQNQH

SEQ ID NO: 2287055 - protein, 8 aa, Cryptosporidium parvum
VNHSNTHP

SEQ ID NO: 2287056 - protein, 7 aa, Cryptosporidium parvum
VNIPETK

SEQ ID NO: 2287057 - protein, 6 aa, Cryptosporidium parvum
VNKANE

SEQ ID NO: 2287058 - protein, 8 aa, Cryptosporidium parvum
VNKDRKAI

SEQ ID NO: 2287059 - protein, 10 aa, Cryptosporidium parvum
VNKEDEKKKV

SEQ ID NO: 2287060 - protein, 5 aa, Cryptosporidium parvum
VNKET

SEQ ID NO: 2287061 - protein, 7 aa, Cryptosporidium parvum
VNKKKKR

SEQ ID NO: 2287062 - protein, 15 aa, Cryptosporidium parvum
VNKNAERPLLKSKDK

SEQ ID NO: 2287063 - protein, 6 aa, Cryptosporidium parvum
VNKNDK

SEQ ID NO: 2287064 - protein, 9 aa, Cryptosporidium parvum
VNKPSKWEE

SEQ ID NO: 2287065 - protein, 24 aa, Cryptosporidium parvum
VNKSFNTEKNLSSTLSSGKDSVKV

SEQ ID NO: 2287066 - protein, 15 aa, Cryptosporidium parvum
VNKSPKSETRPVFSS

SEQ ID NO: 2287067 - protein, 21 aa, Cryptosporidium parvum
VNKTNKLNASIGDDVATGNHS

SEQ ID NO: 2287068 - protein, 4 aa, Cryptosporidium parvum
VNLE

SEQ ID NO: 2287069 - protein, 14 aa, Cryptosporidium parvum
VNLSKRAGQLSQEE

SEQ ID NO: 2287070 - protein, 6 aa, Cryptosporidium parvum
VNNATN

SEQ ID NO: 2287071 - protein, 6 aa, Cryptosporidium parvum
VNNDDI

SEQ ID NO: 2287072 - protein, 16 aa, Cryptosporidium parvum
VNNDNNDVEVPDDSSR

SEQ ID NO: 2287073 - protein, 59 aa, Cryptosporidium parvum
VNNDSGGAKLKKEKGEITKEMKNKANKSDEKEKIKVSKGKGELEKEGNNDEKKSKKQIE

SEQ ID NO: 2287074 - protein, 11 aa, Cryptosporidium parvum
VNNEDGLGQRN

SEQ ID NO: 2287075 - protein, 16 aa, Cryptosporidium parvum
VNNEDTSLNTRAGTPY

SEQ ID NO: 2287076 - protein, 7 aa, Cryptosporidium parvum
VNNEKLD

SEQ ID NO: 2287077 - protein, 4 aa, Cryptosporidium parvum
VNNG

SEQ ID NO: 2287078 - protein, 11 aa, Cryptosporidium parvum
VNNGNNPNNRN

SEQ ID NO: 2287079 - protein, 15 aa, Cryptosporidium parvum
VNNGNVSNANGSNNF

SEQ ID NO: 2287080 - protein, 6 aa, Cryptosporidium parvum
VNNKES

SEQ ID NO: 2287081 - protein, 4 aa, Cryptosporidium parvum
VNNN

SEQ ID NO: 2287082 - protein, 24 aa, Cryptosporidium parvum
VNNNDNGVYEEEDDEDEDDDNEEQ

SEQ ID NO: 2287083 - protein, 7 aa, Cryptosporidium parvum
VNNNINS

SEQ ID NO: 2287084 - protein, 5 aa, Cryptosporidium parvum
VNNNL

SEQ ID NO: 2287085 - protein, 9 aa, Cryptosporidium parvum
VNNNLQSSL

SEQ ID NO: 2287086 - protein, 21 aa, Cryptosporidium parvum
VNNNNNNNNNCINTNGNNSSI

SEQ ID NO: 2287087 - protein, 15 aa, Cryptosporidium parvum
VNNNSTQNESNDYNV

SEQ ID NO: 2287088 - protein, 11 aa, Cryptosporidium parvum
VNNNTSKIISS

SEQ ID NO: 2287089 - protein, 6 aa, Cryptosporidium parvum
VNNPNT

SEQ ID NO: 2287090 - protein, 6 aa, Cryptosporidium parvum
VNNPPV

SEQ ID NO: 2287091 - protein, 5 aa, Cryptosporidium parvum
VNNPT

SEQ ID NO: 2287092 - protein, 10 aa, Cryptosporidium parvum
VNNRRSSTRC

SEQ ID NO: 2287093 - protein, 32 aa, Cryptosporidium parvum; identical to SEQ ID NO: 2166686

SEQ ID NO: 2287094 - protein, 8 aa, Cryptosporidium parvum
VNNSGAED

SEQ ID NO: 2287095 - protein, 23 aa, Cryptosporidium parvum
VNNSNNNIGNNSSNSNNGGVGGG

SEQ ID NO: 2287096 - protein, 8 aa, Cryptosporidium parvum
VNNSRSKI

SEQ ID NO: 2287097 - protein, 10 aa, Cryptosporidium parvum
VNNSTGGNNL

SEQ ID NO: 2287098 - protein, 5 aa, Cryptosporidium parvum
VNNTF

SEQ ID NO: 2287099 - protein, 38 aa, Cryptosporidium parvum; identical to SEQ ID NO: 2166689

SEQ ID NO: 2287100 - protein, 12 aa, Cryptosporidium parvum
VNPEEKRPRKSI

SEQ ID NO: 2287101 - protein, 6 aa, Cryptosporidium parvum
VNPGTY

SEQ ID NO: 2287102 - protein, 8 aa, Cryptosporidium parvum
VNPKGDLG

SEQ ID NO: 2287103 - protein, 8 aa, Cryptosporidium parvum
VNPKNNLP

SEQ ID NO: 2287104 - protein, 10 aa, Cryptosporidium parvum
VNPNDDQKEN

SEQ ID NO: 2287105 - protein, 7 aa, Cryptosporidium parvum
VNPNDGL

SEQ ID NO: 2287106 - protein, 35 aa, Cryptosporidium parvum
VNPPNQSWSSLTSGVSNSAIGQTNLPGNSQLNNSS

SEQ ID NO: 2287107 - protein, 6 aa, Cryptosporidium parvum
VNPPSR

SEQ ID NO: 2287108 - protein, 4 aa, Cryptosporidium parvum
VNPT

SEQ ID NO: 2287109 - protein, 5 aa, Cryptosporidium parvum
VNPYD

SEQ ID NO: 2287110 - protein, 5 aa, Cryptosporidium parvum
VNPYP

SEQ ID NO: 2287111 - protein, 13 aa, Cryptosporidium parvum
VNQEDQKPATAIP

SEQ ID NO: 2287112 - protein, 11 aa, Cryptosporidium parvum
VNQKPNIGRQN

SEQ ID NO: 2287113 - protein, 5 aa, Cryptosporidium parvum
VNQKY

SEQ ID NO: 2287114 - protein, 23 aa, Cryptosporidium parvum
VNQNQNLDLSQNQNQNQNQNQNI

SEQ ID NO: 2287115 - protein, 20 aa, Cryptosporidium parvum
VNQNQNQNQNLDVNQSQNLD

SEQ ID NO: 2287116 - protein, 6 aa, Cryptosporidium parvum
VNQNRN

SEQ ID NO: 2287117 - protein, 9 aa, Cryptosporidium parvum
VNQTMEENG

SEQ ID NO: 2287118 - protein, 39 aa, Cryptosporidium parvum
VNQTRSSAKKVRRRRNNDDREEDAESENQDKSKSDQEQR

SEQ ID NO: 2287119 - protein, 12 aa, Cryptosporidium parvum
VNRGRGGSSNLN

SEQ ID NO: 2287120 - protein, 27 aa, Cryptosporidium parvum
VNSATNIENNTSTATITSTATTSPSVV

SEQ ID NO: 2287121 - protein, 5 aa, Cryptosporidium parvum
VNSCT

SEQ ID NO: 2287122 - protein, 5 aa, Cryptosporidium parvum
VNSDR

SEQ ID NO: 2287123 - protein, 13 aa, Cryptosporidium parvum
VNSDSPKKARYEN

SEQ ID NO: 2287124 - protein, 7 aa, Cryptosporidium parvum
VNSETRR

SEQ ID NO: 2287125 - protein, 6 aa, Cryptosporidium parvum
VNSGEA

SEQ ID NO: 2287126 - protein, 16 aa, Cryptosporidium parvum
VNSGEVELDDQQTPPN

SEQ ID NO: 2287127 - protein, 10 aa, Cryptosporidium parvum
VNSIRGQSNV

SEQ ID NO: 2287128 - protein, 11 aa, Cryptosporidium parvum
VNSKGEKVTPE

SEQ ID NO: 2287129 - protein, 15 aa, Cryptosporidium parvum
VNSKYKEVLNTLRSQ

SEQ ID NO: 2287130 - protein, 11 aa, Cryptosporidium parvum
VNSNEKDTNVL

SEQ ID NO: 2287131 - protein, 8 aa, Cryptosporidium parvum
VNSNNTVQ

SEQ ID NO: 2287132 - protein, 10 aa, Cryptosporidium parvum
VNSNSNNNNF

SEQ ID NO: 2287133 - protein, 10 aa, Cryptosporidium parvum
VNSQGRPALG

SEQ ID NO: 2287134 - protein, 16 aa, Cryptosporidium parvum
VNSQSSNIDHINSNNT

SEQ ID NO: 2287135 - protein, 5 aa, Cryptosporidium parvum
VNSRI

SEQ ID NO: 2287136 - protein, 12 aa, Cryptosporidium parvum
VNSRNSIQNSNI

SEQ ID NO: 2287137 - protein, 11 aa, Cryptosporidium parvum
VNSRSYTNIPY

SEQ ID NO: 2287138 - protein, 13 aa, Cryptosporidium parvum
VNSSADEFAQRKN

SEQ ID NO: 2287139 - protein, 6 aa, Cryptosporidium parvum
VNSSGS

SEQ ID NO: 2287140 - protein, 23 aa, Cryptosporidium parvum
VNSSLSSEELSANSDSSNTDCAG

SEQ ID NO: 2287141 - protein, 7 aa, Cryptosporidium parvum
VNSSTEV

SEQ ID NO: 2287142 - protein, 6 aa, Cryptosporidium parvum
VNTDGT

SEQ ID NO: 2287143 - protein, 5 aa, Cryptosporidium parvum
VNTET

SEQ ID NO: 2287144 - protein, 13 aa, Cryptosporidium parvum
VNTETGNNSDNVN

SEQ ID NO: 2287145 - protein, 8 aa, Cryptosporidium parvum
VNTRQQSI

SEQ ID NO: 2287146 - protein, 4 aa, Cryptosporidium parvum
VPAE

SEQ ID NO: 2287147 - protein, 15 aa, Cryptosporidium parvum
VPAPDEKTYKETTEA

SEQ ID NO: 2287148 - protein, 10 aa, Cryptosporidium parvum
VPATASNNLA

SEQ ID NO: 2287149 - protein, 8 aa, Cryptosporidium parvum
VPDASNGV

SEQ ID NO: 2287150 - protein, 7 aa, Cryptosporidium parvum
VPDDNGR

SEQ ID NO: 2287151 - protein, 11 aa, Cryptosporidium parvum
VPDETSEEQNT

SEQ ID NO: 2287152 - protein, 15 aa, Cryptosporidium parvum
VPDKKSLPNNLEASN

SEQ ID NO: 2287153 - protein, 8 aa, Cryptosporidium parvum
VPDKPQHS

SEQ ID NO: 2287154 - protein, 14 aa, Cryptosporidium parvum
VPDLKSSVSGNSRA

SEQ ID NO: 2287155 - protein, 4 aa, Cryptosporidium parvum
VPDP

SEQ ID NO: 2287156 - protein, 8 aa, Cryptosporidium parvum
VPDPSENA

SEQ ID NO: 2287157 - protein, 12 aa, Cryptosporidium parvum
VPDRSSGNEDNG

SEQ ID NO: 2287158 - protein, 4 aa, Cryptosporidium parvum
VPDT

SEQ ID NO: 2287159 - protein, 8 aa, Cryptosporidium parvum
VPDTPFKE

SEQ ID NO: 2287160 - protein, 13 aa, Cryptosporidium parvum
VPEDLRKTSPTGH

SEQ ID NO: 2287161 - protein, 16 aa, Cryptosporidium parvum
VPEDTTPLGSSPTTDS

SEQ ID NO: 2287162 - protein, 9 aa, Cryptosporidium parvum
VPEGESNDL

SEQ ID NO: 2287163 - protein, 5 aa, Cryptosporidium parvum
VPEIG

SEQ ID NO: 2287164 - protein, 12 aa, Cryptosporidium parvum
VPENSESLPKPQ

SEQ ID NO: 2287165 - protein, 6 aa, Cryptosporidium parvum
VPEPKI

SEQ ID NO: 2287166 - protein, 8 aa, Cryptosporidium parvum
VPGGGACE

SEQ ID NO: 2287167 - protein, 6 aa, Cryptosporidium parvum
VPGGGS

SEQ ID NO: 2287168 - protein, 8 aa, Cryptosporidium parvum
VPGGSIST

SEQ ID NO: 2287169 - protein, 8 aa, Cryptosporidium parvum
VPGKGDIS

SEQ ID NO: 2287170 - protein, 74 aa, Cryptosporidium parvum
VPGPYQSGGSTFPPPPPPPPPPPPPLQAPSNEDFPPPPPPPPPPPPLPSPPPPTLPPPPSLPPYPVPGSQSSMP

SEQ ID NO: 2287171 - protein, 5 aa, Cryptosporidium parvum
VPGSS

SEQ ID NO: 2287172 - protein, 10 aa, Cryptosporidium parvum
VPGSSRGGRI

SEQ ID NO: 2287173 - protein, 5 aa, Cryptosporidium parvum
VPGTL

SEQ ID NO: 2287174 - protein, 13 aa, Cryptosporidium parvum
VPGTSHKLGNSQS

SEQ ID NO: 2287175 - protein, 8 aa, Cryptosporidium parvum
VPGTSTTG

SEQ ID NO: 2287176 - protein, 5 aa, Cryptosporidium parvum
VPGYG

SEQ ID NO: 2287177 - protein, 4 aa, Cryptosporidium parvum
VPIG

SEQ ID NO: 2287178 - protein, 8 aa, Cryptosporidium parvum
VPIGATPE

SEQ ID NO: 2287179 - protein, 5 aa, Cryptosporidium parvum
VPIPD

SEQ ID NO: 2287180 - protein, 9 aa, Cryptosporidium parvum
VPISQANPV

SEQ ID NO: 2287181 - protein, 9 aa, Cryptosporidium parvum
VPKDTNAAV

SEQ ID NO: 2287182 - protein, 5 aa, Cryptosporidium parvum
VPKED

SEQ ID NO: 2287183 - protein, 11 aa, Cryptosporidium parvum
VPKKDDSVDGM

SEQ ID NO: 2287184 - protein, 5 aa, Cryptosporidium parvum
VPKKI

SEQ ID NO: 2287185 - protein, 7 aa, Cryptosporidium parvum
VPKNTPG

SEQ ID NO: 2287186 - protein, 11 aa, Cryptosporidium parvum
VPKRPQQASIR

SEQ ID NO: 2287187 - protein, 9 aa, Cryptosporidium parvum
VPLESSDRT

SEQ ID NO: 2287188 - protein, 9 aa, Cryptosporidium parvum
VPMTPSGKS

SEQ ID NO: 2287189 - protein, 13 aa, Cryptosporidium parvum
VPNDNLKNDPASC

SEQ ID NO: 2287190 - protein, 5 aa, Cryptosporidium parvum
VPNDQ

SEQ ID NO: 2287191 - protein, 12 aa, Cryptosporidium parvum
VPNDQGNRTTPS

SEQ ID NO: 2287192 - protein, 6 aa, Cryptosporidium parvum
VPNDSH

SEQ ID NO: 2287193 - protein, 8 aa, Cryptosporidium parvum
VPNDYEPN

SEQ ID NO: 2287194 - protein, 6 aa, Cryptosporidium parvum
VPNEYA

SEQ ID NO: 2287195 - protein, 4 aa, Cryptosporidium parvum
VPNG

SEQ ID NO: 2287196 - protein, 5 aa, Cryptosporidium parvum
VPNHD

SEQ ID NO: 2287197 - protein, 8 aa, Cryptosporidium parvum
VPNNNKVP

SEQ ID NO: 2287198 - protein, 7 aa, Cryptosporidium parvum
VPNNTRE

SEQ ID NO: 2287199 - protein, 6 aa, Cryptosporidium parvum
VPNQPY

SEQ ID NO: 2287200 - protein, 10 aa, Cryptosporidium parvum
VPNQQGQQDK

SEQ ID NO: 2287201 - protein, 6 aa, Cryptosporidium parvum
VPNRTN

SEQ ID NO: 2287202 - protein, 7 aa, Cryptosporidium parvum
VPNTKGI

SEQ ID NO: 2287203 - protein, 4 aa, Cryptosporidium parvum
VPNY

SEQ ID NO: 2287204 - protein, 9 aa, Cryptosporidium parvum
VPNYPDKSL

SEQ ID NO: 2287205 - protein, 8 aa, Cryptosporidium parvum
VPPENASS

SEQ ID NO: 2287206 - protein, 8 aa, Cryptosporidium parvum
VPPEPDVE

SEQ ID NO: 2287207 - protein, 5 aa, Cryptosporidium parvum
VPPET

SEQ ID NO: 2287208 - protein, 9 aa, Cryptosporidium parvum
VPPKTNPRV

SEQ ID NO: 2287209 - protein, 6 aa, Cryptosporidium parvum
VPPNTP

SEQ ID NO: 2287210 - protein, 26 aa, Cryptosporidium parvum
VPPRNSTIGTDDSSSSNTTISRQSRP

SEQ ID NO: 2287211 - protein, 10 aa, Cryptosporidium parvum
VPPSSSPTIS

SEQ ID NO: 2287212 - protein, 4 aa, Cryptosporidium parvum
VPPT

SEQ ID NO: 2287213 - protein, 6 aa, Cryptosporidium parvum
VPPTGV

SEQ ID NO: 2287214 - protein, 9 aa, Cryptosporidium parvum
VPPTPQGVA

SEQ ID NO: 2287215 - protein, 5 aa, Cryptosporidium parvum
VPQEG

SEQ ID NO: 2287216 - protein, 6 aa, Cryptosporidium parvum
VPQGKA

SEQ ID NO: 2287217 - protein, 7 aa, Cryptosporidium parvum
VPQNSET

SEQ ID NO: 2287218 - protein, 11 aa, Cryptosporidium parvum
VPRNDSPLEDA

SEQ ID NO: 2287219 - protein, 10 aa, Cryptosporidium parvum
VPRNRGEGSI

SEQ ID NO: 2287220 - protein, 5 aa, Cryptosporidium parvum
VPRPG

SEQ ID NO: 2287221 - protein, 9 aa, Cryptosporidium parvum
VPRSPSYSV

SEQ ID NO: 2287222 - protein, 7 aa, Cryptosporidium parvum
VPSDEEL

SEQ ID NO: 2287223 - protein, 6 aa, Cryptosporidium parvum
VPSENG

SEQ ID NO: 2287224 - protein, 5 aa, Cryptosporidium parvum
VPSGV

SEQ ID NO: 2287225 - protein, 13 aa, Cryptosporidium parvum
VPSGYSQHPVSVG

SEQ ID NO: 2287226 - protein, 4 aa, Cryptosporidium parvum
VPSH

SEQ ID NO: 2287227 - protein, 18 aa, Cryptosporidium parvum
VPSNGFSNIDSNQSSGAE

SEQ ID NO: 2287228 - protein, 24 aa, Cryptosporidium parvum
VPSNISKADVSYNSKITNTSEKSI

SEQ ID NO: 2287229 - protein, 15 aa, Cryptosporidium parvum
VPSPKTSLTAKKRVN

SEQ ID NO: 2287230 - protein, 20 aa, Cryptosporidium parvum
VPSSPMPSPEREQRNSGIGT

SEQ ID NO: 2287231 - protein, 8 aa, Cryptosporidium parvum
VPSSQATV

SEQ ID NO: 2287232 - protein, 29 aa, Cryptosporidium parvum
VPSSSSSSISGSGIESNNSNNSENNKSMI

SEQ ID NO: 2287233 - protein, 12 aa, Cryptosporidium parvum
VPSTSELKSNEI

SEQ ID NO: 2287234 - protein, 10 aa, Cryptosporidium parvum
VPTDGATGQP

SEQ ID NO: 2287235 - protein, 5 aa, Cryptosporidium parvum
VPTDK

SEQ ID NO: 2287236 - protein, 7 aa, Cryptosporidium parvum
VPTGEGK

SEQ ID NO: 2287237 - protein, 11 aa, Cryptosporidium parvum
VPTNNNGSKFK

SEQ ID NO: 2287238 - protein, 10 aa, Cryptosporidium parvum
VPTSSLSSSS

SEQ ID NO: 2287239 - protein, 7 aa, Cryptosporidium parvum
VPVGDDK

SEQ ID NO: 2287240 - protein, 110 aa, Cryptosporidium parvum
VPVKPSPLLKSKSEKEKEKEDKDEEKKEKEDKEKKEKLKEKGEEGKEKEEGKEKEKEKEKDEKDKSKSKTKDFEKEKLKETEKGEKEAEKDSSKKESKDEEKKEKEDPIA

SEQ ID NO: 2287241 - protein, 102 aa, Cryptosporidium parvum
VPVKPSPLLKSKSEKEKEKEEDKDEEKKEKDKEKKEKLKEKEEEGKEKSNEKDKGEDKDEKDKSKSKIKDSQKEEKLEETEKNSLKKESKDDEKKEKEDPIA

SEQ ID NO: 2287242 - protein, 92 aa, Cryptosporidium parvum
VPVKPSPLLKSKSEKEKEKEEDKDEEKKEKEDKEKKEKLKEKEEEGKEKEKEKVKAQKKKDEKEEKDKDEKEDDKEKSKESENLEKKPTISE

SEQ ID NO: 2287243 - protein, 4 aa, Cryptosporidium parvum
VPYC

SEQ ID NO: 2287244 - protein, 5 aa, Cryptosporidium parvum
VPYRD

SEQ ID NO: 2287245 - protein, 9 aa, Cryptosporidium parvum
VPYSESNKS

SEQ ID NO: 2287246 - protein, 6 aa, Cryptosporidium parvum
VPYTKS

SEQ ID NO: 2287247 - protein, 6 aa, Cryptosporidium parvum
VQADTR

SEQ ID NO: 2287248 - protein, 14 aa, Cryptosporidium parvum
VQDEEAEGSGAEEI

SEQ ID NO: 2287249 - protein, 10 aa, Cryptosporidium parvum
VQDGTDDPSQ

SEQ ID NO: 2287250 - protein, 18 aa, Cryptosporidium parvum
VQDNSSEDTVSIPKTPRD

SEQ ID NO: 2287251 - protein, 8 aa, Cryptosporidium parvum
VQEETEIQ

SEQ ID NO: 2287252 - protein, 9 aa, Cryptosporidium parvum
VQEGYQDPA

SEQ ID NO: 2287253 - protein, 7 aa, Cryptosporidium parvum
VQEKNLD

SEQ ID NO: 2287254 - protein, 10 aa, Cryptosporidium parvum
VQESDQDIKS

SEQ ID NO: 2287255 - protein, 4 aa, Cryptosporidium parvum
VQET

SEQ ID NO: 2287256 - protein, 7 aa, Cryptosporidium parvum
VQGDPYV

SEQ ID NO: 2287257 - protein, 8 aa, Cryptosporidium parvum
VQGHDQNK

SEQ ID NO: 2287258 - protein, 9 aa, Cryptosporidium parvum
VQGKKENLS

SEQ ID NO: 2287259 - protein, 16 aa, Cryptosporidium parvum
VQGNGQGGRPGSHGHQ

SEQ ID NO: 2287260 - protein, 5 aa, Cryptosporidium parvum
VQGPE

SEQ ID NO: 2287261 - protein, 6 aa, Cryptosporidium parvum
VQGTEG

SEQ ID NO: 2287262 - protein, 9 aa, Cryptosporidium parvum
VQGTTYPGS

SEQ ID NO: 2287263 - protein, 5 aa, Cryptosporidium parvum
VQHEQ

SEQ ID NO: 2287264 - protein, 7 aa, Cryptosporidium parvum
VQIPRYS

SEQ ID NO: 2287265 - protein, 11 aa, Cryptosporidium parvum
VQKSKADKCDD

SEQ ID NO: 2287266 - protein, 6 aa, Cryptosporidium parvum
VQKSRQ

SEQ ID NO: 2287267 - protein, 4 aa, Cryptosporidium parvum
VQKY

SEQ ID NO: 2287268 - protein, 11 aa, Cryptosporidium parvum
VQNDDSSSEYS

SEQ ID NO: 2287269 - protein, 4 aa, Cryptosporidium parvum
VQNE

SEQ ID NO: 2287270 - protein, 9 aa, Cryptosporidium parvum
VQNKSMDNN

SEQ ID NO: 2287271 - protein, 8 aa, Cryptosporidium parvum
VQNQNTKN

SEQ ID NO: 2287272 - protein, 7 aa, Cryptosporidium parvum
VQNSGGN

SEQ ID NO: 2287273 - protein, 14 aa, Cryptosporidium parvum
VQNSINPKVKDVST

SEQ ID NO: 2287274 - protein, 10 aa, Cryptosporidium parvum
VQNSINQQEI

SEQ ID NO: 2287275 - protein, 5 aa, Cryptosporidium parvum
VQNSN

SEQ ID NO: 2287276 - protein, 21 aa, Cryptosporidium parvum
VQNTAKSGAFPATSPQSRVYN

SEQ ID NO: 2287277 - protein, 19 aa, Cryptosporidium parvum
VQNTTDESLNATSSAIATN

SEQ ID NO: 2287278 - protein, 6 aa, Cryptosporidium parvum
VQPFGS

SEQ ID NO: 2287279 - protein, 8 aa, Cryptosporidium parvum
VQPRRSQT

SEQ ID NO: 2287280 - protein, 6 aa, Cryptosporidium parvum
VQPTDK

SEQ ID NO: 2287281 - protein, 14 aa, Cryptosporidium parvum
VQQEDESSSQNDCN

SEQ ID NO: 2287282 - protein, 4 aa, Cryptosporidium parvum
VQQR

SEQ ID NO: 2287283 - protein, 18 aa, Cryptosporidium parvum
VQRKTKAKGFVTSEDRLR

SEQ ID NO: 2287284 - protein, 6 aa, Cryptosporidium parvum
VQRQED

SEQ ID NO: 2287285 - protein, 10 aa, Cryptosporidium parvum
VQRTEKGKEV

SEQ ID NO: 2287286 - protein, 7 aa, Cryptosporidium parvum
VQSKGAQ

SEQ ID NO: 2287287 - protein, 18 aa, Cryptosporidium parvum
VQSKGQSRAKLSEKKQGK

SEQ ID NO: 2287288 - protein, 10 aa, Cryptosporidium parvum
VQSSDSEEIT

SEQ ID NO: 2287289 - protein, 18 aa, Cryptosporidium parvum
VQSTNSAFVQPSQNHSMN

SEQ ID NO: 2287290 - protein, 7 aa, Cryptosporidium parvum
VQSYTSY

SEQ ID NO: 2287291 - protein, 49 aa, Cryptosporidium parvum; identical to SEQ ID NO: 2166855

SEQ ID NO: 2287292 - protein, 6 aa, Cryptosporidium parvum
VQTATH

SEQ ID NO: 2287293 - protein, 12 aa, Cryptosporidium parvum
VQTKNKGGMDVK

SEQ ID NO: 2287294 - protein, 23 aa, Cryptosporidium parvum
VQTNDTTSINISPTTSGGDDDNL

SEQ ID NO: 2287295 - protein, 6 aa, Cryptosporidium parvum
VQTNEE

SEQ ID NO: 2287296 - protein, 7 aa, Cryptosporidium parvum
VQTRENE

SEQ ID NO: 2287297 - protein, 13 aa, Cryptosporidium parvum
VQTSTNTSMAEDN

SEQ ID NO: 2287298 - protein, 11 aa, Cryptosporidium parvum
VQVENQKPTNI

SEQ ID NO: 2287299 - protein, 8 aa, Cryptosporidium parvum
VQYSNKEN

SEQ ID NO: 2287300 - protein, 4 aa, Cryptosporidium parvum
VRAA

SEQ ID NO: 2287301 - protein, 10 aa, Cryptosporidium parvum
VRAQNSGSPQ

SEQ ID NO: 2287302 - protein, 22 aa, Cryptosporidium parvum
VRARSSNPFLSNPKSKKNVKMN

SEQ ID NO: 2287303 - protein, 17 aa, Cryptosporidium parvum
VRDNRNIDTNNSSNLKV

SEQ ID NO: 2287304 - protein, 5 aa, Cryptosporidium parvum
VRDNV

SEQ ID NO: 2287305 - protein, 10 aa, Cryptosporidium parvum
VREKDPTRSL

SEQ ID NO: 2287306 - protein, 10 aa, Cryptosporidium parvum
VRENDPNRAL

SEQ ID NO: 2287307 - protein, 11 aa, Cryptosporidium parvum
VRERKVTRGDQ

SEQ ID NO: 2287308 - protein, 4 aa, Cryptosporidium parvum
VRET

SEQ ID NO: 2287309 - protein, 12 aa, Cryptosporidium parvum
VRFSTKGSLGSG

SEQ ID NO: 2287310 - protein, 6 aa, Cryptosporidium parvum
VRGPSR

SEQ ID NO: 2287311 - protein, 12 aa, Cryptosporidium parvum
VRGSSGDKYRQQ

SEQ ID NO: 2287312 - protein, 6 aa, Cryptosporidium parvum
VRIEPE

SEQ ID NO: 2287313 - protein, 8 aa, Cryptosporidium parvum
VRKEDQAE

SEQ ID NO: 2287314 - protein, 7 aa, Cryptosporidium parvum
VRKSGVP

SEQ ID NO: 2287315 - protein, 10 aa, Cryptosporidium parvum
VRKSKTFSSR

SEQ ID NO: 2287316 - protein, 33 aa, Cryptosporidium parvum; identical to SEQ ID NO: 2166873

SEQ ID NO: 2287317 - protein, 6 aa, Cryptosporidium parvum
VRMDTD

SEQ ID NO: 2287318 - protein, 6 aa, Cryptosporidium parvum
VRNENN

SEQ ID NO: 2287319 - protein, 14 aa, Cryptosporidium parvum
VRNSEADVSKDSDH

SEQ ID NO: 2287320 - protein, 8 aa, Cryptosporidium parvum
VRNSSSNI

SEQ ID NO: 2287321 - protein, 6 aa, Cryptosporidium parvum
VRNTEK

SEQ ID NO: 2287322 - protein, 5 aa, Cryptosporidium parvum
VRNTS

SEQ ID NO: 2287323 - protein, 15 aa, Cryptosporidium parvum
VRPDSKYTGRKRKSG

SEQ ID NO: 2287324 - protein, 6 aa, Cryptosporidium parvum
VRPENT

SEQ ID NO: 2287325 - protein, 7 aa, Cryptosporidium parvum
VRPRTIE

SEQ ID NO: 2287326 - protein, 19 aa, Cryptosporidium parvum
VRQGKEKELAKANAKGPNI

SEQ ID NO: 2287327 - protein, 4 aa, Cryptosporidium parvum
VRQR

SEQ ID NO: 2287328 - protein, 9 aa, Cryptosporidium parvum
VRQRGESDA

SEQ ID NO: 2287329 - protein, 8 aa, Cryptosporidium parvum
VRRGTEKF

SEQ ID NO: 2287330 - protein, 15 aa, Cryptosporidium parvum
VRRHKGKQQDGSNCS

SEQ ID NO: 2287331 - protein, 21 aa, Cryptosporidium parvum
VRSDSKEARRTSIQGKELEGE

SEQ ID NO: 2287332 - protein, 7 aa, Cryptosporidium parvum
VRSSGTC

SEQ ID NO: 2287333 - protein, 6 aa, Cryptosporidium parvum
VRTAES

SEQ ID NO: 2287334 - protein, 19 aa, Cryptosporidium parvum
VRTEDNEIRRSSQYNSANV

SEQ ID NO: 2287335 - protein, 6 aa, Cryptosporidium parvum
VRTLNG

SEQ ID NO: 2287336 - protein, 5 aa, Cryptosporidium parvum
VRTPT

SEQ ID NO: 2287337 - protein, 18 aa, Cryptosporidium parvum
VRTRDHQEQQKKCSAIQK

SEQ ID NO: 2287338 - protein, 4 aa, Cryptosporidium parvum
VRTS

SEQ ID NO: 2287339 - protein, 7 aa, Cryptosporidium parvum
VRTTGKT

SEQ ID NO: 2287340 - protein, 4 aa, Cryptosporidium parvum
VSAE

SEQ ID NO: 2287341 - protein, 22 aa, Cryptosporidium parvum
VSAGDATNSRTAVGKNEEGDLK

SEQ ID NO: 2287342 - protein, 17 aa, Cryptosporidium parvum
VSAGTGIPSSGGSILGN

SEQ ID NO: 2287343 - protein, 20 aa, Cryptosporidium parvum
VSALNTSSSRISSMENTKLN

SEQ ID NO: 2287344 - protein, 8 aa, Cryptosporidium parvum
VSAQQNVR

SEQ ID NO: 2287345 - protein, 14 aa, Cryptosporidium parvum
VSASGTSRSGQGAF

SEQ ID NO: 2287346 - protein, 14 aa, Cryptosporidium parvum
VSASRSSYLGTQSI

SEQ ID NO: 2287347 - protein, 17 aa, Cryptosporidium parvum
VSATGANAVQAGHHPPC

SEQ ID NO: 2287348 - protein, 8 aa, Cryptosporidium parvum
VSDASKSM

SEQ ID NO: 2287349 - protein, 6 aa, Cryptosporidium parvum
VSDDGT

SEQ ID NO: 2287350 - protein, 6 aa, Cryptosporidium parvum
VSDDNY

SEQ ID NO: 2287351 - protein, 5 aa, Cryptosporidium parvum
VSDDQ

SEQ ID NO: 2287352 - protein, 11 aa, Cryptosporidium parvum
VSDEAMESSET

SEQ ID NO: 2287353 - protein, 10 aa, Cryptosporidium parvum
VSDEKTIESF

SEQ ID NO: 2287354 - protein, 15 aa, Cryptosporidium parvum
VSDENCGTNFGTGGM

SEQ ID NO: 2287355 - protein, 9 aa, Cryptosporidium parvum
VSDGSELKT

SEQ ID NO: 2287356 - protein, 37 aa, Cryptosporidium parvum
VSDNNSNSVQNQSSGVSTNSSYTAGGGHTGNIGASNV

SEQ ID NO: 2287357 - protein, 13 aa, Cryptosporidium parvum
VSDPDSNDSKGDA

SEQ ID NO: 2287358 - protein, 6 aa, Cryptosporidium parvum
VSDPKL

SEQ ID NO: 2287359 - protein, 14 aa, Cryptosporidium parvum
VSDQTKVNSTSNEI

SEQ ID NO: 2287360 - protein, 12 aa, Cryptosporidium parvum
VSDRSTNIEEGT

SEQ ID NO: 2287361 - protein, 5 aa, Cryptosporidium parvum
VSDYG

SEQ ID NO: 2287362 - protein, 22 aa, Cryptosporidium parvum
VSEAQSPSTYKLSRPSSSNFSN

SEQ ID NO: 2287363 - protein, 5 aa, Cryptosporidium parvum
VSEDD

SEQ ID NO: 2287364 - protein, 6 aa, Cryptosporidium parvum
VSEDNR

SEQ ID NO: 2287365 - protein, 11 aa, Cryptosporidium parvum
VSEDTSDSDNY

SEQ ID NO: 2287366 - protein, 4 aa, Cryptosporidium parvum
VSEE

SEQ ID NO: 2287367 - protein, 8 aa, Cryptosporidium parvum
VSEEDDKL

SEQ ID NO: 2287368 - protein, 8 aa, Cryptosporidium parvum
VSEEENSE

SEQ ID NO: 2287369 - protein, 12 aa, Cryptosporidium parvum
VSEERKKTQQAL

SEQ ID NO: 2287370 - protein, 8 aa, Cryptosporidium parvum
VSEETTTG

SEQ ID NO: 2287371 - protein, 6 aa, Cryptosporidium parvum
VSEFRS

SEQ ID NO: 2287372 - protein, 6 aa, Cryptosporidium parvum
VSEGIN

SEQ ID NO: 2287373 - protein, 9 aa, Cryptosporidium parvum
VSEKKRDEI

SEQ ID NO: 2287374 - protein, 8 aa, Cryptosporidium parvum
VSEKLAKT

SEQ ID NO: 2287375 - protein, 32 aa, Cryptosporidium parvum
VSEKRRNDEQQSVPKRAPNKRASASPNTGVSR

SEQ ID NO: 2287376 - protein, 7 aa, Cryptosporidium parvum
VSEKSDD

SEQ ID NO: 2287377 - protein, 4 aa, Cryptosporidium parvum
VSEL

SEQ ID NO: 2287378 - protein, 30 aa, Cryptosporidium parvum
VSENATRRSSRINKNGYDSDSLNHEQSSTF

SEQ ID NO: 2287379 - protein, 6 aa, Cryptosporidium parvum
VSENDT

SEQ ID NO: 2287380 - protein, 7 aa, Cryptosporidium parvum
VSENRTA

SEQ ID NO: 2287381 - protein, 6 aa, Cryptosporidium parvum
VSEPPK

SEQ ID NO: 2287382 - protein, 6 aa, Cryptosporidium parvum
VSEQAK

SEQ ID NO: 2287383 - protein, 8 aa, Cryptosporidium parvum
VSESASKL

SEQ ID NO: 2287384 - protein, 6 aa, Cryptosporidium parvum
VSESDR

SEQ ID NO: 2287385 - protein, 7 aa, Cryptosporidium parvum
VSESGKR

SEQ ID NO: 2287386 - protein, 13 aa, Cryptosporidium parvum
VSESKQKGPKMSL

SEQ ID NO: 2287387 - protein, 8 aa, Cryptosporidium parvum
VSESLQRK

SEQ ID NO: 2287388 - protein, 4 aa, Cryptosporidium parvum
VSET

SEQ ID NO: 2287389 - protein, 7 aa, Cryptosporidium parvum
VSETSIT

SEQ ID NO: 2287390 - protein, 7 aa, Cryptosporidium parvum
VSEWENG

SEQ ID NO: 2287391 - protein, 26 aa, Cryptosporidium parvum
VSFSRSGSNIMSNSNGIGNGIKSEFD

SEQ ID NO: 2287392 - protein, 6 aa, Cryptosporidium parvum
VSGAPN

SEQ ID NO: 2287393 - protein, 4 aa, Cryptosporidium parvum
VSGE

SEQ ID NO: 2287394 - protein, 6 aa, Cryptosporidium parvum
VSGEFD

SEQ ID NO: 2287395 - protein, 12 aa, Cryptosporidium parvum
VSGEGQPTSSSS

SEQ ID NO: 2287396 - protein, 8 aa, Cryptosporidium parvum
VSGELKGN

SEQ ID NO: 2287397 - protein, 7 aa, Cryptosporidium parvum
VSGENQH

SEQ ID NO: 2287398 - protein, 7 aa, Cryptosporidium parvum
VSGGGQI

SEQ ID NO: 2287399 - protein, 8 aa, Cryptosporidium parvum
VSGKRSVE

SEQ ID NO: 2287400 - protein, 8 aa, Cryptosporidium parvum
VSGKYEPN

SEQ ID NO: 2287401 - protein, 18 aa, Cryptosporidium parvum
VSGRKRRLSSDDEETPIK

SEQ ID NO: 2287402 - protein, 8 aa, Cryptosporidium parvum
VSGSNQKW

SEQ ID NO: 2287403 - protein, 9 aa, Cryptosporidium parvum
VSGTGWDVR

SEQ ID NO: 2287404 - protein, 21 aa, Cryptosporidium parvum
VSGTPGKPSVPGTSGVGNSNS

SEQ ID NO: 2287405 - protein, 8 aa, Cryptosporidium parvum
VSGTSEAS

SEQ ID NO: 2287406 - protein, 9 aa, Cryptosporidium parvum
VSHDSEGNL

SEQ ID NO: 2287407 - protein, 9 aa, Cryptosporidium parvum
VSHTNGNPV

SEQ ID NO: 2287408 - protein, 11 aa, Cryptosporidium parvum
VSIDNSGPTIP

SEQ ID NO: 2287409 - protein, 6 aa, Cryptosporidium parvum
VSIKKG

SEQ ID NO: 2287410 - protein, 10 aa, Cryptosporidium parvum
VSKDSSKIEF

SEQ ID NO: 2287411 - protein, 11 aa, Cryptosporidium parvum
VSKESKPAFSK

SEQ ID NO: 2287412 - protein, 4 aa, Cryptosporidium parvum
VSKG

SEQ ID NO: 2287413 - protein, 8 aa, Cryptosporidium parvum
VSKGGTQL

SEQ ID NO: 2287414 - protein, 14 aa, Cryptosporidium parvum
VSKGNNVSNKDGRT

SEQ ID NO: 2287415 - protein, 12 aa, Cryptosporidium parvum
VSKHREGSTGTN

SEQ ID NO: 2287416 - protein, 12 aa, Cryptosporidium parvum
VSKNAPSGEYLS

SEQ ID NO: 2287417 - protein, 10 aa, Cryptosporidium parvum
VSKPDDSDVI

SEQ ID NO: 2287418 - protein, 7 aa, Cryptosporidium parvum
VSKPGWG

SEQ ID NO: 2287419 - protein, 8 aa, Cryptosporidium parvum
VSKRRGPV

SEQ ID NO: 2287420 - protein, 19 aa, Cryptosporidium parvum
VSKRSNPDTETSSSSGIDE

SEQ ID NO: 2287421 - protein, 12 aa, Cryptosporidium parvum
VSKRTELTEQQK

SEQ ID NO: 2287422 - protein, 4 aa, Cryptosporidium parvum
VSKY

SEQ ID NO: 2287423 - protein, 15 aa, Cryptosporidium parvum
VSLNSGGNNEKKNRW

SEQ ID NO: 2287424 - protein, 6 aa, Cryptosporidium parvum
VSLTDY

SEQ ID NO: 2287425 - protein, 17 aa, Cryptosporidium parvum
VSNDENSSNSEEETNLV

SEQ ID NO: 2287426 - protein, 8 aa, Cryptosporidium parvum
VSNDYNSQ

SEQ ID NO: 2287427 - protein, 9 aa, Cryptosporidium parvum
VSNEGSHGD

SEQ ID NO: 2287428 - protein, 7 aa, Cryptosporidium parvum
VSNETER

SEQ ID NO: 2287429 - protein, 6 aa, Cryptosporidium parvum
VSNETM

SEQ ID NO: 2287430 - protein, 22 aa, Cryptosporidium parvum
VSNFDDTPNNSKNKKSQGNLNS

SEQ ID NO: 2287431 - protein, 10 aa, Cryptosporidium parvum
VSNGSHPSNV

SEQ ID NO: 2287432 - protein, 15 aa, Cryptosporidium parvum
VSNGTKVTKRSSSFH

SEQ ID NO: 2287433 - protein, 8 aa, Cryptosporidium parvum
VSNKNDEE

SEQ ID NO: 2287434 - protein, 19 aa, Cryptosporidium parvum
VSNKVDTDSKISLISTNSK

SEQ ID NO: 2287435 - protein, 8 aa, Cryptosporidium parvum
VSNLNQPE

SEQ ID NO: 2287436 - protein, 12 aa, Cryptosporidium parvum
VSNLNSSESERH

SEQ ID NO: 2287437 - protein, 9 aa, Cryptosporidium parvum
VSNNEGAGG

SEQ ID NO: 2287438 - protein, 13 aa, Cryptosporidium parvum
VSNNQREGVEKEP

SEQ ID NO: 2287439 - protein, 9 aa, Cryptosporidium parvum
VSNNSAENK

SEQ ID NO: 2287440 - protein, 8 aa, Cryptosporidium parvum
VSNNSNRS

SEQ ID NO: 2287441 - protein, 7 aa, Cryptosporidium parvum
VSNPGSH

SEQ ID NO: 2287442 - protein, 10 aa, Cryptosporidium parvum
VSNPSPTSKS

SEQ ID NO: 2287443 - protein, 10 aa, Cryptosporidium parvum
VSNQDETTSE

SEQ ID NO: 2287444 - protein, 8 aa, Cryptosporidium parvum
VSNRQGSS

SEQ ID NO: 2287445 - protein, 6 aa, Cryptosporidium parvum
VSNSEV

SEQ ID NO: 2287446 - protein, 6 aa, Cryptosporidium parvum
VSNSGW

SEQ ID NO: 2287447 - protein, 14 aa, Cryptosporidium parvum
VSNSSQSQYNGTNI

SEQ ID NO: 2287448 - protein, 9 aa, Cryptosporidium parvum
VSNTSGKCN

SEQ ID NO: 2287449 - protein, 21 aa, Cryptosporidium parvum
VSPDAKRIKDSNGSEDDYASE

SEQ ID NO: 2287450 - protein, 6 aa, Cryptosporidium parvum
VSPDGQ

SEQ ID NO: 2287451 - protein, 4 aa, Cryptosporidium parvum
VSPE

SEQ ID NO: 2287452 - protein, 4 aa, Cryptosporidium parvum
VSPG

SEQ ID NO: 2287453 - protein, 5 aa, Cryptosporidium parvum
VSPHE

SEQ ID NO: 2287454 - protein, 6 aa, Cryptosporidium parvum
VSPHET

SEQ ID NO: 2287455 - protein, 7 aa, Cryptosporidium parvum
VSPHPEL

SEQ ID NO: 2287456 - protein, 4 aa, Cryptosporidium parvum
VSPN

SEQ ID NO: 2287457 - protein, 15 aa, Cryptosporidium parvum
VSPPGGDFSDPVTTA

SEQ ID NO: 2287458 - protein, 26 aa, Cryptosporidium parvum
VSPPGYGKSGKLTNSKIGNKSETISS

SEQ ID NO: 2287459 - protein, 37 aa, Cryptosporidium parvum
VSPPQMSSNQSVKLPATSNPVVSPSVSAAAAAAAAAA

SEQ ID NO: 2287460 - protein, 8 aa, Cryptosporidium parvum
VSPRNNSI

SEQ ID NO: 2287461 - protein, 6 aa, Cryptosporidium parvum
VSPSEL

SEQ ID NO: 2287462 - protein, 30 aa, Cryptosporidium parvum
VSPSSHSKSIVEPAKDQTVNNYSATPLSDN

SEQ ID NO: 2287463 - protein, 6 aa, Cryptosporidium parvum
VSPTHY

SEQ ID NO: 2287464 - protein, 16 aa, Cryptosporidium parvum
VSPTNTSRPSKYSPGC

SEQ ID NO: 2287465 - protein, 9 aa, Cryptosporidium parvum
VSPTTGASG

SEQ ID NO: 2287466 - protein, 9 aa, Cryptosporidium parvum
VSQAKDDKH

SEQ ID NO: 2287467 - protein, 6 aa, Cryptosporidium parvum
VSQESP

SEQ ID NO: 2287468 - protein, 5 aa, Cryptosporidium parvum
VSQKA

SEQ ID NO: 2287469 - protein, 6 aa, Cryptosporidium parvum
VSQKEK

SEQ ID NO: 2287470 - protein, 9 aa, Cryptosporidium parvum
VSQNSPGQV

SEQ ID NO: 2287471 - protein, 10 aa, Cryptosporidium parvum
VSQPINSQKS

SEQ ID NO: 2287472 - protein, 17 aa, Cryptosporidium parvum
VSQSDPVNDSDINDIPR

SEQ ID NO: 2287473 - protein, 7 aa, Cryptosporidium parvum
VSQTNSK

SEQ ID NO: 2287474 - protein, 14 aa, Cryptosporidium parvum
VSQTPEVSSSGENY

SEQ ID NO: 2287475 - protein, 13 aa, Cryptosporidium parvum
VSQTQNDTSSEIN

SEQ ID NO: 2287476 - protein, 7 aa, Cryptosporidium parvum
VSRDEKV

SEQ ID NO: 2287477 - protein, 107 aa, Cryptosporidium parvum
VSRGRSRSRRNSSKSNFSESNRNSIIGSSDSEKDSKIASKSKSKDKLKSESKNKLSSGSNSENSIESESSSSSSSSSESGSRSASRSESNSSSRSESESSNSENEMK

SEQ ID NO: 2287478 - protein, 8 aa, Cryptosporidium parvum
VSRNNDNM

SEQ ID NO: 2287479 - protein, 35 aa, Cryptosporidium parvum
VSRNRSTSLNQSSCENPERGRNNHRKIETPQNESN

SEQ ID NO: 2287480 - protein, 31 aa, Cryptosporidium parvum
VSRPNDYSQALQSSSSSTAVGGSGTNIQSPY

SEQ ID NO: 2287481 - protein, 5 aa, Cryptosporidium parvum
VSRSL

SEQ ID NO: 2287482 - protein, 12 aa, Cryptosporidium parvum
VSRTAGGPTRIQ

SEQ ID NO: 2287483 - protein, 12 aa, Cryptosporidium parvum
VSSANLSDSNMP

SEQ ID NO: 2287484 - protein, 4 aa, Cryptosporidium parvum
VSSD

SEQ ID NO: 2287485 - protein, 7 aa, Cryptosporidium parvum
VSSDGVY

SEQ ID NO: 2287486 - protein, 23 aa, Cryptosporidium parvum
VSSEDNSDNTASSDINDKDKNLS

SEQ ID NO: 2287487 - protein, 5 aa, Cryptosporidium parvum
VSSEN

SEQ ID NO: 2287488 - protein, 7 aa, Cryptosporidium parvum
VSSFPGS

SEQ ID NO: 2287489 - protein, 7 aa, Cryptosporidium parvum
VSSISGG

SEQ ID NO: 2287490 - protein, 26 aa, Cryptosporidium parvum
VSSKEETNKIEPTVKSDDKKDQLDKT

SEQ ID NO: 2287491 - protein, 7 aa, Cryptosporidium parvum
VSSLPNE

SEQ ID NO: 2287492 - protein, 14 aa, Cryptosporidium parvum
VSSLRKATSRSCDS

SEQ ID NO: 2287493 - protein, 14 aa, Cryptosporidium parvum
VSSLSNEQVDQIRK

SEQ ID NO: 2287494 - protein, 7 aa, Cryptosporidium parvum
VSSNGNA

SEQ ID NO: 2287495 - protein, 24 aa, Cryptosporidium parvum
VSSNSNGIKGGASNASNSHDPNNL

SEQ ID NO: 2287496 - protein, 9 aa, Cryptosporidium parvum
VSSNSSGSI

SEQ ID NO: 2287497 - protein, 10 aa, Cryptosporidium parvum
VSSNSTGKGM

SEQ ID NO: 2287498 - protein, 10 aa, Cryptosporidium parvum
VSSPNKPGKI

SEQ ID NO: 2287499 - protein, 10 aa, Cryptosporidium parvum
VSSPNSIPNM

SEQ ID NO: 2287500 - protein, 13 aa, Cryptosporidium parvum
VSSPSNDEDVSEK

SEQ ID NO: 2287501 - protein, 11 aa, Cryptosporidium parvum
VSSQQRKHNSM

SEQ ID NO: 2287502 - protein, 9 aa, Cryptosporidium parvum
VSSSDSPLN

SEQ ID NO: 2287503 - protein, 11 aa, Cryptosporidium parvum
VSSSESTAISP

SEQ ID NO: 2287504 - protein, 9 aa, Cryptosporidium parvum
VSSSNFSSN

SEQ ID NO: 2287505 - protein, 26 aa, Cryptosporidium parvum
VSSSSSKKESGGESTNLDDPTQNSLS

SEQ ID NO: 2287506 - protein, 11 aa, Cryptosporidium parvum
VSSSSSSKENL

SEQ ID NO: 2287507 - protein, 18 aa, Cryptosporidium parvum
VSSSSSSLQSLSYSDGDL

SEQ ID NO: 2287508 - protein, 11 aa, Cryptosporidium parvum
VSSTGGKKEIK

SEQ ID NO: 2287509 - protein, 6 aa, Cryptosporidium parvum
VSSTPI

SEQ ID NO: 2287510 - protein, 16 aa, Cryptosporidium parvum
VSSVESEGFDPSQLPS

SEQ ID NO: 2287511 - protein, 9 aa, Cryptosporidium parvum
VSTEKESEQ

SEQ ID NO: 2287512 - protein, 8 aa, Cryptosporidium parvum
VSTFSPDG

SEQ ID NO: 2287513 - protein, 41 aa, Cryptosporidium parvum; identical to SEQ ID NO: 2167037

SEQ ID NO: 2287514 - protein, 13 aa, Cryptosporidium parvum
VSTNEDGKGLKGN

SEQ ID NO: 2287515 - protein, 47 aa, Cryptosporidium parvum
VSTNNNNNNNNNNNNNNNNNNNNSNNNDNDDNDNDNDNDNDSGNNIN

SEQ ID NO: 2287516 - protein, 11 aa, Cryptosporidium parvum
VSTNRNDRPIQ

SEQ ID NO: 2287517 - protein, 4 aa, Cryptosporidium parvum
VSTP

SEQ ID NO: 2287518 - protein, 5 aa, Cryptosporidium parvum
VSTQA

SEQ ID NO: 2287519 - protein, 6 aa, Cryptosporidium parvum
VSTQHE

SEQ ID NO: 2287520 - protein, 13 aa, Cryptosporidium parvum
VSTQTSKVAATTG

SEQ ID NO: 2287521 - protein, 5 aa, Cryptosporidium parvum
VSTRK

SEQ ID NO: 2287522 - protein, 6 aa, Cryptosporidium parvum
VSTRNL

SEQ ID NO: 2287523 - protein, 19 aa, Cryptosporidium parvum
VSTSGSGNGLVESSREENN

SEQ ID NO: 2287524 - protein, 24 aa, Cryptosporidium parvum
VSTSSSSTSASSPTPSSSNPIDTS

SEQ ID NO: 2287525 - protein, 9 aa, Cryptosporidium parvum
VSTTLSAPK

SEQ ID NO: 2287526 - protein, 9 aa, Cryptosporidium parvum
VSTTSSLGS

SEQ ID NO: 2287527 - protein, 5 aa, Cryptosporidium parvum
VSVNP

SEQ ID NO: 2287528 - protein, 12 aa, Cryptosporidium parvum
VSVSSASTVVTK

SEQ ID NO: 2287529 - protein, 12 aa, Cryptosporidium parvum
VSYNSKSQPIKE

SEQ ID NO: 2287530 - protein, 4 aa, Cryptosporidium parvum
VTAD

SEQ ID NO: 2287531 - protein, 10 aa, Cryptosporidium parvum
VTAEKKRKLL

SEQ ID NO: 2287532 - protein, 18 aa, Cryptosporidium parvum
VTASNNNAANHSPPSISS

SEQ ID NO: 2287533 - protein, 16 aa, Cryptosporidium parvum
VTASSPAISPPSQALN

SEQ ID NO: 2287534 - protein, 31 aa, Cryptosporidium parvum; identical to SEQ ID NO: 2167052

SEQ ID NO: 2287535 - protein, 5 aa, Cryptosporidium parvum
VTDDT

SEQ ID NO: 2287536 - protein, 8 aa, Cryptosporidium parvum
VTDNTGTG

SEQ ID NO: 2287537 - protein, 10 aa, Cryptosporidium parvum
VTDPENKSIG

SEQ ID NO: 2287538 - protein, 13 aa, Cryptosporidium parvum
VTDPGDSDIIRSY

SEQ ID NO: 2287539 - protein, 8 aa, Cryptosporidium parvum
VTDQSGFE

SEQ ID NO: 2287540 - protein, 10 aa, Cryptosporidium parvum
VTEASKDNTT

SEQ ID NO: 2287541 - protein, 4 aa, Cryptosporidium parvum
VTED

SEQ ID NO: 2287542 - protein, 7 aa, Cryptosporidium parvum
VTEDNDK

SEQ ID NO: 2287543 - protein, 9 aa, Cryptosporidium parvum
VTEDPEYQE

SEQ ID NO: 2287544 - protein, 6 aa, Cryptosporidium parvum
VTEDQK

SEQ ID NO: 2287545 - protein, 14 aa, Cryptosporidium parvum
VTEDQKSEIKGIPK

SEQ ID NO: 2287546 - protein, 6 aa, Cryptosporidium parvum
VTEEND

SEQ ID NO: 2287547 - protein, 24 aa, Cryptosporidium parvum
VTEGNGSTGSISFNGNSMSRGRRM

SEQ ID NO: 2287548 - protein, 9 aa, Cryptosporidium parvum
VTEIEDPNS

SEQ ID NO: 2287549 - protein, 19 aa, Cryptosporidium parvum
VTEKATSEAVEQKAAELTQ

SEQ ID NO: 2287550 - protein, 6 aa, Cryptosporidium parvum
VTEKNR

SEQ ID NO: 2287551 - protein, 53 aa, Cryptosporidium parvum; identical to SEQ ID NO: 2167063

SEQ ID NO: 2287552 - protein, 6 aa, Cryptosporidium parvum
VTEQTI

SEQ ID NO: 2287553 - protein, 9 aa, Cryptosporidium parvum
VTERSENQN

SEQ ID NO: 2287554 - protein, 8 aa, Cryptosporidium parvum
VTESNGYI

SEQ ID NO: 2287555 - protein, 36 aa, Cryptosporidium parvum
VTETETVTATETVTATEAVTATATADNEENNNDKQA

SEQ ID NO: 2287556 - protein, 5 aa, Cryptosporidium parvum
VTETS

SEQ ID NO: 2287557 - protein, 12 aa, Cryptosporidium parvum
VTGEASSSVRKG

SEQ ID NO: 2287558 - protein, 4 aa, Cryptosporidium parvum
VTGG

SEQ ID NO: 2287559 - protein, 7 aa, Cryptosporidium parvum
VTGGNPL

SEQ ID NO: 2287560 - protein, 5 aa, Cryptosporidium parvum
VTGHH

SEQ ID NO: 2287561 - protein, 4 aa, Cryptosporidium parvum
VTGK

SEQ ID NO: 2287562 - protein, 23 aa, Cryptosporidium parvum
VTGLPAPPTLATPPGLATPPSVP

SEQ ID NO: 2287563 - protein, 5 aa, Cryptosporidium parvum
VTGPI

SEQ ID NO: 2287564 - protein, 13 aa, Cryptosporidium parvum
VTGSGIGVGTGGI

SEQ ID NO: 2287565 - protein, 9 aa, Cryptosporidium parvum
VTGSTFHRD

SEQ ID NO: 2287566 - protein, 7 aa, Cryptosporidium parvum
VTGTEDK

SEQ ID NO: 2287567 - protein, 8 aa, Cryptosporidium parvum
VTHPGSGY

SEQ ID NO: 2287568 - protein, 13 aa, Cryptosporidium parvum
VTINADKKSISNK

SEQ ID NO: 2287569 - protein, 6 aa, Cryptosporidium parvum
VTKKSP

SEQ ID NO: 2287570 - protein, 10 aa, Cryptosporidium parvum
VTKNKDGSLV

SEQ ID NO: 2287571 - protein, 12 aa, Cryptosporidium parvum
VTKNSTIGEGRK

SEQ ID NO: 2287572 - protein, 8 aa, Cryptosporidium parvum
VTKSGVNK

SEQ ID NO: 2287573 - protein, 10 aa, Cryptosporidium parvum
VTKTEKEMEA

SEQ ID NO: 2287574 - protein, 4 aa, Cryptosporidium parvum
VTNE

SEQ ID NO: 2287575 - protein, 5 aa, Cryptosporidium parvum
VTNET

SEQ ID NO: 2287576 - protein, 16 aa, Cryptosporidium parvum
VTNISGDINSSGPELQ

SEQ ID NO: 2287577 - protein, 18 aa, Cryptosporidium parvum
VTNKDDAPRLNQSSFKTG

SEQ ID NO: 2287578 - protein, 18 aa, Cryptosporidium parvum
VTNNDQVGINKEEQSSYL

SEQ ID NO: 2287579 - protein, 9 aa, Cryptosporidium parvum
VTNNKTDKF

SEQ ID NO: 2287580 - protein, 16 aa, Cryptosporidium parvum
VTNNPEIDGCINAVLL

SEQ ID NO: 2287581 - protein, 6 aa, Cryptosporidium parvum
VTNSRA

SEQ ID NO: 2287582 - protein, 9 aa, Cryptosporidium parvum
VTNSSPSFS

SEQ ID NO: 2287583 - protein, 65 aa, Cryptosporidium parvum
VTNTKRPISSKNQSTTTTTTKMTTTTTSTSTSTSSSSSSSSADVTNSDTSNEETNTEDSESSELE

SEQ ID NO: 2287584 - protein, 13 aa, Cryptosporidium parvum
VTPDGHNFSTRKR

SEQ ID NO: 2287585 - protein, 8 aa, Cryptosporidium parvum
VTPDSRDD

SEQ ID NO: 2287586 - protein, 4 aa, Cryptosporidium parvum
VTPE

SEQ ID NO: 2287587 - protein, 5 aa, Cryptosporidium parvum
VTPGH

SEQ ID NO: 2287588 - protein, 45 aa, Cryptosporidium parvum
VTPHTTTTKEEGGKHYSSQNNNGISTSRKDFHATPNRRGGGDSHY

SEQ ID NO: 2287589 - protein, 4 aa, Cryptosporidium parvum
VTPL

SEQ ID NO: 2287590 - protein, 5 aa, Cryptosporidium parvum
VTPNA

SEQ ID NO: 2287591 - protein, 5 aa, Cryptosporidium parvum
VTPNE

SEQ ID NO: 2287592 - protein, 9 aa, Cryptosporidium parvum
VTPPPPMNH

SEQ ID NO: 2287593 - protein, 5 aa, Cryptosporidium parvum
VTPRP

SEQ ID NO: 2287594 - protein, 5 aa, Cryptosporidium parvum
VTPSD

SEQ ID NO: 2287595 - protein, 7 aa, Cryptosporidium parvum
VTPSGKQ

SEQ ID NO: 2287596 - protein, 6 aa, Cryptosporidium parvum
VTPSKP

SEQ ID NO: 2287597 - protein, 5 aa, Cryptosporidium parvum
VTQDN

SEQ ID NO: 2287598 - protein, 4 aa, Cryptosporidium parvum
VTQE

SEQ ID NO: 2287599 - protein, 5 aa, Cryptosporidium parvum
VTQER

SEQ ID NO: 2287600 - protein, 5 aa, Cryptosporidium parvum
VTQES

SEQ ID NO: 2287601 - protein, 5 aa, Cryptosporidium parvum
VTQGQ

SEQ ID NO: 2287602 - protein, 19 aa, Cryptosporidium parvum
VTQINTNKKSKKRKSTEIL

SEQ ID NO: 2287603 - protein, 10 aa, Cryptosporidium parvum
VTQKSVNSTI

SEQ ID NO: 2287604 - protein, 8 aa, Cryptosporidium parvum
VTQNKKDT

SEQ ID NO: 2287605 - protein, 9 aa, Cryptosporidium parvum
VTRESSQDW

SEQ ID NO: 2287606 - protein, 8 aa, Cryptosporidium parvum
VTRQSYDE

SEQ ID NO: 2287607 - protein, 4 aa, Cryptosporidium parvum
VTSA

SEQ ID NO: 2287608 - protein, 6 aa, Cryptosporidium parvum
VTSANL

SEQ ID NO: 2287609 - protein, 9 aa, Cryptosporidium parvum
VTSDDPNLS

SEQ ID NO: 2287610 - protein, 11 aa, Cryptosporidium parvum
VTSDEGRELAD

SEQ ID NO: 2287611 - protein, 9 aa, Cryptosporidium parvum
VTSEDEGKL

SEQ ID NO: 2287612 - protein, 8 aa, Cryptosporidium parvum
VTSGTEKD

SEQ ID NO: 2287613 - protein, 9 aa, Cryptosporidium parvum
VTSISGDKI

SEQ ID NO: 2287614 - protein, 11 aa, Cryptosporidium parvum
VTSKNHGYRGK

SEQ ID NO: 2287615 - protein, 6 aa, Cryptosporidium parvum
VTSNSD

SEQ ID NO: 2287616 - protein, 9 aa, Cryptosporidium parvum
VTSPELTPQ

SEQ ID NO: 2287617 - protein, 13 aa, Cryptosporidium parvum
VTSPENKGKSKHL

SEQ ID NO: 2287618 - protein, 5 aa, Cryptosporidium parvum
VTSPV

SEQ ID NO: 2287619 - protein, 9 aa, Cryptosporidium parvum
VTSQGPGTS

SEQ ID NO: 2287620 - protein, 17 aa, Cryptosporidium parvum
VTSRSRNQSRPISPVEK

SEQ ID NO: 2287621 - protein, 14 aa, Cryptosporidium parvum
VTSSTTTSSPSAIT

SEQ ID NO: 2287622 - protein, 4 aa, Cryptosporidium parvum
VTTK

SEQ ID NO: 2287623 - protein, 10 aa, Cryptosporidium parvum
VTTPNGNDSN

SEQ ID NO: 2287624 - protein, 7 aa, Cryptosporidium parvum
VTTSEYI

SEQ ID NO: 2287625 - protein, 12 aa, Cryptosporidium parvum
VTTSINTPNTIC

SEQ ID NO: 2287626 - protein, 13 aa, Cryptosporidium parvum
VTTTKGEKTLSPN

SEQ ID NO: 2287627 - protein, 9 aa, Cryptosporidium parvum
VTTTTQIQS

SEQ ID NO: 2287628 - protein, 30 aa, Cryptosporidium parvum
VTYEKSGTYTSQRTEPRTPTCQNSSPGVQS

SEQ ID NO: 2287629 - protein, 11 aa, Cryptosporidium parvum
VVEPNSSQSNL

SEQ ID NO: 2287630 - protein, 7 aa, Cryptosporidium parvum
VVGGPNI

SEQ ID NO: 2287631 - protein, 7 aa, Cryptosporidium parvum
VVNGKGS

SEQ ID NO: 2287632 - protein, 4 aa, Cryptosporidium parvum
VVPG

SEQ ID NO: 2287633 - protein, 12 aa, Cryptosporidium parvum
VVPGGGASEIAS

SEQ ID NO: 2287634 - protein, 18 aa, Cryptosporidium parvum
VVPGSAVTTASISGGSKM

SEQ ID NO: 2287635 - protein, 22 aa, Cryptosporidium parvum
VVPQSNSYIRPQSRTKNCESVE

SEQ ID NO: 2287636 - protein, 8 aa, Cryptosporidium parvum
VVQSPERL

SEQ ID NO: 2287637 - protein, 10 aa, Cryptosporidium parvum
VVRSDGTKEI

SEQ ID NO: 2287638 - protein, 7 aa, Cryptosporidium parvum
VVSSQQK

SEQ ID NO: 2287639 - protein, 7 aa, Cryptosporidium parvum
VVSSTQD

SEQ ID NO: 2287640 - protein, 11 aa, Cryptosporidium parvum
VVTNGSPKVEL

SEQ ID NO: 2287641 - protein, 197 aa, Cryptosporidium parvum
VVTTTSTTGYPTTTTTGSPNTTTSTTRSPTTTSTTGNPTTTTTKAPNATTTSTTGNPTTTTTKAPNVTTTSTTRSPIATTTGSPTTTTTKAPNVTTTSTTEHPTTTSTTGYPTTTSTTGYPTTTSTTGYPTTTSTTGYPTTTSTTGQPTTTSTTGYPTTTSTTGYPTTTTTTTIPDITTTTTEYPNTTTTTSEPPKY

SEQ ID NO: 2287642 - protein, 11 aa, Cryptosporidium parvum
VYEDESNRNSQ

SEQ ID NO: 2287643 - protein, 16 aa, Cryptosporidium parvum
VYGDSKERSKQEEYKN

SEQ ID NO: 2287644 - protein, 7 aa, Cryptosporidium parvum
VYGNTTN

SEQ ID NO: 2287645 - protein, 6 aa, Cryptosporidium parvum
VYGPKG

SEQ ID NO: 2287646 - protein, 7 aa, Cryptosporidium parvum
VYNPRTR

SEQ ID NO: 2287647 - protein, 6 aa, Cryptosporidium parvum
VYPPSD

SEQ ID NO: 2287648 - protein, 8 aa, Cryptosporidium parvum
VYSTKRPK

SEQ ID NO: 2287649 - protein, 13 aa, Cryptosporidium parvum
VYTSGKSSTAAGL

SEQ ID NO: 2287650 - protein, 29 aa, Cryptosporidium parvum
VYTSSNSQHIHSNSNSSHIESKKQSGHIN

SEQ ID NO: 2287651 - protein, 4 aa, Cryptosporidium parvum
WAAG

SEQ ID NO: 2287652 - protein, 5 aa, Cryptosporidium parvum
WADED

SEQ ID NO: 2287653 - protein, 10 aa, Cryptosporidium parvum
WANGRKDGKG

SEQ ID NO: 2287654 - protein, 25 aa, Cryptosporidium parvum
WASTSSSGESDTEPELTSFYPHFNS

SEQ ID NO: 2287655 - protein, 7 aa, Cryptosporidium parvum
WDDIGNN

SEQ ID NO: 2287656 - protein, 6 aa, Cryptosporidium parvum
WDDSRD

SEQ ID NO: 2287657 - protein, 19 aa, Cryptosporidium parvum
WDETQKELHNAKNSLSDVS

SEQ ID NO: 2287658 - protein, 7 aa, Cryptosporidium parvum
WDPNDKL

SEQ ID NO: 2287659 - protein, 7 aa, Cryptosporidium parvum
WDQSDKS

SEQ ID NO: 2287660 - protein, 6 aa, Cryptosporidium parvum
WDRTSQ

SEQ ID NO: 2287661 - protein, 13 aa, Cryptosporidium parvum
WDSDEEKKVNHSN

SEQ ID NO: 2287662 - protein, 6 aa, Cryptosporidium parvum
WDSNRS

SEQ ID NO: 2287663 - protein, 15 aa, Cryptosporidium parvum
WDSNSKSDQLNTSQD

SEQ ID NO: 2287664 - protein, 8 aa, Cryptosporidium parvum
WDSRDSYK

SEQ ID NO: 2287665 - protein, 4 aa, Cryptosporidium parvum
WDTQ

SEQ ID NO: 2287666 - protein, 16 aa, Cryptosporidium parvum
WEEEEEDSGWSSEDEK

SEQ ID NO: 2287667 - protein, 12 aa, Cryptosporidium parvum
WEGDDDNNYKNN

SEQ ID NO: 2287668 - protein, 7 aa, Cryptosporidium parvum
WEKPSKY

SEQ ID NO: 2287669 - protein, 5 aa, Cryptosporidium parvum
WESVG

SEQ ID NO: 2287670 - protein, 22 aa, Cryptosporidium parvum
WGAHGGGAFSGKDATKVDRSGA

SEQ ID NO: 2287671 - protein, 16 aa, Cryptosporidium parvum
WGGKSYSCTPTTKESL

SEQ ID NO: 2287672 - protein, 10 aa, Cryptosporidium parvum
WGLPSPDSQG

SEQ ID NO: 2287673 - protein, 24 aa, Cryptosporidium parvum
WGSKQINTQNSQLGSISNNRDFST

SEQ ID NO: 2287674 - protein, 8 aa, Cryptosporidium parvum
WIGPTTSS

SEQ ID NO: 2287675 - protein, 16 aa, Cryptosporidium parvum
WKDREIDSDKNKRFDE

SEQ ID NO: 2287676 - protein, 8 aa, Cryptosporidium parvum
WKESDESN

SEQ ID NO: 2287677 - protein, 21 aa, Cryptosporidium parvum
WKESNSQKRINDENSSSYTIQ

SEQ ID NO: 2287678 - protein, 5 aa, Cryptosporidium parvum
WKGNK

SEQ ID NO: 2287679 - protein, 15 aa, Cryptosporidium parvum
WKKSPENPMNENPKL

SEQ ID NO: 2287680 - protein, 21 aa, Cryptosporidium parvum
WKNDNVSKKNYNHEETPKVGQ

SEQ ID NO: 2287681 - protein, 8 aa, Cryptosporidium parvum
WKNNETQM

SEQ ID NO: 2287682 - protein, 7 aa, Cryptosporidium parvum
WKQQKDQ

SEQ ID NO: 2287683 - protein, 8 aa, Cryptosporidium parvum
WKSDSNPV

SEQ ID NO: 2287684 - protein, 12 aa, Cryptosporidium parvum
WKSNRQLSEYIF

SEQ ID NO: 2287685 - protein, 4 aa, Cryptosporidium parvum
WKSS

SEQ ID NO: 2287686 - protein, 8 aa, Cryptosporidium parvum
WKTDPDHP

SEQ ID NO: 2287687 - protein, 6 aa, Cryptosporidium parvum
WKTHPQ

SEQ ID NO: 2287688 - protein, 4 aa, Cryptosporidium parvum
WMRP

SEQ ID NO: 2287689 - protein, 73 aa, Cryptosporidium parvum
WNDSKKKKTGASRKRKNETTKKQESLKVKNPQKSNLKKTSAKPTKKSRIDDSDEEDDYIDGDNYSDEDDYYDD

SEQ ID NO: 2287690 - protein, 14 aa, Cryptosporidium parvum
WNETSSNLSNSPKI

SEQ ID NO: 2287691 - protein, 5 aa, Cryptosporidium parvum
WNHPT

SEQ ID NO: 2287692 - protein, 10 aa, Cryptosporidium parvum
WNKENSPFQG

SEQ ID NO: 2287693 - protein, 10 aa, Cryptosporidium parvum
WNNAESQVKY

SEQ ID NO: 2287694 - protein, 4 aa, Cryptosporidium parvum
WNND

SEQ ID NO: 2287695 - protein, 9 aa, Cryptosporidium parvum
WNPANDKQA

SEQ ID NO: 2287696 - protein, 6 aa, Cryptosporidium parvum
WNPQAD

SEQ ID NO: 2287697 - protein, 19 aa, Cryptosporidium parvum
WNPQNDEQAQSRAHRIGQK

SEQ ID NO: 2287698 - protein, 12 aa, Cryptosporidium parvum
WNPQNDLQAEAR

SEQ ID NO: 2287699 - protein, 7 aa, Cryptosporidium parvum
WNPQNDV

SEQ ID NO: 2287700 - protein, 6 aa, Cryptosporidium parvum
WNPSNE

SEQ ID NO: 2287701 - protein, 42 aa, Cryptosporidium parvum
WNQPNTGSQASSMQTVSQGAQDIRNTDASNQGIPASTQKSLE

SEQ ID NO: 2287702 - protein, 12 aa, Cryptosporidium parvum
WNSNSAVSSPYG

SEQ ID NO: 2287703 - protein, 41 aa, Cryptosporidium parvum
WNSSERIQRSKPRTAKIAENTEDFDDYSEYTRPSEAPIRTP

SEQ ID NO: 2287704 - protein, 11 aa, Cryptosporidium parvum
WNSSNLNKSTV

SEQ ID NO: 2287705 - protein, 28 aa, Cryptosporidium parvum
WPFGSQNRENFPQNITSNSNNGKIDGSC

SEQ ID NO: 2287706 - protein, 8 aa, Cryptosporidium parvum
WPGGQTKQ

SEQ ID NO: 2287707 - protein, 7 aa, Cryptosporidium parvum
WPSEDGH

SEQ ID NO: 2287708 - protein, 9 aa, Cryptosporidium parvum
WPTRDGTGV

SEQ ID NO: 2287709 - protein, 5 aa, Cryptosporidium parvum
WQEGG

SEQ ID NO: 2287710 - protein, 8 aa, Cryptosporidium parvum
WQETRPEN

SEQ ID NO: 2287711 - protein, 5 aa, Cryptosporidium parvum
WQGKG

SEQ ID NO: 2287712 - protein, 5 aa, Cryptosporidium parvum
WRKPK

SEQ ID NO: 2287713 - protein, 8 aa, Cryptosporidium parvum
WRSKSKKN

SEQ ID NO: 2287714 - protein, 4 aa, Cryptosporidium parvum
WRSN

SEQ ID NO: 2287715 - protein, 15 aa, Cryptosporidium parvum
WRSNKNNTKNLYNGN

SEQ ID NO: 2287716 - protein, 8 aa, Cryptosporidium parvum
WRSNRTNK

SEQ ID NO: 2287717 - protein, 4 aa, Cryptosporidium parvum
WRTR

SEQ ID NO: 2287718 - protein, 6 aa, Cryptosporidium parvum
WSDEET

SEQ ID NO: 2287719 - protein, 6 aa, Cryptosporidium parvum
WSEDGD

SEQ ID NO: 2287720 - protein, 8 aa, Cryptosporidium parvum
WSEDKGMN

SEQ ID NO: 2287721 - protein, 22 aa, Cryptosporidium parvum
WSERSGYKEAWKKGENRYGDKW

SEQ ID NO: 2287722 - protein, 7 aa, Cryptosporidium parvum
WSGPGEN

SEQ ID NO: 2287723 - protein, 33 aa, Cryptosporidium parvum
WSGSTTNQNKEENNDQQSEFDHSTEKDQDEHTA

SEQ ID NO: 2287724 - protein, 11 aa, Cryptosporidium parvum
WSKKNNGKQLR

SEQ ID NO: 2287725 - protein, 8 aa, Cryptosporidium parvum
WSKRDREN

SEQ ID NO: 2287726 - protein, 5 aa, Cryptosporidium parvum
WSNQE

SEQ ID NO: 2287727 - protein, 49 aa, Cryptosporidium parvum
WSNRNGNTEEVDKSISNNISDNSTSFPALSKNSQFSQSQVKTQNNNHSL

SEQ ID NO: 2287728 - protein, 7 aa, Cryptosporidium parvum
WSPEGER

SEQ ID NO: 2287729 - protein, 5 aa, Cryptosporidium parvum
WSPEI

SEQ ID NO: 2287730 - protein, 6 aa, Cryptosporidium parvum
WSPKSN

SEQ ID NO: 2287731 - protein, 4 aa, Cryptosporidium parvum
WSRD

SEQ ID NO: 2287732 - protein, 4 aa, Cryptosporidium parvum
WSRK

SEQ ID NO: 2287733 - protein, 9 aa, Cryptosporidium parvum
WSSNSKSYS

SEQ ID NO: 2287734 - protein, 16 aa, Cryptosporidium parvum
WSTDGGSLSLNGDDGT

SEQ ID NO: 2287735 - protein, 16 aa, Cryptosporidium parvum
WTQPGDENTKIKFIRY

SEQ ID NO: 2287736 - protein, 14 aa, Cryptosporidium parvum
YAADSSNSPKGHNH

SEQ ID NO: 2287737 - protein, 9 aa, Cryptosporidium parvum
YAALGPSQD

SEQ ID NO: 2287738 - protein, 4 aa, Cryptosporidium parvum
YAAN

SEQ ID NO: 2287739 - protein, 6 aa, Cryptosporidium parvum
YADISG

SEQ ID NO: 2287740 - protein, 6 aa, Cryptosporidium parvum
YADKED

SEQ ID NO: 2287741 - protein, 15 aa, Cryptosporidium parvum
YADNNNKENSQTVDE

SEQ ID NO: 2287742 - protein, 5 aa, Cryptosporidium parvum
YAEKL

SEQ ID NO: 2287743 - protein, 13 aa, Cryptosporidium parvum
YAHEINNSDRPYS

SEQ ID NO: 2287744 - protein, 4 aa, Cryptosporidium parvum
YAIR

SEQ ID NO: 2287745 - protein, 11 aa, Cryptosporidium parvum
YAKDEKGEEIQ

SEQ ID NO: 2287746 - protein, 6 aa, Cryptosporidium parvum
YAKNHG

SEQ ID NO: 2287747 - protein, 7 aa, Cryptosporidium parvum
YAKPPFS

SEQ ID NO: 2287748 - protein, 5 aa, Cryptosporidium parvum
YALSD

SEQ ID NO: 2287749 - protein, 9 aa, Cryptosporidium parvum
YANGASTKY

SEQ ID NO: 2287750 - protein, 4 aa, Cryptosporidium parvum
YANI

SEQ ID NO: 2287751 - protein, 26 aa, Cryptosporidium parvum
YANNSYKNSGNSNNIVSNNNGLSQTQ

SEQ ID NO: 2287752 - protein, 10 aa, Cryptosporidium parvum
YANSNANSMN

SEQ ID NO: 2287753 - protein, 4 aa, Cryptosporidium parvum
YAPA

SEQ ID NO: 2287754 - protein, 7 aa, Cryptosporidium parvum
YAPRNTY

SEQ ID NO: 2287755 - protein, 11 aa, Cryptosporidium parvum
YAPRPSSGPHK

SEQ ID NO: 2287756 - protein, 12 aa, Cryptosporidium parvum
YAQEKEEKEEHN

SEQ ID NO: 2287757 - protein, 5 aa, Cryptosporidium parvum
YAQKQ

SEQ ID NO: 2287758 - protein, 12 aa, Cryptosporidium parvum
YAQNGKDKKECV

SEQ ID NO: 2287759 - protein, 12 aa, Cryptosporidium parvum
YARIDSRTNIQE

SEQ ID NO: 2287760 - protein, 5 aa, Cryptosporidium parvum
YARQQ

SEQ ID NO: 2287761 - protein, 17 aa, Cryptosporidium parvum
YASREANSKTSEKKSLT

SEQ ID NO: 2287762 - protein, 7 aa, Cryptosporidium parvum
YASSGKI

SEQ ID NO: 2287763 - protein, 9 aa, Cryptosporidium parvum
YASSNIGGI

SEQ ID NO: 2287764 - protein, 9 aa, Cryptosporidium parvum
YATGGYGQI

SEQ ID NO: 2287765 - protein, 12 aa, Cryptosporidium parvum
YATGKGSSGVGL

SEQ ID NO: 2287766 - protein, 6 aa, Cryptosporidium parvum
YATGSV

SEQ ID NO: 2287767 - protein, 11 aa, Cryptosporidium parvum
YATNTLRGKDR

SEQ ID NO: 2287768 - protein, 4 aa, Cryptosporidium parvum
YATS

SEQ ID NO: 2287769 - protein, 10 aa, Cryptosporidium parvum
YDDDDRQADS

SEQ ID NO: 2287770 - protein, 8 aa, Cryptosporidium parvum
YDDDFKGK

SEQ ID NO: 2287771 - protein, 24 aa, Cryptosporidium parvum
YDDDNNNNNNNNNNNFSSKSSGIP

SEQ ID NO: 2287772 - protein, 14 aa, Cryptosporidium parvum
YDDDQSLAEARREG

SEQ ID NO: 2287773 - protein, 29 aa, Cryptosporidium parvum
YDDDSTTTTNNNNNNINNNTTSDANTLSH

SEQ ID NO: 2287774 - protein, 13 aa, Cryptosporidium parvum
YDDGSKKRKSSNK

SEQ ID NO: 2287775 - protein, 8 aa, Cryptosporidium parvum
YDDNEDNR

SEQ ID NO: 2287776 - protein, 14 aa, Cryptosporidium parvum
YDDSQTRNTNFTEQ

SEQ ID NO: 2287777 - protein, 7 aa, Cryptosporidium parvum
YDDYETD

SEQ ID NO: 2287778 - protein, 6 aa, Cryptosporidium parvum
YDEDLQ

SEQ ID NO: 2287779 - protein, 11 aa, Cryptosporidium parvum
YDEEISDNLSN

SEQ ID NO: 2287780 - protein, 7 aa, Cryptosporidium parvum
YDEHNRR

SEQ ID NO: 2287781 - protein, 4 aa, Cryptosporidium parvum
YDEK

SEQ ID NO: 2287782 - protein, 7 aa, Cryptosporidium parvum
YDEPTIP

SEQ ID NO: 2287783 - protein, 18 aa, Cryptosporidium parvum
YDETSGKMIKSNSKYRQE

SEQ ID NO: 2287784 - protein, 5 aa, Cryptosporidium parvum
YDGGT

SEQ ID NO: 2287785 - protein, 4 aa, Cryptosporidium parvum
YDGK

SEQ ID NO: 2287786 - protein, 6 aa, Cryptosporidium parvum
YDGKKS

SEQ ID NO: 2287787 - protein, 8 aa, Cryptosporidium parvum
YDGKTPYG

SEQ ID NO: 2287788 - protein, 18 aa, Cryptosporidium parvum
YDGNKVGGGYRGGGSDPL

SEQ ID NO: 2287789 - protein, 56 aa, Cryptosporidium parvum
YDHDDDDDDDDDDNDNDNDNDNDNDNDNEEEETEEEEKEKNREEEDLEEEKEENKN

SEQ ID NO: 2287790 - protein, 8 aa, Cryptosporidium parvum
YDKEREQL

SEQ ID NO: 2287791 - protein, 6 aa, Cryptosporidium parvum
YDKNDK

SEQ ID NO: 2287792 - protein, 17 aa, Cryptosporidium parvum
YDKNKDNGDFNNNENLN

SEQ ID NO: 2287793 - protein, 11 aa, Cryptosporidium parvum
YDKNKVDVKSE

SEQ ID NO: 2287794 - protein, 10 aa, Cryptosporidium parvum
YDKNNDPRIE

SEQ ID NO: 2287795 - protein, 11 aa, Cryptosporidium parvum
YDKRNNQYSND

SEQ ID NO: 2287796 - protein, 12 aa, Cryptosporidium parvum
YDKSENKYQQNS

SEQ ID NO: 2287797 - protein, 9 aa, Cryptosporidium parvum
YDKTEDDLK

SEQ ID NO: 2287798 - protein, 20 aa, Cryptosporidium parvum
YDLESSRTVDSETARNYAKE

SEQ ID NO: 2287799 - protein, 8 aa, Cryptosporidium parvum
YDLNPRDS

SEQ ID NO: 2287800 - protein, 7 aa, Cryptosporidium parvum
YDNDSEI

SEQ ID NO: 2287801 - protein, 9 aa, Cryptosporidium parvum
YDNEKNPDY

SEQ ID NO: 2287802 - protein, 8 aa, Cryptosporidium parvum
YDNGGVTD

SEQ ID NO: 2287803 - protein, 15 aa, Cryptosporidium parvum
YDNNSDKHDQNSSLN

SEQ ID NO: 2287804 - protein, 7 aa, Cryptosporidium parvum
YDNPHET

SEQ ID NO: 2287805 - protein, 13 aa, Cryptosporidium parvum
YDNQSINNNLSSC

SEQ ID NO: 2287806 - protein, 9 aa, Cryptosporidium parvum
YDNQTTVQP

SEQ ID NO: 2287807 - protein, 13 aa, Cryptosporidium parvum
YDNSEKNSSDGCE

SEQ ID NO: 2287808 - protein, 9 aa, Cryptosporidium parvum
YDPDGINTS

SEQ ID NO: 2287809 - protein, 12 aa, Cryptosporidium parvum
YDPDKNKPISTI

SEQ ID NO: 2287810 - protein, 10 aa, Cryptosporidium parvum
YDPDNNDFNN

SEQ ID NO: 2287811 - protein, 7 aa, Cryptosporidium parvum
YDPEKVE

SEQ ID NO: 2287812 - protein, 19 aa, Cryptosporidium parvum
YDPGNLRSSFSPSASDNLN

SEQ ID NO: 2287813 - protein, 10 aa, Cryptosporidium parvum
YDPGPPDNHT

SEQ ID NO: 2287814 - protein, 10 aa, Cryptosporidium parvum
YDPKSPNTYT

SEQ ID NO: 2287815 - protein, 13 aa, Cryptosporidium parvum
YDPKSRSMREDPF

SEQ ID NO: 2287816 - protein, 7 aa, Cryptosporidium parvum
YDPQEDD

SEQ ID NO: 2287817 - protein, 7 aa, Cryptosporidium parvum
YDPSTGI

SEQ ID NO: 2287818 - protein, 7 aa, Cryptosporidium parvum
YDQAKLS

SEQ ID NO: 2287819 - protein, 6 aa, Cryptosporidium parvum
YDQDEV

SEQ ID NO: 2287820 - protein, 12 aa, Cryptosporidium parvum
YDQDQQNNYENK

SEQ ID NO: 2287821 - protein, 12 aa, Cryptosporidium parvum
YDQLKEKSSKWK

SEQ ID NO: 2287822 - protein, 7 aa, Cryptosporidium parvum
YDQNNPT

SEQ ID NO: 2287823 - protein, 8 aa, Cryptosporidium parvum
YDQNPYNE

SEQ ID NO: 2287824 - protein, 13 aa, Cryptosporidium parvum
YDQNRSTISIDPT

SEQ ID NO: 2287825 - protein, 9 aa, Cryptosporidium parvum
YDQPGNKIS

SEQ ID NO: 2287826 - protein, 9 aa, Cryptosporidium parvum
YDRPITSKP

SEQ ID NO: 2287827 - protein, 4 aa, Cryptosporidium parvum
YDRQ

SEQ ID NO: 2287828 - protein, 9 aa, Cryptosporidium parvum
YDRTKEQLE

SEQ ID NO: 2287829 - protein, 14 aa, Cryptosporidium parvum
YDSEKPCSEDGDEV

SEQ ID NO: 2287830 - protein, 14 aa, Cryptosporidium parvum
YDSENGDNSNRAKN

SEQ ID NO: 2287831 - protein, 7 aa, Cryptosporidium parvum
YDSKENR

SEQ ID NO: 2287832 - protein, 7 aa, Cryptosporidium parvum
YDSLEEQ

SEQ ID NO: 2287833 - protein, 10 aa, Cryptosporidium parvum
YDSNPQESKL

SEQ ID NO: 2287834 - protein, 12 aa, Cryptosporidium parvum
YDSRTTTFSPEG

SEQ ID NO: 2287835 - protein, 20 aa, Cryptosporidium parvum
YDSSNNYENDSNSECQTNSS

SEQ ID NO: 2287836 - protein, 17 aa, Cryptosporidium parvum
YDSTSNDINSNSGGGIN

SEQ ID NO: 2287837 - protein, 13 aa, Cryptosporidium parvum
YDTEKTKLEKKKK

SEQ ID NO: 2287838 - protein, 4 aa, Cryptosporidium parvum
YDTF

SEQ ID NO: 2287839 - protein, 7 aa, Cryptosporidium parvum
YDTGEEV

SEQ ID NO: 2287840 - protein, 8 aa, Cryptosporidium parvum
YDTPIEKE

SEQ ID NO: 2287841 - protein, 12 aa, Cryptosporidium parvum
YDTSSISNTEDI

SEQ ID NO: 2287842 - protein, 22 aa, Cryptosporidium parvum
YDTSTLKNQSNSTMSANQNPNI

SEQ ID NO: 2287843 - protein, 9 aa, Cryptosporidium parvum
YDVTTYSSN

SEQ ID NO: 2287844 - protein, 9 aa, Cryptosporidium parvum
YDYKEPQSY

SEQ ID NO: 2287845 - protein, 9 aa, Cryptosporidium parvum
YEAEGKTEY

SEQ ID NO: 2287846 - protein, 8 aa, Cryptosporidium parvum
YEARKKEI

SEQ ID NO: 2287847 - protein, 12 aa, Cryptosporidium parvum
YEDDEENSVKEN

SEQ ID NO: 2287848 - protein, 4 aa, Cryptosporidium parvum
YEDE

SEQ ID NO: 2287849 - protein, 10 aa, Cryptosporidium parvum
YEDGGSASLN

SEQ ID NO: 2287850 - protein, 40 aa, Cryptosporidium parvum
YEDGTNRSSDEDYNDKKESNHEISNKNNDLNNYHSPEESN

SEQ ID NO: 2287851 - protein, 5 aa, Cryptosporidium parvum
YEDNG

SEQ ID NO: 2287852 - protein, 13 aa, Cryptosporidium parvum
YEDPNSWRLSKRR

SEQ ID NO: 2287853 - protein, 4 aa, Cryptosporidium parvum
YEDS

SEQ ID NO: 2287854 - protein, 11 aa, Cryptosporidium parvum
YEEDDDNDAVA

SEQ ID NO: 2287855 - protein, 6 aa, Cryptosporidium parvum
YEEDIK

SEQ ID NO: 2287856 - protein, 26 aa, Cryptosporidium parvum
YEEEDSKIISNKAKTATGNKLTKAEI

SEQ ID NO: 2287857 - protein, 13 aa, Cryptosporidium parvum
YEEEKSEADEELS

SEQ ID NO: 2287858 - protein, 8 aa, Cryptosporidium parvum
YEEEQYSN

SEQ ID NO: 2287859 - protein, 21 aa, Cryptosporidium parvum
YEEERDKHSNNTTSTREKNEN

SEQ ID NO: 2287860 - protein, 5 aa, Cryptosporidium parvum
YEEKE

SEQ ID NO: 2287861 - protein, 11 aa, Cryptosporidium parvum
YEEKGKSDKEN

SEQ ID NO: 2287862 - protein, 8 aa, Cryptosporidium parvum
YEENPKFQ

SEQ ID NO: 2287863 - protein, 6 aa, Cryptosporidium parvum
YEENRE

SEQ ID NO: 2287864 - protein, 7 aa, Cryptosporidium parvum
YEEQGTS

SEQ ID NO: 2287865 - protein, 6 aa, Cryptosporidium parvum
YEEQRR

SEQ ID NO: 2287866 - protein, 10 aa, Cryptosporidium parvum
YEEQRRNQTL

SEQ ID NO: 2287867 - protein, 4 aa, Cryptosporidium parvum
YEES

SEQ ID NO: 2287868 - protein, 12 aa, Cryptosporidium parvum
YEESENTANQRL

SEQ ID NO: 2287869 - protein, 6 aa, Cryptosporidium parvum
YEGANE

SEQ ID NO: 2287870 - protein, 7 aa, Cryptosporidium parvum
YEGEGYD

SEQ ID NO: 2287871 - protein, 21 aa, Cryptosporidium parvum
YEGEQHSNNKRKENELLSTPE

SEQ ID NO: 2287872 - protein, 19 aa, Cryptosporidium parvum
YEGPQDDETAKGIRNCDPD

SEQ ID NO: 2287873 - protein, 4 aa, Cryptosporidium parvum
YEGQ

SEQ ID NO: 2287874 - protein, 16 aa, Cryptosporidium parvum
YEGSECDQEASPDDFD

SEQ ID NO: 2287875 - protein, 5 aa, Cryptosporidium parvum
YEGTD

SEQ ID NO: 2287876 - protein, 16 aa, Cryptosporidium parvum
YEHRTQENRGKSEIDS

SEQ ID NO: 2287877 - protein, 8 aa, Cryptosporidium parvum
YEKGDTDF

SEQ ID NO: 2287878 - protein, 8 aa, Cryptosporidium parvum
YEKGINDL

SEQ ID NO: 2287879 - protein, 6 aa, Cryptosporidium parvum
YEKNRD

SEQ ID NO: 2287880 - protein, 23 aa, Cryptosporidium parvum
YEKTHSGQQKISEQANDEKNEFD

SEQ ID NO: 2287881 - protein, 11 aa, Cryptosporidium parvum
YEKTISTEKAT

SEQ ID NO: 2287882 - protein, 9 aa, Cryptosporidium parvum
YEKYKTEDL

SEQ ID NO: 2287883 - protein, 4 aa, Cryptosporidium parvum
YEND

SEQ ID NO: 2287884 - protein, 6 aa, Cryptosporidium parvum
YENDSL

SEQ ID NO: 2287885 - protein, 4 aa, Cryptosporidium parvum
YENE

SEQ ID NO: 2287886 - protein, 8 aa, Cryptosporidium parvum
YENEKNEK

SEQ ID NO: 2287887 - protein, 15 aa, Cryptosporidium parvum
YENENHSSQSIRNQT

SEQ ID NO: 2287888 - protein, 12 aa, Cryptosporidium parvum
YENEVNSSAVQR

SEQ ID NO: 2287889 - protein, 13 aa, Cryptosporidium parvum
YENGRPKSGGLND

SEQ ID NO: 2287890 - protein, 5 aa, Cryptosporidium parvum
YENGT

SEQ ID NO: 2287891 - protein, 7 aa, Cryptosporidium parvum
YENIDNK

SEQ ID NO: 2287892 - protein, 22 aa, Cryptosporidium parvum
YENNDKVQTSNSITKNTKSLIT

SEQ ID NO: 2287893 - protein, 10 aa, Cryptosporidium parvum
YENNNNNINE

SEQ ID NO: 2287894 - protein, 10 aa, Cryptosporidium parvum
YENSEVTSSF

SEQ ID NO: 2287895 - protein, 11 aa, Cryptosporidium parvum
YENSGDEKSIS

SEQ ID NO: 2287896 - protein, 7 aa, Cryptosporidium parvum
YEPENPE

SEQ ID NO: 2287897 - protein, 17 aa, Cryptosporidium parvum
YEPETDIENKAGYMNSE

SEQ ID NO: 2287898 - protein, 15 aa, Cryptosporidium parvum
YEPSISPNNTADPNQ

SEQ ID NO: 2287899 - protein, 6 aa, Cryptosporidium parvum
YEPSSS

SEQ ID NO: 2287900 - protein, 8 aa, Cryptosporidium parvum
YEQISSEA

SEQ ID NO: 2287901 - protein, 6 aa, Cryptosporidium parvum
YEQPSR

SEQ ID NO: 2287902 - protein, 5 aa, Cryptosporidium parvum
YEQQM

SEQ ID NO: 2287903 - protein, 15 aa, Cryptosporidium parvum
YEQSLDDSNNRQEQL

SEQ ID NO: 2287904 - protein, 7 aa, Cryptosporidium parvum
YERPTPV

SEQ ID NO: 2287905 - protein, 5 aa, Cryptosporidium parvum
YESEG

SEQ ID NO: 2287906 - protein, 24 aa, Cryptosporidium parvum
YESEPEPENDNDNETEDDEDGYEP

SEQ ID NO: 2287907 - protein, 8 aa, Cryptosporidium parvum
YESESKSV

SEQ ID NO: 2287908 - protein, 9 aa, Cryptosporidium parvum
YESGDVDGA

SEQ ID NO: 2287909 - protein, 5 aa, Cryptosporidium parvum
YESIE

SEQ ID NO: 2287910 - protein, 12 aa, Cryptosporidium parvum
YESITTSTFSKD

SEQ ID NO: 2287911 - protein, 4 aa, Cryptosporidium parvum
YESK

SEQ ID NO: 2287912 - protein, 15 aa, Cryptosporidium parvum
YESPVRNNTKFNRRQ

SEQ ID NO: 2287913 - protein, 15 aa, Cryptosporidium parvum
YESSKNKDLESENAA

SEQ ID NO: 2287914 - protein, 15 aa, Cryptosporidium parvum
YESWKDGRLKMILSE

SEQ ID NO: 2287915 - protein, 6 aa, Cryptosporidium parvum
YETELS

SEQ ID NO: 2287916 - protein, 11 aa, Cryptosporidium parvum
YETKGTKSYME

SEQ ID NO: 2287917 - protein, 7 aa, Cryptosporidium parvum
YETSEPV

SEQ ID NO: 2287918 - protein, 11 aa, Cryptosporidium parvum
YETTQSGKTQI

SEQ ID NO: 2287919 - protein, 6 aa, Cryptosporidium parvum
YEYDEP

SEQ ID NO: 2287920 - protein, 10 aa, Cryptosporidium parvum
YFPSNSSSIS

SEQ ID NO: 2287921 - protein, 60 aa, Cryptosporidium parvum
YFRKDSSRSPERYRNRNQISKGIEYSRSNSISPDRISSNSSRRYPNPNFEKNLDSKLDKV

SEQ ID NO: 2287922 - protein, 5 aa, Cryptosporidium parvum
YGAAD

SEQ ID NO: 2287923 - protein, 4 aa, Cryptosporidium parvum
YGAD

SEQ ID NO: 2287924 - protein, 9 aa, Cryptosporidium parvum
YGAKELPSN

SEQ ID NO: 2287925 - protein, 10 aa, Cryptosporidium parvum
YGANNNMNST

SEQ ID NO: 2287926 - protein, 6 aa, Cryptosporidium parvum
YGAPNE

SEQ ID NO: 2287927 - protein, 5 aa, Cryptosporidium parvum
YGARG

SEQ ID NO: 2287928 - protein, 29 aa, Cryptosporidium parvum
YGARKHKDLKSLNEELDESSIENQNKQTF

SEQ ID NO: 2287929 - protein, 62 aa, Cryptosporidium parvum
YGARNGSISVSNNHRNFGNGSSTKRYKTGTNSGTKKFGTTTTGIASTNQPSNSVSSKIKPED

SEQ ID NO: 2287930 - protein, 9 aa, Cryptosporidium parvum
YGDEADIHD

SEQ ID NO: 2287931 - protein, 11 aa, Cryptosporidium parvum
YGDNSQTTKLN

SEQ ID NO: 2287932 - protein, 4 aa, Cryptosporidium parvum
YGDT

SEQ ID NO: 2287933 - protein, 7 aa, Cryptosporidium parvum
YGEEQPV

SEQ ID NO: 2287934 - protein, 7 aa, Cryptosporidium parvum
YGEITRG

SEQ ID NO: 2287935 - protein, 6 aa, Cryptosporidium parvum
YGEPEK

SEQ ID NO: 2287936 - protein, 9 aa, Cryptosporidium parvum
YGGATNAST

SEQ ID NO: 2287937 - protein, 8 aa, Cryptosporidium parvum
YGGDNGFN

SEQ ID NO: 2287938 - protein, 7 aa, Cryptosporidium parvum
YGGEDCP

SEQ ID NO: 2287939 - protein, 17 aa, Cryptosporidium parvum
YGIPRRNTTVPKTPKFA

SEQ ID NO: 2287940 - protein, 9 aa, Cryptosporidium parvum
YGKAAGVEA

SEQ ID NO: 2287941 - protein, 4 aa, Cryptosporidium parvum
YGKT

SEQ ID NO: 2287942 - protein, 7 aa, Cryptosporidium parvum
YGKVETT

SEQ ID NO: 2287943 - protein, 14 aa, Cryptosporidium parvum
YGKYEGRSDESSVD

SEQ ID NO: 2287944 - protein, 7 aa, Cryptosporidium parvum
YGLDPED

SEQ ID NO: 2287945 - protein, 23 aa, Cryptosporidium parvum
YGLGATNIGDEGGFAPDIATPEE

SEQ ID NO: 2287946 - protein, 7 aa, Cryptosporidium parvum
YGNCNNG

SEQ ID NO: 2287947 - protein, 7 aa, Cryptosporidium parvum
YGNNASK

SEQ ID NO: 2287948 - protein, 8 aa, Cryptosporidium parvum
YGNNNNNI

SEQ ID NO: 2287949 - protein, 10 aa, Cryptosporidium parvum
YGNNSNSFRR

SEQ ID NO: 2287950 - protein, 27 aa, Cryptosporidium parvum
YGNPYKSYRGGGGGVGGYSGNRHIVNP

SEQ ID NO: 2287951 - protein, 24 aa, Cryptosporidium parvum
YGNSRSGAKPANFSYQSNPEPRRD

SEQ ID NO: 2287952 - protein, 6 aa, Cryptosporidium parvum
YGPDTG

SEQ ID NO: 2287953 - protein, 7 aa, Cryptosporidium parvum
YGPESRG

SEQ ID NO: 2287954 - protein, 5 aa, Cryptosporidium parvum
YGPFS

SEQ ID NO: 2287955 - protein, 8 aa, Cryptosporidium parvum
YGPPPSYP

SEQ ID NO: 2287956 - protein, 4 aa, Cryptosporidium parvum
YGQC

SEQ ID NO: 2287957 - protein, 14 aa, Cryptosporidium parvum
YGQEGKRSNYSPYP

SEQ ID NO: 2287958 - protein, 11 aa, Cryptosporidium parvum
YGQQNNSMNDM

SEQ ID NO: 2287959 - protein, 9 aa, Cryptosporidium parvum
YGREDNNPY

SEQ ID NO: 2287960 - protein, 5 aa, Cryptosporidium parvum
YGRHI

SEQ ID NO: 2287961 - protein, 14 aa, Cryptosporidium parvum
YGRITSKNSPMEVS

SEQ ID NO: 2287962 - protein, 5 aa, Cryptosporidium parvum
YGRQI

SEQ ID NO: 2287963 - protein, 8 aa, Cryptosporidium parvum
YGRRAPEP

SEQ ID NO: 2287964 - protein, 4 aa, Cryptosporidium parvum
YGRY

SEQ ID NO: 2287965 - protein, 4 aa, Cryptosporidium parvum
YGSD

SEQ ID NO: 2287966 - protein, 10 aa, Cryptosporidium parvum
YGSDAKTRKM

SEQ ID NO: 2287967 - protein, 12 aa, Cryptosporidium parvum
YGSKNGHSNTHI

SEQ ID NO: 2287968 - protein, 5 aa, Cryptosporidium parvum
YGSLD

SEQ ID NO: 2287969 - protein, 18 aa, Cryptosporidium parvum
YGSLDGEIEARRKEGQDN

SEQ ID NO: 2287970 - protein, 23 aa, Cryptosporidium parvum
YGSNQETSNKSSAIQVSEQGRLG

SEQ ID NO: 2287971 - protein, 11 aa, Cryptosporidium parvum
YGSNSQQPRDY

SEQ ID NO: 2287972 - protein, 25 aa, Cryptosporidium parvum
YGSPDIREPSPPPIYDKNGSRINTR

SEQ ID NO: 2287973 - protein, 7 aa, Cryptosporidium parvum
YGSPEIR

SEQ ID NO: 2287974 - protein, 4 aa, Cryptosporidium parvum
YGSQ

SEQ ID NO: 2287975 - protein, 7 aa, Cryptosporidium parvum
YGSRNTE

SEQ ID NO: 2287976 - protein, 18 aa, Cryptosporidium parvum
YGSSSFPIGSEEKMEKSG

SEQ ID NO: 2287977 - protein, 11 aa, Cryptosporidium parvum
YGTKNEDENIQ

SEQ ID NO: 2287978 - protein, 4 aa, Cryptosporidium parvum
YGTP

SEQ ID NO: 2287979 - protein, 14 aa, Cryptosporidium parvum
YGTSRRVSSRQGRF

SEQ ID NO: 2287980 - protein, 15 aa, Cryptosporidium parvum
YGTSSELNSIQEKGV

SEQ ID NO: 2287981 - protein, 5 aa, Cryptosporidium parvum
YGVEK

SEQ ID NO: 2287982 - protein, 5 aa, Cryptosporidium parvum
YHEKE

SEQ ID NO: 2287983 - protein, 24 aa, Cryptosporidium parvum
YHESPLSDGKSFIEDEGKKTAKNL

SEQ ID NO: 2287984 - protein, 12 aa, Cryptosporidium parvum
YHNREEKRTTQQ

SEQ ID NO: 2287985 - protein, 14 aa, Cryptosporidium parvum
YHPDLNPSEEAKNK

SEQ ID NO: 2287986 - protein, 6 aa, Cryptosporidium parvum
YHPSNH

SEQ ID NO: 2287987 - protein, 6 aa, Cryptosporidium parvum
YHSKSN

SEQ ID NO: 2287988 - protein, 9 aa, Cryptosporidium parvum
YHTKNKNQV

SEQ ID NO: 2287989 - protein, 4 aa, Cryptosporidium parvum
YHTR

SEQ ID NO: 2287990 - protein, 8 aa, Cryptosporidium parvum
YIATTRDD

SEQ ID NO: 2287991 - protein, 12 aa, Cryptosporidium parvum
YIDQGGGKRKGA

SEQ ID NO: 2287992 - protein, 8 aa, Cryptosporidium parvum
YIERNGKG

SEQ ID NO: 2287993 - protein, 5 aa, Cryptosporidium parvum
YIGPE

SEQ ID NO: 2287994 - protein, 20 aa, Cryptosporidium parvum
YIKPGKDQNKSTLGSSVQDT

SEQ ID NO: 2287995 - protein, 9 aa, Cryptosporidium parvum
YIPSGDTEK

SEQ ID NO: 2287996 - protein, 12 aa, Cryptosporidium parvum
YISGSAEAIQDQ

SEQ ID NO: 2287997 - protein, 4 aa, Cryptosporidium parvum
YISS

SEQ ID NO: 2287998 - protein, 34 aa, Cryptosporidium parvum
YISSSPSSSSSSSSSSSSSSSSASFLTPSSSTQL

SEQ ID NO: 2287999 - protein, 12 aa, Cryptosporidium parvum
YISTSDSSSNQQ

SEQ ID NO: 2288000 - protein, 16 aa, Cryptosporidium parvum
YITESTPLSGASGGSI

SEQ ID NO: 2288001 - protein, 11 aa, Cryptosporidium parvum
YITPPNGDATR

SEQ ID NO: 2288002 - protein, 8 aa, Cryptosporidium parvum
YKAEEEKE

SEQ ID NO: 2288003 - protein, 8 aa, Cryptosporidium parvum
YKAKKTMM

SEQ ID NO: 2288004 - protein, 6 aa, Cryptosporidium parvum
YKAKQG

SEQ ID NO: 2288005 - protein, 10 aa, Cryptosporidium parvum
YKAQRKQSAE

SEQ ID NO: 2288006 - protein, 11 aa, Cryptosporidium parvum
YKASESTKTQS

SEQ ID NO: 2288007 - protein, 5 aa, Cryptosporidium parvum
YKATK

SEQ ID NO: 2288008 - protein, 4 aa, Cryptosporidium parvum
YKDA

SEQ ID NO: 2288009 - protein, 11 aa, Cryptosporidium parvum
YKDEKHSMSTS

SEQ ID NO: 2288010 - protein, 7 aa, Cryptosporidium parvum
YKDENQC

SEQ ID NO: 2288011 - protein, 9 aa, Cryptosporidium parvum
YKDGEKSVN

SEQ ID NO: 2288012 - protein, 8 aa, Cryptosporidium parvum
YKDHPNYR

SEQ ID NO: 2288013 - protein, 18 aa, Cryptosporidium parvum
YKDKYKALKTENKDLKGR

SEQ ID NO: 2288014 - protein, 8 aa, Cryptosporidium parvum
YKDPDTNV

SEQ ID NO: 2288015 - protein, 6 aa, Cryptosporidium parvum
YKDPIK

SEQ ID NO: 2288016 - protein, 9 aa, Cryptosporidium parvum
YKDPQNESL

SEQ ID NO: 2288017 - protein, 5 aa, Cryptosporidium parvum
YKDPS

SEQ ID NO: 2288018 - protein, 14 aa, Cryptosporidium parvum
YKDPSEAKDEREEL

SEQ ID NO: 2288019 - protein, 16 aa, Cryptosporidium parvum
YKDRSRSQNEYYNSGI

SEQ ID NO: 2288020 - protein, 15 aa, Cryptosporidium parvum
YKEDYEKKNKTILQD

SEQ ID NO: 2288021 - protein, 31 aa, Cryptosporidium parvum
YKEEDYSSTITSLESTPSKICSRNEPSVQKS

SEQ ID NO: 2288022 - protein, 21 aa, Cryptosporidium parvum
YKEEEEEEEEIQEEPKQEEEL

SEQ ID NO: 2288023 - protein, 11 aa, Cryptosporidium parvum
YKEKDQNPNSY

SEQ ID NO: 2288024 - protein, 8 aa, Cryptosporidium parvum
YKEKPEED

SEQ ID NO: 2288025 - protein, 10 aa, Cryptosporidium parvum
YKEKTASNSI

SEQ ID NO: 2288026 - protein, 7 aa, Cryptosporidium parvum
YKENQKS

SEQ ID NO: 2288027 - protein, 8 aa, Cryptosporidium parvum
YKESDDQQ

SEQ ID NO: 2288028 - protein, 12 aa, Cryptosporidium parvum
YKESPKSCEATA

SEQ ID NO: 2288029 - protein, 4 aa, Cryptosporidium parvum
YKET

SEQ ID NO: 2288030 - protein, 14 aa, Cryptosporidium parvum
YKEVDDDAYGGGSI

SEQ ID NO: 2288031 - protein, 11 aa, Cryptosporidium parvum
YKGGDFKRQGE

SEQ ID NO: 2288032 - protein, 10 aa, Cryptosporidium parvum
YKGGPNNEDQ

SEQ ID NO: 2288033 - protein, 11 aa, Cryptosporidium parvum
YKGKNGDHAAM

SEQ ID NO: 2288034 - protein, 8 aa, Cryptosporidium parvum
YKGSNGDL

SEQ ID NO: 2288035 - protein, 18 aa, Cryptosporidium parvum
YKGTAQKKKARLSIDEDP

SEQ ID NO: 2288036 - protein, 17 aa, Cryptosporidium parvum
YKGTGFNGHKKSYPNYL

SEQ ID NO: 2288037 - protein, 9 aa, Cryptosporidium parvum
YKKDSNPYD

SEQ ID NO: 2288038 - protein, 8 aa, Cryptosporidium parvum
YKKKRDEF

SEQ ID NO: 2288039 - protein, 4 aa, Cryptosporidium parvum
YKKN

SEQ ID NO: 2288040 - protein, 13 aa, Cryptosporidium parvum
YKKSAEEELGDDP

SEQ ID NO: 2288041 - protein, 8 aa, Cryptosporidium parvum
YKLNENDQ

SEQ ID NO: 2288042 - protein, 5 aa, Cryptosporidium parvum
YKMNS

SEQ ID NO: 2288043 - protein, 12 aa, Cryptosporidium parvum
YKNDEIYKMNVS

SEQ ID NO: 2288044 - protein, 8 aa, Cryptosporidium parvum
YKNDTNRI

SEQ ID NO: 2288045 - protein, 15 aa, Cryptosporidium parvum
YKNGELTSSNDALNS

SEQ ID NO: 2288046 - protein, 13 aa, Cryptosporidium parvum
YKNGTNNGDKISV

SEQ ID NO: 2288047 - protein, 4 aa, Cryptosporidium parvum
YKNI

SEQ ID NO: 2288048 - protein, 9 aa, Cryptosporidium parvum
YKNKESKKM

SEQ ID NO: 2288049 - protein, 6 aa, Cryptosporidium parvum
YKNLNK

SEQ ID NO: 2288050 - protein, 10 aa, Cryptosporidium parvum
YKNNQTHPHP

SEQ ID NO: 2288051 - protein, 8 aa, Cryptosporidium parvum
YKNPNNDA

SEQ ID NO: 2288052 - protein, 10 aa, Cryptosporidium parvum
YKNPNNNGTR

SEQ ID NO: 2288053 - protein, 7 aa, Cryptosporidium parvum
YKNSNEI

SEQ ID NO: 2288054 - protein, 10 aa, Cryptosporidium parvum
YKNTPKSIPR

SEQ ID NO: 2288055 - protein, 6 aa, Cryptosporidium parvum
YKNTPN

SEQ ID NO: 2288056 - protein, 15 aa, Cryptosporidium parvum
YKNTYDSIVSDISLR

SEQ ID NO: 2288057 - protein, 6 aa, Cryptosporidium parvum
YKPDMS

SEQ ID NO: 2288058 - protein, 6 aa, Cryptosporidium parvum
YKPENT

SEQ ID NO: 2288059 - protein, 30 aa, Cryptosporidium parvum; identical to SEQ ID NO: 2167520

SEQ ID NO: 2288060 - protein, 7 aa, Cryptosporidium parvum
YKPGTTN

SEQ ID NO: 2288061 - protein, 7 aa, Cryptosporidium parvum
YKPLKKT

SEQ ID NO: 2288062 - protein, 6 aa, Cryptosporidium parvum
YKPNCD

SEQ ID NO: 2288063 - protein, 15 aa, Cryptosporidium parvum
YKPSPVKYKGPTSSY

SEQ ID NO: 2288064 - protein, 8 aa, Cryptosporidium parvum
YKPTLRSE

SEQ ID NO: 2288065 - protein, 19 aa, Cryptosporidium parvum
YKQKSSKKKVKREAYSSSV

SEQ ID NO: 2288066 - protein, 14 aa, Cryptosporidium parvum
YKQQKRQHKKEMRG

SEQ ID NO: 2288067 - protein, 25 aa, Cryptosporidium parvum
YKQRRKIKKNSINSDDNENENFEKE

SEQ ID NO: 2288068 - protein, 6 aa, Cryptosporidium parvum
YKRDGL

SEQ ID NO: 2288069 - protein, 20 aa, Cryptosporidium parvum
YKRNKRSKSLINGERVNEEN

SEQ ID NO: 2288070 - protein, 9 aa, Cryptosporidium parvum
YKRPPSIGT

SEQ ID NO: 2288071 - protein, 4 aa, Cryptosporidium parvum
YKRR

SEQ ID NO: 2288072 - protein, 4 aa, Cryptosporidium parvum
YKRS

SEQ ID NO: 2288073 - protein, 33 aa, Cryptosporidium parvum
YKSANYESEKESNPVDNSETTSRGKRHKKDTSD

SEQ ID NO: 2288074 - protein, 5 aa, Cryptosporidium parvum
YKSDN

SEQ ID NO: 2288075 - protein, 46 aa, Cryptosporidium parvum
YKSDPYRRYPSPRDYREGSRSYGGNRHPPYRSRSRSPPPSRGYERY

SEQ ID NO: 2288076 - protein, 37 aa, Cryptosporidium parvum
YKSEQESDDYSRRKNVKSLKERKKEKTGKKKGKKDLV

SEQ ID NO: 2288077 - protein, 6 aa, Cryptosporidium parvum
YKSIKN

SEQ ID NO: 2288078 - protein, 14 aa, Cryptosporidium parvum
YKSKAQTNSGNEKS

SEQ ID NO: 2288079 - protein, 11 aa, Cryptosporidium parvum
YKSKENITSKK

SEQ ID NO: 2288080 - protein, 10 aa, Cryptosporidium parvum
YKSKGSELEA

SEQ ID NO: 2288081 - protein, 10 aa, Cryptosporidium parvum
YKSKHRPPWR

SEQ ID NO: 2288082 - protein, 10 aa, Cryptosporidium parvum
YKSKVQRRAI

SEQ ID NO: 2288083 - protein, 8 aa, Cryptosporidium parvum
YKSNENTK

SEQ ID NO: 2288084 - protein, 10 aa, Cryptosporidium parvum
YKSNESKNQF

SEQ ID NO: 2288085 - protein, 10 aa, Cryptosporidium parvum
YKSNKREKIN

SEQ ID NO: 2288086 - protein, 7 aa, Cryptosporidium parvum
YKSNPDL

SEQ ID NO: 2288087 - protein, 7 aa, Cryptosporidium parvum
YKSNQDK

SEQ ID NO: 2288088 - protein, 17 aa, Cryptosporidium parvum
YKSNTSHKFDESSPIEK

SEQ ID NO: 2288089 - protein, 7 aa, Cryptosporidium parvum
YKSPERL

SEQ ID NO: 2288090 - protein, 15 aa, Cryptosporidium parvum
YKSPMVPRKASNHSY

SEQ ID NO: 2288091 - protein, 6 aa, Cryptosporidium parvum
YKSPSP

SEQ ID NO: 2288092 - protein, 5 aa, Cryptosporidium parvum
YKSQD

SEQ ID NO: 2288093 - protein, 19 aa, Cryptosporidium parvum
YKSRKNDKLIKSGKSIISQ

SEQ ID NO: 2288094 - protein, 9 aa, Cryptosporidium parvum
YKSSDELPH

SEQ ID NO: 2288095 - protein, 9 aa, Cryptosporidium parvum
YKSSPPDSR

SEQ ID NO: 2288096 - protein, 14 aa, Cryptosporidium parvum
YKSSSAEMQIQDIT

SEQ ID NO: 2288097 - protein, 9 aa, Cryptosporidium parvum
YKSTNRVQD

SEQ ID NO: 2288098 - protein, 9 aa, Cryptosporidium parvum
YKSTQQPPV

SEQ ID NO: 2288099 - protein, 14 aa, Cryptosporidium parvum
YKTGLEDGQEDSQT

SEQ ID NO: 2288100 - protein, 9 aa, Cryptosporidium parvum
YKTKELSAQ

SEQ ID NO: 2288101 - protein, 9 aa, Cryptosporidium parvum
YKTTQGDEV

SEQ ID NO: 2288102 - protein, 8 aa, Cryptosporidium parvum
YKTTSPNE

SEQ ID NO: 2288103 - protein, 4 aa, Cryptosporidium parvum
YKWT

SEQ ID NO: 2288104 - protein, 8 aa, Cryptosporidium parvum
YLASGSDD

SEQ ID NO: 2288105 - protein, 10 aa, Cryptosporidium parvum
YLGSTSYTNY

SEQ ID NO: 2288106 - protein, 4 aa, Cryptosporidium parvum
YLNT

SEQ ID NO: 2288107 - protein, 8 aa, Cryptosporidium parvum
YLPGADNE

SEQ ID NO: 2288108 - protein, 25 aa, Cryptosporidium parvum
YLPPPSLPYSSTSRDGERSQNHNIQ

SEQ ID NO: 2288109 - protein, 36 aa, Cryptosporidium parvum
YLQTESKDGTQGSNCKRSLDSNGNKNKKKKKYDSSS

SEQ ID NO: 2288110 - protein, 9 aa, Cryptosporidium parvum
YLSPKYRNN

SEQ ID NO: 2288111 - protein, 4 aa, Cryptosporidium parvum
YLTE

SEQ ID NO: 2288112 - protein, 5 aa, Cryptosporidium parvum
YLTEE

SEQ ID NO: 2288113 - protein, 11 aa, Cryptosporidium parvum
YLTEEPNKYGK

SEQ ID NO: 2288114 - protein, 7 aa, Cryptosporidium parvum
YLTEPST

SEQ ID NO: 2288115 - protein, 10 aa, Cryptosporidium parvum
YLTSGTTGEA

SEQ ID NO: 2288116 - protein, 31 aa, Cryptosporidium parvum
YMAPSSRSTSSSSNSVISSSSLVSNSSIYSR

SEQ ID NO: 2288117 - protein, 50 aa, Cryptosporidium parvum
YMNDGPREGAAKASMSDKTNKDEQSIPKISTPVASTKQSVVPTSSTQLTG

SEQ ID NO: 2288118 - protein, 4 aa, Cryptosporidium parvum
YMTG

SEQ ID NO: 2288119 - protein, 16 aa, Cryptosporidium parvum
YNANFGPSSVSANYNY

SEQ ID NO: 2288120 - protein, 9 aa, Cryptosporidium parvum
YNDDSANIE

SEQ ID NO: 2288121 - protein, 16 aa, Cryptosporidium parvum
YNDEEEEKKDNDIVDE

SEQ ID NO: 2288122 - protein, 8 aa, Cryptosporidium parvum
YNDGNENE

SEQ ID NO: 2288123 - protein, 13 aa, Cryptosporidium parvum
YNDPVDKSVAKNQ

SEQ ID NO: 2288124 - protein, 7 aa, Cryptosporidium parvum
YNDSCAP

SEQ ID NO: 2288125 - protein, 7 aa, Cryptosporidium parvum
YNDSIQS

SEQ ID NO: 2288126 - protein, 5 aa, Cryptosporidium parvum
YNEDN

SEQ ID NO: 2288127 - protein, 7 aa, Cryptosporidium parvum
YNEESMN

SEQ ID NO: 2288128 - protein, 4 aa, Cryptosporidium parvum
YNEI

SEQ ID NO: 2288129 - protein, 12 aa, Cryptosporidium parvum
YNEISRNMSGNE

SEQ ID NO: 2288130 - protein, 10 aa, Cryptosporidium parvum
YNEKHKSEPL

SEQ ID NO: 2288131 - protein, 5 aa, Cryptosporidium parvum
YNEKI

SEQ ID NO: 2288132 - protein, 11 aa, Cryptosporidium parvum
YNENENSGEDV

SEQ ID NO: 2288133 - protein, 18 aa, Cryptosporidium parvum
YNESDRDKVDHDESDREE

SEQ ID NO: 2288134 - protein, 16 aa, Cryptosporidium parvum
YNESKGKLESMVSPLY

SEQ ID NO: 2288135 - protein, 9 aa, Cryptosporidium parvum
YNGEESSYS

SEQ ID NO: 2288136 - protein, 8 aa, Cryptosporidium parvum
YNGEQERI

SEQ ID NO: 2288137 - protein, 21 aa, Cryptosporidium parvum
YNGKSDHSNPTTLNASKSRNE

SEQ ID NO: 2288138 - protein, 9 aa, Cryptosporidium parvum
YNGSNITSQ

SEQ ID NO: 2288139 - protein, 4 aa, Cryptosporidium parvum
YNHE

SEQ ID NO: 2288140 - protein, 27 aa, Cryptosporidium parvum
YNHGSKQGNSNYGNSGFGQTYRQREHR

SEQ ID NO: 2288141 - protein, 12 aa, Cryptosporidium parvum
YNHSKNHETESV

SEQ ID NO: 2288142 - protein, 8 aa, Cryptosporidium parvum
YNHSSQEI

SEQ ID NO: 2288143 - protein, 5 aa, Cryptosporidium parvum
YNISE

SEQ ID NO: 2288144 - protein, 11 aa, Cryptosporidium parvum
YNKADNNDPHI

SEQ ID NO: 2288145 - protein, 4 aa, Cryptosporidium parvum
YNKD

SEQ ID NO: 2288146 - protein, 8 aa, Cryptosporidium parvum
YNKDEDKN

SEQ ID NO: 2288147 - protein, 11 aa, Cryptosporidium parvum
YNKEIDDQKTN

SEQ ID NO: 2288148 - protein, 7 aa, Cryptosporidium parvum
YNKESSK

SEQ ID NO: 2288149 - protein, 5 aa, Cryptosporidium parvum
YNKGE

SEQ ID NO: 2288150 - protein, 17 aa, Cryptosporidium parvum
YNKGEHKTINRAKNSDF

SEQ ID NO: 2288151 - protein, 4 aa, Cryptosporidium parvum
YNKN

SEQ ID NO: 2288152 - protein, 36 aa, Cryptosporidium parvum
YNKNQELSNFGGNGEGAMGASIGSSNVHGNNLGNSQ

SEQ ID NO: 2288153 - protein, 5 aa, Cryptosporidium parvum
YNKRN

SEQ ID NO: 2288154 - protein, 7 aa, Cryptosporidium parvum
YNKSEAI

SEQ ID NO: 2288155 - protein, 8 aa, Cryptosporidium parvum
YNKSMDRI

SEQ ID NO: 2288156 - protein, 42 aa, Cryptosporidium parvum
YNKSNDINNDNNNNNNNNNNNNNDNNNNDNDNKNNNNNKNNK

SEQ ID NO: 2288157 - protein, 11 aa, Cryptosporidium parvum
YNKSSGQTTSN

SEQ ID NO: 2288158 - protein, 10 aa, Cryptosporidium parvum
YNKSYDSNKW

SEQ ID NO: 2288159 - protein, 10 aa, Cryptosporidium parvum
YNLSPNQHTQ

SEQ ID NO: 2288160 - protein, 14 aa, Cryptosporidium parvum
YNMQDSKTEFSSPE

SEQ ID NO: 2288161 - protein, 17 aa, Cryptosporidium parvum
YNNEAQNNHDEGSKSQT

SEQ ID NO: 2288162 - protein, 8 aa, Cryptosporidium parvum
YNNEGISN

SEQ ID NO: 2288163 - protein, 5 aa, Cryptosporidium parvum
YNNEV

SEQ ID NO: 2288164 - protein, 7 aa, Cryptosporidium parvum
YNNGKEI

SEQ ID NO: 2288165 - protein, 8 aa, Cryptosporidium parvum
YNNGKKQI

SEQ ID NO: 2288166 - protein, 9 aa, Cryptosporidium parvum
YNNGKSCES

SEQ ID NO: 2288167 - protein, 16 aa, Cryptosporidium parvum
YNNGLKETKVSQIPSN

SEQ ID NO: 2288168 - protein, 16 aa, Cryptosporidium parvum
YNNIDSSSSPVSPEVS

SEQ ID NO: 2288169 - protein, 18 aa, Cryptosporidium parvum
YNNKEGNFSNFDGTRRSG

SEQ ID NO: 2288170 - protein, 9 aa, Cryptosporidium parvum
YNNKTDKAP

SEQ ID NO: 2288171 - protein, 7 aa, Cryptosporidium parvum
YNNNENT

SEQ ID NO: 2288172 - protein, 11 aa, Cryptosporidium parvum
YNNNKVPNIPV

SEQ ID NO: 2288173 - protein, 10 aa, Cryptosporidium parvum
YNNNNNNLEV

SEQ ID NO: 2288174 - protein, 19 aa, Cryptosporidium parvum
YNNNNNNNNNNSNSNNIPS

SEQ ID NO: 2288175 - protein, 5 aa, Cryptosporidium parvum
YNNNS

SEQ ID NO: 2288176 - protein, 16 aa, Cryptosporidium parvum
YNNPDVNDDNHSFNSQ

SEQ ID NO: 2288177 - protein, 19 aa, Cryptosporidium parvum
YNNPNLNSSVSQPGPSQFQ

SEQ ID NO: 2288178 - protein, 6 aa, Cryptosporidium parvum
YNNQSS

SEQ ID NO: 2288179 - protein, 4 aa, Cryptosporidium parvum
YNNS

SEQ ID NO: 2288180 - protein, 5 aa, Cryptosporidium parvum
YNNSE

SEQ ID NO: 2288181 - protein, 5 aa, Cryptosporidium parvum
YNNSF

SEQ ID NO: 2288182 - protein, 19 aa, Cryptosporidium parvum
YNNSKPNFTHSSKYPPPNN

SEQ ID NO: 2288183 - protein, 7 aa, Cryptosporidium parvum
YNNSPNH

SEQ ID NO: 2288184 - protein, 9 aa, Cryptosporidium parvum
YNNSSKALD

SEQ ID NO: 2288185 - protein, 6 aa, Cryptosporidium parvum
YNNTEG

SEQ ID NO: 2288186 - protein, 5 aa, Cryptosporidium parvum
YNNTS

SEQ ID NO: 2288187 - protein, 6 aa, Cryptosporidium parvum
YNPAPT

SEQ ID NO: 2288188 - protein, 11 aa, Cryptosporidium parvum
YNPEKKEFQTP

SEQ ID NO: 2288189 - protein, 9 aa, Cryptosporidium parvum
YNPENSENL

SEQ ID NO: 2288190 - protein, 5 aa, Cryptosporidium parvum
YNPKQ

SEQ ID NO: 2288191 - protein, 9 aa, Cryptosporidium parvum
YNPKSTRLA

SEQ ID NO: 2288192 - protein, 9 aa, Cryptosporidium parvum
YNPKTSNNA

SEQ ID NO: 2288193 - protein, 12 aa, Cryptosporidium parvum
YNPLTDNQYSYQ

SEQ ID NO: 2288194 - protein, 5 aa, Cryptosporidium parvum
YNPND

SEQ ID NO: 2288195 - protein, 11 aa, Cryptosporidium parvum
YNPNEQEKLTS

SEQ ID NO: 2288196 - protein, 22 aa, Cryptosporidium parvum
YNPNPGTSLNYKSGVSSSAFGS

SEQ ID NO: 2288197 - protein, 7 aa, Cryptosporidium parvum
YNPNSKT

SEQ ID NO: 2288198 - protein, 8 aa, Cryptosporidium parvum
YNPSEVES

SEQ ID NO: 2288199 - protein, 9 aa, Cryptosporidium parvum
YNPSNPGGI

SEQ ID NO: 2288200 - protein, 9 aa, Cryptosporidium parvum
YNPTTNQVS

SEQ ID NO: 2288201 - protein, 8 aa, Cryptosporidium parvum
YNPYSTQH

SEQ ID NO: 2288202 - protein, 5 aa, Cryptosporidium parvum
YNQED

SEQ ID NO: 2288203 - protein, 5 aa, Cryptosporidium parvum
YNQEK

SEQ ID NO: 2288204 - protein, 32 aa, Cryptosporidium parvum
YNQKESSKEYCKHKKKSKKSKEKHKKKDNLLK

SEQ ID NO: 2288205 - protein, 5 aa, Cryptosporidium parvum
YNQLE

SEQ ID NO: 2288206 - protein, 9 aa, Cryptosporidium parvum
YNQRNGSQI

SEQ ID NO: 2288207 - protein, 10 aa, Cryptosporidium parvum
YNSAKDIKDI

SEQ ID NO: 2288208 - protein, 11 aa, Cryptosporidium parvum
YNSDKDSKITS

SEQ ID NO: 2288209 - protein, 17 aa, Cryptosporidium parvum
YNSEFSSNKIPIKENRS

SEQ ID NO: 2288210 - protein, 8 aa, Cryptosporidium parvum
YNSEKNLT

SEQ ID NO: 2288211 - protein, 11 aa, Cryptosporidium parvum
YNSERSSGLHA

SEQ ID NO: 2288212 - protein, 62 aa, Cryptosporidium parvum
YNSGGGGGGGGSGGYQSQHSSNYSHSRHNHAADNFGSQTGGSHSKSGGGASQYGSHSHSGGF

SEQ ID NO: 2288213 - protein, 9 aa, Cryptosporidium parvum
YNSGKSGYG

SEQ ID NO: 2288214 - protein, 5 aa, Cryptosporidium parvum
YNSIE

SEQ ID NO: 2288215 - protein, 39 aa, Cryptosporidium parvum
YNSKIETRTEEKSVYESNYDKVSKADARYNSDSSQIYPP

SEQ ID NO: 2288216 - protein, 17 aa, Cryptosporidium parvum
YNSNDGNNNSNNHNHYN

SEQ ID NO: 2288217 - protein, 11 aa, Cryptosporidium parvum
YNSNEKPASSA

SEQ ID NO: 2288218 - protein, 13 aa, Cryptosporidium parvum
YNSNQSVSRGKKI

SEQ ID NO: 2288219 - protein, 21 aa, Cryptosporidium parvum
YNSPKNTKNENINNKSNDNTL

SEQ ID NO: 2288220 - protein, 6 aa, Cryptosporidium parvum
YNSPNN

SEQ ID NO: 2288221 - protein, 4 aa, Cryptosporidium parvum
YNSQ

SEQ ID NO: 2288222 - protein, 6 aa, Cryptosporidium parvum
YNSSEV

SEQ ID NO: 2288223 - protein, 16 aa, Cryptosporidium parvum
YNSSLENSKRGKRRNI

SEQ ID NO: 2288224 - protein, 7 aa, Cryptosporidium parvum
YNSSSYN

SEQ ID NO: 2288225 - protein, 5 aa, Cryptosporidium parvum
YNTAP

SEQ ID NO: 2288226 - protein, 13 aa, Cryptosporidium parvum
YNTDSNNLNESER

SEQ ID NO: 2288227 - protein, 8 aa, Cryptosporidium parvum
YNTEATNN

SEQ ID NO: 2288228 - protein, 5 aa, Cryptosporidium parvum
YNTEP

SEQ ID NO: 2288229 - protein, 23 aa, Cryptosporidium parvum
YNTHSNGKVTSDKEKNEECGPNS

SEQ ID NO: 2288230 - protein, 15 aa, Cryptosporidium parvum
YNTKKDEKKERRKKR

SEQ ID NO: 2288231 - protein, 12 aa, Cryptosporidium parvum
YNTLTNEKQQSS

SEQ ID NO: 2288232 - protein, 14 aa, Cryptosporidium parvum
YNTNDFPINNGYYH

SEQ ID NO: 2288233 - protein, 51 aa, Cryptosporidium parvum
YNTNSTGNVYGGGAGGGAGAGGGAGAGGGAGASGGAGASGGAEGGEALDDE

SEQ ID NO: 2288234 - protein, 10 aa, Cryptosporidium parvum
YNTNTNNKTK

SEQ ID NO: 2288235 - protein, 7 aa, Cryptosporidium parvum
YNTPSNR

SEQ ID NO: 2288236 - protein, 60 aa, Cryptosporidium parvum
YNTYNNPTNSQPQPVQQTTYPPPNNNSSIPTTGSSYNTAYGSQFPPKHEAKMNNPPMQTS

SEQ ID NO: 2288237 - protein, 4 aa, Cryptosporidium parvum
YNVE

SEQ ID NO: 2288238 - protein, 33 aa, Cryptosporidium parvum
YNVSDESKSAEKRLESKRSGDTNVVESEHESNV

SEQ ID NO: 2288239 - protein, 17 aa, Cryptosporidium parvum
YNYNNNNNNIGEGGGRQ

SEQ ID NO: 2288240 - protein, 9 aa, Cryptosporidium parvum
YNYQSNNQV

SEQ ID NO: 2288241 - protein, 4 aa, Cryptosporidium parvum
YPAA

SEQ ID NO: 2288242 - protein, 8 aa, Cryptosporidium parvum
YPAKNGEK

SEQ ID NO: 2288243 - protein, 11 aa, Cryptosporidium parvum
YPANTSEIDPI

SEQ ID NO: 2288244 - protein, 12 aa, Cryptosporidium parvum
YPDAAKKIEESA

SEQ ID NO: 2288245 - protein, 11 aa, Cryptosporidium parvum
YPDGTTTPQNS

SEQ ID NO: 2288246 - protein, 10 aa, Cryptosporidium parvum
YPDKPSGEDS

SEQ ID NO: 2288247 - protein, 4 aa, Cryptosporidium parvum
YPDY

SEQ ID NO: 2288248 - protein, 16 aa, Cryptosporidium parvum
YPEEKTNEVPKGNKEK

SEQ ID NO: 2288249 - protein, 4 aa, Cryptosporidium parvum
YPEL

SEQ ID NO: 2288250 - protein, 6 aa, Cryptosporidium parvum
YPENSG

SEQ ID NO: 2288251 - protein, 6 aa, Cryptosporidium parvum
YPESDQ

SEQ ID NO: 2288252 - protein, 6 aa, Cryptosporidium parvum
YPFKPP

SEQ ID NO: 2288253 - protein, 8 aa, Cryptosporidium parvum
YPFKPPKV

SEQ ID NO: 2288254 - protein, 13 aa, Cryptosporidium parvum
YPFSGTNNSSKDS

SEQ ID NO: 2288255 - protein, 14 aa, Cryptosporidium parvum
YPGAPFPQTGPTHP

SEQ ID NO: 2288256 - protein, 6 aa, Cryptosporidium parvum
YPGDSE

SEQ ID NO: 2288257 - protein, 4 aa, Cryptosporidium parvum
YPGR

SEQ ID NO: 2288258 - protein, 6 aa, Cryptosporidium parvum
YPGSNI

SEQ ID NO: 2288259 - protein, 5 aa, Cryptosporidium parvum
YPIKY

SEQ ID NO: 2288260 - protein, 5 aa, Cryptosporidium parvum
YPKEV

SEQ ID NO: 2288261 - protein, 8 aa, Cryptosporidium parvum
YPKPNHSV

SEQ ID NO: 2288262 - protein, 6 aa, Cryptosporidium parvum
YPKQGD

SEQ ID NO: 2288263 - protein, 33 aa, Cryptosporidium parvum
YPMANANNSMNNRSFEQNRGLRPHTSSNSGANN

SEQ ID NO: 2288264 - protein, 9 aa, Cryptosporidium parvum
YPNESEKGN

SEQ ID NO: 2288265 - protein, 10 aa, Cryptosporidium parvum
YPNNTGTPIG

SEQ ID NO: 2288266 - protein, 5 aa, Cryptosporidium parvum
YPNSN

SEQ ID NO: 2288267 - protein, 5 aa, Cryptosporidium parvum
YPNSS

SEQ ID NO: 2288268 - protein, 5 aa, Cryptosporidium parvum
YPPEF

SEQ ID NO: 2288269 - protein, 12 aa, Cryptosporidium parvum
YPPIKNKSPEYV

SEQ ID NO: 2288270 - protein, 13 aa, Cryptosporidium parvum
YPPKQPINMFGAH

SEQ ID NO: 2288271 - protein, 8 aa, Cryptosporidium parvum
YPPPTQKT

SEQ ID NO: 2288272 - protein, 7 aa, Cryptosporidium parvum
YPPQSQI

SEQ ID NO: 2288273 - protein, 10 aa, Cryptosporidium parvum
YPPSMQNGRD

SEQ ID NO: 2288274 - protein, 5 aa, Cryptosporidium parvum
YPPTI

SEQ ID NO: 2288275 - protein, 10 aa, Cryptosporidium parvum
YPQHSTGKSS

SEQ ID NO: 2288276 - protein, 8 aa, Cryptosporidium parvum
YPQKKSPL

SEQ ID NO: 2288277 - protein, 13 aa, Cryptosporidium parvum
YPREPKKKLSGLD

SEQ ID NO: 2288278 - protein, 12 aa, Cryptosporidium parvum
YPRTETNSFSDS

SEQ ID NO: 2288279 - protein, 7 aa, Cryptosporidium parvum
YPRTNNK

SEQ ID NO: 2288280 - protein, 11 aa, Cryptosporidium parvum
YPSDLNQNNLQ

SEQ ID NO: 2288281 - protein, 5 aa, Cryptosporidium parvum
YPSDP

SEQ ID NO: 2288282 - protein, 9 aa, Cryptosporidium parvum
YPSDSNSDL

SEQ ID NO: 2288283 - protein, 13 aa, Cryptosporidium parvum
YPSPLTAKTPDNL

SEQ ID NO: 2288284 - protein, 5 aa, Cryptosporidium parvum
YPSPT

SEQ ID NO: 2288285 - protein, 27 aa, Cryptosporidium parvum
YPSTSQDHLTTEISQSQISSSQKPKDK

SEQ ID NO: 2288286 - protein, 8 aa, Cryptosporidium parvum
YPTEKSDK

SEQ ID NO: 2288287 - protein, 4 aa, Cryptosporidium parvum
YPTG

SEQ ID NO: 2288288 - protein, 7 aa, Cryptosporidium parvum
YPTQSGS

SEQ ID NO: 2288289 - protein, 8 aa, Cryptosporidium parvum
YPTSPDVV

SEQ ID NO: 2288290 - protein, 6 aa, Cryptosporidium parvum
YPVEEA

SEQ ID NO: 2288291 - protein, 6 aa, Cryptosporidium parvum
YPYEPP

SEQ ID NO: 2288292 - protein, 36 aa, Cryptosporidium parvum
YQAQSQTIGQNQGYSQSGGYYGSSNDNTMQGQNRVR

SEQ ID NO: 2288293 - protein, 10 aa, Cryptosporidium parvum
YQDAVNQKKE

SEQ ID NO: 2288294 - protein, 18 aa, Cryptosporidium parvum
YQDDNGNTALHKSSANGH

SEQ ID NO: 2288295 - protein, 11 aa, Cryptosporidium parvum
YQDDRKSSIQS

SEQ ID NO: 2288296 - protein, 6 aa, Cryptosporidium parvum
YQDENF

SEQ ID NO: 2288297 - protein, 14 aa, Cryptosporidium parvum
YQDKVSKTPLSTPD

SEQ ID NO: 2288298 - protein, 13 aa, Cryptosporidium parvum
YQEKRGPANSLSS

SEQ ID NO: 2288299 - protein, 9 aa, Cryptosporidium parvum
YQENNGSKN

SEQ ID NO: 2288300 - protein, 5 aa, Cryptosporidium parvum
YQEPT

SEQ ID NO: 2288301 - protein, 4 aa, Cryptosporidium parvum
YQER

SEQ ID NO: 2288302 - protein, 4 aa, Cryptosporidium parvum
YQES

SEQ ID NO: 2288303 - protein, 10 aa, Cryptosporidium parvum
YQGKGKGSMA

SEQ ID NO: 2288304 - protein, 14 aa, Cryptosporidium parvum
YQGRQGSTLNGRSN

SEQ ID NO: 2288305 - protein, 7 aa, Cryptosporidium parvum
YQGVQPP

SEQ ID NO: 2288306 - protein, 9 aa, Cryptosporidium parvum
YQKDDPNSF

SEQ ID NO: 2288307 - protein, 7 aa, Cryptosporidium parvum
YQKDSNN

SEQ ID NO: 2288308 - protein, 18 aa, Cryptosporidium parvum
YQKDYSNNNNSNGNGNVN

SEQ ID NO: 2288309 - protein, 4 aa, Cryptosporidium parvum
YQKE

SEQ ID NO: 2288310 - protein, 5 aa, Cryptosporidium parvum
YQKNS

SEQ ID NO: 2288311 - protein, 4 aa, Cryptosporidium parvum
YQKR

SEQ ID NO: 2288312 - protein, 4 aa, Cryptosporidium parvum
YQKS

SEQ ID NO: 2288313 - protein, 6 aa, Cryptosporidium parvum
YQKSDF

SEQ ID NO: 2288314 - protein, 5 aa, Cryptosporidium parvum
YQKSE

SEQ ID NO: 2288315 - protein, 17 aa, Cryptosporidium parvum
YQLGKKTEEEISETKIT

SEQ ID NO: 2288316 - protein, 4 aa, Cryptosporidium parvum
YQNE

SEQ ID NO: 2288317 - protein, 33 aa, Cryptosporidium parvum
YQNEDDKEVNKKDDFGNEGFDDSCDDDDDDDWQ

SEQ ID NO: 2288318 - protein, 17 aa, Cryptosporidium parvum
YQQEKDTKTNTNKQTKE

SEQ ID NO: 2288319 - protein, 6 aa, Cryptosporidium parvum
YQQNNQ

SEQ ID NO: 2288320 - protein, 9 aa, Cryptosporidium parvum
YQQQQQQQV

SEQ ID NO: 2288321 - protein, 10 aa, Cryptosporidium parvum
YQQQSHNQNY

SEQ ID NO: 2288322 - protein, 4 aa, Cryptosporidium parvum
YQQS

SEQ ID NO: 2288323 - protein, 10 aa, Cryptosporidium parvum
YQSDSDVAAE

SEQ ID NO: 2288324 - protein, 6 aa, Cryptosporidium parvum
YQSEEN

SEQ ID NO: 2288325 - protein, 5 aa, Cryptosporidium parvum
YQSEK

SEQ ID NO: 2288326 - protein, 8 aa, Cryptosporidium parvum
YQSKNDIN

SEQ ID NO: 2288327 - protein, 7 aa, Cryptosporidium parvum
YQSNEVE

SEQ ID NO: 2288328 - protein, 15 aa, Cryptosporidium parvum
YQSNNENEHGNSITE

SEQ ID NO: 2288329 - protein, 23 aa, Cryptosporidium parvum
YQSQSKRRKRERERQTKSESINT

SEQ ID NO: 2288330 - protein, 7 aa, Cryptosporidium parvum
YQSSKSV

SEQ ID NO: 2288331 - protein, 12 aa, Cryptosporidium parvum
YQTNLKRNVGRI

SEQ ID NO: 2288332 - protein, 12 aa, Cryptosporidium parvum
YQTNPHTWRATG

SEQ ID NO: 2288333 - protein, 9 aa, Cryptosporidium parvum
YQTRQTTGA

SEQ ID NO: 2288334 - protein, 5 aa, Cryptosporidium parvum
YQVTP

SEQ ID NO: 2288335 - protein, 17 aa, Cryptosporidium parvum
YQYPSDCKQEDTQNTEF

SEQ ID NO: 2288336 - protein, 25 aa, Cryptosporidium parvum
YQYSGPSFDSNPNNPGAEHEISDIA

SEQ ID NO: 2288337 - protein, 7 aa, Cryptosporidium parvum
YRAATEK

SEQ ID NO: 2288338 - protein, 9 aa, Cryptosporidium parvum
YRASKEKNL

SEQ ID NO: 2288339 - protein, 10 aa, Cryptosporidium parvum
YRDDSLGIAK

SEQ ID NO: 2288340 - protein, 5 aa, Cryptosporidium parvum
YRDEI

SEQ ID NO: 2288341 - protein, 11 aa, Cryptosporidium parvum
YRDKNLSSSIG

SEQ ID NO: 2288342 - protein, 4 aa, Cryptosporidium parvum
YRDT

SEQ ID NO: 2288343 - protein, 7 aa, Cryptosporidium parvum
YREERRK

SEQ ID NO: 2288344 - protein, 18 aa, Cryptosporidium parvum
YREGGIKREELKQNKFGR

SEQ ID NO: 2288345 - protein, 7 aa, Cryptosporidium parvum
YRESQNT

SEQ ID NO: 2288346 - protein, 7 aa, Cryptosporidium parvum
YRGEGIE

SEQ ID NO: 2288347 - protein, 10 aa, Cryptosporidium parvum
YRGKKSNGQF

SEQ ID NO: 2288348 - protein, 4 aa, Cryptosporidium parvum
YRGN

SEQ ID NO: 2288349 - protein, 7 aa, Cryptosporidium parvum
YRGTRDS

SEQ ID NO: 2288350 - protein, 11 aa, Cryptosporidium parvum
YRGTRKEYKNV

SEQ ID NO: 2288351 - protein, 6 aa, Cryptosporidium parvum
YRHPQL

SEQ ID NO: 2288352 - protein, 9 aa, Cryptosporidium parvum
YRISPNNTI

SEQ ID NO: 2288353 - protein, 9 aa, Cryptosporidium parvum
YRKATQKVA

SEQ ID NO: 2288354 - protein, 7 aa, Cryptosporidium parvum
YRKRKCD

SEQ ID NO: 2288355 - protein, 46 aa, Cryptosporidium parvum
YRKRRSKRKQNEQNSEKDGLNLDGSNNSTSITENDSFGDRYSNDNT

SEQ ID NO: 2288356 - protein, 29 aa, Cryptosporidium parvum
YRKSSPSSSSSSISNTHPSTGKNTFGSHQ

SEQ ID NO: 2288357 - protein, 17 aa, Cryptosporidium parvum
YRNARNGEINPNEALRE

SEQ ID NO: 2288358 - protein, 5 aa, Cryptosporidium parvum
YRNIP

SEQ ID NO: 2288359 - protein, 24 aa, Cryptosporidium parvum
YRNKTDSTDPSNFTNIETENENIQ

SEQ ID NO: 2288360 - protein, 9 aa, Cryptosporidium parvum
YRNNGIKSN

SEQ ID NO: 2288361 - protein, 8 aa, Cryptosporidium parvum
YRNPGPIQ

SEQ ID NO: 2288362 - protein, 10 aa, Cryptosporidium parvum
YRNQNTRKGY

SEQ ID NO: 2288363 - protein, 5 aa, Cryptosporidium parvum
YRNRG

SEQ ID NO: 2288364 - protein, 6 aa, Cryptosporidium parvum
YRNTKT

SEQ ID NO: 2288365 - protein, 17 aa, Cryptosporidium parvum
YRPNGNSNKGENSSSMN

SEQ ID NO: 2288366 - protein, 4 aa, Cryptosporidium parvum
YRPP

SEQ ID NO: 2288367 - protein, 8 aa, Cryptosporidium parvum
YRPPNNPE

SEQ ID NO: 2288368 - protein, 22 aa, Cryptosporidium parvum
YRQPGSCKNSKSMNNLASNSSV

SEQ ID NO: 2288369 - protein, 6 aa, Cryptosporidium parvum
YRRRSS

SEQ ID NO: 2288370 - protein, 15 aa, Cryptosporidium parvum
YRRSSVGSRKSIGGN

SEQ ID NO: 2288371 - protein, 14 aa, Cryptosporidium parvum
YRSGLTSGHKYKND

SEQ ID NO: 2288372 - protein, 15 aa, Cryptosporidium parvum
YRSGNSSSSIGSQGV

SEQ ID NO: 2288373 - protein, 9 aa, Cryptosporidium parvum
YRSNSSQLN

SEQ ID NO: 2288374 - protein, 18 aa, Cryptosporidium parvum
YRTGEDEDTPNSNNEEIP

SEQ ID NO: 2288375 - protein, 20 aa, Cryptosporidium parvum
YRYGSPAEDYHKYSGRHENS

SEQ ID NO: 2288376 - protein, 9 aa, Cryptosporidium parvum
YSAASQAAA

SEQ ID NO: 2288377 - protein, 6 aa, Cryptosporidium parvum
YSDDTK

SEQ ID NO: 2288378 - protein, 9 aa, Cryptosporidium parvum
YSDEEKKNV

SEQ ID NO: 2288379 - protein, 5 aa, Cryptosporidium parvum
YSDEI

SEQ ID NO: 2288380 - protein, 23 aa, Cryptosporidium parvum
YSDENENSYVTKNSANGKVNTNF

SEQ ID NO: 2288381 - protein, 30 aa, Cryptosporidium parvum; identical to SEQ ID NO: 2167780

SEQ ID NO: 2288382 - protein, 17 aa, Cryptosporidium parvum
YSDIPSRNKKRNEGGYN

SEQ ID NO: 2288383 - protein, 20 aa, Cryptosporidium parvum
YSDNSAQNNEDTYSSDDDRH

SEQ ID NO: 2288384 - protein, 10 aa, Cryptosporidium parvum
YSDNSAYENS

SEQ ID NO: 2288385 - protein, 4 aa, Cryptosporidium parvum
YSDP

SEQ ID NO: 2288386 - protein, 5 aa, Cryptosporidium parvum
YSDSI

SEQ ID NO: 2288387 - protein, 6 aa, Cryptosporidium parvum
YSDSNI

SEQ ID NO: 2288388 - protein, 5 aa, Cryptosporidium parvum
YSDTR

SEQ ID NO: 2288389 - protein, 6 aa, Cryptosporidium parvum
YSDWGS

SEQ ID NO: 2288390 - protein, 31 aa, Cryptosporidium parvum; identical to SEQ ID NO: 2167786

SEQ ID NO: 2288391 - protein, 5 aa, Cryptosporidium parvum
YSEED

SEQ ID NO: 2288392 - protein, 15 aa, Cryptosporidium parvum
YSEENSGGETDKEED

SEQ ID NO: 2288393 - protein, 10 aa, Cryptosporidium parvum
YSEGFPGTRY

SEQ ID NO: 2288394 - protein, 5 aa, Cryptosporidium parvum
YSEIG

SEQ ID NO: 2288395 - protein, 7 aa, Cryptosporidium parvum
YSESQTM

SEQ ID NO: 2288396 - protein, 5 aa, Cryptosporidium parvum
YSESY

SEQ ID NO: 2288397 - protein, 5 aa, Cryptosporidium parvum
YSEYN

SEQ ID NO: 2288398 - protein, 7 aa, Cryptosporidium parvum
YSGDYST

SEQ ID NO: 2288399 - protein, 7 aa, Cryptosporidium parvum
YSGGEGT

SEQ ID NO: 2288400 - protein, 13 aa, Cryptosporidium parvum
YSGGKLDKSEKLD

SEQ ID NO: 2288401 - protein, 12 aa, Cryptosporidium parvum
YSGNETNNITNV

SEQ ID NO: 2288402 - protein, 5 aa, Cryptosporidium parvum
YSGQM

SEQ ID NO: 2288403 - protein, 5 aa, Cryptosporidium parvum
YSGRT

SEQ ID NO: 2288404 - protein, 12 aa, Cryptosporidium parvum
YSGSNDKSQGVD

SEQ ID NO: 2288405 - protein, 8 aa, Cryptosporidium parvum
YSGSNGSS

SEQ ID NO: 2288406 - protein, 21 aa, Cryptosporidium parvum
YSGSTMPSQYTNTNNRKLSNY

SEQ ID NO: 2288407 - protein, 5 aa, Cryptosporidium parvum
YSHKP

SEQ ID NO: 2288408 - protein, 7 aa, Cryptosporidium parvum
YSHNQHN

SEQ ID NO: 2288409 - protein, 27 aa, Cryptosporidium parvum
YSIGQNDGASTGRISNGINTNNNTTNN

SEQ ID NO: 2288410 - protein, 12 aa, Cryptosporidium parvum
YSIGSDSTIYTQ

SEQ ID NO: 2288411 - protein, 32 aa, Cryptosporidium parvum
YSIKGNKNKEQKSPGLINNTKTSGSFDNTTAG

SEQ ID NO: 2288412 - protein, 7 aa, Cryptosporidium parvum
YSKATST

SEQ ID NO: 2288413 - protein, 10 aa, Cryptosporidium parvum
YSKEKDESQL

SEQ ID NO: 2288414 - protein, 6 aa, Cryptosporidium parvum
YSKENQ

SEQ ID NO: 2288415 - protein, 4 aa, Cryptosporidium parvum
YSKI

SEQ ID NO: 2288416 - protein, 12 aa, Cryptosporidium parvum
YSKKQFNSISNL

SEQ ID NO: 2288417 - protein, 17 aa, Cryptosporidium parvum
YSKNDNSEGGEKTGETR

SEQ ID NO: 2288418 - protein, 8 aa, Cryptosporidium parvum
YSKNNPIE

SEQ ID NO: 2288419 - protein, 5 aa, Cryptosporidium parvum
YSKPI

SEQ ID NO: 2288420 - protein, 11 aa, Cryptosporidium parvum
YSKPTKSEDGN

SEQ ID NO: 2288421 - protein, 7 aa, Cryptosporidium parvum
YSKPVKR

SEQ ID NO: 2288422 - protein, 16 aa, Cryptosporidium parvum
YSKSDRSSLPGESQSC

SEQ ID NO: 2288423 - protein, 7 aa, Cryptosporidium parvum
YSKSEDK

SEQ ID NO: 2288424 - protein, 5 aa, Cryptosporidium parvum
YSKSK

SEQ ID NO: 2288425 - protein, 6 aa, Cryptosporidium parvum
YSKTAY

SEQ ID NO: 2288426 - protein, 6 aa, Cryptosporidium parvum
YSKYGS

SEQ ID NO: 2288427 - protein, 9 aa, Cryptosporidium parvum
YSLEETNEK

SEQ ID NO: 2288428 - protein, 11 aa, Cryptosporidium parvum
YSLPSFSEGPS

SEQ ID NO: 2288429 - protein, 52 aa, Cryptosporidium parvum
YSLSNTNSNHHHSNIERERKGESKNQKEREEESKSEKERERKEKKESKSEIV

SEQ ID NO: 2288430 - protein, 19 aa, Cryptosporidium parvum
YSMNTTSSRVVENEDSGIL

SEQ ID NO: 2288431 - protein, 9 aa, Cryptosporidium parvum
YSNDDNEVF

SEQ ID NO: 2288432 - protein, 9 aa, Cryptosporidium parvum
YSNDPNKQV

SEQ ID NO: 2288433 - protein, 14 aa, Cryptosporidium parvum
YSNEGSVKQFRPSS

SEQ ID NO: 2288434 - protein, 9 aa, Cryptosporidium parvum
YSNEIEYDQ

SEQ ID NO: 2288435 - protein, 9 aa, Cryptosporidium parvum
YSNETRTNS

SEQ ID NO: 2288436 - protein, 4 aa, Cryptosporidium parvum
YSNG

SEQ ID NO: 2288437 - protein, 16 aa, Cryptosporidium parvum
YSNGTVSIDNNGDKSS

SEQ ID NO: 2288438 - protein, 13 aa, Cryptosporidium parvum
YSNHNNQITPPHN

SEQ ID NO: 2288439 - protein, 16 aa, Cryptosporidium parvum
YSNISSPIQQNNTGDL

SEQ ID NO: 2288440 - protein, 12 aa, Cryptosporidium parvum
YSNKDLEEKQRN

SEQ ID NO: 2288441 - protein, 7 aa, Cryptosporidium parvum
YSNKPQA

SEQ ID NO: 2288442 - protein, 7 aa, Cryptosporidium parvum
YSNLQSS

SEQ ID NO: 2288443 - protein, 4 aa, Cryptosporidium parvum
YSNN

SEQ ID NO: 2288444 - protein, 11 aa, Cryptosporidium parvum
YSNNPKGTNYV

SEQ ID NO: 2288445 - protein, 11 aa, Cryptosporidium parvum
YSNNSDDFASK

SEQ ID NO: 2288446 - protein, 31 aa, Cryptosporidium parvum
YSNNTSGIQQIPTQNNSQIGTKSNETKPLSI

SEQ ID NO: 2288447 - protein, 7 aa, Cryptosporidium parvum
YSNPNNY

SEQ ID NO: 2288448 - protein, 8 aa, Cryptosporidium parvum
YSNPNSIT

SEQ ID NO: 2288449 - protein, 6 aa, Cryptosporidium parvum
YSNSAT

SEQ ID NO: 2288450 - protein, 19 aa, Cryptosporidium parvum
YSNSGGNKSLQSSSSNPTN

SEQ ID NO: 2288451 - protein, 5 aa, Cryptosporidium parvum
YSNSR

SEQ ID NO: 2288452 - protein, 15 aa, Cryptosporidium parvum
YSNTGGQASKSTPFG

SEQ ID NO: 2288453 - protein, 8 aa, Cryptosporidium parvum
YSNYKDPK

SEQ ID NO: 2288454 - protein, 9 aa, Cryptosporidium parvum
YSPDSKNGK

SEQ ID NO: 2288455 - protein, 13 aa, Cryptosporidium parvum
YSPEDQEKKEPVY

SEQ ID NO: 2288456 - protein, 9 aa, Cryptosporidium parvum
YSPETRSWT

SEQ ID NO: 2288457 - protein, 10 aa, Cryptosporidium parvum
YSPMSPSSPL

SEQ ID NO: 2288458 - protein, 4 aa, Cryptosporidium parvum
YSPN

SEQ ID NO: 2288459 - protein, 45 aa, Cryptosporidium parvum; identical to SEQ ID NO: 2167854

SEQ ID NO: 2288460 - protein, 18 aa, Cryptosporidium parvum
YSPRESKEVCGGKKRSEI

SEQ ID NO: 2288461 - protein, 15 aa, Cryptosporidium parvum
YSPSENEDSNEEIDE

SEQ ID NO: 2288462 - protein, 17 aa, Cryptosporidium parvum
YSPSIVSNDSKTKSDYV

SEQ ID NO: 2288463 - protein, 7 aa, Cryptosporidium parvum
YSPSNGY

SEQ ID NO: 2288464 - protein, 5 aa, Cryptosporidium parvum
YSPSV

SEQ ID NO: 2288465 - protein, 6 aa, Cryptosporidium parvum
YSPTEI

SEQ ID NO: 2288466 - protein, 7 aa, Cryptosporidium parvum
YSPTNGT

SEQ ID NO: 2288467 - protein, 10 aa, Cryptosporidium parvum
YSQDKFKRNR

SEQ ID NO: 2288468 - protein, 8 aa, Cryptosporidium parvum
YSQEDENK

SEQ ID NO: 2288469 - protein, 9 aa, Cryptosporidium parvum
YSQEYEVPP

SEQ ID NO: 2288470 - protein, 12 aa, Cryptosporidium parvum
YSQGPNPSQHGL

SEQ ID NO: 2288471 - protein, 10 aa, Cryptosporidium parvum
YSQNGNSLPV

SEQ ID NO: 2288472 - protein, 8 aa, Cryptosporidium parvum
YSQNNGEI

SEQ ID NO: 2288473 - protein, 5 aa, Cryptosporidium parvum
YSQPA

SEQ ID NO: 2288474 - protein, 11 aa, Cryptosporidium parvum
YSQSSMNEESS

SEQ ID NO: 2288475 - protein, 25 aa, Cryptosporidium parvum
YSQSYSQGSSSNLGGLTETDSKTMS

SEQ ID NO: 2288476 - protein, 14 aa, Cryptosporidium parvum
YSREETPSSANKEQ

SEQ ID NO: 2288477 - protein, 9 aa, Cryptosporidium parvum
YSREQKCEL

SEQ ID NO: 2288478 - protein, 4 aa, Cryptosporidium parvum
YSRK

SEQ ID NO: 2288479 - protein, 10 aa, Cryptosporidium parvum
YSRKNSENKY

SEQ ID NO: 2288480 - protein, 9 aa, Cryptosporidium parvum
YSRKSDNLI

SEQ ID NO: 2288481 - protein, 6 aa, Cryptosporidium parvum
YSRNGN

SEQ ID NO: 2288482 - protein, 17 aa, Cryptosporidium parvum
YSRQSETPRASFTNTYN

SEQ ID NO: 2288483 - protein, 8 aa, Cryptosporidium parvum
YSRRSYNS

SEQ ID NO: 2288484 - protein, 9 aa, Cryptosporidium parvum
YSSAEQRER

SEQ ID NO: 2288485 - protein, 6 aa, Cryptosporidium parvum
YSSAGT

SEQ ID NO: 2288486 - protein, 6 aa, Cryptosporidium parvum
YSSDPY

SEQ ID NO: 2288487 - protein, 7 aa, Cryptosporidium parvum
YSSEEIN

SEQ ID NO: 2288488 - protein, 9 aa, Cryptosporidium parvum
YSSEKTPNK

SEQ ID NO: 2288489 - protein, 21 aa, Cryptosporidium parvum
YSSENKRATPQQTISNRAPNI

SEQ ID NO: 2288490 - protein, 5 aa, Cryptosporidium parvum
YSSFS

SEQ ID NO: 2288491 - protein, 10 aa, Cryptosporidium parvum
YSSGAEWNPM

SEQ ID NO: 2288492 - protein, 8 aa, Cryptosporidium parvum
YSSKDTME

SEQ ID NO: 2288493 - protein, 9 aa, Cryptosporidium parvum
YSSKNTSYH

SEQ ID NO: 2288494 - protein, 7 aa, Cryptosporidium parvum
YSSLSPS

SEQ ID NO: 2288495 - protein, 15 aa, Cryptosporidium parvum
YSSNDRKSPRSAEIT

SEQ ID NO: 2288496 - protein, 10 aa, Cryptosporidium parvum
YSSNKDEHSI

SEQ ID NO: 2288497 - protein, 7 aa, Cryptosporidium parvum
YSSNPSY

SEQ ID NO: 2288498 - protein, 8 aa, Cryptosporidium parvum
YSSNSNLD

SEQ ID NO: 2288499 - protein, 8 aa, Cryptosporidium parvum
YSSPVGDL

SEQ ID NO: 2288500 - protein, 11 aa, Cryptosporidium parvum
YSSQGRSQGRV

SEQ ID NO: 2288501 - protein, 9 aa, Cryptosporidium parvum
YSSRAPPEH

SEQ ID NO: 2288502 - protein, 18 aa, Cryptosporidium parvum
YSSRVNSKQNNKKKDLKI

SEQ ID NO: 2288503 - protein, 4 aa, Cryptosporidium parvum
YSSS

SEQ ID NO: 2288504 - protein, 26 aa, Cryptosporidium parvum
YSSSDESSSSGSSSSDDSKEWSDDSI

SEQ ID NO: 2288505 - protein, 16 aa, Cryptosporidium parvum
YSSSKTSLNNQKQKKY

SEQ ID NO: 2288506 - protein, 28 aa, Cryptosporidium parvum
YSSSNKDNPGDEGSGISIEERIKKLGED

SEQ ID NO: 2288507 - protein, 9 aa, Cryptosporidium parvum
YSSSTESES

SEQ ID NO: 2288508 - protein, 9 aa, Cryptosporidium parvum
YSSTKGVEK

SEQ ID NO: 2288509 - protein, 6 aa, Cryptosporidium parvum
YSSVNT

SEQ ID NO: 2288510 - protein, 5 aa, Cryptosporidium parvum
YSTAA

SEQ ID NO: 2288511 - protein, 8 aa, Cryptosporidium parvum
YSTAPIGG

SEQ ID NO: 2288512 - protein, 16 aa, Cryptosporidium parvum
YSTAPKEMKGKKPQEL

SEQ ID NO: 2288513 - protein, 7 aa, Cryptosporidium parvum
YSTDGKY

SEQ ID NO: 2288514 - protein, 14 aa, Cryptosporidium parvum
YSTDSNNRRVYDNN

SEQ ID NO: 2288515 - protein, 7 aa, Cryptosporidium parvum
YSTEKRK

SEQ ID NO: 2288516 - protein, 10 aa, Cryptosporidium parvum
YSTGEPERLG

SEQ ID NO: 2288517 - protein, 5 aa, Cryptosporidium parvum
YSTND

SEQ ID NO: 2288518 - protein, 5 aa, Cryptosporidium parvum
YSTPG

SEQ ID NO: 2288519 - protein, 9 aa, Cryptosporidium parvum
YSTPTTKNG

SEQ ID NO: 2288520 - protein, 12 aa, Cryptosporidium parvum
YSTSKSKLPDLN

SEQ ID NO: 2288521 - protein, 4 aa, Cryptosporidium parvum
YSVD

SEQ ID NO: 2288522 - protein, 6 aa, Cryptosporidium parvum
YSVDGA

SEQ ID NO: 2288523 - protein, 6 aa, Cryptosporidium parvum
YSYGKN

SEQ ID NO: 2288524 - protein, 11 aa, Cryptosporidium parvum
YSYNSNDQSYK

SEQ ID NO: 2288525 - protein, 6 aa, Cryptosporidium parvum
YTAENR

SEQ ID NO: 2288526 - protein, 12 aa, Cryptosporidium parvum
YTASKKNEENLN

SEQ ID NO: 2288527 - protein, 10 aa, Cryptosporidium parvum
YTDSQFSSSI

SEQ ID NO: 2288528 - protein, 15 aa, Cryptosporidium parvum
YTEANDNSYSPNKSS

SEQ ID NO: 2288529 - protein, 4 aa, Cryptosporidium parvum
YTED

SEQ ID NO: 2288530 - protein, 11 aa, Cryptosporidium parvum
YTENDVTSELT

SEQ ID NO: 2288531 - protein, 5 aa, Cryptosporidium parvum
YTEPR

SEQ ID NO: 2288532 - protein, 9 aa, Cryptosporidium parvum
YTEQNGRIT

SEQ ID NO: 2288533 - protein, 6 aa, Cryptosporidium parvum
YTESKG

SEQ ID NO: 2288534 - protein, 7 aa, Cryptosporidium parvum
YTETDPV

SEQ ID NO: 2288535 - protein, 13 aa, Cryptosporidium parvum
YTGGSTGELIVCS

SEQ ID NO: 2288536 - protein, 11 aa, Cryptosporidium parvum
YTGKDDPESIY

SEQ ID NO: 2288537 - protein, 22 aa, Cryptosporidium parvum
YTGNSHSHQLEPPNEDLVEDQS

SEQ ID NO: 2288538 - protein, 6 aa, Cryptosporidium parvum
YTGPLT

SEQ ID NO: 2288539 - protein, 6 aa, Cryptosporidium parvum
YTGSDV

SEQ ID NO: 2288540 - protein, 7 aa, Cryptosporidium parvum
YTGSGKT

SEQ ID NO: 2288541 - protein, 12 aa, Cryptosporidium parvum
YTHGSSSKVGYT

SEQ ID NO: 2288542 - protein, 7 aa, Cryptosporidium parvum
YTKEEGA

SEQ ID NO: 2288543 - protein, 5 aa, Cryptosporidium parvum
YTMEG

SEQ ID NO: 2288544 - protein, 20 aa, Cryptosporidium parvum
YTNEAPESNGLSKMNPGPSF

SEQ ID NO: 2288545 - protein, 8 aa, Cryptosporidium parvum
YTNGTPHM

SEQ ID NO: 2288546 - protein, 13 aa, Cryptosporidium parvum
YTNKSEKKSERFS

SEQ ID NO: 2288547 - protein, 10 aa, Cryptosporidium parvum
YTNSARNGSS

SEQ ID NO: 2288548 - protein, 6 aa, Cryptosporidium parvum
YTPDGI

SEQ ID NO: 2288549 - protein, 9 aa, Cryptosporidium parvum
YTPGKLKSN

SEQ ID NO: 2288550 - protein, 4 aa, Cryptosporidium parvum
YTPK

SEQ ID NO: 2288551 - protein, 7 aa, Cryptosporidium parvum
YTPNPHD

SEQ ID NO: 2288552 - protein, 20 aa, Cryptosporidium parvum
YTPSTASSIRDKMNLHNLEV

SEQ ID NO: 2288553 - protein, 14 aa, Cryptosporidium parvum
YTQMSGRAGRRGID

SEQ ID NO: 2288554 - protein, 5 aa, Cryptosporidium parvum
YTQQE

SEQ ID NO: 2288555 - protein, 9 aa, Cryptosporidium parvum
YTQSERKDL

SEQ ID NO: 2288556 - protein, 6 aa, Cryptosporidium parvum
YTRDSL

SEQ ID NO: 2288557 - protein, 7 aa, Cryptosporidium parvum
YTRETSI

SEQ ID NO: 2288558 - protein, 11 aa, Cryptosporidium parvum
YTRKKNQKGKW

SEQ ID NO: 2288559 - protein, 11 aa, Cryptosporidium parvum
YTRKKSAETQK

SEQ ID NO: 2288560 - protein, 4 aa, Cryptosporidium parvum
YTRQ

SEQ ID NO: 2288561 - protein, 9 aa, Cryptosporidium parvum
YTSGENGDY

SEQ ID NO: 2288562 - protein, 11 aa, Cryptosporidium parvum
YTSGKGASAVG

SEQ ID NO: 2288563 - protein, 18 aa, Cryptosporidium parvum
YTSKEGKNVEVYSSKSSE

SEQ ID NO: 2288564 - protein, 5 aa, Cryptosporidium parvum
YTSKQ

SEQ ID NO: 2288565 - protein, 13 aa, Cryptosporidium parvum
YTSNGLDSNGRGQ

SEQ ID NO: 2288566 - protein, 10 aa, Cryptosporidium parvum
YTSNSKEFND

SEQ ID NO: 2288567 - protein, 7 aa, Cryptosporidium parvum
YTSQADI

SEQ ID NO: 2288568 - protein, 27 aa, Cryptosporidium parvum
YTSRNSYNRRGNDDRRNRGNQRPNSSL

SEQ ID NO: 2288569 - protein, 6 aa, Cryptosporidium parvum
YTSTPG

SEQ ID NO: 2288570 - protein, 9 aa, Cryptosporidium parvum
YTTKTSPQI

SEQ ID NO: 2288571 - protein, 7 aa, Cryptosporidium parvum
YTTREQT

SEQ ID NO: 2288572 - protein, 14 aa, Cryptosporidium parvum
YTTSESNMVSFKQS

SEQ ID NO: 2288573 - protein, 6 aa, Cryptosporidium parvum
YTTSSN

SEQ ID NO: 2288574 - protein, 17 aa, Cryptosporidium parvum
YTTTQQTQKYKDQYSES

SEQ ID NO: 2288575 - protein, 5 aa, Cryptosporidium parvum
YTTVR

SEQ ID NO: 2288576 - protein, 7 aa, Cryptosporidium parvum
YVAPNPG

SEQ ID NO: 2288577 - protein, 12 aa, Cryptosporidium parvum
YVDEENSNKSNF

SEQ ID NO: 2288578 - protein, 6 aa, Cryptosporidium parvum
YVDEQE

SEQ ID NO: 2288579 - protein, 5 aa, Cryptosporidium parvum
YVDES

SEQ ID NO: 2288580 - protein, 15 aa, Cryptosporidium parvum
YVEEGEEGEEEGKEF

SEQ ID NO: 2288581 - protein, 9 aa, Cryptosporidium parvum
YVGDPSQFD

SEQ ID NO: 2288582 - protein, 5 aa, Cryptosporidium parvum
YVGGS

SEQ ID NO: 2288583 - protein, 13 aa, Cryptosporidium parvum
YVGPSKAPIGGNS

SEQ ID NO: 2288584 - protein, 5 aa, Cryptosporidium parvum
YVNKE

SEQ ID NO: 2288585 - protein, 31 aa, Cryptosporidium parvum
YVNKPNNTNTGVTTTTINTNTNTNNTTNTIG

SEQ ID NO: 2288586 - protein, 9 aa, Cryptosporidium parvum
YVNSGDKLP

SEQ ID NO: 2288587 - protein, 10 aa, Cryptosporidium parvum
YVPEDEDNNP

SEQ ID NO: 2288588 - protein, 5 aa, Cryptosporidium parvum
YVPGE

SEQ ID NO: 2288589 - protein, 10 aa, Cryptosporidium parvum
YVPNNNVEEE

SEQ ID NO: 2288590 - protein, 11 aa, Cryptosporidium parvum
YVPSSNKELNQ

SEQ ID NO: 2288591 - protein, 10 aa, Cryptosporidium parvum
YVSPKNDSRN

SEQ ID NO: 2288592 - protein, 8 aa, Cryptosporidium parvum
YVSSPNTF

SEQ ID NO: 2288593 - protein, 9 aa, Cryptosporidium parvum
YVSSTGDQI

SEQ ID NO: 2288594 - protein, 7 aa, Cryptosporidium parvum
YVTPRTE

SEQ ID NO: 2288595 - protein, 12 aa, Cryptosporidium parvum
YYDNKNNELNNE

SEQ ID NO: 2288596 - protein, 11 aa, Cryptosporidium parvum
YYDQGYDNDYA

SEQ ID NO: 2288597 - protein, 19 aa, Cryptosporidium parvum
YYGDGANSSGGARLQSGRE

SEQ ID NO: 2288598 - protein, 9 aa, Cryptosporidium parvum
YYGENNGLT

SEQ ID NO: 2288599 - protein, 10 aa, Cryptosporidium parvum
YYKSKSNIGL

SEQ ID NO: 2288600 - protein, 18 aa, Cryptosporidium parvum
YYNEKGNIKYEKNHQDPE

SEQ ID NO: 2288601 - protein, 13 aa, Cryptosporidium parvum
YYNNNSNNDNSSI

SEQ ID NO: 2288602 - protein, 64 aa, Cryptosporidium parvum
YYNNSNKKVRYSDDSLDYSQDNELSREYRNRNNNNNNNNSNNNNMNNNYHNNNNNNNNTNSDEI

SEQ ID NO: 2288603 - protein, 5 aa, Cryptosporidium parvum
YYQNN

SEQ ID NO: 2288604 - protein, 14 aa, Cryptosporidium parvum
YYQQSGRAGRDSKF

SEQ ID NO: 2288605 - protein, 4 aa, Cryptosporidium parvum
YYRG

SEQ ID NO: 2288606 - protein, 16 aa, Cryptosporidium parvum
YYRSKNTGCCGSSCGG

SEQ ID NO: 2288607 - protein, 23 aa, Cryptosporidium parvum
YYRTRSSSYCTSTCSSSSPPTTG

SEQ ID NO: 2288608 - protein, 5 aa, Cryptosporidium parvum
YYSGD

SEQ ID NO: 2288609 - protein, 9 aa, Cryptosporidium parvum
YYSKKSGVL

SEQ ID NO: 2288610 - protein, 18 aa, Cryptosporidium parvum
YYSNNDTCKITDLSLNQF

SEQ ID NO: 2288611 - protein, 4 aa, Cryptosporidium parvum
YYSS

SEQ ID NO: 2288612 - protein, 9 aa, Cryptosporidium parvum
YYSSNDDYL

SEQ ID NO: 2288613 - protein, 8 aa, Cryptosporidium parvum
YYTDEDGY

SEQ ID NO: 2288614 - protein, 17 aa, Cryptosporidium parvum
YYYGEGNETCSSSDDAP

SEQ ID NO: 2288615 - protein, 24 aa, Cryptosporidium parvum
PAEESSWFSGWFGASETTPAPPPT

SEQ ID NO: 2288616 - protein, 24 aa, Cryptosporidium parvum
DSNLLCKIPKGFTFEQAAALPVVA

SEQ ID NO: 2288617 - protein, 22 aa, Cryptosporidium parvum
EGIPPDQQRLIFAGKQLEDGRT

SEQ ID NO: 2288618 - protein, 18 aa, Cryptosporidium parvum
KRPDIKYKCVAVDVMMEE

SEQ ID NO: 2288619 - protein, 20 aa, Cryptosporidium parvum
LKAKVPVKPSPLLKSKSEKE

SEQ ID NO: 2288620 - protein, 20 aa, Cryptosporidium parvum
NLLKKGGCFVELGKRGIWTE

SEQ ID NO: 2288621 - protein, 20 aa, Cryptosporidium parvum
EDPSWFGGMLTRIKNLVEEG

SEQ ID NO: 2288622 - protein, 21 aa, Cryptosporidium parvum
ESLPLKVFDMRGSDENGIDAF

SEQ ID NO: 2288623 - protein, 18 aa, Cryptosporidium parvum
ESVYAPKVYGAWNLHECC

SEQ ID NO: 2288624 - protein, 31 aa, Cryptosporidium parvum; identical to SEQ ID NO: 2171890

SEQ ID NO: 2288625 - protein, 19 aa, Cryptosporidium parvum
GIAPGCLKTYVTTDSNLLC

SEQ ID NO: 2288626 - protein, 17 aa, Cryptosporidium parvum
IQKESTLHLVLRLRGGM

SEQ ID NO: 2288627 - protein, 28 aa, Cryptosporidium parvum
KESTLHLVLRLRGGMQIFVKTLTGKTIT

SEQ ID NO: 2288628 - protein, 18 aa, Cryptosporidium parvum
LKLGEVVTTIPTIGFNVE

SEQ ID NO: 2288629 - protein, 19 aa, Cryptosporidium parvum
LNKNLKHFVMFSSVASLLG

SEQ ID NO: 2288630 - protein, 24 aa, Cryptosporidium parvum
PPAEESSWFSGWFGTSAPEEPPKE

SEQ ID NO: 2288631 - protein, 22 aa, Cryptosporidium parvum
QIECIKCDVSILSQVESAFREI

SEQ ID NO: 2288632 - protein, 18 aa, Cryptosporidium parvum
TILYKLKLGEVVTTIPTI

SEQ ID NO: 2288633 - protein, 19 aa, Cryptosporidium parvum
AAAIYSRYFFDSQPAKLFL

SEQ ID NO: 2288634 - protein, 24 aa, Cryptosporidium parvum
AAANCGAFAYQIMFEFDPIKWCSK

SEQ ID NO: 2288635 - protein, 18 aa, Cryptosporidium parvum
AAANEWGGVSGNWGGSAA

SEQ ID NO: 2288636 - protein, 26 aa, Cryptosporidium parvum
AAANSWKPIEDGFEISNVIKGNTIDS

SEQ ID NO: 2288637 - protein, 20 aa, Cryptosporidium parvum
AACEGCGETPYVKLLTQLFG

SEQ ID NO: 2288638 - protein, 20 aa, Cryptosporidium parvum
AACINLILRNYVLTKRYDLG

SEQ ID NO: 2288639 - protein, 25 aa, Cryptosporidium parvum
AAELMPRFCHYLQLSHEIVGIAEYV

SEQ ID NO: 2288640 - protein, 25 aa, Cryptosporidium parvum
AAFNLKNRRFTILDAPGHKSFVPNM

SEQ ID NO: 2288641 - protein, 30 aa, Cryptosporidium parvum; identical to SEQ ID NO: 2168016

SEQ ID NO: 2288642 - protein, 19 aa, Cryptosporidium parvum
AAFVDFMATVALNYTKSQF

SEQ ID NO: 2288643 - protein, 18 aa, Cryptosporidium parvum
AAGGRYDQLIGMFSQKNI

SEQ ID NO: 2288644 - protein, 17 aa, Cryptosporidium parvum
AAGMLSHASIMRYRKKK

SEQ ID NO: 2288645 - protein, 25 aa, Cryptosporidium parvum
AAIFKDPTLIIALHLKDTGNCIPLK

SEQ ID NO: 2288646 - protein, 18 aa, Cryptosporidium parvum
AAIIKLSQIKVWNTCQTH

SEQ ID NO: 2288647 - protein, 18 aa, Cryptosporidium parvum
AAILSNGELYTWGCSKNG

SEQ ID NO: 2288648 - protein, 17 aa, Cryptosporidium parvum
AAIPLPIVKKFLGNHLF

SEQ ID NO: 2288649 - protein, 18 aa, Cryptosporidium parvum
AAIQAGVLKGEIKDLLLL

SEQ ID NO: 2288650 - protein, 30 aa, Cryptosporidium parvum
AAIRRSKILFDICKEFIKLKYVNYSLYNRI

SEQ ID NO: 2288651 - protein, 18 aa, Cryptosporidium parvum
AAIVVKKCKNAIQKYLEC

SEQ ID NO: 2288652 - protein, 22 aa, Cryptosporidium parvum
AAKLNEERLRIEANKNSEHPES

SEQ ID NO: 2288653 - protein, 26 aa, Cryptosporidium parvum
AAKQLPLYILGVLKCPAFRDYKEVSQ

SEQ ID NO: 2288654 - protein, 19 aa, Cryptosporidium parvum
AALKVAIEFLEHKRAEKSP

SEQ ID NO: 2288655 - protein, 17 aa, Cryptosporidium parvum
AALNFNGHFNFGHHSIQ

SEQ ID NO: 2288656 - protein, 17 aa, Cryptosporidium parvum
AANCARYELAVLAIEDG

SEQ ID NO: 2288657 - protein, 24 aa, Cryptosporidium parvum
AANELKSRVSIVYSSSSKIIYSKS

SEQ ID NO: 2288658 - protein, 20 aa, Cryptosporidium parvum
AAQEIVKFVGKYTPLRQFFF

SEQ ID NO: 2288659 - protein, 20 aa, Cryptosporidium parvum
AAQSKYSWHILVTNVDGKLI

SEQ ID NO: 2288660 - protein, 26 aa, Cryptosporidium parvum
AAQTGPKLQEWLGLRDWKNNQSKKQN

SEQ ID NO: 2288661 - protein, 23 aa, Cryptosporidium parvum
AARRRPYSSLTEMAAYFSNIEPQ

SEQ ID NO: 2288662 - protein, 22 aa, Cryptosporidium parvum
AASKRSSFCLGPELICEPNILN

SEQ ID NO: 2288663 - protein, 28 aa, Cryptosporidium parvum
AAVLCSKGNIYLPAWARIYNDRTKLEPA

SEQ ID NO: 2288664 - protein, 25 aa, Cryptosporidium parvum
AAYCTGLLCARRVLKQLNMDKIFTG

SEQ ID NO: 2288665 - protein, 19 aa, Cryptosporidium parvum
AAYKTAFWNGIDWTASSFA

SEQ ID NO: 2288666 - protein, 20 aa, Cryptosporidium parvum
AAYSGWYSPYGYTMPFMGSY

SEQ ID NO: 2288667 - protein, 18 aa, Cryptosporidium parvum
ACAPYEMKHLKKRERTVA

SEQ ID NO: 2288668 - protein, 18 aa, Cryptosporidium parvum
ACHSCLDGFIDIEDLEVI

SEQ ID NO: 2288669 - protein, 27 aa, Cryptosporidium parvum
ACIDFPLKQYRMQMGIRVELEDPKELA

SEQ ID NO: 2288670 - protein, 18 aa, Cryptosporidium parvum
ACILEIISVSSSEFKASL

SEQ ID NO: 2288671 - protein, 18 aa, Cryptosporidium parvum
ACITTSFDLWIKNEDREF

SEQ ID NO: 2288672 - protein, 20 aa, Cryptosporidium parvum
ACLGANMLRRQEYRKFYDRN

SEQ ID NO: 2288673 - protein, 19 aa, Cryptosporidium parvum
ACNLMHFRIRQIIERSIEK

SEQ ID NO: 2288674 - protein, 19 aa, Cryptosporidium parvum
ACNNLFRATSFLEVKPNFN

SEQ ID NO: 2288675 - protein, 20 aa, Cryptosporidium parvum
ACPGEEIIVTGIYRTFRDQK

SEQ ID NO: 2288676 - protein, 20 aa, Cryptosporidium parvum
ACTDKGKLQFIKELDGNTHK

SEQ ID NO: 2288677 - protein, 19 aa, Cryptosporidium parvum
ACWNFHIAHACKQKLLNTG

SEQ ID NO: 2288678 - protein, 26 aa, Cryptosporidium parvum
ADADILCTMPWQFVIIDEAHRLKNRG

SEQ ID NO: 2288679 - protein, 18 aa, Cryptosporidium parvum
ADALRSFINTDLNLLFNY

SEQ ID NO: 2288680 - protein, 17 aa, Cryptosporidium parvum
ADARTALEYYINSNDLK

SEQ ID NO: 2288681 - protein, 22 aa, Cryptosporidium parvum
ADCNEFCFLQLFNLPGNILTLY

SEQ ID NO: 2288682 - protein, 17 aa, Cryptosporidium parvum
ADCYSNLGLVYRLLGDC

SEQ ID NO: 2288683 - protein, 21 aa, Cryptosporidium parvum
ADDLLPLLIFCIIQSNPTKIK

SEQ ID NO: 2288684 - protein, 22 aa, Cryptosporidium parvum
ADELKLLYPYISHLNSLCINWM

SEQ ID NO: 2288685 - protein, 18 aa, Cryptosporidium parvum
ADFDSWDGFGAHFSDYGG

SEQ ID NO: 2288686 - protein, 23 aa, Cryptosporidium parvum
ADFRSHLYIPRYDNQLGVDPKCL

SEQ ID NO: 2288687 - protein, 22 aa, Cryptosporidium parvum
ADFVLLSGFGFSAAVPVDTHIL

SEQ ID NO: 2288688 - protein, 21 aa, Cryptosporidium parvum
ADFYYSYIVLFKYLNHCYKKY

SEQ ID NO: 2288689 - protein, 24 aa, Cryptosporidium parvum
ADGFLYEWQNNVFLSANYSTNSKL

SEQ ID NO: 2288690 - protein, 23 aa, Cryptosporidium parvum
ADGSEIRATCFTKAVDKFYDMLK

SEQ ID NO: 2288691 - protein, 19 aa, Cryptosporidium parvum
ADIALKVEPNNVVFKKVRY

SEQ ID NO: 2288692 - protein, 19 aa, Cryptosporidium parvum
ADIDGFLVGGASLKPTFAK

SEQ ID NO: 2288693 - protein, 18 aa, Cryptosporidium parvum
ADIDLIWHNCQLYNHESS

SEQ ID NO: 2288694 - protein, 30 aa, Cryptosporidium parvum
ADIGYNSKIPLSFDERTVFESKPVANSNAD

SEQ ID NO: 2288695 - protein, 20 aa, Cryptosporidium parvum
ADIIMCSDIFTWSDVYTSDL

SEQ ID NO: 2288696 - protein, 24 aa, Cryptosporidium parvum
ADIKAICTEAGLLALRERRMRVTQ

SEQ ID NO: 2288697 - protein, 18 aa, Cryptosporidium parvum
ADINSCIKLFPMIENNIK

SEQ ID NO: 2288698 - protein, 18 aa, Cryptosporidium parvum
ADIYFYWQELGMKDENLY

SEQ ID NO: 2288699 - protein, 24 aa, Cryptosporidium parvum
ADIYPRFHDCMEWDTCASHIIIRQ

SEQ ID NO: 2288700 - protein, 19 aa, Cryptosporidium parvum
ADKACGFGVYTYANGNRYE

SEQ ID NO: 2288701 - protein, 22 aa, Cryptosporidium parvum
ADKTGGLKLFLLDNEGTLTPDF

SEQ ID NO: 2288702 - protein, 22 aa, Cryptosporidium parvum
ADKTIKIWGLDFGNIQRSFHAH

SEQ ID NO: 2288703 - protein, 24 aa, Cryptosporidium parvum
ADLKECQYHLKVTVPDFELTREKY

SEQ ID NO: 2288704 - protein, 17 aa, Cryptosporidium parvum
ADLKILGITPFNVSFTS

SEQ ID NO: 2288705 - protein, 17 aa, Cryptosporidium parvum
ADLKTLINEAALIRVNK

SEQ ID NO: 2288706 - protein, 22 aa, Cryptosporidium parvum
ADLSLWCSLKTTLLGELPLSSK

SEQ ID NO: 2288707 - protein, 18 aa, Cryptosporidium parvum
ADPFSEFTCGPIDCNKQV

SEQ ID NO: 2288708 - protein, 24 aa, Cryptosporidium parvum
ADPPWNSGWIDIWFSEEDALTHDI

SEQ ID NO: 2288709 - protein, 29 aa, Cryptosporidium parvum
ADPPYSPYCLRCIMVCTISPSVTFFQQTY

SEQ ID NO: 2288710 - protein, 17 aa, Cryptosporidium parvum
ADPRVPFSPDYWQKQIL

SEQ ID NO: 2288711 - protein, 23 aa, Cryptosporidium parvum
ADQDFNGAQVYYGAVQTPSQTTY

SEQ ID NO: 2288712 - protein, 20 aa, Cryptosporidium parvum
ADRFCLRRLIDFSLGSISSE

SEQ ID NO: 2288713 - protein, 19 aa, Cryptosporidium parvum
ADRGIVCIDEFDKMSFSDR

SEQ ID NO: 2288714 - protein, 26 aa, Cryptosporidium parvum
ADRWQCGKCLKQFKGEEYVHKHLAKK

SEQ ID NO: 2288715 - protein, 24 aa, Cryptosporidium parvum
ADSRLSKCKLQFNNVELMTKMNAL

SEQ ID NO: 2288716 - protein, 18 aa, Cryptosporidium parvum
ADTLKQFLVLYGHSLPVA

SEQ ID NO: 2288717 - protein, 18 aa, Cryptosporidium parvum
AEALRLATEQSIRVNDEG

SEQ ID NO: 2288718 - protein, 22 aa, Cryptosporidium parvum
AEDPFSVFGLVLVPSRELSYQV

SEQ ID NO: 2288719 - protein, 23 aa, Cryptosporidium parvum
AEELWKLCYTFGDPWVVHPKNKS

SEQ ID NO: 2288720 - protein, 18 aa, Cryptosporidium parvum
AEEMFKKIAEAYEVLSDP

SEQ ID NO: 2288721 - protein, 20 aa, Cryptosporidium parvum
AEERESVLILSTDPAHNLSD

SEQ ID NO: 2288722 - protein, 30 aa, Cryptosporidium parvum
AEFHNSRSSLIRWSKVSSTIYLFGTTQVQL

SEQ ID NO: 2288723 - protein, 18 aa, Cryptosporidium parvum
AEGGVYWERIFQLIPCPY

SEQ ID NO: 2288724 - protein, 21 aa, Cryptosporidium parvum
AEHKGKPFLPGLIEKMTGPVL

SEQ ID NO: 2288725 - protein, 17 aa, Cryptosporidium parvum
AEIKRIFERYENDYNQI

SEQ ID NO: 2288726 - protein, 19 aa, Cryptosporidium parvum
AEIPLDLTDEYLAKWLDGK

SEQ ID NO: 2288727 - protein, 24 aa, Cryptosporidium parvum
AEIPPKYILNFPIKNPLFITSNIK

SEQ ID NO: 2288728 - protein, 23 aa, Cryptosporidium parvum
AEISPLRSGLMINEESEEKFGVG

SEQ ID NO: 2288729 - protein, 17 aa, Cryptosporidium parvum
AEITKNILKPCINFTQD

SEQ ID NO: 2288730 - protein, 24 aa, Cryptosporidium parvum
AEKLAREAWRRWIQEEGNVVDDIT

SEQ ID NO: 2288731 - protein, 33 aa, Cryptosporidium parvum
AEKMREILCTMIASPVLIKFGLLEKVIQFLLTF

SEQ ID NO: 2288732 - protein, 25 aa, Cryptosporidium parvum
AEKREVWTLGCLLHTLVFGYPPYFD

SEQ ID NO: 2288733 - protein, 26 aa, Cryptosporidium parvum
AELACEILRPNGIFVTKVFRSTDYNS

SEQ ID NO: 2288734 - protein, 20 aa, Cryptosporidium parvum
AELCSLNLQKRLRVLPPKHP

SEQ ID NO: 2288735 - protein, 19 aa, Cryptosporidium parvum
AELEKYLSAIELLDEDMNY

SEQ ID NO: 2288736 - protein, 17 aa, Cryptosporidium parvum
AELGLNLHQLYNGRIPA

SEQ ID NO: 2288737 - protein, 24 aa, Cryptosporidium parvum
AELLKPFPTGISWYCKKRRFYTSN

SEQ ID NO: 2288738 - protein, 20 aa, Cryptosporidium parvum
AELQCVLCFIFHVERISSSN

SEQ ID NO: 2288739 - protein, 20 aa, Cryptosporidium parvum
AEMRKYKSLQTKRRLSKRIS

SEQ ID NO: 2288740 - protein, 19 aa, Cryptosporidium parvum
AENFKIYWTPCSQPSNIDH

SEQ ID NO: 2288741 - protein, 24 aa, Cryptosporidium parvum
AENKNKDCLPLFFSSNTPIRKGYE

SEQ ID NO: 2288742 - protein, 23 aa, Cryptosporidium parvum
AENLCYLAKLFLDHKTLQYDVEP

SEQ ID NO: 2288743 - protein, 20 aa, Cryptosporidium parvum
AENQAICLATLLKCLETEQV

SEQ ID NO: 2288744 - protein, 25 aa, Cryptosporidium parvum
AENRNRLKLLLSWLEERVQEGYQDP

SEQ ID NO: 2288745 - protein, 18 aa, Cryptosporidium parvum
AENWKNILKSVQFENYKE

SEQ ID NO: 2288746 - protein, 23 aa, Cryptosporidium parvum
AEPLEILLHLPLVCEDKNTPYVF

SEQ ID NO: 2288747 - protein, 17 aa, Cryptosporidium parvum
AERAFSAYIKSLFILTP

SEQ ID NO: 2288748 - protein, 21 aa, Cryptosporidium parvum
AESFPTPGTESFYITQLSILT

SEQ ID NO: 2288749 - protein, 24 aa, Cryptosporidium parvum
AETNRLALLGLDWDNITADDIYVV

SEQ ID NO: 2288750 - protein, 19 aa, Cryptosporidium parvum
AETTRYVRDHNVPKERVER

SEQ ID NO: 2288751 - protein, 17 aa, Cryptosporidium parvum
AETVSMCELVFDQQMNY

SEQ ID NO: 2288752 - protein, 24 aa, Cryptosporidium parvum
AEVREVFLRMLAIGSLSRIVEDIN

SEQ ID NO: 2288753 - protein, 25 aa, Cryptosporidium parvum
AEYPTDIRLLSSIAVLTQRITDRAF

SEQ ID NO: 2288754 - protein, 18 aa, Cryptosporidium parvum
AFAGFKYDTMSRILIASY

SEQ ID NO: 2288755 - protein, 19 aa, Cryptosporidium parvum
AFASRFKTQIVDLFQVLTE

SEQ ID NO: 2288756 - protein, 17 aa, Cryptosporidium parvum
AFCPSLSSPGILASASW

SEQ ID NO: 2288757 - protein, 17 aa, Cryptosporidium parvum
AFDKAKCASENSQSGTS

SEQ ID NO: 2288758 - protein, 22 aa, Cryptosporidium parvum
AFEGDLWIKINIEFLDKYVSFF

SEQ ID NO: 2288759 - protein, 45 aa, Cryptosporidium parvum
AFEIQYAKDFEFFFGVPYRPYIRLSRYRFGKNMKYPRDLKQEEAV

SEQ ID NO: 2288760 - protein, 19 aa, Cryptosporidium parvum
AFERNLLFSGFIKVKKLKG

SEQ ID NO: 2288761 - protein, 18 aa, Cryptosporidium parvum
AFEVLARIQIKKLLRPSL

SEQ ID NO: 2288762 - protein, 21 aa, Cryptosporidium parvum
AFFGTSFAPLFALQYGLVTSK

SEQ ID NO: 2288763 - protein, 19 aa, Cryptosporidium parvum
AFGALLARMLDPNKRVEEA

SEQ ID NO: 2288764 - protein, 20 aa, Cryptosporidium parvum
AFGELALLYNCPRAASVVAK

SEQ ID NO: 2288765 - protein, 19 aa, Cryptosporidium parvum
AFGNWDMYSGMKLQGLSST

SEQ ID NO: 2288766 - protein, 18 aa, Cryptosporidium parvum
AFIIKLFGLKNMQITPER

SEQ ID NO: 2288767 - protein, 22 aa, Cryptosporidium parvum
AFIPCIPPVRYEYSEIKEPNSG

SEQ ID NO: 2288768 - protein, 22 aa, Cryptosporidium parvum
AFITKRPDLFGTIEEAVAGTHG

SEQ ID NO: 2288769 - protein, 17 aa, Cryptosporidium parvum
AFKDLQGFHAIIIHLIR

SEQ ID NO: 2288770 - protein, 24 aa, Cryptosporidium parvum
AFKGRKFLCSELIHGGTDPNVENI

SEQ ID NO: 2288771 - protein, 37 aa, Cryptosporidium parvum
AFKIAECIKPALAKSPAWLRFIDICLNEIFQKLDLKD

SEQ ID NO: 2288772 - protein, 22 aa, Cryptosporidium parvum
AFKRRFSPIRIIMEDISSHYVT

SEQ ID NO: 2288773 - protein, 21 aa, Cryptosporidium parvum
AFKSKCPYCDRSFLKRTLKIH

SEQ ID NO: 2288774 - protein, 21 aa, Cryptosporidium parvum
AFKTWEIYCSAILESRITALD

SEQ ID NO: 2288775 - protein, 29 aa, Cryptosporidium parvum
AFLKLESLVSEFLKKILIVVENWSNYINC

SEQ ID NO: 2288776 - protein, 21 aa, Cryptosporidium parvum
AFNIMVYCLRLDRMDLNHEFP

SEQ ID NO: 2288777 - protein, 24 aa, Cryptosporidium parvum
AFNLPFDYRSPVIMACMGTGIAPF

SEQ ID NO: 2288778 - protein, 20 aa, Cryptosporidium parvum
AFNQTICGFDILRTVTGKSV

SEQ ID NO: 2288779 - protein, 21 aa, Cryptosporidium parvum
AFPDDKLLPIYSRVVIQRIPW

SEQ ID NO: 2288780 - protein, 18 aa, Cryptosporidium parvum
AFPDRINEALKIYEEGLN

SEQ ID NO: 2288781 - protein, 18 aa, Cryptosporidium parvum
AFQAFKLTTQIYYNLSND

SEQ ID NO: 2288782 - protein, 17 aa, Cryptosporidium parvum
AFQIYKKFSFNNEAVET

SEQ ID NO: 2288783 - protein, 25 aa, Cryptosporidium parvum
AFRHFCELHLIPLYKQVYGNEDFTT

SEQ ID NO: 2288784 - protein, 17 aa, Cryptosporidium parvum
AFRRPEGTFLYFEDNAG

SEQ ID NO: 2288785 - protein, 25 aa, Cryptosporidium parvum
AFSAILCAGIDGILHKIHPAAYLNT

SEQ ID NO: 2288786 - protein, 20 aa, Cryptosporidium parvum
AFTSSFLRQIWPEVWASNRN

SEQ ID NO: 2288787 - protein, 21 aa, Cryptosporidium parvum
AFWEKCLLFFESVFNNIYSIN

SEQ ID NO: 2288788 - protein, 26 aa, Cryptosporidium parvum
AFWHFLSLFIQFIFRTIYSFDENGVE

SEQ ID NO: 2288789 - protein, 32 aa, Cryptosporidium parvum; identical to SEQ ID NO: 2168132

SEQ ID NO: 2288790 - protein, 20 aa, Cryptosporidium parvum
AFYLEKYLSLVNEVYGSGDL

SEQ ID NO: 2288791 - protein, 17 aa, Cryptosporidium parvum
AGAFRYVLLMKENVTTT

SEQ ID NO: 2288792 - protein, 24 aa, Cryptosporidium parvum
AGAHGKDTWGIFRIHQFEKVEQFC

SEQ ID NO: 2288793 - protein, 19 aa, Cryptosporidium parvum
AGATVLADRGIVCIDEFDK

SEQ ID NO: 2288794 - protein, 18 aa, Cryptosporidium parvum
AGCPLTYMMNIELRKGKS

SEQ ID NO: 2288795 - protein, 17 aa, Cryptosporidium parvum
AGDAGEAIFNYMKEQNR

SEQ ID NO: 2288796 - protein, 24 aa, Cryptosporidium parvum
AGDGRFFLPEAIQIISEIAAAHKV

SEQ ID NO: 2288797 - protein, 19 aa, Cryptosporidium parvum
AGERIELRVTPTSDLSKTM

SEQ ID NO: 2288798 - protein, 24 aa, Cryptosporidium parvum
AGFTYQPKFSIRDLFSLPAKYLKY

SEQ ID NO: 2288799 - protein, 18 aa, Cryptosporidium parvum
AGGIPIDPSISATVAAAT

SEQ ID NO: 2288800 - protein, 24 aa, Cryptosporidium parvum
AGGRRWICNMCGYSNETLSFYYCG

SEQ ID NO: 2288801 - protein, 23 aa, Cryptosporidium parvum
AGGYLRVLNSWNRIGKMQNEFFE

SEQ ID NO: 2288802 - protein, 17 aa, Cryptosporidium parvum
AGIDVMFSEIGSAIEEV

SEQ ID NO: 2288803 - protein, 26 aa, Cryptosporidium parvum
AGIELLRLITWYLSWNRILEYPNASF

SEQ ID NO: 2288804 - protein, 32 aa, Cryptosporidium parvum
AGIKSFPELGVWRCCCEANGKPIEFVSSRSLL

SEQ ID NO: 2288805 - protein, 19 aa, Cryptosporidium parvum
AGINPGSSITFISVKTGKR

SEQ ID NO: 2288806 - protein, 18 aa, Cryptosporidium parvum
AGINRKWITGQIGNSGNN

SEQ ID NO: 2288807 - protein, 17 aa, Cryptosporidium parvum
AGKIQCSYLSSTSHGNR

SEQ ID NO: 2288808 - protein, 17 aa, Cryptosporidium parvum
AGKPYSVALSFISSQAT

SEQ ID NO: 2288809 - protein, 26 aa, Cryptosporidium parvum
AGLPHFSTGFMRSWGRDTFIAFNGIL

SEQ ID NO: 2288810 - protein, 17 aa, Cryptosporidium parvum
AGLQFPVGRVARYLKKG

SEQ ID NO: 2288811 - protein, 25 aa, Cryptosporidium parvum
AGPEADRGWSDFFSLKTLLDPKTGF

SEQ ID NO: 2288812 - protein, 18 aa, Cryptosporidium parvum
AGPYARKLFVDEFGLPES

SEQ ID NO: 2288813 - protein, 24 aa, Cryptosporidium parvum
AGRLKPGEVYRMYTKQAYSEFMTS

SEQ ID NO: 2288814 - protein, 28 aa, Cryptosporidium parvum
AGRNLPLNRFKYSPIVAALKHNHKLLPV

SEQ ID NO: 2288815 - protein, 18 aa, Cryptosporidium parvum
AGRWQLSITPGYSRINQE

SEQ ID NO: 2288816 - protein, 24 aa, Cryptosporidium parvum
AGSCGASACRDCVKNYLEQNKAVA

SEQ ID NO: 2288817 - protein, 20 aa, Cryptosporidium parvum
AGTGKTQWCLTLITSVLLRN

SEQ ID NO: 2288818 - protein, 19 aa, Cryptosporidium parvum
AGTKGFKRGIFIFTGNDLE

SEQ ID NO: 2288819 - protein, 26 aa, Cryptosporidium parvum
AGTNISLCLCENNNLYYWFLNNECGF

SEQ ID NO: 2288820 - protein, 18 aa, Cryptosporidium parvum
AGTTSIECGMSLMEEISD

SEQ ID NO: 2288821 - protein, 27 aa, Cryptosporidium parvum
AGVLKGEIKDLLLLDVTPLSLGIETLG

SEQ ID NO: 2288822 - protein, 20 aa, Cryptosporidium parvum
AGVPCVIPPLPEDFVTQKSD

SEQ ID NO: 2288823 - protein, 22 aa, Cryptosporidium parvum
AGYKIPENLLIKSYDTEKTKLE

SEQ ID NO: 2288824 - protein, 30 aa, Cryptosporidium parvum
AGYPVRFPHFEFLLDYMILFSPCGQLSISK

SEQ ID NO: 2288825 - protein, 32 aa, Cryptosporidium parvum
AHGWSVHREFLLNLFKYYGFDSKWNWSNKQLL

SEQ ID NO: 2288826 - protein, 18 aa, Cryptosporidium parvum
AHIHSCILYFVDISEECG

SEQ ID NO: 2288827 - protein, 30 aa, Cryptosporidium parvum; identical to SEQ ID NO: 2168173

SEQ ID NO: 2288828 - protein, 19 aa, Cryptosporidium parvum
AHLEEMALICMNKKHSKYL

SEQ ID NO: 2288829 - protein, 23 aa, Cryptosporidium parvum
AHLRPRSQFFSSVMRIRNSLAIA

SEQ ID NO: 2288830 - protein, 17 aa, Cryptosporidium parvum
AHNGVVYDLKIIGDGSG

SEQ ID NO: 2288831 - protein, 17 aa, Cryptosporidium parvum
AHNPLFFSKRNAYRGQN

SEQ ID NO: 2288832 - protein, 21 aa, Cryptosporidium parvum
AHPFNLIYLDYLEKMKKNTKT

SEQ ID NO: 2288833 - protein, 23 aa, Cryptosporidium parvum
AHPHAGPAQILFPHMAINGQHSA

SEQ ID NO: 2288834 - protein, 19 aa, Cryptosporidium parvum
AHQIKGFRLQESEDESVSS

SEQ ID NO: 2288835 - protein, 18 aa, Cryptosporidium parvum
AHRVKELRKKSVIRSDTF

SEQ ID NO: 2288836 - protein, 29 aa, Cryptosporidium parvum
AHSIYLKLLFKISILFGVNQHISDLIVKY

SEQ ID NO: 2288837 - protein, 17 aa, Cryptosporidium parvum
AHVLKMVAIHRVDSLEE

SEQ ID NO: 2288838 - protein, 27 aa, Cryptosporidium parvum
AHVPGCTSEFCLACELVHLTFMLYSCK

SEQ ID NO: 2288839 - protein, 21 aa, Cryptosporidium parvum
AIAAFDLARSFGWGIQVSHRS

SEQ ID NO: 2288840 - protein, 25 aa, Cryptosporidium parvum
AIAGLCKISSLAPLFSSLNICDDIL

SEQ ID NO: 2288841 - protein, 18 aa, Cryptosporidium parvum
AIAGSIVFHHFAIWAKFT

SEQ ID NO: 2288842 - protein, 19 aa, Cryptosporidium parvum
AICGEKGVHIWSFEYNGNH

SEQ ID NO: 2288843 - protein, 18 aa, Cryptosporidium parvum
AICKLVWQDYARVNKFSA

SEQ ID NO: 2288844 - protein, 23 aa, Cryptosporidium parvum
AIDASMWIYQFLAAIREGSQWGN

SEQ ID NO: 2288845 - protein, 24 aa, Cryptosporidium parvum
AIDDLKSGCNLFEKKSPRDEQLRE

SEQ ID NO: 2288846 - protein, 26 aa, Cryptosporidium parvum
AIDLTKIRIRSCKRVVLIEYCKDSEL

SEQ ID NO: 2288847 - protein, 18 aa, Cryptosporidium parvum
AIDQDGLRDALRHASNML

SEQ ID NO: 2288848 - protein, 19 aa, Cryptosporidium parvum
AIEELYRLAVKKVSKNFIC

SEQ ID NO: 2288849 - protein, 24 aa, Cryptosporidium parvum
AIESGCKVVLFGSLYRVIHESAKI

SEQ ID NO: 2288850 - protein, 24 aa, Cryptosporidium parvum
AIFSKKLVPLFEWVCEQSPMSDIL

SEQ ID NO: 2288851 - protein, 19 aa, Cryptosporidium parvum
AIGAMGFNGMEEINSLNGD

SEQ ID NO: 2288852 - protein, 17 aa, Cryptosporidium parvum
AIGDLIRTPVHLVSSAL

SEQ ID NO: 2288853 - protein, 20 aa, Cryptosporidium parvum
AIGKGTRAYQNFLKLKPRKE

SEQ ID NO: 2288854 - protein, 25 aa, Cryptosporidium parvum
AIGNAPWPMGVTMVGIHERAGRTKI

SEQ ID NO: 2288855 - protein, 26 aa, Cryptosporidium parvum
AIGQPLLMRVYEDFFSMRGAKVAQLL

SEQ ID NO: 2288856 - protein, 18 aa, Cryptosporidium parvum
AIIFDWKEFKILNKSTEN

SEQ ID NO: 2288857 - protein, 22 aa, Cryptosporidium parvum
AIIKQLQIFTGIENLNIDNINT

SEQ ID NO: 2288858 - protein, 19 aa, Cryptosporidium parvum
AIIRFKSKETIYCSCEFLD

SEQ ID NO: 2288859 - protein, 18 aa, Cryptosporidium parvum
AIISCLNSLEIIHPKEPI

SEQ ID NO: 2288860 - protein, 29 aa, Cryptosporidium parvum
AIKKGSSRISLQWGCLAEEYPKFDVSVEE

SEQ ID NO: 2288861 - protein, 23 aa, Cryptosporidium parvum
AIKLLAIVRDIKRQIKLIKNQHN

SEQ ID NO: 2288862 - protein, 22 aa, Cryptosporidium parvum
AIKNSIDSIEFLDLFNSDKIKY

SEQ ID NO: 2288863 - protein, 19 aa, Cryptosporidium parvum
AILKFPKLVDEIITMIASC

SEQ ID NO: 2288864 - protein, 20 aa, Cryptosporidium parvum
AIMLEKNFIFSIVDPQVLQI

SEQ ID NO: 2288865 - protein, 23 aa, Cryptosporidium parvum
AINDPRISKIFTDADFAIDPTNP

SEQ ID NO: 2288866 - protein, 18 aa, Cryptosporidium parvum
AINKARLKKMAARAQVLT

SEQ ID NO: 2288867 - protein, 28 aa, Cryptosporidium parvum
AINSLKNPLLFWFKGLFRQNEPTHIRPA

SEQ ID NO: 2288868 - protein, 25 aa, Cryptosporidium parvum
AIRDTRFNYILGIVLYSVRTRSKFK

SEQ ID NO: 2288869 - protein, 19 aa, Cryptosporidium parvum
AISFLRLYEKWSNTRSNHV

SEQ ID NO: 2288870 - protein, 23 aa, Cryptosporidium parvum
AISKIESLEELWINDNDICDINQ

SEQ ID NO: 2288871 - protein, 26 aa, Cryptosporidium parvum
AISQKIGMRYCHRYKNIYLLEISAHS

SEQ ID NO: 2288872 - protein, 22 aa, Cryptosporidium parvum
  misc_feature (22)..(22): Xaa can be any naturally occurring amino acid
AISRQRIYEMITEIQNREDLYX

SEQ ID NO: 2288873 - protein, 24 aa, Cryptosporidium parvum
AISTLCQISRILAKDFPKNLSKDG

SEQ ID NO: 2288874 - protein, 23 aa, Cryptosporidium parvum
AIWPGITSKGAFNPKVLIGLINA

SEQ ID NO: 2288875 - protein, 19 aa, Cryptosporidium parvum
AIWRHQLLCHCIPFNRFCY

SEQ ID NO: 2288876 - protein, 26 aa, Cryptosporidium parvum
AIYAFSNRYADMILTIYGMSCLRSVL

SEQ ID NO: 2288877 - protein, 19 aa, Cryptosporidium parvum
AIYEKAFHIIVSYFPYEYE

SEQ ID NO: 2288878 - protein, 18 aa, Cryptosporidium parvum
AIYSYLFKEGAIVVHKNP

SEQ ID NO: 2288879 - protein, 24 aa, Cryptosporidium parvum
AIYYVKLFVPMGMPEEGLERYVKY

SEQ ID NO: 2288880 - protein, 30 aa, Cryptosporidium parvum
AKAIYSKLFDWLVFRINKSMTNGLMNNNIG

SEQ ID NO: 2288881 - protein, 20 aa, Cryptosporidium parvum
AKALLQYELRQWFLSNPPSN

SEQ ID NO: 2288882 - protein, 18 aa, Cryptosporidium parvum
AKEGFKTEFSNIMGDCLL

SEQ ID NO: 2288883 - protein, 17 aa, Cryptosporidium parvum
AKEGPMMLDDLKSKINA

SEQ ID NO: 2288884 - protein, 17 aa, Cryptosporidium parvum
AKEKALYRKKGGIPEGL

SEQ ID NO: 2288885 - protein, 23 aa, Cryptosporidium parvum
AKELFSSGFVLPRCNFKEALADL

SEQ ID NO: 2288886 - protein, 28 aa, Cryptosporidium parvum
AKEQGYRARSAFKLIQLAQKFNIFKNCQ

SEQ ID NO: 2288887 - protein, 19 aa, Cryptosporidium parvum
AKEVLKCGANRVWLDPTEM

SEQ ID NO: 2288888 - protein, 20 aa, Cryptosporidium parvum
AKFELKMSLIKSELNLQKDS

SEQ ID NO: 2288889 - protein, 22 aa, Cryptosporidium parvum
AKFKAMLVEDAYGFETTYVDFL

SEQ ID NO: 2288890 - protein, 17 aa, Cryptosporidium parvum
AKFPELFQGKLKPWKGI

SEQ ID NO: 2288891 - protein, 21 aa, Cryptosporidium parvum
AKFYIAELLLALDYLNNIQGH

SEQ ID NO: 2288892 - protein, 21 aa, Cryptosporidium parvum
AKFYLGKRCAYIYKAKTIKNG

SEQ ID NO: 2288893 - protein, 18 aa, Cryptosporidium parvum
AKGFSWLESNPCQFDINQ

SEQ ID NO: 2288894 - protein, 20 aa, Cryptosporidium parvum
AKGLTSLRCPICSKSLGDNS

SEQ ID NO: 2288895 - protein, 21 aa, Cryptosporidium parvum
AKHHGFPGIFFNGAVLIGPNG

SEQ ID NO: 2288896 - protein, 25 aa, Cryptosporidium parvum
AKHVYGIECSEIVHVARNIIKDNNL

SEQ ID NO: 2288897 - protein, 18 aa, Cryptosporidium parvum
AKHVYLHHLKAYRSFNNG

SEQ ID NO: 2288898 - protein, 17 aa, Cryptosporidium parvum
AKIASAFTFAFTASELH

SEQ ID NO: 2288899 - protein, 20 aa, Cryptosporidium parvum
AKIEIIGLFSATNIIAVNSN

SEQ ID NO: 2288900 - protein, 25 aa, Cryptosporidium parvum
AKIKPPPCIEGPFTCFGSQLSSDIS

SEQ ID NO: 2288901 - protein, 22 aa, Cryptosporidium parvum
AKIKVLYCGICHSDVHQVKNEW

SEQ ID NO: 2288902 - protein, 17 aa, Cryptosporidium parvum
AKILKRRNPGISISIDE

SEQ ID NO: 2288903 - protein, 20 aa, Cryptosporidium parvum
AKILPNRNFKESKYDISCIS

SEQ ID NO: 2288904 - protein, 19 aa, Cryptosporidium parvum
AKINFYVDKEFVYKADDGF

SEQ ID NO: 2288905 - protein, 18 aa, Cryptosporidium parvum
AKIQSICLGEEMDEYAWS

SEQ ID NO: 2288906 - protein, 17 aa, Cryptosporidium parvum
AKISSIFSRFLSSNLFS

SEQ ID NO: 2288907 - protein, 24 aa, Cryptosporidium parvum
AKKDFRYICEFDYFSRDAKLQSRK

SEQ ID NO: 2288908 - protein, 22 aa, Cryptosporidium parvum
AKKFAKQFSCGASVVKGTSGKP

SEQ ID NO: 2288909 - protein, 20 aa, Cryptosporidium parvum
AKKFNEGCIIFIDEIDTLAS

SEQ ID NO: 2288910 - protein, 20 aa, Cryptosporidium parvum
AKKGLKFCLKDGNLSHIVSR

SEQ ID NO: 2288911 - protein, 22 aa, Cryptosporidium parvum
AKKIKSGCWTTDMINESIQNLE

SEQ ID NO: 2288912 - protein, 28 aa, Cryptosporidium parvum
AKKSSECMGRISRFVSRYLANKGMTIGI

SEQ ID NO: 2288913 - protein, 18 aa, Cryptosporidium parvum
AKLELPDFLKLKDCSSKS

SEQ ID NO: 2288914 - protein, 19 aa, Cryptosporidium parvum
AKLFEGIVIWLSVNDSKIL

SEQ ID NO: 2288915 - protein, 22 aa, Cryptosporidium parvum
AKLRTDNEWSLLSEIAVNCAVA

SEQ ID NO: 2288916 - protein, 19 aa, Cryptosporidium parvum
AKLYILIEIQRMASVIGNP

SEQ ID NO: 2288917 - protein, 18 aa, Cryptosporidium parvum
AKMKHLIKMFSDLLSQEE

SEQ ID NO: 2288918 - protein, 18 aa, Cryptosporidium parvum
AKNALFKEMHLVMKENEG

SEQ ID NO: 2288919 - protein, 22 aa, Cryptosporidium parvum
AKQRTTGSILRKSIDASDDNYS

SEQ ID NO: 2288920 - protein, 21 aa, Cryptosporidium parvum
AKRILSHIIPELSISQFNESV

SEQ ID NO: 2288921 - protein, 21 aa, Cryptosporidium parvum
AKRIWLKYLPEDRILSCGSKE

SEQ ID NO: 2288922 - protein, 22 aa, Cryptosporidium parvum
AKRRLREKLLRKEISDMKKQKN

SEQ ID NO: 2288923 - protein, 27 aa, Cryptosporidium parvum
AKSCSCSCPLVTFSSSNSFLIQLKSGE

SEQ ID NO: 2288924 - protein, 19 aa, Cryptosporidium parvum
AKSEFSYRVYCYDNLKLGQ

SEQ ID NO: 2288925 - protein, 20 aa, Cryptosporidium parvum
AKTDCLLWALDRETFNHIVK

SEQ ID NO: 2288926 - protein, 17 aa, Cryptosporidium parvum
AKTGLWKNINVKWSHNI

SEQ ID NO: 2288927 - protein, 18 aa, Cryptosporidium parvum
AKTIKEWLHKALKSETAV

SEQ ID NO: 2288928 - protein, 20 aa, Cryptosporidium parvum
AKVLRINWDYKNKFTQRLNN

SEQ ID NO: 2288929 - protein, 18 aa, Cryptosporidium parvum
AKWDLGWMNDTLSYLYTP

SEQ ID NO: 2288930 - protein, 17 aa, Cryptosporidium parvum
AKYKFPGRQKVVVSDKW

SEQ ID NO: 2288931 - protein, 18 aa, Cryptosporidium parvum
AKYKIPFDEDTIIEAFQV

SEQ ID NO: 2288932 - protein, 19 aa, Cryptosporidium parvum
ALADLRLMFNDGRAWDMNI

SEQ ID NO: 2288933 - protein, 17 aa, Cryptosporidium parvum
ALAQFGVVLTDEGYNNI

SEQ ID NO: 2288934 - protein, 19 aa, Cryptosporidium parvum
ALCKFPAHVQQLLMESNGK

SEQ ID NO: 2288935 - protein, 22 aa, Cryptosporidium parvum
ALCNCLKDDIQWTIDNLYTDIP

SEQ ID NO: 2288936 - protein, 23 aa, Cryptosporidium parvum
ALDPNVLASLGLNVQKPTLQPIQ

SEQ ID NO: 2288937 - protein, 29 aa, Cryptosporidium parvum
ALDRANVFLRWNLAPTKQQIAEFLEMAQG

SEQ ID NO: 2288938 - protein, 19 aa, Cryptosporidium parvum
ALDVFPRLLAENSGLNSTD

SEQ ID NO: 2288939 - protein, 20 aa, Cryptosporidium parvum
ALDVSEPCQLVFSLRYLNNF

SEQ ID NO: 2288940 - protein, 23 aa, Cryptosporidium parvum
ALDYCAKAKILVVKDIERDEIEF

SEQ ID NO: 2288941 - protein, 19 aa, Cryptosporidium parvum
ALDYKEFRNLLTQLLILPE

SEQ ID NO: 2288942 - protein, 21 aa, Cryptosporidium parvum
ALEEIISFQGLWKSICEIEGT

SEQ ID NO: 2288943 - protein, 17 aa, Cryptosporidium parvum
ALEIFYKEMEKLPDEFY

SEQ ID NO: 2288944 - protein, 25 aa, Cryptosporidium parvum
ALEIGFNMLLCFSKLPDIQSEMKVE

SEQ ID NO: 2288945 - protein, 25 aa, Cryptosporidium parvum
ALELKDLKTSIGNRVVGNTMLTMPQ

SEQ ID NO: 2288946 - protein, 24 aa, Cryptosporidium parvum
ALELTWKYPIENSSNFPNDKNMIG

SEQ ID NO: 2288947 - protein, 22 aa, Cryptosporidium parvum
ALELYPLPFPKIGGVKSPKLAL

SEQ ID NO: 2288948 - protein, 25 aa, Cryptosporidium parvum
ALENYELLDYITIQLFGYASFSNEL

SEQ ID NO: 2288949 - protein, 17 aa, Cryptosporidium parvum
ALEREKFNFEKRLREEM

SEQ ID NO: 2288950 - protein, 26 aa, Cryptosporidium parvum
ALERLMKMIIRLADCGLIHGDFNEFN

SEQ ID NO: 2288951 - protein, 26 aa, Cryptosporidium parvum
ALETFCSGGFRGGPRMVALANFREGK

SEQ ID NO: 2288952 - protein, 21 aa, Cryptosporidium parvum
ALFDKLYGEWALLSRQTQEDL

SEQ ID NO: 2288953 - protein, 26 aa, Cryptosporidium parvum
ALGGHPFGGSMAYRGGELGRHPPYPG

SEQ ID NO: 2288954 - protein, 24 aa, Cryptosporidium parvum
ALGLRPVEIYEFSRLNFVNTVLSK

SEQ ID NO: 2288955 - protein, 19 aa, Cryptosporidium parvum
ALHELLRPHLLRRVKEDVM

SEQ ID NO: 2288956 - protein, 23 aa, Cryptosporidium parvum
ALHPEPFGVLGYQKFGDDGQYEY

SEQ ID NO: 2288957 - protein, 23 aa, Cryptosporidium parvum
ALHQFRPSPLYFMDEVDAALDFR

SEQ ID NO: 2288958 - protein, 17 aa, Cryptosporidium parvum
ALIFCPTIEWCRKSLQI

SEQ ID NO: 2288959 - protein, 18 aa, Cryptosporidium parvum
ALIRVNKLYKRFKLDNNA

SEQ ID NO: 2288960 - protein, 32 aa, Cryptosporidium parvum
ALISYYIQHGILFKRLGIIIVDELHLLGDEQR

SEQ ID NO: 2288961 - protein, 26 aa, Cryptosporidium parvum
ALKILKSRCSIPFIANGGISNYEDIQ

SEQ ID NO: 2288962 - protein, 32 aa, Cryptosporidium parvum
ALKKAMFKPAAWFKGILLPLAEDESCTIKEAI
